United States Patent 7,250,496 (BIOINFORMATICALLY DETECTABLE GROUP OF NOVEL REGULATORY GENES AND USES THEREOF) - sequence listing, part 24

SEQ ID NO: 1016360 - RNA, 19 nt, Human
aagaaacacaacuuguaca

SEQ ID NO: 1016361 - RNA, 24 nt, Human
aaugagagggaaccacaggaaaaa

SEQ ID NO: 1016362 - RNA, 24 nt, Human
acccagguauccccucuacccagc

SEQ ID NO: 1016363 - RNA, 21 nt, Human
acccugacuucaccagggcuu

SEQ ID NO: 1016364 - RNA, 18 nt, Human
agacaagaaaaugggagg

SEQ ID NO: 1016365 - RNA, 19 nt, Human
agcuggacaacagcuguuc

SEQ ID NO: 1016366 - RNA, 18 nt, Human
aggagagaauaucagggu

SEQ ID NO: 1016367 - RNA, 18 nt, Human
aggaguacaaaagaaaac

SEQ ID NO: 1016368 - RNA, 24 nt, Human
aggcaggucuucaaaagaaggaga

SEQ ID NO: 1016369 - RNA, 21 nt, Human
agguggccaccuggggcccuu

SEQ ID NO: 1016370 - RNA, 24 nt, Human
aguaacugggacaaaugagaggga

SEQ ID NO: 1016371 - RNA, 21 nt, Human
auaauauauauauauauauau

SEQ ID NO: 1016372 - RNA, 25 nt, Human
auaauauauauauauauauauuaua

SEQ ID NO: 1016373 - RNA, 19 nt, Human
aucaagauacagcucaugg

SEQ ID NO: 1016374 - RNA, 19 nt, Human
aucaaggaagggaaggucu

SEQ ID NO: 1016375 - RNA, 21 nt, Human
aucacccuucccccucccaaa

SEQ ID NO: 1016376 - RNA, 22 nt, Human
caaauaaagccaaaggucaaaa

SEQ ID NO: 1016377 - RNA, 24 nt, Human
cacacagcggcagaacagacaaga

SEQ ID NO: 1016378 - RNA, 20 nt, Human
cacaccugguaacgcagaag

SEQ ID NO: 1016379 - RNA, 23 nt, Human
cacaggaaaaagacugacgucuc

SEQ ID NO: 1016380 - RNA, 27 nt, Human
cagaaaacuuuaucacccuucccccuc

SEQ ID NO: 1016381 - RNA, 21 nt, Human
cagcggcagaacagacaagaa

SEQ ID NO: 1016382 - RNA, 19 nt, Human
cagucuucagcuuuccaga

SEQ ID NO: 1016383 - RNA, 19 nt, Human
cagucuuugucucuuuuag

SEQ ID NO: 1016384 - RNA, 23 nt, Human
cauaaaaugugagcugcaccuaa

SEQ ID NO: 1016385 - RNA, 23 nt, Human
caugugaugaaaaauauugcuuu

SEQ ID NO: 1016386 - RNA, 21 nt, Human
ccaagaaggaaccugaggccc

SEQ ID NO: 1016387 - RNA, 27 nt, Human
ccacaggaaaaagacugacgucucccc

SEQ ID NO: 1016388 - RNA, 20 nt, Human
ccaccaccaccagugucuug

SEQ ID NO: 1016389 - RNA, 23 nt, Human
ccaccacucccacacccugacuu

SEQ ID NO: 1016390 - RNA, 19 nt, Human
ccacucccacacccugacu

SEQ ID NO: 1016391 - RNA, 19 nt, Human
ccacuccuucucucuaucc

SEQ ID NO: 1016392 - RNA, 23 nt, Human
ccagaacaaggcagaagggaaga

SEQ ID NO: 1016393 - RNA, 19 nt, Human
cccagcaccauagugaggu

SEQ ID NO: 1016394 - RNA, 25 nt, Human
ccccaacucuccgacuccccaagcc

SEQ ID NO: 1016395 - RNA, 24 nt, Human
ccccaggcuucuuccuaaucacac

SEQ ID NO: 1016396 - RNA, 22 nt, Human
cccccucccaaauaaagccaaa

SEQ ID NO: 1016397 - RNA, 25 nt, Human
cccgccccgcugccgcgcgcucccg

SEQ ID NO: 1016398 - RNA, 19 nt, Human
cccucauuuucccauccca

SEQ ID NO: 1016399 - RNA, 23 nt, Human
cccuguuuccagacuagucaaug

SEQ ID NO: 1016400 - RNA, 23 nt, Human
ccgccccgcugccgcgcgcuccc

SEQ ID NO: 1016401 - RNA, 23 nt, Human
ccgccgccucccggcagugccgu

SEQ ID NO: 1016402 - RNA, 25 nt, Human
ccgccgccucccggcagugccgucc

SEQ ID NO: 1016403 - RNA, 26 nt, Human
ccgccgccucccggcagugccguccu

SEQ ID NO: 1016404 - RNA, 21 nt, Human
ccgccgucguugucaccgccg

SEQ ID NO: 1016405 - RNA, 23 nt, Human
ccgccgucguugucaccgccgcc

SEQ ID NO: 1016406 - RNA, 24 nt, Human
ccgccgucguugucaccgccgccu

SEQ ID NO: 1016407 - RNA, 19 nt, Human
ccgccucccggcagugccg

SEQ ID NO: 1016408 - RNA, 18 nt, Human
ccgcgcgcucccgccagg

SEQ ID NO: 1016409 - RNA, 19 nt, Human
ccgcgcgcucccgccaggc

SEQ ID NO: 1016410 - RNA, 19 nt, Human
ccgcugccgcgcgcucccg

SEQ ID NO: 1016411 - RNA, 18 nt, Human
ccguauauguaucccucc

SEQ ID NO: 1016412 - RNA, 30 nt, Human
ccguauauguaucccucccucauuuucccu

SEQ ID NO: 1016413 - RNA, 24 nt, Human
ccucccggcagugccguccugccu

SEQ ID NO: 1016414 - RNA, 24 nt, Human
ccucuugugaccaaaauuccagac

SEQ ID NO: 1016415 - RNA, 21 nt, Human
ccuuugguguaggcgcagagg

SEQ ID NO: 1016416 - RNA, 22 nt, Human
cgcgcggcccccgcacgcucca

SEQ ID NO: 1016417 - RNA, 20 nt, Human
cuacccagcaccauagugag

SEQ ID NO: 1016418 - RNA, 18 nt, Human
cucaaugccaccacuccc

SEQ ID NO: 1016419 - RNA, 20 nt, Human
cucccaccaccaccaguguc

SEQ ID NO: 1016420 - RNA, 26 nt, Human
cuccccaagccuacugcauuuuagaa

SEQ ID NO: 1016421 - RNA, 18 nt, Human
cugccgcgcgcucccgcc

SEQ ID NO: 1016422 - RNA, 18 nt, Human
cugguaacgcagaagagg

SEQ ID NO: 1016423 - RNA, 22 nt, Human
cuuagcaccagcagaggaugcu

SEQ ID NO: 1016424 - RNA, 21 nt, Human
cuuuaucacccuucccccucc

SEQ ID NO: 1016425 - RNA, 22 nt, Human
gacucaccucuccccaggcuuc

SEQ ID NO: 1016426 - RNA, 18 nt, Human
gagcaauugcacaaaugu

SEQ ID NO: 1016427 - RNA, 18 nt, Human
gagccuagaaaacuaauu

SEQ ID NO: 1016428 - RNA, 22 nt, Human
gaggaguacaaaagaaaaccag

SEQ ID NO: 1016429 - RNA, 18 nt, Human
gaucaaggaagggaaggu

SEQ ID NO: 1016430 - RNA, 20 nt, Human
gcagaacagacaagaaaaug

SEQ ID NO: 1016431 - RNA, 24 nt, Human
gcagaacagacaagaaaaugggag

SEQ ID NO: 1016432 - RNA, 19 nt, Human
gcagcgcgcggcccccgca

SEQ ID NO: 1016433 - RNA, 21 nt, Human
gcaugugaugaaaaauauugc

SEQ ID NO: 1016434 - RNA, 20 nt, Human
gcuaaagcuggacaacagcu

SEQ ID NO: 1016435 - RNA, 21 nt, Human
gcuuuguuuacugcagucuuu

SEQ ID NO: 1016436 - RNA, 19 nt, Human
ggcagaacagacaagaaaa

SEQ ID NO: 1016437 - RNA, 24 nt, Human
ggcagaacagacaagaaaauggga

SEQ ID NO: 1016438 - RNA, 24 nt, Human
gggaaacagaaaacuuuaucaccc

SEQ ID NO: 1016439 - RNA, 19 nt, Human
gggaaacuuaaaauccuug

SEQ ID NO: 1016440 - RNA, 24 nt, Human
gggaaccacaggaaaaagacugac

SEQ ID NO: 1016441 - RNA, 22 nt, Human
gggaagauuaagaaacacaacu

SEQ ID NO: 1016442 - RNA, 21 nt, Human
gggaagcaacagagaggagua

SEQ ID NO: 1016443 - RNA, 22 nt, Human
gggaaggaagguggccaccugg

SEQ ID NO: 1016444 - RNA, 18 nt, Human
gggaaggucuuaaaagau

SEQ ID NO: 1016445 - RNA, 18 nt, Human
gggcaaggaaaacagggc

SEQ ID NO: 1016446 - RNA, 24 nt, Human
guaacaauaauaaaaaaaauuauu

SEQ ID NO: 1016447 - RNA, 25 nt, Human
guuccaaagaugucccuguuuccag

SEQ ID NO: 1016448 - RNA, 22 nt, Human
uaaaagauaaaaggggggguug

SEQ ID NO: 1016449 - RNA, 21 nt, Human
uaaagaggagcuuuguuuacu

SEQ ID NO: 1016450 - RNA, 24 nt, Human
uaacccccaagggacaaucggagg

SEQ ID NO: 1016451 - RNA, 24 nt, Human
uaagcuaggggaggcuccaagggg

SEQ ID NO: 1016452 - RNA, 25 nt, Human
uaagggcucuguuuccuacaaaguu

SEQ ID NO: 1016453 - RNA, 19 nt, Human
uacaaaagaaaaccaggga

SEQ ID NO: 1016454 - RNA, 24 nt, Human
uacaaaagaaaaccagggaaacag

SEQ ID NO: 1016455 - RNA, 23 nt, Human
uacagcucauggauggaggcagg

SEQ ID NO: 1016456 - RNA, 18 nt, Human
uagaacccagguaucccc

SEQ ID NO: 1016457 - RNA, 24 nt, Human
uagcccaggcccacacagcggcag

SEQ ID NO: 1016458 - RNA, 25 nt, Human
uauauauauauauuauauguacaca

SEQ ID NO: 1016459 - RNA, 31 nt, Human
uauauauauauuauauguacacacacaccuu

SEQ ID NO: 1016460 - RNA, 20 nt, Human
uauauguacacacacaccug

SEQ ID NO: 1016461 - RNA, 24 nt, Human
uauguacacacacaccugguaacg

SEQ ID NO: 1016462 - RNA, 26 nt, Human
uauuuauaauauauauauauauauau

SEQ ID NO: 1016463 - RNA, 23 nt, Human
ucaaucucuucuuguuauuccca

SEQ ID NO: 1016464 - RNA, 20 nt, Human
ucaaugccaccacucccaca

SEQ ID NO: 1016465 - RNA, 20 nt, Human
ucacccgcgagcccggugcc

SEQ ID NO: 1016466 - RNA, 20 nt, Human
ucacccuucccccucccaaa

SEQ ID NO: 1016467 - RNA, 19 nt, Human
ucagacagaucaagauaca

SEQ ID NO: 1016468 - RNA, 21 nt, Human
uccaaaugaugaauaaccacc

SEQ ID NO: 1016469 - RNA, 23 nt, Human
uccaagaaggaaccugaggcccc

SEQ ID NO: 1016470 - RNA, 22 nt, Human
uccaaggggccaguaggagcac

SEQ ID NO: 1016471 - RNA, 18 nt, Human
uccacgacuacaguucca

SEQ ID NO: 1016472 - RNA, 22 nt, Human
uccagggaucaaggaagggaag

SEQ ID NO: 1016473 - RNA, 21 nt, Human
ucccaagcccuuuaagggcuc

SEQ ID NO: 1016474 - RNA, 19 nt, Human
uccccagaacaaggcagaa

SEQ ID NO: 1016475 - RNA, 19 nt, Human
ucccucccucauuuuccca

SEQ ID NO: 1016476 - RNA, 27 nt, Human
uccguaacaauaauaaaaaaaauuauu

SEQ ID NO: 1016477 - RNA, 21 nt, Human
uccguaguuaguaacugggac

SEQ ID NO: 1016478 - RNA, 22 nt, Human
ucguugucaccgccgccucccg

SEQ ID NO: 1016479 - RNA, 18 nt, Human
ucuaaucccucuccccca

SEQ ID NO: 1016480 - RNA, 24 nt, Human
ucucaaugccaccacucccacacc

SEQ ID NO: 1016481 - RNA, 18 nt, Human
ucucacccgcgagcccgg

SEQ ID NO: 1016482 - RNA, 21 nt, Human
ucucagggccccaacucuccg

SEQ ID NO: 1016483 - RNA, 20 nt, Human
ucuccccucuuuuccugcug

SEQ ID NO: 1016484 - RNA, 23 nt, Human
ucuccucuccaaguccuucccuc

SEQ ID NO: 1016485 - RNA, 21 nt, Human
ucucugucuucaaucucuucu

SEQ ID NO: 1016486 - RNA, 18 nt, Human
ucugguuuaaaaaugauc

SEQ ID NO: 1016487 - RNA, 24 nt, Human
ucuguuuccuacaaaguucaugua

SEQ ID NO: 1016488 - RNA, 24 nt, Human
ucuucaaucucuucuuguuauucc

SEQ ID NO: 1016489 - RNA, 18 nt, Human
ugaaggaaagcacauggg

SEQ ID NO: 1016490 - RNA, 21 nt, Human
ugaaggaaagcacaugggagg

SEQ ID NO: 1016491 - RNA, 24 nt, Human
ugaaggaaagcacaugggaggggg

SEQ ID NO: 1016492 - RNA, 25 nt, Human
ugaaggaaagcacaugggaggggga

SEQ ID NO: 1016493 - RNA, 21 nt, Human
ugaauaaccaccuccccagaa

SEQ ID NO: 1016494 - RNA, 21 nt, Human
ugacgucuccccucuuuuccu

SEQ ID NO: 1016495 - RNA, 18 nt, Human
ugaggaaugggaagagua

SEQ ID NO: 1016496 - RNA, 19 nt, Human
ugagggaaggaagguggcc

SEQ ID NO: 1016497 - RNA, 20 nt, Human
ugagggaaggaagguggcca

SEQ ID NO: 1016498 - RNA, 24 nt, Human
ugagggaaggaagguggccaccug

SEQ ID NO: 1016499 - RNA, 18 nt, Human
ugaucucccaccaccacc

SEQ ID NO: 1016500 - RNA, 26 nt, Human
ugcagaguucaaccagguuacugugu

SEQ ID NO: 1016501 - RNA, 23 nt, Human
ugccaccacucccacacccugag

SEQ ID NO: 1016502 - RNA, 23 nt, Human
uggaaucggugguuuaaaaaaug

SEQ ID NO: 1016503 - RNA, 24 nt, Human
uggcuaaucagaauaaaaaauaaa

SEQ ID NO: 1016504 - RNA, 19 nt, Human
ugggaggagggaagcaaca

SEQ ID NO: 1016505 - RNA, 18 nt, Human
ugggagggggaaagguga

SEQ ID NO: 1016506 - RNA, 26 nt, Human
ugggagggggaaaggugauuccaaau

SEQ ID NO: 1016507 - RNA, 22 nt, Human
uguacacaugcaaaugguugca

SEQ ID NO: 1016508 - RNA, 19 nt, Human
uuacugcagucuuugucuc

SEQ ID NO: 1016509 - RNA, 24 nt, Human
uuagguagucuucucaaugccacc

SEQ ID NO: 1016510 - RNA, 18 nt, Human
uucaaaagaaggagagaa

SEQ ID NO: 1016511 - RNA, 20 nt, Human
uugaagccauguucuuccca

SEQ ID NO: 1016512 - RNA, 21 nt, Human
uugagcuguaaauccuuuucu

SEQ ID NO: 1016513 - RNA, 23 nt, Human
uugcagguggaaaacauggacag

SEQ ID NO: 1016514 - RNA, 24 nt, Human
uuggagcucugaugggaaaucugc

SEQ ID NO: 1016515 - RNA, 21 nt, Human
aaacaacacuggcaauuuuga

SEQ ID NO: 1016516 - RNA, 21 nt, Human
aaacgaauaugcagaacaauc

SEQ ID NO: 1016517 - RNA, 23 nt, Human
aagcuaaccaaaaacuccaacaa

SEQ ID NO: 1016518 - RNA, 20 nt, Human
aauacauucauaguaaccac

SEQ ID NO: 1016519 - RNA, 19 nt, Human
acacagcucuucccccaac

SEQ ID NO: 1016520 - RNA, 24 nt, Human
acacugcuaauuuggcuggaacaa

SEQ ID NO: 1016521 - RNA, 22 nt, Human
acagaucuuuugcaacuucagc

SEQ ID NO: 1016522 - RNA, 24 nt, Human
acaugcacacacgcgcgcacacgg

SEQ ID NO: 1016523 - RNA, 18 nt, Human
accccaaauaaauaacug

SEQ ID NO: 1016524 - RNA, 21 nt, Human
accugugccguggguggagaa

SEQ ID NO: 1016525 - RNA, 33 nt, Human
acgcgcgcacacgcacagacacgcacacacagu

SEQ ID NO: 1016526 - RNA, 19 nt, Human
agcagcucaggacccagga

SEQ ID NO: 1016527 - RNA, 20 nt, Human
agcgggccccgcggcucggc

SEQ ID NO: 1016528 - RNA, 20 nt, Human
agcuaaccaaaaacuccaac

SEQ ID NO: 1016529 - RNA, 20 nt, Human
aggaagacccucagacuuug

SEQ ID NO: 1016530 - RNA, 18 nt, Human
aggugcccaauggcuggg

SEQ ID NO: 1016531 - RNA, 21 nt, Human
augaacagaaaggcaaaaaaa

SEQ ID NO: 1016532 - RNA, 22 nt, Human
augcacacacgcgcgcacacgc

SEQ ID NO: 1016533 - RNA, 20 nt, Human
augguccccuccccuuccca

SEQ ID NO: 1016534 - RNA, 24 nt, Human
caaaaaacaguucacagaugaaca

SEQ ID NO: 1016535 - RNA, 19 nt, Human
caaaaacuccaacaagagg

SEQ ID NO: 1016536 - RNA, 19 nt, Human
caagcaaaugccucagccc

SEQ ID NO: 1016537 - RNA, 31 nt, Human
cacacgcgcgcacacgcacagacacgcacag

SEQ ID NO: 1016538 - RNA, 18 nt, Human
cacagcaucgggcugccc

SEQ ID NO: 1016539 - RNA, 25 nt, Human
cacaugcacacacgcgcgcacacgc

SEQ ID NO: 1016540 - RNA, 24 nt, Human
cacgcauguccaacccagacaaca

SEQ ID NO: 1016541 - RNA, 19 nt, Human
cacugcuaauuuggcugga

SEQ ID NO: 1016542 - RNA, 25 nt, Human
cagaccccaaauaaauaacuggaag

SEQ ID NO: 1016543 - RNA, 18 nt, Human
cagaggugcccaauggcu

SEQ ID NO: 1016544 - RNA, 23 nt, Human
cagcaauacauucauaguaacca

SEQ ID NO: 1016545 - RNA, 23 nt, Human
cagcucugcaggaggccacggcg

SEQ ID NO: 1016546 - RNA, 23 nt, Human
caggaccccgcggcucucucccc

SEQ ID NO: 1016547 - RNA, 18 nt, Human
caguaaggaugccucccc

SEQ ID NO: 1016548 - RNA, 24 nt, Human
cagugcacagaucuuuugcaacuu

SEQ ID NO: 1016549 - RNA, 18 nt, Human
caugcggccgcgcucaug

SEQ ID NO: 1016550 - RNA, 24 nt, Human
ccacacgcauguccaacccagaca

SEQ ID NO: 1016551 - RNA, 22 nt, Human
ccaggggcuggcugccucaugg

SEQ ID NO: 1016552 - RNA, 19 nt, Human
cccacacacagcaucgggc

SEQ ID NO: 1016553 - RNA, 22 nt, Human
cccagaggugcccaauggcugg

SEQ ID NO: 1016554 - RNA, 19 nt, Human
ccccaacggcgcacacgcu

SEQ ID NO: 1016555 - RNA, 23 nt, Human
ccccaacggcgcacacgcuucug

SEQ ID NO: 1016556 - RNA, 21 nt, Human
cccggcgcugcggcuccuccc

SEQ ID NO: 1016557 - RNA, 21 nt, Human
cccgggcggggucgcccggcg

SEQ ID NO: 1016558 - RNA, 23 nt, Human
cccugccaggggcuggcugccuc

SEQ ID NO: 1016559 - RNA, 23 nt, Human
ccugcagguuugcucgcuuggcu

SEQ ID NO: 1016560 - RNA, 19 nt, Human
ccugccccacacacagcau

SEQ ID NO: 1016561 - RNA, 20 nt, Human
cgcauguccaacccagacaa

SEQ ID NO: 1016562 - RNA, 24 nt, Human
cggaagccaccuucacuguucagu

SEQ ID NO: 1016563 - RNA, 19 nt, Human
cggcaaaaaauguacaaac

SEQ ID NO: 1016564 - RNA, 22 nt, Human
cggcaaaaaauguacaaaccag

SEQ ID NO: 1016565 - RNA, 21 nt, Human
cggcgacugcagcggccgagg

SEQ ID NO: 1016566 - RNA, 20 nt, Human
cucagcccggaaccuuggcc

SEQ ID NO: 1016567 - RNA, 21 nt, Human
cucaugguccccuccccuucc

SEQ ID NO: 1016568 - RNA, 18 nt, Human
cucccggccugcggcggc

SEQ ID NO: 1016569 - RNA, 19 nt, Human
cuccgcaccaaggauccua

SEQ ID NO: 1016570 - RNA, 19 nt, Human
cucugcaggaggccacggc

SEQ ID NO: 1016571 - RNA, 24 nt, Human
cugaagcccacacgcauguccaac

SEQ ID NO: 1016572 - RNA, 22 nt, Human
cuggaacaaaaaaaaaaaauca

SEQ ID NO: 1016573 - RNA, 18 nt, Human
gaacaaucucggaaacug

SEQ ID NO: 1016574 - RNA, 20 nt, Human
gagaagaaaacguaaaagcc

SEQ ID NO: 1016575 - RNA, 23 nt, Human
gagggcaacgaagggccgcacag

SEQ ID NO: 1016576 - RNA, 21 nt, Human
gaguggcggggucagcaggag

SEQ ID NO: 1016577 - RNA, 20 nt, Human
gcacagucgccccugccagg

SEQ ID NO: 1016578 - RNA, 21 nt, Human
gccaagcaaaugccucagccc

SEQ ID NO: 1016579 - RNA, 22 nt, Human
gccauccuggccauucccgacu

SEQ ID NO: 1016580 - RNA, 20 nt, Human
gccaucugugacuauaaaua

SEQ ID NO: 1016581 - RNA, 31 nt, Human
gcgcgcacacgcacagacacgcacacacaca

SEQ ID NO: 1016582 - RNA, 23 nt, Human
gcggcggcggcggcgacugcagc

SEQ ID NO: 1016583 - RNA, 18 nt, Human
gcggcggcggcggcggcg

SEQ ID NO: 1016584 - RNA, 22 nt, Human
gcggcggcggcggcggcgacug

SEQ ID NO: 1016585 - RNA, 18 nt, Human
gcuccucccggccugcgg

SEQ ID NO: 1016586 - RNA, 20 nt, Human
gcugcggcuccucccggccu

SEQ ID NO: 1016587 - RNA, 24 nt, Human
ggaaacagcagcucaggacccagg

SEQ ID NO: 1016588 - RNA, 21 nt, Human
ggaacaaaaaaaaaaaaucag

SEQ ID NO: 1016589 - RNA, 19 nt, Human
ggaagucugugagcaaguu

SEQ ID NO: 1016590 - RNA, 23 nt, Human
ggacccaggauuugaauaaccca

SEQ ID NO: 1016591 - RNA, 23 nt, Human
ggagcccccugaaaugacugcuu

SEQ ID NO: 1016592 - RNA, 21 nt, Human
ggccugcggcggcggcggcgg

SEQ ID NO: 1016593 - RNA, 25 nt, Human
ggcggcggcggcgacugcagcggcc

SEQ ID NO: 1016594 - RNA, 20 nt, Human
guccggcaaaaaauguacaa

SEQ ID NO: 1016595 - RNA, 22 nt, Human
gugaccaaguccacuuccaaac

SEQ ID NO: 1016596 - RNA, 22 nt, Human
guggcucagguaggucccuuug

SEQ ID NO: 1016597 - RNA, 28 nt, Human
uaaccaaaaacuccaacaagagggcgcc

SEQ ID NO: 1016598 - RNA, 22 nt, Human
uacagaguaauuaaaaacaaaa

SEQ ID NO: 1016599 - RNA, 21 nt, Human
uaggugccauuuauacacugc

SEQ ID NO: 1016600 - RNA, 21 nt, Human
ucacuggauucacuguuuuuc

SEQ ID NO: 1016601 - RNA, 18 nt, Human
ucagugcacagaucuuuu

SEQ ID NO: 1016602 - RNA, 19 nt, Human
uccaacccagacaacaaug

SEQ ID NO: 1016603 - RNA, 18 nt, Human
ucccaggagggagacgcc

SEQ ID NO: 1016604 - RNA, 23 nt, Human
ucccucuggcugugacacagcuc

SEQ ID NO: 1016605 - RNA, 21 nt, Human
ucccugaaacgucgguuucua

SEQ ID NO: 1016606 - RNA, 21 nt, Human
ucucuuaguguggagggcaag

SEQ ID NO: 1016607 - RNA, 19 nt, Human
ucugcggugaccaagucca

SEQ ID NO: 1016608 - RNA, 18 nt, Human
ucuuaaggugcauacugu

SEQ ID NO: 1016609 - RNA, 20 nt, Human
ugaaaagucaaguauacuug

SEQ ID NO: 1016610 - RNA, 23 nt, Human
ugaaagcaggagggcaacgaagg

SEQ ID NO: 1016611 - RNA, 22 nt, Human
ugacacacaugcacacacgcgg

SEQ ID NO: 1016612 - RNA, 18 nt, Human
ugacacagcucuuccccc

SEQ ID NO: 1016613 - RNA, 22 nt, Human
ugagagccucuuccucugccau

SEQ ID NO: 1016614 - RNA, 20 nt, Human
ugauuggaaacagcagcuca

SEQ ID NO: 1016615 - RNA, 19 nt, Human
ugauuugcacacacuugcc

SEQ ID NO: 1016616 - RNA, 22 nt, Human
ugcaaacgaauaugcagaacaa

SEQ ID NO: 1016617 - RNA, 18 nt, Human
uggagaagaaaacguaaa

SEQ ID NO: 1016618 - RNA, 18 nt, Human
uggagagcggggcggugc

SEQ ID NO: 1016619 - RNA, 22 nt, Human
uggcaauuuugacacacaugca

SEQ ID NO: 1016620 - RNA, 20 nt, Human
uggccauucccgacuggagc

SEQ ID NO: 1016621 - RNA, 18 nt, Human
uggcucagguaggucccu

SEQ ID NO: 1016622 - RNA, 22 nt, Human
uggcuggaacaaaaaaaaaaaa

SEQ ID NO: 1016623 - RNA, 24 nt, Human
ugugauccggggagugcacugcug

SEQ ID NO: 1016624 - RNA, 20 nt, Human
ugugcaaacgaauaugcaga

SEQ ID NO: 1016625 - RNA, 24 nt, Human
ugugcaaacgaauaugcagaacaa

SEQ ID NO: 1016626 - RNA, 22 nt, Human
uuaaaaacaaaaaacaguucac

SEQ ID NO: 1016627 - RNA, 19 nt, Human
uugcugagagggucaaagg

SEQ ID NO: 1016628 - RNA, 24 nt, Human
uuucuauguaaacgcccugcugug

SEQ ID NO: 1016629 - RNA, 22 nt, Human
uuugcaucagcagugguagaag

SEQ ID NO: 1016630 - RNA, 20 nt, Human
aaaaacauaaaacagacaca

SEQ ID NO: 1016631 - RNA, 21 nt, Human
aaaaacauaaaacagacacaa

SEQ ID NO: 1016632 - RNA, 21 nt, Human
aaagaggcugacugggccccc

SEQ ID NO: 1016633 - RNA, 19 nt, Human
acaggcccagacacagacc

SEQ ID NO: 1016634 - RNA, 21 nt, Human
agaaguugguggggagggggg

SEQ ID NO: 1016635 - RNA, 23 nt, Human
agaaguugguggggagggggggu

SEQ ID NO: 1016636 - RNA, 18 nt, Human
aguuaggaguagccuggc

SEQ ID NO: 1016637 - RNA, 19 nt, Human
auggcagugggccaagccu

SEQ ID NO: 1016638 - RNA, 19 nt, Human
cacagcacacagacacggg

SEQ ID NO: 1016639 - RNA, 19 nt, Human
caccuauccaccaccaccc

SEQ ID NO: 1016640 - RNA, 24 nt, Human
caccuauccaccaccacccagagc

SEQ ID NO: 1016641 - RNA, 23 nt, Human
cacugccccagccaugggacagg

SEQ ID NO: 1016642 - RNA, 19 nt, Human
caggucccugacaccaagg

SEQ ID NO: 1016643 - RNA, 19 nt, Human
ccaccacccagagcaggcc

SEQ ID NO: 1016644 - RNA, 23 nt, Human
ccacccagagcaggccagggcag

SEQ ID NO: 1016645 - RNA, 20 nt, Human
cccagugugcuuucccacgg

SEQ ID NO: 1016646 - RNA, 23 nt, Human
ccccccgucgccucccacaagag

SEQ ID NO: 1016647 - RNA, 23 nt, Human
ccccgucgccucccacaagagca

SEQ ID NO: 1016648 - RNA, 28 nt, Human
ccccgugccugcucccgccugccccccc

SEQ ID NO: 1016649 - RNA, 20 nt, Human
ccccuguggcagcaucaccc

SEQ ID NO: 1016650 - RNA, 21 nt, Human
cccgccgauggguccacacca

SEQ ID NO: 1016651 - RNA, 21 nt, Human
ccggccacagcuggcuggcug

SEQ ID NO: 1016652 - RNA, 20 nt, Human
ccgugccugcucccgccugc

SEQ ID NO: 1016653 - RNA, 24 nt, Human
ccgugccugcucccgccugccccc

SEQ ID NO: 1016654 - RNA, 23 nt, Human
ccuauccaccaccacccagagca

SEQ ID NO: 1016655 - RNA, 25 nt, Human
ccucccacaagagcauaaagcaaag

SEQ ID NO: 1016656 - RNA, 27 nt, Human
ccucccacaagagcauaaagcaaaggu

SEQ ID NO: 1016657 - RNA, 22 nt, Human
ccuuggggugggguucuccagu

SEQ ID NO: 1016658 - RNA, 22 nt, Human
cgccugcccccccgucgccucc

SEQ ID NO: 1016659 - RNA, 19 nt, Human
cggggcugcggacguggca

SEQ ID NO: 1016660 - RNA, 22 nt, Human
cuccccagugugcuuucccacg

SEQ ID NO: 1016661 - RNA, 19 nt, Human
cucccgccugcccccccgu

SEQ ID NO: 1016662 - RNA, 21 nt, Human
cugcucccgccugcccccccg

SEQ ID NO: 1016663 - RNA, 25 nt, Human
cuguccaccuauccaccaccaccca

SEQ ID NO: 1016664 - RNA, 21 nt, Human
gaguagccuggcgggggacac

SEQ ID NO: 1016665 - RNA, 23 nt, Human
gccugagggcuggggagggggcu

SEQ ID NO: 1016666 - RNA, 22 nt, Human
gccugcucccgccugccccccc

SEQ ID NO: 1016667 - RNA, 21 nt, Human
ggacaggcccagacacagacc

SEQ ID NO: 1016668 - RNA, 18 nt, Human
ggcagagaaguugguggg

SEQ ID NO: 1016669 - RNA, 20 nt, Human
ggcagagaaguuggugggga

SEQ ID NO: 1016670 - RNA, 20 nt, Human
ggcagggagggccugagggc

SEQ ID NO: 1016671 - RNA, 23 nt, Human
ggcagggagggccugagggcugg

SEQ ID NO: 1016672 - RNA, 23 nt, Human
ggcuggggagggggcucugggug

SEQ ID NO: 1016673 - RNA, 21 nt, Human
gggagggccugagggcugggg

SEQ ID NO: 1016674 - RNA, 21 nt, Human
gggcccccggccacagcuggc

SEQ ID NO: 1016675 - RNA, 22 nt, Human
gggcccccggccacaggacccu

SEQ ID NO: 1016676 - RNA, 18 nt, Human
gggcccccucacugcccu

SEQ ID NO: 1016677 - RNA, 23 nt, Human
gggcuggggagggggcucugggu

SEQ ID NO: 1016678 - RNA, 23 nt, Human
ggggagggggggugcgcuguggg

SEQ ID NO: 1016679 - RNA, 26 nt, Human
ggggggugcgcuguggggucgagggc

SEQ ID NO: 1016680 - RNA, 19 nt, Human
gggguccugguccccgugg

SEQ ID NO: 1016681 - RNA, 20 nt, Human
ggugccucuguccaucucug

SEQ ID NO: 1016682 - RNA, 20 nt, Human
ggugcugggugauggcagug

SEQ ID NO: 1016683 - RNA, 20 nt, Human
guagccuggcgggggacacu

SEQ ID NO: 1016684 - RNA, 21 nt, Human
gucccugacaccaagggaagc

SEQ ID NO: 1016685 - RNA, 22 nt, Human
uaaaacagacacaacgcaagca

SEQ ID NO: 1016686 - RNA, 24 nt, Human
uaaaacagacacaacgcaagcaga

SEQ ID NO: 1016687 - RNA, 18 nt, Human
uacaagcuuccagcgggg

SEQ ID NO: 1016688 - RNA, 20 nt, Human
uauccaccaccacccagagc

SEQ ID NO: 1016689 - RNA, 23 nt, Human
uccacaccaggcugggguggccu

SEQ ID NO: 1016690 - RNA, 25 nt, Human
ucccagugagccgacuuccccaugg

SEQ ID NO: 1016691 - RNA, 21 nt, Human
uccccagugugcuuucccacg

SEQ ID NO: 1016692 - RNA, 18 nt, Human
uccccaugggcagaugag

SEQ ID NO: 1016693 - RNA, 23 nt, Human
ucccuggggcagagaaguuggug

SEQ ID NO: 1016694 - RNA, 25 nt, Human
ucccuggggcagagaaguugguggg

SEQ ID NO: 1016695 - RNA, 22 nt, Human
uccguaaggggaccauuggggg

SEQ ID NO: 1016696 - RNA, 18 nt, Human
ucuguccaccuauccacc

SEQ ID NO: 1016697 - RNA, 18 nt, Human
ucuguccaucucugggac

SEQ ID NO: 1016698 - RNA, 20 nt, Human
ugacaccaagggaagcacug

SEQ ID NO: 1016699 - RNA, 22 nt, Human
ugagggcuggggagggggcucu

SEQ ID NO: 1016700 - RNA, 20 nt, Human
ugccaagcuacaagcuucca

SEQ ID NO: 1016701 - RNA, 19 nt, Human
ugcugggugauggcagugg

SEQ ID NO: 1016702 - RNA, 23 nt, Human
uggaggcguggcacucucucccg

SEQ ID NO: 1016703 - RNA, 25 nt, Human
uggcaccauggcggauguguggcag

SEQ ID NO: 1016704 - RNA, 21 nt, Human
uggcagggagggccugagggc

SEQ ID NO: 1016705 - RNA, 22 nt, Human
uggcaugccuuggggugggguu

SEQ ID NO: 1016706 - RNA, 18 nt, Human
uggcuggcuggccgucug

SEQ ID NO: 1016707 - RNA, 21 nt, Human
ugggcagaugaguggacgggc

SEQ ID NO: 1016708 - RNA, 28 nt, Human
uggggagggggggugcgcuguggggucc

SEQ ID NO: 1016709 - RNA, 25 nt, Human
uggggcagagaaguugguggggagg

SEQ ID NO: 1016710 - RNA, 19 nt, Human
ugggggcccugggugccuc

SEQ ID NO: 1016711 - RNA, 19 nt, Human
ugggguggccucggguccc

SEQ ID NO: 1016712 - RNA, 23 nt, Human
ugggguggccucgggucccuggg

SEQ ID NO: 1016713 - RNA, 18 nt, Human
ugguggggagggggggug

SEQ ID NO: 1016714 - RNA, 29 nt, Human
ugguggggagggggggugcgcuguggggu

SEQ ID NO: 1016715 - RNA, 20 nt, Human
uugggggcuggccuggcggu

SEQ ID NO: 1016716 - RNA, 23 nt, Human
uuuggcagggagggccugagggc

SEQ ID NO: 1016717 - RNA, 20 nt, Human
aaagaaaaacaguuaaaagg

SEQ ID NO: 1016718 - RNA, 20 nt, Human
aaccacggagacccaacucg

SEQ ID NO: 1016719 - RNA, 27 nt, Human
aaccagugccagggcccaagagaccca

SEQ ID NO: 1016720 - RNA, 23 nt, Human
aagaaaaugccagugugcaacug

SEQ ID NO: 1016721 - RNA, 21 nt, Human
accaggaagggggagccggcc

SEQ ID NO: 1016722 - RNA, 25 nt, Human
acugggugacuaaagaccaaagaaa

SEQ ID NO: 1016723 - RNA, 21 nt, Human
agaagggagaccaggaagggg

SEQ ID NO: 1016724 - RNA, 21 nt, Human
agaccaggaagggggagccgg

SEQ ID NO: 1016725 - RNA, 19 nt, Human
agccggccugaaccacgga

SEQ ID NO: 1016726 - RNA, 23 nt, Human
agggagaccaggaagggggagcc

SEQ ID NO: 1016727 - RNA, 23 nt, Human
caacugggugacuaaagaccaaa

SEQ ID NO: 1016728 - RNA, 18 nt, Human
cagcgggagaagggagac

SEQ ID NO: 1016729 - RNA, 28 nt, Human
ccaaagguggcagcgacuuguccucccc

SEQ ID NO: 1016730 - RNA, 19 nt, Human
ccagugugcaacuggguga

SEQ ID NO: 1016731 - RNA, 20 nt, Human
ccaguuaucagaggugacug

SEQ ID NO: 1016732 - RNA, 24 nt, Human
cggccggcagcugacggcaggaaa

SEQ ID NO: 1016733 - RNA, 25 nt, Human
gaagacaaucuccucccgauaaacc

SEQ ID NO: 1016734 - RNA, 19 nt, Human
gaccaaagaaaaacaguua

SEQ ID NO: 1016735 - RNA, 24 nt, Human
gcccuggaagacaaucuccucccg

SEQ ID NO: 1016736 - RNA, 19 nt, Human
ggaagggggagccggccug

SEQ ID NO: 1016737 - RNA, 24 nt, Human
ggcaggaaacggaccgucccaggg

SEQ ID NO: 1016738 - RNA, 23 nt, Human
ggugacuaaagaccaaagaaaaa

SEQ ID NO: 1016739 - RNA, 21 nt, Human
uaacuucucaccugaaaucuc

SEQ ID NO: 1016740 - RNA, 20 nt, Human
uacuugcucucugucucagg

SEQ ID NO: 1016741 - RNA, 24 nt, Human
uagcccuaauuaaacacaaacaaa

SEQ ID NO: 1016742 - RNA, 18 nt, Human
uagcccuggaagacaauc

SEQ ID NO: 1016743 - RNA, 19 nt, Human
ucuucugccacugccuuga

SEQ ID NO: 1016744 - RNA, 20 nt, Human
ucuucugccacugccuugag

SEQ ID NO: 1016745 - RNA, 24 nt, Human
ugacuaaagaccaaagaaaaacag

SEQ ID NO: 1016746 - RNA, 18 nt, Human
uugcagcaagaaaaugcc

SEQ ID NO: 1016747 - RNA, 25 nt, Human
aaaucaccccaagaaaagaacaugu

SEQ ID NO: 1016748 - RNA, 23 nt, Human
aagaaaccuaggcaggcaguggg

SEQ ID NO: 1016749 - RNA, 24 nt, Human
aagcaacacaggcaagaacaaacu

SEQ ID NO: 1016750 - RNA, 25 nt, Human
aagcaugucucuagucaaguguaua

SEQ ID NO: 1016751 - RNA, 21 nt, Human
aagccaaagacagagacagaa

SEQ ID NO: 1016752 - RNA, 27 nt, Human
aaucuuuuaaagucagauuucuuguuc

SEQ ID NO: 1016753 - RNA, 21 nt, Human
acaccaggaauggagaagcca

SEQ ID NO: 1016754 - RNA, 22 nt, Human
acauacacucucucugauggcu

SEQ ID NO: 1016755 - RNA, 21 nt, Human
acccgcagcggccccucagcu

SEQ ID NO: 1016756 - RNA, 19 nt, Human
acccggcccugccuucccc

SEQ ID NO: 1016757 - RNA, 21 nt, Human
acuggcacuuucugaagcucc

SEQ ID NO: 1016758 - RNA, 25 nt, Human
agacagagacagaacuuuggcagga

SEQ ID NO: 1016759 - RNA, 21 nt, Human
agagacagaacuuuggcagga

SEQ ID NO: 1016760 - RNA, 19 nt, Human
agaggugugugaacagauc

SEQ ID NO: 1016761 - RNA, 20 nt, Human
agcaaaaaaauggguccuuu

SEQ ID NO: 1016762 - RNA, 23 nt, Human
aggaagaagcagaggaaacaaga

SEQ ID NO: 1016763 - RNA, 21 nt, Human
aggcagucuugaguuaccaug

SEQ ID NO: 1016764 - RNA, 24 nt, Human
aggccaagaguuucuccuccacag

SEQ ID NO: 1016765 - RNA, 23 nt, Human
agugaaggaugggcuaggugaug

SEQ ID NO: 1016766 - RNA, 33 nt, Human
aucucaccuacuuuaggagucccuccuccagga

SEQ ID NO: 1016767 - RNA, 21 nt, Human
augcugggcuccuuuccaggu

SEQ ID NO: 1016768 - RNA, 20 nt, Human
auggugcuuagcucucagug

SEQ ID NO: 1016769 - RNA, 21 nt, Human
cacaacuguggcuaaaccaga

SEQ ID NO: 1016770 - RNA, 20 nt, Human
caccaggaauggagaagccc

SEQ ID NO: 1016771 - RNA, 19 nt, Human
cacccgcagcggccccuca

SEQ ID NO: 1016772 - RNA, 22 nt, Human
caccuuauccuucccacugauc

SEQ ID NO: 1016773 - RNA, 23 nt, Human
cacuacugaggaccaagaguuca

SEQ ID NO: 1016774 - RNA, 25 nt, Human
cagaagccaaagacagagacagaac

SEQ ID NO: 1016775 - RNA, 21 nt, Human
cauagccuucccagaagcaaa

SEQ ID NO: 1016776 - RNA, 18 nt, Human
ccaccgcgcccggcucca

SEQ ID NO: 1016777 - RNA, 24 nt, Human
ccaccgcgcccggcuccaagcagg

SEQ ID NO: 1016778 - RNA, 18 nt, Human
ccccuuuccuaucuuguc

SEQ ID NO: 1016779 - RNA, 19 nt, Human
cccgcagcggccccucagc

SEQ ID NO: 1016780 - RNA, 18 nt, Human
cccggcccugccuucccc

SEQ ID NO: 1016781 - RNA, 18 nt, Human
ccgcacuccacccgcagc

SEQ ID NO: 1016782 - RNA, 21 nt, Human
ccgccgcacuccacccgcagc

SEQ ID NO: 1016783 - RNA, 21 nt, Human
ccgccgcugccaccgcgcccg

SEQ ID NO: 1016784 - RNA, 25 nt, Human
ccgcugccaccgcgcccggcuccaa

SEQ ID NO: 1016785 - RNA, 20 nt, Human
ccuagacaauacuuuggcuc

SEQ ID NO: 1016786 - RNA, 22 nt, Human
ccucaggauuccaagugggagu

SEQ ID NO: 1016787 - RNA, 19 nt, Human
cgacuccgccgcacuccac

SEQ ID NO: 1016788 - RNA, 23 nt, Human
cgccgcugccgccgcugccaccg

SEQ ID NO: 1016789 - RNA, 23 nt, Human
cgcgcccggcuccaagcaggccc

SEQ ID NO: 1016790 - RNA, 18 nt, Human
cggccgccggguccucuc

SEQ ID NO: 1016791 - RNA, 24 nt, Human
cuccuccacacuuucuguuggaca

SEQ ID NO: 1016792 - RNA, 19 nt, Human
cuuuggaacuggccugcag

SEQ ID NO: 1016793 - RNA, 18 nt, Human
cuuuguugcugaugauug

SEQ ID NO: 1016794 - RNA, 24 nt, Human
gaauaaaccaguuuccugcccaag

SEQ ID NO: 1016795 - RNA, 20 nt, Human
gacccggcccugccuucccc

SEQ ID NO: 1016796 - RNA, 21 nt, Human
gagacagaacuuuggcaggaa

SEQ ID NO: 1016797 - RNA, 20 nt, Human
gagacauaaucuacuaucaa

SEQ ID NO: 1016798 - RNA, 21 nt, Human
gagcaaaaaaauggguccuuu

SEQ ID NO: 1016799 - RNA, 23 nt, Human
gagcacuugauaggccaagaguu

SEQ ID NO: 1016800 - RNA, 19 nt, Human
gagcagacucagaugcucc

SEQ ID NO: 1016801 - RNA, 24 nt, Human
gagcauauacaagcaugaagccac

SEQ ID NO: 1016802 - RNA, 24 nt, Human
gagcugaaucucacauucaaguuc

SEQ ID NO: 1016803 - RNA, 22 nt, Human
gaggcgcggugcagcaggcggc

SEQ ID NO: 1016804 - RNA, 22 nt, Human
gaguauaggaauaaaccaguuu

SEQ ID NO: 1016805 - RNA, 19 nt, Human
gauucuggcuagaaagcuc

SEQ ID NO: 1016806 - RNA, 23 nt, Human
gcaacauaaacaguggcuuaagc

SEQ ID NO: 1016807 - RNA, 18 nt, Human
gcaggaacgcggcggagg

SEQ ID NO: 1016808 - RNA, 24 nt, Human
gccaccgcgcccggcuccaagcag

SEQ ID NO: 1016809 - RNA, 27 nt, Human
gccgacccggcccugccuuccccgcac

SEQ ID NO: 1016810 - RNA, 22 nt, Human
gcuagaaagcucuuaaucccaa

SEQ ID NO: 1016811 - RNA, 24 nt, Human
gcuuaguaucgcaccugcuuccgu

SEQ ID NO: 1016812 - RNA, 22 nt, Human
gcuuaugugugauagugacagc

SEQ ID NO: 1016813 - RNA, 18 nt, Human
ggaaagacagccacagag

SEQ ID NO: 1016814 - RNA, 25 nt, Human
ggagaagccaacuuacuggcuugga

SEQ ID NO: 1016815 - RNA, 19 nt, Human
ggcccugccuuccccgcac

SEQ ID NO: 1016816 - RNA, 27 nt, Human
gggauugaugaaagaaaagaguaacaa

SEQ ID NO: 1016817 - RNA, 23 nt, Human
gggcucacagaccuucucuugga

SEQ ID NO: 1016818 - RNA, 25 nt, Human
ggugcagcaggcggcggaucaagcu

SEQ ID NO: 1016819 - RNA, 19 nt, Human
gugaaauuccaaaacacaa

SEQ ID NO: 1016820 - RNA, 25 nt, Human
gugaaggaugggcuaggugaugagc

SEQ ID NO: 1016821 - RNA, 22 nt, Human
gugugugaacagaucuuggcug

SEQ ID NO: 1016822 - RNA, 22 nt, Human
uaaaagcaacacaggcaagaac

SEQ ID NO: 1016823 - RNA, 20 nt, Human
uaaaccaguuuccugcccaa

SEQ ID NO: 1016824 - RNA, 23 nt, Human
uaaaggaaacagaacuuaggccc

SEQ ID NO: 1016825 - RNA, 23 nt, Human
uaagagccuguuucaaaucaagc

SEQ ID NO: 1016826 - RNA, 19 nt, Human
uaagcaaacacucuuugga

SEQ ID NO: 1016827 - RNA, 22 nt, Human
uaguaagcaaagaguaaauccu

SEQ ID NO: 1016828 - RNA, 19 nt, Human
uauaggaauaaaccaguuu

SEQ ID NO: 1016829 - RNA, 22 nt, Human
uauaguuaaacauucucaugcc

SEQ ID NO: 1016830 - RNA, 21 nt, Human
uauucuugggcugaggcuuag

SEQ ID NO: 1016831 - RNA, 18 nt, Human
ucaacaccuggauccacu

SEQ ID NO: 1016832 - RNA, 22 nt, Human
ucaagaauaucagacaccagga

SEQ ID NO: 1016833 - RNA, 23 nt, Human
ucaaggugcaaacuagagcugaa

SEQ ID NO: 1016834 - RNA, 21 nt, Human
ucacaacuguggcuaaaccag

SEQ ID NO: 1016835 - RNA, 21 nt, Human
ucacuggggaaaucaaggugc

SEQ ID NO: 1016836 - RNA, 19 nt, Human
ucagggaaagacagccaca

SEQ ID NO: 1016837 - RNA, 21 nt, Human
ucagugaucuaggaauuuccu

SEQ ID NO: 1016838 - RNA, 25 nt, Human
uccacaggcggcgccgacccggccc

SEQ ID NO: 1016839 - RNA, 21 nt, Human
uccagaccuuguucuagaccu

SEQ ID NO: 1016840 - RNA, 20 nt, Human
ucccagaagcaaaguuagcu

SEQ ID NO: 1016841 - RNA, 20 nt, Human
ucccaggugauuaaaucacc

SEQ ID NO: 1016842 - RNA, 22 nt, Human
uccccgcacggacgggacucac

SEQ ID NO: 1016843 - RNA, 19 nt, Human
uccccuuuccuaucuuguc

SEQ ID NO: 1016844 - RNA, 18 nt, Human
ucccugcuggcuacacag

SEQ ID NO: 1016845 - RNA, 18 nt, Human
uccuccagcauacccugg

SEQ ID NO: 1016846 - RNA, 23 nt, Human
ucgccgccgcugccgccgcugcc

SEQ ID NO: 1016847 - RNA, 23 nt, Human
ucgcgaggccgacuccgccgcac

SEQ ID NO: 1016848 - RNA, 19 nt, Human
ucuaaacauuuccagaccu

SEQ ID NO: 1016849 - RNA, 19 nt, Human
ucucaggagcacuugauag

SEQ ID NO: 1016850 - RNA, 20 nt, Human
ucucuagcuuuuaaagcugg

SEQ ID NO: 1016851 - RNA, 22 nt, Human
ucucuagucaaguguauaggac

SEQ ID NO: 1016852 - RNA, 18 nt, Human
ucucuuggauuuugugcc

SEQ ID NO: 1016853 - RNA, 23 nt, Human
ugaaagaaaagaguaacaguuga

SEQ ID NO: 1016854 - RNA, 21 nt, Human
ugaagagcacguuucuggggu

SEQ ID NO: 1016855 - RNA, 21 nt, Human
ugaauuguguucacuuuuugc

SEQ ID NO: 1016856 - RNA, 20 nt, Human
ugagaacaagagaacuagag

SEQ ID NO: 1016857 - RNA, 21 nt, Human
ugagagaggaggcagcaacau

SEQ ID NO: 1016858 - RNA, 19 nt, Human
ugaugagcaaaaaaauggg

SEQ ID NO: 1016859 - RNA, 19 nt, Human
ugauuaaaucaccccaaga

SEQ ID NO: 1016860 - RNA, 19 nt, Human
ugcaaagccacuuaggagc

SEQ ID NO: 1016861 - RNA, 24 nt, Human
ugccuggacagaagccaaagacag

SEQ ID NO: 1016862 - RNA, 28 nt, Human
ugccuggacagaagccaaagacagagac

SEQ ID NO: 1016863 - RNA, 22 nt, Human
ugccuuaugaugggcuuccagu

SEQ ID NO: 1016864 - RNA, 18 nt, Human
uggcucaaggaagcugca

SEQ ID NO: 1016865 - RNA, 23 nt, Human
uggggcuaagaaaaccguuucca

SEQ ID NO: 1016866 - RNA, 23 nt, Human
ugggguuuccccuuuccuaucuu

SEQ ID NO: 1016867 - RNA, 24 nt, Human
ugggguuuccccuuuccuaucuug

SEQ ID NO: 1016868 - RNA, 23 nt, Human
uguaagacuucugcauucugucu

SEQ ID NO: 1016869 - RNA, 18 nt, Human
uguaucuuugaaaagaug

SEQ ID NO: 1016870 - RNA, 18 nt, Human
ugucaagaauaucagaca

SEQ ID NO: 1016871 - RNA, 22 nt, Human
ugucuggucaugacaagcaguu

SEQ ID NO: 1016872 - RNA, 24 nt, Human
ugugcagaugaaaauuugagaucc

SEQ ID NO: 1016873 - RNA, 22 nt, Human
uguuggacaccuuauccuuccc

SEQ ID NO: 1016874 - RNA, 23 nt, Human
uguuggauggggcucacagaccc

SEQ ID NO: 1016875 - RNA, 21 nt, Human
uucagacauagccuucccaga

SEQ ID NO: 1016876 - RNA, 23 nt, Human
uucauucguauuugaauuguguu

SEQ ID NO: 1016877 - RNA, 21 nt, Human
uugaaucuuaagcaaacacuc

SEQ ID NO: 1016878 - RNA, 28 nt, Human
aaaaaaaaaaugaaauggaaacugagaa

SEQ ID NO: 1016879 - RNA, 20 nt, Human
aaaaaacagcagaagcccug

SEQ ID NO: 1016880 - RNA, 21 nt, Human
aaaaaagaaacugucagagag

SEQ ID NO: 1016881 - RNA, 19 nt, Human
aaaaaaugacaaaaucacu

SEQ ID NO: 1016882 - RNA, 19 nt, Human
aaaaagaaacugucagaga

SEQ ID NO: 1016883 - RNA, 24 nt, Human
aaaucacuaagucaccaaaacuag

SEQ ID NO: 1016884 - RNA, 23 nt, Human
aacgaaaugcagggaaagguccg

SEQ ID NO: 1016885 - RNA, 24 nt, Human
aacgacuguucuguaaccccuaca

SEQ ID NO: 1016886 - RNA, 23 nt, Human
aacuuacugcuuuccagaaccuu

SEQ ID NO: 1016887 - RNA, 19 nt, Human
aagcagguucaucacucca

SEQ ID NO: 1016888 - RNA, 24 nt, Human
aagcagguucaucacuccaauuug

SEQ ID NO: 1016889 - RNA, 25 nt, Human
aagcagguucaucacuccaauuugu

SEQ ID NO: 1016890 - RNA, 18 nt, Human
aaggaucccaggccccag

SEQ ID NO: 1016891 - RNA, 19 nt, Human
aagugcaguaguacaugau

SEQ ID NO: 1016892 - RNA, 18 nt, Human
aaguugcagccggcuccg

SEQ ID NO: 1016893 - RNA, 19 nt, Human
aauggaaacugagaaaaga

SEQ ID NO: 1016894 - RNA, 26 nt, Human
acaaagaaauauauacaaaauguuca

SEQ ID NO: 1016895 - RNA, 18 nt, Human
acggcgggccgcgguagc

SEQ ID NO: 1016896 - RNA, 25 nt, Human
agaaaaaaaaaaaugaaauggaaga

SEQ ID NO: 1016897 - RNA, 26 nt, Human
aggaagaaaauacuccaacagaaugu

SEQ ID NO: 1016898 - RNA, 24 nt, Human
aggaaggaaaucaccuaaaaaaga

SEQ ID NO: 1016899 - RNA, 23 nt, Human
aggcacuaaaaacccaugcagcu

SEQ ID NO: 1016900 - RNA, 22 nt, Human
auauauguauauauauauauaa

SEQ ID NO: 1016901 - RNA, 19 nt, Human
auauguauauauauauaua

SEQ ID NO: 1016902 - RNA, 20 nt, Human
aucccaggccccagggcggg

SEQ ID NO: 1016903 - RNA, 26 nt, Human
aucccaggccccagggcggguagccc

SEQ ID NO: 1016904 - RNA, 27 nt, Human
aucgccgccgccgucuccuccuccccc

SEQ ID NO: 1016905 - RNA, 18 nt, Human
augcugugaugcacugga

SEQ ID NO: 1016906 - RNA, 21 nt, Human
caaaguaucucaauucagaag

SEQ ID NO: 1016907 - RNA, 24 nt, Human
caaggcuucuguuucaaaaaagcu

SEQ ID NO: 1016908 - RNA, 18 nt, Human
cagcccgggucaggucag

SEQ ID NO: 1016909 - RNA, 18 nt, Human
caggucagagggcagcga

SEQ ID NO: 1016910 - RNA, 24 nt, Human
cauacuaauccuuccauuuucaaa

SEQ ID NO: 1016911 - RNA, 22 nt, Human
cauucuaaaaaucuacacuugg

SEQ ID NO: 1016912 - RNA, 24 nt, Human
ccacaauuucaaauaaugcaggaa

SEQ ID NO: 1016913 - RNA, 27 nt, Human
ccaggccccagggcggguagccccggc

SEQ ID NO: 1016914 - RNA, 19 nt, Human
ccauuuauaaaaugacauu

SEQ ID NO: 1016915 - RNA, 22 nt, Human
ccccaaggaucccaggccccag

SEQ ID NO: 1016916 - RNA, 22 nt, Human
ccccagggcggguagccccggc

SEQ ID NO: 1016917 - RNA, 22 nt, Human
cccccgcugcagcccgggucag

SEQ ID NO: 1016918 - RNA, 21 nt, Human
cccccucccggcuuccaacuc

SEQ ID NO: 1016919 - RNA, 22 nt, Human
ccccggccgcuaagaguggcuc

SEQ ID NO: 1016920 - RNA, 19 nt, Human
cccgaggcugccagcagcu

SEQ ID NO: 1016921 - RNA, 24 nt, Human
cccggccgcuaagaguggcucacg

SEQ ID NO: 1016922 - RNA, 18 nt, Human
cccggcuuccaacucucc

SEQ ID NO: 1016923 - RNA, 19 nt, Human
ccgccgccgucuccuccuc

SEQ ID NO: 1016924 - RNA, 18 nt, Human
ccgccgcggcucccccuc

SEQ ID NO: 1016925 - RNA, 21 nt, Human
ccuaaguacaugcaauuacca

SEQ ID NO: 1016926 - RNA, 22 nt, Human
ccucccggcuuccaacucuccu

SEQ ID NO: 1016927 - RNA, 19 nt, Human
cgcgcgcacggccacgccg

SEQ ID NO: 1016928 - RNA, 25 nt, Human
cgcggcucccccucccggcuuccaa

SEQ ID NO: 1016929 - RNA, 21 nt, Human
cggcucccccucccggcuucc

SEQ ID NO: 1016930 - RNA, 18 nt, Human
cggcuccgggcucucacu

SEQ ID NO: 1016931 - RNA, 20 nt, Human
cuagaaaaaaaaaaaugaaa

SEQ ID NO: 1016932 - RNA, 22 nt, Human
cuaugccucaugagggccacgg

SEQ ID NO: 1016933 - RNA, 19 nt, Human
cucccgccucacuuggcua

SEQ ID NO: 1016934 - RNA, 20 nt, Human
cugcccgaggcugccagcag

SEQ ID NO: 1016935 - RNA, 19 nt, Human
cuguuucuccccagcccac

SEQ ID NO: 1016936 - RNA, 25 nt, Human
gaaaauacuccaacagaauguuaua

SEQ ID NO: 1016937 - RNA, 22 nt, Human
gaaccuaacaaagcagcuuuaa

SEQ ID NO: 1016938 - RNA, 20 nt, Human
gaaggaaaucaccuaaaaaa

SEQ ID NO: 1016939 - RNA, 28 nt, Human
gagccaaggcgcggggagggacgggaga

SEQ ID NO: 1016940 - RNA, 19 nt, Human
gcacuggaaaccaaagacc

SEQ ID NO: 1016941 - RNA, 21 nt, Human
gcaggaaggaaaucaccuaaa

SEQ ID NO: 1016942 - RNA, 18 nt, Human
gccagcagcuuggucagc

SEQ ID NO: 1016943 - RNA, 23 nt, Human
gccccaaggaucccaggccccag

SEQ ID NO: 1016944 - RNA, 23 nt, Human
gcccgaggcugccagcagcuugg

SEQ ID NO: 1016945 - RNA, 24 nt, Human
gcggccgggagaucgccgccgccg

SEQ ID NO: 1016946 - RNA, 23 nt, Human
ggaaaauacuuuuuaauuaugaa

SEQ ID NO: 1016947 - RNA, 21 nt, Human
ggcaggaaggaaaucaccuaa

SEQ ID NO: 1016948 - RNA, 23 nt, Human
ggccacggcgggccgcgguagcc

SEQ ID NO: 1016949 - RNA, 20 nt, Human
ggcuugcuccugcccuuagg

SEQ ID NO: 1016950 - RNA, 20 nt, Human
guacaugcaauuaccaugua

SEQ ID NO: 1016951 - RNA, 21 nt, Human
guauuaucuagcaacaaaaca

SEQ ID NO: 1016952 - RNA, 22 nt, Human
gucaccaaaacuagaaaaaaaa

SEQ ID NO: 1016953 - RNA, 19 nt, Human
uaaaaaacagcagaagccc

SEQ ID NO: 1016954 - RNA, 21 nt, Human
uaaaaaacagcagaagcccug

SEQ ID NO: 1016955 - RNA, 23 nt, Human
uaaaaacaagaccaugaaguuga

SEQ ID NO: 1016956 - RNA, 25 nt, Human
uaaaaauaaaaaacagcagaagccc

SEQ ID NO: 1016957 - RNA, 19 nt, Human
uaaagcaggaaauguggcc

SEQ ID NO: 1016958 - RNA, 20 nt, Human
uaaagcaggaaauguggccc

SEQ ID NO: 1016959 - RNA, 21 nt, Human
uaagacccacagucagcauua

SEQ ID NO: 1016960 - RNA, 25 nt, Human
uacaaaauguucaaguauuaguuaa

SEQ ID NO: 1016961 - RNA, 24 nt, Human
uacaacggagccuggcaggaagga

SEQ ID NO: 1016962 - RNA, 20 nt, Human
uacauacugaaauaaacaga

SEQ ID NO: 1016963 - RNA, 19 nt, Human
uacugugucacauucaugc

SEQ ID NO: 1016964 - RNA, 28 nt, Human
uacuuuugguuuauauauauauauauau

SEQ ID NO: 1016965 - RNA, 22 nt, Human
uagcacaaaguuagucauuuca

SEQ ID NO: 1016966 - RNA, 19 nt, Human
uauauauauauauauauau

SEQ ID NO: 1016967 - RNA, 18 nt, Human
uauauauauauguauaua

SEQ ID NO: 1016968 - RNA, 20 nt, Human
uauauauauguauauauaua

SEQ ID NO: 1016969 - RNA, 23 nt, Human
uauauauauguauauauauauau

SEQ ID NO: 1016970 - RNA, 18 nt, Human
uauauguauauauauaua

SEQ ID NO: 1016971 - RNA, 22 nt, Human
uauauguauauauauauauaau

SEQ ID NO: 1016972 - RNA, 23 nt, Human
uaucuagcaacaaaacauuuaca

SEQ ID NO: 1016973 - RNA, 18 nt, Human
uauguauauauauauaua

SEQ ID NO: 1016974 - RNA, 18 nt, Human
uauguauauauauauaua

SEQ ID NO: 1016975 - RNA, 27 nt, Human
ucacgggccccaaggaucccaggcccc

SEQ ID NO: 1016976 - RNA, 19 nt, Human
ucagagggcagcgaacaag

SEQ ID NO: 1016977 - RNA, 23 nt, Human
uccaauaucauguuagagaugaa

SEQ ID NO: 1016978 - RNA, 22 nt, Human
ucgucgccaaacugcugcuugc

SEQ ID NO: 1016979 - RNA, 19 nt, Human
ucuccuccucccccgcugc

SEQ ID NO: 1016980 - RNA, 18 nt, Human
ugaaagggguaaacgcgg

SEQ ID NO: 1016981 - RNA, 20 nt, Human
ugaaagggguaaacgcggau

SEQ ID NO: 1016982 - RNA, 23 nt, Human
ugacaaaaucacuaagucaccaa

SEQ ID NO: 1016983 - RNA, 24 nt, Human
ugacguaaggaagaaaauacucca

SEQ ID NO: 1016984 - RNA, 20 nt, Human
ugcccgaggcugccagcagc

SEQ ID NO: 1016985 - RNA, 22 nt, Human
uggaauuucaaaguaucucaau

SEQ ID NO: 1016986 - RNA, 19 nt, Human
uggccgaaacgaaaugcag

SEQ ID NO: 1016987 - RNA, 24 nt, Human
uggcucacgggccccaaggauccc

SEQ ID NO: 1016988 - RNA, 23 nt, Human
ugguguaagggaguugaaagggg

SEQ ID NO: 1016989 - RNA, 24 nt, Human
uguauauauauauauaauucagua

SEQ ID NO: 1016990 - RNA, 18 nt, Human
ugugcaagaacaaggauu

SEQ ID NO: 1016991 - RNA, 19 nt, Human
ugugcaagaacaaggauuc

SEQ ID NO: 1016992 - RNA, 19 nt, Human
uguuauaguuuuuagaaaa

SEQ ID NO: 1016993 - RNA, 18 nt, Human
uuaaaaauaaaaaacagc

SEQ ID NO: 1016994 - RNA, 24 nt, Human
uuaaaaauaggccauacuaauccu

SEQ ID NO: 1016995 - RNA, 25 nt, Human
uuaaaauaaagcaggaaauguggcc

SEQ ID NO: 1016996 - RNA, 22 nt, Human
uucaaauaaucuuuccaacuac

SEQ ID NO: 1016997 - RNA, 23 nt, Human
uucaaguauuaguuaaauuucaa

SEQ ID NO: 1016998 - RNA, 19 nt, Human
uucaucacuccaauuugug

SEQ ID NO: 1016999 - RNA, 18 nt, Human
uugcagccggcuccgggc

SEQ ID NO: 1017000 - RNA, 23 nt, Human
uugugcaagaacaaggauuccau

SEQ ID NO: 1017001 - RNA, 18 nt, Human
uuuaaagccccuauuaga

SEQ ID NO: 1017002 - RNA, 19 nt, Human
uuuauauauauauauauau

SEQ ID NO: 1017003 - RNA, 19 nt, Human
uuuauauauauauauauau

SEQ ID NO: 1017004 - RNA, 22 nt, Human
uuucaaauaaucuuuccaacua

SEQ ID NO: 1017005 - RNA, 22 nt, Human
uuuccagaaccuuuuaagaccc

SEQ ID NO: 1017006 - RNA, 21 nt, Human
uuugacuacuguuucucccca

SEQ ID NO: 1017007 - RNA, 30 nt, Human
uuugguuuauauauauauauauauauguaa

SEQ ID NO: 1017008 - RNA, 21 nt, Human
aacuggcaaauccugucccca

SEQ ID NO: 1017009 - RNA, 21 nt, Human
aauggcccccaguccaccuuu

SEQ ID NO: 1017010 - RNA, 20 nt, Human
accaggaacccccuggaaac

SEQ ID NO: 1017011 - RNA, 23 nt, Human
acccaaaccuuuucucuuuccca

SEQ ID NO: 1017012 - RNA, 18 nt, Human
accuuagcauccacuguc

SEQ ID NO: 1017013 - RNA, 19 nt, Human
agaaggccagggcugcaac

SEQ ID NO: 1017014 - RNA, 21 nt, Human
agacccugauccccagucccu

SEQ ID NO: 1017015 - RNA, 23 nt, Human
agccacagagccaucucacaggg

SEQ ID NO: 1017016 - RNA, 18 nt, Human
agccaccacguccucccc

SEQ ID NO: 1017017 - RNA, 23 nt, Human
agcccagaccaccgguguggccc

SEQ ID NO: 1017018 - RNA, 24 nt, Human
agcugagacuugggcaaaaaccug

SEQ ID NO: 1017019 - RNA, 18 nt, Human
aggagggugucacacaua

SEQ ID NO: 1017020 - RNA, 19 nt, Human
aggcaguggguugagggga

SEQ ID NO: 1017021 - RNA, 21 nt, Human
aggccgugugccucaguuucc

SEQ ID NO: 1017022 - RNA, 24 nt, Human
aguuucucugggccacccccaacc

SEQ ID NO: 1017023 - RNA, 18 nt, Human
auccccucagguauaaag

SEQ ID NO: 1017024 - RNA, 18 nt, Human
caagucgggauaccagcc

SEQ ID NO: 1017025 - RNA, 22 nt, Human
cacaggaagcaaauggccccca

SEQ ID NO: 1017026 - RNA, 20 nt, Human
cagagcccagacccugaucc

SEQ ID NO: 1017027 - RNA, 19 nt, Human
cagccacagagccaucuca

SEQ ID NO: 1017028 - RNA, 19 nt, Human
cagcuccaucuugucugaa

SEQ ID NO: 1017029 - RNA, 20 nt, Human
caggccgugugccucaguuu

SEQ ID NO: 1017030 - RNA, 20 nt, Human
cagugcugugacugucggcc

SEQ ID NO: 1017031 - RNA, 18 nt, Human
ccaaaccuuuucucuuuc

SEQ ID NO: 1017032 - RNA, 18 nt, Human
ccagagguggcggcugac

SEQ ID NO: 1017033 - RNA, 23 nt, Human
ccaugccugcaucccucucaccu

SEQ ID NO: 1017034 - RNA, 20 nt, Human
ccccaugggcaucccucucc

SEQ ID NO: 1017035 - RNA, 23 nt, Human
cccccaacccaugccugcauccc

SEQ ID NO: 1017036 - RNA, 24 nt, Human
ccccuaggaagucuuggaugaaca

SEQ ID NO: 1017037 - RNA, 23 nt, Human
ccccuggaaaccggacccgaccc

SEQ ID NO: 1017038 - RNA, 21 nt, Human
cccgacccgcgguccccagcc

SEQ ID NO: 1017039 - RNA, 19 nt, Human
ccucgagcaccaggaaccc

SEQ ID NO: 1017040 - RNA, 21 nt, Human
ccugaacgagugccaccggaa

SEQ ID NO: 1017041 - RNA, 18 nt, Human
ccuuggaggugaggcucc

SEQ ID NO: 1017042 - RNA, 24 nt, Human
cggcugacagagcccagacccuga

SEQ ID NO: 1017043 - RNA, 18 nt, Human
cuagaguucagccaccac

SEQ ID NO: 1017044 - RNA, 23 nt, Human
cucaccuuagcauccacugucau

SEQ ID NO: 1017045 - RNA, 18 nt, Human
cucugaauagucucggcc

SEQ ID NO: 1017046 - RNA, 22 nt, Human
gacaggguugggggugaagugg

SEQ ID NO: 1017047 - RNA, 18 nt, Human
gacccugauccccagucc

SEQ ID NO: 1017048 - RNA, 22 nt, Human
gagcccagacccugauccccag

SEQ ID NO: 1017049 - RNA, 20 nt, Human
gaggugaggcuccagguagg

SEQ ID NO: 1017050 - RNA, 19 nt, Human
gauaccagccacagagcca

SEQ ID NO: 1017051 - RNA, 19 nt, Human
gaugaacagaggcaguggg

SEQ ID NO: 1017052 - RNA, 23 nt, Human
gcaccacagugcagugcugugac

SEQ ID NO: 1017053 - RNA, 21 nt, Human
ggacccgacccgcggucccca

SEQ ID NO: 1017054 - RNA, 20 nt, Human
ggccacccccaacccaugcc

SEQ ID NO: 1017055 - RNA, 22 nt, Human
gggcaucccucuccugagucgg

SEQ ID NO: 1017056 - RNA, 23 nt, Human
ggggagguccucaggaggguguc

SEQ ID NO: 1017057 - RNA, 19 nt, Human
gucugaaguuaacaucauc

SEQ ID NO: 1017058 - RNA, 20 nt, Human
gugaaguggccaccaaaccc

SEQ ID NO: 1017059 - RNA, 22 nt, Human
uagggacagggccuggucugcu

SEQ ID NO: 1017060 - RNA, 18 nt, Human
ucagcgucuacaaacaug

SEQ ID NO: 1017061 - RNA, 20 nt, Human
uccccacgugcaaaugaaau

SEQ ID NO: 1017062 - RNA, 22 nt, Human
ucccccaugggcaucccucucc

SEQ ID NO: 1017063 - RNA, 18 nt, Human
uccucgccgccagccucg

SEQ ID NO: 1017064 - RNA, 18 nt, Human
uccugagucggcuaugug

SEQ ID NO: 1017065 - RNA, 21 nt, Human
uccuuggaggugaggcuccag

SEQ ID NO: 1017066 - RNA, 24 nt, Human
ucuacaaacaugauguucagugga

SEQ ID NO: 1017067 - RNA, 21 nt, Human
ucucugggccacccccaaccc

SEQ ID NO: 1017068 - RNA, 22 nt, Human
ucugggccacccccaacccaug

SEQ ID NO: 1017069 - RNA, 23 nt, Human
ucugucccugccaugaagggcca

SEQ ID NO: 1017070 - RNA, 18 nt, Human
ugacuagcaagcacggga

SEQ ID NO: 1017071 - RNA, 24 nt, Human
ugauccccagucccuuguggucuc

SEQ ID NO: 1017072 - RNA, 25 nt, Human
uggcagugagcauguguuggcuucg

SEQ ID NO: 1017073 - RNA, 25 nt, Human
uggccaagcugagacuugggcaaaa

SEQ ID NO: 1017074 - RNA, 20 nt, Human
uggcccccaguccaccuuuc

SEQ ID NO: 1017075 - RNA, 25 nt, Human
uggcggcugacagagcccagacccu

SEQ ID NO: 1017076 - RNA, 21 nt, Human
ugggcaucccucuccugaguc

SEQ ID NO: 1017077 - RNA, 23 nt, Human
uguccagccuccaauugaggagg

SEQ ID NO: 1017078 - RNA, 22 nt, Human
ugugugugaagccaggccaggc

SEQ ID NO: 1017079 - RNA, 22 nt, Human
uuccuuggaggugaggcuccaa

SEQ ID NO: 1017080 - RNA, 23 nt, Human
aaaaagggugaaucugaacagaa

SEQ ID NO: 1017081 - RNA, 24 nt, Human
aaaggcauugccacauucuucuca

SEQ ID NO: 1017082 - RNA, 19 nt, Human
aaagugcuggcauuacaga

SEQ ID NO: 1017083 - RNA, 24 nt, Human
aaagugcuggcauuacagauguga

SEQ ID NO: 1017084 - RNA, 19 nt, Human
aauagagaugggguuuugc

SEQ ID NO: 1017085 - RNA, 21 nt, Human
acaacauuugagcaacugcuu

SEQ ID NO: 1017086 - RNA, 21 nt, Human
acagcaauacccaaaaagacc

SEQ ID NO: 1017087 - RNA, 19 nt, Human
acagccucuucacucaggu

SEQ ID NO: 1017088 - RNA, 18 nt, Human
acccugggcugauggccc

SEQ ID NO: 1017089 - RNA, 19 nt, Human
acuccggaaaggcaccagc

SEQ ID NO: 1017090 - RNA, 20 nt, Human
acuccggaaaggcaccagcc

SEQ ID NO: 1017091 - RNA, 30 nt, Human
agaugggguuuugcuauguuggccaggcuu

SEQ ID NO: 1017092 - RNA, 19 nt, Human
agcaaccacuccggaaagg

SEQ ID NO: 1017093 - RNA, 20 nt, Human
agcaauucuccugcuucagc

SEQ ID NO: 1017094 - RNA, 23 nt, Human
agccaaaacucugaucucuucua

SEQ ID NO: 1017095 - RNA, 21 nt, Human
agcugggauuacaggggccug

SEQ ID NO: 1017096 - RNA, 21 nt, Human
aggaaagaaaaaauacucuag

SEQ ID NO: 1017097 - RNA, 18 nt, Human
aggcaagacuccagggug

SEQ ID NO: 1017098 - RNA, 23 nt, Human
aggcaagacuccaggguggggcc

SEQ ID NO: 1017099 - RNA, 24 nt, Human
aggugauccacccaccuuggccuc

SEQ ID NO: 1017100 - RNA, 24 nt, Human
agguuugaagauuaguuaaaagcu

SEQ ID NO: 1017101 - RNA, 19 nt, Human
agugguuccuuuuuuuccc

SEQ ID NO: 1017102 - RNA, 21 nt, Human
agugguuccuuuuuuucccau

SEQ ID NO: 1017103 - RNA, 23 nt, Human
auagaguuccucuccaguauaaa

SEQ ID NO: 1017104 - RNA, 22 nt, Human
auaggaaugaagagcaugaauu

SEQ ID NO: 1017105 - RNA, 18 nt, Human
auggcccaaggauaaggc

SEQ ID NO: 1017106 - RNA, 24 nt, Human
augggguuuugcuauguuggccag

SEQ ID NO: 1017107 - RNA, 20 nt, Human
auguuggccaggcuggucuc

SEQ ID NO: 1017108 - RNA, 22 nt, Human
auucugcucuggacauccucaa

SEQ ID NO: 1017109 - RNA, 21 nt, Human
auuuuaguaugaggccucugg

SEQ ID NO: 1017110 - RNA, 20 nt, Human
caaaaagggugaaucugaac

SEQ ID NO: 1017111 - RNA, 24 nt, Human
caaagugcuggcauuacagaugug

SEQ ID NO: 1017112 - RNA, 24 nt, Human
caccacacgcagcuaauuuuugua

SEQ ID NO: 1017113 - RNA, 22 nt, Human
cacccaccuuggccucccaaag

SEQ ID NO: 1017114 - RNA, 23 nt, Human
cacccaccuuggccucccaaagu

SEQ ID NO: 1017115 - RNA, 21 nt, Human
cacuccggaaaggcaccagcc

SEQ ID NO: 1017116 - RNA, 24 nt, Human
cacuccggaaaggcaccagccaaa

SEQ ID NO: 1017117 - RNA, 20 nt, Human
cacugagacauaggcagaau

SEQ ID NO: 1017118 - RNA, 21 nt, Human
cacugcaaucuucgccuccca

SEQ ID NO: 1017119 - RNA, 21 nt, Human
cagcaauacccaaaaagacca

SEQ ID NO: 1017120 - RNA, 27 nt, Human
cagcaauacccaaaaagaccagguuuc

SEQ ID NO: 1017121 - RNA, 18 nt, Human
cagccucuucacucaggu

SEQ ID NO: 1017122 - RNA, 19 nt, Human
caguaugaauuuucuuauc

SEQ ID NO: 1017123 - RNA, 20 nt, Human
caguaugaauuuucuuaugu

SEQ ID NO: 1017124 - RNA, 19 nt, Human
caucuuacauuuuaauguc

SEQ ID NO: 1017125 - RNA, 18 nt, Human
cauuacagaugugagcca

SEQ ID NO: 1017126 - RNA, 19 nt, Human
cauucauucaaaugaugac

SEQ ID NO: 1017127 - RNA, 18 nt, Human
ccaaaaagaccagguuuc

SEQ ID NO: 1017128 - RNA, 24 nt, Human
ccaaaacucugaucucuucuaauc

SEQ ID NO: 1017129 - RNA, 22 nt, Human
ccaaagugcuggcauuacagau

SEQ ID NO: 1017130 - RNA, 24 nt, Human
ccaaagugcuggcauuacagaugu

SEQ ID NO: 1017131 - RNA, 21 nt, Human
ccaaccaaagacaucucuugu

SEQ ID NO: 1017132 - RNA, 23 nt, Human
cccaauuagcugggauuacaggg

SEQ ID NO: 1017133 - RNA, 23 nt, Human
cccagguuugagcaauucuccug

SEQ ID NO: 1017134 - RNA, 22 nt, Human
ccggauaccaaccaaagacauc

SEQ ID NO: 1017135 - RNA, 21 nt, Human
ccucaggugauccacccaccu

SEQ ID NO: 1017136 - RNA, 24 nt, Human
ccucccagguuugagcaauucucc

SEQ ID NO: 1017137 - RNA, 21 nt, Human
ccugccaccacacgcagcuaa

SEQ ID NO: 1017138 - RNA, 24 nt, Human
ccugcccucaggugauccacccac

SEQ ID NO: 1017139 - RNA, 22 nt, Human
ccuuguggaauucgggaauugu

SEQ ID NO: 1017140 - RNA, 21 nt, Human
cuagcucuugggcaaaaggaa

SEQ ID NO: 1017141 - RNA, 24 nt, Human
cucaggugauccacccaccuuggc

SEQ ID NO: 1017142 - RNA, 20 nt, Human
cucagguuuucaucaugcau

SEQ ID NO: 1017143 - RNA, 21 nt, Human
cuccaguaugaauuuucuuau

SEQ ID NO: 1017144 - RNA, 24 nt, Human
cuccuuguuuuucauccaacuauc

SEQ ID NO: 1017145 - RNA, 24 nt, Human
cugcaaucuucgccucccagguuu

SEQ ID NO: 1017146 - RNA, 23 nt, Human
cugcuucagccucccaauuagcu

SEQ ID NO: 1017147 - RNA, 22 nt, Human
cuuguggucauaaacauucauu

SEQ ID NO: 1017148 - RNA, 28 nt, Human
gaaaggcaccagccaaaacuggagaccc

SEQ ID NO: 1017149 - RNA, 21 nt, Human
gaauacucuuuuuuuguuuug

SEQ ID NO: 1017150 - RNA, 25 nt, Human
gagcagauaauaauggcuuuuccac

SEQ ID NO: 1017151 - RNA, 22 nt, Human
gcaaucuucgccucccagguuu

SEQ ID NO: 1017152 - RNA, 18 nt, Human
gcagaaaaaguugaagac

SEQ ID NO: 1017153 - RNA, 20 nt, Human
gcagaaaaaguugaagacuu

SEQ ID NO: 1017154 - RNA, 19 nt, Human
gcccaaauaaagcccacac

SEQ ID NO: 1017155 - RNA, 18 nt, Human
gcuauguuggccaggcug

SEQ ID NO: 1017156 - RNA, 20 nt, Human
gcuauguuggccaggcuggu

SEQ ID NO: 1017157 - RNA, 21 nt, Human
gcucuuguugcuuuggcugga

SEQ ID NO: 1017158 - RNA, 23 nt, Human
ggaaaggcaccagccaaaacucu

SEQ ID NO: 1017159 - RNA, 21 nt, Human
ggauaaggcaggcaggagaga

SEQ ID NO: 1017160 - RNA, 20 nt, Human
gggaaacucucaaccggaua

SEQ ID NO: 1017161 - RNA, 24 nt, Human
gggaaacucucaaccggauaccaa

SEQ ID NO: 1017162 - RNA, 23 nt, Human
gggcaaaaggaaagaaaaaauac

SEQ ID NO: 1017163 - RNA, 22 nt, Human
gggguuuugcuauguuggccag

SEQ ID NO: 1017164 - RNA, 22 nt, Human
ggguuuugcuauguuggccagg

SEQ ID NO: 1017165 - RNA, 26 nt, Human
guaaaagaaauaaaaauauuuaaaac

SEQ ID NO: 1017166 - RNA, 18 nt, Human
guaaagguacuacaaccc

SEQ ID NO: 1017167 - RNA, 22 nt, Human
guccaguauuacauuuuacggg

SEQ ID NO: 1017168 - RNA, 19 nt, Human
gucucauuucucuugucac

SEQ ID NO: 1017169 - RNA, 24 nt, Human
gugauccacccaccuuggccuccc

SEQ ID NO: 1017170 - RNA, 21 nt, Human
gugugugcagaaaaaguugaa

SEQ ID NO: 1017171 - RNA, 23 nt, Human
uaaagcccacacguuuucccaca

SEQ ID NO: 1017172 - RNA, 24 nt, Human
uaacuguagcaggucacugaacaa

SEQ ID NO: 1017173 - RNA, 22 nt, Human
uaagauaaauauguauucuuag

SEQ ID NO: 1017174 - RNA, 20 nt, Human
uaauaccgaccuaacagaaa

SEQ ID NO: 1017175 - RNA, 24 nt, Human
uaauagagaugggguuuugcuaug

SEQ ID NO: 1017176 - RNA, 23 nt, Human
uaauuugaauguaauuauacauc

SEQ ID NO: 1017177 - RNA, 21 nt, Human
uacccaaaaagaccagguuuc

SEQ ID NO: 1017178 - RNA, 23 nt, Human
uacccaaaaagaccagguuucug

SEQ ID NO: 1017179 - RNA, 19 nt, Human
uaccuuagauauuucuacu

SEQ ID NO: 1017180 - RNA, 24 nt, Human
uagaaaggugugaggacugauuaa

SEQ ID NO: 1017181 - RNA, 23 nt, Human
uagagacagcaauacccaaaaag

SEQ ID NO: 1017182 - RNA, 22 nt, Human
uagagaugggguuuugcuaugu

SEQ ID NO: 1017183 - RNA, 22 nt, Human
uagcaaaguaaaagaaauaaaa

SEQ ID NO: 1017184 - RNA, 22 nt, Human
uauauauuacucugcucaaccc

SEQ ID NO: 1017185 - RNA, 19 nt, Human
uauguagcaaggugugagg

SEQ ID NO: 1017186 - RNA, 19 nt, Human
uauguuggccaggcugguc

SEQ ID NO: 1017187 - RNA, 22 nt, Human
uauguuggccaggcuggucuca

SEQ ID NO: 1017188 - RNA, 24 nt, Human
uauguuggccaggcuggucucaga

SEQ ID NO: 1017189 - RNA, 19 nt, Human
ucaccaguaugauuuaugu

SEQ ID NO: 1017190 - RNA, 19 nt, Human
ucacugcaaucuucgccuc

SEQ ID NO: 1017191 - RNA, 24 nt, Human
ucacugcaaucuucgccucccagg

SEQ ID NO: 1017192 - RNA, 25 nt, Human
ucacugcaaucuucgccucccaggu

SEQ ID NO: 1017193 - RNA, 18 nt, Human
ucagccucccaauuagcu

SEQ ID NO: 1017194 - RNA, 20 nt, Human
ucagccucccaauuagcugg

SEQ ID NO: 1017195 - RNA, 27 nt, Human
ucagcucacugcaaucuucgccuccca

SEQ ID NO: 1017196 - RNA, 21 nt, Human
ucaggaaacugggaaacucuc

SEQ ID NO: 1017197 - RNA, 19 nt, Human
uccagaccuccuccuuguu

SEQ ID NO: 1017198 - RNA, 18 nt, Human
ucccaaagugcuggcauu

SEQ ID NO: 1017199 - RNA, 21 nt, Human
ucccagguuugagcaauucuc

SEQ ID NO: 1017200 - RNA, 24 nt, Human
ucccagguuugagcaauucuccug

SEQ ID NO: 1017201 - RNA, 19 nt, Human
uccuauauaaaucccgcug

SEQ ID NO: 1017202 - RNA, 19 nt, Human
uccuccagagagaauucua

SEQ ID NO: 1017203 - RNA, 20 nt, Human
uccuuguggaauucgggaau

SEQ ID NO: 1017204 - RNA, 24 nt, Human
ucgugugugcagaaaaaguugaag

SEQ ID NO: 1017205 - RNA, 24 nt, Human
ucucaaccggauaccaaccaaaga

SEQ ID NO: 1017206 - RNA, 23 nt, Human
ucugcucuggacauccucaaaua

SEQ ID NO: 1017207 - RNA, 19 nt, Human
ucuuauguguagaaaggug

SEQ ID NO: 1017208 - RNA, 21 nt, Human
ugaagagcaugaauuugaguu

SEQ ID NO: 1017209 - RNA, 25 nt, Human
ugaaucugaacagaacugcagcugg

SEQ ID NO: 1017210 - RNA, 21 nt, Human
ugacaaccauuuaaaggcuuu

SEQ ID NO: 1017211 - RNA, 20 nt, Human
ugacccugggcugauggccc

SEQ ID NO: 1017212 - RNA, 20 nt, Human
ugaggcaagacuccagggug

SEQ ID NO: 1017213 - RNA, 23 nt, Human
ugaggccucugguauuuucuaag

SEQ ID NO: 1017214 - RNA, 24 nt, Human
ugauauacuacuaauucacuuuaa

SEQ ID NO: 1017215 - RNA, 24 nt, Human
ugauccacccaccuuggccuccca

SEQ ID NO: 1017216 - RNA, 22 nt, Human
ugccacauucuucacaacuaua

SEQ ID NO: 1017217 - RNA, 22 nt, Human
ugccacauucuucacaauugua

SEQ ID NO: 1017218 - RNA, 22 nt, Human
ugccacauuuuucacauuugua

SEQ ID NO: 1017219 - RNA, 18 nt, Human
ugccuaggugauugugag

SEQ ID NO: 1017220 - RNA, 24 nt, Human
ugcuauguuggccaggcuggucuc

SEQ ID NO: 1017221 - RNA, 22 nt, Human
ugcucuuguugcuuuggcugga

SEQ ID NO: 1017222 - RNA, 24 nt, Human
ugcuucagccucccaauuagcugg

SEQ ID NO: 1017223 - RNA, 18 nt, Human
ugcuucaugguuuuccuc

SEQ ID NO: 1017224 - RNA, 24 nt, Human
ugcuuuaucuauuuuucuaagggc

SEQ ID NO: 1017225 - RNA, 24 nt, Human
ugcuuuggcuggaguguaguggug

SEQ ID NO: 1017226 - RNA, 24 nt, Human
uggcauuacagaugugagccagca

SEQ ID NO: 1017227 - RNA, 26 nt, Human
uggcauuacagaugugagccagcaca

SEQ ID NO: 1017228 - RNA, 27 nt, Human
uggcauuacagaugugagccagcacaa

SEQ ID NO: 1017229 - RNA, 24 nt, Human
uggccaggcuggucucagacuccu

SEQ ID NO: 1017230 - RNA, 23 nt, Human
uggcuggaguguaguggugugau

SEQ ID NO: 1017231 - RNA, 22 nt, Human
ugggauuacaggggccugccac

SEQ ID NO: 1017232 - RNA, 24 nt, Human
ugggauuacaggggccugccacca

SEQ ID NO: 1017233 - RNA, 20 nt, Human
ugggcaaaaggaaagaaaaa

SEQ ID NO: 1017234 - RNA, 24 nt, Human
ugggguuuugcuauguuggccagg

SEQ ID NO: 1017235 - RNA, 24 nt, Human
uggugugauuucagcucacugcaa

SEQ ID NO: 1017236 - RNA, 20 nt, Human
uguaggguuucuuuccagua

SEQ ID NO: 1017237 - RNA, 23 nt, Human
uguaggguuucuuuccaguauga

SEQ ID NO: 1017238 - RNA, 19 nt, Human
uguauaguaagguaugagg

SEQ ID NO: 1017239 - RNA, 19 nt, Human
ugucaaaauuauugucaca

SEQ ID NO: 1017240 - RNA, 24 nt, Human
ugugauacaaguaaagguacuaca

SEQ ID NO: 1017241 - RNA, 22 nt, Human
ugugauauuuuucacauuucua

SEQ ID NO: 1017242 - RNA, 21 nt, Human
ugugcaguauccaggcauugc

SEQ ID NO: 1017243 - RNA, 19 nt, Human
uguguagaaaggugugagg

SEQ ID NO: 1017244 - RNA, 25 nt, Human
uguuagaaaguucgagguguuguca

SEQ ID NO: 1017245 - RNA, 18 nt, Human
uuaauagagaugggguuu

SEQ ID NO: 1017246 - RNA, 18 nt, Human
uuaauagagaugggguuu

SEQ ID NO: 1017247 - RNA, 18 nt, Human
uuaauagagaugggguuu

SEQ ID NO: 1017248 - RNA, 20 nt, Human
uuaauagagaugggguuuug

SEQ ID NO: 1017249 - RNA, 24 nt, Human
uuaauagagaugggguuuugcuau

SEQ ID NO: 1017250 - RNA, 23 nt, Human
uuaucuuauguuuagugagguuu

SEQ ID NO: 1017251 - RNA, 19 nt, Human
uucaguugcuagucuagac

SEQ ID NO: 1017252 - RNA, 21 nt, Human
uuccaguaugaauuuucuuau

SEQ ID NO: 1017253 - RNA, 21 nt, Human
uuccucuagugcaaaaugggu

SEQ ID NO: 1017254 - RNA, 24 nt, Human
uucucuaacaacacauuccuauau

SEQ ID NO: 1017255 - RNA, 18 nt, Human
uugagcaacugcuucaug

SEQ ID NO: 1017256 - RNA, 25 nt, Human
uugcucuuguugcuuuggggucggc

SEQ ID NO: 1017257 - RNA, 24 nt, Human
uugcuuuggcuggaguguaguggu

SEQ ID NO: 1017258 - RNA, 18 nt, Human
uuggcuggaguguagugg

SEQ ID NO: 1017259 - RNA, 20 nt, Human
uuucaccaguaugauuuaug

SEQ ID NO: 1017260 - RNA, 24 nt, Human
uuugagcaauucuccugcuucagc

SEQ ID NO: 1017261 - RNA, 25 nt, Human
uuugcuccagacaggugaucagaua

SEQ ID NO: 1017262 - RNA, 20 nt, Human
uuuguacaaucuuucugaag

SEQ ID NO: 1017263 - RNA, 24 nt, Human
uuuguaguuucucuccaguaugaa

SEQ ID NO: 1017264 - RNA, 19 nt, Human
uuuuccucuagugcaaaau

SEQ ID NO: 1017265 - RNA, 23 nt, Human
uuuugcuauguuggccaggcugg

SEQ ID NO: 1017266 - RNA, 24 nt, Human
uuuugcucuuguugcuuuggcugg

SEQ ID NO: 1017267 - RNA, 21 nt, Human
uuuuuaauagagaugggguuu

SEQ ID NO: 1017268 - RNA, 21 nt, Human
uuuuuaauagagaugggguuu

SEQ ID NO: 1017269 - RNA, 20 nt, Human
aaaaaaguacuugaagaaga

SEQ ID NO: 1017270 - RNA, 26 nt, Human
aaaaauaaaaaaguacuugaagaaga

SEQ ID NO: 1017271 - RNA, 23 nt, Human
aaacagaagaaaauguuuucuag

SEQ ID NO: 1017272 - RNA, 21 nt, Human
aaaguaaagaaaaaaaaagga

SEQ ID NO: 1017273 - RNA, 20 nt, Human
aaauacauaccugaccucaa

SEQ ID NO: 1017274 - RNA, 24 nt, Human
aagaaaaaaaaaggaaaccuacaa

SEQ ID NO: 1017275 - RNA, 22 nt, Human
aagacagcuuaacucaaagguc

SEQ ID NO: 1017276 - RNA, 19 nt, Human
aaguuacuccuacucuccc

SEQ ID NO: 1017277 - RNA, 24 nt, Human
acaaagauuagcaaacagaagaaa

SEQ ID NO: 1017278 - RNA, 22 nt, Human
acagaagaaaauguuuucuaga

SEQ ID NO: 1017279 - RNA, 22 nt, Human
accacaguuacauauuguagca

SEQ ID NO: 1017280 - RNA, 23 nt, Human
agaaaaaaaaaggaaaccuacaa

SEQ ID NO: 1017281 - RNA, 20 nt, Human
agaaauacauaccugaccuc

SEQ ID NO: 1017282 - RNA, 20 nt, Human
agaggcaggaaggcaugaau

SEQ ID NO: 1017283 - RNA, 20 nt, Human
aggaaaaagcaaguagggaa

SEQ ID NO: 1017284 - RNA, 19 nt, Human
aggcaauuaaccacaguua

SEQ ID NO: 1017285 - RNA, 23 nt, Human
agggaacaaaacugaugaaaagu

SEQ ID NO: 1017286 - RNA, 24 nt, Human
aguuuaaagaguagauggggaggg

SEQ ID NO: 1017287 - RNA, 23 nt, Human
cauccugcuuauaaagacagcuu

SEQ ID NO: 1017288 - RNA, 22 nt, Human
ccaccgugacuacuggcuccgg

SEQ ID NO: 1017289 - RNA, 23 nt, Human
ccauagccaagaggcaggaaggc

SEQ ID NO: 1017290 - RNA, 18 nt, Human
cccaaagagaagcuuguu

SEQ ID NO: 1017291 - RNA, 23 nt, Human
ccuacaauaaguugguauaaaag

SEQ ID NO: 1017292 - RNA, 24 nt, Human
ccuuaccuuccuaauaauggguaa

SEQ ID NO: 1017293 - RNA, 24 nt, Human
gagaugcauaacuaagaaaugaaa

SEQ ID NO: 1017294 - RNA, 23 nt, Human
gggccauagccaagaggcaggaa

SEQ ID NO: 1017295 - RNA, 19 nt, Human
gucuuuaaaaagcauggag

SEQ ID NO: 1017296 - RNA, 21 nt, Human
uaaguuacuccuacucuccca

SEQ ID NO: 1017297 - RNA, 19 nt, Human
uagauggggagggccauag

SEQ ID NO: 1017298 - RNA, 22 nt, Human
uagccaagaggcaggaaggcau

SEQ ID NO: 1017299 - RNA, 23 nt, Human
uauaaaaguauacagacacgcaa

SEQ ID NO: 1017300 - RNA, 24 nt, Human
uauguacaaaauacuaucuauaug

SEQ ID NO: 1017301 - RNA, 23 nt, Human
ucagugaugagauggauuucaaa

SEQ ID NO: 1017302 - RNA, 18 nt, Human
uccaaggaaaaagcaagu

SEQ ID NO: 1017303 - RNA, 20 nt, Human
ugaaauggaggaaguagaau

SEQ ID NO: 1017304 - RNA, 18 nt, Human
ugaccccaaagagaagcu

SEQ ID NO: 1017305 - RNA, 22 nt, Human
uggugaaauggaggaaguagaa

SEQ ID NO: 1017306 - RNA, 20 nt, Human
uuagcaaacagaagaaaaug

SEQ ID NO: 1017307 - RNA, 19 nt, Human
uucuagauagggaacaaaa

SEQ ID NO: 1017308 - RNA, 18 nt, Human
uuuuuuuuuuuuuuuuug

SEQ ID NO: 1017309 - RNA, 19 nt, Human
aaaaaaaccaggagagaua

SEQ ID NO: 1017310 - RNA, 27 nt, Human
aaaaaaccaggagagauagugggcacc

SEQ ID NO: 1017311 - RNA, 24 nt, Human
aaaaaaggaaaacuuaaauuaaaa

SEQ ID NO: 1017312 - RNA, 18 nt, Human
aaacaugcgcacaaacuu

SEQ ID NO: 1017313 - RNA, 21 nt, Human
aaagggacaaaaaaggccagg

SEQ ID NO: 1017314 - RNA, 18 nt, Human
aaccauuugaaaaacagu

SEQ ID NO: 1017315 - RNA, 24 nt, Human
aacuccaggugcaagaguugaaaa

SEQ ID NO: 1017316 - RNA, 21 nt, Human
aagcuccuccuccuuccccuc

SEQ ID NO: 1017317 - RNA, 18 nt, Human
aaguauauuugugcuaua

SEQ ID NO: 1017318 - RNA, 19 nt, Human
accccagccucaagggagc

SEQ ID NO: 1017319 - RNA, 21 nt, Human
acgcaaccccagccucaaggg

SEQ ID NO: 1017320 - RNA, 24 nt, Human
acgcaaccccagccucaagggagc

SEQ ID NO: 1017321 - RNA, 22 nt, Human
acucaagguagacuggcuccag

SEQ ID NO: 1017322 - RNA, 19 nt, Human
acucugcugccacccaaug

SEQ ID NO: 1017323 - RNA, 23 nt, Human
acugggguucaguagccucuuuu

SEQ ID NO: 1017324 - RNA, 18 nt, Human
agacgcaaccccagccuc

SEQ ID NO: 1017325 - RNA, 18 nt, Human
agagauuuuucugaccuu

SEQ ID NO: 1017326 - RNA, 21 nt, Human
agagucccuauugugucacag

SEQ ID NO: 1017327 - RNA, 22 nt, Human
agaguugaaaagcccaagggug

SEQ ID NO: 1017328 - RNA, 19 nt, Human
agcacucacucccucacca

SEQ ID NO: 1017329 - RNA, 22 nt, Human
agcacucacucccucaccauuu

SEQ ID NO: 1017330 - RNA, 22 nt, Human
agccaacagguucccaguuuca

SEQ ID NO: 1017331 - RNA, 22 nt, Human
aggaaggucauaggaagaggga

SEQ ID NO: 1017332 - RNA, 20 nt, Human
aggaggaggacaagucccaa

SEQ ID NO: 1017333 - RNA, 20 nt, Human
agggaacaaacacccagagc

SEQ ID NO: 1017334 - RNA, 19 nt, Human
agggacaaaaaaggccagg

SEQ ID NO: 1017335 - RNA, 19 nt, Human
agggagcugugagaaagcc

SEQ ID NO: 1017336 - RNA, 23 nt, Human
agguaguagauggcagagguggg

SEQ ID NO: 1017337 - RNA, 21 nt, Human
aggugaugcccauuuuacaga

SEQ ID NO: 1017338 - RNA, 21 nt, Human
caacagacgcaaccccagccu

SEQ ID NO: 1017339 - RNA, 19 nt, Human
caagacagagcuccagagg

SEQ ID NO: 1017340 - RNA, 22 nt, Human
cacccaggauccuccgcggcag

SEQ ID NO: 1017341 - RNA, 18 nt, Human
cacugguagggaacuggu

SEQ ID NO: 1017342 - RNA, 20 nt, Human
cagaaaagcccucugaggua

SEQ ID NO: 1017343 - RNA, 19 nt, Human
cagacgcaaccccagccuc

SEQ ID NO: 1017344 - RNA, 18 nt, Human
caguucuaagugcuucac

SEQ ID NO: 1017345 - RNA, 26 nt, Human
cauguucuuuuuggcuuucuggggcu

SEQ ID NO: 1017346 - RNA, 20 nt, Human
cauuuuacagauaaggacac

SEQ ID NO: 1017347 - RNA, 18 nt, Human
ccaggagagauaaaggga

SEQ ID NO: 1017348 - RNA, 24 nt, Human
cccagccucaagggagcgggagau

SEQ ID NO: 1017349 - RNA, 20 nt, Human
ccccaaaauguccaggagga

SEQ ID NO: 1017350 - RNA, 23 nt, Human
ccccaaaauguccaggaggagga

SEQ ID NO: 1017351 - RNA, 22 nt, Human
ccccacacccaauggcugccag

SEQ ID NO: 1017352 - RNA, 22 nt, Human
cccccaaaauguccaggaggag

SEQ ID NO: 1017353 - RNA, 23 nt, Human
cccccacacccaauggcugccag

SEQ ID NO: 1017354 - RNA, 20 nt, Human
ccccgcacacgcgccuccuc

SEQ ID NO: 1017355 - RNA, 22 nt, Human
ccccgcacacgcgccuccucgc

SEQ ID NO: 1017356 - RNA, 22 nt, Human
cccgcacacgcgccuccucgca

SEQ ID NO: 1017357 - RNA, 18 nt, Human
cccgcccccgagccuagc

SEQ ID NO: 1017358 - RNA, 25 nt, Human
cccucaccauuuucagcaccuaaaa

SEQ ID NO: 1017359 - RNA, 24 nt, Human
ccgcgucaacagacgcaaccccag

SEQ ID NO: 1017360 - RNA, 23 nt, Human
ccuccgcggcagcgccaggacuc

SEQ ID NO: 1017361 - RNA, 20 nt, Human
ccuccguguucccggcuggc

SEQ ID NO: 1017362 - RNA, 24 nt, Human
ccuccuccuuccccuccguguucc

SEQ ID NO: 1017363 - RNA, 19 nt, Human
cgacaagacagagcuccag

SEQ ID NO: 1017364 - RNA, 23 nt, Human
cgacaagacagagcuccagagga

SEQ ID NO: 1017365 - RNA, 20 nt, Human
cgagaaguuaaauguugcaa

SEQ ID NO: 1017366 - RNA, 21 nt, Human
cguuguacagcuucuccacuu

SEQ ID NO: 1017367 - RNA, 19 nt, Human
cugauggaauccagcugug

SEQ ID NO: 1017368 - RNA, 18 nt, Human
cugcacccaggauccucc

SEQ ID NO: 1017369 - RNA, 19 nt, Human
cuuaaauuaaaagcgauac

SEQ ID NO: 1017370 - RNA, 19 nt, Human
cuuccacccauggcugacu

SEQ ID NO: 1017371 - RNA, 22 nt, Human
cuucucugagcggcugcaccca

SEQ ID NO: 1017372 - RNA, 18 nt, Human
gaaaaacaugcgcacaaa

SEQ ID NO: 1017373 - RNA, 18 nt, Human
gaagcuucucugagcggc

SEQ ID NO: 1017374 - RNA, 23 nt, Human
gaagcuucucugagcggcugcac

SEQ ID NO: 1017375 - RNA, 23 nt, Human
gacaaaaaaggccaggcacuuaa

SEQ ID NO: 1017376 - RNA, 18 nt, Human
gagaaaaacuguaaaaaa

SEQ ID NO: 1017377 - RNA, 23 nt, Human
gagaaaaacuguaaaaaaggaaa

SEQ ID NO: 1017378 - RNA, 18 nt, Human
gagcggcugcacccagga

SEQ ID NO: 1017379 - RNA, 21 nt, Human
gcagaacuccaggugcaagag

SEQ ID NO: 1017380 - RNA, 19 nt, Human
gcagcaacacaggugacug

SEQ ID NO: 1017381 - RNA, 23 nt, Human
gcagcaacacaggugacugauuu

SEQ ID NO: 1017382 - RNA, 20 nt, Human
gcagggaacaaacacccaga

SEQ ID NO: 1017383 - RNA, 18 nt, Human
gcguuucuaccuuggccu

SEQ ID NO: 1017384 - RNA, 22 nt, Human
ggaagcacaagggagcugugag

SEQ ID NO: 1017385 - RNA, 24 nt, Human
ggccgcgucaacagacgcaacccc

SEQ ID NO: 1017386 - RNA, 20 nt, Human
guccaugcugacgagccccc

SEQ ID NO: 1017387 - RNA, 20 nt, Human
gugucaacucccaugaaaaa

SEQ ID NO: 1017388 - RNA, 19 nt, Human
uaaagggacaaaaaaggcc

SEQ ID NO: 1017389 - RNA, 22 nt, Human
uaaauuaaaagcgauacauugu

SEQ ID NO: 1017390 - RNA, 20 nt, Human
uaacagcaaucgucgaugaa

SEQ ID NO: 1017391 - RNA, 20 nt, Human
uaaccagcagaacuccaggu

SEQ ID NO: 1017392 - RNA, 24 nt, Human
uaagaaaaaaaccaggagagauaa

SEQ ID NO: 1017393 - RNA, 23 nt, Human
uaagaagaguaaagugcuggaga

SEQ ID NO: 1017394 - RNA, 18 nt, Human
uaagacuacuguguuuca

SEQ ID NO: 1017395 - RNA, 23 nt, Human
uaagcuccuccuccuuccccucc

SEQ ID NO: 1017396 - RNA, 19 nt, Human
uaaggacaccgaggcccug

SEQ ID NO: 1017397 - RNA, 25 nt, Human
uaaggacaccgaggcccugagagau

SEQ ID NO: 1017398 - RNA, 20 nt, Human
uacagauaaggacaccgagg

SEQ ID NO: 1017399 - RNA, 19 nt, Human
uaccuuggccugcagcaac

SEQ ID NO: 1017400 - RNA, 21 nt, Human
ucaccauuuucagcaccuaaa

SEQ ID NO: 1017401 - RNA, 20 nt, Human
ucacucccucaccauuuuca

SEQ ID NO: 1017402 - RNA, 25 nt, Human
ucaguagccucuuuuaagcuccucc

SEQ ID NO: 1017403 - RNA, 24 nt, Human
uccaacuuucaacauccgaguaac

SEQ ID NO: 1017404 - RNA, 24 nt, Human
ucccaguggucacuuccacacacc

SEQ ID NO: 1017405 - RNA, 19 nt, Human
ucccggcuggcagggcugu

SEQ ID NO: 1017406 - RNA, 18 nt, Human
ucccucaccauuuucagc

SEQ ID NO: 1017407 - RNA, 23 nt, Human
ucuaccuuggccugcagcaacac

SEQ ID NO: 1017408 - RNA, 22 nt, Human
ucucugagcggcugcacccagg

SEQ ID NO: 1017409 - RNA, 20 nt, Human
ugaaaaacaguguaaggccc

SEQ ID NO: 1017410 - RNA, 23 nt, Human
ugaaaaacaguguaaggccccaa

SEQ ID NO: 1017411 - RNA, 22 nt, Human
ugaaaagcccaagggugcagag

SEQ ID NO: 1017412 - RNA, 23 nt, Human
ugaauccugacguuguacagcuu

SEQ ID NO: 1017413 - RNA, 21 nt, Human
ugacaagacacugguagggaa

SEQ ID NO: 1017414 - RNA, 21 nt, Human
ugagaaagccucccuuccacc

SEQ ID NO: 1017415 - RNA, 19 nt, Human
ugagccacuuaguggcagg

SEQ ID NO: 1017416 - RNA, 23 nt, Human
ugauggaauccagcuguguuuug

SEQ ID NO: 1017417 - RNA, 21 nt, Human
ugauuuacagacugcccccac

SEQ ID NO: 1017418 - RNA, 24 nt, Human
ugcagagcacucacucccucacca

SEQ ID NO: 1017419 - RNA, 22 nt, Human
uggcagggaacaaacacccaga

SEQ ID NO: 1017420 - RNA, 21 nt, Human
ugggacucugcugccacccaa

SEQ ID NO: 1017421 - RNA, 18 nt, Human
ugggagguuaggagugga

SEQ ID NO: 1017422 - RNA, 21 nt, Human
ugggagguuaggaguggaagg

SEQ ID NO: 1017423 - RNA, 22 nt, Human
uggggcuuaagaaaaaaaccag

SEQ ID NO: 1017424 - RNA, 22 nt, Human
uggguucauuucugauuccaga

SEQ ID NO: 1017425 - RNA, 23 nt, Human
uggucacuuccacacaccacagg

SEQ ID NO: 1017426 - RNA, 19 nt, Human
uggugagcccucaugugcu

SEQ ID NO: 1017427 - RNA, 18 nt, Human
uguccaggaggaggagga

SEQ ID NO: 1017428 - RNA, 19 nt, Human
uguccaugcugacgagccc

SEQ ID NO: 1017429 - RNA, 24 nt, Human
ugugacugagccacuuaguggcag

SEQ ID NO: 1017430 - RNA, 18 nt, Human
uuagccaacagguuccca

SEQ ID NO: 1017431 - RNA, 22 nt, Human
uuccuuucuuguaacacaagua

SEQ ID NO: 1017432 - RNA, 21 nt, Human
uucucugagcggcugcaccca

SEQ ID NO: 1017433 - RNA, 24 nt, Human
uuuacagauaaggacaccgaggcc

SEQ ID NO: 1017434 - RNA, 22 nt, Human
uuuccauagagucccuauugug

SEQ ID NO: 1017435 - RNA, 21 nt, Human
aaaauccaaaaacaaagcccc

SEQ ID NO: 1017436 - RNA, 29 nt, Human
aaacaaaaggcuggaaagcgagggacccc

SEQ ID NO: 1017437 - RNA, 21 nt, Human
aaagacaugagucaguuuuug

SEQ ID NO: 1017438 - RNA, 24 nt, Human
aaagagcugggauuacagguguga

SEQ ID NO: 1017439 - RNA, 24 nt, Human
aaagugcugggauuacaggcguga

SEQ ID NO: 1017440 - RNA, 23 nt, Human
aaaucaccuccaccacaacuucu

SEQ ID NO: 1017441 - RNA, 20 nt, Human
aaccaagggugcuggagcag

SEQ ID NO: 1017442 - RNA, 25 nt, Human
aacccccuggugaagucccccugcc

SEQ ID NO: 1017443 - RNA, 18 nt, Human
aaccugcacacuugcaca

SEQ ID NO: 1017444 - RNA, 21 nt, Human
aacuccuagccucaggugauc

SEQ ID NO: 1017445 - RNA, 19 nt, Human
aagaaagaaaacuauuugc

SEQ ID NO: 1017446 - RNA, 21 nt, Human
aagagcugggauuacaggugu

SEQ ID NO: 1017447 - RNA, 24 nt, Human
aagcaaccgagaguaacauucuaa

SEQ ID NO: 1017448 - RNA, 19 nt, Human
aagcaucauguaaaucuca

SEQ ID NO: 1017449 - RNA, 20 nt, Human
aagccagcucuaucuauaac

SEQ ID NO: 1017450 - RNA, 23 nt, Human
aaggacacugcacacuuuggcac

SEQ ID NO: 1017451 - RNA, 19 nt, Human
aagggugcuggagcagcuc

SEQ ID NO: 1017452 - RNA, 18 nt, Human
aaggguucaaaccaacau

SEQ ID NO: 1017453 - RNA, 23 nt, Human
aagucccccugcccgauagccug

SEQ ID NO: 1017454 - RNA, 19 nt, Human
aagugcugggauuacaggc

SEQ ID NO: 1017455 - RNA, 19 nt, Human
aagugcugggauuacaggc

SEQ ID NO: 1017456 - RNA, 20 nt, Human
aaucccacuucacaauauac

SEQ ID NO: 1017457 - RNA, 22 nt, Human
aauuaauuucaaugcuccuuuc

SEQ ID NO: 1017458 - RNA, 20 nt, Human
acagaccuggauggucugca

SEQ ID NO: 1017459 - RNA, 25 nt, Human
acagcacaaauauuuaauacaccuu

SEQ ID NO: 1017460 - RNA, 21 nt, Human
acagcccagagaaaagggcca

SEQ ID NO: 1017461 - RNA, 20 nt, Human
acagcuuuauaccaaaaugu

SEQ ID NO: 1017462 - RNA, 18 nt, Human
acaggcgcccaccacgcc

SEQ ID NO: 1017463 - RNA, 20 nt, Human
acagugggagagauggaggc

SEQ ID NO: 1017464 - RNA, 18 nt, Human
acgggguuucacuauguu

SEQ ID NO: 1017465 - RNA, 23 nt, Human
acgggguuucacuauguuggcca

SEQ ID NO: 1017466 - RNA, 24 nt, Human
acgggguuucacuauguuggccag

SEQ ID NO: 1017467 - RNA, 18 nt, Human
acgggguuuugccauguu

SEQ ID NO: 1017468 - RNA, 23 nt, Human
acgggguuuugccauguuggcca

SEQ ID NO: 1017469 - RNA, 24 nt, Human
acgggguuuugccauguuggccag

SEQ ID NO: 1017470 - RNA, 18 nt, Human
acuauguuggccaggcug

SEQ ID NO: 1017471 - RNA, 22 nt, Human
acucuugucgcccaggcuggag

SEQ ID NO: 1017472 - RNA, 21 nt, Human
acugcaaucucugccucccgg

SEQ ID NO: 1017473 - RNA, 22 nt, Human
acugcaaucucugccucccggg

SEQ ID NO: 1017474 - RNA, 21 nt, Human
agaaaacagugacacacacug

SEQ ID NO: 1017475 - RNA, 18 nt, Human
agaaaacuauuugcuucc

SEQ ID NO: 1017476 - RNA, 20 nt, Human
agaaaacuauuugcuuccag

SEQ ID NO: 1017477 - RNA, 19 nt, Human
agaaaacuugaagugacug

SEQ ID NO: 1017478 - RNA, 20 nt, Human
agacuacaggcacauaccac

SEQ ID NO: 1017479 - RNA, 23 nt, Human
agagaguggccuguguggggggc

SEQ ID NO: 1017480 - RNA, 24 nt, Human
agagcugggauuacaggugugagc

SEQ ID NO: 1017481 - RNA, 18 nt, Human
agcagcugggauuacagg

SEQ ID NO: 1017482 - RNA, 24 nt, Human
aggaaacauggugaaaggggaggc

SEQ ID NO: 1017483 - RNA, 18 nt, Human
aggaaauaggggugagag

SEQ ID NO: 1017484 - RNA, 19 nt, Human
aggacagaagucaagagcu

SEQ ID NO: 1017485 - RNA, 20 nt, Human
aggcacauaccaccacaccc

SEQ ID NO: 1017486 - RNA, 28 nt, Human
aggcagagucucugcuccacucuucuuu

SEQ ID NO: 1017487 - RNA, 25 nt, Human
aggcuggagugcaguaguaugaucu

SEQ ID NO: 1017488 - RNA, 25 nt, Human
aggcuggagugcaguggcacgaucu

SEQ ID NO: 1017489 - RNA, 20 nt, Human
aggguucaagugauucuccu

SEQ ID NO: 1017490 - RNA, 24 nt, Human
aggguucaagugauucuccugucu

SEQ ID NO: 1017491 - RNA, 19 nt, Human
agguaacagaaacaaaauu

SEQ ID NO: 1017492 - RNA, 24 nt, Human
aggugaucugccugccucagccuc

SEQ ID NO: 1017493 - RNA, 24 nt, Human
aguaguaugaucuuggcucacugc

SEQ ID NO: 1017494 - RNA, 22 nt, Human
agucaacacagaucccugagcc

SEQ ID NO: 1017495 - RNA, 20 nt, Human
agucccccugcccgauagcc

SEQ ID NO: 1017496 - RNA, 23 nt, Human
agugauccacccgccucggccuc

SEQ ID NO: 1017497 - RNA, 24 nt, Human
agugauucuccugucucagccucc

SEQ ID NO: 1017498 - RNA, 24 nt, Human
agugcaguaguaugaucuuggcuc

SEQ ID NO: 1017499 - RNA, 21 nt, Human
agugcaguggcacgaucucag

SEQ ID NO: 1017500 - RNA, 23 nt, Human
agugcaguggcacgaucucagcu

SEQ ID NO: 1017501 - RNA, 18 nt, Human
agugcugggauuacaggc

SEQ ID NO: 1017502 - RNA, 20 nt, Human
auccaaaaacaaagccccac

SEQ ID NO: 1017503 - RNA, 18 nt, Human
augcuuauggucccuuua

SEQ ID NO: 1017504 - RNA, 18 nt, Human
auucuccugucucagccu

SEQ ID NO: 1017505 - RNA, 19 nt, Human
caaaaacaaagccccacug

SEQ ID NO: 1017506 - RNA, 18 nt, Human
caacagccugacaggauc

SEQ ID NO: 1017507 - RNA, 22 nt, Human
caagaggcaauagacuucagau

SEQ ID NO: 1017508 - RNA, 23 nt, Human
caagaggcaauagacuucagaua

SEQ ID NO: 1017509 - RNA, 22 nt, Human
caagcgauucuccugccucagc

SEQ ID NO: 1017510 - RNA, 22 nt, Human
caaguaacaucaggucaagaua

SEQ ID NO: 1017511 - RNA, 22 nt, Human
caagugauucuccugucucagc

SEQ ID NO: 1017512 - RNA, 18 nt, Human
cacaacugcccaacaccu

SEQ ID NO: 1017513 - RNA, 18 nt, Human
cacacacaauuucugggg

SEQ ID NO: 1017514 - RNA, 19 nt, Human
cacacucaccagaucuguu

SEQ ID NO: 1017515 - RNA, 22 nt, Human
cacagaaaacuugaagugacug

SEQ ID NO: 1017516 - RNA, 20 nt, Human
cacagaacaguuuggcuucu

SEQ ID NO: 1017517 - RNA, 24 nt, Human
caccacacccagcuaauuuuugua

SEQ ID NO: 1017518 - RNA, 21 nt, Human
cacuauguuggccaggcuggu

SEQ ID NO: 1017519 - RNA, 24 nt, Human
cacuauguuggccaggcuggucuc

SEQ ID NO: 1017520 - RNA, 21 nt, Human
cacucugucaccaggcuggag

SEQ ID NO: 1017521 - RNA, 24 nt, Human
cacucuugucgcccaggcuggagu

SEQ ID NO: 1017522 - RNA, 21 nt, Human
cacuugcacacacacaggcag

SEQ ID NO: 1017523 - RNA, 23 nt, Human
cagcaaaaagacaaaauaaaacc

SEQ ID NO: 1017524 - RNA, 23 nt, Human
cagcagggccauauacuugggcu

SEQ ID NO: 1017525 - RNA, 23 nt, Human
cagccacuguuugucaaaaaucu

SEQ ID NO: 1017526 - RNA, 20 nt, Human
cagccuccugaguagcugag

SEQ ID NO: 1017527 - RNA, 23 nt, Human
caggcgcccaccacgcccggcuu

SEQ ID NO: 1017528 - RNA, 22 nt, Human
caggugaucugccugccucagc

SEQ ID NO: 1017529 - RNA, 23 nt, Human
cauaaacccccuggugaaguccc

SEQ ID NO: 1017530 - RNA, 24 nt, Human
cauaccaccacacccagcuaauuu

SEQ ID NO: 1017531 - RNA, 22 nt, Human
cauguuggccaggcuggucugc

SEQ ID NO: 1017532 - RNA, 22 nt, Human
ccaaaaacaaagccccacugag

SEQ ID NO: 1017533 - RNA, 25 nt, Human
ccaaaaacaaagccccacugagggu

SEQ ID NO: 1017534 - RNA, 21 nt, Human
ccaaagagcugggauuacagg

SEQ ID NO: 1017535 - RNA, 23 nt, Human
ccaaagagcugggauuacaggug

SEQ ID NO: 1017536 - RNA, 24 nt, Human
ccaaagagcugggauuacaggugu

SEQ ID NO: 1017537 - RNA, 28 nt, Human
ccaaagcuugguauguggcccugggcuc

SEQ ID NO: 1017538 - RNA, 22 nt, Human
ccaaagugcugggauuacaggc

SEQ ID NO: 1017539 - RNA, 22 nt, Human
ccaaagugcugggauuacaggc

SEQ ID NO: 1017540 - RNA, 24 nt, Human
ccaaagugcugggauuacaggcgu

SEQ ID NO: 1017541 - RNA, 18 nt, Human
ccaaaucaccuccaccac

SEQ ID NO: 1017542 - RNA, 21 nt, Human
ccacacguacacauacauaca

SEQ ID NO: 1017543 - RNA, 24 nt, Human
ccagcaaaaagacaaaauaaaacc

SEQ ID NO: 1017544 - RNA, 20 nt, Human
ccaggguucaagugauucuc

SEQ ID NO: 1017545 - RNA, 23 nt, Human
ccaggguucaagugauucuccug

SEQ ID NO: 1017546 - RNA, 19 nt, Human
ccauguuggccaggcuggu

SEQ ID NO: 1017547 - RNA, 20 nt, Human
ccauguuggccaggcugguc

SEQ ID NO: 1017548 - RNA, 22 nt, Human
ccauucccaaacccacagaaca

SEQ ID NO: 1017549 - RNA, 22 nt, Human
cccaaagagcugggauuacagg

SEQ ID NO: 1017550 - RNA, 24 nt, Human
cccaaagagcugggauuacaggug

SEQ ID NO: 1017551 - RNA, 22 nt, Human
cccaaaucaccuccaccacaac

SEQ ID NO: 1017552 - RNA, 20 nt, Human
cccggguucaagcgauucuc

SEQ ID NO: 1017553 - RNA, 23 nt, Human
cccggguucaagcgauucuccug

SEQ ID NO: 1017554 - RNA, 24 nt, Human
cccuccuuucccaauuuauuuggg

SEQ ID NO: 1017555 - RNA, 21 nt, Human
ccuagccucaggugaucugcc

SEQ ID NO: 1017556 - RNA, 22 nt, Human
ccucaggugaucugccugccuc

SEQ ID NO: 1017557 - RNA, 24 nt, Human
ccuccaggguucaagugauucucc

SEQ ID NO: 1017558 - RNA, 24 nt, Human
ccucccggguucaagcgauucucc

SEQ ID NO: 1017559 - RNA, 22 nt, Human
ccugaccuugagugauccaccc

SEQ ID NO: 1017560 - RNA, 19 nt, Human
ccugagcagcugggauuac

SEQ ID NO: 1017561 - RNA, 23 nt, Human
ccugagcagcugggauuacaggc

SEQ ID NO: 1017562 - RNA, 24 nt, Human
ccugagcagcugggauuacaggcg

SEQ ID NO: 1017563 - RNA, 19 nt, Human
ccugaguagcugagacuac

SEQ ID NO: 1017564 - RNA, 24 nt, Human
ccugaguagcugagacuacaggca

SEQ ID NO: 1017565 - RNA, 18 nt, Human
ccuggcuaguaaccacuu

SEQ ID NO: 1017566 - RNA, 22 nt, Human
cgccucggccucccaaagagcu

SEQ ID NO: 1017567 - RNA, 24 nt, Human
cgccucggccucccaaagagcugg

SEQ ID NO: 1017568 - RNA, 24 nt, Human
cgggguuucacuauguuggccagg

SEQ ID NO: 1017569 - RNA, 24 nt, Human
cgggguuuugccauguuggccagg

SEQ ID NO: 1017570 - RNA, 20 nt, Human
cuaaaagauagucagcagaa

SEQ ID NO: 1017571 - RNA, 23 nt, Human
cuaauuuuuguauuuuuaauaga

SEQ ID NO: 1017572 - RNA, 21 nt, Human
cuagucuaucccaaaucaccu

SEQ ID NO: 1017573 - RNA, 23 nt, Human
cucacucugucaccaggcuggag

SEQ ID NO: 1017574 - RNA, 23 nt, Human
cucaggugaucugccugccucag

SEQ ID NO: 1017575 - RNA, 21 nt, Human
cucagucucacacacaauuuc

SEQ ID NO: 1017576 - RNA, 18 nt, Human
cuccacucuucuuuccca

SEQ ID NO: 1017577 - RNA, 19 nt, Human
cuccaggguucaagugauu

SEQ ID NO: 1017578 - RNA, 21 nt, Human
cucccccaccaucuuaguugc

SEQ ID NO: 1017579 - RNA, 18 nt, Human
cuccuucacucucaucuu

SEQ ID NO: 1017580 - RNA, 19 nt, Human
cucuugucgcccaggcugg

SEQ ID NO: 1017581 - RNA, 22 nt, Human
cugagcagcugggauuacaggc

SEQ ID NO: 1017582 - RNA, 24 nt, Human
cugcaaucucugccucccggguuc

SEQ ID NO: 1017583 - RNA, 23 nt, Human
cugccucagccucccaaagugcu

SEQ ID NO: 1017584 - RNA, 24 nt, Human
cugccucagccucccaaagugcug

SEQ ID NO: 1017585 - RNA, 23 nt, Human
cugccucagccuccugagcagcu

SEQ ID NO: 1017586 - RNA, 23 nt, Human
cugucucagccuccugaguagcu

SEQ ID NO: 1017587 - RNA, 18 nt, Human
cuucucaaucucauacag

SEQ ID NO: 1017588 - RNA, 24 nt, Human
cuugucgcccaggcuggagugcag

SEQ ID NO: 1017589 - RNA, 18 nt, Human
cuuuauaaacugaguaga

SEQ ID NO: 1017590 - RNA, 21 nt, Human
cuuuuuguauuuuuaguagag

SEQ ID NO: 1017591 - RNA, 24 nt, Human
cuuuuuguauuuuuaguagagacg

SEQ ID NO: 1017592 - RNA, 18 nt, Human
gaaaacuauuugcuucca

SEQ ID NO: 1017593 - RNA, 24 nt, Human
gaccuugagugauccacccgccuc

SEQ ID NO: 1017594 - RNA, 24 nt, Human
gacggagucucacucugucaccag

SEQ ID NO: 1017595 - RNA, 19 nt, Human
gacgggguuuugccauguu

SEQ ID NO: 1017596 - RNA, 24 nt, Human
gagacgggguuucacuauguuggc

SEQ ID NO: 1017597 - RNA, 24 nt, Human
gagacgggguuuugccauguuggc

SEQ ID NO: 1017598 - RNA, 18 nt, Human
gagcaagcagaaguugcu

SEQ ID NO: 1017599 - RNA, 25 nt, Human
gagcacacccauggugccagcugca

SEQ ID NO: 1017600 - RNA, 26 nt, Human
gaggaaccugaugauuugggggcagg

SEQ ID NO: 1017601 - RNA, 23 nt, Human
gauccucaaagucuggcacuuaa

SEQ ID NO: 1017602 - RNA, 21 nt, Human
gaucugccugccucagccucc

SEQ ID NO: 1017603 - RNA, 18 nt, Human
gauuacaggcgugagcca

SEQ ID NO: 1017604 - RNA, 21 nt, Human
gauuacaggcgugagccacca

SEQ ID NO: 1017605 - RNA, 22 nt, Human
gauuacaggcgugagccaccac

SEQ ID NO: 1017606 - RNA, 18 nt, Human
gauuacaggugugagcca

SEQ ID NO: 1017607 - RNA, 21 nt, Human
gauuacaggugugagccacca

SEQ ID NO: 1017608 - RNA, 24 nt, Human
gauuacaggugugagccaccaggc

SEQ ID NO: 1017609 - RNA, 21 nt, Human
gauucuccugccucagccucc

SEQ ID NO: 1017610 - RNA, 20 nt, Human
gcaacuccuagccucaggug

SEQ ID NO: 1017611 - RNA, 22 nt, Human
gcaacuucuaccuccaggguuc

SEQ ID NO: 1017612 - RNA, 18 nt, Human
gccauguuggccaggcug

SEQ ID NO: 1017613 - RNA, 20 nt, Human
gccauguuggccaggcuggu

SEQ ID NO: 1017614 - RNA, 22 nt, Human
gccauguuggccaggcuggucu

SEQ ID NO: 1017615 - RNA, 19 nt, Human
gcccaacaccucaccuacc

SEQ ID NO: 1017616 - RNA, 19 nt, Human
gcccaggcuggagugcagu

SEQ ID NO: 1017617 - RNA, 19 nt, Human
gccucccaaagagcuggga

SEQ ID NO: 1017618 - RNA, 24 nt, Human
gcgauucuccugccucagccuccu

SEQ ID NO: 1017619 - RNA, 21 nt, Human
gcucacugcaacuucuaccuc

SEQ ID NO: 1017620 - RNA, 19 nt, Human
gcuggagugcaguggcacg

SEQ ID NO: 1017621 - RNA, 21 nt, Human
ggagcacacccauggugccag

SEQ ID NO: 1017622 - RNA, 21 nt, Human
ggaggcagggcagggggcuca

SEQ ID NO: 1017623 - RNA, 19 nt, Human
ggauuacaggcgugagcca

SEQ ID NO: 1017624 - RNA, 23 nt, Human
gggaagaagaaaauuuuucccac

SEQ ID NO: 1017625 - RNA, 19 nt, Human
gggcucagagcaagcagaa

SEQ ID NO: 1017626 - RNA, 23 nt, Human
ggggcucacagacccucuugaag

SEQ ID NO: 1017627 - RNA, 23 nt, Human
gggguuucacuauguuggccagg

SEQ ID NO: 1017628 - RNA, 23 nt, Human
gggguuuugccauguuggccagg

SEQ ID NO: 1017629 - RNA, 24 nt, Human
ggugaaaggggaggcagggcaggg

SEQ ID NO: 1017630 - RNA, 24 nt, Human
guaauacucucagaaguucccaca

SEQ ID NO: 1017631 - RNA, 23 nt, Human
guagagacgggguuuugccaugu

SEQ ID NO: 1017632 - RNA, 24 nt, Human
guauggccuucguaauucuagaag

SEQ ID NO: 1017633 - RNA, 19 nt, Human
gucaguuuuugucagguca

SEQ ID NO: 1017634 - RNA, 24 nt, Human
gucucacucugucaccaggcugga

SEQ ID NO: 1017635 - RNA, 24 nt, Human
gugauccacccgccucggccuccc

SEQ ID NO: 1017636 - RNA, 18 nt, Human
gugaucugccugccucag

SEQ ID NO: 1017637 - RNA, 24 nt, Human
gugaucugccugccucagccuccc

SEQ ID NO: 1017638 - RNA, 24 nt, Human
gugauucuccugucucagccuccu

SEQ ID NO: 1017639 - RNA, 21 nt, Human
uaaaaccuccagcaagaacuu

SEQ ID NO: 1017640 - RNA, 22 nt, Human
uaaagcaagaaaacagugacac

SEQ ID NO: 1017641 - RNA, 21 nt, Human
uaaagguacaccuccaguuca

SEQ ID NO: 1017642 - RNA, 24 nt, Human
uaacagaaacaaaauuuagaugua

SEQ ID NO: 1017643 - RNA, 19 nt, Human
uaacccccucucccccacc

SEQ ID NO: 1017644 - RNA, 20 nt, Human
uaagaaagaaaacuauuugc

SEQ ID NO: 1017645 - RNA, 24 nt, Human
uaauagagacgggguuucacuaug

SEQ ID NO: 1017646 - RNA, 24 nt, Human
uaauuuuuguauuuuuaauagaga

SEQ ID NO: 1017647 - RNA, 18 nt, Human
uacaccuuuugcaacaag

SEQ ID NO: 1017648 - RNA, 23 nt, Human
uacaggcgugagccaccacgccc

SEQ ID NO: 1017649 - RNA, 23 nt, Human
uacaggugugagccaccaggccc

SEQ ID NO: 1017650 - RNA, 23 nt, Human
uacugcaaucucugccucccggg

SEQ ID NO: 1017651 - RNA, 19 nt, Human
uacuucaccaagaaaggga

SEQ ID NO: 1017652 - RNA, 19 nt, Human
uacuugggcuuggagguga

SEQ ID NO: 1017653 - RNA, 20 nt, Human
uagaauuagacaaaagcaac

SEQ ID NO: 1017654 - RNA, 21 nt, Human
uagagacgggguuucacuaug

SEQ ID NO: 1017655 - RNA, 22 nt, Human
uagagacgggguuucacuaugu

SEQ ID NO: 1017656 - RNA, 22 nt, Human
uagagacgggguuuugccaugu

SEQ ID NO: 1017657 - RNA, 18 nt, Human
uaguaaguaaugacuuuc

SEQ ID NO: 1017658 - RNA, 24 nt, Human
uaguagagacgggguuuugccaug

SEQ ID NO: 1017659 - RNA, 20 nt, Human
uaucccaaaucaccuccacc

SEQ ID NO: 1017660 - RNA, 22 nt, Human
uaucccaaaucaccuccaccac

SEQ ID NO: 1017661 - RNA, 23 nt, Human
uauguuggccaggcuggucucaa

SEQ ID NO: 1017662 - RNA, 24 nt, Human
uauguuggccaggcuggucucaaa

SEQ ID NO: 1017663 - RNA, 24 nt, Human
ucaacacagaucccugagccauag

SEQ ID NO: 1017664 - RNA, 23 nt, Human
ucacuaccuugaauuuagaguga

SEQ ID NO: 1017665 - RNA, 22 nt, Human
ucacuauguuggccaggcuggu

SEQ ID NO: 1017666 - RNA, 23 nt, Human
ucacucuugucgcccaggcugga

SEQ ID NO: 1017667 - RNA, 23 nt, Human
ucacugcaacuucuaccuccagg

SEQ ID NO: 1017668 - RNA, 24 nt, Human
ucacugcaacuucuaccuccaggg

SEQ ID NO: 1017669 - RNA, 19 nt, Human
ucagcagagcagccacugu

SEQ ID NO: 1017670 - RNA, 22 nt, Human
ucaggugaucugccugccucag

SEQ ID NO: 1017671 - RNA, 24 nt, Human
ucauucuucuaauccauauucaau

SEQ ID NO: 1017672 - RNA, 24 nt, Human
uccaggguucaagugauucuccug

SEQ ID NO: 1017673 - RNA, 20 nt, Human
uccauaaacccccuggugaa

SEQ ID NO: 1017674 - RNA, 19 nt, Human
ucccaaagagcugggauua

SEQ ID NO: 1017675 - RNA, 23 nt, Human
ucccaaagagcugggauuacagg

SEQ ID NO: 1017676 - RNA, 23 nt, Human
ucccaaagagcugggauuacagg

SEQ ID NO: 1017677 - RNA, 24 nt, Human
ucccaaagagcugggauuacaggu

SEQ ID NO: 1017678 - RNA, 24 nt, Human
ucccaaagugcugggauuacaggc

SEQ ID NO: 1017679 - RNA, 19 nt, Human
ucccaaaucaccuccacca

SEQ ID NO: 1017680 - RNA, 18 nt, Human
ucccagagaaguaugguu

SEQ ID NO: 1017681 - RNA, 19 nt, Human
ucccauagagcugcccaga

SEQ ID NO: 1017682 - RNA, 21 nt, Human
ucccggguucaagcgauucuc

SEQ ID NO: 1017683 - RNA, 24 nt, Human
ucccggguucaagcgauucuccug

SEQ ID NO: 1017684 - RNA, 19 nt, Human
uccuccuugacccccuccu

SEQ ID NO: 1017685 - RNA, 24 nt, Human
uccugagcagcugggauuacaggc

SEQ ID NO: 1017686 - RNA, 24 nt, Human
uccugaguagcugagacuacaggc

SEQ ID NO: 1017687 - RNA, 24 nt, Human
ucgcccaggcuggagugcaguagu

SEQ ID NO: 1017688 - RNA, 24 nt, Human
ucuaacccccucucccccaccauc

SEQ ID NO: 1017689 - RNA, 24 nt, Human
ucuaccuccaggguucaagugauu

SEQ ID NO: 1017690 - RNA, 23 nt, Human
ucucacucugucaccaggcugga

SEQ ID NO: 1017691 - RNA, 21 nt, Human
ucucugaggggaaacaggguu

SEQ ID NO: 1017692 - RNA, 23 nt, Human
ucugcuugagguccugaaaacug

SEQ ID NO: 1017693 - RNA, 23 nt, Human
ucugucaccaggcuggagugcag

SEQ ID NO: 1017694 - RNA, 21 nt, Human
ucuucuggggaagaagaaaau

SEQ ID NO: 1017695 - RNA, 20 nt, Human
ugaaaaugcggcuucacuac

SEQ ID NO: 1017696 - RNA, 18 nt, Human
ugaacaaaccaaaagggu

SEQ ID NO: 1017697 - RNA, 18 nt, Human
ugacaaacacagguuccc

SEQ ID NO: 1017698 - RNA, 23 nt, Human
ugacaaacacagguucccacacg

SEQ ID NO: 1017699 - RNA, 24 nt, Human
ugaccuugagugauccacccgccu

SEQ ID NO: 1017700 - RNA, 24 nt, Human
ugagacuacaggcacauaccacca

SEQ ID NO: 1017701 - RNA, 24 nt, Human
ugagcagcugggauuacaggcgcc

SEQ ID NO: 1017702 - RNA, 19 nt, Human
ugauuugcuuccugaauuc

SEQ ID NO: 1017703 - RNA, 21 nt, Human
ugcaguggcacgaucucagcu

SEQ ID NO: 1017704 - RNA, 18 nt, Human
ugcaugguguggaacugc

SEQ ID NO: 1017705 - RNA, 20 nt, Human
ugccagcugcacucccccgc

SEQ ID NO: 1017706 - RNA, 22 nt, Human
ugccauguuggccaggcugguc

SEQ ID NO: 1017707 - RNA, 27 nt, Human
ugccauguuggccaggcuggucugcaa

SEQ ID NO: 1017708 - RNA, 24 nt, Human
ugccucagccucccaaagugcugg

SEQ ID NO: 1017709 - RNA, 24 nt, Human
ugccucagccuccugagcagcugg

SEQ ID NO: 1017710 - RNA, 18 nt, Human
ugccucaucacuaaaguu

SEQ ID NO: 1017711 - RNA, 24 nt, Human
ugcugggauuacaggcgugagcca

SEQ ID NO: 1017712 - RNA, 26 nt, Human
ugcuguacuuaaaaucuugucagagg

SEQ ID NO: 1017713 - RNA, 20 nt, Human
ugcuucaaaaaaagccuuug

SEQ ID NO: 1017714 - RNA, 22 nt, Human
ugcuuuauaaacugaguagaga

SEQ ID NO: 1017715 - RNA, 22 nt, Human
uggaaaacaccccgugagccca

SEQ ID NO: 1017716 - RNA, 19 nt, Human
uggagugcaguaguaugau

SEQ ID NO: 1017717 - RNA, 23 nt, Human
uggagugcaguaguaugaucuug

SEQ ID NO: 1017718 - RNA, 24 nt, Human
uggagugcaguaguaugaucuugg

SEQ ID NO: 1017719 - RNA, 23 nt, Human
uggagugcaguggcacgaucuca

SEQ ID NO: 1017720 - RNA, 24 nt, Human
uggagugcaguggcacgaucucag

SEQ ID NO: 1017721 - RNA, 24 nt, Human
uggcacgaucucagcuuacugcaa

SEQ ID NO: 1017722 - RNA, 24 nt, Human
uggccaggcuggucucaaaugccu

SEQ ID NO: 1017723 - RNA, 24 nt, Human
uggccaggcuggucugcaacuccu

SEQ ID NO: 1017724 - RNA, 23 nt, Human
ugggaaaagcuucucaaucucau

SEQ ID NO: 1017725 - RNA, 18 nt, Human
ugggagagauggaggcug

SEQ ID NO: 1017726 - RNA, 21 nt, Human
ugggauuacaggcgcccacca

SEQ ID NO: 1017727 - RNA, 18 nt, Human
ugggauuacaggcgugag

SEQ ID NO: 1017728 - RNA, 19 nt, Human
ugggauuacaggcgugagc

SEQ ID NO: 1017729 - RNA, 22 nt, Human
ugggauuacaggcgugagccac

SEQ ID NO: 1017730 - RNA, 23 nt, Human
ugggauuacaggcgugagccacc

SEQ ID NO: 1017731 - RNA, 24 nt, Human
ugggauuacaggcgugagccacca

SEQ ID NO: 1017732 - RNA, 18 nt, Human
ugggauuacaggugugag

SEQ ID NO: 1017733 - RNA, 19 nt, Human
ugggauuacaggugugagc

SEQ ID NO: 1017734 - RNA, 22 nt, Human
ugggauuacaggugugagccac

SEQ ID NO: 1017735 - RNA, 23 nt, Human
ugggauuacaggugugagccacc

SEQ ID NO: 1017736 - RNA, 24 nt, Human
ugggauuacaggugugagccacca

SEQ ID NO: 1017737 - RNA, 19 nt, Human
ugggcuccucccccaauuu

SEQ ID NO: 1017738 - RNA, 22 nt, Human
ugggggcagggauaaaaccauu

SEQ ID NO: 1017739 - RNA, 21 nt, Human
uggugucuguaaggacuugac

SEQ ID NO: 1017740 - RNA, 18 nt, Human
ugguguuaaaagaauuuc

SEQ ID NO: 1017741 - RNA, 21 nt, Human
uguaaagguagacguuagguc

SEQ ID NO: 1017742 - RNA, 21 nt, Human
uguauuuuuaguagagacggg

SEQ ID NO: 1017743 - RNA, 24 nt, Human
ugucucagccuccugaguagcuga

SEQ ID NO: 1017744 - RNA, 19 nt, Human
uuaaagccagcucuaucua

SEQ ID NO: 1017745 - RNA, 23 nt, Human
uuaaagguaagucaggagcugaa

SEQ ID NO: 1017746 - RNA, 21 nt, Human
uuaagaaagaaaacuauuugc

SEQ ID NO: 1017747 - RNA, 21 nt, Human
uuaauagagacgggguuucac

SEQ ID NO: 1017748 - RNA, 24 nt, Human
uuaauagagacgggguuucacuau

SEQ ID NO: 1017749 - RNA, 24 nt, Human
uuacugcaaucucugccucccggg

SEQ ID NO: 1017750 - RNA, 25 nt, Human
uuacugcaaucucugccucccgggu

SEQ ID NO: 1017751 - RNA, 18 nt, Human
uuaguagagacgggguuu

SEQ ID NO: 1017752 - RNA, 22 nt, Human
uuaguagagacgggguuuugcc

SEQ ID NO: 1017753 - RNA, 24 nt, Human
uuaguagagacgggguuuugccau

SEQ ID NO: 1017754 - RNA, 21 nt, Human
uuauaaacauuuuugcaguca

SEQ ID NO: 1017755 - RNA, 25 nt, Human
uuaugcuagggguaugccuggcuag

SEQ ID NO: 1017756 - RNA, 24 nt, Human
uuauuguuuccucugaaggacacu

SEQ ID NO: 1017757 - RNA, 21 nt, Human
uucaagcgauucuccugccuc

SEQ ID NO: 1017758 - RNA, 23 nt, Human
uucaagcgauucuccugccucag

SEQ ID NO: 1017759 - RNA, 24 nt, Human
uucaagcgauucuccugccucagc

SEQ ID NO: 1017760 - RNA, 23 nt, Human
uucaagugauucuccugucucag

SEQ ID NO: 1017761 - RNA, 20 nt, Human
uucacaauauacuucaaucu

SEQ ID NO: 1017762 - RNA, 24 nt, Human
uucacucuugucgcccaggcugga

SEQ ID NO: 1017763 - RNA, 22 nt, Human
uucccacaacugcccaacaccu

SEQ ID NO: 1017764 - RNA, 25 nt, Human
uucccacacguacacauacauacaa

SEQ ID NO: 1017765 - RNA, 19 nt, Human
uuccuccuugacccccucc

SEQ ID NO: 1017766 - RNA, 21 nt, Human
uucucugaggggaaacagggu

SEQ ID NO: 1017767 - RNA, 21 nt, Human
uugaagccuauccauaaaccc

SEQ ID NO: 1017768 - RNA, 19 nt, Human
uugcaacaagaucuucucu

SEQ ID NO: 1017769 - RNA, 20 nt, Human
uuggcuuuaagccauuagaa

SEQ ID NO: 1017770 - RNA, 23 nt, Human
uuguauuuuuaguagagacgggg

SEQ ID NO: 1017771 - RNA, 24 nt, Human
uuuaauacaccuuuugcaacaaga

SEQ ID NO: 1017772 - RNA, 24 nt, Human
uuucacuauguuggccaggcuggu

SEQ ID NO: 1017773 - RNA, 24 nt, Human
uuucacucuugucgcccaggcugg

SEQ ID NO: 1017774 - RNA, 23 nt, Human
uuuugccauguuggccaggcugg

SEQ ID NO: 1017775 - RNA, 24 nt, Human
uuuuuaauagagacgggguuucac

SEQ ID NO: 1017776 - RNA, 21 nt, Human
uuuuuaguagagacgggguuu

SEQ ID NO: 1017777 - RNA, 21 nt, Human
uuuuuaguagagacgggguuu

SEQ ID NO: 1017778 - RNA, 20 nt, Human
uuuuuguauuuuuaauagag

SEQ ID NO: 1017779 - RNA, 23 nt, Human
uuuuuguauuuuuaauagagacg

SEQ ID NO: 1017780 - RNA, 21 nt, Human
uuuuuguauuuuuaguagaga

SEQ ID NO: 1017781 - RNA, 19 nt, Human
aaauggauuuuccuguguc

SEQ ID NO: 1017782 - RNA, 18 nt, Human
aaggcaucgcgcacccug

SEQ ID NO: 1017783 - RNA, 24 nt, Human
acaauagcaacagaagacuuucac

SEQ ID NO: 1017784 - RNA, 20 nt, Human
agaauagcaaaaauaaaaga

SEQ ID NO: 1017785 - RNA, 18 nt, Human
augaccaaauauuugagc

SEQ ID NO: 1017786 - RNA, 19 nt, Human
caugaccaaauauuugagc

SEQ ID NO: 1017787 - RNA, 18 nt, Human
cccacaauagcaacagaa

SEQ ID NO: 1017788 - RNA, 25 nt, Human
cccugcggcagcggcugcgcugccu

SEQ ID NO: 1017789 - RNA, 20 nt, Human
ccugcggguggccgcgacuc

SEQ ID NO: 1017790 - RNA, 19 nt, Human
cggcagcggcugcgcugcc

SEQ ID NO: 1017791 - RNA, 23 nt, Human
gagcccacaauagcaacagaaga

SEQ ID NO: 1017792 - RNA, 20 nt, Human
ggccgcgacucaggccggga

SEQ ID NO: 1017793 - RNA, 23 nt, Human
uacauucuucccccaugaccaaa

SEQ ID NO: 1017794 - RNA, 25 nt, Human
uagcaaaaauaaaagaguggggaaa

SEQ ID NO: 1017795 - RNA, 19 nt, Human
ucccccaugaccaaauauu

SEQ ID NO: 1017796 - RNA, 23 nt, Human
ucccccaugaccaaauauuugag

SEQ ID NO: 1017797 - RNA, 24 nt, Human
ucccccaugaccaaauauuugagc

SEQ ID NO: 1017798 - RNA, 21 nt, Human
ucuucccccaugaccaaauau

SEQ ID NO: 1017799 - RNA, 24 nt, Human
ugaccaaauauuugagcccacaau

SEQ ID NO: 1017800 - RNA, 20 nt, Human
ugagcccacaauagcaacag

SEQ ID NO: 1017801 - RNA, 18 nt, Human
ugccucagcccacagcuc

SEQ ID NO: 1017802 - RNA, 24 nt, Human
uggaagacaugggaaguuuauuuu

SEQ ID NO: 1017803 - RNA, 23 nt, Human
ugugccagugccacaacccuaca

SEQ ID NO: 1017804 - RNA, 22 nt, Human
uuucaaaauccagaguguugcu

SEQ ID NO: 1017805 - RNA, 28 nt, Human
uuuuuuuuuuuuuuuuuuuuuuuggggg

SEQ ID NO: 1017806 - RNA, 24 nt, Human
aaaaaagacaagaggaaaccgaaa

SEQ ID NO: 1017807 - RNA, 19 nt, Human
aagaggaaaccgaaaaagg

SEQ ID NO: 1017808 - RNA, 27 nt, Human
aaguuuaaguguuuuuuuuuuuuuuuu

SEQ ID NO: 1017809 - RNA, 25 nt, Human
aauaaaaaaaaaaagacaagaggaa

SEQ ID NO: 1017810 - RNA, 22 nt, Human
aauucuguuaaaaaacaaaaaa

SEQ ID NO: 1017811 - RNA, 19 nt, Human
accuaugggcugagggcua

SEQ ID NO: 1017812 - RNA, 19 nt, Human
agacaaaaugguucuaaac

SEQ ID NO: 1017813 - RNA, 19 nt, Human
agacaagaggaaaccgaaa

SEQ ID NO: 1017814 - RNA, 19 nt, Human
agcaagguggcggcuggcu

SEQ ID NO: 1017815 - RNA, 20 nt, Human
agcaagguggcggcuggcug

SEQ ID NO: 1017816 - RNA, 23 nt, Human
agcugcuggugcuggguugauuu

SEQ ID NO: 1017817 - RNA, 24 nt, Human
aggaaaccgaaaaaggaggggugg

SEQ ID NO: 1017818 - RNA, 22 nt, Human
aggggggaaggagagaagcgag

SEQ ID NO: 1017819 - RNA, 21 nt, Human
agguggcggcuggcugguuug

SEQ ID NO: 1017820 - RNA, 20 nt, Human
caaaaugguucuaaacugaa

SEQ ID NO: 1017821 - RNA, 24 nt, Human
caagaggaaaccgaaaaaggaggg

SEQ ID NO: 1017822 - RNA, 24 nt, Human
caccccccccacucccgugccccc

SEQ ID NO: 1017823 - RNA, 27 nt, Human
cacucccgugcccccagcaagggcugg

SEQ ID NO: 1017824 - RNA, 19 nt, Human
cagcucgcggacugcugga

SEQ ID NO: 1017825 - RNA, 19 nt, Human
ccaagagaaggguucccac

SEQ ID NO: 1017826 - RNA, 24 nt, Human
ccaguauggaccuuuggaaugcaa

SEQ ID NO: 1017827 - RNA, 25 nt, Human
ccaugucaccccccccacucccgug

SEQ ID NO: 1017828 - RNA, 20 nt, Human
ccccacucccgugcccccag

SEQ ID NO: 1017829 - RNA, 18 nt, Human
ccccccacucccgugccc

SEQ ID NO: 1017830 - RNA, 23 nt, Human
ccccccacucccgugcccccagc

SEQ ID NO: 1017831 - RNA, 20 nt, Human
cccgugcccccagcaagggc

SEQ ID NO: 1017832 - RNA, 18 nt, Human
ccgcgccccggggugccc

SEQ ID NO: 1017833 - RNA, 21 nt, Human
ccuccgcgccccggggugccc

SEQ ID NO: 1017834 - RNA, 20 nt, Human
ccuucccuuccuccucacug

SEQ ID NO: 1017835 - RNA, 23 nt, Human
cgggaggagcccuuggggcggcg

SEQ ID NO: 1017836 - RNA, 21 nt, Human
cuccaacaucucugaaccgcc

SEQ ID NO: 1017837 - RNA, 18 nt, Human
cuguucaagugaagagau

SEQ ID NO: 1017838 - RNA, 18 nt, Human
cuuuggaaugcaaggguu

SEQ ID NO: 1017839 - RNA, 18 nt, Human
gaaaccaaguaaccagua

SEQ ID NO: 1017840 - RNA, 21 nt, Human
gacaagaggaaaccgaaaaag

SEQ ID NO: 1017841 - RNA, 19 nt, Human
gagaagcgaggagcgcucc

SEQ ID NO: 1017842 - RNA, 21 nt, Human
gaggagagggcgagugcagcg

SEQ ID NO: 1017843 - RNA, 21 nt, Human
gcaaggguuuuuucaccccca

SEQ ID NO: 1017844 - RNA, 20 nt, Human
gccuagggcccaugucaccc

SEQ ID NO: 1017845 - RNA, 28 nt, Human
ggcaggccgggaggucgggggacuaguc

SEQ ID NO: 1017846 - RNA, 18 nt, Human
gggaaggagagaagcgag

SEQ ID NO: 1017847 - RNA, 24 nt, Human
gggaggguccggcggagugcggca

SEQ ID NO: 1017848 - RNA, 20 nt, Human
ggggaggggccgaaaguuug

SEQ ID NO: 1017849 - RNA, 20 nt, Human
ggguuuuuucacccccagac

SEQ ID NO: 1017850 - RNA, 20 nt, Human
gugaauauuuuguucaacag

SEQ ID NO: 1017851 - RNA, 18 nt, Human
gugcagcggcgcgggccg

SEQ ID NO: 1017852 - RNA, 19 nt, Human
gugcagcggcgcgggccgg

SEQ ID NO: 1017853 - RNA, 20 nt, Human
gugcagcggcgcgggccggc

SEQ ID NO: 1017854 - RNA, 21 nt, Human
gugguugguagcugcuggugc

SEQ ID NO: 1017855 - RNA, 22 nt, Human
uaaccaguauggaccuuuggaa

SEQ ID NO: 1017856 - RNA, 24 nt, Human
ucaccccccccacucccgugcccc

SEQ ID NO: 1017857 - RNA, 18 nt, Human
ucacuggcgcccucuugc

SEQ ID NO: 1017858 - RNA, 23 nt, Human
ucccaaacucaucggaguccuaa

SEQ ID NO: 1017859 - RNA, 20 nt, Human
ucucugaaccgccuucccuu

SEQ ID NO: 1017860 - RNA, 23 nt, Human
ugaaaccaaguaaccaguaugga

SEQ ID NO: 1017861 - RNA, 18 nt, Human
ugaaccgccuucccuucc

SEQ ID NO: 1017862 - RNA, 25 nt, Human
ugcaaggguuuuuucacccccaacg

SEQ ID NO: 1017863 - RNA, 23 nt, Human
ugcccggcccgccccccccgcgg

SEQ ID NO: 1017864 - RNA, 24 nt, Human
uggaccuuuggaaugcaaggguuu

SEQ ID NO: 1017865 - RNA, 21 nt, Human
uggcugguuuguuuacaccgg

SEQ ID NO: 1017866 - RNA, 23 nt, Human
uggguugauuuuuccugaagucc

SEQ ID NO: 1017867 - RNA, 24 nt, Human
uggugguugguagcugcuggugcu

SEQ ID NO: 1017868 - RNA, 21 nt, Human
uguuuuuuuuuuuuuuuuguu

SEQ ID NO: 1017869 - RNA, 22 nt, Human
uuaaaaaacaaaaaacaccuau

SEQ ID NO: 1017870 - RNA, 18 nt, Human
uucccuuccuccucacuc

SEQ ID NO: 1017871 - RNA, 19 nt, Human
uuuuuuuuuuuuuuguucu

SEQ ID NO: 1017872 - RNA, 19 nt, Human
aagagcgcucagcccacag

SEQ ID NO: 1017873 - RNA, 26 nt, Human
aaguagaggggagauuaagagcgcuc

SEQ ID NO: 1017874 - RNA, 25 nt, Human
acaauauauguaucacuccuugggg

SEQ ID NO: 1017875 - RNA, 24 nt, Human
accccaauuuggggagccucugcc

SEQ ID NO: 1017876 - RNA, 21 nt, Human
accccugcugugucuguccug

SEQ ID NO: 1017877 - RNA, 24 nt, Human
acucauuucaucuuccagaacccu

SEQ ID NO: 1017878 - RNA, 20 nt, Human
aggaagggcugaugcugaug

SEQ ID NO: 1017879 - RNA, 18 nt, Human
agggcucugggaggaagg

SEQ ID NO: 1017880 - RNA, 20 nt, Human
cacugcuuggcauggguguc

SEQ ID NO: 1017881 - RNA, 24 nt, Human
cagaacccucugaaguaugaucau

SEQ ID NO: 1017882 - RNA, 25 nt, Human
ccagaacccucugaaguaugaucau

SEQ ID NO: 1017883 - RNA, 18 nt, Human
ccaggagcagcugggaca

SEQ ID NO: 1017884 - RNA, 18 nt, Human
ccccagaccccugcugug

SEQ ID NO: 1017885 - RNA, 19 nt, Human
ccccagaccccugcugugu

SEQ ID NO: 1017886 - RNA, 20 nt, Human
ccugcgugcucccacugcuu

SEQ ID NO: 1017887 - RNA, 20 nt, Human
gaaugagggcucugggagga

SEQ ID NO: 1017888 - RNA, 23 nt, Human
gagcagcugggacagggacccca

SEQ ID NO: 1017889 - RNA, 19 nt, Human
gcaaggcuccgugccccag

SEQ ID NO: 1017890 - RNA, 21 nt, Human
gccccaauaccuucuuagcuu

SEQ ID NO: 1017891 - RNA, 22 nt, Human
ggaaugagggcucugggaggaa

SEQ ID NO: 1017892 - RNA, 24 nt, Human
ggaccccacuuuuacaauacagcu

SEQ ID NO: 1017893 - RNA, 20 nt, Human
guacuuuacacucauuucau

SEQ ID NO: 1017894 - RNA, 23 nt, Human
gugccccagaccccugcuguguc

SEQ ID NO: 1017895 - RNA, 20 nt, Human
gugcucccacugcuuggcau

SEQ ID NO: 1017896 - RNA, 25 nt, Human
uacaauacagcuguaaauauauaca

SEQ ID NO: 1017897 - RNA, 22 nt, Human
uacacaauauauguaucacucc

SEQ ID NO: 1017898 - RNA, 18 nt, Human
uccagaacccucugaagu

SEQ ID NO: 1017899 - RNA, 18 nt, Human
uccccggccuugugcugc

SEQ ID NO: 1017900 - RNA, 22 nt, Human
ugaaguaugaucaucaucuguu

SEQ ID NO: 1017901 - RNA, 25 nt, Human
ugagggcucugggaggaagggcuga

SEQ ID NO: 1017902 - RNA, 24 nt, Human
ugcaugccagucacccuucugagu

SEQ ID NO: 1017903 - RNA, 20 nt, Human
uggaaugagggcucugggag

SEQ ID NO: 1017904 - RNA, 20 nt, Human
uggaauuggaaugagggcuc

SEQ ID NO: 1017905 - RNA, 21 nt, Human
uggcauggguguccccggccu

SEQ ID NO: 1017906 - RNA, 24 nt, Human
uggcauggguguccccggccuugu

SEQ ID NO: 1017907 - RNA, 22 nt, Human
uguccccggccuugugcugcuu

SEQ ID NO: 1017908 - RNA, 25 nt, Human
uucacagacaaggaaacugagguuc

SEQ ID NO: 1017909 - RNA, 25 nt, Human
aaaaacacaaaaggagaaaaaaaug

SEQ ID NO: 1017910 - RNA, 19 nt, Human
aaaaaugcaguuugcuuuu

SEQ ID NO: 1017911 - RNA, 26 nt, Human
aaaagaaacaaauucacaagaaacaa

SEQ ID NO: 1017912 - RNA, 18 nt, Human
aaacaaaaagcaaggagc

SEQ ID NO: 1017913 - RNA, 19 nt, Human
aaaggaagaggggaugaga

SEQ ID NO: 1017914 - RNA, 24 nt, Human
aacaaccuugggcaaccacaaaga

SEQ ID NO: 1017915 - RNA, 21 nt, Human
aagaaacaaaaagcaaggagc

SEQ ID NO: 1017916 - RNA, 22 nt, Human
aagagacuguagagggcagccc

SEQ ID NO: 1017917 - RNA, 24 nt, Human
aagauuuuuaaaaaugcaguuugc

SEQ ID NO: 1017918 - RNA, 24 nt, Human
aagcaaagcaagaaacaaaaagca

SEQ ID NO: 1017919 - RNA, 25 nt, Human
aagcaaagcaagaaacaaaaagcaa

SEQ ID NO: 1017920 - RNA, 22 nt, Human
aagcaagaaacaaaaagcaagg

SEQ ID NO: 1017921 - RNA, 31 nt, Human
aagcaagaaacaaaaagcaaggagccagagg

SEQ ID NO: 1017922 - RNA, 22 nt, Human
aaucucucucucccagccccac

SEQ ID NO: 1017923 - RNA, 22 nt, Human
acaaaaacacacauguucaaag

SEQ ID NO: 1017924 - RNA, 20 nt, Human
acaacccuccucacccucuc

SEQ ID NO: 1017925 - RNA, 21 nt, Human
acacaaccucuaucccaagga

SEQ ID NO: 1017926 - RNA, 25 nt, Human
acacaaccucuaucccaaggaaauu

SEQ ID NO: 1017927 - RNA, 24 nt, Human
acacuguaaaaaucucaaagagca

SEQ ID NO: 1017928 - RNA, 26 nt, Human
acuagauuuuaaaugcuuuagauuuu

SEQ ID NO: 1017929 - RNA, 20 nt, Human
acuccaaaaaaaaaaaauca

SEQ ID NO: 1017930 - RNA, 23 nt, Human
agagacuguagagggcagccccc

SEQ ID NO: 1017931 - RNA, 19 nt, Human
agaggaggagaagggauua

SEQ ID NO: 1017932 - RNA, 20 nt, Human
agagggagaacaggggaugg

SEQ ID NO: 1017933 - RNA, 22 nt, Human
agagggaugcacaucucccaga

SEQ ID NO: 1017934 - RNA, 20 nt, Human
agaggggaugagagaugucg

SEQ ID NO: 1017935 - RNA, 21 nt, Human
agaguuacagguuggaaaggg

SEQ ID NO: 1017936 - RNA, 19 nt, Human
agauuugaaaagcaaagua

SEQ ID NO: 1017937 - RNA, 22 nt, Human
agcaacagagggagaacagggg

SEQ ID NO: 1017938 - RNA, 24 nt, Human
aggagaaaaaaaugguauuucaaa

SEQ ID NO: 1017939 - RNA, 18 nt, Human
agggaaagcagggaaacg

SEQ ID NO: 1017940 - RNA, 18 nt, Human
agggaaauguaaggaaau

SEQ ID NO: 1017941 - RNA, 24 nt, Human
aggggagcaacagagggagaacag

SEQ ID NO: 1017942 - RNA, 19 nt, Human
auagggcagcaguagagga

SEQ ID NO: 1017943 - RNA, 21 nt, Human
aucccuucuaucuuuauucca

SEQ ID NO: 1017944 - RNA, 19 nt, Human
aucuaaucucucucuccca

SEQ ID NO: 1017945 - RNA, 22 nt, Human
auucugaacaacccuccucacc

SEQ ID NO: 1017946 - RNA, 24 nt, Human
caaaaaaaaaggaaaagaaacaaa

SEQ ID NO: 1017947 - RNA, 23 nt, Human
caaaaacacuaccuuuucucucc

SEQ ID NO: 1017948 - RNA, 22 nt, Human
caaaacaaccuugggcaaccac

SEQ ID NO: 1017949 - RNA, 20 nt, Human
caaacagguacaaaggaggu

SEQ ID NO: 1017950 - RNA, 26 nt, Human
caaagacuccaaaaaaaaaaaaucag

SEQ ID NO: 1017951 - RNA, 21 nt, Human
caaagcaagaaacaaaaagca

SEQ ID NO: 1017952 - RNA, 20 nt, Human
caaaugaaauuuacggagac

SEQ ID NO: 1017953 - RNA, 19 nt, Human
caacaaagacuccaaaaaa

SEQ ID NO: 1017954 - RNA, 21 nt, Human
caacacaaccucuaucccaag

SEQ ID NO: 1017955 - RNA, 23 nt, Human
caacccuccucacccucucaaaa

SEQ ID NO: 1017956 - RNA, 22 nt, Human
caaggagucucaguuacgcaaa

SEQ ID NO: 1017957 - RNA, 21 nt, Human
cacccucucaaaauucuuaaa

SEQ ID NO: 1017958 - RNA, 21 nt, Human
cagaaagauuuuuaaaaaugc

SEQ ID NO: 1017959 - RNA, 21 nt, Human
cagccccacaaaauauagcaa

SEQ ID NO: 1017960 - RNA, 20 nt, Human
caggggggaauaaaggaaga

SEQ ID NO: 1017961 - RNA, 21 nt, Human
caucccuucuaucuuuauucc

SEQ ID NO: 1017962 - RNA, 18 nt, Human
cauuucugacaauaaaca

SEQ ID NO: 1017963 - RNA, 20 nt, Human
ccaaaaaagcacuaggcuaa

SEQ ID NO: 1017964 - RNA, 22 nt, Human
ccaacacaaccucuaucccaag

SEQ ID NO: 1017965 - RNA, 19 nt, Human
ccacaacacaaaaacacac

SEQ ID NO: 1017966 - RNA, 21 nt, Human
ccacaacacaaaaacacacau

SEQ ID NO: 1017967 - RNA, 22 nt, Human
ccagcaaaacgucauucuuucc

SEQ ID NO: 1017968 - RNA, 20 nt, Human
ccagccuccagagauuagaa

SEQ ID NO: 1017969 - RNA, 18 nt, Human
ccaugccccaagucuucc

SEQ ID NO: 1017970 - RNA, 19 nt, Human
cccacaaaauauagcaaca

SEQ ID NO: 1017971 - RNA, 25 nt, Human
cccacggccauggccaguguuugcc

SEQ ID NO: 1017972 - RNA, 21 nt, Human
cccaggggggaauaaaggaag

SEQ ID NO: 1017973 - RNA, 19 nt, Human
cccaguacucccacggcca

SEQ ID NO: 1017974 - RNA, 21 nt, Human
cccaguacucccacggccaug

SEQ ID NO: 1017975 - RNA, 23 nt, Human
cccaugaaaggagaaggguccug

SEQ ID NO: 1017976 - RNA, 24 nt, Human
ccccccgcccccucgccucccgaa

SEQ ID NO: 1017977 - RNA, 22 nt, Human
cccccucgccucccgaagccug

SEQ ID NO: 1017978 - RNA, 19 nt, Human
ccccgcccccucgccuccc

SEQ ID NO: 1017979 - RNA, 22 nt, Human
ccccgcccccucgccucccgaa

SEQ ID NO: 1017980 - RNA, 21 nt, Human
cccuaaagugccaagucaagc

SEQ ID NO: 1017981 - RNA, 18 nt, Human
ccucggcgcugcuccccc

SEQ ID NO: 1017982 - RNA, 22 nt, Human
ccucggcgcugcuccccccgcc

SEQ ID NO: 1017983 - RNA, 18 nt, Human
ccuucuaucuuuauucca

SEQ ID NO: 1017984 - RNA, 21 nt, Human
cgacuccaaaccauguuggca

SEQ ID NO: 1017985 - RNA, 25 nt, Human
cgcaaaacaaccuugggcaaccaca

SEQ ID NO: 1017986 - RNA, 23 nt, Human
cggcgcugcuccccccgcccccu

SEQ ID NO: 1017987 - RNA, 18 nt, Human
cggcggccucggcgcugc

SEQ ID NO: 1017988 - RNA, 22 nt, Human
cggcggccucggcgcugcuccc

SEQ ID NO: 1017989 - RNA, 22 nt, Human
cuaaucucucucucccagcccc

SEQ ID NO: 1017990 - RNA, 22 nt, Human
cuaccugucucucccaugaaag

SEQ ID NO: 1017991 - RNA, 20 nt, Human
cuccaaaaaaaaaaaaucag

SEQ ID NO: 1017992 - RNA, 25 nt, Human
cuccaaaaaaaaaaaaucagacuuc

SEQ ID NO: 1017993 - RNA, 20 nt, Human
cucccaguacucccacggcc

SEQ ID NO: 1017994 - RNA, 20 nt, Human
cuccccccgcccccucgccu

SEQ ID NO: 1017995 - RNA, 22 nt, Human
cucccgaagccugcggcucacc

SEQ ID NO: 1017996 - RNA, 19 nt, Human
cugcugcuucuuuuuuguc

SEQ ID NO: 1017997 - RNA, 23 nt, Human
cuuccaagcaagugagcaccauu

SEQ ID NO: 1017998 - RNA, 23 nt, Human
cuuuaagagcugcugcugcuucu

SEQ ID NO: 1017999 - RNA, 23 nt, Human
gaacaacccuccucacccucuca

SEQ ID NO: 1018000 - RNA, 21 nt, Human
gacucauagacuuuguuccuu

SEQ ID NO: 1018001 - RNA, 23 nt, Human
gagaugcugggaucaaagaaggg

SEQ ID NO: 1018002 - RNA, 19 nt, Human
gaggcauauggagcagaag

SEQ ID NO: 1018003 - RNA, 22 nt, Human
gaggcggaggcggcggccucgg

SEQ ID NO: 1018004 - RNA, 22 nt, Human
gcaaaacaaccuugggcaacca

SEQ ID NO: 1018005 - RNA, 24 nt, Human
gcaaaacaaccuugggcaaccaca

SEQ ID NO: 1018006 - RNA, 22 nt, Human
gcaagaaacaaaaagcaaggag

SEQ ID NO: 1018007 - RNA, 18 nt, Human
gccugcuuccaagcaagu

SEQ ID NO: 1018008 - RNA, 19 nt, Human
gcugucccaugccccaagu

SEQ ID NO: 1018009 - RNA, 22 nt, Human
ggaaacggcugagauaguuuaa

SEQ ID NO: 1018010 - RNA, 19 nt, Human
ggaaagcagggaaacggcu

SEQ ID NO: 1018011 - RNA, 24 nt, Human
ggaaagcauauucuacaucccuuc

SEQ ID NO: 1018012 - RNA, 21 nt, Human
ggaaauugugaugcccagaau

SEQ ID NO: 1018013 - RNA, 18 nt, Human
ggauuuagaagacaguaa

SEQ ID NO: 1018014 - RNA, 25 nt, Human
gggaaaaacacaaaaggagaaaaga

SEQ ID NO: 1018015 - RNA, 23 nt, Human
gggaaagcagggaaacggcugag

SEQ ID NO: 1018016 - RNA, 23 nt, Human
gggaauaaaggaagaggggauga

SEQ ID NO: 1018017 - RNA, 18 nt, Human
gggcagcaguagaggagg

SEQ ID NO: 1018018 - RNA, 21 nt, Human
gggcuuguccgucccccaccc

SEQ ID NO: 1018019 - RNA, 18 nt, Human
ggggauggggagguggag

SEQ ID NO: 1018020 - RNA, 21 nt, Human
gguaggagccagaaccauagg

SEQ ID NO: 1018021 - RNA, 21 nt, Human
guagagggcagcccccucccu

SEQ ID NO: 1018022 - RNA, 23 nt, Human
guggaggguguauguaugugugu

SEQ ID NO: 1018023 - RNA, 23 nt, Human
uaaaaaugcaguuugcuuuugug

SEQ ID NO: 1018024 - RNA, 20 nt, Human
uaaaagagcucccuggaagg

SEQ ID NO: 1018025 - RNA, 19 nt, Human
uaaauucucugaagcauau

SEQ ID NO: 1018026 - RNA, 26 nt, Human
uaacagcaguguccuucacuaacagg

SEQ ID NO: 1018027 - RNA, 23 nt, Human
uaagccauguuugugaaacacaa

SEQ ID NO: 1018028 - RNA, 23 nt, Human
uaaggaaucucagguuccacaac

SEQ ID NO: 1018029 - RNA, 18 nt, Human
uaaucuaaucucucucuc

SEQ ID NO: 1018030 - RNA, 22 nt, Human
uaaucuaaucucucucucccag

SEQ ID NO: 1018031 - RNA, 18 nt, Human
uacagguuggaaaggggg

SEQ ID NO: 1018032 - RNA, 19 nt, Human
uaccuagaauaagagaaaa

SEQ ID NO: 1018033 - RNA, 21 nt, Human
uacucccaguacucccacggc

SEQ ID NO: 1018034 - RNA, 21 nt, Human
uagaauaagagaaaacaaaga

SEQ ID NO: 1018035 - RNA, 21 nt, Human
uagauucugaacaacccuccu

SEQ ID NO: 1018036 - RNA, 21 nt, Human
uagcuguaucucaacuacagu

SEQ ID NO: 1018037 - RNA, 22 nt, Human
uagucaauauaccaaagucgac

SEQ ID NO: 1018038 - RNA, 26 nt, Human
uauagcaacaaagacuccaaaaaaag

SEQ ID NO: 1018039 - RNA, 18 nt, Human
uaugcagugggaagaguu

SEQ ID NO: 1018040 - RNA, 19 nt, Human
uaugguauuugaagauaag

SEQ ID NO: 1018041 - RNA, 18 nt, Human
uauguaugugugugcugu

SEQ ID NO: 1018042 - RNA, 19 nt, Human
uauguaugugugugcugug

SEQ ID NO: 1018043 - RNA, 19 nt, Human
uauuccauuuucuaucccc

SEQ ID NO: 1018044 - RNA, 24 nt, Human
ucaaagagcauacuaguuaccaug

SEQ ID NO: 1018045 - RNA, 20 nt, Human
ucacccucucaaaauucuua

SEQ ID NO: 1018046 - RNA, 25 nt, Human
ucacccucucaaaauucuuaaguuu

SEQ ID NO: 1018047 - RNA, 19 nt, Human
uccacaacacaaaaacaca

SEQ ID NO: 1018048 - RNA, 24 nt, Human
uccacaauggaaagagccgggguc

SEQ ID NO: 1018049 - RNA, 19 nt, Human
ucccaugaaaggagaaggg

SEQ ID NO: 1018050 - RNA, 25 nt, Human
ucgauucuagcuucugaggcacacu

SEQ ID NO: 1018051 - RNA, 22 nt, Human
ucuaugguauuugaagauaagu

SEQ ID NO: 1018052 - RNA, 18 nt, Human
ucucucucucccagcccc

SEQ ID NO: 1018053 - RNA, 21 nt, Human
ucucucucucccagccccaca

SEQ ID NO: 1018054 - RNA, 18 nt, Human
ucugccauuagccuggga

SEQ ID NO: 1018055 - RNA, 23 nt, Human
ucuucccuaaaaaggcuuccaaa

SEQ ID NO: 1018056 - RNA, 21 nt, Human
ugaaauguagaacuuuaagau

SEQ ID NO: 1018057 - RNA, 19 nt, Human
ugaccuuguacaaaaacac

SEQ ID NO: 1018058 - RNA, 23 nt, Human
ugacuaaccacugcaaaugaaau

SEQ ID NO: 1018059 - RNA, 21 nt, Human
ugagaauaacccucacuuuaa

SEQ ID NO: 1018060 - RNA, 25 nt, Human
ugagaauaacccucacuuuaagagc

SEQ ID NO: 1018061 - RNA, 26 nt, Human
ugagcugucccaugccccaagucuuc

SEQ ID NO: 1018062 - RNA, 21 nt, Human
ugaguacauuggaaaguggga

SEQ ID NO: 1018063 - RNA, 22 nt, Human
ugauaaagcaaagcaagaaaca

SEQ ID NO: 1018064 - RNA, 18 nt, Human
ugauacagagcccugucu

SEQ ID NO: 1018065 - RNA, 23 nt, Human
ugcccagaauuuuaggugaaagc

SEQ ID NO: 1018066 - RNA, 21 nt, Human
ugccuaaauucucugaagcau

SEQ ID NO: 1018067 - RNA, 19 nt, Human
ugcuagucuauaccucgau

SEQ ID NO: 1018068 - RNA, 25 nt, Human
uggaaugaacugauaaagcaaagca

SEQ ID NO: 1018069 - RNA, 21 nt, Human
ugggaaaaacacaaaaggaga

SEQ ID NO: 1018070 - RNA, 24 nt, Human
ugggcaaccacaaagaagagggau

SEQ ID NO: 1018071 - RNA, 18 nt, Human
uggggagguggagggugu

SEQ ID NO: 1018072 - RNA, 24 nt, Human
uguuacuaaaggggaaacagagca

SEQ ID NO: 1018073 - RNA, 23 nt, Human
uuacaacaggcaaaaaaggcuuu

SEQ ID NO: 1018074 - RNA, 18 nt, Human
uuacuccucuuuuuggga

SEQ ID NO: 1018075 - RNA, 20 nt, Human
uuaggugaaagccaaagcaa

SEQ ID NO: 1018076 - RNA, 20 nt, Human
uucacuaacagcaguguccu

SEQ ID NO: 1018077 - RNA, 25 nt, Human
uucuugaguacauuggaaaguggga

SEQ ID NO: 1018078 - RNA, 19 nt, Human
uuguaggugucucacucuc

SEQ ID NO: 1018079 - RNA, 20 nt, Human
uuucugacaauaaacaauga

SEQ ID NO: 1018080 - RNA, 25 nt, Human
uuucuuuaaaagccacuggagagcu

SEQ ID NO: 1018081 - RNA, 24 nt, Human
uuuuugggaaaaaagaauucuuug

SEQ ID NO: 1018082 - RNA, 24 nt, Human
uuuuuuuuguccuuuuuaacuuuu

SEQ ID NO: 1018083 - RNA, 21 nt, Human
aaacaaggcagaagcuacaaa

SEQ ID NO: 1018084 - RNA, 22 nt, Human
aaacagagauacuuuaagucca

SEQ ID NO: 1018085 - RNA, 20 nt, Human
aaaugcuugaaguuguuacu

SEQ ID NO: 1018086 - RNA, 20 nt, Human
aacaggcucagaacucucuc

SEQ ID NO: 1018087 - RNA, 21 nt, Human
aacucagagggaagucuucga

SEQ ID NO: 1018088 - RNA, 24 nt, Human
aagucagcagaaacggccugagca

SEQ ID NO: 1018089 - RNA, 21 nt, Human
acagggcaccacaguguacaa

SEQ ID NO: 1018090 - RNA, 20 nt, Human
acucccaccccaaccuuccu

SEQ ID NO: 1018091 - RNA, 26 nt, Human
acucccaccccaaccuuccuggaagg

SEQ ID NO: 1018092 - RNA, 26 nt, Human
agaaacacauaccauccagccccuga

SEQ ID NO: 1018093 - RNA, 27 nt, Human
agaaacacauaccauccagccccugaa

SEQ ID NO: 1018094 - RNA, 23 nt, Human
agcacucacucacucucccuagc

SEQ ID NO: 1018095 - RNA, 18 nt, Human
agcagcuggggauggggg

SEQ ID NO: 1018096 - RNA, 18 nt, Human
agcugcaaugcaaacuga

SEQ ID NO: 1018097 - RNA, 18 nt, Human
aggauagagaagggagag

SEQ ID NO: 1018098 - RNA, 21 nt, Human
aggcaaacggagccacucucu

SEQ ID NO: 1018099 - RNA, 21 nt, Human
agugaagacugaaugucaacu

SEQ ID NO: 1018100 - RNA, 21 nt, Human
auaaggcagcagaaacacaua

SEQ ID NO: 1018101 - RNA, 21 nt, Human
augaaggcucagaaaaagucu

SEQ ID NO: 1018102 - RNA, 18 nt, Human
caaacucagagcagcugg

SEQ ID NO: 1018103 - RNA, 22 nt, Human
caacucagagggaagucuucga

SEQ ID NO: 1018104 - RNA, 19 nt, Human
cacaacuuugccugucuuc

SEQ ID NO: 1018105 - RNA, 22 nt, Human
cacagcaucaccaaagcgggga

SEQ ID NO: 1018106 - RNA, 24 nt, Human
cacccagaagucagcacacauacu

SEQ ID NO: 1018107 - RNA, 20 nt, Human
cacccuggaguuuucuccgc

SEQ ID NO: 1018108 - RNA, 25 nt, Human
cacgacugauuacuuucaaucccag

SEQ ID NO: 1018109 - RNA, 21 nt, Human
cacucaaaacucccaccccaa

SEQ ID NO: 1018110 - RNA, 20 nt, Human
cacucacucacucucccuag

SEQ ID NO: 1018111 - RNA, 21 nt, Human
cagaaacacauaccauccagc

SEQ ID NO: 1018112 - RNA, 24 nt, Human
cagcagaaacacauaccauccagc

SEQ ID NO: 1018113 - RNA, 21 nt, Human
cagcugcaaugcaaacugaaa

SEQ ID NO: 1018114 - RNA, 23 nt, Human
caggaagguuucucuaaaauuaa

SEQ ID NO: 1018115 - RNA, 23 nt, Human
cauccagccccugaaccugaauu

SEQ ID NO: 1018116 - RNA, 20 nt, Human
cauccucuuucccacucaaa

SEQ ID NO: 1018117 - RNA, 23 nt, Human
ccaaaacagacaucaugcuaagg

SEQ ID NO: 1018118 - RNA, 20 nt, Human
ccaaagccauucaaacagcc

SEQ ID NO: 1018119 - RNA, 19 nt, Human
ccacucaaaacucccaccc

SEQ ID NO: 1018120 - RNA, 19 nt, Human
ccagccccugaaccugaau

SEQ ID NO: 1018121 - RNA, 20 nt, Human
ccagcugcaaugcaaacuga

SEQ ID NO: 1018122 - RNA, 22 nt, Human
cccaccccaaccuuccuggaag

SEQ ID NO: 1018123 - RNA, 20 nt, Human
cccacucaaaacucccaccc

SEQ ID NO: 1018124 - RNA, 23 nt, Human
cccagcugcaaugcaaacugaaa

SEQ ID NO: 1018125 - RNA, 23 nt, Human
ccucuuucccacucaaaacuccc

SEQ ID NO: 1018126 - RNA, 24 nt, Human
ccucuuucccacucaaaacuccca

SEQ ID NO: 1018127 - RNA, 23 nt, Human
ccuggaaggcagggcuaacagga

SEQ ID NO: 1018128 - RNA, 23 nt, Human
cggccugagcagugcccaagagc

SEQ ID NO: 1018129 - RNA, 20 nt, Human
cggcuaaacccugacaucuu

SEQ ID NO: 1018130 - RNA, 23 nt, Human
cgggccccgagucccagcccacc

SEQ ID NO: 1018131 - RNA, 19 nt, Human
cuaaacccugacaucagua

SEQ ID NO: 1018132 - RNA, 18 nt, Human
cuaaggucccucucccuu

SEQ ID NO: 1018133 - RNA, 22 nt, Human
cucaaaacucccaccccaaccu

SEQ ID NO: 1018134 - RNA, 23 nt, Human
cuuagcacggaugaaggcucaga

SEQ ID NO: 1018135 - RNA, 23 nt, Human
cuugaaguuguuacuuugcucau

SEQ ID NO: 1018136 - RNA, 19 nt, Human
gaaacaggauagagaaggg

SEQ ID NO: 1018137 - RNA, 21 nt, Human
gaaggcagggcuaacaggacc

SEQ ID NO: 1018138 - RNA, 24 nt, Human
gcaagucagcagaaacggccugag

SEQ ID NO: 1018139 - RNA, 21 nt, Human
gcacagcaucaccaaagcggg

SEQ ID NO: 1018140 - RNA, 20 nt, Human
gccccgagucccagcccacc

SEQ ID NO: 1018141 - RNA, 21 nt, Human
gccccgagucccagcccaccc

SEQ ID NO: 1018142 - RNA, 22 nt, Human
ggaauucuuuuacugugcgcuu

SEQ ID NO: 1018143 - RNA, 18 nt, Human
gggaugggggucucagcu

SEQ ID NO: 1018144 - RNA, 22 nt, Human
gguguugggguguagagaggaa

SEQ ID NO: 1018145 - RNA, 24 nt, Human
gucaacaaauauuuauugggcauu

SEQ ID NO: 1018146 - RNA, 18 nt, Human
uacaguuucuccugaauu

SEQ ID NO: 1018147 - RNA, 20 nt, Human
uagaaucaaaccaaaaacaa

SEQ ID NO: 1018148 - RNA, 19 nt, Human
uagauacgccgucaaacaa

SEQ ID NO: 1018149 - RNA, 24 nt, Human
uagcaaacaggcucagaacucucu

SEQ ID NO: 1018150 - RNA, 24 nt, Human
ucacucacucucccuagcaaacag

SEQ ID NO: 1018151 - RNA, 21 nt, Human
ucagcacacauacugcuggga

SEQ ID NO: 1018152 - RNA, 20 nt, Human
ucaucuccugagggcaauuc

SEQ ID NO: 1018153 - RNA, 19 nt, Human
uccaacuccuucuaugggu

SEQ ID NO: 1018154 - RNA, 22 nt, Human
uccaacuccuucuauggguuua

SEQ ID NO: 1018155 - RNA, 18 nt, Human
uccaagggugccagagca

SEQ ID NO: 1018156 - RNA, 22 nt, Human
uccagggcccccgaagccgcuc

SEQ ID NO: 1018157 - RNA, 22 nt, Human
ucccacucaaaacucccacccc

SEQ ID NO: 1018158 - RNA, 25 nt, Human
ucccacucaaaacucccaccccaac

SEQ ID NO: 1018159 - RNA, 23 nt, Human
ucccuagcaaacaggcucagaac

SEQ ID NO: 1018160 - RNA, 24 nt, Human
ucccuccaggaagguuucucuaaa

SEQ ID NO: 1018161 - RNA, 23 nt, Human
uccuagugucaguuuugaguuuc

SEQ ID NO: 1018162 - RNA, 24 nt, Human
uccucuuucccacucaaaacuccc

SEQ ID NO: 1018163 - RNA, 21 nt, Human
ucuggggcacccagaagucag

SEQ ID NO: 1018164 - RNA, 19 nt, Human
ugaauugacaaacugaacu

SEQ ID NO: 1018165 - RNA, 19 nt, Human
ugagauggcucucaucucc

SEQ ID NO: 1018166 - RNA, 18 nt, Human
ugcagcccaaacucagag

SEQ ID NO: 1018167 - RNA, 18 nt, Human
ugccagagcagucauagc

SEQ ID NO: 1018168 - RNA, 20 nt, Human
ugccagagcagucauagcac

SEQ ID NO: 1018169 - RNA, 27 nt, Human
uggaaggcagggcuaacaggaccuccu

SEQ ID NO: 1018170 - RNA, 20 nt, Human
uggccugauccaagggugcc

SEQ ID NO: 1018171 - RNA, 21 nt, Human
uggggaacacgaaaagauuuc

SEQ ID NO: 1018172 - RNA, 19 nt, Human
ugguggauugaauaaggca

SEQ ID NO: 1018173 - RNA, 19 nt, Human
uguagagaggaagugacuc

SEQ ID NO: 1018174 - RNA, 23 nt, Human
ugucuagauuuccaagcaugaag

SEQ ID NO: 1018175 - RNA, 23 nt, Human
uucccacucaaaacucccacccc

SEQ ID NO: 1018176 - RNA, 23 nt, Human
uugggguguagagaggaagugac

SEQ ID NO: 1018177 - RNA, 23 nt, Human
uuucuggggcacccagaagucag

SEQ ID NO: 1018178 - RNA, 19 nt, Human
acuccaggccuggccugca

SEQ ID NO: 1018179 - RNA, 19 nt, Human
agacccgggaggaaagcaa

SEQ ID NO: 1018180 - RNA, 26 nt, Human
agacccgggaggaaagcaagucaaga

SEQ ID NO: 1018181 - RNA, 21 nt, Human
aggggucggaggcuggagacc

SEQ ID NO: 1018182 - RNA, 24 nt, Human
auggggcgaggggucggaggcugg

SEQ ID NO: 1018183 - RNA, 20 nt, Human
caagacaaaugcuugaccca

SEQ ID NO: 1018184 - RNA, 22 nt, Human
caccacuacgcucucaccagcc

SEQ ID NO: 1018185 - RNA, 23 nt, Human
cagacaccucucauauucgcccc

SEQ ID NO: 1018186 - RNA, 24 nt, Human
cccgccucuccuccacagaaccca

SEQ ID NO: 1018187 - RNA, 22 nt, Human
cccucagccuccccauuacccc

SEQ ID NO: 1018188 - RNA, 21 nt, Human
ccugcagccacucugguggac

SEQ ID NO: 1018189 - RNA, 21 nt, Human
cgccccgaucucagauuccug

SEQ ID NO: 1018190 - RNA, 24 nt, Human
cggggacuccaggccuggccugca

SEQ ID NO: 1018191 - RNA, 18 nt, Human
cugccagcuccuucaugg

SEQ ID NO: 1018192 - RNA, 21 nt, Human
gaagaggugcccucagccucc

SEQ ID NO: 1018193 - RNA, 19 nt, Human
gauuccugcccacuguccc

SEQ ID NO: 1018194 - RNA, 19 nt, Human
gcccaguuuccacucuuaa

SEQ ID NO: 1018195 - RNA, 18 nt, Human
ggaaaggggcaugaguug

SEQ ID NO: 1018196 - RNA, 23 nt, Human
ggagacccgggaggaaagcaagu

SEQ ID NO: 1018197 - RNA, 21 nt, Human
ggaggcuggagacccgggagg

SEQ ID NO: 1018198 - RNA, 19 nt, Human
gggaaaggggcaugaguug

SEQ ID NO: 1018199 - RNA, 19 nt, Human
gggacuccaggccuggccu

SEQ ID NO: 1018200 - RNA, 21 nt, Human
gucaagacaaaugcuugaccc

SEQ ID NO: 1018201 - RNA, 23 nt, Human
ucaagacaaaugcuugacccacg

SEQ ID NO: 1018202 - RNA, 24 nt, Human
ucaagacaaaugcuugacccacgg

SEQ ID NO: 1018203 - RNA, 22 nt, Human
uccacagaacccacauccuagg

SEQ ID NO: 1018204 - RNA, 23 nt, Human
uccacucuuaacucccccagaca

SEQ ID NO: 1018205 - RNA, 21 nt, Human
uccaggccuggccugcagcca

SEQ ID NO: 1018206 - RNA, 19 nt, Human
uccugggaaaggggcauga

SEQ ID NO: 1018207 - RNA, 20 nt, Human
uccugggaaaggggcaugag

SEQ ID NO: 1018208 - RNA, 18 nt, Human
ucggaggcuggagacccg

SEQ ID NO: 1018209 - RNA, 22 nt, Human
ugaguugguaggaagucagguu

SEQ ID NO: 1018210 - RNA, 23 nt, Human
uuaccccgccucuccuccacaga

SEQ ID NO: 1018211 - RNA, 21 nt, Human
uucauggggcgaggggucgga

SEQ ID NO: 1018212 - RNA, 20 nt, Human
uuggcuuugggucugggguc

SEQ ID NO: 1018213 - RNA, 23 nt, Human
uuuauuuccaccugccagcuccu

SEQ ID NO: 1018214 - RNA, 18 nt, Human
aaaaagcaaacaaaaccu

SEQ ID NO: 1018215 - RNA, 25 nt, Human
aaaaauagggggggaagccgguacc

SEQ ID NO: 1018216 - RNA, 20 nt, Human
aacaaaguaacuuacaacua

SEQ ID NO: 1018217 - RNA, 21 nt, Human
aagcauacaucauuucaaagc

SEQ ID NO: 1018218 - RNA, 26 nt, Human
aauaaaaauaaugggaaaaaaucgga

SEQ ID NO: 1018219 - RNA, 21 nt, Human
aauaaugggaaaaaaucggaa

SEQ ID NO: 1018220 - RNA, 21 nt, Human
acuagagacaaaugcccacaa

SEQ ID NO: 1018221 - RNA, 22 nt, Human
agaaaguuauuuuuggccuugc

SEQ ID NO: 1018222 - RNA, 26 nt, Human
agagcaacugaagcacacauccugca

SEQ ID NO: 1018223 - RNA, 22 nt, Human
agaguaaucucacacacaccaa

SEQ ID NO: 1018224 - RNA, 19 nt, Human
agggggggaagcuagggca

SEQ ID NO: 1018225 - RNA, 20 nt, Human
auaucaaaauacacagagca

SEQ ID NO: 1018226 - RNA, 19 nt, Human
aucugggugauggggugug

SEQ ID NO: 1018227 - RNA, 24 nt, Human
caacaaaaugacaucuguguacca

SEQ ID NO: 1018228 - RNA, 24 nt, Human
caacuagugucaaaaagcaaacaa

SEQ ID NO: 1018229 - RNA, 22 nt, Human
cacaagaucugcagaaacauuc

SEQ ID NO: 1018230 - RNA, 18 nt, Human
cacagagcaacugaagca

SEQ ID NO: 1018231 - RNA, 21 nt, Human
cacuagagacaaaugcccaca

SEQ ID NO: 1018232 - RNA, 22 nt, Human
cagaggcuuuaaaacuguugca

SEQ ID NO: 1018233 - RNA, 20 nt, Human
cauauagaaaaacaaacucu

SEQ ID NO: 1018234 - RNA, 21 nt, Human
caucauuucaaagcaaaagua

SEQ ID NO: 1018235 - RNA, 26 nt, Human
cauuuuuauuaucaauuaugcagagg

SEQ ID NO: 1018236 - RNA, 18 nt, Human
cccacaagaucugcagaa

SEQ ID NO: 1018237 - RNA, 23 nt, Human
cggagcacauuuuuuuuuuuggg

SEQ ID NO: 1018238 - RNA, 23 nt, Human
cuaguuaauaaaagacacaaaaa

SEQ ID NO: 1018239 - RNA, 23 nt, Human
cucacacacaccaauaaggaacu

SEQ ID NO: 1018240 - RNA, 19 nt, Human
cucgucuucgccaguacuc

SEQ ID NO: 1018241 - RNA, 24 nt, Human
gagacaaaugcccacaagaucugc

SEQ ID NO: 1018242 - RNA, 19 nt, Human
ggugaugggguguguggag

SEQ ID NO: 1018243 - RNA, 21 nt, Human
gugaugggguguguggagaag

SEQ ID NO: 1018244 - RNA, 19 nt, Human
guguaccagagcauacaua

SEQ ID NO: 1018245 - RNA, 24 nt, Human
guugcuagaguaaucucacacaca

SEQ ID NO: 1018246 - RNA, 19 nt, Human
uaaaaacaagaaugucaug

SEQ ID NO: 1018247 - RNA, 25 nt, Human
uaaaaauaaugggaaaaaaucggaa

SEQ ID NO: 1018248 - RNA, 23 nt, Human
uaacacugaagauuuacagacac

SEQ ID NO: 1018249 - RNA, 21 nt, Human
uaauaaaagacacaaaaauaa

SEQ ID NO: 1018250 - RNA, 18 nt, Human
uacaaagaucuacguguu

SEQ ID NO: 1018251 - RNA, 23 nt, Human
uacacagagcaacugaagcacac

SEQ ID NO: 1018252 - RNA, 24 nt, Human
uacaucacugcuagaauauuuagc

SEQ ID NO: 1018253 - RNA, 19 nt, Human
uagaaaaacaaacucugca

SEQ ID NO: 1018254 - RNA, 27 nt, Human
uagaaaaacaaacucugcagucucacu

SEQ ID NO: 1018255 - RNA, 21 nt, Human
uagaaaaacuugguucuucca

SEQ ID NO: 1018256 - RNA, 24 nt, Human
uagggcaaccagaaaauaaaauaa

SEQ ID NO: 1018257 - RNA, 23 nt, Human
uauacacaagaaaaaaauauuca

SEQ ID NO: 1018258 - RNA, 22 nt, Human
uauacugcuaaugcacaacuaa

SEQ ID NO: 1018259 - RNA, 21 nt, Human
uaucaacaguaagauguaauu

SEQ ID NO: 1018260 - RNA, 23 nt, Human
uaugucaaaaagucaacuguaca

SEQ ID NO: 1018261 - RNA, 21 nt, Human
ucggagcacauuuuuuuuuuu

SEQ ID NO: 1018262 - RNA, 21 nt, Human
ucuuccaugaaauccuuuaaa

SEQ ID NO: 1018263 - RNA, 20 nt, Human
ugaaugaaaaacagccaaca

SEQ ID NO: 1018264 - RNA, 19 nt, Human
ugagcacucgaauggcagg

SEQ ID NO: 1018265 - RNA, 27 nt, Human
ugggugucuuuccauucaaauaauacc

SEQ ID NO: 1018266 - RNA, 19 nt, Human
ugucaaaaagcaaacaaaa

SEQ ID NO: 1018267 - RNA, 23 nt, Human
ugucaaaaagcaaacaaaaccuc

SEQ ID NO: 1018268 - RNA, 23 nt, Human
ugugaaaaaugcccuuuccacuu

SEQ ID NO: 1018269 - RNA, 22 nt, Human
uguguaccagagcauacauaua

SEQ ID NO: 1018270 - RNA, 19 nt, Human
uucacauauagaaaaacaa

SEQ ID NO: 1018271 - RNA, 26 nt, Human
uucauuuuuuguguauuucacuguag

SEQ ID NO: 1018272 - RNA, 21 nt, Human
uucuuccaugaaauccuuuaa

SEQ ID NO: 1018273 - RNA, 20 nt, Human
uuggccuugcuaugucaaaa

SEQ ID NO: 1018274 - RNA, 24 nt, Human
uuugaauaugauuuuacugaagca

SEQ ID NO: 1018275 - RNA, 23 nt, Human
aaaauacguacaaaguuagccca

SEQ ID NO: 1018276 - RNA, 18 nt, Human
aaacaaccccaaaauauu

SEQ ID NO: 1018277 - RNA, 18 nt, Human
aaagggacaaggaaaaaa

SEQ ID NO: 1018278 - RNA, 24 nt, Human
aaccgccacccccucacacaccuc

SEQ ID NO: 1018279 - RNA, 22 nt, Human
acaaggaaaaaaguuagacagc

SEQ ID NO: 1018280 - RNA, 23 nt, Human
acaccgaggggcuggaggcggcg

SEQ ID NO: 1018281 - RNA, 22 nt, Human
accccggggcucuccggggcac

SEQ ID NO: 1018282 - RNA, 21 nt, Human
acguucacccuuguccccccc

SEQ ID NO: 1018283 - RNA, 20 nt, Human
acucagagccagacagcgcc

SEQ ID NO: 1018284 - RNA, 24 nt, Human
agagcaaggccaaacaccuccgcc

SEQ ID NO: 1018285 - RNA, 24 nt, Human
agagcacauguuugcacacacagg

SEQ ID NO: 1018286 - RNA, 26 nt, Human
agcagauguaguugacacaugucccc

SEQ ID NO: 1018287 - RNA, 26 nt, Human
agccagacagcgccagcagugaaccc

SEQ ID NO: 1018288 - RNA, 22 nt, Human
aggaagucaauagagauucagg

SEQ ID NO: 1018289 - RNA, 20 nt, Human
aggggagggcggccggcugc

SEQ ID NO: 1018290 - RNA, 21 nt, Human
aggggcuggaggcggcgguga

SEQ ID NO: 1018291 - RNA, 24 nt, Human
aggggcuggaggcggcggugagcu

SEQ ID NO: 1018292 - RNA, 21 nt, Human
aggugguggugguucugaagc

SEQ ID NO: 1018293 - RNA, 19 nt, Human
agucagccguggaacucag

SEQ ID NO: 1018294 - RNA, 28 nt, Human
caaaguuagcccauucgacccccaacuc

SEQ ID NO: 1018295 - RNA, 23 nt, Human
caaggaaaaaaguuagacagcug

SEQ ID NO: 1018296 - RNA, 18 nt, Human
cacaccucucccccaaac

SEQ ID NO: 1018297 - RNA, 19 nt, Human
cacgcuccccggagcuccc

SEQ ID NO: 1018298 - RNA, 19 nt, Human
cagcagggcgcguuaggaa

SEQ ID NO: 1018299 - RNA, 20 nt, Human
cagugccccgcuuggcuagg

SEQ ID NO: 1018300 - RNA, 21 nt, Human
ccaaaaugggggaggggagaa

SEQ ID NO: 1018301 - RNA, 20 nt, Human
ccaaacaccuccgccgccau

SEQ ID NO: 1018302 - RNA, 23 nt, Human
ccaaccgccacccccucacacac

SEQ ID NO: 1018303 - RNA, 20 nt, Human
ccaccugacaguggggaggg

SEQ ID NO: 1018304 - RNA, 28 nt, Human
ccagagggguaggagcugagccccaagc

SEQ ID NO: 1018305 - RNA, 23 nt, Human
ccagcagugaacccgguggacag

SEQ ID NO: 1018306 - RNA, 21 nt, Human
ccagguuaucaggacuacagg

SEQ ID NO: 1018307 - RNA, 19 nt, Human
cccaaaauauuucccccuc

SEQ ID NO: 1018308 - RNA, 22 nt, Human
cccaaaauauuucccccucccc

SEQ ID NO: 1018309 - RNA, 20 nt, Human
ccccagacgcaggaguccau

SEQ ID NO: 1018310 - RNA, 22 nt, Human
ccccccagaacagaaaucccgc

SEQ ID NO: 1018311 - RNA, 22 nt, Human
ccccccagaacagaaaucccgc

SEQ ID NO: 1018312 - RNA, 22 nt, Human
ccccgccgcgccuugagcuaga

SEQ ID NO: 1018313 - RNA, 18 nt, Human
ccccggagcucccuguac

SEQ ID NO: 1018314 - RNA, 22 nt, Human
ccccucacacaccucuccccca

SEQ ID NO: 1018315 - RNA, 23 nt, Human
ccccucacacaccucucccccaa

SEQ ID NO: 1018316 - RNA, 24 nt, Human
cccgcacuauccucccuacacaca

SEQ ID NO: 1018317 - RNA, 21 nt, Human
cccugggccccggggggcagg

SEQ ID NO: 1018318 - RNA, 21 nt, Human
cccuguaccgggccgcuaaca

SEQ ID NO: 1018319 - RNA, 25 nt, Human
ccgccgccauugggccgaauugcug

SEQ ID NO: 1018320 - RNA, 18 nt, Human
ccugacaguggggagggg

SEQ ID NO: 1018321 - RNA, 19 nt, Human
ccugggccccggggggcag

SEQ ID NO: 1018322 - RNA, 20 nt, Human
ccuggguagcccauaggccc

SEQ ID NO: 1018323 - RNA, 18 nt, Human
ccuguccccaccaguccc

SEQ ID NO: 1018324 - RNA, 25 nt, Human
cgaaacaaauagcgcgcaugagaac

SEQ ID NO: 1018325 - RNA, 23 nt, Human
cgacccccaacuccuaaagaagg

SEQ ID NO: 1018326 - RNA, 25 nt, Human
cgcacuauccucccuacacacagcc

SEQ ID NO: 1018327 - RNA, 21 nt, Human
cgcccacccccuuggcuauua

SEQ ID NO: 1018328 - RNA, 21 nt, Human
cgcgcccacccccuuggcuau

SEQ ID NO: 1018329 - RNA, 21 nt, Human
cggcagaguagauguaagggg

SEQ ID NO: 1018330 - RNA, 21 nt, Human
cguucacccuuguccccccca

SEQ ID NO: 1018331 - RNA, 23 nt, Human
cuaaagcgaaagugaggguccac

SEQ ID NO: 1018332 - RNA, 18 nt, Human
cucacacuucccugcucc

SEQ ID NO: 1018333 - RNA, 19 nt, Human
cucucucucucucacacuu

SEQ ID NO: 1018334 - RNA, 20 nt, Human
cugaagcgccccagccauau

SEQ ID NO: 1018335 - RNA, 18 nt, Human
gaacucagagccagacag

SEQ ID NO: 1018336 - RNA, 20 nt, Human
gaacucagagccagacagcg

SEQ ID NO: 1018337 - RNA, 20 nt, Human
gcagucagccguggaacuca

SEQ ID NO: 1018338 - RNA, 21 nt, Human
gccaaacaccuccgccgccau

SEQ ID NO: 1018339 - RNA, 21 nt, Human
gcccccaaaaugggggagggg

SEQ ID NO: 1018340 - RNA, 23 nt, Human
gcgcaauuccaaagggacaagga

SEQ ID NO: 1018341 - RNA, 22 nt, Human
gcggcagaguagauguaagggg

SEQ ID NO: 1018342 - RNA, 25 nt, Human
gcuaaagcgaaagugaggguccagu

SEQ ID NO: 1018343 - RNA, 21 nt, Human
gcugcgcgcucuucccugggc

SEQ ID NO: 1018344 - RNA, 25 nt, Human
gcuggaggcggcggugagcuggggg

SEQ ID NO: 1018345 - RNA, 29 nt, Human
ggacggcugggggaggccuggggaggcuu

SEQ ID NO: 1018346 - RNA, 21 nt, Human
ggcggcggugagcugggggcc

SEQ ID NO: 1018347 - RNA, 23 nt, Human
gggaguggaggugacagaaauga

SEQ ID NO: 1018348 - RNA, 22 nt, Human
gggccagguuaucaggacuaca

SEQ ID NO: 1018349 - RNA, 20 nt, Human
ggggaguggaggugacagaa

SEQ ID NO: 1018350 - RNA, 21 nt, Human
ggggaguggaggugacagaaa

SEQ ID NO: 1018351 - RNA, 21 nt, Human
ggguaggagcugagccccaag

SEQ ID NO: 1018352 - RNA, 22 nt, Human
ggguggcgugggcugcgcgcuc

SEQ ID NO: 1018353 - RNA, 20 nt, Human
guaaaguuuuuuuuuuuuuc

SEQ ID NO: 1018354 - RNA, 18 nt, Human
gugaacccgguggacaga

SEQ ID NO: 1018355 - RNA, 21 nt, Human
guggaggugacagaaaugaug

SEQ ID NO: 1018356 - RNA, 22 nt, Human
guggggaggggaaaggaaaacc

SEQ ID NO: 1018357 - RNA, 21 nt, Human
gugguucugaagcgccccagc

SEQ ID NO: 1018358 - RNA, 22 nt, Human
guuuuuuuuuuuuucuuucuuu

SEQ ID NO: 1018359 - RNA, 19 nt, Human
uaaagcgaaagugaggguc

SEQ ID NO: 1018360 - RNA, 18 nt, Human
uaacuaaggagaguacaa

SEQ ID NO: 1018361 - RNA, 19 nt, Human
uacgacuuuggggaacaau

SEQ ID NO: 1018362 - RNA, 22 nt, Human
uagcagcagggcgcguuaggaa

SEQ ID NO: 1018363 - RNA, 19 nt, Human
uauccucccuacacacagc

SEQ ID NO: 1018364 - RNA, 21 nt, Human
uauccucccuacacacagccu

SEQ ID NO: 1018365 - RNA, 20 nt, Human
ucacacaccucucccccaaa

SEQ ID NO: 1018366 - RNA, 22 nt, Human
uccaaagggacaaggaaaaaag

SEQ ID NO: 1018367 - RNA, 23 nt, Human
uccagggaggaggagcgagaaaa

SEQ ID NO: 1018368 - RNA, 24 nt, Human
uccccaccaguccccuucucccgc

SEQ ID NO: 1018369 - RNA, 20 nt, Human
ucccccccagaacagaaauu

SEQ ID NO: 1018370 - RNA, 18 nt, Human
ucccuacacacagccucc

SEQ ID NO: 1018371 - RNA, 20 nt, Human
uccucguggaggcccgggac

SEQ ID NO: 1018372 - RNA, 19 nt, Human
ucucaguccaggugggcca

SEQ ID NO: 1018373 - RNA, 21 nt, Human
ucucccgcccccaaaaugggg

SEQ ID NO: 1018374 - RNA, 19 nt, Human
ucucucacacuucccugcu

SEQ ID NO: 1018375 - RNA, 20 nt, Human
ucucucucucucucacacuu

SEQ ID NO: 1018376 - RNA, 19 nt, Human
ucugcagucagccguggaa

SEQ ID NO: 1018377 - RNA, 20 nt, Human
ucugugauucuaagaauaga

SEQ ID NO: 1018378 - RNA, 21 nt, Human
ucuguggguugcuggggguuc

SEQ ID NO: 1018379 - RNA, 21 nt, Human
ucuuaugucuuuacgacuuug

SEQ ID NO: 1018380 - RNA, 18 nt, Human
ucuuucucuucuucuucc

SEQ ID NO: 1018381 - RNA, 18 nt, Human
ucuuucuuucucuucuuc

SEQ ID NO: 1018382 - RNA, 22 nt, Human
ucuuucuuucuuucucuucucc

SEQ ID NO: 1018383 - RNA, 24 nt, Human
ugacacauguccccauuucccuua

SEQ ID NO: 1018384 - RNA, 23 nt, Human
ugacagaaaugaugauguuggag

SEQ ID NO: 1018385 - RNA, 19 nt, Human
ugacaguggggaggggaaa

SEQ ID NO: 1018386 - RNA, 21 nt, Human
ugacaguggggaggggaaagg

SEQ ID NO: 1018387 - RNA, 20 nt, Human
ugagcugggggccauggugu

SEQ ID NO: 1018388 - RNA, 23 nt, Human
ugccgacccacgcuccccggagc

SEQ ID NO: 1018389 - RNA, 23 nt, Human
ugcuccaaccgccacccccucac

SEQ ID NO: 1018390 - RNA, 19 nt, Human
uggaagugugaaaacuuuu

SEQ ID NO: 1018391 - RNA, 20 nt, Human
uggaggcggcggugagcugg

SEQ ID NO: 1018392 - RNA, 22 nt, Human
uggaggcggcggugagcugggg

SEQ ID NO: 1018393 - RNA, 25 nt, Human
uggccuuggcucauggaaacaaccc

SEQ ID NO: 1018394 - RNA, 23 nt, Human
ugggccccggggggcaggcccag

SEQ ID NO: 1018395 - RNA, 24 nt, Human
ugggcugcgcgcucuucccugggc

SEQ ID NO: 1018396 - RNA, 23 nt, Human
ugggggaggggagaagauguugg

SEQ ID NO: 1018397 - RNA, 22 nt, Human
uggggguucugcuccagagggg

SEQ ID NO: 1018398 - RNA, 20 nt, Human
uggguugcuggggguucugc

SEQ ID NO: 1018399 - RNA, 24 nt, Human
uggugguucugaagcgccccagcc

SEQ ID NO: 1018400 - RNA, 19 nt, Human
uguaccgggccgcuaacac

SEQ ID NO: 1018401 - RNA, 22 nt, Human
ugugaaaacuuucuccuugcaa

SEQ ID NO: 1018402 - RNA, 19 nt, Human
uguucuggaagugugaaaa

SEQ ID NO: 1018403 - RNA, 22 nt, Human
uucuccuguccccaccaguccc

SEQ ID NO: 1018404 - RNA, 18 nt, Human
uucuuucuuucuuucucu

SEQ ID NO: 1018405 - RNA, 22 nt, Human
uugacacauguccccauuuccc

SEQ ID NO: 1018406 - RNA, 22 nt, Human
uugauuucuuaaacuuccaggg

SEQ ID NO: 1018407 - RNA, 21 nt, Human
uuggcucauggaaacaacccc

SEQ ID NO: 1018408 - RNA, 21 nt, Human
uuuuuuuuucuuucuuucuuu

SEQ ID NO: 1018409 - RNA, 21 nt, Human
aacuucuuuuguccuggccuc

SEQ ID NO: 1018410 - RNA, 21 nt, Human
agcgauuggcagagugaacac

SEQ ID NO: 1018411 - RNA, 21 nt, Human
cacaaucaggcccauagaccc

SEQ ID NO: 1018412 - RNA, 18 nt, Human
ccuccagcgauuggcaga

SEQ ID NO: 1018413 - RNA, 22 nt, Human
cgguggcaagucugagucacgg

SEQ ID NO: 1018414 - RNA, 19 nt, Human
cuuaacucugcuuauuccu

SEQ ID NO: 1018415 - RNA, 21 nt, Human
gaccgagauuuuggaaauggc

SEQ ID NO: 1018416 - RNA, 21 nt, Human
gccucggcugcucgauuggcu

SEQ ID NO: 1018417 - RNA, 23 nt, Human
ggcagagugaacaccacauuuga

SEQ ID NO: 1018418 - RNA, 26 nt, Human
uaggaugugguccaaggacucccacu

SEQ ID NO: 1018419 - RNA, 23 nt, Human
ucaggcccauagacccucacugg

SEQ ID NO: 1018420 - RNA, 18 nt, Human
uggcaagucugagucacg

SEQ ID NO: 1018421 - RNA, 24 nt, Human
uggcaguagccucggcugcucgau

SEQ ID NO: 1018422 - RNA, 22 nt, Human
ugguccaaggacucccacuuau

SEQ ID NO: 1018423 - RNA, 25 nt, Human
uguccuggccucuuaacucugcuua

SEQ ID NO: 1018424 - RNA, 20 nt, Human
ugucucagguuaggaugugg

SEQ ID NO: 1018425 - RNA, 18 nt, Human
uucccacucuauccucca

SEQ ID NO: 1018426 - RNA, 19 nt, Human
aaaaaauaaaauagagagg

SEQ ID NO: 1018427 - RNA, 20 nt, Human
aaaauaauagugacggagaa

SEQ ID NO: 1018428 - RNA, 20 nt, Human
aaauaaaaucaagaaacucg

SEQ ID NO: 1018429 - RNA, 23 nt, Human
aacacuauuucucuagggauacu

SEQ ID NO: 1018430 - RNA, 18 nt, Human
aagaaaauauuuucacac

SEQ ID NO: 1018431 - RNA, 22 nt, Human
aagaaacucgggcccaaugaac

SEQ ID NO: 1018432 - RNA, 22 nt, Human
aagccgacaaaauauaagaaac

SEQ ID NO: 1018433 - RNA, 22 nt, Human
aaggaacuguucuguaccgacu

SEQ ID NO: 1018434 - RNA, 21 nt, Human
aaguaacaaaguucauaaaga

SEQ ID NO: 1018435 - RNA, 24 nt, Human
aaucauggaauuuuagaccuggaa

SEQ ID NO: 1018436 - RNA, 21 nt, Human
acaaaauauaagaaacaaaga

SEQ ID NO: 1018437 - RNA, 20 nt, Human
acaccaagaagaaauuucaa

SEQ ID NO: 1018438 - RNA, 18 nt, Human
accaagaagaaauuucaa

SEQ ID NO: 1018439 - RNA, 21 nt, Human
acuacaaagggacagcauaag

SEQ ID NO: 1018440 - RNA, 19 nt, Human
acuagagucaaggauucca

SEQ ID NO: 1018441 - RNA, 22 nt, Human
agaacuauacaccaagaagaaa

SEQ ID NO: 1018442 - RNA, 24 nt, Human
agaaguucagaaagaaugauuaug

SEQ ID NO: 1018443 - RNA, 21 nt, Human
agaauauauaagagaggaaca

SEQ ID NO: 1018444 - RNA, 21 nt, Human
agauguuagagaacuauggcu

SEQ ID NO: 1018445 - RNA, 22 nt, Human
aggaacuuuuaaaacaguagaa

SEQ ID NO: 1018446 - RNA, 21 nt, Human
agucauuaugcugggugaaaa

SEQ ID NO: 1018447 - RNA, 19 nt, Human
agucuucuuuacgaaaagc

SEQ ID NO: 1018448 - RNA, 23 nt, Human
auaaaauagagaggaacuuuuaa

SEQ ID NO: 1018449 - RNA, 22 nt, Human
auagagaggaacuuuuaaaaca

SEQ ID NO: 1018450 - RNA, 24 nt, Human
aucaaacgagaccugcauucuuga

SEQ ID NO: 1018451 - RNA, 21 nt, Human
auuuuuuuagugccaucuguu

SEQ ID NO: 1018452 - RNA, 19 nt, Human
caaaugaccaagaucaaag

SEQ ID NO: 1018453 - RNA, 22 nt, Human
caaauggccaaucuuaggucaa

SEQ ID NO: 1018454 - RNA, 24 nt, Human
caagaacagcugguaaaaaguuaa

SEQ ID NO: 1018455 - RNA, 26 nt, Human
cacaaaauuauuaaauccgauuguau

SEQ ID NO: 1018456 - RNA, 26 nt, Human
caccaacaaauggccaaucuuagguc

SEQ ID NO: 1018457 - RNA, 18 nt, Human
cgaaaagcaguuccugug

SEQ ID NO: 1018458 - RNA, 23 nt, Human
cgacaaaauauaagaaacaaaga

SEQ ID NO: 1018459 - RNA, 18 nt, Human
cucagaacaccaucucaa

SEQ ID NO: 1018460 - RNA, 19 nt, Human
cucauuuuucacagcuuca

SEQ ID NO: 1018461 - RNA, 19 nt, Human
cugggugaaaaagcauuuc

SEQ ID NO: 1018462 - RNA, 21 nt, Human
gaaaaagauccacuaauuaga

SEQ ID NO: 1018463 - RNA, 19 nt, Human
gaacaccaucucaaauaug

SEQ ID NO: 1018464 - RNA, 28 nt, Human
gaacagcuucaaagaaagagggaacgcc

SEQ ID NO: 1018465 - RNA, 22 nt, Human
gccgacaaaauauaagaaacaa

SEQ ID NO: 1018466 - RNA, 21 nt, Human
gcugacuacaaagggacagca

SEQ ID NO: 1018467 - RNA, 24 nt, Human
ggugaaaaagcauuucaagaggga

SEQ ID NO: 1018468 - RNA, 21 nt, Human
guuaacacuuauaacaacgaa

SEQ ID NO: 1018469 - RNA, 22 nt, Human
uaaaaugaaaaguaucuuggug

SEQ ID NO: 1018470 - RNA, 30 nt, Human
uaaaaugacauggaugaaccucaaagucaa

SEQ ID NO: 1018471 - RNA, 24 nt, Human
uaagccgacaaaauauaagaaaca

SEQ ID NO: 1018472 - RNA, 24 nt, Human
uaagccgacaaaauauaagaaaca

SEQ ID NO: 1018473 - RNA, 24 nt, Human
uaauaaggcauggaaauaaaagua

SEQ ID NO: 1018474 - RNA, 22 nt, Human
uacaaaaucauggaauuuuaga

SEQ ID NO: 1018475 - RNA, 22 nt, Human
uacaacacuaauagcuacaccu

SEQ ID NO: 1018476 - RNA, 19 nt, Human
uagagcuagaaggagcuga

SEQ ID NO: 1018477 - RNA, 24 nt, Human
uagcaaugagcuaucacacuuucc

SEQ ID NO: 1018478 - RNA, 22 nt, Human
uauaaaaaaauucugcuauucc

SEQ ID NO: 1018479 - RNA, 23 nt, Human
uauaauaggaagcaaaaauaaga

SEQ ID NO: 1018480 - RNA, 18 nt, Human
uauauguaagguaugaga

SEQ ID NO: 1018481 - RNA, 23 nt, Human
uaucuugguguuuaguuuggaau

SEQ ID NO: 1018482 - RNA, 24 nt, Human
uauuuuuggaaauauaaaacucua

SEQ ID NO: 1018483 - RNA, 25 nt, Human
ucacacuuuccaguggaaaaagauc

SEQ ID NO: 1018484 - RNA, 18 nt, Human
ucuaaagugacuagaaac

SEQ ID NO: 1018485 - RNA, 21 nt, Human
ucucuugcuuuccccucuucu

SEQ ID NO: 1018486 - RNA, 18 nt, Human
ucuuaggucaaauggaag

SEQ ID NO: 1018487 - RNA, 27 nt, Human
ugaaaaaauacaacacuaauagcuaca

SEQ ID NO: 1018488 - RNA, 19 nt, Human
ugaaaaagcauuucaagag

SEQ ID NO: 1018489 - RNA, 21 nt, Human
ugagacagaaucccaucagcu

SEQ ID NO: 1018490 - RNA, 18 nt, Human
ugagacuuauauguaagg

SEQ ID NO: 1018491 - RNA, 21 nt, Human
ugcugggugaaaaagcauuuc

SEQ ID NO: 1018492 - RNA, 20 nt, Human
uggaaaaagauccacuaauu

SEQ ID NO: 1018493 - RNA, 20 nt, Human
uggaacuguuagaaguucag

SEQ ID NO: 1018494 - RNA, 23 nt, Human
uuaaaacaguagaacagauaucc

SEQ ID NO: 1018495 - RNA, 26 nt, Human
uuaacccuguauaaaaaaauucugcu

SEQ ID NO: 1018496 - RNA, 26 nt, Human
uucuguaccgacugcaguaguggugc

SEQ ID NO: 1018497 - RNA, 22 nt, Human
uuucacaccaacaaauggccaa

SEQ ID NO: 1018498 - RNA, 20 nt, Human
uuuggcauauuuuuggaaau

SEQ ID NO: 1018499 - RNA, 23 nt, Human
uuuuuggaaauauaaaacucuag

SEQ ID NO: 1018500 - RNA, 23 nt, Human
aaaaaaaaaaaaaauucaaagaa

SEQ ID NO: 1018501 - RNA, 23 nt, Human
aaaaaaaaaacccagaacacaaa

SEQ ID NO: 1018502 - RNA, 18 nt, Human
aaaaacccagaacacaaa

SEQ ID NO: 1018503 - RNA, 22 nt, Human
aaaacacagguaucuggaccca

SEQ ID NO: 1018504 - RNA, 24 nt, Human
aaacaaaacaauuacucaaaaaga

SEQ ID NO: 1018505 - RNA, 21 nt, Human
aacauaacauguggcaaccaa

SEQ ID NO: 1018506 - RNA, 21 nt, Human
aacaugagucaacaggaaaga

SEQ ID NO: 1018507 - RNA, 22 nt, Human
aaccaaucaaucugggucacaa

SEQ ID NO: 1018508 - RNA, 18 nt, Human
aagcagcuauccacagga

SEQ ID NO: 1018509 - RNA, 20 nt, Human
aauuuguugcucucuuccuc

SEQ ID NO: 1018510 - RNA, 24 nt, Human
acaaaacaauuacucaaaaagaua

SEQ ID NO: 1018511 - RNA, 24 nt, Human
acaggaaagacgcggcagccugug

SEQ ID NO: 1018512 - RNA, 20 nt, Human
accuucauuaggcacuacug

SEQ ID NO: 1018513 - RNA, 21 nt, Human
agaaagaagcuaaaguacuua

SEQ ID NO: 1018514 - RNA, 18 nt, Human
agauaaauaacgaagaga

SEQ ID NO: 1018515 - RNA, 23 nt, Human
agauauugacaggguucaaauaa

SEQ ID NO: 1018516 - RNA, 18 nt, Human
agaugaaauggcugcaga

SEQ ID NO: 1018517 - RNA, 20 nt, Human
agaugaaauggcugcagaaa

SEQ ID NO: 1018518 - RNA, 21 nt, Human
aggaacagagucaaaacacag

SEQ ID NO: 1018519 - RNA, 24 nt, Human
aggaucuaagacacuuaaaaauau

SEQ ID NO: 1018520 - RNA, 26 nt, Human
aggcaggaagcgcacaaaggggaccc

SEQ ID NO: 1018521 - RNA, 23 nt, Human
auauacguuacacaagugucauu

SEQ ID NO: 1018522 - RNA, 24 nt, Human
aucuggacccagccaccuagcguu

SEQ ID NO: 1018523 - RNA, 19 nt, Human
caacaaacauaacaugugg

SEQ ID NO: 1018524 - RNA, 21 nt, Human
cacaggggacccaagccaugu

SEQ ID NO: 1018525 - RNA, 21 nt, Human
caucucccgcgccucccaaac

SEQ ID NO: 1018526 - RNA, 23 nt, Human
caugagaaccacuucaacaaaca

SEQ ID NO: 1018527 - RNA, 24 nt, Human
caugagaaccacuucaacaaacau

SEQ ID NO: 1018528 - RNA, 21 nt, Human
caugccuacagcuucacaaga

SEQ ID NO: 1018529 - RNA, 22 nt, Human
ccaagcagcuauccacaggaac

SEQ ID NO: 1018530 - RNA, 22 nt, Human
cccagaacacaaauguguaaua

SEQ ID NO: 1018531 - RNA, 24 nt, Human
ccuccaaaaaaaaaaaaaauucaa

SEQ ID NO: 1018532 - RNA, 22 nt, Human
ccucgggcacgaacagccgccu

SEQ ID NO: 1018533 - RNA, 21 nt, Human
ccuucauuaggcacuacugug

SEQ ID NO: 1018534 - RNA, 19 nt, Human
cuauccacaggaacagagu

SEQ ID NO: 1018535 - RNA, 25 nt, Human
cuggaggaaccaaacaugagucaac

SEQ ID NO: 1018536 - RNA, 18 nt, Human
cugggucacaaaaagcca

SEQ ID NO: 1018537 - RNA, 24 nt, Human
cuguggaaucugcacauucggucu

SEQ ID NO: 1018538 - RNA, 22 nt, Human
gaccaagcagcuauccacagga

SEQ ID NO: 1018539 - RNA, 22 nt, Human
gagaaccacuucaacaaacaua

SEQ ID NO: 1018540 - RNA, 24 nt, Human
gcaugagaaccacuucaacaaaca

SEQ ID NO: 1018541 - RNA, 19 nt, Human
gcgcccggcggcgccacca

SEQ ID NO: 1018542 - RNA, 23 nt, Human
ggggacccaagccauguugcuac

SEQ ID NO: 1018543 - RNA, 18 nt, Human
uaacgaagagaauuaagu

SEQ ID NO: 1018544 - RNA, 23 nt, Human
uaggguuuucucaaucugauuac

SEQ ID NO: 1018545 - RNA, 22 nt, Human
ucagaccaagcagcuauccaca

SEQ ID NO: 1018546 - RNA, 22 nt, Human
uccaagaaggacggaagaucaa

SEQ ID NO: 1018547 - RNA, 24 nt, Human
uccaagaaggacggaagaucaaga

SEQ ID NO: 1018548 - RNA, 18 nt, Human
uccacaggaacagaguca

SEQ ID NO: 1018549 - RNA, 19 nt, Human
ucccucuuccucucgccag

SEQ ID NO: 1018550 - RNA, 20 nt, Human
uccuccaaaaaaaaaaaaaa

SEQ ID NO: 1018551 - RNA, 23 nt, Human
uccuccuccaaaaaaaaaaaaaa

SEQ ID NO: 1018552 - RNA, 22 nt, Human
ucucaaccuucauuaggcacua

SEQ ID NO: 1018553 - RNA, 18 nt, Human
ucucccgcgccucccaaa

SEQ ID NO: 1018554 - RNA, 19 nt, Human
ucucccgcgccucccaaaa

SEQ ID NO: 1018555 - RNA, 21 nt, Human
ucucugugguuugguaagggu

SEQ ID NO: 1018556 - RNA, 20 nt, Human
ugaaauggcugcagaaagaa

SEQ ID NO: 1018557 - RNA, 25 nt, Human
ugaaauggcugcagaaagaagcuaa

SEQ ID NO: 1018558 - RNA, 23 nt, Human
ugaguugguuaaaaaaaaaaaaa

SEQ ID NO: 1018559 - RNA, 25 nt, Human
ugaguugguuaaaaaaaaaaaaaaa

SEQ ID NO: 1018560 - RNA, 23 nt, Human
uggaauacucauaggguuuucuc

SEQ ID NO: 1018561 - RNA, 18 nt, Human
uggaaucugcacauucgg

SEQ ID NO: 1018562 - RNA, 20 nt, Human
uggcugcagaaagaagcuaa

SEQ ID NO: 1018563 - RNA, 19 nt, Human
uguggcaaccaaucaaucu

SEQ ID NO: 1018564 - RNA, 20 nt, Human
uuucccacaugcagacacug

SEQ ID NO: 1018565 - RNA, 22 nt, Human
aaaaacaaaaaaggcaaauggc

SEQ ID NO: 1018566 - RNA, 21 nt, Human
aaaacaaaaaaggcaaauggc

SEQ ID NO: 1018567 - RNA, 19 nt, Human
aaaguacugggauuacagg

SEQ ID NO: 1018568 - RNA, 25 nt, Human
aaaguacugggauuacaggcauuug

SEQ ID NO: 1018569 - RNA, 21 nt, Human
aaauagccuccaaauuagagg

SEQ ID NO: 1018570 - RNA, 20 nt, Human
aacauuugcugagugaguau

SEQ ID NO: 1018571 - RNA, 22 nt, Human
aacugaaugaacucucauaaaa

SEQ ID NO: 1018572 - RNA, 18 nt, Human
aagaaacaacccaaaaca

SEQ ID NO: 1018573 - RNA, 21 nt, Human
aaguacugggauuacaggcau

SEQ ID NO: 1018574 - RNA, 28 nt, Human
aaguacugggauuacaggcauuugagcc

SEQ ID NO: 1018575 - RNA, 20 nt, Human
acaggguuucaccauguugg

SEQ ID NO: 1018576 - RNA, 21 nt, Human
acaggguuucaccauguuggu

SEQ ID NO: 1018577 - RNA, 23 nt, Human
acaggguuucaccauguugguca

SEQ ID NO: 1018578 - RNA, 24 nt, Human
accauguuggucaugcuggucucg

SEQ ID NO: 1018579 - RNA, 18 nt, Human
acuccaucaggguuuuag

SEQ ID NO: 1018580 - RNA, 19 nt, Human
agucaagaaacaacccaaa

SEQ ID NO: 1018581 - RNA, 20 nt, Human
agugcaauggugcaauauug

SEQ ID NO: 1018582 - RNA, 24 nt, Human
agugcaauggugcaauauuggcuc

SEQ ID NO: 1018583 - RNA, 18 nt, Human
auuugcugagugaguaug

SEQ ID NO: 1018584 - RNA, 24 nt, Human
auuuuuguauuuuugguagagaca

SEQ ID NO: 1018585 - RNA, 28 nt, Human
caaaacacucacuuccuaucaaaagccc

SEQ ID NO: 1018586 - RNA, 25 nt, Human
caaaguacugggauuacaggcauuu

SEQ ID NO: 1018587 - RNA, 23 nt, Human
caaccucuaccucccagguucaa

SEQ ID NO: 1018588 - RNA, 22 nt, Human
caagcaauucuccugccucagc

SEQ ID NO: 1018589 - RNA, 24 nt, Human
caccauguuggucaugcuggucuc

SEQ ID NO: 1018590 - RNA, 24 nt, Human
caccucagccucccaaaguacugg

SEQ ID NO: 1018591 - RNA, 21 nt, Human
cacugcaaccucuaccuccca

SEQ ID NO: 1018592 - RNA, 22 nt, Human
caggguuucaccauguugguca

SEQ ID NO: 1018593 - RNA, 24 nt, Human
caggugaugcgcccaccccugaag

SEQ ID NO: 1018594 - RNA, 24 nt, Human
cagucaagaaacaacccaaaacac

SEQ ID NO: 1018595 - RNA, 22 nt, Human
caugcuggucucgaacuccuga

SEQ ID NO: 1018596 - RNA, 21 nt, Human
cauuucaacauggaauucugg

SEQ ID NO: 1018597 - RNA, 24 nt, Human
ccaaaguacugggauuacaggcau

SEQ ID NO: 1018598 - RNA, 24 nt, Human
ccaauucuuuccucgacuucucca

SEQ ID NO: 1018599 - RNA, 22 nt, Human
ccaccugauccuaucaggccaa

SEQ ID NO: 1018600 - RNA, 22 nt, Human
ccaggcaaccauaucuucccau

SEQ ID NO: 1018601 - RNA, 24 nt, Human
ccaucaggguuuuagcacauuugg

SEQ ID NO: 1018602 - RNA, 24 nt, Human
cccaaaguacugggauuacaggca

SEQ ID NO: 1018603 - RNA, 23 nt, Human
cccagguucaagcaauucuccug

SEQ ID NO: 1018604 - RNA, 22 nt, Human
ccccuacaccucuagagaaacc

SEQ ID NO: 1018605 - RNA, 23 nt, Human
cccggguagcugggauuacaggu

SEQ ID NO: 1018606 - RNA, 24 nt, Human
cccggguagcugggauuacaggug

SEQ ID NO: 1018607 - RNA, 19 nt, Human
cccucuacccgcuguauuc

SEQ ID NO: 1018608 - RNA, 20 nt, Human
ccgcuguauuccgcaucaua

SEQ ID NO: 1018609 - RNA, 23 nt, Human
ccggguagcugggauuacaggug

SEQ ID NO: 1018610 - RNA, 24 nt, Human
ccucccagguucaagcaauucucc

SEQ ID NO: 1018611 - RNA, 21 nt, Human
ccucgacuucuccaaaacuga

SEQ ID NO: 1018612 - RNA, 25 nt, Human
ccucuagagaaaccucuccacucau

SEQ ID NO: 1018613 - RNA, 24 nt, Human
ccugaccucaggugaugcgcccac

SEQ ID NO: 1018614 - RNA, 24 nt, Human
ccugccucagccucccggguagcu

SEQ ID NO: 1018615 - RNA, 24 nt, Human
cucacugcaaccucuaccucccag

SEQ ID NO: 1018616 - RNA, 24 nt, Human
cucacuuccuaucaaaagccccac

SEQ ID NO: 1018617 - RNA, 24 nt, Human
cucagccucccggguagcugggau

SEQ ID NO: 1018618 - RNA, 20 nt, Human
cugcaaccucuaccucccag

SEQ ID NO: 1018619 - RNA, 23 nt, Human
cugcaaccucuaccucccagguu

SEQ ID NO: 1018620 - RNA, 24 nt, Human
cugcaaccucuaccucccagguuc

SEQ ID NO: 1018621 - RNA, 26 nt, Human
gaaaccucuccacucaugaggcacuc

SEQ ID NO: 1018622 - RNA, 24 nt, Human
gaccucaggugaugcgcccaccuc

SEQ ID NO: 1018623 - RNA, 19 nt, Human
gaggccauuucaacaugga

SEQ ID NO: 1018624 - RNA, 20 nt, Human
gauuacaggcauuugagcca

SEQ ID NO: 1018625 - RNA, 21 nt, Human
gauuacaggugcccacaacua

SEQ ID NO: 1018626 - RNA, 22 nt, Human
gcaaccucuaccucccagguuc

SEQ ID NO: 1018627 - RNA, 23 nt, Human
gcagugaagaaaugccaagauac

SEQ ID NO: 1018628 - RNA, 24 nt, Human
gccccaccugauccuaucaggcca

SEQ ID NO: 1018629 - RNA, 18 nt, Human
gccuggcuaauuuuugua

SEQ ID NO: 1018630 - RNA, 21 nt, Human
gcucacugcaaccucuaccuc

SEQ ID NO: 1018631 - RNA, 23 nt, Human
gcuggucucgaacuccugaccuc

SEQ ID NO: 1018632 - RNA, 19 nt, Human
ggucucgaacuccugaccu

SEQ ID NO: 1018633 - RNA, 20 nt, Human
ggucucgaacuccugaccuc

SEQ ID NO: 1018634 - RNA, 24 nt, Human
ggugaugcgcccaccucagccucc

SEQ ID NO: 1018635 - RNA, 21 nt, Human
guagagacaggguuucaccau

SEQ ID NO: 1018636 - RNA, 22 nt, Human
guagagacaggguuucaccaug

SEQ ID NO: 1018637 - RNA, 18 nt, Human
guagcugggauuacaggu

SEQ ID NO: 1018638 - RNA, 21 nt, Human
gucaagaaacaacccaaaaca

SEQ ID NO: 1018639 - RNA, 24 nt, Human
gugaugcgcccaccucagccuccc

SEQ ID NO: 1018640 - RNA, 24 nt, Human
uaauuuuuguauuuuugguagaga

SEQ ID NO: 1018641 - RNA, 24 nt, Human
uacaggcauuugagccaccacgcc

SEQ ID NO: 1018642 - RNA, 22 nt, Human
uacugggauuacaggcauuuga

SEQ ID NO: 1018643 - RNA, 22 nt, Human
uagagacaggguuucaccaugu

SEQ ID NO: 1018644 - RNA, 18 nt, Human
uagaggccauuucaacau

SEQ ID NO: 1018645 - RNA, 25 nt, Human
uagccuccaaauuagaggccauuuc

SEQ ID NO: 1018646 - RNA, 26 nt, Human
ucaaaaauagccuccaaauuagaggc

SEQ ID NO: 1018647 - RNA, 21 nt, Human
ucaaaagccccaccugauccu

SEQ ID NO: 1018648 - RNA, 24 nt, Human
ucacugcaaccucuaccucccagg

SEQ ID NO: 1018649 - RNA, 25 nt, Human
ucacugcaaccucuaccucccaggu

SEQ ID NO: 1018650 - RNA, 26 nt, Human
ucacuuccuaucaaaagccccaccug

SEQ ID NO: 1018651 - RNA, 20 nt, Human
ucagccucccggguagcugg

SEQ ID NO: 1018652 - RNA, 24 nt, Human
uccagucaagaaacaacccaaaac

SEQ ID NO: 1018653 - RNA, 24 nt, Human
ucccaaaguacugggauuacaggc

SEQ ID NO: 1018654 - RNA, 21 nt, Human
ucccagguucaagcaauucuc

SEQ ID NO: 1018655 - RNA, 24 nt, Human
ucccagguucaagcaauucuccug

SEQ ID NO: 1018656 - RNA, 30 nt, Human
uccccuacaccucuagagaaaccucuccac

SEQ ID NO: 1018657 - RNA, 23 nt, Human
ucccggguagcugggauuacagg

SEQ ID NO: 1018658 - RNA, 24 nt, Human
ucccggguagcugggauuacaggu

SEQ ID NO: 1018659 - RNA, 19 nt, Human
ucgacuucuccaaaacuga

SEQ ID NO: 1018660 - RNA, 22 nt, Human
ucgcuaccuucaaaaauagccu

SEQ ID NO: 1018661 - RNA, 24 nt, Human
ucuccugccucagccucccgggua

SEQ ID NO: 1018662 - RNA, 19 nt, Human
ucucgaacuccugaccuca

SEQ ID NO: 1018663 - RNA, 22 nt, Human
ucugaaagggacugaaaaugaa

SEQ ID NO: 1018664 - RNA, 22 nt, Human
ucugaugccuguggucuuuucu

SEQ ID NO: 1018665 - RNA, 24 nt, Human
ucuggcauaaauuagcaaguugau

SEQ ID NO: 1018666 - RNA, 23 nt, Human
ugaaaagcuacacuaaugacuaa

SEQ ID NO: 1018667 - RNA, 23 nt, Human
ugaaaaggcguguauacugaaaa

SEQ ID NO: 1018668 - RNA, 21 nt, Human
ugaaagcuuaauuuucaaauc

SEQ ID NO: 1018669 - RNA, 24 nt, Human
ugaaagggacugaaaaugaaaagg

SEQ ID NO: 1018670 - RNA, 25 nt, Human
ugaaagggacugaaaaugaaaaggc

SEQ ID NO: 1018671 - RNA, 18 nt, Human
ugaccucaggugaugcgc

SEQ ID NO: 1018672 - RNA, 19 nt, Human
ugagugaguaugccgaaug

SEQ ID NO: 1018673 - RNA, 22 nt, Human
ugauugauuucugaugccugug

SEQ ID NO: 1018674 - RNA, 19 nt, Human
ugcccaggcaggagugcaa

SEQ ID NO: 1018675 - RNA, 24 nt, Human
ugccucagccucccggguagcugg

SEQ ID NO: 1018676 - RNA, 21 nt, Human
uggaauaaaacuccaucaggg

SEQ ID NO: 1018677 - RNA, 22 nt, Human
uggaauucuggggugacaauuc

SEQ ID NO: 1018678 - RNA, 19 nt, Human
ugggaaggcagaucuccag

SEQ ID NO: 1018679 - RNA, 18 nt, Human
ugggauuacaggcauuug

SEQ ID NO: 1018680 - RNA, 23 nt, Human
ugggauuacaggcauuugagcca

SEQ ID NO: 1018681 - RNA, 24 nt, Human
ugggauuacaggcauuugagccac

SEQ ID NO: 1018682 - RNA, 26 nt, Human
ugggauuacaggcauuugagccacca

SEQ ID NO: 1018683 - RNA, 20 nt, Human
ugggauuacaggugcccaca

SEQ ID NO: 1018684 - RNA, 24 nt, Human
ugggauuacaggugcccacaacua

SEQ ID NO: 1018685 - RNA, 23 nt, Human
ugguagagacaggguuucaccau

SEQ ID NO: 1018686 - RNA, 24 nt, Human
ugguagagacaggguuucaccaug

SEQ ID NO: 1018687 - RNA, 24 nt, Human
uggucaugcuggucucgaacuccu

SEQ ID NO: 1018688 - RNA, 21 nt, Human
uucaagcaauucuccugccuc

SEQ ID NO: 1018689 - RNA, 24 nt, Human
uucaagcaauucuccugccucagc

SEQ ID NO: 1018690 - RNA, 20 nt, Human
uuccaggcaaccauaucuuc

SEQ ID NO: 1018691 - RNA, 22 nt, Human
uuccucgacuucuccaaaacug

SEQ ID NO: 1018692 - RNA, 22 nt, Human
uucuuuccucgacuucuccaaa

SEQ ID NO: 1018693 - RNA, 18 nt, Human
uugcccaggcaggagugc

SEQ ID NO: 1018694 - RNA, 24 nt, Human
uugguagagacaggguuucaccau

SEQ ID NO: 1018695 - RNA, 23 nt, Human
uuguugcccaggcaggagugcaa

SEQ ID NO: 1018696 - RNA, 20 nt, Human
uuuugcucuuguugcccagg

SEQ ID NO: 1018697 - RNA, 24 nt, Human
uuuugcucuuguugcccaggcagg

SEQ ID NO: 1018698 - RNA, 22 nt, Human
uuuuugguagagacaggguuuc

SEQ ID NO: 1018699 - RNA, 24 nt, Human
uuuuugguagagacaggguuucac

SEQ ID NO: 1018700 - RNA, 20 nt, Human
uuuuuguauuuuugguagag

SEQ ID NO: 1018701 - RNA, 25 nt, Human
aaacaagagagugaaauaaauagag

SEQ ID NO: 1018702 - RNA, 21 nt, Human
aaggggaccgagggugcaggg

SEQ ID NO: 1018703 - RNA, 21 nt, Human
acaagaaagccgucucuaccc

SEQ ID NO: 1018704 - RNA, 21 nt, Human
acuccacccuccaugccccag

SEQ ID NO: 1018705 - RNA, 22 nt, Human
agacagggaggagacugacuga

SEQ ID NO: 1018706 - RNA, 18 nt, Human
agcacagcuccugcccag

SEQ ID NO: 1018707 - RNA, 22 nt, Human
agccagcguggcggccagggca

SEQ ID NO: 1018708 - RNA, 18 nt, Human
aggccucugcaccuccag

SEQ ID NO: 1018709 - RNA, 23 nt, Human
aguggagagggccggaggggagg

SEQ ID NO: 1018710 - RNA, 23 nt, Human
auggcaaacagacagaggccagg

SEQ ID NO: 1018711 - RNA, 19 nt, Human
auggggacagagggguugg

SEQ ID NO: 1018712 - RNA, 26 nt, Human
augggggagcaggagcucaaggggag

SEQ ID NO: 1018713 - RNA, 22 nt, Human
caaacagacagaggccaggccu

SEQ ID NO: 1018714 - RNA, 20 nt, Human
cacccuuucucccagcacag

SEQ ID NO: 1018715 - RNA, 20 nt, Human
cagcgaggcugggagucccc

SEQ ID NO: 1018716 - RNA, 23 nt, Human
cagggcacagggggaaaccccga

SEQ ID NO: 1018717 - RNA, 19 nt, Human
ccacuccacccuccaugcc

SEQ ID NO: 1018718 - RNA, 21 nt, Human
ccacuccacccuccaugcccc

SEQ ID NO: 1018719 - RNA, 24 nt, Human
ccauggcaaacagacagaggccag

SEQ ID NO: 1018720 - RNA, 22 nt, Human
cccacuccacccuccaugcccc

SEQ ID NO: 1018721 - RNA, 19 nt, Human
cccgaggcccacuccaccc

SEQ ID NO: 1018722 - RNA, 28 nt, Human
cccggcccuacaccccagccagcguggc

SEQ ID NO: 1018723 - RNA, 21 nt, Human
cccuggcugugcugcccucug

SEQ ID NO: 1018724 - RNA, 19 nt, Human
ccggcccuggcugugcugc

SEQ ID NO: 1018725 - RNA, 20 nt, Human
cucugcaccuccagcgaggc

SEQ ID NO: 1018726 - RNA, 25 nt, Human
gaaaccccgaggccauccucggggg

SEQ ID NO: 1018727 - RNA, 24 nt, Human
gaaagcagcucugauaccaggagc

SEQ ID NO: 1018728 - RNA, 18 nt, Human
gaaccuggaaggggaccg

SEQ ID NO: 1018729 - RNA, 18 nt, Human
gaaccuggaaggggaccg

SEQ ID NO: 1018730 - RNA, 19 nt, Human
gaggaugggggauggggga

SEQ ID NO: 1018731 - RNA, 23 nt, Human
gcccacuccacccuccaugcccc

SEQ ID NO: 1018732 - RNA, 19 nt, Human
gcccggcccuacaccccag

SEQ ID NO: 1018733 - RNA, 18 nt, Human
gcuuggggaaggcagccg

SEQ ID NO: 1018734 - RNA, 21 nt, Human
ggagagggccggaggggaggg

SEQ ID NO: 1018735 - RNA, 21 nt, Human
ggagagggccggaggggaggg

SEQ ID NO: 1018736 - RNA, 21 nt, Human
ggagggauuccuggggaaagg

SEQ ID NO: 1018737 - RNA, 25 nt, Human
ggaguccccucagccccaccugccc

SEQ ID NO: 1018738 - RNA, 19 nt, Human
ggcaaacagacagaggcca

SEQ ID NO: 1018739 - RNA, 19 nt, Human
ggccagggcagggccaggu

SEQ ID NO: 1018740 - RNA, 21 nt, Human
ggcugggaguccccucagccc

SEQ ID NO: 1018741 - RNA, 18 nt, Human
gggaaagaguggagacag

SEQ ID NO: 1018742 - RNA, 18 nt, Human
gggaaagggccguuagca

SEQ ID NO: 1018743 - RNA, 19 nt, Human
gggcagggccaggugggca

SEQ ID NO: 1018744 - RNA, 19 nt, Human
gggcgcugggagggcugcc

SEQ ID NO: 1018745 - RNA, 21 nt, Human
ggggaaggcagccguugggga

SEQ ID NO: 1018746 - RNA, 20 nt, Human
ggggagggauuccuggggaa

SEQ ID NO: 1018747 - RNA, 18 nt, Human
gugcugcccucuggaaag

SEQ ID NO: 1018748 - RNA, 21 nt, Human
uaccaggagcggcugucaggg

SEQ ID NO: 1018749 - RNA, 22 nt, Human
uacccaugggcgaccccauggg

SEQ ID NO: 1018750 - RNA, 22 nt, Human
ucccuaaagacacccggcccug

SEQ ID NO: 1018751 - RNA, 27 nt, Human
ucccuaaagacacccggcccuggcugu

SEQ ID NO: 1018752 - RNA, 18 nt, Human
ucucccagcacagcuccu

SEQ ID NO: 1018753 - RNA, 19 nt, Human
ugaaaggggcccaucccca

SEQ ID NO: 1018754 - RNA, 24 nt, Human
ugaaauaaauagagggaaagagug

SEQ ID NO: 1018755 - RNA, 21 nt, Human
ugcccggcccuacaccccagc

SEQ ID NO: 1018756 - RNA, 19 nt, Human
ugcccuaggaguguugggc

SEQ ID NO: 1018757 - RNA, 21 nt, Human
ugcugcccucuggaaagcagc

SEQ ID NO: 1018758 - RNA, 19 nt, Human
uggaaagcagcucugauac

SEQ ID NO: 1018759 - RNA, 23 nt, Human
uggaaagcagcucugauaccagg

SEQ ID NO: 1018760 - RNA, 27 nt, Human
uggaaagcagcucugauaccaggagcg

SEQ ID NO: 1018761 - RNA, 19 nt, Human
uggaaggggaccgagggug

SEQ ID NO: 1018762 - RNA, 23 nt, Human
uggaaggggaccgagggugcagg

SEQ ID NO: 1018763 - RNA, 22 nt, Human
uggagagggccggaggggaggg

SEQ ID NO: 1018764 - RNA, 19 nt, Human
uggcaaacagacagaggcc

SEQ ID NO: 1018765 - RNA, 18 nt, Human
ugggaggaugggggaugg

SEQ ID NO: 1018766 - RNA, 18 nt, Human
uggggacagagggguugg

SEQ ID NO: 1018767 - RNA, 19 nt, Human
ugucuggaaagcaguggag

SEQ ID NO: 1018768 - RNA, 20 nt, Human
uuagcaccaccaggcuccau

SEQ ID NO: 1018769 - RNA, 18 nt, Human
aaaaaaaccccacaaaac

SEQ ID NO: 1018770 - RNA, 28 nt, Human
aaaaaacaaaagaaacaaacaaacaaaa

SEQ ID NO: 1018771 - RNA, 19 nt, Human
aaaaaugaaaacucuucug

SEQ ID NO: 1018772 - RNA, 25 nt, Human
aaaacaaaagaaacaaacaaacaaa

SEQ ID NO: 1018773 - RNA, 19 nt, Human
aaaaccccacaaaacucaa

SEQ ID NO: 1018774 - RNA, 18 nt, Human
aaaacucuucugcccuug

SEQ ID NO: 1018775 - RNA, 19 nt, Human
aaacaaaaaaaccccacaa

SEQ ID NO: 1018776 - RNA, 20 nt, Human
aaacaaacaaaaaaacccca

SEQ ID NO: 1018777 - RNA, 24 nt, Human
aaacaaacaaaaaaaccccacaaa

SEQ ID NO: 1018778 - RNA, 25 nt, Human
aaacaaacaaaaaaaccccacaaaa

SEQ ID NO: 1018779 - RNA, 25 nt, Human
aaacauaugcccucaaacaccucac

SEQ ID NO: 1018780 - RNA, 23 nt, Human
aacaaacaaaaaaaccccacaaa

SEQ ID NO: 1018781 - RNA, 25 nt, Human
aaccccacaaaacucaaugauuuaa

SEQ ID NO: 1018782 - RNA, 23 nt, Human
acaaaagaaacaaacaaacaaaa

SEQ ID NO: 1018783 - RNA, 22 nt, Human
acaaacaaacaaaaaaacccca

SEQ ID NO: 1018784 - RNA, 28 nt, Human
acaaacaaacaaaaaaaccccacaaaac

SEQ ID NO: 1018785 - RNA, 21 nt, Human
accaggugaaaucauaacagc

SEQ ID NO: 1018786 - RNA, 20 nt, Human
acccgcccccaucccucccu

SEQ ID NO: 1018787 - RNA, 19 nt, Human
acgugggaaaaaaagauaa

SEQ ID NO: 1018788 - RNA, 20 nt, Human
agauaaaacuaugccuuuaa

SEQ ID NO: 1018789 - RNA, 20 nt, Human
agauaccaaaggcguacagu

SEQ ID NO: 1018790 - RNA, 22 nt, Human
aggaaggaaaggcaguuaucag

SEQ ID NO: 1018791 - RNA, 19 nt, Human
auacccgcccccaucccuc

SEQ ID NO: 1018792 - RNA, 19 nt, Human
augaaugagaagaagcuac

SEQ ID NO: 1018793 - RNA, 20 nt, Human
augugaagacaucacccaaa

SEQ ID NO: 1018794 - RNA, 24 nt, Human
caaacaaaaaaaccccacaaaacu

SEQ ID NO: 1018795 - RNA, 22 nt, Human
caaacaaacaaaaaaaccccac

SEQ ID NO: 1018796 - RNA, 24 nt, Human
caaacaaacaaaaaaaccccacaa

SEQ ID NO: 1018797 - RNA, 23 nt, Human
caaacaccucacaugcagauucc

SEQ ID NO: 1018798 - RNA, 20 nt, Human
caaacauaugcccucaaaca

SEQ ID NO: 1018799 - RNA, 26 nt, Human
caaauaauuuuacaacuugaugguaa

SEQ ID NO: 1018800 - RNA, 24 nt, Human
caagaaagggaagaaagaaauuaa

SEQ ID NO: 1018801 - RNA, 18 nt, Human
cacuguguagcaagaaag

SEQ ID NO: 1018802 - RNA, 22 nt, Human
cacuuuggaauaaaugcccaga

SEQ ID NO: 1018803 - RNA, 20 nt, Human
cagaaaggauuccuguggug

SEQ ID NO: 1018804 - RNA, 23 nt, Human
cagugagugagagcucuaggcac

SEQ ID NO: 1018805 - RNA, 23 nt, Human
cauauagcuuuaaaaacuggaaa

SEQ ID NO: 1018806 - RNA, 18 nt, Human
cccaaaugucagcggagc

SEQ ID NO: 1018807 - RNA, 25 nt, Human
cccuacgccgauacccgcccccauc

SEQ ID NO: 1018808 - RNA, 24 nt, Human
ccuuaccaacuauuaccuuucuua

SEQ ID NO: 1018809 - RNA, 18 nt, Human
cgagggccccuacgccga

SEQ ID NO: 1018810 - RNA, 26 nt, Human
cugcuccucuuuagccuuaggugaca

SEQ ID NO: 1018811 - RNA, 19 nt, Human
cuguggugaugcucccucu

SEQ ID NO: 1018812 - RNA, 19 nt, Human
gacauauuaaauguauuua

SEQ ID NO: 1018813 - RNA, 20 nt, Human
ggcuccuucagcgugcaccg

SEQ ID NO: 1018814 - RNA, 18 nt, Human
uaaaaaugaaaacucuuc

SEQ ID NO: 1018815 - RNA, 20 nt, Human
uaacagcaugaaaguaagac

SEQ ID NO: 1018816 - RNA, 21 nt, Human
uacccgcccccaucccucccu

SEQ ID NO: 1018817 - RNA, 20 nt, Human
uacgccgauacccgccccca

SEQ ID NO: 1018818 - RNA, 19 nt, Human
uagcaagaaagggaagaaa

SEQ ID NO: 1018819 - RNA, 23 nt, Human
uagcaagaaagggaagaaagaaa

SEQ ID NO: 1018820 - RNA, 24 nt, Human
uagccuuaggaaaauaaauaaugc

SEQ ID NO: 1018821 - RNA, 22 nt, Human
uaggaaaauaaauaaugcagua

SEQ ID NO: 1018822 - RNA, 22 nt, Human
uaucuaccacgugggaaaaaaa

SEQ ID NO: 1018823 - RNA, 23 nt, Human
uaugaagcagugaaacauauagc

SEQ ID NO: 1018824 - RNA, 22 nt, Human
uauuucauccuuaugucgcuua

SEQ ID NO: 1018825 - RNA, 18 nt, Human
ucaagaacuguaauuuuc

SEQ ID NO: 1018826 - RNA, 21 nt, Human
ucccuguaaugucacagagau

SEQ ID NO: 1018827 - RNA, 21 nt, Human
ucgucuuuccuguucugccac

SEQ ID NO: 1018828 - RNA, 24 nt, Human
ugaaacauauagcuuuaaaaacug

SEQ ID NO: 1018829 - RNA, 18 nt, Human
ugaaaguaagaccagauu

SEQ ID NO: 1018830 - RNA, 18 nt, Human
ugaaaucauaacagcaug

SEQ ID NO: 1018831 - RNA, 19 nt, Human
ugaucacuguguagcaaga

SEQ ID NO: 1018832 - RNA, 21 nt, Human
ugccacaccgacacucguccc

SEQ ID NO: 1018833 - RNA, 25 nt, Human
ugcucccucuuucaaacauaugccc

SEQ ID NO: 1018834 - RNA, 19 nt, Human
uggaauaaaugcccagaag

SEQ ID NO: 1018835 - RNA, 21 nt, Human
uggaauaaaugcccagaaggu

SEQ ID NO: 1018836 - RNA, 20 nt, Human
uggugaugcucccucuuucc

SEQ ID NO: 1018837 - RNA, 20 nt, Human
ugucacagcaauauccguuc

SEQ ID NO: 1018838 - RNA, 19 nt, Human
uguggugaugcucccucuu

SEQ ID NO: 1018839 - RNA, 21 nt, Human
uguucugccacuuuuaacaua

SEQ ID NO: 1018840 - RNA, 18 nt, Human
uuaaaacacugauucacc

SEQ ID NO: 1018841 - RNA, 27 nt, Human
uuuaaauaacauuggccuuaccaacua

SEQ ID NO: 1018842 - RNA, 20 nt, Human
uuuagccuuaggaaaauaaa

SEQ ID NO: 1018843 - RNA, 23 nt, Human
uuuccaaaaaacaaaagaaacaa

SEQ ID NO: 1018844 - RNA, 20 nt, Human
aaaacaaugggaaauuugca

SEQ ID NO: 1018845 - RNA, 21 nt, Human
aaaagcaauugcaccaaccua

SEQ ID NO: 1018846 - RNA, 22 nt, Human
aaacagaagaaaagccaacugg

SEQ ID NO: 1018847 - RNA, 22 nt, Human
aaauaaaucacagaaucucuau

SEQ ID NO: 1018848 - RNA, 20 nt, Human
aaauucaguacagucauuua

SEQ ID NO: 1018849 - RNA, 19 nt, Human
aagaaucacagaucuaaag

SEQ ID NO: 1018850 - RNA, 18 nt, Human
aagcaucccugacuuaaa

SEQ ID NO: 1018851 - RNA, 23 nt, Human
aagccauuuuuaaaguaaacugg

SEQ ID NO: 1018852 - RNA, 23 nt, Human
aaguaaacugggagaggcaacuu

SEQ ID NO: 1018853 - RNA, 18 nt, Human
aaucacagaucuaaagca

SEQ ID NO: 1018854 - RNA, 22 nt, Human
acugcaguuuuucaaccaaauu

SEQ ID NO: 1018855 - RNA, 20 nt, Human
agaaaagccaacuggugcag

SEQ ID NO: 1018856 - RNA, 19 nt, Human
agacaaaauguuuggaaac

SEQ ID NO: 1018857 - RNA, 24 nt, Human
aggaggugggauuuaaaaaucaaa

SEQ ID NO: 1018858 - RNA, 19 nt, Human
aggggauaaaauaaauagu

SEQ ID NO: 1018859 - RNA, 21 nt, Human
aguucaguguacaagagaugu

SEQ ID NO: 1018860 - RNA, 21 nt, Human
auaaaaagacacaauuccaaa

SEQ ID NO: 1018861 - RNA, 22 nt, Human
auaaagcaucccugacuuaaaa

SEQ ID NO: 1018862 - RNA, 24 nt, Human
auagaacccauuggccagacaaaa

SEQ ID NO: 1018863 - RNA, 18 nt, Human
auagaauaaagcaucccu

SEQ ID NO: 1018864 - RNA, 25 nt, Human
auggaacauaaaaagacacaauucc

SEQ ID NO: 1018865 - RNA, 24 nt, Human
caacaucuuuuauuuacauguuua

SEQ ID NO: 1018866 - RNA, 21 nt, Human
caccguagggagaaacggcug

SEQ ID NO: 1018867 - RNA, 20 nt, Human
cauaaaaagacacaauucca

SEQ ID NO: 1018868 - RNA, 24 nt, Human
cauaagugcuuuaaaauagaauaa

SEQ ID NO: 1018869 - RNA, 22 nt, Human
cauuuuuaaaguaaacugggag

SEQ ID NO: 1018870 - RNA, 21 nt, Human
ccaagcagacagucacacaga

SEQ ID NO: 1018871 - RNA, 20 nt, Human
cucauggucaauuuacuugc

SEQ ID NO: 1018872 - RNA, 21 nt, Human
cuccaagcagacagucacaca

SEQ ID NO: 1018873 - RNA, 19 nt, Human
cugaaaacauaccaaaucu

SEQ ID NO: 1018874 - RNA, 22 nt, Human
cuugaggaggugggauuuaaaa

SEQ ID NO: 1018875 - RNA, 19 nt, Human
gaagaaaagccaacuggug

SEQ ID NO: 1018876 - RNA, 19 nt, Human
gccacacagcuguuaaaac

SEQ ID NO: 1018877 - RNA, 24 nt, Human
ggcaacuuaguaauauauguacau

SEQ ID NO: 1018878 - RNA, 21 nt, Human
guaaucaauuucuucaaguau

SEQ ID NO: 1018879 - RNA, 18 nt, Human
gucaaaaugcaaaugaaa

SEQ ID NO: 1018880 - RNA, 20 nt, Human
guuaccaaacagcccagaac

SEQ ID NO: 1018881 - RNA, 24 nt, Human
uaaaaaacguaauauaccuaugca

SEQ ID NO: 1018882 - RNA, 21 nt, Human
uaaaaaucaaacauaugaauu

SEQ ID NO: 1018883 - RNA, 19 nt, Human
uaaaacagaagaaaagcca

SEQ ID NO: 1018884 - RNA, 24 nt, Human
uaaaaggggauaaaauaaauagua

SEQ ID NO: 1018885 - RNA, 22 nt, Human
uaaaauaaauaguaagucaaga

SEQ ID NO: 1018886 - RNA, 21 nt, Human
uaaacaugauacaaaagcuga

SEQ ID NO: 1018887 - RNA, 22 nt, Human
uaaaccacugccaucaaauauu

SEQ ID NO: 1018888 - RNA, 21 nt, Human
uaaagcaucccugacuuaaaa

SEQ ID NO: 1018889 - RNA, 20 nt, Human
uaaaguaaacugggagaggc

SEQ ID NO: 1018890 - RNA, 25 nt, Human
uaaaugcaaaauguauaauaaagua

SEQ ID NO: 1018891 - RNA, 18 nt, Human
uaagauaaaugagcagcc

SEQ ID NO: 1018892 - RNA, 23 nt, Human
uaagucaagaaucacagaucuaa

SEQ ID NO: 1018893 - RNA, 23 nt, Human
uaaugagaauuuuuuuuuccauu

SEQ ID NO: 1018894 - RNA, 23 nt, Human
uaauuguccuauguuaucaagga

SEQ ID NO: 1018895 - RNA, 24 nt, Human
uaauuguccuauguuaucaaggag

SEQ ID NO: 1018896 - RNA, 22 nt, Human
uaccuaaaagcuuaauuuuuaa

SEQ ID NO: 1018897 - RNA, 21 nt, Human
uagaacccauuggccagacaa

SEQ ID NO: 1018898 - RNA, 20 nt, Human
uauccacagagcugcuguga

SEQ ID NO: 1018899 - RNA, 24 nt, Human
ucaaggcacauucuuuucuugugc

SEQ ID NO: 1018900 - RNA, 21 nt, Human
ucagccacacagcuguuaaaa

SEQ ID NO: 1018901 - RNA, 24 nt, Human
uccacagagcugcugugaaugucc

SEQ ID NO: 1018902 - RNA, 19 nt, Human
ucccugagggcgccuguca

SEQ ID NO: 1018903 - RNA, 21 nt, Human
ucccuuaguccgaaggaaaag

SEQ ID NO: 1018904 - RNA, 22 nt, Human
ucuauagaacccauuggccaga

SEQ ID NO: 1018905 - RNA, 20 nt, Human
ugacuuaaaaggggauaaaa

SEQ ID NO: 1018906 - RNA, 27 nt, Human
ugagaauaaaacagaagaaaagccaac

SEQ ID NO: 1018907 - RNA, 22 nt, Human
ugauaaaccacugccaucaaau

SEQ ID NO: 1018908 - RNA, 18 nt, Human
ugcaaauauauaaugcau

SEQ ID NO: 1018909 - RNA, 25 nt, Human
ugcaaaugaaacuguacgguuuuaa

SEQ ID NO: 1018910 - RNA, 20 nt, Human
ugcaaaugcaaauauauaau

SEQ ID NO: 1018911 - RNA, 25 nt, Human
ugcacugaauaauuuucaacauucu

SEQ ID NO: 1018912 - RNA, 19 nt, Human
ugcaugcacagcuaucaca

SEQ ID NO: 1018913 - RNA, 22 nt, Human
ugggagaggcaacuuaguaaua

SEQ ID NO: 1018914 - RNA, 20 nt, Human
uggugcaaaagcaauugcac

SEQ ID NO: 1018915 - RNA, 22 nt, Human
ugucacuucuuuuuaucuucau

SEQ ID NO: 1018916 - RNA, 20 nt, Human
ugugaucugcuuauaucuua

SEQ ID NO: 1018917 - RNA, 25 nt, Human
uucaugcauuuuaauggcauuuuaa

SEQ ID NO: 1018918 - RNA, 20 nt, Human
uugcccuugaagaaauagua

SEQ ID NO: 1018919 - RNA, 21 nt, Human
uuucaauuucucuacacuaaa

SEQ ID NO: 1018920 - RNA, 21 nt, Human
uuuucaacauucugaaauuac

SEQ ID NO: 1018921 - RNA, 23 nt, Human
aaaaggaaaggcggaaacgcaga

SEQ ID NO: 1018922 - RNA, 23 nt, Human
aaagacggagacaacucugaaga

SEQ ID NO: 1018923 - RNA, 22 nt, Human
aacgugagacaaacaaaaggaa

SEQ ID NO: 1018924 - RNA, 21 nt, Human
accccugaaaucccgggaccg

SEQ ID NO: 1018925 - RNA, 19 nt, Human
agaauaucacuuccuaaca

SEQ ID NO: 1018926 - RNA, 21 nt, Human
aggaaaggcggaaacgcagaa

SEQ ID NO: 1018927 - RNA, 21 nt, Human
caaaacgugagacaaacaaaa

SEQ ID NO: 1018928 - RNA, 27 nt, Human
caacaggcccuucuccacagugugaag

SEQ ID NO: 1018929 - RNA, 19 nt, Human
ccacagugugaagacucug

SEQ ID NO: 1018930 - RNA, 23 nt, Human
ccaguauuaaccaucugauauuc

SEQ ID NO: 1018931 - RNA, 24 nt, Human
ccccugaaaucccgggaccgccuc

SEQ ID NO: 1018932 - RNA, 22 nt, Human
cccugaaaucccgggaccgccu

SEQ ID NO: 1018933 - RNA, 22 nt, Human
cggagacaacucugaagauaca

SEQ ID NO: 1018934 - RNA, 19 nt, Human
cuggaaauuucuaauaucc

SEQ ID NO: 1018935 - RNA, 21 nt, Human
gaaaucccgggaccgccuccc

SEQ ID NO: 1018936 - RNA, 24 nt, Human
ggaaagacggagacaacucugaag

SEQ ID NO: 1018937 - RNA, 27 nt, Human
gugagacaaacaaaaggaaaggcggaa

SEQ ID NO: 1018938 - RNA, 19 nt, Human
uaaccaucugauauucaac

SEQ ID NO: 1018939 - RNA, 28 nt, Human
uaucacuuccuaacaaaagccauccuau

SEQ ID NO: 1018940 - RNA, 24 nt, Human
uccacagugugaagacucugaggc

SEQ ID NO: 1018941 - RNA, 23 nt, Human
uccuauuuguaguuuugccaaaa

SEQ ID NO: 1018942 - RNA, 22 nt, Human
ugagacaaacaaaaggaaaggc

SEQ ID NO: 1018943 - RNA, 19 nt, Human
uucaggaugucaacaggcc

SEQ ID NO: 1018944 - RNA, 21 nt, Human
caacucuucuuuccuggcucc

SEQ ID NO: 1018945 - RNA, 23 nt, Human
ccggucccgccgagagccgagga

SEQ ID NO: 1018946 - RNA, 20 nt, Human
ccuucaucucacuccaacuc

SEQ ID NO: 1018947 - RNA, 18 nt, Human
cucggcucaggcaugagg

SEQ ID NO: 1018948 - RNA, 21 nt, Human
gucauaguccuuccuucaucu

SEQ ID NO: 1018949 - RNA, 24 nt, Human
ugaggcuuucuuuccuucugggcu

SEQ ID NO: 1018950 - RNA, 21 nt, Human
ugcguggcggggcuggguggg

SEQ ID NO: 1018951 - RNA, 23 nt, Human
ugggcuuccugggccaauagagg

SEQ ID NO: 1018952 - RNA, 21 nt, Human
ugucaccgccggucccgccga

SEQ ID NO: 1018953 - RNA, 19 nt, Human
uuuccuggcuccccgcucg

SEQ ID NO: 1018954 - RNA, 23 nt, Human
aaaaaagaaagaaaaucaccuaa

SEQ ID NO: 1018955 - RNA, 18 nt, Human
aaaagaaagaaaaucacc

SEQ ID NO: 1018956 - RNA, 25 nt, Human
aaaauaaaccacaagaagaccaaaa

SEQ ID NO: 1018957 - RNA, 21 nt, Human
aacaugguaagaccccguucu

SEQ ID NO: 1018958 - RNA, 21 nt, Human
aaccacaagaagaccaaaacu

SEQ ID NO: 1018959 - RNA, 20 nt, Human
aaccaggagguggaggaggu

SEQ ID NO: 1018960 - RNA, 21 nt, Human
aacccccccaccaccaaaaaa

SEQ ID NO: 1018961 - RNA, 23 nt, Human
aacugcuugaaccaggaggugga

SEQ ID NO: 1018962 - RNA, 21 nt, Human
aagaaaaucaccuaauaacac

SEQ ID NO: 1018963 - RNA, 24 nt, Human
aagaaagaaaaucaccuaauaaca

SEQ ID NO: 1018964 - RNA, 25 nt, Human
aagaaagaaaaucaccuaauaacac

SEQ ID NO: 1018965 - RNA, 21 nt, Human
aagcugaggcagaacugcuug

SEQ ID NO: 1018966 - RNA, 23 nt, Human
aagcuggcuuuaaaguugugacc

SEQ ID NO: 1018967 - RNA, 20 nt, Human
aauaagccacaaaauaaacc

SEQ ID NO: 1018968 - RNA, 29 nt, Human
aauaauaauaaaaauaaaaauguauuguc

SEQ ID NO: 1018969 - RNA, 25 nt, Human
acagaauuuuauucagccuuuaaaa

SEQ ID NO: 1018970 - RNA, 23 nt, Human
acagagcaagauucugucucaaa

SEQ ID NO: 1018971 - RNA, 24 nt, Human
acagagcaagauucugucucaaaa

SEQ ID NO: 1018972 - RNA, 19 nt, Human
accaaaaaaagaaagaaaa

SEQ ID NO: 1018973 - RNA, 21 nt, Human
accaaaaaaagaaagaaaauc

SEQ ID NO: 1018974 - RNA, 24 nt, Human
accaaaaaaagaaagaaaaucacc

SEQ ID NO: 1018975 - RNA, 24 nt, Human
accacugcacucuagucugggcaa

SEQ ID NO: 1018976 - RNA, 23 nt, Human
accuuaaaaauauaacguuaagc

SEQ ID NO: 1018977 - RNA, 24 nt, Human
acugcacucuagucugggcaacag

SEQ ID NO: 1018978 - RNA, 24 nt, Human
acugcacucuagucugggcaacag

SEQ ID NO: 1018979 - RNA, 18 nt, Human
agagcaagauucugucuc

SEQ ID NO: 1018980 - RNA, 20 nt, Human
agccacaaaauaaaccaccc

SEQ ID NO: 1018981 - RNA, 18 nt, Human
agccagguguagaauguc

SEQ ID NO: 1018982 - RNA, 22 nt, Human
agccuggccaacaugguaagac

SEQ ID NO: 1018983 - RNA, 24 nt, Human
agccuggccaacaugguaagaccc

SEQ ID NO: 1018984 - RNA, 23 nt, Human
agcggggcaugguggugcaugcc

SEQ ID NO: 1018985 - RNA, 24 nt, Human
agucugggcaacagagcaagauuc

SEQ ID NO: 1018986 - RNA, 20 nt, Human
auaggauauaccauacagcc

SEQ ID NO: 1018987 - RNA, 22 nt, Human
aucccagcacuuugggaggcca

SEQ ID NO: 1018988 - RNA, 19 nt, Human
augccuguaaucccagcac

SEQ ID NO: 1018989 - RNA, 23 nt, Human
auucacaaacgaaggccucccuu

SEQ ID NO: 1018990 - RNA, 24 nt, Human
auugcaccacugcacucuagucug

SEQ ID NO: 1018991 - RNA, 20 nt, Human
caaaauaaaccacaagaaga

SEQ ID NO: 1018992 - RNA, 21 nt, Human
caaagcgaguggcucacuuga

SEQ ID NO: 1018993 - RNA, 20 nt, Human
caacacaugacuaacagaau

SEQ ID NO: 1018994 - RNA, 19 nt, Human
caacccccccaccaccaaa

SEQ ID NO: 1018995 - RNA, 22 nt, Human
caacccccccaccaccaaaaaa

SEQ ID NO: 1018996 - RNA, 18 nt, Human
cacauucacuuaccacuc

SEQ ID NO: 1018997 - RNA, 25 nt, Human
caccaaaaaaagaaagaaaaucacc

SEQ ID NO: 1018998 - RNA, 24 nt, Human
caccacugcacucuagucugggca

SEQ ID NO: 1018999 - RNA, 23 nt, Human
cacucuagucugggcaacagagc

SEQ ID NO: 1019000 - RNA, 18 nt, Human
cacugcacucuagucugg

SEQ ID NO: 1019001 - RNA, 19 nt, Human
cacugcacucuagucuggg

SEQ ID NO: 1019002 - RNA, 21 nt, Human
cacugcacucuagucugggca

SEQ ID NO: 1019003 - RNA, 23 nt, Human
cacugcacucuagucugggcaac

SEQ ID NO: 1019004 - RNA, 24 nt, Human
cacugcacucuagucugggcaaca

SEQ ID NO: 1019005 - RNA, 23 nt, Human
cagaauuuuauucagccuuuaaa

SEQ ID NO: 1019006 - RNA, 21 nt, Human
cagcacuuugggaggccaaag

SEQ ID NO: 1019007 - RNA, 24 nt, Human
caugccuguaaucccagacacuug

SEQ ID NO: 1019008 - RNA, 24 nt, Human
caugccuguaaucccagcacuuug

SEQ ID NO: 1019009 - RNA, 21 nt, Human
cauucacgcaacccccccacc

SEQ ID NO: 1019010 - RNA, 26 nt, Human
cauugcacaaugugaaugacuuaaca

SEQ ID NO: 1019011 - RNA, 23 nt, Human
ccacaaaauaaaccacaagaaga

SEQ ID NO: 1019012 - RNA, 20 nt, Human
ccacugcacucuagucuggg

SEQ ID NO: 1019013 - RNA, 20 nt, Human
ccacugcacucuagucuggg

SEQ ID NO: 1019014 - RNA, 21 nt, Human
ccacugcacucuagucugggc

SEQ ID NO: 1019015 - RNA, 23 nt, Human
ccacugcacucuagucugggcaa

SEQ ID NO: 1019016 - RNA, 24 nt, Human
ccacugcacucuagucugggcaac

SEQ ID NO: 1019017 - RNA, 21 nt, Human
cccagacacuugggaagcuga

SEQ ID NO: 1019018 - RNA, 21 nt, Human
ccuacaguauucaguacagua

SEQ ID NO: 1019019 - RNA, 23 nt, Human
ccuggccaacaugguaagacccc

SEQ ID NO: 1019020 - RNA, 24 nt, Human
ccuggccaacaugguaagaccccg

SEQ ID NO: 1019021 - RNA, 18 nt, Human
ccuguaaucccagacacu

SEQ ID NO: 1019022 - RNA, 22 nt, Human
ccuguaaucccagcacuuuggg

SEQ ID NO: 1019023 - RNA, 23 nt, Human
cgcaacccccccaccaccaaaaa

SEQ ID NO: 1019024 - RNA, 21 nt, Human
cuacagcacaguaacaaccua

SEQ ID NO: 1019025 - RNA, 24 nt, Human
cucaugccuguaaucccagcacuu

SEQ ID NO: 1019026 - RNA, 23 nt, Human
cugcuugaaccaggagguggagg

SEQ ID NO: 1019027 - RNA, 21 nt, Human
cugggcaacagagcaagauuc

SEQ ID NO: 1019028 - RNA, 24 nt, Human
cugugugaagucuuuccccaucug

SEQ ID NO: 1019029 - RNA, 19 nt, Human
cuuaccauguguuccaaca

SEQ ID NO: 1019030 - RNA, 20 nt, Human
cuuggaaggugccuccucau

SEQ ID NO: 1019031 - RNA, 18 nt, Human
gagguugcaggaagccaa

SEQ ID NO: 1019032 - RNA, 23 nt, Human
gagguugcaggaagccaagauug

SEQ ID NO: 1019033 - RNA, 23 nt, Human
gaguagauuucugugugaagucu

SEQ ID NO: 1019034 - RNA, 23 nt, Human
gcaacccccccaccaccaaaaaa

SEQ ID NO: 1019035 - RNA, 24 nt, Human
gcacucuagucugggcaacagagc

SEQ ID NO: 1019036 - RNA, 21 nt, Human
gccaacaugguaagaccccgu

SEQ ID NO: 1019037 - RNA, 22 nt, Human
gccacaaaauaaaccacaagaa

SEQ ID NO: 1019038 - RNA, 19 nt, Human
gccagguguagaauguccu

SEQ ID NO: 1019039 - RNA, 19 nt, Human
gccgggcacgguggcucau

SEQ ID NO: 1019040 - RNA, 20 nt, Human
gccuguaaucccagacacuu

SEQ ID NO: 1019041 - RNA, 24 nt, Human
gcucacuugaggucgggaguuuga

SEQ ID NO: 1019042 - RNA, 22 nt, Human
ggagguugcaggaagccaagau

SEQ ID NO: 1019043 - RNA, 24 nt, Human
ggagguugcaggaagccaagauug

SEQ ID NO: 1019044 - RNA, 19 nt, Human
ggaguuugagaccagccug

SEQ ID NO: 1019045 - RNA, 23 nt, Human
ggcacgguggcucaugccuguaa

SEQ ID NO: 1019046 - RNA, 24 nt, Human
gggcaugguggugcaugccuguaa

SEQ ID NO: 1019047 - RNA, 19 nt, Human
gggcugggccuucugggug

SEQ ID NO: 1019048 - RNA, 19 nt, Human
ggucgggaguuugagacca

SEQ ID NO: 1019049 - RNA, 19 nt, Human
ggugagcuucucucuaaga

SEQ ID NO: 1019050 - RNA, 23 nt, Human
gguggcucaugccuguaauccca

SEQ ID NO: 1019051 - RNA, 24 nt, Human
gguggcucaugccuguaaucccag

SEQ ID NO: 1019052 - RNA, 24 nt, Human
gguggugcaugccuguaaucccag

SEQ ID NO: 1019053 - RNA, 19 nt, Human
guagaauguccuucagaag

SEQ ID NO: 1019054 - RNA, 23 nt, Human
guggcucaugccuguaaucccag

SEQ ID NO: 1019055 - RNA, 25 nt, Human
guuaagcaacacaugacuaacagaa

SEQ ID NO: 1019056 - RNA, 20 nt, Human
uaagcaacacaugacuaaca

SEQ ID NO: 1019057 - RNA, 23 nt, Human
uaagccacaaaauaaaccacaaa

SEQ ID NO: 1019058 - RNA, 25 nt, Human
uaagccacaaaauaaaccacaagaa

SEQ ID NO: 1019059 - RNA, 23 nt, Human
uacacaaugucuauaaagucuac

SEQ ID NO: 1019060 - RNA, 24 nt, Human
uaccauacagccuaggcauucacg

SEQ ID NO: 1019061 - RNA, 22 nt, Human
ucacuugaggucgggaguuuga

SEQ ID NO: 1019062 - RNA, 22 nt, Human
ucaugccuguaaucccagcacu

SEQ ID NO: 1019063 - RNA, 18 nt, Human
uccgucaugcucagccag

SEQ ID NO: 1019064 - RNA, 18 nt, Human
ucucacagggcugggccu

SEQ ID NO: 1019065 - RNA, 21 nt, Human
ucucuacuaaaaauacaaaaa

SEQ ID NO: 1019066 - RNA, 20 nt, Human
ucuggguggacaaagcuggc

SEQ ID NO: 1019067 - RNA, 22 nt, Human
ugacuaacagaauuuuauucag

SEQ ID NO: 1019068 - RNA, 23 nt, Human
ugagaccagccuggccaacaugg

SEQ ID NO: 1019069 - RNA, 24 nt, Human
ugagaccagccuggccaacauggu

SEQ ID NO: 1019070 - RNA, 21 nt, Human
ugaggcagaacugcuugaacc

SEQ ID NO: 1019071 - RNA, 18 nt, Human
ugaggucgggaguuugag

SEQ ID NO: 1019072 - RNA, 23 nt, Human
ugcaguacuguaagcuucauuca

SEQ ID NO: 1019073 - RNA, 24 nt, Human
ugccuguaaucccagacacuuggg

SEQ ID NO: 1019074 - RNA, 23 nt, Human
ugccuguaaucccagcacuuugg

SEQ ID NO: 1019075 - RNA, 19 nt, Human
ugcucagccagguguagaa

SEQ ID NO: 1019076 - RNA, 24 nt, Human
uggauggagugaggaauaagguuu

SEQ ID NO: 1019077 - RNA, 24 nt, Human
uggcucacuugaggucgggaguuu

SEQ ID NO: 1019078 - RNA, 22 nt, Human
uggcucaugccuguaaucccag

SEQ ID NO: 1019079 - RNA, 24 nt, Human
uggcucaugccuguaaucccagca

SEQ ID NO: 1019080 - RNA, 31 nt, Human
ugggaagcugaggcagaacugcuugaaccaa

SEQ ID NO: 1019081 - RNA, 24 nt, Human
ugggaggccaaagcgaguggcuca

SEQ ID NO: 1019082 - RNA, 20 nt, Human
ugggguguguuccgucaugc

SEQ ID NO: 1019083 - RNA, 21 nt, Human
ugguaaguucucugugagucu

SEQ ID NO: 1019084 - RNA, 21 nt, Human
uggugcaugccuguaauccca

SEQ ID NO: 1019085 - RNA, 22 nt, Human
uggugcaugccuguaaucccag

SEQ ID NO: 1019086 - RNA, 24 nt, Human
ugguggugcaugccuguaauccca

SEQ ID NO: 1019087 - RNA, 23 nt, Human
uguuaagcaacacaugacuaaca

SEQ ID NO: 1019088 - RNA, 24 nt, Human
uuaccauguguuccaacagccuac

SEQ ID NO: 1019089 - RNA, 20 nt, Human
uuagcggggcaugguggugc

SEQ ID NO: 1019090 - RNA, 24 nt, Human
uuagcggggcaugguggugcaugc

SEQ ID NO: 1019091 - RNA, 20 nt, Human
aacacagcaagaccgcaucu

SEQ ID NO: 1019092 - RNA, 20 nt, Human
aagaaugaaauacucacuga

SEQ ID NO: 1019093 - RNA, 22 nt, Human
aaguaucauaagcccccaagcu

SEQ ID NO: 1019094 - RNA, 19 nt, Human
acacagaaucuacauauug

SEQ ID NO: 1019095 - RNA, 21 nt, Human
acacagcaagaccgcaucucu

SEQ ID NO: 1019096 - RNA, 21 nt, Human
acauauugaagaccauguguu

SEQ ID NO: 1019097 - RNA, 19 nt, Human
acucaggaggcugaggcag

SEQ ID NO: 1019098 - RNA, 18 nt, Human
agcaggaguuugagacca

SEQ ID NO: 1019099 - RNA, 24 nt, Human
aggaucacuugagagcaggaguuu

SEQ ID NO: 1019100 - RNA, 18 nt, Human
aggcaggaggaucacuug

SEQ ID NO: 1019101 - RNA, 24 nt, Human
aggcugaggcaggaggaucacuug

SEQ ID NO: 1019102 - RNA, 22 nt, Human
agguuuccuuccuggcugggca

SEQ ID NO: 1019103 - RNA, 22 nt, Human
auagauuuuucuuccuugguau

SEQ ID NO: 1019104 - RNA, 20 nt, Human
aucacuugagagcaggaguu

SEQ ID NO: 1019105 - RNA, 23 nt, Human
cacccuguauuucacuccauccu

SEQ ID NO: 1019106 - RNA, 24 nt, Human
caggaggcugaggcaggaggauca

SEQ ID NO: 1019107 - RNA, 18 nt, Human
caggaguuugagaccagc

SEQ ID NO: 1019108 - RNA, 24 nt, Human
cauaaaaagaaauccacaucuaau

SEQ ID NO: 1019109 - RNA, 21 nt, Human
cauaagcccccaagcugaaua

SEQ ID NO: 1019110 - RNA, 23 nt, Human
cauccagaguugggccagaaggc

SEQ ID NO: 1019111 - RNA, 20 nt, Human
ccauccuuggcuaccuuccc

SEQ ID NO: 1019112 - RNA, 28 nt, Human
cccagcccuggaccuggccugcugggac

SEQ ID NO: 1019113 - RNA, 23 nt, Human
cccaggggaaaaacacaggucac

SEQ ID NO: 1019114 - RNA, 20 nt, Human
cccauaauuuccaaaggacc

SEQ ID NO: 1019115 - RNA, 22 nt, Human
cccauaauuuccaaaggaccca

SEQ ID NO: 1019116 - RNA, 20 nt, Human
cccuggaccuggccugcugg

SEQ ID NO: 1019117 - RNA, 24 nt, Human
ccugcugggacagcaacccuuucu

SEQ ID NO: 1019118 - RNA, 21 nt, Human
ccuguagguuuccuuccuggc

SEQ ID NO: 1019119 - RNA, 24 nt, Human
ccuugcucgucagacucuucuccc

SEQ ID NO: 1019120 - RNA, 24 nt, Human
cuuccuggcugggcagaguccuaa

SEQ ID NO: 1019121 - RNA, 22 nt, Human
gaggaucacuugagagcaggag

SEQ ID NO: 1019122 - RNA, 24 nt, Human
gaucacuugagagcaggaguuuga

SEQ ID NO: 1019123 - RNA, 21 nt, Human
gcugggcagaguccuaagcag

SEQ ID NO: 1019124 - RNA, 22 nt, Human
ggaucacuugagagcaggaguu

SEQ ID NO: 1019125 - RNA, 22 nt, Human
gguacuagaaguaucauaagcc

SEQ ID NO: 1019126 - RNA, 20 nt, Human
uaaaauauucauaggaucua

SEQ ID NO: 1019127 - RNA, 28 nt, Human
uaacagggcuucucuccaauauauguuc

SEQ ID NO: 1019128 - RNA, 23 nt, Human
uauauguucuaaagugagaaagg

SEQ ID NO: 1019129 - RNA, 22 nt, Human
uaucauaagcccccaagcugaa

SEQ ID NO: 1019130 - RNA, 18 nt, Human
ucacuugagagcaggagu

SEQ ID NO: 1019131 - RNA, 19 nt, Human
ucacuugagagcaggaguu

SEQ ID NO: 1019132 - RNA, 23 nt, Human
uccaauauauguucuaaagugag

SEQ ID NO: 1019133 - RNA, 21 nt, Human
uccagaguugggccagaaggc

SEQ ID NO: 1019134 - RNA, 23 nt, Human
uccaggugaccauaacagggcuu

SEQ ID NO: 1019135 - RNA, 24 nt, Human
ucuaugucacacagaaucuacaua

SEQ ID NO: 1019136 - RNA, 19 nt, Human
ucucagcugcaggcgacag

SEQ ID NO: 1019137 - RNA, 21 nt, Human
ucucuuuggguacuagaagua

SEQ ID NO: 1019138 - RNA, 24 nt, Human
ugaaaagauaacuaaaauauucau

SEQ ID NO: 1019139 - RNA, 25 nt, Human
ugaaaagauaacuaaaauauucaua

SEQ ID NO: 1019140 - RNA, 20 nt, Human
ugaggcaggaggaucacuug

SEQ ID NO: 1019141 - RNA, 25 nt, Human
ugaggcaggaggaucacuugagagc

SEQ ID NO: 1019142 - RNA, 23 nt, Human
ugauaaaaacaaucauagcuaua

SEQ ID NO: 1019143 - RNA, 24 nt, Human
ugguauuugauuuuuucccauaau

SEQ ID NO: 1019144 - RNA, 19 nt, Human
uguagguuuccuuccuggc

SEQ ID NO: 1019145 - RNA, 19 nt, Human
uuaaacugaaaagauaacu

SEQ ID NO: 1019146 - RNA, 18 nt, Human
uugaagaccauguguucu

SEQ ID NO: 1019147 - RNA, 22 nt, Human
uugagagcaggaguuugagacc

SEQ ID NO: 1019148 - RNA, 18 nt, Human
uugguauuugauuuuuuc

SEQ ID NO: 1019149 - RNA, 23 nt, Human
uuuauuacuuuaagaaagaaggg

SEQ ID NO: 1019150 - RNA, 26 nt, Human
aagcaaaagacacugacggaagagga

SEQ ID NO: 1019151 - RNA, 22 nt, Human
acuccacguugcgcgcuccgcc

SEQ ID NO: 1019152 - RNA, 22 nt, Human
agcgcccgucucucuugugccc

SEQ ID NO: 1019153 - RNA, 20 nt, Human
caccacccgccugcucuguc

SEQ ID NO: 1019154 - RNA, 19 nt, Human
ccuggguugcacuuggccc

SEQ ID NO: 1019155 - RNA, 22 nt, Human
cgcuccgccgggagucgaagca

SEQ ID NO: 1019156 - RNA, 21 nt, Human
cuccacguugcgcgcuccgcc

SEQ ID NO: 1019157 - RNA, 20 nt, Human
cuccgccgggagucgaagca

SEQ ID NO: 1019158 - RNA, 26 nt, Human
cucucuugugcccuagcagaggcugg

SEQ ID NO: 1019159 - RNA, 18 nt, Human
cugcucugucacuuucuc

SEQ ID NO: 1019160 - RNA, 19 nt, Human
gcuccgaaacagccguggc

SEQ ID NO: 1019161 - RNA, 21 nt, Human
ggcacgccgcucgcgggcggc

SEQ ID NO: 1019162 - RNA, 19 nt, Human
uaagacuuccaaaagaaca

SEQ ID NO: 1019163 - RNA, 24 nt, Human
ucacuuucucuacaaaggaaggac

SEQ ID NO: 1019164 - RNA, 20 nt, Human
uccugagcuccgaaacagcc

SEQ ID NO: 1019165 - RNA, 18 nt, Human
ucucuacaaaggaaggac

SEQ ID NO: 1019166 - RNA, 19 nt, Human
ugcacuuggccccugcacg

SEQ ID NO: 1019167 - RNA, 18 nt, Human
aaauagacaagcuaaaca

SEQ ID NO: 1019168 - RNA, 24 nt, Human
aaaucacauccuacugaauuuaaa

SEQ ID NO: 1019169 - RNA, 24 nt, Human
aacagggagggaggaggugaggga

SEQ ID NO: 1019170 - RNA, 20 nt, Human
aacccuacacuucugcccac

SEQ ID NO: 1019171 - RNA, 21 nt, Human
aagaagcuacacacacaagca

SEQ ID NO: 1019172 - RNA, 18 nt, Human
aagcaauugaaaagaagc

SEQ ID NO: 1019173 - RNA, 19 nt, Human
aagcaucucaguuuggagg

SEQ ID NO: 1019174 - RNA, 26 nt, Human
aagccaaucugucuuagggaagccaa

SEQ ID NO: 1019175 - RNA, 18 nt, Human
aauccucaguggucaucu

SEQ ID NO: 1019176 - RNA, 21 nt, Human
acaagcaauuaucauagcauc

SEQ ID NO: 1019177 - RNA, 20 nt, Human
acaucugcccagccauccaa

SEQ ID NO: 1019178 - RNA, 18 nt, Human
acuaagcaauugaaaaga

SEQ ID NO: 1019179 - RNA, 21 nt, Human
acuaagcaauugaaaagaagc

SEQ ID NO: 1019180 - RNA, 21 nt, Human
agaaagccaaucugucuuagg

SEQ ID NO: 1019181 - RNA, 21 nt, Human
agacaagcuaaacacuagccg

SEQ ID NO: 1019182 - RNA, 22 nt, Human
agacaggaaaaugggucacuga

SEQ ID NO: 1019183 - RNA, 22 nt, Human
agauauggcaaauagacaagcu

SEQ ID NO: 1019184 - RNA, 22 nt, Human
agcaauugaaaagaagcaaaaa

SEQ ID NO: 1019185 - RNA, 21 nt, Human
agcacaaaaucaaugcuugcu

SEQ ID NO: 1019186 - RNA, 19 nt, Human
aggaagaacaagcccacaa

SEQ ID NO: 1019187 - RNA, 20 nt, Human
aggacucagggggauaggca

SEQ ID NO: 1019188 - RNA, 22 nt, Human
aggagggaaaggggcagcuugg

SEQ ID NO: 1019189 - RNA, 18 nt, Human
agugaacggugaguggaa

SEQ ID NO: 1019190 - RNA, 18 nt, Human
aguucagggagcagaauu

SEQ ID NO: 1019191 - RNA, 23 nt, Human
auuuacccaccagggaucaucaa

SEQ ID NO: 1019192 - RNA, 18 nt, Human
caaaaucacauccuacug

SEQ ID NO: 1019193 - RNA, 19 nt, Human
caaauaaauggaauguucc

SEQ ID NO: 1019194 - RNA, 19 nt, Human
caaaugaaaaacugcuaua

SEQ ID NO: 1019195 - RNA, 24 nt, Human
caagagcagaggcccucauuuugu

SEQ ID NO: 1019196 - RNA, 20 nt, Human
caagccaaugugcauagggc

SEQ ID NO: 1019197 - RNA, 21 nt, Human
cacagcuucuuguaauccuca

SEQ ID NO: 1019198 - RNA, 19 nt, Human
cacagugcuuggcacacac

SEQ ID NO: 1019199 - RNA, 21 nt, Human
cacccccaaaaucacauccua

SEQ ID NO: 1019200 - RNA, 19 nt, Human
cacuagcuuaaggcagagu

SEQ ID NO: 1019201 - RNA, 24 nt, Human
cagcugaggaagagcaguugguau

SEQ ID NO: 1019202 - RNA, 22 nt, Human
caggaaaaugggucacugaaag

SEQ ID NO: 1019203 - RNA, 23 nt, Human
caguccacccccaaaaucacauc

SEQ ID NO: 1019204 - RNA, 22 nt, Human
cagucuucaacuuggcccauua

SEQ ID NO: 1019205 - RNA, 20 nt, Human
cauuacucugugacagugcc

SEQ ID NO: 1019206 - RNA, 24 nt, Human
cauuagaaagccaaucugucuuag

SEQ ID NO: 1019207 - RNA, 21 nt, Human
ccaccacgugccaagucugau

SEQ ID NO: 1019208 - RNA, 21 nt, Human
ccugcacugaggacucagggg

SEQ ID NO: 1019209 - RNA, 19 nt, Human
ccuggggccccagcaguug

SEQ ID NO: 1019210 - RNA, 25 nt, Human
cuacugaauuuaaaccuaauugugu

SEQ ID NO: 1019211 - RNA, 24 nt, Human
cucaaucaaaagcaacuaacuacu

SEQ ID NO: 1019212 - RNA, 19 nt, Human
cucugcacagugcuuggca

SEQ ID NO: 1019213 - RNA, 19 nt, Human
cucugugacagugccugcu

SEQ ID NO: 1019214 - RNA, 20 nt, Human
cucugugacagugccugcua

SEQ ID NO: 1019215 - RNA, 18 nt, Human
cucuuugguaaugucugu

SEQ ID NO: 1019216 - RNA, 18 nt, Human
cugaggaagagcaguugg

SEQ ID NO: 1019217 - RNA, 20 nt, Human
cugaucagccuggcgguggg

SEQ ID NO: 1019218 - RNA, 23 nt, Human
cugcgcaaugcaauagccaccuc

SEQ ID NO: 1019219 - RNA, 21 nt, Human
cugcuaugugguagagccuca

SEQ ID NO: 1019220 - RNA, 21 nt, Human
cuggauucacaagcuccucuu

SEQ ID NO: 1019221 - RNA, 26 nt, Human
cugggcccacagauggcagaguccag

SEQ ID NO: 1019222 - RNA, 19 nt, Human
cuuucauccacugguccug

SEQ ID NO: 1019223 - RNA, 24 nt, Human
gcaaauagacaagcuaaacacuag

SEQ ID NO: 1019224 - RNA, 20 nt, Human
gcccauuauaagccucaagg

SEQ ID NO: 1019225 - RNA, 20 nt, Human
gcgcaaugcaauagccaccu

SEQ ID NO: 1019226 - RNA, 19 nt, Human
ggaacuguguacccucugc

SEQ ID NO: 1019227 - RNA, 19 nt, Human
ggaggaggugagggaaggg

SEQ ID NO: 1019228 - RNA, 22 nt, Human
ggagggaggaggugagggaagg

SEQ ID NO: 1019229 - RNA, 19 nt, Human
ggcaaaagcaugaagaaau

SEQ ID NO: 1019230 - RNA, 21 nt, Human
gggaagccagccuaucuuggg

SEQ ID NO: 1019231 - RNA, 19 nt, Human
ggggauuaaugccauuacu

SEQ ID NO: 1019232 - RNA, 18 nt, Human
gucuuagggaagccaaga

SEQ ID NO: 1019233 - RNA, 23 nt, Human
uaaaucaagagcagaggcccuca

SEQ ID NO: 1019234 - RNA, 19 nt, Human
uacacacacaagcaauuau

SEQ ID NO: 1019235 - RNA, 22 nt, Human
uacacccuaaaacccacuuggg

SEQ ID NO: 1019236 - RNA, 22 nt, Human
uacucugugacagugccugcua

SEQ ID NO: 1019237 - RNA, 19 nt, Human
uacuucaugggggggggga

SEQ ID NO: 1019238 - RNA, 21 nt, Human
uagggaagccaagauggaauu

SEQ ID NO: 1019239 - RNA, 27 nt, Human
uaguguccaccacgugccaagucuggu

SEQ ID NO: 1019240 - RNA, 18 nt, Human
uauacacccuaaaaccca

SEQ ID NO: 1019241 - RNA, 21 nt, Human
uaugauuagaaacacuaagca

SEQ ID NO: 1019242 - RNA, 22 nt, Human
ucaauaauggcucuugcaagaa

SEQ ID NO: 1019243 - RNA, 18 nt, Human
ucaguccacccccaaaau

SEQ ID NO: 1019244 - RNA, 19 nt, Human
uccaccacgugccaagucu

SEQ ID NO: 1019245 - RNA, 22 nt, Human
uccacccccaaaaucacauccu

SEQ ID NO: 1019246 - RNA, 24 nt, Human
uccacccccaaaaucacauccuac

SEQ ID NO: 1019247 - RNA, 18 nt, Human
ugaaaagaagcaaaaagg

SEQ ID NO: 1019248 - RNA, 18 nt, Human
ugaaaagaagcaaaaagg

SEQ ID NO: 1019249 - RNA, 25 nt, Human
ugaaccugagcagaggaucggcuga

SEQ ID NO: 1019250 - RNA, 21 nt, Human
ugacagugccugcuauguggu

SEQ ID NO: 1019251 - RNA, 18 nt, Human
ugacaucaugggcauaaa

SEQ ID NO: 1019252 - RNA, 18 nt, Human
ugcaauagccaccucucu

SEQ ID NO: 1019253 - RNA, 22 nt, Human
ugcccagaggaagagugugauu

SEQ ID NO: 1019254 - RNA, 22 nt, Human
uggacaggcuuacaucugccca

SEQ ID NO: 1019255 - RNA, 18 nt, Human
uggaggcauuuucauggg

SEQ ID NO: 1019256 - RNA, 22 nt, Human
uggcacacacugagcacaaaau

SEQ ID NO: 1019257 - RNA, 19 nt, Human
uggcaggaagaacaagccc

SEQ ID NO: 1019258 - RNA, 24 nt, Human
ugggaagagcaugggcucuguagc

SEQ ID NO: 1019259 - RNA, 24 nt, Human
ugggaggccugaagggaggguguu

SEQ ID NO: 1019260 - RNA, 19 nt, Human
uggggccccagcaguugcc

SEQ ID NO: 1019261 - RNA, 22 nt, Human
ugucuugcauguugguucuaaa

SEQ ID NO: 1019262 - RNA, 24 nt, Human
ugugguagagccucaagaaauguu

SEQ ID NO: 1019263 - RNA, 24 nt, Human
uguuagcugcuuuuccacuuccuu

SEQ ID NO: 1019264 - RNA, 27 nt, Human
uucauggggggggggauaauucaggga

SEQ ID NO: 1019265 - RNA, 24 nt, Human
uuccuggauucacaagcuccucuu

SEQ ID NO: 1019266 - RNA, 22 nt, Human
uuggggcaaaacuggggacagc

SEQ ID NO: 1019267 - RNA, 21 nt, Human
uuuggcaggaagaacaagccc

SEQ ID NO: 1019268 - RNA, 24 nt, Human
aaagugcugggauuacaggcauga

SEQ ID NO: 1019269 - RNA, 23 nt, Human
aagguaggucuucugauuccaaa

SEQ ID NO: 1019270 - RNA, 19 nt, Human
aagugcugggauuacaggc

SEQ ID NO: 1019271 - RNA, 21 nt, Human
aagugcugggauuacaggcau

SEQ ID NO: 1019272 - RNA, 26 nt, Human
aagugcugggauuacaggcaugagcc

SEQ ID NO: 1019273 - RNA, 24 nt, Human
aauuuuuguauuuuaguagagaug

SEQ ID NO: 1019274 - RNA, 23 nt, Human
accauguuggucaggcuggucuc

SEQ ID NO: 1019275 - RNA, 18 nt, Human
acugacaggaaacuaaag

SEQ ID NO: 1019276 - RNA, 19 nt, Human
acugcaaccuccgcccucc

SEQ ID NO: 1019277 - RNA, 21 nt, Human
agaaauauauaucauuugucc

SEQ ID NO: 1019278 - RNA, 18 nt, Human
agacucuuguccgcccaa

SEQ ID NO: 1019279 - RNA, 23 nt, Human
agacuugaaaguugggaugaacu

SEQ ID NO: 1019280 - RNA, 23 nt, Human
agcugggauuaccggugugugcc

SEQ ID NO: 1019281 - RNA, 18 nt, Human
aggcaugagccaccaagc

SEQ ID NO: 1019282 - RNA, 21 nt, Human
aggcaugagccaccaagcccg

SEQ ID NO: 1019283 - RNA, 18 nt, Human
aggcuugucucgaacucc

SEQ ID NO: 1019284 - RNA, 24 nt, Human
aggugauccacucgcuucggccuc

SEQ ID NO: 1019285 - RNA, 23 nt, Human
aguagcugggauuaccggugugu

SEQ ID NO: 1019286 - RNA, 20 nt, Human
agugcaauggcgcgauccug

SEQ ID NO: 1019287 - RNA, 19 nt, Human
aguugggaugaacuuuauu

SEQ ID NO: 1019288 - RNA, 23 nt, Human
augggguuucaccauguugguca

SEQ ID NO: 1019289 - RNA, 24 nt, Human
augggguuucaccauguuggucag

SEQ ID NO: 1019290 - RNA, 24 nt, Human
auuuuaguagagaugggguuucac

SEQ ID NO: 1019291 - RNA, 20 nt, Human
caaagauccuuucacuuaac

SEQ ID NO: 1019292 - RNA, 24 nt, Human
caaaguccugggacuacaggagug

SEQ ID NO: 1019293 - RNA, 23 nt, Human
caaagugcugggauuacaggcau

SEQ ID NO: 1019294 - RNA, 24 nt, Human
caaagugcugggauuacaggcaug

SEQ ID NO: 1019295 - RNA, 22 nt, Human
caacuccacaccugacauucug

SEQ ID NO: 1019296 - RNA, 24 nt, Human
caacuuuauugacaacugaaugau

SEQ ID NO: 1019297 - RNA, 22 nt, Human
caagcgacucuccugucucagc

SEQ ID NO: 1019298 - RNA, 22 nt, Human
cacaaagauccuuucacuuaac

SEQ ID NO: 1019299 - RNA, 22 nt, Human
cacaacaacccugugagguagg

SEQ ID NO: 1019300 - RNA, 21 nt, Human
caccauguuggucaggcuggu

SEQ ID NO: 1019301 - RNA, 24 nt, Human
caccauguuggucaggcuggucuc

SEQ ID NO: 1019302 - RNA, 24 nt, Human
caccucggccucccaaaguccugg

SEQ ID NO: 1019303 - RNA, 22 nt, Human
cacugcacccagcccaugucua

SEQ ID NO: 1019304 - RNA, 24 nt, Human
cagcagggacacuaucuuuaaaau

SEQ ID NO: 1019305 - RNA, 20 nt, Human
cagccuccugaguagcuggg

SEQ ID NO: 1019306 - RNA, 18 nt, Human
cagggauucuauuccauu

SEQ ID NO: 1019307 - RNA, 18 nt, Human
ccacugcacccagcccau

SEQ ID NO: 1019308 - RNA, 20 nt, Human
cccagguucaagcgacucuc

SEQ ID NO: 1019309 - RNA, 23 nt, Human
cccagguucaagcgacucuccug

SEQ ID NO: 1019310 - RNA, 22 nt, Human
ccucccagguucaagcgacucu

SEQ ID NO: 1019311 - RNA, 19 nt, Human
ccuccgcccucccagguuc

SEQ ID NO: 1019312 - RNA, 20 nt, Human
ccugaccucaggugauccac

SEQ ID NO: 1019313 - RNA, 20 nt, Human
ccugaccucaggugauccac

SEQ ID NO: 1019314 - RNA, 19 nt, Human
ccugaguagcugggauuac

SEQ ID NO: 1019315 - RNA, 24 nt, Human
ccugucucagccuccugaguagcu

SEQ ID NO: 1019316 - RNA, 22 nt, Human
cgcccaacuccacaccugacau

SEQ ID NO: 1019317 - RNA, 24 nt, Human
cgcucuuguugcccaggcuggagu

SEQ ID NO: 1019318 - RNA, 20 nt, Human
cggugugugcccccaugccc

SEQ ID NO: 1019319 - RNA, 24 nt, Human
cucaaagugcugggauuacaggca

SEQ ID NO: 1019320 - RNA, 19 nt, Human
cucaagggaucuucccacc

SEQ ID NO: 1019321 - RNA, 24 nt, Human
cucaagggaucuucccaccucggc

SEQ ID NO: 1019322 - RNA, 25 nt, Human
cucacugcaaccuccgcccucccag

SEQ ID NO: 1019323 - RNA, 24 nt, Human
cucagccuccugaguagcugggau

SEQ ID NO: 1019324 - RNA, 23 nt, Human
cuccugggcucaagggaucuucc

SEQ ID NO: 1019325 - RNA, 26 nt, Human
cucuccugucucagccuccugaguag

SEQ ID NO: 1019326 - RNA, 24 nt, Human
cugcaaccuccgcccucccagguu

SEQ ID NO: 1019327 - RNA, 25 nt, Human
cugcaaccuccgcccucccagguuc

SEQ ID NO: 1019328 - RNA, 24 nt, Human
cuuguugcccaggcuggagugcaa

SEQ ID NO: 1019329 - RNA, 18 nt, Human
gacuacaggagugagcca

SEQ ID NO: 1019330 - RNA, 23 nt, Human
gacuacaggagugagccacugca

SEQ ID NO: 1019331 - RNA, 24 nt, Human
gagaugggguuucaccauguuggu

SEQ ID NO: 1019332 - RNA, 24 nt, Human
gagccacugcacccagcccauguc

SEQ ID NO: 1019333 - RNA, 23 nt, Human
gaguagcugggauuaccggugug

SEQ ID NO: 1019334 - RNA, 24 nt, Human
gagugagccacugcacccagccca

SEQ ID NO: 1019335 - RNA, 18 nt, Human
gauuacaggcaugagcca

SEQ ID NO: 1019336 - RNA, 21 nt, Human
gauuacaggcaugagccacca

SEQ ID NO: 1019337 - RNA, 24 nt, Human
gauuacaggcaugagccaccaagc

SEQ ID NO: 1019338 - RNA, 23 nt, Human
gcaaccuccgcccucccagguuc

SEQ ID NO: 1019339 - RNA, 19 nt, Human
gcccaggcuggagugcaau

SEQ ID NO: 1019340 - RNA, 24 nt, Human
gcgacucuccugucucagccuccu

SEQ ID NO: 1019341 - RNA, 24 nt, Human
gcucuuguugcccaggcuggagug

SEQ ID NO: 1019342 - RNA, 25 nt, Human
gcuggagugcaauggcgcgauccug

SEQ ID NO: 1019343 - RNA, 20 nt, Human
ggacuacaggagugagccac

SEQ ID NO: 1019344 - RNA, 19 nt, Human
ggauuacaggcaugagcca

SEQ ID NO: 1019345 - RNA, 23 nt, Human
gggaaagccaggaaucaaaggua

SEQ ID NO: 1019346 - RNA, 22 nt, Human
gggguuucaccauguuggucag

SEQ ID NO: 1019347 - RNA, 23 nt, Human
guagagaugggguuucaccaugu

SEQ ID NO: 1019348 - RNA, 22 nt, Human
gugauccacucgcuucggccuc

SEQ ID NO: 1019349 - RNA, 20 nt, Human
uaaaaugcauacuauacaca

SEQ ID NO: 1019350 - RNA, 23 nt, Human
uaauuuuuguauuuuaguagaga

SEQ ID NO: 1019351 - RNA, 19 nt, Human
uacaggagugagccacugc

SEQ ID NO: 1019352 - RNA, 24 nt, Human
uacaggagugagccacugcaccca

SEQ ID NO: 1019353 - RNA, 20 nt, Human
uacaggcaugagccaccaag

SEQ ID NO: 1019354 - RNA, 23 nt, Human
uacaggcaugagccaccaagccc

SEQ ID NO: 1019355 - RNA, 21 nt, Human
uaccggugugugcccccaugc

SEQ ID NO: 1019356 - RNA, 22 nt, Human
uagagaugggguuucaccaugu

SEQ ID NO: 1019357 - RNA, 23 nt, Human
uagcugggauuaccggugugugc

SEQ ID NO: 1019358 - RNA, 24 nt, Human
uaguagagaugggguuucaccaug

SEQ ID NO: 1019359 - RNA, 25 nt, Human
uaguagagaugggguuucaccaugu

SEQ ID NO: 1019360 - RNA, 23 nt, Human
ucaaagugcugggauuacaggca

SEQ ID NO: 1019361 - RNA, 24 nt, Human
ucaaagugcugggauuacaggcau

SEQ ID NO: 1019362 - RNA, 18 nt, Human
ucacugcaaccuccgccc

SEQ ID NO: 1019363 - RNA, 23 nt, Human
ucacugcaaccuccgcccuccca

SEQ ID NO: 1019364 - RNA, 25 nt, Human
ucacugcaaccuccgcccucccagg

SEQ ID NO: 1019365 - RNA, 23 nt, Human
ucacuuaacccucacaacaaccc

SEQ ID NO: 1019366 - RNA, 20 nt, Human
ucagccuccugaguagcugg

SEQ ID NO: 1019367 - RNA, 21 nt, Human
ucccagguucaagcgacucuc

SEQ ID NO: 1019368 - RNA, 24 nt, Human
ucccagguucaagcgacucuccug

SEQ ID NO: 1019369 - RNA, 22 nt, Human
uccugaguagcugggauuaccg

SEQ ID NO: 1019370 - RNA, 24 nt, Human
uccugaguagcugggauuaccggu

SEQ ID NO: 1019371 - RNA, 20 nt, Human
uccugggcucaagggaucuu

SEQ ID NO: 1019372 - RNA, 21 nt, Human
uccugggcucaagggaucuuc

SEQ ID NO: 1019373 - RNA, 24 nt, Human
uccugggcucaagggaucuuccca

SEQ ID NO: 1019374 - RNA, 23 nt, Human
ucgcucuuguugcccaggcugga

SEQ ID NO: 1019375 - RNA, 24 nt, Human
ucucaaagugcugggauuacaggc

SEQ ID NO: 1019376 - RNA, 22 nt, Human
ucucgaacuccugggcucaagg

SEQ ID NO: 1019377 - RNA, 22 nt, Human
ucuuguugcccaggcuggagug

SEQ ID NO: 1019378 - RNA, 22 nt, Human
ugaccucaggugauccacucgc

SEQ ID NO: 1019379 - RNA, 23 nt, Human
ugaccucaggugauccacucgcu

SEQ ID NO: 1019380 - RNA, 24 nt, Human
ugaccucaggugauccacucgcuu

SEQ ID NO: 1019381 - RNA, 18 nt, Human
ugcccaggcuggagugca

SEQ ID NO: 1019382 - RNA, 21 nt, Human
ugcccaggcuggagugcaaug

SEQ ID NO: 1019383 - RNA, 21 nt, Human
ugcccaggcuggagugcaaug

SEQ ID NO: 1019384 - RNA, 24 nt, Human
ugcccaggcuggagugcaauggcg

SEQ ID NO: 1019385 - RNA, 24 nt, Human
uggagugcaauggcgcgauccugg

SEQ ID NO: 1019386 - RNA, 22 nt, Human
ugggacuacaggagugagccac

SEQ ID NO: 1019387 - RNA, 22 nt, Human
ugggacuacaggagugagccac

SEQ ID NO: 1019388 - RNA, 24 nt, Human
ugggacuacaggagugagccacug

SEQ ID NO: 1019389 - RNA, 18 nt, Human
ugggauuacaggcaugag

SEQ ID NO: 1019390 - RNA, 19 nt, Human
ugggauuacaggcaugagc

SEQ ID NO: 1019391 - RNA, 22 nt, Human
ugggauuacaggcaugagccac

SEQ ID NO: 1019392 - RNA, 23 nt, Human
ugggauuacaggcaugagccacc

SEQ ID NO: 1019393 - RNA, 24 nt, Human
ugggauuacaggcaugagccacca

SEQ ID NO: 1019394 - RNA, 25 nt, Human
ugggauuaccggugugugcccccau

SEQ ID NO: 1019395 - RNA, 22 nt, Human
ugggcucaagggaucuucccac

SEQ ID NO: 1019396 - RNA, 24 nt, Human
ugggcucaagggaucuucccaccu

SEQ ID NO: 1019397 - RNA, 24 nt, Human
ugggguuucaccauguuggucagg

SEQ ID NO: 1019398 - RNA, 24 nt, Human
uggucaggcuggucucaaaauccu

SEQ ID NO: 1019399 - RNA, 23 nt, Human
ugucuaguaaagaguaaauaaua

SEQ ID NO: 1019400 - RNA, 24 nt, Human
ugucucagccuccugaguagcugg

SEQ ID NO: 1019401 - RNA, 22 nt, Human
uguuacccaggcuugucucgaa

SEQ ID NO: 1019402 - RNA, 20 nt, Human
uguugcccaggcuggagugc

SEQ ID NO: 1019403 - RNA, 20 nt, Human
uguuuuuguagacuugaaag

SEQ ID NO: 1019404 - RNA, 21 nt, Human
uguuuuuguagacuugaaagu

SEQ ID NO: 1019405 - RNA, 24 nt, Human
uuagaagaaauauauaucauuugu

SEQ ID NO: 1019406 - RNA, 18 nt, Human
uuaguagagaugggguuu

SEQ ID NO: 1019407 - RNA, 22 nt, Human
uuaguagagaugggguuucacc

SEQ ID NO: 1019408 - RNA, 24 nt, Human
uuaguagagaugggguuucaccau

SEQ ID NO: 1019409 - RNA, 21 nt, Human
uuauuguugcucucauuuaca

SEQ ID NO: 1019410 - RNA, 22 nt, Human
uucacuuaacccucacaacaac

SEQ ID NO: 1019411 - RNA, 24 nt, Human
uucgcucuuguugcccaggcugga

SEQ ID NO: 1019412 - RNA, 18 nt, Human
uugcccaggcuggagugc

SEQ ID NO: 1019413 - RNA, 24 nt, Human
uuucaccauguuggucaggcuggu

SEQ ID NO: 1019414 - RNA, 24 nt, Human
uuucgcucuuguugcccaggcugg

SEQ ID NO: 1019415 - RNA, 19 nt, Human
uuuuuguauuuuaguagag

SEQ ID NO: 1019416 - RNA, 27 nt, Human
aaaaaacaaagcaacgugagacaagca

SEQ ID NO: 1019417 - RNA, 21 nt, Human
aaacaaagcaacgugagacaa

SEQ ID NO: 1019418 - RNA, 24 nt, Human
aaacggcaagagccauaaauggca

SEQ ID NO: 1019419 - RNA, 24 nt, Human
aaauggcaggugagaaagucuaac

SEQ ID NO: 1019420 - RNA, 19 nt, Human
aagcugccaacaacacuca

SEQ ID NO: 1019421 - RNA, 22 nt, Human
aaguguaacacauaccuggaac

SEQ ID NO: 1019422 - RNA, 18 nt, Human
acaaagcaacgugagaca

SEQ ID NO: 1019423 - RNA, 21 nt, Human
agcaaauggggagaagcagag

SEQ ID NO: 1019424 - RNA, 21 nt, Human
aggcuggaaaaaaauccaugg

SEQ ID NO: 1019425 - RNA, 18 nt, Human
aggguuucuccgacacau

SEQ ID NO: 1019426 - RNA, 18 nt, Human
auguuagaaaguguaaca

SEQ ID NO: 1019427 - RNA, 22 nt, Human
caacgugagacaagcaguuccc

SEQ ID NO: 1019428 - RNA, 22 nt, Human
caagcaguucccaaguugguga

SEQ ID NO: 1019429 - RNA, 22 nt, Human
caagcugccaacaacacucaua

SEQ ID NO: 1019430 - RNA, 19 nt, Human
cacauggacuaugcaacuc

SEQ ID NO: 1019431 - RNA, 18 nt, Human
cacuguauauccuuagau

SEQ ID NO: 1019432 - RNA, 20 nt, Human
cacuguguggaccucacagg

SEQ ID NO: 1019433 - RNA, 20 nt, Human
caggugguagacaugauacg

SEQ ID NO: 1019434 - RNA, 21 nt, Human
caugaaaccaguaugucuuga

SEQ ID NO: 1019435 - RNA, 21 nt, Human
cccuaacuugucagagaggaa

SEQ ID NO: 1019436 - RNA, 21 nt, Human
cggcaagagccauaaauggca

SEQ ID NO: 1019437 - RNA, 22 nt, Human
cuagcaaauggggagaagcaga

SEQ ID NO: 1019438 - RNA, 23 nt, Human
cuagcaaauggggagaagcagag

SEQ ID NO: 1019439 - RNA, 24 nt, Human
cuagcaaauggggagaagcagagg

SEQ ID NO: 1019440 - RNA, 24 nt, Human
cucuguguaaacgaggcagugucc

SEQ ID NO: 1019441 - RNA, 21 nt, Human
cuugaaaaagacaguccuucu

SEQ ID NO: 1019442 - RNA, 18 nt, Human
ggaaaaaaauccauggag

SEQ ID NO: 1019443 - RNA, 22 nt, Human
ggagaagcagaggucugcuucc

SEQ ID NO: 1019444 - RNA, 19 nt, Human
ggcuucugccucagaaacu

SEQ ID NO: 1019445 - RNA, 22 nt, Human
uaaaugauacacacugugugga

SEQ ID NO: 1019446 - RNA, 25 nt, Human
uaacuugucagagaggaagacucag

SEQ ID NO: 1019447 - RNA, 21 nt, Human
uacacacuguguggaccucac

SEQ ID NO: 1019448 - RNA, 23 nt, Human
uacuccuucaguauaauuacacu

SEQ ID NO: 1019449 - RNA, 21 nt, Human
uccaugcccuaacuugucaga

SEQ ID NO: 1019450 - RNA, 22 nt, Human
uccgacacauggacuaugcaac

SEQ ID NO: 1019451 - RNA, 22 nt, Human
uccuuagauguuggggcuucca

SEQ ID NO: 1019452 - RNA, 19 nt, Human
ucucuggcacaaagcuggg

SEQ ID NO: 1019453 - RNA, 20 nt, Human
ucuugaaaaagacaguccuu

SEQ ID NO: 1019454 - RNA, 20 nt, Human
ugacauaaacggcaagagcc

SEQ ID NO: 1019455 - RNA, 22 nt, Human
ugauacggcuucugccucagaa

SEQ ID NO: 1019456 - RNA, 18 nt, Human
ugccucagaaacugucag

SEQ ID NO: 1019457 - RNA, 20 nt, Human
uggcaagcugccaacaacac

SEQ ID NO: 1019458 - RNA, 21 nt, Human
uguaaaaaacaaagcaacgug

SEQ ID NO: 1019459 - RNA, 19 nt, Human
uuccuugagcagguucagg

SEQ ID NO: 1019460 - RNA, 18 nt, Human
aaaacaagaaaaaaugga

SEQ ID NO: 1019461 - RNA, 19 nt, Human
aaaacaagaaaaaauggag

SEQ ID NO: 1019462 - RNA, 27 nt, Human
aaacaagaaaaaauggaggggggaccc

SEQ ID NO: 1019463 - RNA, 22 nt, Human
aaacagacgccaucauucucca

SEQ ID NO: 1019464 - RNA, 19 nt, Human
aaacagcaaacuuggcagc

SEQ ID NO: 1019465 - RNA, 18 nt, Human
aaacuuggcagcaggaug

SEQ ID NO: 1019466 - RNA, 20 nt, Human
aagaaacagcaaacuuggca

SEQ ID NO: 1019467 - RNA, 23 nt, Human
aagcaaccgcaaaucauccaagg

SEQ ID NO: 1019468 - RNA, 18 nt, Human
aagcauuggcaugaauga

SEQ ID NO: 1019469 - RNA, 25 nt, Human
aaggugaacaaccuuaaguaacaaa

SEQ ID NO: 1019470 - RNA, 18 nt, Human
aagguuauucagagcagg

SEQ ID NO: 1019471 - RNA, 24 nt, Human
acaaacucaaauaaccacugguac

SEQ ID NO: 1019472 - RNA, 22 nt, Human
acaccgcaagucccagaccaca

SEQ ID NO: 1019473 - RNA, 19 nt, Human
accccagagcccacuccca

SEQ ID NO: 1019474 - RNA, 23 nt, Human
accccagagcccacucccauccc

SEQ ID NO: 1019475 - RNA, 18 nt, Human
accccuauggcccgacuc

SEQ ID NO: 1019476 - RNA, 20 nt, Human
accgcaagucccagaccacg

SEQ ID NO: 1019477 - RNA, 18 nt, Human
accugaaggugccaagaa

SEQ ID NO: 1019478 - RNA, 21 nt, Human
agaacgccaaccccagcccac

SEQ ID NO: 1019479 - RNA, 23 nt, Human
agaacgccaaccccagcccacaa

SEQ ID NO: 1019480 - RNA, 23 nt, Human
agaacucuuccaggcagcugcuc

SEQ ID NO: 1019481 - RNA, 28 nt, Human
agagcccacucccauccccccagacagc

SEQ ID NO: 1019482 - RNA, 24 nt, Human
agagccccauuaacaacucccucc

SEQ ID NO: 1019483 - RNA, 21 nt, Human
agagcuccuucugccaauccu

SEQ ID NO: 1019484 - RNA, 18 nt, Human
agcaggaugaagaccugg

SEQ ID NO: 1019485 - RNA, 21 nt, Human
agcccacucccauccccccag

SEQ ID NO: 1019486 - RNA, 19 nt, Human
aggaggaggugggaagagg

SEQ ID NO: 1019487 - RNA, 26 nt, Human
aggaggaggugggaagagggggaccc

SEQ ID NO: 1019488 - RNA, 22 nt, Human
aggcaaucacaaacaacugccc

SEQ ID NO: 1019489 - RNA, 24 nt, Human
aggcugcagaacauagccaggagg

SEQ ID NO: 1019490 - RNA, 18 nt, Human
aggugccaagaaacagca

SEQ ID NO: 1019491 - RNA, 22 nt, Human
aggugccaagaaacagcaaacu

SEQ ID NO: 1019492 - RNA, 24 nt, Human
augccaccccccuccaucccccag

SEQ ID NO: 1019493 - RNA, 22 nt, Human
caacacuccugagacaagccau

SEQ ID NO: 1019494 - RNA, 24 nt, Human
caacucuuaaaauguaaaaaacaa

SEQ ID NO: 1019495 - RNA, 22 nt, Human
caaggaccuucagagagaccag

SEQ ID NO: 1019496 - RNA, 22 nt, Human
caagucccagaccacagccaua

SEQ ID NO: 1019497 - RNA, 18 nt, Human
cacauaugaccccagagc

SEQ ID NO: 1019498 - RNA, 19 nt, Human
cacauaugaccccagagcc

SEQ ID NO: 1019499 - RNA, 22 nt, Human
cacccagcaucucuguacccaa

SEQ ID NO: 1019500 - RNA, 20 nt, Human
caccccccuccaucccccag

SEQ ID NO: 1019501 - RNA, 23 nt, Human
caccgcaagucccagaccacagc

SEQ ID NO: 1019502 - RNA, 20 nt, Human
caccguguccccugcucucc

SEQ ID NO: 1019503 - RNA, 24 nt, Human
cagaacgccaaccccagcccacaa

SEQ ID NO: 1019504 - RNA, 21 nt, Human
cagagcccacucccauccccc

SEQ ID NO: 1019505 - RNA, 22 nt, Human
cagagcccacucccaucccccc

SEQ ID NO: 1019506 - RNA, 25 nt, Human
cagagcccacucccauccccccaga

SEQ ID NO: 1019507 - RNA, 21 nt, Human
cagauucucccauuccugcuc

SEQ ID NO: 1019508 - RNA, 22 nt, Human
ccaacuccgcuucucccucugu

SEQ ID NO: 1019509 - RNA, 22 nt, Human
ccacaggguuuucaggacagcc

SEQ ID NO: 1019510 - RNA, 21 nt, Human
ccacucccauccccccagaca

SEQ ID NO: 1019511 - RNA, 19 nt, Human
cccacucccauccccccag

SEQ ID NO: 1019512 - RNA, 20 nt, Human
cccagagcccacucccaucc

SEQ ID NO: 1019513 - RNA, 23 nt, Human
cccauuaacaacucccuccuaga

SEQ ID NO: 1019514 - RNA, 21 nt, Human
ccccagacagcagcggggcac

SEQ ID NO: 1019515 - RNA, 20 nt, Human
ccccagagcccacucccauc

SEQ ID NO: 1019516 - RNA, 24 nt, Human
ccccagagcccacucccauccccc

SEQ ID NO: 1019517 - RNA, 25 nt, Human
ccccagagcccacucccaucccccc

SEQ ID NO: 1019518 - RNA, 24 nt, Human
ccccauuaacaacucccuccuaga

SEQ ID NO: 1019519 - RNA, 21 nt, Human
ccccuauggcccgacucaacc

SEQ ID NO: 1019520 - RNA, 20 nt, Human
cccugcucuccggccuaagu

SEQ ID NO: 1019521 - RNA, 20 nt, Human
ccucuugguccuuuugagac

SEQ ID NO: 1019522 - RNA, 19 nt, Human
ccuucugccaauccuccag

SEQ ID NO: 1019523 - RNA, 24 nt, Human
cucuguacccaacuccgcuucucc

SEQ ID NO: 1019524 - RNA, 20 nt, Human
gaaccagccaccagucccug

SEQ ID NO: 1019525 - RNA, 22 nt, Human
gaacgccaaccccagcccacaa

SEQ ID NO: 1019526 - RNA, 22 nt, Human
gacagcagcggggcacacauuc

SEQ ID NO: 1019527 - RNA, 20 nt, Human
gagacaagccaucugugugc

SEQ ID NO: 1019528 - RNA, 24 nt, Human
gcaccacaggaccuuccucuucca

SEQ ID NO: 1019529 - RNA, 25 nt, Human
gcagcggggcacacauucaacaccg

SEQ ID NO: 1019530 - RNA, 22 nt, Human
gccaauccuccagauucuccca

SEQ ID NO: 1019531 - RNA, 23 nt, Human
gcccacucccauccccccagaca

SEQ ID NO: 1019532 - RNA, 24 nt, Human
gcccuggaaccagccaccaguccc

SEQ ID NO: 1019533 - RNA, 20 nt, Human
gccuuugggcuuggcuuggu

SEQ ID NO: 1019534 - RNA, 24 nt, Human
ggaggaggugggaagaggagaggg

SEQ ID NO: 1019535 - RNA, 23 nt, Human
ggaggugggaagaggagaggggu

SEQ ID NO: 1019536 - RNA, 19 nt, Human
ggcacacauucaacacucc

SEQ ID NO: 1019537 - RNA, 24 nt, Human
gggaaccuagcaccguguccccug

SEQ ID NO: 1019538 - RNA, 20 nt, Human
ggugccaagaaacagcaaac

SEQ ID NO: 1019539 - RNA, 19 nt, Human
gucccugacugcagugucu

SEQ ID NO: 1019540 - RNA, 18 nt, Human
guuauacuucccagaacu

SEQ ID NO: 1019541 - RNA, 22 nt, Human
uaaaacaagaaaaaauggaggg

SEQ ID NO: 1019542 - RNA, 23 nt, Human
uaaguaagcaucagugggcuaaa

SEQ ID NO: 1019543 - RNA, 20 nt, Human
uaauuccaaaaaagguuauu

SEQ ID NO: 1019544 - RNA, 21 nt, Human
uauucagagcagggcuaagca

SEQ ID NO: 1019545 - RNA, 22 nt, Human
ucagaacgccaaccccagccca

SEQ ID NO: 1019546 - RNA, 18 nt, Human
ucaggaagaacucagucc

SEQ ID NO: 1019547 - RNA, 19 nt, Human
ucccagaacucuuccaggc

SEQ ID NO: 1019548 - RNA, 20 nt, Human
ucccuguggggucagaacgc

SEQ ID NO: 1019549 - RNA, 23 nt, Human
ucccuguggggucagaacgccaa

SEQ ID NO: 1019550 - RNA, 26 nt, Human
ugaaacagacgccaucauucuccagg

SEQ ID NO: 1019551 - RNA, 20 nt, Human
ugaccccagagcccacuccc

SEQ ID NO: 1019552 - RNA, 19 nt, Human
ugagaaaaccagagaccug

SEQ ID NO: 1019553 - RNA, 23 nt, Human
ugagaaaaccagagaccugaagg

SEQ ID NO: 1019554 - RNA, 26 nt, Human
ugccaccccccuccaucccccagacg

SEQ ID NO: 1019555 - RNA, 21 nt, Human
uggcaugaaugagaaaaccag

SEQ ID NO: 1019556 - RNA, 22 nt, Human
uggcaugaaugagaaaaccaga

SEQ ID NO: 1019557 - RNA, 24 nt, Human
uggcaugaaugagaaaaccagaga

SEQ ID NO: 1019558 - RNA, 19 nt, Human
uggccuggacucuucuucc

SEQ ID NO: 1019559 - RNA, 19 nt, Human
ugggaagaggagaggggua

SEQ ID NO: 1019560 - RNA, 25 nt, Human
ugggugggcaccacaggaccuuccu

SEQ ID NO: 1019561 - RNA, 21 nt, Human
uuauucagagcagggcuaagc

SEQ ID NO: 1019562 - RNA, 20 nt, Human
uucacauaugaccccagagc

SEQ ID NO: 1019563 - RNA, 22 nt, Human
uucacuggaaucuuucuucuca

SEQ ID NO: 1019564 - RNA, 21 nt, Human
uugguacugggacaagggaag

SEQ ID NO: 1019565 - RNA, 18 nt, Human
aagcaggaugugccgugg

SEQ ID NO: 1019566 - RNA, 23 nt, Human
aagcaggaugugccguggcuggg

SEQ ID NO: 1019567 - RNA, 18 nt, Human
aagcuggcagagcggcgc

SEQ ID NO: 1019568 - RNA, 23 nt, Human
acaaagcaggaugugccguggcu

SEQ ID NO: 1019569 - RNA, 25 nt, Human
acagcccgggagguggccacagaug

SEQ ID NO: 1019570 - RNA, 22 nt, Human
acccauggacccaccccacagg

SEQ ID NO: 1019571 - RNA, 24 nt, Human
accgcagccucgcccgcggggcga

SEQ ID NO: 1019572 - RNA, 23 nt, Human
agaccugaguccuugccacccug

SEQ ID NO: 1019573 - RNA, 20 nt, Human
agcagcccccuggggggcca

SEQ ID NO: 1019574 - RNA, 23 nt, Human
agcccgggagguggccacagaug

SEQ ID NO: 1019575 - RNA, 20 nt, Human
aggaaaagauggcagccagg

SEQ ID NO: 1019576 - RNA, 24 nt, Human
aggcacagguugguagggcagagg

SEQ ID NO: 1019577 - RNA, 23 nt, Human
aggcgcccuguucuuggucucca

SEQ ID NO: 1019578 - RNA, 23 nt, Human
aggcgggaaggcgagccagccgg

SEQ ID NO: 1019579 - RNA, 22 nt, Human
agggagccaguaccgguggagc

SEQ ID NO: 1019580 - RNA, 23 nt, Human
agguggccacagauggaaggaga

SEQ ID NO: 1019581 - RNA, 18 nt, Human
agugccgauggagcaggg

SEQ ID NO: 1019582 - RNA, 18 nt, Human
agugccgauggagcaggg

SEQ ID NO: 1019583 - RNA, 20 nt, Human
agugccgcuggaguuggggc

SEQ ID NO: 1019584 - RNA, 21 nt, Human
caccagugccgauggagcagg

SEQ ID NO: 1019585 - RNA, 26 nt, Human
cagaaagccccugccgccgugacuaa

SEQ ID NO: 1019586 - RNA, 22 nt, Human
cagaggccugacccauggaccc

SEQ ID NO: 1019587 - RNA, 23 nt, Human
cagcagcccccuggggggccaag

SEQ ID NO: 1019588 - RNA, 21 nt, Human
cagcccgggagguggccacag

SEQ ID NO: 1019589 - RNA, 27 nt, Human
caggcgcccuguucuuggucuccaggg

SEQ ID NO: 1019590 - RNA, 21 nt, Human
cagggugggggccaaagagcc

SEQ ID NO: 1019591 - RNA, 19 nt, Human
ccacacagucaaaugaggc

SEQ ID NO: 1019592 - RNA, 20 nt, Human
ccagugccgauggagcaggg

SEQ ID NO: 1019593 - RNA, 27 nt, Human
ccagugccgauggagcagggugccggg

SEQ ID NO: 1019594 - RNA, 19 nt, Human
ccagugccguuggagcugg

SEQ ID NO: 1019595 - RNA, 24 nt, Human
cccccggguuuccggccaagccag

SEQ ID NO: 1019596 - RNA, 24 nt, Human
cccccggguuuccggccccgaccc

SEQ ID NO: 1019597 - RNA, 24 nt, Human
ccccuggggggccaaggccagucc

SEQ ID NO: 1019598 - RNA, 19 nt, Human
cccugugguagcugggcug

SEQ ID NO: 1019599 - RNA, 22 nt, Human
ccgguggagcugggcguuggug

SEQ ID NO: 1019600 - RNA, 23 nt, Human
ccugacccauggacccaccccac

SEQ ID NO: 1019601 - RNA, 20 nt, Human
ccugaggcucaggguugguc

SEQ ID NO: 1019602 - RNA, 30 nt, Human
cgcggucccacaggugugggcugucucucu

SEQ ID NO: 1019603 - RNA, 20 nt, Human
cgcuggagccaccauuaucc

SEQ ID NO: 1019604 - RNA, 22 nt, Human
cggagcccggugcuugauguug

SEQ ID NO: 1019605 - RNA, 25 nt, Human
cggagcccggugcuugauguuggag

SEQ ID NO: 1019606 - RNA, 19 nt, Human
cggcaggcgggaaggcgag

SEQ ID NO: 1019607 - RNA, 21 nt, Human
cuagcagugcgcgcgcccucc

SEQ ID NO: 1019608 - RNA, 18 nt, Human
cuccaggguuggccuccu

SEQ ID NO: 1019609 - RNA, 21 nt, Human
gaaaagauggcagccaggcgc

SEQ ID NO: 1019610 - RNA, 24 nt, Human
gaaagccccugccgccgugacuaa

SEQ ID NO: 1019611 - RNA, 18 nt, Human
gacccauggacccacccc

SEQ ID NO: 1019612 - RNA, 22 nt, Human
gagccaguaccgguggagcugg

SEQ ID NO: 1019613 - RNA, 21 nt, Human
gagcggcgcgggggaccagca

SEQ ID NO: 1019614 - RNA, 21 nt, Human
gaggcucgggggcuucuggga

SEQ ID NO: 1019615 - RNA, 20 nt, Human
gcaaaggcaggccgaguccg

SEQ ID NO: 1019616 - RNA, 19 nt, Human
gccccgcgcuguccaccgc

SEQ ID NO: 1019617 - RNA, 20 nt, Human
gcccgcggggcgagcggcga

SEQ ID NO: 1019618 - RNA, 20 nt, Human
gccggagccccgcgcugucc

SEQ ID NO: 1019619 - RNA, 18 nt, Human
gccuccugucgcuggagc

SEQ ID NO: 1019620 - RNA, 22 nt, Human
gccuggaaacgggagugggagg

SEQ ID NO: 1019621 - RNA, 19 nt, Human
ggagcagggcguuagugcu

SEQ ID NO: 1019622 - RNA, 19 nt, Human
ggagcagggugguagugcc

SEQ ID NO: 1019623 - RNA, 22 nt, Human
ggaguggggcgccgaguggggc

SEQ ID NO: 1019624 - RNA, 21 nt, Human
ggcacagguugguagggcaga

SEQ ID NO: 1019625 - RNA, 21 nt, Human
ggccgagggcaaaggcaggcc

SEQ ID NO: 1019626 - RNA, 19 nt, Human
ggccugaggcucaggguug

SEQ ID NO: 1019627 - RNA, 19 nt, Human
ggcugggccucccccgggu

SEQ ID NO: 1019628 - RNA, 18 nt, Human
gggcgggaggggaaggcu

SEQ ID NO: 1019629 - RNA, 22 nt, Human
gguagugccgauggagccggac

SEQ ID NO: 1019630 - RNA, 21 nt, Human
guggccacagauggaaggaga

SEQ ID NO: 1019631 - RNA, 24 nt, Human
uacccuggggucccucggacagcc

SEQ ID NO: 1019632 - RNA, 20 nt, Human
uaggccgagggcaaaggcag

SEQ ID NO: 1019633 - RNA, 21 nt, Human
ucccaaaguccagcagccccc

SEQ ID NO: 1019634 - RNA, 25 nt, Human
ucccacaggugugggcugucucucc

SEQ ID NO: 1019635 - RNA, 19 nt, Human
ucccggccacucggagccc

SEQ ID NO: 1019636 - RNA, 19 nt, Human
uccguucccuuugagcgcu

SEQ ID NO: 1019637 - RNA, 25 nt, Human
uccuccacgcccacugaaaggcaca

SEQ ID NO: 1019638 - RNA, 18 nt, Human
ucuccaggguuggccucc

SEQ ID NO: 1019639 - RNA, 19 nt, Human
ugacccauggacccacccc

SEQ ID NO: 1019640 - RNA, 24 nt, Human
ugacuaagacccgcggucccacag

SEQ ID NO: 1019641 - RNA, 19 nt, Human
ugaugauggagcagggugg

SEQ ID NO: 1019642 - RNA, 22 nt, Human
ugauggaguggggcgccgagug

SEQ ID NO: 1019643 - RNA, 23 nt, Human
ugccaggaauguguuggggcucc

SEQ ID NO: 1019644 - RNA, 23 nt, Human
uggaauggggcaccagugccguu

SEQ ID NO: 1019645 - RNA, 24 nt, Human
uggagccaccauuauccucaccag

SEQ ID NO: 1019646 - RNA, 23 nt, Human
uggagcggggugguagugccgau

SEQ ID NO: 1019647 - RNA, 23 nt, Human
uggagugggacaccagugccgau

SEQ ID NO: 1019648 - RNA, 20 nt, Human
uggaguggggcaccaauguc

SEQ ID NO: 1019649 - RNA, 19 nt, Human
uggcagagcggcgcggggg

SEQ ID NO: 1019650 - RNA, 19 nt, Human
uggcugggccucccccggg

SEQ ID NO: 1019651 - RNA, 25 nt, Human
ugggccccagaaccuguacuuucag

SEQ ID NO: 1019652 - RNA, 20 nt, Human
ugguagugccgauggagccg

SEQ ID NO: 1019653 - RNA, 19 nt, Human
uuagugccgauggaauggg

SEQ ID NO: 1019654 - RNA, 20 nt, Human
uuagugccgauggagcaggg

SEQ ID NO: 1019655 - RNA, 20 nt, Human
uuagugccgauggagcaggg

SEQ ID NO: 1019656 - RNA, 19 nt, Human
uuagugccgauggagcggg

SEQ ID NO: 1019657 - RNA, 23 nt, Human
uuagugccgcuggaguuggggcg

SEQ ID NO: 1019658 - RNA, 19 nt, Human
uuagugcugauggaguggg

SEQ ID NO: 1019659 - RNA, 19 nt, Human
uuagugcugauggaguggg

SEQ ID NO: 1019660 - RNA, 19 nt, Human
aaaaauaaaauaaaccaaa

SEQ ID NO: 1019661 - RNA, 20 nt, Human
aaaaaugugcaucuuaugcc

SEQ ID NO: 1019662 - RNA, 24 nt, Human
aaacccacaacaaaaugaacccaa

SEQ ID NO: 1019663 - RNA, 24 nt, Human
aaaguuguaagaacucaagaauau

SEQ ID NO: 1019664 - RNA, 27 nt, Human
aaauagcuacgaaacucacaccgugau

SEQ ID NO: 1019665 - RNA, 27 nt, Human
aacccacaacaaaaugaacccaaaaaa

SEQ ID NO: 1019666 - RNA, 27 nt, Human
aacccuugagauguauauaacauuuaa

SEQ ID NO: 1019667 - RNA, 24 nt, Human
aagagaagaucagguuuucuaaaa

SEQ ID NO: 1019668 - RNA, 18 nt, Human
aagagguuaaucuccucu

SEQ ID NO: 1019669 - RNA, 25 nt, Human
aagcaucaagacccucaguuagcau

SEQ ID NO: 1019670 - RNA, 22 nt, Human
aaguaggaaaugaaagguuggg

SEQ ID NO: 1019671 - RNA, 18 nt, Human
aaguuuuacaccauggaa

SEQ ID NO: 1019672 - RNA, 20 nt, Human
acaaaacagaaugccacccc

SEQ ID NO: 1019673 - RNA, 28 nt, Human
acaacaaaaugaacccaaaaaaaagaga

SEQ ID NO: 1019674 - RNA, 20 nt, Human
acacacaucugcgccaucuc

SEQ ID NO: 1019675 - RNA, 19 nt, Human
acaccauggaaaacaagau

SEQ ID NO: 1019676 - RNA, 18 nt, Human
acuagaaacaagaggcug

SEQ ID NO: 1019677 - RNA, 18 nt, Human
acucacaggagaggugcu

SEQ ID NO: 1019678 - RNA, 19 nt, Human
agaaagaaccuaagaggca

SEQ ID NO: 1019679 - RNA, 22 nt, Human
agagaaaagagaauggaguugg

SEQ ID NO: 1019680 - RNA, 20 nt, Human
agcaaguaauaggaagagaa

SEQ ID NO: 1019681 - RNA, 22 nt, Human
agcauuuuccugccucacuuua

SEQ ID NO: 1019682 - RNA, 23 nt, Human
aggaaaugaaagguuggguuugg

SEQ ID NO: 1019683 - RNA, 25 nt, Human
agguuaaucuccucuuuuugauugu

SEQ ID NO: 1019684 - RNA, 24 nt, Human
aguaaggcucuuuuuaauuaugaa

SEQ ID NO: 1019685 - RNA, 22 nt, Human
agucaaaggcucaagcaucaag

SEQ ID NO: 1019686 - RNA, 24 nt, Human
aucaagacccucaguuagcauuuc

SEQ ID NO: 1019687 - RNA, 21 nt, Human
aucacuaaaauguacagucau

SEQ ID NO: 1019688 - RNA, 24 nt, Human
auccugaugcugaguaaguuuuac

SEQ ID NO: 1019689 - RNA, 27 nt, Human
caaaacccacaacaaaaugaacccaaa

SEQ ID NO: 1019690 - RNA, 20 nt, Human
caacauaaaauaaacuguuu

SEQ ID NO: 1019691 - RNA, 21 nt, Human
caagauugugaagaaaaccaa

SEQ ID NO: 1019692 - RNA, 23 nt, Human
cacaaaacagaaugccaccccaa

SEQ ID NO: 1019693 - RNA, 20 nt, Human
cacaaauucuguccaugugg

SEQ ID NO: 1019694 - RNA, 24 nt, Human
cacaacaaaaugaacccaaaaaaa

SEQ ID NO: 1019695 - RNA, 22 nt, Human
caccaggugguaaaaaaacaag

SEQ ID NO: 1019696 - RNA, 20 nt, Human
cauuagccacucacaggaga

SEQ ID NO: 1019697 - RNA, 23 nt, Human
cauucccggcuccagagcagaaa

SEQ ID NO: 1019698 - RNA, 23 nt, Human
ccaugugguauguaaagaaagua

SEQ ID NO: 1019699 - RNA, 23 nt, Human
cccacaacaaaaugaacccaaaa

SEQ ID NO: 1019700 - RNA, 26 nt, Human
cccacaacaaaaugaacccaaaaagg

SEQ ID NO: 1019701 - RNA, 19 nt, Human
ccccaauuguacuauagaa

SEQ ID NO: 1019702 - RNA, 26 nt, Human
cccggggccccgggccggaccgcgga

SEQ ID NO: 1019703 - RNA, 22 nt, Human
cgaaacucacaccgugaucucc

SEQ ID NO: 1019704 - RNA, 18 nt, Human
cggggccccgggccggac

SEQ ID NO: 1019705 - RNA, 20 nt, Human
gaagagaaugggcaaacugg

SEQ ID NO: 1019706 - RNA, 19 nt, Human
gagaucccggggccccggg

SEQ ID NO: 1019707 - RNA, 27 nt, Human
gcaaacagugaggggaaaccgguaccc

SEQ ID NO: 1019708 - RNA, 20 nt, Human
ggaaagggucugguuaaccc

SEQ ID NO: 1019709 - RNA, 19 nt, Human
ggagcuuggguuguucucc

SEQ ID NO: 1019710 - RNA, 24 nt, Human
gucuccccuaagugccuccugcug

SEQ ID NO: 1019711 - RNA, 22 nt, Human
gugaagaaaaccaaaacccaca

SEQ ID NO: 1019712 - RNA, 20 nt, Human
uaaagaaacauucuugggga

SEQ ID NO: 1019713 - RNA, 22 nt, Human
uaauauuaacaauaauaauaag

SEQ ID NO: 1019714 - RNA, 21 nt, Human
uagcaccacacaugggucucg

SEQ ID NO: 1019715 - RNA, 25 nt, Human
uauuccuccaaaggcuggauuugga

SEQ ID NO: 1019716 - RNA, 21 nt, Human
uauuuuaaaaaagaagaaaaa

SEQ ID NO: 1019717 - RNA, 20 nt, Human
ucaaaguacauacuagaaac

SEQ ID NO: 1019718 - RNA, 22 nt, Human
ucaaaguacauacuagaaacaa

SEQ ID NO: 1019719 - RNA, 25 nt, Human
uccaacuucccaaugaauuucucaa

SEQ ID NO: 1019720 - RNA, 23 nt, Human
uccagagcagaaaaaugugcauc

SEQ ID NO: 1019721 - RNA, 18 nt, Human
uccccauccccaaaucca

SEQ ID NO: 1019722 - RNA, 20 nt, Human
ucucggaggcugggaaccag

SEQ ID NO: 1019723 - RNA, 23 nt, Human
ucucgucauaaaguuguaagaac

SEQ ID NO: 1019724 - RNA, 26 nt, Human
ugaacccaaaaaaaagagaagaucag

SEQ ID NO: 1019725 - RNA, 19 nt, Human
ugaagaaaaccaaaaccca

SEQ ID NO: 1019726 - RNA, 20 nt, Human
ugcacgagagaaaagagaau

SEQ ID NO: 1019727 - RNA, 22 nt, Human
ugcauguuuccccauccccaaa

SEQ ID NO: 1019728 - RNA, 24 nt, Human
ugcgccaucucuuccaacauaaaa

SEQ ID NO: 1019729 - RNA, 19 nt, Human
uggaaugaaguaggaaaug

SEQ ID NO: 1019730 - RNA, 20 nt, Human
uggggaaggguuucaagagg

SEQ ID NO: 1019731 - RNA, 27 nt, Human
uguaaaauguucaagauugugaagaaa

SEQ ID NO: 1019732 - RNA, 21 nt, Human
ugugaagaaaaccaaaaccca

SEQ ID NO: 1019733 - RNA, 18 nt, Human
ugugugaggaguggaggg

SEQ ID NO: 1019734 - RNA, 20 nt, Human
ugugugugugaggaguggag

SEQ ID NO: 1019735 - RNA, 22 nt, Human
uucaaugaaguccgucuauaaa

SEQ ID NO: 1019736 - RNA, 19 nt, Human
uucaaugguuugucaguua

SEQ ID NO: 1019737 - RNA, 20 nt, Human
uucacaaaacagaaugccac

SEQ ID NO: 1019738 - RNA, 21 nt, Human
uucacaaaacagaaugccacc

SEQ ID NO: 1019739 - RNA, 19 nt, Human
uucaccaggugguaaaaaa

SEQ ID NO: 1019740 - RNA, 24 nt, Human
uucaccaggugguaaaaaaacaag

SEQ ID NO: 1019741 - RNA, 21 nt, Human
uucuuggggaaggguuucaag

SEQ ID NO: 1019742 - RNA, 21 nt, Human
uuggggaaggguuucaagagg

SEQ ID NO: 1019743 - RNA, 20 nt, Human
uuuaagaaagaaccuaagag

SEQ ID NO: 1019744 - RNA, 22 nt, Human
uuugaaaugucuuccaacuucc

SEQ ID NO: 1019745 - RNA, 27 nt, Human
aaaaaaaaaaaagauaugaucuaugua

SEQ ID NO: 1019746 - RNA, 24 nt, Human
aaagagugagacucugucucaaaa

SEQ ID NO: 1019747 - RNA, 22 nt, Human
aaagcucuucccacaguucucu

SEQ ID NO: 1019748 - RNA, 18 nt, Human
aacacggugaaaccccgu

SEQ ID NO: 1019749 - RNA, 19 nt, Human
aacacggugaaaccccguu

SEQ ID NO: 1019750 - RNA, 21 nt, Human
aacacggugaaaccccguuuu

SEQ ID NO: 1019751 - RNA, 23 nt, Human
aacacggugaaaccccguuuuua

SEQ ID NO: 1019752 - RNA, 24 nt, Human
aauggcgugaacuugggaggcgga

SEQ ID NO: 1019753 - RNA, 21 nt, Human
aauuguaggcuguuugaagca

SEQ ID NO: 1019754 - RNA, 24 nt, Human
accccguuuuuacuaaaaauacaa

SEQ ID NO: 1019755 - RNA, 18 nt, Human
acugcagucaggcuuggg

SEQ ID NO: 1019756 - RNA, 21 nt, Human
aggcaggagaauggcgugaac

SEQ ID NO: 1019757 - RNA, 21 nt, Human
aggcaggagaauggcgugaac

SEQ ID NO: 1019758 - RNA, 24 nt, Human
aggcaggagaauggcgugaacuug

SEQ ID NO: 1019759 - RNA, 24 nt, Human
aggcggagcuugcagcgagcugag

SEQ ID NO: 1019760 - RNA, 18 nt, Human
aggcugaggcaggagaau

SEQ ID NO: 1019761 - RNA, 24 nt, Human
auguacaaagcucuucccacaguu

SEQ ID NO: 1019762 - RNA, 22 nt, Human
caaagcccuucccacacuucuc

SEQ ID NO: 1019763 - RNA, 23 nt, Human
caccuguagucccaguuacucgg

SEQ ID NO: 1019764 - RNA, 24 nt, Human
caccuguagucccaguuacucggg

SEQ ID NO: 1019765 - RNA, 24 nt, Human
cacugcagucaggcuugggugaaa

SEQ ID NO: 1019766 - RNA, 20 nt, Human
cagaaaucccuuugcuuucc

SEQ ID NO: 1019767 - RNA, 22 nt, Human
cagguacccuaaguuaucacuc

SEQ ID NO: 1019768 - RNA, 24 nt, Human
caguuacucgggaggcugaggcag

SEQ ID NO: 1019769 - RNA, 18 nt, Human
cccagccaaagcccuucc

SEQ ID NO: 1019770 - RNA, 22 nt, Human
cccagccaaagcccuucccaca

SEQ ID NO: 1019771 - RNA, 19 nt, Human
ccgcagccguagcucccgc

SEQ ID NO: 1019772 - RNA, 23 nt, Human
ccuggcuaacacggugaaacccc

SEQ ID NO: 1019773 - RNA, 24 nt, Human
ccuggcuaacacggugaaaccccg

SEQ ID NO: 1019774 - RNA, 21 nt, Human
ccuguagucccaguuacucgg

SEQ ID NO: 1019775 - RNA, 23 nt, Human
cgacggugcuuccuuuccucuaa

SEQ ID NO: 1019776 - RNA, 24 nt, Human
cgagaccauccuggcuaacacggu

SEQ ID NO: 1019777 - RNA, 18 nt, Human
cgccacugcagucaggcu

SEQ ID NO: 1019778 - RNA, 19 nt, Human
cgggcaccuguagucccag

SEQ ID NO: 1019779 - RNA, 19 nt, Human
cucugucucaaaaaaaaaa

SEQ ID NO: 1019780 - RNA, 18 nt, Human
cuggcuaacacggugaaa

SEQ ID NO: 1019781 - RNA, 24 nt, Human
gaaagagugagacucugucucaaa

SEQ ID NO: 1019782 - RNA, 20 nt, Human
gagacgcagaacagcucaaa

SEQ ID NO: 1019783 - RNA, 24 nt, Human
gccacugcagucaggcuuggguga

SEQ ID NO: 1019784 - RNA, 24 nt, Human
gcuaacacggugaaaccccguuuu

SEQ ID NO: 1019785 - RNA, 22 nt, Human
gcugaggcaggagaauggcgug

SEQ ID NO: 1019786 - RNA, 23 nt, Human
gcuugggugaaagagugagacuc

SEQ ID NO: 1019787 - RNA, 21 nt, Human
ggcgggcaccuguagucccag

SEQ ID NO: 1019788 - RNA, 24 nt, Human
gggugugguggcgggcaccuguag

SEQ ID NO: 1019789 - RNA, 24 nt, Human
gguggcgggcaccuguagucccag

SEQ ID NO: 1019790 - RNA, 21 nt, Human
gucucaaaaaaaaaaaaaaag

SEQ ID NO: 1019791 - RNA, 24 nt, Human
gugaaagagugagacucugucuca

SEQ ID NO: 1019792 - RNA, 18 nt, Human
uaacacggugaaaccccg

SEQ ID NO: 1019793 - RNA, 19 nt, Human
uaacacggugaaaccccgu

SEQ ID NO: 1019794 - RNA, 19 nt, Human
uaacacggugaaaccccgu

SEQ ID NO: 1019795 - RNA, 23 nt, Human
uaacucccgcagccguagcuccc

SEQ ID NO: 1019796 - RNA, 18 nt, Human
uacuaaaaauacaaaaaa

SEQ ID NO: 1019797 - RNA, 24 nt, Human
uaucacagaauaaaggguaacucc

SEQ ID NO: 1019798 - RNA, 24 nt, Human
uaugaucuauguacaaagcucuuc

SEQ ID NO: 1019799 - RNA, 23 nt, Human
uauguacaaagcucuucccacag

SEQ ID NO: 1019800 - RNA, 20 nt, Human
ucaaaaaaaaaaaaaaagau

SEQ ID NO: 1019801 - RNA, 24 nt, Human
ucaggcuugggugaaagagugaga

SEQ ID NO: 1019802 - RNA, 23 nt, Human
ucugucucaaaaaaaaaaaaaaa

SEQ ID NO: 1019803 - RNA, 23 nt, Human
ugaggcaggagaauggcgugaac

SEQ ID NO: 1019804 - RNA, 23 nt, Human
ugaggcaggagaauggcgugaac

SEQ ID NO: 1019805 - RNA, 23 nt, Human
ugccagguacccuaaguuaucac

SEQ ID NO: 1019806 - RNA, 20 nt, Human
ugggucagaugaguugaggc

SEQ ID NO: 1019807 - RNA, 21 nt, Human
ugggugaaagagugagacucu

SEQ ID NO: 1019808 - RNA, 24 nt, Human
ugguggcgggcaccuguaguccca

SEQ ID NO: 1019809 - RNA, 18 nt, Human
uuagcugggugugguggc

SEQ ID NO: 1019810 - RNA, 24 nt, Human
uuagcugggugugguggcgggcac

SEQ ID NO: 1019811 - RNA, 24 nt, Human
uucagaagggccugcgagacgcag

SEQ ID NO: 1019812 - RNA, 19 nt, Human
uugaagcagugaggcagcc

SEQ ID NO: 1019813 - RNA, 19 nt, Human
uugcagcgagcugagauag

SEQ ID NO: 1019814 - RNA, 22 nt, Human
uugcagcgagcugagauagcgc

SEQ ID NO: 1019815 - RNA, 25 nt, Human
aucauugggugguugcgagccccaa

SEQ ID NO: 1019816 - RNA, 24 nt, Human
caagaagucccuucccugcagcuc

SEQ ID NO: 1019817 - RNA, 19 nt, Human
cacuccauaaauauguaua

SEQ ID NO: 1019818 - RNA, 18 nt, Human
ccaagaagucccuucccu

SEQ ID NO: 1019819 - RNA, 19 nt, Human
cugcagcucuuuuagaaag

SEQ ID NO: 1019820 - RNA, 20 nt, Human
gcccaggcuucuuuucuccu

SEQ ID NO: 1019821 - RNA, 21 nt, Human
gcccaggcuucuuuucuccug

SEQ ID NO: 1019822 - RNA, 21 nt, Human
ggaaggacucgcaagaugugg

SEQ ID NO: 1019823 - RNA, 20 nt, Human
gggcucugcucuccgcccag

SEQ ID NO: 1019824 - RNA, 18 nt, Human
ucuccgcccaggcuucuu

SEQ ID NO: 1019825 - RNA, 19 nt, Human
uguaucaaauuucacacuc

SEQ ID NO: 1019826 - RNA, 18 nt, Human
aaacugcagcaaccucag

SEQ ID NO: 1019827 - RNA, 22 nt, Human
aacugcagcaaccucagucccc

SEQ ID NO: 1019828 - RNA, 22 nt, Human
agccccugguacgugggcuucc

SEQ ID NO: 1019829 - RNA, 21 nt, Human
ccccaaacuaucgcggaaaaa

SEQ ID NO: 1019830 - RNA, 29 nt, Human
cgcggaaaaacugcagcaaccucaguccc

SEQ ID NO: 1019831 - RNA, 24 nt, Human
gaaaaacugcagcaaccucagucc

SEQ ID NO: 1019832 - RNA, 22 nt, Human
gacugagugaagacuuuauugc

SEQ ID NO: 1019833 - RNA, 20 nt, Human
uccugggaaagcagaauugu

SEQ ID NO: 1019834 - RNA, 20 nt, Human
ugaugcaguuccugggaaag

SEQ ID NO: 1019835 - RNA, 19 nt, Human
uggaaacuugcagaguccu

SEQ ID NO: 1019836 - RNA, 22 nt, Human
uggaaacuugcagaguccugag

SEQ ID NO: 1019837 - RNA, 19 nt, Human
ugguuacagguauguuucu

SEQ ID NO: 1019838 - RNA, 19 nt, Human
aaagcagaauccugccucu

SEQ ID NO: 1019839 - RNA, 21 nt, Human
aacuaccagggacaaaacugc

SEQ ID NO: 1019840 - RNA, 21 nt, Human
acuaccagggacaaaacugcg

SEQ ID NO: 1019841 - RNA, 19 nt, Human
agggacaaaacugcagcaa

SEQ ID NO: 1019842 - RNA, 20 nt, Human
caaccucacaguaacggagc

SEQ ID NO: 1019843 - RNA, 22 nt, Human
caagggaaagcagaauccugcc

SEQ ID NO: 1019844 - RNA, 22 nt, Human
cagaauccugccucugcucucc

SEQ ID NO: 1019845 - RNA, 18 nt, Human
cucgcggaacugacccaa

SEQ ID NO: 1019846 - RNA, 18 nt, Human
cugacccaaacuaccagg

SEQ ID NO: 1019847 - RNA, 23 nt, Human
gaaagcagaauccugccucugcu

SEQ ID NO: 1019848 - RNA, 19 nt, Human
gacccaaacuaccagggac

SEQ ID NO: 1019849 - RNA, 24 nt, Human
uaacuaucacacuguaccccauaa

SEQ ID NO: 1019850 - RNA, 18 nt, Human
uaccagggacaaaacugc

SEQ ID NO: 1019851 - RNA, 21 nt, Human
uaccagggacaaaacugcagc

SEQ ID NO: 1019852 - RNA, 18 nt, Human
uaccccauaaaugaguac

SEQ ID NO: 1019853 - RNA, 19 nt, Human
uaccccauaaaugaguaca

SEQ ID NO: 1019854 - RNA, 19 nt, Human
ugauuugaucauuacacau

SEQ ID NO: 1019855 - RNA, 19 nt, Human
ugcagcaaccucacaguaa

SEQ ID NO: 1019856 - RNA, 21 nt, Human
uguuaauuacacugauuugau

SEQ ID NO: 1019857 - RNA, 22 nt, Human
uuaaggauccagugcguagguc

SEQ ID NO: 1019858 - RNA, 20 nt, Human
caagaaugagccuuucuacc

SEQ ID NO: 1019859 - RNA, 21 nt, Human
cagaaggccuucgguaggcuc

SEQ ID NO: 1019860 - RNA, 20 nt, Human
ccaaacaaaagaccgcuagc

SEQ ID NO: 1019861 - RNA, 22 nt, Human
cuacuccuuuuuuccccaaaca

SEQ ID NO: 1019862 - RNA, 25 nt, Human
cuacuccuuuuuuccccaaacaaaa

SEQ ID NO: 1019863 - RNA, 18 nt, Human
cuggguccuaucugcaaa

SEQ ID NO: 1019864 - RNA, 23 nt, Human
gugcauuucggggaaguuugaaa

SEQ ID NO: 1019865 - RNA, 18 nt, Human
ucagucccucucccaaaa

SEQ ID NO: 1019866 - RNA, 24 nt, Human
ucagucccucucccaaaacagccc

SEQ ID NO: 1019867 - RNA, 18 nt, Human
ucccaaaacagcccaugg

SEQ ID NO: 1019868 - RNA, 23 nt, Human
ucccaaaacagcccaugggguuc

SEQ ID NO: 1019869 - RNA, 26 nt, Human
ucccaaaacagcccaugggguucugc

SEQ ID NO: 1019870 - RNA, 19 nt, Human
uccccaaacaaaagaccgc

SEQ ID NO: 1019871 - RNA, 21 nt, Human
ucccucucccaaaacagccca

SEQ ID NO: 1019872 - RNA, 24 nt, Human
ucuggggaagugcagaguccuaag

SEQ ID NO: 1019873 - RNA, 23 nt, Human
ugcacuguacucagucccucucc

SEQ ID NO: 1019874 - RNA, 22 nt, Human
ugcauuucggggaaguuugaaa

SEQ ID NO: 1019875 - RNA, 20 nt, Human
ugcugcuuugugaaccacag

SEQ ID NO: 1019876 - RNA, 23 nt, Human
ugcuuuuugagaagucaggguuc

SEQ ID NO: 1019877 - RNA, 24 nt, Human
ugcuuuuugagaagucaggguucc

SEQ ID NO: 1019878 - RNA, 19 nt, Human
uguugcacuguacucaguc

SEQ ID NO: 1019879 - RNA, 22 nt, Human
uuccuucuggggaagugcagag

SEQ ID NO: 1019880 - RNA, 19 nt, Human
uucugcugccuccuccucu

SEQ ID NO: 1019881 - RNA, 21 nt, Human
uuugaguaguguugcacugua

SEQ ID NO: 1019882 - RNA, 21 nt, Human
aaaaucccucgugaaaccccu

SEQ ID NO: 1019883 - RNA, 19 nt, Human
aagauggaacaaagggugg

SEQ ID NO: 1019884 - RNA, 19 nt, Human
agcuaaacuucagcagaug

SEQ ID NO: 1019885 - RNA, 19 nt, Human
augaaauguccuaguuuug

SEQ ID NO: 1019886 - RNA, 23 nt, Human
caaaaucccucgugaaaccccuc

SEQ ID NO: 1019887 - RNA, 18 nt, Human
caacauuaaccagaaaca

SEQ ID NO: 1019888 - RNA, 26 nt, Human
caagugcacacauggguacauauaca

SEQ ID NO: 1019889 - RNA, 22 nt, Human
caucucugcucaagauggaaca

SEQ ID NO: 1019890 - RNA, 24 nt, Human
cauuuuugcaacauuaaccagaaa

SEQ ID NO: 1019891 - RNA, 18 nt, Human
ccucgugaaaccccucuc

SEQ ID NO: 1019892 - RNA, 24 nt, Human
cucaagauggaacaaaggguggga

SEQ ID NO: 1019893 - RNA, 18 nt, Human
cucgugaaaccccucuca

SEQ ID NO: 1019894 - RNA, 23 nt, Human
cuggaaaauuucagcucccauuu

SEQ ID NO: 1019895 - RNA, 26 nt, Human
cuugcaaauauuacaguaaaacucug

SEQ ID NO: 1019896 - RNA, 20 nt, Human
cuugcaggauuucuccucca

SEQ ID NO: 1019897 - RNA, 24 nt, Human
gaaaggcagagaccuuucugggag

SEQ ID NO: 1019898 - RNA, 26 nt, Human
gagcaccuacauugcguuaugaaaug

SEQ ID NO: 1019899 - RNA, 23 nt, Human
gaguagaaaaucaauuauguaaa

SEQ ID NO: 1019900 - RNA, 19 nt, Human
gcaacauuaaccagaaaca

SEQ ID NO: 1019901 - RNA, 23 nt, Human
uaaaaaaugcgcuuaaaaauuuc

SEQ ID NO: 1019902 - RNA, 22 nt, Human
uaaauuccugaccauacucaua

SEQ ID NO: 1019903 - RNA, 27 nt, Human
uaaccagaaacauuguuuaucaguuug

SEQ ID NO: 1019904 - RNA, 24 nt, Human
uacauauacacacacacaaagcua

SEQ ID NO: 1019905 - RNA, 20 nt, Human
uauacacacacacaaagcua

SEQ ID NO: 1019906 - RNA, 18 nt, Human
ucagaucaucauaaugcu

SEQ ID NO: 1019907 - RNA, 24 nt, Human
ucccucgugaaaccccucucauua

SEQ ID NO: 1019908 - RNA, 20 nt, Human
ucuuucuuuuucuagagaaa

SEQ ID NO: 1019909 - RNA, 23 nt, Human
ugcacacauggguacauauacac

SEQ ID NO: 1019910 - RNA, 24 nt, Human
uguccuaguuuuguagacuagcaa

SEQ ID NO: 1019911 - RNA, 23 nt, Human
uuaggcaugcucaucacuguacu

SEQ ID NO: 1019912 - RNA, 27 nt, Human
uuuuaaaaauucuuuuucuacugaaag

SEQ ID NO: 1019913 - RNA, 20 nt, Human
aguaauggagcacaaaggaa

SEQ ID NO: 1019914 - RNA, 21 nt, Human
caaguucagaaggacccgccg

SEQ ID NO: 1019915 - RNA, 24 nt, Human
cucaaacuacgcgguuauguagca

SEQ ID NO: 1019916 - RNA, 22 nt, Human
cuccuacuuuuuggagucuuca

SEQ ID NO: 1019917 - RNA, 21 nt, Human
guugcgaccccaagcgaaggu

SEQ ID NO: 1019918 - RNA, 21 nt, Human
uagcaaccgcaggcucccccg

SEQ ID NO: 1019919 - RNA, 31 nt, Human
uauauacacauauuaaaauuucauaccauaa

SEQ ID NO: 1019920 - RNA, 19 nt, Human
ucccaaaacaaagaaaugu

SEQ ID NO: 1019921 - RNA, 19 nt, Human
uucccaaaacaaagaaaug

SEQ ID NO: 1019922 - RNA, 25 nt, Human
uuuuccuccuacuuuuuggagucuu

SEQ ID NO: 1019923 - RNA, 22 nt, Human
aagggcccccucacaggaccag

SEQ ID NO: 1019924 - RNA, 21 nt, Human
ccccucacaggaccaggaggu

SEQ ID NO: 1019925 - RNA, 19 nt, Human
uccuaaaguagauuagacc

SEQ ID NO: 1019926 - RNA, 22 nt, Human
ucugucuggagacguucucccc

SEQ ID NO: 1019927 - RNA, 20 nt, Human
ugucuggagacguucucccc

SEQ ID NO: 1019928 - RNA, 19 nt, Human
aaccggaccaccagguccc

SEQ ID NO: 1019929 - RNA, 21 nt, Human
aaccggaccaccaggucccag

SEQ ID NO: 1019930 - RNA, 19 nt, Human
caccaggucccagcgagcc

SEQ ID NO: 1019931 - RNA, 20 nt, Human
caccaggucccagcgagccc

SEQ ID NO: 1019932 - RNA, 24 nt, Human
caggucccagcgagccccaaucuu

SEQ ID NO: 1019933 - RNA, 21 nt, Human
cauaaccggaccaccaggucc

SEQ ID NO: 1019934 - RNA, 19 nt, Human
cccaaucuuaagucccuga

SEQ ID NO: 1019935 - RNA, 18 nt, Human
cugcucucccacgaggcu

SEQ ID NO: 1019936 - RNA, 20 nt, Human
gcgcaguccuuuuucaggcu

SEQ ID NO: 1019937 - RNA, 21 nt, Human
ggaccaccaggucccagcgag

SEQ ID NO: 1019938 - RNA, 19 nt, Human
uaagucccugacauuagga

SEQ ID NO: 1019939 - RNA, 23 nt, Human
uaagucccugacauuaggagggg

SEQ ID NO: 1019940 - RNA, 21 nt, Human
ucccauaaccggaccaccagg

SEQ ID NO: 1019941 - RNA, 20 nt, Human
ugagagaaggcagaaucgug

SEQ ID NO: 1019942 - RNA, 23 nt, Human
ugccuggaacaguggagcuuugc

SEQ ID NO: 1019943 - RNA, 21 nt, Human
uggagcuuugcuuucaguagc

SEQ ID NO: 1019944 - RNA, 21 nt, Human
uugcagaguccugaguuaugc

SEQ ID NO: 1019945 - RNA, 20 nt, Human
uuucaggcucugcucuccca

SEQ ID NO: 1019946 - RNA, 20 nt, Human
aaacaagauguacuauaaaa

SEQ ID NO: 1019947 - RNA, 21 nt, Human
aagaauccaccccuggcuguu

SEQ ID NO: 1019948 - RNA, 19 nt, Human
acuccagucuuggucugug

SEQ ID NO: 1019949 - RNA, 27 nt, Human
aggcaggugguagagcaaaagggaccc

SEQ ID NO: 1019950 - RNA, 21 nt, Human
auaucccauaagauaguucua

SEQ ID NO: 1019951 - RNA, 24 nt, Human
auccaccccuggcuguuucugauu

SEQ ID NO: 1019952 - RNA, 21 nt, Human
cacccccacucucagcggccc

SEQ ID NO: 1019953 - RNA, 20 nt, Human
cacuguuagccuaaacaaca

SEQ ID NO: 1019954 - RNA, 18 nt, Human
cagccacccccacucuca

SEQ ID NO: 1019955 - RNA, 27 nt, Human
cagccacccccacucucagcggccccu

SEQ ID NO: 1019956 - RNA, 24 nt, Human
cauaauagcacuuaaaaguuaaaa

SEQ ID NO: 1019957 - RNA, 21 nt, Human
cauccagaacacgugcauuau

SEQ ID NO: 1019958 - RNA, 27 nt, Human
ccaaugaacaauggagauauuuccuuc

SEQ ID NO: 1019959 - RNA, 20 nt, Human
ccagccacccccacucucag

SEQ ID NO: 1019960 - RNA, 21 nt, Human
cccagccacccccacucucag

SEQ ID NO: 1019961 - RNA, 20 nt, Human
ccccuggcuguuucugauua

SEQ ID NO: 1019962 - RNA, 22 nt, Human
cguugauaagcugucugucccu

SEQ ID NO: 1019963 - RNA, 23 nt, Human
cguugauaagcugucugucccuu

SEQ ID NO: 1019964 - RNA, 20 nt, Human
cucggccuccgccuccuccu

SEQ ID NO: 1019965 - RNA, 20 nt, Human
cugcucccagccacccccac

SEQ ID NO: 1019966 - RNA, 21 nt, Human
cugggagauccaagaaucagg

SEQ ID NO: 1019967 - RNA, 22 nt, Human
cuuuguagaugcaucuuuuuua

SEQ ID NO: 1019968 - RNA, 18 nt, Human
gaagaaaggcagguggua

SEQ ID NO: 1019969 - RNA, 19 nt, Human
gaagaaugacauuagccuu

SEQ ID NO: 1019970 - RNA, 21 nt, Human
gacugaaguccuuuagcgaca

SEQ ID NO: 1019971 - RNA, 19 nt, Human
ggcuugaaggugauuccug

SEQ ID NO: 1019972 - RNA, 18 nt, Human
guagagcaaaagagguga

SEQ ID NO: 1019973 - RNA, 27 nt, Human
uaaacaacaacuuagguauaaaaaucc

SEQ ID NO: 1019974 - RNA, 19 nt, Human
uaauuucugccaaagccuc

SEQ ID NO: 1019975 - RNA, 22 nt, Human
uacgaaguaaggccacugguga

SEQ ID NO: 1019976 - RNA, 19 nt, Human
uagcugguuuaguaaguug

SEQ ID NO: 1019977 - RNA, 20 nt, Human
uagguauaaaaauccagacc

SEQ ID NO: 1019978 - RNA, 24 nt, Human
uauaaaaauccagaccucugcuaa

SEQ ID NO: 1019979 - RNA, 21 nt, Human
uaugaugaguugcaaauucuc

SEQ ID NO: 1019980 - RNA, 26 nt, Human
uauuaaaaacuccuuuuuuaagauuc

SEQ ID NO: 1019981 - RNA, 22 nt, Human
uccaccccuggcuguuucugau

SEQ ID NO: 1019982 - RNA, 20 nt, Human
ucccagccacccccacucuc

SEQ ID NO: 1019983 - RNA, 25 nt, Human
uccucggccuccgccuccuccuccg

SEQ ID NO: 1019984 - RNA, 24 nt, Human
uccuuauucuuccuuucagcuuca

SEQ ID NO: 1019985 - RNA, 21 nt, Human
uccuucuuaauuucugccaaa

SEQ ID NO: 1019986 - RNA, 19 nt, Human
ucucagcggcccuggacuc

SEQ ID NO: 1019987 - RNA, 20 nt, Human
ugacugaaguccuuuagcga

SEQ ID NO: 1019988 - RNA, 21 nt, Human
ugauuccugguccucggccuc

SEQ ID NO: 1019989 - RNA, 25 nt, Human
uggaagaaugacauuagccuucuuu

SEQ ID NO: 1019990 - RNA, 23 nt, Human
ugguagagcaaaagaggugagcu

SEQ ID NO: 1019991 - RNA, 24 nt, Human
uguauauuaacaccaaaauuacuu

SEQ ID NO: 1019992 - RNA, 25 nt, Human
uuacuccagucuuggucuguggagu

SEQ ID NO: 1019993 - RNA, 21 nt, Human
uucacagggagacaaacaaga

SEQ ID NO: 1019994 - RNA, 18 nt, Human
uucugcuuacgaaguaag

SEQ ID NO: 1019995 - RNA, 20 nt, Human
uuguagaugcaucuuuuuua

SEQ ID NO: 1019996 - RNA, 24 nt, Human
aaaaaaaaaacaaaaaacaaaaaa

SEQ ID NO: 1019997 - RNA, 18 nt, Human
aaaaaaaaaagggaaaaa

SEQ ID NO: 1019998 - RNA, 24 nt, Human
aaaaaagggaaaaacagcaaacgu

SEQ ID NO: 1019999 - RNA, 23 nt, Human
aaaagaaaaagggagcaaacaaa

SEQ ID NO: 1020000 - RNA, 23 nt, Human
aaaaugcuuuugccuugcgugcu

SEQ ID NO: 1020001 - RNA, 24 nt, Human
aaacaaaaaaaaagagagaacgag

SEQ ID NO: 1020002 - RNA, 21 nt, Human
aaacagugcauuuacguucuu

SEQ ID NO: 1020003 - RNA, 21 nt, Human
aaagaaaaagggagcaaacaa

SEQ ID NO: 1020004 - RNA, 23 nt, Human
aaagcaauuaaaaaaaaaaggga

SEQ ID NO: 1020005 - RNA, 21 nt, Human
aacaaaggaagaaugugaaac

SEQ ID NO: 1020006 - RNA, 22 nt, Human
aaccacacguuaggcugcagcc

SEQ ID NO: 1020007 - RNA, 19 nt, Human
aacccaaguucuaaaagcc

SEQ ID NO: 1020008 - RNA, 20 nt, Human
aacuaagagcaucaacacaa

SEQ ID NO: 1020009 - RNA, 20 nt, Human
aacucaugcauuucuguagc

SEQ ID NO: 1020010 - RNA, 22 nt, Human
aagacaaaaaauauauugaaaa

SEQ ID NO: 1020011 - RNA, 22 nt, Human
aagcaccaccaaaucacacgga

SEQ ID NO: 1020012 - RNA, 19 nt, Human
aagcauuuugugacaggac

SEQ ID NO: 1020013 - RNA, 31 nt, Human
aaggaggaaggggagaaaaagaaaaagggaa

SEQ ID NO: 1020014 - RNA, 20 nt, Human
aagggagcaaacaaaaaaaa

SEQ ID NO: 1020015 - RNA, 19 nt, Human
aaguccguuuucucacaga

SEQ ID NO: 1020016 - RNA, 19 nt, Human
aaguucuuugacacccccc

SEQ ID NO: 1020017 - RNA, 22 nt, Human
aaugaccacaaaaagaaaaucc

SEQ ID NO: 1020018 - RNA, 18 nt, Human
acaaagacaaaaaauaua

SEQ ID NO: 1020019 - RNA, 22 nt, Human
accaaaucacacggacaagacc

SEQ ID NO: 1020020 - RNA, 19 nt, Human
accacaaaaagaaaaucca

SEQ ID NO: 1020021 - RNA, 18 nt, Human
accacacguuaggcugca

SEQ ID NO: 1020022 - RNA, 23 nt, Human
accguaccacaacuauauagaga

SEQ ID NO: 1020023 - RNA, 21 nt, Human
accuaaacucugagcuggcau

SEQ ID NO: 1020024 - RNA, 24 nt, Human
acgcaucuccaucuuccuugaacc

SEQ ID NO: 1020025 - RNA, 19 nt, Human
acuggagggaauuucuacu

SEQ ID NO: 1020026 - RNA, 23 nt, Human
acuuuguugggggggaaaaaagg

SEQ ID NO: 1020027 - RNA, 24 nt, Human
agaagaaauuuaauuaacucuacu

SEQ ID NO: 1020028 - RNA, 23 nt, Human
agaaguugccacagaaaguuuua

SEQ ID NO: 1020029 - RNA, 22 nt, Human
agacaggaaaacaaacacugug

SEQ ID NO: 1020030 - RNA, 18 nt, Human
agccuggucaggaacaac

SEQ ID NO: 1020031 - RNA, 23 nt, Human
agggaggguaaggaggaagggga

SEQ ID NO: 1020032 - RNA, 23 nt, Human
agguuuccaacagccagaaaaaa

SEQ ID NO: 1020033 - RNA, 21 nt, Human
aguuggggguggaggguggug

SEQ ID NO: 1020034 - RNA, 21 nt, Human
auaauaaacaaagaaaagucc

SEQ ID NO: 1020035 - RNA, 21 nt, Human
auacaaugcaaacaaagacaa

SEQ ID NO: 1020036 - RNA, 19 nt, Human
auauauguauauauauaua

SEQ ID NO: 1020037 - RNA, 19 nt, Human
auauguauauauauauaua

SEQ ID NO: 1020038 - RNA, 20 nt, Human
auauguauauauauauauau

SEQ ID NO: 1020039 - RNA, 22 nt, Human
aucaaauuaugucccacaaaac

SEQ ID NO: 1020040 - RNA, 23 nt, Human
aucuccaucuuccuugaacccaa

SEQ ID NO: 1020041 - RNA, 23 nt, Human
augcuccaaggccauuuucacag

SEQ ID NO: 1020042 - RNA, 24 nt, Human
auuacagccaaauuaacacacauu

SEQ ID NO: 1020043 - RNA, 25 nt, Human
auuacuuuugcuaccugacugugcu

SEQ ID NO: 1020044 - RNA, 19 nt, Human
auuaugucccacaaaaccu

SEQ ID NO: 1020045 - RNA, 23 nt, Human
auuucucucacugggaacuguca

SEQ ID NO: 1020046 - RNA, 22 nt, Human
caaaaaaaaagagagaacgacc

SEQ ID NO: 1020047 - RNA, 20 nt, Human
caaaaaacaaaaaaacuuug

SEQ ID NO: 1020048 - RNA, 19 nt, Human
caaaaaauauauugaaaac

SEQ ID NO: 1020049 - RNA, 22 nt, Human
caaaagacaaugcaguguugac

SEQ ID NO: 1020050 - RNA, 21 nt, Human
caaacaaagacaaaaaauaua

SEQ ID NO: 1020051 - RNA, 23 nt, Human
caaauuuuaaacaaaagcaauua

SEQ ID NO: 1020052 - RNA, 20 nt, Human
caacuaagagcaucaacaca

SEQ ID NO: 1020053 - RNA, 23 nt, Human
caagacaggaaaacaaacacugu

SEQ ID NO: 1020054 - RNA, 18 nt, Human
caagacucaacuaagagc

SEQ ID NO: 1020055 - RNA, 21 nt, Human
cacucacaaugaccacaaaaa

SEQ ID NO: 1020056 - RNA, 18 nt, Human
cacugugcaaaaugcuuu

SEQ ID NO: 1020057 - RNA, 19 nt, Human
cagcaaacguuuuccaugc

SEQ ID NO: 1020058 - RNA, 22 nt, Human
cagcaacacacaauggaguuuu

SEQ ID NO: 1020059 - RNA, 28 nt, Human
cagccaaauuaacacacauuuaaccaaa

SEQ ID NO: 1020060 - RNA, 26 nt, Human
cauacaagaaaacuuguucaaccauc

SEQ ID NO: 1020061 - RNA, 19 nt, Human
caugucaaucaaggcaguc

SEQ ID NO: 1020062 - RNA, 18 nt, Human
cauucaguaucuuaagca

SEQ ID NO: 1020063 - RNA, 23 nt, Human
ccucaaaggaaaaacaccucucu

SEQ ID NO: 1020064 - RNA, 24 nt, Human
cggacaagaccuaaaugccagaag

SEQ ID NO: 1020065 - RNA, 23 nt, Human
cuaaaugccagaaggaaaaugca

SEQ ID NO: 1020066 - RNA, 20 nt, Human
cucauuagagccuggucagg

SEQ ID NO: 1020067 - RNA, 18 nt, Human
cugaacuuccucaccccc

SEQ ID NO: 1020068 - RNA, 23 nt, Human
cuuacuuccccuauccccucaaa

SEQ ID NO: 1020069 - RNA, 21 nt, Human
cuuuaaaugccauuacagcca

SEQ ID NO: 1020070 - RNA, 26 nt, Human
gaaaaugcacacuuucugaacuuccu

SEQ ID NO: 1020071 - RNA, 20 nt, Human
gacgcaucuccaucuuccuu

SEQ ID NO: 1020072 - RNA, 24 nt, Human
gcaauuaaaaaaaaaagggaaaaa

SEQ ID NO: 1020073 - RNA, 22 nt, Human
gcccauguaaucaauuacagua

SEQ ID NO: 1020074 - RNA, 26 nt, Human
gcugcaauauccuuuuucaucccaag

SEQ ID NO: 1020075 - RNA, 21 nt, Human
ggaaaacaaacacugugcaaa

SEQ ID NO: 1020076 - RNA, 18 nt, Human
gggaaaaaagagcucaaa

SEQ ID NO: 1020077 - RNA, 23 nt, Human
gggggagaguaagggagggaggg

SEQ ID NO: 1020078 - RNA, 22 nt, Human
gggggggagaguaagggaggga

SEQ ID NO: 1020079 - RNA, 18 nt, Human
ggggguggaggguggugg

SEQ ID NO: 1020080 - RNA, 23 nt, Human
ggggguggagggugguggugggg

SEQ ID NO: 1020081 - RNA, 23 nt, Human
gggguggaggguggugguggggg

SEQ ID NO: 1020082 - RNA, 21 nt, Human
gguaaggaggaaggggagaaa

SEQ ID NO: 1020083 - RNA, 18 nt, Human
ggugguggggggggagag

SEQ ID NO: 1020084 - RNA, 21 nt, Human
guggugguggggggggagagu

SEQ ID NO: 1020085 - RNA, 22 nt, Human
uaaaaauuauuuuaacauaaac

SEQ ID NO: 1020086 - RNA, 26 nt, Human
uaaaauaaaaauaaaaacagugcauu

SEQ ID NO: 1020087 - RNA, 22 nt, Human
uaaagauaaugcuccaaggcca

SEQ ID NO: 1020088 - RNA, 21 nt, Human
uaaaugcacacugcacaugca

SEQ ID NO: 1020089 - RNA, 19 nt, Human
uaaauguguacaccuaaac

SEQ ID NO: 1020090 - RNA, 22 nt, Human
uaaccaaauauuuccaaaacag

SEQ ID NO: 1020091 - RNA, 24 nt, Human
uaaccuggggagagaggaauuucu

SEQ ID NO: 1020092 - RNA, 27 nt, Human
uaagaauaagaauuuagaucucuuccc

SEQ ID NO: 1020093 - RNA, 23 nt, Human
uaauaaacaaagaaaagucccaa

SEQ ID NO: 1020094 - RNA, 25 nt, Human
uacaagaaaacuuguucaaccaucc

SEQ ID NO: 1020095 - RNA, 21 nt, Human
uacaccuaaacucugagcugg

SEQ ID NO: 1020096 - RNA, 20 nt, Human
uacaguauacaauaacagua

SEQ ID NO: 1020097 - RNA, 19 nt, Human
uacuuuucaagacucaacu

SEQ ID NO: 1020098 - RNA, 24 nt, Human
uagaccguaccacaacuauauaga

SEQ ID NO: 1020099 - RNA, 19 nt, Human
uagagaucuauuuauauau

SEQ ID NO: 1020100 - RNA, 25 nt, Human
uagcuuuaauuucaaagggaacaac

SEQ ID NO: 1020101 - RNA, 22 nt, Human
uagucuacuaacccccuucccc

SEQ ID NO: 1020102 - RNA, 20 nt, Human
uauauauauguauauauaua

SEQ ID NO: 1020103 - RNA, 23 nt, Human
uauauauauguauauauauauau

SEQ ID NO: 1020104 - RNA, 18 nt, Human
uauauauguauauauaua

SEQ ID NO: 1020105 - RNA, 18 nt, Human
uauauguauauauauaua

SEQ ID NO: 1020106 - RNA, 23 nt, Human
uauccccucaaaggaaaaacacc

SEQ ID NO: 1020107 - RNA, 20 nt, Human
uaugacccaagcaccaccaa

SEQ ID NO: 1020108 - RNA, 18 nt, Human
uauguauauauauauaua

SEQ ID NO: 1020109 - RNA, 19 nt, Human
uauguauauauauauauau

SEQ ID NO: 1020110 - RNA, 24 nt, Human
uauuuacuuuucaagacucaacua

SEQ ID NO: 1020111 - RNA, 27 nt, Human
ucagaaauuuuccauuugggucuaagg

SEQ ID NO: 1020112 - RNA, 21 nt, Human
uccaacagccagaaaaaauuc

SEQ ID NO: 1020113 - RNA, 20 nt, Human
uccaguccuuucagccuggg

SEQ ID NO: 1020114 - RNA, 27 nt, Human
ucccacaaaaccuacaaaauagcuuua

SEQ ID NO: 1020115 - RNA, 23 nt, Human
uccccucaaaggaaaaacaccuc

SEQ ID NO: 1020116 - RNA, 20 nt, Human
uccuggaacauacaagaaaa

SEQ ID NO: 1020117 - RNA, 26 nt, Human
uccuuucagccuggggcuuuuucagu

SEQ ID NO: 1020118 - RNA, 22 nt, Human
ucuaaagugcaaaaacaaguua

SEQ ID NO: 1020119 - RNA, 23 nt, Human
ucuauuuauauauauguauauau

SEQ ID NO: 1020120 - RNA, 24 nt, Human
ucuccaucuuccuugaacccaagu

SEQ ID NO: 1020121 - RNA, 21 nt, Human
ucucucacuaagaauaagaau

SEQ ID NO: 1020122 - RNA, 22 nt, Human
ugacaaaauuaagccauaugaa

SEQ ID NO: 1020123 - RNA, 18 nt, Human
ugacacccccccagccca

SEQ ID NO: 1020124 - RNA, 25 nt, Human
ugacacccccccagcccauguaauc

SEQ ID NO: 1020125 - RNA, 23 nt, Human
ugaucccaguguacuuucagcau

SEQ ID NO: 1020126 - RNA, 19 nt, Human
ugcaaacaaagacaaaaaa

SEQ ID NO: 1020127 - RNA, 23 nt, Human
ugccacagaaaguuuuaagucaa

SEQ ID NO: 1020128 - RNA, 21 nt, Human
ugcuggucauuaaaaccacac

SEQ ID NO: 1020129 - RNA, 20 nt, Human
uggagggugguggugggggg

SEQ ID NO: 1020130 - RNA, 20 nt, Human
uggccgccgugguacauguc

SEQ ID NO: 1020131 - RNA, 21 nt, Human
ugggaacugucagaaaaccag

SEQ ID NO: 1020132 - RNA, 18 nt, Human
uggugguggggggggaga

SEQ ID NO: 1020133 - RNA, 21 nt, Human
uguaaacauuuauauuuuccu

SEQ ID NO: 1020134 - RNA, 18 nt, Human
ugucagaaaaccagaagu

SEQ ID NO: 1020135 - RNA, 27 nt, Human
uguuuguaaacauuuauauuuuccuuu

SEQ ID NO: 1020136 - RNA, 24 nt, Human
uuaacucuacuuaucaaauuaugu

SEQ ID NO: 1020137 - RNA, 24 nt, Human
uucagaaauuuuccauuugggucu

SEQ ID NO: 1020138 - RNA, 23 nt, Human
uucauauaauuuauugcaguuag

SEQ ID NO: 1020139 - RNA, 22 nt, Human
uuccaaaacaguccagcaacac

SEQ ID NO: 1020140 - RNA, 30 nt, Human
uuccucacccccgccaaagagcuuccgacu

SEQ ID NO: 1020141 - RNA, 18 nt, Human
uuuacguucuucauaaca

SEQ ID NO: 1020142 - RNA, 24 nt, Human
uuuguuauaaaugcacacugcaca

SEQ ID NO: 1020143 - RNA, 21 nt, Human
uuuuuuuuuuuuuuuucucag

SEQ ID NO: 1020144 - RNA, 20 nt, Human
accucaaagagugucucagg

SEQ ID NO: 1020145 - RNA, 21 nt, Human
agaaagcccacagcuauuugg

SEQ ID NO: 1020146 - RNA, 20 nt, Human
aggggaucuggcugguagcc

SEQ ID NO: 1020147 - RNA, 21 nt, Human
caacccagccagcaguuccag

SEQ ID NO: 1020148 - RNA, 21 nt, Human
cagcagcaacccagccagcag

SEQ ID NO: 1020149 - RNA, 20 nt, Human
cagcaguuccagaaagccca

SEQ ID NO: 1020150 - RNA, 19 nt, Human
caugaccagcagcaaccca

SEQ ID NO: 1020151 - RNA, 21 nt, Human
ccaaauacuucagcgggaaca

SEQ ID NO: 1020152 - RNA, 23 nt, Human
ccaaauacuucagcgggaacacc

SEQ ID NO: 1020153 - RNA, 30 nt, Human
ccagccagcaguuccagaaagcccacagcu

SEQ ID NO: 1020154 - RNA, 27 nt, Human
cccaugaccagcagcaacccagccagc

SEQ ID NO: 1020155 - RNA, 20 nt, Human
gcagcaacccagccagcagu

SEQ ID NO: 1020156 - RNA, 19 nt, Human
ucucaggcucaaacgaaua

SEQ ID NO: 1020157 - RNA, 18 nt, Human
ugaccagcagcaacccag

SEQ ID NO: 1020158 - RNA, 24 nt, Human
ugggcccaugaccagcagcaaccc

SEQ ID NO: 1020159 - RNA, 18 nt, Human
ugguaauggauaguugga

SEQ ID NO: 1020160 - RNA, 21 nt, Human
ugguaauggauaguuggacac

SEQ ID NO: 1020161 - RNA, 19 nt, Human
uuccagaaagcccacagcu

SEQ ID NO: 1020162 - RNA, 19 nt, Human
aaaagugaugacauacccc

SEQ ID NO: 1020163 - RNA, 22 nt, Human
aaagacacucccagccuucgcc

SEQ ID NO: 1020164 - RNA, 19 nt, Human
aaauaaccuacagaaagag

SEQ ID NO: 1020165 - RNA, 19 nt, Human
aagggcuggugggaaagac

SEQ ID NO: 1020166 - RNA, 23 nt, Human
aauaaauaaccuacagaaagagc

SEQ ID NO: 1020167 - RNA, 22 nt, Human
acagaaagagcagcgcuggagg

SEQ ID NO: 1020168 - RNA, 19 nt, Human
agagcagcgcuggaggcug

SEQ ID NO: 1020169 - RNA, 25 nt, Human
agcgcuggaggcuggcccuugagcc

SEQ ID NO: 1020170 - RNA, 23 nt, Human
auagagcauuauguggaaggagg

SEQ ID NO: 1020171 - RNA, 20 nt, Human
caacuucagaguuccaaccu

SEQ ID NO: 1020172 - RNA, 21 nt, Human
caacuucagaguuccaaccuu

SEQ ID NO: 1020173 - RNA, 21 nt, Human
ccaacuucagaguuccaaccu

SEQ ID NO: 1020174 - RNA, 23 nt, Human
ccccaccaugggcaagggcuggu

SEQ ID NO: 1020175 - RNA, 24 nt, Human
ccuccccaccaugggcaagggcug

SEQ ID NO: 1020176 - RNA, 23 nt, Human
cuggaggcuggcccuugagccac

SEQ ID NO: 1020177 - RNA, 19 nt, Human
gcccuugagccacccacug

SEQ ID NO: 1020178 - RNA, 21 nt, Human
ggaaagacacucccagccuuc

SEQ ID NO: 1020179 - RNA, 21 nt, Human
guaacuuuauuccaccuucuc

SEQ ID NO: 1020180 - RNA, 23 nt, Human
uaaccuacagaaagagcagcgcu

SEQ ID NO: 1020181 - RNA, 21 nt, Human
uacagaaagagcagcgcugga

SEQ ID NO: 1020182 - RNA, 23 nt, Human
uaccccugguucauuucuggguu

SEQ ID NO: 1020183 - RNA, 21 nt, Human
uccuaggccaauucaaaaccg

SEQ ID NO: 1020184 - RNA, 18 nt, Human
ugaaaaaagugaugacau

SEQ ID NO: 1020185 - RNA, 23 nt, Human
ugacauaccccugguucauuucu

SEQ ID NO: 1020186 - RNA, 20 nt, Human
uuccaaaauaaggucaagua

SEQ ID NO: 1020187 - RNA, 21 nt, Human
uuccaccuucuccaacuucag

SEQ ID NO: 1020188 - RNA, 25 nt, Human
aaaagcuucuguccuucacaugauu

SEQ ID NO: 1020189 - RNA, 20 nt, Human
aaagaacauuucucaguuca

SEQ ID NO: 1020190 - RNA, 18 nt, Human
aaagacaaaauaagagga

SEQ ID NO: 1020191 - RNA, 23 nt, Human
aaagugguuaaaaacugaaaaag

SEQ ID NO: 1020192 - RNA, 20 nt, Human
aaugacaaacacagauggaa

SEQ ID NO: 1020193 - RNA, 18 nt, Human
acacaccuaugacuugca

SEQ ID NO: 1020194 - RNA, 19 nt, Human
acucaguucucuacaauuu

SEQ ID NO: 1020195 - RNA, 18 nt, Human
acucccaaacaaaauaag

SEQ ID NO: 1020196 - RNA, 26 nt, Human
agaaacuggugcaaaagacaaaauaa

SEQ ID NO: 1020197 - RNA, 21 nt, Human
agcugccauuggggaaaaaaa

SEQ ID NO: 1020198 - RNA, 19 nt, Human
augaauaaauuuaggguuc

SEQ ID NO: 1020199 - RNA, 18 nt, Human
caaaaucaaucaagacca

SEQ ID NO: 1020200 - RNA, 19 nt, Human
caaaguagccuauugcagc

SEQ ID NO: 1020201 - RNA, 24 nt, Human
caaaguuucacuccaaagcuaccu

SEQ ID NO: 1020202 - RNA, 22 nt, Human
caagagggcugccacugacuga

SEQ ID NO: 1020203 - RNA, 21 nt, Human
cacaguuuggugcauaccaau

SEQ ID NO: 1020204 - RNA, 20 nt, Human
cagacgcacacaucaacagc

SEQ ID NO: 1020205 - RNA, 23 nt, Human
ccaaaguagccuauugcagccaa

SEQ ID NO: 1020206 - RNA, 22 nt, Human
ccaaaugcuuuauauaggaacc

SEQ ID NO: 1020207 - RNA, 21 nt, Human
ccacucggagaaauuagucau

SEQ ID NO: 1020208 - RNA, 19 nt, Human
ccagaaaaugaaagggaca

SEQ ID NO: 1020209 - RNA, 22 nt, Human
ccagacccaccgcugagaaggc

SEQ ID NO: 1020210 - RNA, 21 nt, Human
cccacauccagacccaccgcu

SEQ ID NO: 1020211 - RNA, 19 nt, Human
cccaccuaaaaaaugagau

SEQ ID NO: 1020212 - RNA, 19 nt, Human
ccccauuucucuguaccac

SEQ ID NO: 1020213 - RNA, 21 nt, Human
cccccaccuaaaaaaugagau

SEQ ID NO: 1020214 - RNA, 18 nt, Human
ccuaaaagugguuaaaaa

SEQ ID NO: 1020215 - RNA, 21 nt, Human
ccugccacccccaccuaaaaa

SEQ ID NO: 1020216 - RNA, 22 nt, Human
ccugccacccccaccuaaaaaa

SEQ ID NO: 1020217 - RNA, 28 nt, Human
cgccagugagggcugaaagccaguaguc

SEQ ID NO: 1020218 - RNA, 23 nt, Human
cucauagaacuacugaaacagcu

SEQ ID NO: 1020219 - RNA, 19 nt, Human
cucuacaauuucaucaaaa

SEQ ID NO: 1020220 - RNA, 20 nt, Human
cucuguacugaucucuccuc

SEQ ID NO: 1020221 - RNA, 19 nt, Human
cugaaaaagaacaaaaagg

SEQ ID NO: 1020222 - RNA, 23 nt, Human
cugcaauaagggcccacacccag

SEQ ID NO: 1020223 - RNA, 19 nt, Human
cuugcaauccucauagaac

SEQ ID NO: 1020224 - RNA, 22 nt, Human
gaaaaaaaaugaaaauaaaagg

SEQ ID NO: 1020225 - RNA, 20 nt, Human
gaaaaccuaaaagugguuaa

SEQ ID NO: 1020226 - RNA, 18 nt, Human
gaaaugacaaacacagau

SEQ ID NO: 1020227 - RNA, 21 nt, Human
gagaaaagcugccauugggga

SEQ ID NO: 1020228 - RNA, 18 nt, Human
gagaauggagaugaggga

SEQ ID NO: 1020229 - RNA, 20 nt, Human
gaugucacucuuagcucugu

SEQ ID NO: 1020230 - RNA, 22 nt, Human
gcaauaagggcccacacccaga

SEQ ID NO: 1020231 - RNA, 24 nt, Human
ggacagaaccaccaaguacacaau

SEQ ID NO: 1020232 - RNA, 18 nt, Human
guuucuguaaggggaaaa

SEQ ID NO: 1020233 - RNA, 19 nt, Human
guuuuuuucuccccuggaa

SEQ ID NO: 1020234 - RNA, 23 nt, Human
uaaaaaagcaauaaucagacgca

SEQ ID NO: 1020235 - RNA, 23 nt, Human
uaacaaaaaugagauuuguuaca

SEQ ID NO: 1020236 - RNA, 23 nt, Human
uaauuaguuuguggaauaucauc

SEQ ID NO: 1020237 - RNA, 24 nt, Human
uacaccugccacccccaccuaaaa

SEQ ID NO: 1020238 - RNA, 21 nt, Human
uacaguucuugguaacaaaaa

SEQ ID NO: 1020239 - RNA, 23 nt, Human
uaccuuaguuuacccacauccag

SEQ ID NO: 1020240 - RNA, 21 nt, Human
uagcgucaaauuaaccuuagc

SEQ ID NO: 1020241 - RNA, 23 nt, Human
uaguggggacuauuacacuugcu

SEQ ID NO: 1020242 - RNA, 26 nt, Human
uauacaaaccauaaaauucguauagu

SEQ ID NO: 1020243 - RNA, 18 nt, Human
uaucagacaauccaauua

SEQ ID NO: 1020244 - RNA, 19 nt, Human
uaucgaacaagguauggag

SEQ ID NO: 1020245 - RNA, 19 nt, Human
uaugccacacacaccuaug

SEQ ID NO: 1020246 - RNA, 21 nt, Human
ucaguucccccucuugaguuu

SEQ ID NO: 1020247 - RNA, 23 nt, Human
uccaaauuuuguggggaagaaac

SEQ ID NO: 1020248 - RNA, 23 nt, Human
uccagacccaccgcugagaaggc

SEQ ID NO: 1020249 - RNA, 22 nt, Human
ucccuauuuucaaguuucaagg

SEQ ID NO: 1020250 - RNA, 19 nt, Human
uccuucaauuuucauuugc

SEQ ID NO: 1020251 - RNA, 23 nt, Human
uccuucaauuuucauuugcacau

SEQ ID NO: 1020252 - RNA, 18 nt, Human
ucuccccuggaaaaaaaa

SEQ ID NO: 1020253 - RNA, 24 nt, Human
ucucuacaauuucaucaaaaacug

SEQ ID NO: 1020254 - RNA, 21 nt, Human
ucuguaccacagcucaggcug

SEQ ID NO: 1020255 - RNA, 21 nt, Human
ucuuaugaauaaauuuagggu

SEQ ID NO: 1020256 - RNA, 21 nt, Human
ucuugaguuuuuugcuguugg

SEQ ID NO: 1020257 - RNA, 18 nt, Human
ugaaaaagaacaaaaagg

SEQ ID NO: 1020258 - RNA, 22 nt, Human
ugaaaagucuuucaagauuaaa

SEQ ID NO: 1020259 - RNA, 22 nt, Human
ugaaaauaagaaccucacuucc

SEQ ID NO: 1020260 - RNA, 21 nt, Human
ugaaacagcuagaguuuggaa

SEQ ID NO: 1020261 - RNA, 25 nt, Human
ugacaaacacagauggaauuaauca

SEQ ID NO: 1020262 - RNA, 19 nt, Human
ugacugaaaacacagcacu

SEQ ID NO: 1020263 - RNA, 23 nt, Human
ugauaugccacacacaccuauga

SEQ ID NO: 1020264 - RNA, 19 nt, Human
ugauguuuuuuucuccccu

SEQ ID NO: 1020265 - RNA, 22 nt, Human
ugccacugacugaaaacacagc

SEQ ID NO: 1020266 - RNA, 23 nt, Human
uggaaucacucacagguuugcca

SEQ ID NO: 1020267 - RNA, 18 nt, Human
uggagcaagagggcugcc

SEQ ID NO: 1020268 - RNA, 22 nt, Human
uggcaaacgucauaaaagcuuu

SEQ ID NO: 1020269 - RNA, 21 nt, Human
uggugcauaccaauauguaug

SEQ ID NO: 1020270 - RNA, 24 nt, Human
ugugggguucacaagucaucuguu

SEQ ID NO: 1020271 - RNA, 19 nt, Human
uucaagggcaacaagguca

SEQ ID NO: 1020272 - RNA, 24 nt, Human
uucaaguuucaagggcaacaaggu

SEQ ID NO: 1020273 - RNA, 23 nt, Human
uucacaguuuggugcauaccaau

SEQ ID NO: 1020274 - RNA, 21 nt, Human
uucauauucuuuccuucaauu

SEQ ID NO: 1020275 - RNA, 20 nt, Human
uugccagaguaagaaaagag

SEQ ID NO: 1020276 - RNA, 22 nt, Human
uuuacccacauccagacccacc

SEQ ID NO: 1020277 - RNA, 20 nt, Human
uuucaagggcaacaagguca

SEQ ID NO: 1020278 - RNA, 20 nt, Human
uuugcacauccacacugugg

SEQ ID NO: 1020279 - RNA, 20 nt, Human
uuuguggaauaucauccccu

SEQ ID NO: 1020280 - RNA, 24 nt, Human
uuuguuacucccaaacaaaauaag

SEQ ID NO: 1020281 - RNA, 24 nt, Human
uuuucaguucccccucuugaguuu

SEQ ID NO: 1020282 - RNA, 20 nt, Human
uuuuucauacaacuacagaa

SEQ ID NO: 1020283 - RNA, 21 nt, Human
uuuuuugcuguuggccaugac

SEQ ID NO: 1020284 - RNA, 25 nt, Human
aaagacacaauccccaauuuccccc

SEQ ID NO: 1020285 - RNA, 22 nt, Human
acagggaaagacacaaucccca

SEQ ID NO: 1020286 - RNA, 19 nt, Human
acccugaggucaccucaga

SEQ ID NO: 1020287 - RNA, 27 nt, Human
accucccucacaaugagcccccauuag

SEQ ID NO: 1020288 - RNA, 18 nt, Human
agcccggggccgggggcu

SEQ ID NO: 1020289 - RNA, 22 nt, Human
agcccggggccgggggcuccca

SEQ ID NO: 1020290 - RNA, 18 nt, Human
aggaagaaguaucaaaaa

SEQ ID NO: 1020291 - RNA, 19 nt, Human
aggcgcggccggcuccggc

SEQ ID NO: 1020292 - RNA, 20 nt, Human
aucugcgccaggacuucccc

SEQ ID NO: 1020293 - RNA, 23 nt, Human
cacccugaggucaccucagagac

SEQ ID NO: 1020294 - RNA, 20 nt, Human
cacccuggggcaggguggac

SEQ ID NO: 1020295 - RNA, 19 nt, Human
caccucccucacaaugagc

SEQ ID NO: 1020296 - RNA, 21 nt, Human
caccuuggcuuuaaaaagacc

SEQ ID NO: 1020297 - RNA, 26 nt, Human
caccuuggcuuuaaaaagaccaagag

SEQ ID NO: 1020298 - RNA, 18 nt, Human
cagcccaggcgcggccgg

SEQ ID NO: 1020299 - RNA, 21 nt, Human
cagccgugcccgccuacgaag

SEQ ID NO: 1020300 - RNA, 24 nt, Human
caggagcccggggccgggggcucc

SEQ ID NO: 1020301 - RNA, 20 nt, Human
caggcgccgccacgccggcc

SEQ ID NO: 1020302 - RNA, 18 nt, Human
ccagcccaggcgcggccg

SEQ ID NO: 1020303 - RNA, 25 nt, Human
cccaaaugcuccuacugaauguccc

SEQ ID NO: 1020304 - RNA, 20 nt, Human
cccgccuacgaaggcgcccu

SEQ ID NO: 1020305 - RNA, 20 nt, Human
ccggccccguggcccaucug

SEQ ID NO: 1020306 - RNA, 23 nt, Human
ccggccccguggcccaucugcgc

SEQ ID NO: 1020307 - RNA, 19 nt, Human
ccucagagacuugccaucc

SEQ ID NO: 1020308 - RNA, 23 nt, Human
ccucugaauaugccaccucaccu

SEQ ID NO: 1020309 - RNA, 18 nt, Human
ccucugccaauuccuggg

SEQ ID NO: 1020310 - RNA, 26 nt, Human
ccucugcugccucugcaccucccuca

SEQ ID NO: 1020311 - RNA, 20 nt, Human
ccucuggagucaggaacaag

SEQ ID NO: 1020312 - RNA, 23 nt, Human
ccugaagauauuuauucccaucc

SEQ ID NO: 1020313 - RNA, 21 nt, Human
cgaaggcgcccugaacccaug

SEQ ID NO: 1020314 - RNA, 22 nt, Human
cgaggagccccgcuccagccca

SEQ ID NO: 1020315 - RNA, 22 nt, Human
cgaggcaggaaccgagcgccac

SEQ ID NO: 1020316 - RNA, 23 nt, Human
cgccacgcuucucacccuauaua

SEQ ID NO: 1020317 - RNA, 21 nt, Human
cgccagcaggagcccggggcc

SEQ ID NO: 1020318 - RNA, 22 nt, Human
cgccaggacuuccccgaggcag

SEQ ID NO: 1020319 - RNA, 20 nt, Human
cgccuuagcccgaaaccagc

SEQ ID NO: 1020320 - RNA, 18 nt, Human
cgcggccggcuccggcgc

SEQ ID NO: 1020321 - RNA, 21 nt, Human
cggcgccagcaggagcccggg

SEQ ID NO: 1020322 - RNA, 25 nt, Human
cggcuccggcgccuaggccucaguc

SEQ ID NO: 1020323 - RNA, 21 nt, Human
cuacgaaggcgcccugaaccc

SEQ ID NO: 1020324 - RNA, 20 nt, Human
cuacuuccucugccaauucc

SEQ ID NO: 1020325 - RNA, 20 nt, Human
cucucguuccucuggaguca

SEQ ID NO: 1020326 - RNA, 19 nt, Human
cugcaccucccucacaaug

SEQ ID NO: 1020327 - RNA, 20 nt, Human
gaagauauuuauucccaucc

SEQ ID NO: 1020328 - RNA, 22 nt, Human
gccccgcuccagcccaggcgcg

SEQ ID NO: 1020329 - RNA, 21 nt, Human
gccccguggcccaucugcgcc

SEQ ID NO: 1020330 - RNA, 22 nt, Human
ggcgccagcaggagcccggggc

SEQ ID NO: 1020331 - RNA, 18 nt, Human
ggcuuuaaaaagaccaag

SEQ ID NO: 1020332 - RNA, 18 nt, Human
ggucauauuuacaugugu

SEQ ID NO: 1020333 - RNA, 19 nt, Human
uaaaaagaccaagagggua

SEQ ID NO: 1020334 - RNA, 20 nt, Human
uaggccucagucggucccag

SEQ ID NO: 1020335 - RNA, 24 nt, Human
uauuuuucucacacaggugggggg

SEQ ID NO: 1020336 - RNA, 22 nt, Human
ucaggggccccggaagcccaaa

SEQ ID NO: 1020337 - RNA, 20 nt, Human
uccagggaaucucucuuucc

SEQ ID NO: 1020338 - RNA, 27 nt, Human
ucccaaaugaggaagaaguaucaaaaa

SEQ ID NO: 1020339 - RNA, 22 nt, Human
ucccaacuggggccuucgggac

SEQ ID NO: 1020340 - RNA, 21 nt, Human
ucccaggcgccgccacgccgg

SEQ ID NO: 1020341 - RNA, 21 nt, Human
ucccaggguacuuggccccuc

SEQ ID NO: 1020342 - RNA, 22 nt, Human
ucccaggguacuuggccccucu

SEQ ID NO: 1020343 - RNA, 20 nt, Human
ucccucacaaugagccccca

SEQ ID NO: 1020344 - RNA, 19 nt, Human
uccucugcugccucugcac

SEQ ID NO: 1020345 - RNA, 18 nt, Human
ucucaggggccccggaag

SEQ ID NO: 1020346 - RNA, 21 nt, Human
ucucaggggccccggaagccc

SEQ ID NO: 1020347 - RNA, 23 nt, Human
ucucaggggccccggaagcccaa

SEQ ID NO: 1020348 - RNA, 24 nt, Human
ucugcgccaggacuuccccgaggc

SEQ ID NO: 1020349 - RNA, 28 nt, Human
ucuggagucaggaacaagaccggggucc

SEQ ID NO: 1020350 - RNA, 18 nt, Human
ugaccugcaaauuccacc

SEQ ID NO: 1020351 - RNA, 28 nt, Human
ugcaaauuccaccuuauuauugcccuug

SEQ ID NO: 1020352 - RNA, 24 nt, Human
ugcugccucugcaccucccucaca

SEQ ID NO: 1020353 - RNA, 19 nt, Human
uggaaugcucucguuccuc

SEQ ID NO: 1020354 - RNA, 23 nt, Human
uggaaugcucucguuccucugga

SEQ ID NO: 1020355 - RNA, 18 nt, Human
uggauucccaaacuuguu

SEQ ID NO: 1020356 - RNA, 23 nt, Human
ugggcugaccugcaaauuccacc

SEQ ID NO: 1020357 - RNA, 26 nt, Human
uugggccucugguuccuuuuugucug

SEQ ID NO: 1020358 - RNA, 19 nt, Human
uuuauuuuucucacacagg

SEQ ID NO: 1020359 - RNA, 23 nt, Human
uuucaguuuuaugccaauccucu

SEQ ID NO: 1020360 - RNA, 20 nt, Human
aaaaaggcuuguacuccaaa

SEQ ID NO: 1020361 - RNA, 24 nt, Human
aaaguguugggauuacaggcguga

SEQ ID NO: 1020362 - RNA, 23 nt, Human
aacauucugagacugcuagacuc

SEQ ID NO: 1020363 - RNA, 23 nt, Human
aacugaaacuuuuaauacaccaa

SEQ ID NO: 1020364 - RNA, 21 nt, Human
aaguguugggauuacaggcgu

SEQ ID NO: 1020365 - RNA, 26 nt, Human
aaguguugggauuacaggcgugagcc

SEQ ID NO: 1020366 - RNA, 19 nt, Human
aaucauagcucacugcagc

SEQ ID NO: 1020367 - RNA, 22 nt, Human
aaugcaguggcagaucucggcu

SEQ ID NO: 1020368 - RNA, 23 nt, Human
aaugcaguggcagaucucggcuc

SEQ ID NO: 1020369 - RNA, 18 nt, Human
acaggguuucaccauguu

SEQ ID NO: 1020370 - RNA, 20 nt, Human
acaggguuucaccauguugg

SEQ ID NO: 1020371 - RNA, 24 nt, Human
acaggguuucaccauguuggucag

SEQ ID NO: 1020372 - RNA, 18 nt, Human
accauguuggucaggcug

SEQ ID NO: 1020373 - RNA, 25 nt, Human
acucuguugcccaggcuggaaugca

SEQ ID NO: 1020374 - RNA, 19 nt, Human
acugcagccucaaacuccu

SEQ ID NO: 1020375 - RNA, 18 nt, Human
agccucccgaauagcugg

SEQ ID NO: 1020376 - RNA, 24 nt, Human
aggcuggaaugcaguggcagaucu

SEQ ID NO: 1020377 - RNA, 24 nt, Human
agugauucucaugccucagccucc

SEQ ID NO: 1020378 - RNA, 23 nt, Human
agugcaaugguggaaucauagcu

SEQ ID NO: 1020379 - RNA, 18 nt, Human
auagcucacugcagccuc

SEQ ID NO: 1020380 - RNA, 22 nt, Human
augccucagccucccgaauagc

SEQ ID NO: 1020381 - RNA, 23 nt, Human
augccucagccucccgaauagcu

SEQ ID NO: 1020382 - RNA, 21 nt, Human
auuuuuuauuuuuugguagag

SEQ ID NO: 1020383 - RNA, 24 nt, Human
auuuuuuauuuuuugguagagaca

SEQ ID NO: 1020384 - RNA, 24 nt, Human
caaaguguugggauuacaggcgug

SEQ ID NO: 1020385 - RNA, 23 nt, Human
caacccccaccucccagguucaa

SEQ ID NO: 1020386 - RNA, 24 nt, Human
caacccccaccucccagguucaag

SEQ ID NO: 1020387 - RNA, 22 nt, Human
caagugauucucaugccucagc

SEQ ID NO: 1020388 - RNA, 28 nt, Human
caagugauucucaugccucagccucccg

SEQ ID NO: 1020389 - RNA, 18 nt, Human
caccauguuggucaggcu

SEQ ID NO: 1020390 - RNA, 22 nt, Human
caccggaccgcugugaagccuc

SEQ ID NO: 1020391 - RNA, 24 nt, Human
cacucuguugcccaggcuggaaug

SEQ ID NO: 1020392 - RNA, 22 nt, Human
cagaacucuaaaauguuuguua

SEQ ID NO: 1020393 - RNA, 18 nt, Human
cagaauccuggagaacau

SEQ ID NO: 1020394 - RNA, 24 nt, Human
cagccucaaacuccugggcucaaa

SEQ ID NO: 1020395 - RNA, 22 nt, Human
caggaauaagguuucuccccag

SEQ ID NO: 1020396 - RNA, 23 nt, Human
cagggucuugcucuguugcccag

SEQ ID NO: 1020397 - RNA, 24 nt, Human
caggguuucaccauguuggucagg

SEQ ID NO: 1020398 - RNA, 24 nt, Human
caguguggacucuuugguguuuaa

SEQ ID NO: 1020399 - RNA, 22 nt, Human
ccaaaguguugggauuacaggc

SEQ ID NO: 1020400 - RNA, 22 nt, Human
ccaaaguguugggauuacaggc

SEQ ID NO: 1020401 - RNA, 24 nt, Human
ccaaaguguugggauuacaggcgu

SEQ ID NO: 1020402 - RNA, 19 nt, Human
ccacaucugccucccaaag

SEQ ID NO: 1020403 - RNA, 24 nt, Human
ccaccucccagguucaagugauuc

SEQ ID NO: 1020404 - RNA, 25 nt, Human
ccaguggccuuuccacacuuauccc

SEQ ID NO: 1020405 - RNA, 20 nt, Human
cccagguucaagugauucuc

SEQ ID NO: 1020406 - RNA, 23 nt, Human
cccagguucaagugauucucaug

SEQ ID NO: 1020407 - RNA, 22 nt, Human
cccccaccucccagguucaagu

SEQ ID NO: 1020408 - RNA, 24 nt, Human
cccgaauagcugggacuacaggcg

SEQ ID NO: 1020409 - RNA, 22 nt, Human
ccucccagguucaagugauucu

SEQ ID NO: 1020410 - RNA, 22 nt, Human
ccugcaacccccaccucccagg

SEQ ID NO: 1020411 - RNA, 24 nt, Human
ccugggcucaaaugaugcuucccc

SEQ ID NO: 1020412 - RNA, 25 nt, Human
ccuguccgcucuaggaaucugggag

SEQ ID NO: 1020413 - RNA, 19 nt, Human
cgcccuguccgcucuagga

SEQ ID NO: 1020414 - RNA, 18 nt, Human
cggcucccugcaaccccc

SEQ ID NO: 1020415 - RNA, 24 nt, Human
cucaaaugaugcuuccacaucugc

SEQ ID NO: 1020416 - RNA, 21 nt, Human
cucacugcagccucaaacucc

SEQ ID NO: 1020417 - RNA, 24 nt, Human
cucacugcagccucaaacuccugg

SEQ ID NO: 1020418 - RNA, 18 nt, Human
cucccagguucaagugau

SEQ ID NO: 1020419 - RNA, 20 nt, Human
cucccaugugguauuggugg

SEQ ID NO: 1020420 - RNA, 24 nt, Human
cucccgaauagcugggacuacagg

SEQ ID NO: 1020421 - RNA, 24 nt, Human
cucccugcaacccccaccucccag

SEQ ID NO: 1020422 - RNA, 24 nt, Human
cuccugggcucaaaugaugcuucc

SEQ ID NO: 1020423 - RNA, 18 nt, Human
cugauguuuaaccagauc

SEQ ID NO: 1020424 - RNA, 21 nt, Human
cugcaacccccaccucccagg

SEQ ID NO: 1020425 - RNA, 23 nt, Human
cugcaacccccaccucccagguu

SEQ ID NO: 1020426 - RNA, 24 nt, Human
cugcaacccccaccucccagguuc

SEQ ID NO: 1020427 - RNA, 23 nt, Human
cugcagccucaaacuccugggcu

SEQ ID NO: 1020428 - RNA, 24 nt, Human
cuggaaugcaguggcagaucucgg

SEQ ID NO: 1020429 - RNA, 18 nt, Human
cugguuacaaguauaagg

SEQ ID NO: 1020430 - RNA, 18 nt, Human
cuuguacuccaaacaaag

SEQ ID NO: 1020431 - RNA, 26 nt, Human
gaauagcugggacuacaggcgccugc

SEQ ID NO: 1020432 - RNA, 24 nt, Human
gacuacaggcgccugccaccaugc

SEQ ID NO: 1020433 - RNA, 24 nt, Human
gaucucggcucccugcaaccccca

SEQ ID NO: 1020434 - RNA, 18 nt, Human
gauuacaggcgugagcca

SEQ ID NO: 1020435 - RNA, 21 nt, Human
gauuacaggcgugagccacca

SEQ ID NO: 1020436 - RNA, 24 nt, Human
gauuacaggcgugagccaccauac

SEQ ID NO: 1020437 - RNA, 20 nt, Human
gcccaggcuggaaugcagug

SEQ ID NO: 1020438 - RNA, 27 nt, Human
gcucuguugcccagacuggagugcaau

SEQ ID NO: 1020439 - RNA, 19 nt, Human
ggauuacaggcgugagcca

SEQ ID NO: 1020440 - RNA, 22 nt, Human
ggguuucaccauguuggucagg

SEQ ID NO: 1020441 - RNA, 21 nt, Human
gguagagacaggguuucacca

SEQ ID NO: 1020442 - RNA, 21 nt, Human
guagagacaggguuucaccau

SEQ ID NO: 1020443 - RNA, 22 nt, Human
guagagacaggguuucaccaug

SEQ ID NO: 1020444 - RNA, 24 nt, Human
gugauucucaugccucagccuccc

SEQ ID NO: 1020445 - RNA, 25 nt, Human
uaaccagaucugagcgcuggcuaaa

SEQ ID NO: 1020446 - RNA, 18 nt, Human
uaagguuucucacagugc

SEQ ID NO: 1020447 - RNA, 27 nt, Human
uacaggcgugagccaccauacguaucc

SEQ ID NO: 1020448 - RNA, 22 nt, Human
uagagacaggguuucaccaugu

SEQ ID NO: 1020449 - RNA, 24 nt, Human
uagcucacugcagccucaaacucc

SEQ ID NO: 1020450 - RNA, 27 nt, Human
ucacacccggcgaaccugguggaccuc

SEQ ID NO: 1020451 - RNA, 24 nt, Human
ucacugcagccucaaacuccuggg

SEQ ID NO: 1020452 - RNA, 20 nt, Human
ucagccucccgaauagcugg

SEQ ID NO: 1020453 - RNA, 24 nt, Human
ucccaaaguguugggauuacaggc

SEQ ID NO: 1020454 - RNA, 21 nt, Human
ucccagguucaagugauucuc

SEQ ID NO: 1020455 - RNA, 24 nt, Human
ucccagguucaagugauucucaug

SEQ ID NO: 1020456 - RNA, 24 nt, Human
ucccgaauagcugggacuacaggc

SEQ ID NO: 1020457 - RNA, 18 nt, Human
ucccugcaacccccaccu

SEQ ID NO: 1020458 - RNA, 24 nt, Human
ucccugcaacccccaccucccagg

SEQ ID NO: 1020459 - RNA, 22 nt, Human
uccuggagaacauucugagacu

SEQ ID NO: 1020460 - RNA, 23 nt, Human
ucucacucuguugcccaggcugg

SEQ ID NO: 1020461 - RNA, 24 nt, Human
ucucacucuguugcccaggcugga

SEQ ID NO: 1020462 - RNA, 26 nt, Human
ucucacucuguugcccaggcuggaau

SEQ ID NO: 1020463 - RNA, 27 nt, Human
ucucacucuguugcccaggcuggaaug

SEQ ID NO: 1020464 - RNA, 19 nt, Human
ucugagcuccaacugaaac

SEQ ID NO: 1020465 - RNA, 24 nt, Human
ucuguugcccagacuggagugcaa

SEQ ID NO: 1020466 - RNA, 18 nt, Human
ucuguugcccaggcugga

SEQ ID NO: 1020467 - RNA, 24 nt, Human
ucuguugcccaggcuggaaugcag

SEQ ID NO: 1020468 - RNA, 24 nt, Human
ucuugcucuguugcccagacugga

SEQ ID NO: 1020469 - RNA, 19 nt, Human
ucuuggucuuguucucacc

SEQ ID NO: 1020470 - RNA, 21 nt, Human
ucuuugccuucagaauccugg

SEQ ID NO: 1020471 - RNA, 24 nt, Human
ugacugaaggcuuucccacacuca

SEQ ID NO: 1020472 - RNA, 21 nt, Human
ugcaguggcagaucucggcuc

SEQ ID NO: 1020473 - RNA, 21 nt, Human
ugcccagacuggagugcaaug

SEQ ID NO: 1020474 - RNA, 24 nt, Human
ugcccaggcuggaaugcaguggca

SEQ ID NO: 1020475 - RNA, 27 nt, Human
ugccucagccucccgaauagcugggac

SEQ ID NO: 1020476 - RNA, 24 nt, Human
ugcucuguugcccagacuggagug

SEQ ID NO: 1020477 - RNA, 23 nt, Human
uggaaugcaguggcagaucucgg

SEQ ID NO: 1020478 - RNA, 20 nt, Human
uggagugcaaugguggaauc

SEQ ID NO: 1020479 - RNA, 21 nt, Human
uggagugcaaugguggaauca

SEQ ID NO: 1020480 - RNA, 23 nt, Human
uggcuuuccaaucuuggucuugu

SEQ ID NO: 1020481 - RNA, 21 nt, Human
ugggacuacaggcgccugcca

SEQ ID NO: 1020482 - RNA, 22 nt, Human
ugggacuacaggcgccugccac

SEQ ID NO: 1020483 - RNA, 24 nt, Human
ugggacuacaggcgccugccacca

SEQ ID NO: 1020484 - RNA, 25 nt, Human
ugggacuacaggcgccugccaccau

SEQ ID NO: 1020485 - RNA, 18 nt, Human
ugggauuacaggcgugag

SEQ ID NO: 1020486 - RNA, 22 nt, Human
ugggauuacaggcgugagccac

SEQ ID NO: 1020487 - RNA, 23 nt, Human
ugggauuacaggcgugagccacc

SEQ ID NO: 1020488 - RNA, 24 nt, Human
ugggauuacaggcgugagccacca

SEQ ID NO: 1020489 - RNA, 25 nt, Human
ugggauuacaggcgugagccaccau

SEQ ID NO: 1020490 - RNA, 24 nt, Human
ugguagagacaggguuucaccaug

SEQ ID NO: 1020491 - RNA, 24 nt, Human
ugguggaaucauagcucacugcag

SEQ ID NO: 1020492 - RNA, 22 nt, Human
ugugguauuggugguuuuuuuu

SEQ ID NO: 1020493 - RNA, 20 nt, Human
uguugcccagacuggagugc

SEQ ID NO: 1020494 - RNA, 24 nt, Human
uuaaccuuucauuacaaaaacuga

SEQ ID NO: 1020495 - RNA, 23 nt, Human
uucaagugauucucaugccucag

SEQ ID NO: 1020496 - RNA, 19 nt, Human
uucccacacucaucacauu

SEQ ID NO: 1020497 - RNA, 18 nt, Human
uugcccagacuggagugc

SEQ ID NO: 1020498 - RNA, 24 nt, Human
uugguagagacaggguuucaccau

SEQ ID NO: 1020499 - RNA, 25 nt, Human
uuggugguuuuuuuuuuuuuuuaaa

SEQ ID NO: 1020500 - RNA, 21 nt, Human
uuucaccauguuggucaggcu

SEQ ID NO: 1020501 - RNA, 21 nt, Human
uuugccuucagaauccuggag

SEQ ID NO: 1020502 - RNA, 24 nt, Human
uuuuugguagagacaggguuucac

SEQ ID NO: 1020503 - RNA, 23 nt, Human
uuuuuugguagagacaggguuuc

SEQ ID NO: 1020504 - RNA, 27 nt, Human
uuuuuuuuuuuuaaauagacagggucu

SEQ ID NO: 1020505 - RNA, 27 nt, Human
uuuuuuuuuuuuuuuaaauagacaggg

SEQ ID NO: 1020506 - RNA, 20 nt, Human
aaagccuuuccacacuguaa

SEQ ID NO: 1020507 - RNA, 18 nt, Human
accagaugguaagauguu

SEQ ID NO: 1020508 - RNA, 24 nt, Human
agaugacaaaugaugaucuaaaac

SEQ ID NO: 1020509 - RNA, 20 nt, Human
aggucuuuucgaaugcuaaa

SEQ ID NO: 1020510 - RNA, 20 nt, Human
cggguaaaagccuuuccaca

SEQ ID NO: 1020511 - RNA, 19 nt, Human
gaccagaugguaagauguu

SEQ ID NO: 1020512 - RNA, 21 nt, Human
uaaacacucauagggcuucuc

SEQ ID NO: 1020513 - RNA, 21 nt, Human
ugucgaaugaggucuuuucga

SEQ ID NO: 1020514 - RNA, 18 nt, Human
accaacucgcugauguua

SEQ ID NO: 1020515 - RNA, 21 nt, Human
cuccaguaugaacuaucuuau

SEQ ID NO: 1020516 - RNA, 19 nt, Human
gagaauauacuaaagccuu

SEQ ID NO: 1020517 - RNA, 25 nt, Human
gagcagauauuaaugacuuuuccau

SEQ ID NO: 1020518 - RNA, 23 nt, Human
uaaauaccaacucgcugauguua

SEQ ID NO: 1020519 - RNA, 21 nt, Human
uacacuaaaggcuuuuccaca

SEQ ID NO: 1020520 - RNA, 21 nt, Human
uaucuuauguuuaguaagggu

SEQ ID NO: 1020521 - RNA, 21 nt, Human
uaucuuauguuuaguaagggu

SEQ ID NO: 1020522 - RNA, 19 nt, Human
uccacuucugggaguuuuc

SEQ ID NO: 1020523 - RNA, 20 nt, Human
ucucuccaguaugaacuauc

SEQ ID NO: 1020524 - RNA, 20 nt, Human
ucucuccaguaugaauuauc

SEQ ID NO: 1020525 - RNA, 21 nt, Human
ucucuuauguucaguaagggu

SEQ ID NO: 1020526 - RNA, 21 nt, Human
ucucuuauguuuaguaagagu

SEQ ID NO: 1020527 - RNA, 19 nt, Human
ucuuaugucuaguaagggu

SEQ ID NO: 1020528 - RNA, 23 nt, Human
ugagaaugcccuaaaggcacugc

SEQ ID NO: 1020529 - RNA, 22 nt, Human
ugccacauucuucacauuugua

SEQ ID NO: 1020530 - RNA, 23 nt, Human
uguaggguuucucuccaguauga

SEQ ID NO: 1020531 - RNA, 23 nt, Human
uguaggguuucucuccaguauga

SEQ ID NO: 1020532 - RNA, 23 nt, Human
uguaggguuucucuccaguauga

SEQ ID NO: 1020533 - RNA, 22 nt, Human
ugugcaauaaggaaaacuccac

SEQ ID NO: 1020534 - RNA, 22 nt, Human
uucucuuauguuuaguaagagu

SEQ ID NO: 1020535 - RNA, 20 nt, Human
uugagaauauacuaaagccu

SEQ ID NO: 1020536 - RNA, 22 nt, Human
uuguaugguuucucuuuaguau

SEQ ID NO: 1020537 - RNA, 19 nt, Human
uuuguaagguuucucucca

SEQ ID NO: 1020538 - RNA, 19 nt, Human
uuuguaggguuucucucca

SEQ ID NO: 1020539 - RNA, 19 nt, Human
uuuguaggguuucucucca

SEQ ID NO: 1020540 - RNA, 19 nt, Human
uuuguaggguuucucucca

SEQ ID NO: 1020541 - RNA, 18 nt, Human
aaauaugaaaaguugcau

SEQ ID NO: 1020542 - RNA, 28 nt, Human
auaaaacaaaauuacauuagaagaccuc

SEQ ID NO: 1020543 - RNA, 20 nt, Human
aucacgcuaacaaaauaaac

SEQ ID NO: 1020544 - RNA, 24 nt, Human
caaaauaaacuaaauaugaaaagu

SEQ ID NO: 1020545 - RNA, 20 nt, Human
cccggaggaggcgcucgugc

SEQ ID NO: 1020546 - RNA, 31 nt, Human
cucaaaauaaaacaaaauuacauuagaagaa

SEQ ID NO: 1020547 - RNA, 22 nt, Human
uaaaaucacgcuaacaaaauaa

SEQ ID NO: 1020548 - RNA, 26 nt, Human
uaauacaaacagagcuaaaaucacgg

SEQ ID NO: 1020549 - RNA, 25 nt, Human
ucacauuauucuuaauaggaucgug

SEQ ID NO: 1020550 - RNA, 20 nt, Human
ucguguagaaacauuccaau

SEQ ID NO: 1020551 - RNA, 21 nt, Human
aaaaaggggucugaggaaagc

SEQ ID NO: 1020552 - RNA, 18 nt, Human
aaacaaggguccuggggc

SEQ ID NO: 1020553 - RNA, 22 nt, Human
aaacaaggguccuggggcauag

SEQ ID NO: 1020554 - RNA, 20 nt, Human
aaagcgcuauugaaacgcga

SEQ ID NO: 1020555 - RNA, 21 nt, Human
accaggaaaggaagagagacc

SEQ ID NO: 1020556 - RNA, 21 nt, Human
accccacccggugccaggcca

SEQ ID NO: 1020557 - RNA, 18 nt, Human
accggagugcaaugccug

SEQ ID NO: 1020558 - RNA, 23 nt, Human
agaagaacguuuuccaggcgccu

SEQ ID NO: 1020559 - RNA, 22 nt, Human
agaccaggaaaggaagagagac

SEQ ID NO: 1020560 - RNA, 18 nt, Human
agcaaaagccucucccuc

SEQ ID NO: 1020561 - RNA, 20 nt, Human
agcggagcagcguagaugag

SEQ ID NO: 1020562 - RNA, 19 nt, Human
aggaacgccggacccacgg

SEQ ID NO: 1020563 - RNA, 19 nt, Human
aggaacgccggacccacgg

SEQ ID NO: 1020564 - RNA, 20 nt, Human
aggaagagagaccaggaggg

SEQ ID NO: 1020565 - RNA, 22 nt, Human
aggcucagacucuagcacccac

SEQ ID NO: 1020566 - RNA, 23 nt, Human
aggcuggggccgaggcggcacca

SEQ ID NO: 1020567 - RNA, 19 nt, Human
auaaagcgcuauugaaacg

SEQ ID NO: 1020568 - RNA, 21 nt, Human
aucauggugaggucugaccug

SEQ ID NO: 1020569 - RNA, 23 nt, Human
aucauggugaggucugaccuggg

SEQ ID NO: 1020570 - RNA, 21 nt, Human
aucccugccccacccugggga

SEQ ID NO: 1020571 - RNA, 20 nt, Human
augcugcugcaccagauuga

SEQ ID NO: 1020572 - RNA, 18 nt, Human
caagggcagggaaaguca

SEQ ID NO: 1020573 - RNA, 21 nt, Human
caccaauugggaggcccaggg

SEQ ID NO: 1020574 - RNA, 21 nt, Human
caccaggaaaauccuacccca

SEQ ID NO: 1020575 - RNA, 19 nt, Human
cacccggcaaggugguugg

SEQ ID NO: 1020576 - RNA, 18 nt, Human
cagauugaggggcugggg

SEQ ID NO: 1020577 - RNA, 21 nt, Human
cagcucugugaacaugcaguc

SEQ ID NO: 1020578 - RNA, 18 nt, Human
caggccagcagcuucccg

SEQ ID NO: 1020579 - RNA, 24 nt, Human
caugcagucugcaaucuggauacc

SEQ ID NO: 1020580 - RNA, 21 nt, Human
cauggugaggucugaccuggg

SEQ ID NO: 1020581 - RNA, 24 nt, Human
ccagcagcuucccgagcagcggag

SEQ ID NO: 1020582 - RNA, 19 nt, Human
ccaggcgccuucccccucu

SEQ ID NO: 1020583 - RNA, 18 nt, Human
cccacccuggggaccccc

SEQ ID NO: 1020584 - RNA, 21 nt, Human
cccagggcaggagagccugag

SEQ ID NO: 1020585 - RNA, 18 nt, Human
cccauggagaaagagccc

SEQ ID NO: 1020586 - RNA, 19 nt, Human
ccccacccuggggaccccc

SEQ ID NO: 1020587 - RNA, 18 nt, Human
ccccaggagcuggccucc

SEQ ID NO: 1020588 - RNA, 24 nt, Human
cccccaaccggagugcaaugccug

SEQ ID NO: 1020589 - RNA, 21 nt, Human
cccccuggcucuuccccagca

SEQ ID NO: 1020590 - RNA, 23 nt, Human
cccccuggcucuuccccagcagc

SEQ ID NO: 1020591 - RNA, 23 nt, Human
ccccgcucgggucggccagggag

SEQ ID NO: 1020592 - RNA, 18 nt, Human
cccguaggagcaaacagu

SEQ ID NO: 1020593 - RNA, 20 nt, Human
cccugccccacccuggggag

SEQ ID NO: 1020594 - RNA, 20 nt, Human
ccggacccacggcaagggca

SEQ ID NO: 1020595 - RNA, 22 nt, Human
ccuccugucgcuucugguuuua

SEQ ID NO: 1020596 - RNA, 30 nt, Human
ccucgccccucugcccugggagaacuggaa

SEQ ID NO: 1020597 - RNA, 20 nt, Human
ccucucacuuuacucgguca

SEQ ID NO: 1020598 - RNA, 23 nt, Human
ccucugaauguacaaccuggggc

SEQ ID NO: 1020599 - RNA, 23 nt, Human
ccugucgcuucugguuuuauccg

SEQ ID NO: 1020600 - RNA, 22 nt, Human
ccuuugggcgcuucccgaggcg

SEQ ID NO: 1020601 - RNA, 22 nt, Human
ccuuuuauuuaaugucaagaau

SEQ ID NO: 1020602 - RNA, 20 nt, Human
cgcccggagcuauggagcag

SEQ ID NO: 1020603 - RNA, 20 nt, Human
cggcugcccacugugauccc

SEQ ID NO: 1020604 - RNA, 18 nt, Human
cguagccaaucuguuccc

SEQ ID NO: 1020605 - RNA, 25 nt, Human
cucccucgccccucugcccugggag

SEQ ID NO: 1020606 - RNA, 21 nt, Human
cuccguccggcccugcccucc

SEQ ID NO: 1020607 - RNA, 23 nt, Human
cucgcggucccccuggcucuucc

SEQ ID NO: 1020608 - RNA, 19 nt, Human
cugccugugggggaccagg

SEQ ID NO: 1020609 - RNA, 20 nt, Human
cuucgggacucccugguggc

SEQ ID NO: 1020610 - RNA, 19 nt, Human
cuucugguuuuauccgugg

SEQ ID NO: 1020611 - RNA, 23 nt, Human
gaacaugcagucugcaaucugga

SEQ ID NO: 1020612 - RNA, 21 nt, Human
gacacaaacaaggguccuggg

SEQ ID NO: 1020613 - RNA, 18 nt, Human
gacaggcuggggccgagg

SEQ ID NO: 1020614 - RNA, 22 nt, Human
gagaaagagcccucugaauggu

SEQ ID NO: 1020615 - RNA, 22 nt, Human
gagcagcggagguaggcggaga

SEQ ID NO: 1020616 - RNA, 20 nt, Human
gagcugggcguccauucaga

SEQ ID NO: 1020617 - RNA, 20 nt, Human
gaggcccagggcaggagagc

SEQ ID NO: 1020618 - RNA, 20 nt, Human
gagugcuguuccccgcucgg

SEQ ID NO: 1020619 - RNA, 19 nt, Human
ggacaggcuggggccgagg

SEQ ID NO: 1020620 - RNA, 21 nt, Human
ggcagcgcgcgccccuucccg

SEQ ID NO: 1020621 - RNA, 21 nt, Human
ggcccugcccucccccagccc

SEQ ID NO: 1020622 - RNA, 21 nt, Human
ggccggacagcuccaucuaca

SEQ ID NO: 1020623 - RNA, 24 nt, Human
ggccggacagcuccaucuacagcc

SEQ ID NO: 1020624 - RNA, 28 nt, Human
ggcuggggccgaggcggcaccaggagcu

SEQ ID NO: 1020625 - RNA, 19 nt, Human
gggcaggagagccugaggc

SEQ ID NO: 1020626 - RNA, 20 nt, Human
ggggcuggggacaggcuggg

SEQ ID NO: 1020627 - RNA, 20 nt, Human
ggugaaccgucucaccugcc

SEQ ID NO: 1020628 - RNA, 24 nt, Human
ggugaaccgucucaccugccucuc

SEQ ID NO: 1020629 - RNA, 22 nt, Human
ggugcucaggccgcccccgauc

SEQ ID NO: 1020630 - RNA, 22 nt, Human
guaggagcaaacaguccccuuc

SEQ ID NO: 1020631 - RNA, 21 nt, Human
guccggcccugcccuccccca

SEQ ID NO: 1020632 - RNA, 21 nt, Human
gucggccagggagaagaagaa

SEQ ID NO: 1020633 - RNA, 24 nt, Human
guucccggcucccaggaaccccag

SEQ ID NO: 1020634 - RNA, 24 nt, Human
uacccuuagcacaucccucggccu

SEQ ID NO: 1020635 - RNA, 26 nt, Human
uacccuuagcacaucccucggccuuc

SEQ ID NO: 1020636 - RNA, 23 nt, Human
uagcacccacuugcccggcgcug

SEQ ID NO: 1020637 - RNA, 19 nt, Human
ucaccaggaaaauccuacc

SEQ ID NO: 1020638 - RNA, 21 nt, Human
uccauguccgugagcacgggc

SEQ ID NO: 1020639 - RNA, 18 nt, Human
ucccauggagaaagagcc

SEQ ID NO: 1020640 - RNA, 18 nt, Human
uccccagcagcugggucc

SEQ ID NO: 1020641 - RNA, 18 nt, Human
uccccagcagcugggucc

SEQ ID NO: 1020642 - RNA, 19 nt, Human
uccccagcagcugggucca

SEQ ID NO: 1020643 - RNA, 24 nt, Human
uccccugaugaccaucuguggccc

SEQ ID NO: 1020644 - RNA, 23 nt, Human
ucccucgccccucugcccuggga

SEQ ID NO: 1020645 - RNA, 24 nt, Human
ucccugccccacccuggggacccc

SEQ ID NO: 1020646 - RNA, 21 nt, Human
ucccuuugcacggcaaaaagg

SEQ ID NO: 1020647 - RNA, 22 nt, Human
uccuaccccaccuaucugagag

SEQ ID NO: 1020648 - RNA, 20 nt, Human
ucggccagggagaagaagaa

SEQ ID NO: 1020649 - RNA, 21 nt, Human
ucucacagcaaaagccucucc

SEQ ID NO: 1020650 - RNA, 24 nt, Human
ucuccuaaccuugggaccugauuu

SEQ ID NO: 1020651 - RNA, 24 nt, Human
ucuguggcccaguggucccagggc

SEQ ID NO: 1020652 - RNA, 20 nt, Human
ugaaggggaauccuuugggc

SEQ ID NO: 1020653 - RNA, 21 nt, Human
ugacaagaugcugcugcaccg

SEQ ID NO: 1020654 - RNA, 18 nt, Human
ugacacaaacaagggucc

SEQ ID NO: 1020655 - RNA, 23 nt, Human
ugacggcuacucucacagcaaaa

SEQ ID NO: 1020656 - RNA, 24 nt, Human
ugaggacacccggcaaggugguug

SEQ ID NO: 1020657 - RNA, 22 nt, Human
ugaggcuuuacuguaggcaagc

SEQ ID NO: 1020658 - RNA, 19 nt, Human
ugcccucccccagcccagc

SEQ ID NO: 1020659 - RNA, 22 nt, Human
uggauaccuuuuauuuaauguc

SEQ ID NO: 1020660 - RNA, 19 nt, Human
ugggaagagacacgugacg

SEQ ID NO: 1020661 - RNA, 18 nt, Human
uggucccagggcacucga

SEQ ID NO: 1020662 - RNA, 21 nt, Human
uggugaggucugaccuggggc

SEQ ID NO: 1020663 - RNA, 18 nt, Human
uuagcacaucccucggcc

SEQ ID NO: 1020664 - RNA, 22 nt, Human
uuccccgcucgggucggccagg

SEQ ID NO: 1020665 - RNA, 21 nt, Human
uuuccaggcgccuucccccuc

SEQ ID NO: 1020666 - RNA, 22 nt, Human
aaacaagagaggggaaaacugg

SEQ ID NO: 1020667 - RNA, 18 nt, Human
aaaucgcuggcuagauuu

SEQ ID NO: 1020668 - RNA, 19 nt, Human
aacccagcauuuuugguuu

SEQ ID NO: 1020669 - RNA, 20 nt, Human
aaccugcuuauggcucaaaa

SEQ ID NO: 1020670 - RNA, 20 nt, Human
aagaaccugcuuauggcuca

SEQ ID NO: 1020671 - RNA, 24 nt, Human
acaacaaagcucugacauaaacaa

SEQ ID NO: 1020672 - RNA, 20 nt, Human
acagugauaaaaccaacuua

SEQ ID NO: 1020673 - RNA, 22 nt, Human
acauugugucuuccugaugaua

SEQ ID NO: 1020674 - RNA, 23 nt, Human
caaaugaaauuagaugcauacag

SEQ ID NO: 1020675 - RNA, 27 nt, Human
caccccaauucagaucucccuggccag

SEQ ID NO: 1020676 - RNA, 21 nt, Human
caugugaacguaacuuagagu

SEQ ID NO: 1020677 - RNA, 22 nt, Human
ccacuuccugccuucccuccug

SEQ ID NO: 1020678 - RNA, 19 nt, Human
cccugaggcuggguccuca

SEQ ID NO: 1020679 - RNA, 21 nt, Human
ccgcuugaagcugucccuggg

SEQ ID NO: 1020680 - RNA, 21 nt, Human
ccgcuugaagcugucccuggg

SEQ ID NO: 1020681 - RNA, 22 nt, Human
ccgcuugaagcugucccugggg

SEQ ID NO: 1020682 - RNA, 24 nt, Human
ccucguggucccacuuccugccuu

SEQ ID NO: 1020683 - RNA, 22 nt, Human
cugucccugggggaaccgggca

SEQ ID NO: 1020684 - RNA, 22 nt, Human
gagauucugcucuucaccccaa

SEQ ID NO: 1020685 - RNA, 21 nt, Human
gcgccuuccaccuaaacacuc

SEQ ID NO: 1020686 - RNA, 23 nt, Human
gggccucguggucccacuuccug

SEQ ID NO: 1020687 - RNA, 27 nt, Human
guaagcccucagccuaaccuacccaau

SEQ ID NO: 1020688 - RNA, 24 nt, Human
uaaacaagagaggggaaaacugga

SEQ ID NO: 1020689 - RNA, 19 nt, Human
uaaggacuuugaacccagc

SEQ ID NO: 1020690 - RNA, 23 nt, Human
uacccaauaagaauuuccuuaca

SEQ ID NO: 1020691 - RNA, 18 nt, Human
uaccgcuugaagcugucc

SEQ ID NO: 1020692 - RNA, 23 nt, Human
ucccugaggcuggguccucagau

SEQ ID NO: 1020693 - RNA, 22 nt, Human
uccuuacaaagugagaggcuua

SEQ ID NO: 1020694 - RNA, 18 nt, Human
uggaagaggugacgcugg

SEQ ID NO: 1020695 - RNA, 18 nt, Human
uggaagaggugacgcugg

SEQ ID NO: 1020696 - RNA, 21 nt, Human
uggaagaggugacgcuggggc

SEQ ID NO: 1020697 - RNA, 23 nt, Human
uggaagaggugacgcuggggcau

SEQ ID NO: 1020698 - RNA, 18 nt, Human
uggccagacgaguuagaa

SEQ ID NO: 1020699 - RNA, 21 nt, Human
uggguccucagaugucugucc

SEQ ID NO: 1020700 - RNA, 22 nt, Human
uggucaucaacauagacagcag

SEQ ID NO: 1020701 - RNA, 24 nt, Human
uguugagggaggaagggaauucua

SEQ ID NO: 1020702 - RNA, 21 nt, Human
uuccacagauagcuauuuggg

SEQ ID NO: 1020703 - RNA, 22 nt, Human
uuccugccuucccuccugggcu

SEQ ID NO: 1020704 - RNA, 24 nt, Human
aagaagucaaguuuccuucuuaaa

SEQ ID NO: 1020705 - RNA, 21 nt, Human
accgaauugaaguuucccuua

SEQ ID NO: 1020706 - RNA, 20 nt, Human
agacaggagagucaaucugg

SEQ ID NO: 1020707 - RNA, 21 nt, Human
agagugucccggccaggagcu

SEQ ID NO: 1020708 - RNA, 24 nt, Human
agccuuagugacaaauucugagcc

SEQ ID NO: 1020709 - RNA, 21 nt, Human
agcggcagcggauccucgggc

SEQ ID NO: 1020710 - RNA, 21 nt, Human
agcggcagcggauccucgggc

SEQ ID NO: 1020711 - RNA, 18 nt, Human
agggauggauaagagacc

SEQ ID NO: 1020712 - RNA, 18 nt, Human
agucccgagcggcagcgg

SEQ ID NO: 1020713 - RNA, 21 nt, Human
caaggacacuauaucaaaggc

SEQ ID NO: 1020714 - RNA, 23 nt, Human
caaggacacuauaucaaaggcug

SEQ ID NO: 1020715 - RNA, 20 nt, Human
cacguuccagcccgguccug

SEQ ID NO: 1020716 - RNA, 21 nt, Human
cacuacuucugauacuucugc

SEQ ID NO: 1020717 - RNA, 21 nt, Human
cagcggauccucgggcuccgc

SEQ ID NO: 1020718 - RNA, 24 nt, Human
cccccgaguauaccaaaggauaag

SEQ ID NO: 1020719 - RNA, 19 nt, Human
ccuggaaccaaucccccga

SEQ ID NO: 1020720 - RNA, 21 nt, Human
cgccacuucccuuccccgcaa

SEQ ID NO: 1020721 - RNA, 19 nt, Human
cuccaguagugagccaagg

SEQ ID NO: 1020722 - RNA, 27 nt, Human
cugcagccgagggcagaaccggggucc

SEQ ID NO: 1020723 - RNA, 18 nt, Human
cuucugauacuucugcug

SEQ ID NO: 1020724 - RNA, 22 nt, Human
gacacauagaaugcacaaaaca

SEQ ID NO: 1020725 - RNA, 22 nt, Human
gcacaaaacaaaauugaaacaa

SEQ ID NO: 1020726 - RNA, 20 nt, Human
gccuuagugacaaauucuga

SEQ ID NO: 1020727 - RNA, 21 nt, Human
gcuagagucacaaggacacua

SEQ ID NO: 1020728 - RNA, 23 nt, Human
ggacacuauaucaaaggcugcug

SEQ ID NO: 1020729 - RNA, 20 nt, Human
ggcucagucccgagcggcag

SEQ ID NO: 1020730 - RNA, 24 nt, Human
uaaguguacuugaaauagagaguu

SEQ ID NO: 1020731 - RNA, 23 nt, Human
uacuucugauacuucugcugagu

SEQ ID NO: 1020732 - RNA, 19 nt, Human
ucauauacacagguuccac

SEQ ID NO: 1020733 - RNA, 25 nt, Human
uccauaccacuacuucugauacuuc

SEQ ID NO: 1020734 - RNA, 23 nt, Human
ucccccgaguauaccaaaggaua

SEQ ID NO: 1020735 - RNA, 20 nt, Human
ugaaauagagaguugaugag

SEQ ID NO: 1020736 - RNA, 21 nt, Human
ugaacagaguuugaaagcaca

SEQ ID NO: 1020737 - RNA, 22 nt, Human
ugaauacccuucacaggguuuc

SEQ ID NO: 1020738 - RNA, 19 nt, Human
ugaauguucugacacauag

SEQ ID NO: 1020739 - RNA, 19 nt, Human
ugagcccagaacuugcaga

SEQ ID NO: 1020740 - RNA, 21 nt, Human
ugaggcuaacauugcuacaga

SEQ ID NO: 1020741 - RNA, 23 nt, Human
ugaguaucuaacauauugcacuu

SEQ ID NO: 1020742 - RNA, 22 nt, Human
ugcacaaaacaaaauugaaacc

SEQ ID NO: 1020743 - RNA, 21 nt, Human
ugcguggcgggcucagucccg

SEQ ID NO: 1020744 - RNA, 20 nt, Human
ugcuacagacaggagaguca

SEQ ID NO: 1020745 - RNA, 22 nt, Human
ugcuugaagucucaugcuagag

SEQ ID NO: 1020746 - RNA, 19 nt, Human
uggaaccaaucccccgagu

SEQ ID NO: 1020747 - RNA, 25 nt, Human
uggcaauauccuuuauuucuccagu

SEQ ID NO: 1020748 - RNA, 19 nt, Human
uuauauccauaccacuacu

SEQ ID NO: 1020749 - RNA, 25 nt, Human
uugaaauagagaguugaugaguuau

SEQ ID NO: 1020750 - RNA, 26 nt, Human
uuuuuuuucaacugaacagaguuuga

SEQ ID NO: 1020751 - RNA, 19 nt, Human
aaauauuaacaaggguacu

SEQ ID NO: 1020752 - RNA, 24 nt, Human
aagauacucugcauaaaugaaaua

SEQ ID NO: 1020753 - RNA, 18 nt, Human
agaguauaaacaugggaa

SEQ ID NO: 1020754 - RNA, 21 nt, Human
caaaugcaaaguauauauuau

SEQ ID NO: 1020755 - RNA, 19 nt, Human
caacaaugaaaacagaaua

SEQ ID NO: 1020756 - RNA, 20 nt, Human
caagaacaaaacagacuugc

SEQ ID NO: 1020757 - RNA, 22 nt, Human
caagaacaaaacagacuugcua

SEQ ID NO: 1020758 - RNA, 21 nt, Human
cucugcauaaaugaaauaaac

SEQ ID NO: 1020759 - RNA, 22 nt, Human
gagcuggaguuaacauuuuucu

SEQ ID NO: 1020760 - RNA, 20 nt, Human
uaaacaugggaaaaugaguu

SEQ ID NO: 1020761 - RNA, 19 nt, Human
uaauuaagucuuuauuuaa

SEQ ID NO: 1020762 - RNA, 23 nt, Human
uacagugugggaagaguauaaac

SEQ ID NO: 1020763 - RNA, 22 nt, Human
uacaugccauaucuacagugug

SEQ ID NO: 1020764 - RNA, 21 nt, Human
uaccaaacuccaagauacucu

SEQ ID NO: 1020765 - RNA, 21 nt, Human
uagaacauucaaguaucuaca

SEQ ID NO: 1020766 - RNA, 20 nt, Human
uaugucuccuuucacccaua

SEQ ID NO: 1020767 - RNA, 23 nt, Human
uauuaucauaagauggaaauuac

SEQ ID NO: 1020768 - RNA, 19 nt, Human
ugaaauaaacucaacuugc

SEQ ID NO: 1020769 - RNA, 19 nt, Human
uggaaauuaccaaacucca

SEQ ID NO: 1020770 - RNA, 25 nt, Human
ugugggaagaguauaaacaugggaa

SEQ ID NO: 1020771 - RNA, 21 nt, Human
uuaccaaacuccaagauacuc

SEQ ID NO: 1020772 - RNA, 20 nt, Human
uuacuuuuauuacaagaaca

SEQ ID NO: 1020773 - RNA, 21 nt, Human
uucacccauaucacaaaugca

SEQ ID NO: 1020774 - RNA, 20 nt, Human
aaaacacagaucaacaaacg

SEQ ID NO: 1020775 - RNA, 25 nt, Human
aaaacacagaucaacaaacggaaug

SEQ ID NO: 1020776 - RNA, 19 nt, Human
aaaauguccaccaggaaac

SEQ ID NO: 1020777 - RNA, 22 nt, Human
aaaucagaagcaaauauggcaa

SEQ ID NO: 1020778 - RNA, 23 nt, Human
aaauguccuuaagcuaaaauuuu

SEQ ID NO: 1020779 - RNA, 21 nt, Human
aacaguuaacaagcuuuacaa

SEQ ID NO: 1020780 - RNA, 21 nt, Human
aagauguaccaauacuggaaa

SEQ ID NO: 1020781 - RNA, 22 nt, Human
acagcaccggagagcacuguac

SEQ ID NO: 1020782 - RNA, 23 nt, Human
accacaaaaauguaucaaauaac

SEQ ID NO: 1020783 - RNA, 24 nt, Human
agaaauaauucucccacaagcaaa

SEQ ID NO: 1020784 - RNA, 18 nt, Human
agaagccaagauguacca

SEQ ID NO: 1020785 - RNA, 21 nt, Human
agagcacuguacaaaaugucc

SEQ ID NO: 1020786 - RNA, 21 nt, Human
agcaaaaaggucagcaucaag

SEQ ID NO: 1020787 - RNA, 22 nt, Human
aggaggcaaacaaaacugggca

SEQ ID NO: 1020788 - RNA, 21 nt, Human
aggcucaaggcuagaagacaa

SEQ ID NO: 1020789 - RNA, 18 nt, Human
auacugaauuuuaccuag

SEQ ID NO: 1020790 - RNA, 21 nt, Human
augcucacuggcuuccccaca

SEQ ID NO: 1020791 - RNA, 23 nt, Human
caaacauuuacaaagcaaucuaa

SEQ ID NO: 1020792 - RNA, 21 nt, Human
caacauauuauuuaagccaca

SEQ ID NO: 1020793 - RNA, 21 nt, Human
caagaaucugaugcccuaaua

SEQ ID NO: 1020794 - RNA, 24 nt, Human
caagcaaaaaggucagcaucaaga

SEQ ID NO: 1020795 - RNA, 18 nt, Human
cacaagcaaaaaggucag

SEQ ID NO: 1020796 - RNA, 20 nt, Human
cagucuuaucuuguaaagcu

SEQ ID NO: 1020797 - RNA, 21 nt, Human
ccacaagcaaaaaggucagca

SEQ ID NO: 1020798 - RNA, 21 nt, Human
cccacauccacacuuucagac

SEQ ID NO: 1020799 - RNA, 19 nt, Human
ccggagagcacuguacaaa

SEQ ID NO: 1020800 - RNA, 18 nt, Human
ccuaauacuaauguggaa

SEQ ID NO: 1020801 - RNA, 18 nt, Human
cuaaaauuuuaagggcug

SEQ ID NO: 1020802 - RNA, 22 nt, Human
cuaaucucaugcaauuuuaaaa

SEQ ID NO: 1020803 - RNA, 22 nt, Human
cucauuuauuucuucccucuca

SEQ ID NO: 1020804 - RNA, 22 nt, Human
cugaaggcugaaaaacauuugc

SEQ ID NO: 1020805 - RNA, 22 nt, Human
cugcaauaaaauuauuccaagu

SEQ ID NO: 1020806 - RNA, 24 nt, Human
cuggucucucaaguaaccuagaua

SEQ ID NO: 1020807 - RNA, 20 nt, Human
gaguggcaaaaggcagguuu

SEQ ID NO: 1020808 - RNA, 25 nt, Human
guacaaaauguccaccaggaaacca

SEQ ID NO: 1020809 - RNA, 22 nt, Human
gucagcaucaagaauuuaauuu

SEQ ID NO: 1020810 - RNA, 20 nt, Human
uaaaacacagaucaacaaac

SEQ ID NO: 1020811 - RNA, 22 nt, Human
uaaaauaaucuacaaauaucag

SEQ ID NO: 1020812 - RNA, 21 nt, Human
uaaaauguccuuaagcuaaaa

SEQ ID NO: 1020813 - RNA, 23 nt, Human
uaacuaccacuccgcuucaugaa

SEQ ID NO: 1020814 - RNA, 21 nt, Human
uaccaauacuggaaagguuuu

SEQ ID NO: 1020815 - RNA, 22 nt, Human
uauguacauacauuggagcaug

SEQ ID NO: 1020816 - RNA, 18 nt, Human
uaugugaaggguacaagg

SEQ ID NO: 1020817 - RNA, 22 nt, Human
uauuuaguauaacuuuggcugg

SEQ ID NO: 1020818 - RNA, 21 nt, Human
ucacaaauuccaauucuguaa

SEQ ID NO: 1020819 - RNA, 18 nt, Human
ucccacaagcaaaaaggu

SEQ ID NO: 1020820 - RNA, 22 nt, Human
uccccacauccacacuuucaga

SEQ ID NO: 1020821 - RNA, 22 nt, Human
ucuacaaauaucagaauacuaa

SEQ ID NO: 1020822 - RNA, 20 nt, Human
ucuauaacucacacauagua

SEQ ID NO: 1020823 - RNA, 21 nt, Human
ucucaaguaaccuagauauua

SEQ ID NO: 1020824 - RNA, 18 nt, Human
ucugaguuucauaacccu

SEQ ID NO: 1020825 - RNA, 18 nt, Human
ugcaacagagaugauuag

SEQ ID NO: 1020826 - RNA, 27 nt, Human
ugcccuaauacuaauguggaaaaacaa

SEQ ID NO: 1020827 - RNA, 25 nt, Human
uggaaagguuuuaaacagucuuauu

SEQ ID NO: 1020828 - RNA, 18 nt, Human
uggcuuccccacauccac

SEQ ID NO: 1020829 - RNA, 28 nt, Human
uguacaaaauguccaccaggaaaccaaa

SEQ ID NO: 1020830 - RNA, 24 nt, Human
uuaaagaaauguauuaagaguccu

SEQ ID NO: 1020831 - RNA, 21 nt, Human
uuagaguugucaacgcuguac

SEQ ID NO: 1020832 - RNA, 27 nt, Human
uuauguacauacauuggagcauguggu

SEQ ID NO: 1020833 - RNA, 20 nt, Human
uucugcuugggguuugggcc

SEQ ID NO: 1020834 - RNA, 24 nt, Human
uuuaaaauguccuuaagcuaaaau

SEQ ID NO: 1020835 - RNA, 23 nt, Human
uuuccauguaauggaagacugca

SEQ ID NO: 1020836 - RNA, 23 nt, Human
uuucugaaggcugaaaaacauuu

SEQ ID NO: 1020837 - RNA, 24 nt, Human
uuuucuuuucugcuugggguuugg

SEQ ID NO: 1020838 - RNA, 23 nt, Human
aacacgcccccucucccucccuc

SEQ ID NO: 1020839 - RNA, 25 nt, Human
aaccgaguugggaauuuccacggga

SEQ ID NO: 1020840 - RNA, 21 nt, Human
aaggaggagggcggccggggg

SEQ ID NO: 1020841 - RNA, 22 nt, Human
aauuuccacgggaagucggggg

SEQ ID NO: 1020842 - RNA, 21 nt, Human
acaaacacagacuucaggcac

SEQ ID NO: 1020843 - RNA, 22 nt, Human
aggaaggguuuaguucuggaaa

SEQ ID NO: 1020844 - RNA, 22 nt, Human
caaaggccuugucuccacgaca

SEQ ID NO: 1020845 - RNA, 21 nt, Human
caacacgcccccucucccucc

SEQ ID NO: 1020846 - RNA, 21 nt, Human
caaguccacagagauaaagga

SEQ ID NO: 1020847 - RNA, 22 nt, Human
cacccacuccuccaugagaacc

SEQ ID NO: 1020848 - RNA, 21 nt, Human
cacccgggggccacagcgccc

SEQ ID NO: 1020849 - RNA, 23 nt, Human
cacgcccccucucccucccucca

SEQ ID NO: 1020850 - RNA, 21 nt, Human
cacucggcggccagagcagca

SEQ ID NO: 1020851 - RNA, 19 nt, Human
cagcgcccuugcaucgugc

SEQ ID NO: 1020852 - RNA, 21 nt, Human
caggaacaaagaaaggaggag

SEQ ID NO: 1020853 - RNA, 23 nt, Human
ccacagcgcccuugcaucgugcu

SEQ ID NO: 1020854 - RNA, 22 nt, Human
ccagccacaggaacaaagaaag

SEQ ID NO: 1020855 - RNA, 21 nt, Human
ccccccagccacaggaacaaa

SEQ ID NO: 1020856 - RNA, 19 nt, Human
cccccccagccacaggaac

SEQ ID NO: 1020857 - RNA, 18 nt, Human
ccccccgccccucacucg

SEQ ID NO: 1020858 - RNA, 18 nt, Human
cccccgggccccccccgc

SEQ ID NO: 1020859 - RNA, 25 nt, Human
ccccgccccucacucggcggccaga

SEQ ID NO: 1020860 - RNA, 19 nt, Human
ccccgggccccccccgccc

SEQ ID NO: 1020861 - RNA, 24 nt, Human
ccccucucccucccuccaugugca

SEQ ID NO: 1020862 - RNA, 21 nt, Human
cccuccuugucuccacccacu

SEQ ID NO: 1020863 - RNA, 24 nt, Human
cccuugcaucgugcuccuuauucc

SEQ ID NO: 1020864 - RNA, 29 nt, Human
ccugaccccugacccugugaccgguuccg

SEQ ID NO: 1020865 - RNA, 21 nt, Human
ccuugucuccacccacuccuc

SEQ ID NO: 1020866 - RNA, 23 nt, Human
cgaaagcuaccccaccccaguag

SEQ ID NO: 1020867 - RNA, 21 nt, Human
cgcccccgggccccccccgcc

SEQ ID NO: 1020868 - RNA, 19 nt, Human
cgcccccucucccucccuc

SEQ ID NO: 1020869 - RNA, 21 nt, Human
cgggccccccccgccccucac

SEQ ID NO: 1020870 - RNA, 21 nt, Human
gacuacaaccaccugaccccu

SEQ ID NO: 1020871 - RNA, 23 nt, Human
gacuuacucccuccuugucucca

SEQ ID NO: 1020872 - RNA, 20 nt, Human
gccacaggaacaaagaaagg

SEQ ID NO: 1020873 - RNA, 21 nt, Human
gcccccucucccucccuccau

SEQ ID NO: 1020874 - RNA, 19 nt, Human
gcgcauccuugagaggggg

SEQ ID NO: 1020875 - RNA, 24 nt, Human
ggaggagggcggccgggggggucu

SEQ ID NO: 1020876 - RNA, 19 nt, Human
ggauguucaacacgccccc

SEQ ID NO: 1020877 - RNA, 21 nt, Human
gggaggggauacccccccagc

SEQ ID NO: 1020878 - RNA, 19 nt, Human
ggggagggguugaguagua

SEQ ID NO: 1020879 - RNA, 22 nt, Human
gggugauggugaaacugugguu

SEQ ID NO: 1020880 - RNA, 28 nt, Human
ggugauggugaaacugugguuccccuuu

SEQ ID NO: 1020881 - RNA, 21 nt, Human
guagguucuaggacaagggug

SEQ ID NO: 1020882 - RNA, 23 nt, Human
gucuccacgacaacacaaacaca

SEQ ID NO: 1020883 - RNA, 26 nt, Human
uaaagagcgcauccuugagagggggu

SEQ ID NO: 1020884 - RNA, 27 nt, Human
uaaagagcgcauccuugagagggggua

SEQ ID NO: 1020885 - RNA, 19 nt, Human
uacucccuccuugucucca

SEQ ID NO: 1020886 - RNA, 18 nt, Human
uagaaugggcgggugaug

SEQ ID NO: 1020887 - RNA, 19 nt, Human
uccacagagauaaaggaag

SEQ ID NO: 1020888 - RNA, 18 nt, Human
uccuugucuccacccacu

SEQ ID NO: 1020889 - RNA, 26 nt, Human
ucggcggccagagcagcaaccugggc

SEQ ID NO: 1020890 - RNA, 18 nt, Human
ucuccacccacuccucca

SEQ ID NO: 1020891 - RNA, 24 nt, Human
ucuccacccacuccuccaugagaa

SEQ ID NO: 1020892 - RNA, 26 nt, Human
ucucgggccgcgcgcccccgggcccc

SEQ ID NO: 1020893 - RNA, 18 nt, Human
ucuguggagcaggggcuu

SEQ ID NO: 1020894 - RNA, 19 nt, Human
ugaaacugugguuccccuu

SEQ ID NO: 1020895 - RNA, 21 nt, Human
ugaguaguagaaugggcgggu

SEQ ID NO: 1020896 - RNA, 22 nt, Human
uggggcucaaaggccuugucuc

SEQ ID NO: 1020897 - RNA, 24 nt, Human
uggggcucaaaggccuugucucca

SEQ ID NO: 1020898 - RNA, 19 nt, Human
uggugaaacugugguuccc

SEQ ID NO: 1020899 - RNA, 19 nt, Human
ugucuccacccacuccucc

SEQ ID NO: 1020900 - RNA, 21 nt, Human
uguggagcaggggcuucagug

SEQ ID NO: 1020901 - RNA, 22 nt, Human
uguggugggagaucacccgggg

SEQ ID NO: 1020902 - RNA, 18 nt, Human
uucuggaaauaccuuggg

SEQ ID NO: 1020903 - RNA, 22 nt, Human
uugcaucgugcuccuuauuccc

SEQ ID NO: 1020904 - RNA, 23 nt, Human
uuucccgaaagcuaccccacccc

SEQ ID NO: 1020905 - RNA, 22 nt, Human
aaaacaaauccacauuaccuaa

SEQ ID NO: 1020906 - RNA, 20 nt, Human
aaaagaacagaugugagcaa

SEQ ID NO: 1020907 - RNA, 22 nt, Human
aaacacauuccagugcucauaa

SEQ ID NO: 1020908 - RNA, 23 nt, Human
aaacaggacaucaaaccuuccaa

SEQ ID NO: 1020909 - RNA, 18 nt, Human
aaagaguguauucucaag

SEQ ID NO: 1020910 - RNA, 22 nt, Human
aaagaguguauucucaagauuc

SEQ ID NO: 1020911 - RNA, 19 nt, Human
aaagcaaaccaaugagaaa

SEQ ID NO: 1020912 - RNA, 24 nt, Human
aaagugcugggauuacaggcguga

SEQ ID NO: 1020913 - RNA, 24 nt, Human
aaagugcugggauuacagguguga

SEQ ID NO: 1020914 - RNA, 22 nt, Human
aaaguguugggauuauaggcau

SEQ ID NO: 1020915 - RNA, 24 nt, Human
aaaguguugggauuauaggcauga

SEQ ID NO: 1020916 - RNA, 19 nt, Human
aaauaccacaaaacacuaa

SEQ ID NO: 1020917 - RNA, 22 nt, Human
aaauagcuaccaaaacaaaucc

SEQ ID NO: 1020918 - RNA, 23 nt, Human
aacuaccacccaagcgugccacc

SEQ ID NO: 1020919 - RNA, 23 nt, Human
aacuuauuuuauccccuccucca

SEQ ID NO: 1020920 - RNA, 18 nt, Human
aacuuguggcuccuucuc

SEQ ID NO: 1020921 - RNA, 18 nt, Human
aagauacccauucaaaua

SEQ ID NO: 1020922 - RNA, 22 nt, Human
aagcaaaccaaugagaaauacc

SEQ ID NO: 1020923 - RNA, 23 nt, Human
aagcaacccccuucuccugccuc

SEQ ID NO: 1020924 - RNA, 21 nt, Human
aagcagcuuuaucuauaaugu

SEQ ID NO: 1020925 - RNA, 19 nt, Human
aaguagcugggauuauagg

SEQ ID NO: 1020926 - RNA, 24 nt, Human
aagucacucucuuagcaucuccau

SEQ ID NO: 1020927 - RNA, 18 nt, Human
aagugcugggauuacagg

SEQ ID NO: 1020928 - RNA, 19 nt, Human
aagugcugggauuacaggc

SEQ ID NO: 1020929 - RNA, 19 nt, Human
aagugcugggauuacaggc

SEQ ID NO: 1020930 - RNA, 19 nt, Human
aagugcugggauuacaggu

SEQ ID NO: 1020931 - RNA, 26 nt, Human
aagugcugggauuacaggugugagcc

SEQ ID NO: 1020932 - RNA, 21 nt, Human
aaguguugggauuauaggcau

SEQ ID NO: 1020933 - RNA, 24 nt, Human
aauagcuaccaaaacaaauccaca

SEQ ID NO: 1020934 - RNA, 19 nt, Human
aaucauaguucacugcagc

SEQ ID NO: 1020935 - RNA, 18 nt, Human
aauggaacuggugggugg

SEQ ID NO: 1020936 - RNA, 23 nt, Human
aauuaucuguuucauauuuagaa

SEQ ID NO: 1020937 - RNA, 20 nt, Human
acaaauuccagcccaaagau

SEQ ID NO: 1020938 - RNA, 21 nt, Human
acaauccccucaguauacgug

SEQ ID NO: 1020939 - RNA, 21 nt, Human
acacaaauuugaggaauuaga

SEQ ID NO: 1020940 - RNA, 19 nt, Human
acacagcuuaaaagcaugu

SEQ ID NO: 1020941 - RNA, 23 nt, Human
acacagcuuaaaagcaugugcaa

SEQ ID NO: 1020942 - RNA, 24 nt, Human
acaguuaaaacaaacaagauaccc

SEQ ID NO: 1020943 - RNA, 23 nt, Human
accaaguacuguaaauauuuaca

SEQ ID NO: 1020944 - RNA, 25 nt, Human
acccaucucggccucccaaagugcu

SEQ ID NO: 1020945 - RNA, 23 nt, Human
acgagauggggucuugcucuguu

SEQ ID NO: 1020946 - RNA, 25 nt, Human
acuaaaauacaaaacacugccuuag

SEQ ID NO: 1020947 - RNA, 24 nt, Human
acuauguuggccaggcuggucucg

SEQ ID NO: 1020948 - RNA, 18 nt, Human
acuauguuggucaggcug

SEQ ID NO: 1020949 - RNA, 22 nt, Human
acucaccccauuacccauucca

SEQ ID NO: 1020950 - RNA, 25 nt, Human
acucuuuuacccaggcuggagugua

SEQ ID NO: 1020951 - RNA, 22 nt, Human
acuguagucucaaacuccuggg

SEQ ID NO: 1020952 - RNA, 23 nt, Human
acuuauuuuauccccuccuccau

SEQ ID NO: 1020953 - RNA, 28 nt, Human
acuuuuugcccagguucgucuugaauca

SEQ ID NO: 1020954 - RNA, 24 nt, Human
agaaaaaaaguuucuauuuagaag

SEQ ID NO: 1020955 - RNA, 25 nt, Human
agaaaaaccacaguuaagacucaaa

SEQ ID NO: 1020956 - RNA, 19 nt, Human
agaauccugccuaucugcc

SEQ ID NO: 1020957 - RNA, 22 nt, Human
agacaaguuccaaaguuccaca

SEQ ID NO: 1020958 - RNA, 22 nt, Human
agacacccuaccaccucccagg

SEQ ID NO: 1020959 - RNA, 24 nt, Human
agacuaaaaccagacaacagagcu

SEQ ID NO: 1020960 - RNA, 22 nt, Human
agagaagaccccacuguaugga

SEQ ID NO: 1020961 - RNA, 19 nt, Human
agagaugggguuucacuau

SEQ ID NO: 1020962 - RNA, 21 nt, Human
agcaccauaaucuaagacaga

SEQ ID NO: 1020963 - RNA, 23 nt, Human
agcacccuguccuacccugguga

SEQ ID NO: 1020964 - RNA, 20 nt, Human
agcacgcaucaucugugccc

SEQ ID NO: 1020965 - RNA, 20 nt, Human
agcgauucuccugccuuggc

SEQ ID NO: 1020966 - RNA, 23 nt, Human
agcgauucuccugccuuggccuc

SEQ ID NO: 1020967 - RNA, 20 nt, Human
agcgcucacaucccccgccc

SEQ ID NO: 1020968 - RNA, 18 nt, Human
agcuaccaaaacaaaucc

SEQ ID NO: 1020969 - RNA, 20 nt, Human
agcuaguuuuuuuuuuuuuu

SEQ ID NO: 1020970 - RNA, 23 nt, Human
agcuaguuuuuuuuuuuuuuuuu

SEQ ID NO: 1020971 - RNA, 23 nt, Human
agcuaguuuuuuuuuuuuuuuuu

SEQ ID NO: 1020972 - RNA, 18 nt, Human
aggagcuugagaaucaga

SEQ ID NO: 1020973 - RNA, 19 nt, Human
aggcuggagugcaguggca

SEQ ID NO: 1020974 - RNA, 19 nt, Human
agggacaagauuuguaagc

SEQ ID NO: 1020975 - RNA, 24 nt, Human
aggugauccacccaucucggccuc

SEQ ID NO: 1020976 - RNA, 21 nt, Human
agguucaagugauucuccugc

SEQ ID NO: 1020977 - RNA, 22 nt, Human
agguucaagugauucuccugcc

SEQ ID NO: 1020978 - RNA, 23 nt, Human
agguucaagugauucuccugccu

SEQ ID NO: 1020979 - RNA, 19 nt, Human
aguagagaugggguuucac

SEQ ID NO: 1020980 - RNA, 19 nt, Human
aguagcugauggacacaua

SEQ ID NO: 1020981 - RNA, 21 nt, Human
aguagcugggacuguauguac

SEQ ID NO: 1020982 - RNA, 18 nt, Human
aguagcugggauuacagg

SEQ ID NO: 1020983 - RNA, 20 nt, Human
agugcaauggugugaucucg

SEQ ID NO: 1020984 - RNA, 24 nt, Human
agugcaauggugugaucucggcuc

SEQ ID NO: 1020985 - RNA, 21 nt, Human
agugcaguggcacaaucauag

SEQ ID NO: 1020986 - RNA, 23 nt, Human
agugcaguggcacaaucauaguu

SEQ ID NO: 1020987 - RNA, 24 nt, Human
agugugguggugcaaucgcggcuc

SEQ ID NO: 1020988 - RNA, 18 nt, Human
auaguucacugcagccuu

SEQ ID NO: 1020989 - RNA, 21 nt, Human
auaguugcuuuucuuguuugu

SEQ ID NO: 1020990 - RNA, 19 nt, Human
aucauaccuaaaacccacu

SEQ ID NO: 1020991 - RNA, 22 nt, Human
auccugccuaucugcccucuca

SEQ ID NO: 1020992 - RNA, 18 nt, Human
aucgcggcucacugcaac

SEQ ID NO: 1020993 - RNA, 24 nt, Human
augaaccaccgcuccuggcagaau

SEQ ID NO: 1020994 - RNA, 24 nt, Human
augauccacccaccucagccuccc

SEQ ID NO: 1020995 - RNA, 21 nt, Human
auggccagcauuucagacacc

SEQ ID NO: 1020996 - RNA, 18 nt, Human
augggguuucacuauguu

SEQ ID NO: 1020997 - RNA, 24 nt, Human
augggguuucacuauguuggccag

SEQ ID NO: 1020998 - RNA, 21 nt, Human
augggguuucacuauguuggu

SEQ ID NO: 1020999 - RNA, 23 nt, Human
augggguuucacuauguugguca

SEQ ID NO: 1021000 - RNA, 24 nt, Human
augggguuucacuauguuggucag

SEQ ID NO: 1021001 - RNA, 24 nt, Human
auuacauuacagcaaagccaaacu

SEQ ID NO: 1021002 - RNA, 24 nt, Human
auuuuuguauuuuuaguagagaug

SEQ ID NO: 1021003 - RNA, 30 nt, Human
auuuuuuuuuuuuguauuuuuaguagagaa

SEQ ID NO: 1021004 - RNA, 23 nt, Human
caaaacaaauccacauuaccuaa

SEQ ID NO: 1021005 - RNA, 24 nt, Human
caaaacacuaaaagaacagaugug

SEQ ID NO: 1021006 - RNA, 23 nt, Human
caaaaccucaaauaccacaaaac

SEQ ID NO: 1021007 - RNA, 23 nt, Human
caaacaggcagaaaaugcucugc

SEQ ID NO: 1021008 - RNA, 24 nt, Human
caaaccaaugagaaauaccuaucu

SEQ ID NO: 1021009 - RNA, 25 nt, Human
caaacuccugggcucaggugauccu

SEQ ID NO: 1021010 - RNA, 20 nt, Human
caaagcugcugccacccaaa

SEQ ID NO: 1021011 - RNA, 24 nt, Human
caaagugcugggauuacaggcgug

SEQ ID NO: 1021012 - RNA, 24 nt, Human
caaagugcugggauuacaggugug

SEQ ID NO: 1021013 - RNA, 20 nt, Human
caaaguuccacaaaguccuc

SEQ ID NO: 1021014 - RNA, 27 nt, Human
caacaaguaaacacccugguguuagga

SEQ ID NO: 1021015 - RNA, 19 nt, Human
caagugauucuccugccuc

SEQ ID NO: 1021016 - RNA, 22 nt, Human
caagugauucuccugccuccgc

SEQ ID NO: 1021017 - RNA, 23 nt, Human
cacagcagcuuggugucuaccag

SEQ ID NO: 1021018 - RNA, 24 nt, Human
caccacgccuggcuaauuuuugua

SEQ ID NO: 1021019 - RNA, 22 nt, Human
cacccaccucagccucccaaag

SEQ ID NO: 1021020 - RNA, 23 nt, Human
cacccaccucagccucccaaagu

SEQ ID NO: 1021021 - RNA, 22 nt, Human
cacccaucucggccucccaaag

SEQ ID NO: 1021022 - RNA, 23 nt, Human
cacccaucucggccucccaaagu

SEQ ID NO: 1021023 - RNA, 18 nt, Human
caccgcuccuggcagaau

SEQ ID NO: 1021024 - RNA, 24 nt, Human
caccucagccucccaaagugcugg

SEQ ID NO: 1021025 - RNA, 24 nt, Human
caccugguuaauuuuuuuuuuuug

SEQ ID NO: 1021026 - RNA, 24 nt, Human
cacuaaaagaacagaugugagcaa

SEQ ID NO: 1021027 - RNA, 19 nt, Human
cacuaugcugauuucagca

SEQ ID NO: 1021028 - RNA, 23 nt, Human
cacuaugcugauuucagcagaac

SEQ ID NO: 1021029 - RNA, 20 nt, Human
cacuaugucagccuuguacc

SEQ ID NO: 1021030 - RNA, 21 nt, Human
cacuauguuggccaggcuggu

SEQ ID NO: 1021031 - RNA, 24 nt, Human
cacuauguuggccaggcuggucuc

SEQ ID NO: 1021032 - RNA, 21 nt, Human
cacuauguuggucaggcuggu

SEQ ID NO: 1021033 - RNA, 22 nt, Human
cacuauguuggucaggcugguc

SEQ ID NO: 1021034 - RNA, 18 nt, Human
cacucuaugaacuacucc

SEQ ID NO: 1021035 - RNA, 24 nt, Human
cacucuuuuacccaggcuggagug

SEQ ID NO: 1021036 - RNA, 21 nt, Human
cacugcaaccuccgccuccca

SEQ ID NO: 1021037 - RNA, 24 nt, Human
cagaaaaugcucugcuaauaccau

SEQ ID NO: 1021038 - RNA, 18 nt, Human
cagaacaaaauggcauca

SEQ ID NO: 1021039 - RNA, 22 nt, Human
cagacaacagagcucuguuaac

SEQ ID NO: 1021040 - RNA, 22 nt, Human
cagacacccuaccaccucccag

SEQ ID NO: 1021041 - RNA, 20 nt, Human
cagagcaggggcuguggcag

SEQ ID NO: 1021042 - RNA, 21 nt, Human
cagccacagagaagaccccac

SEQ ID NO: 1021043 - RNA, 18 nt, Human
cagccucagccuccuaaa

SEQ ID NO: 1021044 - RNA, 25 nt, Human
cagccucagccuccuaaaguguugg

SEQ ID NO: 1021045 - RNA, 20 nt, Human
cagccuccugaguagcuggg

SEQ ID NO: 1021046 - RNA, 25 nt, Human
cagcuaguuuuuuuuuuuuuuuuuu

SEQ ID NO: 1021047 - RNA, 24 nt, Human
caugauccacccaccucagccucc

SEQ ID NO: 1021048 - RNA, 18 nt, Human
ccaaagcugcugccaccc

SEQ ID NO: 1021049 - RNA, 20 nt, Human
ccaaagugcugggauuacag

SEQ ID NO: 1021050 - RNA, 20 nt, Human
ccaaagugcugggauuacag

SEQ ID NO: 1021051 - RNA, 21 nt, Human
ccaaagugcugggauuacagg

SEQ ID NO: 1021052 - RNA, 21 nt, Human
ccaaagugcugggauuacagg

SEQ ID NO: 1021053 - RNA, 22 nt, Human
ccaaagugcugggauuacaggc

SEQ ID NO: 1021054 - RNA, 22 nt, Human
ccaaagugcugggauuacaggc

SEQ ID NO: 1021055 - RNA, 24 nt, Human
ccaaagugcugggauuacaggcgu

SEQ ID NO: 1021056 - RNA, 24 nt, Human
ccaaagugcugggauuacaggugu

SEQ ID NO: 1021057 - RNA, 20 nt, Human
ccaccacgccuggcuaauuu

SEQ ID NO: 1021058 - RNA, 26 nt, Human
ccacccaccucagccucccaaagugc

SEQ ID NO: 1021059 - RNA, 21 nt, Human
ccacgacucucccagaauauc

SEQ ID NO: 1021060 - RNA, 19 nt, Human
ccacucauagaauccugcc

SEQ ID NO: 1021061 - RNA, 19 nt, Human
ccagcccaaagauaaacuu

SEQ ID NO: 1021062 - RNA, 24 nt, Human
ccagcuaguuuuuuuaaaaaauua

SEQ ID NO: 1021063 - RNA, 20 nt, Human
ccaggcucuggcugccugau

SEQ ID NO: 1021064 - RNA, 23 nt, Human
cccaaguagcugggauuauaggc

SEQ ID NO: 1021065 - RNA, 24 nt, Human
cccaaguagcugggauuauaggcg

SEQ ID NO: 1021066 - RNA, 20 nt, Human
cccaggcuggagugcaaugg

SEQ ID NO: 1021067 - RNA, 23 nt, Human
cccagguucaagugauucuccuc

SEQ ID NO: 1021068 - RNA, 23 nt, Human
cccagguucaagugauucuccug

SEQ ID NO: 1021069 - RNA, 22 nt, Human
cccauggggauugaagaaaaac

SEQ ID NO: 1021070 - RNA, 18 nt, Human
ccccaaauccaagaaaaa

SEQ ID NO: 1021071 - RNA, 22 nt, Human
ccccacuguauggaggcuacaa

SEQ ID NO: 1021072 - RNA, 23 nt, Human
cccgaguagcugggauuacaggu

SEQ ID NO: 1021073 - RNA, 24 nt, Human
cccgaguagcugggauuacaggug

SEQ ID NO: 1021074 - RNA, 18 nt, Human
cccuaccaccucccaggc

SEQ ID NO: 1021075 - RNA, 21 nt, Human
ccgaguagcugggauuacagg

SEQ ID NO: 1021076 - RNA, 24 nt, Human
ccgaguagcugggauuacaggugu

SEQ ID NO: 1021077 - RNA, 25 nt, Human
ccgcccaagauauccucucugccgc

SEQ ID NO: 1021078 - RNA, 24 nt, Human
ccgccucccagguucaagugauuc

SEQ ID NO: 1021079 - RNA, 23 nt, Human
ccgccucccgaguagcugggauu

SEQ ID NO: 1021080 - RNA, 23 nt, Human
ccuaaaguguugggauuauaggc

SEQ ID NO: 1021081 - RNA, 24 nt, Human
ccuaugggccccacuggguaaggg

SEQ ID NO: 1021082 - RNA, 23 nt, Human
ccucaaauaccacaaaacacuaa

SEQ ID NO: 1021083 - RNA, 20 nt, Human
ccucccaggcucuggcugcc

SEQ ID NO: 1021084 - RNA, 24 nt, Human
ccucccagguucaagugauucucc

SEQ ID NO: 1021085 - RNA, 19 nt, Human
ccuccgccucccgaguagc

SEQ ID NO: 1021086 - RNA, 18 nt, Human
ccucuagccuaugggccc

SEQ ID NO: 1021087 - RNA, 22 nt, Human
ccugaccgcaugauccacccac

SEQ ID NO: 1021088 - RNA, 23 nt, Human
ccugaccucaggugauccaccca

SEQ ID NO: 1021089 - RNA, 24 nt, Human
ccugaccucaggugauccacccau

SEQ ID NO: 1021090 - RNA, 19 nt, Human
ccugaguagcugggacugu

SEQ ID NO: 1021091 - RNA, 23 nt, Human
ccugccuuggccucccaaguagc

SEQ ID NO: 1021092 - RNA, 18 nt, Human
ccuggcuucaagugaucc

SEQ ID NO: 1021093 - RNA, 20 nt, Human
ccuggcuucaagugauccac

SEQ ID NO: 1021094 - RNA, 18 nt, Human
ccugggcucaggugaucc

SEQ ID NO: 1021095 - RNA, 24 nt, Human
ccuucugguuucgagcgauucucc

SEQ ID NO: 1021096 - RNA, 25 nt, Human
ccuuggccucccaaguagcugggau

SEQ ID NO: 1021097 - RNA, 19 nt, Human
ccuuguggaacuccugauu

SEQ ID NO: 1021098 - RNA, 24 nt, Human
cgaucugucgcgcaggcuggagug

SEQ ID NO: 1021099 - RNA, 22 nt, Human
cgccucccagguucaagugauu

SEQ ID NO: 1021100 - RNA, 21 nt, Human
cggugcugccaagggcucagc

SEQ ID NO: 1021101 - RNA, 24 nt, Human
cuaaaaccagacaacagagcucug

SEQ ID NO: 1021102 - RNA, 22 nt, Human
cuaaaacccacuggccucuacc

SEQ ID NO: 1021103 - RNA, 24 nt, Human
cuacuguagucucaaacuccuggg

SEQ ID NO: 1021104 - RNA, 18 nt, Human
cuagccuaugggccccac

SEQ ID NO: 1021105 - RNA, 21 nt, Human
cucaccccauuacccauucca

SEQ ID NO: 1021106 - RNA, 24 nt, Human
cucacugcaaccuccgccucccag

SEQ ID NO: 1021107 - RNA, 18 nt, Human
cucagaauaguugcuuuu

SEQ ID NO: 1021108 - RNA, 25 nt, Human
cucccaaguaaaaccaaguacugua

SEQ ID NO: 1021109 - RNA, 19 nt, Human
cucccagguucaagugauu

SEQ ID NO: 1021110 - RNA, 23 nt, Human
cuccugggcucaggugauccucu

SEQ ID NO: 1021111 - RNA, 24 nt, Human
cucuaaagaguaucucccccaccu

SEQ ID NO: 1021112 - RNA, 22 nt, Human
cucuguccaccuguuucgauca

SEQ ID NO: 1021113 - RNA, 20 nt, Human
cucuguugcccaggcuggag

SEQ ID NO: 1021114 - RNA, 20 nt, Human
cucuuguugcccaggcugga

SEQ ID NO: 1021115 - RNA, 18 nt, Human
cucuuuuacccaggcugg

SEQ ID NO: 1021116 - RNA, 24 nt, Human
cugaaauuaguaggaguaauagaa

SEQ ID NO: 1021117 - RNA, 23 nt, Human
cugcaaccuccgccucccagguu

SEQ ID NO: 1021118 - RNA, 24 nt, Human
cugcaaccuccgccucccagguuc

SEQ ID NO: 1021119 - RNA, 23 nt, Human
cugccaccuccaccuucugguuu

SEQ ID NO: 1021120 - RNA, 24 nt, Human
cugccaccuccaccuucugguuuc

SEQ ID NO: 1021121 - RNA, 23 nt, Human
cugccuccgccucccgaguagcu

SEQ ID NO: 1021122 - RNA, 23 nt, Human
cugccuuggccucccaaguagcu

SEQ ID NO: 1021123 - RNA, 23 nt, Human
cugcuucagccuccugaguagcu

SEQ ID NO: 1021124 - RNA, 22 nt, Human
cugcuuccaaaacuaccaccca

SEQ ID NO: 1021125 - RNA, 24 nt, Human
cuuguugcccaggcuggagugcaa

SEQ ID NO: 1021126 - RNA, 20 nt, Human
gaaacaggacaucaaaccuu

SEQ ID NO: 1021127 - RNA, 21 nt, Human
gaacagaugugagcaacuuau

SEQ ID NO: 1021128 - RNA, 21 nt, Human
gaacugaauccauagggacaa

SEQ ID NO: 1021129 - RNA, 22 nt, Human
gaccgcaugauccacccaccuc

SEQ ID NO: 1021130 - RNA, 24 nt, Human
gaccucaggugauccacccaucuc

SEQ ID NO: 1021131 - RNA, 20 nt, Human
gagagggugaucaguuuuug

SEQ ID NO: 1021132 - RNA, 20 nt, Human
gagaugggguuucacuaugu

SEQ ID NO: 1021133 - RNA, 24 nt, Human
gagaugggguuucacuauguuggc

SEQ ID NO: 1021134 - RNA, 24 nt, Human
gagaugggguuucacuauguuggu

SEQ ID NO: 1021135 - RNA, 22 nt, Human
gagccaccaugccuggccccaa

SEQ ID NO: 1021136 - RNA, 25 nt, Human
gagcgauucuccugccuuggccucc

SEQ ID NO: 1021137 - RNA, 26 nt, Human
gaguagcugggacuguauguacaugc

SEQ ID NO: 1021138 - RNA, 24 nt, Human
gaguagcugggauuacaggugugc

SEQ ID NO: 1021139 - RNA, 18 nt, Human
gauuacaggcgugagcca

SEQ ID NO: 1021140 - RNA, 21 nt, Human
gauuacaggcgugagccacca

SEQ ID NO: 1021141 - RNA, 24 nt, Human
gauuacaggcgugagccaccaugc

SEQ ID NO: 1021142 - RNA, 18 nt, Human
gauuacaggugugagcca

SEQ ID NO: 1021143 - RNA, 21 nt, Human
gauuacaggugugagccacca

SEQ ID NO: 1021144 - RNA, 22 nt, Human
gauuacaggugugagccaccac

SEQ ID NO: 1021145 - RNA, 18 nt, Human
gauuacaggugugcgcca

SEQ ID NO: 1021146 - RNA, 21 nt, Human
gauuauaggcaugaaccaccg

SEQ ID NO: 1021147 - RNA, 19 nt, Human
gccagcugcccagcuaguu

SEQ ID NO: 1021148 - RNA, 20 nt, Human
gcccgugguaccguggucag

SEQ ID NO: 1021149 - RNA, 19 nt, Human
gccgcaacagauucagccu

SEQ ID NO: 1021150 - RNA, 23 nt, Human
gcgcaggcuggagugugguggug

SEQ ID NO: 1021151 - RNA, 24 nt, Human
gcuaucauccugcuucagccuccu

SEQ ID NO: 1021152 - RNA, 19 nt, Human
gcucaguguacccucuaaa

SEQ ID NO: 1021153 - RNA, 25 nt, Human
gcucuguugcccaggcuggagugca

SEQ ID NO: 1021154 - RNA, 20 nt, Human
gcucuuguugcccaggcugg

SEQ ID NO: 1021155 - RNA, 21 nt, Human
gcucuuguugcccaggcugga

SEQ ID NO: 1021156 - RNA, 24 nt, Human
gcucuuguugcccaggcuggagug

SEQ ID NO: 1021157 - RNA, 30 nt, Human; identical to SEQ ID NO: 654829

SEQ ID NO: 1021158 - RNA, 19 nt, Human
gcuggagugcaguggcaca

SEQ ID NO: 1021159 - RNA, 23 nt, Human
gcuggucacaaacuccugaccuc

SEQ ID NO: 1021160 - RNA, 24 nt, Human
ggauuacaggcgugagccaccaug

SEQ ID NO: 1021161 - RNA, 22 nt, Human
ggcuggagugcaauggugugau

SEQ ID NO: 1021162 - RNA, 24 nt, Human
ggcuggucacaaacuccugaccuc

SEQ ID NO: 1021163 - RNA, 20 nt, Human
ggggcuguggcagcccgugg

SEQ ID NO: 1021164 - RNA, 22 nt, Human
gggguuucacuauguuggccag

SEQ ID NO: 1021165 - RNA, 22 nt, Human
gggguuucacuauguuggucag

SEQ ID NO: 1021166 - RNA, 21 nt, Human
gggucucacuuuuugcccagg

SEQ ID NO: 1021167 - RNA, 22 nt, Human
gggucuugcucuguugcccagg

SEQ ID NO: 1021168 - RNA, 18 nt, Human
ggguuucacuauguuggc

SEQ ID NO: 1021169 - RNA, 23 nt, Human
ggucagucacagcagcuuggugu

SEQ ID NO: 1021170 - RNA, 20 nt, Human
gguuucgagcgauucuccug

SEQ ID NO: 1021171 - RNA, 22 nt, Human
guagcacgcaucaucugugccc

SEQ ID NO: 1021172 - RNA, 18 nt, Human
guagcugggauuacaggu

SEQ ID NO: 1021173 - RNA, 18 nt, Human
guagcugggauuauaggc

SEQ ID NO: 1021174 - RNA, 19 nt, Human
gucucgaacuccugaccgc

SEQ ID NO: 1021175 - RNA, 23 nt, Human
gugauccaccagccucagccucc

SEQ ID NO: 1021176 - RNA, 24 nt, Human
gugauccacccaucucggccuccc

SEQ ID NO: 1021177 - RNA, 20 nt, Human
gugauucuccugccuccgcc

SEQ ID NO: 1021178 - RNA, 19 nt, Human
guguugggauuauaggcau

SEQ ID NO: 1021179 - RNA, 19 nt, Human
uaaaacaaacaagauaccc

SEQ ID NO: 1021180 - RNA, 20 nt, Human
uaaaaccagacaacagagcu

SEQ ID NO: 1021181 - RNA, 19 nt, Human
uaaaagaacagaugugagc

SEQ ID NO: 1021182 - RNA, 18 nt, Human
uaaagagaugaggucuca

SEQ ID NO: 1021183 - RNA, 24 nt, Human
uaaagagaugaggucucacucuuu

SEQ ID NO: 1021184 - RNA, 24 nt, Human
uaaagcaccauaaucuaagacaga

SEQ ID NO: 1021185 - RNA, 19 nt, Human
uaaccaauuucucauccua

SEQ ID NO: 1021186 - RNA, 19 nt, Human
uaaguccuagcacaacuga

SEQ ID NO: 1021187 - RNA, 18 nt, Human
uaaguguggucauggacc

SEQ ID NO: 1021188 - RNA, 21 nt, Human
uaaugagugauccaaagcugc

SEQ ID NO: 1021189 - RNA, 24 nt, Human
uaauuuuuguauuuuuaguagaga

SEQ ID NO: 1021190 - RNA, 24 nt, Human
uacaauuagauaaaauuguccaaa

SEQ ID NO: 1021191 - RNA, 23 nt, Human
uacacagagaaaagacugcuaac

SEQ ID NO: 1021192 - RNA, 24 nt, Human
uacacagagaaaagacugcuaacc

SEQ ID NO: 1021193 - RNA, 18 nt, Human
uacacagcuuaaaagcau

SEQ ID NO: 1021194 - RNA, 22 nt, Human
uacaggcgugagccaccaugcc

SEQ ID NO: 1021195 - RNA, 22 nt, Human
uacaggcgugagccaccaugcc

SEQ ID NO: 1021196 - RNA, 23 nt, Human
uacaggcgugagccaccaugccu

SEQ ID NO: 1021197 - RNA, 22 nt, Human
uacaggugugagccaccacgcc

SEQ ID NO: 1021198 - RNA, 22 nt, Human
uacaggugugcgccaccacgcc

SEQ ID NO: 1021199 - RNA, 23 nt, Human
uaccacugguggugccuugaagc

SEQ ID NO: 1021200 - RNA, 22 nt, Human
uacccacaaccauccaaacuua

SEQ ID NO: 1021201 - RNA, 21 nt, Human
uacccaggcuggaguguagug

SEQ ID NO: 1021202 - RNA, 24 nt, Human
uacccaggcuggaguguaguggca

SEQ ID NO: 1021203 - RNA, 22 nt, Human
uacccucuaaagaguaucuccc

SEQ ID NO: 1021204 - RNA, 21 nt, Human
uagaacuaaaauacaaaacac

SEQ ID NO: 1021205 - RNA, 23 nt, Human
uagaacuaaaauacaaaacacug

SEQ ID NO: 1021206 - RNA, 22 nt, Human
uagagaugggguuucacuaugu

SEQ ID NO: 1021207 - RNA, 22 nt, Human
uagagaugggguuucacuaugu

SEQ ID NO: 1021208 - RNA, 18 nt, Human
uagcacaacugacugcuu

SEQ ID NO: 1021209 - RNA, 22 nt, Human
uagcacccuguccuacccuggu

SEQ ID NO: 1021210 - RNA, 22 nt, Human
uagccuaugggccccacugggu

SEQ ID NO: 1021211 - RNA, 21 nt, Human
uagcucaguguacccucuaaa

SEQ ID NO: 1021212 - RNA, 23 nt, Human
uaggcgcccgccacuacaccugg

SEQ ID NO: 1021213 - RNA, 23 nt, Human
uaguagagaugggguuucacuau

SEQ ID NO: 1021214 - RNA, 24 nt, Human
uaguagagaugggguuucacuaug

SEQ ID NO: 1021215 - RNA, 24 nt, Human
uaguagagaugggguuucacuaug

SEQ ID NO: 1021216 - RNA, 25 nt, Human
uaguagcacccuguccuacccuggu

SEQ ID NO: 1021217 - RNA, 24 nt, Human
uagucuucaaugagaaacaggaca

SEQ ID NO: 1021218 - RNA, 18 nt, Human
uaguuaaaauauccuuua

SEQ ID NO: 1021219 - RNA, 24 nt, Human
uaguucacugcagccuugaacucu

SEQ ID NO: 1021220 - RNA, 19 nt, Human
uauaaugugggagcauggu

SEQ ID NO: 1021221 - RNA, 20 nt, Human
uauaaugugggagcaugguc

SEQ ID NO: 1021222 - RNA, 21 nt, Human
uauggaggcuacaauuaacca

SEQ ID NO: 1021223 - RNA, 18 nt, Human
uauguacaugccaccaug

SEQ ID NO: 1021224 - RNA, 19 nt, Human
uauguuggccaggcugguc

SEQ ID NO: 1021225 - RNA, 24 nt, Human
uauguuggccaggcuggucucgaa

SEQ ID NO: 1021226 - RNA, 23 nt, Human
uauguuggucaggcuggucacaa

SEQ ID NO: 1021227 - RNA, 24 nt, Human
uauguuggucaggcuggucacaaa

SEQ ID NO: 1021228 - RNA, 19 nt, Human
uauuacauuacagcaaagc

SEQ ID NO: 1021229 - RNA, 20 nt, Human
uauuacauuacagcaaagcc

SEQ ID NO: 1021230 - RNA, 19 nt, Human
uauugaggugaagagaaga

SEQ ID NO: 1021231 - RNA, 20 nt, Human
ucaagagucugaaacaccuu

SEQ ID NO: 1021232 - RNA, 20 nt, Human
ucaagcuaucauccugcuuc

SEQ ID NO: 1021233 - RNA, 19 nt, Human
ucaagugauccaccagccu

SEQ ID NO: 1021234 - RNA, 20 nt, Human
ucaagugauccaccagccuc

SEQ ID NO: 1021235 - RNA, 19 nt, Human
ucaagugauucuccugccu

SEQ ID NO: 1021236 - RNA, 22 nt, Human
ucacuauguuggccaggcuggu

SEQ ID NO: 1021237 - RNA, 22 nt, Human
ucacuauguuggucaggcuggu

SEQ ID NO: 1021238 - RNA, 24 nt, Human
ucacucuuuuacccaggcuggagu

SEQ ID NO: 1021239 - RNA, 19 nt, Human
ucacugcaaccuccgccuc

SEQ ID NO: 1021240 - RNA, 24 nt, Human
ucacugcaaccuccgccucccagg

SEQ ID NO: 1021241 - RNA, 25 nt, Human
ucacugcaaccuccgccucccaggu

SEQ ID NO: 1021242 - RNA, 27 nt, Human
ucacugcaaccuccgccucccagguuc

SEQ ID NO: 1021243 - RNA, 19 nt, Human
ucacugcagccuugaacuc

SEQ ID NO: 1021244 - RNA, 23 nt, Human
ucacugcagccuugaacucuugg

SEQ ID NO: 1021245 - RNA, 23 nt, Human
ucacugcagccuugaacucuugg

SEQ ID NO: 1021246 - RNA, 24 nt, Human
ucacugcagccuugaacucuuggg

SEQ ID NO: 1021247 - RNA, 18 nt, Human
ucacugccaccuccaccu

SEQ ID NO: 1021248 - RNA, 23 nt, Human
ucacugccaccuccaccuucugg

SEQ ID NO: 1021249 - RNA, 24 nt, Human
ucacugccaccuccaccuucuggu

SEQ ID NO: 1021250 - RNA, 20 nt, Human
ucagcaugaccuuguaauaa

SEQ ID NO: 1021251 - RNA, 18 nt, Human
ucagccucccaaagugcu

SEQ ID NO: 1021252 - RNA, 23 nt, Human
ucagccuccugaguagcugggac

SEQ ID NO: 1021253 - RNA, 22 nt, Human
ucagcugccgcaacagauucag

SEQ ID NO: 1021254 - RNA, 28 nt, Human
ucaguguacccucuaaagaguaucuccc

SEQ ID NO: 1021255 - RNA, 21 nt, Human
uccacccaccucagccuccca

SEQ ID NO: 1021256 - RNA, 23 nt, Human
ucccaaagugcugggauuacagg

SEQ ID NO: 1021257 - RNA, 24 nt, Human
ucccaaagugcugggauuacaggc

SEQ ID NO: 1021258 - RNA, 24 nt, Human
ucccaaguagcugggauuauaggc

SEQ ID NO: 1021259 - RNA, 24 nt, Human
ucccagaauaucuguauuuuuacc

SEQ ID NO: 1021260 - RNA, 21 nt, Human
ucccaggcucuggcugccuga

SEQ ID NO: 1021261 - RNA, 21 nt, Human
ucccagguucaagugauucuc

SEQ ID NO: 1021262 - RNA, 24 nt, Human
ucccagguucaagugauucuccug

SEQ ID NO: 1021263 - RNA, 23 nt, Human
ucccgaguagcugggauuacagg

SEQ ID NO: 1021264 - RNA, 24 nt, Human
ucccgaguagcugggauuacaggu

SEQ ID NO: 1021265 - RNA, 24 nt, Human
uccuaaaguguugggauuauaggc

SEQ ID NO: 1021266 - RNA, 25 nt, Human
uccuaaaguguugggauuauaggca

SEQ ID NO: 1021267 - RNA, 20 nt, Human
uccucuagccuaugggcccc

SEQ ID NO: 1021268 - RNA, 20 nt, Human
uccugaguagcugggacugu

SEQ ID NO: 1021269 - RNA, 24 nt, Human
uccuuuagaaagacuaaaaccaga

SEQ ID NO: 1021270 - RNA, 22 nt, Human
ucgaucacaaccagucagaagg

SEQ ID NO: 1021271 - RNA, 24 nt, Human
ucgcgcaggcuggagugugguggu

SEQ ID NO: 1021272 - RNA, 21 nt, Human
ucggugcuacaagagaaagaa

SEQ ID NO: 1021273 - RNA, 19 nt, Human
ucggugcugccaagggcuc

SEQ ID NO: 1021274 - RNA, 22 nt, Human
ucggugcugccaagggcucagc

SEQ ID NO: 1021275 - RNA, 21 nt, Human
ucuaaagaguaucucccccac

SEQ ID NO: 1021276 - RNA, 19 nt, Human
ucucaaacuccugggcuca

SEQ ID NO: 1021277 - RNA, 19 nt, Human
ucucacucugguuggugga

SEQ ID NO: 1021278 - RNA, 23 nt, Human
ucucacucuuuuacccaggcugg

SEQ ID NO: 1021279 - RNA, 24 nt, Human
ucucacucuuuuacccaggcugga

SEQ ID NO: 1021280 - RNA, 18 nt, Human
ucucacuuuuugcccagg

SEQ ID NO: 1021281 - RNA, 24 nt, Human
ucucagaauaguugcuuuucuugu

SEQ ID NO: 1021282 - RNA, 22 nt, Human
ucucccaaguaaaaccaaguac

SEQ ID NO: 1021283 - RNA, 23 nt, Human
ucucccaaguaaaaccaaguacu

SEQ ID NO: 1021284 - RNA, 20 nt, Human
ucuccugccucucugaacau

SEQ ID NO: 1021285 - RNA, 24 nt, Human
ucucgaucugucgcgcaggcugga

SEQ ID NO: 1021286 - RNA, 20 nt, Human
ucucggccucccaaagugcu

SEQ ID NO: 1021287 - RNA, 19 nt, Human
ucuguagacuaccuugcua

SEQ ID NO: 1021288 - RNA, 24 nt, Human
ucugucgcgcaggcuggagugugg

SEQ ID NO: 1021289 - RNA, 24 nt, Human
ucuguugcccaggcuggagugcag

SEQ ID NO: 1021290 - RNA, 23 nt, Human
ucuugcucuguugcccaggcugg

SEQ ID NO: 1021291 - RNA, 24 nt, Human
ucuugcucuguugcccaggcugga

SEQ ID NO: 1021292 - RNA, 22 nt, Human
ucuuguugcccaggcuggagug

SEQ ID NO: 1021293 - RNA, 23 nt, Human
ucuuguuuguuuuuuuaauuuuu

SEQ ID NO: 1021294 - RNA, 24 nt, Human
ucuuuuacccaggcuggaguguag

SEQ ID NO: 1021295 - RNA, 19 nt, Human
ugaaaaaaagguaaaaacc

SEQ ID NO: 1021296 - RNA, 20 nt, Human
ugaaaaaaagguaaaaacca

SEQ ID NO: 1021297 - RNA, 22 nt, Human
ugaaacaccuugugacaguagu

SEQ ID NO: 1021298 - RNA, 24 nt, Human
ugaagaaaaaccacaguuaagacu

SEQ ID NO: 1021299 - RNA, 21 nt, Human
ugaauaaaucccuguuuguaa

SEQ ID NO: 1021300 - RNA, 24 nt, Human
ugacaguaguggcaucuuacagaa

SEQ ID NO: 1021301 - RNA, 21 nt, Human
ugaccucaggugauccaccca

SEQ ID NO: 1021302 - RNA, 24 nt, Human
ugaccucaggugauccacccaucu

SEQ ID NO: 1021303 - RNA, 24 nt, Human
ugauccacccaccucagccuccca

SEQ ID NO: 1021304 - RNA, 24 nt, Human
ugauccacccaucucggccuccca

SEQ ID NO: 1021305 - RNA, 21 nt, Human
ugccaaaaccucaaauaccac

SEQ ID NO: 1021306 - RNA, 24 nt, Human
ugccaaaaccucaaauaccacaaa

SEQ ID NO: 1021307 - RNA, 27 nt, Human
ugccaaaaccucaaauaccacaaaaca

SEQ ID NO: 1021308 - RNA, 19 nt, Human
ugccaagggcucagcgcuc

SEQ ID NO: 1021309 - RNA, 19 nt, Human
ugccaccuccaccuucugg

SEQ ID NO: 1021310 - RNA, 18 nt, Human
ugcccaggcuggagugca

SEQ ID NO: 1021311 - RNA, 18 nt, Human
ugcccaggcuggagugca

SEQ ID NO: 1021312 - RNA, 21 nt, Human
ugcccaggcuggagugcaaug

SEQ ID NO: 1021313 - RNA, 24 nt, Human
ugcccaggcuggagugcaauggug

SEQ ID NO: 1021314 - RNA, 21 nt, Human
ugcccaggcuggagugcagug

SEQ ID NO: 1021315 - RNA, 22 nt, Human
ugcccaggcuggagugcagugg

SEQ ID NO: 1021316 - RNA, 24 nt, Human
ugcccaggcuggagugcaguggca

SEQ ID NO: 1021317 - RNA, 24 nt, Human
ugccuccgccucccgaguagcugg

SEQ ID NO: 1021318 - RNA, 24 nt, Human
ugcucuuguugcccaggcuggagu

SEQ ID NO: 1021319 - RNA, 24 nt, Human
ugcugggauuacaggcgugagcca

SEQ ID NO: 1021320 - RNA, 24 nt, Human
ugcugggauuacaggugugagcca

SEQ ID NO: 1021321 - RNA, 24 nt, Human
ugcuucagccuccugaguagcugg

SEQ ID NO: 1021322 - RNA, 21 nt, Human
uggaacacacaaauuugagga

SEQ ID NO: 1021323 - RNA, 24 nt, Human
uggacuuuuaaguuuaagcagcuu

SEQ ID NO: 1021324 - RNA, 19 nt, Human
uggagugcaauggugugau

SEQ ID NO: 1021325 - RNA, 23 nt, Human
uggagugcaauggugugaucucg

SEQ ID NO: 1021326 - RNA, 24 nt, Human
uggagugcaauggugugaucucgg

SEQ ID NO: 1021327 - RNA, 18 nt, Human
uggagugcaguggcacaa

SEQ ID NO: 1021328 - RNA, 19 nt, Human
uggagugcaguggcacaau

SEQ ID NO: 1021329 - RNA, 21 nt, Human
uggagugcaguggcacaauca

SEQ ID NO: 1021330 - RNA, 19 nt, Human
uggaguguaguggcaccau

SEQ ID NO: 1021331 - RNA, 24 nt, Human
uggcaaacaaccaagagguaauau

SEQ ID NO: 1021332 - RNA, 20 nt, Human
uggcacaaucauaguucacu

SEQ ID NO: 1021333 - RNA, 24 nt, Human
uggcacaaucauaguucacugcag

SEQ ID NO: 1021334 - RNA, 19 nt, Human
uggcaccaucauagcuacu

SEQ ID NO: 1021335 - RNA, 21 nt, Human
uggcagaacaaaauggcauca

SEQ ID NO: 1021336 - RNA, 19 nt, Human
uggcagcccgugguaccgu

SEQ ID NO: 1021337 - RNA, 24 nt, Human
uggccaggcuggucucgaacuccu

SEQ ID NO: 1021338 - RNA, 19 nt, Human
uggcugccugauaaaaaaa

SEQ ID NO: 1021339 - RNA, 24 nt, Human
uggcuucaagugauccaccagccu

SEQ ID NO: 1021340 - RNA, 24 nt, Human
ugggacuguauguacaugccacca

SEQ ID NO: 1021341 - RNA, 18 nt, Human
ugggauuacaggcgugag

SEQ ID NO: 1021342 - RNA, 22 nt, Human
ugggauuacaggcgugagccac

SEQ ID NO: 1021343 - RNA, 23 nt, Human
ugggauuacaggcgugagccacc

SEQ ID NO: 1021344 - RNA, 24 nt, Human
ugggauuacaggcgugagccacca

SEQ ID NO: 1021345 - RNA, 25 nt, Human
ugggauuacaggcgugagccaccau

SEQ ID NO: 1021346 - RNA, 18 nt, Human
ugggauuacaggugugag

SEQ ID NO: 1021347 - RNA, 19 nt, Human
ugggauuacaggugugagc

SEQ ID NO: 1021348 - RNA, 22 nt, Human
ugggauuacaggugugagccac

SEQ ID NO: 1021349 - RNA, 23 nt, Human
ugggauuacaggugugagccacc

SEQ ID NO: 1021350 - RNA, 24 nt, Human
ugggauuacaggugugagccacca

SEQ ID NO: 1021351 - RNA, 18 nt, Human
ugggauuacaggugugcg

SEQ ID NO: 1021352 - RNA, 19 nt, Human
ugggauuacaggugugcgc

SEQ ID NO: 1021353 - RNA, 21 nt, Human
ugggauuacaggugugcgcca

SEQ ID NO: 1021354 - RNA, 22 nt, Human
ugggauuacaggugugcgccac

SEQ ID NO: 1021355 - RNA, 24 nt, Human
ugggauuacaggugugcgccacca

SEQ ID NO: 1021356 - RNA, 21 nt, Human
ugggauuauaggcaugaacca

SEQ ID NO: 1021357 - RNA, 23 nt, Human
ugggauuauaggcaugaaccacc

SEQ ID NO: 1021358 - RNA, 24 nt, Human
ugggauuauaggcaugaaccaccg

SEQ ID NO: 1021359 - RNA, 21 nt, Human
ugggauuauaggcgcccgcca

SEQ ID NO: 1021360 - RNA, 22 nt, Human
ugggauuauaggcgcccgccac

SEQ ID NO: 1021361 - RNA, 22 nt, Human
ugggauuauaggcgcccgccac

SEQ ID NO: 1021362 - RNA, 24 nt, Human
ugggauuauaggcgcccgccacua

SEQ ID NO: 1021363 - RNA, 19 nt, Human
ugggcucaggugauccucu

SEQ ID NO: 1021364 - RNA, 24 nt, Human
uggggucuugcucuguugcccagg

SEQ ID NO: 1021365 - RNA, 24 nt, Human
ugggguuucacuauguuggccagg

SEQ ID NO: 1021366 - RNA, 24 nt, Human
ugggguuucacuauguuggucagg

SEQ ID NO: 1021367 - RNA, 24 nt, Human
uggucaggcuggucacaaacuccu

SEQ ID NO: 1021368 - RNA, 18 nt, Human
uggugauaaccucaggua

SEQ ID NO: 1021369 - RNA, 24 nt, Human
uguaagcuauacaaaucucccaag

SEQ ID NO: 1021370 - RNA, 21 nt, Human
uguauguacaugccaccaugu

SEQ ID NO: 1021371 - RNA, 21 nt, Human
uguauuuuuaguagagauggg

SEQ ID NO: 1021372 - RNA, 21 nt, Human
ugugagcaacuuauuuaaguc

SEQ ID NO: 1021373 - RNA, 21 nt, Human
ugugcaugccacucaagggcc

SEQ ID NO: 1021374 - RNA, 20 nt, Human
uguggcuccuucucacuaag

SEQ ID NO: 1021375 - RNA, 18 nt, Human
uguuacacagcuuaaaag

SEQ ID NO: 1021376 - RNA, 20 nt, Human
uguugcccaggcuggagugc

SEQ ID NO: 1021377 - RNA, 24 nt, Human
uuaaauaaguccuagcacaacuga

SEQ ID NO: 1021378 - RNA, 23 nt, Human
uuaaguucuacauuuaguagcug

SEQ ID NO: 1021379 - RNA, 21 nt, Human
uuacaguuaaaacaaacaaga

SEQ ID NO: 1021380 - RNA, 24 nt, Human
uuacccaggcuggaguguaguggc

SEQ ID NO: 1021381 - RNA, 20 nt, Human
uuaggagcuugagaaucaga

SEQ ID NO: 1021382 - RNA, 18 nt, Human
uuaguagagaugggguuu

SEQ ID NO: 1021383 - RNA, 18 nt, Human
uuaguagagaugggguuu

SEQ ID NO: 1021384 - RNA, 21 nt, Human
uuaguagagaugggguuucac

SEQ ID NO: 1021385 - RNA, 21 nt, Human
uuaguagagaugggguuucac

SEQ ID NO: 1021386 - RNA, 21 nt, Human
uuaguagagaugggguuucac

SEQ ID NO: 1021387 - RNA, 21 nt, Human
uuaguagagaugggguuucac

SEQ ID NO: 1021388 - RNA, 24 nt, Human
uuaguagagaugggguuucacuau

SEQ ID NO: 1021389 - RNA, 24 nt, Human
uuaguagagaugggguuucacuau

SEQ ID NO: 1021390 - RNA, 19 nt, Human
uucaagaagacacucuucu

SEQ ID NO: 1021391 - RNA, 23 nt, Human
uucaagugauccaccagccucag

SEQ ID NO: 1021392 - RNA, 21 nt, Human
uucaagugauucuccugccuc

SEQ ID NO: 1021393 - RNA, 24 nt, Human
uucaagugauucuccugccuccgc

SEQ ID NO: 1021394 - RNA, 20 nt, Human
uucaccccaaauccaagaaa

SEQ ID NO: 1021395 - RNA, 21 nt, Human
uucagcaugaccuuguaauaa

SEQ ID NO: 1021396 - RNA, 24 nt, Human
uucagccuccugaguagcugggac

SEQ ID NO: 1021397 - RNA, 19 nt, Human
uucauauuuagaaagucac

SEQ ID NO: 1021398 - RNA, 20 nt, Human
uucauauuuagaaagucacu

SEQ ID NO: 1021399 - RNA, 23 nt, Human
uuccuggcuucaagugauccacc

SEQ ID NO: 1021400 - RNA, 18 nt, Human
uucgagcgauucuccugc

SEQ ID NO: 1021401 - RNA, 23 nt, Human
uucgagcgauucuccugccuugg

SEQ ID NO: 1021402 - RNA, 24 nt, Human
uucgagcgauucuccugccuuggc

SEQ ID NO: 1021403 - RNA, 25 nt, Human
uucucaagauucuucuugggcaguu

SEQ ID NO: 1021404 - RNA, 28 nt, Human
uucuuguuuguuuuuuuaauuuuuuuuu

SEQ ID NO: 1021405 - RNA, 18 nt, Human
uugcccaggcuggagugc

SEQ ID NO: 1021406 - RNA, 24 nt, Human
uugcccaggcuggagugcaguggc

SEQ ID NO: 1021407 - RNA, 24 nt, Human
uugcucuguugcccaggcuggagu

SEQ ID NO: 1021408 - RNA, 22 nt, Human
uugcucuuguugcccaggcugg

SEQ ID NO: 1021409 - RNA, 23 nt, Human
uugcucuuguugcccaggcugga

SEQ ID NO: 1021410 - RNA, 22 nt, Human
uugcuuuucuuguuuguuuuuu

SEQ ID NO: 1021411 - RNA, 23 nt, Human
uuggccuacuuagagcuggucuu

SEQ ID NO: 1021412 - RNA, 24 nt, Human
uuggccuacuuagagcuggucuuu

SEQ ID NO: 1021413 - RNA, 21 nt, Human
uugggauuauaggcaugaacc

SEQ ID NO: 1021414 - RNA, 18 nt, Human
uugguucugugucugugg

SEQ ID NO: 1021415 - RNA, 23 nt, Human
uuguauuuuuaguagagaugggg

SEQ ID NO: 1021416 - RNA, 22 nt, Human
uuguccaaacucaauguuagaa

SEQ ID NO: 1021417 - RNA, 25 nt, Human
uuguggcuccuucucacuaaguggc

SEQ ID NO: 1021418 - RNA, 24 nt, Human
uuucacuauguuggccaggcuggu

SEQ ID NO: 1021419 - RNA, 24 nt, Human
uuucagaaauaucuuccuuuuuuu

SEQ ID NO: 1021420 - RNA, 20 nt, Human
uuucauauuuagaaagucac

SEQ ID NO: 1021421 - RNA, 22 nt, Human
uuugccaaaaccucaaauacca

SEQ ID NO: 1021422 - RNA, 24 nt, Human
uuugcucuuguugcccaggcugga

SEQ ID NO: 1021423 - RNA, 23 nt, Human
uuuguagagacaggggucucacu

SEQ ID NO: 1021424 - RNA, 24 nt, Human
uuuugcucuuguugcccaggcugg

SEQ ID NO: 1021425 - RNA, 23 nt, Human
uuuuuaauuuuuuuuuucugguc

SEQ ID NO: 1021426 - RNA, 24 nt, Human
uuuuuaguagagaugggguuucac

SEQ ID NO: 1021427 - RNA, 24 nt, Human
uuuuuaguagagaugggguuucac

SEQ ID NO: 1021428 - RNA, 20 nt, Human
uuuuuguauuuuuaguagag

SEQ ID NO: 1021429 - RNA, 22 nt, Human
uuuuuguauuuuuaguagagaa

SEQ ID NO: 1021430 - RNA, 24 nt, Human
uuuuuuguauuuuuaguagagaug

SEQ ID NO: 1021431 - RNA, 22 nt, Human
uuuuuuguauuuuuaguagagg

SEQ ID NO: 1021432 - RNA, 18 nt, Human
uuuuuuuguagagacagg

SEQ ID NO: 1021433 - RNA, 24 nt, Human
uuuuuuuuuuuuugagauagaguu

SEQ ID NO: 1021434 - RNA, 18 nt, Human
uuuuuuuuuuuuuuuuug

SEQ ID NO: 1021435 - RNA, 19 nt, Human
aaaaggccagaugacuggu

SEQ ID NO: 1021436 - RNA, 27 nt, Human
aaacacaaccuuaacauagcaaaaaua

SEQ ID NO: 1021437 - RNA, 24 nt, Human
aaacauccuucaccgcacacaucc

SEQ ID NO: 1021438 - RNA, 22 nt, Human
aaacccaaggccaucuggccuc

SEQ ID NO: 1021439 - RNA, 26 nt, Human
acaguaaaaugagccacuuauaggga

SEQ ID NO: 1021440 - RNA, 24 nt, Human
accgcacacaucccgccucugacu

SEQ ID NO: 1021441 - RNA, 22 nt, Human
acuaaggcuuuucuguggccag

SEQ ID NO: 1021442 - RNA, 21 nt, Human
agcaguuucacaauggcugau

SEQ ID NO: 1021443 - RNA, 18 nt, Human
agcuccaaguucccaguu

SEQ ID NO: 1021444 - RNA, 19 nt, Human
aggauuaaacccaaggcca

SEQ ID NO: 1021445 - RNA, 20 nt, Human
aggcaucaccaaacuagaaa

SEQ ID NO: 1021446 - RNA, 22 nt, Human
aggcaucaccaaacuagaaaca

SEQ ID NO: 1021447 - RNA, 21 nt, Human
agggaaaagcaagcucagacg

SEQ ID NO: 1021448 - RNA, 23 nt, Human
augcaggucaacuuauaugcuug

SEQ ID NO: 1021449 - RNA, 18 nt, Human
caaaagcagaguguccag

SEQ ID NO: 1021450 - RNA, 22 nt, Human
caccaaacuagaaacaaauucc

SEQ ID NO: 1021451 - RNA, 18 nt, Human
cagaagacaguaaaauga

SEQ ID NO: 1021452 - RNA, 21 nt, Human
cagaucaacuuuacugaaucu

SEQ ID NO: 1021453 - RNA, 19 nt, Human
ccaaaaccaccaucaccgc

SEQ ID NO: 1021454 - RNA, 19 nt, Human
cccgccucugacucccagc

SEQ ID NO: 1021455 - RNA, 18 nt, Human
cuccugcuuccuguccgc

SEQ ID NO: 1021456 - RNA, 20 nt, Human
cuugagcuaauacuaaggcu

SEQ ID NO: 1021457 - RNA, 21 nt, Human
gcaaaaauaaggccaccagga

SEQ ID NO: 1021458 - RNA, 20 nt, Human
gcagaguguccagagggaaa

SEQ ID NO: 1021459 - RNA, 21 nt, Human
gcaggucaacuuauaugcuug

SEQ ID NO: 1021460 - RNA, 25 nt, Human
gccaggauuaaacccaaggccaucu

SEQ ID NO: 1021461 - RNA, 22 nt, Human
gggaagaguaaaagggagaccg

SEQ ID NO: 1021462 - RNA, 24 nt, Human
uaaaaugagccacuuauagggaua

SEQ ID NO: 1021463 - RNA, 20 nt, Human
uaacauagcaaaaauaaggc

SEQ ID NO: 1021464 - RNA, 23 nt, Human
uagcaaaaauaaggccaccagga

SEQ ID NO: 1021465 - RNA, 20 nt, Human
uaugcaacuugacaauauuc

SEQ ID NO: 1021466 - RNA, 27 nt, Human
ucaagauagagaguaaagauuuaaaaa

SEQ ID NO: 1021467 - RNA, 19 nt, Human
ucaccaaacuagaaacaaa

SEQ ID NO: 1021468 - RNA, 21 nt, Human
uccucagucccaggacaaguc

SEQ ID NO: 1021469 - RNA, 30 nt, Human
uccuucaccgcacacaucccgccucugacu

SEQ ID NO: 1021470 - RNA, 18 nt, Human
ucugcauuguauuuguac

SEQ ID NO: 1021471 - RNA, 23 nt, Human
ugacaauauucuguaugcuuaac

SEQ ID NO: 1021472 - RNA, 19 nt, Human
ugacugguaaauuuuccuc

SEQ ID NO: 1021473 - RNA, 26 nt, Human
ugagaugggaaaaugcauacagauca

SEQ ID NO: 1021474 - RNA, 19 nt, Human
ugugcugaucacugaguuc

SEQ ID NO: 1021475 - RNA, 23 nt, Human
uuuacuuaagcuuucuuccacgu

SEQ ID NO: 1021476 - RNA, 24 nt, Human
uuuaggggucaugcucaagccccu

SEQ ID NO: 1021477 - RNA, 18 nt, Human
aacagaguccccuuucca

SEQ ID NO: 1021478 - RNA, 19 nt, Human
aacagaguccccuuuccag

SEQ ID NO: 1021479 - RNA, 21 nt, Human
aaccgcgcgcggacccagggc

SEQ ID NO: 1021480 - RNA, 19 nt, Human
aagccgccgccaggccuga

SEQ ID NO: 1021481 - RNA, 21 nt, Human
acacggcucaacaggaaggcc

SEQ ID NO: 1021482 - RNA, 18 nt, Human
agagaugggcaguguccc

SEQ ID NO: 1021483 - RNA, 24 nt, Human
agagaugggcaguguccggagucc

SEQ ID NO: 1021484 - RNA, 23 nt, Human
agaggucggcgccgucaucaccc

SEQ ID NO: 1021485 - RNA, 19 nt, Human
aggccccggccguggucaa

SEQ ID NO: 1021486 - RNA, 19 nt, Human
augggcagugucccauuug

SEQ ID NO: 1021487 - RNA, 18 nt, Human
cacaacagugccaagagg

SEQ ID NO: 1021488 - RNA, 24 nt, Human
cacuucgcucucacaacagugcca

SEQ ID NO: 1021489 - RNA, 20 nt, Human
caggaaaugcccaaggcccc

SEQ ID NO: 1021490 - RNA, 21 nt, Human
ccaaaaaaacuguagcuggcg

SEQ ID NO: 1021491 - RNA, 24 nt, Human
ccaauggccaacagaguccccuuu

SEQ ID NO: 1021492 - RNA, 24 nt, Human
ccaauggccaacagaguccccuuu

SEQ ID NO: 1021493 - RNA, 24 nt, Human
ccccgagcccgcgccuucgcggac

SEQ ID NO: 1021494 - RNA, 21 nt, Human
ccccgccgucgccgcgaccca

SEQ ID NO: 1021495 - RNA, 18 nt, Human
ccgcgacccacacuugcc

SEQ ID NO: 1021496 - RNA, 22 nt, Human
ccgggaacgacacugccccaaa

SEQ ID NO: 1021497 - RNA, 22 nt, Human
ccuccgggaacgacacugcccc

SEQ ID NO: 1021498 - RNA, 23 nt, Human
cgcggacccagggccuuagcccc

SEQ ID NO: 1021499 - RNA, 23 nt, Human
cggccgaccuccgggaacgacac

SEQ ID NO: 1021500 - RNA, 26 nt, Human
cuugccggaguccucagcagggccuc

SEQ ID NO: 1021501 - RNA, 21 nt, Human
gacgcgccgcguagcugguga

SEQ ID NO: 1021502 - RNA, 25 nt, Human
gccccgagcccgcgccuucgcggac

SEQ ID NO: 1021503 - RNA, 20 nt, Human
gccggaguccucagcagggc

SEQ ID NO: 1021504 - RNA, 24 nt, Human
gcggccgaccuccgggaacgacac

SEQ ID NO: 1021505 - RNA, 20 nt, Human
gguaacggcggccgaccucc

SEQ ID NO: 1021506 - RNA, 23 nt, Human
ucaccgucccgcaggcgccccga

SEQ ID NO: 1021507 - RNA, 18 nt, Human
uccaauggccaacagagu

SEQ ID NO: 1021508 - RNA, 18 nt, Human
uccaauggccaacagagu

SEQ ID NO: 1021509 - RNA, 23 nt, Human
uccgggaacgacacugccccaaa

SEQ ID NO: 1021510 - RNA, 22 nt, Human
ugccccaaaccguuccuuagcu

SEQ ID NO: 1021511 - RNA, 21 nt, Human
ugccggaguccucagcagggc

SEQ ID NO: 1021512 - RNA, 23 nt, Human
uggccaacagaguccccuuucca

SEQ ID NO: 1021513 - RNA, 23 nt, Human
uggccaacagaguccccuuucca

SEQ ID NO: 1021514 - RNA, 21 nt, Human
uguccggaguccucagcaggg

SEQ ID NO: 1021515 - RNA, 21 nt, Human
uucaugacgacauaacccaaa

SEQ ID NO: 1021516 - RNA, 20 nt, Human
uuuacacggcucaacaggaa

SEQ ID NO: 1021517 - RNA, 22 nt, Human
aaaaagccagagccccaccccc

SEQ ID NO: 1021518 - RNA, 19 nt, Human
aaaagaugaggacccucaa

SEQ ID NO: 1021519 - RNA, 22 nt, Human
aaagugcaacacaccucaugaa

SEQ ID NO: 1021520 - RNA, 24 nt, Human
aaaguuacccaaacauccauaaca

SEQ ID NO: 1021521 - RNA, 18 nt, Human
aacacaccucaugaaagc

SEQ ID NO: 1021522 - RNA, 22 nt, Human
aacugcccagggagacacagga

SEQ ID NO: 1021523 - RNA, 21 nt, Human
aagcacaggagauuuucgcac

SEQ ID NO: 1021524 - RNA, 18 nt, Human
aagcaguuccaaauuugg

SEQ ID NO: 1021525 - RNA, 23 nt, Human
aauccacucuacacaguaacaaa

SEQ ID NO: 1021526 - RNA, 24 nt, Human
aaucuccuuuuguuugccacaguc

SEQ ID NO: 1021527 - RNA, 20 nt, Human
acacaugcugaaacagcaca

SEQ ID NO: 1021528 - RNA, 22 nt, Human
acagaagacagcaaucccucaa

SEQ ID NO: 1021529 - RNA, 22 nt, Human
acauccaccucagucacucgga

SEQ ID NO: 1021530 - RNA, 19 nt, Human
accaacuaugcccuccuca

SEQ ID NO: 1021531 - RNA, 18 nt, Human
accccacgccuccaccgc

SEQ ID NO: 1021532 - RNA, 21 nt, Human
accgagacuuguggauguccc

SEQ ID NO: 1021533 - RNA, 21 nt, Human
acgagagccgcguagaaagcc

SEQ ID NO: 1021534 - RNA, 20 nt, Human
acuaaggcggcugcuucugg

SEQ ID NO: 1021535 - RNA, 24 nt, Human
acuccaagucucaaucuacccggu

SEQ ID NO: 1021536 - RNA, 18 nt, Human
acugcaccgagacuugug

SEQ ID NO: 1021537 - RNA, 22 nt, Human
acugcccagggagacacaggaa

SEQ ID NO: 1021538 - RNA, 19 nt, Human
acugggcucacaggaaauc

SEQ ID NO: 1021539 - RNA, 18 nt, Human
agaaagcacagaagucug

SEQ ID NO: 1021540 - RNA, 23 nt, Human
agcaauacaaaugagcaaacaau

SEQ ID NO: 1021541 - RNA, 18 nt, Human
agccagagccccaccccc

SEQ ID NO: 1021542 - RNA, 21 nt, Human
agguuuauuuguaauagccaa

SEQ ID NO: 1021543 - RNA, 18 nt, Human
auaaagguggugcccaca

SEQ ID NO: 1021544 - RNA, 26 nt, Human
augcaacaagauaauggauuaaccuu

SEQ ID NO: 1021545 - RNA, 19 nt, Human
augcacucccaucccacac

SEQ ID NO: 1021546 - RNA, 24 nt, Human
augucugaagguccugagaauuuc

SEQ ID NO: 1021547 - RNA, 21 nt, Human
auuuguaauagccaaaaacug

SEQ ID NO: 1021548 - RNA, 22 nt, Human
caaaauccccaagaguaaagac

SEQ ID NO: 1021549 - RNA, 18 nt, Human
caaaggguacucacagag

SEQ ID NO: 1021550 - RNA, 18 nt, Human
caagaguaaagacugcca

SEQ ID NO: 1021551 - RNA, 20 nt, Human
caauaguguaaauuagguca

SEQ ID NO: 1021552 - RNA, 23 nt, Human
caaugguagggggugaagugggg

SEQ ID NO: 1021553 - RNA, 25 nt, Human
caauuaaguugacaaagaagaaaaa

SEQ ID NO: 1021554 - RNA, 23 nt, Human
cacauccaccucagucacucgga

SEQ ID NO: 1021555 - RNA, 23 nt, Human
cacucggaaugcuggcuggguca

SEQ ID NO: 1021556 - RNA, 19 nt, Human
cacugcugagguuccuguc

SEQ ID NO: 1021557 - RNA, 18 nt, Human
cacuguauaaaucagagc

SEQ ID NO: 1021558 - RNA, 32 nt, Human
cacugucuuucuuugcuagguuccacgagaag

SEQ ID NO: 1021559 - RNA, 18 nt, Human
cagaagacagcaaucccu

SEQ ID NO: 1021560 - RNA, 21 nt, Human
cagagccccacccccuaaaaa

SEQ ID NO: 1021561 - RNA, 19 nt, Human
cagguacagaagacagcaa

SEQ ID NO: 1021562 - RNA, 23 nt, Human
cauaacaauuaaguugacaaaga

SEQ ID NO: 1021563 - RNA, 25 nt, Human
cauaacaauuaaguugacaaagaag

SEQ ID NO: 1021564 - RNA, 19 nt, Human
cauccccacuccauuaucu

SEQ ID NO: 1021565 - RNA, 19 nt, Human
caugaaagccucccacaua

SEQ ID NO: 1021566 - RNA, 21 nt, Human
ccacauccaccucagucacuc

SEQ ID NO: 1021567 - RNA, 24 nt, Human
ccacgccuccaccgcgcuggacgc

SEQ ID NO: 1021568 - RNA, 21 nt, Human
ccaggccacaaaguuaggcac

SEQ ID NO: 1021569 - RNA, 24 nt, Human
ccauauuccucucccuacaauuua

SEQ ID NO: 1021570 - RNA, 18 nt, Human
cccaagaguaaagacugc

SEQ ID NO: 1021571 - RNA, 19 nt, Human
cccacaccaucauaacugc

SEQ ID NO: 1021572 - RNA, 20 nt, Human
cccacccccuaaaaaguaca

SEQ ID NO: 1021573 - RNA, 25 nt, Human
ccgaaaccccacgccuccaccgcgc

SEQ ID NO: 1021574 - RNA, 19 nt, Human
ccugcagucuucacugucu

SEQ ID NO: 1021575 - RNA, 23 nt, Human
cgagagccgcguagaaagccgac

SEQ ID NO: 1021576 - RNA, 23 nt, Human
cgcaccaacuaugcccuccucac

SEQ ID NO: 1021577 - RNA, 19 nt, Human
cuagaucauguuugcucag

SEQ ID NO: 1021578 - RNA, 26 nt, Human
cucacugggcucacaggaaauccugg

SEQ ID NO: 1021579 - RNA, 27 nt, Human
cucuacacaguaacaaaauccccaaga

SEQ ID NO: 1021580 - RNA, 20 nt, Human
cugggcucacaggaaauccu

SEQ ID NO: 1021581 - RNA, 20 nt, Human
cugugcaggucaacugccca

SEQ ID NO: 1021582 - RNA, 21 nt, Human
cugugggcucagccgaaaccc

SEQ ID NO: 1021583 - RNA, 22 nt, Human
cuuacagucaauguuacuugcc

SEQ ID NO: 1021584 - RNA, 19 nt, Human
cuuaucaggaaucucccca

SEQ ID NO: 1021585 - RNA, 20 nt, Human
cuuccgccacaggcacuggc

SEQ ID NO: 1021586 - RNA, 26 nt, Human
gaaagccucccacauauguggugcuu

SEQ ID NO: 1021587 - RNA, 19 nt, Human
gacuuguggauguccccuc

SEQ ID NO: 1021588 - RNA, 21 nt, Human
gagcaaacaauugauucaugc

SEQ ID NO: 1021589 - RNA, 24 nt, Human
gcaauaguguaaauuaggucaaac

SEQ ID NO: 1021590 - RNA, 20 nt, Human
gccaaaaacugaaaguuacc

SEQ ID NO: 1021591 - RNA, 22 nt, Human
gccaggccacaaaguuaggcac

SEQ ID NO: 1021592 - RNA, 20 nt, Human
gccgaaaccccacgccucca

SEQ ID NO: 1021593 - RNA, 21 nt, Human
gcuuaucaggaaucuccccag

SEQ ID NO: 1021594 - RNA, 21 nt, Human
ggcucacaggaaauccuggca

SEQ ID NO: 1021595 - RNA, 22 nt, Human
gggcucacaggaaauccuggca

SEQ ID NO: 1021596 - RNA, 20 nt, Human
gggugaaguggggggggggg

SEQ ID NO: 1021597 - RNA, 20 nt, Human
guccuuuuggugagagcuag

SEQ ID NO: 1021598 - RNA, 18 nt, Human
gugucaggaaaucccagc

SEQ ID NO: 1021599 - RNA, 21 nt, Human
uaaaaacgcucacaagacuaa

SEQ ID NO: 1021600 - RNA, 19 nt, Human
uaaagacugccacaauagg

SEQ ID NO: 1021601 - RNA, 25 nt, Human
uaagacaaguaagucacagcuauca

SEQ ID NO: 1021602 - RNA, 22 nt, Human
uaagcaaugauguccacaucca

SEQ ID NO: 1021603 - RNA, 23 nt, Human
uaaguugacaaagaagaaaaauu

SEQ ID NO: 1021604 - RNA, 21 nt, Human
uacaaagugcaacacaccuca

SEQ ID NO: 1021605 - RNA, 20 nt, Human
uagaaaaugcuugcuguugc

SEQ ID NO: 1021606 - RNA, 24 nt, Human
uagccaaaaacugaaaguuaccca

SEQ ID NO: 1021607 - RNA, 20 nt, Human
uaucaggaaucuccccaggg

SEQ ID NO: 1021608 - RNA, 24 nt, Human
ucaauccacucuacacaguaacaa

SEQ ID NO: 1021609 - RNA, 21 nt, Human
ucacugcugagguuccugucc

SEQ ID NO: 1021610 - RNA, 18 nt, Human
ucacugggcucacaggaa

SEQ ID NO: 1021611 - RNA, 28 nt, Human
uccacucuacacaguaacaaaaucccca

SEQ ID NO: 1021612 - RNA, 20 nt, Human
ucccugagcaaaauggagug

SEQ ID NO: 1021613 - RNA, 19 nt, Human
ucucuucugucacugcuga

SEQ ID NO: 1021614 - RNA, 24 nt, Human
ucugccauccuuugguccccucug

SEQ ID NO: 1021615 - RNA, 23 nt, Human
ucuggauaucagggacuugaucc

SEQ ID NO: 1021616 - RNA, 23 nt, Human
ugaaacagcacauuuuacacuuu

SEQ ID NO: 1021617 - RNA, 20 nt, Human
ugacaaagaagaaaaauugu

SEQ ID NO: 1021618 - RNA, 19 nt, Human
ugacaguggccuuggccac

SEQ ID NO: 1021619 - RNA, 19 nt, Human
ugcaacaagauaauggauu

SEQ ID NO: 1021620 - RNA, 19 nt, Human
ugcccugugggcucagccg

SEQ ID NO: 1021621 - RNA, 22 nt, Human
ugcucagaaccuaaucaugagg

SEQ ID NO: 1021622 - RNA, 23 nt, Human
ugcuguugcuugugaauugugga

SEQ ID NO: 1021623 - RNA, 21 nt, Human
uggccacaggagauacagaug

SEQ ID NO: 1021624 - RNA, 20 nt, Human
uggugugaguccuaugagga

SEQ ID NO: 1021625 - RNA, 18 nt, Human
ugucugaagguccugaga

SEQ ID NO: 1021626 - RNA, 20 nt, Human
uguggauguccccucuagaa

SEQ ID NO: 1021627 - RNA, 24 nt, Human
uguggauguccccucuagaauguu

SEQ ID NO: 1021628 - RNA, 22 nt, Human
uuacccaaacauccauaacaau

SEQ ID NO: 1021629 - RNA, 18 nt, Human
uucacugucuuucuuugc

SEQ ID NO: 1021630 - RNA, 22 nt, Human
uucacugucuuucuuugcuagg

SEQ ID NO: 1021631 - RNA, 21 nt, Human
uucaugcaacaagauaaugga

SEQ ID NO: 1021632 - RNA, 19 nt, Human
uuccaaauuugggcgauuu

SEQ ID NO: 1021633 - RNA, 19 nt, Human
uugguccccucugaggcac

SEQ ID NO: 1021634 - RNA, 23 nt, Human
uuucauagguguacacacaugcu

SEQ ID NO: 1021635 - RNA, 26 nt, Human
acaaccauccacccaguagacaucaa

SEQ ID NO: 1021636 - RNA, 26 nt, Human
acaguggaaggccgacgccccaaggg

SEQ ID NO: 1021637 - RNA, 23 nt, Human
accauccacccaguagacaucac

SEQ ID NO: 1021638 - RNA, 22 nt, Human
agccgcgggaugagauuuaacc

SEQ ID NO: 1021639 - RNA, 21 nt, Human
aggcacagagggggauauaag

SEQ ID NO: 1021640 - RNA, 23 nt, Human
caaaaagaauggucagagaagca

SEQ ID NO: 1021641 - RNA, 18 nt, Human
caaguagccagucuaaac

SEQ ID NO: 1021642 - RNA, 22 nt, Human
cagaaaaggcacagagggggau

SEQ ID NO: 1021643 - RNA, 25 nt, Human
cagagaagcagcccccaaaucacaa

SEQ ID NO: 1021644 - RNA, 20 nt, Human
cagcgcuauuucugcagaag

SEQ ID NO: 1021645 - RNA, 20 nt, Human
caguagacaucaccaagugc

SEQ ID NO: 1021646 - RNA, 24 nt, Human
cauucaauaaacauuuauuagcac

SEQ ID NO: 1021647 - RNA, 21 nt, Human
ccccaaaucacaaccauccac

SEQ ID NO: 1021648 - RNA, 24 nt, Human
ccccaaaucacaaccauccaccca

SEQ ID NO: 1021649 - RNA, 18 nt, Human
cccccaaaucacaaccau

SEQ ID NO: 1021650 - RNA, 22 nt, Human
cccccaaaucacaaccauccac

SEQ ID NO: 1021651 - RNA, 23 nt, Human
cccccaaaucacaaccauccacc

SEQ ID NO: 1021652 - RNA, 24 nt, Human
cccccaaaucacaaccauccaccc

SEQ ID NO: 1021653 - RNA, 24 nt, Human
ccuaggccaaggcaguacucaggc

SEQ ID NO: 1021654 - RNA, 18 nt, Human
cugauaauguguaguggu

SEQ ID NO: 1021655 - RNA, 23 nt, Human
gcccccaaaucacaaccauccac

SEQ ID NO: 1021656 - RNA, 24 nt, Human
uaaagcccagcccacaauuucuau

SEQ ID NO: 1021657 - RNA, 18 nt, Human
uacccggggacaaaagaa

SEQ ID NO: 1021658 - RNA, 23 nt, Human
uagacaucaccaagugcugguuu

SEQ ID NO: 1021659 - RNA, 20 nt, Human
uaggccaaggcaguacucag

SEQ ID NO: 1021660 - RNA, 24 nt, Human
ucaaaaagaauggucagagaagca

SEQ ID NO: 1021661 - RNA, 25 nt, Human
ucaauaaacauuuauuagcaccugc

SEQ ID NO: 1021662 - RNA, 18 nt, Human
uccacccaguagacauca

SEQ ID NO: 1021663 - RNA, 20 nt, Human
ucccucuacccggggacaaa

SEQ ID NO: 1021664 - RNA, 24 nt, Human
ucuuaccucuucuagacaacucuc

SEQ ID NO: 1021665 - RNA, 21 nt, Human
ugacaaaugagcaccaacucu

SEQ ID NO: 1021666 - RNA, 19 nt, Human
ugggagagaacaaacaguu

SEQ ID NO: 1021667 - RNA, 20 nt, Human
ugguaaauaaagcccagccc

SEQ ID NO: 1021668 - RNA, 26 nt, Human
uguagugguaaauaaagcccagccca

SEQ ID NO: 1021669 - RNA, 18 nt, Human
aaagugcauggagauucu

SEQ ID NO: 1021670 - RNA, 22 nt, Human
aacaggaaauguggucuacaaa

SEQ ID NO: 1021671 - RNA, 18 nt, Human
aaguucuuagcacagagc

SEQ ID NO: 1021672 - RNA, 24 nt, Human
acagugagaguuuggaaucacugc

SEQ ID NO: 1021673 - RNA, 18 nt, Human
accccaaaacucuggucc

SEQ ID NO: 1021674 - RNA, 22 nt, Human
agauauauacauugaguccucc

SEQ ID NO: 1021675 - RNA, 18 nt, Human
aggaaauggggagaaagu

SEQ ID NO: 1021676 - RNA, 20 nt, Human
aggccacagccuccucacca

SEQ ID NO: 1021677 - RNA, 19 nt, Human
auugaugauuuuguaauga

SEQ ID NO: 1021678 - RNA, 25 nt, Human
caaagagcaacagcucaauaaacac

SEQ ID NO: 1021679 - RNA, 25 nt, Human
caagacagacagaucuguugaaucc

SEQ ID NO: 1021680 - RNA, 22 nt, Human
caccaagcuuaaaaauuggaaa

SEQ ID NO: 1021681 - RNA, 25 nt, Human
caccgagacacccacuucacaacag

SEQ ID NO: 1021682 - RNA, 18 nt, Human
cacuucacaacagggcgg

SEQ ID NO: 1021683 - RNA, 21 nt, Human
cagaagaaaaacaaauuacac

SEQ ID NO: 1021684 - RNA, 20 nt, Human
cagcauguuugccagggccc

SEQ ID NO: 1021685 - RNA, 24 nt, Human
ccaagcuuaaaaauuggaaaguuu

SEQ ID NO: 1021686 - RNA, 24 nt, Human
ccacugauuuaacucuaaucucgu

SEQ ID NO: 1021687 - RNA, 18 nt, Human
ccacugguauuguuccuc

SEQ ID NO: 1021688 - RNA, 21 nt, Human
ccauagccauugucuaaccca

SEQ ID NO: 1021689 - RNA, 26 nt, Human
ccauagccauugucuaacccagaagg

SEQ ID NO: 1021690 - RNA, 22 nt, Human
ccccaaggcuccaccgagacac

SEQ ID NO: 1021691 - RNA, 23 nt, Human
cccccuucuucugggacuguccc

SEQ ID NO: 1021692 - RNA, 26 nt, Human
ccucccuaggcaagauagucaggaac

SEQ ID NO: 1021693 - RNA, 24 nt, Human
ccucuaggaaauggggagaaaguu

SEQ ID NO: 1021694 - RNA, 19 nt, Human
ccugcaguccuggucucuc

SEQ ID NO: 1021695 - RNA, 19 nt, Human
ccugcucuaggccaacucc

SEQ ID NO: 1021696 - RNA, 18 nt, Human
ccugggacucagcuguca

SEQ ID NO: 1021697 - RNA, 27 nt, Human
cggggagugaggacagcacucucuuuc

SEQ ID NO: 1021698 - RNA, 22 nt, Human
cggugaguccuucaagaggcuc

SEQ ID NO: 1021699 - RNA, 19 nt, Human
cuaugcugaccucauccaa

SEQ ID NO: 1021700 - RNA, 21 nt, Human
cuauugaugauuuuguaauga

SEQ ID NO: 1021701 - RNA, 23 nt, Human
cucccaggcacacgcuguuccca

SEQ ID NO: 1021702 - RNA, 23 nt, Human
cucuaggccaacuccucucucac

SEQ ID NO: 1021703 - RNA, 23 nt, Human
cucugugcugagcucacaguggc

SEQ ID NO: 1021704 - RNA, 24 nt, Human
cuucaagaggcuccuagaaaaggg

SEQ ID NO: 1021705 - RNA, 19 nt, Human
cuucagcuaugcugaccuc

SEQ ID NO: 1021706 - RNA, 20 nt, Human
gacuuagaccccaaaacucu

SEQ ID NO: 1021707 - RNA, 19 nt, Human
gagaaaguaggagaaccac

SEQ ID NO: 1021708 - RNA, 23 nt, Human
gagcucacaguggccugcucuag

SEQ ID NO: 1021709 - RNA, 21 nt, Human
gccguugugaagauuaaauga

SEQ ID NO: 1021710 - RNA, 18 nt, Human
gcuguggugccaccucgg

SEQ ID NO: 1021711 - RNA, 18 nt, Human
gcuuaccugggacucagc

SEQ ID NO: 1021712 - RNA, 20 nt, Human
gcuugcaauuccagggccau

SEQ ID NO: 1021713 - RNA, 24 nt, Human
ggagaguagggacucggggaguga

SEQ ID NO: 1021714 - RNA, 24 nt, Human
ggucuuuacagagcuccuucucag

SEQ ID NO: 1021715 - RNA, 20 nt, Human
gugcugagcucacaguggcc

SEQ ID NO: 1021716 - RNA, 18 nt, Human
uaaaaauuggaaaguuua

SEQ ID NO: 1021717 - RNA, 24 nt, Human
uaagagcacgauagacucaagaca

SEQ ID NO: 1021718 - RNA, 19 nt, Human
uagacucaagacagacaga

SEQ ID NO: 1021719 - RNA, 23 nt, Human
uauaagacuuagaccccaaaacu

SEQ ID NO: 1021720 - RNA, 23 nt, Human
uauacaaaguucuuagcacagag

SEQ ID NO: 1021721 - RNA, 20 nt, Human
uaugcaauuccagucccgac

SEQ ID NO: 1021722 - RNA, 18 nt, Human
uauuuguuuaaaaaauuc

SEQ ID NO: 1021723 - RNA, 26 nt, Human
ucaccucccaaucuccaacgcucccc

SEQ ID NO: 1021724 - RNA, 20 nt, Human
ucacuguucuuccuacucug

SEQ ID NO: 1021725 - RNA, 20 nt, Human
ucaggccagggauccacugg

SEQ ID NO: 1021726 - RNA, 19 nt, Human
ucagggcauguauucuuca

SEQ ID NO: 1021727 - RNA, 21 nt, Human
uccaccgagacacccacuuca

SEQ ID NO: 1021728 - RNA, 23 nt, Human
uccauauuuguuuaaaaaauuca

SEQ ID NO: 1021729 - RNA, 21 nt, Human
ucccaagccucuaggaaaugg

SEQ ID NO: 1021730 - RNA, 19 nt, Human
ucccuaggcaagauaguca

SEQ ID NO: 1021731 - RNA, 21 nt, Human
ucccucaggccagggauccac

SEQ ID NO: 1021732 - RNA, 20 nt, Human
ucccucaggccagggauccc

SEQ ID NO: 1021733 - RNA, 19 nt, Human
uccuggggccguugugaag

SEQ ID NO: 1021734 - RNA, 24 nt, Human
uccuucucagcauguuugccaggg

SEQ ID NO: 1021735 - RNA, 23 nt, Human
ucuccuggggccguugugaagau

SEQ ID NO: 1021736 - RNA, 24 nt, Human
ucuccuggggggucuuuacagagc

SEQ ID NO: 1021737 - RNA, 22 nt, Human
ucucggagguauuacuugguuu

SEQ ID NO: 1021738 - RNA, 23 nt, Human
ucugagcuucuuccccugucuuu

SEQ ID NO: 1021739 - RNA, 20 nt, Human
ugagaaaguaggagaaccac

SEQ ID NO: 1021740 - RNA, 21 nt, Human
ugccugggcuugcaauuccag

SEQ ID NO: 1021741 - RNA, 24 nt, Human
ugccuucaaaucuggauccuuagu

SEQ ID NO: 1021742 - RNA, 22 nt, Human
ugcucaggaccacugauuuaac

SEQ ID NO: 1021743 - RNA, 22 nt, Human
ugcuccagcacgagcagcucca

SEQ ID NO: 1021744 - RNA, 18 nt, Human
uggaacucccaggcacac

SEQ ID NO: 1021745 - RNA, 23 nt, Human
uggauccuuaguauuuguaauuc

SEQ ID NO: 1021746 - RNA, 21 nt, Human
uggccugcucuaggccaacuc

SEQ ID NO: 1021747 - RNA, 18 nt, Human
uggcucaaauacugacac

SEQ ID NO: 1021748 - RNA, 20 nt, Human
uggcucaaauacugacacag

SEQ ID NO: 1021749 - RNA, 20 nt, Human
ugggagaguagggacucggg

SEQ ID NO: 1021750 - RNA, 20 nt, Human
uggggagaaaguuaguacuu

SEQ ID NO: 1021751 - RNA, 24 nt, Human
uggucucuucuguaugcaauucca

SEQ ID NO: 1021752 - RNA, 18 nt, Human
uuagaccccaaaacucug

SEQ ID NO: 1021753 - RNA, 21 nt, Human
uucaaaggcuguggugccacc

SEQ ID NO: 1021754 - RNA, 20 nt, Human
uugggaaggucagggcaugu

SEQ ID NO: 1021755 - RNA, 20 nt, Human
uuugccagggcccagggcuu

SEQ ID NO: 1021756 - RNA, 20 nt, Human
uuuguaaugaugucacuguc

SEQ ID NO: 1021757 - RNA, 22 nt, Human
uuuguaauucacuuccaaauua

SEQ ID NO: 1021758 - RNA, 19 nt, Human
aaaaaaccaaccuaaaccc

SEQ ID NO: 1021759 - RNA, 23 nt, Human
aaaaaaccaaccuaaacccauau

SEQ ID NO: 1021760 - RNA, 24 nt, Human
aaaagccagaacauaacaguggga

SEQ ID NO: 1021761 - RNA, 23 nt, Human
aaccaaaaagcucuggcccuccc

SEQ ID NO: 1021762 - RNA, 27 nt, Human
aacccagaaacacuuccaccaaaaaaa

SEQ ID NO: 1021763 - RNA, 21 nt, Human
aacuaguauccgcugaguccc

SEQ ID NO: 1021764 - RNA, 22 nt, Human
aacuccaagguucuugagcugu

SEQ ID NO: 1021765 - RNA, 24 nt, Human
aagcagaagguaaaagaagggacc

SEQ ID NO: 1021766 - RNA, 22 nt, Human
aagucugcacaccuuggggaca

SEQ ID NO: 1021767 - RNA, 19 nt, Human
aaguuuccagcaacagcuu

SEQ ID NO: 1021768 - RNA, 19 nt, Human
aauuuguaaaucagaacca

SEQ ID NO: 1021769 - RNA, 21 nt, Human
accccaagaggacuggugaca

SEQ ID NO: 1021770 - RNA, 25 nt, Human
accccacagcccagcgggagcuuca

SEQ ID NO: 1021771 - RNA, 19 nt, Human
accgugugacaaacaaggu

SEQ ID NO: 1021772 - RNA, 18 nt, Human
acuucccuaacccagaaa

SEQ ID NO: 1021773 - RNA, 22 nt, Human
agacagcuuuggcaagagccca

SEQ ID NO: 1021774 - RNA, 22 nt, Human
agcaacagcuuuuauuaacaac

SEQ ID NO: 1021775 - RNA, 19 nt, Human
agcagguuuucaaacacau

SEQ ID NO: 1021776 - RNA, 22 nt, Human
aggaaguagccgagaaccaaua

SEQ ID NO: 1021777 - RNA, 27 nt, Human
aggcauuuaagacugaaccagugaacu

SEQ ID NO: 1021778 - RNA, 18 nt, Human
aggcggcagaagcuccag

SEQ ID NO: 1021779 - RNA, 21 nt, Human
caaaaaaccaaccuaaaccca

SEQ ID NO: 1021780 - RNA, 22 nt, Human
caaaaaaccaaccuaaacccau

SEQ ID NO: 1021781 - RNA, 21 nt, Human
caaaaagcucuggcccuccca

SEQ ID NO: 1021782 - RNA, 19 nt, Human
caaggaaaggagacacuug

SEQ ID NO: 1021783 - RNA, 20 nt, Human
caaggaaaggagacacuugc

SEQ ID NO: 1021784 - RNA, 21 nt, Human
caccggcaggcgcggagcccc

SEQ ID NO: 1021785 - RNA, 23 nt, Human
cagcagcaguguacaagcgcgag

SEQ ID NO: 1021786 - RNA, 21 nt, Human
cagcgggagcuucagcucugg

SEQ ID NO: 1021787 - RNA, 23 nt, Human
cagcgggagcuucagcucugguc

SEQ ID NO: 1021788 - RNA, 22 nt, Human
caggcucccaaauggagaggua

SEQ ID NO: 1021789 - RNA, 22 nt, Human
cauaaggaaaacauuugugaca

SEQ ID NO: 1021790 - RNA, 23 nt, Human
caucaaaaaaccaaccuaaaccc

SEQ ID NO: 1021791 - RNA, 25 nt, Human
caucaaaaaaccaaccuaaacccuc

SEQ ID NO: 1021792 - RNA, 21 nt, Human
caucugaggauuuuuugugcu

SEQ ID NO: 1021793 - RNA, 21 nt, Human
ccagaaacacuuccaccaaaa

SEQ ID NO: 1021794 - RNA, 21 nt, Human
ccagcuucuggcaaccccaca

SEQ ID NO: 1021795 - RNA, 22 nt, Human
ccccaaaccucuuucuucuaau

SEQ ID NO: 1021796 - RNA, 23 nt, Human
ccccaaaccucuuucuucuaauu

SEQ ID NO: 1021797 - RNA, 23 nt, Human
ccccgggauggcaaccccagcuu

SEQ ID NO: 1021798 - RNA, 18 nt, Human
cccgagagacaaacacug

SEQ ID NO: 1021799 - RNA, 26 nt, Human
ccuaaagcaaguuuccagcaacagcc

SEQ ID NO: 1021800 - RNA, 22 nt, Human
ccuaacccagaaacacuuccac

SEQ ID NO: 1021801 - RNA, 21 nt, Human
cgcggagccccacagcagcag

SEQ ID NO: 1021802 - RNA, 24 nt, Human
cuacaaagcagguuuucaaacaca

SEQ ID NO: 1021803 - RNA, 21 nt, Human
cucacaucagucccucaaacg

SEQ ID NO: 1021804 - RNA, 24 nt, Human
cuccaagguucuugagcuguuccu

SEQ ID NO: 1021805 - RNA, 20 nt, Human
cugacccuccuccccacuua

SEQ ID NO: 1021806 - RNA, 21 nt, Human
cuuagcugacccuccucccca

SEQ ID NO: 1021807 - RNA, 23 nt, Human
gaacuccaagguucuugagcugu

SEQ ID NO: 1021808 - RNA, 24 nt, Human
gcucuggcccucccacuucucuua

SEQ ID NO: 1021809 - RNA, 23 nt, Human
ggauaaacagacuuuaacuuccc

SEQ ID NO: 1021810 - RNA, 21 nt, Human
ggcgcggagccccacagcagc

SEQ ID NO: 1021811 - RNA, 18 nt, Human
gugaacuucuuccagaaa

SEQ ID NO: 1021812 - RNA, 21 nt, Human
uaaaaaggcaccaugcaggca

SEQ ID NO: 1021813 - RNA, 23 nt, Human
uaacuucccuaacccagaaacac

SEQ ID NO: 1021814 - RNA, 20 nt, Human
uauccuaaaaaggcaccaug

SEQ ID NO: 1021815 - RNA, 22 nt, Human
ucccaaugccauggcucauuuu

SEQ ID NO: 1021816 - RNA, 19 nt, Human
ucucacuuucuggaaaguc

SEQ ID NO: 1021817 - RNA, 20 nt, Human
ucucacuuucuggaaaguca

SEQ ID NO: 1021818 - RNA, 19 nt, Human
ucugagugaacuucuucca

SEQ ID NO: 1021819 - RNA, 26 nt, Human
ucuguaacaugagacagauagcaagc

SEQ ID NO: 1021820 - RNA, 24 nt, Human
ugacauguaccccgggauggcaac

SEQ ID NO: 1021821 - RNA, 23 nt, Human
ugagugaacuucuuccagaaauu

SEQ ID NO: 1021822 - RNA, 21 nt, Human
ugccauggcucauuuucaggu

SEQ ID NO: 1021823 - RNA, 20 nt, Human
uggcaaccccagcuucuggc

SEQ ID NO: 1021824 - RNA, 21 nt, Human
ugggaggaaugagugugaaac

SEQ ID NO: 1021825 - RNA, 22 nt, Human
ugguacaaaaccccaagaggac

SEQ ID NO: 1021826 - RNA, 23 nt, Human
ugugaaacaagagguggagaagc

SEQ ID NO: 1021827 - RNA, 18 nt, Human
uucauugugcuauucaug

SEQ ID NO: 1021828 - RNA, 25 nt, Human
uucuaauucaucugaggauuuuuug

SEQ ID NO: 1021829 - RNA, 18 nt, Human
uucucggugccaccagug

SEQ ID NO: 1021830 - RNA, 23 nt, Human
uugugcuauucaugacccagaaa

SEQ ID NO: 1021831 - RNA, 22 nt, Human
uuucacguuuaauauguaaugg

SEQ ID NO: 1021832 - RNA, 20 nt, Human
uuucgccagauuucccucca

SEQ ID NO: 1021833 - RNA, 20 nt, Human
aaaaauaaagaugaaaaauu

SEQ ID NO: 1021834 - RNA, 20 nt, Human
aacuaccaaaaaugucucua

SEQ ID NO: 1021835 - RNA, 20 nt, Human
aagaacaaaacauacaggga

SEQ ID NO: 1021836 - RNA, 23 nt, Human
aagaacaaaacauacagggagga

SEQ ID NO: 1021837 - RNA, 22 nt, Human
aagaauucgccgcugaccccuc

SEQ ID NO: 1021838 - RNA, 24 nt, Human
aagcaaagaacaaaacauacaggg

SEQ ID NO: 1021839 - RNA, 21 nt, Human
acaggaacuggacuucuccca

SEQ ID NO: 1021840 - RNA, 23 nt, Human
accaauaaucaguuuuauuuuuu

SEQ ID NO: 1021841 - RNA, 23 nt, Human
accaguaacaaagugguacugag

SEQ ID NO: 1021842 - RNA, 22 nt, Human
acccugaaggcuucuccaugcu

SEQ ID NO: 1021843 - RNA, 21 nt, Human
accuuaaaaauaaagaugaaa

SEQ ID NO: 1021844 - RNA, 24 nt, Human
accuuaaaaauaaagaugaaaaau

SEQ ID NO: 1021845 - RNA, 19 nt, Human
agaauauucacaugcucaa

SEQ ID NO: 1021846 - RNA, 20 nt, Human
agacguacauuuucaccccc

SEQ ID NO: 1021847 - RNA, 23 nt, Human
agagaauggcagucaguuugccu

SEQ ID NO: 1021848 - RNA, 23 nt, Human
agcaggcugcaaacauauuacca

SEQ ID NO: 1021849 - RNA, 20 nt, Human
agcugcaagaaaaccuguaa

SEQ ID NO: 1021850 - RNA, 18 nt, Human
aggaucgggggagcggag

SEQ ID NO: 1021851 - RNA, 25 nt, Human
aggaucgggggagcggaggugacgg

SEQ ID NO: 1021852 - RNA, 19 nt, Human
aggugacggaagccgccgc

SEQ ID NO: 1021853 - RNA, 19 nt, Human
aguggccagggcugugaga

SEQ ID NO: 1021854 - RNA, 24 nt, Human
auaaagaugaaaaauuuaugaacg

SEQ ID NO: 1021855 - RNA, 24 nt, Human
aucaaacauucuucuuccuuaaag

SEQ ID NO: 1021856 - RNA, 18 nt, Human
caacaggccgaaagaauu

SEQ ID NO: 1021857 - RNA, 22 nt, Human
caauccgugugcaucagguacc

SEQ ID NO: 1021858 - RNA, 25 nt, Human
cagaaccuggauucucuugauauug

SEQ ID NO: 1021859 - RNA, 21 nt, Human
cagacacucaaagaggccaca

SEQ ID NO: 1021860 - RNA, 20 nt, Human
cagcaacagugacguuuggg

SEQ ID NO: 1021861 - RNA, 19 nt, Human
caggacaaccagaaagcua

SEQ ID NO: 1021862 - RNA, 24 nt, Human
caggccgaaagaauucgccgcuga

SEQ ID NO: 1021863 - RNA, 26 nt, Human
ccauacaaagacaagcagcuggccgu

SEQ ID NO: 1021864 - RNA, 21 nt, Human
cccaugugucucggggcaauc

SEQ ID NO: 1021865 - RNA, 18 nt, Human
cccgacugagaacccgug

SEQ ID NO: 1021866 - RNA, 19 nt, Human
cccgugcuguagaccaagg

SEQ ID NO: 1021867 - RNA, 21 nt, Human
ccuuaaaaauaaagaugaaaa

SEQ ID NO: 1021868 - RNA, 21 nt, Human
cgccgcugaccccuccuuggc

SEQ ID NO: 1021869 - RNA, 23 nt, Human
cgccgcugaccccuccuuggccc

SEQ ID NO: 1021870 - RNA, 22 nt, Human
cggucguuaagguggaucuucc

SEQ ID NO: 1021871 - RNA, 24 nt, Human
cguuggggcuucucucgggggguc

SEQ ID NO: 1021872 - RNA, 19 nt, Human
cuccaucaaacauucuucu

SEQ ID NO: 1021873 - RNA, 20 nt, Human
cucuugauauuggaagaaga

SEQ ID NO: 1021874 - RNA, 23 nt, Human
cugaaggcuucuccaugcuacag

SEQ ID NO: 1021875 - RNA, 22 nt, Human
cugaccccuccuuggcccaugu

SEQ ID NO: 1021876 - RNA, 25 nt, Human
cuuagcagcaucucugaugucuucu

SEQ ID NO: 1021877 - RNA, 25 nt, Human
cuuccccccauucuaacuaccaaaa

SEQ ID NO: 1021878 - RNA, 20 nt, Human
gaaccuggauucucuugaua

SEQ ID NO: 1021879 - RNA, 22 nt, Human
gacugcaugauuauuuucaacc

SEQ ID NO: 1021880 - RNA, 21 nt, Human
gagaauauucacaugcucaag

SEQ ID NO: 1021881 - RNA, 22 nt, Human
gagaauggcagucaguuugccu

SEQ ID NO: 1021882 - RNA, 23 nt, Human
gagguuguccagaaggaaauuag

SEQ ID NO: 1021883 - RNA, 23 nt, Human
gcagggcaccaggacaaccagaa

SEQ ID NO: 1021884 - RNA, 19 nt, Human
gcccauguggugacaucug

SEQ ID NO: 1021885 - RNA, 18 nt, Human
gccucgucuucccaguuu

SEQ ID NO: 1021886 - RNA, 19 nt, Human
ggaaaggggcagaugacag

SEQ ID NO: 1021887 - RNA, 21 nt, Human
ggaaaggggcagaugacagga

SEQ ID NO: 1021888 - RNA, 20 nt, Human
ggauucucuugauauuggaa

SEQ ID NO: 1021889 - RNA, 18 nt, Human
gggaauaggaucggggga

SEQ ID NO: 1021890 - RNA, 21 nt, Human
ggugacggaagccgccgccga

SEQ ID NO: 1021891 - RNA, 25 nt, Human
guagaccaagggucggccaaguuuu

SEQ ID NO: 1021892 - RNA, 20 nt, Human
uagaaguaucugucacucuu

SEQ ID NO: 1021893 - RNA, 24 nt, Human
uagaaguggucugaagucauuuug

SEQ ID NO: 1021894 - RNA, 18 nt, Human
uagcagcaucucugaugu

SEQ ID NO: 1021895 - RNA, 23 nt, Human
uagcagcaucucugaugucuucu

SEQ ID NO: 1021896 - RNA, 23 nt, Human
uagcguaagugcucacaagauuc

SEQ ID NO: 1021897 - RNA, 22 nt, Human
uaggaucgggggagcggaggug

SEQ ID NO: 1021898 - RNA, 18 nt, Human
uaugccauuggucaagga

SEQ ID NO: 1021899 - RNA, 22 nt, Human
ucacaagauucauaaaaaugga

SEQ ID NO: 1021900 - RNA, 26 nt, Human
ucagguaccaguaacaaagugguacu

SEQ ID NO: 1021901 - RNA, 22 nt, Human
ucaguggccagggcugugagac

SEQ ID NO: 1021902 - RNA, 26 nt, Human
uccaugcuacagacguacaggggacc

SEQ ID NO: 1021903 - RNA, 20 nt, Human
ucccaaguuccguggauucu

SEQ ID NO: 1021904 - RNA, 24 nt, Human
ucccaaguuccguggauucuuuug

SEQ ID NO: 1021905 - RNA, 22 nt, Human
ucgcccgacugagaacccgugc

SEQ ID NO: 1021906 - RNA, 22 nt, Human
ucgccgcugaccccuccuuggc

SEQ ID NO: 1021907 - RNA, 24 nt, Human
ucuccaugcuacagacguacauuu

SEQ ID NO: 1021908 - RNA, 24 nt, Human
ucucccaaguuccguggauucuuu

SEQ ID NO: 1021909 - RNA, 19 nt, Human
ucucggggcaaucgacucc

SEQ ID NO: 1021910 - RNA, 22 nt, Human
ugaaaaguaaagcaaagaacaa

SEQ ID NO: 1021911 - RNA, 18 nt, Human
ugacauuaaaugccacgg

SEQ ID NO: 1021912 - RNA, 19 nt, Human
ugagaacccgugcuguaga

SEQ ID NO: 1021913 - RNA, 22 nt, Human
ugaggaaucaagugagacuagg

SEQ ID NO: 1021914 - RNA, 19 nt, Human
ugauuucucucuuuagugu

SEQ ID NO: 1021915 - RNA, 19 nt, Human
ugcaagaaaaccuguaaga

SEQ ID NO: 1021916 - RNA, 22 nt, Human
ugcaaggugaaaaguaaagcaa

SEQ ID NO: 1021917 - RNA, 19 nt, Human
ugcaucagguaccaguaac

SEQ ID NO: 1021918 - RNA, 19 nt, Human
uggaaguccagggcugcug

SEQ ID NO: 1021919 - RNA, 21 nt, Human
uggcaagccauacaaagacaa

SEQ ID NO: 1021920 - RNA, 20 nt, Human
uggcuggaaucauuuccaca

SEQ ID NO: 1021921 - RNA, 23 nt, Human
uggggcuucucucggggggucug

SEQ ID NO: 1021922 - RNA, 22 nt, Human
ugucaguggccagggcugugag

SEQ ID NO: 1021923 - RNA, 23 nt, Human
uguggggggcuccugugugcugg

SEQ ID NO: 1021924 - RNA, 21 nt, Human
uuaaggguuauuuagaggagu

SEQ ID NO: 1021925 - RNA, 18 nt, Human
uuacaagucaggaguauc

SEQ ID NO: 1021926 - RNA, 24 nt, Human
uuagcagcaucucugaugucuucu

SEQ ID NO: 1021927 - RNA, 21 nt, Human
uucaugaccuuccacguuccu

SEQ ID NO: 1021928 - RNA, 21 nt, Human
uuggcccaugugucucggggc

SEQ ID NO: 1021929 - RNA, 19 nt, Human
uuguccagaaggaaauuag

SEQ ID NO: 1021930 - RNA, 20 nt, Human
uuuacaggaacuggacuucu

SEQ ID NO: 1021931 - RNA, 22 nt, Human
uuucuccaucaaacauucuucu

SEQ ID NO: 1021932 - RNA, 26 nt, Human
aaaaagaugcaccucugaauauccuu

SEQ ID NO: 1021933 - RNA, 21 nt, Human
aaaguuguucccucgaaggug

SEQ ID NO: 1021934 - RNA, 23 nt, Human
aacaaaaauggaaaacuuacagu

SEQ ID NO: 1021935 - RNA, 29 nt, Human
aacccccuacaaucacagucauccacacc

SEQ ID NO: 1021936 - RNA, 22 nt, Human
aaggcuuucccaaacucaucac

SEQ ID NO: 1021937 - RNA, 23 nt, Human
acagaaaaagaugcaccucugaa

SEQ ID NO: 1021938 - RNA, 26 nt, Human
acccccaaaagaagaauaaugcugac

SEQ ID NO: 1021939 - RNA, 22 nt, Human
accugguuuguagacaaguggu

SEQ ID NO: 1021940 - RNA, 25 nt, Human
agaucuucaacuacagccacagccu

SEQ ID NO: 1021941 - RNA, 18 nt, Human
agcaacccccuacaauca

SEQ ID NO: 1021942 - RNA, 22 nt, Human
aggcaaaaagauucauaucuga

SEQ ID NO: 1021943 - RNA, 22 nt, Human
agguauugguaucauccucugu

SEQ ID NO: 1021944 - RNA, 21 nt, Human
auaaauuuuauaagaacagaa

SEQ ID NO: 1021945 - RNA, 24 nt, Human
caaaagaagaauaaugcugacauu

SEQ ID NO: 1021946 - RNA, 24 nt, Human
caaaguugcugaccaacccccaaa

SEQ ID NO: 1021947 - RNA, 21 nt, Human
cacacaggagacaccaacacc

SEQ ID NO: 1021948 - RNA, 25 nt, Human
cacagucauccacacaggagacacc

SEQ ID NO: 1021949 - RNA, 18 nt, Human
caccauaggcugaagcug

SEQ ID NO: 1021950 - RNA, 18 nt, Human
cacccagcaacccccuac

SEQ ID NO: 1021951 - RNA, 23 nt, Human
cagagcauauguuuaacccuggc

SEQ ID NO: 1021952 - RNA, 21 nt, Human
cagaguucucggagccggcuc

SEQ ID NO: 1021953 - RNA, 22 nt, Human
cagaucuucaacuacagccaca

SEQ ID NO: 1021954 - RNA, 19 nt, Human
cagccuccuccccacucuc

SEQ ID NO: 1021955 - RNA, 20 nt, Human
ccaacuccugguucucaggu

SEQ ID NO: 1021956 - RNA, 23 nt, Human
ccacagccuccuccccacucucc

SEQ ID NO: 1021957 - RNA, 24 nt, Human
ccacagcucacaaauggggaggaa

SEQ ID NO: 1021958 - RNA, 21 nt, Human
ccacccagcaacccccuacaa

SEQ ID NO: 1021959 - RNA, 19 nt, Human
cccgcacccaggccuggag

SEQ ID NO: 1021960 - RNA, 19 nt, Human
ccuacaaucacagucaucc

SEQ ID NO: 1021961 - RNA, 21 nt, Human
ccucugaauauccuuugaucu

SEQ ID NO: 1021962 - RNA, 22 nt, Human
cuaaagucccacagcucacaaa

SEQ ID NO: 1021963 - RNA, 23 nt, Human
cuacagccacagccuccucccca

SEQ ID NO: 1021964 - RNA, 20 nt, Human
cucaaaaacagccccuccau

SEQ ID NO: 1021965 - RNA, 22 nt, Human
cucaaaaacagccccuccauaa

SEQ ID NO: 1021966 - RNA, 20 nt, Human
cucacuaagcucuuguucca

SEQ ID NO: 1021967 - RNA, 21 nt, Human
cucaggcaggauagucaggaa

SEQ ID NO: 1021968 - RNA, 21 nt, Human
cuccauaacaauuuauuucca

SEQ ID NO: 1021969 - RNA, 22 nt, Human
cugcagcaccccaaugaccgau

SEQ ID NO: 1021970 - RNA, 20 nt, Human
cuggagccugguucccuggc

SEQ ID NO: 1021971 - RNA, 19 nt, Human
cuguaugucuguugguucc

SEQ ID NO: 1021972 - RNA, 18 nt, Human
cuuccuccacuuucacaa

SEQ ID NO: 1021973 - RNA, 24 nt, Human
cuugcuuugaugccaacuccuggu

SEQ ID NO: 1021974 - RNA, 18 nt, Human
gaccauagcaaugauuuc

SEQ ID NO: 1021975 - RNA, 21 nt, Human
gcauauguuuaacccuggcaa

SEQ ID NO: 1021976 - RNA, 18 nt, Human
gccacagccuccucccca

SEQ ID NO: 1021977 - RNA, 19 nt, Human
gccccuccauaacaauuua

SEQ ID NO: 1021978 - RNA, 18 nt, Human
gcuagggaauaagaaggc

SEQ ID NO: 1021979 - RNA, 18 nt, Human
gcuguaugucuguugguu

SEQ ID NO: 1021980 - RNA, 22 nt, Human
ggaaaucauaagaaauggaccg

SEQ ID NO: 1021981 - RNA, 18 nt, Human
ggaaggcuuacucuggcu

SEQ ID NO: 1021982 - RNA, 19 nt, Human
gguggcggggcugcagcac

SEQ ID NO: 1021983 - RNA, 21 nt, Human
guaacaaaaauggaaaacuua

SEQ ID NO: 1021984 - RNA, 21 nt, Human
guaagcagcaagcugcccaag

SEQ ID NO: 1021985 - RNA, 22 nt, Human
uaaaacuacagguuucauacua

SEQ ID NO: 1021986 - RNA, 23 nt, Human
uaaaacuacuuaaaugaugcugc

SEQ ID NO: 1021987 - RNA, 23 nt, Human
uaaaaugccuaauaagguugcaa

SEQ ID NO: 1021988 - RNA, 24 nt, Human
uaacaaaaauggaaaacuuacagu

SEQ ID NO: 1021989 - RNA, 23 nt, Human
uacagaaaaagaugcaccucuga

SEQ ID NO: 1021990 - RNA, 21 nt, Human
uaccuugugaagaacagagau

SEQ ID NO: 1021991 - RNA, 24 nt, Human
uaugaaaugagacauagauuucua

SEQ ID NO: 1021992 - RNA, 18 nt, Human
ucaaaaacagccccucca

SEQ ID NO: 1021993 - RNA, 22 nt, Human
ucaaaaacagccccuccauaac

SEQ ID NO: 1021994 - RNA, 21 nt, Human
uccccaaaaccuuacauuugu

SEQ ID NO: 1021995 - RNA, 20 nt, Human
uccccaguaagcagcaagcu

SEQ ID NO: 1021996 - RNA, 23 nt, Human
uccucuguuuuacagguggggag

SEQ ID NO: 1021997 - RNA, 24 nt, Human
ucuaaaaugccuaauaagguugca

SEQ ID NO: 1021998 - RNA, 20 nt, Human
ucuaaaccauuaaaacuaca

SEQ ID NO: 1021999 - RNA, 24 nt, Human
ugacagaguucucggagccggcuc

SEQ ID NO: 1022000 - RNA, 28 nt, Human
ugaccaacccccaaaagaagaauaaugc

SEQ ID NO: 1022001 - RNA, 24 nt, Human
ugauaugaaucaucaacauaguua

SEQ ID NO: 1022002 - RNA, 19 nt, Human
uggaaggcuuacucuggcu

SEQ ID NO: 1022003 - RNA, 20 nt, Human
uggaaggcuuacucuggcuu

SEQ ID NO: 1022004 - RNA, 20 nt, Human
uggacgauucuuauucccca

SEQ ID NO: 1022005 - RNA, 27 nt, Human
uggcacucaaaguugcugaccaacccc

SEQ ID NO: 1022006 - RNA, 23 nt, Human
uggcggggcugcagcaccccaau

SEQ ID NO: 1022007 - RNA, 23 nt, Human
uggcucacuaagcucuuguucca

SEQ ID NO: 1022008 - RNA, 22 nt, Human
uggcuuuaaguaaagggauaac

SEQ ID NO: 1022009 - RNA, 20 nt, Human
uggggaggaaagauuugaac

SEQ ID NO: 1022010 - RNA, 20 nt, Human
ugguggaggcaaaaagauuc

SEQ ID NO: 1022011 - RNA, 20 nt, Human
uguaugucuguugguuccug

SEQ ID NO: 1022012 - RNA, 18 nt, Human
ugucaccauaggcugaag

SEQ ID NO: 1022013 - RNA, 19 nt, Human
ugucuaagcaugcuggucu

SEQ ID NO: 1022014 - RNA, 27 nt, Human
uguuccacauccuccaagagcacuuca

SEQ ID NO: 1022015 - RNA, 22 nt, Human
uuaguccaguucugcuggaaca

SEQ ID NO: 1022016 - RNA, 26 nt, Human
uuaguccaguucugcuggaacaguau

SEQ ID NO: 1022017 - RNA, 18 nt, Human
uucccuggcucacuaagc

SEQ ID NO: 1022018 - RNA, 22 nt, Human
uucuuggucccagauagggucu

SEQ ID NO: 1022019 - RNA, 23 nt, Human
uugcuccagcaccagcagcucca

SEQ ID NO: 1022020 - RNA, 23 nt, Human
uuggaaggcuuacucuggcuuua

SEQ ID NO: 1022021 - RNA, 18 nt, Human
uuggucccagauaggguc

SEQ ID NO: 1022022 - RNA, 23 nt, Human
uuuaaaauuuucugauuuaaucu

SEQ ID NO: 1022023 - RNA, 23 nt, Human
uuuaaaggaaaucauaagaaaug

SEQ ID NO: 1022024 - RNA, 21 nt, Human
uuucuaaaccauuaaaacuac

SEQ ID NO: 1022025 - RNA, 19 nt, Human
uuucuggccuuagccacuu

SEQ ID NO: 1022026 - RNA, 21 nt, Human
uuugaacuuggugccagagca

SEQ ID NO: 1022027 - RNA, 18 nt, Human
uuuuuuuuuuuuuuuuug

SEQ ID NO: 1022028 - RNA, 18 nt, Human
uuuuuuuuuuuuuuuuug

SEQ ID NO: 1022029 - RNA, 27 nt, Human
aaaaaaaaaaaaaaagaacaaguaaaa

SEQ ID NO: 1022030 - RNA, 21 nt, Human
aaaaaaaagaacaaguaaaaa

SEQ ID NO: 1022031 - RNA, 24 nt, Human
aaaaacaaaaacaaacaaaagaaa

SEQ ID NO: 1022032 - RNA, 20 nt, Human
aaaaaggcaacuaagaaaua

SEQ ID NO: 1022033 - RNA, 25 nt, Human
aaaacaaacaaaagaaaacuguacc

SEQ ID NO: 1022034 - RNA, 26 nt, Human
aaacaaacaaaagaaaacuguaccag

SEQ ID NO: 1022035 - RNA, 30 nt, Human
aaaccucccaccaaaaacaaaaacaaagcg

SEQ ID NO: 1022036 - RNA, 26 nt, Human
aaagaacaaguaaaaauggagacuac

SEQ ID NO: 1022037 - RNA, 19 nt, Human
aaagaauucuccugccuca

SEQ ID NO: 1022038 - RNA, 20 nt, Human
aaagcuucaggcaguggcua

SEQ ID NO: 1022039 - RNA, 24 nt, Human
aaagugcugggauuagaggcauga

SEQ ID NO: 1022040 - RNA, 24 nt, Human
aaauagccauauaacaugcaggaa

SEQ ID NO: 1022041 - RNA, 26 nt, Human
aacaaacaaaagaaaacuguaccagu

SEQ ID NO: 1022042 - RNA, 21 nt, Human
aacaacaaaaaggcaacuaag

SEQ ID NO: 1022043 - RNA, 21 nt, Human
aacaagaacauucacagcagc

SEQ ID NO: 1022044 - RNA, 21 nt, Human
aaccuaacuguccaucggugg

SEQ ID NO: 1022045 - RNA, 20 nt, Human
aagaaaacagacacaagagg

SEQ ID NO: 1022046 - RNA, 24 nt, Human
aagaauucuccugccucagccucc

SEQ ID NO: 1022047 - RNA, 19 nt, Human
aaguagcugggauuacagg

SEQ ID NO: 1022048 - RNA, 26 nt, Human
aaguagcugggauuacaggugcaugc

SEQ ID NO: 1022049 - RNA, 19 nt, Human
aagugcugggauuagaggc

SEQ ID NO: 1022050 - RNA, 18 nt, Human
acaguacauaccucaaag

SEQ ID NO: 1022051 - RNA, 18 nt, Human
acauacucuucucaccau

SEQ ID NO: 1022052 - RNA, 22 nt, Human
acauauacuaagugcaucaguu

SEQ ID NO: 1022053 - RNA, 23 nt, Human
accaaaaaaaaaaaaaaaaaaaa

SEQ ID NO: 1022054 - RNA, 21 nt, Human
accaaaaacaaaaacaaacaa

SEQ ID NO: 1022055 - RNA, 24 nt, Human
accauguuggccaggcugaucucg

SEQ ID NO: 1022056 - RNA, 22 nt, Human
accgugcccagccgggagaugg

SEQ ID NO: 1022057 - RNA, 21 nt, Human
accuaauagcaaaucucagca

SEQ ID NO: 1022058 - RNA, 23 nt, Human
accucaggugaucccccagccuc

SEQ ID NO: 1022059 - RNA, 23 nt, Human
accuuaacuugcugggccucagc

SEQ ID NO: 1022060 - RNA, 18 nt, Human
acgauaauggagguuaag

SEQ ID NO: 1022061 - RNA, 25 nt, Human
acucuguugcccaggcuggagugca

SEQ ID NO: 1022062 - RNA, 22 nt, Human
acuguagagagagucaggccug

SEQ ID NO: 1022063 - RNA, 24 nt, Human
acuguagagagagucaggccuguc

SEQ ID NO: 1022064 - RNA, 30 nt, Human
acuuuaaaaccaaaaaaaaaaaaaaaaaaa

SEQ ID NO: 1022065 - RNA, 20 nt, Human
agaauagugauaaccuuuga

SEQ ID NO: 1022066 - RNA, 19 nt, Human
agaguuuaacauaccucuc

SEQ ID NO: 1022067 - RNA, 22 nt, Human
agaguuuaacauaccucucuca

SEQ ID NO: 1022068 - RNA, 18 nt, Human
agaugacuuugauagccc

SEQ ID NO: 1022069 - RNA, 27 nt, Human
agauggaagcuuuuuuuuauuauuauu

SEQ ID NO: 1022070 - RNA, 21 nt, Human
agcaaauaccuaugacucagu

SEQ ID NO: 1022071 - RNA, 24 nt, Human
agccauauaacaugcaggaaccuu

SEQ ID NO: 1022072 - RNA, 22 nt, Human
agcuuuuuuuuauuauuauuau

SEQ ID NO: 1022073 - RNA, 22 nt, Human
aggaaaaacaaaucuaugguga

SEQ ID NO: 1022074 - RNA, 21 nt, Human
aggcaugagccaccgugccca

SEQ ID NO: 1022075 - RNA, 25 nt, Human
aggcuggagugcaguggcgcaaucu

SEQ ID NO: 1022076 - RNA, 18 nt, Human
aggugaucccccagccuc

SEQ ID NO: 1022077 - RNA, 20 nt, Human
agugcaguggcgcaaucucg

SEQ ID NO: 1022078 - RNA, 24 nt, Human
agugcaguggcgcaaucucggcuc

SEQ ID NO: 1022079 - RNA, 23 nt, Human
auauauguauguauauacauaaa

SEQ ID NO: 1022080 - RNA, 18 nt, Human
auauguauguauauacau

SEQ ID NO: 1022081 - RNA, 21 nt, Human
auggucacaggagggcuccuc

SEQ ID NO: 1022082 - RNA, 19 nt, Human
auuacaggugcaugccacc

SEQ ID NO: 1022083 - RNA, 22 nt, Human
caaaauucaccaagguguaccc

SEQ ID NO: 1022084 - RNA, 22 nt, Human
caaagaauucuccugccucagc

SEQ ID NO: 1022085 - RNA, 24 nt, Human
caaagaggccacauacucuucuca

SEQ ID NO: 1022086 - RNA, 24 nt, Human
caaagugcugggauuagaggcaug

SEQ ID NO: 1022087 - RNA, 18 nt, Human
caacauagauaaaucuca

SEQ ID NO: 1022088 - RNA, 23 nt, Human
caacuaagaaauagccauauaac

SEQ ID NO: 1022089 - RNA, 22 nt, Human
caaucugaacagaaaacccagg

SEQ ID NO: 1022090 - RNA, 19 nt, Human
cacaauggaauacuauuca

SEQ ID NO: 1022091 - RNA, 21 nt, Human
cacacugccaaucugaacaga

SEQ ID NO: 1022092 - RNA, 20 nt, Human
caccaaaaacaaaaacaaac

SEQ ID NO: 1022093 - RNA, 24 nt, Human
caccauguuggccaggcugaucuc

SEQ ID NO: 1022094 - RNA, 27 nt, Human
caccauguuggccaggcugaucucgaa

SEQ ID NO: 1022095 - RNA, 20 nt, Human
cacccagaugacuuugauag

SEQ ID NO: 1022096 - RNA, 22 nt, Human
cacuauauuaagugaagaaaac

SEQ ID NO: 1022097 - RNA, 22 nt, Human
cacucccaccgugccgugccgc

SEQ ID NO: 1022098 - RNA, 24 nt, Human
cacucccaccgugccgugccgcac

SEQ ID NO: 1022099 - RNA, 24 nt, Human
cacucuguugcccaggcuggagug

SEQ ID NO: 1022100 - RNA, 21 nt, Human
cacugcaaccucugccuccug

SEQ ID NO: 1022101 - RNA, 23 nt, Human
cacugcaaccucugccuccuggg

SEQ ID NO: 1022102 - RNA, 20 nt, Human
cacugccaaucugaacagaa

SEQ ID NO: 1022103 - RNA, 24 nt, Human
cagaguuucacucuguugcccagg

SEQ ID NO: 1022104 - RNA, 20 nt, Human
cagcagcuuuauucauaaca

SEQ ID NO: 1022105 - RNA, 25 nt, Human
cagccucagccucccaaagugcugg

SEQ ID NO: 1022106 - RNA, 19 nt, Human
cagcuuccucaucugggaa

SEQ ID NO: 1022107 - RNA, 19 nt, Human
caggugaaauaaaccuccc

SEQ ID NO: 1022108 - RNA, 22 nt, Human
cauauauauguauguauauaca

SEQ ID NO: 1022109 - RNA, 24 nt, Human
caugaaaccaucccugaacacaau

SEQ ID NO: 1022110 - RNA, 22 nt, Human
caugccacccagaugacuuuga

SEQ ID NO: 1022111 - RNA, 24 nt, Human
cauguuggccaggcugaucucgaa

SEQ ID NO: 1022112 - RNA, 23 nt, Human
ccaaaaaaaaaaaaaaaaaaaaa

SEQ ID NO: 1022113 - RNA, 26 nt, Human
ccaaaaacaaaaacaaacaaaagaaa

SEQ ID NO: 1022114 - RNA, 24 nt, Human
ccaaagugcugggauuagaggcau

SEQ ID NO: 1022115 - RNA, 21 nt, Human
ccaaguagcugggauuacagg

SEQ ID NO: 1022116 - RNA, 25 nt, Human
ccacauacucuucucaccauguaau

SEQ ID NO: 1022117 - RNA, 24 nt, Human
ccacccagaugacuuugauagccc

SEQ ID NO: 1022118 - RNA, 20 nt, Human
ccagagucacauccagugac

SEQ ID NO: 1022119 - RNA, 21 nt, Human
ccagccggagacacucccacc

SEQ ID NO: 1022120 - RNA, 28 nt, Human
ccagccggagacacucccaccgugccgu

SEQ ID NO: 1022121 - RNA, 22 nt, Human
cccaaguagcugggauuacagg

SEQ ID NO: 1022122 - RNA, 23 nt, Human
cccaaguagcugggauuacaggu

SEQ ID NO: 1022123 - RNA, 24 nt, Human
cccaaguagcugggauuacaggug

SEQ ID NO: 1022124 - RNA, 20 nt, Human
cccaccaaaaacaaaaacaa

SEQ ID NO: 1022125 - RNA, 26 nt, Human
cccaccuuaacuugcugggccucagc

SEQ ID NO: 1022126 - RNA, 21 nt, Human
cccagaugacuuugauagccc

SEQ ID NO: 1022127 - RNA, 24 nt, Human
ccccagccucagccucccaaagug

SEQ ID NO: 1022128 - RNA, 26 nt, Human
cccccagccucagccucccaaagugc

SEQ ID NO: 1022129 - RNA, 22 nt, Human
ccgugccgugccgcaccgcgcc

SEQ ID NO: 1022130 - RNA, 21 nt, Human
ccucaggugaucccccagccu

SEQ ID NO: 1022131 - RNA, 24 nt, Human
ccuccuggguucaaagaauucucc

SEQ ID NO: 1022132 - RNA, 19 nt, Human
ccucugccuccuggguuca

SEQ ID NO: 1022133 - RNA, 18 nt, Human
ccugaccucaggugaucc

SEQ ID NO: 1022134 - RNA, 18 nt, Human
ccugaccucaggugaucc

SEQ ID NO: 1022135 - RNA, 32 nt, Human
ccugaccucaggugaucccccagccucagccg

SEQ ID NO: 1022136 - RNA, 23 nt, Human
ccugccucagccucccaaguagc

SEQ ID NO: 1022137 - RNA, 21 nt, Human
ccuugcuugcaagaagggcug

SEQ ID NO: 1022138 - RNA, 18 nt, Human
cgugccgugccgcaccgc

SEQ ID NO: 1022139 - RNA, 25 nt, Human
cuaaggaggaagggguaauuugggu

SEQ ID NO: 1022140 - RNA, 22 nt, Human
cuagaaaucaugucuacuuguc

SEQ ID NO: 1022141 - RNA, 24 nt, Human
cucacugcaaccucugccuccugg

SEQ ID NO: 1022142 - RNA, 24 nt, Human
cucagccucccaaguagcugggau

SEQ ID NO: 1022143 - RNA, 19 nt, Human
cucauauucauacuagccu

SEQ ID NO: 1022144 - RNA, 21 nt, Human
cuccuggguucaaagaauucu

SEQ ID NO: 1022145 - RNA, 19 nt, Human
cugcaaccucugccuccug

SEQ ID NO: 1022146 - RNA, 23 nt, Human
cugcaaccucugccuccuggguu

SEQ ID NO: 1022147 - RNA, 24 nt, Human
cugcaaccucugccuccuggguuc

SEQ ID NO: 1022148 - RNA, 23 nt, Human
cugccucagccucccaaguagcu

SEQ ID NO: 1022149 - RNA, 22 nt, Human
cuggagccaggguuugaggucu

SEQ ID NO: 1022150 - RNA, 18 nt, Human
cugggccucagcuuccuc

SEQ ID NO: 1022151 - RNA, 23 nt, Human
cugggccucagcuuccucaucug

SEQ ID NO: 1022152 - RNA, 22 nt, Human
cuguacacuucagauguaugca

SEQ ID NO: 1022153 - RNA, 21 nt, Human
cuguagagagagucaggccug

SEQ ID NO: 1022154 - RNA, 18 nt, Human
gaagaaaacagacacaag

SEQ ID NO: 1022155 - RNA, 24 nt, Human
gaccucaggugaucccccagccuc

SEQ ID NO: 1022156 - RNA, 20 nt, Human
gaugcaaagcuucaggcagu

SEQ ID NO: 1022157 - RNA, 18 nt, Human
gauuacaggugcaugcca

SEQ ID NO: 1022158 - RNA, 18 nt, Human
gauuagaggcaugagcca

SEQ ID NO: 1022159 - RNA, 24 nt, Human
gauuagaggcaugagccaccgugc

SEQ ID NO: 1022160 - RNA, 19 nt, Human
gccucagcuuccucaucug

SEQ ID NO: 1022161 - RNA, 20 nt, Human
gccucagcuuccucaucugg

SEQ ID NO: 1022162 - RNA, 23 nt, Human
gcugaucucgaacuccugaccuc

SEQ ID NO: 1022163 - RNA, 19 nt, Human
gcuggagugcaguggcgca

SEQ ID NO: 1022164 - RNA, 19 nt, Human
ggaaagucauagccccaug

SEQ ID NO: 1022165 - RNA, 22 nt, Human
gggauuucaccauguuggccag

SEQ ID NO: 1022166 - RNA, 23 nt, Human
gggauuucaccauguuggccagg

SEQ ID NO: 1022167 - RNA, 23 nt, Human
gggccucagcuuccucaucuggu

SEQ ID NO: 1022168 - RNA, 24 nt, Human
ggggauuucaccauguuggccagg

SEQ ID NO: 1022169 - RNA, 18 nt, Human
guagcugggauuacaggu

SEQ ID NO: 1022170 - RNA, 20 nt, Human
gucauuugugauaacaugga

SEQ ID NO: 1022171 - RNA, 24 nt, Human
gugaucccccagccucagccuccc

SEQ ID NO: 1022172 - RNA, 21 nt, Human
gugcauauuuuucauguaugg

SEQ ID NO: 1022173 - RNA, 24 nt, Human
guuucacucuguugcccaggcugg

SEQ ID NO: 1022174 - RNA, 19 nt, Human
uaacaguacauaccucaaa

SEQ ID NO: 1022175 - RNA, 19 nt, Human
uaacauaccucucucaaua

SEQ ID NO: 1022176 - RNA, 21 nt, Human
uaagaaauagccauauaacau

SEQ ID NO: 1022177 - RNA, 18 nt, Human
uaagugaagaaaacagac

SEQ ID NO: 1022178 - RNA, 24 nt, Human
uaauuuuuauauuuuuaguagaga

SEQ ID NO: 1022179 - RNA, 18 nt, Human
uacaugcauguaugcauu

SEQ ID NO: 1022180 - RNA, 22 nt, Human
uagaagaauaagccacaccaga

SEQ ID NO: 1022181 - RNA, 22 nt, Human
uagagaggggauuucaccaugu

SEQ ID NO: 1022182 - RNA, 18 nt, Human
uagauuacagaagcaaga

SEQ ID NO: 1022183 - RNA, 19 nt, Human
uagccaggaccggaggaaa

SEQ ID NO: 1022184 - RNA, 24 nt, Human
uaguagagaggggauuucaccaug

SEQ ID NO: 1022185 - RNA, 21 nt, Human
uauauguauguauauacauaa

SEQ ID NO: 1022186 - RNA, 22 nt, Human
uauauguauguauauacauaaa

SEQ ID NO: 1022187 - RNA, 23 nt, Human
uauguauauacauaaauuuaaaa

SEQ ID NO: 1022188 - RNA, 18 nt, Human
uauguauguauauacaua

SEQ ID NO: 1022189 - RNA, 20 nt, Human
uauucauacuagccaggacc

SEQ ID NO: 1022190 - RNA, 21 nt, Human
ucacucuguugcccaggcugg

SEQ ID NO: 1022191 - RNA, 22 nt, Human
ucacucuguugcccaggcugga

SEQ ID NO: 1022192 - RNA, 23 nt, Human
ucacucuguugcccaggcuggag

SEQ ID NO: 1022193 - RNA, 24 nt, Human
ucacucuguugcccaggcuggagu

SEQ ID NO: 1022194 - RNA, 24 nt, Human
ucacugcaaccucugccuccuggg

SEQ ID NO: 1022195 - RNA, 25 nt, Human
ucacugcaaccucugccuccugggu

SEQ ID NO: 1022196 - RNA, 26 nt, Human
ucacugcaaccucugccuccuggguu

SEQ ID NO: 1022197 - RNA, 22 nt, Human
ucagacuauggacuauuacaca

SEQ ID NO: 1022198 - RNA, 18 nt, Human
ucagccucccaaagugcu

SEQ ID NO: 1022199 - RNA, 20 nt, Human
ucagccucccaaguagcugg

SEQ ID NO: 1022200 - RNA, 18 nt, Human
ucauagccccauguguuu

SEQ ID NO: 1022201 - RNA, 21 nt, Human
uccaugaagcauuuauaaaaa

SEQ ID NO: 1022202 - RNA, 24 nt, Human
ucccaaagugcugggauuagaggc

SEQ ID NO: 1022203 - RNA, 23 nt, Human
ucccaaguagcugggauuacagg

SEQ ID NO: 1022204 - RNA, 24 nt, Human
ucccaaguagcugggauuacaggu

SEQ ID NO: 1022205 - RNA, 19 nt, Human
ucccaccaaaaacaaaaac

SEQ ID NO: 1022206 - RNA, 19 nt, Human
ucccccagccucagccucc

SEQ ID NO: 1022207 - RNA, 20 nt, Human
ucccccagccucagccuccc

SEQ ID NO: 1022208 - RNA, 24 nt, Human
ucccugaacacaauaucuucccca

SEQ ID NO: 1022209 - RNA, 21 nt, Human
ucccugcaagccagccggaga

SEQ ID NO: 1022210 - RNA, 21 nt, Human
uccuggguucaaagaauucuc

SEQ ID NO: 1022211 - RNA, 24 nt, Human
uccuggguucaaagaauucuccug

SEQ ID NO: 1022212 - RNA, 21 nt, Human
ucucagucgguguucucccug

SEQ ID NO: 1022213 - RNA, 26 nt, Human
ucuccugccucagccucccaaguagc

SEQ ID NO: 1022214 - RNA, 23 nt, Human
ucucgaacuccugaccucaggug

SEQ ID NO: 1022215 - RNA, 18 nt, Human
ucuguugcccaggcugga

SEQ ID NO: 1022216 - RNA, 24 nt, Human
ucuguugcccaggcuggagugcag

SEQ ID NO: 1022217 - RNA, 21 nt, Human
ugaaauaaaccucccaccaaa

SEQ ID NO: 1022218 - RNA, 22 nt, Human
ugaaauaaaccucccaccaaaa

SEQ ID NO: 1022219 - RNA, 22 nt, Human
ugaaccuggaggacagaacuca

SEQ ID NO: 1022220 - RNA, 19 nt, Human
ugaauggauaaagaaaaug

SEQ ID NO: 1022221 - RNA, 24 nt, Human
ugacacuauauuaagugaagaaaa

SEQ ID NO: 1022222 - RNA, 19 nt, Human
ugaccucaggugauccccc

SEQ ID NO: 1022223 - RNA, 20 nt, Human
ugaccucaggugauccccca

SEQ ID NO: 1022224 - RNA, 24 nt, Human
ugaccucaggugaucccccagccu

SEQ ID NO: 1022225 - RNA, 25 nt, Human
ugaccucaggugaucccccagccuc

SEQ ID NO: 1022226 - RNA, 24 nt, Human
ugacucaguaacaaagaggccaca

SEQ ID NO: 1022227 - RNA, 22 nt, Human
ugagacagaguuucacucuguu

SEQ ID NO: 1022228 - RNA, 25 nt, Human
ugauaauacaacauagauaaaucuc

SEQ ID NO: 1022229 - RNA, 19 nt, Human
ugauggagaccgugguggg

SEQ ID NO: 1022230 - RNA, 22 nt, Human
ugcaguggcgcaaucucggcuc

SEQ ID NO: 1022231 - RNA, 23 nt, Human
ugcaguggcgcaaucucggcuca

SEQ ID NO: 1022232 - RNA, 21 nt, Human
ugcaucugucaaacucaucca

SEQ ID NO: 1022233 - RNA, 22 nt, Human
ugcaucugucaaacucauccaa

SEQ ID NO: 1022234 - RNA, 18 nt, Human
ugcccaggcuggagugca

SEQ ID NO: 1022235 - RNA, 21 nt, Human
ugcccaggcuggagugcagug

SEQ ID NO: 1022236 - RNA, 22 nt, Human
ugcccaggcuggagugcagugg

SEQ ID NO: 1022237 - RNA, 24 nt, Human
ugcccaggcuggagugcaguggcg

SEQ ID NO: 1022238 - RNA, 24 nt, Human
ugccucagccucccaaguagcugg

SEQ ID NO: 1022239 - RNA, 24 nt, Human
ugcugcaaucacauaaauaugcca

SEQ ID NO: 1022240 - RNA, 21 nt, Human
uggaaucaaccuaacugucca

SEQ ID NO: 1022241 - RNA, 23 nt, Human
uggagugcaguggcgcaaucucg

SEQ ID NO: 1022242 - RNA, 24 nt, Human
uggagugcaguggcgcaaucucgg

SEQ ID NO: 1022243 - RNA, 24 nt, Human
uggccaggcugaucucgaacuccu

SEQ ID NO: 1022244 - RNA, 21 nt, Human
ugggauuacaggugcaugcca

SEQ ID NO: 1022245 - RNA, 22 nt, Human
ugggauuacaggugcaugccac

SEQ ID NO: 1022246 - RNA, 24 nt, Human
ugggauuacaggugcaugccacca

SEQ ID NO: 1022247 - RNA, 22 nt, Human
ugggauuagaggcaugagccac

SEQ ID NO: 1022248 - RNA, 23 nt, Human
ugggauuagaggcaugagccacc

SEQ ID NO: 1022249 - RNA, 24 nt, Human
ugggauuagaggcaugagccaccg

SEQ ID NO: 1022250 - RNA, 23 nt, Human
uggguauagacauauacaaaauu

SEQ ID NO: 1022251 - RNA, 23 nt, Human
uggugguuacaugcauguaugca

SEQ ID NO: 1022252 - RNA, 22 nt, Human
uguaugcauuucacuauaaguc

SEQ ID NO: 1022253 - RNA, 19 nt, Human
uguccaaaaggcaagaagu

SEQ ID NO: 1022254 - RNA, 21 nt, Human
uuacaauuaaaccaaaaugaa

SEQ ID NO: 1022255 - RNA, 26 nt, Human
uuagaaaccaacaacaaaaaggcaac

SEQ ID NO: 1022256 - RNA, 18 nt, Human
uuaguagagaggggauuu

SEQ ID NO: 1022257 - RNA, 24 nt, Human
uuaguagagaggggauuucaccau

SEQ ID NO: 1022258 - RNA, 21 nt, Human
uuauggucacaggagggcucc

SEQ ID NO: 1022259 - RNA, 22 nt, Human
uucagauguaugcauuucacua

SEQ ID NO: 1022260 - RNA, 23 nt, Human
uucauaacaauaaaaccugcagg

SEQ ID NO: 1022261 - RNA, 20 nt, Human
uuccccagagucacauccag

SEQ ID NO: 1022262 - RNA, 24 nt, Human
uugcccaggcuggagugcaguggc

SEQ ID NO: 1022263 - RNA, 20 nt, Human
uuggcagcuagaagaauaag

SEQ ID NO: 1022264 - RNA, 23 nt, Human
uuuaaaaccaaaaaaaaaaaaaa

SEQ ID NO: 1022265 - RNA, 24 nt, Human
uuuaacauaccucucucaauaaau

SEQ ID NO: 1022266 - RNA, 24 nt, Human
uuuacuaucauuacaaugaauggu

SEQ ID NO: 1022267 - RNA, 21 nt, Human
uuuauauuuuuacaaaaugga

SEQ ID NO: 1022268 - RNA, 21 nt, Human
uuucaccauguuggccaggcu

SEQ ID NO: 1022269 - RNA, 22 nt, Human
uuucacucuguugcccaggcug

SEQ ID NO: 1022270 - RNA, 23 nt, Human
uuucacucuguugcccaggcugg

SEQ ID NO: 1022271 - RNA, 24 nt, Human
uuucacucuguugcccaggcugga

SEQ ID NO: 1022272 - RNA, 24 nt, Human
uuuuuaguagagaggggauuucac

SEQ ID NO: 1022273 - RNA, 20 nt, Human
uuuuuauauuuuuaguagag

SEQ ID NO: 1022274 - RNA, 24 nt, Human
uuuuucagcaauacauaaucaugg

SEQ ID NO: 1022275 - RNA, 20 nt, Human
cacaaugaauaauacauuua

SEQ ID NO: 1022276 - RNA, 22 nt, Human
cagagcucgccgccagcccuuc

SEQ ID NO: 1022277 - RNA, 26 nt, Human
cuccucuauacauacucacaguuuag

SEQ ID NO: 1022278 - RNA, 20 nt, Human
cucgccgccagcccuuccua

SEQ ID NO: 1022279 - RNA, 23 nt, Human
gauuuuacuccucuauacauacu

SEQ ID NO: 1022280 - RNA, 22 nt, Human
gccuccaguucgcaccaggucc

SEQ ID NO: 1022281 - RNA, 19 nt, Human
ggcgggaccagggauucac

SEQ ID NO: 1022282 - RNA, 18 nt, Human
gggccaagaguguugaaa

SEQ ID NO: 1022283 - RNA, 21 nt, Human
gugcacccgcuucgccucccc

SEQ ID NO: 1022284 - RNA, 18 nt, Human
ucacgggcugcaggaccc

SEQ ID NO: 1022285 - RNA, 20 nt, Human
ugaaagcagagcguucccuc

SEQ ID NO: 1022286 - RNA, 24 nt, Human
uucgcaccagguccaagucucggc

SEQ ID NO: 1022287 - RNA, 23 nt, Human
uuuguuggaauuuauuacuuugu

SEQ ID NO: 1022288 - RNA, 22 nt, Human
aacaaagcaaaguuacucuccu

SEQ ID NO: 1022289 - RNA, 22 nt, Human
aagcacagccuggcacaaauac

SEQ ID NO: 1022290 - RNA, 22 nt, Human
aaggucccaccuccuaauacuu

SEQ ID NO: 1022291 - RNA, 18 nt, Human
aauagaagggccacagga

SEQ ID NO: 1022292 - RNA, 22 nt, Human
aaucacuucccaaaggucccac

SEQ ID NO: 1022293 - RNA, 27 nt, Human
agagcagaaaauagaagggccacagga

SEQ ID NO: 1022294 - RNA, 19 nt, Human
agcccagguaaugcccucc

SEQ ID NO: 1022295 - RNA, 19 nt, Human
aggaaggcugggagggaag

SEQ ID NO: 1022296 - RNA, 19 nt, Human
agguucucuguagcccucu

SEQ ID NO: 1022297 - RNA, 19 nt, Human
augcagccucaacuaaagc

SEQ ID NO: 1022298 - RNA, 22 nt, Human
caaucggggcggcugagggcga

SEQ ID NO: 1022299 - RNA, 18 nt, Human
cacaggacaaacucccuc

SEQ ID NO: 1022300 - RNA, 23 nt, Human
cagccucaacuaaagcuuguaac

SEQ ID NO: 1022301 - RNA, 18 nt, Human
caggacaaacucccucua

SEQ ID NO: 1022302 - RNA, 19 nt, Human
caguaaacaguuuauguag

SEQ ID NO: 1022303 - RNA, 19 nt, Human
caguaggugcaguugucug

SEQ ID NO: 1022304 - RNA, 23 nt, Human
caucaguaggugcaguugucugu

SEQ ID NO: 1022305 - RNA, 24 nt, Human
ccaauagcccagguaaugcccucc

SEQ ID NO: 1022306 - RNA, 24 nt, Human
ccacgcaucucacggcucgcugac

SEQ ID NO: 1022307 - RNA, 26 nt, Human
ccacgcaucucacggcucgcugacgc

SEQ ID NO: 1022308 - RNA, 22 nt, Human
ccccaauagcccagguaaugcc

SEQ ID NO: 1022309 - RNA, 18 nt, Human
cccucuggauucugucug

SEQ ID NO: 1022310 - RNA, 20 nt, Human
cgaacaaguuaugcagccuc

SEQ ID NO: 1022311 - RNA, 19 nt, Human
cucacagagcagaaaauag

SEQ ID NO: 1022312 - RNA, 19 nt, Human
cucuuggggacacaugggu

SEQ ID NO: 1022313 - RNA, 19 nt, Human
cuucccaaaggucccaccu

SEQ ID NO: 1022314 - RNA, 23 nt, Human
gagggaagccagagggaaagugc

SEQ ID NO: 1022315 - RNA, 18 nt, Human
ggaaggcugggagggaag

SEQ ID NO: 1022316 - RNA, 20 nt, Human
ggagguuugguggagguguc

SEQ ID NO: 1022317 - RNA, 18 nt, Human
gguuugguggaggugucc

SEQ ID NO: 1022318 - RNA, 21 nt, Human
guucuggaggcugggaaguuc

SEQ ID NO: 1022319 - RNA, 21 nt, Human
uaaggaggggacaaaacaucc

SEQ ID NO: 1022320 - RNA, 19 nt, Human
uagaaagcacagccuggca

SEQ ID NO: 1022321 - RNA, 23 nt, Human
uaggaaagagaccacauuucccc

SEQ ID NO: 1022322 - RNA, 21 nt, Human
ucaaaacaucaguaggugcag

SEQ ID NO: 1022323 - RNA, 22 nt, Human
uccaaaccaaggaaggcuggga

SEQ ID NO: 1022324 - RNA, 24 nt, Human
ucggggcggcugagggcgaaccgg

SEQ ID NO: 1022325 - RNA, 19 nt, Human
ucucacggcucgcugacgc

SEQ ID NO: 1022326 - RNA, 19 nt, Human
ucucuuggggacacauggg

SEQ ID NO: 1022327 - RNA, 18 nt, Human
ugagggcucaugucuguu

SEQ ID NO: 1022328 - RNA, 22 nt, Human
ugcaagaggagguuugguggag

SEQ ID NO: 1022329 - RNA, 22 nt, Human
ugcugcaucuuuuggaagggag

SEQ ID NO: 1022330 - RNA, 19 nt, Human
ugggagggaagccagaggg

SEQ ID NO: 1022331 - RNA, 19 nt, Human
uggggagaguguaacaggc

SEQ ID NO: 1022332 - RNA, 22 nt, Human
uguccuagauuguuugcagucc

SEQ ID NO: 1022333 - RNA, 23 nt, Human
uguuucaacaguaaacaguuuau

SEQ ID NO: 1022334 - RNA, 18 nt, Human
uuccugcucuccacggag

SEQ ID NO: 1022335 - RNA, 20 nt, Human
uugacuuaaucacuucccaa

SEQ ID NO: 1022336 - RNA, 20 nt, Human
uuggaagggaggagcauugu

SEQ ID NO: 1022337 - RNA, 23 nt, Human
uuucccagaguucuggaggcugg

SEQ ID NO: 1022338 - RNA, 21 nt, Human
aaaaacaaaacaaaacaaaga

SEQ ID NO: 1022339 - RNA, 22 nt, Human
aaaaacaaaacaaaacaaagaa

SEQ ID NO: 1022340 - RNA, 24 nt, Human
aaaaacaaaacaaaacaaagaaaa

SEQ ID NO: 1022341 - RNA, 20 nt, Human
aaaacaaaacaaaacaaaga

SEQ ID NO: 1022342 - RNA, 21 nt, Human
aaacaaaacaaaacaaagaaa

SEQ ID NO: 1022343 - RNA, 24 nt, Human
aaacaaaacaaaacaaagaaaaca

SEQ ID NO: 1022344 - RNA, 21 nt, Human
aacaaaacaaaacaaagaaaa

SEQ ID NO: 1022345 - RNA, 21 nt, Human
aacagagcgagacuccgucuc

SEQ ID NO: 1022346 - RNA, 24 nt, Human
aacagagcgagacuccgucucaaa

SEQ ID NO: 1022347 - RNA, 20 nt, Human
aacaugaugaaaccccgccu

SEQ ID NO: 1022348 - RNA, 18 nt, Human
aagagaggcugggaagua

SEQ ID NO: 1022349 - RNA, 23 nt, Human
aaguuggaaacaaacacaugaau

SEQ ID NO: 1022350 - RNA, 21 nt, Human
aaucaucuugguaacauuuaa

SEQ ID NO: 1022351 - RNA, 18 nt, Human
aaucgcuugaaccuggga

SEQ ID NO: 1022352 - RNA, 24 nt, Human
aaucgcuugaaccugggaggcgga

SEQ ID NO: 1022353 - RNA, 28 nt, Human
acaaaacaaaacaaagaaaacauuaaga

SEQ ID NO: 1022354 - RNA, 24 nt, Human
acaaaacaaagaaaacauuaagag

SEQ ID NO: 1022355 - RNA, 25 nt, Human
acaccccccacccugccuucuccca

SEQ ID NO: 1022356 - RNA, 24 nt, Human
acagagcgagacuccgucucaaaa

SEQ ID NO: 1022357 - RNA, 19 nt, Human
acccccaaacucuggggag

SEQ ID NO: 1022358 - RNA, 24 nt, Human
acccccaaacucuggggaguauuc

SEQ ID NO: 1022359 - RNA, 24 nt, Human
accccgccucuauuaaauauacaa

SEQ ID NO: 1022360 - RNA, 19 nt, Human
accuuuauuagaguuggaa

SEQ ID NO: 1022361 - RNA, 21 nt, Human
acucugcgaggcggggaggac

SEQ ID NO: 1022362 - RNA, 21 nt, Human
acucuggggaguauuccagaa

SEQ ID NO: 1022363 - RNA, 18 nt, Human
acugcacuccagccuggg

SEQ ID NO: 1022364 - RNA, 24 nt, Human
acugcacuccagccugggaaacag

SEQ ID NO: 1022365 - RNA, 22 nt, Human
agauagcgccacugcacuccag

SEQ ID NO: 1022366 - RNA, 23 nt, Human
agaucacuugaggucaggaguuc

SEQ ID NO: 1022367 - RNA, 24 nt, Human
agcacuuugggaggcugagguggg

SEQ ID NO: 1022368 - RNA, 24 nt, Human
agccugggaaacagagcgagacuc

SEQ ID NO: 1022369 - RNA, 22 nt, Human
aggcaugagaaucgcuugaacc

SEQ ID NO: 1022370 - RNA, 24 nt, Human
aggcaugagaaucgcuugaaccug

SEQ ID NO: 1022371 - RNA, 24 nt, Human
aggcaugguggcucacaccuguaa

SEQ ID NO: 1022372 - RNA, 19 nt, Human
aggcggacguugcagugag

SEQ ID NO: 1022373 - RNA, 24 nt, Human
aggcggacguugcagugagccaag

SEQ ID NO: 1022374 - RNA, 21 nt, Human
aggcugaggugggcagaucac

SEQ ID NO: 1022375 - RNA, 24 nt, Human
aggcugaggugggcagaucacuug

SEQ ID NO: 1022376 - RNA, 22 nt, Human
aggugggcagaucacuugaggu

SEQ ID NO: 1022377 - RNA, 23 nt, Human
aggugggcagaucacuugagguc

SEQ ID NO: 1022378 - RNA, 22 nt, Human
aguaagcaguauaaaauuacaa

SEQ ID NO: 1022379 - RNA, 24 nt, Human
auagcgccacugcacuccagccug

SEQ ID NO: 1022380 - RNA, 21 nt, Human
aucaucuugguaacauuuaag

SEQ ID NO: 1022381 - RNA, 20 nt, Human
augcauuuaauuccaacccc

SEQ ID NO: 1022382 - RNA, 24 nt, Human
auggggcaaaagagaggcugggaa

SEQ ID NO: 1022383 - RNA, 23 nt, Human
augucguacaccuguggucccag

SEQ ID NO: 1022384 - RNA, 27 nt, Human
auuccuuucccccacuccuuuuguuuu

SEQ ID NO: 1022385 - RNA, 20 nt, Human
caaaacaaaacaaagaaaac

SEQ ID NO: 1022386 - RNA, 21 nt, Human
caaauguaauaagauggacag

SEQ ID NO: 1022387 - RNA, 24 nt, Human
cacaccuguaaucccagcacuuug

SEQ ID NO: 1022388 - RNA, 19 nt, Human
caccuguaaucccagcacu

SEQ ID NO: 1022389 - RNA, 24 nt, Human
caccuguaaucccagcacuuuggg

SEQ ID NO: 1022390 - RNA, 23 nt, Human
caccuguggucccagcuacucgg

SEQ ID NO: 1022391 - RNA, 24 nt, Human
cacggccaggcaugguggcucaca

SEQ ID NO: 1022392 - RNA, 24 nt, Human
cacuccagccugggaaacagagcg

SEQ ID NO: 1022393 - RNA, 18 nt, Human
cacugcacuccagccugg

SEQ ID NO: 1022394 - RNA, 19 nt, Human
cacugcacuccagccuggg

SEQ ID NO: 1022395 - RNA, 19 nt, Human
cacugcacuccagccuggg

SEQ ID NO: 1022396 - RNA, 24 nt, Human
cacugcacuccagccugggaaaca

SEQ ID NO: 1022397 - RNA, 24 nt, Human
cagaucacuugaggucaggaguuc

SEQ ID NO: 1022398 - RNA, 26 nt, Human
cagaucacuugaggucaggaguucaa

SEQ ID NO: 1022399 - RNA, 21 nt, Human
cagcacuuugggaggcugagg

SEQ ID NO: 1022400 - RNA, 24 nt, Human
cagcacuuugggaggcugaggugg

SEQ ID NO: 1022401 - RNA, 22 nt, Human
cauuuaauuccaaccccucauu

SEQ ID NO: 1022402 - RNA, 19 nt, Human
ccaaccuggcuuugcagca

SEQ ID NO: 1022403 - RNA, 19 nt, Human
ccacugcacuccagccugg

SEQ ID NO: 1022404 - RNA, 20 nt, Human
ccacugcacuccagccuggg

SEQ ID NO: 1022405 - RNA, 23 nt, Human
ccacugcacuccagccugggaaa

SEQ ID NO: 1022406 - RNA, 24 nt, Human
ccacugcacuccagccugggaaac

SEQ ID NO: 1022407 - RNA, 20 nt, Human
ccauccuuaaaaacauuaag

SEQ ID NO: 1022408 - RNA, 23 nt, Human
ccccacccugccuucucccaacu

SEQ ID NO: 1022409 - RNA, 25 nt, Human
cccccaaacucuggggaguauucca

SEQ ID NO: 1022410 - RNA, 25 nt, Human
cccccaacgcccccggggagcugga

SEQ ID NO: 1022411 - RNA, 24 nt, Human
ccccccacccugccuucucccaac

SEQ ID NO: 1022412 - RNA, 23 nt, Human
ccgcggagccccccaacgccccc

SEQ ID NO: 1022413 - RNA, 22 nt, Human
ccgucucaaaaacaaaacaaaa

SEQ ID NO: 1022414 - RNA, 22 nt, Human
ccugggaaacagagcgagacuc

SEQ ID NO: 1022415 - RNA, 21 nt, Human
ccuguggucccagcuacucgg

SEQ ID NO: 1022416 - RNA, 22 nt, Human
ccuuaaaaacauuaagagcaaa

SEQ ID NO: 1022417 - RNA, 21 nt, Human
ccuuucccccacuccuuuugu

SEQ ID NO: 1022418 - RNA, 21 nt, Human
ccuuuuauuuuuccacacccc

SEQ ID NO: 1022419 - RNA, 24 nt, Human
cgaggcaugagaaucgcuugaacc

SEQ ID NO: 1022420 - RNA, 21 nt, Human
cgcuugaaccugggaggcgga

SEQ ID NO: 1022421 - RNA, 21 nt, Human
cggcgggcgaaucccgaggcc

SEQ ID NO: 1022422 - RNA, 18 nt, Human
cgucccggcgugcugggc

SEQ ID NO: 1022423 - RNA, 24 nt, Human
cguugcagugagccaagauagcgc

SEQ ID NO: 1022424 - RNA, 24 nt, Human
cuacauggugcaaggacuuuuccu

SEQ ID NO: 1022425 - RNA, 20 nt, Human
cucaauuccuuucccccacu

SEQ ID NO: 1022426 - RNA, 22 nt, Human
cucacaccuguaaucccagcac

SEQ ID NO: 1022427 - RNA, 24 nt, Human
cucacaccuguaaucccagcacuu

SEQ ID NO: 1022428 - RNA, 19 nt, Human
cuuaagauuucuuuuucuc

SEQ ID NO: 1022429 - RNA, 23 nt, Human
cuuaagauuucuuuuucucaauu

SEQ ID NO: 1022430 - RNA, 23 nt, Human
cuuugggaggcugaggugggcag

SEQ ID NO: 1022431 - RNA, 23 nt, Human
gaauggggcaaaagagaggcugg

SEQ ID NO: 1022432 - RNA, 19 nt, Human
gacguugcagugagccaag

SEQ ID NO: 1022433 - RNA, 23 nt, Human
gaucacuugaggucaggaguuca

SEQ ID NO: 1022434 - RNA, 24 nt, Human
gaucacuugaggucaggaguucaa

SEQ ID NO: 1022435 - RNA, 24 nt, Human
gauucagagguggucucaaaguug

SEQ ID NO: 1022436 - RNA, 24 nt, Human
gcacuccagccugggaaacagagc

SEQ ID NO: 1022437 - RNA, 24 nt, Human
gcccgcggagccccccaacgcccc

SEQ ID NO: 1022438 - RNA, 20 nt, Human
gcgggcgaaucccgaggccc

SEQ ID NO: 1022439 - RNA, 22 nt, Human
gcgggcgaaucccgaggcccag

SEQ ID NO: 1022440 - RNA, 21 nt, Human
gcuggccgggcccggcgcccc

SEQ ID NO: 1022441 - RNA, 18 nt, Human
ggacguugcagugagcca

SEQ ID NO: 1022442 - RNA, 20 nt, Human
ggacguugcagugagccaag

SEQ ID NO: 1022443 - RNA, 19 nt, Human
ggagccccccaacgccccc

SEQ ID NO: 1022444 - RNA, 21 nt, Human
ggaugccaaagugggggacga

SEQ ID NO: 1022445 - RNA, 23 nt, Human
ggcccggcgccccaaccuggcuu

SEQ ID NO: 1022446 - RNA, 25 nt, Human
ggcgccccaaccuggcuuugcagca

SEQ ID NO: 1022447 - RNA, 19 nt, Human
gggaugccaaaguggggga

SEQ ID NO: 1022448 - RNA, 26 nt, Human
gggcagaucacuugaggucaggaguu

SEQ ID NO: 1022449 - RNA, 18 nt, Human
gggcgcuggccgggcccg

SEQ ID NO: 1022450 - RNA, 20 nt, Human
ggggcaaaagagaggcuggg

SEQ ID NO: 1022451 - RNA, 18 nt, Human
ggucucaaaguuguuaca

SEQ ID NO: 1022452 - RNA, 24 nt, Human
gguggcucacaccuguaaucccag

SEQ ID NO: 1022453 - RNA, 20 nt, Human
guaaagcaagcugcacuucc

SEQ ID NO: 1022454 - RNA, 22 nt, Human
gucucaaaaacaaaacaaaaca

SEQ ID NO: 1022455 - RNA, 19 nt, Human
uacaccuguggucccagcu

SEQ ID NO: 1022456 - RNA, 22 nt, Human
uauuuuuccacaccccccaccc

SEQ ID NO: 1022457 - RNA, 18 nt, Human
ucaggaguucaacaugau

SEQ ID NO: 1022458 - RNA, 21 nt, Human
uccagaauggggcaaaagaga

SEQ ID NO: 1022459 - RNA, 20 nt, Human
uccagccugggaaacagagc

SEQ ID NO: 1022460 - RNA, 23 nt, Human
uccagccugggaaacagagcgag

SEQ ID NO: 1022461 - RNA, 24 nt, Human
uccagccugggaaacagagcgaga

SEQ ID NO: 1022462 - RNA, 27 nt, Human
ucccgaggcccaggcccgcggagcccc

SEQ ID NO: 1022463 - RNA, 23 nt, Human
ucccggcgugcugggcgaccgcg

SEQ ID NO: 1022464 - RNA, 18 nt, Human
ucgcuugaaccugggagg

SEQ ID NO: 1022465 - RNA, 28 nt, Human
ucuuuuucucaauuccuuucccccacuc

SEQ ID NO: 1022466 - RNA, 19 nt, Human
ugaacacccccaaacucug

SEQ ID NO: 1022467 - RNA, 24 nt, Human
ugaaccugggaggcggacguugca

SEQ ID NO: 1022468 - RNA, 24 nt, Human
ugaggugggcagaucacuugaggu

SEQ ID NO: 1022469 - RNA, 26 nt, Human
ugaggugggcagaucacuugagguca

SEQ ID NO: 1022470 - RNA, 22 nt, Human
ugcagugagccaagauagcgcc

SEQ ID NO: 1022471 - RNA, 19 nt, Human
ugccuagagggcgcuggcc

SEQ ID NO: 1022472 - RNA, 24 nt, Human
ugcgaggcggggaggacggaugua

SEQ ID NO: 1022473 - RNA, 21 nt, Human
uggcucacaccuguaauccca

SEQ ID NO: 1022474 - RNA, 22 nt, Human
uggcucacaccuguaaucccag

SEQ ID NO: 1022475 - RNA, 24 nt, Human
uggcucacaccuguaaucccagca

SEQ ID NO: 1022476 - RNA, 24 nt, Human
ugggaggcggacguugcagugagc

SEQ ID NO: 1022477 - RNA, 20 nt, Human
ugggaggcugaggugggcag

SEQ ID NO: 1022478 - RNA, 24 nt, Human
ugggaggcugaggugggcagauca

SEQ ID NO: 1022479 - RNA, 24 nt, Human
ugggcagaucacuugaggucagga

SEQ ID NO: 1022480 - RNA, 24 nt, Human
ugguggcucacaccuguaauccca

SEQ ID NO: 1022481 - RNA, 21 nt, Human
uguaaagcaagcugcacuucc

SEQ ID NO: 1022482 - RNA, 21 nt, Human
ugucguacaccugugguccca

SEQ ID NO: 1022483 - RNA, 24 nt, Human
ugucguacaccuguggucccagcu

SEQ ID NO: 1022484 - RNA, 24 nt, Human
uugaaccugggaggcggacguugc

SEQ ID NO: 1022485 - RNA, 22 nt, Human
uugcagugagccaagauagcgc

SEQ ID NO: 1022486 - RNA, 25 nt, Human
uugggaggcugaggugggcagauca

SEQ ID NO: 1022487 - RNA, 19 nt, Human
uuuuagagaauucuacuua

SEQ ID NO: 1022488 - RNA, 25 nt, Human
uuuuauuuuuccacaccccccaccc

SEQ ID NO: 1022489 - RNA, 18 nt, Human
uuuuccacaccccccacc

SEQ ID NO: 1022490 - RNA, 21 nt, Human
aaaaaaaagaaaaaugcaaag

SEQ ID NO: 1022491 - RNA, 21 nt, Human
aaaagaagaagaaacagugga

SEQ ID NO: 1022492 - RNA, 22 nt, Human
aacacuuuuuuguacuauuuug

SEQ ID NO: 1022493 - RNA, 23 nt, Human
aagaagaagaaacaguggacagc

SEQ ID NO: 1022494 - RNA, 28 nt, Human
aagaagaagaaacaguggacagcaagaa

SEQ ID NO: 1022495 - RNA, 19 nt, Human
aaguagcugggacuacagg

SEQ ID NO: 1022496 - RNA, 20 nt, Human
aaguagcugggacuacaggu

SEQ ID NO: 1022497 - RNA, 26 nt, Human
aaguagcugggacuacagguacacac

SEQ ID NO: 1022498 - RNA, 22 nt, Human
aaucuuggaauggacccuacug

SEQ ID NO: 1022499 - RNA, 20 nt, Human
aaugcaaaguuccaaacagu

SEQ ID NO: 1022500 - RNA, 25 nt, Human
aauuaaaaugcuaaaagaagaagaa

SEQ ID NO: 1022501 - RNA, 20 nt, Human
acaaaaaaagagaggaagaa

SEQ ID NO: 1022502 - RNA, 21 nt, Human
acacagaggugaacuggucac

SEQ ID NO: 1022503 - RNA, 24 nt, Human
acagagugagaacuugucucaaaa

SEQ ID NO: 1022504 - RNA, 27 nt, Human
accucaauaaccugaaguuaaacauca

SEQ ID NO: 1022505 - RNA, 21 nt, Human
accugagccugggaggucaag

SEQ ID NO: 1022506 - RNA, 22 nt, Human
acgccuggcgacucccagccuc

SEQ ID NO: 1022507 - RNA, 19 nt, Human
acuccagccugggugacag

SEQ ID NO: 1022508 - RNA, 24 nt, Human
acuccagccugggugacagaguga

SEQ ID NO: 1022509 - RNA, 25 nt, Human
acucuguugcccaggcuggagugca

SEQ ID NO: 1022510 - RNA, 24 nt, Human
acuguacuccagccugggugacag

SEQ ID NO: 1022511 - RNA, 26 nt, Human
acuguacuccagccugggugacagag

SEQ ID NO: 1022512 - RNA, 23 nt, Human
agaauaacaaaauucacuugccu

SEQ ID NO: 1022513 - RNA, 22 nt, Human
agacaggacacagguuacaggg

SEQ ID NO: 1022514 - RNA, 18 nt, Human
agacauacguggcagugu

SEQ ID NO: 1022515 - RNA, 25 nt, Human
agaggaagaucugcuucuucaaacc

SEQ ID NO: 1022516 - RNA, 24 nt, Human
agccugggugacagagugagaacu

SEQ ID NO: 1022517 - RNA, 24 nt, Human
agcgauucucuugccucagccucc

SEQ ID NO: 1022518 - RNA, 24 nt, Human
aggucaagguugcagugagccaug

SEQ ID NO: 1022519 - RNA, 24 nt, Human
aguggcacacaccuauagucccag

SEQ ID NO: 1022520 - RNA, 26 nt, Human
aucaaccuccccaccucaauaaccuu

SEQ ID NO: 1022521 - RNA, 24 nt, Human
aucaugccacuguacuccagccug

SEQ ID NO: 1022522 - RNA, 23 nt, Human
augaaaacaaacuuuggugaaug

SEQ ID NO: 1022523 - RNA, 22 nt, Human
augccacuguacuccagccugg

SEQ ID NO: 1022524 - RNA, 22 nt, Human
caaaaacaaaaaaagagaggaa

SEQ ID NO: 1022525 - RNA, 21 nt, Human
caaccuccccaccucaauaac

SEQ ID NO: 1022526 - RNA, 22 nt, Human
caagcgauucucuugccucagc

SEQ ID NO: 1022527 - RNA, 27 nt, Human
caagcgauucucuugccucagccuccc

SEQ ID NO: 1022528 - RNA, 22 nt, Human
cacacaauaagcccugaacaga

SEQ ID NO: 1022529 - RNA, 24 nt, Human
cacacaauaagcccugaacagaga

SEQ ID NO: 1022530 - RNA, 24 nt, Human
cacaccaccaugcccggcuaauuu

SEQ ID NO: 1022531 - RNA, 19 nt, Human
cacaccuauagucccagcu

SEQ ID NO: 1022532 - RNA, 20 nt, Human
cacagaggugaacuggucac

SEQ ID NO: 1022533 - RNA, 22 nt, Human
caccccccgccgcggcgcggcc

SEQ ID NO: 1022534 - RNA, 23 nt, Human
caccccccgccgcggcgcggccc

SEQ ID NO: 1022535 - RNA, 23 nt, Human
caccuauagucccagcuacucgg

SEQ ID NO: 1022536 - RNA, 24 nt, Human
caccuauagucccagcuacucggg

SEQ ID NO: 1022537 - RNA, 22 nt, Human
caccuaugccuuaaaucgcgag

SEQ ID NO: 1022538 - RNA, 21 nt, Human
cacuaacgguaacugacaauc

SEQ ID NO: 1022539 - RNA, 24 nt, Human
cacucuguugcccaggcuggagug

SEQ ID NO: 1022540 - RNA, 19 nt, Human
cacuguacuccagccuggg

SEQ ID NO: 1022541 - RNA, 19 nt, Human
cacuguacuccagccuggg

SEQ ID NO: 1022542 - RNA, 21 nt, Human
cacuguacuccagccugggug

SEQ ID NO: 1022543 - RNA, 22 nt, Human
cacuguacuccagccuggguga

SEQ ID NO: 1022544 - RNA, 23 nt, Human
cacuguacuccagccugggugac

SEQ ID NO: 1022545 - RNA, 24 nt, Human
cacuguacuccagccugggugaca

SEQ ID NO: 1022546 - RNA, 24 nt, Human
cacuguacuccagccugggugaca

SEQ ID NO: 1022547 - RNA, 18 nt, Human
cagagcccaccuucccgc

SEQ ID NO: 1022548 - RNA, 22 nt, Human
caucaggaucaugaaaacaaac

SEQ ID NO: 1022549 - RNA, 22 nt, Human
ccacucuguugcccaggcugga

SEQ ID NO: 1022550 - RNA, 24 nt, Human
ccacucuguugcccaggcuggagu

SEQ ID NO: 1022551 - RNA, 20 nt, Human
ccacuguacuccagccuggg

SEQ ID NO: 1022552 - RNA, 20 nt, Human
ccacuguacuccagccuggg

SEQ ID NO: 1022553 - RNA, 21 nt, Human
ccacuguacuccagccugggu

SEQ ID NO: 1022554 - RNA, 21 nt, Human
ccacuguacuccagccugggu

SEQ ID NO: 1022555 - RNA, 23 nt, Human
ccacuguacuccagccuggguga

SEQ ID NO: 1022556 - RNA, 24 nt, Human
ccacuguacuccagccugggugac

SEQ ID NO: 1022557 - RNA, 20 nt, Human
ccagacaggacacagguuac

SEQ ID NO: 1022558 - RNA, 19 nt, Human
ccagagcccaccuucccgc

SEQ ID NO: 1022559 - RNA, 18 nt, Human
ccaguggggugggggaag

SEQ ID NO: 1022560 - RNA, 24 nt, Human
ccaguuucaagcgauucucuugcc

SEQ ID NO: 1022561 - RNA, 23 nt, Human
cccaaguagcugggacuacaggu

SEQ ID NO: 1022562 - RNA, 24 nt, Human
cccaaguagcugggacuacaggua

SEQ ID NO: 1022563 - RNA, 21 nt, Human
cccacacaacuaauauaaagu

SEQ ID NO: 1022564 - RNA, 23 nt, Human
cccccgccgcggcgcggcccagg

SEQ ID NO: 1022565 - RNA, 22 nt, Human
cccgcacgccuggcgacuccca

SEQ ID NO: 1022566 - RNA, 20 nt, Human
ccgacugcggcccccuccuc

SEQ ID NO: 1022567 - RNA, 21 nt, Human
ccuauagucccagcuacucgg

SEQ ID NO: 1022568 - RNA, 24 nt, Human
ccucccaguuucaagcgauucucu

SEQ ID NO: 1022569 - RNA, 19 nt, Human
ccucccggcugcuccccgc

SEQ ID NO: 1022570 - RNA, 21 nt, Human
ccucgccugcccucuuccucc

SEQ ID NO: 1022571 - RNA, 20 nt, Human
ccugaaguuaaacaucacac

SEQ ID NO: 1022572 - RNA, 22 nt, Human
ccugggugacagagugagaacu

SEQ ID NO: 1022573 - RNA, 23 nt, Human
cggcggcggcuccguccccggcu

SEQ ID NO: 1022574 - RNA, 24 nt, Human
cgucuguccuccccuuccuucucc

SEQ ID NO: 1022575 - RNA, 24 nt, Human
cuaggggcaacggcggcggcuccu

SEQ ID NO: 1022576 - RNA, 21 nt, Human
cuauagucccagcuacucggg

SEQ ID NO: 1022577 - RNA, 24 nt, Human
cuaucugcuaauuaaaaugcuaaa

SEQ ID NO: 1022578 - RNA, 18 nt, Human
cucaaaaacaaaaaaaga

SEQ ID NO: 1022579 - RNA, 19 nt, Human
cucaaaaacaaaaaaagag

SEQ ID NO: 1022580 - RNA, 21 nt, Human
cucacuccaaccccugccucc

SEQ ID NO: 1022581 - RNA, 24 nt, Human
cucagccucccaaguagcugggac

SEQ ID NO: 1022582 - RNA, 22 nt, Human
cuccucccggcugcuccccgcu

SEQ ID NO: 1022583 - RNA, 23 nt, Human
cuccucccggcugcuccccgcua

SEQ ID NO: 1022584 - RNA, 19 nt, Human
cucgccugcccucuuccuc

SEQ ID NO: 1022585 - RNA, 21 nt, Human
cugcccucuuccuccaccccc

SEQ ID NO: 1022586 - RNA, 23 nt, Human
cuugccucagccucccaaguagc

SEQ ID NO: 1022587 - RNA, 21 nt, Human
cuugucucaaaaacaaaaaaa

SEQ ID NO: 1022588 - RNA, 24 nt, Human
cuugucucaaaaacaaaaaaagag

SEQ ID NO: 1022589 - RNA, 24 nt, Human
cuuuggugaaugugagcaacugcg

SEQ ID NO: 1022590 - RNA, 23 nt, Human
cuuuuuuuuuuuuuuuuugcgau

SEQ ID NO: 1022591 - RNA, 20 nt, Human
cuuuuuuuuuuuuuuuuugg

SEQ ID NO: 1022592 - RNA, 24 nt, Human
gacagagugagaacuugucucaaa

SEQ ID NO: 1022593 - RNA, 22 nt, Human
gacuacagguacacaccaccau

SEQ ID NO: 1022594 - RNA, 18 nt, Human
gacugcggcccccuccuc

SEQ ID NO: 1022595 - RNA, 20 nt, Human
gagaggaagaucugcuucuu

SEQ ID NO: 1022596 - RNA, 21 nt, Human
gaucugcuucuucaaacccac

SEQ ID NO: 1022597 - RNA, 21 nt, Human
gcaacggcggcggcuccgucc

SEQ ID NO: 1022598 - RNA, 19 nt, Human
gccacuguacuccagccug

SEQ ID NO: 1022599 - RNA, 24 nt, Human
gccacuguacuccagccuggguga

SEQ ID NO: 1022600 - RNA, 21 nt, Human
gcccaggcuggagugcagugu

SEQ ID NO: 1022601 - RNA, 19 nt, Human
gcccccuccucccggcugc

SEQ ID NO: 1022602 - RNA, 23 nt, Human
gccucgccugcccucuuccucca

SEQ ID NO: 1022603 - RNA, 24 nt, Human
gccugggaggucaagguugcagug

SEQ ID NO: 1022604 - RNA, 24 nt, Human
gcgauucucuugccucagccuccc

SEQ ID NO: 1022605 - RNA, 21 nt, Human
gcggccagagcccaccuuccc

SEQ ID NO: 1022606 - RNA, 19 nt, Human
gcucacuccaaccccugcc

SEQ ID NO: 1022607 - RNA, 23 nt, Human
ggcccccuccucccggcugcucc

SEQ ID NO: 1022608 - RNA, 24 nt, Human
ggcgcggcccaggccucucccccg

SEQ ID NO: 1022609 - RNA, 19 nt, Human
gggaggcugaagugggaag

SEQ ID NO: 1022610 - RNA, 21 nt, Human
gggaggcugaagugggaagau

SEQ ID NO: 1022611 - RNA, 18 nt, Human
ggguccccucucccgacu

SEQ ID NO: 1022612 - RNA, 23 nt, Human
guacuccagccugggugacagag

SEQ ID NO: 1022613 - RNA, 24 nt, Human
guacuccagccugggugacagagu

SEQ ID NO: 1022614 - RNA, 24 nt, Human
guccacucuguugcccaggcugga

SEQ ID NO: 1022615 - RNA, 21 nt, Human
gugaacuggucacuucuaauu

SEQ ID NO: 1022616 - RNA, 19 nt, Human
gugaaugugagcaacugcg

SEQ ID NO: 1022617 - RNA, 27 nt, Human
uaaaagaagaagaaacaguggacagga

SEQ ID NO: 1022618 - RNA, 21 nt, Human
uaaaaugcuaaaagaagaaga

SEQ ID NO: 1022619 - RNA, 20 nt, Human
uaagaagagccaguggggug

SEQ ID NO: 1022620 - RNA, 23 nt, Human
uacagguacacaccaccaugccc

SEQ ID NO: 1022621 - RNA, 22 nt, Human
uacuccagccugggugacagag

SEQ ID NO: 1022622 - RNA, 24 nt, Human
uacuccagccugggugacagagug

SEQ ID NO: 1022623 - RNA, 19 nt, Human
uagcugggcauaguggcac

SEQ ID NO: 1022624 - RNA, 23 nt, Human
uaguggcacacaccuauaguccc

SEQ ID NO: 1022625 - RNA, 22 nt, Human
uauaaaguaaucaaccucccca

SEQ ID NO: 1022626 - RNA, 25 nt, Human
ucagaauaacaaaauucacuugccu

SEQ ID NO: 1022627 - RNA, 18 nt, Human
ucagccucccaaguagcu

SEQ ID NO: 1022628 - RNA, 20 nt, Human
ucagccucccaaguagcugg

SEQ ID NO: 1022629 - RNA, 23 nt, Human
ucaugccacuguacuccagccug

SEQ ID NO: 1022630 - RNA, 23 nt, Human
uccacucuguugcccaggcugga

SEQ ID NO: 1022631 - RNA, 23 nt, Human
uccagccugggugacagagugag

SEQ ID NO: 1022632 - RNA, 24 nt, Human
uccagccugggugacagagugaga

SEQ ID NO: 1022633 - RNA, 24 nt, Human
ucccaaguagcugggacuacaggu

SEQ ID NO: 1022634 - RNA, 21 nt, Human
ucccaguuucaagcgauucuc

SEQ ID NO: 1022635 - RNA, 18 nt, Human
ucucaaaaacaaaaaaag

SEQ ID NO: 1022636 - RNA, 19 nt, Human
ucugcuaauuaaaaugcua

SEQ ID NO: 1022637 - RNA, 18 nt, Human
ucuguugcccaggcugga

SEQ ID NO: 1022638 - RNA, 24 nt, Human
ucuguugcccaggcuggagugcag

SEQ ID NO: 1022639 - RNA, 26 nt, Human
ucuugccucagccucccaaguagcug

SEQ ID NO: 1022640 - RNA, 25 nt, Human
ugaaaacacuuuuuuuuuuuuuuuu

SEQ ID NO: 1022641 - RNA, 25 nt, Human
ugaacagagagcuguaggucaaugu

SEQ ID NO: 1022642 - RNA, 22 nt, Human
ugagaacacuuuuuuguacuau

SEQ ID NO: 1022643 - RNA, 24 nt, Human
ugagccugggaggucaagguugca

SEQ ID NO: 1022644 - RNA, 22 nt, Human
ugcagugagccaugaucaugcc

SEQ ID NO: 1022645 - RNA, 18 nt, Human
ugcccaggcuggagugca

SEQ ID NO: 1022646 - RNA, 21 nt, Human
ugcccaggcuggagugcagug

SEQ ID NO: 1022647 - RNA, 22 nt, Human
ugccucagccucccaaguagcu

SEQ ID NO: 1022648 - RNA, 24 nt, Human
ugccucagccucccaaguagcugg

SEQ ID NO: 1022649 - RNA, 21 nt, Human
ugcgauggaguccacucuguu

SEQ ID NO: 1022650 - RNA, 24 nt, Human
ugcggcccccuccucccggcugcu

SEQ ID NO: 1022651 - RNA, 22 nt, Human
ugcuaaaagaagaagaaacagu

SEQ ID NO: 1022652 - RNA, 19 nt, Human
uggaaagaaccacuagaug

SEQ ID NO: 1022653 - RNA, 21 nt, Human
uggaauggacccuacugcuga

SEQ ID NO: 1022654 - RNA, 24 nt, Human
uggagugcagugucacaguccugg

SEQ ID NO: 1022655 - RNA, 21 nt, Human
ugggacuacagguacacacca

SEQ ID NO: 1022656 - RNA, 22 nt, Human
ugggacuacagguacacaccac

SEQ ID NO: 1022657 - RNA, 24 nt, Human
ugggacuacagguacacaccacca

SEQ ID NO: 1022658 - RNA, 21 nt, Human
ugggaggucaagguugcagug

SEQ ID NO: 1022659 - RNA, 24 nt, Human
ugggaggucaagguugcagugagc

SEQ ID NO: 1022660 - RNA, 19 nt, Human
ugggguccccucucccgac

SEQ ID NO: 1022661 - RNA, 22 nt, Human
uggggugggggaagcugaaaac

SEQ ID NO: 1022662 - RNA, 20 nt, Human
uggugaaugugagcaacugc

SEQ ID NO: 1022663 - RNA, 21 nt, Human
ugugaacgucuguccuccccu

SEQ ID NO: 1022664 - RNA, 25 nt, Human
ugugaacgucuguccuccccuuccu

SEQ ID NO: 1022665 - RNA, 18 nt, Human
uuagcugggcauaguggc

SEQ ID NO: 1022666 - RNA, 22 nt, Human
uucaaaaggacacagaggugaa

SEQ ID NO: 1022667 - RNA, 19 nt, Human
uucaaacccacacaacuaa

SEQ ID NO: 1022668 - RNA, 27 nt, Human
uucaaacccacacaacuaauauaaagu

SEQ ID NO: 1022669 - RNA, 23 nt, Human
uucaagcgauucucuugccucag

SEQ ID NO: 1022670 - RNA, 20 nt, Human
uucagaauaacaaaauucac

SEQ ID NO: 1022671 - RNA, 24 nt, Human
uugcagugagccaugaucaugcca

SEQ ID NO: 1022672 - RNA, 24 nt, Human
uugcccaggcuggagugcaguguc

SEQ ID NO: 1022673 - RNA, 22 nt, Human
uuuuuuuuuuuuuugcgaugga

SEQ ID NO: 1022674 - RNA, 22 nt, Human
aaaaacacaucagugaacccag

SEQ ID NO: 1022675 - RNA, 18 nt, Human
aaaacuauuauggcauca

SEQ ID NO: 1022676 - RNA, 25 nt, Human
aaagccuuuucagauugguuuucac

SEQ ID NO: 1022677 - RNA, 21 nt, Human
aaccacacacacacacauaca

SEQ ID NO: 1022678 - RNA, 25 nt, Human
aacccuuuccccucccaucuuccac

SEQ ID NO: 1022679 - RNA, 21 nt, Human
aagcgcguagacccuugaaau

SEQ ID NO: 1022680 - RNA, 21 nt, Human
aaggaauugguccauuuuagc

SEQ ID NO: 1022681 - RNA, 19 nt, Human
aagugcugggauuacaggc

SEQ ID NO: 1022682 - RNA, 21 nt, Human
aagugcugggauuacaggcau

SEQ ID NO: 1022683 - RNA, 23 nt, Human
aagugcugggauuacaggcauga

SEQ ID NO: 1022684 - RNA, 18 nt, Human
aaguucuccuguauuccu

SEQ ID NO: 1022685 - RNA, 25 nt, Human
acacacacauacacguacacacaca

SEQ ID NO: 1022686 - RNA, 21 nt, Human
acaguggcacaaucucagcuc

SEQ ID NO: 1022687 - RNA, 22 nt, Human
acauauauaagucuuuugaacu

SEQ ID NO: 1022688 - RNA, 19 nt, Human
accagcaagguaacaucga

SEQ ID NO: 1022689 - RNA, 19 nt, Human
accaguuuuggguuuuauc

SEQ ID NO: 1022690 - RNA, 24 nt, Human
accauguugaccaggcuggucucg

SEQ ID NO: 1022691 - RNA, 23 nt, Human
acccagcugguccuggcacuuug

SEQ ID NO: 1022692 - RNA, 24 nt, Human
accuugugauccacccgccucagc

SEQ ID NO: 1022693 - RNA, 19 nt, Human
acugcaacauccaccuccc

SEQ ID NO: 1022694 - RNA, 19 nt, Human
agaaagggaguaacaugga

SEQ ID NO: 1022695 - RNA, 23 nt, Human
agacaacucugaagauacagccc

SEQ ID NO: 1022696 - RNA, 20 nt, Human
agauacagcccacucccucg

SEQ ID NO: 1022697 - RNA, 19 nt, Human
aggcaugaaccacuguacc

SEQ ID NO: 1022698 - RNA, 18 nt, Human
aggggguuucaccauguu

SEQ ID NO: 1022699 - RNA, 19 nt, Human
aggggguuucaccauguug

SEQ ID NO: 1022700 - RNA, 24 nt, Human
aggggguuucaccauguugaccag

SEQ ID NO: 1022701 - RNA, 21 nt, Human
agguucaagugauucuucugc

SEQ ID NO: 1022702 - RNA, 22 nt, Human
agguucaagugauucuucugcc

SEQ ID NO: 1022703 - RNA, 18 nt, Human
agguuuuaacaugaaugg

SEQ ID NO: 1022704 - RNA, 19 nt, Human
aguacaaugcugaaaagca

SEQ ID NO: 1022705 - RNA, 25 nt, Human
agucucuaucuaccagcaagguaac

SEQ ID NO: 1022706 - RNA, 24 nt, Human
agugauucuucugccucagccucc

SEQ ID NO: 1022707 - RNA, 18 nt, Human
agugcugggauuacaggc

SEQ ID NO: 1022708 - RNA, 19 nt, Human
agugcugggauuacaggca

SEQ ID NO: 1022709 - RNA, 21 nt, Human
aguguaaauucuaacauaacc

SEQ ID NO: 1022710 - RNA, 24 nt, Human
auagaauaucacuuccuaacaaaa

SEQ ID NO: 1022711 - RNA, 18 nt, Human
aucaaggauaauguuagc

SEQ ID NO: 1022712 - RNA, 25 nt, Human
aucauguuacuugugaacaaaguug

SEQ ID NO: 1022713 - RNA, 26 nt, Human
aucccuccuuuccccucaacucucag

SEQ ID NO: 1022714 - RNA, 26 nt, Human
caaaaccugagaaaaacaaaaggaaa

SEQ ID NO: 1022715 - RNA, 22 nt, Human
caagugauucuucugccucagc

SEQ ID NO: 1022716 - RNA, 19 nt, Human
cacaccagcuugauucugg

SEQ ID NO: 1022717 - RNA, 21 nt, Human
caccauguugaccaggcuggu

SEQ ID NO: 1022718 - RNA, 24 nt, Human
caccauguugaccaggcuggucuc

SEQ ID NO: 1022719 - RNA, 27 nt, Human
caccauguugaccaggcuggucucgaa

SEQ ID NO: 1022720 - RNA, 23 nt, Human
cacccgccucagccucccaaagu

SEQ ID NO: 1022721 - RNA, 21 nt, Human
cacugcaacauccaccuccca

SEQ ID NO: 1022722 - RNA, 19 nt, Human
cagcccacucccucgucgg

SEQ ID NO: 1022723 - RNA, 18 nt, Human
cagcccugggcagcccug

SEQ ID NO: 1022724 - RNA, 20 nt, Human
cagccuccugaguagcuucg

SEQ ID NO: 1022725 - RNA, 20 nt, Human
caucaaacucaaaacauaac

SEQ ID NO: 1022726 - RNA, 18 nt, Human
caucaaggauaauguuag

SEQ ID NO: 1022727 - RNA, 23 nt, Human
caugaaccacuguaccuggccuu

SEQ ID NO: 1022728 - RNA, 24 nt, Human
cauguugaccaggcuggucucgaa

SEQ ID NO: 1022729 - RNA, 19 nt, Human
cauucugucacccaggcug

SEQ ID NO: 1022730 - RNA, 30 nt, Human
ccaaagugaagugcugggauuacaggcauu

SEQ ID NO: 1022731 - RNA, 18 nt, Human
ccacacacacacacauac

SEQ ID NO: 1022732 - RNA, 19 nt, Human
ccacccgccucagccuccc

SEQ ID NO: 1022733 - RNA, 18 nt, Human
ccacuuauacauauauaa

SEQ ID NO: 1022734 - RNA, 18 nt, Human
ccagaucccugucugggg

SEQ ID NO: 1022735 - RNA, 20 nt, Human
cccaggcugcaguacagugg

SEQ ID NO: 1022736 - RNA, 22 nt, Human
cccagguucaagugauucuucu

SEQ ID NO: 1022737 - RNA, 23 nt, Human
cccagguucaagugauucuucug

SEQ ID NO: 1022738 - RNA, 22 nt, Human
cccuccuuuccccucaacucuc

SEQ ID NO: 1022739 - RNA, 24 nt, Human
cccugggcuguaugugugggccuu

SEQ ID NO: 1022740 - RNA, 20 nt, Human
cccuugaaaucccgggaccg

SEQ ID NO: 1022741 - RNA, 22 nt, Human
ccucacaaaaugaguugggaag

SEQ ID NO: 1022742 - RNA, 24 nt, Human
ccucccagguucaagugauucuuc

SEQ ID NO: 1022743 - RNA, 20 nt, Human
ccugaccuugugauccaccc

SEQ ID NO: 1022744 - RNA, 20 nt, Human
ccugagaaaaacaaaaggaa

SEQ ID NO: 1022745 - RNA, 23 nt, Human
ccugcaauccugcuguaauugcu

SEQ ID NO: 1022746 - RNA, 19 nt, Human
ccuuucacuggcucaauag

SEQ ID NO: 1022747 - RNA, 20 nt, Human
cgcaaaaccugagaaaaaca

SEQ ID NO: 1022748 - RNA, 30 nt, Human
cgccucagccucccaaagugaagugcuggg

SEQ ID NO: 1022749 - RNA, 22 nt, Human
cggagacaacucugaagauaca

SEQ ID NO: 1022750 - RNA, 24 nt, Human
cucacugcaacauccaccucccag

SEQ ID NO: 1022751 - RNA, 26 nt, Human
cuccagccucaacccuccucuucaua

SEQ ID NO: 1022752 - RNA, 18 nt, Human
cucccacgcaaaaccugg

SEQ ID NO: 1022753 - RNA, 19 nt, Human
cucccagguucaagugauu

SEQ ID NO: 1022754 - RNA, 24 nt, Human
cuccugaccuugugauccacccgc

SEQ ID NO: 1022755 - RNA, 22 nt, Human
cugaaggcuggaauguucacau

SEQ ID NO: 1022756 - RNA, 23 nt, Human
cugcaacauccaccucccagguu

SEQ ID NO: 1022757 - RNA, 23 nt, Human
cugccucagccuccugaguagcu

SEQ ID NO: 1022758 - RNA, 18 nt, Human
cuggcucaauaguuuugc

SEQ ID NO: 1022759 - RNA, 21 nt, Human
gaaaucccgggaccgccuccc

SEQ ID NO: 1022760 - RNA, 24 nt, Human
gaagugcugggauuacaggcauga

SEQ ID NO: 1022761 - RNA, 22 nt, Human
gaccuugugauccacccgccuc

SEQ ID NO: 1022762 - RNA, 24 nt, Human
gaccuugugauccacccgccucag

SEQ ID NO: 1022763 - RNA, 20 nt, Human
gacggagacaacucugaaga

SEQ ID NO: 1022764 - RNA, 18 nt, Human
gagaaaaacaaaaggaaa

SEQ ID NO: 1022765 - RNA, 22 nt, Human
gauaugaucguauuucaucuuu

SEQ ID NO: 1022766 - RNA, 21 nt, Human
gauuacaggcaugaaccacug

SEQ ID NO: 1022767 - RNA, 24 nt, Human
gauuacaggcaugaaccacuguac

SEQ ID NO: 1022768 - RNA, 26 nt, Human
gcaaaaccugagaaaaaccgggacgu

SEQ ID NO: 1022769 - RNA, 22 nt, Human
gcaacauccaccucccagguuc

SEQ ID NO: 1022770 - RNA, 22 nt, Human
gcauucgccauagaaaagcgcg

SEQ ID NO: 1022771 - RNA, 23 nt, Human
gcccagcuaauuuuuuguauuuu

SEQ ID NO: 1022772 - RNA, 22 nt, Human
gcccugucuuggagagcagcug

SEQ ID NO: 1022773 - RNA, 19 nt, Human
gcugaaaagcaguggugug

SEQ ID NO: 1022774 - RNA, 24 nt, Human
ggaaagacggagacaacucugaag

SEQ ID NO: 1022775 - RNA, 23 nt, Human
ggcuggucucgaacuccugaccu

SEQ ID NO: 1022776 - RNA, 18 nt, Human
gggaugggccugauaaug

SEQ ID NO: 1022777 - RNA, 22 nt, Human
gggguuucaccauguugaccag

SEQ ID NO: 1022778 - RNA, 23 nt, Human
gggguuucaccauguugaccagg

SEQ ID NO: 1022779 - RNA, 22 nt, Human
ggguuucaccauguugaccagg

SEQ ID NO: 1022780 - RNA, 19 nt, Human
gguaggaagagaaagggag

SEQ ID NO: 1022781 - RNA, 20 nt, Human
ggucucgaacuccugaccuu

SEQ ID NO: 1022782 - RNA, 19 nt, Human
guccaauuccuuuuuauca

SEQ ID NO: 1022783 - RNA, 24 nt, Human
gugauccacccgccucagccuccc

SEQ ID NO: 1022784 - RNA, 24 nt, Human
gugauucuucugccucagccuccu

SEQ ID NO: 1022785 - RNA, 19 nt, Human
gugcugggauuacaggcau

SEQ ID NO: 1022786 - RNA, 18 nt, Human
guuaucucugcuuuuauu

SEQ ID NO: 1022787 - RNA, 25 nt, Human
guuccugaucuuaguaggaaagugu

SEQ ID NO: 1022788 - RNA, 19 nt, Human
guugcagaaagcguguggu

SEQ ID NO: 1022789 - RNA, 22 nt, Human
uaauuuuuuguauuuuuaguag

SEQ ID NO: 1022790 - RNA, 23 nt, Human
uaauuuuuuguauuuuuaguaga

SEQ ID NO: 1022791 - RNA, 18 nt, Human
uacaaaaagggaacuacu

SEQ ID NO: 1022792 - RNA, 25 nt, Human
uacacacacacacagagugcaugca

SEQ ID NO: 1022793 - RNA, 22 nt, Human
uacacacgcaugccaccaugcc

SEQ ID NO: 1022794 - RNA, 22 nt, Human
uacaggcaugaaccacuguacc

SEQ ID NO: 1022795 - RNA, 23 nt, Human
uacauuauuauuaacugaagucc

SEQ ID NO: 1022796 - RNA, 21 nt, Human
uaccuuaaguaucucaaaaac

SEQ ID NO: 1022797 - RNA, 20 nt, Human
uagaauaucacuuccuaaca

SEQ ID NO: 1022798 - RNA, 19 nt, Human
uagcuucgacuacacacgc

SEQ ID NO: 1022799 - RNA, 24 nt, Human
uaguagauaggggguuucaccaug

SEQ ID NO: 1022800 - RNA, 20 nt, Human
uauaacccuuuccccuccca

SEQ ID NO: 1022801 - RNA, 24 nt, Human
uauacauuauccuuagaggaaguu

SEQ ID NO: 1022802 - RNA, 22 nt, Human
uauagcacuuccaguacaaugc

SEQ ID NO: 1022803 - RNA, 18 nt, Human
uaucaauaaaagccccac

SEQ ID NO: 1022804 - RNA, 18 nt, Human
uauuaggguaauacuggc

SEQ ID NO: 1022805 - RNA, 18 nt, Human
uauuaggguaauacuggc

SEQ ID NO: 1022806 - RNA, 18 nt, Human
ucaaaagucugagggccc

SEQ ID NO: 1022807 - RNA, 27 nt, Human
ucaacccuccucuucauauucucaaaa

SEQ ID NO: 1022808 - RNA, 19 nt, Human
ucaagugauucuucugccu

SEQ ID NO: 1022809 - RNA, 24 nt, Human
ucacugcaacauccaccucccagg

SEQ ID NO: 1022810 - RNA, 21 nt, Human
uccacccgccucagccuccca

SEQ ID NO: 1022811 - RNA, 22 nt, Human
uccagggcccugucuuggagag

SEQ ID NO: 1022812 - RNA, 30 nt, Human
ucccaaagugaagugcugggauuacaggcc

SEQ ID NO: 1022813 - RNA, 20 nt, Human
ucccagguucaagugauucu

SEQ ID NO: 1022814 - RNA, 24 nt, Human
ucccagguucaagugauucuucug

SEQ ID NO: 1022815 - RNA, 24 nt, Human
ucccaucuuccacaggcuccccaa

SEQ ID NO: 1022816 - RNA, 19 nt, Human
ucccuccuuuccccucaac

SEQ ID NO: 1022817 - RNA, 23 nt, Human
ucccuccuuuccccucaacucuc

SEQ ID NO: 1022818 - RNA, 21 nt, Human
uccucaguguaaauucuaaca

SEQ ID NO: 1022819 - RNA, 19 nt, Human
uccuggcacuuuguuuugg

SEQ ID NO: 1022820 - RNA, 22 nt, Human
ucuaacauaaccuuauuugcau

SEQ ID NO: 1022821 - RNA, 19 nt, Human
ucucauucugucacccagg

SEQ ID NO: 1022822 - RNA, 22 nt, Human
ucucauucugucacccaggcug

SEQ ID NO: 1022823 - RNA, 23 nt, Human
ucucauucugucacccaggcugc

SEQ ID NO: 1022824 - RNA, 24 nt, Human
ucucauucugucacccaggcugca

SEQ ID NO: 1022825 - RNA, 19 nt, Human
ucugaagauacagcccacu

SEQ ID NO: 1022826 - RNA, 19 nt, Human
ucugucacccaggcugcag

SEQ ID NO: 1022827 - RNA, 24 nt, Human
ucugucacccaggcugcaguacag

SEQ ID NO: 1022828 - RNA, 18 nt, Human
ucuguguuuuccguucac

SEQ ID NO: 1022829 - RNA, 21 nt, Human
ucuuggacuugaccauauacu

SEQ ID NO: 1022830 - RNA, 22 nt, Human
ugaaaugacaguccaacagccc

SEQ ID NO: 1022831 - RNA, 22 nt, Human
ugaacccagcugguccuggcac

SEQ ID NO: 1022832 - RNA, 21 nt, Human
ugaagauacagcccacucccu

SEQ ID NO: 1022833 - RNA, 20 nt, Human
ugaauaucaaauguugaaca

SEQ ID NO: 1022834 - RNA, 24 nt, Human
ugaauggauauuggauuuugucaa

SEQ ID NO: 1022835 - RNA, 24 nt, Human
ugaccaggcuggucucgaacuccu

SEQ ID NO: 1022836 - RNA, 22 nt, Human
ugagaaaaacaaaaggaaaggc

SEQ ID NO: 1022837 - RNA, 25 nt, Human
ugccucagccuccugaguagcuucg

SEQ ID NO: 1022838 - RNA, 23 nt, Human
ugcugggauuacaggcaugaacc

SEQ ID NO: 1022839 - RNA, 23 nt, Human
uggaagguuauuaauuacugcuu

SEQ ID NO: 1022840 - RNA, 22 nt, Human
uggaauguucacauauguaccc

SEQ ID NO: 1022841 - RNA, 20 nt, Human
uggaggcgagccuagaucuu

SEQ ID NO: 1022842 - RNA, 24 nt, Human
uggcacaaucucagcucacugcaa

SEQ ID NO: 1022843 - RNA, 18 nt, Human
uggccucuuucauuuuug

SEQ ID NO: 1022844 - RNA, 19 nt, Human
ugggaaguguuaucucugc

SEQ ID NO: 1022845 - RNA, 21 nt, Human
ugggauuacaggcaugaacca

SEQ ID NO: 1022846 - RNA, 22 nt, Human
ugggauuacaggcaugaaccac

SEQ ID NO: 1022847 - RNA, 22 nt, Human
ugggauuacaggcaugaaccac

SEQ ID NO: 1022848 - RNA, 23 nt, Human
ugggauuacaggcaugaaccacu

SEQ ID NO: 1022849 - RNA, 24 nt, Human
ugggauuacaggcaugaaccacug

SEQ ID NO: 1022850 - RNA, 24 nt, Human
ugggauuacaggcaugaaccacug

SEQ ID NO: 1022851 - RNA, 20 nt, Human
ugucuuuuaaugacuugaug

SEQ ID NO: 1022852 - RNA, 24 nt, Human
ugugauccacccgccucagccucc

SEQ ID NO: 1022853 - RNA, 24 nt, Human
uuaguagauaggggguuucaccau

SEQ ID NO: 1022854 - RNA, 25 nt, Human
uuaguagauaggggguuucaccaug

SEQ ID NO: 1022855 - RNA, 22 nt, Human
uuaugcccguauuaaccaucug

SEQ ID NO: 1022856 - RNA, 23 nt, Human
uucaagugauucuucugccucag

SEQ ID NO: 1022857 - RNA, 24 nt, Human
uucaagugauucuucugccucagc

SEQ ID NO: 1022858 - RNA, 21 nt, Human
uucacauauguacccuaggca

SEQ ID NO: 1022859 - RNA, 22 nt, Human
uucacuguuuuccauucucugc

SEQ ID NO: 1022860 - RNA, 18 nt, Human
uuccuaaaguggaagcuu

SEQ ID NO: 1022861 - RNA, 19 nt, Human
uucugguucugcuccagcc

SEQ ID NO: 1022862 - RNA, 25 nt, Human
uugaggauuucugcaucuguguuca

SEQ ID NO: 1022863 - RNA, 21 nt, Human
uuggauuuaauuugcucuucu

SEQ ID NO: 1022864 - RNA, 20 nt, Human
uuguucuuaagcuagcuaga

SEQ ID NO: 1022865 - RNA, 20 nt, Human
uuuaggguuucuccgugucu

SEQ ID NO: 1022866 - RNA, 19 nt, Human
uuuauaucacauaccacuu

SEQ ID NO: 1022867 - RNA, 24 nt, Human
uuucaccauguugaccaggcuggu

SEQ ID NO: 1022868 - RNA, 19 nt, Human
uuuccagggcccugucuug

SEQ ID NO: 1022869 - RNA, 24 nt, Human
uuucugcaucuguguucaauggaa

SEQ ID NO: 1022870 - RNA, 22 nt, Human
uuugaggauuucugcaucugug

SEQ ID NO: 1022871 - RNA, 24 nt, Human
uuuuuaguagauaggggguuucac

SEQ ID NO: 1022872 - RNA, 19 nt, Human
uuuuuguauuuuuaguaga

SEQ ID NO: 1022873 - RNA, 22 nt, Human
uuuuuuguauuuuuaguagaua

SEQ ID NO: 1022874 - RNA, 18 nt, Human
aaaaaacaaaagccguga

SEQ ID NO: 1022875 - RNA, 22 nt, Human
aaaaaaccaccaccauuaagua

SEQ ID NO: 1022876 - RNA, 22 nt, Human
aaaaacucuuuccacgcagccc

SEQ ID NO: 1022877 - RNA, 23 nt, Human
aaaacacagcaagaggacuugag

SEQ ID NO: 1022878 - RNA, 18 nt, Human
aaaagccugguauacagg

SEQ ID NO: 1022879 - RNA, 25 nt, Human
aaacaaaaauacaaaaugugaaaug

SEQ ID NO: 1022880 - RNA, 19 nt, Human
aaacccagagacauuggug

SEQ ID NO: 1022881 - RNA, 21 nt, Human
aaacggucagcaaaggcaggc

SEQ ID NO: 1022882 - RNA, 22 nt, Human
aaauacaaacagacacaaacaa

SEQ ID NO: 1022883 - RNA, 21 nt, Human
aaggauggaauguccucaugg

SEQ ID NO: 1022884 - RNA, 20 nt, Human
aauaaguaauaggaagucaa

SEQ ID NO: 1022885 - RNA, 24 nt, Human
acaaacaaaaauacaaaaugugaa

SEQ ID NO: 1022886 - RNA, 20 nt, Human
acacagcaagaggacuugag

SEQ ID NO: 1022887 - RNA, 28 nt, Human
acacagcacccucacuacaaguaguucu

SEQ ID NO: 1022888 - RNA, 20 nt, Human
acaccaaaauacaaacagac

SEQ ID NO: 1022889 - RNA, 21 nt, Human
acagcaagaggacuugagcac

SEQ ID NO: 1022890 - RNA, 26 nt, Human
accccaaaacggucagcaaaggcagg

SEQ ID NO: 1022891 - RNA, 23 nt, Human
agaaaagcacacacagcacccuc

SEQ ID NO: 1022892 - RNA, 18 nt, Human
agacacaucuccaauaca

SEQ ID NO: 1022893 - RNA, 23 nt, Human
agcaagaggacuugagcacaagc

SEQ ID NO: 1022894 - RNA, 22 nt, Human
agccccagcccuccccgagcag

SEQ ID NO: 1022895 - RNA, 21 nt, Human
agccccaguguacaaccuggu

SEQ ID NO: 1022896 - RNA, 20 nt, Human
aggaaaucugccacgcagca

SEQ ID NO: 1022897 - RNA, 18 nt, Human
aggaagucaauauaauau

SEQ ID NO: 1022898 - RNA, 23 nt, Human
aggacccccggccagccccagcc

SEQ ID NO: 1022899 - RNA, 23 nt, Human
agggacugguacaaaacccagag

SEQ ID NO: 1022900 - RNA, 19 nt, Human
agggggaggcgggccuggg

SEQ ID NO: 1022901 - RNA, 19 nt, Human
agggggaggcgggccuggg

SEQ ID NO: 1022902 - RNA, 23 nt, Human
agguccuggagggaaggaggagg

SEQ ID NO: 1022903 - RNA, 19 nt, Human
agugcuucugaaaacacag

SEQ ID NO: 1022904 - RNA, 24 nt, Human
agugggacacuguugguuuuaggg

SEQ ID NO: 1022905 - RNA, 23 nt, Human
aguuggaagcaguaagcugcguc

SEQ ID NO: 1022906 - RNA, 22 nt, Human
auacaaaaugugaaauguaauc

SEQ ID NO: 1022907 - RNA, 24 nt, Human
auccugaguguggagggggaggcg

SEQ ID NO: 1022908 - RNA, 21 nt, Human
aucugccacgcagcaaacacu

SEQ ID NO: 1022909 - RNA, 24 nt, Human
caaaacacaauauaagaucuaaaa

SEQ ID NO: 1022910 - RNA, 21 nt, Human
caaagccaggcggugcaccac

SEQ ID NO: 1022911 - RNA, 21 nt, Human
cacacagcacccucacuacaa

SEQ ID NO: 1022912 - RNA, 19 nt, Human
cacaccgugggaccuuugc

SEQ ID NO: 1022913 - RNA, 21 nt, Human
cacacgggcagguccuggagg

SEQ ID NO: 1022914 - RNA, 24 nt, Human
cacagaaaggaaacgcacaggcgc

SEQ ID NO: 1022915 - RNA, 18 nt, Human
cacagagaggcaggacgg

SEQ ID NO: 1022916 - RNA, 22 nt, Human
cacagcaccgcagugguggccu

SEQ ID NO: 1022917 - RNA, 24 nt, Human
caccaaaauacaaacagacacaaa

SEQ ID NO: 1022918 - RNA, 23 nt, Human
cacgcagcccugaagcucagcac

SEQ ID NO: 1022919 - RNA, 19 nt, Human
cacggccacagagaggcag

SEQ ID NO: 1022920 - RNA, 18 nt, Human
cagagaggcaggacggca

SEQ ID NO: 1022921 - RNA, 20 nt, Human
cagcccuccccgagcagcag

SEQ ID NO: 1022922 - RNA, 24 nt, Human
caggaaaagaaagaacaugugagu

SEQ ID NO: 1022923 - RNA, 21 nt, Human
caggacccccggccagcccca

SEQ ID NO: 1022924 - RNA, 24 nt, Human
caggcuagaaaaagagaguaaaaa

SEQ ID NO: 1022925 - RNA, 22 nt, Human
caguguacaaccuggucaggau

SEQ ID NO: 1022926 - RNA, 30 nt, Human
caugacaugucuuuucccuccacgccuccu

SEQ ID NO: 1022927 - RNA, 21 nt, Human
cauuuuguaagaaagucaguc

SEQ ID NO: 1022928 - RNA, 21 nt, Human
ccaaaacggucagcaaaggca

SEQ ID NO: 1022929 - RNA, 21 nt, Human
ccaaaauacaaacagacacaa

SEQ ID NO: 1022930 - RNA, 19 nt, Human
ccauguacuccuccacagg

SEQ ID NO: 1022931 - RNA, 24 nt, Human
cccaauaguagacacaucuccaau

SEQ ID NO: 1022932 - RNA, 19 nt, Human
ccccaaagccaggcggugc

SEQ ID NO: 1022933 - RNA, 21 nt, Human
ccccaaauaacaccaucccca

SEQ ID NO: 1022934 - RNA, 21 nt, Human
cccccaaagccaggcggugca

SEQ ID NO: 1022935 - RNA, 20 nt, Human
cccccaaauaacaccauccc

SEQ ID NO: 1022936 - RNA, 20 nt, Human
cccccggccagccccagccc

SEQ ID NO: 1022937 - RNA, 18 nt, Human
cccgcccccaaauaacac

SEQ ID NO: 1022938 - RNA, 20 nt, Human
ccgcagugguggccugugcc

SEQ ID NO: 1022939 - RNA, 23 nt, Human
ccgcccccaaauaacaccauccc

SEQ ID NO: 1022940 - RNA, 23 nt, Human
ccgggacccccaaagccaggcgg

SEQ ID NO: 1022941 - RNA, 20 nt, Human
ccuccgggacccccaaagcc

SEQ ID NO: 1022942 - RNA, 22 nt, Human
ccuccgggacccccaaagccag

SEQ ID NO: 1022943 - RNA, 20 nt, Human
ccugaguguggagggggagg

SEQ ID NO: 1022944 - RNA, 23 nt, Human
cgaacaagaacaggaaaucugcc

SEQ ID NO: 1022945 - RNA, 24 nt, Human
cggccagauggagcaggacauccu

SEQ ID NO: 1022946 - RNA, 20 nt, Human
cguggugucccugcccccuc

SEQ ID NO: 1022947 - RNA, 20 nt, Human
cuaaaaaaaaccaccaccau

SEQ ID NO: 1022948 - RNA, 19 nt, Human
cucagcacuccgggggguc

SEQ ID NO: 1022949 - RNA, 24 nt, Human
cucaggaaaagaaagaacauguga

SEQ ID NO: 1022950 - RNA, 19 nt, Human
cugcgcuguaccuggaguc

SEQ ID NO: 1022951 - RNA, 19 nt, Human
cugguacaaaacccagaga

SEQ ID NO: 1022952 - RNA, 22 nt, Human
cugguacaaaacccagagacau

SEQ ID NO: 1022953 - RNA, 23 nt, Human
cugguauacaggcuagaaaaaga

SEQ ID NO: 1022954 - RNA, 18 nt, Human
cuguaccuggaguccucc

SEQ ID NO: 1022955 - RNA, 18 nt, Human
cugugucccaaagcucag

SEQ ID NO: 1022956 - RNA, 23 nt, Human
gaaacuuggagacucaccgcaga

SEQ ID NO: 1022957 - RNA, 22 nt, Human
gaaagugaucgcuuugcaagga

SEQ ID NO: 1022958 - RNA, 24 nt, Human
gaaccgggggccaaugucaaaaaa

SEQ ID NO: 1022959 - RNA, 23 nt, Human
gacccccaaagccaggcggugca

SEQ ID NO: 1022960 - RNA, 25 nt, Human
gacccccggccagccccagcccucc

SEQ ID NO: 1022961 - RNA, 19 nt, Human
gagcagcagcggucaggga

SEQ ID NO: 1022962 - RNA, 22 nt, Human
gagcagcagcggucagggaagc

SEQ ID NO: 1022963 - RNA, 20 nt, Human
gaguccuccauguacuccuc

SEQ ID NO: 1022964 - RNA, 22 nt, Human
gccacagagaggcaggacggca

SEQ ID NO: 1022965 - RNA, 22 nt, Human
gccuaggcagaaacuuggagac

SEQ ID NO: 1022966 - RNA, 25 nt, Human
gcgggccuggguccugggcagggug

SEQ ID NO: 1022967 - RNA, 19 nt, Human
gcggggaaccccaaaacgg

SEQ ID NO: 1022968 - RNA, 23 nt, Human
ggaaaucccacacucuucagucc

SEQ ID NO: 1022969 - RNA, 21 nt, Human
ggaaccccaaaacggucagca

SEQ ID NO: 1022970 - RNA, 18 nt, Human
ggacccccggccagcccc

SEQ ID NO: 1022971 - RNA, 18 nt, Human
ggaguccuccauguacuc

SEQ ID NO: 1022972 - RNA, 22 nt, Human
ggauccagagcuugacagaaaa

SEQ ID NO: 1022973 - RNA, 20 nt, Human
gggaaccccaaaacggucag

SEQ ID NO: 1022974 - RNA, 18 nt, Human
gggcagguccuggaggga

SEQ ID NO: 1022975 - RNA, 20 nt, Human
gggggucuucacacgggcag

SEQ ID NO: 1022976 - RNA, 19 nt, Human
guagaaccgggggccaaug

SEQ ID NO: 1022977 - RNA, 24 nt, Human
guccuggagggaaggaggaggcca

SEQ ID NO: 1022978 - RNA, 21 nt, Human
uaagaaaagcacacacagcac

SEQ ID NO: 1022979 - RNA, 18 nt, Human
uaagaucuaaaaaaaacc

SEQ ID NO: 1022980 - RNA, 19 nt, Human
uaagcuaaucccgucacag

SEQ ID NO: 1022981 - RNA, 21 nt, Human
uacaaacagacacaaacaaaa

SEQ ID NO: 1022982 - RNA, 24 nt, Human
uacaaacagacacaaacaaaaaua

SEQ ID NO: 1022983 - RNA, 21 nt, Human
uagaaccgggggccaauguca

SEQ ID NO: 1022984 - RNA, 19 nt, Human
ucaaaaaacaaaagccgug

SEQ ID NO: 1022985 - RNA, 22 nt, Human
ucacagaaugagcuaaaauaag

SEQ ID NO: 1022986 - RNA, 18 nt, Human
ucagugggacacuguugg

SEQ ID NO: 1022987 - RNA, 25 nt, Human
uccacaggacccccggccagcccca

SEQ ID NO: 1022988 - RNA, 21 nt, Human
uccagagcuugacagaaaaau

SEQ ID NO: 1022989 - RNA, 18 nt, Human
ucccaaagcucagagagc

SEQ ID NO: 1022990 - RNA, 19 nt, Human
ucccaaagcucagagagcc

SEQ ID NO: 1022991 - RNA, 28 nt, Human
ucccaccgagcgauuacgagaaccucuu

SEQ ID NO: 1022992 - RNA, 18 nt, Human
uccccagaaaaaaaucaa

SEQ ID NO: 1022993 - RNA, 26 nt, Human
uccccgcccccaaauaacaccauccc

SEQ ID NO: 1022994 - RNA, 21 nt, Human
ucccugcccccuccccgcccc

SEQ ID NO: 1022995 - RNA, 28 nt, Human
uccugugucccaaagcucagagagcccc

SEQ ID NO: 1022996 - RNA, 24 nt, Human
ugaagcucagcacuccgggggguc

SEQ ID NO: 1022997 - RNA, 22 nt, Human
ugaaggcacagcaccgcagugg

SEQ ID NO: 1022998 - RNA, 19 nt, Human
ugacuccugcgcuguaccu

SEQ ID NO: 1022999 - RNA, 19 nt, Human
ugagauggacgugcucacc

SEQ ID NO: 1023000 - RNA, 18 nt, Human
ugcaaaguuggaagcagu

SEQ ID NO: 1023001 - RNA, 24 nt, Human
uggaauguccucauggugagugcu

SEQ ID NO: 1023002 - RNA, 19 nt, Human
uggagggaaggaggaggcc

SEQ ID NO: 1023003 - RNA, 18 nt, Human
uggagggggaggcgggcc

SEQ ID NO: 1023004 - RNA, 21 nt, Human
uggccugagagcagggacugg

SEQ ID NO: 1023005 - RNA, 19 nt, Human
uggguccugggcagggugg

SEQ ID NO: 1023006 - RNA, 22 nt, Human
uggguccugggcaggguggccu

SEQ ID NO: 1023007 - RNA, 19 nt, Human
ugguggguagcaaaggucu

SEQ ID NO: 1023008 - RNA, 21 nt, Human
ugguggguagcaaaggucugg

SEQ ID NO: 1023009 - RNA, 18 nt, Human
uguaaacaccaaaauaca

SEQ ID NO: 1023010 - RNA, 24 nt, Human
uguaaacaccaaaauacaaacaga

SEQ ID NO: 1023011 - RNA, 26 nt, Human
ugucaaaaaacaaaagccgugacucc

SEQ ID NO: 1023012 - RNA, 21 nt, Human
ugucacagaaugagcuaaaau

SEQ ID NO: 1023013 - RNA, 21 nt, Human
uuaagaaaagcacacacagca

SEQ ID NO: 1023014 - RNA, 19 nt, Human
uugcauuuucucaguuuuu

SEQ ID NO: 1023015 - RNA, 19 nt, Human
agggacagugaggggggcc

SEQ ID NO: 1023016 - RNA, 19 nt, Human
caggcaggcgggcgggcgg

SEQ ID NO: 1023017 - RNA, 23 nt, Human
cgaggaggucaauggguguuggc

SEQ ID NO: 1023018 - RNA, 25 nt, Human
cgggcaggcaggcaggcgggcgggc

SEQ ID NO: 1023019 - RNA, 27 nt, Human
cgggcgggcaggcaggcaggcgggccc

SEQ ID NO: 1023020 - RNA, 25 nt, Human
gagcgggcgggcaggcaggcaggcc

SEQ ID NO: 1023021 - RNA, 26 nt, Human
gaggaggucaauggguguuggcagcg

SEQ ID NO: 1023022 - RNA, 20 nt, Human
gagucgcgggccgggcgagc

SEQ ID NO: 1023023 - RNA, 19 nt, Human
gcgggccgggcgagcgagc

SEQ ID NO: 1023024 - RNA, 23 nt, Human
gcgggccgggcgagcgagcgggc

SEQ ID NO: 1023025 - RNA, 18 nt, Human
ggcagcgguaccagggac

SEQ ID NO: 1023026 - RNA, 23 nt, Human
gggaaaauuuacuuggagaaggc

SEQ ID NO: 1023027 - RNA, 24 nt, Human
gggccgggcgagcgagcgggcggg

SEQ ID NO: 1023028 - RNA, 19 nt, Human
ugaggggggcuuuccuggg

SEQ ID NO: 1023029 - RNA, 18 nt, Human
aagcaggcaggggccugu

SEQ ID NO: 1023030 - RNA, 23 nt, Human
agcuaucucacaaagccccaagg

SEQ ID NO: 1023031 - RNA, 27 nt, Human
ccacacaagucgacccuagcuaucuca

SEQ ID NO: 1023032 - RNA, 21 nt, Human
cuagaauccacacaagucgac

SEQ ID NO: 1023033 - RNA, 19 nt, Human
cucacaaagccccaaggcc

SEQ ID NO: 1023034 - RNA, 18 nt, Human
ggauagggucagcuccgu

SEQ ID NO: 1023035 - RNA, 21 nt, Human
uagauaaggaucuucaaauau

SEQ ID NO: 1023036 - RNA, 24 nt, Human
uauaaauauucuuagacugacuaa

SEQ ID NO: 1023037 - RNA, 25 nt, Human
ucagcuccguucuacuagaauccac

SEQ ID NO: 1023038 - RNA, 19 nt, Human
uccuuuuucagaaauaauu

SEQ ID NO: 1023039 - RNA, 18 nt, Human
ucggaggccucuauccaa

SEQ ID NO: 1023040 - RNA, 21 nt, Human
ucggauagggucagcuccguu

SEQ ID NO: 1023041 - RNA, 22 nt, Human
ucuugcaggugccuuguggaug

SEQ ID NO: 1023042 - RNA, 26 nt, Human
ugcaggugccuuguggauguucaaca

SEQ ID NO: 1023043 - RNA, 21 nt, Human
ugccuuguggauguucaacag

SEQ ID NO: 1023044 - RNA, 22 nt, Human
ugccuuguggauguucaacagc

SEQ ID NO: 1023045 - RNA, 19 nt, Human
uguuuagaguccuuccuuc

SEQ ID NO: 1023046 - RNA, 22 nt, Human
uuccaaaaguaaugaaggaaug

SEQ ID NO: 1023047 - RNA, 21 nt, Human
aaaauagccacagauccauag

SEQ ID NO: 1023048 - RNA, 24 nt, Human
aaacaauggaauaaaagauuuuau

SEQ ID NO: 1023049 - RNA, 24 nt, Human
aaaguguugggauuacaggcauga

SEQ ID NO: 1023050 - RNA, 23 nt, Human
aagaacuagagacugagucacuu

SEQ ID NO: 1023051 - RNA, 21 nt, Human
aaguguugggauuacaggcau

SEQ ID NO: 1023052 - RNA, 26 nt, Human
aaguguugggauuacaggcaugagcc

SEQ ID NO: 1023053 - RNA, 21 nt, Human
accacgaaaggugcuuaagga

SEQ ID NO: 1023054 - RNA, 23 nt, Human
accucaaacaauggaauaaaaga

SEQ ID NO: 1023055 - RNA, 19 nt, Human
agaaaccucaaacaaugga

SEQ ID NO: 1023056 - RNA, 24 nt, Human
agccagucauugcauuuucaagga

SEQ ID NO: 1023057 - RNA, 22 nt, Human
aggaaugaauucuaacugcaaa

SEQ ID NO: 1023058 - RNA, 22 nt, Human
aguagaaaugggguuucgccau

SEQ ID NO: 1023059 - RNA, 24 nt, Human
agugauucuccugccucagccucc

SEQ ID NO: 1023060 - RNA, 24 nt, Human
agugcauuggcacgaucuuggcuc

SEQ ID NO: 1023061 - RNA, 18 nt, Human
auagcugggauuacaggc

SEQ ID NO: 1023062 - RNA, 18 nt, Human
auagcugggauuacaggc

SEQ ID NO: 1023063 - RNA, 20 nt, Human
auggaauaaaagauuuuaug

SEQ ID NO: 1023064 - RNA, 21 nt, Human
augggguuucgccauguuggu

SEQ ID NO: 1023065 - RNA, 24 nt, Human
augggguuucgccauguuggucag

SEQ ID NO: 1023066 - RNA, 18 nt, Human
auucuccugccucagccu

SEQ ID NO: 1023067 - RNA, 18 nt, Human
auuuuuuuuuuuuccuuu

SEQ ID NO: 1023068 - RNA, 24 nt, Human
caaaguguugggauuacaggcaug

SEQ ID NO: 1023069 - RNA, 22 nt, Human
caagugauucuccugccucagc

SEQ ID NO: 1023070 - RNA, 21 nt, Human
cacacacaguacauuuaugug

SEQ ID NO: 1023071 - RNA, 23 nt, Human
caccaggccuagcuaauugugua

SEQ ID NO: 1023072 - RNA, 23 nt, Human
caccugccucggacucccaaagu

SEQ ID NO: 1023073 - RNA, 21 nt, Human
cacugcaaccuccgccuccug

SEQ ID NO: 1023074 - RNA, 23 nt, Human
cacugcaaccuccgccuccuggg

SEQ ID NO: 1023075 - RNA, 24 nt, Human
cauguuggucaggcuggucuugaa

SEQ ID NO: 1023076 - RNA, 23 nt, Human
ccaaaguguugggauuacaggca

SEQ ID NO: 1023077 - RNA, 24 nt, Human
ccaaaguguugggauuacaggcau

SEQ ID NO: 1023078 - RNA, 23 nt, Human
ccaccaggccuagcuaauugugu

SEQ ID NO: 1023079 - RNA, 19 nt, Human
ccauguuggucaggcuggu

SEQ ID NO: 1023080 - RNA, 21 nt, Human
ccauguuggucaggcuggucu

SEQ ID NO: 1023081 - RNA, 24 nt, Human
cccaaaguguugggauuacaggca

SEQ ID NO: 1023082 - RNA, 18 nt, Human
cccaggauggagugcauu

SEQ ID NO: 1023083 - RNA, 24 nt, Human
ccgccuccuggguucaagugauuc

SEQ ID NO: 1023084 - RNA, 22 nt, Human
ccuccgccuccuggguucaagu

SEQ ID NO: 1023085 - RNA, 21 nt, Human
ccuccuggguucaagugauuc

SEQ ID NO: 1023086 - RNA, 24 nt, Human
ccuccuggguucaagugauucucc

SEQ ID NO: 1023087 - RNA, 21 nt, Human
ccugaccucaggugauccacc

SEQ ID NO: 1023088 - RNA, 23 nt, Human
ccugaccucaggugauccaccug

SEQ ID NO: 1023089 - RNA, 23 nt, Human
ccugaccucaggugauccaccug

SEQ ID NO: 1023090 - RNA, 23 nt, Human
ccuggguucaagugauucuccuc

SEQ ID NO: 1023091 - RNA, 23 nt, Human
ccuggguucaagugauucuccug

SEQ ID NO: 1023092 - RNA, 24 nt, Human
cgccauguuggucaggcuggucuu

SEQ ID NO: 1023093 - RNA, 22 nt, Human
cuauauagcugggauuacaggc

SEQ ID NO: 1023094 - RNA, 24 nt, Human
cucacugcaaccuccgccuccugg

SEQ ID NO: 1023095 - RNA, 21 nt, Human
cuccuggguucaagugauucu

SEQ ID NO: 1023096 - RNA, 23 nt, Human
cugcaaccuccgccuccuggguu

SEQ ID NO: 1023097 - RNA, 23 nt, Human
cugccucagccuccuauauagcu

SEQ ID NO: 1023098 - RNA, 21 nt, Human
cuuacacauuacauuugugug

SEQ ID NO: 1023099 - RNA, 22 nt, Human
cuuuuaguagaaaugggguuuc

SEQ ID NO: 1023100 - RNA, 24 nt, Human
gaaaugggguuucgccauguuggu

SEQ ID NO: 1023101 - RNA, 24 nt, Human
gaccucaggugauccaccugccuc

SEQ ID NO: 1023102 - RNA, 20 nt, Human
gaccuuugaaauauauaaug

SEQ ID NO: 1023103 - RNA, 19 nt, Human
gacuugucuuucuuuccuc

SEQ ID NO: 1023104 - RNA, 18 nt, Human
gauuacaggcaugagcca

SEQ ID NO: 1023105 - RNA, 22 nt, Human
gauuacaggcaugagccacugc

SEQ ID NO: 1023106 - RNA, 23 nt, Human
gauuacaggcaugagccacugca

SEQ ID NO: 1023107 - RNA, 18 nt, Human
gauuacaggcgcacgcca

SEQ ID NO: 1023108 - RNA, 22 nt, Human
gcaaccuccgccuccuggguuc

SEQ ID NO: 1023109 - RNA, 20 nt, Human
gcucuuuuugcccaggaugg

SEQ ID NO: 1023110 - RNA, 23 nt, Human
gcuggucuugaacuccugaccuc

SEQ ID NO: 1023111 - RNA, 22 nt, Human
ggauuacaggcaugagccacug

SEQ ID NO: 1023112 - RNA, 24 nt, Human
ggcuggucuugaacuccugaccuc

SEQ ID NO: 1023113 - RNA, 22 nt, Human
gggguuucgccauguuggucag

SEQ ID NO: 1023114 - RNA, 19 nt, Human
ggucuugaacuccugaccu

SEQ ID NO: 1023115 - RNA, 24 nt, Human
gugauccaccugccucggacuccc

SEQ ID NO: 1023116 - RNA, 24 nt, Human
gugauucuccugccucagccuccu

SEQ ID NO: 1023117 - RNA, 21 nt, Human
uaacugcaaaaguuaccaccu

SEQ ID NO: 1023118 - RNA, 24 nt, Human
uacaggcaugagccacugcaccca

SEQ ID NO: 1023119 - RNA, 22 nt, Human
uagaaaugggguuucgccaugu

SEQ ID NO: 1023120 - RNA, 24 nt, Human
uaguagaaaugggguuucgccaug

SEQ ID NO: 1023121 - RNA, 25 nt, Human
uauagcugggauuacaggcgcacgc

SEQ ID NO: 1023122 - RNA, 19 nt, Human
ucaagugauucuccugccu

SEQ ID NO: 1023123 - RNA, 23 nt, Human
ucacugcaaccuccgccuccugg

SEQ ID NO: 1023124 - RNA, 24 nt, Human
ucacugcaaccuccgccuccuggg

SEQ ID NO: 1023125 - RNA, 25 nt, Human
ucacugcaaccuccgccuccugggu

SEQ ID NO: 1023126 - RNA, 27 nt, Human
ucacugcaaccuccgccuccuggguuc

SEQ ID NO: 1023127 - RNA, 21 nt, Human
ucaggugauccaccugccucg

SEQ ID NO: 1023128 - RNA, 24 nt, Human
ucccaaaguguugggauuacaggc

SEQ ID NO: 1023129 - RNA, 24 nt, Human
uccuauauagcugggauuacaggc

SEQ ID NO: 1023130 - RNA, 21 nt, Human
uccuggguucaagugauucuc

SEQ ID NO: 1023131 - RNA, 24 nt, Human
uccuggguucaagugauucuccug

SEQ ID NO: 1023132 - RNA, 22 nt, Human
ucgccauguuggucaggcuggu

SEQ ID NO: 1023133 - RNA, 24 nt, Human
ucgccauguuggucaggcuggucu

SEQ ID NO: 1023134 - RNA, 26 nt, Human
ucuccugccucagccuccuauauagc

SEQ ID NO: 1023135 - RNA, 23 nt, Human
ucuugaacuccugaccucaggug

SEQ ID NO: 1023136 - RNA, 19 nt, Human
ucuuuccucuuccucuucu

SEQ ID NO: 1023137 - RNA, 20 nt, Human
ucuuucuuuccucuuccucu

SEQ ID NO: 1023138 - RNA, 21 nt, Human
ugaaagucacaaacaguagcc

SEQ ID NO: 1023139 - RNA, 24 nt, Human
ugaccucaggugauccaccugccu

SEQ ID NO: 1023140 - RNA, 20 nt, Human
ugacuugucuuucuuuccuc

SEQ ID NO: 1023141 - RNA, 23 nt, Human
ugacuugucuuucuuuuggaagc

SEQ ID NO: 1023142 - RNA, 25 nt, Human
ugagaaaccucaaacaauggaauaa

SEQ ID NO: 1023143 - RNA, 18 nt, Human
ugcauuuuuuuuuuuucc

SEQ ID NO: 1023144 - RNA, 24 nt, Human
ugccucagccuccuauauagcugg

SEQ ID NO: 1023145 - RNA, 24 nt, Human
uggaauaaaagauuuuauaaccug

SEQ ID NO: 1023146 - RNA, 20 nt, Human
uggagugcauuggcacgauc

SEQ ID NO: 1023147 - RNA, 24 nt, Human
uggagugcauuggcacgaucuugg

SEQ ID NO: 1023148 - RNA, 19 nt, Human
uggaugucuauuaauacuu

SEQ ID NO: 1023149 - RNA, 18 nt, Human
ugggauuacaggcaugag

SEQ ID NO: 1023150 - RNA, 19 nt, Human
ugggauuacaggcaugagc

SEQ ID NO: 1023151 - RNA, 21 nt, Human
ugggauuacaggcaugagcca

SEQ ID NO: 1023152 - RNA, 22 nt, Human
ugggauuacaggcaugagccac

SEQ ID NO: 1023153 - RNA, 22 nt, Human
ugggauuacaggcaugagccac

SEQ ID NO: 1023154 - RNA, 24 nt, Human
ugggauuacaggcaugagccacug

SEQ ID NO: 1023155 - RNA, 26 nt, Human
ugggauuacaggcaugagccacugca

SEQ ID NO: 1023156 - RNA, 22 nt, Human
ugggauuacaggcgcacgccac

SEQ ID NO: 1023157 - RNA, 24 nt, Human
ugggauuacaggcgcacgccacca

SEQ ID NO: 1023158 - RNA, 24 nt, Human
ugggguuucgccauguuggucagg

SEQ ID NO: 1023159 - RNA, 23 nt, Human
uggguucaagugauucuccugcc

SEQ ID NO: 1023160 - RNA, 24 nt, Human
uggguucaagugauucuccugccu

SEQ ID NO: 1023161 - RNA, 24 nt, Human
uggucaggcuggucuugaacuccu

SEQ ID NO: 1023162 - RNA, 24 nt, Human
ugucacacacaguacauuuaugug

SEQ ID NO: 1023163 - RNA, 18 nt, Human
uuaguagaaaugggguuu

SEQ ID NO: 1023164 - RNA, 22 nt, Human
uuaguagaaaugggguuucgcc

SEQ ID NO: 1023165 - RNA, 24 nt, Human
uuaguagaaaugggguuucgccau

SEQ ID NO: 1023166 - RNA, 21 nt, Human
uucaagugauucuccugccuc

SEQ ID NO: 1023167 - RNA, 23 nt, Human
uucaagugauucuccugccucag

SEQ ID NO: 1023168 - RNA, 24 nt, Human
uucaagugauucuccugccucagc

SEQ ID NO: 1023169 - RNA, 19 nt, Human
uucccagauaggcaccacg

SEQ ID NO: 1023170 - RNA, 20 nt, Human
uugaacucaugaggaguuug

SEQ ID NO: 1023171 - RNA, 26 nt, Human
uugcauuuucaaggaaucucucaggc

SEQ ID NO: 1023172 - RNA, 24 nt, Human
uugcccaggauggagugcauuggc

SEQ ID NO: 1023173 - RNA, 24 nt, Human
uuucgccauguuggucaggcuggu

SEQ ID NO: 1023174 - RNA, 24 nt, Human
uuugcucuuuuugcccaggaugga

SEQ ID NO: 1023175 - RNA, 19 nt, Human
uuuguaagguuucucucca

SEQ ID NO: 1023176 - RNA, 22 nt, Human
uuugugugguuccaucaaauac

SEQ ID NO: 1023177 - RNA, 20 nt, Human
uuuugcucuuuuugcccagg

SEQ ID NO: 1023178 - RNA, 24 nt, Human
uuuugcucuuuuugcccaggaugg

SEQ ID NO: 1023179 - RNA, 23 nt, Human
aaaccggguccagaucuucagga

SEQ ID NO: 1023180 - RNA, 21 nt, Human
acacaacuuccccaggccccc

SEQ ID NO: 1023181 - RNA, 25 nt, Human
agcccggagcuucggcgucgggguc

SEQ ID NO: 1023182 - RNA, 21 nt, Human
aggcucugggucuucagaaac

SEQ ID NO: 1023183 - RNA, 20 nt, Human
cacaacacacaacuucccca

SEQ ID NO: 1023184 - RNA, 22 nt, Human
cagauccuccgagacgggcucc

SEQ ID NO: 1023185 - RNA, 21 nt, Human
ccaggcccccgaggaugccgg

SEQ ID NO: 1023186 - RNA, 21 nt, Human
ccccaggcccccgaggaugcc

SEQ ID NO: 1023187 - RNA, 19 nt, Human
ccuccgagacgggcuccag

SEQ ID NO: 1023188 - RNA, 25 nt, Human
cuuccccaggcccccgaggaugccg

SEQ ID NO: 1023189 - RNA, 18 nt, Human
gcucugggucuucagaaa

SEQ ID NO: 1023190 - RNA, 20 nt, Human
gggcuccagaucuucauagc

SEQ ID NO: 1023191 - RNA, 21 nt, Human
uccagaucuucauagcugggg

SEQ ID NO: 1023192 - RNA, 26 nt, Human
uccccaggcccccgaggaugccggcg

SEQ ID NO: 1023193 - RNA, 19 nt, Human
ugacugcacaacacacaac

SEQ ID NO: 1023194 - RNA, 18 nt, Human
aaacaaggucucaggcgc

SEQ ID NO: 1023195 - RNA, 21 nt, Human
aaacugccaucucgugacuug

SEQ ID NO: 1023196 - RNA, 24 nt, Human
acacuucuucuuccuccuccggga

SEQ ID NO: 1023197 - RNA, 22 nt, Human
agcaacggagacacugcucgcc

SEQ ID NO: 1023198 - RNA, 22 nt, Human
aggccagcucuuucuuccccaa

SEQ ID NO: 1023199 - RNA, 19 nt, Human
auggcuggaaggccaaggc

SEQ ID NO: 1023200 - RNA, 19 nt, Human
caaauagcucccggcucga

SEQ ID NO: 1023201 - RNA, 22 nt, Human
caaggcacaggaagcaacggag

SEQ ID NO: 1023202 - RNA, 24 nt, Human
cacuucuggcuccaaaacugccau

SEQ ID NO: 1023203 - RNA, 19 nt, Human
cacuucuucuuccuccucc

SEQ ID NO: 1023204 - RNA, 24 nt, Human
ccacacccagcacaucaggaggug

SEQ ID NO: 1023205 - RNA, 19 nt, Human
ccacugcucccuagcaggu

SEQ ID NO: 1023206 - RNA, 24 nt, Human
ccugcccuggcuuccuccugggag

SEQ ID NO: 1023207 - RNA, 25 nt, Human
cgaaaccauagauacgagcgggcua

SEQ ID NO: 1023208 - RNA, 21 nt, Human
cgaguggcucccucaccgcca

SEQ ID NO: 1023209 - RNA, 22 nt, Human
cucccucaccgccauuccccgc

SEQ ID NO: 1023210 - RNA, 20 nt, Human
cugguaaagcugaccuaaga

SEQ ID NO: 1023211 - RNA, 27 nt, Human
cuucuggcuccaaaacugccaucuuac

SEQ ID NO: 1023212 - RNA, 27 nt, Human
gaaaccauagauacgagcgggcuacug

SEQ ID NO: 1023213 - RNA, 22 nt, Human
gccaaggcacaggaagcaacgg

SEQ ID NO: 1023214 - RNA, 22 nt, Human
guaccacauggcuggaaggcca

SEQ ID NO: 1023215 - RNA, 18 nt, Human
gugaagccuucuucuugg

SEQ ID NO: 1023216 - RNA, 19 nt, Human
uaccacauggcuggaaggc

SEQ ID NO: 1023217 - RNA, 20 nt, Human
uagcucccggcucgaggccu

SEQ ID NO: 1023218 - RNA, 21 nt, Human
uagcucccggcucgaggccua

SEQ ID NO: 1023219 - RNA, 22 nt, Human
uaggacguauaacacuucuucu

SEQ ID NO: 1023220 - RNA, 18 nt, Human
uccccgcggaacccugcc

SEQ ID NO: 1023221 - RNA, 22 nt, Human
ucgaggccuaaccacacccagc

SEQ ID NO: 1023222 - RNA, 22 nt, Human
ucggggaugcuuuuucugaagg

SEQ ID NO: 1023223 - RNA, 24 nt, Human
ugaaacaaggucucaggcgcaguu

SEQ ID NO: 1023224 - RNA, 23 nt, Human
ugaaggaugcuggccugaaaccu

SEQ ID NO: 1023225 - RNA, 20 nt, Human
ugacugcagguaacaaacug

SEQ ID NO: 1023226 - RNA, 20 nt, Human
ugacuugugaagccuucuuc

SEQ ID NO: 1023227 - RNA, 19 nt, Human
ugcccuggcuuccuccugg

SEQ ID NO: 1023228 - RNA, 24 nt, Human
uggaaggccaaggcacaggaagca

SEQ ID NO: 1023229 - RNA, 21 nt, Human
uggcucccucaccgccauucc

SEQ ID NO: 1023230 - RNA, 25 nt, Human
uuauuucuggaauuuuccauuuaau

SEQ ID NO: 1023231 - RNA, 23 nt, Human
uuccuccucggggaugcuuuuuc

SEQ ID NO: 1023232 - RNA, 21 nt, Human
uuuuuuuuuuuuuuuuuuugg

SEQ ID NO: 1023233 - RNA, 24 nt, Human
aagugcaguucuaucaagaacuag

SEQ ID NO: 1023234 - RNA, 21 nt, Human
acacuaguacaaaacacauca

SEQ ID NO: 1023235 - RNA, 22 nt, Human
acauuuagaggauccagaggac

SEQ ID NO: 1023236 - RNA, 19 nt, Human
agaaaaugccaaguucucc

SEQ ID NO: 1023237 - RNA, 18 nt, Human
agcacaccccucccagcc

SEQ ID NO: 1023238 - RNA, 20 nt, Human
agggagaacuuaauauaaca

SEQ ID NO: 1023239 - RNA, 22 nt, Human
auacacuucuaugaauguauca

SEQ ID NO: 1023240 - RNA, 20 nt, Human
auuccaccgauccuuccccc

SEQ ID NO: 1023241 - RNA, 22 nt, Human
caaaacacaucaacucuaaugc

SEQ ID NO: 1023242 - RNA, 20 nt, Human
cacaccccucccagccccag

SEQ ID NO: 1023243 - RNA, 26 nt, Human
caccccucccagccccagcggccacu

SEQ ID NO: 1023244 - RNA, 25 nt, Human
caccuccccucacauuccaccgauc

SEQ ID NO: 1023245 - RNA, 20 nt, Human
cagaaaaugccaaguucucc

SEQ ID NO: 1023246 - RNA, 23 nt, Human
caguggcaaacaucauuggcuuc

SEQ ID NO: 1023247 - RNA, 21 nt, Human
ccaaaaaacugacacuaaagg

SEQ ID NO: 1023248 - RNA, 23 nt, Human
ccacuagcgacaauauggcuccu

SEQ ID NO: 1023249 - RNA, 22 nt, Human
cccagagaagcugcgccucucu

SEQ ID NO: 1023250 - RNA, 18 nt, Human
cccagccccagcggccac

SEQ ID NO: 1023251 - RNA, 22 nt, Human
cccagccccagcggccacuagc

SEQ ID NO: 1023252 - RNA, 23 nt, Human
ccccagcggccacuagcgacaau

SEQ ID NO: 1023253 - RNA, 23 nt, Human
cccccaggauaaaaaccacgccc

SEQ ID NO: 1023254 - RNA, 23 nt, Human
cccucccagccccagcggccacu

SEQ ID NO: 1023255 - RNA, 23 nt, Human
ccuccaccuccccucacauucca

SEQ ID NO: 1023256 - RNA, 21 nt, Human
ccucucuagcacaccccuccc

SEQ ID NO: 1023257 - RNA, 21 nt, Human
cuagcacaccccucccagccc

SEQ ID NO: 1023258 - RNA, 23 nt, Human
cuagcgacaauauggcuccuaag

SEQ ID NO: 1023259 - RNA, 20 nt, Human
cucaaaagaaagaaaauuuc

SEQ ID NO: 1023260 - RNA, 23 nt, Human
cucaaaagaaagaaaauuucuuu

SEQ ID NO: 1023261 - RNA, 18 nt, Human
cugucuuagaaaauucua

SEQ ID NO: 1023262 - RNA, 24 nt, Human
gaacuuaauauaacacagcccuua

SEQ ID NO: 1023263 - RNA, 18 nt, Human
gcacaccccucccagccc

SEQ ID NO: 1023264 - RNA, 23 nt, Human
gccucucuagcacaccccuccca

SEQ ID NO: 1023265 - RNA, 20 nt, Human
gcgacaauauggcuccuaag

SEQ ID NO: 1023266 - RNA, 21 nt, Human
uacauuauagaacugaugaua

SEQ ID NO: 1023267 - RNA, 24 nt, Human
uagaaaugaacugcacgcguagug

SEQ ID NO: 1023268 - RNA, 25 nt, Human
uauaucagaaaaugccaaguucucc

SEQ ID NO: 1023269 - RNA, 21 nt, Human
uauggaauaccucaaaagaaa

SEQ ID NO: 1023270 - RNA, 26 nt, Human
ucaaaauucacauuuagaggauccag

SEQ ID NO: 1023271 - RNA, 25 nt, Human
ucaacucuaaugcauagaugacgac

SEQ ID NO: 1023272 - RNA, 20 nt, Human
uccaccgauccuucccccag

SEQ ID NO: 1023273 - RNA, 20 nt, Human
ucuagcacaccccucccagc

SEQ ID NO: 1023274 - RNA, 19 nt, Human
ucuaugaauguaucagugg

SEQ ID NO: 1023275 - RNA, 19 nt, Human
ucucuagcacaccccuccc

SEQ ID NO: 1023276 - RNA, 23 nt, Human
ugcugugacacuaguacaaaaca

SEQ ID NO: 1023277 - RNA, 23 nt, Human
uggaauaccucaaaagaaagaaa

SEQ ID NO: 1023278 - RNA, 23 nt, Human
uuggcuuccaaaaaacugacacu

SEQ ID NO: 1023279 - RNA, 28 nt, Human
uuuucccaacuacuuuuauggaauaccu

SEQ ID NO: 1023280 - RNA, 21 nt, Human
agaaggagguggaaacaggga

SEQ ID NO: 1023281 - RNA, 18 nt, Human
agacagcaggacccuaac

SEQ ID NO: 1023282 - RNA, 19 nt, Human
auggugggguagagguugg

SEQ ID NO: 1023283 - RNA, 21 nt, Human
caaaaggacuuuauaucagca

SEQ ID NO: 1023284 - RNA, 22 nt, Human
caagacaaaacaaaaucauuag

SEQ ID NO: 1023285 - RNA, 25 nt, Human
cagcaggacccuaacuagacuuuaa

SEQ ID NO: 1023286 - RNA, 24 nt, Human
cagucgucgccgccgccgccgccu

SEQ ID NO: 1023287 - RNA, 20 nt, Human
ccacagcccugauucaggug

SEQ ID NO: 1023288 - RNA, 21 nt, Human
cccucgccaggccgcuaccuc

SEQ ID NO: 1023289 - RNA, 18 nt, Human
ccgccgccgccucggugc

SEQ ID NO: 1023290 - RNA, 18 nt, Human
ccuccgccgcggccgucc

SEQ ID NO: 1023291 - RNA, 19 nt, Human
cgucgccgccgccgccgcc

SEQ ID NO: 1023292 - RNA, 25 nt, Human
cuuuauaucagcaggacuuuagggc

SEQ ID NO: 1023293 - RNA, 19 nt, Human
gaguaguuuuuuuuuuuuu

SEQ ID NO: 1023294 - RNA, 22 nt, Human
gcagucgucgccgccgccgccg

SEQ ID NO: 1023295 - RNA, 21 nt, Human
gugggguagagguuggagaag

SEQ ID NO: 1023296 - RNA, 18 nt, Human
uaacuagacuuuaaggaa

SEQ ID NO: 1023297 - RNA, 22 nt, Human
uaagaugauuaccacagcccug

SEQ ID NO: 1023298 - RNA, 23 nt, Human
uaagaugauuaccacagcccuga

SEQ ID NO: 1023299 - RNA, 22 nt, Human
uacaaggcaacaugacagacag

SEQ ID NO: 1023300 - RNA, 19 nt, Human
ucaagacaaaacaaaauca

SEQ ID NO: 1023301 - RNA, 25 nt, Human
ucaagacaaaacaaaaucauuaguc

SEQ ID NO: 1023302 - RNA, 21 nt, Human
ucgccgccgccgccgccucgg

SEQ ID NO: 1023303 - RNA, 23 nt, Human
ucgucgccgccgccgccgccucg

SEQ ID NO: 1023304 - RNA, 24 nt, Human
ucgucgccgccgccgccgccucgg

SEQ ID NO: 1023305 - RNA, 20 nt, Human
ucuuugauuugcucucuggg

SEQ ID NO: 1023306 - RNA, 22 nt, Human
ucuuugauuugcucucugggga

SEQ ID NO: 1023307 - RNA, 20 nt, Human
uggugggguagagguuggag

SEQ ID NO: 1023308 - RNA, 20 nt, Human
uuagauaccugaauuugacc

SEQ ID NO: 1023309 - RNA, 18 nt, Human
uucagggauaagaggcau

SEQ ID NO: 1023310 - RNA, 23 nt, Human
aaaaacaaaccuggagccauaug

SEQ ID NO: 1023311 - RNA, 18 nt, Human
aaacacccuccugagucc

SEQ ID NO: 1023312 - RNA, 20 nt, Human
aagagcagagcaaacuguga

SEQ ID NO: 1023313 - RNA, 18 nt, Human
agaaaaacaaaccuggag

SEQ ID NO: 1023314 - RNA, 30 nt, Human
agaaaaacaaaccuggagccauauggcaga

SEQ ID NO: 1023315 - RNA, 24 nt, Human
agacaugcccagaaggcccgaagc

SEQ ID NO: 1023316 - RNA, 23 nt, Human
agcaaacacccuccugaguccuc

SEQ ID NO: 1023317 - RNA, 23 nt, Human
agcauccuccgcguccucuaccc

SEQ ID NO: 1023318 - RNA, 26 nt, Human
aggcccgaagcggcucccgcgacggg

SEQ ID NO: 1023319 - RNA, 20 nt, Human
cacccuuuauguucuguguu

SEQ ID NO: 1023320 - RNA, 22 nt, Human
cagcaaacacccuccugagucc

SEQ ID NO: 1023321 - RNA, 19 nt, Human
cagcagcucagcauccucc

SEQ ID NO: 1023322 - RNA, 19 nt, Human
cagcauccuccgcguccuc

SEQ ID NO: 1023323 - RNA, 24 nt, Human
ccauauggcagacaugcccagaag

SEQ ID NO: 1023324 - RNA, 19 nt, Human
ccguacaucucuaguugug

SEQ ID NO: 1023325 - RNA, 22 nt, Human
cgggggccgaaaagugcacacu

SEQ ID NO: 1023326 - RNA, 18 nt, Human
cugucuguucuugacucu

SEQ ID NO: 1023327 - RNA, 24 nt, Human
gacgccaggagaugccgggagccc

SEQ ID NO: 1023328 - RNA, 19 nt, Human
gacucuuucucgcggcugu

SEQ ID NO: 1023329 - RNA, 18 nt, Human
gagccauauggcagacau

SEQ ID NO: 1023330 - RNA, 22 nt, Human
gcauccguacaucucuaguugu

SEQ ID NO: 1023331 - RNA, 23 nt, Human
ggagcccuccccgucagagugcc

SEQ ID NO: 1023332 - RNA, 20 nt, Human
gggcaaagguguucucauua

SEQ ID NO: 1023333 - RNA, 21 nt, Human
gucuguucuugacucuuucuc

SEQ ID NO: 1023334 - RNA, 21 nt, Human
ucagcauccuccgcguccucu

SEQ ID NO: 1023335 - RNA, 18 nt, Human
uccacugguguuggaaga

SEQ ID NO: 1023336 - RNA, 18 nt, Human
uccccgucagagugccgg

SEQ ID NO: 1023337 - RNA, 21 nt, Human
uccugaguccucaagcgacuc

SEQ ID NO: 1023338 - RNA, 19 nt, Human
ucugucuguucuugacucu

SEQ ID NO: 1023339 - RNA, 20 nt, Human
ucuguucuugacucuuucuc

SEQ ID NO: 1023340 - RNA, 18 nt, Human
ugagaacugacuucaggg

SEQ ID NO: 1023341 - RNA, 23 nt, Human
uuucucgcggcuguaccucugau

SEQ ID NO: 1023342 - RNA, 25 nt, Human
aaaaaaaggacaaaaauaaacaaaa

SEQ ID NO: 1023343 - RNA, 21 nt, Human
aaaaggacaaaaauaaacaaa

SEQ ID NO: 1023344 - RNA, 19 nt, Human
aaacaaaacaucaaauaug

SEQ ID NO: 1023345 - RNA, 22 nt, Human
aaacaaaacaucaaauaugaaa

SEQ ID NO: 1023346 - RNA, 20 nt, Human
aagccaccugugaccaacuu

SEQ ID NO: 1023347 - RNA, 21 nt, Human
aaucuccuucuaccagcaguc

SEQ ID NO: 1023348 - RNA, 22 nt, Human
acauuagagauggaggaggagg

SEQ ID NO: 1023349 - RNA, 26 nt, Human
acccucucucucucuuccuccugccg

SEQ ID NO: 1023350 - RNA, 24 nt, Human
agaaaaggacuuuucccaccaaga

SEQ ID NO: 1023351 - RNA, 24 nt, Human
agaaggagagaggcuucaaggaaa

SEQ ID NO: 1023352 - RNA, 21 nt, Human
agaaggcaaagcugagggcug

SEQ ID NO: 1023353 - RNA, 18 nt, Human
agaguucagaaaaaggau

SEQ ID NO: 1023354 - RNA, 23 nt, Human
agcaaauccuucccuugagcacc

SEQ ID NO: 1023355 - RNA, 25 nt, Human
agccaccagagaacuguggagaacc

SEQ ID NO: 1023356 - RNA, 20 nt, Human
agccucuagucuuacaucag

SEQ ID NO: 1023357 - RNA, 23 nt, Human
aggaagaaaaggacuuuucccac

SEQ ID NO: 1023358 - RNA, 19 nt, Human
aggauaaggaggguaagga

SEQ ID NO: 1023359 - RNA, 20 nt, Human
aggcaaagcugagggcuggg

SEQ ID NO: 1023360 - RNA, 25 nt, Human
aggcaagaauagaacaagaggcugg

SEQ ID NO: 1023361 - RNA, 21 nt, Human
aggcaggcagaccccccagcc

SEQ ID NO: 1023362 - RNA, 18 nt, Human
agggguggagagagggaa

SEQ ID NO: 1023363 - RNA, 20 nt, Human
caaaacaucaaauaugaaaa

SEQ ID NO: 1023364 - RNA, 23 nt, Human
caaagccucccacagcuccuugg

SEQ ID NO: 1023365 - RNA, 19 nt, Human
caaggaagaaaaggacuuu

SEQ ID NO: 1023366 - RNA, 22 nt, Human
cacaagaccuuguggcaggcac

SEQ ID NO: 1023367 - RNA, 18 nt, Human
cacacacuucuaagccac

SEQ ID NO: 1023368 - RNA, 22 nt, Human
cacaucucagcccuugcccccu

SEQ ID NO: 1023369 - RNA, 21 nt, Human
caccugugaccaacuugggaa

SEQ ID NO: 1023370 - RNA, 23 nt, Human
cagaggcccaaggagauggagcc

SEQ ID NO: 1023371 - RNA, 19 nt, Human
caggacuacuucuuccucu

SEQ ID NO: 1023372 - RNA, 21 nt, Human
ccagcaauccaaagacgggug

SEQ ID NO: 1023373 - RNA, 23 nt, Human
ccaguucaggcccagccacuucc

SEQ ID NO: 1023374 - RNA, 19 nt, Human
cccaggccacagguaacca

SEQ ID NO: 1023375 - RNA, 18 nt, Human
ccccaaaucuccuucuac

SEQ ID NO: 1023376 - RNA, 23 nt, Human
ccccaaaucuccuucuaccagca

SEQ ID NO: 1023377 - RNA, 20 nt, Human
ccccaaaucuccuucuaccu

SEQ ID NO: 1023378 - RNA, 23 nt, Human
cccccaguuuuagaagcuuugcu

SEQ ID NO: 1023379 - RNA, 20 nt, Human
cccucucucucucuuccucc

SEQ ID NO: 1023380 - RNA, 22 nt, Human
cccugaggaguggcuucagaag

SEQ ID NO: 1023381 - RNA, 19 nt, Human
ccgacccccaguuuuagaa

SEQ ID NO: 1023382 - RNA, 18 nt, Human
ccgcaacaccccuguuuu

SEQ ID NO: 1023383 - RNA, 24 nt, Human
ccgucuuauuccuucuccuuucca

SEQ ID NO: 1023384 - RNA, 22 nt, Human
ccucccacagcuccuugggggu

SEQ ID NO: 1023385 - RNA, 22 nt, Human
ccuccugccgucuuauuccuuc

SEQ ID NO: 1023386 - RNA, 25 nt, Human
ccucuagucuuacaucagcccaaac

SEQ ID NO: 1023387 - RNA, 19 nt, Human
ccuuggggguggguugggg

SEQ ID NO: 1023388 - RNA, 18 nt, Human
cgacccccaguuuuagaa

SEQ ID NO: 1023389 - RNA, 19 nt, Human
cuacccucucucucucuuc

SEQ ID NO: 1023390 - RNA, 19 nt, Human
cuacccucucucucucuuc

SEQ ID NO: 1023391 - RNA, 22 nt, Human
cuccugaacuuucuguaaacaa

SEQ ID NO: 1023392 - RNA, 22 nt, Human
gaaaugguuacaacaaagaugg

SEQ ID NO: 1023393 - RNA, 19 nt, Human
gaacauuagagauggagga

SEQ ID NO: 1023394 - RNA, 24 nt, Human
gaaggcaggcagaccccccagcca

SEQ ID NO: 1023395 - RNA, 18 nt, Human
gacagggguggagagagg

SEQ ID NO: 1023396 - RNA, 20 nt, Human
gaccccccagccagcaaucc

SEQ ID NO: 1023397 - RNA, 22 nt, Human
gaccccccagccagcaauccaa

SEQ ID NO: 1023398 - RNA, 25 nt, Human
gacuuuucccaccaagaguuggaga

SEQ ID NO: 1023399 - RNA, 23 nt, Human
gagaaagaagacaccaggacuac

SEQ ID NO: 1023400 - RNA, 21 nt, Human
gagaacauuagagauggagga

SEQ ID NO: 1023401 - RNA, 23 nt, Human
gaggacagggguggagagaggga

SEQ ID NO: 1023402 - RNA, 18 nt, Human
gaggagggucugugcccc

SEQ ID NO: 1023403 - RNA, 24 nt, Human
ggaaagccgugacagaggcccaag

SEQ ID NO: 1023404 - RNA, 24 nt, Human
ggaccacaucucagcccuugcccc

SEQ ID NO: 1023405 - RNA, 21 nt, Human
ggacuacuucuuccucuuccc

SEQ ID NO: 1023406 - RNA, 22 nt, Human
ggagccaaggccugucaaggaa

SEQ ID NO: 1023407 - RNA, 22 nt, Human
ggaggaggaggagggucugugc

SEQ ID NO: 1023408 - RNA, 21 nt, Human
ggggguggguuggggagacug

SEQ ID NO: 1023409 - RNA, 25 nt, Human
gggguggagagagggaaaaaaagga

SEQ ID NO: 1023410 - RNA, 25 nt, Human
guaaaaccauaacacacacuucuaa

SEQ ID NO: 1023411 - RNA, 21 nt, Human
guccaguccuugcguuugccu

SEQ ID NO: 1023412 - RNA, 19 nt, Human
uaaacaaaacaucaaauau

SEQ ID NO: 1023413 - RNA, 20 nt, Human
uaaauccaauucccagaaac

SEQ ID NO: 1023414 - RNA, 24 nt, Human
uaccccaaaucuccuucuaccagc

SEQ ID NO: 1023415 - RNA, 19 nt, Human
uacccucucucucucuucc

SEQ ID NO: 1023416 - RNA, 27 nt, Human
uagcaaauccuucccuugagcaccgac

SEQ ID NO: 1023417 - RNA, 26 nt, Human
uaggggaagaaauggcucucagggaa

SEQ ID NO: 1023418 - RNA, 19 nt, Human
ucccaggccacagguaacc

SEQ ID NO: 1023419 - RNA, 21 nt, Human
ucccuugagcaccgaccccca

SEQ ID NO: 1023420 - RNA, 22 nt, Human
ucccuugagcaccgacccccag

SEQ ID NO: 1023421 - RNA, 20 nt, Human
ucucagcccuugcccccuuc

SEQ ID NO: 1023422 - RNA, 21 nt, Human
ucucagcccuugcccccuuca

SEQ ID NO: 1023423 - RNA, 24 nt, Human
ucucucucuuccuccugccgucuu

SEQ ID NO: 1023424 - RNA, 22 nt, Human
ucuggaaggcaggcagaccccc

SEQ ID NO: 1023425 - RNA, 25 nt, Human
ucuuuguaggcagagaaggagagag

SEQ ID NO: 1023426 - RNA, 31 nt, Human
ucuuuugcaggcaagaauagaacaagaggcu

SEQ ID NO: 1023427 - RNA, 18 nt, Human
ugagaguauagggucuuu

SEQ ID NO: 1023428 - RNA, 25 nt, Human
ugcauuuauaaacacagaaaugguu

SEQ ID NO: 1023429 - RNA, 19 nt, Human
ugcuugggaggggaggcug

SEQ ID NO: 1023430 - RNA, 23 nt, Human
ugcuugggaggggaggcugcugg

SEQ ID NO: 1023431 - RNA, 18 nt, Human
uggaaggcaggcagaccc

SEQ ID NO: 1023432 - RNA, 25 nt, Human
uggagaaagaagacaccaggacuac

SEQ ID NO: 1023433 - RNA, 21 nt, Human
uggagagagggaaaaaaagga

SEQ ID NO: 1023434 - RNA, 19 nt, Human
uggaggaggaggagggucu

SEQ ID NO: 1023435 - RNA, 18 nt, Human
uggggguggguuggggag

SEQ ID NO: 1023436 - RNA, 21 nt, Human
ugguauaauauauuuauauau

SEQ ID NO: 1023437 - RNA, 21 nt, Human
ugucaaggaagaaaaggacuu

SEQ ID NO: 1023438 - RNA, 25 nt, Human
ugucaaggaagaaaaggacuuuucc

SEQ ID NO: 1023439 - RNA, 30 nt, Human
uguuuuggaguuucacagauaacacaaagg

SEQ ID NO: 1023440 - RNA, 25 nt, Human
uucacagauaacacaaagccuccca

SEQ ID NO: 1023441 - RNA, 23 nt, Human
uuccagggcuccugaacuuucug

SEQ ID NO: 1023442 - RNA, 23 nt, Human
uuccuucuccuuuccagggcucc

SEQ ID NO: 1023443 - RNA, 21 nt, Human
uuggagaaagaagacaccagg

SEQ ID NO: 1023444 - RNA, 23 nt, Human
uuuauaaacacagaaaugguuac

SEQ ID NO: 1023445 - RNA, 22 nt, Human
uuugcaggcaagaauagaacaa

SEQ ID NO: 1023446 - RNA, 24 nt, Human
aaaaaacuuuugaaacaaugcuua

SEQ ID NO: 1023447 - RNA, 22 nt, Human
aaaagaaaacaaauucagugca

SEQ ID NO: 1023448 - RNA, 22 nt, Human
aaaaugcucuuaugcuauuucu

SEQ ID NO: 1023449 - RNA, 22 nt, Human
aaacaccguuucuaccuaagaa

SEQ ID NO: 1023450 - RNA, 20 nt, Human
aaacagacaaaucugcauca

SEQ ID NO: 1023451 - RNA, 22 nt, Human
aaacagacaaaucugcaucacu

SEQ ID NO: 1023452 - RNA, 23 nt, Human
aaacagauguauaaagugauuag

SEQ ID NO: 1023453 - RNA, 25 nt, Human
aaacagauguauaaagugauuuccu

SEQ ID NO: 1023454 - RNA, 25 nt, Human
aaacaguauacaaacaaacuaccuc

SEQ ID NO: 1023455 - RNA, 27 nt, Human
aaacauacuucacaaaacauccugcuc

SEQ ID NO: 1023456 - RNA, 22 nt, Human
aaauaaauuaaccugaagucau

SEQ ID NO: 1023457 - RNA, 24 nt, Human
aaauacaaacauacuucacaaaac

SEQ ID NO: 1023458 - RNA, 22 nt, Human
aaauguacagcacugaacacaa

SEQ ID NO: 1023459 - RNA, 20 nt, Human
aacuaugaaacucugauccg

SEQ ID NO: 1023460 - RNA, 21 nt, Human
aagaagaguacaaugaagaaa

SEQ ID NO: 1023461 - RNA, 18 nt, Human
aaggugccaguguuugaa

SEQ ID NO: 1023462 - RNA, 20 nt, Human
aaguacuguauagcaaaaug

SEQ ID NO: 1023463 - RNA, 23 nt, Human
acaaaaaucagugaaaggugggg

SEQ ID NO: 1023464 - RNA, 19 nt, Human
acaaaucuacaccaauauu

SEQ ID NO: 1023465 - RNA, 21 nt, Human
acaacuguaauagaaaauuuu

SEQ ID NO: 1023466 - RNA, 25 nt, Human
acagcacugaacacaauuuuguugc

SEQ ID NO: 1023467 - RNA, 24 nt, Human
acaguaauaacaguggaauacauc

SEQ ID NO: 1023468 - RNA, 21 nt, Human
accauacaccaaauguacagc

SEQ ID NO: 1023469 - RNA, 22 nt, Human
accguccugccuucucuacccu

SEQ ID NO: 1023470 - RNA, 21 nt, Human
acgccuuagcaguacaugaac

SEQ ID NO: 1023471 - RNA, 19 nt, Human
acuguaguuccuucccuaa

SEQ ID NO: 1023472 - RNA, 22 nt, Human
agacagcacauaugguagcuca

SEQ ID NO: 1023473 - RNA, 19 nt, Human
agaggcacgucugcacaug

SEQ ID NO: 1023474 - RNA, 20 nt, Human
agcacagaaaauuaagccca

SEQ ID NO: 1023475 - RNA, 18 nt, Human
agccuggcuggucacacc

SEQ ID NO: 1023476 - RNA, 19 nt, Human
aggcaaauaaauacaaaca

SEQ ID NO: 1023477 - RNA, 22 nt, Human
aguacacaacuguaauagaaaa

SEQ ID NO: 1023478 - RNA, 19 nt, Human
agugaaaggugggggaaga

SEQ ID NO: 1023479 - RNA, 24 nt, Human
aguggaauuacuguugaguauugu

SEQ ID NO: 1023480 - RNA, 20 nt, Human
auagugcaguccuuagacaa

SEQ ID NO: 1023481 - RNA, 20 nt, Human
auccugcccuucucccuaca

SEQ ID NO: 1023482 - RNA, 22 nt, Human
augaagaaauaaaagaaaaaca

SEQ ID NO: 1023483 - RNA, 25 nt, Human
caaaacacaucaaguacaaaguagg

SEQ ID NO: 1023484 - RNA, 23 nt, Human
caaaaugcaguuaaaagauagua

SEQ ID NO: 1023485 - RNA, 22 nt, Human
caaauaaauacaaacauacuuc

SEQ ID NO: 1023486 - RNA, 21 nt, Human
caaaucugcaucacuaaaaag

SEQ ID NO: 1023487 - RNA, 22 nt, Human
caaguacaaaguaggcaaauaa

SEQ ID NO: 1023488 - RNA, 19 nt, Human
caauaagcaggucucuucc

SEQ ID NO: 1023489 - RNA, 22 nt, Human
caauaagcaggucucuuccaca

SEQ ID NO: 1023490 - RNA, 19 nt, Human
cacccuuuccuguuuccuc

SEQ ID NO: 1023491 - RNA, 22 nt, Human
caggucucuuccacaucgcccc

SEQ ID NO: 1023492 - RNA, 21 nt, Human
caguuuagcugguugucuaua

SEQ ID NO: 1023493 - RNA, 24 nt, Human
cauucaguuaaaaacauccugccc

SEQ ID NO: 1023494 - RNA, 26 nt, Human
cauuuacacagaggcacgucugcaca

SEQ ID NO: 1023495 - RNA, 20 nt, Human
ccaacauauggcaggaaagc

SEQ ID NO: 1023496 - RNA, 25 nt, Human
ccagccaagucgaauacuuugcuga

SEQ ID NO: 1023497 - RNA, 20 nt, Human
ccauuccuuuccagucaacc

SEQ ID NO: 1023498 - RNA, 22 nt, Human
ccugcccuucucccuacaaaaa

SEQ ID NO: 1023499 - RNA, 22 nt, Human
ccuucccuaaaagcuacuggaa

SEQ ID NO: 1023500 - RNA, 24 nt, Human
cgccccagugcacagaucugguac

SEQ ID NO: 1023501 - RNA, 21 nt, Human
cggcaaccuccacgccuuagc

SEQ ID NO: 1023502 - RNA, 19 nt, Human
cuaaguacaaaucuacacc

SEQ ID NO: 1023503 - RNA, 21 nt, Human
cucaacuauagugcaguccuu

SEQ ID NO: 1023504 - RNA, 19 nt, Human
cucaccuuaccgcaaauuc

SEQ ID NO: 1023505 - RNA, 22 nt, Human
cucagcuuuuuaaucauagauu

SEQ ID NO: 1023506 - RNA, 22 nt, Human
cuccaaaccaaagauaagcccc

SEQ ID NO: 1023507 - RNA, 18 nt, Human
cuggaucugaacuggaga

SEQ ID NO: 1023508 - RNA, 21 nt, Human
cuucaaaaugcaguuaaaaga

SEQ ID NO: 1023509 - RNA, 18 nt, Human
gaaguccuggaauugcuc

SEQ ID NO: 1023510 - RNA, 23 nt, Human
gagguuaauaaaaaauaaacacu

SEQ ID NO: 1023511 - RNA, 20 nt, Human
gccugugugugugagugugu

SEQ ID NO: 1023512 - RNA, 18 nt, Human
gcuaacaaauucugagca

SEQ ID NO: 1023513 - RNA, 20 nt, Human
ggauguguuuguauuugcua

SEQ ID NO: 1023514 - RNA, 21 nt, Human
ggcuguuuuccagcauccugu

SEQ ID NO: 1023515 - RNA, 18 nt, Human
gucucuuccacaucgccc

SEQ ID NO: 1023516 - RNA, 22 nt, Human
gucugcacaugaaaugugugug

SEQ ID NO: 1023517 - RNA, 18 nt, Human
gugugugcacaccaaaaa

SEQ ID NO: 1023518 - RNA, 21 nt, Human
gugugugugugugugugugug

SEQ ID NO: 1023519 - RNA, 20 nt, Human
uaaaaaacucuuugauuagu

SEQ ID NO: 1023520 - RNA, 22 nt, Human
uaaaaacauccugcccuucucc

SEQ ID NO: 1023521 - RNA, 23 nt, Human
uaaaaacauccugcccuucuccc

SEQ ID NO: 1023522 - RNA, 22 nt, Human
uaaaaaggcuuauguuucuuua

SEQ ID NO: 1023523 - RNA, 21 nt, Human
uaaaagaaaaacauaugaaaa

SEQ ID NO: 1023524 - RNA, 23 nt, Human
uaaaagaaaaacauaugaaaaua

SEQ ID NO: 1023525 - RNA, 28 nt, Human
uaaaagaaaaacauaugaaaauaaauaa

SEQ ID NO: 1023526 - RNA, 23 nt, Human
uaaauacaaacauacuucacaaa

SEQ ID NO: 1023527 - RNA, 26 nt, Human
uaacaaacuuguuaaaauauuuagca

SEQ ID NO: 1023528 - RNA, 19 nt, Human
uaacaguaauaacagugga

SEQ ID NO: 1023529 - RNA, 20 nt, Human
uaagguucaagaguucaaau

SEQ ID NO: 1023530 - RNA, 24 nt, Human
uacaaaguaggcaaauaaauacaa

SEQ ID NO: 1023531 - RNA, 22 nt, Human
uaccauacaccaaauguacagc

SEQ ID NO: 1023532 - RNA, 21 nt, Human
uacuggaucugaacuggagag

SEQ ID NO: 1023533 - RNA, 20 nt, Human
uagcaguacaugaaccucua

SEQ ID NO: 1023534 - RNA, 21 nt, Human
uaggcaaauaaauacaaacau

SEQ ID NO: 1023535 - RNA, 21 nt, Human
uagugauaaauccugaaauuc

SEQ ID NO: 1023536 - RNA, 18 nt, Human
uagugggcgccauuuguc

SEQ ID NO: 1023537 - RNA, 23 nt, Human
uauacaaacaaacuaccucaaau

SEQ ID NO: 1023538 - RNA, 19 nt, Human
uauauuuuccauuccuuuc

SEQ ID NO: 1023539 - RNA, 20 nt, Human
uauuuagugauaaauccuga

SEQ ID NO: 1023540 - RNA, 24 nt, Human
ucaaaaugcaguuaaaagauaaaa

SEQ ID NO: 1023541 - RNA, 21 nt, Human
ucaacccaguaagauaaaugc

SEQ ID NO: 1023542 - RNA, 19 nt, Human
ucacaaaacauccugcuca

SEQ ID NO: 1023543 - RNA, 21 nt, Human
ucacaaaacauccugcucaaa

SEQ ID NO: 1023544 - RNA, 18 nt, Human
ucacauucaguuaaaaac

SEQ ID NO: 1023545 - RNA, 20 nt, Human
ucacuaaacuaagguucaag

SEQ ID NO: 1023546 - RNA, 22 nt, Human
ucagcuggggaaaauaaaauua

SEQ ID NO: 1023547 - RNA, 24 nt, Human
uccaugagguuaauaaaaaauaaa

SEQ ID NO: 1023548 - RNA, 23 nt, Human
uccuauaaacagauguauaaagu

SEQ ID NO: 1023549 - RNA, 19 nt, Human
uccuggauguguuccaaaa

SEQ ID NO: 1023550 - RNA, 20 nt, Human
uccuuuuuauaucagcuggg

SEQ ID NO: 1023551 - RNA, 19 nt, Human
ucuacaaaauuuuucauuu

SEQ ID NO: 1023552 - RNA, 25 nt, Human
ucugugugugaguaugccugugugu

SEQ ID NO: 1023553 - RNA, 22 nt, Human
ugaaaagaaaacaaauucagug

SEQ ID NO: 1023554 - RNA, 20 nt, Human
ugaaacucugauccguucag

SEQ ID NO: 1023555 - RNA, 18 nt, Human
ugacgucuuuucuuacug

SEQ ID NO: 1023556 - RNA, 23 nt, Human
ugagguuaauaaaaaauaaacac

SEQ ID NO: 1023557 - RNA, 25 nt, Human
ugagucugugugugugugugugugu

SEQ ID NO: 1023558 - RNA, 22 nt, Human
ugagugcggauuccccacuagu

SEQ ID NO: 1023559 - RNA, 22 nt, Human
ugauaaauccugaaauucauuc

SEQ ID NO: 1023560 - RNA, 19 nt, Human
ugauccguucagaaauuca

SEQ ID NO: 1023561 - RNA, 22 nt, Human
ugcaaacacaaauaaauuaacc

SEQ ID NO: 1023562 - RNA, 21 nt, Human
ugcacaugaaaugugugugca

SEQ ID NO: 1023563 - RNA, 23 nt, Human
ugcauugcuuuuaauccaagaag

SEQ ID NO: 1023564 - RNA, 19 nt, Human
ugccaucacuuuccaucua

SEQ ID NO: 1023565 - RNA, 24 nt, Human
uggaugagucugugugugugugug

SEQ ID NO: 1023566 - RNA, 22 nt, Human
uggauguguuccaaaaugcucu

SEQ ID NO: 1023567 - RNA, 18 nt, Human
uguauagcaaaauguuug

SEQ ID NO: 1023568 - RNA, 22 nt, Human
uguauauuuuguagcauuugaa

SEQ ID NO: 1023569 - RNA, 21 nt, Human
ugugaguaugccugugugugu

SEQ ID NO: 1023570 - RNA, 18 nt, Human
ugugaguguguguguaua

SEQ ID NO: 1023571 - RNA, 18 nt, Human
ugugcaauaaaaaucaaa

SEQ ID NO: 1023572 - RNA, 21 nt, Human
ugugcaauaaaaaucaaacuc

SEQ ID NO: 1023573 - RNA, 18 nt, Human
uguggcaagauuucuauc

SEQ ID NO: 1023574 - RNA, 23 nt, Human
ugugggcucaauuugaagugugg

SEQ ID NO: 1023575 - RNA, 19 nt, Human
ugugugucugugugugagu

SEQ ID NO: 1023576 - RNA, 22 nt, Human
ugugugugaguguguguguaua

SEQ ID NO: 1023577 - RNA, 20 nt, Human
ugugugugugagugugugug

SEQ ID NO: 1023578 - RNA, 21 nt, Human
ugugugugugagugugugugu

SEQ ID NO: 1023579 - RNA, 22 nt, Human
ugugugugugagugugugugua

SEQ ID NO: 1023580 - RNA, 21 nt, Human
ugugugugugugucugugugu

SEQ ID NO: 1023581 - RNA, 21 nt, Human
ugugugugugugucugugugu

SEQ ID NO: 1023582 - RNA, 21 nt, Human
ugugugugugugugucugugu

SEQ ID NO: 1023583 - RNA, 23 nt, Human
ugugugugugugugucugugugu

SEQ ID NO: 1023584 - RNA, 25 nt, Human
ugugugugugugugugucugugugu

SEQ ID NO: 1023585 - RNA, 18 nt, Human
ugugugugugugugugug

SEQ ID NO: 1023586 - RNA, 18 nt, Human
ugugugugugugugugug

SEQ ID NO: 1023587 - RNA, 18 nt, Human
ugugugugugugugugug

SEQ ID NO: 1023588 - RNA, 22 nt, Human
ugugugugugugugugugucug

SEQ ID NO: 1023589 - RNA, 21 nt, Human
ugugugugugugugugugugu

SEQ ID NO: 1023590 - RNA, 21 nt, Human
ugugugugugugugugugugu

SEQ ID NO: 1023591 - RNA, 21 nt, Human
ugugugugugugugugugugu

SEQ ID NO: 1023592 - RNA, 21 nt, Human
ugugugugugugugugugugu

SEQ ID NO: 1023593 - RNA, 21 nt, Human
uguuugaaguaaucauucaga

SEQ ID NO: 1023594 - RNA, 18 nt, Human
uuaaaauauuuagcaaau

SEQ ID NO: 1023595 - RNA, 24 nt, Human
uuacuauauuuuccauuccuuucc

SEQ ID NO: 1023596 - RNA, 21 nt, Human
uuauuuagugauaaauccuga

SEQ ID NO: 1023597 - RNA, 25 nt, Human
uuccuaccauacaccaaauguacag

SEQ ID NO: 1023598 - RNA, 22 nt, Human
uuccuuuccagucaacccagua

SEQ ID NO: 1023599 - RNA, 19 nt, Human
uugauuaguaauaaauaaa

SEQ ID NO: 1023600 - RNA, 18 nt, Human
uugcuaaguacaaaucua

SEQ ID NO: 1023601 - RNA, 21 nt, Human
uuggaaaauaaauuaauaaac

SEQ ID NO: 1023602 - RNA, 21 nt, Human
uuuauaauagacagcacauau

SEQ ID NO: 1023603 - RNA, 21 nt, Human
uuuccuggauguguuccaaaa

SEQ ID NO: 1023604 - RNA, 21 nt, Human
uuucuugcagaaaauuucuac

SEQ ID NO: 1023605 - RNA, 22 nt, Human
uuugugagugcggauuccccac

SEQ ID NO: 1023606 - RNA, 22 nt, Human
aaagacaaugagccccaaauaa

SEQ ID NO: 1023607 - RNA, 18 nt, Human
aauaguauggaggcucuu

SEQ ID NO: 1023608 - RNA, 19 nt, Human
aauuuuguucaucucccuu

SEQ ID NO: 1023609 - RNA, 23 nt, Human
agaaaaggggacacugaaaguau

SEQ ID NO: 1023610 - RNA, 18 nt, Human
agaagcacccauagauua

SEQ ID NO: 1023611 - RNA, 19 nt, Human
aggaacccaaccagacaaa

SEQ ID NO: 1023612 - RNA, 21 nt, Human
aggaacccaaccagacaaaga

SEQ ID NO: 1023613 - RNA, 24 nt, Human
caagugaagaugggugcuuccuuc

SEQ ID NO: 1023614 - RNA, 18 nt, Human
cacaauaaauagaaugca

SEQ ID NO: 1023615 - RNA, 24 nt, Human
cacuccucccgacgccgucgggga

SEQ ID NO: 1023616 - RNA, 18 nt, Human
cacuugugguacaucagu

SEQ ID NO: 1023617 - RNA, 25 nt, Human
cagaaaauucuauaauaaaauuuac

SEQ ID NO: 1023618 - RNA, 19 nt, Human
cagcaccaagugaagaugg

SEQ ID NO: 1023619 - RNA, 22 nt, Human
cauuacagaguuuuaucaagag

SEQ ID NO: 1023620 - RNA, 18 nt, Human
cauucacuucuccuccua

SEQ ID NO: 1023621 - RNA, 21 nt, Human
cauugacuuauuuccaaauua

SEQ ID NO: 1023622 - RNA, 22 nt, Human
ccagaaaaggggacacugaaag

SEQ ID NO: 1023623 - RNA, 27 nt, Human
ccauucacucauuaggauaccuacaua

SEQ ID NO: 1023624 - RNA, 23 nt, Human
cgacgccgucggggagaaaccgg

SEQ ID NO: 1023625 - RNA, 18 nt, Human
cuaguaccauucacucau

SEQ ID NO: 1023626 - RNA, 20 nt, Human
cugugguacaucucuccgac

SEQ ID NO: 1023627 - RNA, 24 nt, Human
gagucucuucccuuauuccaagga

SEQ ID NO: 1023628 - RNA, 23 nt, Human
gauuauuuuuuuccaacacggga

SEQ ID NO: 1023629 - RNA, 24 nt, Human
gcuaauuuuuaaaaccaagguuag

SEQ ID NO: 1023630 - RNA, 20 nt, Human
gugugcuuucauaagauaag

SEQ ID NO: 1023631 - RNA, 18 nt, Human
uaaacagggaaucuggcu

SEQ ID NO: 1023632 - RNA, 18 nt, Human
uaagccaguuucuggaga

SEQ ID NO: 1023633 - RNA, 23 nt, Human
uacaaagacaaugagccccaaau

SEQ ID NO: 1023634 - RNA, 24 nt, Human
uacauuuaucagcauacuaacuaa

SEQ ID NO: 1023635 - RNA, 21 nt, Human
uacuaugagucucuucccuua

SEQ ID NO: 1023636 - RNA, 21 nt, Human
uaucaagaaucucuggaaaau

SEQ ID NO: 1023637 - RNA, 21 nt, Human
uaucagaaaauucuauaauaa

SEQ ID NO: 1023638 - RNA, 21 nt, Human
uaugccagaaaaggggacacu

SEQ ID NO: 1023639 - RNA, 19 nt, Human
uauggaggcucuugugugc

SEQ ID NO: 1023640 - RNA, 20 nt, Human
uauuguaguaacauuacaga

SEQ ID NO: 1023641 - RNA, 18 nt, Human
uccucuaagccaguuucu

SEQ ID NO: 1023642 - RNA, 20 nt, Human
ucggggagaaaccggggaac

SEQ ID NO: 1023643 - RNA, 21 nt, Human
ugaaaagguugucuugugaug

SEQ ID NO: 1023644 - RNA, 24 nt, Human
ugacaacacuugugguacaucagu

SEQ ID NO: 1023645 - RNA, 25 nt, Human
ugacucaagauacacacaacucaau

SEQ ID NO: 1023646 - RNA, 21 nt, Human
ugcagguaaaacauaguuacu

SEQ ID NO: 1023647 - RNA, 18 nt, Human
uggauuuucugagaauga

SEQ ID NO: 1023648 - RNA, 25 nt, Human
ugucuagaaacucaucuuacuaaga

SEQ ID NO: 1023649 - RNA, 22 nt, Human
uuacaaagacaaugagccccaa

SEQ ID NO: 1023650 - RNA, 23 nt, Human
uuaggauaccuacauaacugcaa

SEQ ID NO: 1023651 - RNA, 20 nt, Human
uucacaauaaauagaaugca

SEQ ID NO: 1023652 - RNA, 23 nt, Human
uuuaauaauguacgauucaguaa

SEQ ID NO: 1023653 - RNA, 20 nt, Human
uuucaugacagcgugucuag

SEQ ID NO: 1023654 - RNA, 19 nt, Human
uuuguccauauguacaaga

SEQ ID NO: 1023655 - RNA, 19 nt, Human
aagcccaggagcggccagg

SEQ ID NO: 1023656 - RNA, 22 nt, Human
agcccaggagcggccaggaaau

SEQ ID NO: 1023657 - RNA, 25 nt, Human
aguuauaaguuucuuguaggugcuu

SEQ ID NO: 1023658 - RNA, 24 nt, Human
aucucuucuuuccgcgaagcccag

SEQ ID NO: 1023659 - RNA, 19 nt, Human
augcguggucccauggcca

SEQ ID NO: 1023660 - RNA, 25 nt, Human
caggugauuuauugacgauguguuc

SEQ ID NO: 1023661 - RNA, 18 nt, Human
ccucaugauaugccuugc

SEQ ID NO: 1023662 - RNA, 22 nt, Human
ccugccucugaagaauuaaugu

SEQ ID NO: 1023663 - RNA, 19 nt, Human
cucaugauaugccuugccu

SEQ ID NO: 1023664 - RNA, 23 nt, Human
ggauccuuucacagcuuucaccu

SEQ ID NO: 1023665 - RNA, 19 nt, Human
ggguuccuguuaagucucc

SEQ ID NO: 1023666 - RNA, 18 nt, Human
guggauccuuucacagcu

SEQ ID NO: 1023667 - RNA, 21 nt, Human
uauuuucuuauuacuucauag

SEQ ID NO: 1023668 - RNA, 23 nt, Human
ucaccaugccauuuuuacaaccu

SEQ ID NO: 1023669 - RNA, 25 nt, Human
ucaguaauagugacucuaucucucc

SEQ ID NO: 1023670 - RNA, 20 nt, Human
ucccauggccaugaauggcc

SEQ ID NO: 1023671 - RNA, 23 nt, Human
ucuccaauguccuuggacuuagc

SEQ ID NO: 1023672 - RNA, 21 nt, Human
ucuuggcugaaacagcuuagc

SEQ ID NO: 1023673 - RNA, 22 nt, Human
ugaaagucuuagcccugccucu

SEQ ID NO: 1023674 - RNA, 24 nt, Human
ugacucagucaccauaucaguaag

SEQ ID NO: 1023675 - RNA, 21 nt, Human
ugacuggguuccuguuaaguc

SEQ ID NO: 1023676 - RNA, 22 nt, Human
ugagauggagauuugggugcag

SEQ ID NO: 1023677 - RNA, 18 nt, Human
ugauaugccuugccagaa

SEQ ID NO: 1023678 - RNA, 23 nt, Human
uggauccuuucacagcuuucaac

SEQ ID NO: 1023679 - RNA, 23 nt, Human
uggcaguauguuguugacucagu

SEQ ID NO: 1023680 - RNA, 21 nt, Human
uuggagaggcccacugugaua

SEQ ID NO: 1023681 - RNA, 24 nt, Human
uuuuuuuuuuuuuucuguuacauu

SEQ ID NO: 1023682 - RNA, 22 nt, Human
uuuuuuuuuuuuuuuuucuguu

SEQ ID NO: 1023683 - RNA, 26 nt, Human
uuuuuuuuuuuuuuuuuuuucugggg

SEQ ID NO: 1023684 - RNA, 18 nt, Human
acagacaccuaacaugac

SEQ ID NO: 1023685 - RNA, 23 nt, Human
acagacaccuaacaugacgugac

SEQ ID NO: 1023686 - RNA, 21 nt, Human
acgugacaccgcccguccccc

SEQ ID NO: 1023687 - RNA, 21 nt, Human
auacaccaccucauuuagagu

SEQ ID NO: 1023688 - RNA, 22 nt, Human
augaauucuccaaaauacaaaa

SEQ ID NO: 1023689 - RNA, 18 nt, Human
auucaugggguuuucccu

SEQ ID NO: 1023690 - RNA, 22 nt, Human
cauacaccaccucauuuagagu

SEQ ID NO: 1023691 - RNA, 20 nt, Human
ccccaaaacuguggagugag

SEQ ID NO: 1023692 - RNA, 24 nt, Human
ccccgugucccgcgcacgcgccca

SEQ ID NO: 1023693 - RNA, 21 nt, Human
cccgcgcacgcgcccaaaccg

SEQ ID NO: 1023694 - RNA, 19 nt, Human
cccgcgcgcccgcggccuc

SEQ ID NO: 1023695 - RNA, 20 nt, Human
cccgcgcgcccgcggccucg

SEQ ID NO: 1023696 - RNA, 19 nt, Human
ccgcccgucccccgugucc

SEQ ID NO: 1023697 - RNA, 19 nt, Human
ccgcccgucccccgugucc

SEQ ID NO: 1023698 - RNA, 23 nt, Human
ccucgcgaucacgugacaccgcc

SEQ ID NO: 1023699 - RNA, 22 nt, Human
cgcccgucccccgugucccgcg

SEQ ID NO: 1023700 - RNA, 18 nt, Human
cgggacgagucggggacg

SEQ ID NO: 1023701 - RNA, 19 nt, Human
cuucuacacugagaaugaa

SEQ ID NO: 1023702 - RNA, 18 nt, Human
ggaacucuuucuuaucuc

SEQ ID NO: 1023703 - RNA, 20 nt, Human
gggccgggacgagucgggga

SEQ ID NO: 1023704 - RNA, 20 nt, Human
gguauuuuugguacccaugu

SEQ ID NO: 1023705 - RNA, 21 nt, Human
uaauugcauuuccugaagucc

SEQ ID NO: 1023706 - RNA, 19 nt, Human
uacugugcgucucuucugc

SEQ ID NO: 1023707 - RNA, 20 nt, Human
uagaauuggguauuuuuggu

SEQ ID NO: 1023708 - RNA, 22 nt, Human
uagaguucucauccucauggag

SEQ ID NO: 1023709 - RNA, 25 nt, Human
uauuuuuaaaacuucacacuucaaa

SEQ ID NO: 1023710 - RNA, 25 nt, Human
uauuuuuaaaacuucacacuucaaa

SEQ ID NO: 1023711 - RNA, 19 nt, Human
ucacaggauucuucuuugc

SEQ ID NO: 1023712 - RNA, 21 nt, Human
uccaaaauacaaaauagucug

SEQ ID NO: 1023713 - RNA, 21 nt, Human
uccaagaugaucugucaaaga

SEQ ID NO: 1023714 - RNA, 22 nt, Human
uccauaauaugaauucuccaaa

SEQ ID NO: 1023715 - RNA, 25 nt, Human
uccauacaccaccucauuuagaguu

SEQ ID NO: 1023716 - RNA, 22 nt, Human
uccccaguggaauauuucuaau

SEQ ID NO: 1023717 - RNA, 19 nt, Human
ucccgcgcacgcgcccaaa

SEQ ID NO: 1023718 - RNA, 22 nt, Human
ucccuugacaguacuauucuga

SEQ ID NO: 1023719 - RNA, 21 nt, Human
ucgggcggcuccgaacgggcc

SEQ ID NO: 1023720 - RNA, 18 nt, Human
ucggggacugcaccccga

SEQ ID NO: 1023721 - RNA, 22 nt, Human
ucgguucuacugugcgucucuu

SEQ ID NO: 1023722 - RNA, 24 nt, Human
ucuacaaacguuaucauaauugca

SEQ ID NO: 1023723 - RNA, 20 nt, Human
ucuaugguuuuaaaaguuuu

SEQ ID NO: 1023724 - RNA, 19 nt, Human
ucuccaaaauacaaaauag

SEQ ID NO: 1023725 - RNA, 22 nt, Human
ugaauucuccaaaauacaaaau

SEQ ID NO: 1023726 - RNA, 18 nt, Human
ugagauccacugcaguca

SEQ ID NO: 1023727 - RNA, 22 nt, Human
uggaaggcuuuuggacauucac

SEQ ID NO: 1023728 - RNA, 18 nt, Human
uggacauucacaggauuc

SEQ ID NO: 1023729 - RNA, 25 nt, Human
uggagugaggucucagcuaggucuu

SEQ ID NO: 1023730 - RNA, 19 nt, Human
uguuagguucuccauaaua

SEQ ID NO: 1023731 - RNA, 18 nt, Human
uuccaggaacucuuucuu

SEQ ID NO: 1023732 - RNA, 21 nt, Human
uucccagugucuuuaaauugu

SEQ ID NO: 1023733 - RNA, 21 nt, Human
uugacaguacuauucugaggg

SEQ ID NO: 1023734 - RNA, 24 nt, Human
uuguugcacugucccauauuuagu

SEQ ID NO: 1023735 - RNA, 18 nt, Human
uuuagaguucucauccuc

SEQ ID NO: 1023736 - RNA, 23 nt, Human
uuucugcugcuguacgagaugau

SEQ ID NO: 1023737 - RNA, 24 nt, Human
uuuuugagauccacugcagucaua

SEQ ID NO: 1023738 - RNA, 24 nt, Human
aaaaggauaaauccuucauaaaaa

SEQ ID NO: 1023739 - RNA, 25 nt, Human
aaacagcacacugaaaaaaaaggau

SEQ ID NO: 1023740 - RNA, 19 nt, Human
acaauaccaaggaagacca

SEQ ID NO: 1023741 - RNA, 23 nt, Human
acuuuaaaaucccucaaaaacug

SEQ ID NO: 1023742 - RNA, 18 nt, Human
agacaggugaucaggucu

SEQ ID NO: 1023743 - RNA, 19 nt, Human
agagaauucuauggccaca

SEQ ID NO: 1023744 - RNA, 25 nt, Human
agcaauaaacagcacacugaaaaaa

SEQ ID NO: 1023745 - RNA, 18 nt, Human
agugacaacaauaccaag

SEQ ID NO: 1023746 - RNA, 22 nt, Human
auagcaguuuucuggcagggca

SEQ ID NO: 1023747 - RNA, 20 nt, Human
caacaauaccaaggaagacc

SEQ ID NO: 1023748 - RNA, 21 nt, Human
caacaauaccaaggaagacca

SEQ ID NO: 1023749 - RNA, 19 nt, Human
cagcacacugaaaaaaaag

SEQ ID NO: 1023750 - RNA, 21 nt, Human
cuggcagggcagccacuucuc

SEQ ID NO: 1023751 - RNA, 20 nt, Human
gaauucuauggccacaucuc

SEQ ID NO: 1023752 - RNA, 25 nt, Human
uaaacagcacacugaaaaaaaagga

SEQ ID NO: 1023753 - RNA, 28 nt, Human
uaaugaacuuuuuuuuuccuggaaacuu

SEQ ID NO: 1023754 - RNA, 18 nt, Human
uaccaaggaagaccaggu

SEQ ID NO: 1023755 - RNA, 19 nt, Human
uaccaaggaagaccaggug

SEQ ID NO: 1023756 - RNA, 19 nt, Human
ucagcaauaaacagcacac

SEQ ID NO: 1023757 - RNA, 22 nt, Human
ucccuauauaaauucugcugug

SEQ ID NO: 1023758 - RNA, 19 nt, Human
uccuccagagagaauucua

SEQ ID NO: 1023759 - RNA, 19 nt, Human
ucucagcaauaaacagcac

SEQ ID NO: 1023760 - RNA, 22 nt, Human
ucucaugucucuucacagugaa

SEQ ID NO: 1023761 - RNA, 18 nt, Human
ucugcugugcagugucca

SEQ ID NO: 1023762 - RNA, 20 nt, Human
ugacaacaauaccaaggaag

SEQ ID NO: 1023763 - RNA, 22 nt, Human
uucacagugaaggguuuuuuuc

SEQ ID NO: 1023764 - RNA, 21 nt, Human
uuccuugcuccagacagguga

SEQ ID NO: 1023765 - RNA, 21 nt, Human
aaacauagaacccacaacaac

SEQ ID NO: 1023766 - RNA, 23 nt, Human
aaagguaugucaacauuugagga

SEQ ID NO: 1023767 - RNA, 18 nt, Human
aacucagcuccucuuagg

SEQ ID NO: 1023768 - RNA, 23 nt, Human
aaguccugcccagaaaacucuaa

SEQ ID NO: 1023769 - RNA, 19 nt, Human
acaaaauaaacaagccagg

SEQ ID NO: 1023770 - RNA, 20 nt, Human
accuguaguuuaaaaguuuu

SEQ ID NO: 1023771 - RNA, 21 nt, Human
agaaacaauauucccgccccu

SEQ ID NO: 1023772 - RNA, 22 nt, Human
agcaaaugacacugccuccaca

SEQ ID NO: 1023773 - RNA, 23 nt, Human
auagaacccacaacaacucagcu

SEQ ID NO: 1023774 - RNA, 18 nt, Human
augacacugccuccacaa

SEQ ID NO: 1023775 - RNA, 25 nt, Human
auuauaaauuccauaggggaaguaa

SEQ ID NO: 1023776 - RNA, 30 nt, Human
caacaguaauaauauuaaaaaaaauaaaaa

SEQ ID NO: 1023777 - RNA, 19 nt, Human
caguggcaaaucagaaucu

SEQ ID NO: 1023778 - RNA, 22 nt, Human
cauucuucuuucaagaauaaag

SEQ ID NO: 1023779 - RNA, 20 nt, Human
ccacaaaauaagaauuaucc

SEQ ID NO: 1023780 - RNA, 23 nt, Human
cccacaaaauaaacaagccaggu

SEQ ID NO: 1023781 - RNA, 21 nt, Human
ccccuucucucuuucccuccc

SEQ ID NO: 1023782 - RNA, 21 nt, Human
ccccuucucucuuucccuccc

SEQ ID NO: 1023783 - RNA, 23 nt, Human
ccgccccuucucucuucuguuuc

SEQ ID NO: 1023784 - RNA, 24 nt, Human
ccuguaguuuaaaaguuuugcuau

SEQ ID NO: 1023785 - RNA, 21 nt, Human
ccuugguagaaauggacugcu

SEQ ID NO: 1023786 - RNA, 23 nt, Human
gcagagcaaaugacacugccucc

SEQ ID NO: 1023787 - RNA, 25 nt, Human
gggaaguaaacauagaacccacaac

SEQ ID NO: 1023788 - RNA, 19 nt, Human
guccccuuuggaaugaaaa

SEQ ID NO: 1023789 - RNA, 27 nt, Human
uaaaaugccagucaucaaaacuauggg

SEQ ID NO: 1023790 - RNA, 21 nt, Human
uaaaccaccaaaguccugccc

SEQ ID NO: 1023791 - RNA, 22 nt, Human
uaaagaaacaauauucccgccc

SEQ ID NO: 1023792 - RNA, 23 nt, Human
uaaccccucaaagaggaggugac

SEQ ID NO: 1023793 - RNA, 23 nt, Human
ucaaaacuauggaaaaacagugc

SEQ ID NO: 1023794 - RNA, 20 nt, Human
ucagcuucuucuaaccccuc

SEQ ID NO: 1023795 - RNA, 21 nt, Human
uccugcccagaaaacucuaaa

SEQ ID NO: 1023796 - RNA, 22 nt, Human
ucgggagaucucagcuucuucu

SEQ ID NO: 1023797 - RNA, 19 nt, Human
ugaagaacaaaaaauuggu

SEQ ID NO: 1023798 - RNA, 18 nt, Human
ugcccagaaaacucuaaa

SEQ ID NO: 1023799 - RNA, 24 nt, Human
ugcuauaugguacaguguaaaaca

SEQ ID NO: 1023800 - RNA, 21 nt, Human
ugguacaguguaaaacauacu

SEQ ID NO: 1023801 - RNA, 22 nt, Human
uuaaaaguuuugcuauauggua

SEQ ID NO: 1023802 - RNA, 19 nt, Human
uucccccuucucucuuucc

SEQ ID NO: 1023803 - RNA, 24 nt, Human
uucucucuuucccucccuugcccc

SEQ ID NO: 1023804 - RNA, 19 nt, Human
uugcccccuccaagccaag

SEQ ID NO: 1023805 - RNA, 19 nt, Human
aggggccggugagaggagu

SEQ ID NO: 1023806 - RNA, 18 nt, Human
aguugcccaggaaaaaaa

SEQ ID NO: 1023807 - RNA, 18 nt, Human
aguugcccaggaaaaaga

SEQ ID NO: 1023808 - RNA, 24 nt, Human
ccacaugaugaucugauucucuuc

SEQ ID NO: 1023809 - RNA, 24 nt, Human
ccacaugaugaucugauucucuuc

SEQ ID NO: 1023810 - RNA, 23 nt, Human
ccaggaacaaugguaauccccac

SEQ ID NO: 1023811 - RNA, 23 nt, Human
ccaggaacaaugguaauccccac

SEQ ID NO: 1023812 - RNA, 23 nt, Human
ccuccugccucugcgaccaagga

SEQ ID NO: 1023813 - RNA, 23 nt, Human
cggucgggugccuccugccucug

SEQ ID NO: 1023814 - RNA, 21 nt, Human
cuagagcgccagcucugcccc

SEQ ID NO: 1023815 - RNA, 24 nt, Human
cugaggagggaguuggaaguuuau

SEQ ID NO: 1023816 - RNA, 23 nt, Human
gaaaggagggagggacuguagag

SEQ ID NO: 1023817 - RNA, 23 nt, Human
gaaaggagggagggacuguagag

SEQ ID NO: 1023818 - RNA, 20 nt, Human
gacagcgucggguacuaaag

SEQ ID NO: 1023819 - RNA, 18 nt, Human
gcggucgggugccuccug

SEQ ID NO: 1023820 - RNA, 20 nt, Human
gcggucgggugccuccugcc

SEQ ID NO: 1023821 - RNA, 22 nt, Human
gggcuagagcgccagcucugcc

SEQ ID NO: 1023822 - RNA, 23 nt, Human
uaacuuuaauaaggaaauucaac

SEQ ID NO: 1023823 - RNA, 23 nt, Human
uaacuuuaauaaggaaauucaac

SEQ ID NO: 1023824 - RNA, 18 nt, Human
ucccagacagcgucgggu

SEQ ID NO: 1023825 - RNA, 22 nt, Human
ucugcgaccaaggagccgaaac

SEQ ID NO: 1023826 - RNA, 20 nt, Human
uggacaaggcaucuaaaaac

SEQ ID NO: 1023827 - RNA, 20 nt, Human
uggacaaggcaucuaaaaac

SEQ ID NO: 1023828 - RNA, 24 nt, Human
accagaaaaauuugguccauaaaa

SEQ ID NO: 1023829 - RNA, 23 nt, Human
cccgucuacuuagugcucgggag

SEQ ID NO: 1023830 - RNA, 27 nt, Human
ucgggaguuguagugauaauuucucuc

SEQ ID NO: 1023831 - RNA, 21 nt, Human
uuggaucguacaguaccagaa

SEQ ID NO: 1023832 - RNA, 20 nt, Human
uuguagugauaauuucucuc

SEQ ID NO: 1023833 - RNA, 19 nt, Human
aaccacugaauaacugaag

SEQ ID NO: 1023834 - RNA, 18 nt, Human
ccgccgucgccugcccac

SEQ ID NO: 1023835 - RNA, 20 nt, Human
uauguuaauauuucaaauau

SEQ ID NO: 1023836 - RNA, 21 nt, Human
aagacacaacaggggcggccg

SEQ ID NO: 1023837 - RNA, 22 nt, Human
aaggaggaagagggcuggagag

SEQ ID NO: 1023838 - RNA, 18 nt, Human
accuggccgaggccagcu

SEQ ID NO: 1023839 - RNA, 24 nt, Human
agacaagaugcaaagagcggcccg

SEQ ID NO: 1023840 - RNA, 18 nt, Human
agaccuacgccccagugg

SEQ ID NO: 1023841 - RNA, 20 nt, Human
agaggaaggaggaagagggc

SEQ ID NO: 1023842 - RNA, 20 nt, Human
agaggaaggaggaagagggc

SEQ ID NO: 1023843 - RNA, 21 nt, Human
aggaggaagagggcuggagag

SEQ ID NO: 1023844 - RNA, 24 nt, Human
caagacaagaugcaaagagcggcc

SEQ ID NO: 1023845 - RNA, 18 nt, Human
caaggcagcuccacggcc

SEQ ID NO: 1023846 - RNA, 21 nt, Human
caccucaaggcagcuccacgg

SEQ ID NO: 1023847 - RNA, 23 nt, Human
cacugcaccucaaggcagcucca

SEQ ID NO: 1023848 - RNA, 18 nt, Human
cagcagccgcccgccucg

SEQ ID NO: 1023849 - RNA, 24 nt, Human
caggggaagucaggucccucagga

SEQ ID NO: 1023850 - RNA, 23 nt, Human
cauccaggcccucggaccuggcc

SEQ ID NO: 1023851 - RNA, 20 nt, Human
ccaguggguaugccucuccu

SEQ ID NO: 1023852 - RNA, 21 nt, Human
cccggcccucaccucagcagc

SEQ ID NO: 1023853 - RNA, 19 nt, Human
cccucaggaaccccuccuc

SEQ ID NO: 1023854 - RNA, 18 nt, Human
cccuccucccccagagga

SEQ ID NO: 1023855 - RNA, 20 nt, Human
cccuccucccccagaggaag

SEQ ID NO: 1023856 - RNA, 23 nt, Human
cccucggaccuggccgaggccag

SEQ ID NO: 1023857 - RNA, 19 nt, Human
ccuaaagggcagugaggag

SEQ ID NO: 1023858 - RNA, 21 nt, Human
ccucaggaaccccuccucccc

SEQ ID NO: 1023859 - RNA, 21 nt, Human
cgaggccagcugugggcaaga

SEQ ID NO: 1023860 - RNA, 21 nt, Human
cucaggaaccccuccuccccc

SEQ ID NO: 1023861 - RNA, 23 nt, Human
cucaggaaccccuccucccccag

SEQ ID NO: 1023862 - RNA, 24 nt, Human
cuggaagcuccacugugagucuga

SEQ ID NO: 1023863 - RNA, 21 nt, Human
cuggauccccaacacugcacc

SEQ ID NO: 1023864 - RNA, 24 nt, Human
cuggcccugggagccuaaagggca

SEQ ID NO: 1023865 - RNA, 18 nt, Human
gaaaaaaagacacaacag

SEQ ID NO: 1023866 - RNA, 22 nt, Human
gaggaaggaggaagagggcugg

SEQ ID NO: 1023867 - RNA, 20 nt, Human
gauccccaacacugcaccuc

SEQ ID NO: 1023868 - RNA, 19 nt, Human
ggagaguccugaggucgcg

SEQ ID NO: 1023869 - RNA, 19 nt, Human
ggcagcccugggggcuggu

SEQ ID NO: 1023870 - RNA, 19 nt, Human
gggcaagacaagaugcaaa

SEQ ID NO: 1023871 - RNA, 22 nt, Human
gggcggcagcccugggggcugg

SEQ ID NO: 1023872 - RNA, 20 nt, Human
gucacggaggggacacggag

SEQ ID NO: 1023873 - RNA, 19 nt, Human
uagcaagaggccuggagca

SEQ ID NO: 1023874 - RNA, 21 nt, Human
ucaggaaccccuccuccccca

SEQ ID NO: 1023875 - RNA, 23 nt, Human
ucauuggcuuuauucuggguccu

SEQ ID NO: 1023876 - RNA, 24 nt, Human
ucccucaggaaccccuccuccccc

SEQ ID NO: 1023877 - RNA, 19 nt, Human
ugcucaguuccucagcaac

SEQ ID NO: 1023878 - RNA, 18 nt, Human
uggauccccaacacugca

SEQ ID NO: 1023879 - RNA, 23 nt, Human
uggcccggcccucaccucagcag

SEQ ID NO: 1023880 - RNA, 19 nt, Human
uggcccugggagccuaaag

SEQ ID NO: 1023881 - RNA, 20 nt, Human
ugggcugcccggaagaguag

SEQ ID NO: 1023882 - RNA, 21 nt, Human
ugggggcuggugcagaaaaua

SEQ ID NO: 1023883 - RNA, 22 nt, Human
uggguaugccucuccucuggcc

SEQ ID NO: 1023884 - RNA, 19 nt, Human
uucuggguccuggaagcuc

SEQ ID NO: 1023885 - RNA, 25 nt, Human
uuuuuuuuuuuuuuuuuuuuucagg

SEQ ID NO: 1023886 - RNA, 25 nt, Human
aaccacaagagugaaauaauacacc

SEQ ID NO: 1023887 - RNA, 21 nt, Human
aagaaagaaaaaaaaaaagga

SEQ ID NO: 1023888 - RNA, 22 nt, Human
aagaaagaaaaaaaaaaaggac

SEQ ID NO: 1023889 - RNA, 20 nt, Human
aagcggcggcgguagggacg

SEQ ID NO: 1023890 - RNA, 22 nt, Human
aagcggcggcgguagggacguu

SEQ ID NO: 1023891 - RNA, 24 nt, Human
aaucgcuugaacccgggaggcaga

SEQ ID NO: 1023892 - RNA, 24 nt, Human
accugaggucaggaguucaagacc

SEQ ID NO: 1023893 - RNA, 19 nt, Human
acugcacugcagccugggc

SEQ ID NO: 1023894 - RNA, 23 nt, Human
acugcacugcagccugggcgaug

SEQ ID NO: 1023895 - RNA, 24 nt, Human
acugcacugcagccugggcgaugg

SEQ ID NO: 1023896 - RNA, 22 nt, Human
agaaucgcuugaacccgggagg

SEQ ID NO: 1023897 - RNA, 21 nt, Human
agacaagaucgugucacugca

SEQ ID NO: 1023898 - RNA, 20 nt, Human
agagguugcagugagacaag

SEQ ID NO: 1023899 - RNA, 24 nt, Human
agagguugcagugagacaagaucg

SEQ ID NO: 1023900 - RNA, 23 nt, Human
agaucaccugaggucaggaguuc

SEQ ID NO: 1023901 - RNA, 23 nt, Human
agcacuuugugaggccgaggcag

SEQ ID NO: 1023902 - RNA, 24 nt, Human
agccugggcgauggagcaagacuc

SEQ ID NO: 1023903 - RNA, 20 nt, Human
agcugggugugguggugggu

SEQ ID NO: 1023904 - RNA, 22 nt, Human
agcugggugugguggugggugc

SEQ ID NO: 1023905 - RNA, 23 nt, Human
agcugggugugguggugggugcc

SEQ ID NO: 1023906 - RNA, 23 nt, Human
aggaguucaagaccaggcuggcc

SEQ ID NO: 1023907 - RNA, 19 nt, Human
aggcagagguugcagugag

SEQ ID NO: 1023908 - RNA, 24 nt, Human
aggcagagguugcagugagacaag

SEQ ID NO: 1023909 - RNA, 26 nt, Human
aggcagaucaccugaggucaggaguu

SEQ ID NO: 1023910 - RNA, 24 nt, Human
aggcaggagaaucgcuugaacccg

SEQ ID NO: 1023911 - RNA, 22 nt, Human
aggcaggcagaucaccugaggu

SEQ ID NO: 1023912 - RNA, 26 nt, Human
aggcaggcagaucaccugaggucagg

SEQ ID NO: 1023913 - RNA, 19 nt, Human
aggccaaaaaaccacaaga

SEQ ID NO: 1023914 - RNA, 20 nt, Human
aggcugaggcaggagaaucg

SEQ ID NO: 1023915 - RNA, 24 nt, Human
aggcugaggcaggagaaucgcuug

SEQ ID NO: 1023916 - RNA, 23 nt, Human
aucaccugaggucaggaguucaa

SEQ ID NO: 1023917 - RNA, 24 nt, Human
aucgugucacugcacugcagccug

SEQ ID NO: 1023918 - RNA, 27 nt, Human
augcaaaaaauggacuaaaagggaccc

SEQ ID NO: 1023919 - RNA, 19 nt, Human
augccuguaauccuagcac

SEQ ID NO: 1023920 - RNA, 26 nt, Human
caaaaaaccacaagagugaaauaaua

SEQ ID NO: 1023921 - RNA, 24 nt, Human
caagaccaggcuggccaauguggu

SEQ ID NO: 1023922 - RNA, 23 nt, Human
caagacucuuucucaaaaaaaga

SEQ ID NO: 1023923 - RNA, 20 nt, Human
caagaucgugucacugcacu

SEQ ID NO: 1023924 - RNA, 26 nt, Human
cacacacgcgucgggacuaggccgcg

SEQ ID NO: 1023925 - RNA, 26 nt, Human
cacacacgcgucgggacuaggccgcg

SEQ ID NO: 1023926 - RNA, 22 nt, Human
cacacgcgucgggacuaggccg

SEQ ID NO: 1023927 - RNA, 22 nt, Human
cacacgcgucgggacuaggccg

SEQ ID NO: 1023928 - RNA, 24 nt, Human
cacacgcgucgggacuaggccgcg

SEQ ID NO: 1023929 - RNA, 24 nt, Human
cacacgcgucgggacuaggccgcg

SEQ ID NO: 1023930 - RNA, 23 nt, Human
caccugaggucaggaguucaaga

SEQ ID NO: 1023931 - RNA, 19 nt, Human
cacugcacugcagccuggg

SEQ ID NO: 1023932 - RNA, 19 nt, Human
cacugcacugcagccuggg

SEQ ID NO: 1023933 - RNA, 20 nt, Human
cacugcacugcagccugggc

SEQ ID NO: 1023934 - RNA, 23 nt, Human
cacugcacugcagccugggcgau

SEQ ID NO: 1023935 - RNA, 24 nt, Human
cacugcacugcagccugggcgaug

SEQ ID NO: 1023936 - RNA, 27 nt, Human
cacugcacugcagccugggcgauggag

SEQ ID NO: 1023937 - RNA, 23 nt, Human
cacugcagccugggcgauggagc

SEQ ID NO: 1023938 - RNA, 27 nt, Human
cagaucaccugaggucaggaguucaag

SEQ ID NO: 1023939 - RNA, 24 nt, Human
cagcuacucaggaggcugaggcag

SEQ ID NO: 1023940 - RNA, 24 nt, Human
caggcagaucaccugaggucagga

SEQ ID NO: 1023941 - RNA, 24 nt, Human
caugccuguaauccuagcacuuug

SEQ ID NO: 1023942 - RNA, 18 nt, Human
ccacugccgccgucgccg

SEQ ID NO: 1023943 - RNA, 18 nt, Human
ccacugccgccgucgccg

SEQ ID NO: 1023944 - RNA, 22 nt, Human
ccauuaucuauauucuugucug

SEQ ID NO: 1023945 - RNA, 18 nt, Human
cccccauggcagagaccc

SEQ ID NO: 1023946 - RNA, 18 nt, Human
cccccauggcagagaccc

SEQ ID NO: 1023947 - RNA, 23 nt, Human
ccccgucucuacuaaaaauacaa

SEQ ID NO: 1023948 - RNA, 18 nt, Human
ccgccgccgcugccccug

SEQ ID NO: 1023949 - RNA, 19 nt, Human
ccgccgcugccccugucgc

SEQ ID NO: 1023950 - RNA, 19 nt, Human
ccgccgcugccccugucgc

SEQ ID NO: 1023951 - RNA, 19 nt, Human
ccgccgcugccccugucgc

SEQ ID NO: 1023952 - RNA, 19 nt, Human
ccgccgcugccccugucgc

SEQ ID NO: 1023953 - RNA, 19 nt, Human
ccggcggcgccagguuccc

SEQ ID NO: 1023954 - RNA, 22 nt, Human
ccggcggcgccagguucccggg

SEQ ID NO: 1023955 - RNA, 22 nt, Human
ccugggcgauggagcaagacuc

SEQ ID NO: 1023956 - RNA, 19 nt, Human
ccuguaauuccagcuacuc

SEQ ID NO: 1023957 - RNA, 21 nt, Human
ccuguaauuccagcuacucag

SEQ ID NO: 1023958 - RNA, 19 nt, Human
cggcgguagggacguugcc

SEQ ID NO: 1023959 - RNA, 22 nt, Human
cgggugcaggcgcgucacuccc

SEQ ID NO: 1023960 - RNA, 22 nt, Human
cgggugcaggcgcgucacuccc

SEQ ID NO: 1023961 - RNA, 19 nt, Human
cucaaaaaaagaaagaaaa

SEQ ID NO: 1023962 - RNA, 19 nt, Human
cucaaaaaaagaaagaaaa

SEQ ID NO: 1023963 - RNA, 22 nt, Human
cucaaaaaaagaaagaaaaaaa

SEQ ID NO: 1023964 - RNA, 24 nt, Human
cucaugccuguaauccuagcacuu

SEQ ID NO: 1023965 - RNA, 26 nt, Human
cuggccaauguggugaaugaagcccc

SEQ ID NO: 1023966 - RNA, 19 nt, Human
gaagccccgucucuacuaa

SEQ ID NO: 1023967 - RNA, 18 nt, Human
gagaccccgucgggcucc

SEQ ID NO: 1023968 - RNA, 21 nt, Human
gagcaagacucuuucucaaaa

SEQ ID NO: 1023969 - RNA, 19 nt, Human
gaggcaggcagaucaccug

SEQ ID NO: 1023970 - RNA, 25 nt, Human
gaggcaggcagaucaccugagguca

SEQ ID NO: 1023971 - RNA, 21 nt, Human
gaggccgaggcaggcagauca

SEQ ID NO: 1023972 - RNA, 23 nt, Human
gaucaccugaggucaggaguuca

SEQ ID NO: 1023973 - RNA, 24 nt, Human
gaucaccugaggucaggaguucaa

SEQ ID NO: 1023974 - RNA, 21 nt, Human
gaucccuugacuaagucuaga

SEQ ID NO: 1023975 - RNA, 21 nt, Human
gcaauauuacaaauacugagu

SEQ ID NO: 1023976 - RNA, 21 nt, Human
gcaggcgcgucacucccccau

SEQ ID NO: 1023977 - RNA, 21 nt, Human
gcaggcgcgucacucccccau

SEQ ID NO: 1023978 - RNA, 22 nt, Human
gccgccacugccgccgucgccg

SEQ ID NO: 1023979 - RNA, 22 nt, Human
gccgccacugccgccgucgccg

SEQ ID NO: 1023980 - RNA, 20 nt, Human
gcuggccaauguggugaaug

SEQ ID NO: 1023981 - RNA, 28 nt, Human
gcuggccaauguggugaaugaagccccg

SEQ ID NO: 1023982 - RNA, 25 nt, Human
ggacguugccaagccacgucaucag

SEQ ID NO: 1023983 - RNA, 23 nt, Human
ggccgggugcuguggcucaugcc

SEQ ID NO: 1023984 - RNA, 24 nt, Human
gggugcuguggcucaugccuguaa

SEQ ID NO: 1023985 - RNA, 24 nt, Human
gucacugcacugcagccugggcga

SEQ ID NO: 1023986 - RNA, 20 nt, Human
guggcucaugccuguaaucc

SEQ ID NO: 1023987 - RNA, 20 nt, Human
guggcucaugccuguaaucc

SEQ ID NO: 1023988 - RNA, 24 nt, Human
guggugaaugaagccccgucucua

SEQ ID NO: 1023989 - RNA, 23 nt, Human
guggugggugccuguaauuccag

SEQ ID NO: 1023990 - RNA, 19 nt, Human
uaaaaauacaaaaaugagc

SEQ ID NO: 1023991 - RNA, 18 nt, Human
uaauguuucauucuguau

SEQ ID NO: 1023992 - RNA, 23 nt, Human
uacugagucauuuaaucuucauu

SEQ ID NO: 1023993 - RNA, 21 nt, Human
uagcacacacgcgucgggacu

SEQ ID NO: 1023994 - RNA, 21 nt, Human
uagcacacacgcgucgggacu

SEQ ID NO: 1023995 - RNA, 25 nt, Human
uagcacuuugugaggccgaggcagg

SEQ ID NO: 1023996 - RNA, 19 nt, Human
uauuacaaauacugaguca

SEQ ID NO: 1023997 - RNA, 19 nt, Human
ucaaaaaaagaaagaaaaa

SEQ ID NO: 1023998 - RNA, 23 nt, Human
ucaccugaggucaggaguucaag

SEQ ID NO: 1023999 - RNA, 20 nt, Human
ucacugcacugcagccuggg

SEQ ID NO: 1024000 - RNA, 21 nt, Human
ucacugcacugcagccugggc

SEQ ID NO: 1024001 - RNA, 24 nt, Human
ucacugcacugcagccugggcgau

SEQ ID NO: 1024002 - RNA, 20 nt, Human
ucccccauggcagagacccc

SEQ ID NO: 1024003 - RNA, 20 nt, Human
ucccccauggcagagacccc

SEQ ID NO: 1024004 - RNA, 27 nt, Human
ucccccauggcagagaccccgucgggc

SEQ ID NO: 1024005 - RNA, 27 nt, Human
ucccccauggcagagaccccgucgggc

SEQ ID NO: 1024006 - RNA, 18 nt, Human
ucgcuugaacccgggagg

SEQ ID NO: 1024007 - RNA, 18 nt, Human
ucgggcuccugcaggccg

SEQ ID NO: 1024008 - RNA, 18 nt, Human
ucgggcuccugcaggccg

SEQ ID NO: 1024009 - RNA, 22 nt, Human
ucucuacuaaaaauacaaaaau

SEQ ID NO: 1024010 - RNA, 18 nt, Human
ugaaauaauacacccagc

SEQ ID NO: 1024011 - RNA, 20 nt, Human
ugaaauaauacacccagcaa

SEQ ID NO: 1024012 - RNA, 24 nt, Human
ugagcugggugugguggugggugc

SEQ ID NO: 1024013 - RNA, 20 nt, Human
ugaggcaggagaaucgcuug

SEQ ID NO: 1024014 - RNA, 24 nt, Human
ugaggcaggagaaucgcuugaacc

SEQ ID NO: 1024015 - RNA, 25 nt, Human
ugaggcaggagaaucgcuugaaccc

SEQ ID NO: 1024016 - RNA, 19 nt, Human
ugaggccaaaaaaccacaa

SEQ ID NO: 1024017 - RNA, 23 nt, Human
ugauguaauacaucauguuuacu

SEQ ID NO: 1024018 - RNA, 22 nt, Human
ugccuguaauccuagcacuuug

SEQ ID NO: 1024019 - RNA, 24 nt, Human
ugccuguaauuccagcuacucagg

SEQ ID NO: 1024020 - RNA, 19 nt, Human
uggcucaugccuguaaucc

SEQ ID NO: 1024021 - RNA, 24 nt, Human
uggcucaugccuguaauccuagca

SEQ ID NO: 1024022 - RNA, 22 nt, Human
uggugggugccuguaauuccag

SEQ ID NO: 1024023 - RNA, 24 nt, Human
ugguggugggugccuguaauucca

SEQ ID NO: 1024024 - RNA, 22 nt, Human
ugucucgccgcugccgcggaac

SEQ ID NO: 1024025 - RNA, 22 nt, Human
ugucucgccgcugccgcggaac

SEQ ID NO: 1024026 - RNA, 24 nt, Human
uguggcucaugccuguaauccuag

SEQ ID NO: 1024027 - RNA, 18 nt, Human
uuaaauaauuacuccacu

SEQ ID NO: 1024028 - RNA, 22 nt, Human
uucauuugggucuuuguaauaa

SEQ ID NO: 1024029 - RNA, 22 nt, Human
uugcagugagacaagaucgugu

SEQ ID NO: 1024030 - RNA, 23 nt, Human
uuucauucuguauuuaaauuucc

SEQ ID NO: 1024031 - RNA, 21 nt, Human
uuugggucuuuguaauaaaca

SEQ ID NO: 1024032 - RNA, 23 nt, Human
uuuuuauccuucuggcaauauua

SEQ ID NO: 1024033 - RNA, 20 nt, Human
uuuuuuuuuuuuuuuuccau

SEQ ID NO: 1024034 - RNA, 24 nt, Human
aaacaguucuuaaacaaagccucg

SEQ ID NO: 1024035 - RNA, 21 nt, Human
aggccaaauaugguggcccau

SEQ ID NO: 1024036 - RNA, 18 nt, Human
auuccucccuuccccucc

SEQ ID NO: 1024037 - RNA, 21 nt, Human
cagcaugaaauaaugcugccu

SEQ ID NO: 1024038 - RNA, 20 nt, Human
caugaaauaaugcugccuga

SEQ ID NO: 1024039 - RNA, 18 nt, Human
cgauuugcucagaaauuc

SEQ ID NO: 1024040 - RNA, 18 nt, Human
cucguacaggccaggagg

SEQ ID NO: 1024041 - RNA, 19 nt, Human
gaaagaaauauuacaggaa

SEQ ID NO: 1024042 - RNA, 22 nt, Human
ggaagucuccuuaauuccugua

SEQ ID NO: 1024043 - RNA, 26 nt, Human
uaaacaaagccucguacaggccagga

SEQ ID NO: 1024044 - RNA, 20 nt, Human
uaauaaacaguucuuaaaca

SEQ ID NO: 1024045 - RNA, 20 nt, Human
uacccugacuccuggaaucu

SEQ ID NO: 1024046 - RNA, 18 nt, Human
uagcuuucuuaagaagau

SEQ ID NO: 1024047 - RNA, 18 nt, Human
uaugccaagggaagaauc

SEQ ID NO: 1024048 - RNA, 27 nt, Human
ucagaaauucucuacccugacuccugg

SEQ ID NO: 1024049 - RNA, 19 nt, Human
uccaaagcuagggccugca

SEQ ID NO: 1024050 - RNA, 18 nt, Human
ugacuccuggaaucuccc

SEQ ID NO: 1024051 - RNA, 19 nt, Human
uggaaagaaauauuacagg

SEQ ID NO: 1024052 - RNA, 24 nt, Human
uucaagacauagcuuucuuaagaa

SEQ ID NO: 1024053 - RNA, 20 nt, Human
uuccucguuccaaagcuagg

SEQ ID NO: 1024054 - RNA, 24 nt, Human
uucuguaaagucaaacuuccaaga

SEQ ID NO: 1024055 - RNA, 22 nt, Human
uuugcucagaaauucucuaccc

SEQ ID NO: 1024056 - RNA, 19 nt, Human
uuuuuuuuuuuuuuuuugu

SEQ ID NO: 1024057 - RNA, 20 nt, Human
uuuuuuuuuuuuuuuuuugg

SEQ ID NO: 1024058 - RNA, 22 nt, Human
aaaaguaagaguugacaaaaaa

SEQ ID NO: 1024059 - RNA, 22 nt, Human
aaaaguaagaguugacaaaaaa

SEQ ID NO: 1024060 - RNA, 24 nt, Human
aaacagaaagugggaaagaucaag

SEQ ID NO: 1024061 - RNA, 24 nt, Human
aaacagaaagugggaaagaucaag

SEQ ID NO: 1024062 - RNA, 25 nt, Human
aaacagaaagugggaaagaucaagg

SEQ ID NO: 1024063 - RNA, 25 nt, Human
aaacagaaagugggaaagaucaagg

SEQ ID NO: 1024064 - RNA, 19 nt, Human
aaacauuuggauccaugaa

SEQ ID NO: 1024065 - RNA, 19 nt, Human
aaacauuuggauccaugaa

SEQ ID NO: 1024066 - RNA, 18 nt, Human
aacaaauacacaacugag

SEQ ID NO: 1024067 - RNA, 24 nt, Human
aagaaccuuagcacaaaaggacuc

SEQ ID NO: 1024068 - RNA, 26 nt, Human
aagguaucacuagaggucaaugaaaa

SEQ ID NO: 1024069 - RNA, 26 nt, Human
aagguaucacuagaggucaaugaaaa

SEQ ID NO: 1024070 - RNA, 23 nt, Human
acaaaaaagguacaucuucucca

SEQ ID NO: 1024071 - RNA, 23 nt, Human
acaaaaaagguacaucuucucca

SEQ ID NO: 1024072 - RNA, 21 nt, Human
acaaaaggacucaacaaacau

SEQ ID NO: 1024073 - RNA, 21 nt, Human
acaaagaaaggacucaacaaa

SEQ ID NO: 1024074 - RNA, 22 nt, Human
acaaagaaaggacucaacaaac

SEQ ID NO: 1024075 - RNA, 21 nt, Human
acccuguguucaaaccagucc

SEQ ID NO: 1024076 - RNA, 22 nt, Human
acccuguguucaaaccaguccc

SEQ ID NO: 1024077 - RNA, 19 nt, Human
accuuagcacaaagaaagg

SEQ ID NO: 1024078 - RNA, 19 nt, Human
agaaaacaaauaaagaucc

SEQ ID NO: 1024079 - RNA, 19 nt, Human
agaaaacaaauaaagaucc

SEQ ID NO: 1024080 - RNA, 23 nt, Human
agaaaacaaauaaagauccaaau

SEQ ID NO: 1024081 - RNA, 19 nt, Human
agcagagcucagaugcaga

SEQ ID NO: 1024082 - RNA, 22 nt, Human
agcucuuuccuguucccaccau

SEQ ID NO: 1024083 - RNA, 18 nt, Human
aguggaugacaaaagcca

SEQ ID NO: 1024084 - RNA, 18 nt, Human
aguggaugacaaaagcca

SEQ ID NO: 1024085 - RNA, 24 nt, Human
auaaagauccaaauacgugaguug

SEQ ID NO: 1024086 - RNA, 24 nt, Human
auaaagauccaaauacgugaguug

SEQ ID NO: 1024087 - RNA, 21 nt, Human
auaaggcacaaaaagauacca

SEQ ID NO: 1024088 - RNA, 21 nt, Human
auaaggcacaaaaagauacca

SEQ ID NO: 1024089 - RNA, 18 nt, Human
auaccaagaauguuaaca

SEQ ID NO: 1024090 - RNA, 18 nt, Human
auaccaagaauguuaaca

SEQ ID NO: 1024091 - RNA, 21 nt, Human
augaaacaaaacauacaauag

SEQ ID NO: 1024092 - RNA, 21 nt, Human
augaaacaaaacauacaauag

SEQ ID NO: 1024093 - RNA, 20 nt, Human
augaacaaauacacaacuga

SEQ ID NO: 1024094 - RNA, 20 nt, Human
augaacaaauacacaacuga

SEQ ID NO: 1024095 - RNA, 28 nt, Human
augaacaucugaaaccagugaucgagaa

SEQ ID NO: 1024096 - RNA, 28 nt, Human
augaacaucugaaaccagugaucgagaa

SEQ ID NO: 1024097 - RNA, 20 nt, Human
augagguguaacauaagcuc

SEQ ID NO: 1024098 - RNA, 18 nt, Human
caaaaagauaccaagaau

SEQ ID NO: 1024099 - RNA, 22 nt, Human
caaaaggacucaacaaacaaug

SEQ ID NO: 1024100 - RNA, 18 nt, Human
caagaaccuuagcacaaa

SEQ ID NO: 1024101 - RNA, 18 nt, Human
caagaaccuuagcacaaa

SEQ ID NO: 1024102 - RNA, 19 nt, Human
cacaaagaaaggacucaac

SEQ ID NO: 1024103 - RNA, 20 nt, Human
cacaaagaaaggacucaaca

SEQ ID NO: 1024104 - RNA, 18 nt, Human
cacauauaaccaccugcc

SEQ ID NO: 1024105 - RNA, 18 nt, Human
cacauauaaccaccugcc

SEQ ID NO: 1024106 - RNA, 27 nt, Human
caccgcaagaaccuuagcacaaagaaa

SEQ ID NO: 1024107 - RNA, 23 nt, Human
cagagcucagaugcagagagagg

SEQ ID NO: 1024108 - RNA, 21 nt, Human
cagaggccuuuucuaggaucu

SEQ ID NO: 1024109 - RNA, 21 nt, Human
cagucuuuccuguaaugaugg

SEQ ID NO: 1024110 - RNA, 21 nt, Human
cagucuuuccuguaaugaugg

SEQ ID NO: 1024111 - RNA, 22 nt, Human
cauacaauaguggaugacaaaa

SEQ ID NO: 1024112 - RNA, 22 nt, Human
cauacaauaguggaugacaaaa

SEQ ID NO: 1024113 - RNA, 18 nt, Human
caucugaaaccagugauc

SEQ ID NO: 1024114 - RNA, 18 nt, Human
caucugaaaccagugauc

SEQ ID NO: 1024115 - RNA, 20 nt, Human
caugaauaaaauuaucuucc

SEQ ID NO: 1024116 - RNA, 20 nt, Human
ccacauauaaccaccugccu

SEQ ID NO: 1024117 - RNA, 20 nt, Human
ccacauauaaccaccugccu

SEQ ID NO: 1024118 - RNA, 20 nt, Human
ccaugcugcuguccuccagg

SEQ ID NO: 1024119 - RNA, 22 nt, Human
ccuaaaacagucagaugagcuc

SEQ ID NO: 1024120 - RNA, 22 nt, Human
ccuaaaacagucagaugagcuc

SEQ ID NO: 1024121 - RNA, 20 nt, Human
ccuggggaagaagacagggg

SEQ ID NO: 1024122 - RNA, 18 nt, Human
ccuguaaugaugguuggg

SEQ ID NO: 1024123 - RNA, 18 nt, Human
ccuguaaugaugguuggg

SEQ ID NO: 1024124 - RNA, 19 nt, Human
ccuuagcacaaaaggacuc

SEQ ID NO: 1024125 - RNA, 20 nt, Human
cuaaaacauucuccuccucc

SEQ ID NO: 1024126 - RNA, 20 nt, Human
cuaaaacauucuccuccucc

SEQ ID NO: 1024127 - RNA, 20 nt, Human
cuaggaucuuucuccaugcu

SEQ ID NO: 1024128 - RNA, 18 nt, Human
cuccauggguagcagagc

SEQ ID NO: 1024129 - RNA, 18 nt, Human
cuccccaucugcacaccc

SEQ ID NO: 1024130 - RNA, 18 nt, Human
cuccccaucugcacaccc

SEQ ID NO: 1024131 - RNA, 18 nt, Human
cugaaucuuugaaaagaa

SEQ ID NO: 1024132 - RNA, 18 nt, Human
cugaaucuuugaaaagaa

SEQ ID NO: 1024133 - RNA, 20 nt, Human
cuuucccuccuuccacacuu

SEQ ID NO: 1024134 - RNA, 18 nt, Human
cuuuccuguucccaccau

SEQ ID NO: 1024135 - RNA, 19 nt, Human
gaacaaauacacaacugag

SEQ ID NO: 1024136 - RNA, 23 nt, Human
gaacaucugaaaccagugaucga

SEQ ID NO: 1024137 - RNA, 23 nt, Human
gaacaucugaaaccagugaucga

SEQ ID NO: 1024138 - RNA, 23 nt, Human
gaauuaaauucaccaugucugca

SEQ ID NO: 1024139 - RNA, 23 nt, Human
gaauuaaauucaccaugucugca

SEQ ID NO: 1024140 - RNA, 19 nt, Human
gcacaaaaggacucaacaa

SEQ ID NO: 1024141 - RNA, 18 nt, Human
gccaguacccccucccca

SEQ ID NO: 1024142 - RNA, 18 nt, Human
gccaguacccccucccca

SEQ ID NO: 1024143 - RNA, 26 nt, Human
gccuuuucuaggaucuuucuccaugc

SEQ ID NO: 1024144 - RNA, 18 nt, Human
ggaggugagggaagucag

SEQ ID NO: 1024145 - RNA, 20 nt, Human
gggaagucagaggccugggg

SEQ ID NO: 1024146 - RNA, 19 nt, Human
gggaggugagggaagucag

SEQ ID NO: 1024147 - RNA, 24 nt, Human
uaaaugaacaucugaaaccaguga

SEQ ID NO: 1024148 - RNA, 24 nt, Human
uaaaugaacaucugaaaccaguga

SEQ ID NO: 1024149 - RNA, 21 nt, Human
uaaggcacaaaaagauaccaa

SEQ ID NO: 1024150 - RNA, 24 nt, Human
uagcacaaaaggacucaacaaaca

SEQ ID NO: 1024151 - RNA, 25 nt, Human
uagcacaaaaggacucaacaaacau

SEQ ID NO: 1024152 - RNA, 20 nt, Human
ucaaugaaacaaaacauaca

SEQ ID NO: 1024153 - RNA, 20 nt, Human
ucaaugaaacaaaacauaca

SEQ ID NO: 1024154 - RNA, 26 nt, Human
ucagaggccuuuucuaggaucuuucu

SEQ ID NO: 1024155 - RNA, 21 nt, Human
uccacacuugcaguccaggga

SEQ ID NO: 1024156 - RNA, 24 nt, Human
uccacagaugccagagcuugcugg

SEQ ID NO: 1024157 - RNA, 24 nt, Human
uccacagaugccagagcuugcugg

SEQ ID NO: 1024158 - RNA, 23 nt, Human
uccaugcugcuguccuccaggaa

SEQ ID NO: 1024159 - RNA, 23 nt, Human
ucccuccuuccacacuugcaguc

SEQ ID NO: 1024160 - RNA, 25 nt, Human
ugaaaagaauauaauaaaugaacau

SEQ ID NO: 1024161 - RNA, 25 nt, Human
ugaaaagaauauaauaaaugaacau

SEQ ID NO: 1024162 - RNA, 18 nt, Human
ugaacaaauacacaacug

SEQ ID NO: 1024163 - RNA, 19 nt, Human
ugagggaagucagaggccu

SEQ ID NO: 1024164 - RNA, 22 nt, Human
ugagggaagucagaggccuggg

SEQ ID NO: 1024165 - RNA, 20 nt, Human
ugagggaagucagaggccuu

SEQ ID NO: 1024166 - RNA, 21 nt, Human
ugaguugaucaucugauaaaa

SEQ ID NO: 1024167 - RNA, 21 nt, Human
ugaguugaucaucugauaaaa

SEQ ID NO: 1024168 - RNA, 19 nt, Human
ugccuaaaacauucuccuc

SEQ ID NO: 1024169 - RNA, 19 nt, Human
ugccuaaaacauucuccuc

SEQ ID NO: 1024170 - RNA, 22 nt, Human
ugggaggugagggaagucagag

SEQ ID NO: 1024171 - RNA, 22 nt, Human
ugggaggugagggaagucagag

SEQ ID NO: 1024172 - RNA, 24 nt, Human
uguucaaaccagucccagcuccug

SEQ ID NO: 1024173 - RNA, 24 nt, Human
uguucaaaccagucccagcuccug

SEQ ID NO: 1024174 - RNA, 22 nt, Human
uucacagucuuuccuguaauga

SEQ ID NO: 1024175 - RNA, 22 nt, Human
uucacagucuuuccuguaauga

SEQ ID NO: 1024176 - RNA, 24 nt, Human
uucccuccuuccacacuugcaguc

SEQ ID NO: 1024177 - RNA, 20 nt, Human
uucuccaugcugcuguccuc

SEQ ID NO: 1024178 - RNA, 22 nt, Human
uuuccuguucccaccauccauc

SEQ ID NO: 1024179 - RNA, 28 nt, Human
uuucuaggaucuuucuccaugcugcugu

SEQ ID NO: 1024180 - RNA, 18 nt, Human
aaagucccccaugucucc

SEQ ID NO: 1024181 - RNA, 24 nt, Human
aaagucccccaugucuccuuacuc

SEQ ID NO: 1024182 - RNA, 19 nt, Human
aagcaggugggccacucca

SEQ ID NO: 1024183 - RNA, 21 nt, Human
aagcaggugggccacuccagg

SEQ ID NO: 1024184 - RNA, 23 nt, Human
aagcaggugggccacuccaggac

SEQ ID NO: 1024185 - RNA, 19 nt, Human
ccagagcgguggcggccau

SEQ ID NO: 1024186 - RNA, 24 nt, Human
ccccaugucuccuuacuccguggg

SEQ ID NO: 1024187 - RNA, 22 nt, Human
ccgcugggcugcuugagcaugc

SEQ ID NO: 1024188 - RNA, 20 nt, Human
gagcaugcuuccuccccgcc

SEQ ID NO: 1024189 - RNA, 22 nt, Human
gggcaagcaggugggccacucc

SEQ ID NO: 1024190 - RNA, 19 nt, Human
uauauaucucacuaacauu

SEQ ID NO: 1024191 - RNA, 23 nt, Human
ucccccaugucuccuuacuccgu

SEQ ID NO: 1024192 - RNA, 19 nt, Human
ucucacuaacauuaaggaa

SEQ ID NO: 1024193 - RNA, 19 nt, Human
ugguccagagcgguggcgg

SEQ ID NO: 1024194 - RNA, 21 nt, Human
uucacacuuccuaaccaaaaa

SEQ ID NO: 1024195 - RNA, 19 nt, Human
acaaaaaguuuuuccacau

SEQ ID NO: 1024196 - RNA, 25 nt, Human
acauucauuacauucauaggguuuu

SEQ ID NO: 1024197 - RNA, 23 nt, Human
auugugagguaugacuucuggcu

SEQ ID NO: 1024198 - RNA, 20 nt, Human
cauucauuacauucauaggg

SEQ ID NO: 1024199 - RNA, 20 nt, Human
cauucauuacauucauaggg

SEQ ID NO: 1024200 - RNA, 23 nt, Human
cauucauuacauucauaggguug

SEQ ID NO: 1024201 - RNA, 23 nt, Human
cauucauuacauucauaggguug

SEQ ID NO: 1024202 - RNA, 18 nt, Human
gauuucugacaaaaaguu

SEQ ID NO: 1024203 - RNA, 21 nt, Human
gcuaaagguuuuuccacauuc

SEQ ID NO: 1024204 - RNA, 26 nt, Human
gggucuuuccccugugugaguuaucu

SEQ ID NO: 1024205 - RNA, 23 nt, Human
uaagguaugauuucugacaaaaa

SEQ ID NO: 1024206 - RNA, 19 nt, Human
uccacauucauuacaucca

SEQ ID NO: 1024207 - RNA, 23 nt, Human
uccacauucauuacauccauaug

SEQ ID NO: 1024208 - RNA, 21 nt, Human
ugaguucccugaugggugcug

SEQ ID NO: 1024209 - RNA, 22 nt, Human
uggcuaaagguuuuuccacauu

SEQ ID NO: 1024210 - RNA, 24 nt, Human
ugugaguucccugaugggugcuga

SEQ ID NO: 1024211 - RNA, 19 nt, Human
uuccccugugugaguucua

SEQ ID NO: 1024212 - RNA, 24 nt, Human
uuuuccacauucacuacacugaua

SEQ ID NO: 1024213 - RNA, 23 nt, Human
aacacugcucgucggguccagca

SEQ ID NO: 1024214 - RNA, 20 nt, Human
aacuguggauaaaacaaagu

SEQ ID NO: 1024215 - RNA, 22 nt, Human
aagcacccugcagcccuagcga

SEQ ID NO: 1024216 - RNA, 20 nt, Human
acaaugggggccgcaaaaaa

SEQ ID NO: 1024217 - RNA, 25 nt, Human
accccaaggcccgaugggucccgcg

SEQ ID NO: 1024218 - RNA, 20 nt, Human
agacaggagaggggcacgua

SEQ ID NO: 1024219 - RNA, 24 nt, Human
agacaggagaggggcacguaccgg

SEQ ID NO: 1024220 - RNA, 25 nt, Human
agagcuuguuccgaagcaagcacua

SEQ ID NO: 1024221 - RNA, 22 nt, Human
agccgaugcugaaugguacgcg

SEQ ID NO: 1024222 - RNA, 21 nt, Human
agccugaggaaggugggacuc

SEQ ID NO: 1024223 - RNA, 18 nt, Human
agggcccuggugagaggg

SEQ ID NO: 1024224 - RNA, 21 nt, Human
aggugggacucgggcggagcc

SEQ ID NO: 1024225 - RNA, 18 nt, Human
auccagcccuccccugga

SEQ ID NO: 1024226 - RNA, 20 nt, Human
cagacauguugacauaacag

SEQ ID NO: 1024227 - RNA, 22 nt, Human
cccccugcugugguucccgaac

SEQ ID NO: 1024228 - RNA, 23 nt, Human
ccccgguaccggggccgcgucua

SEQ ID NO: 1024229 - RNA, 21 nt, Human
ccccuggacccuaggucacgg

SEQ ID NO: 1024230 - RNA, 23 nt, Human
cccuaggucacggcaaucaaccc

SEQ ID NO: 1024231 - RNA, 22 nt, Human
ccgaagcaagcacccugcagcc

SEQ ID NO: 1024232 - RNA, 25 nt, Human
ccuccggauaguccccgagagcuuu

SEQ ID NO: 1024233 - RNA, 22 nt, Human
ccugcaggcugccuccggauag

SEQ ID NO: 1024234 - RNA, 22 nt, Human
cgaagcaagcacccugcagccc

SEQ ID NO: 1024235 - RNA, 23 nt, Human
cgaagcaagcacccugcagcccu

SEQ ID NO: 1024236 - RNA, 24 nt, Human
cgcggucggacuucuacacccgcc

SEQ ID NO: 1024237 - RNA, 23 nt, Human
cggaccagcgggcgagggcccug

SEQ ID NO: 1024238 - RNA, 25 nt, Human
cgggcggagccgaugcugaauggua

SEQ ID NO: 1024239 - RNA, 21 nt, Human
cuacacccgccuccagacagg

SEQ ID NO: 1024240 - RNA, 18 nt, Human
gacagcagucuggcuucc

SEQ ID NO: 1024241 - RNA, 18 nt, Human
gaggaaggugggacucgg

SEQ ID NO: 1024242 - RNA, 22 nt, Human
gauccagcccuccccuggaccc

SEQ ID NO: 1024243 - RNA, 24 nt, Human
gcagcacaaugggggccgcaaaaa

SEQ ID NO: 1024244 - RNA, 18 nt, Human
gcccuagcgauccagccc

SEQ ID NO: 1024245 - RNA, 23 nt, Human
gcggucggacuucuacacccgcc

SEQ ID NO: 1024246 - RNA, 23 nt, Human
ggaaggugggacucgggcggagc

SEQ ID NO: 1024247 - RNA, 20 nt, Human
ggacucgggcggagccgaug

SEQ ID NO: 1024248 - RNA, 20 nt, Human
ggaggccuucugugccggga

SEQ ID NO: 1024249 - RNA, 19 nt, Human
ggggcacaggccuguugag

SEQ ID NO: 1024250 - RNA, 20 nt, Human
ggggccgcgucuacgugggg

SEQ ID NO: 1024251 - RNA, 23 nt, Human
gguccagcagcacaaugggggcc

SEQ ID NO: 1024252 - RNA, 19 nt, Human
guucccgaaccccaaggcc

SEQ ID NO: 1024253 - RNA, 23 nt, Human
uaacuguggauaaaacaaaguca

SEQ ID NO: 1024254 - RNA, 24 nt, Human
uauggcuguuuguuacauacagug

SEQ ID NO: 1024255 - RNA, 18 nt, Human
ucagccaaucagagccug

SEQ ID NO: 1024256 - RNA, 18 nt, Human
ucccgaaccccaaggccc

SEQ ID NO: 1024257 - RNA, 19 nt, Human
ucuacacccgccuccagac

SEQ ID NO: 1024258 - RNA, 20 nt, Human
ugacauaacagugaaauaca

SEQ ID NO: 1024259 - RNA, 22 nt, Human
ugaggaaggugggacucgggcg

SEQ ID NO: 1024260 - RNA, 26 nt, Human
ugccugaacccccgguaccggggccg

SEQ ID NO: 1024261 - RNA, 19 nt, Human
uggcuuccgcggucggacu

SEQ ID NO: 1024262 - RNA, 19 nt, Human
ugggucccgcgggggucgc

SEQ ID NO: 1024263 - RNA, 22 nt, Human
ugguucccgaaccccaaggccc

SEQ ID NO: 1024264 - RNA, 18 nt, Human
ugucuuaaauauggcugu

SEQ ID NO: 1024265 - RNA, 19 nt, Human
aaaaaacccccgccaaauc

SEQ ID NO: 1024266 - RNA, 25 nt, Human
aaaccucccccaucaucuuagaagg

SEQ ID NO: 1024267 - RNA, 18 nt, Human
aagaaagaaacucgcgga

SEQ ID NO: 1024268 - RNA, 20 nt, Human
aaggaagagaggacugaggg

SEQ ID NO: 1024269 - RNA, 21 nt, Human
aauagcagagacagcggcaaa

SEQ ID NO: 1024270 - RNA, 23 nt, Human
acccgaguccccauacgaggccc

SEQ ID NO: 1024271 - RNA, 19 nt, Human
acccucacccgagucccca

SEQ ID NO: 1024272 - RNA, 27 nt, Human
acuuuuuuuuuuuuuuuuuuuuuuuuu

SEQ ID NO: 1024273 - RNA, 19 nt, Human
agagaugcagggaggcuga

SEQ ID NO: 1024274 - RNA, 25 nt, Human
agaggaaaggggagaugauaaagaa

SEQ ID NO: 1024275 - RNA, 26 nt, Human
agaggaagggggcgggacguggagag

SEQ ID NO: 1024276 - RNA, 22 nt, Human
agaguuggggagguguucaggg

SEQ ID NO: 1024277 - RNA, 24 nt, Human
aggaaaaaaacccccgccaaaucc

SEQ ID NO: 1024278 - RNA, 22 nt, Human
aggaagaaaagucuugggaugc

SEQ ID NO: 1024279 - RNA, 19 nt, Human
aggaggcaggaagaggaag

SEQ ID NO: 1024280 - RNA, 19 nt, Human
aggcagcucccaacaggaa

SEQ ID NO: 1024281 - RNA, 24 nt, Human
aggcaggaagaggaagggggcggg

SEQ ID NO: 1024282 - RNA, 27 nt, Human
aggcaggaagaggaagggggcgggguc

SEQ ID NO: 1024283 - RNA, 18 nt, Human
agggagggaggcggcggg

SEQ ID NO: 1024284 - RNA, 22 nt, Human
agugcagggaggccaggagaga

SEQ ID NO: 1024285 - RNA, 26 nt, Human
caaacccucgacgccggccuccggac

SEQ ID NO: 1024286 - RNA, 19 nt, Human
caaaccucccccaucaucu

SEQ ID NO: 1024287 - RNA, 24 nt, Human
cacccgaguccccauacgaggccc

SEQ ID NO: 1024288 - RNA, 22 nt, Human
cagagacagcggcaaacccucg

SEQ ID NO: 1024289 - RNA, 18 nt, Human
caggagcaggacagaagc

SEQ ID NO: 1024290 - RNA, 18 nt, Human
cagggaugaggcaggccu

SEQ ID NO: 1024291 - RNA, 22 nt, Human
caggguggagguccagagaauu

SEQ ID NO: 1024292 - RNA, 24 nt, Human
ccaaauccgaaccgcguuguagcu

SEQ ID NO: 1024293 - RNA, 22 nt, Human
ccaacacugcucccugccccca

SEQ ID NO: 1024294 - RNA, 21 nt, Human
ccaggguggagguccagagaa

SEQ ID NO: 1024295 - RNA, 19 nt, Human
cccagacuuuuuuuuuuuu

SEQ ID NO: 1024296 - RNA, 18 nt, Human
ccccaggggagggauggg

SEQ ID NO: 1024297 - RNA, 23 nt, Human
ccccauacgaggcccggcuugcc

SEQ ID NO: 1024298 - RNA, 20 nt, Human
ccccccaggggagggauggg

SEQ ID NO: 1024299 - RNA, 22 nt, Human
ccccuauggggaggauggaaau

SEQ ID NO: 1024300 - RNA, 19 nt, Human
cccgccaaauccgaaccgc

SEQ ID NO: 1024301 - RNA, 24 nt, Human
cccucgacgccggccuccggacag

SEQ ID NO: 1024302 - RNA, 24 nt, Human
cccuugguccuuaggggugggggc

SEQ ID NO: 1024303 - RNA, 19 nt, Human
ccgcugccgcugcuggcuu

SEQ ID NO: 1024304 - RNA, 19 nt, Human
ccuacaguuggcagaggag

SEQ ID NO: 1024305 - RNA, 24 nt, Human
ccuucaagaaagaaacucgcggac

SEQ ID NO: 1024306 - RNA, 18 nt, Human
cgagccugggguugggga

SEQ ID NO: 1024307 - RNA, 19 nt, Human
cgagccugggguuggggag

SEQ ID NO: 1024308 - RNA, 25 nt, Human
cgcgugcaacaaaccucccccauca

SEQ ID NO: 1024309 - RNA, 20 nt, Human
cgcucaggcucccuuggucc

SEQ ID NO: 1024310 - RNA, 18 nt, Human
cggaaccaguacucgcca

SEQ ID NO: 1024311 - RNA, 21 nt, Human
cggaaccaguacucgccaccc

SEQ ID NO: 1024312 - RNA, 19 nt, Human
cggccuccggacagcuccc

SEQ ID NO: 1024313 - RNA, 21 nt, Human
cgugaaugaaucuagccccca

SEQ ID NO: 1024314 - RNA, 18 nt, Human
cucccucuucuccucucc

SEQ ID NO: 1024315 - RNA, 23 nt, Human
cucgacgccggccuccggacagc

SEQ ID NO: 1024316 - RNA, 20 nt, Human
cugcuggcuuuugcagcagc

SEQ ID NO: 1024317 - RNA, 19 nt, Human
cuggaagggucagcgccgc

SEQ ID NO: 1024318 - RNA, 20 nt, Human
cuggcuuuugcagcagccgc

SEQ ID NO: 1024319 - RNA, 19 nt, Human
cuugggaugcggggcagag

SEQ ID NO: 1024320 - RNA, 20 nt, Human
cuugggaugcggggcagagc

SEQ ID NO: 1024321 - RNA, 22 nt, Human
gaaugaaucuagcccccacacc

SEQ ID NO: 1024322 - RNA, 18 nt, Human
gaccuggaagggucagcg

SEQ ID NO: 1024323 - RNA, 18 nt, Human
gacgggagguuggagaag

SEQ ID NO: 1024324 - RNA, 19 nt, Human
gacuuuuuuuuuuuuuuuu

SEQ ID NO: 1024325 - RNA, 18 nt, Human
gagaggggagagagcccc

SEQ ID NO: 1024326 - RNA, 20 nt, Human
gagaugggagaggggagaga

SEQ ID NO: 1024327 - RNA, 20 nt, Human
gaggauggaaauagcagaga

SEQ ID NO: 1024328 - RNA, 24 nt, Human
gaggggagagagccccuaugggga

SEQ ID NO: 1024329 - RNA, 19 nt, Human
gagugcagggagguuucca

SEQ ID NO: 1024330 - RNA, 22 nt, Human
gaugaggaggcaggaagaggaa

SEQ ID NO: 1024331 - RNA, 20 nt, Human
gaugauaaagaagggaagga

SEQ ID NO: 1024332 - RNA, 21 nt, Human
gaugauaaagaagggaaggaa

SEQ ID NO: 1024333 - RNA, 18 nt, Human
gaugcaggagcaggacag

SEQ ID NO: 1024334 - RNA, 20 nt, Human
gcaggaagaggaagggggcg

SEQ ID NO: 1024335 - RNA, 21 nt, Human
gccaggcacccuugggugucc

SEQ ID NO: 1024336 - RNA, 21 nt, Human
gcucccgcugccgcugcuggc

SEQ ID NO: 1024337 - RNA, 21 nt, Human
ggaaauagcagagacagcggc

SEQ ID NO: 1024338 - RNA, 20 nt, Human
ggaaggaagagaggacugag

SEQ ID NO: 1024339 - RNA, 23 nt, Human
ggagcccucucccaacacugcuc

SEQ ID NO: 1024340 - RNA, 24 nt, Human
ggaggcaggaagaggaagggggcg

SEQ ID NO: 1024341 - RNA, 23 nt, Human
gggagggagggaggcggcggguc

SEQ ID NO: 1024342 - RNA, 21 nt, Human
gggaugggcccaaggcagcuc

SEQ ID NO: 1024343 - RNA, 23 nt, Human
gggcccaaggcagcucccaacag

SEQ ID NO: 1024344 - RNA, 21 nt, Human
ggggccagggccaucaguugg

SEQ ID NO: 1024345 - RNA, 22 nt, Human
gucagcuagggagggagggagg

SEQ ID NO: 1024346 - RNA, 22 nt, Human
guccuuaggggugggggccagg

SEQ ID NO: 1024347 - RNA, 18 nt, Human
uagaaaauaauuauagag

SEQ ID NO: 1024348 - RNA, 19 nt, Human
uagcucgguccccgccucc

SEQ ID NO: 1024349 - RNA, 24 nt, Human
uagugcagggagguuggaaccagu

SEQ ID NO: 1024350 - RNA, 23 nt, Human
ucucccaacacugcucccugccc

SEQ ID NO: 1024351 - RNA, 19 nt, Human
ucucccucuucuccucucc

SEQ ID NO: 1024352 - RNA, 22 nt, Human
ucugcgaccugccaggcacccu

SEQ ID NO: 1024353 - RNA, 23 nt, Human
ucuugggaugcggggcagagccc

SEQ ID NO: 1024354 - RNA, 18 nt, Human
ugagaugggagaggggag

SEQ ID NO: 1024355 - RNA, 19 nt, Human
ugcagcagccgcagcccgg

SEQ ID NO: 1024356 - RNA, 24 nt, Human
ugcagggaugaggcaggccuacag

SEQ ID NO: 1024357 - RNA, 21 nt, Human
ugccaagacaaugaaaguugg

SEQ ID NO: 1024358 - RNA, 25 nt, Human
ugccaagacaaugaaaguugggagg

SEQ ID NO: 1024359 - RNA, 19 nt, Human
ugccaggcacccuugggug

SEQ ID NO: 1024360 - RNA, 22 nt, Human
ugccaggcacccuugggugucc

SEQ ID NO: 1024361 - RNA, 21 nt, Human
ugcucccugcccccaagccuc

SEQ ID NO: 1024362 - RNA, 20 nt, Human
ugcuuaagggagaugaggag

SEQ ID NO: 1024363 - RNA, 21 nt, Human
uggaaauagcagagacagccg

SEQ ID NO: 1024364 - RNA, 23 nt, Human
uggagguccagagaauuuggggg

SEQ ID NO: 1024365 - RNA, 22 nt, Human
uggcaagaugcaggagcaggac

SEQ ID NO: 1024366 - RNA, 18 nt, Human
ugggaggaggcggccagg

SEQ ID NO: 1024367 - RNA, 18 nt, Human
ugggaggaggcggccagg

SEQ ID NO: 1024368 - RNA, 20 nt, Human
ugggaggaggcggccagggu

SEQ ID NO: 1024369 - RNA, 23 nt, Human
ugggaggaggcggccagggugga

SEQ ID NO: 1024370 - RNA, 18 nt, Human
uggggagguguucaggga

SEQ ID NO: 1024371 - RNA, 24 nt, Human
ugggggccagggccaucaguuggg

SEQ ID NO: 1024372 - RNA, 18 nt, Human
ugggguuggggagcccuc

SEQ ID NO: 1024373 - RNA, 24 nt, Human
uguccgacccuggguggucccagc

SEQ ID NO: 1024374 - RNA, 19 nt, Human
uuaagggagaugaggaggc

SEQ ID NO: 1024375 - RNA, 19 nt, Human
uuaggggugggggccaggg

SEQ ID NO: 1024376 - RNA, 21 nt, Human
uuggaaccagugcagggauga

SEQ ID NO: 1024377 - RNA, 21 nt, Human
uuggcagaggagccuggcaag

SEQ ID NO: 1024378 - RNA, 20 nt, Human
uuggggagguguucagggag

SEQ ID NO: 1024379 - RNA, 22 nt, Human
uuggggggcuggaagaagugca

SEQ ID NO: 1024380 - RNA, 25 nt, Human
uuuuuuuuuuuuuuuuuuuuuaagg

SEQ ID NO: 1024381 - RNA, 19 nt, Human
agucacuggccacgcccgc

SEQ ID NO: 1024382 - RNA, 24 nt, Human
cagcaauuauuuuuauguaacaac

SEQ ID NO: 1024383 - RNA, 19 nt, Human
cccgcggcgccucgccuuc

SEQ ID NO: 1024384 - RNA, 22 nt, Human
cccgcggcgccucgccuucuag

SEQ ID NO: 1024385 - RNA, 24 nt, Human
cgccucgccuucuagucacuggcc

SEQ ID NO: 1024386 - RNA, 24 nt, Human
uuuuuuuuuuuuuuuuuuacacag

SEQ ID NO: 1024387 - RNA, 18 nt, Human
aaaaaaaauagcaaaaaa

SEQ ID NO: 1024388 - RNA, 25 nt, Human
aaaagcaaaaacaaaacaaaacaaa

SEQ ID NO: 1024389 - RNA, 20 nt, Human
aaaaugccacccagagguua

SEQ ID NO: 1024390 - RNA, 19 nt, Human
aaacaaaacaaaacaaaaa

SEQ ID NO: 1024391 - RNA, 26 nt, Human
aaagcaaaaacaaaacaaaacaaaaa

SEQ ID NO: 1024392 - RNA, 21 nt, Human
aaauucauaaugaaaaugcca

SEQ ID NO: 1024393 - RNA, 24 nt, Human
aagcaaaaacaaaacaaaacaaaa

SEQ ID NO: 1024394 - RNA, 22 nt, Human
aagcaagacagguggugaacaa

SEQ ID NO: 1024395 - RNA, 19 nt, Human
aaugaaaaugccacccaga

SEQ ID NO: 1024396 - RNA, 19 nt, Human
acaaaacaaaacaaaaaac

SEQ ID NO: 1024397 - RNA, 21 nt, Human
acaaaacaaaacaaaaaacca

SEQ ID NO: 1024398 - RNA, 23 nt, Human
acccugaauaucugcuagugggg

SEQ ID NO: 1024399 - RNA, 18 nt, Human
agaagagcuguuucagca

SEQ ID NO: 1024400 - RNA, 24 nt, Human
agaagagcuguuucagcacaaccc

SEQ ID NO: 1024401 - RNA, 19 nt, Human
agacaaccagauccccuga

SEQ ID NO: 1024402 - RNA, 20 nt, Human
agcacaacccaccagaaaca

SEQ ID NO: 1024403 - RNA, 23 nt, Human
agguacagagauuugagagagcc

SEQ ID NO: 1024404 - RNA, 22 nt, Human
auggcacagauacaccaacacc

SEQ ID NO: 1024405 - RNA, 21 nt, Human
caaaaaaaaaaacaaaacuca

SEQ ID NO: 1024406 - RNA, 25 nt, Human
caaaaaaccacucagcuuaaucagc

SEQ ID NO: 1024407 - RNA, 25 nt, Human
caaaaacaaaacaaaacaaaaaacc

SEQ ID NO: 1024408 - RNA, 21 nt, Human
caaaacaaaaaaccacucagc

SEQ ID NO: 1024409 - RNA, 19 nt, Human
caaccagauccccugacua

SEQ ID NO: 1024410 - RNA, 24 nt, Human
caaccagauccccugacuaaagcu

SEQ ID NO: 1024411 - RNA, 23 nt, Human
caacccacugaccaucucagcuc

SEQ ID NO: 1024412 - RNA, 18 nt, Human
cacacacaauuuuggugg

SEQ ID NO: 1024413 - RNA, 22 nt, Human
cacacauaaaguacacuaacac

SEQ ID NO: 1024414 - RNA, 22 nt, Human
cacaucuucaggaagacccuuu

SEQ ID NO: 1024415 - RNA, 23 nt, Human
caccagaaacauuggccaccaug

SEQ ID NO: 1024416 - RNA, 22 nt, Human
cacccagagguuaacagcuugc

SEQ ID NO: 1024417 - RNA, 18 nt, Human
cagcacaacccaccagaa

SEQ ID NO: 1024418 - RNA, 22 nt, Human
cagcacaacccaccagaaacaa

SEQ ID NO: 1024419 - RNA, 22 nt, Human
cagcacaacccaccagaaacau

SEQ ID NO: 1024420 - RNA, 19 nt, Human
cagcucucuucuaaagggg

SEQ ID NO: 1024421 - RNA, 19 nt, Human
cauaaagauagaauccaca

SEQ ID NO: 1024422 - RNA, 22 nt, Human
ccaagguaauagcauggcaaag

SEQ ID NO: 1024423 - RNA, 18 nt, Human
ccaccagaaacauuggcc

SEQ ID NO: 1024424 - RNA, 28 nt, Human
ccagggccgggcgaguagccgggguccc

SEQ ID NO: 1024425 - RNA, 20 nt, Human
cccaagaaugcugacaauaa

SEQ ID NO: 1024426 - RNA, 22 nt, Human
cccaccagaaacauuggccacc

SEQ ID NO: 1024427 - RNA, 22 nt, Human
cccagaaggcaccuccucucau

SEQ ID NO: 1024428 - RNA, 22 nt, Human
cccagagguuaacagcuugcca

SEQ ID NO: 1024429 - RNA, 19 nt, Human
cccccaaacacacacaauu

SEQ ID NO: 1024430 - RNA, 22 nt, Human
cccccaaacacacacaauuuug

SEQ ID NO: 1024431 - RNA, 21 nt, Human
ccccugacuaaagcuuggcuc

SEQ ID NO: 1024432 - RNA, 19 nt, Human
cccgcgggcucggcccugg

SEQ ID NO: 1024433 - RNA, 21 nt, Human
cccugaauaucugcuaguggg

SEQ ID NO: 1024434 - RNA, 20 nt, Human
ccgccgccgccucccaccgc

SEQ ID NO: 1024435 - RNA, 21 nt, Human
ccgccgccgccucccaccgcc

SEQ ID NO: 1024436 - RNA, 22 nt, Human
ccgccgccgccucccaccgccc

SEQ ID NO: 1024437 - RNA, 23 nt, Human
ccgccgccgccucccaccgccca

SEQ ID NO: 1024438 - RNA, 23 nt, Human
ccggcuccuggcuccuccgaggu

SEQ ID NO: 1024439 - RNA, 19 nt, Human
ccuacaguuaaaaaugggg

SEQ ID NO: 1024440 - RNA, 20 nt, Human
ccuacaguuaaaaauggggc

SEQ ID NO: 1024441 - RNA, 22 nt, Human
ccuccaugaaauuaaagcugug

SEQ ID NO: 1024442 - RNA, 21 nt, Human
ccucccaccgcccagggccgg

SEQ ID NO: 1024443 - RNA, 19 nt, Human
ccugaauaucugcuagugg

SEQ ID NO: 1024444 - RNA, 19 nt, Human
cgccgccgccgccgccgcc

SEQ ID NO: 1024445 - RNA, 23 nt, Human
cgcgagcgccgccgccgccgccg

SEQ ID NO: 1024446 - RNA, 25 nt, Human
cuacacaucugccaagguaauagca

SEQ ID NO: 1024447 - RNA, 24 nt, Human
cucucucucccccaaacacacaca

SEQ ID NO: 1024448 - RNA, 18 nt, Human
cuugggccacacauaaag

SEQ ID NO: 1024449 - RNA, 19 nt, Human
gcaaaaaaaaaaacaaaac

SEQ ID NO: 1024450 - RNA, 21 nt, Human
gcaaaaaaaaaaacaaaacuc

SEQ ID NO: 1024451 - RNA, 20 nt, Human
gcagggccagauuagaacau

SEQ ID NO: 1024452 - RNA, 18 nt, Human
gcagucaaaugcauuuau

SEQ ID NO: 1024453 - RNA, 19 nt, Human
gccacauucaaagcugucc

SEQ ID NO: 1024454 - RNA, 18 nt, Human
gcccugguuccggcuccu

SEQ ID NO: 1024455 - RNA, 19 nt, Human
gcccugguuccggcuccug

SEQ ID NO: 1024456 - RNA, 20 nt, Human
gcgccgccgccgccgccgcc

SEQ ID NO: 1024457 - RNA, 25 nt, Human
gcuagccccggcccgcgggcucggc

SEQ ID NO: 1024458 - RNA, 22 nt, Human
gcuagccccggcccgcgggcuu

SEQ ID NO: 1024459 - RNA, 18 nt, Human
ggcaguacccuaguuuau

SEQ ID NO: 1024460 - RNA, 22 nt, Human
gugccacacuggaagaagaguu

SEQ ID NO: 1024461 - RNA, 21 nt, Human
guggcagggccagauuagaac

SEQ ID NO: 1024462 - RNA, 21 nt, Human
guguugcucacuuguuuacau

SEQ ID NO: 1024463 - RNA, 21 nt, Human
uaaagcaacucaccaaaggua

SEQ ID NO: 1024464 - RNA, 24 nt, Human
uaauagcauggcaaauaguauuuu

SEQ ID NO: 1024465 - RNA, 18 nt, Human
uacaagagauacgaggca

SEQ ID NO: 1024466 - RNA, 18 nt, Human
uacaccaacacagagaua

SEQ ID NO: 1024467 - RNA, 22 nt, Human
uagcaaaaaaaaaaacaaaacu

SEQ ID NO: 1024468 - RNA, 23 nt, Human
uagcaaaaaaaaaaacaaaacuc

SEQ ID NO: 1024469 - RNA, 23 nt, Human
uagcuuaagcaagacagguggug

SEQ ID NO: 1024470 - RNA, 25 nt, Human
uaucucuaugucucucucuccccca

SEQ ID NO: 1024471 - RNA, 19 nt, Human
uauuuggccaaauuuuuca

SEQ ID NO: 1024472 - RNA, 22 nt, Human
ucacaaaauauuagagguggga

SEQ ID NO: 1024473 - RNA, 21 nt, Human
uccacaucuucaggaagaccc

SEQ ID NO: 1024474 - RNA, 18 nt, Human
ucucucucucccccaaac

SEQ ID NO: 1024475 - RNA, 22 nt, Human
ucugucucuaucucuaugucuc

SEQ ID NO: 1024476 - RNA, 24 nt, Human
ucugucucuaucucuaugucucuc

SEQ ID NO: 1024477 - RNA, 24 nt, Human
ugccaugcaugcaacugugugcgc

SEQ ID NO: 1024478 - RNA, 21 nt, Human
uggcaaauaguauuuuucuug

SEQ ID NO: 1024479 - RNA, 24 nt, Human
uggcacagauacaccaacacagag

SEQ ID NO: 1024480 - RNA, 21 nt, Human
ugggauggaucacucuagacc

SEQ ID NO: 1024481 - RNA, 22 nt, Human
ugguuggaaguucucagaagag

SEQ ID NO: 1024482 - RNA, 24 nt, Human
uguauagcucagccucaucugaag

SEQ ID NO: 1024483 - RNA, 25 nt, Human
uguauuaaaaagcaaaaacaaaaca

SEQ ID NO: 1024484 - RNA, 26 nt, Human
ugucuccagguuagagcauggguggu

SEQ ID NO: 1024485 - RNA, 24 nt, Human
uuaaaaaaaauagcaaaaaaaaaa

SEQ ID NO: 1024486 - RNA, 18 nt, Human
uucacaaaauauuagagg

SEQ ID NO: 1024487 - RNA, 24 nt, Human
uugucuugggccacacauaaagua

SEQ ID NO: 1024488 - RNA, 22 nt, Human
uuuacauaacucaggccacccu

SEQ ID NO: 1024489 - RNA, 18 nt, Human
uuucuuggggacaagagu

SEQ ID NO: 1024490 - RNA, 23 nt, Human
aaacacaugcacacugguaacaa

SEQ ID NO: 1024491 - RNA, 22 nt, Human
aaaggcagagauggagaggaga

SEQ ID NO: 1024492 - RNA, 26 nt, Human
acacagguccagaggccucgccugga

SEQ ID NO: 1024493 - RNA, 22 nt, Human
agaaaacauuucccuggaggcu

SEQ ID NO: 1024494 - RNA, 21 nt, Human
agaguuuccggcuggcucagg

SEQ ID NO: 1024495 - RNA, 26 nt, Human
aggaagagggugcaggccuuuccugg

SEQ ID NO: 1024496 - RNA, 21 nt, Human
aggcagagauggagaggagac

SEQ ID NO: 1024497 - RNA, 20 nt, Human
aggcagagauggagaggagg

SEQ ID NO: 1024498 - RNA, 21 nt, Human
agggagcuggcuuccugggag

SEQ ID NO: 1024499 - RNA, 18 nt, Human
aggugguucuagaagcag

SEQ ID NO: 1024500 - RNA, 20 nt, Human
aggugguucuagaagcagga

SEQ ID NO: 1024501 - RNA, 23 nt, Human
caaaccccuucagcugugcuaag

SEQ ID NO: 1024502 - RNA, 24 nt, Human
cacauaguguuucuacaggcacgc

SEQ ID NO: 1024503 - RNA, 22 nt, Human
cacugguaacaaaggcagagau

SEQ ID NO: 1024504 - RNA, 21 nt, Human
caggaagagggugcaggccuu

SEQ ID NO: 1024505 - RNA, 20 nt, Human
ccccagcucgcccucgugcc

SEQ ID NO: 1024506 - RNA, 20 nt, Human
ccccugaggagugaaguaga

SEQ ID NO: 1024507 - RNA, 23 nt, Human
cccugaggagugaaguagaaggg

SEQ ID NO: 1024508 - RNA, 19 nt, Human
ccucucugcaaagcuccug

SEQ ID NO: 1024509 - RNA, 18 nt, Human
cgcggccccagcucgccc

SEQ ID NO: 1024510 - RNA, 19 nt, Human
cuucaggaaagaggguauc

SEQ ID NO: 1024511 - RNA, 21 nt, Human
gaacacagguccagaggccuc

SEQ ID NO: 1024512 - RNA, 24 nt, Human
gaggaagaguuuccggcuggcuca

SEQ ID NO: 1024513 - RNA, 20 nt, Human
gcaggccuuuccuggugccc

SEQ ID NO: 1024514 - RNA, 23 nt, Human
gguaacaaaggcagagauggaga

SEQ ID NO: 1024515 - RNA, 31 nt, Human
uaaaaaaacacacaaacacaugcacacuggg

SEQ ID NO: 1024516 - RNA, 19 nt, Human
uaacuggccgagucaauau

SEQ ID NO: 1024517 - RNA, 22 nt, Human
uaagaccggacugacaagcuag

SEQ ID NO: 1024518 - RNA, 22 nt, Human
uaccugaggugguucuagaagc

SEQ ID NO: 1024519 - RNA, 22 nt, Human
ucacaaaccccuucagcugugc

SEQ ID NO: 1024520 - RNA, 21 nt, Human
uccuggugcccaccagccuga

SEQ ID NO: 1024521 - RNA, 19 nt, Human
ucucuaagaccggacugac

SEQ ID NO: 1024522 - RNA, 21 nt, Human
ucugcaaagcuccugaggggc

SEQ ID NO: 1024523 - RNA, 24 nt, Human
ugacaggacuuuggcacaggaaca

SEQ ID NO: 1024524 - RNA, 23 nt, Human
ugaccacauaguguuucuacagg

SEQ ID NO: 1024525 - RNA, 20 nt, Human
uggcacaggaacacaggucc

SEQ ID NO: 1024526 - RNA, 22 nt, Human
ugggagggauguucuccccgga

SEQ ID NO: 1024527 - RNA, 18 nt, Human
ugguucuagaagcaggaa

SEQ ID NO: 1024528 - RNA, 23 nt, Human
uucacaaaccccuucagcugugc

SEQ ID NO: 1024529 - RNA, 19 nt, Human
uucuacaggcacgccucac

SEQ ID NO: 1024530 - RNA, 23 nt, Human
uucuccccggaaggcuggaggaa

SEQ ID NO: 1024531 - RNA, 25 nt, Human
uuuccuggugcccaccagccugaca

SEQ ID NO: 1024532 - RNA, 24 nt, Human
uuuggcacaggaacacagguccag

SEQ ID NO: 1024533 - RNA, 24 nt, Human
uuuuuuuuuuuuuuuuuuaacugg

SEQ ID NO: 1024534 - RNA, 24 nt, Human
aaagugcugggauuauagguguga

SEQ ID NO: 1024535 - RNA, 18 nt, Human
aaauguguagaaaggcag

SEQ ID NO: 1024536 - RNA, 27 nt, Human
aagaaaacaaagccuuaggccgggcgu

SEQ ID NO: 1024537 - RNA, 27 nt, Human
aagcaauucuccugacucauccucccg

SEQ ID NO: 1024538 - RNA, 18 nt, Human
aagggcccagcugacaaa

SEQ ID NO: 1024539 - RNA, 21 nt, Human
aagucaaggaaaugaaaacau

SEQ ID NO: 1024540 - RNA, 18 nt, Human
aagugcugggauuauagg

SEQ ID NO: 1024541 - RNA, 26 nt, Human
aagugcugggauuauaggugugagcc

SEQ ID NO: 1024542 - RNA, 24 nt, Human
aaucaccugaacccguguggcaga

SEQ ID NO: 1024543 - RNA, 18 nt, Human
acaccacugcacuccagc

SEQ ID NO: 1024544 - RNA, 20 nt, Human
acaccacugcacuccagccu

SEQ ID NO: 1024545 - RNA, 20 nt, Human
acagggcgagacuccgucuc

SEQ ID NO: 1024546 - RNA, 24 nt, Human
acagggcgagacuccgucucaaaa

SEQ ID NO: 1024547 - RNA, 24 nt, Human
acaugaggucaggaguuugggacc

SEQ ID NO: 1024548 - RNA, 18 nt, Human
acauggcaaaccccaucu

SEQ ID NO: 1024549 - RNA, 19 nt, Human
acauggcaaaccccaucuc

SEQ ID NO: 1024550 - RNA, 19 nt, Human
accacugcacuccagccug

SEQ ID NO: 1024551 - RNA, 24 nt, Human
accacugcacuccagccuggguga

SEQ ID NO: 1024552 - RNA, 24 nt, Human
accauguuggccaggcuggucuug

SEQ ID NO: 1024553 - RNA, 24 nt, Human
accccaucucuacuaaaaauacaa

SEQ ID NO: 1024554 - RNA, 18 nt, Human
acgggguuucaccauguu

SEQ ID NO: 1024555 - RNA, 23 nt, Human
acgggguuucaccauguuggcca

SEQ ID NO: 1024556 - RNA, 24 nt, Human
acgggguuucaccauguuggccag

SEQ ID NO: 1024557 - RNA, 24 nt, Human
acucuguugcccaggcuggagugc

SEQ ID NO: 1024558 - RNA, 18 nt, Human
acugcacuccagccuggg

SEQ ID NO: 1024559 - RNA, 24 nt, Human
acugcacuccagccugggugacag

SEQ ID NO: 1024560 - RNA, 18 nt, Human
agaaaggcagaaaugagg

SEQ ID NO: 1024561 - RNA, 22 nt, Human
agaggcugaggcaagagaauca

SEQ ID NO: 1024562 - RNA, 18 nt, Human
agagguugcagugagccg

SEQ ID NO: 1024563 - RNA, 19 nt, Human
agauguugggaaucagaga

SEQ ID NO: 1024564 - RNA, 24 nt, Human
agcacuuugggaggcugagguggg

SEQ ID NO: 1024565 - RNA, 23 nt, Human
agccgggcguggugacacaugcc

SEQ ID NO: 1024566 - RNA, 24 nt, Human
agccugggugacagggcgagacuc

SEQ ID NO: 1024567 - RNA, 23 nt, Human
agccuguaaucccagcacuuugg

SEQ ID NO: 1024568 - RNA, 21 nt, Human
aggaggugagccacuccuugu

SEQ ID NO: 1024569 - RNA, 18 nt, Human
aggcaagagaaucaccug

SEQ ID NO: 1024570 - RNA, 18 nt, Human
aggcaagagaaucaccug

SEQ ID NO: 1024571 - RNA, 24 nt, Human
aggcaagagaaucaccugaacccg

SEQ ID NO: 1024572 - RNA, 18 nt, Human
aggccgggcgugguggcu

SEQ ID NO: 1024573 - RNA, 21 nt, Human
aggcugagguggguggauuac

SEQ ID NO: 1024574 - RNA, 25 nt, Human
aggcuggagugcaguggcacaaucu

SEQ ID NO: 1024575 - RNA, 20 nt, Human
agguggguggauuacaugag

SEQ ID NO: 1024576 - RNA, 18 nt, Human
aguaacugggauuauagg

SEQ ID NO: 1024577 - RNA, 24 nt, Human
agugacaagaaguaaauguguaga

SEQ ID NO: 1024578 - RNA, 21 nt, Human
agugcaguggcacaaucucag

SEQ ID NO: 1024579 - RNA, 21 nt, Human
augcugccuucuuuacaggca

SEQ ID NO: 1024580 - RNA, 19 nt, Human
auugcacccagccuguuac

SEQ ID NO: 1024581 - RNA, 22 nt, Human
auugcacccagccuguuaccag

SEQ ID NO: 1024582 - RNA, 24 nt, Human
caaagugcugggauuauaggugug

SEQ ID NO: 1024583 - RNA, 23 nt, Human
caaccuccaucuccuggguucaa

SEQ ID NO: 1024584 - RNA, 21 nt, Human
caaggaaaugaaaacauggca

SEQ ID NO: 1024585 - RNA, 21 nt, Human
cacaauggugacugagauggg

SEQ ID NO: 1024586 - RNA, 21 nt, Human
cacaccacugcacuccagccu

SEQ ID NO: 1024587 - RNA, 18 nt, Human
cacaggcaaggaggugag

SEQ ID NO: 1024588 - RNA, 21 nt, Human
caccauguuggccaggcuggu

SEQ ID NO: 1024589 - RNA, 23 nt, Human
caccauguuggccaggcuggucu

SEQ ID NO: 1024590 - RNA, 24 nt, Human
caccauguuggccaggcuggucuu

SEQ ID NO: 1024591 - RNA, 27 nt, Human
caccauguuggccaggcuggucuugaa

SEQ ID NO: 1024592 - RNA, 22 nt, Human
cacuccagccugggugacaggg

SEQ ID NO: 1024593 - RNA, 23 nt, Human
cacuccagccugggugacagggc

SEQ ID NO: 1024594 - RNA, 24 nt, Human
cacuccagccugggugacagggcg

SEQ ID NO: 1024595 - RNA, 24 nt, Human
cacucuguugcccaggcuggagug

SEQ ID NO: 1024596 - RNA, 23 nt, Human
cacugcaaccuccaucuccuggg

SEQ ID NO: 1024597 - RNA, 19 nt, Human
cacugcacuccagccuggg

SEQ ID NO: 1024598 - RNA, 19 nt, Human
cacugcacuccagccuggg

SEQ ID NO: 1024599 - RNA, 22 nt, Human
cacugcacuccagccuggguga

SEQ ID NO: 1024600 - RNA, 23 nt, Human
cacugcacuccagccugggugac

SEQ ID NO: 1024601 - RNA, 24 nt, Human
cacugcacuccagccugggugaca

SEQ ID NO: 1024602 - RNA, 24 nt, Human
cacugcacuccagccugggugaca

SEQ ID NO: 1024603 - RNA, 24 nt, Human
cagcacuuugggaggcugaggugg

SEQ ID NO: 1024604 - RNA, 20 nt, Human
caggugaaguguggggcuug

SEQ ID NO: 1024605 - RNA, 22 nt, Human
cauaaagaguggaggaaauggu

SEQ ID NO: 1024606 - RNA, 24 nt, Human
caugaggucaggaguuugggacca

SEQ ID NO: 1024607 - RNA, 24 nt, Human
cauguuggccaggcuggucuugaa

SEQ ID NO: 1024608 - RNA, 20 nt, Human
cauugcacccagccuguuac

SEQ ID NO: 1024609 - RNA, 23 nt, Human
cauugcacccagccuguuaccag

SEQ ID NO: 1024610 - RNA, 21 nt, Human
ccaaagugcugggauuauagg

SEQ ID NO: 1024611 - RNA, 24 nt, Human
ccaaagugcugggauuauaggugu

SEQ ID NO: 1024612 - RNA, 24 nt, Human
ccacucuguugcccaggcuggagu

SEQ ID NO: 1024613 - RNA, 20 nt, Human
ccacugcacuccagccuggg

SEQ ID NO: 1024614 - RNA, 20 nt, Human
ccacugcacuccagccuggg

SEQ ID NO: 1024615 - RNA, 21 nt, Human
ccacugcacuccagccugggu

SEQ ID NO: 1024616 - RNA, 21 nt, Human
ccacugcacuccagccugggu

SEQ ID NO: 1024617 - RNA, 23 nt, Human
ccacugcacuccagccuggguga

SEQ ID NO: 1024618 - RNA, 24 nt, Human
ccacugcacuccagccugggugac

SEQ ID NO: 1024619 - RNA, 20 nt, Human
ccagagugacaagaaguaaa

SEQ ID NO: 1024620 - RNA, 18 nt, Human
ccauugcacccagccugu

SEQ ID NO: 1024621 - RNA, 23 nt, Human
cccgaguaacugggauuauaggu

SEQ ID NO: 1024622 - RNA, 24 nt, Human
cccgaguaacugggauuauaggug

SEQ ID NO: 1024623 - RNA, 18 nt, Human
ccgagcucacaccacugc

SEQ ID NO: 1024624 - RNA, 21 nt, Human
ccucaagugauccgccucccu

SEQ ID NO: 1024625 - RNA, 24 nt, Human
ccucucgugagccagguacugggc

SEQ ID NO: 1024626 - RNA, 18 nt, Human
ccugaccucaagugaucc

SEQ ID NO: 1024627 - RNA, 19 nt, Human
ccugaccucaagugauccg

SEQ ID NO: 1024628 - RNA, 24 nt, Human
ccugaccucaagugauccgccucc

SEQ ID NO: 1024629 - RNA, 23 nt, Human
ccuggccuacauggcaaacccca

SEQ ID NO: 1024630 - RNA, 22 nt, Human
ccugggugacagggcgagacuc

SEQ ID NO: 1024631 - RNA, 23 nt, Human
ccuggguucaagcaauucuccug

SEQ ID NO: 1024632 - RNA, 22 nt, Human
ccuguaaucccagcacuuuggg

SEQ ID NO: 1024633 - RNA, 18 nt, Human
ccuguaaucccagcuacu

SEQ ID NO: 1024634 - RNA, 22 nt, Human
ccuguaaucccagcuacuucag

SEQ ID NO: 1024635 - RNA, 24 nt, Human
cgggguuucaccauguuggccagg

SEQ ID NO: 1024636 - RNA, 23 nt, Human
cuagcauagcaaaaguggggaau

SEQ ID NO: 1024637 - RNA, 24 nt, Human
cucacaccacugcacuccagccug

SEQ ID NO: 1024638 - RNA, 24 nt, Human
cucacugcaaccuccaucuccugg

SEQ ID NO: 1024639 - RNA, 21 nt, Human
cuccuggguucaagcaauucu

SEQ ID NO: 1024640 - RNA, 23 nt, Human
cugcaaccuccaucuccuggguu

SEQ ID NO: 1024641 - RNA, 24 nt, Human
cugcaaccuccaucuccuggguuc

SEQ ID NO: 1024642 - RNA, 20 nt, Human
cugccuucuuuacaggcaag

SEQ ID NO: 1024643 - RNA, 21 nt, Human
cugggauuauaggugugagcc

SEQ ID NO: 1024644 - RNA, 21 nt, Human
gacacaugccuguaaucccag

SEQ ID NO: 1024645 - RNA, 24 nt, Human
gacagggcgagacuccgucucaaa

SEQ ID NO: 1024646 - RNA, 20 nt, Human
gaccucaagugauccgccuc

SEQ ID NO: 1024647 - RNA, 24 nt, Human
gagacgggguuucaccauguuggc

SEQ ID NO: 1024648 - RNA, 23 nt, Human
gagcucacaccacugcacuccag

SEQ ID NO: 1024649 - RNA, 21 nt, Human
gauccgccucccucagccucc

SEQ ID NO: 1024650 - RNA, 20 nt, Human
gauggggcuucagggaagaa

SEQ ID NO: 1024651 - RNA, 21 nt, Human
gauuacaugaggucaggaguu

SEQ ID NO: 1024652 - RNA, 21 nt, Human
gauuacaugaggucaggaguu

SEQ ID NO: 1024653 - RNA, 24 nt, Human
gauuacaugaggucaggaguuugg

SEQ ID NO: 1024654 - RNA, 18 nt, Human
gauuauaggugugagcca

SEQ ID NO: 1024655 - RNA, 21 nt, Human
gcaagagaaucaccugaaccc

SEQ ID NO: 1024656 - RNA, 24 nt, Human
gcacuccagccugggugacagggc

SEQ ID NO: 1024657 - RNA, 20 nt, Human
gcccaggcuggagugcagug

SEQ ID NO: 1024658 - RNA, 20 nt, Human
gcccucaaaaacuaacaaaa

SEQ ID NO: 1024659 - RNA, 18 nt, Human
gccugggugacagggcga

SEQ ID NO: 1024660 - RNA, 19 nt, Human
gccuguaaucccagcacuu

SEQ ID NO: 1024661 - RNA, 20 nt, Human
gccuguaaucccagcuacuu

SEQ ID NO: 1024662 - RNA, 19 nt, Human
gcuggagugcaguggcaca

SEQ ID NO: 1024663 - RNA, 23 nt, Human
gcuggucuugaacuccugaccuc

SEQ ID NO: 1024664 - RNA, 20 nt, Human
ggaaucagagauggaaauuc

SEQ ID NO: 1024665 - RNA, 19 nt, Human
ggcagagguugcagugagc

SEQ ID NO: 1024666 - RNA, 20 nt, Human
ggcagagguugcagugagcc

SEQ ID NO: 1024667 - RNA, 23 nt, Human
ggcagagguugcagugagccgag

SEQ ID NO: 1024668 - RNA, 19 nt, Human
ggccauaaagaguggagga

SEQ ID NO: 1024669 - RNA, 23 nt, Human
ggcgugguggcuuaagccuguaa

SEQ ID NO: 1024670 - RNA, 24 nt, Human
ggcuggucuugaacuccugaccuc

SEQ ID NO: 1024671 - RNA, 21 nt, Human
ggcuuaagccuguaaucccag

SEQ ID NO: 1024672 - RNA, 21 nt, Human
gggaagaaaagaaaaugaggc

SEQ ID NO: 1024673 - RNA, 23 nt, Human
gggaagaaaagaaaaugaggcaa

SEQ ID NO: 1024674 - RNA, 22 nt, Human
gggaaucagagauggaaauucu

SEQ ID NO: 1024675 - RNA, 24 nt, Human
gggcguggugacacaugccuguaa

SEQ ID NO: 1024676 - RNA, 23 nt, Human
gggguuucaccauguuggccagg

SEQ ID NO: 1024677 - RNA, 19 nt, Human
ggucuugaacuccugaccu

SEQ ID NO: 1024678 - RNA, 24 nt, Human
ggugacacaugccuguaaucccag

SEQ ID NO: 1024679 - RNA, 21 nt, Human
gguggauuacaugaggucagg

SEQ ID NO: 1024680 - RNA, 24 nt, Human
gguggcuuaagccuguaaucccag

SEQ ID NO: 1024681 - RNA, 20 nt, Human
gguugcagugagccgagcuc

SEQ ID NO: 1024682 - RNA, 23 nt, Human
guagagacgggguuucaccaugu

SEQ ID NO: 1024683 - RNA, 24 nt, Human
gugauccgccucccucagccuccc

SEQ ID NO: 1024684 - RNA, 18 nt, Human
guugcagugagccgagcu

SEQ ID NO: 1024685 - RNA, 24 nt, Human
uaagccuguaaucccagcacuuug

SEQ ID NO: 1024686 - RNA, 30 nt, Human
uaauuuuuuuugucuguuuuuaguagagaa

SEQ ID NO: 1024687 - RNA, 18 nt, Human
uacauggcaaaccccauc

SEQ ID NO: 1024688 - RNA, 19 nt, Human
uaccaggugaagugugggg

SEQ ID NO: 1024689 - RNA, 22 nt, Human
uagagacgggguuucaccaugu

SEQ ID NO: 1024690 - RNA, 19 nt, Human
uaggugccagccgccaugc

SEQ ID NO: 1024691 - RNA, 24 nt, Human
uaguagagacgggguuucaccaug

SEQ ID NO: 1024692 - RNA, 26 nt, Human
uaguagagacgggguuucaccauguu

SEQ ID NO: 1024693 - RNA, 20 nt, Human
ucaaggaaaugaaaacaugg

SEQ ID NO: 1024694 - RNA, 23 nt, Human
ucacaccacugcacuccagccug

SEQ ID NO: 1024695 - RNA, 24 nt, Human
ucacugcaaccuccaucuccuggg

SEQ ID NO: 1024696 - RNA, 25 nt, Human
ucacugcaaccuccaucuccugggu

SEQ ID NO: 1024697 - RNA, 26 nt, Human
ucacugcaaccuccaucuccuggguu

SEQ ID NO: 1024698 - RNA, 24 nt, Human
ucagaagucuuuuugaaugcuccu

SEQ ID NO: 1024699 - RNA, 24 nt, Human
ucagggaagaaaagaaaaugaggc

SEQ ID NO: 1024700 - RNA, 23 nt, Human
uccagccugggugacagggcgag

SEQ ID NO: 1024701 - RNA, 24 nt, Human
uccagccugggugacagggcgaga

SEQ ID NO: 1024702 - RNA, 23 nt, Human
ucccaaagugcugggauuauagg

SEQ ID NO: 1024703 - RNA, 19 nt, Human
ucccacucuguugcccagg

SEQ ID NO: 1024704 - RNA, 24 nt, Human
ucccacucuguugcccaggcugga

SEQ ID NO: 1024705 - RNA, 26 nt, Human
ucccacucuguugcccaggcuggagu

SEQ ID NO: 1024706 - RNA, 27 nt, Human
ucccacucuguugcccaggcuggagug

SEQ ID NO: 1024707 - RNA, 23 nt, Human
ucccgaguaacugggauuauagg

SEQ ID NO: 1024708 - RNA, 24 nt, Human
ucccgaguaacugggauuauaggu

SEQ ID NO: 1024709 - RNA, 23 nt, Human
ucccucagccucccaaagugcug

SEQ ID NO: 1024710 - RNA, 24 nt, Human
ucccucagccucccaaagugcugg

SEQ ID NO: 1024711 - RNA, 21 nt, Human
uccgccucccucagccuccca

SEQ ID NO: 1024712 - RNA, 18 nt, Human
uccugggugcgguggcac

SEQ ID NO: 1024713 - RNA, 21 nt, Human
uccuggguucaagcaauucuc

SEQ ID NO: 1024714 - RNA, 24 nt, Human
uccuggguucaagcaauucuccug

SEQ ID NO: 1024715 - RNA, 24 nt, Human
ucuccuggguucaagcaauucucc

SEQ ID NO: 1024716 - RNA, 21 nt, Human
ucucuacuaaaaauacaaaaa

SEQ ID NO: 1024717 - RNA, 18 nt, Human
ucuguugcccaggcugga

SEQ ID NO: 1024718 - RNA, 21 nt, Human
ucuugaacuccugaccucaag

SEQ ID NO: 1024719 - RNA, 19 nt, Human
ucuuuugugugugugaauc

SEQ ID NO: 1024720 - RNA, 19 nt, Human
ugaagggagagaagaggaa

SEQ ID NO: 1024721 - RNA, 19 nt, Human
ugaaugcugccuucuuuac

SEQ ID NO: 1024722 - RNA, 23 nt, Human
ugacaagaaguaaauguguagaa

SEQ ID NO: 1024723 - RNA, 21 nt, Human
ugaccucaagugauccgccuc

SEQ ID NO: 1024724 - RNA, 22 nt, Human
ugagauggagucccacucuguu

SEQ ID NO: 1024725 - RNA, 20 nt, Human
ugaggcaagagaaucaccug

SEQ ID NO: 1024726 - RNA, 24 nt, Human
ugaggcaagagaaucaccugaacc

SEQ ID NO: 1024727 - RNA, 25 nt, Human
ugaggcaagagaaucaccugaaccc

SEQ ID NO: 1024728 - RNA, 22 nt, Human
ugagguggguggauuacaugag

SEQ ID NO: 1024729 - RNA, 23 nt, Human
ugagguggguggauuacaugagg

SEQ ID NO: 1024730 - RNA, 24 nt, Human
ugagguggguggauuacaugaggu

SEQ ID NO: 1024731 - RNA, 26 nt, Human
ugagguggguggauuacaugagguca

SEQ ID NO: 1024732 - RNA, 20 nt, Human
ugcacccagccuguuaccag

SEQ ID NO: 1024733 - RNA, 22 nt, Human
ugcaguggcacaaucucagcuc

SEQ ID NO: 1024734 - RNA, 18 nt, Human
ugcccaggcuggagugca

SEQ ID NO: 1024735 - RNA, 21 nt, Human
ugcccaggcuggagugcagug

SEQ ID NO: 1024736 - RNA, 22 nt, Human
ugcccaggcuggagugcagugg

SEQ ID NO: 1024737 - RNA, 24 nt, Human
ugcccaggcuggagugcaguggca

SEQ ID NO: 1024738 - RNA, 19 nt, Human
ugccuguaaucccagcuac

SEQ ID NO: 1024739 - RNA, 18 nt, Human
ugccuuauucaucuugcu

SEQ ID NO: 1024740 - RNA, 20 nt, Human
ugccuuauucaucuugcuaa

SEQ ID NO: 1024741 - RNA, 18 nt, Human
uggacgauuuaccaggug

SEQ ID NO: 1024742 - RNA, 18 nt, Human
uggaggcaagccagcuuc

SEQ ID NO: 1024743 - RNA, 18 nt, Human
uggagugcaguggcacaa

SEQ ID NO: 1024744 - RNA, 23 nt, Human
uggagugcaguggcacaaucuca

SEQ ID NO: 1024745 - RNA, 24 nt, Human
uggagugcaguggcacaaucucag

SEQ ID NO: 1024746 - RNA, 23 nt, Human
uggauuacaugaggucaggaguu

SEQ ID NO: 1024747 - RNA, 24 nt, Human
uggauuacaugaggucaggaguuu

SEQ ID NO: 1024748 - RNA, 24 nt, Human
uggcacaaucucagcucacugcaa

SEQ ID NO: 1024749 - RNA, 21 nt, Human
uggcacaguuaaaguuggcau

SEQ ID NO: 1024750 - RNA, 24 nt, Human
uggccaggcuggucuugaacuccu

SEQ ID NO: 1024751 - RNA, 22 nt, Human
uggcuuaagccuguaaucccag

SEQ ID NO: 1024752 - RNA, 24 nt, Human
uggcuuaagccuguaaucccagca

SEQ ID NO: 1024753 - RNA, 23 nt, Human
ugggaccagccuggccuacaugg

SEQ ID NO: 1024754 - RNA, 20 nt, Human
ugggaggcugaggugggugg

SEQ ID NO: 1024755 - RNA, 22 nt, Human
ugggaggcugagguggguggau

SEQ ID NO: 1024756 - RNA, 23 nt, Human
ugggaggcugagguggguggauu

SEQ ID NO: 1024757 - RNA, 20 nt, Human
ugggauuauaggugccagcc

SEQ ID NO: 1024758 - RNA, 21 nt, Human
ugggauuauaggugccagccg

SEQ ID NO: 1024759 - RNA, 24 nt, Human
ugggauuauaggugccagccgcca

SEQ ID NO: 1024760 - RNA, 25 nt, Human
ugggauuauaggugccagccgccau

SEQ ID NO: 1024761 - RNA, 18 nt, Human
ugggauuauaggugugag

SEQ ID NO: 1024762 - RNA, 19 nt, Human
ugggauuauaggugugagc

SEQ ID NO: 1024763 - RNA, 21 nt, Human
ugggauuauaggugugagcca

SEQ ID NO: 1024764 - RNA, 21 nt, Human
ugggauuauaggugugagcca

SEQ ID NO: 1024765 - RNA, 22 nt, Human
ugggauuauaggugugagccau

SEQ ID NO: 1024766 - RNA, 24 nt, Human
ugggauuauaggugugagccauug

SEQ ID NO: 1024767 - RNA, 24 nt, Human
uggguggauuacaugaggucagga

SEQ ID NO: 1024768 - RNA, 21 nt, Human
uggguucaagcaauucuccug

SEQ ID NO: 1024769 - RNA, 18 nt, Human
ugguaucuuuugugugug

SEQ ID NO: 1024770 - RNA, 24 nt, Human
uggugacacaugccuguaauccca

SEQ ID NO: 1024771 - RNA, 24 nt, Human
ugguggcuuaagccuguaauccca

SEQ ID NO: 1024772 - RNA, 25 nt, Human
uguagaaaggcagaaaugaggaaaa

SEQ ID NO: 1024773 - RNA, 28 nt, Human
ugugaaagugaaacaauuagaaaugagu

SEQ ID NO: 1024774 - RNA, 18 nt, Human
ugugaaucuggaggcaag

SEQ ID NO: 1024775 - RNA, 21 nt, Human
uguugcccaggcuggagugca

SEQ ID NO: 1024776 - RNA, 19 nt, Human
uguuuauucucucauugca

SEQ ID NO: 1024777 - RNA, 20 nt, Human
uuagccgggcguggugacac

SEQ ID NO: 1024778 - RNA, 24 nt, Human
uuagccgggcguggugacacaugc

SEQ ID NO: 1024779 - RNA, 26 nt, Human
uuaggccgggcgugguggcuuaagcc

SEQ ID NO: 1024780 - RNA, 18 nt, Human
uuaguagagacgggguuu

SEQ ID NO: 1024781 - RNA, 22 nt, Human
uuaguagagacgggguuucacc

SEQ ID NO: 1024782 - RNA, 24 nt, Human
uuaguagagacgggguuucaccau

SEQ ID NO: 1024783 - RNA, 18 nt, Human
uuauaggugugagccauu

SEQ ID NO: 1024784 - RNA, 21 nt, Human
uucaagcaauucuccugacuc

SEQ ID NO: 1024785 - RNA, 22 nt, Human
uucaguguuuauucucucauug

SEQ ID NO: 1024786 - RNA, 18 nt, Human
uugcagugagccgagcuc

SEQ ID NO: 1024787 - RNA, 20 nt, Human
uugcagugagccgagcucac

SEQ ID NO: 1024788 - RNA, 24 nt, Human
uuucaccauguuggccaggcuggu

SEQ ID NO: 1024789 - RNA, 24 nt, Human
uuuugucuguuuuuaguagagacg

SEQ ID NO: 1024790 - RNA, 24 nt, Human
uuuuuaguagagacgggguuucac

SEQ ID NO: 1024791 - RNA, 24 nt, Human
uuuuugucuguuuuuaguagagaa

SEQ ID NO: 1024792 - RNA, 23 nt, Human
uuuuuugucuguuuuuaguagag

SEQ ID NO: 1024793 - RNA, 22 nt, Human
uuuuuuuuuuuuuugagaugga

SEQ ID NO: 1024794 - RNA, 18 nt, Human
uuuuuuuuuuuuuuuuug

SEQ ID NO: 1024795 - RNA, 28 nt, Human
accuugaaggaugcuggaagacucagag

SEQ ID NO: 1024796 - RNA, 21 nt, Human
agccagcgcuggggcaacccg

SEQ ID NO: 1024797 - RNA, 21 nt, Human
agcgcccagucgagcccgggg

SEQ ID NO: 1024798 - RNA, 19 nt, Human
caggccccaggugcggacg

SEQ ID NO: 1024799 - RNA, 23 nt, Human
ccccagaguucagaggucuuggg

SEQ ID NO: 1024800 - RNA, 25 nt, Human
cccggcccugaggcaagguacuuug

SEQ ID NO: 1024801 - RNA, 21 nt, Human
ccgagauggcggcagccagcg

SEQ ID NO: 1024802 - RNA, 24 nt, Human
ccgucccuucgcuggugggaagaa

SEQ ID NO: 1024803 - RNA, 19 nt, Human
cggggcagcggcugccggg

SEQ ID NO: 1024804 - RNA, 20 nt, Human
cucccggcgugcuccgcggc

SEQ ID NO: 1024805 - RNA, 19 nt, Human
cucuuuagcugugcauagc

SEQ ID NO: 1024806 - RNA, 25 nt, Human
cugauggcgguagcagcgcccaguc

SEQ ID NO: 1024807 - RNA, 23 nt, Human
gagauggcggcagccagcgcugg

SEQ ID NO: 1024808 - RNA, 19 nt, Human
gcagcggcugccgggccgg

SEQ ID NO: 1024809 - RNA, 22 nt, Human
ggaagaagccgagauggcggca

SEQ ID NO: 1024810 - RNA, 22 nt, Human
uccccagaguucagaggucuug

SEQ ID NO: 1024811 - RNA, 19 nt, Human
ucccggcgugcuccgcggc

SEQ ID NO: 1024812 - RNA, 24 nt, Human
ucgcuggugggaagaagccgagau

SEQ ID NO: 1024813 - RNA, 23 nt, Human
ucuggcuuccacgccuuggggcu

SEQ ID NO: 1024814 - RNA, 20 nt, Human
ugaaggaugcuggaagacuc

SEQ ID NO: 1024815 - RNA, 20 nt, Human
ugaguuacagacggaaggag

SEQ ID NO: 1024816 - RNA, 24 nt, Human
uggaagacucagaguccccagagu

SEQ ID NO: 1024817 - RNA, 22 nt, Human
uggcggcagccagcgcuggggc

SEQ ID NO: 1024818 - RNA, 21 nt, Human
ugggaagaagccgagauggcg

SEQ ID NO: 1024819 - RNA, 22 nt, Human
caacgcuacuuccagaccucaa

SEQ ID NO: 1024820 - RNA, 20 nt, Human
caacuugaaagcagccaucc

SEQ ID NO: 1024821 - RNA, 25 nt, Human
cgcccaacugcaaugaccugcccac

SEQ ID NO: 1024822 - RNA, 18 nt, Human
cuagggguggcaggggag

SEQ ID NO: 1024823 - RNA, 20 nt, Human
cugccacagcugcugagcgc

SEQ ID NO: 1024824 - RNA, 27 nt, Human
cugcugagcgcccaacugcaaugaccu

SEQ ID NO: 1024825 - RNA, 21 nt, Human
ucuuuaauugcaaacaacuug

SEQ ID NO: 1024826 - RNA, 23 nt, Human
ugaaagcagccauccuaggggug

SEQ ID NO: 1024827 - RNA, 24 nt, Human
ugagcgcccaacugcaaugaccug

SEQ ID NO: 1024828 - RNA, 22 nt, Human
ugccacagcugcugagcgccca

SEQ ID NO: 1024829 - RNA, 18 nt, Human
ugcugagcgcccaacugc

SEQ ID NO: 1024830 - RNA, 23 nt, Human
uugaaagcagccauccuaggggu

SEQ ID NO: 1024831 - RNA, 24 nt, Human
aaacacccccggcacagccaugcc

SEQ ID NO: 1024832 - RNA, 23 nt, Human
aaaccaaggcucagagaggacca

SEQ ID NO: 1024833 - RNA, 24 nt, Human
aagcaggagcaucacuugaacucg

SEQ ID NO: 1024834 - RNA, 25 nt, Human
aagcaggagcaucacuugaacucgg

SEQ ID NO: 1024835 - RNA, 20 nt, Human
aaggucccacagggacccaa

SEQ ID NO: 1024836 - RNA, 33 nt, Human
acaaggucccacagggacccaagaauccaccuu

SEQ ID NO: 1024837 - RNA, 18 nt, Human
accaugcaugcacaaggu

SEQ ID NO: 1024838 - RNA, 25 nt, Human
acccuccccgacaggcaccgcuggu

SEQ ID NO: 1024839 - RNA, 21 nt, Human
acugcauuccagccuggcgac

SEQ ID NO: 1024840 - RNA, 23 nt, Human
acugcauuccagccuggcgacag

SEQ ID NO: 1024841 - RNA, 25 nt, Human
acugcauuccagccuggcgacagag

SEQ ID NO: 1024842 - RNA, 21 nt, Human
agacagcaguuauucugagca

SEQ ID NO: 1024843 - RNA, 23 nt, Human
agauggccccucuccccugcugg

SEQ ID NO: 1024844 - RNA, 20 nt, Human
agcagacggaaccagccaga

SEQ ID NO: 1024845 - RNA, 20 nt, Human
agccuggcgacagagugaaa

SEQ ID NO: 1024846 - RNA, 23 nt, Human
agcuggugggguucccacuccau

SEQ ID NO: 1024847 - RNA, 19 nt, Human
aggcaccgcuggcucuccu

SEQ ID NO: 1024848 - RNA, 20 nt, Human
aggcucagagaggaccaugc

SEQ ID NO: 1024849 - RNA, 21 nt, Human
agguggagguugcagugagcc

SEQ ID NO: 1024850 - RNA, 24 nt, Human
agguggagguugcagugagccgag

SEQ ID NO: 1024851 - RNA, 28 nt, Human
auagucccuguagucccagcuacucagg

SEQ ID NO: 1024852 - RNA, 23 nt, Human
aucacuugaacucgggaggugga

SEQ ID NO: 1024853 - RNA, 19 nt, Human
auugauaggaaggugggag

SEQ ID NO: 1024854 - RNA, 24 nt, Human
auugcccuacugcauuccagccug

SEQ ID NO: 1024855 - RNA, 21 nt, Human
caagugcacggagccccuucc

SEQ ID NO: 1024856 - RNA, 18 nt, Human
caaucccagguccuguag

SEQ ID NO: 1024857 - RNA, 20 nt, Human
cacugcugaagaaaccaagg

SEQ ID NO: 1024858 - RNA, 23 nt, Human
cacugcugcugucaccaucaacc

SEQ ID NO: 1024859 - RNA, 19 nt, Human
cagagcccagggcagugcu

SEQ ID NO: 1024860 - RNA, 19 nt, Human
cagccuggcgacagaguga

SEQ ID NO: 1024861 - RNA, 21 nt, Human
caggaagcccucagcaaacac

SEQ ID NO: 1024862 - RNA, 24 nt, Human
caggaggccgaagcaggagcauca

SEQ ID NO: 1024863 - RNA, 22 nt, Human
caggaugacaccugcaccugcu

SEQ ID NO: 1024864 - RNA, 23 nt, Human
cauuccagccuggcgacagagug

SEQ ID NO: 1024865 - RNA, 25 nt, Human
cauucccaguuuagauucccagggg

SEQ ID NO: 1024866 - RNA, 19 nt, Human
ccacugcggccagcaccgc

SEQ ID NO: 1024867 - RNA, 22 nt, Human
ccaggaugauguugccuccucu

SEQ ID NO: 1024868 - RNA, 22 nt, Human
ccaugccauagccagacaacag

SEQ ID NO: 1024869 - RNA, 20 nt, Human
ccccuagaaccuacugcggg

SEQ ID NO: 1024870 - RNA, 18 nt, Human
ccccuuccuccucggcca

SEQ ID NO: 1024871 - RNA, 22 nt, Human
cccucagcaaacacccccggca

SEQ ID NO: 1024872 - RNA, 21 nt, Human
ccgucuucccagggauggugg

SEQ ID NO: 1024873 - RNA, 26 nt, Human
ccucaccgccgaugagaccucccucg

SEQ ID NO: 1024874 - RNA, 22 nt, Human
ccuggcgacagagugaaauucc

SEQ ID NO: 1024875 - RNA, 21 nt, Human
ccuguagucccagcuacucag

SEQ ID NO: 1024876 - RNA, 22 nt, Human
ccuguagucccagcuacucagg

SEQ ID NO: 1024877 - RNA, 21 nt, Human
cgcccgucacgaugaccgucu

SEQ ID NO: 1024878 - RNA, 19 nt, Human
cgggagguggagguugcag

SEQ ID NO: 1024879 - RNA, 29 nt, Human
cgggagguggagguugcagugacaacggu

SEQ ID NO: 1024880 - RNA, 24 nt, Human
cgggagguggagguugcagugagc

SEQ ID NO: 1024881 - RNA, 21 nt, Human
cgggcugggaacucuagacac

SEQ ID NO: 1024882 - RNA, 21 nt, Human
cguacacuuagagcugccugu

SEQ ID NO: 1024883 - RNA, 19 nt, Human
cuacugcauuccagccugg

SEQ ID NO: 1024884 - RNA, 20 nt, Human
cuacugcauuccagccuggc

SEQ ID NO: 1024885 - RNA, 23 nt, Human
cuacugcauuccagccuggcgac

SEQ ID NO: 1024886 - RNA, 19 nt, Human
cucaggaugacaccugcac

SEQ ID NO: 1024887 - RNA, 19 nt, Human
cucucuggcugggcucugg

SEQ ID NO: 1024888 - RNA, 21 nt, Human
cuggcgacagagugaaauucc

SEQ ID NO: 1024889 - RNA, 20 nt, Human
cuggcuuucaaaucugcucc

SEQ ID NO: 1024890 - RNA, 18 nt, Human
cugggcucuggcacagga

SEQ ID NO: 1024891 - RNA, 19 nt, Human
cuucccagggaugguggcc

SEQ ID NO: 1024892 - RNA, 21 nt, Human
cuugaacucgggagguggagg

SEQ ID NO: 1024893 - RNA, 22 nt, Human
gaagcaggagcaucacuugaac

SEQ ID NO: 1024894 - RNA, 19 nt, Human
gaaggggacccgccugggc

SEQ ID NO: 1024895 - RNA, 23 nt, Human
gagguugcagugagccgagauug

SEQ ID NO: 1024896 - RNA, 23 nt, Human
gcauuccagccuggcgacagagu

SEQ ID NO: 1024897 - RNA, 22 nt, Human
gcccucagcaaacacccccggc

SEQ ID NO: 1024898 - RNA, 18 nt, Human
gcggccgccaguccuggg

SEQ ID NO: 1024899 - RNA, 18 nt, Human
gcgggcauggcggacagc

SEQ ID NO: 1024900 - RNA, 22 nt, Human
gcuguaccacaccaucauggga

SEQ ID NO: 1024901 - RNA, 22 nt, Human
gcuuccucaccgccgaugagac

SEQ ID NO: 1024902 - RNA, 23 nt, Human
ggaaccagccagagcccagggca

SEQ ID NO: 1024903 - RNA, 19 nt, Human
ggacccgccugggcuuccu

SEQ ID NO: 1024904 - RNA, 22 nt, Human
ggagguugcagugagccgagau

SEQ ID NO: 1024905 - RNA, 24 nt, Human
ggagguugcagugagccgagauug

SEQ ID NO: 1024906 - RNA, 26 nt, Human
ggcaagccccaccggugacauagucc

SEQ ID NO: 1024907 - RNA, 19 nt, Human
ggcacagccaugccauagc

SEQ ID NO: 1024908 - RNA, 24 nt, Human
ggcauggcggacagcuguccucgg

SEQ ID NO: 1024909 - RNA, 22 nt, Human
gggaugguggccuugcuggggc

SEQ ID NO: 1024910 - RNA, 21 nt, Human
guugcagugagccgagauugc

SEQ ID NO: 1024911 - RNA, 22 nt, Human
guugcagugagccgagauugcc

SEQ ID NO: 1024912 - RNA, 24 nt, Human
uacugcauuccagccuggcgacag

SEQ ID NO: 1024913 - RNA, 18 nt, Human
uagcagcagcuggugggg

SEQ ID NO: 1024914 - RNA, 21 nt, Human
ucacugcugcugucaccauca

SEQ ID NO: 1024915 - RNA, 22 nt, Human
ucacuugaacucgggaggugga

SEQ ID NO: 1024916 - RNA, 24 nt, Human
ucacuugaacucgggagguggagg

SEQ ID NO: 1024917 - RNA, 22 nt, Human
uccacugcggccagcaccgccc

SEQ ID NO: 1024918 - RNA, 18 nt, Human
uccagccuggcgacagag

SEQ ID NO: 1024919 - RNA, 24 nt, Human
ucccacagggacccaagaauccac

SEQ ID NO: 1024920 - RNA, 21 nt, Human
ucccacuccaugccgugcaga

SEQ ID NO: 1024921 - RNA, 19 nt, Human
uccccugcuggcagcagag

SEQ ID NO: 1024922 - RNA, 18 nt, Human
uccugggucucccggcuc

SEQ ID NO: 1024923 - RNA, 23 nt, Human
ucgcuguaccacaccaucauggg

SEQ ID NO: 1024924 - RNA, 20 nt, Human
ucugagcaucucacugcuga

SEQ ID NO: 1024925 - RNA, 19 nt, Human
ucugcaguuuggacuacca

SEQ ID NO: 1024926 - RNA, 20 nt, Human
ucuggcacaggaagcccuca

SEQ ID NO: 1024927 - RNA, 24 nt, Human
ugaagaaaccaaggcucagagagg

SEQ ID NO: 1024928 - RNA, 18 nt, Human
ugagagucugcaguuugg

SEQ ID NO: 1024929 - RNA, 22 nt, Human
ugagccgagauugcccuacugc

SEQ ID NO: 1024930 - RNA, 24 nt, Human
ugcaggccaguccacugcggccag

SEQ ID NO: 1024931 - RNA, 20 nt, Human
ugcaugcacaaggucccaca

SEQ ID NO: 1024932 - RNA, 18 nt, Human
ugccauagccagacaaca

SEQ ID NO: 1024933 - RNA, 21 nt, Human
ugccauagccagacaacagcu

SEQ ID NO: 1024934 - RNA, 18 nt, Human
ugcccuacugcauuccag

SEQ ID NO: 1024935 - RNA, 25 nt, Human
ugccuccucuccuggccaaguucca

SEQ ID NO: 1024936 - RNA, 19 nt, Human
ugcugcugucaccaucaac

SEQ ID NO: 1024937 - RNA, 20 nt, Human
ugcugcugucaccaucaacc

SEQ ID NO: 1024938 - RNA, 25 nt, Human
uggcugggcucuggcacaggaagcc

SEQ ID NO: 1024939 - RNA, 20 nt, Human
ugggcucuggcacaggaagc

SEQ ID NO: 1024940 - RNA, 23 nt, Human
uuagauucccaggggaagcauca

SEQ ID NO: 1024941 - RNA, 19 nt, Human
uucacggagcaccuuggaa

SEQ ID NO: 1024942 - RNA, 22 nt, Human
uucacggagcaccuuggaaccc

SEQ ID NO: 1024943 - RNA, 21 nt, Human
uuccaaggcggucugcuuccc

SEQ ID NO: 1024944 - RNA, 18 nt, Human
uucccagggaugguggcc

SEQ ID NO: 1024945 - RNA, 24 nt, Human
uugaacucgggagguggagguugc

SEQ ID NO: 1024946 - RNA, 19 nt, Human
uugcagugagccgagauug

SEQ ID NO: 1024947 - RNA, 20 nt, Human
uugcagugagccgagauugc

SEQ ID NO: 1024948 - RNA, 22 nt, Human
uugcagugagccgagauugccc

SEQ ID NO: 1024949 - RNA, 22 nt, Human
uuuuuuuuuuaaaugagcaagu

SEQ ID NO: 1024950 - RNA, 20 nt, Human
uuuuuuuuuuuuaaaugagc

SEQ ID NO: 1024951 - RNA, 23 nt, Human
uuuuuuuuuuuuuuuuuuaaaug

SEQ ID NO: 1024952 - RNA, 23 nt, Human
aaaaaaaaaaaaaaagaaaagaa

SEQ ID NO: 1024953 - RNA, 18 nt, Human
aaaauuagcugggcgugg

SEQ ID NO: 1024954 - RNA, 24 nt, Human
aaaauucccuuacugugccuacuu

SEQ ID NO: 1024955 - RNA, 19 nt, Human
aacacggugaaaccccauc

SEQ ID NO: 1024956 - RNA, 20 nt, Human
aacacggugaaaccccaucu

SEQ ID NO: 1024957 - RNA, 21 nt, Human
aacacggugaaaccccaucuc

SEQ ID NO: 1024958 - RNA, 21 nt, Human
aacacggugaaaccccaucuc

SEQ ID NO: 1024959 - RNA, 25 nt, Human
aaucgcuugaacccaggaggcgaga

SEQ ID NO: 1024960 - RNA, 18 nt, Human
acagagugaaacucuguc

SEQ ID NO: 1024961 - RNA, 19 nt, Human
acagagugaaacucugucu

SEQ ID NO: 1024962 - RNA, 20 nt, Human
acagagugaaacucugucuc

SEQ ID NO: 1024963 - RNA, 24 nt, Human
acagagugaaacucugucucaaaa

SEQ ID NO: 1024964 - RNA, 24 nt, Human
accccaucucugcuaaaaauacaa

SEQ ID NO: 1024965 - RNA, 24 nt, Human
accugaggucaggaguucaagacc

SEQ ID NO: 1024966 - RNA, 24 nt, Human
acuccagccugggugacagaguga

SEQ ID NO: 1024967 - RNA, 28 nt, Human
acucugucucaaaaaaaaaaaaaaagaa

SEQ ID NO: 1024968 - RNA, 18 nt, Human
agagugaaacucugucuc

SEQ ID NO: 1024969 - RNA, 24 nt, Human
agccuggccaacacggugaaaccc

SEQ ID NO: 1024970 - RNA, 22 nt, Human
agccugggugacagagugaaac

SEQ ID NO: 1024971 - RNA, 24 nt, Human
agccugggugacagagugaaacuc

SEQ ID NO: 1024972 - RNA, 18 nt, Human
agcuagagagaugccaca

SEQ ID NO: 1024973 - RNA, 23 nt, Human
agcugggcgugguggcaggcgcc

SEQ ID NO: 1024974 - RNA, 18 nt, Human
aggaggccugaagcacaa

SEQ ID NO: 1024975 - RNA, 23 nt, Human
aggcaggagaaucgcuugaaccc

SEQ ID NO: 1024976 - RNA, 24 nt, Human
aggcaggagaaucgcuugaaccca

SEQ ID NO: 1024977 - RNA, 22 nt, Human
aggcaguuggaucaccugaggu

SEQ ID NO: 1024978 - RNA, 26 nt, Human
aggcaguuggaucaccugaggucagg

SEQ ID NO: 1024979 - RNA, 18 nt, Human
aggccccagggggcccug

SEQ ID NO: 1024980 - RNA, 21 nt, Human
aggccgaggcaguuggaucac

SEQ ID NO: 1024981 - RNA, 20 nt, Human
aggcugaggcaggagaaucg

SEQ ID NO: 1024982 - RNA, 24 nt, Human
aggcugaggcaggagaaucgcuug

SEQ ID NO: 1024983 - RNA, 24 nt, Human
aguggcucacagcuguaaucccag

SEQ ID NO: 1024984 - RNA, 23 nt, Human
aguuggaucaccugaggucagga

SEQ ID NO: 1024985 - RNA, 24 nt, Human
aucaugccauugcacuccagccug

SEQ ID NO: 1024986 - RNA, 21 nt, Human
auugcacuccagccuggguga

SEQ ID NO: 1024987 - RNA, 24 nt, Human
auugcacuccagccugggugacag

SEQ ID NO: 1024988 - RNA, 22 nt, Human
caaggcaggaggcugagauggg

SEQ ID NO: 1024989 - RNA, 24 nt, Human
cacagcuguaaucccagcacuuug

SEQ ID NO: 1024990 - RNA, 20 nt, Human
cacaguuuaggauccaaaag

SEQ ID NO: 1024991 - RNA, 21 nt, Human
cacaguuuaggauccaaaagg

SEQ ID NO: 1024992 - RNA, 23 nt, Human
caccugaggucaggaguucaaga

SEQ ID NO: 1024993 - RNA, 22 nt, Human
cacuccagccugggugacagag

SEQ ID NO: 1024994 - RNA, 24 nt, Human
cacuccagccugggugacagagug

SEQ ID NO: 1024995 - RNA, 24 nt, Human
cagcacuuugggaggccgaggcag

SEQ ID NO: 1024996 - RNA, 24 nt, Human
cagcuacucgggaggcugaggcag

SEQ ID NO: 1024997 - RNA, 23 nt, Human
cagcuguaaucccagcacuuugg

SEQ ID NO: 1024998 - RNA, 24 nt, Human
cagcuguaaucccagcacuuuggg

SEQ ID NO: 1024999 - RNA, 19 nt, Human
cauugcacuccagccuggg

SEQ ID NO: 1025000 - RNA, 21 nt, Human
cauugcacuccagccugggug

SEQ ID NO: 1025001 - RNA, 22 nt, Human
cauugcacuccagccuggguga

SEQ ID NO: 1025002 - RNA, 24 nt, Human
cauugcacuccagccugggugaca

SEQ ID NO: 1025003 - RNA, 25 nt, Human
cauugcacuccagccugggugacag

SEQ ID NO: 1025004 - RNA, 20 nt, Human
ccacugggcugucuccgugc

SEQ ID NO: 1025005 - RNA, 20 nt, Human
ccacugggcugucuccgugc

SEQ ID NO: 1025006 - RNA, 23 nt, Human
ccagaauaggagaugaaugaaaa

SEQ ID NO: 1025007 - RNA, 22 nt, Human
ccagcucugaagccagaagccc

SEQ ID NO: 1025008 - RNA, 23 nt, Human
ccagugggaucugggcccuccuc

SEQ ID NO: 1025009 - RNA, 20 nt, Human
ccauugcacuccagccuggg

SEQ ID NO: 1025010 - RNA, 21 nt, Human
ccauugcacuccagccugggu

SEQ ID NO: 1025011 - RNA, 21 nt, Human
ccauugcacuccagccugggu

SEQ ID NO: 1025012 - RNA, 22 nt, Human
ccauugcacuccagccugggug

SEQ ID NO: 1025013 - RNA, 23 nt, Human
ccauugcacuccagccuggguga

SEQ ID NO: 1025014 - RNA, 24 nt, Human
ccauugcacuccagccugggugac

SEQ ID NO: 1025015 - RNA, 21 nt, Human
cccacaauucccagcucugaa

SEQ ID NO: 1025016 - RNA, 24 nt, Human
cccacaauucccagcucugaagcc

SEQ ID NO: 1025017 - RNA, 22 nt, Human
cccagcucugaagccagaagcc

SEQ ID NO: 1025018 - RNA, 24 nt, Human
ccccugugcucuccgcuucaggcu

SEQ ID NO: 1025019 - RNA, 18 nt, Human
cccuggccuccagcugca

SEQ ID NO: 1025020 - RNA, 21 nt, Human
ccucaucccccugugcucucc

SEQ ID NO: 1025021 - RNA, 23 nt, Human
ccucuaucggcuccccgcugccu

SEQ ID NO: 1025022 - RNA, 24 nt, Human
ccuggccaacacggugaaacccca

SEQ ID NO: 1025023 - RNA, 20 nt, Human
ccugggugacagagugaaac

SEQ ID NO: 1025024 - RNA, 22 nt, Human
ccugggugacagagugaaacuc

SEQ ID NO: 1025025 - RNA, 21 nt, Human
ccuguaaucccagcuacucgg

SEQ ID NO: 1025026 - RNA, 22 nt, Human
ccuguaaucccagcuacucggg

SEQ ID NO: 1025027 - RNA, 24 nt, Human
cgagaucaugccauugcacuccag

SEQ ID NO: 1025028 - RNA, 20 nt, Human
cgaggcaguuggaucaccug

SEQ ID NO: 1025029 - RNA, 24 nt, Human
cgaggcaguuggaucaccugaggu

SEQ ID NO: 1025030 - RNA, 26 nt, Human
cgaggcaguuggaucaccugagguca

SEQ ID NO: 1025031 - RNA, 23 nt, Human
cgccuguaaucccagcuacucgg

SEQ ID NO: 1025032 - RNA, 25 nt, Human
cucaaaaaaaaaaaaaaagaaaaga

SEQ ID NO: 1025033 - RNA, 24 nt, Human
cucacagcuguaaucccagcacuu

SEQ ID NO: 1025034 - RNA, 19 nt, Human
cucugucucaaaaaaaaaa

SEQ ID NO: 1025035 - RNA, 19 nt, Human
cugaagcacaauuggucua

SEQ ID NO: 1025036 - RNA, 23 nt, Human
cuggccaacacggugaaacccca

SEQ ID NO: 1025037 - RNA, 21 nt, Human
cugggaucccaauacuaaaga

SEQ ID NO: 1025038 - RNA, 20 nt, Human
cugugccuacuugccccucu

SEQ ID NO: 1025039 - RNA, 24 nt, Human
gacagagugaaacucugucucaaa

SEQ ID NO: 1025040 - RNA, 22 nt, Human
gaccacagcaggcaaaggagcc

SEQ ID NO: 1025041 - RNA, 23 nt, Human
gagaaucgcuugaacccaggagg

SEQ ID NO: 1025042 - RNA, 21 nt, Human
gaucaccugaggucaggaguu

SEQ ID NO: 1025043 - RNA, 23 nt, Human
gaucaccugaggucaggaguuca

SEQ ID NO: 1025044 - RNA, 24 nt, Human
gaucaccugaggucaggaguucaa

SEQ ID NO: 1025045 - RNA, 24 nt, Human
gcacuccagccugggugacagagu

SEQ ID NO: 1025046 - RNA, 22 nt, Human
gcaggagaaucgcuugaaccca

SEQ ID NO: 1025047 - RNA, 20 nt, Human
gcaguuggaucaccugaggu

SEQ ID NO: 1025048 - RNA, 24 nt, Human
gccaacacggugaaaccccaucuc

SEQ ID NO: 1025049 - RNA, 19 nt, Human
gccauugcacuccagccug

SEQ ID NO: 1025050 - RNA, 24 nt, Human
gccauugcacuccagccuggguga

SEQ ID NO: 1025051 - RNA, 23 nt, Human
gccuguaaucccagcuacucggg

SEQ ID NO: 1025052 - RNA, 22 nt, Human
gcucaggccagccauggacccu

SEQ ID NO: 1025053 - RNA, 25 nt, Human
gcucugaagccagaagcccagccuc

SEQ ID NO: 1025054 - RNA, 23 nt, Human
ggaaugcagcuugcaguguggag

SEQ ID NO: 1025055 - RNA, 19 nt, Human
ggaccacagcaggcaaagg

SEQ ID NO: 1025056 - RNA, 21 nt, Human
ggagggcagggaugggagggu

SEQ ID NO: 1025057 - RNA, 24 nt, Human
ggagggcagggaugggaggguaaa

SEQ ID NO: 1025058 - RNA, 19 nt, Human
ggaugggaggguaaagagg

SEQ ID NO: 1025059 - RNA, 23 nt, Human
ggcaaggccuauaggccccaggg

SEQ ID NO: 1025060 - RNA, 21 nt, Human
ggcaggcgccuguaaucccag

SEQ ID NO: 1025061 - RNA, 22 nt, Human
ggcagggaugggaggguaaaga

SEQ ID NO: 1025062 - RNA, 21 nt, Human
ggccgggugcaguggcucaca

SEQ ID NO: 1025063 - RNA, 23 nt, Human
ggcgugguggcaggcgccuguaa

SEQ ID NO: 1025064 - RNA, 25 nt, Human
ggcugcaagugcaaggcaggaggcu

SEQ ID NO: 1025065 - RNA, 24 nt, Human
gggcaaggccuauaggccccaggg

SEQ ID NO: 1025066 - RNA, 23 nt, Human
gggcagggaugggaggguaaaga

SEQ ID NO: 1025067 - RNA, 20 nt, Human
gggcccuccucccacaauuc

SEQ ID NO: 1025068 - RNA, 18 nt, Human
gggcucuuugaaagacca

SEQ ID NO: 1025069 - RNA, 24 nt, Human
gggugcaguggcucacagcuguaa

SEQ ID NO: 1025070 - RNA, 23 nt, Human
gguaaagagggcucuuugaaaga

SEQ ID NO: 1025071 - RNA, 19 nt, Human
ggugcaguggcucacagcu

SEQ ID NO: 1025072 - RNA, 24 nt, Human
gguggcaggcgccuguaaucccag

SEQ ID NO: 1025073 - RNA, 22 nt, Human
guagcccuggccuccagcugca

SEQ ID NO: 1025074 - RNA, 21 nt, Human
gucucaaaaaaaaaaaaaaag

SEQ ID NO: 1025075 - RNA, 20 nt, Human
uaaauucccggccgggugca

SEQ ID NO: 1025076 - RNA, 20 nt, Human
uaauaauaaaagcagagugc

SEQ ID NO: 1025077 - RNA, 20 nt, Human
uaggaaagcauccacaguag

SEQ ID NO: 1025078 - RNA, 23 nt, Human
uaggaaagcauccacaguagaaa

SEQ ID NO: 1025079 - RNA, 19 nt, Human
ucaaaaaaaaaaaaaaaga

SEQ ID NO: 1025080 - RNA, 19 nt, Human
ucaaugguuggaaucaagg

SEQ ID NO: 1025081 - RNA, 23 nt, Human
ucaccugaggucaggaguucaag

SEQ ID NO: 1025082 - RNA, 19 nt, Human
ucagaccuaggcugaccag

SEQ ID NO: 1025083 - RNA, 23 nt, Human
ucaugccauugcacuccagccug

SEQ ID NO: 1025084 - RNA, 26 nt, Human
uccacaguagaaagauaaauugagaa

SEQ ID NO: 1025085 - RNA, 22 nt, Human
uccagccugggugacagaguga

SEQ ID NO: 1025086 - RNA, 20 nt, Human
ucccagagugagacuuaguu

SEQ ID NO: 1025087 - RNA, 21 nt, Human
ucccagagugagacuuaguuu

SEQ ID NO: 1025088 - RNA, 18 nt, Human
ucccagcucugaagccag

SEQ ID NO: 1025089 - RNA, 19 nt, Human
ucccagcucugaagccaga

SEQ ID NO: 1025090 - RNA, 18 nt, Human
uccccgcugccugccacc

SEQ ID NO: 1025091 - RNA, 20 nt, Human
ucccugacuuguggccacug

SEQ ID NO: 1025092 - RNA, 21 nt, Human
ucccugacuuguggccacugg

SEQ ID NO: 1025093 - RNA, 24 nt, Human
ucgggaggcugaggcaggagaauc

SEQ ID NO: 1025094 - RNA, 24 nt, Human
ucucaaaaaaaaaaaaaaagaaaa

SEQ ID NO: 1025095 - RNA, 21 nt, Human
ucucugcuaaaaauacaaaaa

SEQ ID NO: 1025096 - RNA, 18 nt, Human
ucugcccuuccuuucuga

SEQ ID NO: 1025097 - RNA, 23 nt, Human
ucugucucaaaaaaaaaaaaaaa

SEQ ID NO: 1025098 - RNA, 18 nt, Human
ugaagccagaagcccagc

SEQ ID NO: 1025099 - RNA, 21 nt, Human
ugaagccccaaaucuaaguag

SEQ ID NO: 1025100 - RNA, 22 nt, Human
ugacagagugaaacucugucuc

SEQ ID NO: 1025101 - RNA, 26 nt, Human
ugacuuguggccacuggggcaggccu

SEQ ID NO: 1025102 - RNA, 20 nt, Human
ugagcuggguguucccaggg

SEQ ID NO: 1025103 - RNA, 20 nt, Human
ugaggcaggagaaucgcuug

SEQ ID NO: 1025104 - RNA, 24 nt, Human
ugaggcaggagaaucgcuugaacc

SEQ ID NO: 1025105 - RNA, 25 nt, Human
ugaggcaggagaaucgcuugaaccc

SEQ ID NO: 1025106 - RNA, 24 nt, Human
ugcacuccagccugggugacagag

SEQ ID NO: 1025107 - RNA, 22 nt, Human
ugcagcuugcaguguggagggc

SEQ ID NO: 1025108 - RNA, 20 nt, Human
ugcccuuccuuucugacuuc

SEQ ID NO: 1025109 - RNA, 24 nt, Human
uggaucaccugaggucaggaguuc

SEQ ID NO: 1025110 - RNA, 27 nt, Human
uggaucaccugaggucaggaguucaag

SEQ ID NO: 1025111 - RNA, 22 nt, Human
uggcaggcgccuguaaucccag

SEQ ID NO: 1025112 - RNA, 22 nt, Human
uggcucacagcuguaaucccag

SEQ ID NO: 1025113 - RNA, 24 nt, Human
uggcucacagcuguaaucccagca

SEQ ID NO: 1025114 - RNA, 18 nt, Human
uggcuggaaugcagcuug

SEQ ID NO: 1025115 - RNA, 19 nt, Human
uggcuggaaugcagcuugc

SEQ ID NO: 1025116 - RNA, 20 nt, Human
uggcuggaaugcagcuugca

SEQ ID NO: 1025117 - RNA, 24 nt, Human
ugggaggccgaggcaguuggauca

SEQ ID NO: 1025118 - RNA, 22 nt, Human
ugggcugucuccgugcauucaa

SEQ ID NO: 1025119 - RNA, 24 nt, Human
ugguggcaggcgccuguaauccca

SEQ ID NO: 1025120 - RNA, 21 nt, Human
ugugaaaggcugccuggagga

SEQ ID NO: 1025121 - RNA, 18 nt, Human
uuagcugggcgugguggc

SEQ ID NO: 1025122 - RNA, 24 nt, Human
uuagcugggcgugguggcaggcgc

SEQ ID NO: 1025123 - RNA, 23 nt, Human
uuccugaucaaguuucuuaagcu

SEQ ID NO: 1025124 - RNA, 21 nt, Human
uuccuucuggguagcagcuag

SEQ ID NO: 1025125 - RNA, 27 nt, Human
uuguggccacuggggcaggccugagcu

SEQ ID NO: 1025126 - RNA, 18 nt, Human
uuuuuuuuuuuuuuucug

SEQ ID NO: 1025127 - RNA, 22 nt, Human
uuuuuuuuuuuuuuuuucuguu

SEQ ID NO: 1025128 - RNA, 25 nt, Human
aaaacaccuguuuacuacuuacuaa

SEQ ID NO: 1025129 - RNA, 18 nt, Human
aaacaaagugccaaaugc

SEQ ID NO: 1025130 - RNA, 23 nt, Human
aaaccacccccaugauccaauca

SEQ ID NO: 1025131 - RNA, 19 nt, Human
aaagacaauuuaaaaugua

SEQ ID NO: 1025132 - RNA, 21 nt, Human
aacuauaaaaccuaccaaaca

SEQ ID NO: 1025133 - RNA, 22 nt, Human
aagaggaaagagaaaagcccag

SEQ ID NO: 1025134 - RNA, 23 nt, Human
aauagccaaauaccuuaguagcc

SEQ ID NO: 1025135 - RNA, 18 nt, Human
aauggcacaggacuuggu

SEQ ID NO: 1025136 - RNA, 19 nt, Human
aauucgagaugaaauuugg

SEQ ID NO: 1025137 - RNA, 21 nt, Human
acagacaaaccauaccagcca

SEQ ID NO: 1025138 - RNA, 24 nt, Human
accaaguauuuccuucuaaaaagu

SEQ ID NO: 1025139 - RNA, 18 nt, Human
accauucucaccauauuu

SEQ ID NO: 1025140 - RNA, 24 nt, Human
acuuacauuuaaauacuccagcau

SEQ ID NO: 1025141 - RNA, 20 nt, Human
agaaguagcaagaaggauga

SEQ ID NO: 1025142 - RNA, 18 nt, Human
agacaaaccauaccagcc

SEQ ID NO: 1025143 - RNA, 18 nt, Human
aggaaagagaaaagccca

SEQ ID NO: 1025144 - RNA, 22 nt, Human
aggcuuuaaaauuuuuuagaau

SEQ ID NO: 1025145 - RNA, 24 nt, Human
agugaggaguuaaaggggcagagc

SEQ ID NO: 1025146 - RNA, 22 nt, Human
auagccaaauaccuuaguagcc

SEQ ID NO: 1025147 - RNA, 23 nt, Human
auuuuuuuauucacuagauagca

SEQ ID NO: 1025148 - RNA, 25 nt, Human
caacaggaagaauagcaauuucucc

SEQ ID NO: 1025149 - RNA, 22 nt, Human
caagaaacuuacaaucaugggg

SEQ ID NO: 1025150 - RNA, 21 nt, Human
caagaaggaugaacugaagca

SEQ ID NO: 1025151 - RNA, 19 nt, Human
caagcccacuuuuagguau

SEQ ID NO: 1025152 - RNA, 20 nt, Human
caaggguaguaaaacuccag

SEQ ID NO: 1025153 - RNA, 21 nt, Human
cacuaucaggagaacaucgua

SEQ ID NO: 1025154 - RNA, 23 nt, Human
cagauaucuuucaaacuaauuuu

SEQ ID NO: 1025155 - RNA, 22 nt, Human
cagcaagcccacuuuuagguau

SEQ ID NO: 1025156 - RNA, 22 nt, Human
caggagaacaucguaggggaaa

SEQ ID NO: 1025157 - RNA, 24 nt, Human
ccacccccaugauccaaucaccuc

SEQ ID NO: 1025158 - RNA, 20 nt, Human
ccccaugauccaaucaccuc

SEQ ID NO: 1025159 - RNA, 23 nt, Human
cccccaugauccaaucaccuccc

SEQ ID NO: 1025160 - RNA, 25 nt, Human
ccucccaccaggucucucccuagac

SEQ ID NO: 1025161 - RNA, 20 nt, Human
cgccaucaaaacaucaaugu

SEQ ID NO: 1025162 - RNA, 22 nt, Human
cguacaaacaccuguacacgug

SEQ ID NO: 1025163 - RNA, 24 nt, Human
cucaagaaacuuacaaucaugggg

SEQ ID NO: 1025164 - RNA, 21 nt, Human
cucacccacuaucaggagaac

SEQ ID NO: 1025165 - RNA, 20 nt, Human
cucaccuacaucuuccaaca

SEQ ID NO: 1025166 - RNA, 22 nt, Human
cucauuaaaauacuuacauuua

SEQ ID NO: 1025167 - RNA, 18 nt, Human
gaagaccggaauuaaacc

SEQ ID NO: 1025168 - RNA, 23 nt, Human
ggacacagacaaaccauaccagc

SEQ ID NO: 1025169 - RNA, 20 nt, Human
uaaaaaaugcagccaaccac

SEQ ID NO: 1025170 - RNA, 22 nt, Human
uaaaaaaugcagccaaccaccu

SEQ ID NO: 1025171 - RNA, 24 nt, Human
uaaaaccuaccaaacaaagugcca

SEQ ID NO: 1025172 - RNA, 25 nt, Human
uaaaaccuaccaaacaaagugccaa

SEQ ID NO: 1025173 - RNA, 26 nt, Human
uaaaaccuaccaaacaaagugccaaa

SEQ ID NO: 1025174 - RNA, 27 nt, Human
uaacuuccuuucaaucagcaaaacacc

SEQ ID NO: 1025175 - RNA, 19 nt, Human
uacgaaacauauuuuucuc

SEQ ID NO: 1025176 - RNA, 21 nt, Human
uagaaguagcaagaaggauga

SEQ ID NO: 1025177 - RNA, 21 nt, Human
uagaugccuaucauuucauuu

SEQ ID NO: 1025178 - RNA, 21 nt, Human
uagccaaauaccuuaguagcc

SEQ ID NO: 1025179 - RNA, 20 nt, Human
uaggguaauaguggugaggu

SEQ ID NO: 1025180 - RNA, 23 nt, Human
uauuuucucaccuacaucuucca

SEQ ID NO: 1025181 - RNA, 20 nt, Human
ucaaaacaucaauguacuga

SEQ ID NO: 1025182 - RNA, 19 nt, Human
ucacaaggcuucaggagaa

SEQ ID NO: 1025183 - RNA, 21 nt, Human
ucaggagaaagagugaggagu

SEQ ID NO: 1025184 - RNA, 27 nt, Human
uccaacacuauuaauuacuuuugaauu

SEQ ID NO: 1025185 - RNA, 21 nt, Human
ucccuagacacauggggauua

SEQ ID NO: 1025186 - RNA, 18 nt, Human
ugaggacacagacaaacc

SEQ ID NO: 1025187 - RNA, 22 nt, Human
ugauccaaucaccucccaccag

SEQ ID NO: 1025188 - RNA, 18 nt, Human
ugcgauuucuccagauau

SEQ ID NO: 1025189 - RNA, 20 nt, Human
ugguuaggagaagaggaaag

SEQ ID NO: 1025190 - RNA, 19 nt, Human
uuacucauuaaaauacuua

SEQ ID NO: 1025191 - RNA, 29 nt, Human
uucaaucagcaaaacaccuguuuacuacu

SEQ ID NO: 1025192 - RNA, 19 nt, Human
uugaaacuauaaaaccuac

SEQ ID NO: 1025193 - RNA, 22 nt, Human
uuuaaaaagcccuauuguuuua

SEQ ID NO: 1025194 - RNA, 18 nt, Human
uuuuguuucuucccccuc

SEQ ID NO: 1025195 - RNA, 21 nt, Human
aaaaccuucucagggccaaag

SEQ ID NO: 1025196 - RNA, 23 nt, Human
aaauuuccagcacgaaccagcuc

SEQ ID NO: 1025197 - RNA, 25 nt, Human
acacacauacacacauacacacaua

SEQ ID NO: 1025198 - RNA, 20 nt, Human
acacgcacacacauacacag

SEQ ID NO: 1025199 - RNA, 22 nt, Human
acauacacacauacacacugua

SEQ ID NO: 1025200 - RNA, 20 nt, Human
accccaagaaacccaggaga

SEQ ID NO: 1025201 - RNA, 21 nt, Human
acccgggcagggcaggggacc

SEQ ID NO: 1025202 - RNA, 18 nt, Human
acgaaccagcucgccacc

SEQ ID NO: 1025203 - RNA, 23 nt, Human
acgcacacacauacacacauaca

SEQ ID NO: 1025204 - RNA, 20 nt, Human
agcacgaaccagcucgccac

SEQ ID NO: 1025205 - RNA, 22 nt, Human
agcacgaaccagcucgccaccu

SEQ ID NO: 1025206 - RNA, 19 nt, Human
aggaugggggcagcugaga

SEQ ID NO: 1025207 - RNA, 20 nt, Human
aggcaaaaggagaagucgcg

SEQ ID NO: 1025208 - RNA, 18 nt, Human
aggcuguguggcaagggc

SEQ ID NO: 1025209 - RNA, 19 nt, Human
aggggcuggggcucugggg

SEQ ID NO: 1025210 - RNA, 21 nt, Human
agggggcagugugggggacac

SEQ ID NO: 1025211 - RNA, 24 nt, Human
agggggcuucccgugccccacagg

SEQ ID NO: 1025212 - RNA, 21 nt, Human
auaacuaugguccccucccaa

SEQ ID NO: 1025213 - RNA, 23 nt, Human
auggacgcugaugucagccacca

SEQ ID NO: 1025214 - RNA, 18 nt, Human
caacggcuggggaaacuc

SEQ ID NO: 1025215 - RNA, 19 nt, Human
caagggacgucuacugugg

SEQ ID NO: 1025216 - RNA, 28 nt, Human
cacacacauacacacauacacacauaca

SEQ ID NO: 1025217 - RNA, 21 nt, Human
cacacccacacaugcaggucc

SEQ ID NO: 1025218 - RNA, 21 nt, Human
cacacuccagcgccagaaaag

SEQ ID NO: 1025219 - RNA, 27 nt, Human
cacauacacacauacacacuguaccuu

SEQ ID NO: 1025220 - RNA, 22 nt, Human
cacccacacaugcagguccuac

SEQ ID NO: 1025221 - RNA, 26 nt, Human
cacgcacacacauacacacauacaca

SEQ ID NO: 1025222 - RNA, 19 nt, Human
cacuaacuccccugcccua

SEQ ID NO: 1025223 - RNA, 21 nt, Human
cacuguuuguaaacuggaccc

SEQ ID NO: 1025224 - RNA, 30 nt, Human
cagagacacgcacacacauacacacauaca

SEQ ID NO: 1025225 - RNA, 24 nt, Human
caggagaaauuuccagcacgaacc

SEQ ID NO: 1025226 - RNA, 20 nt, Human
cagggccccaaccugguguu

SEQ ID NO: 1025227 - RNA, 21 nt, Human
cagggggagcugggaccugcu

SEQ ID NO: 1025228 - RNA, 24 nt, Human
cauucuggcagccgugggguucug

SEQ ID NO: 1025229 - RNA, 28 nt, Human
ccagggccccaaccuggugguagcaaga

SEQ ID NO: 1025230 - RNA, 21 nt, Human
cccaacucuaacauacuagau

SEQ ID NO: 1025231 - RNA, 22 nt, Human
cccaggaccccgccccaggccc

SEQ ID NO: 1025232 - RNA, 23 nt, Human
ccccacacuguuuguaaacugga

SEQ ID NO: 1025233 - RNA, 26 nt, Human
ccccacacuguuuguaaacuggaccc

SEQ ID NO: 1025234 - RNA, 19 nt, Human
ccccacaggccagcucaga

SEQ ID NO: 1025235 - RNA, 21 nt, Human
ccccgccccaggcccugagcc

SEQ ID NO: 1025236 - RNA, 19 nt, Human
ccccugguguccaccgccc

SEQ ID NO: 1025237 - RNA, 21 nt, Human
cccugcacacuccagcgccag

SEQ ID NO: 1025238 - RNA, 20 nt, Human
cccugcccugugagcccuuc

SEQ ID NO: 1025239 - RNA, 24 nt, Human
ccggcagaggucccugggccuggg

SEQ ID NO: 1025240 - RNA, 19 nt, Human
ccucugggugccucuggga

SEQ ID NO: 1025241 - RNA, 21 nt, Human
ccugguccuuggagggagugg

SEQ ID NO: 1025242 - RNA, 18 nt, Human
ccuuggagggaguggggg

SEQ ID NO: 1025243 - RNA, 19 nt, Human
ccuuggagggagugggggu

SEQ ID NO: 1025244 - RNA, 23 nt, Human
cgagagagagagcgagcacggca

SEQ ID NO: 1025245 - RNA, 22 nt, Human
cgcacacacauacacacauaca

SEQ ID NO: 1025246 - RNA, 23 nt, Human
cgcccugcacacuccagcgccag

SEQ ID NO: 1025247 - RNA, 21 nt, Human
cggcaagacaugaggggcugg

SEQ ID NO: 1025248 - RNA, 28 nt, Human
cggcagaggucccugggccugggacagu

SEQ ID NO: 1025249 - RNA, 21 nt, Human
cuaugguccccucccaacucu

SEQ ID NO: 1025250 - RNA, 23 nt, Human
cuccccugcccuaaggauggggg

SEQ ID NO: 1025251 - RNA, 19 nt, Human
cugcucuggggucaggcug

SEQ ID NO: 1025252 - RNA, 20 nt, Human
cuggggucaggcuggaggcu

SEQ ID NO: 1025253 - RNA, 20 nt, Human
cugguggagacccucuagcc

SEQ ID NO: 1025254 - RNA, 19 nt, Human
cugugagcccuucuauccu

SEQ ID NO: 1025255 - RNA, 24 nt, Human
gacagugacauaaacugagguaaa

SEQ ID NO: 1025256 - RNA, 19 nt, Human
gaccugguccuuggaggga

SEQ ID NO: 1025257 - RNA, 21 nt, Human
gaccugguccuuggagggagu

SEQ ID NO: 1025258 - RNA, 18 nt, Human
gaccuguggccccgccuc

SEQ ID NO: 1025259 - RNA, 19 nt, Human
gagcccuucuauccccaca

SEQ ID NO: 1025260 - RNA, 21 nt, Human
gaggacccggcagaggucccu

SEQ ID NO: 1025261 - RNA, 18 nt, Human
gaggauggggucuuggag

SEQ ID NO: 1025262 - RNA, 20 nt, Human
gagggagagagagaaagaga

SEQ ID NO: 1025263 - RNA, 19 nt, Human
gcagugugggggacacagg

SEQ ID NO: 1025264 - RNA, 20 nt, Human
gcccuaaggaugggggcagc

SEQ ID NO: 1025265 - RNA, 20 nt, Human
gcccuggggccaccccacac

SEQ ID NO: 1025266 - RNA, 18 nt, Human
gcggcugggagaggcagc

SEQ ID NO: 1025267 - RNA, 18 nt, Human
gcuguguggcaagggcug

SEQ ID NO: 1025268 - RNA, 18 nt, Human
ggaagcccaggcuacuac

SEQ ID NO: 1025269 - RNA, 21 nt, Human
ggacccgggcagggcagggga

SEQ ID NO: 1025270 - RNA, 21 nt, Human
ggagguuggcauguuugaccc

SEQ ID NO: 1025271 - RNA, 23 nt, Human
ggcagccgugggguucuguucag

SEQ ID NO: 1025272 - RNA, 21 nt, Human
ggcccugagccaagcauggac

SEQ ID NO: 1025273 - RNA, 24 nt, Human
gggaagcaccgaaggacagggggc

SEQ ID NO: 1025274 - RNA, 22 nt, Human
gggagaggcagccccgaugggc

SEQ ID NO: 1025275 - RNA, 21 nt, Human
gggcacagcagggagaguggg

SEQ ID NO: 1025276 - RNA, 23 nt, Human
gggcacagcagggagaguggggc

SEQ ID NO: 1025277 - RNA, 18 nt, Human
ggggcuggggcucugggg

SEQ ID NO: 1025278 - RNA, 23 nt, Human
gggggcuucccgugccccacagg

SEQ ID NO: 1025279 - RNA, 20 nt, Human
gugcacacacaccuagucac

SEQ ID NO: 1025280 - RNA, 23 nt, Human
gugcacacacaccuagucacaca

SEQ ID NO: 1025281 - RNA, 27 nt, Human
guuuagagaaguaaauaacacauuuaa

SEQ ID NO: 1025282 - RNA, 19 nt, Human
uaacagagagagggagaga

SEQ ID NO: 1025283 - RNA, 23 nt, Human
uaaggcaaaaggagaagucgcgg

SEQ ID NO: 1025284 - RNA, 18 nt, Human
uaaggggcaaaggguccc

SEQ ID NO: 1025285 - RNA, 24 nt, Human
uaaggggcaaagggucccagcccg

SEQ ID NO: 1025286 - RNA, 19 nt, Human
uacacacauacacacauac

SEQ ID NO: 1025287 - RNA, 22 nt, Human
uacacacauacacacauacaca

SEQ ID NO: 1025288 - RNA, 20 nt, Human
uacaguguuauuuuuugcua

SEQ ID NO: 1025289 - RNA, 19 nt, Human
uagucacacacucgccccc

SEQ ID NO: 1025290 - RNA, 19 nt, Human
ucagggaacauucuggcag

SEQ ID NO: 1025291 - RNA, 23 nt, Human
uccccugcccuaaggaugggggc

SEQ ID NO: 1025292 - RNA, 20 nt, Human
ucccgugccccacaggccag

SEQ ID NO: 1025293 - RNA, 24 nt, Human
ucccugggccugggacagugcggc

SEQ ID NO: 1025294 - RNA, 21 nt, Human
ucggcuccacacuaacucccc

SEQ ID NO: 1025295 - RNA, 18 nt, Human
ucuacccaggaccccgcc

SEQ ID NO: 1025296 - RNA, 21 nt, Human
ucuacccaggaccccgcccca

SEQ ID NO: 1025297 - RNA, 21 nt, Human
ucucugagaccugguccuugg

SEQ ID NO: 1025298 - RNA, 20 nt, Human
ucucugggaagcaccgaagg

SEQ ID NO: 1025299 - RNA, 21 nt, Human
ucugcucuggggucaggcugg

SEQ ID NO: 1025300 - RNA, 22 nt, Human
ucugcucuggggucaggcugga

SEQ ID NO: 1025301 - RNA, 26 nt, Human
ucuggggcuaggacucuacccaggac

SEQ ID NO: 1025302 - RNA, 24 nt, Human
ugaccagggccuucucugagaccu

SEQ ID NO: 1025303 - RNA, 20 nt, Human
ugagguaaacaucugugacc

SEQ ID NO: 1025304 - RNA, 19 nt, Human
ugcacacuccagcgccaga

SEQ ID NO: 1025305 - RNA, 23 nt, Human
ugcuacuuaccuggcauguggag

SEQ ID NO: 1025306 - RNA, 19 nt, Human
ugcuggaagcccaggcuac

SEQ ID NO: 1025307 - RNA, 18 nt, Human
uggagguuggcauguuug

SEQ ID NO: 1025308 - RNA, 24 nt, Human
uggcagcaccagggccccaaccug

SEQ ID NO: 1025309 - RNA, 21 nt, Human
ugggaagcaccgaaggacagg

SEQ ID NO: 1025310 - RNA, 20 nt, Human
ugggagaggcagccccgaug

SEQ ID NO: 1025311 - RNA, 18 nt, Human
uggggagguggagucugg

SEQ ID NO: 1025312 - RNA, 23 nt, Human
uggggagguggagucuggagagg

SEQ ID NO: 1025313 - RNA, 18 nt, Human
ugggggacacagggucug

SEQ ID NO: 1025314 - RNA, 20 nt, Human
ugggggacacagggucuggg

SEQ ID NO: 1025315 - RNA, 24 nt, Human
ugugaccaacaccucuccuaaggg

SEQ ID NO: 1025316 - RNA, 19 nt, Human
uguggagggcccauaccca

SEQ ID NO: 1025317 - RNA, 19 nt, Human
uguggcaagggcugggagg

SEQ ID NO: 1025318 - RNA, 21 nt, Human
ugugggggacacagggucugg

SEQ ID NO: 1025319 - RNA, 22 nt, Human
ugugggggacacagggucugga

SEQ ID NO: 1025320 - RNA, 18 nt, Human
uguguggcaagggcuggg

SEQ ID NO: 1025321 - RNA, 21 nt, Human
uucacagaagaaucgcaacaa

SEQ ID NO: 1025322 - RNA, 24 nt, Human
uucagugggccugguggagacccu

SEQ ID NO: 1025323 - RNA, 18 nt, Human
uuccagcacgaaccaggg

SEQ ID NO: 1025324 - RNA, 25 nt, Human
uucucacacccacacaugcaggucc

SEQ ID NO: 1025325 - RNA, 21 nt, Human
uucugcucuggggucaggcug

SEQ ID NO: 1025326 - RNA, 22 nt, Human
uucugcucuggggucaggcugg

SEQ ID NO: 1025327 - RNA, 23 nt, Human
uucugcucuggggucaggcugga

SEQ ID NO: 1025328 - RNA, 24 nt, Human
uucuucgacagugacauaaacuga

SEQ ID NO: 1025329 - RNA, 22 nt, Human
uugaccccaagaaacccaggag

SEQ ID NO: 1025330 - RNA, 24 nt, Human
uuggagggaguggggguuugcuac

SEQ ID NO: 1025331 - RNA, 18 nt, Human
aaaaccaaaccaacagaa

SEQ ID NO: 1025332 - RNA, 24 nt, Human
aaaaccaaaccaacagaaaaggaa

SEQ ID NO: 1025333 - RNA, 18 nt, Human
aacagaaaaggaagcuga

SEQ ID NO: 1025334 - RNA, 22 nt, Human
aaccuaacaaucucaagacaca

SEQ ID NO: 1025335 - RNA, 20 nt, Human
aagcagaaaggaagucagcc

SEQ ID NO: 1025336 - RNA, 22 nt, Human
aagcagaaaggaagucagccag

SEQ ID NO: 1025337 - RNA, 24 nt, Human
aagcagaaaggaagucagccagag

SEQ ID NO: 1025338 - RNA, 18 nt, Human
aagcugccacugcccacc

SEQ ID NO: 1025339 - RNA, 22 nt, Human
aaggagacaagaaagggcuuca

SEQ ID NO: 1025340 - RNA, 21 nt, Human
aaggggcccaggugguucugc

SEQ ID NO: 1025341 - RNA, 19 nt, Human
accuagauccacuaccccg

SEQ ID NO: 1025342 - RNA, 18 nt, Human
acgcggccuccgggcugg

SEQ ID NO: 1025343 - RNA, 18 nt, Human
acggagugccccaggccc

SEQ ID NO: 1025344 - RNA, 20 nt, Human
agaaugacaggagggaccgu

SEQ ID NO: 1025345 - RNA, 22 nt, Human
agacuacuagaagcagaaagga

SEQ ID NO: 1025346 - RNA, 23 nt, Human
agaguccccccaaccauucacau

SEQ ID NO: 1025347 - RNA, 21 nt, Human
agcccccucccccacggccga

SEQ ID NO: 1025348 - RNA, 18 nt, Human
agcccguggcuccuggac

SEQ ID NO: 1025349 - RNA, 23 nt, Human
aggaaggaggcagccuugaggac

SEQ ID NO: 1025350 - RNA, 21 nt, Human
aggcagccuugaggaccccaa

SEQ ID NO: 1025351 - RNA, 22 nt, Human
agugucuuucaaguuaaacagc

SEQ ID NO: 1025352 - RNA, 24 nt, Human
auacaaaagugugaaguuauuuuu

SEQ ID NO: 1025353 - RNA, 18 nt, Human
auagaucuguaucauaca

SEQ ID NO: 1025354 - RNA, 22 nt, Human
auaucucacaauaaaaacgcca

SEQ ID NO: 1025355 - RNA, 19 nt, Human
caaaaggaaggaggcagcc

SEQ ID NO: 1025356 - RNA, 23 nt, Human
caagucugguccccgaaggccgg

SEQ ID NO: 1025357 - RNA, 19 nt, Human
cacagaguagccaauauag

SEQ ID NO: 1025358 - RNA, 21 nt, Human
cacccuggaugcagaagcccu

SEQ ID NO: 1025359 - RNA, 20 nt, Human
cacuggcaaaaagggaggag

SEQ ID NO: 1025360 - RNA, 20 nt, Human
cagaguccccccaaccauuc

SEQ ID NO: 1025361 - RNA, 25 nt, Human
cagccugccccuccaacgggccaga

SEQ ID NO: 1025362 - RNA, 24 nt, Human
cagccuugaggaccccaaagacgg

SEQ ID NO: 1025363 - RNA, 22 nt, Human
cagcucuuccucccuccucucc

SEQ ID NO: 1025364 - RNA, 23 nt, Human
cagcugcaauucguaacccuaau

SEQ ID NO: 1025365 - RNA, 19 nt, Human
cagggccuggaagccagag

SEQ ID NO: 1025366 - RNA, 29 nt, Human
ccaaaaaaaaccuaacaaucucaagacaa

SEQ ID NO: 1025367 - RNA, 20 nt, Human
ccaaaugcugccccccacaa

SEQ ID NO: 1025368 - RNA, 22 nt, Human
ccacagccucagccugccccuc

SEQ ID NO: 1025369 - RNA, 22 nt, Human
ccagagcgggcgcgggcggacg

SEQ ID NO: 1025370 - RNA, 18 nt, Human
ccaggcuucccgagggga

SEQ ID NO: 1025371 - RNA, 22 nt, Human
cccaaggagaaaaccugccaaa

SEQ ID NO: 1025372 - RNA, 25 nt, Human
cccagaaacuccaugagaaaaacgc

SEQ ID NO: 1025373 - RNA, 18 nt, Human
cccagcucuuccucccuc

SEQ ID NO: 1025374 - RNA, 21 nt, Human
cccagcucuuccucccuccuc

SEQ ID NO: 1025375 - RNA, 19 nt, Human
cccaggugguucugcaaag

SEQ ID NO: 1025376 - RNA, 19 nt, Human
ccccaacccuccacccggc

SEQ ID NO: 1025377 - RNA, 20 nt, Human
ccccaaggagaaaaccugcc

SEQ ID NO: 1025378 - RNA, 19 nt, Human
ccccagccugucguacccc

SEQ ID NO: 1025379 - RNA, 21 nt, Human
ccccaggcccgcccgcccacc

SEQ ID NO: 1025380 - RNA, 20 nt, Human
ccccgaaggccggaaccucc

SEQ ID NO: 1025381 - RNA, 21 nt, Human
cccgcccgcccaccccagggg

SEQ ID NO: 1025382 - RNA, 18 nt, Human
cccgggaaguugcgcggc

SEQ ID NO: 1025383 - RNA, 22 nt, Human
cccucccccacggccgaaaggg

SEQ ID NO: 1025384 - RNA, 18 nt, Human
cccuggaugcagaagccc

SEQ ID NO: 1025385 - RNA, 19 nt, Human
cccuuucuuuccuccccaa

SEQ ID NO: 1025386 - RNA, 20 nt, Human
ccgcccaccccagggggacc

SEQ ID NO: 1025387 - RNA, 21 nt, Human
ccgcccuuucuuuccucccca

SEQ ID NO: 1025388 - RNA, 23 nt, Human
ccgcccuuucuuuccuccccaac

SEQ ID NO: 1025389 - RNA, 21 nt, Human
ccggcaacuugggcagcacuu

SEQ ID NO: 1025390 - RNA, 20 nt, Human
ccgggaaguugcgcggcucc

SEQ ID NO: 1025391 - RNA, 21 nt, Human
ccucaggacugggauguggga

SEQ ID NO: 1025392 - RNA, 21 nt, Human
ccuccccaacccuccacccuc

SEQ ID NO: 1025393 - RNA, 21 nt, Human
ccugccaaaugcugcccccca

SEQ ID NO: 1025394 - RNA, 18 nt, Human
ccuggcucuaggccucuc

SEQ ID NO: 1025395 - RNA, 26 nt, Human
cgaagaaaaccaaaccaacagaaaag

SEQ ID NO: 1025396 - RNA, 22 nt, Human
cgacagaacccccaggcugugu

SEQ ID NO: 1025397 - RNA, 18 nt, Human
cgcccaccccagggggac

SEQ ID NO: 1025398 - RNA, 21 nt, Human
cgcgugcgaugcacacacgcg

SEQ ID NO: 1025399 - RNA, 28 nt, Human
cgcgugcgaugcacacacgcguguucag

SEQ ID NO: 1025400 - RNA, 21 nt, Human
cgggggccagagcgggcgcgg

SEQ ID NO: 1025401 - RNA, 21 nt, Human
cgucccaacuaccgcuaccac

SEQ ID NO: 1025402 - RNA, 22 nt, Human
cuaguccauguguucucagcuc

SEQ ID NO: 1025403 - RNA, 22 nt, Human
cucagcuaguccauguguucuc

SEQ ID NO: 1025404 - RNA, 21 nt, Human
cuccaugagaaaaacgcauca

SEQ ID NO: 1025405 - RNA, 19 nt, Human
cucccgaggccaccgcccu

SEQ ID NO: 1025406 - RNA, 19 nt, Human
cuccuggacgcuuauccug

SEQ ID NO: 1025407 - RNA, 22 nt, Human
cucuaggccucucgcccagcuc

SEQ ID NO: 1025408 - RNA, 23 nt, Human
cucuuccucccuccucuccucug

SEQ ID NO: 1025409 - RNA, 19 nt, Human
cugaaauucauaguguuua

SEQ ID NO: 1025410 - RNA, 21 nt, Human
cugcgggauuugccggccucc

SEQ ID NO: 1025411 - RNA, 23 nt, Human
cuuguccccuccacagccucagc

SEQ ID NO: 1025412 - RNA, 25 nt, Human
gaaaaacgcaucaacggcaaacuga

SEQ ID NO: 1025413 - RNA, 24 nt, Human
gagaaugacaggagggaccguggc

SEQ ID NO: 1025414 - RNA, 22 nt, Human
gagggaccguggcagcugcggg

SEQ ID NO: 1025415 - RNA, 28 nt, Human
gccaccgcccuuucuuuccuccccaacc

SEQ ID NO: 1025416 - RNA, 22 nt, Human
gccagaguccccccaaccauuc

SEQ ID NO: 1025417 - RNA, 19 nt, Human
gccauacaaaagugugaag

SEQ ID NO: 1025418 - RNA, 24 nt, Human
gcccuuucuuuccuccccaacccu

SEQ ID NO: 1025419 - RNA, 19 nt, Human
gccugccccuccaacgggc

SEQ ID NO: 1025420 - RNA, 24 nt, Human
gcgaagaaaaccaaaccaacagaa

SEQ ID NO: 1025421 - RNA, 24 nt, Human
gcgcggcuccgcgggggccagagc

SEQ ID NO: 1025422 - RNA, 21 nt, Human
ggacacgagcccccuccccca

SEQ ID NO: 1025423 - RNA, 23 nt, Human
ggacugggaugugggaaucgggc

SEQ ID NO: 1025424 - RNA, 20 nt, Human
ggagguguucccauuuguac

SEQ ID NO: 1025425 - RNA, 24 nt, Human
ggcaaaaggaaggaggcagccuug

SEQ ID NO: 1025426 - RNA, 23 nt, Human
ggcauagugucugcacuggcaaa

SEQ ID NO: 1025427 - RNA, 23 nt, Human
ggccaggcuucccgaggggaggu

SEQ ID NO: 1025428 - RNA, 23 nt, Human
ggccuccgggcuggguugggggg

SEQ ID NO: 1025429 - RNA, 23 nt, Human
gggggccagagcgggcgcgggcg

SEQ ID NO: 1025430 - RNA, 25 nt, Human
ggggggacacgagcccccuccccca

SEQ ID NO: 1025431 - RNA, 24 nt, Human
gugauaugcucggggugggagccc

SEQ ID NO: 1025432 - RNA, 22 nt, Human
uaaaaacgccauacaaaagugu

SEQ ID NO: 1025433 - RNA, 26 nt, Human
uaaaacauguaacucaauccauccgc

SEQ ID NO: 1025434 - RNA, 18 nt, Human
uaaagaaggaaaacuaca

SEQ ID NO: 1025435 - RNA, 19 nt, Human
uaaagaaggaaaacuacau

SEQ ID NO: 1025436 - RNA, 19 nt, Human
uaacucaauccauccgcga

SEQ ID NO: 1025437 - RNA, 21 nt, Human
uacagcacaguuucucccgga

SEQ ID NO: 1025438 - RNA, 21 nt, Human
uacagcacaguuucucccgga

SEQ ID NO: 1025439 - RNA, 23 nt, Human
uacagcacaguuucucccggagu

SEQ ID NO: 1025440 - RNA, 21 nt, Human
uaccccgcuucucgucccaac

SEQ ID NO: 1025441 - RNA, 22 nt, Human
uagguacccccugugaauuugg

SEQ ID NO: 1025442 - RNA, 24 nt, Human
uagugucugcacuggcaaaaaggg

SEQ ID NO: 1025443 - RNA, 21 nt, Human
ucaauccauccgcgaagaaaa

SEQ ID NO: 1025444 - RNA, 23 nt, Human
ucacuuuggcccgggcucccggg

SEQ ID NO: 1025445 - RNA, 23 nt, Human
uccaaaaaaaaccuaacaaucuc

SEQ ID NO: 1025446 - RNA, 21 nt, Human
uccaagagauuggcaaaagga

SEQ ID NO: 1025447 - RNA, 26 nt, Human
uccaagagauuggcaaaaggaaggag

SEQ ID NO: 1025448 - RNA, 19 nt, Human
uccauccgcgaagaaaacc

SEQ ID NO: 1025449 - RNA, 22 nt, Human
uccccaacccuccacccggcuc

SEQ ID NO: 1025450 - RNA, 19 nt, Human
uccccgaaggccggaaccu

SEQ ID NO: 1025451 - RNA, 23 nt, Human
ucccgaggccaccgcccuuucuu

SEQ ID NO: 1025452 - RNA, 18 nt, Human
ucccggcgcccagaugcu

SEQ ID NO: 1025453 - RNA, 18 nt, Human
ucggggugggagcccgug

SEQ ID NO: 1025454 - RNA, 22 nt, Human
ucugcaccucugcgugugugca

SEQ ID NO: 1025455 - RNA, 19 nt, Human
ucugucugguuaauuuuug

SEQ ID NO: 1025456 - RNA, 18 nt, Human
ugacaggagggaccgugg

SEQ ID NO: 1025457 - RNA, 19 nt, Human
ugaggaacuaccuagaucc

SEQ ID NO: 1025458 - RNA, 23 nt, Human
ugaggaccccaaagacggagcag

SEQ ID NO: 1025459 - RNA, 18 nt, Human
ugaguccaagagauuggc

SEQ ID NO: 1025460 - RNA, 18 nt, Human
ugagucccucaggacugg

SEQ ID NO: 1025461 - RNA, 27 nt, Human
ugcgaugcacacacgcguguucagugc

SEQ ID NO: 1025462 - RNA, 18 nt, Human
uggaugcagaagcccuug

SEQ ID NO: 1025463 - RNA, 18 nt, Human
uggcaaaaagggaggagu

SEQ ID NO: 1025464 - RNA, 19 nt, Human
uggccaggcuucccgaggg

SEQ ID NO: 1025465 - RNA, 21 nt, Human
uggcuccuggacgcuuauccu

SEQ ID NO: 1025466 - RNA, 19 nt, Human
uggcucuaggccucucgcc

SEQ ID NO: 1025467 - RNA, 19 nt, Human
ugggaugugggaaucgggc

SEQ ID NO: 1025468 - RNA, 19 nt, Human
uggguaugaagacuggucc

SEQ ID NO: 1025469 - RNA, 21 nt, Human
ugucugguuaauuuuugucug

SEQ ID NO: 1025470 - RNA, 19 nt, Human
ugugugcaugcgugucugu

SEQ ID NO: 1025471 - RNA, 21 nt, Human
uuaaggccgacagaaccccca

SEQ ID NO: 1025472 - RNA, 19 nt, Human
uugaggaccccaaagacgg

SEQ ID NO: 1025473 - RNA, 24 nt, Human
uugcagcuccacucugcccagaaa

SEQ ID NO: 1025474 - RNA, 21 nt, Human
uuuaagacaaacacuuuuucu

SEQ ID NO: 1025475 - RNA, 22 nt, Human
uuuaagacaaacacuuuuucuc

SEQ ID NO: 1025476 - RNA, 18 nt, Human
uuuuuuuuuuuuuuuuug

SEQ ID NO: 1025477 - RNA, 18 nt, Human
agaaggacaaaauuaugg

SEQ ID NO: 1025478 - RNA, 20 nt, Human
aggggaagcgggagggcccu

SEQ ID NO: 1025479 - RNA, 21 nt, Human
caagcuggugaagggaaugca

SEQ ID NO: 1025480 - RNA, 21 nt, Human
cccgaccucgggcuuccuaac

SEQ ID NO: 1025481 - RNA, 20 nt, Human
ccuugcggcuuccgccccuc

SEQ ID NO: 1025482 - RNA, 21 nt, Human
cgccggcgcuccagguguucc

SEQ ID NO: 1025483 - RNA, 19 nt, Human
cgccucucugcccucggag

SEQ ID NO: 1025484 - RNA, 19 nt, Human
cgcggccaggccgaggcgc

SEQ ID NO: 1025485 - RNA, 25 nt, Human
cgcggggacagccgagcuccgccgg

SEQ ID NO: 1025486 - RNA, 18 nt, Human
cggaggggaagcgggagg

SEQ ID NO: 1025487 - RNA, 22 nt, Human
cgggagggcccuugggguaacg

SEQ ID NO: 1025488 - RNA, 21 nt, Human
gaccucgggcuuccuaaccug

SEQ ID NO: 1025489 - RNA, 18 nt, Human
gcuggccccgacgccgcg

SEQ ID NO: 1025490 - RNA, 22 nt, Human
ggccgggacucgagccccgguu

SEQ ID NO: 1025491 - RNA, 18 nt, Human
gggagggcccuuggggua

SEQ ID NO: 1025492 - RNA, 18 nt, Human
ucagugcaucagaagcuu

SEQ ID NO: 1025493 - RNA, 23 nt, Human
ucccuugcggcuuccgccccucu

SEQ ID NO: 1025494 - RNA, 18 nt, Human
uccgccggcgcuccaggu

SEQ ID NO: 1025495 - RNA, 21 nt, Human
uccgcggggcaggcucagguc

SEQ ID NO: 1025496 - RNA, 21 nt, Human
ugcgcgcugcgccugcagccg

SEQ ID NO: 1025497 - RNA, 19 nt, Human
ugcguccgggcgcggacgc

SEQ ID NO: 1025498 - RNA, 20 nt, Human
uggaagaaucacagauaaga

SEQ ID NO: 1025499 - RNA, 19 nt, Human
uggugaagggaaugcacuu

SEQ ID NO: 1025500 - RNA, 21 nt, Human
uugcggcuuccgccccucucc

SEQ ID NO: 1025501 - RNA, 18 nt, Human
aacucggucccagaauag

SEQ ID NO: 1025502 - RNA, 20 nt, Human
agaaacuagcaaaaagucag

SEQ ID NO: 1025503 - RNA, 21 nt, Human
agaagccauggcuuccccccu

SEQ ID NO: 1025504 - RNA, 21 nt, Human
auagaaacuagcaaaaaguca

SEQ ID NO: 1025505 - RNA, 22 nt, Human
aucuauccagucugcucuccca

SEQ ID NO: 1025506 - RNA, 21 nt, Human
caacagcucuaguacaguacu

SEQ ID NO: 1025507 - RNA, 24 nt, Human
caccuuagcucuguccucugaggg

SEQ ID NO: 1025508 - RNA, 26 nt, Human
cagaauagaaacuagcaaaaagucag

SEQ ID NO: 1025509 - RNA, 22 nt, Human
cagucugcucucccacgccuca

SEQ ID NO: 1025510 - RNA, 23 nt, Human
cauggcuuccccccuaccuccuc

SEQ ID NO: 1025511 - RNA, 22 nt, Human
ccaaucuagguaaucccugucc

SEQ ID NO: 1025512 - RNA, 22 nt, Human
ccacaaaaacaaaguuucucaa

SEQ ID NO: 1025513 - RNA, 20 nt, Human
ccucugagggauuugccagg

SEQ ID NO: 1025514 - RNA, 23 nt, Human
ccugcagccuauuuuucccagag

SEQ ID NO: 1025515 - RNA, 24 nt, Human
cuagcaaaaagucaguacaguacu

SEQ ID NO: 1025516 - RNA, 21 nt, Human
gaagccauggcuuccccccua

SEQ ID NO: 1025517 - RNA, 19 nt, Human
guggagaucagaagccaug

SEQ ID NO: 1025518 - RNA, 22 nt, Human
guugcaccacaauaguucucca

SEQ ID NO: 1025519 - RNA, 24 nt, Human
uaaacccaaggccuggcacagggg

SEQ ID NO: 1025520 - RNA, 22 nt, Human
uaaaguggaguggagaucagaa

SEQ ID NO: 1025521 - RNA, 26 nt, Human
uaaaguggaguggagaucagaagcca

SEQ ID NO: 1025522 - RNA, 22 nt, Human
uaaucccuguccaccuuagcuc

SEQ ID NO: 1025523 - RNA, 19 nt, Human
uagaaacuagcaaaaaguc

SEQ ID NO: 1025524 - RNA, 21 nt, Human
uagaaacuagcaaaaagucag

SEQ ID NO: 1025525 - RNA, 26 nt, Human
uagauaacuuucuuacuuccacaaaa

SEQ ID NO: 1025526 - RNA, 18 nt, Human
uaugaaaaaagggcaggu

SEQ ID NO: 1025527 - RNA, 25 nt, Human
uaugaaaaaagggcaggugcagaug

SEQ ID NO: 1025528 - RNA, 19 nt, Human
uaugcaggaaaguuugagu

SEQ ID NO: 1025529 - RNA, 21 nt, Human
ucagaagccauggcuuccccc

SEQ ID NO: 1025530 - RNA, 25 nt, Human
ucucaucuauccagucugcucuccc

SEQ ID NO: 1025531 - RNA, 23 nt, Human
ucuccauucucuuuagucugaac

SEQ ID NO: 1025532 - RNA, 23 nt, Human
ucugcucucccacgccucagaug

SEQ ID NO: 1025533 - RNA, 18 nt, Human
uggcuuccccccuaccuc

SEQ ID NO: 1025534 - RNA, 20 nt, Human
ugguaugaaaaaagggcagg

SEQ ID NO: 1025535 - RNA, 19 nt, Human
uguaaacccaaggccuggc

SEQ ID NO: 1025536 - RNA, 19 nt, Human
ugugguaugaaaaaagggc

SEQ ID NO: 1025537 - RNA, 24 nt, Human
uuagcucuguccucugagggauuu

SEQ ID NO: 1025538 - RNA, 24 nt, Human
uuccacaaaaacaaaguuucucaa

SEQ ID NO: 1025539 - RNA, 23 nt, Human
uugcaccacaauaguucuccauu

SEQ ID NO: 1025540 - RNA, 19 nt, Human
uuugugguaugaaaaaagg

SEQ ID NO: 1025541 - RNA, 24 nt, Human
agcucgagaccagccugggcagca

SEQ ID NO: 1025542 - RNA, 23 nt, Human
aggagcucgagaccagccugggc

SEQ ID NO: 1025543 - RNA, 19 nt, Human
aggaucacuugaggucagg

SEQ ID NO: 1025544 - RNA, 21 nt, Human
aggaucacuugaggucaggag

SEQ ID NO: 1025545 - RNA, 24 nt, Human
aguggcucacaccuguaaucccag

SEQ ID NO: 1025546 - RNA, 24 nt, Human
augcuggggcaggaggaucacuug

SEQ ID NO: 1025547 - RNA, 24 nt, Human
cacaccuguaaucccagcacuuug

SEQ ID NO: 1025548 - RNA, 18 nt, Human
caccuguaaucccagcac

SEQ ID NO: 1025549 - RNA, 19 nt, Human
caccuguaaucccagcacu

SEQ ID NO: 1025550 - RNA, 24 nt, Human
cagcacuuuggaaugcuggggcag

SEQ ID NO: 1025551 - RNA, 25 nt, Human
cagcauagggagacccccgcccccc

SEQ ID NO: 1025552 - RNA, 18 nt, Human
caggaggaucacuugagg

SEQ ID NO: 1025553 - RNA, 23 nt, Human
caggccaggcaguggcucacacc

SEQ ID NO: 1025554 - RNA, 24 nt, Human
cauaaaauuuaaacauuagccagg

SEQ ID NO: 1025555 - RNA, 24 nt, Human
cauagggagacccccgcccccccc

SEQ ID NO: 1025556 - RNA, 18 nt, Human
ccaggccaggcaguggcu

SEQ ID NO: 1025557 - RNA, 22 nt, Human
ccccccgccaucucuacauaaa

SEQ ID NO: 1025558 - RNA, 20 nt, Human
cccccgccccccccgccauc

SEQ ID NO: 1025559 - RNA, 23 nt, Human
ccccgccccccccgccaucucua

SEQ ID NO: 1025560 - RNA, 26 nt, Human
cccggccccggcucugagcgaggcgg

SEQ ID NO: 1025561 - RNA, 24 nt, Human
ccgccccccccgccaucucuacau

SEQ ID NO: 1025562 - RNA, 18 nt, Human
ccgcucuggcccggcccc

SEQ ID NO: 1025563 - RNA, 24 nt, Human
ccuacggccaggccaggcaguggc

SEQ ID NO: 1025564 - RNA, 20 nt, Human
cgccgcucuggcccggcccc

SEQ ID NO: 1025565 - RNA, 21 nt, Human
cggcucugagcgaggcggcga

SEQ ID NO: 1025566 - RNA, 21 nt, Human
cuagauaggcucauucuacug

SEQ ID NO: 1025567 - RNA, 22 nt, Human
cucacaccuguaaucccagcac

SEQ ID NO: 1025568 - RNA, 24 nt, Human
cucacaccuguaaucccagcacuu

SEQ ID NO: 1025569 - RNA, 18 nt, Human
cucuggcccggccccggc

SEQ ID NO: 1025570 - RNA, 18 nt, Human
cugugccuguagucccag

SEQ ID NO: 1025571 - RNA, 24 nt, Human
gacccccgccccccccgccaucuc

SEQ ID NO: 1025572 - RNA, 25 nt, Human
gacccccgccccccccgccaucucu

SEQ ID NO: 1025573 - RNA, 27 nt, Human
gacccccgccccccccgccaucucuac

SEQ ID NO: 1025574 - RNA, 18 nt, Human
gaucacuugaggucagga

SEQ ID NO: 1025575 - RNA, 24 nt, Human
gaucacuugaggucaggagcucga

SEQ ID NO: 1025576 - RNA, 24 nt, Human
gccccggcucugagcgaggcggcg

SEQ ID NO: 1025577 - RNA, 25 nt, Human
gcuggggcaggaggaucacuugagg

SEQ ID NO: 1025578 - RNA, 18 nt, Human
ggaucacuugaggucagg

SEQ ID NO: 1025579 - RNA, 23 nt, Human
ggaucacuugaggucaggagcuc

SEQ ID NO: 1025580 - RNA, 18 nt, Human
gggcaggaggaucacuug

SEQ ID NO: 1025581 - RNA, 21 nt, Human
gggccggggccgggcccgggg

SEQ ID NO: 1025582 - RNA, 21 nt, Human
gggccggggccgggcccgggg

SEQ ID NO: 1025583 - RNA, 19 nt, Human
ggggccgggcccggggucu

SEQ ID NO: 1025584 - RNA, 20 nt, Human
ggggggccggggccgggccc

SEQ ID NO: 1025585 - RNA, 24 nt, Human
guggccugugccuguagucccagc

SEQ ID NO: 1025586 - RNA, 18 nt, Human
uacugucuucuccagggc

SEQ ID NO: 1025587 - RNA, 20 nt, Human
uacugucuucuccagggcuc

SEQ ID NO: 1025588 - RNA, 32 nt, Human
uacugucuucuccagggcucuucuaugaaaag

SEQ ID NO: 1025589 - RNA, 24 nt, Human
uagccaggugugguggccugugcc

SEQ ID NO: 1025590 - RNA, 18 nt, Human
ugccuguagucccagcua

SEQ ID NO: 1025591 - RNA, 19 nt, Human
ugccuguagucccagcuac

SEQ ID NO: 1025592 - RNA, 24 nt, Human
uggccugugccuguagucccagcu

SEQ ID NO: 1025593 - RNA, 21 nt, Human
uggcucacaccuguaauccca

SEQ ID NO: 1025594 - RNA, 22 nt, Human
uggcucacaccuguaaucccag

SEQ ID NO: 1025595 - RNA, 24 nt, Human
uggcucacaccuguaaucccagca

SEQ ID NO: 1025596 - RNA, 20 nt, Human
uggggcaggaggaucacuug

SEQ ID NO: 1025597 - RNA, 26 nt, Human
uggggcaggaggaucacuugagguca

SEQ ID NO: 1025598 - RNA, 24 nt, Human
ugguggccugugccuguaguccca

SEQ ID NO: 1025599 - RNA, 22 nt, Human
uucuccagggcucuucuaugaa

SEQ ID NO: 1025600 - RNA, 28 nt, Human
uucuccagggcucuucuaugaaacaguu

SEQ ID NO: 1025601 - RNA, 18 nt, Human
uuuggaaugcuggggcag

SEQ ID NO: 1025602 - RNA, 18 nt, Human
uuuuuuuuuuuuuuuuug

SEQ ID NO: 1025603 - RNA, 23 nt, Human
agggcugcaucccggcccagaac

SEQ ID NO: 1025604 - RNA, 24 nt, Human
cacccccagcuucccgcacagucc

SEQ ID NO: 1025605 - RNA, 22 nt, Human
cagaaccccgggccccaccaug

SEQ ID NO: 1025606 - RNA, 21 nt, Human
caucccggcccagaaccccgg

SEQ ID NO: 1025607 - RNA, 24 nt, Human
ccagaaccccgggccccaccaugc

SEQ ID NO: 1025608 - RNA, 24 nt, Human
ccaugcauccacccccagcuuccc

SEQ ID NO: 1025609 - RNA, 24 nt, Human
cccagaaccccgggccccaccaug

SEQ ID NO: 1025610 - RNA, 19 nt, Human
cccccagcuucccgcacag

SEQ ID NO: 1025611 - RNA, 23 nt, Human
cccccagcuucccgcacaguccc

SEQ ID NO: 1025612 - RNA, 25 nt, Human
ccccgggccccaccaugcauccacc

SEQ ID NO: 1025613 - RNA, 18 nt, Human
cgcaguccggagcgcagg

SEQ ID NO: 1025614 - RNA, 21 nt, Human
cggcccagaaccccgggcccc

SEQ ID NO: 1025615 - RNA, 22 nt, Human
gcccagaaccccgggccccacc

SEQ ID NO: 1025616 - RNA, 22 nt, Human
ucccggcccagaaccccgggcc

SEQ ID NO: 1025617 - RNA, 20 nt, Human
ucuuuauuaagauggggacc

SEQ ID NO: 1025618 - RNA, 22 nt, Human
aaaaggaacaaaggaaacaaaa

SEQ ID NO: 1025619 - RNA, 19 nt, Human
aacaguccaaaucaguuuc

SEQ ID NO: 1025620 - RNA, 21 nt, Human
aaguuuuggaaguuuaaagcu

SEQ ID NO: 1025621 - RNA, 21 nt, Human
acagaguauaaacguaaaaag

SEQ ID NO: 1025622 - RNA, 19 nt, Human
agaagaacagaguauaaac

SEQ ID NO: 1025623 - RNA, 24 nt, Human
agaguauaaacguaaaaaggaaca

SEQ ID NO: 1025624 - RNA, 18 nt, Human
agcaaguguaggcaaaau

SEQ ID NO: 1025625 - RNA, 24 nt, Human
aggaacaaaggaaacaaaaaugac

SEQ ID NO: 1025626 - RNA, 20 nt, Human
agggcagcuauuuuucuaau

SEQ ID NO: 1025627 - RNA, 19 nt, Human
caaaggaugaaaaauuucc

SEQ ID NO: 1025628 - RNA, 21 nt, Human
cgcaaaggaugaaaaauuucc

SEQ ID NO: 1025629 - RNA, 20 nt, Human
cugagauaacuggcuucuuc

SEQ ID NO: 1025630 - RNA, 22 nt, Human
cuggcuucuucaucaccucgug

SEQ ID NO: 1025631 - RNA, 18 nt, Human
gaaacaaaaaugacaggc

SEQ ID NO: 1025632 - RNA, 18 nt, Human
gcuucuucaucaccucgu

SEQ ID NO: 1025633 - RNA, 21 nt, Human
uaaaaaggaacaaaggaaaca

SEQ ID NO: 1025634 - RNA, 22 nt, Human
uacuuuuagccuuuaacagucc

SEQ ID NO: 1025635 - RNA, 24 nt, Human
uagcaaguguaggcaaaauguguc

SEQ ID NO: 1025636 - RNA, 18 nt, Human
ucugagagcgaagaaaag

SEQ ID NO: 1025637 - RNA, 23 nt, Human
uuucaagggcagcuauuuuucua

SEQ ID NO: 1025638 - RNA, 22 nt, Human
uuuuuuuuuuuuuuuuuucaag

SEQ ID NO: 1025639 - RNA, 21 nt, Human
aaagaccaacaaacuucccuu

SEQ ID NO: 1025640 - RNA, 23 nt, Human
accaaaaacgacuuguacaccac

SEQ ID NO: 1025641 - RNA, 20 nt, Human
accgugcacacuggcaaggc

SEQ ID NO: 1025642 - RNA, 22 nt, Human
agcaggaaagaaguuauaccaa

SEQ ID NO: 1025643 - RNA, 23 nt, Human
agcaggaaagaaguuauaccaaa

SEQ ID NO: 1025644 - RNA, 20 nt, Human
aggaaacaguguuuccugga

SEQ ID NO: 1025645 - RNA, 20 nt, Human
aggcacuggcggaugcuggc

SEQ ID NO: 1025646 - RNA, 22 nt, Human
aggcagguuaagguccacaggc

SEQ ID NO: 1025647 - RNA, 23 nt, Human
aggcauucaacaaagaaguaagc

SEQ ID NO: 1025648 - RNA, 21 nt, Human
aggcugcuccccagggacccc

SEQ ID NO: 1025649 - RNA, 23 nt, Human
aggcugcuccccagggaccccag

SEQ ID NO: 1025650 - RNA, 21 nt, Human
agggaccccagcaccugccuu

SEQ ID NO: 1025651 - RNA, 28 nt, Human
agggugccuucuuugcauccaaagcuuu

SEQ ID NO: 1025652 - RNA, 22 nt, Human
auaccgcacucugccugaaaua

SEQ ID NO: 1025653 - RNA, 23 nt, Human
auggugacaaagguguucugguc

SEQ ID NO: 1025654 - RNA, 22 nt, Human
caaaacaucuugaaacuugcca

SEQ ID NO: 1025655 - RNA, 23 nt, Human
caacaaacuuccccagcagugcc

SEQ ID NO: 1025656 - RNA, 24 nt, Human
cacucugaccuuugaaauuggggg

SEQ ID NO: 1025657 - RNA, 18 nt, Human
cagagccccggacuuucc

SEQ ID NO: 1025658 - RNA, 23 nt, Human
caggaaagaaguuauaccaaaaa

SEQ ID NO: 1025659 - RNA, 23 nt, Human
cagguuaagguccacaggcugcu

SEQ ID NO: 1025660 - RNA, 18 nt, Human
caucucucuuguacugau

SEQ ID NO: 1025661 - RNA, 26 nt, Human
ccaaaaacgacuuguacaccacagac

SEQ ID NO: 1025662 - RNA, 18 nt, Human
ccagggaccccagcaccu

SEQ ID NO: 1025663 - RNA, 18 nt, Human
ccaucugcauucuggcug

SEQ ID NO: 1025664 - RNA, 21 nt, Human
ccccagagccccggacuuucc

SEQ ID NO: 1025665 - RNA, 20 nt, Human
ccccagggaccccagcaccu

SEQ ID NO: 1025666 - RNA, 20 nt, Human
ccccagggaccccagcaccu

SEQ ID NO: 1025667 - RNA, 18 nt, Human
ccucacaguggggaugaa

SEQ ID NO: 1025668 - RNA, 19 nt, Human
ccucugagcugggggcagg

SEQ ID NO: 1025669 - RNA, 19 nt, Human
ccucugaguaccgugugaa

SEQ ID NO: 1025670 - RNA, 25 nt, Human
cgacuuguacaccacagacauuaua

SEQ ID NO: 1025671 - RNA, 19 nt, Human
cugcacuucccucacagug

SEQ ID NO: 1025672 - RNA, 26 nt, Human
cuggaaauuuaucuaauaaagaccaa

SEQ ID NO: 1025673 - RNA, 19 nt, Human
cuggguacugagagaucua

SEQ ID NO: 1025674 - RNA, 21 nt, Human
cuuccccagcagugccucuga

SEQ ID NO: 1025675 - RNA, 20 nt, Human
cuuguggaagucagggugcc

SEQ ID NO: 1025676 - RNA, 21 nt, Human
gaaagaaguuauaccaaaaac

SEQ ID NO: 1025677 - RNA, 22 nt, Human
gaagcuuugguuccauuuuagg

SEQ ID NO: 1025678 - RNA, 21 nt, Human
gaccaacaaacuuccccagca

SEQ ID NO: 1025679 - RNA, 18 nt, Human
gagaaugacaacucacag

SEQ ID NO: 1025680 - RNA, 20 nt, Human
gagggagcugggaagcuuug

SEQ ID NO: 1025681 - RNA, 24 nt, Human
gcagcagcagcaggaaagaaguuu

SEQ ID NO: 1025682 - RNA, 19 nt, Human
gcaggccaguggacaugga

SEQ ID NO: 1025683 - RNA, 20 nt, Human
gccaagccagcuccaucugc

SEQ ID NO: 1025684 - RNA, 18 nt, Human
gcuguguauagugaccuc

SEQ ID NO: 1025685 - RNA, 21 nt, Human
ggcacuggcggaugcuggcag

SEQ ID NO: 1025686 - RNA, 18 nt, Human
gggaacagccaagccagc

SEQ ID NO: 1025687 - RNA, 24 nt, Human
gggaagcagcagcagcaggaaaga

SEQ ID NO: 1025688 - RNA, 24 nt, Human
gggaagcuuugguuccauuuuagg

SEQ ID NO: 1025689 - RNA, 22 nt, Human
guacaccacagacauuauaacc

SEQ ID NO: 1025690 - RNA, 18 nt, Human
gucauuucugcucuguuc

SEQ ID NO: 1025691 - RNA, 24 nt, Human
gugggauggggugcuccauaugug

SEQ ID NO: 1025692 - RNA, 18 nt, Human
uaccgugugaauucuggu

SEQ ID NO: 1025693 - RNA, 18 nt, Human
uauaacccuuuccucaaa

SEQ ID NO: 1025694 - RNA, 21 nt, Human
uccagggaacagccaagccag

SEQ ID NO: 1025695 - RNA, 19 nt, Human
uccucaaagaaacagucau

SEQ ID NO: 1025696 - RNA, 22 nt, Human
ucuccguucugugaagugaggu

SEQ ID NO: 1025697 - RNA, 21 nt, Human
ucugaguggaaaaaguccugg

SEQ ID NO: 1025698 - RNA, 19 nt, Human
ucugcauucuggcugcagc

SEQ ID NO: 1025699 - RNA, 26 nt, Human
ucuggcugcagcguguacauuagggg

SEQ ID NO: 1025700 - RNA, 26 nt, Human
ucuuguggaagucagggugccuucuu

SEQ ID NO: 1025701 - RNA, 18 nt, Human
ugaauaugcacucugacc

SEQ ID NO: 1025702 - RNA, 21 nt, Human
ugaccucuugacuuucaaccu

SEQ ID NO: 1025703 - RNA, 22 nt, Human
ugacuuucaaccugagcacccu

SEQ ID NO: 1025704 - RNA, 19 nt, Human
ugcauccaaagcuuugagg

SEQ ID NO: 1025705 - RNA, 19 nt, Human
ugcccauccagggaacagc

SEQ ID NO: 1025706 - RNA, 24 nt, Human
ugcuccccagggaccccagcaccu

SEQ ID NO: 1025707 - RNA, 27 nt, Human
uggaauauaccgcacucugccugaaaa

SEQ ID NO: 1025708 - RNA, 22 nt, Human
uggauagaugagaaugacaacu

SEQ ID NO: 1025709 - RNA, 24 nt, Human
uggccucuggacacugcacuuccc

SEQ ID NO: 1025710 - RNA, 18 nt, Human
uggcuccccagagccccu

SEQ ID NO: 1025711 - RNA, 19 nt, Human
ugugauggugacaaaggug

SEQ ID NO: 1025712 - RNA, 22 nt, Human
uguguacacucuagccugcgug

SEQ ID NO: 1025713 - RNA, 24 nt, Human
uguguacacucuagccugcgugug

SEQ ID NO: 1025714 - RNA, 22 nt, Human
uguuggguauuauggacagguc

SEQ ID NO: 1025715 - RNA, 21 nt, Human
uuggccucuggacacugcacu

SEQ ID NO: 1025716 - RNA, 19 nt, Human
uauuucuuguacagaagua

SEQ ID NO: 1025717 - RNA, 22 nt, Human
uguacagaaguaauuccaauuc

SEQ ID NO: 1025718 - RNA, 20 nt, Human
uuuuuuuuuuuuuuugucag

SEQ ID NO: 1025719 - RNA, 20 nt, Human
uuuuuuuuuuuuuuugucag

SEQ ID NO: 1025720 - RNA, 24 nt, Human
agaggaucauccggcggcugcggg

SEQ ID NO: 1025721 - RNA, 20 nt, Human
aggcagcacccgugcucccc

SEQ ID NO: 1025722 - RNA, 22 nt, Human
aggcagcacccgugcuccccgc

SEQ ID NO: 1025723 - RNA, 20 nt, Human
agggcaccgcuggcacgggg

SEQ ID NO: 1025724 - RNA, 19 nt, Human
aggguccggaggcaggagg

SEQ ID NO: 1025725 - RNA, 22 nt, Human
auccgcacggaaggcagcaccc

SEQ ID NO: 1025726 - RNA, 27 nt, Human
caccaaagcugaggcuaguccgagggc

SEQ ID NO: 1025727 - RNA, 22 nt, Human
cacccgugcuccccgcuggagg

SEQ ID NO: 1025728 - RNA, 23 nt, Human
cacccgugcuccccgcuggaggc

SEQ ID NO: 1025729 - RNA, 19 nt, Human
cagaagggcaccgcuggca

SEQ ID NO: 1025730 - RNA, 20 nt, Human
ccaaagcugaggcuaguccg

SEQ ID NO: 1025731 - RNA, 18 nt, Human
ccacaaggcagggcgugc

SEQ ID NO: 1025732 - RNA, 19 nt, Human
ccccacggccgggagcggg

SEQ ID NO: 1025733 - RNA, 23 nt, Human
cgggaggccguggcuccacaagg

SEQ ID NO: 1025734 - RNA, 25 nt, Human
cuaaccccugagggauccgggcgcg

SEQ ID NO: 1025735 - RNA, 23 nt, Human
cugugggagacagagacgggagc

SEQ ID NO: 1025736 - RNA, 23 nt, Human
gaaggguccggaggcaggagggc

SEQ ID NO: 1025737 - RNA, 19 nt, Human
gcgagacagaggggacaca

SEQ ID NO: 1025738 - RNA, 18 nt, Human
ggacacaaacgcagcaag

SEQ ID NO: 1025739 - RNA, 22 nt, Human
ggcgugcugccaccaaagcuga

SEQ ID NO: 1025740 - RNA, 18 nt, Human
ggcugcgggcggcugggg

SEQ ID NO: 1025741 - RNA, 18 nt, Human
gggaaggguccggaggca

SEQ ID NO: 1025742 - RNA, 21 nt, Human
gggaggccguggcuccacaag

SEQ ID NO: 1025743 - RNA, 23 nt, Human
gggcgugcugccaccaaagcuga

SEQ ID NO: 1025744 - RNA, 18 nt, Human
ucgaggcccggaagucca

SEQ ID NO: 1025745 - RNA, 19 nt, Human
ugaccgaguccaggaaagc

SEQ ID NO: 1025746 - RNA, 18 nt, Human
ugaggcuaguccgagggc

SEQ ID NO: 1025747 - RNA, 19 nt, Human
ugggagacagagacgggag

SEQ ID NO: 1025748 - RNA, 18 nt, Human
ugugcggaagaaaucgag

SEQ ID NO: 1025749 - RNA, 19 nt, Human
ugugcggaagaaaucgagg

SEQ ID NO: 1025750 - RNA, 20 nt, Human
ugugcggaagaaaucgaggc

SEQ ID NO: 1025751 - RNA, 22 nt, Human
uuuuuuuuuuuuuugguuuugg

SEQ ID NO: 1025752 - RNA, 24 nt, Human
uuuuuuuuuuuuuuuuuugguuuu

SEQ ID NO: 1025753 - RNA, 22 nt, Human
uuuuuuuuuuuuuuuuuuuggg

SEQ ID NO: 1025754 - RNA, 25 nt, Human
aagugaucuucccaccucagcuucu

SEQ ID NO: 1025755 - RNA, 23 nt, Human
acaccugcaggcagaagcccagg

SEQ ID NO: 1025756 - RNA, 23 nt, Human
accucagcuucuggaguagcugg

SEQ ID NO: 1025757 - RNA, 22 nt, Human
agcagaugaugaagccagcugg

SEQ ID NO: 1025758 - RNA, 18 nt, Human
aggcagaagcccaggccu

SEQ ID NO: 1025759 - RNA, 19 nt, Human
aggcagaagcccaggccuc

SEQ ID NO: 1025760 - RNA, 23 nt, Human
aguagcugggacuauaggcaugu

SEQ ID NO: 1025761 - RNA, 24 nt, Human
augaagccagcugggcuugugucc

SEQ ID NO: 1025762 - RNA, 22 nt, Human
caccugcaggcagaagcccagg

SEQ ID NO: 1025763 - RNA, 22 nt, Human
cacugcagccucaaucucccag

SEQ ID NO: 1025764 - RNA, 21 nt, Human
cacugggucuuaccaaggccu

SEQ ID NO: 1025765 - RNA, 23 nt, Human
cagacaccugcaggcagaagccc

SEQ ID NO: 1025766 - RNA, 24 nt, Human
cagccucaaucucccaggcucaag

SEQ ID NO: 1025767 - RNA, 26 nt, Human
cagcgucccccaaacccaacaccucc

SEQ ID NO: 1025768 - RNA, 19 nt, Human
caggcagaagcccaggccu

SEQ ID NO: 1025769 - RNA, 19 nt, Human
caggucccuccccgccccc

SEQ ID NO: 1025770 - RNA, 21 nt, Human
ccacauauguuugcucaaggc

SEQ ID NO: 1025771 - RNA, 21 nt, Human
ccagggccggccgagggagga

SEQ ID NO: 1025772 - RNA, 23 nt, Human
cccaagcuggagugcaauggcau

SEQ ID NO: 1025773 - RNA, 22 nt, Human
cccaggcucaagugaucuuccc

SEQ ID NO: 1025774 - RNA, 21 nt, Human
cccgacccugcaccugcccaa

SEQ ID NO: 1025775 - RNA, 26 nt, Human
cccgccccccuccucaaaucaggcca

SEQ ID NO: 1025776 - RNA, 22 nt, Human
cccuagagcuccacaaucagcc

SEQ ID NO: 1025777 - RNA, 23 nt, Human
cccuccccgccccccuccucaaa

SEQ ID NO: 1025778 - RNA, 21 nt, Human
cccugcaucaccaccucuuuu

SEQ ID NO: 1025779 - RNA, 23 nt, Human
ccgcaggucccuccccgcccccc

SEQ ID NO: 1025780 - RNA, 20 nt, Human
ccuccccgccccccuccuca

SEQ ID NO: 1025781 - RNA, 21 nt, Human
ccugcuguaaccacuaccuuu

SEQ ID NO: 1025782 - RNA, 23 nt, Human
cgagccggagaagggggcggggc

SEQ ID NO: 1025783 - RNA, 27 nt, Human
cgccccccuccucaaaucaggccaaag

SEQ ID NO: 1025784 - RNA, 21 nt, Human
cgccgcagacaccugcaggca

SEQ ID NO: 1025785 - RNA, 19 nt, Human
cggccgagggaggaggcgg

SEQ ID NO: 1025786 - RNA, 24 nt, Human
cucaagugaucuucccaccucagc

SEQ ID NO: 1025787 - RNA, 24 nt, Human
cucagcuucuggaguagcugggac

SEQ ID NO: 1025788 - RNA, 25 nt, Human
cucccaggcucaagugaucuuccca

SEQ ID NO: 1025789 - RNA, 18 nt, Human
cuccccgccccccuccuc

SEQ ID NO: 1025790 - RNA, 23 nt, Human
cugaagccaauacagcacugggu

SEQ ID NO: 1025791 - RNA, 24 nt, Human
cugaagccaauacagcacuggguc

SEQ ID NO: 1025792 - RNA, 23 nt, Human
cugcagccucaaucucccaggcu

SEQ ID NO: 1025793 - RNA, 24 nt, Human
cuggaguagcugggacuauaggca

SEQ ID NO: 1025794 - RNA, 24 nt, Human
cuggagugcaauggcaugaucuca

SEQ ID NO: 1025795 - RNA, 22 nt, Human
cugggaaccagggccaggggga

SEQ ID NO: 1025796 - RNA, 20 nt, Human
gaacccgacccugcaccugc

SEQ ID NO: 1025797 - RNA, 18 nt, Human
gacccugcaccugcccaa

SEQ ID NO: 1025798 - RNA, 22 nt, Human
gacccugcaccugcccaaggga

SEQ ID NO: 1025799 - RNA, 19 nt, Human
gacuauaggcauguaccac

SEQ ID NO: 1025800 - RNA, 18 nt, Human
gccaaaucgggcuguacc

SEQ ID NO: 1025801 - RNA, 19 nt, Human
gcucaagugaucuucccac

SEQ ID NO: 1025802 - RNA, 22 nt, Human
gcucaagugaucuucccaccuc

SEQ ID NO: 1025803 - RNA, 19 nt, Human
gcuggagugcaauggcaug

SEQ ID NO: 1025804 - RNA, 22 nt, Human
ggcaaauucccccagcagguuc

SEQ ID NO: 1025805 - RNA, 21 nt, Human
ggccgagggaggaggcgggcu

SEQ ID NO: 1025806 - RNA, 23 nt, Human
ggggccgcaagccgcaggucccu

SEQ ID NO: 1025807 - RNA, 21 nt, Human
gucccuccccgccccccuccu

SEQ ID NO: 1025808 - RNA, 19 nt, Human
ucacugcagccucaaucuc

SEQ ID NO: 1025809 - RNA, 23 nt, Human
ucacugcagccucaaucucccag

SEQ ID NO: 1025810 - RNA, 24 nt, Human
ucacugcagccucaaucucccagg

SEQ ID NO: 1025811 - RNA, 20 nt, Human
ucaggguggcaaauuccccc

SEQ ID NO: 1025812 - RNA, 24 nt, Human
uccacaaucagcagaugaugaagc

SEQ ID NO: 1025813 - RNA, 18 nt, Human
ucccaggcucaagugauc

SEQ ID NO: 1025814 - RNA, 19 nt, Human
ucccccaaacccaacaccu

SEQ ID NO: 1025815 - RNA, 19 nt, Human
ucccccaaacccaacaccu

SEQ ID NO: 1025816 - RNA, 19 nt, Human
uccccgccccccuccucaa

SEQ ID NO: 1025817 - RNA, 22 nt, Human
uccccgccccccuccucaaauc

SEQ ID NO: 1025818 - RNA, 18 nt, Human
ucccuccccgccccccuc

SEQ ID NO: 1025819 - RNA, 24 nt, Human
uccggaggcuuugaacccgacccu

SEQ ID NO: 1025820 - RNA, 24 nt, Human
ucuggaguagcugggacuauaggc

SEQ ID NO: 1025821 - RNA, 23 nt, Human
ucuugcucuggugcccaagcugg

SEQ ID NO: 1025822 - RNA, 24 nt, Human
ucuugcucuggugcccaagcugga

SEQ ID NO: 1025823 - RNA, 19 nt, Human
ugcagccucaaucucccag

SEQ ID NO: 1025824 - RNA, 22 nt, Human
ugccagcgucccccaaacccaa

SEQ ID NO: 1025825 - RNA, 24 nt, Human
ugcccaagcuggagugcaauggca

SEQ ID NO: 1025826 - RNA, 24 nt, Human
ugcucuggugcccaagcuggagug

SEQ ID NO: 1025827 - RNA, 19 nt, Human
uggagugcaauggcaugau

SEQ ID NO: 1025828 - RNA, 24 nt, Human
uggagugcaauggcaugaucucag

SEQ ID NO: 1025829 - RNA, 24 nt, Human
uggcaugaucucagcucacugcag

SEQ ID NO: 1025830 - RNA, 21 nt, Human
ugggacuauaggcauguacca

SEQ ID NO: 1025831 - RNA, 24 nt, Human
ugggacuauaggcauguaccacug

SEQ ID NO: 1025832 - RNA, 23 nt, Human
uuaucugcaacauucucagcuac

SEQ ID NO: 1025833 - RNA, 23 nt, Human
uucccaccucagcuucuggagua

SEQ ID NO: 1025834 - RNA, 22 nt, Human
uugcuaggucauucucuucuau

SEQ ID NO: 1025835 - RNA, 18 nt, Human
uuugaacccgacccugca

SEQ ID NO: 1025836 - RNA, 20 nt, Human
uuuuagguacuacuugauug

SEQ ID NO: 1025837 - RNA, 20 nt, Human
uuuuuuuuuuugagacaagg

SEQ ID NO: 1025838 - RNA, 23 nt, Human
uuuuuuuuuuuugagacaagguc

SEQ ID NO: 1025839 - RNA, 24 nt, Human
uuuuuuuuuuuugagacaaggucu

SEQ ID NO: 1025840 - RNA, 20 nt, Human
uuuuuuuuuuuuuuuuuugg

SEQ ID NO: 1025841 - RNA, 22 nt, Human
acccccaguccccgccccuagc

SEQ ID NO: 1025842 - RNA, 20 nt, Human
agaugggcagacugaagccc

SEQ ID NO: 1025843 - RNA, 18 nt, Human
aggcacccccucccccug

SEQ ID NO: 1025844 - RNA, 23 nt, Human
agucugaggucacacagcagucu

SEQ ID NO: 1025845 - RNA, 25 nt, Human
cacccccaguccccgccccuagccc

SEQ ID NO: 1025846 - RNA, 19 nt, Human
cagacugaagcccaagagu

SEQ ID NO: 1025847 - RNA, 19 nt, Human
ccagagcccgucuggccaa

SEQ ID NO: 1025848 - RNA, 23 nt, Human
ccccuaaauagcacccccagucc

SEQ ID NO: 1025849 - RNA, 24 nt, Human
ccccuaaauagcacccccaguccc

SEQ ID NO: 1025850 - RNA, 19 nt, Human
ccccuggggagggggucca

SEQ ID NO: 1025851 - RNA, 23 nt, Human
cccgucuggccaaaggugaaaac

SEQ ID NO: 1025852 - RNA, 21 nt, Human
cccugcugccugguuucuccu

SEQ ID NO: 1025853 - RNA, 19 nt, Human
ccgucuggccaaaggugaa

SEQ ID NO: 1025854 - RNA, 18 nt, Human
ccucccccuggggagggg

SEQ ID NO: 1025855 - RNA, 18 nt, Human
cgacagaagggcagaugg

SEQ ID NO: 1025856 - RNA, 21 nt, Human
cgcucugcugcccucgacgca

SEQ ID NO: 1025857 - RNA, 19 nt, Human
cugcugcccucgacgcagc

SEQ ID NO: 1025858 - RNA, 21 nt, Human
cugcugcccucgacgcagcuc

SEQ ID NO: 1025859 - RNA, 18 nt, Human
cugcugucuccauucagc

SEQ ID NO: 1025860 - RNA, 28 nt, Human
gaaaacagugcaggagaaaccgguaccc

SEQ ID NO: 1025861 - RNA, 21 nt, Human
ggugaaaacagugcaggagaa

SEQ ID NO: 1025862 - RNA, 18 nt, Human
guaggucuucccagagcc

SEQ ID NO: 1025863 - RNA, 20 nt, Human
guguaggucuucccagagcc

SEQ ID NO: 1025864 - RNA, 21 nt, Human
ucccagagcccgucuggccaa

SEQ ID NO: 1025865 - RNA, 23 nt, Human
ucccugagcagugcagcacgcuc

SEQ ID NO: 1025866 - RNA, 21 nt, Human
uccugaauccccuuguucccc

SEQ ID NO: 1025867 - RNA, 20 nt, Human
ucuccuggguucccacuugg

SEQ ID NO: 1025868 - RNA, 23 nt, Human
ucuccuggguucccacuuggccu

SEQ ID NO: 1025869 - RNA, 24 nt, Human
ugcagcacgcucugcugcccucga

SEQ ID NO: 1025870 - RNA, 20 nt, Human
ugcaggagaaacugcagagu

SEQ ID NO: 1025871 - RNA, 23 nt, Human
uggaguagcagcugcugucucca

SEQ ID NO: 1025872 - RNA, 19 nt, Human
uggccaaaggugaaaacag

SEQ ID NO: 1025873 - RNA, 22 nt, Human
ugggcagacugaagcccaagag

SEQ ID NO: 1025874 - RNA, 21 nt, Human
uggggaggggguccagucagg

SEQ ID NO: 1025875 - RNA, 20 nt, Human
uuauucauguauuucauccc

SEQ ID NO: 1025876 - RNA, 23 nt, Human
uucauccccugcugccugguuuc

SEQ ID NO: 1025877 - RNA, 22 nt, Human
uuccccuaaauagcacccccag

SEQ ID NO: 1025878 - RNA, 18 nt, Human
uuuuuuuuuuuuuuuuug

SEQ ID NO: 1025879 - RNA, 18 nt, Human
uuuuuuuuuuuuuuuuug

SEQ ID NO: 1025880 - RNA, 23 nt, Human
aagggcugggcaguuucacuggc

SEQ ID NO: 1025881 - RNA, 21 nt, Human
aaugcuagacgccccccgccc

SEQ ID NO: 1025882 - RNA, 22 nt, Human
acagcccggggcucucugcguc

SEQ ID NO: 1025883 - RNA, 21 nt, Human
agagagccgacccuucuccag

SEQ ID NO: 1025884 - RNA, 18 nt, Human
aggcagagaagggcuggg

SEQ ID NO: 1025885 - RNA, 18 nt, Human
aggcagagaagggcuggg

SEQ ID NO: 1025886 - RNA, 22 nt, Human
aggcuuuauugggggugggggg

SEQ ID NO: 1025887 - RNA, 18 nt, Human
agggucgucucugccugg

SEQ ID NO: 1025888 - RNA, 20 nt, Human
ccccuggaccuccgcccuuu

SEQ ID NO: 1025889 - RNA, 18 nt, Human
cccgcagcuguggacagc

SEQ ID NO: 1025890 - RNA, 25 nt, Human
cccgcagcuguggacagcccggggc

SEQ ID NO: 1025891 - RNA, 20 nt, Human
ccgggggacgcuggggagcc

SEQ ID NO: 1025892 - RNA, 21 nt, Human
ccuucuccaggccuaaugcua

SEQ ID NO: 1025893 - RNA, 19 nt, Human
cgagccugaccuggaggag

SEQ ID NO: 1025894 - RNA, 20 nt, Human
cgcccuguuccucugacgcg

SEQ ID NO: 1025895 - RNA, 22 nt, Human
cgcccuguuccucugacgcgua

SEQ ID NO: 1025896 - RNA, 22 nt, Human
cggaguugugggugguggucag

SEQ ID NO: 1025897 - RNA, 18 nt, Human
cggcggaaaacgcaggug

SEQ ID NO: 1025898 - RNA, 21 nt, Human
cugccccuggaccuccgcccu

SEQ ID NO: 1025899 - RNA, 23 nt, Human
gcccagggucgucucugccuggc

SEQ ID NO: 1025900 - RNA, 18 nt, Human
gcguacguuacuuccggc

SEQ ID NO: 1025901 - RNA, 22 nt, Human
ggaggaggucuuagggccugga

SEQ ID NO: 1025902 - RNA, 20 nt, Human
ggaguggggcaaucgaggcg

SEQ ID NO: 1025903 - RNA, 20 nt, Human
ggcucgaggacuucgcucuc

SEQ ID NO: 1025904 - RNA, 19 nt, Human
gggaguggggcaaucgagg

SEQ ID NO: 1025905 - RNA, 19 nt, Human
gggcacggcggaaaacgca

SEQ ID NO: 1025906 - RNA, 19 nt, Human
gggcuuccgagccugaccu

SEQ ID NO: 1025907 - RNA, 19 nt, Human
ggggaguggggcaaucgag

SEQ ID NO: 1025908 - RNA, 19 nt, Human
guggucaguuucccaaugg

SEQ ID NO: 1025909 - RNA, 21 nt, Human
uagacgccccccgcccuguuc

SEQ ID NO: 1025910 - RNA, 25 nt, Human
ucgaggcgguaacuccggcccucuu

SEQ ID NO: 1025911 - RNA, 23 nt, Human
ugaaagaagaggcuuuauugggg

SEQ ID NO: 1025912 - RNA, 23 nt, Human
ugaaagaagaggcuuuauugggg

SEQ ID NO: 1025913 - RNA, 24 nt, Human
ugcaauuaggcagagaagggcugg

SEQ ID NO: 1025914 - RNA, 24 nt, Human
ugccccuggaccuccgcccuuugc

SEQ ID NO: 1025915 - RNA, 20 nt, Human
uggcggaguuguggguggug

SEQ ID NO: 1025916 - RNA, 18 nt, Human
uggggguggggggagugg

SEQ ID NO: 1025917 - RNA, 20 nt, Human
uggggguggggggagugggg

SEQ ID NO: 1025918 - RNA, 18 nt, Human
uuggggguggggggagug

SEQ ID NO: 1025919 - RNA, 20 nt, Human
auaaagagccacguccuaca

SEQ ID NO: 1025920 - RNA, 22 nt, Human
auugucuggaacaucaaggccu

SEQ ID NO: 1025921 - RNA, 18 nt, Human
caaggccuuuccuccccu

SEQ ID NO: 1025922 - RNA, 19 nt, Human
cucacgaauaaagagccac

SEQ ID NO: 1025923 - RNA, 19 nt, Human
cuccccuggcaguggcaca

SEQ ID NO: 1025924 - RNA, 21 nt, Human
guccuacaaccguucccaacg

SEQ ID NO: 1025925 - RNA, 22 nt, Human
ucugaagcucuagguucagcgg

SEQ ID NO: 1025926 - RNA, 19 nt, Human
uuuuuuuuuuuuuuuuuaa

SEQ ID NO: 1025927 - RNA, 19 nt, Human
aaaaaccacauuagagaug

SEQ ID NO: 1025928 - RNA, 21 nt, Human
aaaacaaaaauagaaaaauua

SEQ ID NO: 1025929 - RNA, 19 nt, Human
aacaaaaauagaaaaauua

SEQ ID NO: 1025930 - RNA, 24 nt, Human
acacucacacccacaacaggcacc

SEQ ID NO: 1025931 - RNA, 19 nt, Human
acccacaacaggcacccca

SEQ ID NO: 1025932 - RNA, 21 nt, Human
acccacaacaggcaccccagc

SEQ ID NO: 1025933 - RNA, 25 nt, Human
acuccaaaauccauaaugaaaugga

SEQ ID NO: 1025934 - RNA, 22 nt, Human
acuuuaaauagauuaaaaaaag

SEQ ID NO: 1025935 - RNA, 21 nt, Human
agagauggcauucuucaagcc

SEQ ID NO: 1025936 - RNA, 24 nt, Human
auauauguguguguauauauauau

SEQ ID NO: 1025937 - RNA, 21 nt, Human
caaaucauuuacuaacaugac

SEQ ID NO: 1025938 - RNA, 23 nt, Human
caacaggcaccccagccacugau

SEQ ID NO: 1025939 - RNA, 20 nt, Human
caagcuaaaucugaacccuc

SEQ ID NO: 1025940 - RNA, 25 nt, Human
cacacccacaacaggcaccccagaa

SEQ ID NO: 1025941 - RNA, 22 nt, Human
ccaagcuaaaucugaacccuca

SEQ ID NO: 1025942 - RNA, 20 nt, Human
ccacaacaggcaccccagcc

SEQ ID NO: 1025943 - RNA, 19 nt, Human
ccuuccuggcuacccccuc

SEQ ID NO: 1025944 - RNA, 23 nt, Human
cuaucacucacaacuccaaaauc

SEQ ID NO: 1025945 - RNA, 23 nt, Human
cucacacccacaacaggcacccc

SEQ ID NO: 1025946 - RNA, 20 nt, Human
cuuccuggcuacccccuccc

SEQ ID NO: 1025947 - RNA, 24 nt, Human
cuuccuggcuacccccuccccucc

SEQ ID NO: 1025948 - RNA, 19 nt, Human
gcuacccccuccccuccaa

SEQ ID NO: 1025949 - RNA, 20 nt, Human
guguguauauauauauauau

SEQ ID NO: 1025950 - RNA, 19 nt, Human
guuucuuuuuuuucuucca

SEQ ID NO: 1025951 - RNA, 21 nt, Human
uaaaaccaaaaacaaaaauag

SEQ ID NO: 1025952 - RNA, 23 nt, Human
uaacaugacaacagauuuggcuu

SEQ ID NO: 1025953 - RNA, 22 nt, Human
uagauuaaaaaaaguaauuucu

SEQ ID NO: 1025954 - RNA, 27 nt, Human
uauacuuuuuauauauguguguguaua

SEQ ID NO: 1025955 - RNA, 20 nt, Human
uauauauguguguguauaua

SEQ ID NO: 1025956 - RNA, 26 nt, Human
uauguguguguauauauauauaaugu

SEQ ID NO: 1025957 - RNA, 19 nt, Human
ucacacccacaacaggcag

SEQ ID NO: 1025958 - RNA, 20 nt, Human
ucagcccaaucguucccgcc

SEQ ID NO: 1025959 - RNA, 24 nt, Human
uccaaaacaguucaauauagccac

SEQ ID NO: 1025960 - RNA, 21 nt, Human
ucccucaucuccuauacugaa

SEQ ID NO: 1025961 - RNA, 21 nt, Human
uccuggcagcaaaucucugca

SEQ ID NO: 1025962 - RNA, 23 nt, Human
uccuggcuacccccuccccucca

SEQ ID NO: 1025963 - RNA, 18 nt, Human
ugaacccucaaaauugau

SEQ ID NO: 1025964 - RNA, 21 nt, Human
ugauuccuggcagcaaaucuc

SEQ ID NO: 1025965 - RNA, 19 nt, Human
uggcuacccccuccccucc

SEQ ID NO: 1025966 - RNA, 18 nt, Human
uguauauauauauauaua

SEQ ID NO: 1025967 - RNA, 24 nt, Human
uguauauauauauauauauuuaua

SEQ ID NO: 1025968 - RNA, 18 nt, Human
uguguauauauauauaua

SEQ ID NO: 1025969 - RNA, 20 nt, Human
uguguauauauauauauaua

SEQ ID NO: 1025970 - RNA, 24 nt, Human
uguguauauauauauauauauuua

SEQ ID NO: 1025971 - RNA, 18 nt, Human
uguguguguauauauaua

SEQ ID NO: 1025972 - RNA, 18 nt, Human
uguguguguauauauaua

SEQ ID NO: 1025973 - RNA, 20 nt, Human
uuaaaaccaaaaacaaaaau

SEQ ID NO: 1025974 - RNA, 22 nt, Human
uucaaaaaauauuuucucucau

SEQ ID NO: 1025975 - RNA, 19 nt, Human
uucaaguuuaaugggaaga

SEQ ID NO: 1025976 - RNA, 24 nt, Human
uucaauauagccacaguucaaguu

SEQ ID NO: 1025977 - RNA, 22 nt, Human
uuccaagcuaaaucugaacccu

SEQ ID NO: 1025978 - RNA, 22 nt, Human
uucccgccgccgcaacuccaac

SEQ ID NO: 1025979 - RNA, 20 nt, Human
uuccuggcagcaaaucucug

SEQ ID NO: 1025980 - RNA, 24 nt, Human
uuuaaaaaccacauuagagaugaa

SEQ ID NO: 1025981 - RNA, 18 nt, Human
aaaaagccagacacaaga

SEQ ID NO: 1025982 - RNA, 25 nt, Human
aaagccagacacaagaaaccacaua

SEQ ID NO: 1025983 - RNA, 18 nt, Human
aaagguaauuucaggcug

SEQ ID NO: 1025984 - RNA, 18 nt, Human
aagaggaaugaaaaacug

SEQ ID NO: 1025985 - RNA, 18 nt, Human
acacacaccuggagggca

SEQ ID NO: 1025986 - RNA, 21 nt, Human
acaccuggagggcacccacac

SEQ ID NO: 1025987 - RNA, 22 nt, Human
acagagccuccagugguauacu

SEQ ID NO: 1025988 - RNA, 21 nt, Human
acaggcccacgguugaauacc

SEQ ID NO: 1025989 - RNA, 25 nt, Human
accucaaggagcacgggaccuggga

SEQ ID NO: 1025990 - RNA, 23 nt, Human
agaagaggcaaaucuagacauau

SEQ ID NO: 1025991 - RNA, 19 nt, Human
aggcagugaugauaagggg

SEQ ID NO: 1025992 - RNA, 20 nt, Human
agggguaugagggauacuca

SEQ ID NO: 1025993 - RNA, 18 nt, Human
aggucacaccugcacaua

SEQ ID NO: 1025994 - RNA, 18 nt, Human
agguucuggauguuccug

SEQ ID NO: 1025995 - RNA, 20 nt, Human
agugguaaaaagccagacac

SEQ ID NO: 1025996 - RNA, 24 nt, Human
caacauggaugaacucugaaaacg

SEQ ID NO: 1025997 - RNA, 18 nt, Human
cacaccuggagggcaccc

SEQ ID NO: 1025998 - RNA, 22 nt, Human
cacagcaguagcauuuauaaua

SEQ ID NO: 1025999 - RNA, 20 nt, Human
cagaagaggcaaaucuagac

SEQ ID NO: 1026000 - RNA, 25 nt, Human
cagugguaaaaagccagacacaaga

SEQ ID NO: 1026001 - RNA, 18 nt, Human
cauaaagaggaaugaaaa

SEQ ID NO: 1026002 - RNA, 21 nt, Human
cauggaucccuccggucuccc

SEQ ID NO: 1026003 - RNA, 21 nt, Human
ccucauuccuucggccuccaa

SEQ ID NO: 1026004 - RNA, 19 nt, Human
ccuccaacaucuccccuuu

SEQ ID NO: 1026005 - RNA, 19 nt, Human
cggcagacagaguuuguca

SEQ ID NO: 1026006 - RNA, 25 nt, Human
cguucagugguaaaaagccagacac

SEQ ID NO: 1026007 - RNA, 19 nt, Human
cucacagagccuccagugg

SEQ ID NO: 1026008 - RNA, 20 nt, Human
gaacgaaggacgacgaaugc

SEQ ID NO: 1026009 - RNA, 21 nt, Human
gaacgaaggacgacgaaugca

SEQ ID NO: 1026010 - RNA, 22 nt, Human
gaaugcagaaaugagacagaca

SEQ ID NO: 1026011 - RNA, 18 nt, Human
ggagguaacaggcccacg

SEQ ID NO: 1026012 - RNA, 23 nt, Human
gucugaucaguuucacuuucucu

SEQ ID NO: 1026013 - RNA, 25 nt, Human
guuccuguggauaaccucaaggagc

SEQ ID NO: 1026014 - RNA, 26 nt, Human
guuccuguggauaaccucaaggagcc

SEQ ID NO: 1026015 - RNA, 24 nt, Human
uaaaaagccagacacaagaaacca

SEQ ID NO: 1026016 - RNA, 20 nt, Human
uaccauggaucccuccgguc

SEQ ID NO: 1026017 - RNA, 24 nt, Human
uacugaguuggucacgacccucau

SEQ ID NO: 1026018 - RNA, 26 nt, Human
uaucagagaguuggaaacaaccccaa

SEQ ID NO: 1026019 - RNA, 20 nt, Human
uauuagguagagugaauagg

SEQ ID NO: 1026020 - RNA, 18 nt, Human
uauuauucagccauaaag

SEQ ID NO: 1026021 - RNA, 20 nt, Human
ucagagagccuccucgugcc

SEQ ID NO: 1026022 - RNA, 20 nt, Human
uccagaagaggcaaaucuag

SEQ ID NO: 1026023 - RNA, 18 nt, Human
ucuagggaacagggaccu

SEQ ID NO: 1026024 - RNA, 22 nt, Human
ucugaucaguuucacuuucucu

SEQ ID NO: 1026025 - RNA, 23 nt, Human
ugaauaaagguaauuucaggcug

SEQ ID NO: 1026026 - RNA, 18 nt, Human
ugaguaaacaaacugugg

SEQ ID NO: 1026027 - RNA, 23 nt, Human
ugaguaaacaaacugugguauau

SEQ ID NO: 1026028 - RNA, 20 nt, Human
ugcucuggcagaccuuccuc

SEQ ID NO: 1026029 - RNA, 19 nt, Human
uggcagccuccucagagag

SEQ ID NO: 1026030 - RNA, 19 nt, Human
uguuccuguggauaaccuc

SEQ ID NO: 1026031 - RNA, 21 nt, Human
uuccauggucacacacaccug

SEQ ID NO: 1026032 - RNA, 28 nt, Human
uuuacagcccuucauauuuauuagguag

SEQ ID NO: 1026033 - RNA, 23 nt, Human
uuuuacagcccuucauauuuauu

SEQ ID NO: 1026034 - RNA, 22 nt, Human
uuuuuuuuuuuuuuuuucacag

SEQ ID NO: 1026035 - RNA, 18 nt, Human
aaaucccagccauuccca

SEQ ID NO: 1026036 - RNA, 20 nt, Human
aagggccagaauaagcaaca

SEQ ID NO: 1026037 - RNA, 21 nt, Human
aagggccagaauaagcaacaa

SEQ ID NO: 1026038 - RNA, 18 nt, Human
acacaacagaugcggccu

SEQ ID NO: 1026039 - RNA, 20 nt, Human
accacacaacagaugcggcc

SEQ ID NO: 1026040 - RNA, 22 nt, Human
aggcacauguucgucccugccc

SEQ ID NO: 1026041 - RNA, 18 nt, Human
agugauggggguagaaga

SEQ ID NO: 1026042 - RNA, 21 nt, Human
aucccauuccugagcugacaa

SEQ ID NO: 1026043 - RNA, 23 nt, Human
auggggguagaagauggugacug

SEQ ID NO: 1026044 - RNA, 21 nt, Human
caaagugaacagucugggcuu

SEQ ID NO: 1026045 - RNA, 25 nt, Human
caacgcccaaaucccagccauuccc

SEQ ID NO: 1026046 - RNA, 20 nt, Human
cacacuccccagugcggccc

SEQ ID NO: 1026047 - RNA, 21 nt, Human
caccacacaacagaugcggcc

SEQ ID NO: 1026048 - RNA, 21 nt, Human
cagaacagaaaagugcuuucc

SEQ ID NO: 1026049 - RNA, 18 nt, Human
cagugcagacuggaacua

SEQ ID NO: 1026050 - RNA, 19 nt, Human
caucucauaacucuccucc

SEQ ID NO: 1026051 - RNA, 22 nt, Human
caugguagcaggacaagucacc

SEQ ID NO: 1026052 - RNA, 24 nt, Human
ccagaacagaaaagugcuuuccuu

SEQ ID NO: 1026053 - RNA, 21 nt, Human
cccacagagauugacagccaa

SEQ ID NO: 1026054 - RNA, 21 nt, Human
cccacaguaggaccauagggc

SEQ ID NO: 1026055 - RNA, 22 nt, Human
cccagcccacacuccccagugc

SEQ ID NO: 1026056 - RNA, 22 nt, Human
cccagugcggcccccgcucucc

SEQ ID NO: 1026057 - RNA, 21 nt, Human
ccugagugcuuguggccacca

SEQ ID NO: 1026058 - RNA, 20 nt, Human
cgcccaaaucccagccauuc

SEQ ID NO: 1026059 - RNA, 19 nt, Human
cugcggcccagcccacacu

SEQ ID NO: 1026060 - RNA, 21 nt, Human
cugcugcugggucugccuggc

SEQ ID NO: 1026061 - RNA, 27 nt, Human
gcaaaauagugaagggagccgguaccc

SEQ ID NO: 1026062 - RNA, 24 nt, Human
gcccccgcucuccgcccgcucgcc

SEQ ID NO: 1026063 - RNA, 19 nt, Human
gccuggccaucaaggagca

SEQ ID NO: 1026064 - RNA, 19 nt, Human
gcugcugggucugccuggc

SEQ ID NO: 1026065 - RNA, 19 nt, Human
gggcaaaauagugaaggga

SEQ ID NO: 1026066 - RNA, 18 nt, Human
gguagaagauggugacug

SEQ ID NO: 1026067 - RNA, 24 nt, Human
guggcuguguggugugggaagggc

SEQ ID NO: 1026068 - RNA, 20 nt, Human
uagugaagggagccaggugc

SEQ ID NO: 1026069 - RNA, 18 nt, Human
ucacuggccccucggcug

SEQ ID NO: 1026070 - RNA, 22 nt, Human
uccugagcugacaagacagauu

SEQ ID NO: 1026071 - RNA, 19 nt, Human
uccugggggaaucccauuc

SEQ ID NO: 1026072 - RNA, 18 nt, Human
ucucauaacucuccuccc

SEQ ID NO: 1026073 - RNA, 21 nt, Human
ucuccgcccgcucgccgggag

SEQ ID NO: 1026074 - RNA, 22 nt, Human
ucugggcuucccagaacagaaa

SEQ ID NO: 1026075 - RNA, 21 nt, Human
ugaagggagccaggugcauau

SEQ ID NO: 1026076 - RNA, 19 nt, Human
ugagugcuuguggccacca

SEQ ID NO: 1026077 - RNA, 22 nt, Human
ugagugcuuguggccaccacac

SEQ ID NO: 1026078 - RNA, 23 nt, Human
ugccuggccaucaaggagcagcc

SEQ ID NO: 1026079 - RNA, 20 nt, Human
ugcggccuuccucuucacug

SEQ ID NO: 1026080 - RNA, 20 nt, Human
ugggaagggccagaauaagc

SEQ ID NO: 1026081 - RNA, 24 nt, Human
ugggaagggccagaauaagcaaca

SEQ ID NO: 1026082 - RNA, 26 nt, Human
uggggcucugucaacaugguagcagg

SEQ ID NO: 1026083 - RNA, 24 nt, Human
uggggguagaagauggugacuguu

SEQ ID NO: 1026084 - RNA, 24 nt, Human
uguguggcuguguggugugggaag

SEQ ID NO: 1026085 - RNA, 21 nt, Human
uucacuggccccucggcugcu

SEQ ID NO: 1026086 - RNA, 21 nt, Human
uucccacuagaggccaaaccg

SEQ ID NO: 1026087 - RNA, 23 nt, Human
uuuccagugcagacuggaacuag

SEQ ID NO: 1026088 - RNA, 23 nt, Human
uuuuaugguucucagauaccacu

SEQ ID NO: 1026089 - RNA, 22 nt, Human
uuuuuuuuuuuuaugguucuca

SEQ ID NO: 1026090 - RNA, 21 nt, Human
aagccgaggcgccggccggga

SEQ ID NO: 1026091 - RNA, 18 nt, Human
agacaaguguccggcucc

SEQ ID NO: 1026092 - RNA, 24 nt, Human
aggcuggggagggggcggagaggc

SEQ ID NO: 1026093 - RNA, 22 nt, Human
caccagccgggagacgcagaag

SEQ ID NO: 1026094 - RNA, 21 nt, Human
cagcucggagacgggagacaa

SEQ ID NO: 1026095 - RNA, 22 nt, Human
ccggcggcgcagaggcuucccc

SEQ ID NO: 1026096 - RNA, 20 nt, Human
ccggcuccuccuucggcggc

SEQ ID NO: 1026097 - RNA, 23 nt, Human
cuuaaucccaaacaucucaaaug

SEQ ID NO: 1026098 - RNA, 31 nt, Human
gagaaaggcuggggagggggcggagaggccc

SEQ ID NO: 1026099 - RNA, 21 nt, Human
gagcagcucggagacgggaga

SEQ ID NO: 1026100 - RNA, 19 nt, Human
ggagcagcucggagacggg

SEQ ID NO: 1026101 - RNA, 21 nt, Human
ggcgcagaggcuuccccacca

SEQ ID NO: 1026102 - RNA, 19 nt, Human
gggagggggcggagaggcc

SEQ ID NO: 1026103 - RNA, 24 nt, Human
gggcgagagaaaggcuggggaggg

SEQ ID NO: 1026104 - RNA, 19 nt, Human
uccccaggcggccgccgcc

SEQ ID NO: 1026105 - RNA, 20 nt, Human
uccccaggcggccgccgccu

SEQ ID NO: 1026106 - RNA, 19 nt, Human
ucucuccuccagggguggg

SEQ ID NO: 1026107 - RNA, 28 nt, Human
ugggagaagagggcgagagaaaggcugg

SEQ ID NO: 1026108 - RNA, 22 nt, Human
uggggagcagcucggagacggg

SEQ ID NO: 1026109 - RNA, 20 nt, Human
uuaaucccaaacaucucaaa

SEQ ID NO: 1026110 - RNA, 19 nt, Human
uucaaauuguauggcuuaa

SEQ ID NO: 1026111 - RNA, 25 nt, Human
aaaaaggcaccuacaaauugaaacu

SEQ ID NO: 1026112 - RNA, 21 nt, Human
aacauggcaagacccucaucu

SEQ ID NO: 1026113 - RNA, 19 nt, Human
aacauggugaaacccuguc

SEQ ID NO: 1026114 - RNA, 20 nt, Human
aacauggugaaacccugucu

SEQ ID NO: 1026115 - RNA, 21 nt, Human
aacauggugaaacccugucuc

SEQ ID NO: 1026116 - RNA, 26 nt, Human
aaccaagagcccaaaaacccaaccca

SEQ ID NO: 1026117 - RNA, 22 nt, Human
aaccagccacaaaagaggccuc

SEQ ID NO: 1026118 - RNA, 23 nt, Human
aaccugcccgccuaggccucccg

SEQ ID NO: 1026119 - RNA, 18 nt, Human
aagagcccaaaaacccaa

SEQ ID NO: 1026120 - RNA, 22 nt, Human
aagaguucaccacauuuuggug

SEQ ID NO: 1026121 - RNA, 21 nt, Human
aagcugaucaugaucuuguac

SEQ ID NO: 1026122 - RNA, 23 nt, Human
aaguaucucucuggauucaaacc

SEQ ID NO: 1026123 - RNA, 26 nt, Human
aaguguuaggauuacaggcaugagcc

SEQ ID NO: 1026124 - RNA, 24 nt, Human
aauuaggaaauauuaaaauuaaga

SEQ ID NO: 1026125 - RNA, 24 nt, Human
acaacacaaaaggccaucaacaaa

SEQ ID NO: 1026126 - RNA, 20 nt, Human
acaagaacauucuuccuuau

SEQ ID NO: 1026127 - RNA, 19 nt, Human
acacugaaacucugagaaa

SEQ ID NO: 1026128 - RNA, 21 nt, Human
acccagaaagcgccacaguuc

SEQ ID NO: 1026129 - RNA, 21 nt, Human
acccauauuucgaaaaaacuc

SEQ ID NO: 1026130 - RNA, 22 nt, Human
acugcaaccuccgccucacagg

SEQ ID NO: 1026131 - RNA, 24 nt, Human
acuggcuaacauggugaaacccug

SEQ ID NO: 1026132 - RNA, 25 nt, Human
agaacaaaaagcuacaaauagagga

SEQ ID NO: 1026133 - RNA, 22 nt, Human
agacaggaaagaacaugguuaa

SEQ ID NO: 1026134 - RNA, 18 nt, Human
agagaaugaagacagagg

SEQ ID NO: 1026135 - RNA, 24 nt, Human
agcacuuugggagcccaagguggg

SEQ ID NO: 1026136 - RNA, 23 nt, Human
agcagcuugugccuguaaucuca

SEQ ID NO: 1026137 - RNA, 24 nt, Human
agcagcuugugccuguaaucucag

SEQ ID NO: 1026138 - RNA, 22 nt, Human
agccacuacgccuggccaagaa

SEQ ID NO: 1026139 - RNA, 24 nt, Human
agccuggacaacauggcaagaccc

SEQ ID NO: 1026140 - RNA, 23 nt, Human
agcugggugcagcagcuugugcc

SEQ ID NO: 1026141 - RNA, 19 nt, Human
aggaaauauuaaaauuaag

SEQ ID NO: 1026142 - RNA, 23 nt, Human
aggaguucaagaccagccuggac

SEQ ID NO: 1026143 - RNA, 23 nt, Human
aggauugugugaggucaggaguu

SEQ ID NO: 1026144 - RNA, 24 nt, Human
aggauugugugaggucaggaguuc

SEQ ID NO: 1026145 - RNA, 18 nt, Human
aggccaucaacaaauuag

SEQ ID NO: 1026146 - RNA, 18 nt, Human
aggcuaaggcaggaggau

SEQ ID NO: 1026147 - RNA, 25 nt, Human
aggcuggagugcaguagcgcgaucu

SEQ ID NO: 1026148 - RNA, 21 nt, Human
agggagaagcugaucaugauc

SEQ ID NO: 1026149 - RNA, 19 nt, Human
aggucaggaguucaagacc

SEQ ID NO: 1026150 - RNA, 24 nt, Human
aggugggugaaucacgaggucagg

SEQ ID NO: 1026151 - RNA, 22 nt, Human
aguagagaugggguuuugccau

SEQ ID NO: 1026152 - RNA, 18 nt, Human
aguagcaccuucuucuug

SEQ ID NO: 1026153 - RNA, 21 nt, Human
agucuccaacaccauaugauc

SEQ ID NO: 1026154 - RNA, 20 nt, Human
agugcaguagcgcgaucucg

SEQ ID NO: 1026155 - RNA, 24 nt, Human
agugcaguagcgcgaucucggcuu

SEQ ID NO: 1026156 - RNA, 24 nt, Human
auagguuaagugugcaguguuuau

SEQ ID NO: 1026157 - RNA, 22 nt, Human
aucagcucuccccucuuucucu

SEQ ID NO: 1026158 - RNA, 23 nt, Human
aucagguacagugcuagguacuc

SEQ ID NO: 1026159 - RNA, 24 nt, Human
augggguuuugccauguugcccgg

SEQ ID NO: 1026160 - RNA, 21 nt, Human
caacacaaaaggccaucaaca

SEQ ID NO: 1026161 - RNA, 23 nt, Human
caagagcccaaaaacccaaccca

SEQ ID NO: 1026162 - RNA, 24 nt, Human
caaggugggugaaucacgagguca

SEQ ID NO: 1026163 - RNA, 24 nt, Human
cacaucuguaaucccagcacuuug

SEQ ID NO: 1026164 - RNA, 23 nt, Human
cagcacuuugggagcccaaggug

SEQ ID NO: 1026165 - RNA, 24 nt, Human
cagcacuuugggagcccaaggugg

SEQ ID NO: 1026166 - RNA, 24 nt, Human
cagggucuugcccugucgcccagg

SEQ ID NO: 1026167 - RNA, 20 nt, Human
caguuaggcucucuucuuuu

SEQ ID NO: 1026168 - RNA, 18 nt, Human
caucgucuuccuuuuuuu

SEQ ID NO: 1026169 - RNA, 24 nt, Human
caucuguaaucccagcacuuuggg

SEQ ID NO: 1026170 - RNA, 25 nt, Human
cauguugcccgggcuggucucuaaa

SEQ ID NO: 1026171 - RNA, 19 nt, Human
ccaagagcccaaaaaccca

SEQ ID NO: 1026172 - RNA, 26 nt, Human
ccauccacaaagugagcaguggaagg

SEQ ID NO: 1026173 - RNA, 24 nt, Human
ccaucuaaaauauucaaagcaaag

SEQ ID NO: 1026174 - RNA, 19 nt, Human
ccauguugcccgggcuggu

SEQ ID NO: 1026175 - RNA, 22 nt, Human
ccauguugcccgggcuggucuc

SEQ ID NO: 1026176 - RNA, 21 nt, Human
cccagcacuuugggagcccaa

SEQ ID NO: 1026177 - RNA, 21 nt, Human
cccaucuaaaauauucaaagc

SEQ ID NO: 1026178 - RNA, 23 nt, Human
cccugucgcccaggcuggagugc

SEQ ID NO: 1026179 - RNA, 19 nt, Human
ccgaaguguuaggauuaca

SEQ ID NO: 1026180 - RNA, 24 nt, Human
ccgaaguguuaggauuacaggcau

SEQ ID NO: 1026181 - RNA, 23 nt, Human
ccgagccggcgaaagagaucgug

SEQ ID NO: 1026182 - RNA, 24 nt, Human
ccuaggagcaacagacuauaccau

SEQ ID NO: 1026183 - RNA, 19 nt, Human
ccuguaaucucaguuacuc

SEQ ID NO: 1026184 - RNA, 24 nt, Human
ccugucgcccaggcuggagugcag

SEQ ID NO: 1026185 - RNA, 21 nt, Human
ccuuucaguuaggcucucuuc

SEQ ID NO: 1026186 - RNA, 24 nt, Human
cgagaccauacuggcuaacauggu

SEQ ID NO: 1026187 - RNA, 24 nt, Human
cucacaucuguaaucccagcacuu

SEQ ID NO: 1026188 - RNA, 21 nt, Human
cucucuucuuuuuucucucca

SEQ ID NO: 1026189 - RNA, 23 nt, Human
cucucuucuuuuuucucuccauu

SEQ ID NO: 1026190 - RNA, 19 nt, Human
cugacucuagaacaaaaag

SEQ ID NO: 1026191 - RNA, 21 nt, Human
cuggcuaacauggugaaaccc

SEQ ID NO: 1026192 - RNA, 21 nt, Human
cuggcuaacauggugaaaccc

SEQ ID NO: 1026193 - RNA, 24 nt, Human
cuggcuaacauggugaaacccugu

SEQ ID NO: 1026194 - RNA, 21 nt, Human
cuguauaguagcaccuucuuc

SEQ ID NO: 1026195 - RNA, 18 nt, Human
cuguauuccuaacaaaau

SEQ ID NO: 1026196 - RNA, 22 nt, Human
cuuacaguccuuuuguuuuucc

SEQ ID NO: 1026197 - RNA, 22 nt, Human
cuucuugggaagcaauuucugg

SEQ ID NO: 1026198 - RNA, 24 nt, Human
cuugcccugucgcccaggcuggag

SEQ ID NO: 1026199 - RNA, 22 nt, Human
gaaagagacaggaaagaacaug

SEQ ID NO: 1026200 - RNA, 24 nt, Human
gaaguguuaggauuacaggcauga

SEQ ID NO: 1026201 - RNA, 18 nt, Human
gagaugggguuuugccau

SEQ ID NO: 1026202 - RNA, 18 nt, Human
gagcugcgucugccgaga

SEQ ID NO: 1026203 - RNA, 28 nt, Human
gaguagccgggacuaugccaccacaccg

SEQ ID NO: 1026204 - RNA, 18 nt, Human
gauuacaggcaugagcca

SEQ ID NO: 1026205 - RNA, 21 nt, Human
gauuacaggcaugagccacua

SEQ ID NO: 1026206 - RNA, 22 nt, Human
gauuacaggcaugagccacuac

SEQ ID NO: 1026207 - RNA, 24 nt, Human
gauugugugaggucaggaguucaa

SEQ ID NO: 1026208 - RNA, 18 nt, Human
gcaaauggguugcaccag

SEQ ID NO: 1026209 - RNA, 22 nt, Human
gcaaccuccgccucacagguuc

SEQ ID NO: 1026210 - RNA, 21 nt, Human
gcaccuccgaagaaucaaagu

SEQ ID NO: 1026211 - RNA, 24 nt, Human
gcaugaacaaacaaaaaaaucaua

SEQ ID NO: 1026212 - RNA, 20 nt, Human
gccauguugcccgggcuggu

SEQ ID NO: 1026213 - RNA, 19 nt, Human
gcccaggcuggagugcagu

SEQ ID NO: 1026214 - RNA, 21 nt, Human
gcgccgagccggcgaaagaga

SEQ ID NO: 1026215 - RNA, 24 nt, Human
gcuaacauggugaaacccugucuc

SEQ ID NO: 1026216 - RNA, 20 nt, Human
gcucucuucuuuuuucucuc

SEQ ID NO: 1026217 - RNA, 23 nt, Human
gcucucuucuuuuuucucuccau

SEQ ID NO: 1026218 - RNA, 18 nt, Human
gcugggcgugguggcuca

SEQ ID NO: 1026219 - RNA, 19 nt, Human
ggaaagagacaggaaagaa

SEQ ID NO: 1026220 - RNA, 26 nt, Human
ggaaauaaauaaguugaauucaaaug

SEQ ID NO: 1026221 - RNA, 19 nt, Human
ggauuacaggcaugagcca

SEQ ID NO: 1026222 - RNA, 22 nt, Human
ggauuacaggcaugagccacua

SEQ ID NO: 1026223 - RNA, 23 nt, Human
ggauugugugaggucaggaguuc

SEQ ID NO: 1026224 - RNA, 23 nt, Human
ggcgugguggcucacaucuguaa

SEQ ID NO: 1026225 - RNA, 20 nt, Human
gggguuuugccauguugccc

SEQ ID NO: 1026226 - RNA, 23 nt, Human
gggguuuugccauguugcccggg

SEQ ID NO: 1026227 - RNA, 22 nt, Human
ggguuuugccauguugcccggg

SEQ ID NO: 1026228 - RNA, 18 nt, Human
ggugaaucacgaggucag

SEQ ID NO: 1026229 - RNA, 23 nt, Human
ggugcagcagcuugugccuguaa

SEQ ID NO: 1026230 - RNA, 24 nt, Human
gguggcucacaucuguaaucccag

SEQ ID NO: 1026231 - RNA, 24 nt, Human
guaaaggaucuguuugcaugaaca

SEQ ID NO: 1026232 - RNA, 23 nt, Human
guagagaugggguuuugccaugu

SEQ ID NO: 1026233 - RNA, 21 nt, Human
guagaucuuucuuuaaauaaa

SEQ ID NO: 1026234 - RNA, 22 nt, Human
guauuuuuuuuaguagagaugg

SEQ ID NO: 1026235 - RNA, 25 nt, Human
gugaucagcucuccccucuuucucu

SEQ ID NO: 1026236 - RNA, 23 nt, Human
guggcucacaucuguaaucccag

SEQ ID NO: 1026237 - RNA, 24 nt, Human
gugugaggucaggaguucaagacc

SEQ ID NO: 1026238 - RNA, 21 nt, Human
guucuuuuauuguuacucuuu

SEQ ID NO: 1026239 - RNA, 23 nt, Human
guuuacacaaugacaauaucacc

SEQ ID NO: 1026240 - RNA, 24 nt, Human
guuuugccauguugcccgggcugg

SEQ ID NO: 1026241 - RNA, 21 nt, Human
uaaaauauucaaagcaaaguc

SEQ ID NO: 1026242 - RNA, 24 nt, Human
uaaacuccugagcucagacaaccu

SEQ ID NO: 1026243 - RNA, 26 nt, Human
uaaaucaaccaagagcccaaaaaccc

SEQ ID NO: 1026244 - RNA, 22 nt, Human
uaacauggugaaacccugucuc

SEQ ID NO: 1026245 - RNA, 23 nt, Human
uaacauggugaaacccugucucu

SEQ ID NO: 1026246 - RNA, 20 nt, Human
uaaggaaagauaagcuguaa

SEQ ID NO: 1026247 - RNA, 20 nt, Human
uaaggaaagauaagcuguaa

SEQ ID NO: 1026248 - RNA, 24 nt, Human
uaaggcaggaggauugugugaggu

SEQ ID NO: 1026249 - RNA, 26 nt, Human
uaaggcaggaggauugugugagguca

SEQ ID NO: 1026250 - RNA, 20 nt, Human
uacagagcugggugcagcag

SEQ ID NO: 1026251 - RNA, 22 nt, Human
uacaggcaugagccacuacgcc

SEQ ID NO: 1026252 - RNA, 18 nt, Human
uacugcaaccuccgccuc

SEQ ID NO: 1026253 - RNA, 18 nt, Human
uagaacaaaaagcuacaa

SEQ ID NO: 1026254 - RNA, 22 nt, Human
uagagaugggguuuugccaugu

SEQ ID NO: 1026255 - RNA, 22 nt, Human
uagccgggacuaugccaccaca

SEQ ID NO: 1026256 - RNA, 24 nt, Human
uagccuaggagcaacagacuauac

SEQ ID NO: 1026257 - RNA, 18 nt, Human
uaggauuacaggcaugag

SEQ ID NO: 1026258 - RNA, 21 nt, Human
uaggauuacaggcaugagcca

SEQ ID NO: 1026259 - RNA, 22 nt, Human
uaggauuacaggcaugagccac

SEQ ID NO: 1026260 - RNA, 22 nt, Human
uaggauuacaggcaugagccac

SEQ ID NO: 1026261 - RNA, 23 nt, Human
uaggauuacaggcaugagccacu

SEQ ID NO: 1026262 - RNA, 24 nt, Human
uaggauuacaggcaugagccacua

SEQ ID NO: 1026263 - RNA, 24 nt, Human
uaggauuacaggcaugagccacua

SEQ ID NO: 1026264 - RNA, 24 nt, Human
uaguagagaugggguuuugccaug

SEQ ID NO: 1026265 - RNA, 18 nt, Human
uaucagguacagugcuag

SEQ ID NO: 1026266 - RNA, 23 nt, Human
uauccaauacaaggauacuuaau

SEQ ID NO: 1026267 - RNA, 22 nt, Human
ucaaccaagagcccaaaaaccc

SEQ ID NO: 1026268 - RNA, 23 nt, Human
ucaaguauuccaugaaaauaaca

SEQ ID NO: 1026269 - RNA, 19 nt, Human
ucacaacacaaaaggccau

SEQ ID NO: 1026270 - RNA, 21 nt, Human
ucacagguucaagcuauucuc

SEQ ID NO: 1026271 - RNA, 24 nt, Human
ucacagguucaagcuauucuccug

SEQ ID NO: 1026272 - RNA, 18 nt, Human
ucacgaggucaggagauc

SEQ ID NO: 1026273 - RNA, 24 nt, Human
ucacgaggucaggagaucgagacc

SEQ ID NO: 1026274 - RNA, 19 nt, Human
ucauauuuccuuuuuccua

SEQ ID NO: 1026275 - RNA, 25 nt, Human
ucaucucuacaggaaaaaaaaaagg

SEQ ID NO: 1026276 - RNA, 18 nt, Human
uccauuguacaaaacuca

SEQ ID NO: 1026277 - RNA, 19 nt, Human
ucccgaaguguuaggauua

SEQ ID NO: 1026278 - RNA, 24 nt, Human
ucccgaaguguuaggauuacaggc

SEQ ID NO: 1026279 - RNA, 21 nt, Human
ucccucuuccuuucaguuagg

SEQ ID NO: 1026280 - RNA, 19 nt, Human
uccugccaccuuacagucc

SEQ ID NO: 1026281 - RNA, 24 nt, Human
ucgcccaggcuggagugcaguagc

SEQ ID NO: 1026282 - RNA, 23 nt, Human
ucggcauauuuuuuacugauuuu

SEQ ID NO: 1026283 - RNA, 23 nt, Human
ucuaauagcuaauagucuccaac

SEQ ID NO: 1026284 - RNA, 21 nt, Human
ucuagaacaaaaagcuacaaa

SEQ ID NO: 1026285 - RNA, 22 nt, Human
ucucuaaacuccugagcucaga

SEQ ID NO: 1026286 - RNA, 22 nt, Human
ucucucuggauucaaaccacag

SEQ ID NO: 1026287 - RNA, 19 nt, Human
ucugcucccucuuccuuuc

SEQ ID NO: 1026288 - RNA, 24 nt, Human
ucuggcugggcgugguggcucaca

SEQ ID NO: 1026289 - RNA, 23 nt, Human
ucuugcccugucgcccaggcugg

SEQ ID NO: 1026290 - RNA, 24 nt, Human
ucuugcccugucgcccaggcugga

SEQ ID NO: 1026291 - RNA, 23 nt, Human
ucuugcucugcucccucuuccuu

SEQ ID NO: 1026292 - RNA, 24 nt, Human
ugaacaaacaaaaaaaucauauuc

SEQ ID NO: 1026293 - RNA, 21 nt, Human
ugacuguaagacuucaaguau

SEQ ID NO: 1026294 - RNA, 22 nt, Human
ugagacagggucuugcccuguc

SEQ ID NO: 1026295 - RNA, 22 nt, Human
ugaggcaccaucaaccuaagga

SEQ ID NO: 1026296 - RNA, 22 nt, Human
ugaggcaccaucaaccuaagga

SEQ ID NO: 1026297 - RNA, 20 nt, Human
ugaguagccgggacuaugcc

SEQ ID NO: 1026298 - RNA, 19 nt, Human
ugcaggcaagugcaaaaca

SEQ ID NO: 1026299 - RNA, 21 nt, Human
ugcaguagcgcgaucucggcu

SEQ ID NO: 1026300 - RNA, 24 nt, Human
ugccauguugcccgggcuggucuc

SEQ ID NO: 1026301 - RNA, 25 nt, Human
ugcccgggcuggucucuaaacuccu

SEQ ID NO: 1026302 - RNA, 24 nt, Human
ugcccugucgcccaggcuggagug

SEQ ID NO: 1026303 - RNA, 25 nt, Human
ugcccugucgcccaggcuggagugc

SEQ ID NO: 1026304 - RNA, 21 nt, Human
ugccucagacuccugaguagc

SEQ ID NO: 1026305 - RNA, 24 nt, Human
ugccucagacuccugaguagccgg

SEQ ID NO: 1026306 - RNA, 24 nt, Human
ugccuguaaucucaguuacucagg

SEQ ID NO: 1026307 - RNA, 23 nt, Human
ugcuccacacacaccugggacag

SEQ ID NO: 1026308 - RNA, 23 nt, Human
ugcucugcucccucuuccuuuca

SEQ ID NO: 1026309 - RNA, 22 nt, Human
uggaauaaccagccacaaaaga

SEQ ID NO: 1026310 - RNA, 28 nt, Human
uggaauaaccagccacaaaaggucaucc

SEQ ID NO: 1026311 - RNA, 23 nt, Human
uggagugcaguagcgcgaucucg

SEQ ID NO: 1026312 - RNA, 24 nt, Human
uggagugcaguagcgcgaucucgg

SEQ ID NO: 1026313 - RNA, 24 nt, Human
uggauucaaaccacagaaauguca

SEQ ID NO: 1026314 - RNA, 19 nt, Human
uggcaagacccucaucucu

SEQ ID NO: 1026315 - RNA, 21 nt, Human
uggcucacaucuguaauccca

SEQ ID NO: 1026316 - RNA, 24 nt, Human
uggcucacaucuguaaucccagca

SEQ ID NO: 1026317 - RNA, 24 nt, Human
ugggguuuugccauguugcccggg

SEQ ID NO: 1026318 - RNA, 24 nt, Human
ugguggcucacaucuguaauccca

SEQ ID NO: 1026319 - RNA, 21 nt, Human
uguaagagaaugaagacagag

SEQ ID NO: 1026320 - RNA, 20 nt, Human
uguggaaguaaacaacauga

SEQ ID NO: 1026321 - RNA, 23 nt, Human
ugugguaguacugauaacauuca

SEQ ID NO: 1026322 - RNA, 23 nt, Human
ugugugaggucaggaguucaaga

SEQ ID NO: 1026323 - RNA, 18 nt, Human
uguguuugugaugcucca

SEQ ID NO: 1026324 - RNA, 21 nt, Human
uguuccaacugucuauagcau

SEQ ID NO: 1026325 - RNA, 20 nt, Human
uguuuauacaagucuacaug

SEQ ID NO: 1026326 - RNA, 18 nt, Human
uuacugcaaccuccgccu

SEQ ID NO: 1026327 - RNA, 19 nt, Human
uuacugcaaccuccgccuc

SEQ ID NO: 1026328 - RNA, 24 nt, Human
uuacugcaaccuccgccucacagg

SEQ ID NO: 1026329 - RNA, 21 nt, Human
uuaggaaauauuaaaauuaag

SEQ ID NO: 1026330 - RNA, 18 nt, Human
uuaguagagaugggguuu

SEQ ID NO: 1026331 - RNA, 22 nt, Human
uuaguagagaugggguuuugcc

SEQ ID NO: 1026332 - RNA, 24 nt, Human
uuaguagagaugggguuuugccau

SEQ ID NO: 1026333 - RNA, 18 nt, Human
uucaagcuauucuccugc

SEQ ID NO: 1026334 - RNA, 21 nt, Human
uucaagcuauucuccugccuc

SEQ ID NO: 1026335 - RNA, 22 nt, Human
uucugacucuagaacaaaaagc

SEQ ID NO: 1026336 - RNA, 21 nt, Human
uucuuguuuccaaaaaagucc

SEQ ID NO: 1026337 - RNA, 22 nt, Human
uugagacagggucuugcccugu

SEQ ID NO: 1026338 - RNA, 24 nt, Human
uugcccugucgcccaggcuggagu

SEQ ID NO: 1026339 - RNA, 24 nt, Human
uugugguucacaacacaaaaggcc

SEQ ID NO: 1026340 - RNA, 18 nt, Human
uuugucccaucuaaaaua

SEQ ID NO: 1026341 - RNA, 23 nt, Human
uuuuacacccuguaccaguagau

SEQ ID NO: 1026342 - RNA, 23 nt, Human
uuuugccauguugcccgggcugg

SEQ ID NO: 1026343 - RNA, 24 nt, Human
uuuuuaguagagaugggguuuugc

SEQ ID NO: 1026344 - RNA, 27 nt, Human
uuuuugguauuuuuuuuaguagagaug

SEQ ID NO: 1026345 - RNA, 22 nt, Human
uuuuuuaguagagaugggguuu

SEQ ID NO: 1026346 - RNA, 20 nt, Human
uuuuuuuugagacagggucu

SEQ ID NO: 1026347 - RNA, 20 nt, Human
uuuuuuuuuuugagacaggg

SEQ ID NO: 1026348 - RNA, 23 nt, Human
uuuuuuuuuuuugagacaggguc

SEQ ID NO: 1026349 - RNA, 24 nt, Human
uuuuuuuuuuuuuuugagacaggg

SEQ ID NO: 1026350 - RNA, 27 nt, Human
aaaagaaucaaucagaaugauggacac

SEQ ID NO: 1026351 - RNA, 25 nt, Human
aaagagagagagagagaaagggggc

SEQ ID NO: 1026352 - RNA, 19 nt, Human
aacccacucccacaauaac

SEQ ID NO: 1026353 - RNA, 22 nt, Human
aaggcagaaggguaagagagga

SEQ ID NO: 1026354 - RNA, 24 nt, Human
aaguccacucacaccucaucuguu

SEQ ID NO: 1026355 - RNA, 19 nt, Human
acauuuacuccuuugcuac

SEQ ID NO: 1026356 - RNA, 24 nt, Human
acucauccuucuucucagaaaccc

SEQ ID NO: 1026357 - RNA, 22 nt, Human
agagagagagagaaagggggcc

SEQ ID NO: 1026358 - RNA, 18 nt, Human
aggaugaaagagagagag

SEQ ID NO: 1026359 - RNA, 20 nt, Human
aggcagagcccucaugaccu

SEQ ID NO: 1026360 - RNA, 22 nt, Human
aggcagagcccucaugaccuag

SEQ ID NO: 1026361 - RNA, 19 nt, Human
caaaccauaucagcacacu

SEQ ID NO: 1026362 - RNA, 27 nt, Human
caaacucauccuucuucucagaaaccc

SEQ ID NO: 1026363 - RNA, 20 nt, Human
caggcugauaaugcugucca

SEQ ID NO: 1026364 - RNA, 18 nt, Human
caguggccucuuuucuuc

SEQ ID NO: 1026365 - RNA, 23 nt, Human
cauaaacauuuggggacaccuuc

SEQ ID NO: 1026366 - RNA, 24 nt, Human
cccacucccacaauaacuaaccca

SEQ ID NO: 1026367 - RNA, 24 nt, Human
cccuucucugcuauucucaccaac

SEQ ID NO: 1026368 - RNA, 22 nt, Human
ccggcggccucggguuccccuu

SEQ ID NO: 1026369 - RNA, 23 nt, Human
ccuacacaucuuguuucuggaca

SEQ ID NO: 1026370 - RNA, 20 nt, Human
ccuucucugcuauucucacc

SEQ ID NO: 1026371 - RNA, 24 nt, Human
cucugcuauucucaccaacuucag

SEQ ID NO: 1026372 - RNA, 24 nt, Human
cuguaguuuuuaugggcuuaagaa

SEQ ID NO: 1026373 - RNA, 22 nt, Human
cuuauggccuacacaucuuguu

SEQ ID NO: 1026374 - RNA, 24 nt, Human
cuucaaaccauaucagcacacuua

SEQ ID NO: 1026375 - RNA, 24 nt, Human
cuucaggcugauaaugcuguccau

SEQ ID NO: 1026376 - RNA, 23 nt, Human
cuuuauggccuaucuaguuuacu

SEQ ID NO: 1026377 - RNA, 18 nt, Human
gaaguccacucacaccuc

SEQ ID NO: 1026378 - RNA, 20 nt, Human
gaggaugaaagagagagaga

SEQ ID NO: 1026379 - RNA, 18 nt, Human
gaugaaagagagagagag

SEQ ID NO: 1026380 - RNA, 22 nt, Human
gccucggguuccccuugcugcc

SEQ ID NO: 1026381 - RNA, 21 nt, Human
gguaagagaggaugaaagaga

SEQ ID NO: 1026382 - RNA, 22 nt, Human
gucacaguggccucuuuucuuc

SEQ ID NO: 1026383 - RNA, 27 nt, Human
uaaaaaauaaaauuccuacauucugga

SEQ ID NO: 1026384 - RNA, 33 nt, Human
uaaacauaaaaaauaaaauuccuacauucuggu

SEQ ID NO: 1026385 - RNA, 20 nt, Human
uaagaagaagaccaccuugg

SEQ ID NO: 1026386 - RNA, 22 nt, Human
uaaguucccaucucuugacacu

SEQ ID NO: 1026387 - RNA, 19 nt, Human
uagcacuggcaucuggcaa

SEQ ID NO: 1026388 - RNA, 20 nt, Human
uaggaaaagaaucaaucaga

SEQ ID NO: 1026389 - RNA, 26 nt, Human
ucuaauacauaaacauuuggggacac

SEQ ID NO: 1026390 - RNA, 20 nt, Human
ucuguuccuucauccuuuga

SEQ ID NO: 1026391 - RNA, 22 nt, Human
ucuuacaguucugaaggcuggg

SEQ ID NO: 1026392 - RNA, 20 nt, Human
ucuuacaguucugaaggcuu

SEQ ID NO: 1026393 - RNA, 24 nt, Human
ugaaaaauuuaaacauaaaaaaua

SEQ ID NO: 1026394 - RNA, 24 nt, Human
ugaaacgcuccuuugguagccuua

SEQ ID NO: 1026395 - RNA, 22 nt, Human
ugagcuguccucaagucuugcu

SEQ ID NO: 1026396 - RNA, 24 nt, Human
uggaaggcagaaggguaagagagg

SEQ ID NO: 1026397 - RNA, 22 nt, Human
uggacacagcaucuuuauggcc

SEQ ID NO: 1026398 - RNA, 22 nt, Human
uggcaagggccuucaugcugca

SEQ ID NO: 1026399 - RNA, 18 nt, Human
uugugcuuaggaaaagaa

SEQ ID NO: 1026400 - RNA, 19 nt, Human
cacaccccggcauggcuuu

SEQ ID NO: 1026401 - RNA, 25 nt, Human
cauggcuuugguucugggaccgggc

SEQ ID NO: 1026402 - RNA, 24 nt, Human
ccacaccccggcauggcuuugguu

SEQ ID NO: 1026403 - RNA, 21 nt, Human
cccggcauggcuuugguucug

SEQ ID NO: 1026404 - RNA, 20 nt, Human
cggcauggcuuugguucugg

SEQ ID NO: 1026405 - RNA, 19 nt, Human
cggcucaggccggcugcga

SEQ ID NO: 1026406 - RNA, 21 nt, Human
ucccgcaaggcgagguccccu

SEQ ID NO: 1026407 - RNA, 20 nt, Human
ugcgaggcugggaggucggg

SEQ ID NO: 1026408 - RNA, 22 nt, Human
uggcuuugguucugggaccggg

SEQ ID NO: 1026409 - RNA, 25 nt, Human
uggggucccgcaaggcgaggucccc

SEQ ID NO: 1026410 - RNA, 22 nt, Human
uucacaggcacauguggcuuua

SEQ ID NO: 1026411 - RNA, 19 nt, Human
uuucacaggcacauguggc

SEQ ID NO: 1026412 - RNA, 21 nt, Human
uuuuuuuuuuuuuuucacagg

SEQ ID NO: 1026413 - RNA, 23 nt, Human
uuuuuuuuuuuuuuuuucacagg

SEQ ID NO: 1026414 - RNA, 19 nt, Human
aaagaagcaguccaggagg

SEQ ID NO: 1026415 - RNA, 24 nt, Human
aaucacuugaacccgggaggcgga

SEQ ID NO: 1026416 - RNA, 20 nt, Human
acagaucgagacuccgucuc

SEQ ID NO: 1026417 - RNA, 21 nt, Human
accagcguggccccagcuccu

SEQ ID NO: 1026418 - RNA, 18 nt, Human
acugcacuccagccuggg

SEQ ID NO: 1026419 - RNA, 24 nt, Human
acugcacuccagccugggugacag

SEQ ID NO: 1026420 - RNA, 18 nt, Human
agagccaaaagaagcagu

SEQ ID NO: 1026421 - RNA, 24 nt, Human
agccugggugacagaucgagacuc

SEQ ID NO: 1026422 - RNA, 19 nt, Human
agccuguaauuccagcuac

SEQ ID NO: 1026423 - RNA, 18 nt, Human
aggcaggagaaucacuug

SEQ ID NO: 1026424 - RNA, 24 nt, Human
aggcaggagaaucacuugaacccg

SEQ ID NO: 1026425 - RNA, 24 nt, Human
aggcggagguugcagugagccaag

SEQ ID NO: 1026426 - RNA, 24 nt, Human
aggcugaggcaggagaaucacuug

SEQ ID NO: 1026427 - RNA, 23 nt, Human
agguagacagccuguaauuccag

SEQ ID NO: 1026428 - RNA, 24 nt, Human
caagguugugccacugcacuccag

SEQ ID NO: 1026429 - RNA, 20 nt, Human
cacaggacuguccaugggcc

SEQ ID NO: 1026430 - RNA, 18 nt, Human
cacuccagccugggugac

SEQ ID NO: 1026431 - RNA, 24 nt, Human
cacuccagccugggugacagaucg

SEQ ID NO: 1026432 - RNA, 19 nt, Human
cacugcacuccagccuggg

SEQ ID NO: 1026433 - RNA, 21 nt, Human
cacugcacuccagccugggug

SEQ ID NO: 1026434 - RNA, 22 nt, Human
cacugcacuccagccuggguga

SEQ ID NO: 1026435 - RNA, 23 nt, Human
cacugcacuccagccugggugac

SEQ ID NO: 1026436 - RNA, 24 nt, Human
cacugcacuccagccugggugaca

SEQ ID NO: 1026437 - RNA, 25 nt, Human
cacugcacuccagccugggugacag

SEQ ID NO: 1026438 - RNA, 24 nt, Human
cagaaggcugaggcaggagaauca

SEQ ID NO: 1026439 - RNA, 24 nt, Human
cagcuacucagaaggcugaggcag

SEQ ID NO: 1026440 - RNA, 21 nt, Human
cauccagacacaggacugucc

SEQ ID NO: 1026441 - RNA, 20 nt, Human
ccacugcacuccagccuggg

SEQ ID NO: 1026442 - RNA, 20 nt, Human
ccacugcacuccagccuggg

SEQ ID NO: 1026443 - RNA, 20 nt, Human
ccacugcacuccagccuggg

SEQ ID NO: 1026444 - RNA, 21 nt, Human
ccacugcacuccagccugggu

SEQ ID NO: 1026445 - RNA, 21 nt, Human
ccacugcacuccagccugggu

SEQ ID NO: 1026446 - RNA, 24 nt, Human
ccacugcacuccagccugggugac

SEQ ID NO: 1026447 - RNA, 20 nt, Human
ccagcacugaguccuccuca

SEQ ID NO: 1026448 - RNA, 23 nt, Human
ccaucugccagcacugaguccuc

SEQ ID NO: 1026449 - RNA, 21 nt, Human
ccaugggccucucaggggucu

SEQ ID NO: 1026450 - RNA, 22 nt, Human
ccugggugacagaucgagacuc

SEQ ID NO: 1026451 - RNA, 21 nt, Human
ccuguaauuccagcuacucag

SEQ ID NO: 1026452 - RNA, 22 nt, Human
ccuguaauuccagcuacucaga

SEQ ID NO: 1026453 - RNA, 24 nt, Human
cgggaggcggagguugcagugagc

SEQ ID NO: 1026454 - RNA, 25 nt, Human
cuccucauccagacacaggacuguc

SEQ ID NO: 1026455 - RNA, 22 nt, Human
cugccagcacugaguccuccuc

SEQ ID NO: 1026456 - RNA, 20 nt, Human
cugcccuccagccugccagg

SEQ ID NO: 1026457 - RNA, 23 nt, Human
gagaaucacuugaacccgggagg

SEQ ID NO: 1026458 - RNA, 18 nt, Human
gagguugcagugagccaa

SEQ ID NO: 1026459 - RNA, 19 nt, Human
gagguugcagugagccaag

SEQ ID NO: 1026460 - RNA, 23 nt, Human
gagguugcagugagccaagguug

SEQ ID NO: 1026461 - RNA, 23 nt, Human
gcaggagaaucacuugaacccgg

SEQ ID NO: 1026462 - RNA, 19 nt, Human
gccacugcacuccagccug

SEQ ID NO: 1026463 - RNA, 24 nt, Human
gccacugcacuccagccuggguga

SEQ ID NO: 1026464 - RNA, 18 nt, Human
gcccuccagccugccagg

SEQ ID NO: 1026465 - RNA, 22 nt, Human
gcguggccccagcuccugcccu

SEQ ID NO: 1026466 - RNA, 23 nt, Human
gcuuccuucaggaggcagccagc

SEQ ID NO: 1026467 - RNA, 20 nt, Human
ggagguugcagugagccaag

SEQ ID NO: 1026468 - RNA, 20 nt, Human
ggagguugcagugagccaag

SEQ ID NO: 1026469 - RNA, 24 nt, Human
ggagguugcagugagccaagguug

SEQ ID NO: 1026470 - RNA, 22 nt, Human
gguagacagccuguaauuccag

SEQ ID NO: 1026471 - RNA, 24 nt, Human
guugugccacugcacuccagccug

SEQ ID NO: 1026472 - RNA, 23 nt, Human
uaucccagaccagcguggcccca

SEQ ID NO: 1026473 - RNA, 24 nt, Human
ucacuugaacccgggaggcggagg

SEQ ID NO: 1026474 - RNA, 19 nt, Human
ucauccagacacaggacug

SEQ ID NO: 1026475 - RNA, 24 nt, Human
uccagccugggugacagaucgaga

SEQ ID NO: 1026476 - RNA, 20 nt, Human
ucccagaccagcguggcccc

SEQ ID NO: 1026477 - RNA, 22 nt, Human
ucucaggggucuuuggggcccc

SEQ ID NO: 1026478 - RNA, 22 nt, Human
ugagccaagguugugccacugc

SEQ ID NO: 1026479 - RNA, 23 nt, Human
ugagccaagguugugccacugca

SEQ ID NO: 1026480 - RNA, 20 nt, Human
ugaggcaggagaaucacuug

SEQ ID NO: 1026481 - RNA, 24 nt, Human
ugaggcaggagaaucacuugaacc

SEQ ID NO: 1026482 - RNA, 25 nt, Human
ugaggcaggagaaucacuugaaccc

SEQ ID NO: 1026483 - RNA, 24 nt, Human
uugaacccgggaggcggagguugc

SEQ ID NO: 1026484 - RNA, 18 nt, Human
uugcagugagccaagguu

SEQ ID NO: 1026485 - RNA, 22 nt, Human
uugcagugagccaagguugugc

SEQ ID NO: 1026486 - RNA, 23 nt, Human
uugugccacugcacuccagccug

SEQ ID NO: 1026487 - RNA, 23 nt, Human
aaauaaucgacaaccuuuaaagc

SEQ ID NO: 1026488 - RNA, 24 nt, Human
aagcagaaggggaaaguuguccag

SEQ ID NO: 1026489 - RNA, 26 nt, Human
aagcagaaggggaaaguuguccagaa

SEQ ID NO: 1026490 - RNA, 20 nt, Human
aagugcugggacccacgggg

SEQ ID NO: 1026491 - RNA, 20 nt, Human
aucccagccccuucccugag

SEQ ID NO: 1026492 - RNA, 22 nt, Human
aucccagccccuucccugagcc

SEQ ID NO: 1026493 - RNA, 22 nt, Human
caaccuuuaaagcagaagggga

SEQ ID NO: 1026494 - RNA, 23 nt, Human
cagccucaaccaggcccccugua

SEQ ID NO: 1026495 - RNA, 22 nt, Human
cagcgaagcagcuuugguucuc

SEQ ID NO: 1026496 - RNA, 23 nt, Human
cagcuggcugagaccugccccuc

SEQ ID NO: 1026497 - RNA, 25 nt, Human
caggcccccuguaccugucccuaug

SEQ ID NO: 1026498 - RNA, 23 nt, Human
caucccaggagggucucccugga

SEQ ID NO: 1026499 - RNA, 21 nt, Human
ccauggcaauaagguuucccc

SEQ ID NO: 1026500 - RNA, 20 nt, Human
cccagccccuucccugagcc

SEQ ID NO: 1026501 - RNA, 25 nt, Human
cccugagccccggccucucaggccc

SEQ ID NO: 1026502 - RNA, 19 nt, Human
ccggccucucaggcccauc

SEQ ID NO: 1026503 - RNA, 22 nt, Human
ccuccagccucaaccaggcccc

SEQ ID NO: 1026504 - RNA, 22 nt, Human
ccugagccccggccucucaggc

SEQ ID NO: 1026505 - RNA, 20 nt, Human
cuggcugagaccugccccuc

SEQ ID NO: 1026506 - RNA, 20 nt, Human
cugggguugggguuggggcu

SEQ ID NO: 1026507 - RNA, 19 nt, Human
gagccacacucuccugagg

SEQ ID NO: 1026508 - RNA, 18 nt, Human
gcccccuguaccuguccc

SEQ ID NO: 1026509 - RNA, 21 nt, Human
gccuggggaagggguggcuuc

SEQ ID NO: 1026510 - RNA, 20 nt, Human
ggccgugucuguccucagag

SEQ ID NO: 1026511 - RNA, 19 nt, Human
ggcugagaccugccccucc

SEQ ID NO: 1026512 - RNA, 19 nt, Human
ggcugggguugggguuggg

SEQ ID NO: 1026513 - RNA, 23 nt, Human
gggguugggguuggggcugaggu

SEQ ID NO: 1026514 - RNA, 23 nt, Human
ggguugggguuggggcugaggug

SEQ ID NO: 1026515 - RNA, 20 nt, Human
ggucucggagcuucuuggcc

SEQ ID NO: 1026516 - RNA, 20 nt, Human
gguugggguuggggcugagg

SEQ ID NO: 1026517 - RNA, 18 nt, Human
gucagcuggggcagggga

SEQ ID NO: 1026518 - RNA, 18 nt, Human
guggaagugcugggaccc

SEQ ID NO: 1026519 - RNA, 20 nt, Human
ucaggcccaucccaggaggg

SEQ ID NO: 1026520 - RNA, 22 nt, Human
uccccagcuggcugagaccugc

SEQ ID NO: 1026521 - RNA, 20 nt, Human
ucccuuggggccugucuugc

SEQ ID NO: 1026522 - RNA, 24 nt, Human
ugaccuccagccucaaccaggccc

SEQ ID NO: 1026523 - RNA, 20 nt, Human
ugaggcuuugacccgucagc

SEQ ID NO: 1026524 - RNA, 26 nt, Human
uggggcaggggaugcggcugggguug

SEQ ID NO: 1026525 - RNA, 19 nt, Human
ugggggagggucugggcug

SEQ ID NO: 1026526 - RNA, 22 nt, Human
ugggggagggucugggcugggc

SEQ ID NO: 1026527 - RNA, 19 nt, Human
ugggguugggguuggggcu

SEQ ID NO: 1026528 - RNA, 22 nt, Human
ugucuugccuggggaaggggug

SEQ ID NO: 1026529 - RNA, 25 nt, Human
uuccccagcuggcugagaccugccc

SEQ ID NO: 1026530 - RNA, 21 nt, Human
uugccuggggaagggguggcu

SEQ ID NO: 1026531 - RNA, 27 nt, Human
uuggggcagcgggucuagacuuuucuc

SEQ ID NO: 1026532 - RNA, 18 nt, Human
aagaaaccccaacguuuc

SEQ ID NO: 1026533 - RNA, 20 nt, Human
aagaacgccauuugaggacu

SEQ ID NO: 1026534 - RNA, 24 nt, Human
acucugaaacccccaaaaagacug

SEQ ID NO: 1026535 - RNA, 20 nt, Human
acugguguguggggguaugu

SEQ ID NO: 1026536 - RNA, 18 nt, Human
agagcaucacauguacaa

SEQ ID NO: 1026537 - RNA, 19 nt, Human
agcagccacccuacccagu

SEQ ID NO: 1026538 - RNA, 19 nt, Human
agccagccgccuggagccc

SEQ ID NO: 1026539 - RNA, 18 nt, Human
agcuugcugaggcugucu

SEQ ID NO: 1026540 - RNA, 22 nt, Human
aggcaggggcucucuaggaguu

SEQ ID NO: 1026541 - RNA, 22 nt, Human
aggggaggcgggguguaguugg

SEQ ID NO: 1026542 - RNA, 18 nt, Human
aggguaugaucucaaugu

SEQ ID NO: 1026543 - RNA, 25 nt, Human
agugaaacacagggcugacaaccca

SEQ ID NO: 1026544 - RNA, 19 nt, Human
aucccaggcccucagcucu

SEQ ID NO: 1026545 - RNA, 19 nt, Human
aucucagcagccacccuac

SEQ ID NO: 1026546 - RNA, 23 nt, Human
caauagcuuauccaggcccccaa

SEQ ID NO: 1026547 - RNA, 21 nt, Human
cacacagacaagguguaugca

SEQ ID NO: 1026548 - RNA, 20 nt, Human
cacccccuuccuucuucucc

SEQ ID NO: 1026549 - RNA, 22 nt, Human
cacccccuuccuucuucuccca

SEQ ID NO: 1026550 - RNA, 18 nt, Human
caccugccagcacaugcc

SEQ ID NO: 1026551 - RNA, 22 nt, Human
caccugccaugucugccauccc

SEQ ID NO: 1026552 - RNA, 19 nt, Human
cacuccacauccuuggcca

SEQ ID NO: 1026553 - RNA, 20 nt, Human
cacuuauguuuuaacagagc

SEQ ID NO: 1026554 - RNA, 23 nt, Human
cagaaagugcugcaauagcuuau

SEQ ID NO: 1026555 - RNA, 20 nt, Human
cagaauguggccgacaaggc

SEQ ID NO: 1026556 - RNA, 24 nt, Human
caggaaagcuacugaggcugcugu

SEQ ID NO: 1026557 - RNA, 20 nt, Human
caggaugcaacacccagcuc

SEQ ID NO: 1026558 - RNA, 20 nt, Human
caggaugcaacacccagcuc

SEQ ID NO: 1026559 - RNA, 23 nt, Human
cagggugagcaccggcaccugcc

SEQ ID NO: 1026560 - RNA, 24 nt, Human
cagugagagcagagucuguccccu

SEQ ID NO: 1026561 - RNA, 19 nt, Human
caugucugccaucccaccc

SEQ ID NO: 1026562 - RNA, 24 nt, Human
ccacacagacaagguguaugcaag

SEQ ID NO: 1026563 - RNA, 26 nt, Human
ccacauccuuggccacuuuuugagaa

SEQ ID NO: 1026564 - RNA, 23 nt, Human
ccacccccuuccuucuucuccca

SEQ ID NO: 1026565 - RNA, 25 nt, Human
ccaccugccagcacaugcccacucc

SEQ ID NO: 1026566 - RNA, 23 nt, Human
ccacucugaaacccccaaaaaga

SEQ ID NO: 1026567 - RNA, 20 nt, Human
ccagaaaaaaaaauauggca

SEQ ID NO: 1026568 - RNA, 19 nt, Human
ccaggcccucagcucugcc

SEQ ID NO: 1026569 - RNA, 22 nt, Human
cccacugguuccuggaucccag

SEQ ID NO: 1026570 - RNA, 23 nt, Human
cccagaaaaaaaaauauggcaau

SEQ ID NO: 1026571 - RNA, 22 nt, Human
cccaggaugcaacacccagcuc

SEQ ID NO: 1026572 - RNA, 18 nt, Human
cccaggcccucagcucug

SEQ ID NO: 1026573 - RNA, 20 nt, Human
cccaggcccucagcucugcc

SEQ ID NO: 1026574 - RNA, 23 nt, Human
cccauccaggagaggcaagggaa

SEQ ID NO: 1026575 - RNA, 21 nt, Human
ccccauggccagugacaugcu

SEQ ID NO: 1026576 - RNA, 23 nt, Human
cccccauggccagugacaugcuc

SEQ ID NO: 1026577 - RNA, 20 nt, Human
ccccuuggccaggucaccac

SEQ ID NO: 1026578 - RNA, 25 nt, Human
cccuuggccaggucaccacuagagc

SEQ ID NO: 1026579 - RNA, 22 nt, Human
ccuucuucucccauccaauccc

SEQ ID NO: 1026580 - RNA, 18 nt, Human
cuacaaggguggggcugu

SEQ ID NO: 1026581 - RNA, 18 nt, Human
cuaggaguucacgggcag

SEQ ID NO: 1026582 - RNA, 19 nt, Human
cugacccuuuccuaccaaa

SEQ ID NO: 1026583 - RNA, 21 nt, Human
cuucucggcacauacugcuag

SEQ ID NO: 1026584 - RNA, 20 nt, Human
gaccugcaucucagcagcca

SEQ ID NO: 1026585 - RNA, 23 nt, Human
gaccugcaucucagcagccaccc

SEQ ID NO: 1026586 - RNA, 21 nt, Human
gacugguguguggggguaugu

SEQ ID NO: 1026587 - RNA, 19 nt, Human
gaggagaugcucaauggcu

SEQ ID NO: 1026588 - RNA, 20 nt, Human
gaggagaugcucaauggcuu

SEQ ID NO: 1026589 - RNA, 23 nt, Human
gcaccugccaugucugccauccc

SEQ ID NO: 1026590 - RNA, 24 nt, Human
gccacccuacccagugaccaggag

SEQ ID NO: 1026591 - RNA, 23 nt, Human
ggccacuuuuugagaaagcaagc

SEQ ID NO: 1026592 - RNA, 23 nt, Human
ggccuggagccuuccccugccuc

SEQ ID NO: 1026593 - RNA, 20 nt, Human
ggcgggguguaguuggggaa

SEQ ID NO: 1026594 - RNA, 18 nt, Human
gggaacaggcuccugggg

SEQ ID NO: 1026595 - RNA, 20 nt, Human
gggaggcgggguguaguugg

SEQ ID NO: 1026596 - RNA, 19 nt, Human
gggcagggugagcaccggc

SEQ ID NO: 1026597 - RNA, 19 nt, Human
ggggaacugcuccagguug

SEQ ID NO: 1026598 - RNA, 18 nt, Human
gggggugacgggccaccc

SEQ ID NO: 1026599 - RNA, 18 nt, Human
gggugugcagccagccgc

SEQ ID NO: 1026600 - RNA, 20 nt, Human
ggugauggcaggcagggugu

SEQ ID NO: 1026601 - RNA, 24 nt, Human
gugaaagccucagaaagugcugca

SEQ ID NO: 1026602 - RNA, 18 nt, Human
gugcagccagccgccugg

SEQ ID NO: 1026603 - RNA, 19 nt, Human
uaacagagcaucacaugua

SEQ ID NO: 1026604 - RNA, 18 nt, Human
uaagggcauguguccacu

SEQ ID NO: 1026605 - RNA, 20 nt, Human
uagagcagaugaggggaggc

SEQ ID NO: 1026606 - RNA, 18 nt, Human
uagcuuauccaggccccc

SEQ ID NO: 1026607 - RNA, 18 nt, Human
ucaagaagaggagaugcu

SEQ ID NO: 1026608 - RNA, 19 nt, Human
ucaauguaaaagagggaaa

SEQ ID NO: 1026609 - RNA, 24 nt, Human
ucacagugaaacacagggcugaca

SEQ ID NO: 1026610 - RNA, 23 nt, Human
ucaccuacgaagagaguaagccu

SEQ ID NO: 1026611 - RNA, 22 nt, Human
ucacuggaggaagaaaccccaa

SEQ ID NO: 1026612 - RNA, 18 nt, Human
ucagucgguuucuccggc

SEQ ID NO: 1026613 - RNA, 22 nt, Human
ucccaggcccucagcucugccc

SEQ ID NO: 1026614 - RNA, 24 nt, Human
uccuggaucccaggcccucagcuc

SEQ ID NO: 1026615 - RNA, 23 nt, Human
uccuucuucucccauccaauccc

SEQ ID NO: 1026616 - RNA, 24 nt, Human
ucuaggaguucacgggcaggguga

SEQ ID NO: 1026617 - RNA, 24 nt, Human
ucucccagaaaaaaaaauauggca

SEQ ID NO: 1026618 - RNA, 21 nt, Human
ucuccggccacucugaaaccc

SEQ ID NO: 1026619 - RNA, 20 nt, Human
ucugaaacccccaaaaagac

SEQ ID NO: 1026620 - RNA, 20 nt, Human
ucugucaagugagaaacuga

SEQ ID NO: 1026621 - RNA, 20 nt, Human
ugaaacacagggcugacaac

SEQ ID NO: 1026622 - RNA, 21 nt, Human
ugaaacccccaaaaagacugg

SEQ ID NO: 1026623 - RNA, 24 nt, Human
ugaauuggucacagugaaacacag

SEQ ID NO: 1026624 - RNA, 19 nt, Human
ugagagcagagucuguccc

SEQ ID NO: 1026625 - RNA, 22 nt, Human
ugagagcagagucuguccccuc

SEQ ID NO: 1026626 - RNA, 20 nt, Human
ugcagccagccgccuggagc

SEQ ID NO: 1026627 - RNA, 21 nt, Human
ugcagccagccgccuggagcc

SEQ ID NO: 1026628 - RNA, 23 nt, Human
ugcccacuccacauccuuggcca

SEQ ID NO: 1026629 - RNA, 24 nt, Human
ugcccacuccacauccuuggccac

SEQ ID NO: 1026630 - RNA, 21 nt, Human
ugguccaggacaagcaggggc

SEQ ID NO: 1026631 - RNA, 22 nt, Human
ugguuccuggaucccaggcccu

SEQ ID NO: 1026632 - RNA, 24 nt, Human
uucucccuacagugaaagccucag

SEQ ID NO: 1026633 - RNA, 18 nt, Human
uuucuccggccacucuga

SEQ ID NO: 1026634 - RNA, 23 nt, Human
uuuuuuuuuuuuuuuuuuaaaug

SEQ ID NO: 1026635 - RNA, 24 nt, Human
aaaaacgacaagagggcuccaccu

SEQ ID NO: 1026636 - RNA, 27 nt, Human
aaaaacgacaagagggcuccaccuggc

SEQ ID NO: 1026637 - RNA, 18 nt, Human
aaacgacaagagggcucc

SEQ ID NO: 1026638 - RNA, 24 nt, Human
aaaggagaagccacugcagcugcc

SEQ ID NO: 1026639 - RNA, 22 nt, Human
aaaggcgagcagacacugguca

SEQ ID NO: 1026640 - RNA, 22 nt, Human
aaccagaagcaccaggaagccu

SEQ ID NO: 1026641 - RNA, 21 nt, Human
accccauaaagguuuaaagaa

SEQ ID NO: 1026642 - RNA, 22 nt, Human
accccauaaagguuuaaagaau

SEQ ID NO: 1026643 - RNA, 23 nt, Human
agcaccaggaagccugggaaagg

SEQ ID NO: 1026644 - RNA, 20 nt, Human
aggcaggcauccacacgucc

SEQ ID NO: 1026645 - RNA, 24 nt, Human
aguggcguggggaaccagaagcac

SEQ ID NO: 1026646 - RNA, 25 nt, Human
caaaaacgacaagagggcuccaccu

SEQ ID NO: 1026647 - RNA, 23 nt, Human
caacgucuccucaucugacaucc

SEQ ID NO: 1026648 - RNA, 18 nt, Human
cacagagccgacugcagc

SEQ ID NO: 1026649 - RNA, 18 nt, Human
cacagcacagggcagggc

SEQ ID NO: 1026650 - RNA, 19 nt, Human
cacagcacagggcagggca

SEQ ID NO: 1026651 - RNA, 23 nt, Human
caccuggccccugcaccccacgu

SEQ ID NO: 1026652 - RNA, 24 nt, Human
cacugcagcugccccagacacccc

SEQ ID NO: 1026653 - RNA, 22 nt, Human
cagcacagggcagggcaggcag

SEQ ID NO: 1026654 - RNA, 23 nt, Human
cagcugccccagacaccccaccc

SEQ ID NO: 1026655 - RNA, 18 nt, Human
caggacggggagugaagg

SEQ ID NO: 1026656 - RNA, 23 nt, Human
cagggcagggcaggcaggcaucc

SEQ ID NO: 1026657 - RNA, 26 nt, Human
cauccacacguccugcccaccaccau

SEQ ID NO: 1026658 - RNA, 19 nt, Human
cauuggcagacagcuucug

SEQ ID NO: 1026659 - RNA, 18 nt, Human
cauuugggauccagcguc

SEQ ID NO: 1026660 - RNA, 22 nt, Human
ccagaagcaccaggaagccugg

SEQ ID NO: 1026661 - RNA, 20 nt, Human
ccagacuagagaaggcaugg

SEQ ID NO: 1026662 - RNA, 21 nt, Human
ccagcgucccugaggccagga

SEQ ID NO: 1026663 - RNA, 20 nt, Human
ccccugcaccccacgugugu

SEQ ID NO: 1026664 - RNA, 20 nt, Human
ccccugcaccccacgugugu

SEQ ID NO: 1026665 - RNA, 22 nt, Human
cccucagccacacaggcacucc

SEQ ID NO: 1026666 - RNA, 19 nt, Human
cccucuucccuuuuauucc

SEQ ID NO: 1026667 - RNA, 19 nt, Human
cccugaggccaggacggag

SEQ ID NO: 1026668 - RNA, 19 nt, Human
ccuccaaaugccccucucc

SEQ ID NO: 1026669 - RNA, 19 nt, Human
ccugaggccaggacggagg

SEQ ID NO: 1026670 - RNA, 18 nt, Human
ccugcccaccaccauccc

SEQ ID NO: 1026671 - RNA, 26 nt, Human
cuccacagcacagggcagggcaggca

SEQ ID NO: 1026672 - RNA, 22 nt, Human
cucuccugccauucagcuuuaa

SEQ ID NO: 1026673 - RNA, 19 nt, Human
gagccuccaaaugccccuc

SEQ ID NO: 1026674 - RNA, 20 nt, Human
gaggcugcagggcagaaggc

SEQ ID NO: 1026675 - RNA, 21 nt, Human
gcagcugccccagacacccca

SEQ ID NO: 1026676 - RNA, 20 nt, Human
gcagggagggagccuccaaa

SEQ ID NO: 1026677 - RNA, 20 nt, Human
gccccagacaccccacccca

SEQ ID NO: 1026678 - RNA, 20 nt, Human
gccccucuccugccauucag

SEQ ID NO: 1026679 - RNA, 20 nt, Human
ggacggggagugaaggcagg

SEQ ID NO: 1026680 - RNA, 19 nt, Human
ggcacugaccccugcccag

SEQ ID NO: 1026681 - RNA, 18 nt, Human
ggugcagugugcgaccug

SEQ ID NO: 1026682 - RNA, 21 nt, Human
guccgguggaggcgugugacu

SEQ ID NO: 1026683 - RNA, 19 nt, Human
uagauaacaaaaacgacaa

SEQ ID NO: 1026684 - RNA, 24 nt, Human
uagauaacaaaaacgacaagaggg

SEQ ID NO: 1026685 - RNA, 23 nt, Human
uccaaaugccccucuccugccau

SEQ ID NO: 1026686 - RNA, 24 nt, Human
uccaaaugccccucuccugccauu

SEQ ID NO: 1026687 - RNA, 24 nt, Human
uccacagcacagggcagggcaggc

SEQ ID NO: 1026688 - RNA, 18 nt, Human
uccugcccaccaccaucc

SEQ ID NO: 1026689 - RNA, 23 nt, Human
uccugcccaccaccaucccgcag

SEQ ID NO: 1026690 - RNA, 25 nt, Human
ucgaggcggcagcaguuucuauaag

SEQ ID NO: 1026691 - RNA, 24 nt, Human
ucgcaggcgcauuggcagacagcu

SEQ ID NO: 1026692 - RNA, 20 nt, Human
ugaaggcagggagggagccu

SEQ ID NO: 1026693 - RNA, 19 nt, Human
ugaccugguuaccuacuga

SEQ ID NO: 1026694 - RNA, 20 nt, Human
ugaugagcucaacgucuccu

SEQ ID NO: 1026695 - RNA, 20 nt, Human
ugauguuguaagacuucuca

SEQ ID NO: 1026696 - RNA, 24 nt, Human
ugcgaccugcgcucuccacagcac

SEQ ID NO: 1026697 - RNA, 20 nt, Human
uguccacaaccacagagccg

SEQ ID NO: 1026698 - RNA, 25 nt, Human
uuuuuuuuuuuuuuuuuuuuccagg

SEQ ID NO: 1026699 - RNA, 19 nt, Human
ccacaaaguaaagaaaguu

SEQ ID NO: 1026700 - RNA, 22 nt, Human
uauuuuuauuauuguuaaaaau

SEQ ID NO: 1026701 - RNA, 20 nt, Human
ugaggaacacaaccacaaag

SEQ ID NO: 1026702 - RNA, 23 nt, Human
uguuaaaaauucucauuuugagg

SEQ ID NO: 1026703 - RNA, 24 nt, Human
aaaaggcaaaacaaugcacagaac

SEQ ID NO: 1026704 - RNA, 18 nt, Human
aaagaaucaggagcuuga

SEQ ID NO: 1026705 - RNA, 21 nt, Human
aacuugcauuuuuauuuuuua

SEQ ID NO: 1026706 - RNA, 19 nt, Human
aagaaucaggagcuugaaa

SEQ ID NO: 1026707 - RNA, 24 nt, Human
aauguuuuuaaagcuguucaugau

SEQ ID NO: 1026708 - RNA, 25 nt, Human
acugauuguauccugaaggaaucac

SEQ ID NO: 1026709 - RNA, 22 nt, Human
agauguguuuuuauuucucacu

SEQ ID NO: 1026710 - RNA, 19 nt, Human
aucacaggucuuggcaagg

SEQ ID NO: 1026711 - RNA, 18 nt, Human
cacuccauaacccccagc

SEQ ID NO: 1026712 - RNA, 22 nt, Human
caugauuuaguagaaagaauca

SEQ ID NO: 1026713 - RNA, 21 nt, Human
ccaggauucccacuucccaag

SEQ ID NO: 1026714 - RNA, 18 nt, Human
cccggagucggggccggg

SEQ ID NO: 1026715 - RNA, 22 nt, Human
ccugugucaaggccuuuugagc

SEQ ID NO: 1026716 - RNA, 18 nt, Human
cuuggcaaggucaaguca

SEQ ID NO: 1026717 - RNA, 18 nt, Human
gaaacgguuacccucgug

SEQ ID NO: 1026718 - RNA, 25 nt, Human
gagucggggccgggcgcgcgggaaa

SEQ ID NO: 1026719 - RNA, 18 nt, Human
gccaugggggcugccggc

SEQ ID NO: 1026720 - RNA, 22 nt, Human
ggcaaaacaaugcacagaacaa

SEQ ID NO: 1026721 - RNA, 27 nt, Human
uaaaaaggcaaaacaaugcacagaaca

SEQ ID NO: 1026722 - RNA, 24 nt, Human
uaauuuaaaaaggcaaaacaaugc

SEQ ID NO: 1026723 - RNA, 21 nt, Human
ucuguugcucuuuuucugagg

SEQ ID NO: 1026724 - RNA, 21 nt, Human
ucuuggcaaggucaagucacc

SEQ ID NO: 1026725 - RNA, 24 nt, Human
ugcagguucccugugucaaggccu

SEQ ID NO: 1026726 - RNA, 21 nt, Human
ugucaaggccuuuugagccac

SEQ ID NO: 1026727 - RNA, 22 nt, Human
ugucaaggccuuuugagccacu

SEQ ID NO: 1026728 - RNA, 24 nt, Human
uuaaagcuguucaugauuuaguag

SEQ ID NO: 1026729 - RNA, 23 nt, Human
uugaaacaauuacuucuguugcu

SEQ ID NO: 1026730 - RNA, 19 nt, Human
uuuuuuuauuauugaaaua

SEQ ID NO: 1026731 - RNA, 23 nt, Human
aaaaaaacagacugugaacacca

SEQ ID NO: 1026732 - RNA, 24 nt, Human
aaaaaaacagacugugaacaccaa

SEQ ID NO: 1026733 - RNA, 26 nt, Human
aaaaaaacagacugugaacaccaaag

SEQ ID NO: 1026734 - RNA, 20 nt, Human
aaaaauaccgcaaucuggac

SEQ ID NO: 1026735 - RNA, 20 nt, Human
aaaauaccgcaaucuggaca

SEQ ID NO: 1026736 - RNA, 29 nt, Human
aacaaaaaaacagacugugaacaccaaag

SEQ ID NO: 1026737 - RNA, 21 nt, Human
aagacaaauaucaacaaaugu

SEQ ID NO: 1026738 - RNA, 20 nt, Human
acaacaaaaaaacagacugu

SEQ ID NO: 1026739 - RNA, 23 nt, Human
acacagacucaaauagagaacca

SEQ ID NO: 1026740 - RNA, 23 nt, Human
agcucaaaacaagaguuugacaa

SEQ ID NO: 1026741 - RNA, 23 nt, Human
aggguagcuuacuuaggugacac

SEQ ID NO: 1026742 - RNA, 23 nt, Human
caaaaaaacagacugugaacacc

SEQ ID NO: 1026743 - RNA, 25 nt, Human
caaaaaaacagacugugaacaccaa

SEQ ID NO: 1026744 - RNA, 18 nt, Human
caaagcacuacucagggc

SEQ ID NO: 1026745 - RNA, 24 nt, Human
caaauagagaaccauauauuuaaa

SEQ ID NO: 1026746 - RNA, 19 nt, Human
cacagguuuguuucuucac

SEQ ID NO: 1026747 - RNA, 23 nt, Human
cacucagccuccuucccaaacac

SEQ ID NO: 1026748 - RNA, 21 nt, Human
cagccuccuucccaaacacag

SEQ ID NO: 1026749 - RNA, 24 nt, Human
cagcucaaaacaagaguuugacaa

SEQ ID NO: 1026750 - RNA, 20 nt, Human
caguagucacucagccuccu

SEQ ID NO: 1026751 - RNA, 23 nt, Human
ccaaagcacuacucagggcucuu

SEQ ID NO: 1026752 - RNA, 22 nt, Human
ccacaaaaugauccagcucaaa

SEQ ID NO: 1026753 - RNA, 23 nt, Human
ccaguagucacucagccuccuuc

SEQ ID NO: 1026754 - RNA, 21 nt, Human
cuccucccguagucuaaaccu

SEQ ID NO: 1026755 - RNA, 24 nt, Human
cuccucccguagucuaaaccucaa

SEQ ID NO: 1026756 - RNA, 22 nt, Human
uaauauacuccucccguagucu

SEQ ID NO: 1026757 - RNA, 20 nt, Human
uagcuuacuuaggugacaca

SEQ ID NO: 1026758 - RNA, 19 nt, Human
ucacagguuuguuucuuca

SEQ ID NO: 1026759 - RNA, 31 nt, Human
ucagcauuaaaaaauauaaguuacaacaaag

SEQ ID NO: 1026760 - RNA, 20 nt, Human
ucuuugggaacauaaggcug

SEQ ID NO: 1026761 - RNA, 20 nt, Human
ugugaacaccaaagcacuac

SEQ ID NO: 1026762 - RNA, 24 nt, Human
uuucaguuuugauauucauuuggc

SEQ ID NO: 1026763 - RNA, 21 nt, Human
uuuucaguuuugauauucauu

SEQ ID NO: 1026764 - RNA, 18 nt, Human
aaaaacaaaacagagaaa

SEQ ID NO: 1026765 - RNA, 25 nt, Human
aaaacaaaacagagaaaaugacaag

SEQ ID NO: 1026766 - RNA, 27 nt, Human
aaacauacaaaaacaaaacagagaaaa

SEQ ID NO: 1026767 - RNA, 24 nt, Human
aacaaaacagagaaaaugacaagc

SEQ ID NO: 1026768 - RNA, 19 nt, Human
aacagagaaaaugacaagc

SEQ ID NO: 1026769 - RNA, 24 nt, Human
aagaacuggagaucagcaguuacu

SEQ ID NO: 1026770 - RNA, 21 nt, Human
aagcggccuacaaaauggagu

SEQ ID NO: 1026771 - RNA, 20 nt, Human
acaaaaacaaaacagagaaa

SEQ ID NO: 1026772 - RNA, 22 nt, Human
acaaauaagcggccuacaaaau

SEQ ID NO: 1026773 - RNA, 22 nt, Human
acauagcucuccucuuucgucu

SEQ ID NO: 1026774 - RNA, 21 nt, Human
acugcuggaggcugagcgacc

SEQ ID NO: 1026775 - RNA, 21 nt, Human
agggagacuguuacaucgggg

SEQ ID NO: 1026776 - RNA, 21 nt, Human
auccuuaccaguugacuacag

SEQ ID NO: 1026777 - RNA, 21 nt, Human
auuuuuuuuucuuccuuuuaa

SEQ ID NO: 1026778 - RNA, 22 nt, Human
caaaaacaacuuaauuaagccc

SEQ ID NO: 1026779 - RNA, 25 nt, Human
caaaaacacagcgaaguuggagacc

SEQ ID NO: 1026780 - RNA, 21 nt, Human
caaaauggagucgcagccguc

SEQ ID NO: 1026781 - RNA, 26 nt, Human
caaauaagcggccuacaaaauggagu

SEQ ID NO: 1026782 - RNA, 24 nt, Human
cacaaaacauagcucuccucuuuc

SEQ ID NO: 1026783 - RNA, 23 nt, Human
caccggaacccuccaagaacugg

SEQ ID NO: 1026784 - RNA, 23 nt, Human
caccggaacccuccaagaacugg

SEQ ID NO: 1026785 - RNA, 18 nt, Human
cacugaccauaagggaga

SEQ ID NO: 1026786 - RNA, 18 nt, Human
cauacaaaaacaaaacag

SEQ ID NO: 1026787 - RNA, 26 nt, Human
ccacaaaaacaacuuaauuaagcccc

SEQ ID NO: 1026788 - RNA, 21 nt, Human
ccaucuuccaucuccaacugu

SEQ ID NO: 1026789 - RNA, 22 nt, Human
ccgcaguaggggcguucuucuc

SEQ ID NO: 1026790 - RNA, 24 nt, Human
ccuccaaucugacaggucuacuac

SEQ ID NO: 1026791 - RNA, 23 nt, Human
ccuccugccgcuuccucaguacc

SEQ ID NO: 1026792 - RNA, 23 nt, Human
cgaggccaugcccaacauuucaa

SEQ ID NO: 1026793 - RNA, 20 nt, Human
cggaacccuccaagaacugg

SEQ ID NO: 1026794 - RNA, 20 nt, Human
cgggaagaaucgccguggau

SEQ ID NO: 1026795 - RNA, 21 nt, Human
cguggaugcacacaaauaagc

SEQ ID NO: 1026796 - RNA, 18 nt, Human
cuccuccugccgcuuccu

SEQ ID NO: 1026797 - RNA, 21 nt, Human
cuccuccugccgcuuccucag

SEQ ID NO: 1026798 - RNA, 21 nt, Human
cuguagacugucucuuccaug

SEQ ID NO: 1026799 - RNA, 21 nt, Human
cuucacaacucugcgggaaga

SEQ ID NO: 1026800 - RNA, 18 nt, Human
cuuccaugccauucucug

SEQ ID NO: 1026801 - RNA, 18 nt, Human
cuuuuccuuucuccggcc

SEQ ID NO: 1026802 - RNA, 22 nt, Human
cuuuugacuuugaccuccaauc

SEQ ID NO: 1026803 - RNA, 21 nt, Human
gcccaacauuucaaaaacaca

SEQ ID NO: 1026804 - RNA, 18 nt, Human
gggguaaaaaacauacaa

SEQ ID NO: 1026805 - RNA, 26 nt, Human
uaaaaaacauacaaaaacaaaacaga

SEQ ID NO: 1026806 - RNA, 22 nt, Human
uaacacacacaggaggggcuuu

SEQ ID NO: 1026807 - RNA, 19 nt, Human
uacaucgggguaaaaaaca

SEQ ID NO: 1026808 - RNA, 21 nt, Human
uacccugaugaacuggaagag

SEQ ID NO: 1026809 - RNA, 25 nt, Human
uacuuuugacuuugaccuccaaucu

SEQ ID NO: 1026810 - RNA, 24 nt, Human
uauacaaaaccaucuuccaucucc

SEQ ID NO: 1026811 - RNA, 26 nt, Human
uauaucagacaaugugccacaaaaca

SEQ ID NO: 1026812 - RNA, 21 nt, Human
ucacaaagguaacagcaaaau

SEQ ID NO: 1026813 - RNA, 24 nt, Human
ucaccaggcucaaccaaguagcgu

SEQ ID NO: 1026814 - RNA, 21 nt, Human
ugaacuggaagagacuuucca

SEQ ID NO: 1026815 - RNA, 18 nt, Human
ugaccauaagggagacug

SEQ ID NO: 1026816 - RNA, 22 nt, Human
ugccccuauaaugugugagggu

SEQ ID NO: 1026817 - RNA, 19 nt, Human
uggaagauucugaucccac

SEQ ID NO: 1026818 - RNA, 23 nt, Human
ugucucuuccaugccauucucug

SEQ ID NO: 1026819 - RNA, 18 nt, Human
ugugaaccaccgaucucc

SEQ ID NO: 1026820 - RNA, 20 nt, Human
uguuccaaaaaacaaucagg

SEQ ID NO: 1026821 - RNA, 21 nt, Human
uuaauacauucuucaccaggc

SEQ ID NO: 1026822 - RNA, 22 nt, Human
uuccaaaaaacaaucaggucac

SEQ ID NO: 1026823 - RNA, 21 nt, Human
uuccaaaaccaaacacauuug

SEQ ID NO: 1026824 - RNA, 22 nt, Human
uuccaucuccaacugucuucuc

SEQ ID NO: 1026825 - RNA, 24 nt, Human
uuuccaggcccugauaaugucuuu

SEQ ID NO: 1026826 - RNA, 22 nt, Human
uuugauaaucuaaauccauauc

SEQ ID NO: 1026827 - RNA, 18 nt, Human
cagcugcucgacuccuag

SEQ ID NO: 1026828 - RNA, 24 nt, Human
cgacuccuagucucuuccacuccu

SEQ ID NO: 1026829 - RNA, 23 nt, Human
ugcucgacuccuagucucuucca

SEQ ID NO: 1026830 - RNA, 19 nt, Human
ugugcugagccgcagcugc

SEQ ID NO: 1026831 - RNA, 25 nt, Human
aaaaaaaaaaaaaaaaagaaaagaa

SEQ ID NO: 1026832 - RNA, 22 nt, Human
aagaaaagaaaucacacaaugu

SEQ ID NO: 1026833 - RNA, 24 nt, Human
acaauguuaaaagcaaagauucac

SEQ ID NO: 1026834 - RNA, 23 nt, Human
acccauuuggccccagaagcccu

SEQ ID NO: 1026835 - RNA, 20 nt, Human
agcagguggauuucuccuac

SEQ ID NO: 1026836 - RNA, 23 nt, Human
agcucgcgcuguuaccucaagcc

SEQ ID NO: 1026837 - RNA, 22 nt, Human
cagaagcccugcggacagagaa

SEQ ID NO: 1026838 - RNA, 19 nt, Human
cagccucagcucgcgcugu

SEQ ID NO: 1026839 - RNA, 20 nt, Human
cagcggugcccucccucucc

SEQ ID NO: 1026840 - RNA, 22 nt, Human
caggcaaggaaccuggagucca

SEQ ID NO: 1026841 - RNA, 21 nt, Human
cagguggauuucuccuacucu

SEQ ID NO: 1026842 - RNA, 18 nt, Human
ccacacucagcccccagc

SEQ ID NO: 1026843 - RNA, 19 nt, Human
ccagcagguggauuucucc

SEQ ID NO: 1026844 - RNA, 27 nt, Human
cccgggacccagggccugucccucagg

SEQ ID NO: 1026845 - RNA, 26 nt, Human
cccucaggccacacucagcccccagc

SEQ ID NO: 1026846 - RNA, 22 nt, Human
ccugcggacagagaagagccua

SEQ ID NO: 1026847 - RNA, 21 nt, Human
cgccaagggccccagccucag

SEQ ID NO: 1026848 - RNA, 27 nt, Human
cucagccuccgcgccaagggccccagc

SEQ ID NO: 1026849 - RNA, 18 nt, Human
cucccaggcaaggaaccu

SEQ ID NO: 1026850 - RNA, 27 nt, Human
cuccgcgccaagggccccagccucagc

SEQ ID NO: 1026851 - RNA, 19 nt, Human
cuccgcgccaagggccccc

SEQ ID NO: 1026852 - RNA, 27 nt, Human
cuggccgacgacagcggugcccucccu

SEQ ID NO: 1026853 - RNA, 18 nt, Human
gagcaugcgcagcaaggc

SEQ ID NO: 1026854 - RNA, 21 nt, Human
gccaagggccccagccucagc

SEQ ID NO: 1026855 - RNA, 21 nt, Human
gccccagccucagcucgcgcu

SEQ ID NO: 1026856 - RNA, 23 nt, Human
gggccccagccucagcucgcgcu

SEQ ID NO: 1026857 - RNA, 21 nt, Human
gguugguggccugggaggaug

SEQ ID NO: 1026858 - RNA, 22 nt, Human
uaccucaagccggggucacagc

SEQ ID NO: 1026859 - RNA, 22 nt, Human
ucacccauuuggccccagaagc

SEQ ID NO: 1026860 - RNA, 25 nt, Human
ucacugaggacuccuuggcuucugg

SEQ ID NO: 1026861 - RNA, 20 nt, Human
ucagccuccgcgccaagggc

SEQ ID NO: 1026862 - RNA, 20 nt, Human
ucccucaggccacacucagc

SEQ ID NO: 1026863 - RNA, 22 nt, Human
ucccucaggccacacucagccc

SEQ ID NO: 1026864 - RNA, 21 nt, Human
uccgcgccaagggccccagcc

SEQ ID NO: 1026865 - RNA, 26 nt, Human
ucuaaaaaaaaaaaaaaaaagaaaag

SEQ ID NO: 1026866 - RNA, 18 nt, Human
ugaucuaaaaaaaaaaaa

SEQ ID NO: 1026867 - RNA, 25 nt, Human
ugaucuaaaaaaaaaaaaaaaaaga

SEQ ID NO: 1026868 - RNA, 24 nt, Human
ugcccugucuucuggcuggggccg

SEQ ID NO: 1026869 - RNA, 22 nt, Human
uggccgacgacagcggugcccu

SEQ ID NO: 1026870 - RNA, 24 nt, Human
uggcuggguggggacagcgaugug

SEQ ID NO: 1026871 - RNA, 20 nt, Human
uggcuggguugguggccugg

SEQ ID NO: 1026872 - RNA, 19 nt, Human
uggggacagcgauguggag

SEQ ID NO: 1026873 - RNA, 21 nt, Human
aaaagcucacuaaaaaguugc

SEQ ID NO: 1026874 - RNA, 20 nt, Human
aaauccaaaugaaaauauua

SEQ ID NO: 1026875 - RNA, 21 nt, Human
aaccaaaacacucucucuccc

SEQ ID NO: 1026876 - RNA, 30 nt, Human
aacccuacuaacucaucagagccccacuag

SEQ ID NO: 1026877 - RNA, 24 nt, Human
acaaacaaugucauggucuaugac

SEQ ID NO: 1026878 - RNA, 26 nt, Human
acaaagccaugcugaggaggagccau

SEQ ID NO: 1026879 - RNA, 20 nt, Human
accucagcucuucuuaauau

SEQ ID NO: 1026880 - RNA, 22 nt, Human
acucugcugccacuuugaauag

SEQ ID NO: 1026881 - RNA, 20 nt, Human
agaguugaaagacccauaac

SEQ ID NO: 1026882 - RNA, 19 nt, Human
agaugcucagugaccgggc

SEQ ID NO: 1026883 - RNA, 25 nt, Human
agcaaagaauaccagcccuacaucc

SEQ ID NO: 1026884 - RNA, 19 nt, Human
agcccucagcuuccucauc

SEQ ID NO: 1026885 - RNA, 20 nt, Human
agcuggugugcuaacuccug

SEQ ID NO: 1026886 - RNA, 24 nt, Human
agugcaauggcacaaucucggcuc

SEQ ID NO: 1026887 - RNA, 23 nt, Human
auuuacuuauuuauuuauuuauu

SEQ ID NO: 1026888 - RNA, 22 nt, Human
cacacaagcucagcagcacugg

SEQ ID NO: 1026889 - RNA, 21 nt, Human
caccgcaaccuccgccuccug

SEQ ID NO: 1026890 - RNA, 18 nt, Human
cacggugggcugcggggc

SEQ ID NO: 1026891 - RNA, 24 nt, Human
cacuccccucaagauaacugggaa

SEQ ID NO: 1026892 - RNA, 21 nt, Human
cacuuugaauagaaguccaag

SEQ ID NO: 1026893 - RNA, 21 nt, Human
cagaguugaaagacccauaac

SEQ ID NO: 1026894 - RNA, 21 nt, Human
ccaaaacacucucucucccca

SEQ ID NO: 1026895 - RNA, 30 nt, Human
ccacucugcugccacuuugaauagaagucc

SEQ ID NO: 1026896 - RNA, 19 nt, Human
ccacuuugaauagaagucc

SEQ ID NO: 1026897 - RNA, 21 nt, Human
ccagcccuacaucccacuccc

SEQ ID NO: 1026898 - RNA, 22 nt, Human
ccaugugguucuuggcugcuuc

SEQ ID NO: 1026899 - RNA, 19 nt, Human
cccaggcuggagugcaaug

SEQ ID NO: 1026900 - RNA, 23 nt, Human
cccccaaaccaauaggaucuucu

SEQ ID NO: 1026901 - RNA, 23 nt, Human
cccuacaucccacuccccucaag

SEQ ID NO: 1026902 - RNA, 18 nt, Human
cccucccaacucauuccc

SEQ ID NO: 1026903 - RNA, 24 nt, Human
cccuuugccucacucuggccauuc

SEQ ID NO: 1026904 - RNA, 23 nt, Human
ccgcaaccuccgccuccuggguu

SEQ ID NO: 1026905 - RNA, 24 nt, Human
ccgcaaccuccgccuccuggguuc

SEQ ID NO: 1026906 - RNA, 24 nt, Human
ccgccuccuggguucaagcgauuc

SEQ ID NO: 1026907 - RNA, 18 nt, Human
ccgggcuuccucucccac

SEQ ID NO: 1026908 - RNA, 23 nt, Human
ccuacaucccacuccccucaaga

SEQ ID NO: 1026909 - RNA, 21 nt, Human
ccucaagauaacugggaaaga

SEQ ID NO: 1026910 - RNA, 21 nt, Human
ccucacucuggccauuccaaa

SEQ ID NO: 1026911 - RNA, 19 nt, Human
ccuccgccuccuggguuca

SEQ ID NO: 1026912 - RNA, 24 nt, Human
ccuccuggguucaagcgauucucc

SEQ ID NO: 1026913 - RNA, 21 nt, Human
cuccuggguucaagcgauucu

SEQ ID NO: 1026914 - RNA, 18 nt, Human
cucucuccccacugccuu

SEQ ID NO: 1026915 - RNA, 22 nt, Human
cucuuguugcccaggcuggagu

SEQ ID NO: 1026916 - RNA, 25 nt, Human
cucuuugucuuuccagaguugaaag

SEQ ID NO: 1026917 - RNA, 24 nt, Human
cugcacuauucuuucccaucucaa

SEQ ID NO: 1026918 - RNA, 20 nt, Human
cugcugcacuaauaauccag

SEQ ID NO: 1026919 - RNA, 18 nt, Human
cuuauuuauuuauuuauu

SEQ ID NO: 1026920 - RNA, 18 nt, Human
cuucuugguuagcugccc

SEQ ID NO: 1026921 - RNA, 24 nt, Human
cuuguugcccaggcuggagugcaa

SEQ ID NO: 1026922 - RNA, 21 nt, Human
gacuugcugccucucucccuu

SEQ ID NO: 1026923 - RNA, 18 nt, Human
gaggaggagccaugguuu

SEQ ID NO: 1026924 - RNA, 19 nt, Human
gaguaguccuaaaagcuca

SEQ ID NO: 1026925 - RNA, 19 nt, Human
gcccaggcuggagugcaau

SEQ ID NO: 1026926 - RNA, 20 nt, Human
gcggggcuggagcuggggcc

SEQ ID NO: 1026927 - RNA, 20 nt, Human
gcuacgacugucccugagac

SEQ ID NO: 1026928 - RNA, 24 nt, Human
gcucuuguugcccaggcuggagug

SEQ ID NO: 1026929 - RNA, 25 nt, Human
gcugcuggaaguuguguucccccca

SEQ ID NO: 1026930 - RNA, 19 nt, Human
gcuggagugcaauggcaca

SEQ ID NO: 1026931 - RNA, 18 nt, Human
ggacuuacaacacugaua

SEQ ID NO: 1026932 - RNA, 24 nt, Human
ggaggccgggcgcaguggcucacg

SEQ ID NO: 1026933 - RNA, 24 nt, Human
ggaugaaggaggccgggcgcagug

SEQ ID NO: 1026934 - RNA, 18 nt, Human
gggaacgcggagccuggg

SEQ ID NO: 1026935 - RNA, 18 nt, Human
gggcgcaguggcucacgg

SEQ ID NO: 1026936 - RNA, 28 nt, Human
uaaauagagaaccuuauguuguaaugac

SEQ ID NO: 1026937 - RNA, 19 nt, Human
uaacaaggaaucaaaggag

SEQ ID NO: 1026938 - RNA, 19 nt, Human
uaacuccuguaauucuggg

SEQ ID NO: 1026939 - RNA, 23 nt, Human
uaacuuaaauagagaaccuuaug

SEQ ID NO: 1026940 - RNA, 19 nt, Human
uaagcaaagaauaccagcc

SEQ ID NO: 1026941 - RNA, 23 nt, Human
uacaguccgucuccucuauggag

SEQ ID NO: 1026942 - RNA, 22 nt, Human
uaccagcccuacaucccacucc

SEQ ID NO: 1026943 - RNA, 24 nt, Human
uacugcauguuucuagcccucagc

SEQ ID NO: 1026944 - RNA, 22 nt, Human
uauugggaauaacaaaugagaa

SEQ ID NO: 1026945 - RNA, 24 nt, Human
uauuuauuuauugagauggaguuu

SEQ ID NO: 1026946 - RNA, 19 nt, Human
ucaagcgauucucccgccu

SEQ ID NO: 1026947 - RNA, 23 nt, Human
ucacacaagcucagcagcacugg

SEQ ID NO: 1026948 - RNA, 24 nt, Human
ucaccgcaaccuccgccuccuggg

SEQ ID NO: 1026949 - RNA, 25 nt, Human
ucaccgcaaccuccgccuccugggu

SEQ ID NO: 1026950 - RNA, 27 nt, Human
ucaccgcaaccuccgccuccuggguuc

SEQ ID NO: 1026951 - RNA, 19 nt, Human
ucauaccucagcucuucuu

SEQ ID NO: 1026952 - RNA, 20 nt, Human
ucccacucugcugccacuuu

SEQ ID NO: 1026953 - RNA, 23 nt, Human
uccccacugccuuuuuucuuuug

SEQ ID NO: 1026954 - RNA, 26 nt, Human
uccccccaaaccaauaggaucuucuu

SEQ ID NO: 1026955 - RNA, 23 nt, Human
ucccguguacuuuccuucuccug

SEQ ID NO: 1026956 - RNA, 21 nt, Human
uccuggguucaagcgauucuc

SEQ ID NO: 1026957 - RNA, 24 nt, Human
uccuggguucaagcgauucucccg

SEQ ID NO: 1026958 - RNA, 23 nt, Human
ucgcucuuguugcccaggcugga

SEQ ID NO: 1026959 - RNA, 18 nt, Human
ucuacaguccgucuccuc

SEQ ID NO: 1026960 - RNA, 25 nt, Human
ucucuuugucuuuccagaguugaaa

SEQ ID NO: 1026961 - RNA, 21 nt, Human
ucuggacucuauaccugauuu

SEQ ID NO: 1026962 - RNA, 19 nt, Human
ucuguaauuagugggaagc

SEQ ID NO: 1026963 - RNA, 22 nt, Human
ucuguaauuagugggaagccac

SEQ ID NO: 1026964 - RNA, 22 nt, Human
ucuuguugcccaggcuggagug

SEQ ID NO: 1026965 - RNA, 21 nt, Human
ugacuugcugccucucucccu

SEQ ID NO: 1026966 - RNA, 23 nt, Human
ugagaauaaauauauuuagcccu

SEQ ID NO: 1026967 - RNA, 21 nt, Human
ugccacuuugaauagaagucc

SEQ ID NO: 1026968 - RNA, 18 nt, Human
ugcccaggcuggagugca

SEQ ID NO: 1026969 - RNA, 21 nt, Human
ugcccaggcuggagugcaaug

SEQ ID NO: 1026970 - RNA, 24 nt, Human
ugcccaggcuggagugcaauggca

SEQ ID NO: 1026971 - RNA, 22 nt, Human
ugcccaugugguucuuggcugc

SEQ ID NO: 1026972 - RNA, 23 nt, Human
ugccucacucuggccauuccaaa

SEQ ID NO: 1026973 - RNA, 20 nt, Human
uggaaaagggaacauuuagu

SEQ ID NO: 1026974 - RNA, 23 nt, Human
uggagcugcacuauucuuuccca

SEQ ID NO: 1026975 - RNA, 24 nt, Human
uggagcugcacuauucuuucccau

SEQ ID NO: 1026976 - RNA, 23 nt, Human
uggagugcaauggcacaaucucg

SEQ ID NO: 1026977 - RNA, 24 nt, Human
uggagugcaauggcacaaucucgg

SEQ ID NO: 1026978 - RNA, 24 nt, Human
uggcacaaucucggcucaccgcaa

SEQ ID NO: 1026979 - RNA, 21 nt, Human
ugggaaagacacaaagccaug

SEQ ID NO: 1026980 - RNA, 19 nt, Human
ugggcaggggaucuccuug

SEQ ID NO: 1026981 - RNA, 22 nt, Human
uguaaaugaaccuaagcaaaga

SEQ ID NO: 1026982 - RNA, 20 nt, Human
uguugcccaggcuggagugc

SEQ ID NO: 1026983 - RNA, 21 nt, Human
uguuucuggacucuauaccug

SEQ ID NO: 1026984 - RNA, 26 nt, Human
uuaaucuuugaauuucaauguuuucu

SEQ ID NO: 1026985 - RNA, 23 nt, Human
uucaagcgauucucccgccucag

SEQ ID NO: 1026986 - RNA, 25 nt, Human
uucaagcgauucucccgccucaggg

SEQ ID NO: 1026987 - RNA, 19 nt, Human
uuccagaguugaaagaccc

SEQ ID NO: 1026988 - RNA, 22 nt, Human
uucccugggacccccucccaac

SEQ ID NO: 1026989 - RNA, 24 nt, Human
uucgcucuuguugcccaggcugga

SEQ ID NO: 1026990 - RNA, 18 nt, Human
uugcccaggcuggagugc

SEQ ID NO: 1026991 - RNA, 22 nt, Human
uugcugccucucucccuucugg

SEQ ID NO: 1026992 - RNA, 22 nt, Human
uuguauuuaacuuaaauagaga

SEQ ID NO: 1026993 - RNA, 24 nt, Human
uuucgcucuuguugcccaggcugg

SEQ ID NO: 1026994 - RNA, 24 nt, Human
uuuuuuuuuuuuuuuuuuuuacag

SEQ ID NO: 1026995 - RNA, 22 nt, Human
aauucauuaggugcagaaaucu

SEQ ID NO: 1026996 - RNA, 20 nt, Human
acaucaaauucauuaggugc

SEQ ID NO: 1026997 - RNA, 22 nt, Human
agcucccgguguucagcagccc

SEQ ID NO: 1026998 - RNA, 21 nt, Human
aggaagagccagcagcagcug

SEQ ID NO: 1026999 - RNA, 18 nt, Human
auaugcacgaguguugga

SEQ ID NO: 1027000 - RNA, 21 nt, Human
auucuucuaguugaauucugg

SEQ ID NO: 1027001 - RNA, 21 nt, Human
caagaggaagagccagcagca

SEQ ID NO: 1027002 - RNA, 20 nt, Human
ccccuuucaccauccccgcc

SEQ ID NO: 1027003 - RNA, 21 nt, Human
ccccuuucaccauccccgccg

SEQ ID NO: 1027004 - RNA, 20 nt, Human
ccgccguggagauaucaucg

SEQ ID NO: 1027005 - RNA, 19 nt, Human
cucucugcauggccuuucc

SEQ ID NO: 1027006 - RNA, 21 nt, Human
cuguuccccgaaagaagaauc

SEQ ID NO: 1027007 - RNA, 25 nt, Human
cuuccaguuuaaacaugacaucuua

SEQ ID NO: 1027008 - RNA, 19 nt, Human
gaagcucucugcauggccu

SEQ ID NO: 1027009 - RNA, 23 nt, Human
uagcucccgguguucagcagccc

SEQ ID NO: 1027010 - RNA, 22 nt, Human
uauucuucuaguugaauucugg

SEQ ID NO: 1027011 - RNA, 21 nt, Human
ucaccauccccgccgccgugg

SEQ ID NO: 1027012 - RNA, 21 nt, Human
ucaccuucuaaaaacugacuc

SEQ ID NO: 1027013 - RNA, 18 nt, Human
uccacaaccccuuucacc

SEQ ID NO: 1027014 - RNA, 23 nt, Human
uccccgaaagaagaauccguuuc

SEQ ID NO: 1027015 - RNA, 18 nt, Human
uccccgccgccguggaga

SEQ ID NO: 1027016 - RNA, 26 nt, Human
ucuucacgugcucauaguagcucccc

SEQ ID NO: 1027017 - RNA, 22 nt, Human
ugacagcaucuuagaagcugau

SEQ ID NO: 1027018 - RNA, 21 nt, Human
ugagcagcaggugguccacaa

SEQ ID NO: 1027019 - RNA, 20 nt, Human
ugcggaagccuugggggcag

SEQ ID NO: 1027020 - RNA, 18 nt, Human
uuaaacaugacaucaaau

SEQ ID NO: 1027021 - RNA, 22 nt, Human
uucaggaaaaggccgcaagagg

SEQ ID NO: 1027022 - RNA, 23 nt, Human
uucaggaaaaggccgcaagagga

SEQ ID NO: 1027023 - RNA, 21 nt, Human
uucuuucggauuucuuuuaaa

SEQ ID NO: 1027024 - RNA, 20 nt, Human
aaaggaacuguugacccaaa

SEQ ID NO: 1027025 - RNA, 21 nt, Human
aaaggaacuguugacccaaag

SEQ ID NO: 1027026 - RNA, 18 nt, Human
aagaaccacaccacuaaa

SEQ ID NO: 1027027 - RNA, 19 nt, Human
aagaaccacaccacuaaau

SEQ ID NO: 1027028 - RNA, 19 nt, Human
aagccccaucccugcccag

SEQ ID NO: 1027029 - RNA, 24 nt, Human
aagccugaugaacuuaauccguac

SEQ ID NO: 1027030 - RNA, 19 nt, Human
aagcuggggcaggagagag

SEQ ID NO: 1027031 - RNA, 21 nt, Human
acaccacuaaauccccuuggc

SEQ ID NO: 1027032 - RNA, 21 nt, Human
accauccuguccuuggacccc

SEQ ID NO: 1027033 - RNA, 23 nt, Human
acccaaagcaugaagcaggaccc

SEQ ID NO: 1027034 - RNA, 18 nt, Human
accuagacaaaaacaauu

SEQ ID NO: 1027035 - RNA, 19 nt, Human
acugccagcugccgccgcc

SEQ ID NO: 1027036 - RNA, 23 nt, Human
acugugguggcugaguggaagcu

SEQ ID NO: 1027037 - RNA, 26 nt, Human
agaaaggagaacagaggcaggggagc

SEQ ID NO: 1027038 - RNA, 24 nt, Human
agaaucugaaagcucgagucccag

SEQ ID NO: 1027039 - RNA, 21 nt, Human
agagacaccagcuuggccucc

SEQ ID NO: 1027040 - RNA, 23 nt, Human
agcacgcuuuccucugacccacu

SEQ ID NO: 1027041 - RNA, 22 nt, Human
agccugcggccugagcacacca

SEQ ID NO: 1027042 - RNA, 22 nt, Human
aggacccccaccaaccccagcc

SEQ ID NO: 1027043 - RNA, 24 nt, Human
aggagacugcuuuccaaaugcagc

SEQ ID NO: 1027044 - RNA, 25 nt, Human
aggccaggagagcagcuccaggcac

SEQ ID NO: 1027045 - RNA, 24 nt, Human
aggcuaguugagaaucugaaagcu

SEQ ID NO: 1027046 - RNA, 18 nt, Human
agggaguggguggggccu

SEQ ID NO: 1027047 - RNA, 19 nt, Human
agggaguggguggggccug

SEQ ID NO: 1027048 - RNA, 24 nt, Human
agggcauaaggaauggggacaggg

SEQ ID NO: 1027049 - RNA, 18 nt, Human
aggguggggagggcugag

SEQ ID NO: 1027050 - RNA, 18 nt, Human
aggucuggggguccuggu

SEQ ID NO: 1027051 - RNA, 21 nt, Human
aggugaggucaccuugagcca

SEQ ID NO: 1027052 - RNA, 23 nt, Human
aggugaggucaccuugagccagg

SEQ ID NO: 1027053 - RNA, 20 nt, Human
agugcugugugcauaguugg

SEQ ID NO: 1027054 - RNA, 23 nt, Human
aucagcuuuggccuccugaccca

SEQ ID NO: 1027055 - RNA, 23 nt, Human
auugggggcagccagaagaggag

SEQ ID NO: 1027056 - RNA, 21 nt, Human
caaaacaaccugcgcucaggc

SEQ ID NO: 1027057 - RNA, 23 nt, Human
caaaggaacuguugacccaaagc

SEQ ID NO: 1027058 - RNA, 21 nt, Human
caaaucccagugggucagaaa

SEQ ID NO: 1027059 - RNA, 23 nt, Human
caagaggccuccccguggccacc

SEQ ID NO: 1027060 - RNA, 26 nt, Human
caccaaccccagccagguggccugca

SEQ ID NO: 1027061 - RNA, 21 nt, Human
caccacuaaauccccuuggca

SEQ ID NO: 1027062 - RNA, 23 nt, Human
cacccugcccuguugaccauccu

SEQ ID NO: 1027063 - RNA, 25 nt, Human
cacgcaaaccuucaguuuuugcgau

SEQ ID NO: 1027064 - RNA, 20 nt, Human
cagaaaggagaacagaggca

SEQ ID NO: 1027065 - RNA, 21 nt, Human
cagaggcaggggagcccucgg

SEQ ID NO: 1027066 - RNA, 22 nt, Human
cagcaugccuggccaaagccuc

SEQ ID NO: 1027067 - RNA, 21 nt, Human
cagcgaagagacugagacaag

SEQ ID NO: 1027068 - RNA, 19 nt, Human
cagcugccgccgccucugg

SEQ ID NO: 1027069 - RNA, 20 nt, Human
cagcugccgccgccucugga

SEQ ID NO: 1027070 - RNA, 18 nt, Human
caggaagcccauggugaa

SEQ ID NO: 1027071 - RNA, 20 nt, Human
ccaaccccagccagguggcc

SEQ ID NO: 1027072 - RNA, 20 nt, Human
ccaagccgguggugacccac

SEQ ID NO: 1027073 - RNA, 18 nt, Human
ccaggcacaacaccugcu

SEQ ID NO: 1027074 - RNA, 18 nt, Human
ccagggagguggcccugc

SEQ ID NO: 1027075 - RNA, 18 nt, Human
ccauccuguccuuggacc

SEQ ID NO: 1027076 - RNA, 18 nt, Human
cccaagccgguggugacc

SEQ ID NO: 1027077 - RNA, 23 nt, Human
cccagggagguggcccugcgcgg

SEQ ID NO: 1027078 - RNA, 25 nt, Human
cccaugguggggcaacugugguggc

SEQ ID NO: 1027079 - RNA, 19 nt, Human
ccccaaaguaaaauggggc

SEQ ID NO: 1027080 - RNA, 18 nt, Human
ccccacacaccccaagag

SEQ ID NO: 1027081 - RNA, 18 nt, Human
ccccacacaccccaagag

SEQ ID NO: 1027082 - RNA, 18 nt, Human
ccccaccaaccccagcca

SEQ ID NO: 1027083 - RNA, 20 nt, Human
ccccaucccugcccagcccc

SEQ ID NO: 1027084 - RNA, 23 nt, Human
cccgcgcacccaggaagcccaau

SEQ ID NO: 1027085 - RNA, 20 nt, Human
cccggacagaggagcuaaga

SEQ ID NO: 1027086 - RNA, 24 nt, Human
ccgccuacagcuguuuugccaagg

SEQ ID NO: 1027087 - RNA, 20 nt, Human
ccguccucacagcccuggga

SEQ ID NO: 1027088 - RNA, 22 nt, Human
ccuacagcuguuuugccaaggc

SEQ ID NO: 1027089 - RNA, 22 nt, Human
ccuacuacccaaacccuccuug

SEQ ID NO: 1027090 - RNA, 22 nt, Human
ccuaguagcccggacagaggag

SEQ ID NO: 1027091 - RNA, 20 nt, Human
ccucccuuugaaagaaccac

SEQ ID NO: 1027092 - RNA, 23 nt, Human
ccugaacaucagcuuuggccucc

SEQ ID NO: 1027093 - RNA, 28 nt, Human
ccugcgcucaggcccgcgcacccaggaa

SEQ ID NO: 1027094 - RNA, 27 nt, Human
ccuggagcuggggcaguugccagaagc

SEQ ID NO: 1027095 - RNA, 20 nt, Human
ccuggguucaaguuaaacag

SEQ ID NO: 1027096 - RNA, 26 nt, Human
ccuuccagucugagccaggccugccu

SEQ ID NO: 1027097 - RNA, 23 nt, Human
cgauaaauccaaggaggccagga

SEQ ID NO: 1027098 - RNA, 18 nt, Human
cggcgcuggcacgcuguc

SEQ ID NO: 1027099 - RNA, 21 nt, Human
cgugcuuacaacggauaugca

SEQ ID NO: 1027100 - RNA, 24 nt, Human
cucaggcccgcgcacccaggaagc

SEQ ID NO: 1027101 - RNA, 18 nt, Human
cuccaagggccagccgcg

SEQ ID NO: 1027102 - RNA, 18 nt, Human
cucccggccuggcagguc

SEQ ID NO: 1027103 - RNA, 19 nt, Human
cucucacgcaaaccuucag

SEQ ID NO: 1027104 - RNA, 22 nt, Human
cuucgagcacgcuuuccucuga

SEQ ID NO: 1027105 - RNA, 20 nt, Human
gaccucacgauccccugaac

SEQ ID NO: 1027106 - RNA, 21 nt, Human
gaccugucgucuguccuguuu

SEQ ID NO: 1027107 - RNA, 22 nt, Human
gagaggacccccaccaacccca

SEQ ID NO: 1027108 - RNA, 19 nt, Human
gagaggggagcaggcuucc

SEQ ID NO: 1027109 - RNA, 22 nt, Human
gagcccacugcccuagcucuga

SEQ ID NO: 1027110 - RNA, 26 nt, Human
gaggaccccggguggacagaguccuu

SEQ ID NO: 1027111 - RNA, 18 nt, Human
gcacgcuguccacccugc

SEQ ID NO: 1027112 - RNA, 21 nt, Human
gcacgcuuuccucugacccac

SEQ ID NO: 1027113 - RNA, 19 nt, Human
gcagaaggcgcuugcuccc

SEQ ID NO: 1027114 - RNA, 21 nt, Human
gcauccacccagggagguggc

SEQ ID NO: 1027115 - RNA, 19 nt, Human
gccaaagccuccccacucc

SEQ ID NO: 1027116 - RNA, 23 nt, Human
gccaaggugccccacguggcuug

SEQ ID NO: 1027117 - RNA, 19 nt, Human
gccagagaggggagcaggc

SEQ ID NO: 1027118 - RNA, 22 nt, Human
gccccacuaugucccugcugug

SEQ ID NO: 1027119 - RNA, 18 nt, Human
gcccucgguccccagccc

SEQ ID NO: 1027120 - RNA, 24 nt, Human
gccucuggcuggguguccaccucc

SEQ ID NO: 1027121 - RNA, 18 nt, Human
gccugagcacaccaaucu

SEQ ID NO: 1027122 - RNA, 18 nt, Human
gccuggagcuggggcagu

SEQ ID NO: 1027123 - RNA, 24 nt, Human
ggacacuugggggcugagggcacu

SEQ ID NO: 1027124 - RNA, 21 nt, Human
ggacagggcacagggcacgug

SEQ ID NO: 1027125 - RNA, 20 nt, Human
ggagagcagcuccaggcaca

SEQ ID NO: 1027126 - RNA, 21 nt, Human
ggagagccaggguggggaggg

SEQ ID NO: 1027127 - RNA, 24 nt, Human
ggaggggacguuugcaggucuggg

SEQ ID NO: 1027128 - RNA, 18 nt, Human
ggauggccuggagcuggg

SEQ ID NO: 1027129 - RNA, 18 nt, Human
ggccuggagcuggggcag

SEQ ID NO: 1027130 - RNA, 18 nt, Human
gggacguuugcaggucug

SEQ ID NO: 1027131 - RNA, 19 nt, Human
gggacguuugcaggucugg

SEQ ID NO: 1027132 - RNA, 19 nt, Human
gggcagccagaagaggagg

SEQ ID NO: 1027133 - RNA, 23 nt, Human
gggcaggggcuauggucccaugc

SEQ ID NO: 1027134 - RNA, 19 nt, Human
ggggagggcugagugucug

SEQ ID NO: 1027135 - RNA, 20 nt, Human
ggggcagccagaagaggagg

SEQ ID NO: 1027136 - RNA, 19 nt, Human
ggguggggagggcugagug

SEQ ID NO: 1027137 - RNA, 19 nt, Human
gugcuuccgugugaguugg

SEQ ID NO: 1027138 - RNA, 25 nt, Human
uaaagcuuuaaacaauccuggguuc

SEQ ID NO: 1027139 - RNA, 18 nt, Human
uaagagcgagugcugugu

SEQ ID NO: 1027140 - RNA, 23 nt, Human
uagcaaccucaucugaccccagc

SEQ ID NO: 1027141 - RNA, 21 nt, Human
uagcuccacugccugccuguu

SEQ ID NO: 1027142 - RNA, 20 nt, Human
uauguacaaaacaaccugcg

SEQ ID NO: 1027143 - RNA, 21 nt, Human
ucagaaaggagaacagaggca

SEQ ID NO: 1027144 - RNA, 21 nt, Human
uccacccugcccuguugacca

SEQ ID NO: 1027145 - RNA, 22 nt, Human
uccaccuccugccgggaagcca

SEQ ID NO: 1027146 - RNA, 22 nt, Human
uccagucugagccaggccugcc

SEQ ID NO: 1027147 - RNA, 20 nt, Human
uccccguggccaccaccgcc

SEQ ID NO: 1027148 - RNA, 21 nt, Human
uccgaggguauggcuccuggg

SEQ ID NO: 1027149 - RNA, 18 nt, Human
uccguacgcuggugggag

SEQ ID NO: 1027150 - RNA, 18 nt, Human
uccucgucucucacgcaa

SEQ ID NO: 1027151 - RNA, 21 nt, Human
ucucaagccccaucccugccc

SEQ ID NO: 1027152 - RNA, 18 nt, Human
ucucugggggauccaggg

SEQ ID NO: 1027153 - RNA, 22 nt, Human
ucugaccccagcuucggcuucc

SEQ ID NO: 1027154 - RNA, 21 nt, Human
ugaaagaaccacaccacuaaa

SEQ ID NO: 1027155 - RNA, 20 nt, Human
ugaaggugaggucaccuuga

SEQ ID NO: 1027156 - RNA, 22 nt, Human
ugaauaaccaaaaaauuucuuc

SEQ ID NO: 1027157 - RNA, 22 nt, Human
ugaccauggcauccuucgagca

SEQ ID NO: 1027158 - RNA, 20 nt, Human
ugacccaaagcaugaagcag

SEQ ID NO: 1027159 - RNA, 20 nt, Human
ugaccccagcuucggcuucc

SEQ ID NO: 1027160 - RNA, 20 nt, Human
ugaccuagacaaaaacaauu

SEQ ID NO: 1027161 - RNA, 25 nt, Human
ugacuugcuuuuccaucaucaacuc

SEQ ID NO: 1027162 - RNA, 19 nt, Human
ugagaaucugaaagcucga

SEQ ID NO: 1027163 - RNA, 19 nt, Human
ugagggagcuacagauggg

SEQ ID NO: 1027164 - RNA, 20 nt, Human
ugauggggcuggggcagccu

SEQ ID NO: 1027165 - RNA, 22 nt, Human
ugcagaaggcgcuugcucccaa

SEQ ID NO: 1027166 - RNA, 24 nt, Human
ugcagcucgggccuacuacccaaa

SEQ ID NO: 1027167 - RNA, 22 nt, Human
ugccaaggcuaguugagaaucu

SEQ ID NO: 1027168 - RNA, 23 nt, Human
ugccaggcuggacacuugggggc

SEQ ID NO: 1027169 - RNA, 25 nt, Human
ugccaguuggcccacggaaggccgg

SEQ ID NO: 1027170 - RNA, 23 nt, Human
ugcccuguugaccauccuguccu

SEQ ID NO: 1027171 - RNA, 22 nt, Human
ugccuggccaaagccuccccac

SEQ ID NO: 1027172 - RNA, 21 nt, Human
ugcgauaaauccaaggaggcc

SEQ ID NO: 1027173 - RNA, 18 nt, Human
ugcucuggaggcucugcc

SEQ ID NO: 1027174 - RNA, 18 nt, Human
uggagcagguuugggaug

SEQ ID NO: 1027175 - RNA, 24 nt, Human
uggcccacggaaggccggaaaugc

SEQ ID NO: 1027176 - RNA, 21 nt, Human
uggcuggguguccaccuccug

SEQ ID NO: 1027177 - RNA, 21 nt, Human
ugggaugcucaucccuugaca

SEQ ID NO: 1027178 - RNA, 28 nt, Human
ugggauggccuggagcuggggcaguugc

SEQ ID NO: 1027179 - RNA, 20 nt, Human
uggggcaguugccagaagcu

SEQ ID NO: 1027180 - RNA, 19 nt, Human
ugggggcagccagaagagg

SEQ ID NO: 1027181 - RNA, 24 nt, Human
ugggggcuggacucgagucuucuu

SEQ ID NO: 1027182 - RNA, 18 nt, Human
ugggucagaaaggagaac

SEQ ID NO: 1027183 - RNA, 18 nt, Human
ugguauuugagcucuuga

SEQ ID NO: 1027184 - RNA, 21 nt, Human
ugguggcugaguggaagcugg

SEQ ID NO: 1027185 - RNA, 23 nt, Human
ugguggggcaacugugguggcug

SEQ ID NO: 1027186 - RNA, 20 nt, Human
uguacaaaacaaccugcgcu

SEQ ID NO: 1027187 - RNA, 28 nt, Human
uguccuguuuuaucccccacacacccca

SEQ ID NO: 1027188 - RNA, 24 nt, Human
ugugcaagaccucaccgguucccc

SEQ ID NO: 1027189 - RNA, 21 nt, Human
uguuccuggcuuccccuucca

SEQ ID NO: 1027190 - RNA, 21 nt, Human
uguugaccauccuguccuugg

SEQ ID NO: 1027191 - RNA, 19 nt, Human
uguuggccagguuguacgg

SEQ ID NO: 1027192 - RNA, 20 nt, Human
uucaaguuaaacaguuccag

SEQ ID NO: 1027193 - RNA, 25 nt, Human
uuccgcuguccucgucucucacgca

SEQ ID NO: 1027194 - RNA, 18 nt, Human
aaaaagggucucugcccg

SEQ ID NO: 1027195 - RNA, 19 nt, Human
aaaaagggucucugcccgg

SEQ ID NO: 1027196 - RNA, 19 nt, Human
aaaaauugauaaggugaua

SEQ ID NO: 1027197 - RNA, 20 nt, Human
aaaagcagcuuuuggaaaca

SEQ ID NO: 1027198 - RNA, 26 nt, Human
aagcaucucucucgggcagggcaccc

SEQ ID NO: 1027199 - RNA, 18 nt, Human
aagcccagggggaagagg

SEQ ID NO: 1027200 - RNA, 22 nt, Human
acaagcaagagacuguuucaca

SEQ ID NO: 1027201 - RNA, 20 nt, Human
acgaggccaccccuggaagc

SEQ ID NO: 1027202 - RNA, 19 nt, Human
agaacugaccgaacugcug

SEQ ID NO: 1027203 - RNA, 22 nt, Human
agagccccccacuuucuguccu

SEQ ID NO: 1027204 - RNA, 20 nt, Human
agaugucagugaagguaugg

SEQ ID NO: 1027205 - RNA, 21 nt, Human
agccccggccaccggcucggc

SEQ ID NO: 1027206 - RNA, 21 nt, Human
agcgggaagccgggcugcagg

SEQ ID NO: 1027207 - RNA, 21 nt, Human
aggcucccccucccccucacc

SEQ ID NO: 1027208 - RNA, 20 nt, Human
aguggccaggcgccucgccc

SEQ ID NO: 1027209 - RNA, 21 nt, Human
aucauguuuuggaaaaaauug

SEQ ID NO: 1027210 - RNA, 21 nt, Human
aucuguaaaaguuuaugaaaa

SEQ ID NO: 1027211 - RNA, 22 nt, Human
caacgcaucuuacgaacguggc

SEQ ID NO: 1027212 - RNA, 18 nt, Human
caagacuccagauacaag

SEQ ID NO: 1027213 - RNA, 19 nt, Human
caccagggagggcgucgca

SEQ ID NO: 1027214 - RNA, 21 nt, Human
cacuuucuguccugguggggg

SEQ ID NO: 1027215 - RNA, 27 nt, Human
cagcagcacccuccgggcaggccuggc

SEQ ID NO: 1027216 - RNA, 21 nt, Human
ccagcugucucuucugcuccu

SEQ ID NO: 1027217 - RNA, 20 nt, Human
cccccucccccucaccgguc

SEQ ID NO: 1027218 - RNA, 20 nt, Human
cccccucuguuucaccugca

SEQ ID NO: 1027219 - RNA, 18 nt, Human
cccgacggcggcccucug

SEQ ID NO: 1027220 - RNA, 21 nt, Human
ccgagagccuggagagaggcu

SEQ ID NO: 1027221 - RNA, 19 nt, Human
ccuccgggacuggcauggg

SEQ ID NO: 1027222 - RNA, 20 nt, Human
ccugcagggcugcugcuccu

SEQ ID NO: 1027223 - RNA, 21 nt, Human
ccugcgguggacccgggaggc

SEQ ID NO: 1027224 - RNA, 19 nt, Human
ccugguggggggagcgggg

SEQ ID NO: 1027225 - RNA, 24 nt, Human
cgaagcccagggggaagaggcugg

SEQ ID NO: 1027226 - RNA, 19 nt, Human
cgaucggaucuaacaacgg

SEQ ID NO: 1027227 - RNA, 24 nt, Human
cgcaaggcggugugggcagcagca

SEQ ID NO: 1027228 - RNA, 20 nt, Human
cgccuggcuggcggggggca

SEQ ID NO: 1027229 - RNA, 18 nt, Human
cgggcagggcacccuggg

SEQ ID NO: 1027230 - RNA, 21 nt, Human
cgggugcccuccccaggcucu

SEQ ID NO: 1027231 - RNA, 18 nt, Human
cguccuccucuuccucua

SEQ ID NO: 1027232 - RNA, 22 nt, Human
cuagagccuuaucuuuugagaa

SEQ ID NO: 1027233 - RNA, 18 nt, Human
cuccaaccguggcggggc

SEQ ID NO: 1027234 - RNA, 24 nt, Human
cucccccucccccucaccggucuc

SEQ ID NO: 1027235 - RNA, 19 nt, Human
cuccucagggucguauggc

SEQ ID NO: 1027236 - RNA, 21 nt, Human
cucucgggcagggcacccugg

SEQ ID NO: 1027237 - RNA, 21 nt, Human
cugcugcucuugcuggaacag

SEQ ID NO: 1027238 - RNA, 24 nt, Human
cugcugugguuuugggcuccuggg

SEQ ID NO: 1027239 - RNA, 21 nt, Human
cugguggggggagcggggcgg

SEQ ID NO: 1027240 - RNA, 21 nt, Human
cugugguuuugggcuccuggg

SEQ ID NO: 1027241 - RNA, 19 nt, Human
gaaaaauacacgacaagca

SEQ ID NO: 1027242 - RNA, 21 nt, Human
gaagcccagggggaagaggcu

SEQ ID NO: 1027243 - RNA, 21 nt, Human
gaaggcgaaacuggaccaaca

SEQ ID NO: 1027244 - RNA, 22 nt, Human
gacuuuggugguggagacauca

SEQ ID NO: 1027245 - RNA, 20 nt, Human
gccauggagaccccgacggc

SEQ ID NO: 1027246 - RNA, 23 nt, Human
gccgcaaggcggugugggcagca

SEQ ID NO: 1027247 - RNA, 23 nt, Human
gccuggccgagcugucuccaacc

SEQ ID NO: 1027248 - RNA, 19 nt, Human
gccuggcuggcggggggca

SEQ ID NO: 1027249 - RNA, 19 nt, Human
gcgaaacuggaccaacaaa

SEQ ID NO: 1027250 - RNA, 24 nt, Human
gcucagaaggcgaaacuggaccaa

SEQ ID NO: 1027251 - RNA, 18 nt, Human
gcucugccuuccagccgu

SEQ ID NO: 1027252 - RNA, 21 nt, Human
ggcggugcccucgccgggucu

SEQ ID NO: 1027253 - RNA, 22 nt, Human
ggcugagagccccccacuuucu

SEQ ID NO: 1027254 - RNA, 24 nt, Human
gggcggugcccucgccgggucugg

SEQ ID NO: 1027255 - RNA, 23 nt, Human
ggugcccuccccaggcucugccu

SEQ ID NO: 1027256 - RNA, 19 nt, Human
ggugugggcagcagcaccc

SEQ ID NO: 1027257 - RNA, 22 nt, Human
guggacccgggaggcucucugg

SEQ ID NO: 1027258 - RNA, 18 nt, Human
guggccaggcgccucgcc

SEQ ID NO: 1027259 - RNA, 21 nt, Human
guggcucucugucccccucug

SEQ ID NO: 1027260 - RNA, 18 nt, Human
guucccgcugacccugaa

SEQ ID NO: 1027261 - RNA, 18 nt, Human
uaaaagcagcuuuuggaa

SEQ ID NO: 1027262 - RNA, 21 nt, Human
uaaaagcagcuuuuggaaaca

SEQ ID NO: 1027263 - RNA, 22 nt, Human
uaaaagcagcuuuuggaaacac

SEQ ID NO: 1027264 - RNA, 23 nt, Human
uaaaaucugagcacgcuaagaaa

SEQ ID NO: 1027265 - RNA, 24 nt, Human
uaaaucauguuuuggaaaaaauug

SEQ ID NO: 1027266 - RNA, 22 nt, Human
uacaguaauguuuaaguccaga

SEQ ID NO: 1027267 - RNA, 19 nt, Human
uacuaagacuucucccgua

SEQ ID NO: 1027268 - RNA, 18 nt, Human
uaugacaaaagaaagaug

SEQ ID NO: 1027269 - RNA, 24 nt, Human
ucaacagucacuuucgcuucuucu

SEQ ID NO: 1027270 - RNA, 20 nt, Human
uccagcagaaugaagauuuc

SEQ ID NO: 1027271 - RNA, 20 nt, Human
uccccaggcucugccuucca

SEQ ID NO: 1027272 - RNA, 24 nt, Human
ucccgcugacccugaaacgggggc

SEQ ID NO: 1027273 - RNA, 19 nt, Human
ucccugugguuugacgccu

SEQ ID NO: 1027274 - RNA, 20 nt, Human
uccugcgacgcgaaccccgg

SEQ ID NO: 1027275 - RNA, 23 nt, Human
uccugcgacgcgaaccccgggca

SEQ ID NO: 1027276 - RNA, 23 nt, Human
ucguacuccuccucagggucgua

SEQ ID NO: 1027277 - RNA, 26 nt, Human
ucucucucgggcagggcacccugggc

SEQ ID NO: 1027278 - RNA, 18 nt, Human
ucuguccuggugggggga

SEQ ID NO: 1027279 - RNA, 20 nt, Human
ugaacagcuuccugucucau

SEQ ID NO: 1027280 - RNA, 21 nt, Human
ugacaaaagaaagaugcauuu

SEQ ID NO: 1027281 - RNA, 21 nt, Human
ugaccgaacugcuggacgauc

SEQ ID NO: 1027282 - RNA, 22 nt, Human
ugagaacugaccgaacugcugg

SEQ ID NO: 1027283 - RNA, 24 nt, Human
ugagagccccccacuuucuguccu

SEQ ID NO: 1027284 - RNA, 24 nt, Human
ugcagcgggaagccgggcugcagg

SEQ ID NO: 1027285 - RNA, 19 nt, Human
ugccggcaccccguccucu

SEQ ID NO: 1027286 - RNA, 21 nt, Human
ugccuugggcaaggacgacuu

SEQ ID NO: 1027287 - RNA, 21 nt, Human
ugcucggaccccgcugggggc

SEQ ID NO: 1027288 - RNA, 20 nt, Human
ugcuggaacagcucugccuu

SEQ ID NO: 1027289 - RNA, 21 nt, Human
ugcugugguuuugggcuccug

SEQ ID NO: 1027290 - RNA, 20 nt, Human
uggaaaaaauugauaaggug

SEQ ID NO: 1027291 - RNA, 22 nt, Human
uggaacagcucugccuugggca

SEQ ID NO: 1027292 - RNA, 18 nt, Human
uggacgccugcaggucac

SEQ ID NO: 1027293 - RNA, 26 nt, Human
uggagagaggcucccccucccccuca

SEQ ID NO: 1027294 - RNA, 25 nt, Human
uggccaggcgccucgccugccgggg

SEQ ID NO: 1027295 - RNA, 26 nt, Human
uggccaggcgccucgccugccggggg

SEQ ID NO: 1027296 - RNA, 20 nt, Human
uggcccacgaggccaccccu

SEQ ID NO: 1027297 - RNA, 18 nt, Human
uggccugucguccuccuc

SEQ ID NO: 1027298 - RNA, 22 nt, Human
uggcgccgcccucgcuccacaa

SEQ ID NO: 1027299 - RNA, 20 nt, Human
ugggcaaggacgacuuuggu

SEQ ID NO: 1027300 - RNA, 24 nt, Human
ugugggcagcagcacccuccgggc

SEQ ID NO: 1027301 - RNA, 18 nt, Human
ugugguuuugggcuccug

SEQ ID NO: 1027302 - RNA, 23 nt, Human
ugugguuuugggcuccuggggga

SEQ ID NO: 1027303 - RNA, 18 nt, Human
uguucagcucuucuagca

SEQ ID NO: 1027304 - RNA, 26 nt, Human
uuaaaaaagcaucagaauuguaaaga

SEQ ID NO: 1027305 - RNA, 19 nt, Human
uucaccugcagggcugcug

SEQ ID NO: 1027306 - RNA, 22 nt, Human
uucagaaguacucgaaaaauac

SEQ ID NO: 1027307 - RNA, 21 nt, Human
uucaggagcccuuuccaccuc

SEQ ID NO: 1027308 - RNA, 18 nt, Human
uuccaaagagagucugca

SEQ ID NO: 1027309 - RNA, 24 nt, Human
uugcuggaacagcucugccuuggg

SEQ ID NO: 1027310 - RNA, 18 nt, Human
aagagcauggccccgggg

SEQ ID NO: 1027311 - RNA, 20 nt, Human
agcaagaguccgucucccuc

SEQ ID NO: 1027312 - RNA, 19 nt, Human
agccugggcaacauagcaa

SEQ ID NO: 1027313 - RNA, 23 nt, Human
aggaguucaagaccagccugggc

SEQ ID NO: 1027314 - RNA, 24 nt, Human
aggauugcuugaggccaggaguuc

SEQ ID NO: 1027315 - RNA, 18 nt, Human
aggcaggaggauugcuug

SEQ ID NO: 1027316 - RNA, 23 nt, Human
aggcaggaggauugcuugaggcc

SEQ ID NO: 1027317 - RNA, 21 nt, Human
aggcugaggcaggaggauugc

SEQ ID NO: 1027318 - RNA, 24 nt, Human
aggcugaggcaggaggauugcuug

SEQ ID NO: 1027319 - RNA, 21 nt, Human
aggggauggggugucacucgg

SEQ ID NO: 1027320 - RNA, 24 nt, Human
caacauagcaagaguccgucuccc

SEQ ID NO: 1027321 - RNA, 24 nt, Human
ccccggggcccggcgccuuggccc

SEQ ID NO: 1027322 - RNA, 19 nt, Human
ccucuggcgggaggacggg

SEQ ID NO: 1027323 - RNA, 19 nt, Human
cgugcagagucgugaccug

SEQ ID NO: 1027324 - RNA, 20 nt, Human
cgugcagagucgugaccugg

SEQ ID NO: 1027325 - RNA, 22 nt, Human
cuggugauaagagcauggcccc

SEQ ID NO: 1027326 - RNA, 19 nt, Human
cuuugggaggcugaggcag

SEQ ID NO: 1027327 - RNA, 24 nt, Human
gaggcaggaggauugcuugaggcc

SEQ ID NO: 1027328 - RNA, 24 nt, Human
gauugcuugaggccaggaguucaa

SEQ ID NO: 1027329 - RNA, 19 nt, Human
gcccugaggcucuacacac

SEQ ID NO: 1027330 - RNA, 19 nt, Human
ggaacgcucugugacccuc

SEQ ID NO: 1027331 - RNA, 23 nt, Human
ggauugcuugaggccaggaguuc

SEQ ID NO: 1027332 - RNA, 20 nt, Human
gggcagggacccucuggcgg

SEQ ID NO: 1027333 - RNA, 25 nt, Human
ggggauggggugucacucggggcag

SEQ ID NO: 1027334 - RNA, 24 nt, Human
gguuuguaauccccgugcuuuggg

SEQ ID NO: 1027335 - RNA, 18 nt, Human
ucacucggggcagggacc

SEQ ID NO: 1027336 - RNA, 21 nt, Human
ucacucggggcagggacccuc

SEQ ID NO: 1027337 - RNA, 21 nt, Human
ucuggcgggaggacggguggc

SEQ ID NO: 1027338 - RNA, 20 nt, Human
ugaccuggaccaccccgugg

SEQ ID NO: 1027339 - RNA, 21 nt, Human
ugaggcaggaggauugcuuga

SEQ ID NO: 1027340 - RNA, 24 nt, Human
ugaggcaggaggauugcuugaggc

SEQ ID NO: 1027341 - RNA, 25 nt, Human
ugaggcaggaggauugcuugaggcc

SEQ ID NO: 1027342 - RNA, 26 nt, Human
ugaggcaggaggauugcuugaggcca

SEQ ID NO: 1027343 - RNA, 25 nt, Human
uggcgggaggacggguggcugguga

SEQ ID NO: 1027344 - RNA, 20 nt, Human
ugggaggcugaggcaggagg

SEQ ID NO: 1027345 - RNA, 22 nt, Human
ugggaggcugaggcaggaggau

SEQ ID NO: 1027346 - RNA, 19 nt, Human
ugggcacucagcccugagg

SEQ ID NO: 1027347 - RNA, 18 nt, Human
uggggugucacucggggc

SEQ ID NO: 1027348 - RNA, 21 nt, Human
ugggugaacuggcuccccaag

SEQ ID NO: 1027349 - RNA, 22 nt, Human
uugaggccaggaguucaagacc

SEQ ID NO: 1027350 - RNA, 23 nt, Human
uugcuugaggccaggaguucaag

SEQ ID NO: 1027351 - RNA, 20 nt, Human
uugggaggcugaggcaggag

SEQ ID NO: 1027352 - RNA, 23 nt, Human
uuuuuuuuuuuuuuuuuagccuu

SEQ ID NO: 1027353 - RNA, 24 nt, Human
aggaaaaagaacucuguaaagucc

SEQ ID NO: 1027354 - RNA, 21 nt, Human
cucccgccacuuuacuaggaa

SEQ ID NO: 1027355 - RNA, 24 nt, Human
gaaaaagaacucuguaaaguccua

SEQ ID NO: 1027356 - RNA, 19 nt, Human
gagaaaaggcuuuuuaaua

SEQ ID NO: 1027357 - RNA, 18 nt, Human
ggagaugcgccccgcccu

SEQ ID NO: 1027358 - RNA, 20 nt, Human
uaagaaaccauauucuauca

SEQ ID NO: 1027359 - RNA, 21 nt, Human
ugccaagaggaaaaagaacuc

SEQ ID NO: 1027360 - RNA, 21 nt, Human
uguuauuaggaaaugccaaga

SEQ ID NO: 1027361 - RNA, 31 nt, Human
uguuauuaggaaaugccaagaggaaaaagag

SEQ ID NO: 1027362 - RNA, 25 nt, Human
uuuuuuuuuuuuaagagaaaaggcu

SEQ ID NO: 1027363 - RNA, 19 nt, Human
uuuuuuuuuuuuuuuuuaa

SEQ ID NO: 1027364 - RNA, 25 nt, Human
uuuuuuuuuuuuuuuuuuuaagaga

SEQ ID NO: 1027365 - RNA, 19 nt, Human
aaccggggcugggcuggag

SEQ ID NO: 1027366 - RNA, 19 nt, Human
aaccugccuccgaaaaggc

SEQ ID NO: 1027367 - RNA, 23 nt, Human
aagcacucccugcagccaggaag

SEQ ID NO: 1027368 - RNA, 24 nt, Human
aagcgacacaggcggguacaaacc

SEQ ID NO: 1027369 - RNA, 22 nt, Human
acaaacccaaacagugcagaca

SEQ ID NO: 1027370 - RNA, 22 nt, Human
acacagagcccuccaaguucca

SEQ ID NO: 1027371 - RNA, 25 nt, Human
acaccucacccucugggaagcccca

SEQ ID NO: 1027372 - RNA, 27 nt, Human
accagccacccuccaccucgcaugugc

SEQ ID NO: 1027373 - RNA, 24 nt, Human
accagccuggcguucuucagacac

SEQ ID NO: 1027374 - RNA, 26 nt, Human
accccggagccgccuccucacgccuc

SEQ ID NO: 1027375 - RNA, 18 nt, Human
acccugagguuucccagc

SEQ ID NO: 1027376 - RNA, 21 nt, Human
accuaggugaccccggagccg

SEQ ID NO: 1027377 - RNA, 23 nt, Human
accucacccucugggaagcccca

SEQ ID NO: 1027378 - RNA, 24 nt, Human
accucacccucugggaagccccag

SEQ ID NO: 1027379 - RNA, 25 nt, Human
accucacccucugggaagccccagc

SEQ ID NO: 1027380 - RNA, 23 nt, Human
acgggcccugcuggguggcugcc

SEQ ID NO: 1027381 - RNA, 19 nt, Human
agacagaaggugaaaaugg

SEQ ID NO: 1027382 - RNA, 25 nt, Human
agacagaaggugaaaaugguuucug

SEQ ID NO: 1027383 - RNA, 19 nt, Human
agccugacagcugcccaaa

SEQ ID NO: 1027384 - RNA, 19 nt, Human
agcggggaggaaccggggc

SEQ ID NO: 1027385 - RNA, 21 nt, Human
agcuccuugcucuucacuuug

SEQ ID NO: 1027386 - RNA, 22 nt, Human
aggagggcaauggccaggccuc

SEQ ID NO: 1027387 - RNA, 23 nt, Human
aggcagccuucuggagcuuucug

SEQ ID NO: 1027388 - RNA, 20 nt, Human
aggccagggcugagggcggg

SEQ ID NO: 1027389 - RNA, 22 nt, Human
aggccagggcugagggcgggga

SEQ ID NO: 1027390 - RNA, 21 nt, Human
aggcggguacaaacccaaaca

SEQ ID NO: 1027391 - RNA, 20 nt, Human
aguugcuggguccuagggaa

SEQ ID NO: 1027392 - RNA, 18 nt, Human
auggugguucacgugucu

SEQ ID NO: 1027393 - RNA, 22 nt, Human
caaagccuccagagcacagaac

SEQ ID NO: 1027394 - RNA, 22 nt, Human
caacagcccaggauccuccagg

SEQ ID NO: 1027395 - RNA, 24 nt, Human
caauggccaggccucggccucagc

SEQ ID NO: 1027396 - RNA, 22 nt, Human
cacaagcacucccugcagccag

SEQ ID NO: 1027397 - RNA, 25 nt, Human
cacacgacuguagacguuuggcuuc

SEQ ID NO: 1027398 - RNA, 26 nt, Human
cacauuccacaccagccacccuccac

SEQ ID NO: 1027399 - RNA, 19 nt, Human
cacccccaacccccaaguc

SEQ ID NO: 1027400 - RNA, 21 nt, Human
cacccucugggaagccccagc

SEQ ID NO: 1027401 - RNA, 24 nt, Human
cacuuuggucuucguguggcuggu

SEQ ID NO: 1027402 - RNA, 21 nt, Human
cagagcccuccaaguuccacg

SEQ ID NO: 1027403 - RNA, 18 nt, Human
cagaggcacccugagguu

SEQ ID NO: 1027404 - RNA, 22 nt, Human
cagaucccucccacaaugcucu

SEQ ID NO: 1027405 - RNA, 28 nt, Human
cagaucccucccacaaugcucugaccac

SEQ ID NO: 1027406 - RNA, 20 nt, Human
cagcagacaccucacccucu

SEQ ID NO: 1027407 - RNA, 18 nt, Human
cagcagccugagaccggc

SEQ ID NO: 1027408 - RNA, 18 nt, Human
cagccacccuccaccucg

SEQ ID NO: 1027409 - RNA, 20 nt, Human
cagcccaggauccuccagga

SEQ ID NO: 1027410 - RNA, 18 nt, Human
cagcccccugccuggccu

SEQ ID NO: 1027411 - RNA, 22 nt, Human
cagcgguggaccccagcuuccc

SEQ ID NO: 1027412 - RNA, 18 nt, Human
cagcuggaccccacccuu

SEQ ID NO: 1027413 - RNA, 19 nt, Human
cagcuggaccccacccuuu

SEQ ID NO: 1027414 - RNA, 20 nt, Human
caggaagaguccagccccac

SEQ ID NO: 1027415 - RNA, 21 nt, Human
caggaagaguccagccccacu

SEQ ID NO: 1027416 - RNA, 19 nt, Human
caggagggcaauggccagg

SEQ ID NO: 1027417 - RNA, 21 nt, Human
caggauccuccaggacucucc

SEQ ID NO: 1027418 - RNA, 22 nt, Human
caggcggguacaaacccaaaca

SEQ ID NO: 1027419 - RNA, 28 nt, Human
caguucccucccuucuggagcucugccu

SEQ ID NO: 1027420 - RNA, 19 nt, Human
cauucagagccccccaugg

SEQ ID NO: 1027421 - RNA, 20 nt, Human
ccaaagccuccagagcacag

SEQ ID NO: 1027422 - RNA, 25 nt, Human
ccaaagccuccagagcacagaacgg

SEQ ID NO: 1027423 - RNA, 20 nt, Human
ccaaagcuguaccauuucag

SEQ ID NO: 1027424 - RNA, 20 nt, Human
ccaacccccaaguccucucc

SEQ ID NO: 1027425 - RNA, 21 nt, Human
ccaacccccaaguccucuccc

SEQ ID NO: 1027426 - RNA, 19 nt, Human
ccacaccagccacccucca

SEQ ID NO: 1027427 - RNA, 22 nt, Human
ccacaccagccacccuccaccu

SEQ ID NO: 1027428 - RNA, 22 nt, Human
ccaccuaggugaccccggagcc

SEQ ID NO: 1027429 - RNA, 21 nt, Human
ccagcagacaccucacccucu

SEQ ID NO: 1027430 - RNA, 21 nt, Human
ccagccuuuccugcaggaaga

SEQ ID NO: 1027431 - RNA, 18 nt, Human
ccaggaagaggaggaggc

SEQ ID NO: 1027432 - RNA, 22 nt, Human
ccagggccaggagugucagggg

SEQ ID NO: 1027433 - RNA, 21 nt, Human
ccagggcugagggcggggagg

SEQ ID NO: 1027434 - RNA, 23 nt, Human
ccaggggccggggguccacagcc

SEQ ID NO: 1027435 - RNA, 21 nt, Human
ccaucugcucugcacaccguc

SEQ ID NO: 1027436 - RNA, 20 nt, Human
ccauggguccccuggggccc

SEQ ID NO: 1027437 - RNA, 24 nt, Human
ccauucgcaaugcagcuggacccc

SEQ ID NO: 1027438 - RNA, 23 nt, Human
cccaaacagugcagacauggagg

SEQ ID NO: 1027439 - RNA, 26 nt, Human
cccacaaugcucugaccacccccaaa

SEQ ID NO: 1027440 - RNA, 26 nt, Human
cccacaaugcucugaccacccccaac

SEQ ID NO: 1027441 - RNA, 22 nt, Human
cccauggccugggcaguccauc

SEQ ID NO: 1027442 - RNA, 23 nt, Human
ccccacgcugugccugcccagcu

SEQ ID NO: 1027443 - RNA, 18 nt, Human
ccccagcugccccagauc

SEQ ID NO: 1027444 - RNA, 26 nt, Human
ccccagcugccccagaucccucccac

SEQ ID NO: 1027445 - RNA, 19 nt, Human
ccccagggcuggggugacc

SEQ ID NO: 1027446 - RNA, 23 nt, Human
cccccaacccccaaguccucucc

SEQ ID NO: 1027447 - RNA, 23 nt, Human
cccccaaguccucucccuucugu

SEQ ID NO: 1027448 - RNA, 22 nt, Human
cccccuggcgguuggaacuccu

SEQ ID NO: 1027449 - RNA, 18 nt, Human
ccccgcagguuccucuuc

SEQ ID NO: 1027450 - RNA, 21 nt, Human
ccccucggcacguggucccca

SEQ ID NO: 1027451 - RNA, 23 nt, Human
ccccuggggccccaugcuggaac

SEQ ID NO: 1027452 - RNA, 19 nt, Human
cccgcagcuccccacaacu

SEQ ID NO: 1027453 - RNA, 22 nt, Human
cccguccccuccccgcucacca

SEQ ID NO: 1027454 - RNA, 20 nt, Human
cccucuggggacaccagccu

SEQ ID NO: 1027455 - RNA, 25 nt, Human
cccugagguuucccagcaggcaauu

SEQ ID NO: 1027456 - RNA, 19 nt, Human
cccuggggccccaugcugg

SEQ ID NO: 1027457 - RNA, 24 nt, Human
cccuggggccccaugcuggaaccc

SEQ ID NO: 1027458 - RNA, 18 nt, Human
cccuucugggccuguugc

SEQ ID NO: 1027459 - RNA, 25 nt, Human
ccgcacacgcuccgcugccucuccc

SEQ ID NO: 1027460 - RNA, 27 nt, Human
ccgcagguuccucuucauucagagccc

SEQ ID NO: 1027461 - RNA, 23 nt, Human
ccgguucugugucccguccccuc

SEQ ID NO: 1027462 - RNA, 18 nt, Human
ccuccugcccucccccuc

SEQ ID NO: 1027463 - RNA, 22 nt, Human
ccucugcagcagcacucaacuc

SEQ ID NO: 1027464 - RNA, 30 nt, Human
ccucugcagcagcacucaacucaugcacuu

SEQ ID NO: 1027465 - RNA, 18 nt, Human
ccucugggaagccccagc

SEQ ID NO: 1027466 - RNA, 19 nt, Human
ccucuggggacaccagccu

SEQ ID NO: 1027467 - RNA, 25 nt, Human
ccugcagccaggaagaggaggaggc

SEQ ID NO: 1027468 - RNA, 24 nt, Human
ccugcagcggggaggaaccggggc

SEQ ID NO: 1027469 - RNA, 24 nt, Human
ccuggcgguuggaacuccugucuc

SEQ ID NO: 1027470 - RNA, 19 nt, Human
ccuggggacgccuggggcu

SEQ ID NO: 1027471 - RNA, 20 nt, Human
ccuggggcugccccaauucc

SEQ ID NO: 1027472 - RNA, 20 nt, Human
ccugugcagcagccugagac

SEQ ID NO: 1027473 - RNA, 20 nt, Human
ccuuccauuucacuugguua

SEQ ID NO: 1027474 - RNA, 23 nt, Human
ccuuggagcugcccccgcccugg

SEQ ID NO: 1027475 - RNA, 24 nt, Human
cggccucagcccccugccuggccu

SEQ ID NO: 1027476 - RNA, 22 nt, Human
cgggcacauuccacaccagcca

SEQ ID NO: 1027477 - RNA, 18 nt, Human
cgggcugaaaacaguuca

SEQ ID NO: 1027478 - RNA, 23 nt, Human
cguggccugaugucugcauauuc

SEQ ID NO: 1027479 - RNA, 23 nt, Human
cguugcauguuccugcgugugca

SEQ ID NO: 1027480 - RNA, 23 nt, Human
cucacccucugggaagccccagc

SEQ ID NO: 1027481 - RNA, 22 nt, Human
cucccacaaugcucugaccacc

SEQ ID NO: 1027482 - RNA, 24 nt, Human
cucccaccugugagucccaggggc

SEQ ID NO: 1027483 - RNA, 20 nt, Human
cuccugcccucccccucggc

SEQ ID NO: 1027484 - RNA, 22 nt, Human
cuccuuccauuucacuugguua

SEQ ID NO: 1027485 - RNA, 26 nt, Human
cucggggugggccacggccgguucug

SEQ ID NO: 1027486 - RNA, 22 nt, Human
cugaaaacaguucauccugagu

SEQ ID NO: 1027487 - RNA, 24 nt, Human
cugaagccucucagagcaggucca

SEQ ID NO: 1027488 - RNA, 23 nt, Human
cugaccacccccaacccccaagu

SEQ ID NO: 1027489 - RNA, 21 nt, Human
cugagaccggcuguccaaugg

SEQ ID NO: 1027490 - RNA, 25 nt, Human
cugcaccgccgccugcuccgcccuc

SEQ ID NO: 1027491 - RNA, 20 nt, Human
cugcagccaggaagaggagg

SEQ ID NO: 1027492 - RNA, 18 nt, Human
cugcagcggggaggaacc

SEQ ID NO: 1027493 - RNA, 26 nt, Human
cugcagcggggaggaaccggggcugg

SEQ ID NO: 1027494 - RNA, 20 nt, Human
cugcccaaagccuccagagc

SEQ ID NO: 1027495 - RNA, 18 nt, Human
cugccucucugggcuggc

SEQ ID NO: 1027496 - RNA, 20 nt, Human
cuggaccccacccuuuccug

SEQ ID NO: 1027497 - RNA, 25 nt, Human
cuggggacaccagccuggcguucuu

SEQ ID NO: 1027498 - RNA, 24 nt, Human
cugugaccgcuuugaucaccuggc

SEQ ID NO: 1027499 - RNA, 23 nt, Human
cuucuggacucaaauccuucacc

SEQ ID NO: 1027500 - RNA, 26 nt, Human
cuuggagcugcccccgcccugggcca

SEQ ID NO: 1027501 - RNA, 22 nt, Human
cuuuccugauucccgcaggcca

SEQ ID NO: 1027502 - RNA, 20 nt, Human
gaaccggggcugggcuggaa

SEQ ID NO: 1027503 - RNA, 19 nt, Human
gaagaggaggaggcagccg

SEQ ID NO: 1027504 - RNA, 23 nt, Human
gacacaagcacucccugcagcca

SEQ ID NO: 1027505 - RNA, 19 nt, Human
gacaccagccuggcguucu

SEQ ID NO: 1027506 - RNA, 20 nt, Human
gacccgggcugaaaacaguu

SEQ ID NO: 1027507 - RNA, 24 nt, Human
gacucacguucccacggccaccuu

SEQ ID NO: 1027508 - RNA, 19 nt, Human
gacuguagacguuuggcuu

SEQ ID NO: 1027509 - RNA, 18 nt, Human
gagcacugaccuccuucu

SEQ ID NO: 1027510 - RNA, 21 nt, Human
gagcccagaggcccccgcagc

SEQ ID NO: 1027511 - RNA, 18 nt, Human
gagccccuccagccgccc

SEQ ID NO: 1027512 - RNA, 21 nt, Human
gagcugcccccgcccugggcc

SEQ ID NO: 1027513 - RNA, 19 nt, Human
gagggcaauggccaggccu

SEQ ID NO: 1027514 - RNA, 19 nt, Human
gcacgugguccccacgcug

SEQ ID NO: 1027515 - RNA, 22 nt, Human
gcagagcuuccuucugggaaag

SEQ ID NO: 1027516 - RNA, 22 nt, Human
gcaggagggaaacugcuggcug

SEQ ID NO: 1027517 - RNA, 23 nt, Human
gcaggccagggcugagggcgggg

SEQ ID NO: 1027518 - RNA, 18 nt, Human
gccaggccucggccucag

SEQ ID NO: 1027519 - RNA, 19 nt, Human
gccaggggaggggaggagg

SEQ ID NO: 1027520 - RNA, 19 nt, Human
gcccccgcagguuccucuu

SEQ ID NO: 1027521 - RNA, 19 nt, Human
gcccucaggcagccuucug

SEQ ID NO: 1027522 - RNA, 19 nt, Human
gcccuccugcccucccccu

SEQ ID NO: 1027523 - RNA, 21 nt, Human
gcccucuggggacaccagccu

SEQ ID NO: 1027524 - RNA, 23 nt, Human
gccgggcacauuccacaccagcc

SEQ ID NO: 1027525 - RNA, 18 nt, Human
gccucagcccccugccug

SEQ ID NO: 1027526 - RNA, 24 nt, Human
gccucggccucagcccccugccug

SEQ ID NO: 1027527 - RNA, 21 nt, Human
gccuucuggagcuuucugucu

SEQ ID NO: 1027528 - RNA, 27 nt, Human
gcgccugacuccggaggccucagaggc

SEQ ID NO: 1027529 - RNA, 20 nt, Human
gcuccgcccuccugcccucc

SEQ ID NO: 1027530 - RNA, 20 nt, Human
gcuggacacagagcccucca

SEQ ID NO: 1027531 - RNA, 18 nt, Human
gcuggguccuagggaagg

SEQ ID NO: 1027532 - RNA, 18 nt, Human
ggaccccacccuuuccug

SEQ ID NO: 1027533 - RNA, 21 nt, Human
ggagcccagggccaggagugu

SEQ ID NO: 1027534 - RNA, 23 nt, Human
ggaggagacagaaggugaaaaug

SEQ ID NO: 1027535 - RNA, 20 nt, Human
ggaggaggcagccgggucuu

SEQ ID NO: 1027536 - RNA, 20 nt, Human
ggaggcggggggagcccagg

SEQ ID NO: 1027537 - RNA, 21 nt, Human
ggcacgcuucuuccccucggc

SEQ ID NO: 1027538 - RNA, 22 nt, Human
ggccccaugcuggaaccccagc

SEQ ID NO: 1027539 - RNA, 28 nt, Human
ggccucggccucagcccccugccuggcc

SEQ ID NO: 1027540 - RNA, 22 nt, Human
gggaggaaccggggcugggcug

SEQ ID NO: 1027541 - RNA, 21 nt, Human
gggaggcggggggagcccagg

SEQ ID NO: 1027542 - RNA, 19 nt, Human
gggaggggaggaggugggg

SEQ ID NO: 1027543 - RNA, 21 nt, Human
gggaggggaggagguggggaa

SEQ ID NO: 1027544 - RNA, 24 nt, Human
gggauccugcugcuccuccgccgg

SEQ ID NO: 1027545 - RNA, 19 nt, Human
gggccuccugcaccgccgc

SEQ ID NO: 1027546 - RNA, 18 nt, Human
gggccuguugcugcugac

SEQ ID NO: 1027547 - RNA, 21 nt, Human
gggcugagggcggggaggggc

SEQ ID NO: 1027548 - RNA, 22 nt, Human
gggcugggcuggaggccugggg

SEQ ID NO: 1027549 - RNA, 24 nt, Human
ggggaggaaccggggcugggcugg

SEQ ID NO: 1027550 - RNA, 18 nt, Human
ggggaggggaggaggugg

SEQ ID NO: 1027551 - RNA, 20 nt, Human
gguguguguuucucucuaaa

SEQ ID NO: 1027552 - RNA, 21 nt, Human
gguuauuaggaguggaguugc

SEQ ID NO: 1027553 - RNA, 24 nt, Human
guccacgguucauuuuguguugcc

SEQ ID NO: 1027554 - RNA, 18 nt, Human
guccagccccacucccag

SEQ ID NO: 1027555 - RNA, 26 nt, Human
gucucuccaucucacuucccgugcaa

SEQ ID NO: 1027556 - RNA, 20 nt, Human
gugcaguguguguccacggg

SEQ ID NO: 1027557 - RNA, 21 nt, Human
guggcugcccuucugggccug

SEQ ID NO: 1027558 - RNA, 21 nt, Human
guucccucccuucuggagcuc

SEQ ID NO: 1027559 - RNA, 22 nt, Human
guugcugcugacucacguuccc

SEQ ID NO: 1027560 - RNA, 21 nt, Human
uaccauuucaggcuccugccu

SEQ ID NO: 1027561 - RNA, 23 nt, Human
uacccuggccugcagcggggagg

SEQ ID NO: 1027562 - RNA, 22 nt, Human
uacuccacggcggcuggaacgg

SEQ ID NO: 1027563 - RNA, 24 nt, Human
ucagcccccugccuggccugcacu

SEQ ID NO: 1027564 - RNA, 19 nt, Human
uccaggacucucccccugg

SEQ ID NO: 1027565 - RNA, 19 nt, Human
uccauggcgccugacuccg

SEQ ID NO: 1027566 - RNA, 21 nt, Human
ucccaggggccggggguccac

SEQ ID NO: 1027567 - RNA, 18 nt, Human
uccccaagcccgaggccu

SEQ ID NO: 1027568 - RNA, 22 nt, Human
ucccccuggcgguuggaacucc

SEQ ID NO: 1027569 - RNA, 21 nt, Human
ucccugcgucuggacguagua

SEQ ID NO: 1027570 - RNA, 18 nt, Human
uccucucccuucuguccc

SEQ ID NO: 1027571 - RNA, 18 nt, Human
uccugcaccgccgccugc

SEQ ID NO: 1027572 - RNA, 20 nt, Human
ucgcaugugcguuuaucgau

SEQ ID NO: 1027573 - RNA, 18 nt, Human
ucucugggcuggcucagc

SEQ ID NO: 1027574 - RNA, 23 nt, Human
ucugagccccuccagccgcccuc

SEQ ID NO: 1027575 - RNA, 20 nt, Human
ucuggagcuuucugucugug

SEQ ID NO: 1027576 - RNA, 22 nt, Human
ucugggaagccccagcugcccc

SEQ ID NO: 1027577 - RNA, 22 nt, Human
ugaaacgccacagugggaccuc

SEQ ID NO: 1027578 - RNA, 21 nt, Human
ugaagccucucagagcagguc

SEQ ID NO: 1027579 - RNA, 24 nt, Human
ugaccauuucagccauuggcaagu

SEQ ID NO: 1027580 - RNA, 19 nt, Human
ugacccgggcugaaaacag

SEQ ID NO: 1027581 - RNA, 24 nt, Human
ugacucacguucccacggccaccu

SEQ ID NO: 1027582 - RNA, 18 nt, Human
ugagucccaggggccggg

SEQ ID NO: 1027583 - RNA, 23 nt, Human
ugagucccaggggccgggggucc

SEQ ID NO: 1027584 - RNA, 19 nt, Human
ugcauauucauccgccgug

SEQ ID NO: 1027585 - RNA, 20 nt, Human
ugcccaaagccuccagagca

SEQ ID NO: 1027586 - RNA, 21 nt, Human
ugcccaaagccuccagagcac

SEQ ID NO: 1027587 - RNA, 25 nt, Human
ugcccaaagccuccagagcacagaa

SEQ ID NO: 1027588 - RNA, 20 nt, Human
ugccccaauucccagcagac

SEQ ID NO: 1027589 - RNA, 19 nt, Human
ugccccagaucccucccac

SEQ ID NO: 1027590 - RNA, 23 nt, Human
ugccccagaucccucccacaaug

SEQ ID NO: 1027591 - RNA, 20 nt, Human
ugccuggaugcccgccccug

SEQ ID NO: 1027592 - RNA, 24 nt, Human
ugcucugaccacccccaaccccca

SEQ ID NO: 1027593 - RNA, 22 nt, Human
ugcuggguggcugccaacagcc

SEQ ID NO: 1027594 - RNA, 21 nt, Human
ugcugguggguguugcagugg

SEQ ID NO: 1027595 - RNA, 20 nt, Human
uggaacuccugucucccacc

SEQ ID NO: 1027596 - RNA, 26 nt, Human
uggaacuccugucucccaccugugag

SEQ ID NO: 1027597 - RNA, 24 nt, Human
uggaggagacagaaggugaaaaug

SEQ ID NO: 1027598 - RNA, 25 nt, Human
uggauguggacauugugcugugacc

SEQ ID NO: 1027599 - RNA, 18 nt, Human
uggccugggcaguccauc

SEQ ID NO: 1027600 - RNA, 20 nt, Human
uggcgccucggggccuggcu

SEQ ID NO: 1027601 - RNA, 22 nt, Human
uggcucagccguugcauguucc

SEQ ID NO: 1027602 - RNA, 21 nt, Human
uggcuucuggacucaaauccu

SEQ ID NO: 1027603 - RNA, 18 nt, Human
ugggaaagccaugggucc

SEQ ID NO: 1027604 - RNA, 19 nt, Human
ugggaaagccauggguccc

SEQ ID NO: 1027605 - RNA, 22 nt, Human
ugggaaagccauggguccccug

SEQ ID NO: 1027606 - RNA, 19 nt, Human
ugggauccugcugcuccuc

SEQ ID NO: 1027607 - RNA, 18 nt, Human
ugguggguguugcagugg

SEQ ID NO: 1027608 - RNA, 18 nt, Human
ugguucuagaauucuccu

SEQ ID NO: 1027609 - RNA, 22 nt, Human
ugucccguccccuccccgcuca

SEQ ID NO: 1027610 - RNA, 18 nt, Human
uuccacaccagccacccu

SEQ ID NO: 1027611 - RNA, 20 nt, Human
uuccacaccagccacccucc

SEQ ID NO: 1027612 - RNA, 24 nt, Human
uuccacaccagccacccuccaccu

SEQ ID NO: 1027613 - RNA, 23 nt, Human
uuccacgggccuccugcaccgcc

SEQ ID NO: 1027614 - RNA, 24 nt, Human
uugcagugguuuccagcucuuggu

SEQ ID NO: 1027615 - RNA, 27 nt, Human
uugccaaaccgauguccaaagcuguac

SEQ ID NO: 1027616 - RNA, 21 nt, Human
uugcuggguccuagggaaggu

SEQ ID NO: 1027617 - RNA, 21 nt, Human
uuugccaaaccgauguccaaa

SEQ ID NO: 1027618 - RNA, 30 nt, Human
augaauucucugcugcugcugcugcugccg

SEQ ID NO: 1027619 - RNA, 21 nt, Human
auucucugcugcugcugcugc

SEQ ID NO: 1027620 - RNA, 21 nt, Human
caugaauaaagcccuuccuac

SEQ ID NO: 1027621 - RNA, 23 nt, Human
ccaccaguccuucucuggauucu

SEQ ID NO: 1027622 - RNA, 20 nt, Human
gauucuuucuuggugaggca

SEQ ID NO: 1027623 - RNA, 23 nt, Human
gcugcugcugcugcugcugcugg

SEQ ID NO: 1027624 - RNA, 20 nt, Human
gugguguuccucaagagaaa

SEQ ID NO: 1027625 - RNA, 24 nt, Human
uaauuucuuuccuauauugauugc

SEQ ID NO: 1027626 - RNA, 23 nt, Human
ucaugaauaaagcccuuccuaca

SEQ ID NO: 1027627 - RNA, 19 nt, Human
ucuggauucuuucuuggug

SEQ ID NO: 1027628 - RNA, 18 nt, Human
ugagaauguuuugagaau

SEQ ID NO: 1027629 - RNA, 21 nt, Human
ugcugcugcugcugcugcugc

SEQ ID NO: 1027630 - RNA, 21 nt, Human
ugcugcugcugcugcugcugc

SEQ ID NO: 1027631 - RNA, 23 nt, Human
uucucugcugcugcugcugcugc

SEQ ID NO: 1027632 - RNA, 26 nt, Human
uugauaacugaucaguaauuucuuuc

SEQ ID NO: 1027633 - RNA, 18 nt, Human
aaaaaaggaagaauugaa

SEQ ID NO: 1027634 - RNA, 21 nt, Human
aagacccaaccaaaccaagaa

SEQ ID NO: 1027635 - RNA, 26 nt, Human
aaguaccccaaagaauccauacgaga

SEQ ID NO: 1027636 - RNA, 21 nt, Human
acacuuccaaaccccaaacaa

SEQ ID NO: 1027637 - RNA, 22 nt, Human
acccaaccaaaccaagaaacca

SEQ ID NO: 1027638 - RNA, 20 nt, Human
acggaccugcucaacgagug

SEQ ID NO: 1027639 - RNA, 21 nt, Human
agaaacaaacuaacucaaaua

SEQ ID NO: 1027640 - RNA, 20 nt, Human
agaaacugagaaacaaacua

SEQ ID NO: 1027641 - RNA, 31 nt, Human
agaaacugagaaacaaacuaacucaaauaaa

SEQ ID NO: 1027642 - RNA, 18 nt, Human
agaauccauacgagaaac

SEQ ID NO: 1027643 - RNA, 24 nt, Human
agacccaaccaaaccaagaaacca

SEQ ID NO: 1027644 - RNA, 20 nt, Human
agacccacaggcuuaaggaa

SEQ ID NO: 1027645 - RNA, 18 nt, Human
agcaggacaaccuuccuc

SEQ ID NO: 1027646 - RNA, 18 nt, Human
agccagucgugguggcgc

SEQ ID NO: 1027647 - RNA, 19 nt, Human
aggaagggcuugggggucg

SEQ ID NO: 1027648 - RNA, 26 nt, Human
aggcggaaagcagggcuaagccgacc

SEQ ID NO: 1027649 - RNA, 20 nt, Human
aguaauggacgcgaaagaga

SEQ ID NO: 1027650 - RNA, 20 nt, Human
agugcagacacuuccaaacc

SEQ ID NO: 1027651 - RNA, 23 nt, Human
auuccauacaguaucugcuaaau

SEQ ID NO: 1027652 - RNA, 22 nt, Human
caaacaaugaaucaaacaacca

SEQ ID NO: 1027653 - RNA, 20 nt, Human
caaauaagacccaaccaaac

SEQ ID NO: 1027654 - RNA, 25 nt, Human
caaguugaaaggagcgagcuucuca

SEQ ID NO: 1027655 - RNA, 24 nt, Human
cacagcgcgcugacaauucacgga

SEQ ID NO: 1027656 - RNA, 23 nt, Human
cacucaggcuaccaaaguacccc

SEQ ID NO: 1027657 - RNA, 19 nt, Human
cacugugugagcucacgcc

SEQ ID NO: 1027658 - RNA, 21 nt, Human
caggcuaccaaaguaccccaa

SEQ ID NO: 1027659 - RNA, 19 nt, Human
caguaccaaacaaguugaa

SEQ ID NO: 1027660 - RNA, 18 nt, Human
cauaugauugcagcaucc

SEQ ID NO: 1027661 - RNA, 22 nt, Human
ccaaacaaguugaaaggagcga

SEQ ID NO: 1027662 - RNA, 18 nt, Human
ccaaacaaugaaucaaac

SEQ ID NO: 1027663 - RNA, 22 nt, Human
ccaaccaaaccaagaaaccagu

SEQ ID NO: 1027664 - RNA, 19 nt, Human
ccagucgccugcggccgag

SEQ ID NO: 1027665 - RNA, 23 nt, Human
cccaaagaauccauacgagaaac

SEQ ID NO: 1027666 - RNA, 20 nt, Human
cccacagcgcgcugacaauu

SEQ ID NO: 1027667 - RNA, 18 nt, Human
ccccaaacaaugaaucaa

SEQ ID NO: 1027668 - RNA, 18 nt, Human
cccccagucgguggcugc

SEQ ID NO: 1027669 - RNA, 23 nt, Human
cccguaaccgccguccagucgcc

SEQ ID NO: 1027670 - RNA, 23 nt, Human
ccgauagcaaaccgacgucccug

SEQ ID NO: 1027671 - RNA, 23 nt, Human
ccgccgcggccacacagucgccc

SEQ ID NO: 1027672 - RNA, 27 nt, Human
ccugcggccgagggcaggcuggcggga

SEQ ID NO: 1027673 - RNA, 20 nt, Human
ccuggcggccgccgcggcca

SEQ ID NO: 1027674 - RNA, 21 nt, Human
ccuggcggccgccgcggccac

SEQ ID NO: 1027675 - RNA, 24 nt, Human
cgagaaacugagaaacaaacuaac

SEQ ID NO: 1027676 - RNA, 21 nt, Human
cgccugcggccgagggcaggc

SEQ ID NO: 1027677 - RNA, 22 nt, Human
cguccagucgccugcggccgag

SEQ ID NO: 1027678 - RNA, 23 nt, Human
cucacgcccuuuuucccuuuaaa

SEQ ID NO: 1027679 - RNA, 22 nt, Human
gacgcgaaagagaugaaaaaga

SEQ ID NO: 1027680 - RNA, 26 nt, Human
gagaaacugagaaacaaacuaacuca

SEQ ID NO: 1027681 - RNA, 25 nt, Human
gagcucacgcccuuuuucccuuuaa

SEQ ID NO: 1027682 - RNA, 19 nt, Human
gaggggaggcggggcugcc

SEQ ID NO: 1027683 - RNA, 23 nt, Human
gccuggcggccgccgcggccaca

SEQ ID NO: 1027684 - RNA, 20 nt, Human
gcucuggaggggaggcgggg

SEQ ID NO: 1027685 - RNA, 24 nt, Human
gcucuggaggggaggcggggcugc

SEQ ID NO: 1027686 - RNA, 21 nt, Human
ggacgcgccggcggcggggaa

SEQ ID NO: 1027687 - RNA, 24 nt, Human
ggcucuggaggggaggcggggcug

SEQ ID NO: 1027688 - RNA, 24 nt, Human
ggcuuaaggaagggcuuggggguc

SEQ ID NO: 1027689 - RNA, 20 nt, Human
gggcggagccagccccgggg

SEQ ID NO: 1027690 - RNA, 20 nt, Human
ggggcgucaucagcccauga

SEQ ID NO: 1027691 - RNA, 18 nt, Human
guggcugcucacggccca

SEQ ID NO: 1027692 - RNA, 23 nt, Human
guuuaauauauauauauaugugu

SEQ ID NO: 1027693 - RNA, 22 nt, Human
uaagacccaaccaaaccaagaa

SEQ ID NO: 1027694 - RNA, 19 nt, Human
uacaguaucugcuaaauaa

SEQ ID NO: 1027695 - RNA, 23 nt, Human
uaccccaaagaauccauacgaga

SEQ ID NO: 1027696 - RNA, 19 nt, Human
uauauauauaugugugugu

SEQ ID NO: 1027697 - RNA, 24 nt, Human
uauguguguguguuugaaauagua

SEQ ID NO: 1027698 - RNA, 22 nt, Human
ucaaauaagacccaaccaaacc

SEQ ID NO: 1027699 - RNA, 20 nt, Human
uccaucauuugaaguaaaac

SEQ ID NO: 1027700 - RNA, 23 nt, Human
ucccugcugcgguucuaagugcc

SEQ ID NO: 1027701 - RNA, 18 nt, Human
uccguagcaggacaaccu

SEQ ID NO: 1027702 - RNA, 22 nt, Human
ugaaucaaacaaccaaccaacc

SEQ ID NO: 1027703 - RNA, 20 nt, Human
ugagaaacaaacuaacucag

SEQ ID NO: 1027704 - RNA, 19 nt, Human
ugaugugcuaauaugcucu

SEQ ID NO: 1027705 - RNA, 24 nt, Human
uggcugcucacggcccaguggacc

SEQ ID NO: 1027706 - RNA, 21 nt, Human
uuaaggaagggcuuggggguc

SEQ ID NO: 1027707 - RNA, 21 nt, Human
uucuuagacccacaggcuuaa

SEQ ID NO: 1027708 - RNA, 19 nt, Human
uuucccuuuaaaaacugaa

SEQ ID NO: 1027709 - RNA, 21 nt, Human
uuuuugauuuugauuaucauc

SEQ ID NO: 1027710 - RNA, 24 nt, Human
aaagggcugggauuauagguguga

SEQ ID NO: 1027711 - RNA, 19 nt, Human
aaagugcugggaguacagg

SEQ ID NO: 1027712 - RNA, 24 nt, Human
aaagugcugggauuauaggcguga

SEQ ID NO: 1027713 - RNA, 18 nt, Human
aaaucacuuaaccucaag

SEQ ID NO: 1027714 - RNA, 20 nt, Human
aagaagcggugacugguucc

SEQ ID NO: 1027715 - RNA, 24 nt, Human
aagcaaucugccugucucggccuc

SEQ ID NO: 1027716 - RNA, 20 nt, Human
aaggaagaaguuccagagag

SEQ ID NO: 1027717 - RNA, 24 nt, Human
aaguaccugggauuacaggcgugu

SEQ ID NO: 1027718 - RNA, 19 nt, Human
aagugcugggauuauaggc

SEQ ID NO: 1027719 - RNA, 19 nt, Human
aagugcugggauuauaggc

SEQ ID NO: 1027720 - RNA, 26 nt, Human
aagugcugggauuauaggcgugagcc

SEQ ID NO: 1027721 - RNA, 22 nt, Human
acacagcaacucccaauuucau

SEQ ID NO: 1027722 - RNA, 18 nt, Human
acagaaaaaguacacagg

SEQ ID NO: 1027723 - RNA, 19 nt, Human
acagggucucauuauguug

SEQ ID NO: 1027724 - RNA, 18 nt, Human
accauguuggccaggcug

SEQ ID NO: 1027725 - RNA, 24 nt, Human
accauguuggccaggcuggucucg

SEQ ID NO: 1027726 - RNA, 19 nt, Human
acccaaaagcaugggcaac

SEQ ID NO: 1027727 - RNA, 26 nt, Human
acccaaaagcaugggcaacacccucc

SEQ ID NO: 1027728 - RNA, 22 nt, Human
accccuagcugcaaaggaagcc

SEQ ID NO: 1027729 - RNA, 24 nt, Human
accugaguagcugggauuacgggu

SEQ ID NO: 1027730 - RNA, 24 nt, Human
acggagcuucaccauguuggccag

SEQ ID NO: 1027731 - RNA, 21 nt, Human
acgggguuuugccauuguugg

SEQ ID NO: 1027732 - RNA, 25 nt, Human
acgggguuuugccauuguuggccag

SEQ ID NO: 1027733 - RNA, 20 nt, Human
acgggguuuugccauuguuu

SEQ ID NO: 1027734 - RNA, 23 nt, Human
acggguaucaccauguuggccag

SEQ ID NO: 1027735 - RNA, 24 nt, Human
acucugucgcucaggcuggaaugc

SEQ ID NO: 1027736 - RNA, 19 nt, Human
acugcaaccaccaccuccu

SEQ ID NO: 1027737 - RNA, 18 nt, Human
agacagagucucaugccc

SEQ ID NO: 1027738 - RNA, 24 nt, Human
agcaaaucuccugccucacccucc

SEQ ID NO: 1027739 - RNA, 19 nt, Human
agccaccgcaccuggccua

SEQ ID NO: 1027740 - RNA, 22 nt, Human
agcggugacugguucccaaaac

SEQ ID NO: 1027741 - RNA, 23 nt, Human
agcugggauuacgggugugugcc

SEQ ID NO: 1027742 - RNA, 18 nt, Human
agcuucaccauguuggcc

SEQ ID NO: 1027743 - RNA, 22 nt, Human
aggaggaaggaagaaguuccag

SEQ ID NO: 1027744 - RNA, 20 nt, Human
aggcaggaggaaggaagaag

SEQ ID NO: 1027745 - RNA, 23 nt, Human
aggcgugagccaccgugccuggc

SEQ ID NO: 1027746 - RNA, 24 nt, Human
aggcgugugccaccaugccuggcu

SEQ ID NO: 1027747 - RNA, 25 nt, Human
aggcuggagugcaguggcaugaucu

SEQ ID NO: 1027748 - RNA, 24 nt, Human
agggcugggauuauaggugugagc

SEQ ID NO: 1027749 - RNA, 24 nt, Human
aggugauccaccugccucagccuc

SEQ ID NO: 1027750 - RNA, 21 nt, Human
aggugugagccaccuugccca

SEQ ID NO: 1027751 - RNA, 18 nt, Human
aguagcugggauuacagg

SEQ ID NO: 1027752 - RNA, 23 nt, Human
aguagcugggauuacgggugugu

SEQ ID NO: 1027753 - RNA, 23 nt, Human
agucucaugcccaggcuggagug

SEQ ID NO: 1027754 - RNA, 20 nt, Human
agugcaguggcaugaucucg

SEQ ID NO: 1027755 - RNA, 23 nt, Human
agugcaguggcaugaucucggcu

SEQ ID NO: 1027756 - RNA, 24 nt, Human
agugcaguggcaugaucucggcuc

SEQ ID NO: 1027757 - RNA, 20 nt, Human
agugcaguggcaugaucuug

SEQ ID NO: 1027758 - RNA, 23 nt, Human
agugcaguggcaugaucuuggcu

SEQ ID NO: 1027759 - RNA, 24 nt, Human
agugcaguggcaugaucuuggcuc

SEQ ID NO: 1027760 - RNA, 24 nt, Human
aguggcaugaucucggcucacugc

SEQ ID NO: 1027761 - RNA, 21 nt, Human
aguggcaugaucuuggcucgc

SEQ ID NO: 1027762 - RNA, 24 nt, Human
augauucuccugccucagccuucc

SEQ ID NO: 1027763 - RNA, 24 nt, Human
augcccaggcuggagugcaguggc

SEQ ID NO: 1027764 - RNA, 22 nt, Human
auguugcccaggcuggucuuga

SEQ ID NO: 1027765 - RNA, 21 nt, Human
auuacaggcgugugccaccau

SEQ ID NO: 1027766 - RNA, 24 nt, Human
auuauguugcccaggcuggucuug

SEQ ID NO: 1027767 - RNA, 24 nt, Human
auuuuuguauuuuugguagagacg

SEQ ID NO: 1027768 - RNA, 24 nt, Human
auuuuuguguuuuuaguagagacg

SEQ ID NO: 1027769 - RNA, 24 nt, Human
caaagggcugggauuauaggugug

SEQ ID NO: 1027770 - RNA, 24 nt, Human
caaagugcugggauuauaggcgug

SEQ ID NO: 1027771 - RNA, 23 nt, Human
caaccuccaccucccagguucaa

SEQ ID NO: 1027772 - RNA, 22 nt, Human
caagugauucuccugccucagc

SEQ ID NO: 1027773 - RNA, 24 nt, Human
caagugauucuccugccucagcca

SEQ ID NO: 1027774 - RNA, 22 nt, Human
cacagccucaguagcacccccc

SEQ ID NO: 1027775 - RNA, 24 nt, Human
caccacgcccagcuaauuuuugua

SEQ ID NO: 1027776 - RNA, 23 nt, Human
caccaugccuggcuaauuuuugu

SEQ ID NO: 1027777 - RNA, 21 nt, Human
caccauguuggccaggcuggu

SEQ ID NO: 1027778 - RNA, 21 nt, Human
caccauguuggccaggcuggu

SEQ ID NO: 1027779 - RNA, 24 nt, Human
caccauguuggccaggcuggucuc

SEQ ID NO: 1027780 - RNA, 24 nt, Human
caccauguuggccaggcuggucuc

SEQ ID NO: 1027781 - RNA, 27 nt, Human
caccauguuggccaggcuggucucaaa

SEQ ID NO: 1027782 - RNA, 27 nt, Human
caccauguuggccaggcuggucucgaa

SEQ ID NO: 1027783 - RNA, 21 nt, Human
caccgugccuggccccaaaau

SEQ ID NO: 1027784 - RNA, 23 nt, Human
caccugccucagccucccaaagu

SEQ ID NO: 1027785 - RNA, 22 nt, Human
cacucaguucuaacuacccugg

SEQ ID NO: 1027786 - RNA, 21 nt, Human
cacugcaaccaccaccuccug

SEQ ID NO: 1027787 - RNA, 23 nt, Human
cacugcaaccaccaccuccuggg

SEQ ID NO: 1027788 - RNA, 21 nt, Human
cacugcaaccugucuccuggg

SEQ ID NO: 1027789 - RNA, 20 nt, Human
cagagucggacagaucuggg

SEQ ID NO: 1027790 - RNA, 22 nt, Human
cagaugauucuccugccucagc

SEQ ID NO: 1027791 - RNA, 21 nt, Human
cagcuaugggccugggaccca

SEQ ID NO: 1027792 - RNA, 24 nt, Human
cagggucucauuauguugcccagg

SEQ ID NO: 1027793 - RNA, 22 nt, Human
caggugauccaccugccucagc

SEQ ID NO: 1027794 - RNA, 24 nt, Human
cauguuggccaggcuggucucaaa

SEQ ID NO: 1027795 - RNA, 24 nt, Human
cauguuggccaggcuggucucgaa

SEQ ID NO: 1027796 - RNA, 24 nt, Human
cauuauguugcccaggcuggucuu

SEQ ID NO: 1027797 - RNA, 20 nt, Human
ccaaaagcaugggcaacacc

SEQ ID NO: 1027798 - RNA, 21 nt, Human
ccaaagggcugggauuauagg

SEQ ID NO: 1027799 - RNA, 23 nt, Human
ccaaagggcugggauuauaggug

SEQ ID NO: 1027800 - RNA, 24 nt, Human
ccaaagggcugggauuauaggugu

SEQ ID NO: 1027801 - RNA, 22 nt, Human
ccaaagugcugggauuauaggc

SEQ ID NO: 1027802 - RNA, 24 nt, Human
ccaaagugcugggauuauaggcgu

SEQ ID NO: 1027803 - RNA, 22 nt, Human
ccaaguaccugggauuacaggc

SEQ ID NO: 1027804 - RNA, 24 nt, Human
ccaaguaccugggauuacaggcgu

SEQ ID NO: 1027805 - RNA, 20 nt, Human
ccaccacgcccagcuaauuu

SEQ ID NO: 1027806 - RNA, 24 nt, Human
ccaccuccuggguucaagugauuc

SEQ ID NO: 1027807 - RNA, 26 nt, Human
ccaccugccucagccucccaaagugc

SEQ ID NO: 1027808 - RNA, 21 nt, Human
cccaaaagcaugggcaacacc

SEQ ID NO: 1027809 - RNA, 23 nt, Human
cccaaaaugacuucuuuaaacua

SEQ ID NO: 1027810 - RNA, 20 nt, Human
cccagguucaagcaaaucuc

SEQ ID NO: 1027811 - RNA, 23 nt, Human
cccagguucaagcaaaucucccc

SEQ ID NO: 1027812 - RNA, 23 nt, Human
cccagguucaagcaaaucuccug

SEQ ID NO: 1027813 - RNA, 20 nt, Human
cccgggcugcagugcagugg

SEQ ID NO: 1027814 - RNA, 24 nt, Human
ccucccagguucaagcaaaucucc

SEQ ID NO: 1027815 - RNA, 24 nt, Human
ccuccuggguucaagugauucucc

SEQ ID NO: 1027816 - RNA, 21 nt, Human
ccugaccucaggugauccacc

SEQ ID NO: 1027817 - RNA, 23 nt, Human
ccugaccucaggugauccaccug

SEQ ID NO: 1027818 - RNA, 23 nt, Human
ccugaccucaggugauccaccug

SEQ ID NO: 1027819 - RNA, 22 nt, Human
ccugaguagcugggauuacagg

SEQ ID NO: 1027820 - RNA, 22 nt, Human
ccugaguagcugggauuacagg

SEQ ID NO: 1027821 - RNA, 23 nt, Human
ccugaguagcugggauuacaggu

SEQ ID NO: 1027822 - RNA, 24 nt, Human
ccugaguagcugggauuacaggug

SEQ ID NO: 1027823 - RNA, 22 nt, Human
ccugaguagcugggauuacggg

SEQ ID NO: 1027824 - RNA, 22 nt, Human
ccugaguagcugggauuacggg

SEQ ID NO: 1027825 - RNA, 23 nt, Human
ccugaguagcugggauuacgggu

SEQ ID NO: 1027826 - RNA, 24 nt, Human
ccugaguagcugggauuacgggug

SEQ ID NO: 1027827 - RNA, 24 nt, Human
ccugccucacccuccugaguagcu

SEQ ID NO: 1027828 - RNA, 18 nt, Human
ccuggccccaaaaugacu

SEQ ID NO: 1027829 - RNA, 18 nt, Human
ccuggccucaagugaucc

SEQ ID NO: 1027830 - RNA, 18 nt, Human
ccuggccucaagugaucc

SEQ ID NO: 1027831 - RNA, 21 nt, Human
ccuggccucaagugauccgcc

SEQ ID NO: 1027832 - RNA, 23 nt, Human
ccuggccucaagugauccgccug

SEQ ID NO: 1027833 - RNA, 18 nt, Human
ccugggcucaagcaaucu

SEQ ID NO: 1027834 - RNA, 23 nt, Human
ccugggcucaagcaaucugccug

SEQ ID NO: 1027835 - RNA, 18 nt, Human
ccugggcugguccugggg

SEQ ID NO: 1027836 - RNA, 23 nt, Human
ccuggguucaagugauucuccuc

SEQ ID NO: 1027837 - RNA, 23 nt, Human
ccuggguucaagugauucuccug

SEQ ID NO: 1027838 - RNA, 22 nt, Human
ccugucucggccuccaaaagug

SEQ ID NO: 1027839 - RNA, 25 nt, Human
cggacagaucuggguuuuuuuugga

SEQ ID NO: 1027840 - RNA, 24 nt, Human
cggagcuucaccauguuggccagg

SEQ ID NO: 1027841 - RNA, 24 nt, Human
cgggguuuugccauuguuggccag

SEQ ID NO: 1027842 - RNA, 24 nt, Human
cucacugcaaccaccaccuccugg

SEQ ID NO: 1027843 - RNA, 20 nt, Human
cucacugcaaccugucuccu

SEQ ID NO: 1027844 - RNA, 22 nt, Human
cucacugcaaccugucuccugg

SEQ ID NO: 1027845 - RNA, 23 nt, Human
cucacugcaaccugucuccuggg

SEQ ID NO: 1027846 - RNA, 23 nt, Human
cucagccaccugaguagcuggga

SEQ ID NO: 1027847 - RNA, 23 nt, Human
cucaggugauccaccugccucag

SEQ ID NO: 1027848 - RNA, 18 nt, Human
cuccucagcuuuuauuuu

SEQ ID NO: 1027849 - RNA, 27 nt, Human
cuccuggccacaggagaucugcuuugu

SEQ ID NO: 1027850 - RNA, 20 nt, Human
cuccugggcucaagcaaucu

SEQ ID NO: 1027851 - RNA, 21 nt, Human
cuccugggcucaagcaaucug

SEQ ID NO: 1027852 - RNA, 20 nt, Human
cuccuggguucaagugauuc

SEQ ID NO: 1027853 - RNA, 21 nt, Human
cuccuggguucaagugauucu

SEQ ID NO: 1027854 - RNA, 21 nt, Human
cuccuggguucagaugauucu

SEQ ID NO: 1027855 - RNA, 24 nt, Human
cucgcugcaaccuccaccucccag

SEQ ID NO: 1027856 - RNA, 21 nt, Human
cucggccuccaaaagugcugg

SEQ ID NO: 1027857 - RNA, 24 nt, Human
cucucugucgcccgggcugcagug

SEQ ID NO: 1027858 - RNA, 21 nt, Human
cugaagacagcagggcuguga

SEQ ID NO: 1027859 - RNA, 21 nt, Human
cugaguagcugggauuacagg

SEQ ID NO: 1027860 - RNA, 24 nt, Human
cugaguagcugggauuacaggugu

SEQ ID NO: 1027861 - RNA, 24 nt, Human
cugaguagcugggauuacgggugu

SEQ ID NO: 1027862 - RNA, 23 nt, Human
cugcaaccaccaccuccuggguu

SEQ ID NO: 1027863 - RNA, 23 nt, Human
cugcaaccuccaccucccagguu

SEQ ID NO: 1027864 - RNA, 24 nt, Human
cugcaaccuccaccucccagguuc

SEQ ID NO: 1027865 - RNA, 23 nt, Human
cugccucagccaccugaguagcu

SEQ ID NO: 1027866 - RNA, 23 nt, Human
cugccucagccucccaaagugcu

SEQ ID NO: 1027867 - RNA, 24 nt, Human
cugccucagccucccaaagugcug

SEQ ID NO: 1027868 - RNA, 24 nt, Human
cuggagugcaguggcaugaucucg

SEQ ID NO: 1027869 - RNA, 21 nt, Human
cugggauuauaggugugagcc

SEQ ID NO: 1027870 - RNA, 23 nt, Human
cugggcugguccuggggcuucuc

SEQ ID NO: 1027871 - RNA, 19 nt, Human
cuggucuugaacuccuggg

SEQ ID NO: 1027872 - RNA, 18 nt, Human
cuuaaccucaagccucag

SEQ ID NO: 1027873 - RNA, 21 nt, Human
cuucaccauguuggccaggcu

SEQ ID NO: 1027874 - RNA, 22 nt, Human
cuuccccuaacaaaaccagggg

SEQ ID NO: 1027875 - RNA, 24 nt, Human
cuuuguggucacggacaaaucacu

SEQ ID NO: 1027876 - RNA, 24 nt, Human
gaccucaggugauccaccugccuc

SEQ ID NO: 1027877 - RNA, 20 nt, Human
gacuuuuuuuuuuuuuugaa

SEQ ID NO: 1027878 - RNA, 20 nt, Human
gagaacauuuuaaaauacag

SEQ ID NO: 1027879 - RNA, 24 nt, Human
gagaaugaccccuccucagccuuc

SEQ ID NO: 1027880 - RNA, 18 nt, Human
gagacgggguuuugccau

SEQ ID NO: 1027881 - RNA, 19 nt, Human
gaguagcugggauuacagg

SEQ ID NO: 1027882 - RNA, 25 nt, Human
gaguagcugggauuacagguguaag

SEQ ID NO: 1027883 - RNA, 19 nt, Human
gaguagcugggauuacggg

SEQ ID NO: 1027884 - RNA, 19 nt, Human
gauuaaagguuggguguca

SEQ ID NO: 1027885 - RNA, 18 nt, Human
gauuacaggcgugugcca

SEQ ID NO: 1027886 - RNA, 24 nt, Human
gauuacaggcgugugccaccaugc

SEQ ID NO: 1027887 - RNA, 18 nt, Human
gauuacagguguaagcca

SEQ ID NO: 1027888 - RNA, 21 nt, Human
gauuacagguguaagccacca

SEQ ID NO: 1027889 - RNA, 18 nt, Human
gauuacgggugugugcca

SEQ ID NO: 1027890 - RNA, 18 nt, Human
gauuauaggcgugagcca

SEQ ID NO: 1027891 - RNA, 21 nt, Human
gauuauaggcgugagccaccg

SEQ ID NO: 1027892 - RNA, 24 nt, Human
gauuauaggcgugagccaccgugc

SEQ ID NO: 1027893 - RNA, 18 nt, Human
gauuauaggugugagcca

SEQ ID NO: 1027894 - RNA, 20 nt, Human
gauuauaggugugagccacc

SEQ ID NO: 1027895 - RNA, 20 nt, Human
gauuauaggugugagccacc

SEQ ID NO: 1027896 - RNA, 19 nt, Human
gauucuccugccucagccu

SEQ ID NO: 1027897 - RNA, 22 nt, Human
gcaacacccuccugugaccgaa

SEQ ID NO: 1027898 - RNA, 19 nt, Human
gcaaccaccaccuccuggg

SEQ ID NO: 1027899 - RNA, 22 nt, Human
gcaaccaccaccuccuggguuc

SEQ ID NO: 1027900 - RNA, 22 nt, Human
gcaaccuccaccucccagguuc

SEQ ID NO: 1027901 - RNA, 21 nt, Human
gccacaggagaucugcuggcc

SEQ ID NO: 1027902 - RNA, 19 nt, Human
gccaggcuugaacuccugg

SEQ ID NO: 1027903 - RNA, 22 nt, Human
gcccagcuaauuuuuguauuuu

SEQ ID NO: 1027904 - RNA, 24 nt, Human
gcccaggcuggagugcaguggcau

SEQ ID NO: 1027905 - RNA, 24 nt, Human
gccucagucucccaaagggcuggg

SEQ ID NO: 1027906 - RNA, 21 nt, Human
gcucagaauugacaauuguuc

SEQ ID NO: 1027907 - RNA, 23 nt, Human
gcucaggcuggaaugcaguggca

SEQ ID NO: 1027908 - RNA, 18 nt, Human
gcugaaccccuugcuucc

SEQ ID NO: 1027909 - RNA, 24 nt, Human
gcuggaaugcaguggcacgaucua

SEQ ID NO: 1027910 - RNA, 19 nt, Human
gcuggagugcaguggcaug

SEQ ID NO: 1027911 - RNA, 23 nt, Human
gcuggucucaaacuccugaccuc

SEQ ID NO: 1027912 - RNA, 23 nt, Human
gcuggucucgaacuccuggccuc

SEQ ID NO: 1027913 - RNA, 23 nt, Human
ggagcuucaccauguuggccagg

SEQ ID NO: 1027914 - RNA, 18 nt, Human
ggaggcagagaguuuaga

SEQ ID NO: 1027915 - RNA, 22 nt, Human
ggaggggaacuggggaggaggg

SEQ ID NO: 1027916 - RNA, 24 nt, Human
ggauuacaggcgugugccaccaug

SEQ ID NO: 1027917 - RNA, 19 nt, Human
ggauuacagguguaagcca

SEQ ID NO: 1027918 - RNA, 22 nt, Human
ggccucaagugauccgccugcc

SEQ ID NO: 1027919 - RNA, 24 nt, Human
ggcuggucucaaacuccugaccuc

SEQ ID NO: 1027920 - RNA, 24 nt, Human
ggcuggucucgaacuccuggccuc

SEQ ID NO: 1027921 - RNA, 18 nt, Human
ggcuggucuugaacuccu

SEQ ID NO: 1027922 - RNA, 23 nt, Human
ggggaggagggaucugagugagg

SEQ ID NO: 1027923 - RNA, 24 nt, Human
gggguuuugccauuguuggccagg

SEQ ID NO: 1027924 - RNA, 22 nt, Human
ggguaucaccauguuggccagg

SEQ ID NO: 1027925 - RNA, 23 nt, Human
ggguuuugccauuguuggccagg

SEQ ID NO: 1027926 - RNA, 24 nt, Human
ggugauccaccugccucagccucc

SEQ ID NO: 1027927 - RNA, 19 nt, Human
guagagacgggguuuugcc

SEQ ID NO: 1027928 - RNA, 21 nt, Human
guagagacgggguuuugccau

SEQ ID NO: 1027929 - RNA, 21 nt, Human
guagagacgggguuuugccau

SEQ ID NO: 1027930 - RNA, 18 nt, Human
guagcugggauuacaggu

SEQ ID NO: 1027931 - RNA, 23 nt, Human
guccuggggcuucucacagccuc

SEQ ID NO: 1027932 - RNA, 18 nt, Human
gugauccaccugccucag

SEQ ID NO: 1027933 - RNA, 24 nt, Human
gugauccaccugccucagccuccc

SEQ ID NO: 1027934 - RNA, 24 nt, Human
gugauucuccugccucagccaccu

SEQ ID NO: 1027935 - RNA, 21 nt, Human
uaacaaaaccaggggcuauca

SEQ ID NO: 1027936 - RNA, 18 nt, Human
uaaguugaaacagggucu

SEQ ID NO: 1027937 - RNA, 24 nt, Human
uaauuuuuguauuuuugguagaga

SEQ ID NO: 1027938 - RNA, 24 nt, Human
uaauuuuuguguuuuuaguagaga

SEQ ID NO: 1027939 - RNA, 24 nt, Human
uaauuuuuuguauuuuuaguagag

SEQ ID NO: 1027940 - RNA, 25 nt, Human
uaauuuuuuguauuuuuaguagaga

SEQ ID NO: 1027941 - RNA, 22 nt, Human
uacaggcuugagccaccgcacc

SEQ ID NO: 1027942 - RNA, 18 nt, Human
uacagguguaagccacca

SEQ ID NO: 1027943 - RNA, 23 nt, Human
uaccauacccagcugcucagaau

SEQ ID NO: 1027944 - RNA, 22 nt, Human
uacccagcugcucagaauugac

SEQ ID NO: 1027945 - RNA, 24 nt, Human
uacgggugugugccaccacgccca

SEQ ID NO: 1027946 - RNA, 20 nt, Human
uacucugaagacagcagggc

SEQ ID NO: 1027947 - RNA, 24 nt, Human
uacucugucgcucaggcuggaaug

SEQ ID NO: 1027948 - RNA, 21 nt, Human
uagagacggguaucaccaugu

SEQ ID NO: 1027949 - RNA, 24 nt, Human
uaguagagacggagcuucaccaug

SEQ ID NO: 1027950 - RNA, 26 nt, Human
uaguagagacggagcuucaccauguu

SEQ ID NO: 1027951 - RNA, 23 nt, Human
uaguagagacggguaucaccaug

SEQ ID NO: 1027952 - RNA, 23 nt, Human
uauaggcgugagccaccgugccu

SEQ ID NO: 1027953 - RNA, 19 nt, Human
uaucaaaaagaagcgguga

SEQ ID NO: 1027954 - RNA, 23 nt, Human
uaugggccugggacccacccaaa

SEQ ID NO: 1027955 - RNA, 24 nt, Human
uaugucaagcacaaugccagugcc

SEQ ID NO: 1027956 - RNA, 20 nt, Human
uauguugcccaggcuggucu

SEQ ID NO: 1027957 - RNA, 23 nt, Human
uauguugcccaggcuggucuuga

SEQ ID NO: 1027958 - RNA, 24 nt, Human
uauguugcccaggcuggucuugaa

SEQ ID NO: 1027959 - RNA, 19 nt, Human
uauuuuugguagagacggg

SEQ ID NO: 1027960 - RNA, 20 nt, Human
ucaaaaagaagcggugacug

SEQ ID NO: 1027961 - RNA, 23 nt, Human
ucaaaacggaggugacauugaca

SEQ ID NO: 1027962 - RNA, 20 nt, Human
ucaagcacaaugccagugcc

SEQ ID NO: 1027963 - RNA, 19 nt, Human
ucaagugauucuccugccu

SEQ ID NO: 1027964 - RNA, 22 nt, Human
ucaccauguuggccaggcuggu

SEQ ID NO: 1027965 - RNA, 24 nt, Human
ucacugcaaccaccaccuccuggg

SEQ ID NO: 1027966 - RNA, 27 nt, Human
ucacugcaaccaccaccuccuggguuc

SEQ ID NO: 1027967 - RNA, 22 nt, Human
ucacugcaaccugucuccuggg

SEQ ID NO: 1027968 - RNA, 23 nt, Human
ucacugcaaccugucuccugggu

SEQ ID NO: 1027969 - RNA, 21 nt, Human
ucagagucggacagaucuggg

SEQ ID NO: 1027970 - RNA, 22 nt, Human
ucagagucggacagaucugggu

SEQ ID NO: 1027971 - RNA, 19 nt, Human
ucagaugauucuccugccu

SEQ ID NO: 1027972 - RNA, 21 nt, Human
ucaguagcaccccccgucccc

SEQ ID NO: 1027973 - RNA, 23 nt, Human
ucaguaugaugauguaugucaag

SEQ ID NO: 1027974 - RNA, 24 nt, Human
uccaaaagugcugggaguacaggc

SEQ ID NO: 1027975 - RNA, 19 nt, Human
uccaaguaccugggauuac

SEQ ID NO: 1027976 - RNA, 23 nt, Human
uccaaguaccugggauuacaggc

SEQ ID NO: 1027977 - RNA, 24 nt, Human
uccaaguaccugggauuacaggcg

SEQ ID NO: 1027978 - RNA, 21 nt, Human
uccagguuuuucucucauggg

SEQ ID NO: 1027979 - RNA, 19 nt, Human
ucccaaagggcugggauua

SEQ ID NO: 1027980 - RNA, 23 nt, Human
ucccaaagggcugggauuauagg

SEQ ID NO: 1027981 - RNA, 24 nt, Human
ucccaaagugcugggauuauaggc

SEQ ID NO: 1027982 - RNA, 21 nt, Human
ucccagguucaagcaaaucuc

SEQ ID NO: 1027983 - RNA, 24 nt, Human
ucccagguucaagcaaaucuccug

SEQ ID NO: 1027984 - RNA, 21 nt, Human
uccccuaacaaaaccaggggc

SEQ ID NO: 1027985 - RNA, 23 nt, Human
uccccuaacaaaaccaggggcua

SEQ ID NO: 1027986 - RNA, 24 nt, Human
uccugaguagcugggauuacaggu

SEQ ID NO: 1027987 - RNA, 18 nt, Human
uccugggcucaagcaauc

SEQ ID NO: 1027988 - RNA, 20 nt, Human
uccugggcucaagcaaucug

SEQ ID NO: 1027989 - RNA, 21 nt, Human
uccuggguucaagugauucuc

SEQ ID NO: 1027990 - RNA, 24 nt, Human
uccuggguucaagugauucuccug

SEQ ID NO: 1027991 - RNA, 24 nt, Human
uccuggguucagaugauucuccug

SEQ ID NO: 1027992 - RNA, 22 nt, Human
ucgcccgggcugcagugcagug

SEQ ID NO: 1027993 - RNA, 24 nt, Human
ucgcucaggcuggaaugcaguggc

SEQ ID NO: 1027994 - RNA, 24 nt, Human
ucgcugcaaccuccaccucccagg

SEQ ID NO: 1027995 - RNA, 25 nt, Human
ucgcugcaaccuccaccucccaggu

SEQ ID NO: 1027996 - RNA, 24 nt, Human
ucucaugcccaggcuggagugcag

SEQ ID NO: 1027997 - RNA, 19 nt, Human
ucucauuauguugcccagg

SEQ ID NO: 1027998 - RNA, 23 nt, Human
ucucauuauguugcccaggcugg

SEQ ID NO: 1027999 - RNA, 24 nt, Human
ucucauuauguugcccaggcuggu

SEQ ID NO: 1028000 - RNA, 25 nt, Human
ucuccugccucagccuuccaaguac

SEQ ID NO: 1028001 - RNA, 24 nt, Human
ucuccuggguucagaugauucucc

SEQ ID NO: 1028002 - RNA, 21 nt, Human
ucucgaacuccuggccucaag

SEQ ID NO: 1028003 - RNA, 19 nt, Human
ucugaagucaggguugagg

SEQ ID NO: 1028004 - RNA, 24 nt, Human
ucugucgcucaggcuggaaugcag

SEQ ID NO: 1028005 - RNA, 23 nt, Human
ucuuacucugucgcucaggcugg

SEQ ID NO: 1028006 - RNA, 24 nt, Human
ucuuacucugucgcucaggcugga

SEQ ID NO: 1028007 - RNA, 19 nt, Human
ucuugaacuccugggcuca

SEQ ID NO: 1028008 - RNA, 23 nt, Human
ucuugaacuccugggcucaagca

SEQ ID NO: 1028009 - RNA, 24 nt, Human
ugaacuccugggcucaagcaaucu

SEQ ID NO: 1028010 - RNA, 19 nt, Human
ugacauugacagaaaguga

SEQ ID NO: 1028011 - RNA, 24 nt, Human
ugaccucaggugauccaccugccu

SEQ ID NO: 1028012 - RNA, 24 nt, Human
ugagugauuaaagguuggguguca

SEQ ID NO: 1028013 - RNA, 21 nt, Human
ugaguuuccacacagcaacuc

SEQ ID NO: 1028014 - RNA, 20 nt, Human
ugauucuccugccucagccu

SEQ ID NO: 1028015 - RNA, 18 nt, Human
ugcaaaggaagccaggaa

SEQ ID NO: 1028016 - RNA, 20 nt, Human
ugcagcuaugggccugggac

SEQ ID NO: 1028017 - RNA, 19 nt, Human
ugcagugcaguggcaugau

SEQ ID NO: 1028018 - RNA, 23 nt, Human
ugcagugcaguggcaugaucuug

SEQ ID NO: 1028019 - RNA, 24 nt, Human
ugcagugcaguggcaugaucuugg

SEQ ID NO: 1028020 - RNA, 22 nt, Human
ugcaguggcaugaucucggcuc

SEQ ID NO: 1028021 - RNA, 25 nt, Human
ugcaguggcaugaucuuuggaaggc

SEQ ID NO: 1028022 - RNA, 18 nt, Human
ugcccaggcuggagugca

SEQ ID NO: 1028023 - RNA, 21 nt, Human
ugcccaggcuggagugcagug

SEQ ID NO: 1028024 - RNA, 22 nt, Human
ugcccaggcuggagugcagugg

SEQ ID NO: 1028025 - RNA, 24 nt, Human
ugcccaggcuggagugcaguggca

SEQ ID NO: 1028026 - RNA, 24 nt, Human
ugcccaggcuggucuugaacuccu

SEQ ID NO: 1028027 - RNA, 28 nt, Human
ugcccaggcuggucuugaacuccugggc

SEQ ID NO: 1028028 - RNA, 20 nt, Human
ugcccagggcauuuuugugg

SEQ ID NO: 1028029 - RNA, 20 nt, Human
ugcccagugacagaucuggg

SEQ ID NO: 1028030 - RNA, 24 nt, Human
ugcccagugacagaucuggguuug

SEQ ID NO: 1028031 - RNA, 25 nt, Human
ugcccagugacagaucuggguuugg

SEQ ID NO: 1028032 - RNA, 21 nt, Human
ugccucacccuccugaguagc

SEQ ID NO: 1028033 - RNA, 24 nt, Human
ugccucacccuccugaguagcugg

SEQ ID NO: 1028034 - RNA, 28 nt, Human
ugccucacccuccugaguagcugggauu

SEQ ID NO: 1028035 - RNA, 21 nt, Human
ugccucagccaccugaguagc

SEQ ID NO: 1028036 - RNA, 24 nt, Human
ugccucagccaccugaguagcugg

SEQ ID NO: 1028037 - RNA, 24 nt, Human
ugccucagccucccaaagugcugg

SEQ ID NO: 1028038 - RNA, 24 nt, Human
ugccucagccuuccaaguaccugg

SEQ ID NO: 1028039 - RNA, 18 nt, Human
ugccuggccccaaaauga

SEQ ID NO: 1028040 - RNA, 18 nt, Human
ugccuggccccaaaauga

SEQ ID NO: 1028041 - RNA, 24 nt, Human
uggaaugcaguggcacgaucuagg

SEQ ID NO: 1028042 - RNA, 22 nt, Human
uggagacagagucuuacucugu

SEQ ID NO: 1028043 - RNA, 23 nt, Human
uggaggggaacuggggaggaggg

SEQ ID NO: 1028044 - RNA, 19 nt, Human
uggagugcaguggcaugau

SEQ ID NO: 1028045 - RNA, 24 nt, Human
uggagugcaguggcaugaucucgg

SEQ ID NO: 1028046 - RNA, 21 nt, Human
uggcaugaucuuggcucgcug

SEQ ID NO: 1028047 - RNA, 24 nt, Human
uggccaggcuggucucaaacuccu

SEQ ID NO: 1028048 - RNA, 24 nt, Human
uggccaggcuggucucgaacuccu

SEQ ID NO: 1028049 - RNA, 18 nt, Human
uggccucaagugauccgc

SEQ ID NO: 1028050 - RNA, 24 nt, Human
uggccucaagugauccgccugccu

SEQ ID NO: 1028051 - RNA, 20 nt, Human
uggcucgcugcaaccuccac

SEQ ID NO: 1028052 - RNA, 22 nt, Human
ugggaguacaggcuugagccac

SEQ ID NO: 1028053 - RNA, 23 nt, Human
ugggaguacaggcuugagccacc

SEQ ID NO: 1028054 - RNA, 24 nt, Human
ugggaguacaggcuugagccaccg

SEQ ID NO: 1028055 - RNA, 18 nt, Human
ugggauuacaggcgugug

SEQ ID NO: 1028056 - RNA, 21 nt, Human
ugggauuacaggcgugugcca

SEQ ID NO: 1028057 - RNA, 22 nt, Human
ugggauuacaggcgugugccac

SEQ ID NO: 1028058 - RNA, 24 nt, Human
ugggauuacaggcgugugccacca

SEQ ID NO: 1028059 - RNA, 25 nt, Human
ugggauuacaggcgugugccaccau

SEQ ID NO: 1028060 - RNA, 18 nt, Human
ugggauuacagguguaag

SEQ ID NO: 1028061 - RNA, 19 nt, Human
ugggauuacagguguaagc

SEQ ID NO: 1028062 - RNA, 22 nt, Human
ugggauuacagguguaagccac

SEQ ID NO: 1028063 - RNA, 24 nt, Human
ugggauuacagguguaagccacca

SEQ ID NO: 1028064 - RNA, 19 nt, Human
ugggauuacgggugugugc

SEQ ID NO: 1028065 - RNA, 22 nt, Human
ugggauuacgggugugugccac

SEQ ID NO: 1028066 - RNA, 24 nt, Human
ugggauuacgggugugugccacca

SEQ ID NO: 1028067 - RNA, 18 nt, Human
ugggauuauaggcgugag

SEQ ID NO: 1028068 - RNA, 21 nt, Human
ugggauuauaggcgugagcca

SEQ ID NO: 1028069 - RNA, 22 nt, Human
ugggauuauaggcgugagccac

SEQ ID NO: 1028070 - RNA, 23 nt, Human
ugggauuauaggcgugagccacc

SEQ ID NO: 1028071 - RNA, 23 nt, Human
ugggauuauaggcgugagccacc

SEQ ID NO: 1028072 - RNA, 24 nt, Human
ugggauuauaggcgugagccaccg

SEQ ID NO: 1028073 - RNA, 18 nt, Human
ugggauuauaggugugag

SEQ ID NO: 1028074 - RNA, 19 nt, Human
ugggauuauaggugugagc

SEQ ID NO: 1028075 - RNA, 21 nt, Human
ugggauuauaggugugagcca

SEQ ID NO: 1028076 - RNA, 22 nt, Human
ugggauuauaggugugagccac

SEQ ID NO: 1028077 - RNA, 23 nt, Human
ugggauuauaggugugagccacc

SEQ ID NO: 1028078 - RNA, 25 nt, Human
ugggauuauaggugugagccaccuu

SEQ ID NO: 1028079 - RNA, 20 nt, Human
ugggccugggacccacccaa

SEQ ID NO: 1028080 - RNA, 19 nt, Human
ugggcugguccuggggcuu

SEQ ID NO: 1028081 - RNA, 23 nt, Human
uggguucaagugauucuccugcc

SEQ ID NO: 1028082 - RNA, 24 nt, Human
uggguucaagugauucuccugccu

SEQ ID NO: 1028083 - RNA, 24 nt, Human
uggguucagaugauucuccugccu

SEQ ID NO: 1028084 - RNA, 25 nt, Human
ugguagagacgggguuuugccauug

SEQ ID NO: 1028085 - RNA, 21 nt, Human
uguauuuuuaguagagacgga

SEQ ID NO: 1028086 - RNA, 19 nt, Human
ugucucggccuccaaaagu

SEQ ID NO: 1028087 - RNA, 19 nt, Human
ugugugccaccacgcccag

SEQ ID NO: 1028088 - RNA, 22 nt, Human
uuaaccucaagccucaguuuca

SEQ ID NO: 1028089 - RNA, 18 nt, Human
uuaguagagacggagcuu

SEQ ID NO: 1028090 - RNA, 24 nt, Human
uuaguagagacggagcuucaccau

SEQ ID NO: 1028091 - RNA, 23 nt, Human
uuaguagagacggguaucaccau

SEQ ID NO: 1028092 - RNA, 24 nt, Human
uuaguagagacggguaucaccaug

SEQ ID NO: 1028093 - RNA, 21 nt, Human
uucaagugauucuccugccuc

SEQ ID NO: 1028094 - RNA, 23 nt, Human
uucaagugauucuccugccucag

SEQ ID NO: 1028095 - RNA, 26 nt, Human
uucaagugauucuccugccucagcca

SEQ ID NO: 1028096 - RNA, 23 nt, Human
uucagaugauucuccugccucag

SEQ ID NO: 1028097 - RNA, 23 nt, Human
uucucacagccucaguagcaccc

SEQ ID NO: 1028098 - RNA, 19 nt, Human
uuggccaggcuugaacucc

SEQ ID NO: 1028099 - RNA, 24 nt, Human
uuggcuucuccacaggcuccaggg

SEQ ID NO: 1028100 - RNA, 24 nt, Human
uugguagagacgggguuuugccau

SEQ ID NO: 1028101 - RNA, 23 nt, Human
uuguauuuuuaguagagacggag

SEQ ID NO: 1028102 - RNA, 24 nt, Human
uuuuuaguagagacggagcuucac

SEQ ID NO: 1028103 - RNA, 20 nt, Human
uuuuuaguagagacggguau

SEQ ID NO: 1028104 - RNA, 21 nt, Human
uuuuugguagagacgggguuu

SEQ ID NO: 1028105 - RNA, 24 nt, Human
uuuuugguagagacgggguuuugc

SEQ ID NO: 1028106 - RNA, 21 nt, Human
uuuuuguauuuuuaguagaga

SEQ ID NO: 1028107 - RNA, 20 nt, Human
uuuuuguauuuuugguagag

SEQ ID NO: 1028108 - RNA, 20 nt, Human
uuuuuguguuuuuaguagag

SEQ ID NO: 1028109 - RNA, 24 nt, Human
uuuuuuguauuuuuaguagagacg

SEQ ID NO: 1028110 - RNA, 19 nt, Human
aagcuuguaugcugggcgg

SEQ ID NO: 1028111 - RNA, 19 nt, Human
accacagcauacgucacug

SEQ ID NO: 1028112 - RNA, 19 nt, Human
accauggcagccaaaaacg

SEQ ID NO: 1028113 - RNA, 19 nt, Human
agccacaggcggagaaggc

SEQ ID NO: 1028114 - RNA, 24 nt, Human
aggauggaacagaucaugagauuu

SEQ ID NO: 1028115 - RNA, 22 nt, Human
cacaagaaaaaggauggaacag

SEQ ID NO: 1028116 - RNA, 19 nt, Human
caccacaccauuccugagg

SEQ ID NO: 1028117 - RNA, 21 nt, Human
cagcauacgucacugacgccu

SEQ ID NO: 1028118 - RNA, 21 nt, Human
caggaggaggaguucucaggc

SEQ ID NO: 1028119 - RNA, 21 nt, Human
ccagauacauggacagggaca

SEQ ID NO: 1028120 - RNA, 21 nt, Human
cccacacaagaaaaaggaugg

SEQ ID NO: 1028121 - RNA, 22 nt, Human
ccucugagagucccaggaggag

SEQ ID NO: 1028122 - RNA, 22 nt, Human
cuaggaaucagaucuccacacu

SEQ ID NO: 1028123 - RNA, 19 nt, Human
cucacauuaugcugucggc

SEQ ID NO: 1028124 - RNA, 23 nt, Human
cuggaccuugccucacauuaugc

SEQ ID NO: 1028125 - RNA, 18 nt, Human
gccaccacaccauuccug

SEQ ID NO: 1028126 - RNA, 19 nt, Human
gccaccacaccauuccuga

SEQ ID NO: 1028127 - RNA, 23 nt, Human
gggguguggaggugggagucaga

SEQ ID NO: 1028128 - RNA, 21 nt, Human
uaaaauaagcaaacaacuggc

SEQ ID NO: 1028129 - RNA, 24 nt, Human
uaaaauaagcaaacaacuggcagg

SEQ ID NO: 1028130 - RNA, 26 nt, Human
uaaaauaagcaaacaacuggcaggug

SEQ ID NO: 1028131 - RNA, 26 nt, Human
ucagagcugacagccaggcugaugag

SEQ ID NO: 1028132 - RNA, 19 nt, Human
ucccuguuucucaggcugu

SEQ ID NO: 1028133 - RNA, 20 nt, Human
ucucaggcuguagaugaaag

SEQ ID NO: 1028134 - RNA, 22 nt, Human
ucuguaccauggcagccaaaaa

SEQ ID NO: 1028135 - RNA, 24 nt, Human
ugaagucagguacacgccaaugcc

SEQ ID NO: 1028136 - RNA, 19 nt, Human
ugagccgauccguaagggc

SEQ ID NO: 1028137 - RNA, 19 nt, Human
ugccacagcugaagucagg

SEQ ID NO: 1028138 - RNA, 26 nt, Human
ugcugcgcagccuccacagggcgcuu

SEQ ID NO: 1028139 - RNA, 22 nt, Human
uggagaucuccaaagggggcug

SEQ ID NO: 1028140 - RNA, 18 nt, Human
uggcaucucucugaaguc

SEQ ID NO: 1028141 - RNA, 20 nt, Human
uuacccacacaagaaaaagg

SEQ ID NO: 1028142 - RNA, 19 nt, Human
uuuauacuacccaucugac

SEQ ID NO: 1028143 - RNA, 24 nt, Human
uuuuuuuuuuuuuuuugcagaugu

SEQ ID NO: 1028144 - RNA, 18 nt, Human
uuuuuuuuuuuuuuuuug

SEQ ID NO: 1028145 - RNA, 19 nt, Human
uuuuuuuuuuuuuuuuugc

SEQ ID NO: 1028146 - RNA, 22 nt, Human
ugucaaacaugaucuuucccug

SEQ ID NO: 1028147 - RNA, 22 nt, Human
aaaguguuaggauuauaggcau

SEQ ID NO: 1028148 - RNA, 24 nt, Human
aaaguguuaggauuauaggcauga

SEQ ID NO: 1028149 - RNA, 22 nt, Human
aacaaaauacaaaaaugcccag

SEQ ID NO: 1028150 - RNA, 19 nt, Human
acaacaacaacaaaauaca

SEQ ID NO: 1028151 - RNA, 23 nt, Human
acaggcgcccaccaccacgcccg

SEQ ID NO: 1028152 - RNA, 18 nt, Human
acaggguuucacuguguu

SEQ ID NO: 1028153 - RNA, 19 nt, Human
acaggguuucacuguguua

SEQ ID NO: 1028154 - RNA, 20 nt, Human
acaggguuucacuguguuag

SEQ ID NO: 1028155 - RNA, 24 nt, Human
acaggguuucacuguguuagccag

SEQ ID NO: 1028156 - RNA, 21 nt, Human
accacauguaugugucagagu

SEQ ID NO: 1028157 - RNA, 25 nt, Human
accucccggguucacaccauucucc

SEQ ID NO: 1028158 - RNA, 19 nt, Human
acuccagccuggguggcag

SEQ ID NO: 1028159 - RNA, 24 nt, Human
acuggacuccagccuggguggcag

SEQ ID NO: 1028160 - RNA, 18 nt, Human
agacaggguuucacugug

SEQ ID NO: 1028161 - RNA, 20 nt, Human
agccaccgcacccugccucc

SEQ ID NO: 1028162 - RNA, 20 nt, Human
agcuaccugggaggcugggg

SEQ ID NO: 1028163 - RNA, 24 nt, Human
agcuaccugggaggcugggguggg

SEQ ID NO: 1028164 - RNA, 20 nt, Human
aggcaugagccaccgcaccc

SEQ ID NO: 1028165 - RNA, 20 nt, Human
aggcgcccaccaccacgccc

SEQ ID NO: 1028166 - RNA, 25 nt, Human
aggcuggagugcaguggugcgaucu

SEQ ID NO: 1028167 - RNA, 24 nt, Human
agggcaaaagauaaccacauguag

SEQ ID NO: 1028168 - RNA, 18 nt, Human
aguaguugggacuacagg

SEQ ID NO: 1028169 - RNA, 20 nt, Human
agugcaguggugcgaucucg

SEQ ID NO: 1028170 - RNA, 23 nt, Human
agugcaguggugcgaucucggcu

SEQ ID NO: 1028171 - RNA, 24 nt, Human
agugcaguggugcgaucucggcuc

SEQ ID NO: 1028172 - RNA, 24 nt, Human
aucacgccacuggacuccagccug

SEQ ID NO: 1028173 - RNA, 23 nt, Human
augauccacccgccucggccucc

SEQ ID NO: 1028174 - RNA, 23 nt, Human
caaaauacaaaaaugcccauucu

SEQ ID NO: 1028175 - RNA, 22 nt, Human
caacaacaaaauacaaaaaugc

SEQ ID NO: 1028176 - RNA, 22 nt, Human
cacaccauucuccugccucagc

SEQ ID NO: 1028177 - RNA, 19 nt, Human
cacauguaugugucagagu

SEQ ID NO: 1028178 - RNA, 19 nt, Human
caccucccggguucacacc

SEQ ID NO: 1028179 - RNA, 23 nt, Human
cacuggacuccagccuggguggc

SEQ ID NO: 1028180 - RNA, 24 nt, Human
cacuggacuccagccuggguggca

SEQ ID NO: 1028181 - RNA, 18 nt, Human
cacuguguuagccaggau

SEQ ID NO: 1028182 - RNA, 19 nt, Human
cacuguguuagccaggaug

SEQ ID NO: 1028183 - RNA, 24 nt, Human
cacuguguuagccaggauggucuc

SEQ ID NO: 1028184 - RNA, 20 nt, Human
cagccuccugaguaguuggg

SEQ ID NO: 1028185 - RNA, 21 nt, Human
caggcgcccaccaccacgccc

SEQ ID NO: 1028186 - RNA, 24 nt, Human
caggguuucacuguguuagccagg

SEQ ID NO: 1028187 - RNA, 20 nt, Human
ccacuggacuccagccuggg

SEQ ID NO: 1028188 - RNA, 20 nt, Human
ccacuggacuccagccuggg

SEQ ID NO: 1028189 - RNA, 20 nt, Human
ccacuggacuccagccuggg

SEQ ID NO: 1028190 - RNA, 22 nt, Human
ccacuggacuccagccugggug

SEQ ID NO: 1028191 - RNA, 24 nt, Human
ccacuggacuccagccuggguggc

SEQ ID NO: 1028192 - RNA, 19 nt, Human
ccagacagggcccccgagg

SEQ ID NO: 1028193 - RNA, 21 nt, Human
cccaccaccacgcccggcuac

SEQ ID NO: 1028194 - RNA, 19 nt, Human
cccaggcuggagugcagug

SEQ ID NO: 1028195 - RNA, 22 nt, Human
cccaggcuggagugcaguggug

SEQ ID NO: 1028196 - RNA, 23 nt, Human
ccccgugcaggccggccggccuc

SEQ ID NO: 1028197 - RNA, 20 nt, Human
ccugaccucaugauccaccc

SEQ ID NO: 1028198 - RNA, 23 nt, Human
ccugaguaguugggacuacaggc

SEQ ID NO: 1028199 - RNA, 24 nt, Human
ccugaguaguugggacuacaggcg

SEQ ID NO: 1028200 - RNA, 23 nt, Human
cgccucggccuccuaaaguguua

SEQ ID NO: 1028201 - RNA, 24 nt, Human
cgccucggccuccuaaaguguuag

SEQ ID NO: 1028202 - RNA, 19 nt, Human
cgcugaggcgccagacagg

SEQ ID NO: 1028203 - RNA, 24 nt, Human
cuaaaguguuaggauuauaggcau

SEQ ID NO: 1028204 - RNA, 21 nt, Human
cucaacaacaacaacaaaaua

SEQ ID NO: 1028205 - RNA, 24 nt, Human
cucacugcaagcuccaccucccgg

SEQ ID NO: 1028206 - RNA, 21 nt, Human
cucccggguucacaccauucu

SEQ ID NO: 1028207 - RNA, 24 nt, Human
cuccugaccucaugauccacccgc

SEQ ID NO: 1028208 - RNA, 24 nt, Human
cucgcucugucucccaggcuggag

SEQ ID NO: 1028209 - RNA, 20 nt, Human
cucugucucccaggcuggag

SEQ ID NO: 1028210 - RNA, 24 nt, Human
cugcaagcuccaccucccggguuc

SEQ ID NO: 1028211 - RNA, 21 nt, Human
cugccucagccuccugaguag

SEQ ID NO: 1028212 - RNA, 22 nt, Human
gaccucaugauccacccgccuc

SEQ ID NO: 1028213 - RNA, 20 nt, Human
gacuccagccuggguggcag

SEQ ID NO: 1028214 - RNA, 21 nt, Human
gagacggagucucgcucuguc

SEQ ID NO: 1028215 - RNA, 19 nt, Human
gagccaccgcacccugccu

SEQ ID NO: 1028216 - RNA, 21 nt, Human
gaguacuaaaaaguggcuuac

SEQ ID NO: 1028217 - RNA, 25 nt, Human
gaguaguugggacuacaggcgccca

SEQ ID NO: 1028218 - RNA, 22 nt, Human
gauuauaggcaugagccaccgc

SEQ ID NO: 1028219 - RNA, 23 nt, Human
gauuauaggcaugagccaccgca

SEQ ID NO: 1028220 - RNA, 19 nt, Human
gccacuggacuccagccug

SEQ ID NO: 1028221 - RNA, 24 nt, Human
gccacuggacuccagccugggugg

SEQ ID NO: 1028222 - RNA, 23 nt, Human
gcccggcuacuuuuuuguauuuu

SEQ ID NO: 1028223 - RNA, 20 nt, Human
gcgcugaggcgccagacagg

SEQ ID NO: 1028224 - RNA, 22 nt, Human
ggauuauaggcaugagccaccg

SEQ ID NO: 1028225 - RNA, 20 nt, Human
ggucucgaucuccugaccuc

SEQ ID NO: 1028226 - RNA, 19 nt, Human
guguuaggauuauaggcau

SEQ ID NO: 1028227 - RNA, 22 nt, Human
uagagacaggguuucacugugu

SEQ ID NO: 1028228 - RNA, 24 nt, Human
uagcuaccugggaggcuggggugg

SEQ ID NO: 1028229 - RNA, 18 nt, Human
uaggauuauaggcaugag

SEQ ID NO: 1028230 - RNA, 21 nt, Human
uaggauuauaggcaugagcca

SEQ ID NO: 1028231 - RNA, 22 nt, Human
uaggauuauaggcaugagccac

SEQ ID NO: 1028232 - RNA, 23 nt, Human
uaggauuauaggcaugagccacc

SEQ ID NO: 1028233 - RNA, 24 nt, Human
uaggauuauaggcaugagccaccg

SEQ ID NO: 1028234 - RNA, 20 nt, Human
uaguagagacaggguuucac

SEQ ID NO: 1028235 - RNA, 24 nt, Human
uaguagagacaggguuucacugug

SEQ ID NO: 1028236 - RNA, 19 nt, Human
ucaacaacaacaacaaaau

SEQ ID NO: 1028237 - RNA, 25 nt, Human
ucaacaacaacaacaaaauacaaaa

SEQ ID NO: 1028238 - RNA, 21 nt, Human
ucacaccauucuccugccuca

SEQ ID NO: 1028239 - RNA, 23 nt, Human
ucacgccacuggacuccagccug

SEQ ID NO: 1028240 - RNA, 24 nt, Human
ucacugcaagcuccaccucccggg

SEQ ID NO: 1028241 - RNA, 24 nt, Human
ucacuguguuagccaggauggucu

SEQ ID NO: 1028242 - RNA, 23 nt, Human
ucagccuccugaguaguugggac

SEQ ID NO: 1028243 - RNA, 18 nt, Human
uccagccuggguggcaga

SEQ ID NO: 1028244 - RNA, 22 nt, Human
ucccaggcuggagugcaguggu

SEQ ID NO: 1028245 - RNA, 21 nt, Human
ucccggguucacaccauucuc

SEQ ID NO: 1028246 - RNA, 24 nt, Human
ucccggguucacaccauucuccug

SEQ ID NO: 1028247 - RNA, 24 nt, Human
uccuaaaguguuaggauuauaggc

SEQ ID NO: 1028248 - RNA, 24 nt, Human
uccugaguaguugggacuacaggc

SEQ ID NO: 1028249 - RNA, 24 nt, Human
ucucccaggcuggagugcaguggu

SEQ ID NO: 1028250 - RNA, 18 nt, Human
ucuccugccucagccucc

SEQ ID NO: 1028251 - RNA, 21 nt, Human
ucucgcucugucucccaggcu

SEQ ID NO: 1028252 - RNA, 23 nt, Human
ucucgcucugucucccaggcugg

SEQ ID NO: 1028253 - RNA, 24 nt, Human
ucucgcucugucucccaggcugga

SEQ ID NO: 1028254 - RNA, 19 nt, Human
ucugucucccaggcuggag

SEQ ID NO: 1028255 - RNA, 24 nt, Human
ucugucucccaggcuggagugcag

SEQ ID NO: 1028256 - RNA, 23 nt, Human
ugaagcugcagugagguaugauc

SEQ ID NO: 1028257 - RNA, 23 nt, Human
ugaccucaugauccacccgccuc

SEQ ID NO: 1028258 - RNA, 22 nt, Human
ugcaguggugcgaucucggcuc

SEQ ID NO: 1028259 - RNA, 24 nt, Human
ugccucagccuccugaguaguugg

SEQ ID NO: 1028260 - RNA, 23 nt, Human
uggagugcaguggugcgaucucg

SEQ ID NO: 1028261 - RNA, 24 nt, Human
uggagugcaguggugcgaucucgg

SEQ ID NO: 1028262 - RNA, 19 nt, Human
uggcuuacaaagcagcgug

SEQ ID NO: 1028263 - RNA, 21 nt, Human
ugggacuacaggcgcccacca

SEQ ID NO: 1028264 - RNA, 24 nt, Human
ugggacuacaggcgcccaccacca

SEQ ID NO: 1028265 - RNA, 22 nt, Human
ugggaggcuggggugggaggau

SEQ ID NO: 1028266 - RNA, 18 nt, Human
uggggugggaggauuacu

SEQ ID NO: 1028267 - RNA, 23 nt, Human
uggggugggaggauuacuugagc

SEQ ID NO: 1028268 - RNA, 24 nt, Human
uggggugggaggauuacuugagcc

SEQ ID NO: 1028269 - RNA, 20 nt, Human
ugucagaguacuaaaaagug

SEQ ID NO: 1028270 - RNA, 21 nt, Human
uuaguagagacaggguuucac

SEQ ID NO: 1028271 - RNA, 24 nt, Human
uuaguagagacaggguuucacugu

SEQ ID NO: 1028272 - RNA, 21 nt, Human
uucacuguguuagccaggaug

SEQ ID NO: 1028273 - RNA, 19 nt, Human
uuucacuguguuagccagg

SEQ ID NO: 1028274 - RNA, 20 nt, Human
uuugcugggcgugguggugc

SEQ ID NO: 1028275 - RNA, 24 nt, Human
uuuuuaguagagacaggguuucac

SEQ ID NO: 1028276 - RNA, 21 nt, Human
uuuuuguauuuuuaguagaga

SEQ ID NO: 1028277 - RNA, 21 nt, Human
uuuuuuguauuuuuaguagag

SEQ ID NO: 1028278 - RNA, 24 nt, Human
uuuuuuguauuuuuaguagagaca

SEQ ID NO: 1028279 - RNA, 22 nt, Human
aaacacugaaaacagcucuuac

SEQ ID NO: 1028280 - RNA, 20 nt, Human
aaacagaugguacaaacuuu

SEQ ID NO: 1028281 - RNA, 25 nt, Human
aagaugcugaaaacaaaacaaaaua

SEQ ID NO: 1028282 - RNA, 22 nt, Human
acaaacuuccaacuuucaaauc

SEQ ID NO: 1028283 - RNA, 18 nt, Human
acaaggaaaaauagcacu

SEQ ID NO: 1028284 - RNA, 24 nt, Human
accccgcccaccaagucuuacagc

SEQ ID NO: 1028285 - RNA, 21 nt, Human
agaaaauaaaaguucaaaaac

SEQ ID NO: 1028286 - RNA, 21 nt, Human
agaaagaugcugaaaacaaaa

SEQ ID NO: 1028287 - RNA, 21 nt, Human
agaauauccaaaggacaccuc

SEQ ID NO: 1028288 - RNA, 24 nt, Human
agcagccuugcacucuuaggcggc

SEQ ID NO: 1028289 - RNA, 21 nt, Human
aggcuucucugucaucacaga

SEQ ID NO: 1028290 - RNA, 22 nt, Human
auuccaggcucagaaucuucca

SEQ ID NO: 1028291 - RNA, 30 nt, Human
caacaagaaaauaaaaguucaaaaacuaag

SEQ ID NO: 1028292 - RNA, 26 nt, Human
caauagauccaaacugaaguaccauc

SEQ ID NO: 1028293 - RNA, 21 nt, Human
cacgguccaaucagguucuga

SEQ ID NO: 1028294 - RNA, 18 nt, Human
cacuaugacccagcuccc

SEQ ID NO: 1028295 - RNA, 19 nt, Human
cagcccagaggauuugcgg

SEQ ID NO: 1028296 - RNA, 24 nt, Human
cagcugaaaagggcgccucugcag

SEQ ID NO: 1028297 - RNA, 21 nt, Human
caucacagaauauccaaagga

SEQ ID NO: 1028298 - RNA, 18 nt, Human
cauuuaaaaauauuccau

SEQ ID NO: 1028299 - RNA, 21 nt, Human
cauuuuauugcucagcucacu

SEQ ID NO: 1028300 - RNA, 22 nt, Human
cauuuuuaaaaacaaggaaaaa

SEQ ID NO: 1028301 - RNA, 18 nt, Human
ccaauagauccaaacuga

SEQ ID NO: 1028302 - RNA, 20 nt, Human
ccccaccccaccccgcccac

SEQ ID NO: 1028303 - RNA, 19 nt, Human
ccccaccccgcccaccaag

SEQ ID NO: 1028304 - RNA, 24 nt, Human
cccuccccaccccaccccgcccac

SEQ ID NO: 1028305 - RNA, 25 nt, Human
cccuccccaccccaccccgcccacc

SEQ ID NO: 1028306 - RNA, 22 nt, Human
ccgcgcugcacucaggagcugc

SEQ ID NO: 1028307 - RNA, 18 nt, Human
ccuccccaccccaccccg

SEQ ID NO: 1028308 - RNA, 24 nt, Human
ccucugcaggcaggcggaucacuu

SEQ ID NO: 1028309 - RNA, 19 nt, Human
ccuuccuacccuuuccucc

SEQ ID NO: 1028310 - RNA, 23 nt, Human
cgcaauagauuccaaaaucagga

SEQ ID NO: 1028311 - RNA, 19 nt, Human
cgggccgggacaguggcag

SEQ ID NO: 1028312 - RNA, 20 nt, Human
cuacuggguaacucuuuggu

SEQ ID NO: 1028313 - RNA, 19 nt, Human
cuauaaguuuaagcuacag

SEQ ID NO: 1028314 - RNA, 22 nt, Human
cucacagcauggagcaugacga

SEQ ID NO: 1028315 - RNA, 18 nt, Human
cucccuucccacccuucc

SEQ ID NO: 1028316 - RNA, 23 nt, Human
cucgucauuugaaaggauuccac

SEQ ID NO: 1028317 - RNA, 22 nt, Human
cugcaaccgccuuccccggagc

SEQ ID NO: 1028318 - RNA, 26 nt, Human
cugcugccaugucaaccaguggaauc

SEQ ID NO: 1028319 - RNA, 21 nt, Human
cuuaacuucaaacaaacugca

SEQ ID NO: 1028320 - RNA, 22 nt, Human
cuuaugguuuacauaggauaug

SEQ ID NO: 1028321 - RNA, 21 nt, Human
cuucuaaaacucuaccuucaa

SEQ ID NO: 1028322 - RNA, 22 nt, Human
cuuuccucccuccccaccccac

SEQ ID NO: 1028323 - RNA, 18 nt, Human
cuuuucaaaacuuuauua

SEQ ID NO: 1028324 - RNA, 19 nt, Human
gacccagcucccuacaguc

SEQ ID NO: 1028325 - RNA, 18 nt, Human
gagcagcagcugaaaagg

SEQ ID NO: 1028326 - RNA, 20 nt, Human
gagcagcagcugaaaagggc

SEQ ID NO: 1028327 - RNA, 22 nt, Human
gagcugcaaccgccuuccccgg

SEQ ID NO: 1028328 - RNA, 18 nt, Human
gaguggcgagggggucug

SEQ ID NO: 1028329 - RNA, 21 nt, Human
gauacaguacgagauucauuu

SEQ ID NO: 1028330 - RNA, 19 nt, Human
gcagcagccaggggacaaa

SEQ ID NO: 1028331 - RNA, 24 nt, Human
gcaggagaaggacugggcgcugga

SEQ ID NO: 1028332 - RNA, 22 nt, Human
gcaggcaggcggaucacuuucu

SEQ ID NO: 1028333 - RNA, 22 nt, Human
gccacacucccccaauagaucc

SEQ ID NO: 1028334 - RNA, 21 nt, Human
gccuccaugggguccuaauuc

SEQ ID NO: 1028335 - RNA, 24 nt, Human
ggagcaugacgagguuuauuuccc

SEQ ID NO: 1028336 - RNA, 24 nt, Human
ggagcaugacgagguuuauuuccc

SEQ ID NO: 1028337 - RNA, 18 nt, Human
ggagggcagcagccaggg

SEQ ID NO: 1028338 - RNA, 20 nt, Human
ggagggcagcagccagggga

SEQ ID NO: 1028339 - RNA, 22 nt, Human
ggaguagagaaagcauggagug

SEQ ID NO: 1028340 - RNA, 20 nt, Human
ggcauuuucagguuuucagg

SEQ ID NO: 1028341 - RNA, 23 nt, Human
ggcgcuuggagaccugagcagcc

SEQ ID NO: 1028342 - RNA, 19 nt, Human
gggaaggugggcggacagg

SEQ ID NO: 1028343 - RNA, 21 nt, Human
gggccgggacaguggcaggaa

SEQ ID NO: 1028344 - RNA, 20 nt, Human
gggcuucuggcgagcagcag

SEQ ID NO: 1028345 - RNA, 19 nt, Human
ggggagaaugggagggcag

SEQ ID NO: 1028346 - RNA, 24 nt, Human
gggggugggguggggguuccucug

SEQ ID NO: 1028347 - RNA, 21 nt, Human
gucaaccaguggaaucaaggg

SEQ ID NO: 1028348 - RNA, 19 nt, Human
gucugcuucucccuuccca

SEQ ID NO: 1028349 - RNA, 21 nt, Human
guggcauuuucagguuuucag

SEQ ID NO: 1028350 - RNA, 22 nt, Human
guggccgggccgggacaguggc

SEQ ID NO: 1028351 - RNA, 20 nt, Human
gugguuugaggcagggagua

SEQ ID NO: 1028352 - RNA, 21 nt, Human
uaaaacacuaaccccagacag

SEQ ID NO: 1028353 - RNA, 18 nt, Human
uaaacccccagugaguca

SEQ ID NO: 1028354 - RNA, 20 nt, Human
uaaaggcauaaggcaaccag

SEQ ID NO: 1028355 - RNA, 24 nt, Human
uaaaugacuaugucugcuucuccc

SEQ ID NO: 1028356 - RNA, 22 nt, Human
uaaccccagacaguggaaccaa

SEQ ID NO: 1028357 - RNA, 19 nt, Human
uaagagcuugagaagauuu

SEQ ID NO: 1028358 - RNA, 18 nt, Human
uaaggcaaccaggucucc

SEQ ID NO: 1028359 - RNA, 25 nt, Human
uaggacucaaaacaguaaguuaagu

SEQ ID NO: 1028360 - RNA, 19 nt, Human
uaugacccagcucccuaca

SEQ ID NO: 1028361 - RNA, 19 nt, Human
uaugacccagcucccuaca

SEQ ID NO: 1028362 - RNA, 19 nt, Human
ucaaacagaugguacaaac

SEQ ID NO: 1028363 - RNA, 24 nt, Human
ucagaaucuuccauccagccuucu

SEQ ID NO: 1028364 - RNA, 24 nt, Human
ucagaaucuuccauccagccuucu

SEQ ID NO: 1028365 - RNA, 18 nt, Human
uccaugggguccuaauuc

SEQ ID NO: 1028366 - RNA, 24 nt, Human
ucccuccccaccccaccccgccca

SEQ ID NO: 1028367 - RNA, 21 nt, Human
ucgguucaggagguccaaaga

SEQ ID NO: 1028368 - RNA, 21 nt, Human
ucucacccagcuacuacugga

SEQ ID NO: 1028369 - RNA, 21 nt, Human
ucugcuucucccuucccaccc

SEQ ID NO: 1028370 - RNA, 23 nt, Human
ucugucaucacagaauauccaaa

SEQ ID NO: 1028371 - RNA, 23 nt, Human
ugaaaacagcucuuacaaaaucc

SEQ ID NO: 1028372 - RNA, 18 nt, Human
ugaaguaccaucuggggg

SEQ ID NO: 1028373 - RNA, 24 nt, Human
ugcaggcaggcggaucacuuucua

SEQ ID NO: 1028374 - RNA, 19 nt, Human
ugcauauacucaaacagau

SEQ ID NO: 1028375 - RNA, 18 nt, Human
ugccaggugaccuccuac

SEQ ID NO: 1028376 - RNA, 21 nt, Human
uggagggggagaaugggaggg

SEQ ID NO: 1028377 - RNA, 24 nt, Human
uggagggggagaaugggagggcag

SEQ ID NO: 1028378 - RNA, 19 nt, Human
uggaguggcgagggggucu

SEQ ID NO: 1028379 - RNA, 20 nt, Human
uggaguggcgagggggucug

SEQ ID NO: 1028380 - RNA, 18 nt, Human
uggcaggaagccgcgcug

SEQ ID NO: 1028381 - RNA, 20 nt, Human
ugggagggcagcagccaggg

SEQ ID NO: 1028382 - RNA, 23 nt, Human
ugguagguggggguggggugggg

SEQ ID NO: 1028383 - RNA, 23 nt, Human
ugguuuacauaggauaugcauug

SEQ ID NO: 1028384 - RNA, 21 nt, Human
uguaagaguaaaggcauaagg

SEQ ID NO: 1028385 - RNA, 23 nt, Human
uuaaaugugcauauacucaaaca

SEQ ID NO: 1028386 - RNA, 18 nt, Human
uuacugucccacgcacua

SEQ ID NO: 1028387 - RNA, 24 nt, Human
uuaggcggcagcguccuuucuccc

SEQ ID NO: 1028388 - RNA, 24 nt, Human
uugcccagaagucaacguuugcug

SEQ ID NO: 1028389 - RNA, 20 nt, Human
uuuaaaaacaaggaaaaauu

SEQ ID NO: 1028390 - RNA, 19 nt, Human
uuuaaaaauauuccauuuu

SEQ ID NO: 1028391 - RNA, 23 nt, Human
uuuaagcuacaggcugagaccuu

SEQ ID NO: 1028392 - RNA, 21 nt, Human
uuuuacagcuaucuacagaua

SEQ ID NO: 1028393 - RNA, 22 nt, Human
aaauuuauucugugacauuuuc

SEQ ID NO: 1028394 - RNA, 18 nt, Human
aagcagaagcgaaagcgg

SEQ ID NO: 1028395 - RNA, 23 nt, Human
aagcagaagcgaaagcggugaca

SEQ ID NO: 1028396 - RNA, 24 nt, Human
aagcagaagcgaaagcggugacac

SEQ ID NO: 1028397 - RNA, 24 nt, Human
cauaaaaugauaaggacugcaaca

SEQ ID NO: 1028398 - RNA, 19 nt, Human
cuuuuuuuuuuucacuuca

SEQ ID NO: 1028399 - RNA, 20 nt, Human
gacaccgccgacccgaccua

SEQ ID NO: 1028400 - RNA, 18 nt, Human
gccgacccgaccuaugcg

SEQ ID NO: 1028401 - RNA, 18 nt, Human
gcgcaggcgcgcacucgc

SEQ ID NO: 1028402 - RNA, 21 nt, Human
ucauugaagauauuuuaacau

SEQ ID NO: 1028403 - RNA, 18 nt, Human
ucugugacauuuuccuca

SEQ ID NO: 1028404 - RNA, 23 nt, Human
ugaagauauuuuaacauagauua

SEQ ID NO: 1028405 - RNA, 20 nt, Human
ugacaccgccgacccgaccu

SEQ ID NO: 1028406 - RNA, 24 nt, Human
uucaugaaaaauaaauucuagaag

SEQ ID NO: 1028407 - RNA, 20 nt, Human
uuuucacuucaaacaucauu

SEQ ID NO: 1028408 - RNA, 28 nt, Human
aaagcagccuugcccucuuuaacaauua

SEQ ID NO: 1028409 - RNA, 19 nt, Human
aacaggucauauuaguguc

SEQ ID NO: 1028410 - RNA, 19 nt, Human
aacaugaugaaaccccguc

SEQ ID NO: 1028411 - RNA, 20 nt, Human
aacaugaugaaaccccgucu

SEQ ID NO: 1028412 - RNA, 21 nt, Human
aacaugaugaaaccccgucuc

SEQ ID NO: 1028413 - RNA, 21 nt, Human
aaccaaaacgacaaagcaguc

SEQ ID NO: 1028414 - RNA, 21 nt, Human
aaccccgucucuaccaaaaau

SEQ ID NO: 1028415 - RNA, 23 nt, Human
aagaaacccagcgggugacaagc

SEQ ID NO: 1028416 - RNA, 19 nt, Human
aagcauuucgggaggcuga

SEQ ID NO: 1028417 - RNA, 24 nt, Human
aagcauuucgggaggcugaggugg

SEQ ID NO: 1028418 - RNA, 19 nt, Human
aaggagcuccuggacagaa

SEQ ID NO: 1028419 - RNA, 20 nt, Human
aauuguuugaacccaggagg

SEQ ID NO: 1028420 - RNA, 24 nt, Human
aauuguuugaacccaggaggcgga

SEQ ID NO: 1028421 - RNA, 22 nt, Human
acaaaaccaaaacgacaaagca

SEQ ID NO: 1028422 - RNA, 20 nt, Human
acacugccugccuuuucagc

SEQ ID NO: 1028423 - RNA, 19 nt, Human
acagaacccauacaacagc

SEQ ID NO: 1028424 - RNA, 22 nt, Human
acagaugcuagugaauguucuu

SEQ ID NO: 1028425 - RNA, 18 nt, Human
acaggagcacgcggcgug

SEQ ID NO: 1028426 - RNA, 22 nt, Human
acaggcccuccccagauggcaa

SEQ ID NO: 1028427 - RNA, 19 nt, Human
accaagugcacacucaccc

SEQ ID NO: 1028428 - RNA, 22 nt, Human
accaagugcacacucacccagc

SEQ ID NO: 1028429 - RNA, 22 nt, Human
accaguaauccccgcuauuugg

SEQ ID NO: 1028430 - RNA, 24 nt, Human
accccgucucuaccaaaaauacaa

SEQ ID NO: 1028431 - RNA, 18 nt, Human
accuugaauaaaagcagc

SEQ ID NO: 1028432 - RNA, 22 nt, Human
acgauggccaugcucggcgcgg

SEQ ID NO: 1028433 - RNA, 23 nt, Human
acgcugggccaacccgagcaugu

SEQ ID NO: 1028434 - RNA, 18 nt, Human
acuccagccugggggaca

SEQ ID NO: 1028435 - RNA, 21 nt, Human
acugucuccgcgaccuugggg

SEQ ID NO: 1028436 - RNA, 23 nt, Human
acuugcuggcgucugcagcguca

SEQ ID NO: 1028437 - RNA, 23 nt, Human
agacaaaaccaaaacgacaaagc

SEQ ID NO: 1028438 - RNA, 21 nt, Human
agacagaacccauacaacagc

SEQ ID NO: 1028439 - RNA, 18 nt, Human
agaccucaagaaacccag

SEQ ID NO: 1028440 - RNA, 21 nt, Human
agaggacagccucaccacgug

SEQ ID NO: 1028441 - RNA, 18 nt, Human
agcaauaucaucgauaac

SEQ ID NO: 1028442 - RNA, 20 nt, Human
agcaccuugggaggcugagg

SEQ ID NO: 1028443 - RNA, 24 nt, Human
agcauuucgggaggcugagguggg

SEQ ID NO: 1028444 - RNA, 18 nt, Human
agccucacagcgugcaca

SEQ ID NO: 1028445 - RNA, 24 nt, Human
agccuggccaacaugaugaaaccc

SEQ ID NO: 1028446 - RNA, 24 nt, Human
agccugggggacaaagccagacuc

SEQ ID NO: 1028447 - RNA, 23 nt, Human
agcgcccaugcacccucagccac

SEQ ID NO: 1028448 - RNA, 23 nt, Human
aggcaggagaauuguuugaaccc

SEQ ID NO: 1028449 - RNA, 24 nt, Human
aggcaggagaauuguuugaaccca

SEQ ID NO: 1028450 - RNA, 19 nt, Human
aggcaggaggaugaggucu

SEQ ID NO: 1028451 - RNA, 21 nt, Human
aggcggagguugcagugagcc

SEQ ID NO: 1028452 - RNA, 24 nt, Human
aggcggagguugcagugagccgag

SEQ ID NO: 1028453 - RNA, 29 nt, Human
aggcgguguucugggacuggucgagggcg

SEQ ID NO: 1028454 - RNA, 21 nt, Human
aggcugaggcaggagaauugu

SEQ ID NO: 1028455 - RNA, 24 nt, Human
aggcugaggcaggagaauuguuug

SEQ ID NO: 1028456 - RNA, 22 nt, Human
aggcugaggugggcggaucacg

SEQ ID NO: 1028457 - RNA, 23 nt, Human
agggaggccuggcugccccgggc

SEQ ID NO: 1028458 - RNA, 24 nt, Human
agggaggccuggcugccccgggcu

SEQ ID NO: 1028459 - RNA, 25 nt, Human
agggcaggacacacugaggucugcc

SEQ ID NO: 1028460 - RNA, 22 nt, Human
aggggucccagaguucuccaga

SEQ ID NO: 1028461 - RNA, 25 nt, Human
aggugcccccuauuccugcagcccu

SEQ ID NO: 1028462 - RNA, 21 nt, Human
agucaggcuccucugagcccu

SEQ ID NO: 1028463 - RNA, 19 nt, Human
aguucuccagaaaaaauaa

SEQ ID NO: 1028464 - RNA, 24 nt, Human
auacaacagcagaacuccccagag

SEQ ID NO: 1028465 - RNA, 24 nt, Human
auccugccaucgcacuccagccug

SEQ ID NO: 1028466 - RNA, 23 nt, Human
aucucgcuuuagcagccccccca

SEQ ID NO: 1028467 - RNA, 19 nt, Human
augccuguaaucccagcac

SEQ ID NO: 1028468 - RNA, 18 nt, Human
auggccucuggcuuccag

SEQ ID NO: 1028469 - RNA, 19 nt, Human
caaaaccaaaacgacaaag

SEQ ID NO: 1028470 - RNA, 20 nt, Human
caaaauaagccccgaaauga

SEQ ID NO: 1028471 - RNA, 26 nt, Human
caaacaguccccuuaccaagcccucu

SEQ ID NO: 1028472 - RNA, 24 nt, Human
caacaugaugaaaccccgucucua

SEQ ID NO: 1028473 - RNA, 20 nt, Human
caagacgacagccucacagc

SEQ ID NO: 1028474 - RNA, 22 nt, Human
cacagaugcuagugaauguucu

SEQ ID NO: 1028475 - RNA, 20 nt, Human
cacagugaacggccugugug

SEQ ID NO: 1028476 - RNA, 20 nt, Human
cacagugaacggccugugug

SEQ ID NO: 1028477 - RNA, 24 nt, Human
caccagggccugcauccccaucug

SEQ ID NO: 1028478 - RNA, 23 nt, Human
caccaguaauccccgcuauuugg

SEQ ID NO: 1028479 - RNA, 24 nt, Human
caccaguaauccccgcuauuuggg

SEQ ID NO: 1028480 - RNA, 21 nt, Human
cacccagcuuccucugcccgg

SEQ ID NO: 1028481 - RNA, 25 nt, Human
cacccguaaucccaaagcauuucgg

SEQ ID NO: 1028482 - RNA, 23 nt, Human
caccuggccucuccaugcaccaa

SEQ ID NO: 1028483 - RNA, 24 nt, Human
cacgacgucaggaguuugagacua

SEQ ID NO: 1028484 - RNA, 23 nt, Human
cacuccagccugggggacaaagc

SEQ ID NO: 1028485 - RNA, 18 nt, Human
cacucccacagggcagga

SEQ ID NO: 1028486 - RNA, 24 nt, Human
cagaacuccccagaggacagccuc

SEQ ID NO: 1028487 - RNA, 22 nt, Human
cagaauccauuaacugcuccuc

SEQ ID NO: 1028488 - RNA, 19 nt, Human
cagaggacagccucaccac

SEQ ID NO: 1028489 - RNA, 24 nt, Human
cagcaccuugggaggcugaggcag

SEQ ID NO: 1028490 - RNA, 18 nt, Human
caggacacacugaggucu

SEQ ID NO: 1028491 - RNA, 21 nt, Human
cagggccugcauccccaucug

SEQ ID NO: 1028492 - RNA, 20 nt, Human
cagugagccgagauccugcc

SEQ ID NO: 1028493 - RNA, 23 nt, Human
cagugcaauggcuucaacacuuu

SEQ ID NO: 1028494 - RNA, 18 nt, Human
caguggggaccggccagg

SEQ ID NO: 1028495 - RNA, 18 nt, Human
caucgcacuccagccugg

SEQ ID NO: 1028496 - RNA, 19 nt, Human
caucgcacuccagccuggg

SEQ ID NO: 1028497 - RNA, 24 nt, Human
caucgcacuccagccugggggaca

SEQ ID NO: 1028498 - RNA, 24 nt, Human
caugaacaggucauauuaguguca

SEQ ID NO: 1028499 - RNA, 24 nt, Human
caugccuguaaucccagcaccuug

SEQ ID NO: 1028500 - RNA, 28 nt, Human
ccaaccuggacaacauagcgagagcugg

SEQ ID NO: 1028501 - RNA, 22 nt, Human
ccagagggugugucaggaccug

SEQ ID NO: 1028502 - RNA, 20 nt, Human
ccagauggcaacuuggucuu

SEQ ID NO: 1028503 - RNA, 21 nt, Human
ccagccugggggacaaagcca

SEQ ID NO: 1028504 - RNA, 19 nt, Human
ccagccuguccucaucuca

SEQ ID NO: 1028505 - RNA, 22 nt, Human
ccaggaggcggagguugcagug

SEQ ID NO: 1028506 - RNA, 20 nt, Human
ccaucgcacuccagccuggg

SEQ ID NO: 1028507 - RNA, 24 nt, Human
ccaucgcacuccagccugggggac

SEQ ID NO: 1028508 - RNA, 24 nt, Human
ccaugcucggcgcggcggcucaca

SEQ ID NO: 1028509 - RNA, 19 nt, Human
ccaugggcuuccauggccu

SEQ ID NO: 1028510 - RNA, 24 nt, Human
cccaacaucucgcuuuagcagccc

SEQ ID NO: 1028511 - RNA, 22 nt, Human
cccacagggcaggacacacuga

SEQ ID NO: 1028512 - RNA, 22 nt, Human
cccagcgggugacaagcuuggg

SEQ ID NO: 1028513 - RNA, 18 nt, Human
cccauacaacagcagaac

SEQ ID NO: 1028514 - RNA, 20 nt, Human
cccaugcacccucagccacg

SEQ ID NO: 1028515 - RNA, 21 nt, Human
cccaugcacccucagccacgg

SEQ ID NO: 1028516 - RNA, 20 nt, Human
cccaugcgccaggagaaaac

SEQ ID NO: 1028517 - RNA, 28 nt, Human
cccaugcgccaggagaaaaccggggucc

SEQ ID NO: 1028518 - RNA, 18 nt, Human
ccccagaggacagccucc

SEQ ID NO: 1028519 - RNA, 22 nt, Human
ccccaggccaacaccuggccuc

SEQ ID NO: 1028520 - RNA, 22 nt, Human
cccccaggccaacaccuggccu

SEQ ID NO: 1028521 - RNA, 19 nt, Human
cccccaucuccccuccacc

SEQ ID NO: 1028522 - RNA, 28 nt, Human
cccccuauuccugcagcccuuccuggac

SEQ ID NO: 1028523 - RNA, 18 nt, Human
cccccuccaucccagcgc

SEQ ID NO: 1028524 - RNA, 19 nt, Human
ccccgcccugcuccccucg

SEQ ID NO: 1028525 - RNA, 21 nt, Human
ccccgcccugcuccccucgcc

SEQ ID NO: 1028526 - RNA, 30 nt, Human
ccccgggcuuuagaaccaaaauaagccccu

SEQ ID NO: 1028527 - RNA, 19 nt, Human
cccgcguccccgccgaggc

SEQ ID NO: 1028528 - RNA, 22 nt, Human
cccuacugucuccgcgaccuug

SEQ ID NO: 1028529 - RNA, 21 nt, Human
cccuccaccgccaccagggcc

SEQ ID NO: 1028530 - RNA, 23 nt, Human
cccugaccuuggccgguuucggc

SEQ ID NO: 1028531 - RNA, 23 nt, Human
cccugcuccccucgccccugcac

SEQ ID NO: 1028532 - RNA, 18 nt, Human
ccgccaccagggccugca

SEQ ID NO: 1028533 - RNA, 21 nt, Human
ccgcccugcuccccucgcccc

SEQ ID NO: 1028534 - RNA, 19 nt, Human
ccgcguccccgccgaggcc

SEQ ID NO: 1028535 - RNA, 20 nt, Human
ccgggcgucaccccgcccug

SEQ ID NO: 1028536 - RNA, 21 nt, Human
ccugcacagcccgaguccagc

SEQ ID NO: 1028537 - RNA, 20 nt, Human
ccugcagcccuuccuggacc

SEQ ID NO: 1028538 - RNA, 18 nt, Human
ccugcccccaucuccccu

SEQ ID NO: 1028539 - RNA, 21 nt, Human
ccugcccccaucuccccucca

SEQ ID NO: 1028540 - RNA, 19 nt, Human
ccuggacaacauagcgaga

SEQ ID NO: 1028541 - RNA, 21 nt, Human
ccuggacccagccuguccuca

SEQ ID NO: 1028542 - RNA, 23 nt, Human
ccuggccaacaugaugaaacccc

SEQ ID NO: 1028543 - RNA, 24 nt, Human
ccuggccaacaugaugaaaccccg

SEQ ID NO: 1028544 - RNA, 18 nt, Human
ccuugccccugacccuuc

SEQ ID NO: 1028545 - RNA, 22 nt, Human
cgaguccagccuggucgcugcc

SEQ ID NO: 1028546 - RNA, 24 nt, Human
cgcaccaguaauccccgcuauuug

SEQ ID NO: 1028547 - RNA, 20 nt, Human
cgcgccuuuaaaccugaagc

SEQ ID NO: 1028548 - RNA, 21 nt, Human
cggaucacgacgucaggaguu

SEQ ID NO: 1028549 - RNA, 19 nt, Human
cggcaacgucccugccccc

SEQ ID NO: 1028550 - RNA, 23 nt, Human
cggcucacacccguaaucccaaa

SEQ ID NO: 1028551 - RNA, 21 nt, Human
cggcugggcuccccgcuuucu

SEQ ID NO: 1028552 - RNA, 19 nt, Human
cgggaggcugaggugggcg

SEQ ID NO: 1028553 - RNA, 24 nt, Human
cgggaggcugaggugggcggauca

SEQ ID NO: 1028554 - RNA, 24 nt, Human
cgugcacagugaacggccugugug

SEQ ID NO: 1028555 - RNA, 24 nt, Human
cgugcacagugaacggccugugug

SEQ ID NO: 1028556 - RNA, 20 nt, Human
cuaaucugcauuauuaacac

SEQ ID NO: 1028557 - RNA, 21 nt, Human
cuagaacccgccuugccccug

SEQ ID NO: 1028558 - RNA, 22 nt, Human
cucacacccguaaucccaaagc

SEQ ID NO: 1028559 - RNA, 19 nt, Human
cucaugccuguaaucccag

SEQ ID NO: 1028560 - RNA, 25 nt, Human
cucaugccuguaaucccagcaccuu

SEQ ID NO: 1028561 - RNA, 19 nt, Human
cuccaagcuuccaccucgg

SEQ ID NO: 1028562 - RNA, 20 nt, Human
cuccaggccgcucuccgggc

SEQ ID NO: 1028563 - RNA, 19 nt, Human
cucccacauggcucccagg

SEQ ID NO: 1028564 - RNA, 21 nt, Human
cuccugcggaccguccaggcu

SEQ ID NO: 1028565 - RNA, 21 nt, Human
cucgcuuuagcagccccccca

SEQ ID NO: 1028566 - RNA, 20 nt, Human
cucuccaggccgcucuccgg

SEQ ID NO: 1028567 - RNA, 23 nt, Human
cucuccaggccgcucuccgggcc

SEQ ID NO: 1028568 - RNA, 19 nt, Human
cucuccaugcaccaacacc

SEQ ID NO: 1028569 - RNA, 20 nt, Human
cugcagcccaccccugggga

SEQ ID NO: 1028570 - RNA, 20 nt, Human
cugcagcccuuccuggaccc

SEQ ID NO: 1028571 - RNA, 18 nt, Human
cuggccuugccacuccca

SEQ ID NO: 1028572 - RNA, 21 nt, Human
cugggcuccccgcuuucuggu

SEQ ID NO: 1028573 - RNA, 24 nt, Human
cugugaccagucccugaccuuggc

SEQ ID NO: 1028574 - RNA, 20 nt, Human
cuguugucacuccccuuggc

SEQ ID NO: 1028575 - RNA, 25 nt, Human
cuucuccaucagucugaguuaaagg

SEQ ID NO: 1028576 - RNA, 19 nt, Human
cuuuucagcaaaaauccug

SEQ ID NO: 1028577 - RNA, 21 nt, Human
gacacagaugcuagugaaugu

SEQ ID NO: 1028578 - RNA, 21 nt, Human
gacagggugcccacgccuucu

SEQ ID NO: 1028579 - RNA, 23 nt, Human
gaccaagugcacacucacccagc

SEQ ID NO: 1028580 - RNA, 21 nt, Human
gacccagccuguccucaucuc

SEQ ID NO: 1028581 - RNA, 21 nt, Human
gacugugguucaccgagugug

SEQ ID NO: 1028582 - RNA, 23 nt, Human
gagaauuguuugaacccaggagg

SEQ ID NO: 1028583 - RNA, 20 nt, Human
gagcaaaggggaccaagugc

SEQ ID NO: 1028584 - RNA, 20 nt, Human
gagcagggccuggacagggg

SEQ ID NO: 1028585 - RNA, 18 nt, Human
gaggaacaggcccucccc

SEQ ID NO: 1028586 - RNA, 21 nt, Human
gaggcggagguugcagugagc

SEQ ID NO: 1028587 - RNA, 22 nt, Human
gaggcugaggugggcggaucac

SEQ ID NO: 1028588 - RNA, 22 nt, Human
gagguugcagugagccgagauc

SEQ ID NO: 1028589 - RNA, 21 nt, Human
gaucacgacgucaggaguuug

SEQ ID NO: 1028590 - RNA, 22 nt, Human
gaucacgacgucaggaguuuga

SEQ ID NO: 1028591 - RNA, 24 nt, Human
gaucacgacgucaggaguuugaga

SEQ ID NO: 1028592 - RNA, 20 nt, Human
gcacagacugggacaggaca

SEQ ID NO: 1028593 - RNA, 19 nt, Human
gcaggacacacugaggucu

SEQ ID NO: 1028594 - RNA, 22 nt, Human
gcaggagaauuguuugaaccca

SEQ ID NO: 1028595 - RNA, 24 nt, Human
gccaacaugaugaaaccccgucuc

SEQ ID NO: 1028596 - RNA, 21 nt, Human
gccacgguccucagaccucaa

SEQ ID NO: 1028597 - RNA, 20 nt, Human
gcccaugcacccucagccaa

SEQ ID NO: 1028598 - RNA, 21 nt, Human
gcccccuauuccugcagcccu

SEQ ID NO: 1028599 - RNA, 18 nt, Human
gccccgggcuuuagaacc

SEQ ID NO: 1028600 - RNA, 19 nt, Human
gcccuggacggcagagcuc

SEQ ID NO: 1028601 - RNA, 23 nt, Human
gccugcguggguggcgcucgcgc

SEQ ID NO: 1028602 - RNA, 22 nt, Human
gccuguggacuucauccauggg

SEQ ID NO: 1028603 - RNA, 23 nt, Human
gcggaucacgacgucaggaguuu

SEQ ID NO: 1028604 - RNA, 22 nt, Human
gcuauuugggaggcugaggcag

SEQ ID NO: 1028605 - RNA, 23 nt, Human
gcucaggugcccccuauuccugc

SEQ ID NO: 1028606 - RNA, 18 nt, Human
gcuccucugagcccuccc

SEQ ID NO: 1028607 - RNA, 23 nt, Human
gcucugguuuguagcacuugcug

SEQ ID NO: 1028608 - RNA, 22 nt, Human
gcuuucugcaggcucaggugcc

SEQ ID NO: 1028609 - RNA, 20 nt, Human
ggacaucccccuccauccca

SEQ ID NO: 1028610 - RNA, 19 nt, Human
ggaccguccaggcugcucu

SEQ ID NO: 1028611 - RNA, 18 nt, Human
ggagguugcagugagccg

SEQ ID NO: 1028612 - RNA, 20 nt, Human
ggagguugcagugagccgag

SEQ ID NO: 1028613 - RNA, 22 nt, Human
ggagguugcagugagccgagau

SEQ ID NO: 1028614 - RNA, 23 nt, Human
ggagguugcagugagccgagauc

SEQ ID NO: 1028615 - RNA, 20 nt, Human
ggaucacgacgucaggaguu

SEQ ID NO: 1028616 - RNA, 22 nt, Human
ggauugcugcugggggcacagg

SEQ ID NO: 1028617 - RNA, 22 nt, Human
ggcagggacuggcaggaggcag

SEQ ID NO: 1028618 - RNA, 23 nt, Human
ggcggaucacgacgucaggaguu

SEQ ID NO: 1028619 - RNA, 20 nt, Human
ggcugcuggccugagcuucc

SEQ ID NO: 1028620 - RNA, 20 nt, Human
gggacaggacaucccccucc

SEQ ID NO: 1028621 - RNA, 19 nt, Human
gggacgccuaagacaggag

SEQ ID NO: 1028622 - RNA, 20 nt, Human
gggaggcugaggugggcgga

SEQ ID NO: 1028623 - RNA, 23 nt, Human
gggaggcugaggugggcggauca

SEQ ID NO: 1028624 - RNA, 23 nt, Human
gggcugucaauucccacuuuuuc

SEQ ID NO: 1028625 - RNA, 18 nt, Human
ggggaccaagugcacacu

SEQ ID NO: 1028626 - RNA, 21 nt, Human
ggggguggggaggaagaggag

SEQ ID NO: 1028627 - RNA, 24 nt, Human
ggucccucaugccuguaaucccag

SEQ ID NO: 1028628 - RNA, 24 nt, Human
gucccugcccccaucuccccucca

SEQ ID NO: 1028629 - RNA, 18 nt, Human
gugaaggucauggcaucu

SEQ ID NO: 1028630 - RNA, 22 nt, Human
uaaaaauaaaacgacuaggagc

SEQ ID NO: 1028631 - RNA, 20 nt, Human
uaaaggacgaacguucccga

SEQ ID NO: 1028632 - RNA, 24 nt, Human
uaaaugccagaagaguucuucaau

SEQ ID NO: 1028633 - RNA, 18 nt, Human
uaacaauuaauaagcaca

SEQ ID NO: 1028634 - RNA, 25 nt, Human
uaacccaacaucucgcuuuagcagg

SEQ ID NO: 1028635 - RNA, 24 nt, Human
uaagacaaaaccaaaacgacaaag

SEQ ID NO: 1028636 - RNA, 19 nt, Human
uaagacaggagacgucucc

SEQ ID NO: 1028637 - RNA, 19 nt, Human
uaagccccgaaaugauugg

SEQ ID NO: 1028638 - RNA, 22 nt, Human
uaagucaugaggacccguuguc

SEQ ID NO: 1028639 - RNA, 22 nt, Human
uaaucccaaagcauuucgggag

SEQ ID NO: 1028640 - RNA, 19 nt, Human
uacaacagcagaacucccc

SEQ ID NO: 1028641 - RNA, 21 nt, Human
uacaacagcagaacuccccag

SEQ ID NO: 1028642 - RNA, 22 nt, Human
uacaacagcagaacuccccaga

SEQ ID NO: 1028643 - RNA, 25 nt, Human
uacaacagcagaacuccccagagga

SEQ ID NO: 1028644 - RNA, 21 nt, Human
uaccaaaaauacaaaaauuag

SEQ ID NO: 1028645 - RNA, 21 nt, Human
uagagcccaaagucccaggga

SEQ ID NO: 1028646 - RNA, 19 nt, Human
uagcacccccaggccaaca

SEQ ID NO: 1028647 - RNA, 24 nt, Human
uagccuggccaacaugaugaaacc

SEQ ID NO: 1028648 - RNA, 20 nt, Human
uagcugggugugguggcacg

SEQ ID NO: 1028649 - RNA, 22 nt, Human
uaugaccaauugauucucgcag

SEQ ID NO: 1028650 - RNA, 22 nt, Human
uauuauuagguccagaacacug

SEQ ID NO: 1028651 - RNA, 24 nt, Human
ucacgacgucaggaguuugagacu

SEQ ID NO: 1028652 - RNA, 18 nt, Human
ucacuccccuuggccgcu

SEQ ID NO: 1028653 - RNA, 22 nt, Human
ucaugccuguaaucccagcacc

SEQ ID NO: 1028654 - RNA, 19 nt, Human
uccaagacgacagccucac

SEQ ID NO: 1028655 - RNA, 21 nt, Human
uccagaauccauuaacugcuc

SEQ ID NO: 1028656 - RNA, 23 nt, Human
uccaugcaccaacaccuggccuc

SEQ ID NO: 1028657 - RNA, 18 nt, Human
ucccacauggcucccagg

SEQ ID NO: 1028658 - RNA, 21 nt, Human
ucccagaguucuccagaaaaa

SEQ ID NO: 1028659 - RNA, 22 nt, Human
uccccagauggcaacuuggucu

SEQ ID NO: 1028660 - RNA, 21 nt, Human
ucccgcguccccgccgaggcc

SEQ ID NO: 1028661 - RNA, 24 nt, Human
ucccucaugccuguaaucccagca

SEQ ID NO: 1028662 - RNA, 24 nt, Human
ucccugaucaaaguccucaacucu

SEQ ID NO: 1028663 - RNA, 21 nt, Human
ucccugugaccagucccugac

SEQ ID NO: 1028664 - RNA, 21 nt, Human
uccgcgaccuuggggguucac

SEQ ID NO: 1028665 - RNA, 18 nt, Human
uccucaacucccacccuc

SEQ ID NO: 1028666 - RNA, 19 nt, Human
uccugcagcccuuccugga

SEQ ID NO: 1028667 - RNA, 25 nt, Human
ucgggaggcugaggugggcggauca

SEQ ID NO: 1028668 - RNA, 18 nt, Human
ucuauuagccgggacuga

SEQ ID NO: 1028669 - RNA, 24 nt, Human
ucuccaugcaccaacaccuggccu

SEQ ID NO: 1028670 - RNA, 23 nt, Human
ucugcaggcucaggugcccccua

SEQ ID NO: 1028671 - RNA, 19 nt, Human
ucuggacugugguucaccg

SEQ ID NO: 1028672 - RNA, 20 nt, Human
ucuggcggcugggcuccccg

SEQ ID NO: 1028673 - RNA, 19 nt, Human
ucuuggacuucccaguccc

SEQ ID NO: 1028674 - RNA, 23 nt, Human
ugaaagccuuucuguuccccaga

SEQ ID NO: 1028675 - RNA, 19 nt, Human
ugaagcacgcgcucuccag

SEQ ID NO: 1028676 - RNA, 20 nt, Human
ugacacagacagaacccaua

SEQ ID NO: 1028677 - RNA, 21 nt, Human
ugacacagacagaacccauac

SEQ ID NO: 1028678 - RNA, 21 nt, Human
ugagacuagccuggccaacau

SEQ ID NO: 1028679 - RNA, 23 nt, Human
ugagacuagccuggccaacauga

SEQ ID NO: 1028680 - RNA, 19 nt, Human
ugagagaugauugucuguu

SEQ ID NO: 1028681 - RNA, 20 nt, Human
ugagccgagauccugccauc

SEQ ID NO: 1028682 - RNA, 22 nt, Human
ugagccgagauccugccaucgc

SEQ ID NO: 1028683 - RNA, 22 nt, Human
ugagccggaucugccuccccua

SEQ ID NO: 1028684 - RNA, 24 nt, Human
ugaggcaggagaauuguuugaacc

SEQ ID NO: 1028685 - RNA, 25 nt, Human
ugaggcaggagaauuguuugaaccc

SEQ ID NO: 1028686 - RNA, 22 nt, Human
ugaggugggcggaucacgacgu

SEQ ID NO: 1028687 - RNA, 24 nt, Human
ugaggugggcggaucacgacguca

SEQ ID NO: 1028688 - RNA, 22 nt, Human
ugaguaagucaugaggacccgu

SEQ ID NO: 1028689 - RNA, 22 nt, Human
ugaguagaggcaccagagggug

SEQ ID NO: 1028690 - RNA, 18 nt, Human
ugaguuaaaggccagcuc

SEQ ID NO: 1028691 - RNA, 19 nt, Human
ugaucucguuugucaguga

SEQ ID NO: 1028692 - RNA, 21 nt, Human
ugaucucguuugucagugacu

SEQ ID NO: 1028693 - RNA, 20 nt, Human
ugauguagccacgauggcca

SEQ ID NO: 1028694 - RNA, 20 nt, Human
ugcaauggcuucaacacuuu

SEQ ID NO: 1028695 - RNA, 19 nt, Human
ugcacgugggccucggagg

SEQ ID NO: 1028696 - RNA, 24 nt, Human
ugccccgggcuuuagaaccaaaau

SEQ ID NO: 1028697 - RNA, 22 nt, Human
ugcccggcaacgucccugcccc

SEQ ID NO: 1028698 - RNA, 21 nt, Human
ugccuguaaucccagcaccuu

SEQ ID NO: 1028699 - RNA, 23 nt, Human
ugccuguaaucccagcaccuugg

SEQ ID NO: 1028700 - RNA, 24 nt, Human
ugccuguaaucccagcaccuuggg

SEQ ID NO: 1028701 - RNA, 22 nt, Human
ugccuucagaccagggugagaa

SEQ ID NO: 1028702 - RNA, 23 nt, Human
ugcgccaggagaaaaccuaaagg

SEQ ID NO: 1028703 - RNA, 22 nt, Human
ugcggaccguccaggcugcucu

SEQ ID NO: 1028704 - RNA, 24 nt, Human
ugcugagucgguuuagugaaaauc

SEQ ID NO: 1028705 - RNA, 24 nt, Human
uggaaaaaaaaaaucugugacaau

SEQ ID NO: 1028706 - RNA, 24 nt, Human
uggacuucccaguccccauaaaug

SEQ ID NO: 1028707 - RNA, 21 nt, Human
uggccucuggcuuccaguccu

SEQ ID NO: 1028708 - RNA, 23 nt, Human
uggccuguggacuucauccaugg

SEQ ID NO: 1028709 - RNA, 19 nt, Human
uggcucccaggaauccccc

SEQ ID NO: 1028710 - RNA, 20 nt, Human
uggcucccaggaauccccca

SEQ ID NO: 1028711 - RNA, 18 nt, Human
uggcuuggaaaaaaaaaa

SEQ ID NO: 1028712 - RNA, 19 nt, Human
uggcuuggaaaaaaaaaau

SEQ ID NO: 1028713 - RNA, 19 nt, Human
ugggaggcugaggcagcag

SEQ ID NO: 1028714 - RNA, 19 nt, Human
ugggaggcugaggcagcag

SEQ ID NO: 1028715 - RNA, 21 nt, Human
ugggaggcugaggcagcaguu

SEQ ID NO: 1028716 - RNA, 24 nt, Human
ugggaggcugaggcagcaguuuga

SEQ ID NO: 1028717 - RNA, 19 nt, Human
ugggaggcugaggcaggag

SEQ ID NO: 1028718 - RNA, 22 nt, Human
ugggaggcugaggcaggagaau

SEQ ID NO: 1028719 - RNA, 22 nt, Human
ugggcggaucacgacgucagga

SEQ ID NO: 1028720 - RNA, 21 nt, Human
uggggguggggaggaagagga

SEQ ID NO: 1028721 - RNA, 20 nt, Human
uggggguggggcuuuccgag

SEQ ID NO: 1028722 - RNA, 19 nt, Human
ugggugucagcggggcugg

SEQ ID NO: 1028723 - RNA, 20 nt, Human
ugggugucagcggggcuggg

SEQ ID NO: 1028724 - RNA, 22 nt, Human
ugggugugguggcacgcaccag

SEQ ID NO: 1028725 - RNA, 24 nt, Human
uggucccucaugccuguaauccca

SEQ ID NO: 1028726 - RNA, 25 nt, Human
ugucagugacuucucuggucugagg

SEQ ID NO: 1028727 - RNA, 21 nt, Human
ugucguggaaggcuugagugc

SEQ ID NO: 1028728 - RNA, 22 nt, Human
ugucucggggugaaggucucac

SEQ ID NO: 1028729 - RNA, 22 nt, Human
ugugccugcguggguggcgcuc

SEQ ID NO: 1028730 - RNA, 20 nt, Human
uuacagcagccaaacuucuc

SEQ ID NO: 1028731 - RNA, 18 nt, Human
uuagcugggugugguggc

SEQ ID NO: 1028732 - RNA, 20 nt, Human
uuagcugggugugguggcac

SEQ ID NO: 1028733 - RNA, 22 nt, Human
uuagcugggugugguggcacgc

SEQ ID NO: 1028734 - RNA, 24 nt, Human
uugaacccaggaggcggagguugc

SEQ ID NO: 1028735 - RNA, 19 nt, Human
uugcagugagccgagaucc

SEQ ID NO: 1028736 - RNA, 21 nt, Human
uugcagugagccgagaucccc

SEQ ID NO: 1028737 - RNA, 21 nt, Human
uugcagugagccgagauccug

SEQ ID NO: 1028738 - RNA, 22 nt, Human
uugcagugagccgagauccugc

SEQ ID NO: 1028739 - RNA, 23 nt, Human
uugcagugagccgagauccugcc

SEQ ID NO: 1028740 - RNA, 23 nt, Human
uugcccccaaagaaacgugcaua

SEQ ID NO: 1028741 - RNA, 19 nt, Human
uugcugcugggggcacagg

SEQ ID NO: 1028742 - RNA, 21 nt, Human
uugcuguucacagugcaaugg

SEQ ID NO: 1028743 - RNA, 23 nt, Human
uugggaggcugaggcaggagaau

SEQ ID NO: 1028744 - RNA, 21 nt, Human
uugguaguuuuccagcccucu

SEQ ID NO: 1028745 - RNA, 24 nt, Human
uuguuugaacccaggaggcggagg

SEQ ID NO: 1028746 - RNA, 19 nt, Human
uuugcuguugcccuacugu

SEQ ID NO: 1028747 - RNA, 24 nt, Human
aacuuccagccacccuccccaucg

SEQ ID NO: 1028748 - RNA, 20 nt, Human
acccuggaguccaccagggc

SEQ ID NO: 1028749 - RNA, 21 nt, Human
acuuccagccacccuccccau

SEQ ID NO: 1028750 - RNA, 22 nt, Human
cacccuggaguccaccagggcc

SEQ ID NO: 1028751 - RNA, 26 nt, Human
cacugaguccggguagaucaccuggu

SEQ ID NO: 1028752 - RNA, 19 nt, Human
cagagcuccuggaggugcc

SEQ ID NO: 1028753 - RNA, 18 nt, Human
ccaccagggccuugcagg

SEQ ID NO: 1028754 - RNA, 24 nt, Human
ccagcugcugcuccagccgcugcu

SEQ ID NO: 1028755 - RNA, 19 nt, Human
cccaggauuuggcagagcu

SEQ ID NO: 1028756 - RNA, 20 nt, Human
ccggguagaucaccugguca

SEQ ID NO: 1028757 - RNA, 21 nt, Human
cgaacuuccagccacccuccc

SEQ ID NO: 1028758 - RNA, 19 nt, Human
cgcccaggauuuggcagag

SEQ ID NO: 1028759 - RNA, 18 nt, Human
gaacuuccagccacccuc

SEQ ID NO: 1028760 - RNA, 19 nt, Human
gaguccagcuucucgaacu

SEQ ID NO: 1028761 - RNA, 18 nt, Human
gcagcugaguccagcuuc

SEQ ID NO: 1028762 - RNA, 20 nt, Human
gcuccagccgcugcuucucc

SEQ ID NO: 1028763 - RNA, 20 nt, Human
ggaguccaccagggccuugc

SEQ ID NO: 1028764 - RNA, 21 nt, Human
ucaggcucaggugggcagcug

SEQ ID NO: 1028765 - RNA, 19 nt, Human
ucaggugggcagcugaguc

SEQ ID NO: 1028766 - RNA, 21 nt, Human
ucucgaacuuccagccacccu

SEQ ID NO: 1028767 - RNA, 22 nt, Human
ucucgaacuuccagccacccuc

SEQ ID NO: 1028768 - RNA, 24 nt, Human
ucucgaacuuccagccacccuccc

SEQ ID NO: 1028769 - RNA, 22 nt, Human
ugaguccagcuucucgaacuuc

SEQ ID NO: 1028770 - RNA, 18 nt, Human
uggcagagcuccuggagg

SEQ ID NO: 1028771 - RNA, 18 nt, Human
ugggcagcugaguccagc

SEQ ID NO: 1028772 - RNA, 18 nt, Human
uugcaggcuaggugccgg

SEQ ID NO: 1028773 - RNA, 22 nt, Human
aaaacauuagagugaggaaguc

SEQ ID NO: 1028774 - RNA, 21 nt, Human
aaacaacaccgugguuacuga

SEQ ID NO: 1028775 - RNA, 24 nt, Human
aaacaacauagauuuaucuuggcc

SEQ ID NO: 1028776 - RNA, 19 nt, Human
aaaggacaacaguucuaca

SEQ ID NO: 1028777 - RNA, 28 nt, Human
aacucaccuacuuaauccuacccuccug

SEQ ID NO: 1028778 - RNA, 19 nt, Human
aagaacaggggaaacugag

SEQ ID NO: 1028779 - RNA, 19 nt, Human
acaccuguuuuucaguaac

SEQ ID NO: 1028780 - RNA, 23 nt, Human
acccugcucaccccucccgggcc

SEQ ID NO: 1028781 - RNA, 21 nt, Human
agagaugagauaacacugcca

SEQ ID NO: 1028782 - RNA, 24 nt, Human
agcugaauaguuuuacuacccaau

SEQ ID NO: 1028783 - RNA, 22 nt, Human
aggaaagagauaaugaucuacu

SEQ ID NO: 1028784 - RNA, 20 nt, Human
aggcagguggcuucuuagga

SEQ ID NO: 1028785 - RNA, 20 nt, Human
agucaccaagaaacagugaa

SEQ ID NO: 1028786 - RNA, 23 nt, Human
auaagacaaaaaaucaggccuuu

SEQ ID NO: 1028787 - RNA, 19 nt, Human
aucugggugcaugcauggu

SEQ ID NO: 1028788 - RNA, 20 nt, Human
augaaaaucaaaauaggcag

SEQ ID NO: 1028789 - RNA, 26 nt, Human
augugaaacacagaaagaaaagagac

SEQ ID NO: 1028790 - RNA, 24 nt, Human
caaacuacaaaugacuuuagcuga

SEQ ID NO: 1028791 - RNA, 22 nt, Human
caauucuguacaaaaaugggau

SEQ ID NO: 1028792 - RNA, 21 nt, Human
cacagaaagaaaagagacuac

SEQ ID NO: 1028793 - RNA, 23 nt, Human
cacagaaagaaaagagacuacau

SEQ ID NO: 1028794 - RNA, 21 nt, Human
caccaagaaacagugaagcag

SEQ ID NO: 1028795 - RNA, 21 nt, Human
cagccagcggcacccugcuca

SEQ ID NO: 1028796 - RNA, 24 nt, Human
cagcggcacccugcucaccccucc

SEQ ID NO: 1028797 - RNA, 19 nt, Human
cauuuacucuuaccuaggg

SEQ ID NO: 1028798 - RNA, 20 nt, Human
ccaggacagcggcagaaaca

SEQ ID NO: 1028799 - RNA, 20 nt, Human
ccccagcagccagcggcacc

SEQ ID NO: 1028800 - RNA, 21 nt, Human
cccugcucaccccucccgggc

SEQ ID NO: 1028801 - RNA, 24 nt, Human
ccucccgggccacccugcgccggc

SEQ ID NO: 1028802 - RNA, 18 nt, Human
ccugcagaccccagcagc

SEQ ID NO: 1028803 - RNA, 21 nt, Human
ccugcagaccccagcagccag

SEQ ID NO: 1028804 - RNA, 19 nt, Human
cuacauccaugcccaagaa

SEQ ID NO: 1028805 - RNA, 23 nt, Human
cuccaaaggccagaaaaucagcc

SEQ ID NO: 1028806 - RNA, 18 nt, Human
cugccggguaaacacagg

SEQ ID NO: 1028807 - RNA, 20 nt, Human
cuuacagaaaaaaaagccau

SEQ ID NO: 1028808 - RNA, 25 nt, Human
cuuggcccaauucuauaaagauugg

SEQ ID NO: 1028809 - RNA, 22 nt, Human
gacaauugggguuaaggagaga

SEQ ID NO: 1028810 - RNA, 23 nt, Human
gcagaccccagcagccagcggca

SEQ ID NO: 1028811 - RNA, 22 nt, Human
gcucaccccucccgggccaccc

SEQ ID NO: 1028812 - RNA, 20 nt, Human
ggaaacugagcuuauaaagg

SEQ ID NO: 1028813 - RNA, 18 nt, Human
ggaacugguggugugggc

SEQ ID NO: 1028814 - RNA, 18 nt, Human
ggaagaguaaucaacuac

SEQ ID NO: 1028815 - RNA, 21 nt, Human
gggcagguggggcaaacuaca

SEQ ID NO: 1028816 - RNA, 19 nt, Human
ggugaguuucauucucuag

SEQ ID NO: 1028817 - RNA, 18 nt, Human
guuacugaaauggcacca

SEQ ID NO: 1028818 - RNA, 24 nt, Human
uaaaacaacaccgugguuacugaa

SEQ ID NO: 1028819 - RNA, 18 nt, Human
uaaacacaggcagguggc

SEQ ID NO: 1028820 - RNA, 20 nt, Human
uaaaccauaucuccauagcc

SEQ ID NO: 1028821 - RNA, 23 nt, Human
uaaaggcaucuaaaacaacaccg

SEQ ID NO: 1028822 - RNA, 22 nt, Human
uaagcacauguaauacugaaaa

SEQ ID NO: 1028823 - RNA, 20 nt, Human
uaagcuccuuauccacgacc

SEQ ID NO: 1028824 - RNA, 21 nt, Human
uacagaaaaaaaagccauaug

SEQ ID NO: 1028825 - RNA, 18 nt, Human
uaccugaaaccaaauugu

SEQ ID NO: 1028826 - RNA, 22 nt, Human
uaccugaaaccaaauuguggaa

SEQ ID NO: 1028827 - RNA, 23 nt, Human
uagggcaggaaaccugaauaagc

SEQ ID NO: 1028828 - RNA, 21 nt, Human
uaugcagaaaaucuacacuau

SEQ ID NO: 1028829 - RNA, 21 nt, Human
uauuuugcauuuuucuaguuu

SEQ ID NO: 1028830 - RNA, 26 nt, Human
ucaaauguaaaacucaaaugggcuuc

SEQ ID NO: 1028831 - RNA, 25 nt, Human
ucaauucuguacaaaaaugggaucc

SEQ ID NO: 1028832 - RNA, 18 nt, Human
ucagagagggacuagauc

SEQ ID NO: 1028833 - RNA, 20 nt, Human
ucaggaacuggugguguggg

SEQ ID NO: 1028834 - RNA, 22 nt, Human
uccaaaggccagaaaaucagcc

SEQ ID NO: 1028835 - RNA, 20 nt, Human
uccagcaugugaaguggagc

SEQ ID NO: 1028836 - RNA, 22 nt, Human
uccaggacagcggcagaaacac

SEQ ID NO: 1028837 - RNA, 24 nt, Human
uccauagccaaugcagaccggggc

SEQ ID NO: 1028838 - RNA, 23 nt, Human
uccuacccuccugucuaaaaacc

SEQ ID NO: 1028839 - RNA, 22 nt, Human
uccugagcgcugccaggaguuc

SEQ ID NO: 1028840 - RNA, 24 nt, Human
ucgcgaggcgcaacggccuuuccu

SEQ ID NO: 1028841 - RNA, 24 nt, Human
ucuauuaccaagccuaccugaaac

SEQ ID NO: 1028842 - RNA, 25 nt, Human
ucuccaaaggccagaaaaucagccu

SEQ ID NO: 1028843 - RNA, 22 nt, Human
ucuccauagccaaugcagacuu

SEQ ID NO: 1028844 - RNA, 23 nt, Human
ugaaaacuuacagaaaaaaaagc

SEQ ID NO: 1028845 - RNA, 20 nt, Human
ugaacagugacauuuuaggu

SEQ ID NO: 1028846 - RNA, 20 nt, Human
ugaagcaguuccauuauugc

SEQ ID NO: 1028847 - RNA, 19 nt, Human
ugaauaguuuuacuaccca

SEQ ID NO: 1028848 - RNA, 19 nt, Human
ugaaugugaaacacagaaa

SEQ ID NO: 1028849 - RNA, 21 nt, Human
ugaccugcagaccccagcagc

SEQ ID NO: 1028850 - RNA, 22 nt, Human
ugaccugcagaccccagcagcc

SEQ ID NO: 1028851 - RNA, 23 nt, Human
ugaccugcagaccccagcagcca

SEQ ID NO: 1028852 - RNA, 19 nt, Human
ugagauaacacugccaugg

SEQ ID NO: 1028853 - RNA, 22 nt, Human
ugagauuaagcacauguaauac

SEQ ID NO: 1028854 - RNA, 21 nt, Human
ugcagaaaaucuacacuauuu

SEQ ID NO: 1028855 - RNA, 20 nt, Human
ugccauggugaaaugguuca

SEQ ID NO: 1028856 - RNA, 23 nt, Human
ugccauggugaaaugguucaucu

SEQ ID NO: 1028857 - RNA, 23 nt, Human
ugcuaugaaugugaaacacagaa

SEQ ID NO: 1028858 - RNA, 24 nt, Human
uggaaucaaauguaaaacucaaau

SEQ ID NO: 1028859 - RNA, 21 nt, Human
uggcuucuuaggaguccccuu

SEQ ID NO: 1028860 - RNA, 20 nt, Human
uguuagaacacuggcuaauu

SEQ ID NO: 1028861 - RNA, 20 nt, Human
uguuagcugcaguugcuaug

SEQ ID NO: 1028862 - RNA, 24 nt, Human
uuaaagacaguauucaacacuuaa

SEQ ID NO: 1028863 - RNA, 19 nt, Human
uuaagcacauguaauacug

SEQ ID NO: 1028864 - RNA, 19 nt, Human
uuagagugaggaagucacc

SEQ ID NO: 1028865 - RNA, 21 nt, Human
uuaggaguccccucuccuggg

SEQ ID NO: 1028866 - RNA, 22 nt, Human
uuaguuggaauaagacaaaaaa

SEQ ID NO: 1028867 - RNA, 20 nt, Human
uugaacagugacauuuuagg

SEQ ID NO: 1028868 - RNA, 22 nt, Human
uuggaauaagacaaaaaaucag

SEQ ID NO: 1028869 - RNA, 19 nt, Human
uuuaaagacaguauucaac

SEQ ID NO: 1028870 - RNA, 21 nt, Human
uuugcauuuuucuaguuuaaa

SEQ ID NO: 1028871 - RNA, 23 nt, Human
aaaaugcuaggauuacaggcgug

SEQ ID NO: 1028872 - RNA, 24 nt, Human
aaaaugcuaggauuacaggcguga

SEQ ID NO: 1028873 - RNA, 26 nt, Human
aaaugcuaggauuacaggcgugagcc

SEQ ID NO: 1028874 - RNA, 22 nt, Human
aaccccugaccucaggugaucc

SEQ ID NO: 1028875 - RNA, 19 nt, Human
aacuccuggccaaguuucu

SEQ ID NO: 1028876 - RNA, 19 nt, Human
aagcauccaccucacucau

SEQ ID NO: 1028877 - RNA, 18 nt, Human
acaggguuucaccauguu

SEQ ID NO: 1028878 - RNA, 23 nt, Human
acaggguuucaccauguuggcca

SEQ ID NO: 1028879 - RNA, 24 nt, Human
acaggguuucaccauguuggccag

SEQ ID NO: 1028880 - RNA, 23 nt, Human
accaggugggcuaaggcugggac

SEQ ID NO: 1028881 - RNA, 24 nt, Human
accauguuggccaggcuggucucg

SEQ ID NO: 1028882 - RNA, 19 nt, Human
accccuacuucacaggaua

SEQ ID NO: 1028883 - RNA, 21 nt, Human
acccggcggggcaccgagggc

SEQ ID NO: 1028884 - RNA, 26 nt, Human
acuccaaaauccaggaagcaugacug

SEQ ID NO: 1028885 - RNA, 25 nt, Human
acucuguugcccaggcuggagugca

SEQ ID NO: 1028886 - RNA, 23 nt, Human
agaaagccucgacuccaaaaucc

SEQ ID NO: 1028887 - RNA, 18 nt, Human
aggcuggagugcaguggc

SEQ ID NO: 1028888 - RNA, 24 nt, Human
aggugauccacuguccuuggccuc

SEQ ID NO: 1028889 - RNA, 19 nt, Human
aguaacugggauuacaggc

SEQ ID NO: 1028890 - RNA, 20 nt, Human
aguaacugggauuacaggca

SEQ ID NO: 1028891 - RNA, 21 nt, Human
aguaacugggauuacaggcau

SEQ ID NO: 1028892 - RNA, 22 nt, Human
aguagagacaggguuucaccau

SEQ ID NO: 1028893 - RNA, 23 nt, Human
agugcaguggcgcagucuuggcu

SEQ ID NO: 1028894 - RNA, 24 nt, Human
agugcaguggcgcagucuuggcuc

SEQ ID NO: 1028895 - RNA, 22 nt, Human
caagcaauucuccugccuuagc

SEQ ID NO: 1028896 - RNA, 24 nt, Human
caaguuucucucucucgaagccuc

SEQ ID NO: 1028897 - RNA, 22 nt, Human
caccaccacgccuggcuaauuu

SEQ ID NO: 1028898 - RNA, 24 nt, Human
caccacgccuggcuaauuuuugua

SEQ ID NO: 1028899 - RNA, 18 nt, Human
caccaggugggcuaaggc

SEQ ID NO: 1028900 - RNA, 21 nt, Human
caccauguuggccaggcuggu

SEQ ID NO: 1028901 - RNA, 24 nt, Human
caccauguuggccaggcuggucuc

SEQ ID NO: 1028902 - RNA, 27 nt, Human
caccauguuggccaggcuggucucgaa

SEQ ID NO: 1028903 - RNA, 25 nt, Human
cacuccccaucccaccaggugggcu

SEQ ID NO: 1028904 - RNA, 24 nt, Human
cacucuguugcccaggcuggagug

SEQ ID NO: 1028905 - RNA, 18 nt, Human
cacugcaaucucugccuc

SEQ ID NO: 1028906 - RNA, 24 nt, Human
caggguuucaccauguuggccagg

SEQ ID NO: 1028907 - RNA, 23 nt, Human
caugcaccaccacgccuggcuaa

SEQ ID NO: 1028908 - RNA, 24 nt, Human
cauguuggccaggcuggucucgaa

SEQ ID NO: 1028909 - RNA, 28 nt, Human
ccaaguuucucucucucgaagccuccuu

SEQ ID NO: 1028910 - RNA, 23 nt, Human
cccaccacauuccgguaaaagga

SEQ ID NO: 1028911 - RNA, 22 nt, Human
cccaggcuggagugcaguggcg

SEQ ID NO: 1028912 - RNA, 23 nt, Human
cccagguucaagcaauucuccug

SEQ ID NO: 1028913 - RNA, 19 nt, Human
cccuucugucauuuguccu

SEQ ID NO: 1028914 - RNA, 24 nt, Human
ccucccagguucaagcaauucucc

SEQ ID NO: 1028915 - RNA, 20 nt, Human
ccugaccucaggugauccac

SEQ ID NO: 1028916 - RNA, 22 nt, Human
ccugaccucaggugauccacug

SEQ ID NO: 1028917 - RNA, 23 nt, Human
ccugaccucaggugauccacugu

SEQ ID NO: 1028918 - RNA, 23 nt, Human
ccugccuuagccucuggaguaac

SEQ ID NO: 1028919 - RNA, 19 nt, Human
ccuggccaucagaacuuuc

SEQ ID NO: 1028920 - RNA, 24 nt, Human
ccuggccaucagaacuuucuuuuc

SEQ ID NO: 1028921 - RNA, 23 nt, Human
ccuucugucauuuguccuccaga

SEQ ID NO: 1028922 - RNA, 24 nt, Human
cggggcaccgagggcgucggaccg

SEQ ID NO: 1028923 - RNA, 23 nt, Human
cgugagccaccaugccuggccau

SEQ ID NO: 1028924 - RNA, 24 nt, Human
cucacucuguugcccaggcuggag

SEQ ID NO: 1028925 - RNA, 18 nt, Human
cucacugcaaucucugcc

SEQ ID NO: 1028926 - RNA, 24 nt, Human
cucacugcaaucucugccucccag

SEQ ID NO: 1028927 - RNA, 18 nt, Human
cuccaaaauccaggaagc

SEQ ID NO: 1028928 - RNA, 19 nt, Human
cucgaaccccugaccucag

SEQ ID NO: 1028929 - RNA, 24 nt, Human
cugcaaucucugccucccagguuc

SEQ ID NO: 1028930 - RNA, 24 nt, Human
cuggaguaacugggauuacaggca

SEQ ID NO: 1028931 - RNA, 21 nt, Human
cuggugccagucuuggaugug

SEQ ID NO: 1028932 - RNA, 21 nt, Human
cuuggccuccaaaaaugcuag

SEQ ID NO: 1028933 - RNA, 23 nt, Human
gaccucaggugauccacuguccu

SEQ ID NO: 1028934 - RNA, 22 nt, Human
gaguaacugggauuacaggcau

SEQ ID NO: 1028935 - RNA, 24 nt, Human
gaguaacugggauuacaggcaugc

SEQ ID NO: 1028936 - RNA, 18 nt, Human
gaugcacccggcggggca

SEQ ID NO: 1028937 - RNA, 18 nt, Human
gauuacaggcgugagcca

SEQ ID NO: 1028938 - RNA, 21 nt, Human
gauuacaggcgugagccacca

SEQ ID NO: 1028939 - RNA, 24 nt, Human
gauuacaggcgugagccaccaugc

SEQ ID NO: 1028940 - RNA, 21 nt, Human
gcucacugcaaucucugccuc

SEQ ID NO: 1028941 - RNA, 19 nt, Human
gcuggagugcaguggcgca

SEQ ID NO: 1028942 - RNA, 23 nt, Human
gcuggucucgaaccccugaccuc

SEQ ID NO: 1028943 - RNA, 22 nt, Human
ggaggggcauggggaggagacu

SEQ ID NO: 1028944 - RNA, 22 nt, Human
ggauuacaggcgugagccacca

SEQ ID NO: 1028945 - RNA, 24 nt, Human
ggauuacaggcgugagccaccaug

SEQ ID NO: 1028946 - RNA, 22 nt, Human
ggcggggcaccgagggcgucgg

SEQ ID NO: 1028947 - RNA, 22 nt, Human
ggguuucaccauguuggccagg

SEQ ID NO: 1028948 - RNA, 19 nt, Human
ggucucgaaccccugaccu

SEQ ID NO: 1028949 - RNA, 18 nt, Human
ggugauccacuguccuug

SEQ ID NO: 1028950 - RNA, 20 nt, Human
guaacugggauuacaggcau

SEQ ID NO: 1028951 - RNA, 22 nt, Human
guccuuggccuccaaaaaugcu

SEQ ID NO: 1028952 - RNA, 18 nt, Human
uaaaaggaccuggugaug

SEQ ID NO: 1028953 - RNA, 20 nt, Human
uaaagggacuaaacuagaug

SEQ ID NO: 1028954 - RNA, 24 nt, Human
uaauuuuuguauuuuuaguagaga

SEQ ID NO: 1028955 - RNA, 22 nt, Human
uacaggcaugcaccaccacgcc

SEQ ID NO: 1028956 - RNA, 22 nt, Human
uacaggcgugagccaccaugcc

SEQ ID NO: 1028957 - RNA, 23 nt, Human
uacaggcgugagccaccaugccu

SEQ ID NO: 1028958 - RNA, 24 nt, Human
uagaaagccucgacuccaaaaucc

SEQ ID NO: 1028959 - RNA, 22 nt, Human
uagagacaggguuucaccaugu

SEQ ID NO: 1028960 - RNA, 18 nt, Human
uaggauuacaggcgugag

SEQ ID NO: 1028961 - RNA, 22 nt, Human
uaggauuacaggcgugagccac

SEQ ID NO: 1028962 - RNA, 24 nt, Human
uaggauuacaggcgugagccacca

SEQ ID NO: 1028963 - RNA, 25 nt, Human
uaggauuacaggcgugagccaccau

SEQ ID NO: 1028964 - RNA, 24 nt, Human
uaguagagacaggguuucaccaug

SEQ ID NO: 1028965 - RNA, 26 nt, Human
uaguagagacaggguuucaccauguu

SEQ ID NO: 1028966 - RNA, 24 nt, Human
ucacaucaaagaccagcaggacac

SEQ ID NO: 1028967 - RNA, 24 nt, Human
ucacucuguugcccaggcuggagu

SEQ ID NO: 1028968 - RNA, 19 nt, Human
ucacugcaaucucugccuc

SEQ ID NO: 1028969 - RNA, 24 nt, Human
ucacugcaaucucugccucccagg

SEQ ID NO: 1028970 - RNA, 25 nt, Human
ucacugcaaucucugccucccaggu

SEQ ID NO: 1028971 - RNA, 21 nt, Human
ucccagguucaagcaauucuc

SEQ ID NO: 1028972 - RNA, 24 nt, Human
ucccagguucaagcaauucuccug

SEQ ID NO: 1028973 - RNA, 23 nt, Human
ucucacucuguugcccaggcugg

SEQ ID NO: 1028974 - RNA, 24 nt, Human
ucucacucuguugcccaggcugga

SEQ ID NO: 1028975 - RNA, 26 nt, Human
ucucacucuguugcccaggcuggagu

SEQ ID NO: 1028976 - RNA, 27 nt, Human
ucucacucuguugcccaggcuggagug

SEQ ID NO: 1028977 - RNA, 23 nt, Human
ucuccugccuuagccucuggagu

SEQ ID NO: 1028978 - RNA, 24 nt, Human
ucuggaguaacugggauuacaggc

SEQ ID NO: 1028979 - RNA, 18 nt, Human
ucuguugcccaggcugga

SEQ ID NO: 1028980 - RNA, 24 nt, Human
ucuguugcccaggcuggagugcag

SEQ ID NO: 1028981 - RNA, 20 nt, Human
ugaagugaggaggggcaugg

SEQ ID NO: 1028982 - RNA, 19 nt, Human
ugaccucaggugauccacu

SEQ ID NO: 1028983 - RNA, 22 nt, Human
ugaccucaggugauccacuguc

SEQ ID NO: 1028984 - RNA, 23 nt, Human
ugcaaucucugccucccagguuc

SEQ ID NO: 1028985 - RNA, 22 nt, Human
ugcaguggcgcagucuuggcuc

SEQ ID NO: 1028986 - RNA, 18 nt, Human
ugcccaggcuggagugca

SEQ ID NO: 1028987 - RNA, 21 nt, Human
ugcccaggcuggagugcagug

SEQ ID NO: 1028988 - RNA, 22 nt, Human
ugcccaggcuggagugcagugg

SEQ ID NO: 1028989 - RNA, 21 nt, Human
ugccuuagccucuggaguaac

SEQ ID NO: 1028990 - RNA, 24 nt, Human
ugcuaggauuacaggcgugagcca

SEQ ID NO: 1028991 - RNA, 24 nt, Human
uggaguaacugggauuacaggcau

SEQ ID NO: 1028992 - RNA, 28 nt, Human
uggagugcaguggcgcaguccuagcacg

SEQ ID NO: 1028993 - RNA, 23 nt, Human
uggagugcaguggcgcagucuug

SEQ ID NO: 1028994 - RNA, 24 nt, Human
uggagugcaguggcgcagucuugg

SEQ ID NO: 1028995 - RNA, 24 nt, Human
uggccaggcuggucucgaaccccu

SEQ ID NO: 1028996 - RNA, 21 nt, Human
uggcucacugcaaucucugcc

SEQ ID NO: 1028997 - RNA, 21 nt, Human
ugggauuacaggcaugcacca

SEQ ID NO: 1028998 - RNA, 24 nt, Human
ugggauuacaggcaugcaccacca

SEQ ID NO: 1028999 - RNA, 20 nt, Human
uggggaggagacuaacagcg

SEQ ID NO: 1029000 - RNA, 20 nt, Human
uguccuuggccuccaaaaau

SEQ ID NO: 1029001 - RNA, 23 nt, Human
uguguucaaaggacuuccuguuu

SEQ ID NO: 1029002 - RNA, 23 nt, Human
uguucaaaggacuuccuguuugu

SEQ ID NO: 1029003 - RNA, 20 nt, Human
uuagccucuggaguaacugg

SEQ ID NO: 1029004 - RNA, 24 nt, Human
uuaguagagacaggguuucaccau

SEQ ID NO: 1029005 - RNA, 24 nt, Human
uucaagcaauucuccugccuuagc

SEQ ID NO: 1029006 - RNA, 24 nt, Human
uugcccaggcuggagugcaguggc

SEQ ID NO: 1029007 - RNA, 24 nt, Human
uuucaccauguuggccaggcuggu

SEQ ID NO: 1029008 - RNA, 22 nt, Human
uuuuguauuuuuaguagagaca

SEQ ID NO: 1029009 - RNA, 24 nt, Human
uuuuuaguagagacaggguuucac

SEQ ID NO: 1029010 - RNA, 20 nt, Human
uuuuuguauuuuuaguagag

SEQ ID NO: 1029011 - RNA, 23 nt, Human
aaaaaaaaauaggcgaagcaaaa

SEQ ID NO: 1029012 - RNA, 19 nt, Human
aaaaaaauaggcgaagcaa

SEQ ID NO: 1029013 - RNA, 24 nt, Human
aaaaaaauaggcgaagcaaaauca

SEQ ID NO: 1029014 - RNA, 23 nt, Human
aaaagaaaaaaaaaauaggcgaa

SEQ ID NO: 1029015 - RNA, 23 nt, Human
aaaaggccuggccucagcauuac

SEQ ID NO: 1029016 - RNA, 21 nt, Human
aaaauaggcgaagcaaaauca

SEQ ID NO: 1029017 - RNA, 18 nt, Human
aaacacccacauacacaa

SEQ ID NO: 1029018 - RNA, 23 nt, Human
aaacacccacauacacaacucuu

SEQ ID NO: 1029019 - RNA, 23 nt, Human
aaagaucagauacagaucaaaug

SEQ ID NO: 1029020 - RNA, 25 nt, Human
aacaaagccuacccuuacacaacag

SEQ ID NO: 1029021 - RNA, 18 nt, Human
aagcaaaaucacauacug

SEQ ID NO: 1029022 - RNA, 23 nt, Human
acacaacucuuccccaagucucc

SEQ ID NO: 1029023 - RNA, 23 nt, Human
acagaucaaaugaaagcucuaaa

SEQ ID NO: 1029024 - RNA, 23 nt, Human
agacaacacugcuagauuccuga

SEQ ID NO: 1029025 - RNA, 24 nt, Human
agaggguuugcacugcaggccccu

SEQ ID NO: 1029026 - RNA, 30 nt, Human
agucauucugccuuuaauuaucuucccccu

SEQ ID NO: 1029027 - RNA, 24 nt, Human
auacaggccaaugacuucauacca

SEQ ID NO: 1029028 - RNA, 18 nt, Human
caaggucuaaaaucccua

SEQ ID NO: 1029029 - RNA, 22 nt, Human
cacaacucuuccccaagucucc

SEQ ID NO: 1029030 - RNA, 20 nt, Human
cagacaacacugcuagauuc

SEQ ID NO: 1029031 - RNA, 22 nt, Human
cagccuauaccacggauggcac

SEQ ID NO: 1029032 - RNA, 20 nt, Human
cagcugggcccaccuaguca

SEQ ID NO: 1029033 - RNA, 22 nt, Human
cauaccagccagccuauaccac

SEQ ID NO: 1029034 - RNA, 19 nt, Human
ccagcugggcccaccuagu

SEQ ID NO: 1029035 - RNA, 23 nt, Human
ccagggcagacaacacugcuaga

SEQ ID NO: 1029036 - RNA, 18 nt, Human
cccaaaaaagaaaaaaaa

SEQ ID NO: 1029037 - RNA, 19 nt, Human
cccaaacaaacaaacaagc

SEQ ID NO: 1029038 - RNA, 21 nt, Human
cccaaacaaacaaacaagcua

SEQ ID NO: 1029039 - RNA, 22 nt, Human
ccccaagucuccuuuucccaaa

SEQ ID NO: 1029040 - RNA, 22 nt, Human
cccccaaaaaagaaaaaaaaaa

SEQ ID NO: 1029041 - RNA, 25 nt, Human
ccuauaguucagacagcugcucagc

SEQ ID NO: 1029042 - RNA, 23 nt, Human
ccucucuugacagaaguggaggu

SEQ ID NO: 1029043 - RNA, 22 nt, Human
cgaagcaaaaucacauacuguu

SEQ ID NO: 1029044 - RNA, 21 nt, Human
cugacaugagaauggcgagaa

SEQ ID NO: 1029045 - RNA, 23 nt, Human
cuuuccauuucauccugccuuuu

SEQ ID NO: 1029046 - RNA, 19 nt, Human
gaagccagcugggcccacc

SEQ ID NO: 1029047 - RNA, 22 nt, Human
gcgaagcaaaaucacauacugu

SEQ ID NO: 1029048 - RNA, 19 nt, Human
gcucucuggcauacaggcc

SEQ ID NO: 1029049 - RNA, 21 nt, Human
ggcaggaaaugaaagaucaga

SEQ ID NO: 1029050 - RNA, 20 nt, Human
guuugcacugcaggccccuc

SEQ ID NO: 1029051 - RNA, 20 nt, Human
guuuucuucucuuagcucuc

SEQ ID NO: 1029052 - RNA, 21 nt, Human
uacccuuacacaacaggaauu

SEQ ID NO: 1029053 - RNA, 21 nt, Human
uagaauuauaaccaucuugcc

SEQ ID NO: 1029054 - RNA, 24 nt, Human
uagcacaacuggucuucagcacug

SEQ ID NO: 1029055 - RNA, 21 nt, Human
uagcucucuggcauacaggcc

SEQ ID NO: 1029056 - RNA, 24 nt, Human
uauaguucagacagcugcucagcg

SEQ ID NO: 1029057 - RNA, 22 nt, Human
ucauccugccuuuucaaagcug

SEQ ID NO: 1029058 - RNA, 20 nt, Human
uccaccaucagguggcagga

SEQ ID NO: 1029059 - RNA, 24 nt, Human
ucuucccccaaaaaagaaaaaaaa

SEQ ID NO: 1029060 - RNA, 20 nt, Human
ugaagugucuuuaauaaagg

SEQ ID NO: 1029061 - RNA, 19 nt, Human
ugacagaaguggaggugag

SEQ ID NO: 1029062 - RNA, 18 nt, Human
ugaggaaauuguucagag

SEQ ID NO: 1029063 - RNA, 19 nt, Human
ugcccuccugcacgaagcc

SEQ ID NO: 1029064 - RNA, 22 nt, Human
uggcaggaaaugaaagaucaga

SEQ ID NO: 1029065 - RNA, 22 nt, Human
uggcccaggcccuccuuucagu

SEQ ID NO: 1029066 - RNA, 21 nt, Human
uuucuucucuuagcucucugg

SEQ ID NO: 1029067 - RNA, 27 nt, Human
aaaaaaaaaaaaaacaagcaggggagg

SEQ ID NO: 1029068 - RNA, 21 nt, Human
aaaaaaaaaaaacaagcaggg

SEQ ID NO: 1029069 - RNA, 20 nt, Human
aaaaaaacaagcaggggaga

SEQ ID NO: 1029070 - RNA, 21 nt, Human
aaaagaaacacaaaaaauaug

SEQ ID NO: 1029071 - RNA, 24 nt, Human
aaaagaaacacaaaaaauauggga

SEQ ID NO: 1029072 - RNA, 19 nt, Human
aaaagcaaauguaggcuca

SEQ ID NO: 1029073 - RNA, 25 nt, Human
aaaagggauucuuuuauucacugaa

SEQ ID NO: 1029074 - RNA, 22 nt, Human
aaacaaaggguaucuacauaca

SEQ ID NO: 1029075 - RNA, 24 nt, Human
aaacaaauaccuuccaugaaacug

SEQ ID NO: 1029076 - RNA, 19 nt, Human
aaacagcagcuccaaccaa

SEQ ID NO: 1029077 - RNA, 20 nt, Human
aaacagcuauaaaucaacac

SEQ ID NO: 1029078 - RNA, 25 nt, Human
aaagaaaaauagauuuuauaaaagg

SEQ ID NO: 1029079 - RNA, 21 nt, Human
aaagcaaauguaggcucagcc

SEQ ID NO: 1029080 - RNA, 22 nt, Human
aaagcaaauguaggcucagccc

SEQ ID NO: 1029081 - RNA, 23 nt, Human
aaauauccucacuuacuuggaac

SEQ ID NO: 1029082 - RNA, 23 nt, Human
aaauaugcaaugaucaugaaaau

SEQ ID NO: 1029083 - RNA, 28 nt, Human
aagaaacacaaaaaauaugggaaggaaa

SEQ ID NO: 1029084 - RNA, 27 nt, Human
aagcaaaaguagcagggcuguaaaauu

SEQ ID NO: 1029085 - RNA, 19 nt, Human
aagguaacuagguacuuca

SEQ ID NO: 1029086 - RNA, 25 nt, Human
aaguaaaaaaugaaaaccauuauag

SEQ ID NO: 1029087 - RNA, 19 nt, Human
aauacuagaaccaaauaua

SEQ ID NO: 1029088 - RNA, 21 nt, Human
acagugauugcaacaaaagua

SEQ ID NO: 1029089 - RNA, 19 nt, Human
accacaauaacaacacgga

SEQ ID NO: 1029090 - RNA, 25 nt, Human
acuacagaaaaaacaauucuaaaua

SEQ ID NO: 1029091 - RNA, 19 nt, Human
acucguucuguguccuauc

SEQ ID NO: 1029092 - RNA, 18 nt, Human
agaauaauuguagaaaua

SEQ ID NO: 1029093 - RNA, 19 nt, Human
agcagccagacgccgcuac

SEQ ID NO: 1029094 - RNA, 21 nt, Human
agccagagccucccggacucc

SEQ ID NO: 1029095 - RNA, 21 nt, Human
aggaauuaucaguaggcauuu

SEQ ID NO: 1029096 - RNA, 26 nt, Human
aggucccaaagauuacacuaugauuc

SEQ ID NO: 1029097 - RNA, 21 nt, Human
aguggagaggcggggcccgga

SEQ ID NO: 1029098 - RNA, 20 nt, Human
auaaagcucaaauauggaca

SEQ ID NO: 1029099 - RNA, 23 nt, Human
auagaguuaagauaaccucauuu

SEQ ID NO: 1029100 - RNA, 21 nt, Human
auaguaaaagcaucaucuaaa

SEQ ID NO: 1029101 - RNA, 18 nt, Human
aucucaaacagcuauaaa

SEQ ID NO: 1029102 - RNA, 22 nt, Human
auguaggcucagcccuaccuug

SEQ ID NO: 1029103 - RNA, 19 nt, Human
caaaacaaaggguaucuac

SEQ ID NO: 1029104 - RNA, 30 nt, Human
caaccaaaaaaaaaaaaaaaaacaagcagg

SEQ ID NO: 1029105 - RNA, 23 nt, Human
caagaaaguggccucacucaugc

SEQ ID NO: 1029106 - RNA, 21 nt, Human
caagaaauaugcaaugaucau

SEQ ID NO: 1029107 - RNA, 22 nt, Human
cacaugaucacaaacauuuguu

SEQ ID NO: 1029108 - RNA, 22 nt, Human
cacuguauguuucaggcaaaac

SEQ ID NO: 1029109 - RNA, 23 nt, Human
cagauaaaaacauguggucacca

SEQ ID NO: 1029110 - RNA, 22 nt, Human
cagcaacccaacaacagugauu

SEQ ID NO: 1029111 - RNA, 23 nt, Human
cagcagcuccaaccaaaaaaaaa

SEQ ID NO: 1029112 - RNA, 23 nt, Human
cagccacugguauaaaacaaaua

SEQ ID NO: 1029113 - RNA, 22 nt, Human
ccaaauacuuuauacagugaac

SEQ ID NO: 1029114 - RNA, 24 nt, Human
ccaacaacagugauugcaacaaaa

SEQ ID NO: 1029115 - RNA, 20 nt, Human
ccccgcggacgccaaaguca

SEQ ID NO: 1029116 - RNA, 21 nt, Human
cccgcgacuggagcagccaga

SEQ ID NO: 1029117 - RNA, 18 nt, Human
cccgcggacgccaaaguc

SEQ ID NO: 1029118 - RNA, 20 nt, Human
ccgccgaguggagaggcggg

SEQ ID NO: 1029119 - RNA, 26 nt, Human
cgcgggcagcggcgcgcaggccaggc

SEQ ID NO: 1029120 - RNA, 21 nt, Human
cuaaacagcagcuccaaccaa

SEQ ID NO: 1029121 - RNA, 22 nt, Human
cuacuguugcauuccacuuuga

SEQ ID NO: 1029122 - RNA, 23 nt, Human
cuccaaccaaaaaaaaaaaaaaa

SEQ ID NO: 1029123 - RNA, 20 nt, Human
cuccggagccgccggggucc

SEQ ID NO: 1029124 - RNA, 19 nt, Human
cugcaaaauaaacacccaa

SEQ ID NO: 1029125 - RNA, 23 nt, Human
cuugucaaagauaaauauucaga

SEQ ID NO: 1029126 - RNA, 20 nt, Human
cuuuuaucaucucaaacagc

SEQ ID NO: 1029127 - RNA, 22 nt, Human
gaaaaccauuauaguuuuacca

SEQ ID NO: 1029128 - RNA, 19 nt, Human
gaacagcauuuucaaaaca

SEQ ID NO: 1029129 - RNA, 19 nt, Human
gaauggcuguuuucaggcc

SEQ ID NO: 1029130 - RNA, 23 nt, Human
gauauuaaguaaaaaaugaaaac

SEQ ID NO: 1029131 - RNA, 25 nt, Human
gcaaauguaggcucagcccuaccuu

SEQ ID NO: 1029132 - RNA, 25 nt, Human
gcagccagagccucccggacuccgg

SEQ ID NO: 1029133 - RNA, 31 nt, Human
gcagcuccaaccaaaaaaaaaaaaaaaaaaa

SEQ ID NO: 1029134 - RNA, 23 nt, Human
gccucccggacuccggagccgcc

SEQ ID NO: 1029135 - RNA, 24 nt, Human
gcgcaggccaggcgcuaggacucg

SEQ ID NO: 1029136 - RNA, 19 nt, Human
ggucaaagaaugaaggaca

SEQ ID NO: 1029137 - RNA, 20 nt, Human
guaggcucagcccuaccuug

SEQ ID NO: 1029138 - RNA, 20 nt, Human
gucccaaagauuacacuaug

SEQ ID NO: 1029139 - RNA, 22 nt, Human
gucuguuuucucaucugcaaaa

SEQ ID NO: 1029140 - RNA, 24 nt, Human
uaaaaaauaaacacaaacccaaaa

SEQ ID NO: 1029141 - RNA, 22 nt, Human
uaaaaacauguggucaccagga

SEQ ID NO: 1029142 - RNA, 24 nt, Human
uaaaacaaauaccuuccaugaaac

SEQ ID NO: 1029143 - RNA, 22 nt, Human
uaaaauuaguagaaauggcuuc

SEQ ID NO: 1029144 - RNA, 18 nt, Human
uaaacucacaaguguaaa

SEQ ID NO: 1029145 - RNA, 21 nt, Human
uaaccccaauuccaccauccc

SEQ ID NO: 1029146 - RNA, 23 nt, Human
uaacucuagcaaauauguuacau

SEQ ID NO: 1029147 - RNA, 21 nt, Human
uaauucacuugcugugcucuu

SEQ ID NO: 1029148 - RNA, 25 nt, Human
uacuuuauacagugaacuacagaaa

SEQ ID NO: 1029149 - RNA, 20 nt, Human
uagaaguuccaucugcuaaa

SEQ ID NO: 1029150 - RNA, 19 nt, Human
uauaaaacaaauaccuucc

SEQ ID NO: 1029151 - RNA, 24 nt, Human
uaugggaaggagugaaaugaacau

SEQ ID NO: 1029152 - RNA, 22 nt, Human
ucaaaagccacauuuaauucaa

SEQ ID NO: 1029153 - RNA, 20 nt, Human
ucaaagauaaauauucagau

SEQ ID NO: 1029154 - RNA, 24 nt, Human
ucaaagauaaauauucagauaaac

SEQ ID NO: 1029155 - RNA, 20 nt, Human
ucacucaugcucauucacuc

SEQ ID NO: 1029156 - RNA, 19 nt, Human
ucacuguauguuucaggca

SEQ ID NO: 1029157 - RNA, 20 nt, Human
ucaguaggcauuuuucuucu

SEQ ID NO: 1029158 - RNA, 20 nt, Human
ucaucucaaacagcuauaaa

SEQ ID NO: 1029159 - RNA, 27 nt, Human
uccaaccaaaaaaaaaaaaaaaaacaa

SEQ ID NO: 1029160 - RNA, 18 nt, Human
uccaauauugcacuugau

SEQ ID NO: 1029161 - RNA, 26 nt, Human
ucccggacuccggagccgccgggguc

SEQ ID NO: 1029162 - RNA, 23 nt, Human
ucuaauauaucugcauuaauaga

SEQ ID NO: 1029163 - RNA, 22 nt, Human
ucugaacagcauuuucaaaaca

SEQ ID NO: 1029164 - RNA, 19 nt, Human
ucuuaggcccugucucuaa

SEQ ID NO: 1029165 - RNA, 20 nt, Human
ucuuuuggcaagagauucaa

SEQ ID NO: 1029166 - RNA, 23 nt, Human
ugaaaugaacauggcauaggucc

SEQ ID NO: 1029167 - RNA, 19 nt, Human
ugagcuaaaacaacauuuu

SEQ ID NO: 1029168 - RNA, 20 nt, Human
ugagcuaaaacaacauuuuu

SEQ ID NO: 1029169 - RNA, 23 nt, Human
ugagcuaaaacaacauuuuucca

SEQ ID NO: 1029170 - RNA, 21 nt, Human
ugauaagcuaaaauaaagcuc

SEQ ID NO: 1029171 - RNA, 18 nt, Human
ugauauggggcauuucuu

SEQ ID NO: 1029172 - RNA, 21 nt, Human
ugccauggucaaagaaugaag

SEQ ID NO: 1029173 - RNA, 21 nt, Human
ugccauggucaaagaaugaag

SEQ ID NO: 1029174 - RNA, 19 nt, Human
uggauucuugggauugauc

SEQ ID NO: 1029175 - RNA, 19 nt, Human
uggcuuccaauauugcacu

SEQ ID NO: 1029176 - RNA, 19 nt, Human
uguaaaaugaaugcauuua

SEQ ID NO: 1029177 - RNA, 27 nt, Human
uguaaaauuucauaaaauuugugggau

SEQ ID NO: 1029178 - RNA, 21 nt, Human
uguaacucuagcaaauauguu

SEQ ID NO: 1029179 - RNA, 18 nt, Human
uuaggaaaacaaacaaac

SEQ ID NO: 1029180 - RNA, 18 nt, Human
uuaguagaaauggcuucc

SEQ ID NO: 1029181 - RNA, 20 nt, Human
uucaaaagcaaaaguagcag

SEQ ID NO: 1029182 - RNA, 22 nt, Human
uugcauuccacuuugaaaucac

SEQ ID NO: 1029183 - RNA, 19 nt, Human
uugcuuuuuuuaaaaaacc

SEQ ID NO: 1029184 - RNA, 22 nt, Human
uuguagaaauaaccccaauucc

SEQ ID NO: 1029185 - RNA, 22 nt, Human
uuuaacuagcuauaaaauucca

SEQ ID NO: 1029186 - RNA, 24 nt, Human
aaaaaaaaaaauccaacuuuaaac

SEQ ID NO: 1029187 - RNA, 21 nt, Human
aaacagauagacaaguacaaa

SEQ ID NO: 1029188 - RNA, 23 nt, Human
aaacagauagacaaguacaaaau

SEQ ID NO: 1029189 - RNA, 22 nt, Human
aaagugaaaaaaggaaaaggga

SEQ ID NO: 1029190 - RNA, 22 nt, Human
aaagugaaaaaaggaaaaggga

SEQ ID NO: 1029191 - RNA, 18 nt, Human
aaauacauuucugacaaa

SEQ ID NO: 1029192 - RNA, 19 nt, Human
aacuccuacaucauugcau

SEQ ID NO: 1029193 - RNA, 19 nt, Human
aagaaaagcauggccauua

SEQ ID NO: 1029194 - RNA, 19 nt, Human
aagugacagagaucacgcc

SEQ ID NO: 1029195 - RNA, 21 nt, Human
aaugaaaggagucagaaagaa

SEQ ID NO: 1029196 - RNA, 19 nt, Human
acaacaaauaaaaccuuca

SEQ ID NO: 1029197 - RNA, 22 nt, Human
acaacaaauaaaaccuucaaaa

SEQ ID NO: 1029198 - RNA, 19 nt, Human
acagaguuuuaaucuaaac

SEQ ID NO: 1029199 - RNA, 21 nt, Human
accgcuuccuuagaccauuca

SEQ ID NO: 1029200 - RNA, 23 nt, Human
agacaaguacaaaaucugaauaa

SEQ ID NO: 1029201 - RNA, 19 nt, Human
agacagaagaaugagagga

SEQ ID NO: 1029202 - RNA, 21 nt, Human
agaggaaauuaaaauucagag

SEQ ID NO: 1029203 - RNA, 19 nt, Human
agcaugauaaggaaaaccg

SEQ ID NO: 1029204 - RNA, 22 nt, Human
aggcacaaaaagggaaccugaa

SEQ ID NO: 1029205 - RNA, 22 nt, Human
agggaaccugaaauccaauugc

SEQ ID NO: 1029206 - RNA, 18 nt, Human
aguucuuugugugaggca

SEQ ID NO: 1029207 - RNA, 19 nt, Human
auagaaaccuccugaguaa

SEQ ID NO: 1029208 - RNA, 22 nt, Human
augguagccccuuacugccugg

SEQ ID NO: 1029209 - RNA, 22 nt, Human
auuccaugaaaugaucuugcca

SEQ ID NO: 1029210 - RNA, 20 nt, Human
caaaagagaacuccuacauc

SEQ ID NO: 1029211 - RNA, 20 nt, Human
caagacagugagagugugaa

SEQ ID NO: 1029212 - RNA, 23 nt, Human
cacagguggaugaucugaggcac

SEQ ID NO: 1029213 - RNA, 25 nt, Human
cacccauuaauaaguuuacagaaca

SEQ ID NO: 1029214 - RNA, 27 nt, Human
cagauagacaaguacaaaaucugaaua

SEQ ID NO: 1029215 - RNA, 21 nt, Human
caugaagccaucaagaugagu

SEQ ID NO: 1029216 - RNA, 20 nt, Human
cauuagacuuaaacuuuugu

SEQ ID NO: 1029217 - RNA, 21 nt, Human
cauugauccaauucuuauggu

SEQ ID NO: 1029218 - RNA, 21 nt, Human
ccacaaagaggacuauggucc

SEQ ID NO: 1029219 - RNA, 19 nt, Human
cuaguaauaacaacaacaa

SEQ ID NO: 1029220 - RNA, 26 nt, Human
cucaaaaaaaaaaaaaaaaaaaaauc

SEQ ID NO: 1029221 - RNA, 22 nt, Human
cucaacuucucuaagaagguca

SEQ ID NO: 1029222 - RNA, 19 nt, Human
cucuucaaagggcagguga

SEQ ID NO: 1029223 - RNA, 18 nt, Human
cugaaacuaguuaauacc

SEQ ID NO: 1029224 - RNA, 20 nt, Human
cugagguaaacagauagaca

SEQ ID NO: 1029225 - RNA, 22 nt, Human
cuuauggucuuaucuacucauc

SEQ ID NO: 1029226 - RNA, 19 nt, Human
gaaagguugggccuaaggg

SEQ ID NO: 1029227 - RNA, 20 nt, Human
gaacuccuacaucauugcau

SEQ ID NO: 1029228 - RNA, 21 nt, Human
gaguugcucugggugcagcau

SEQ ID NO: 1029229 - RNA, 22 nt, Human
gaucugaggcacaagcugugau

SEQ ID NO: 1029230 - RNA, 20 nt, Human
gcacaaaaagggaaccugaa

SEQ ID NO: 1029231 - RNA, 21 nt, Human
gcacugugcuggaucaugaag

SEQ ID NO: 1029232 - RNA, 25 nt, Human
gcauugcuaguacucaaaaaaaaaa

SEQ ID NO: 1029233 - RNA, 23 nt, Human
gccaacugucuccauuccuccau

SEQ ID NO: 1029234 - RNA, 24 nt, Human
gccccuuacugccuggaggaauga

SEQ ID NO: 1029235 - RNA, 22 nt, Human
ggcaugaaggcacaaaaaggga

SEQ ID NO: 1029236 - RNA, 19 nt, Human
ggcauuaagaaguagggca

SEQ ID NO: 1029237 - RNA, 21 nt, Human
gucaaggaugguucuaaguca

SEQ ID NO: 1029238 - RNA, 18 nt, Human
uaucugagaucuguugcc

SEQ ID NO: 1029239 - RNA, 24 nt, Human
uauuuuaaugagaggaaauuaaaa

SEQ ID NO: 1029240 - RNA, 22 nt, Human
ucaaaaaaaaaaaaaaaaaaaa

SEQ ID NO: 1029241 - RNA, 23 nt, Human
ucaaaaaaaaaaaaaaaaaaaaa

SEQ ID NO: 1029242 - RNA, 24 nt, Human
ucaaaaaaaaaaaaaaaaaaaaau

SEQ ID NO: 1029243 - RNA, 18 nt, Human
ucaaaaguuguggggaaa

SEQ ID NO: 1029244 - RNA, 25 nt, Human
ucacagugacaaggcaaaaccauag

SEQ ID NO: 1029245 - RNA, 19 nt, Human
uccaaaaaguugaacugcu

SEQ ID NO: 1029246 - RNA, 23 nt, Human
uccauccauccauccacccaccc

SEQ ID NO: 1029247 - RNA, 22 nt, Human
ucccagggaaaugaaucuucag

SEQ ID NO: 1029248 - RNA, 22 nt, Human
ucccugugcauugcuaguacuc

SEQ ID NO: 1029249 - RNA, 23 nt, Human
uccgagacagaagaaugagagga

SEQ ID NO: 1029250 - RNA, 20 nt, Human
uccugaguaacacaguuuau

SEQ ID NO: 1029251 - RNA, 19 nt, Human
ucuuuuuuuuuuuuuuugg

SEQ ID NO: 1029252 - RNA, 18 nt, Human
ugaaaaaaggaaaaggga

SEQ ID NO: 1029253 - RNA, 19 nt, Human
ugaaacuugaagcuaaaug

SEQ ID NO: 1029254 - RNA, 24 nt, Human
ugaauaauuucacaauuccagcaa

SEQ ID NO: 1029255 - RNA, 22 nt, Human
ugaaugaccccugcuguggcca

SEQ ID NO: 1029256 - RNA, 21 nt, Human
ugagcugaaacuugaagcuaa

SEQ ID NO: 1029257 - RNA, 20 nt, Human
ugagguaaacagauagacaa

SEQ ID NO: 1029258 - RNA, 19 nt, Human
ugauguuugagcugaaacu

SEQ ID NO: 1029259 - RNA, 19 nt, Human
ugcaauaauuacucaugca

SEQ ID NO: 1029260 - RNA, 22 nt, Human
ugcauggcauggcuaccgcuuc

SEQ ID NO: 1029261 - RNA, 18 nt, Human
ugccuggaggaaugaaug

SEQ ID NO: 1029262 - RNA, 30 nt, Human
ugcuaguacucaaaaaaaaaaaaaaaaaaa

SEQ ID NO: 1029263 - RNA, 18 nt, Human
ugcuccaaauaaugggac

SEQ ID NO: 1029264 - RNA, 23 nt, Human
uggaaaggaguuuaaaaagccaa

SEQ ID NO: 1029265 - RNA, 19 nt, Human
uggcauggcuaccgcuucc

SEQ ID NO: 1029266 - RNA, 24 nt, Human
uggcauggcuaccgcuuccuuaga

SEQ ID NO: 1029267 - RNA, 24 nt, Human
uguagaguuuuucuuuuuccaugg

SEQ ID NO: 1029268 - RNA, 20 nt, Human
uuaagaaaaugaaagguaga

SEQ ID NO: 1029269 - RNA, 20 nt, Human
uucauaaaccccauaggguu

SEQ ID NO: 1029270 - RNA, 21 nt, Human
uuccauggccacugugcugcu

SEQ ID NO: 1029271 - RNA, 26 nt, Human
uuccuacauuaaaauaaagugacaga

SEQ ID NO: 1029272 - RNA, 22 nt, Human
uucucaagaguugcucugggug

SEQ ID NO: 1029273 - RNA, 19 nt, Human
uucugcaucaacaaguuuu

SEQ ID NO: 1029274 - RNA, 18 nt, Human
uuggucuuaagaaaauga

SEQ ID NO: 1029275 - RNA, 19 nt, Human
uuggucuuaagaaaaugaa

SEQ ID NO: 1029276 - RNA, 20 nt, Human
uuguccuugauccucggaaa

SEQ ID NO: 1029277 - RNA, 18 nt, Human
uuuccgagacagaagaau

SEQ ID NO: 1029278 - RNA, 21 nt, Human
uuucugguccuuauucaucuu

SEQ ID NO: 1029279 - RNA, 26 nt, Human
uuuuccauggccacugugcugcugac

SEQ ID NO: 1029280 - RNA, 23 nt, Human
uuuuuuuuuuuuuuuggcuuuag

SEQ ID NO: 1029281 - RNA, 19 nt, Human
aaaaaccucagcugauguu

SEQ ID NO: 1029282 - RNA, 18 nt, Human
aaaaccucagcugauguu

SEQ ID NO: 1029283 - RNA, 18 nt, Human
aaacaaacaagggggaau

SEQ ID NO: 1029284 - RNA, 23 nt, Human
aagccagaugccagccacgggga

SEQ ID NO: 1029285 - RNA, 24 nt, Human
acagguucauacugaaaaaaaccu

SEQ ID NO: 1029286 - RNA, 18 nt, Human
agccacggggaccacagc

SEQ ID NO: 1029287 - RNA, 21 nt, Human
agccacggggaccacagccuu

SEQ ID NO: 1029288 - RNA, 18 nt, Human
aggaggcuuuugcagaug

SEQ ID NO: 1029289 - RNA, 24 nt, Human
caaacugaaugcugaggaggcuga

SEQ ID NO: 1029290 - RNA, 20 nt, Human
cacagccuuggcccaagagu

SEQ ID NO: 1029291 - RNA, 21 nt, Human
caccccuccugcuucucuucc

SEQ ID NO: 1029292 - RNA, 21 nt, Human
cacccggcaggccuugcuagc

SEQ ID NO: 1029293 - RNA, 18 nt, Human
cagccacggggaccacag

SEQ ID NO: 1029294 - RNA, 23 nt, Human
cccacuggcagggcccggccacc

SEQ ID NO: 1029295 - RNA, 20 nt, Human
cgaggaggcuuuugcagaug

SEQ ID NO: 1029296 - RNA, 19 nt, Human
cugcuucucuuccagcagc

SEQ ID NO: 1029297 - RNA, 22 nt, Human
cugugggggcuggggagggugu

SEQ ID NO: 1029298 - RNA, 21 nt, Human
cuucaagaaaaacaccccucc

SEQ ID NO: 1029299 - RNA, 19 nt, Human
ggcccggccacccuggcug

SEQ ID NO: 1029300 - RNA, 27 nt, Human
gggaaaaaggaaacuucaagaaaaaca

SEQ ID NO: 1029301 - RNA, 20 nt, Human
ggggcuggggagggugucag

SEQ ID NO: 1029302 - RNA, 24 nt, Human
uagcuccauuuaacaccagccaug

SEQ ID NO: 1029303 - RNA, 23 nt, Human
ucagcugauguuaucuguggggg

SEQ ID NO: 1029304 - RNA, 21 nt, Human
uccaggguaacuaagugcucu

SEQ ID NO: 1029305 - RNA, 23 nt, Human
ucuguuuuuguaaaacaaacaag

SEQ ID NO: 1029306 - RNA, 25 nt, Human
ucuuuuguuuauuuauauucuuuaa

SEQ ID NO: 1029307 - RNA, 19 nt, Human
ugaaauguucucagaaccc

SEQ ID NO: 1029308 - RNA, 21 nt, Human
ugaaggcgaggaggcuuuugc

SEQ ID NO: 1029309 - RNA, 20 nt, Human
ugacugcggcacacccggca

SEQ ID NO: 1029310 - RNA, 20 nt, Human
ugaggagagcgcgucacugc

SEQ ID NO: 1029311 - RNA, 21 nt, Human
ugaggagagcgcgucacugcu

SEQ ID NO: 1029312 - RNA, 19 nt, Human
ugcagauguggaccuugag

SEQ ID NO: 1029313 - RNA, 19 nt, Human
ugggggcuggggagggugu

SEQ ID NO: 1029314 - RNA, 24 nt, Human
ugggggcuggggagggugucaggg

SEQ ID NO: 1029315 - RNA, 21 nt, Human
uuaucugugggggcuggggag

SEQ ID NO: 1029316 - RNA, 23 nt, Human
uucauacugaaaaaaaccucagc

SEQ ID NO: 1029317 - RNA, 21 nt, Human
uuccagcagcucgucuccuuc

SEQ ID NO: 1029318 - RNA, 22 nt, Human
uuggcccaagaguggcauuugu

SEQ ID NO: 1029319 - RNA, 25 nt, Human
uuuuuuuuuuuucaccuuucuuuug

SEQ ID NO: 1029320 - RNA, 24 nt, Human
uuuuuuuuuuuuuuuuucaccuuu

SEQ ID NO: 1029321 - RNA, 24 nt, Human
aaagagccuggaccaaucagagcc

SEQ ID NO: 1029322 - RNA, 21 nt, Human
aauggcagacaucaggaagga

SEQ ID NO: 1029323 - RNA, 20 nt, Human
accggauccgccucggggac

SEQ ID NO: 1029324 - RNA, 26 nt, Human
acguugugcuccacccuuuccgggcc

SEQ ID NO: 1029325 - RNA, 22 nt, Human
caccggacugcguuuuuuuucc

SEQ ID NO: 1029326 - RNA, 23 nt, Human
caucaggaaggaggagaggaacc

SEQ ID NO: 1029327 - RNA, 23 nt, Human
cccacaggcgccccgccuccugg

SEQ ID NO: 1029328 - RNA, 22 nt, Human
ccccucuccguguggagcccac

SEQ ID NO: 1029329 - RNA, 20 nt, Human
cgccccgccuccugggcucc

SEQ ID NO: 1029330 - RNA, 20 nt, Human
cggggcggaaaaaauacuuc

SEQ ID NO: 1029331 - RNA, 19 nt, Human
cgucaaagagccuggacca

SEQ ID NO: 1029332 - RNA, 18 nt, Human
cuguacuccagcucucag

SEQ ID NO: 1029333 - RNA, 18 nt, Human
cuguacuccagcucucag

SEQ ID NO: 1029334 - RNA, 19 nt, Human
cuguacuccagcucucagc

SEQ ID NO: 1029335 - RNA, 22 nt, Human
gcucccauuggcugcuuucgac

SEQ ID NO: 1029336 - RNA, 24 nt, Human
ggacugggaaagugcccuccacgg

SEQ ID NO: 1029337 - RNA, 18 nt, Human
ggagaggaaccauuugug

SEQ ID NO: 1029338 - RNA, 18 nt, Human
ggucgcccuccgucgugg

SEQ ID NO: 1029339 - RNA, 19 nt, Human
gucaaagagccuggaccaa

SEQ ID NO: 1029340 - RNA, 22 nt, Human
ucaguacuaccggcccagagca

SEQ ID NO: 1029341 - RNA, 20 nt, Human
ucuucaccgcagugcuuaga

SEQ ID NO: 1029342 - RNA, 21 nt, Human
uucuguacuccagcucucagc

SEQ ID NO: 1029343 - RNA, 22 nt, Human
uugugcuccacccuuuccgggc

SEQ ID NO: 1029344 - RNA, 18 nt, Human
aaagccuggcccuaagga

SEQ ID NO: 1029345 - RNA, 21 nt, Human
aagcagaggucaccaaggccc

SEQ ID NO: 1029346 - RNA, 23 nt, Human
aaggcccagccugagagcgcccc

SEQ ID NO: 1029347 - RNA, 18 nt, Human
aagggccagggccuggag

SEQ ID NO: 1029348 - RNA, 20 nt, Human
acaccugagagcuggaaaug

SEQ ID NO: 1029349 - RNA, 23 nt, Human
acagaccaggggccccaaucccc

SEQ ID NO: 1029350 - RNA, 19 nt, Human
accaggggccccaaucccc

SEQ ID NO: 1029351 - RNA, 20 nt, Human
accaugggugaggcugcugg

SEQ ID NO: 1029352 - RNA, 19 nt, Human
acccaggccaggcccccag

SEQ ID NO: 1029353 - RNA, 18 nt, Human
acccaguugggggccuaa

SEQ ID NO: 1029354 - RNA, 26 nt, Human
accccaucacccaggccaggccccca

SEQ ID NO: 1029355 - RNA, 21 nt, Human
acccucccuccccaggccaaa

SEQ ID NO: 1029356 - RNA, 19 nt, Human
acgcccccuggacugcagg

SEQ ID NO: 1029357 - RNA, 21 nt, Human
acugcggccuaggagguggcu

SEQ ID NO: 1029358 - RNA, 21 nt, Human
agacgggaggccuggaccgca

SEQ ID NO: 1029359 - RNA, 20 nt, Human
agagaguucagcugcccugg

SEQ ID NO: 1029360 - RNA, 23 nt, Human
agaggccucucacaggccugcuc

SEQ ID NO: 1029361 - RNA, 18 nt, Human
agaggucaccaaggccca

SEQ ID NO: 1029362 - RNA, 19 nt, Human
agcagcugggaccuugggc

SEQ ID NO: 1029363 - RNA, 18 nt, Human
agcccagccaaggccagg

SEQ ID NO: 1029364 - RNA, 21 nt, Human
agcugcccaggacucggagcc

SEQ ID NO: 1029365 - RNA, 20 nt, Human
agcuggaaauguugguuugg

SEQ ID NO: 1029366 - RNA, 24 nt, Human
aggccaaacccaguugggggccua

SEQ ID NO: 1029367 - RNA, 19 nt, Human
aggcccagccugagagcgc

SEQ ID NO: 1029368 - RNA, 18 nt, Human
aggcccccagcugcccag

SEQ ID NO: 1029369 - RNA, 20 nt, Human
agggacagcucggggucaag

SEQ ID NO: 1029370 - RNA, 24 nt, Human
agggccaggcacuccuuccacccc

SEQ ID NO: 1029371 - RNA, 24 nt, Human
agggggcuacagccccuuccuguu

SEQ ID NO: 1029372 - RNA, 24 nt, Human
cacagaccaggggccccaaucccc

SEQ ID NO: 1029373 - RNA, 22 nt, Human
caccaaggcccagccugagagc

SEQ ID NO: 1029374 - RNA, 24 nt, Human
caccccaucacccaggccaggccc

SEQ ID NO: 1029375 - RNA, 25 nt, Human
caccccaucacccaggccaggcccc

SEQ ID NO: 1029376 - RNA, 18 nt, Human
caccccccacccccgugc

SEQ ID NO: 1029377 - RNA, 18 nt, Human
cagaccuuccucucccuc

SEQ ID NO: 1029378 - RNA, 18 nt, Human
cagccucugcugccuccc

SEQ ID NO: 1029379 - RNA, 18 nt, Human
cagccugagagcgccccc

SEQ ID NO: 1029380 - RNA, 22 nt, Human
cagcucggggucaagucuccgg

SEQ ID NO: 1029381 - RNA, 24 nt, Human
caggccugaggccaccuccagggc

SEQ ID NO: 1029382 - RNA, 23 nt, Human
cagggccaggcacuccuuccacc

SEQ ID NO: 1029383 - RNA, 18 nt, Human
cagggccuggaggcccgg

SEQ ID NO: 1029384 - RNA, 20 nt, Human
caucacccaggccaggcccc

SEQ ID NO: 1029385 - RNA, 27 nt, Human
cauuucuguacaccugagagcuggaaa

SEQ ID NO: 1029386 - RNA, 19 nt, Human
ccaccaagaggguccuccc

SEQ ID NO: 1029387 - RNA, 21 nt, Human
ccaccccaucacccaggccag

SEQ ID NO: 1029388 - RNA, 21 nt, Human
ccaccccccaacacacccgcc

SEQ ID NO: 1029389 - RNA, 21 nt, Human
ccaccccccacccccgugccc

SEQ ID NO: 1029390 - RNA, 19 nt, Human
cccaacacacccgcccagg

SEQ ID NO: 1029391 - RNA, 20 nt, Human
cccaucacccaggccaggcc

SEQ ID NO: 1029392 - RNA, 23 nt, Human
cccaucacccaggccaggccccc

SEQ ID NO: 1029393 - RNA, 22 nt, Human
cccaugcugcauggccugaggc

SEQ ID NO: 1029394 - RNA, 24 nt, Human
ccccaacacacccgcccagguauu

SEQ ID NO: 1029395 - RNA, 18 nt, Human
ccccacuccccuccacca

SEQ ID NO: 1029396 - RNA, 26 nt, Human
ccccagggccaggcacuccuuccacc

SEQ ID NO: 1029397 - RNA, 21 nt, Human
ccccagggggcuacagccccu

SEQ ID NO: 1029398 - RNA, 25 nt, Human
cccccacuccccuccaccaagaggg

SEQ ID NO: 1029399 - RNA, 22 nt, Human
cccccagacucuguccacagac

SEQ ID NO: 1029400 - RNA, 20 nt, Human
cccccagcugcccaggacuc

SEQ ID NO: 1029401 - RNA, 19 nt, Human
ccccggcggccucaggcga

SEQ ID NO: 1029402 - RNA, 21 nt, Human
ccccucggccaugcccaauuc

SEQ ID NO: 1029403 - RNA, 24 nt, Human
ccccucggccaugcccaauucuag

SEQ ID NO: 1029404 - RNA, 22 nt, Human
cccuaaggaagggcuggggagc

SEQ ID NO: 1029405 - RNA, 18 nt, Human
cccugggcucgagggcuc

SEQ ID NO: 1029406 - RNA, 21 nt, Human
ccucaucuucagaccuuccuc

SEQ ID NO: 1029407 - RNA, 18 nt, Human
ccucccuccccaggccaa

SEQ ID NO: 1029408 - RNA, 18 nt, Human
ccuguguuggggcagcug

SEQ ID NO: 1029409 - RNA, 21 nt, Human
cgagcagcugggaccuugggc

SEQ ID NO: 1029410 - RNA, 22 nt, Human
cgagcagcugggaccuugggcc

SEQ ID NO: 1029411 - RNA, 21 nt, Human
cgcagcuccagccccugcccc

SEQ ID NO: 1029412 - RNA, 23 nt, Human
cgcagcuccagccccugccccuc

SEQ ID NO: 1029413 - RNA, 24 nt, Human
cgcaggcccuuggugggguuccca

SEQ ID NO: 1029414 - RNA, 20 nt, Human
cgcccuaucgcagugcggga

SEQ ID NO: 1029415 - RNA, 27 nt, Human
cggacccucccuccccaggccaaaccc

SEQ ID NO: 1029416 - RNA, 24 nt, Human
cggccggaucuccuggccuguguu

SEQ ID NO: 1029417 - RNA, 19 nt, Human
cgggugccuauaggggagg

SEQ ID NO: 1029418 - RNA, 19 nt, Human
cuacaaaguaaaccgcauu

SEQ ID NO: 1029419 - RNA, 21 nt, Human
cucacgcugcagccuucuaga

SEQ ID NO: 1029420 - RNA, 23 nt, Human
cuccaccaagaggguccucccca

SEQ ID NO: 1029421 - RNA, 22 nt, Human
cuccagccccugccccucggcc

SEQ ID NO: 1029422 - RNA, 19 nt, Human
cucggggggcucccuggcc

SEQ ID NO: 1029423 - RNA, 23 nt, Human
cucucacaggccugcucggguga

SEQ ID NO: 1029424 - RNA, 20 nt, Human
cucucaggacaggcacugca

SEQ ID NO: 1029425 - RNA, 22 nt, Human
cucugugaccacauaugugggc

SEQ ID NO: 1029426 - RNA, 19 nt, Human
cugccccucggccaugccc

SEQ ID NO: 1029427 - RNA, 19 nt, Human
cugccucccuggcuggucc

SEQ ID NO: 1029428 - RNA, 20 nt, Human
cugccucccuggcugguccc

SEQ ID NO: 1029429 - RNA, 20 nt, Human
cugcugcauguggugcuggc

SEQ ID NO: 1029430 - RNA, 19 nt, Human
cuggcccuaaggaagggcu

SEQ ID NO: 1029431 - RNA, 20 nt, Human
cugggaccuugggccacugc

SEQ ID NO: 1029432 - RNA, 26 nt, Human
cuggggagccggacccucccucccca

SEQ ID NO: 1029433 - RNA, 23 nt, Human
cuucaggcagggggcccccaugg

SEQ ID NO: 1029434 - RNA, 21 nt, Human
cuuccaccccccaacacaccc

SEQ ID NO: 1029435 - RNA, 22 nt, Human
cuuccaccccccaacacacccg

SEQ ID NO: 1029436 - RNA, 24 nt, Human
cuuugaggcaagucaguuaccaug

SEQ ID NO: 1029437 - RNA, 22 nt, Human
gaagcagaggucaccaaggccc

SEQ ID NO: 1029438 - RNA, 23 nt, Human
gaagcagaggucaccaaggccca

SEQ ID NO: 1029439 - RNA, 21 nt, Human
gaccuuccucucccucugugg

SEQ ID NO: 1029440 - RNA, 21 nt, Human
gaggugaagggaccaggugcu

SEQ ID NO: 1029441 - RNA, 22 nt, Human
gcagcuccagccccugccccuc

SEQ ID NO: 1029442 - RNA, 20 nt, Human
gcccagccaaggccaggaag

SEQ ID NO: 1029443 - RNA, 22 nt, Human
gccuaaacuggguuccagccuc

SEQ ID NO: 1029444 - RNA, 21 nt, Human
gcucugaggccaggcuugggg

SEQ ID NO: 1029445 - RNA, 18 nt, Human
gcucuuacccuggggcug

SEQ ID NO: 1029446 - RNA, 22 nt, Human
gcuggagaagugcaugagauua

SEQ ID NO: 1029447 - RNA, 18 nt, Human
gcuggccucucacgcugc

SEQ ID NO: 1029448 - RNA, 22 nt, Human
ggaagugcuggcggccggaucu

SEQ ID NO: 1029449 - RNA, 22 nt, Human
ggaccggggucaaggcuggaga

SEQ ID NO: 1029450 - RNA, 22 nt, Human
ggagguggcucuuacccugggg

SEQ ID NO: 1029451 - RNA, 18 nt, Human
ggccacugcggccuagga

SEQ ID NO: 1029452 - RNA, 19 nt, Human
ggccagggccuggaggccc

SEQ ID NO: 1029453 - RNA, 22 nt, Human
ggccagggccuggaggcccggg

SEQ ID NO: 1029454 - RNA, 20 nt, Human
ggccugguucggggccgagg

SEQ ID NO: 1029455 - RNA, 23 nt, Human
ggcgcacgccauguucccuccag

SEQ ID NO: 1029456 - RNA, 23 nt, Human
ggcuggagaagugcaugagaugu

SEQ ID NO: 1029457 - RNA, 22 nt, Human
gggagaagggccagggccugga

SEQ ID NO: 1029458 - RNA, 18 nt, Human
gggaggugaagggaccag

SEQ ID NO: 1029459 - RNA, 18 nt, Human
gggccaggacaucccugg

SEQ ID NO: 1029460 - RNA, 22 nt, Human
gggccugguucggggccgaggg

SEQ ID NO: 1029461 - RNA, 19 nt, Human
gggcuggggagccggaccc

SEQ ID NO: 1029462 - RNA, 19 nt, Human
gggcuggggugagagaguu

SEQ ID NO: 1029463 - RNA, 20 nt, Human
gggcuggggugagagaguuc

SEQ ID NO: 1029464 - RNA, 25 nt, Human
gggggcucccuggccuggcacuggu

SEQ ID NO: 1029465 - RNA, 19 nt, Human
ggugaagggaccaggugcu

SEQ ID NO: 1029466 - RNA, 21 nt, Human
gguguuaucuucuggggccag

SEQ ID NO: 1029467 - RNA, 22 nt, Human
guccacagaccaggggccccaa

SEQ ID NO: 1029468 - RNA, 19 nt, Human
gugaccaccccccaccccc

SEQ ID NO: 1029469 - RNA, 23 nt, Human
uaccaugggugaggcugcuggug

SEQ ID NO: 1029470 - RNA, 23 nt, Human
uagcugcugcauguggugcuggc

SEQ ID NO: 1029471 - RNA, 24 nt, Human
uagcugcugcauguggugcuggcu

SEQ ID NO: 1029472 - RNA, 24 nt, Human
uaggagguggcucuuacccugggg

SEQ ID NO: 1029473 - RNA, 20 nt, Human
ucacccaggccaggccccca

SEQ ID NO: 1029474 - RNA, 25 nt, Human
ucacccaggccaggcccccagcugc

SEQ ID NO: 1029475 - RNA, 19 nt, Human
ucagcugcccugggagguc

SEQ ID NO: 1029476 - RNA, 24 nt, Human
ucaggcagggggcccccauggacc

SEQ ID NO: 1029477 - RNA, 19 nt, Human
ucaggcucugggguggaag

SEQ ID NO: 1029478 - RNA, 18 nt, Human
uccacagaccaggggccc

SEQ ID NO: 1029479 - RNA, 21 nt, Human
uccacagaccaggggccccaa

SEQ ID NO: 1029480 - RNA, 19 nt, Human
ucccagucccccacucccc

SEQ ID NO: 1029481 - RNA, 26 nt, Human
uccccaggccaaacccaguugggggc

SEQ ID NO: 1029482 - RNA, 19 nt, Human
ucccggagggcucugaggc

SEQ ID NO: 1029483 - RNA, 19 nt, Human
ucccuggcuggucccaguc

SEQ ID NO: 1029484 - RNA, 18 nt, Human
ucuagagaggcccucauc

SEQ ID NO: 1029485 - RNA, 18 nt, Human
ucucacgcugcagccuuc

SEQ ID NO: 1029486 - RNA, 21 nt, Human
ugaaccaacguggccuacaaa

SEQ ID NO: 1029487 - RNA, 19 nt, Human
ugaccacauaugugggcaa

SEQ ID NO: 1029488 - RNA, 23 nt, Human
ugaggccaggcuuggggggcugg

SEQ ID NO: 1029489 - RNA, 24 nt, Human
ugaggccaggcuuggggggcugga

SEQ ID NO: 1029490 - RNA, 24 nt, Human
ugcagggucaggcucuggggugga

SEQ ID NO: 1029491 - RNA, 23 nt, Human
ugccagaaucucguggccuuggg

SEQ ID NO: 1029492 - RNA, 21 nt, Human
ugcccaggacucggagccgac

SEQ ID NO: 1029493 - RNA, 23 nt, Human
ugcgggaacccuacagauccccc

SEQ ID NO: 1029494 - RNA, 24 nt, Human
ugcucagagacaguguccuggccu

SEQ ID NO: 1029495 - RNA, 20 nt, Human
ugcucggggggcucccuggc

SEQ ID NO: 1029496 - RNA, 24 nt, Human
ugcugcauggccugaggcuggccu

SEQ ID NO: 1029497 - RNA, 18 nt, Human
uggaccagcagggagaag

SEQ ID NO: 1029498 - RNA, 19 nt, Human
uggaggcccgggacugcgu

SEQ ID NO: 1029499 - RNA, 19 nt, Human
uggccuguguuggggcagc

SEQ ID NO: 1029500 - RNA, 19 nt, Human
uggcugggccugguucggg

SEQ ID NO: 1029501 - RNA, 19 nt, Human
uggcugggccugguucggg

SEQ ID NO: 1029502 - RNA, 22 nt, Human
uggggcagcugcucggggggcu

SEQ ID NO: 1029503 - RNA, 25 nt, Human
uggggccagguccucagaaagcagg

SEQ ID NO: 1029504 - RNA, 21 nt, Human
uggucccagucccccacuccc

SEQ ID NO: 1029505 - RNA, 21 nt, Human
uguugguuuggguuccggggc

SEQ ID NO: 1029506 - RNA, 23 nt, Human
uguugguuuggguuccggggccg

SEQ ID NO: 1029507 - RNA, 21 nt, Human
aaaaaaaaaauuccuuuggga

SEQ ID NO: 1029508 - RNA, 28 nt, Human
aggugauggagagggugggagguguagu

SEQ ID NO: 1029509 - RNA, 22 nt, Human
aucaaguuguaaaucuucaccu

SEQ ID NO: 1029510 - RNA, 23 nt, Human
caacaugagacuggaaaaaaggg

SEQ ID NO: 1029511 - RNA, 22 nt, Human
caucaccggaccuuuggcuuuu

SEQ ID NO: 1029512 - RNA, 20 nt, Human
ccaccucugggucaauuccc

SEQ ID NO: 1029513 - RNA, 25 nt, Human
ccaucucaaaaaaaaaaaaaaaaaa

SEQ ID NO: 1029514 - RNA, 18 nt, Human
cucaaaaaaaaaaaaaaa

SEQ ID NO: 1029515 - RNA, 19 nt, Human
cuccaucucaaaaaaaaaa

SEQ ID NO: 1029516 - RNA, 28 nt, Human
cuucuacauaaaaaucuucaacaugaga

SEQ ID NO: 1029517 - RNA, 19 nt, Human
gaaacggauucucccgcag

SEQ ID NO: 1029518 - RNA, 18 nt, Human
gacagaagcaggaaacuc

SEQ ID NO: 1029519 - RNA, 21 nt, Human
gaccuuuggcuuuuacagcuc

SEQ ID NO: 1029520 - RNA, 22 nt, Human
ggaccuuuggcuuuuacagcuc

SEQ ID NO: 1029521 - RNA, 18 nt, Human
ggugauggagaggguggg

SEQ ID NO: 1029522 - RNA, 21 nt, Human
ggugauggagagggugggagg

SEQ ID NO: 1029523 - RNA, 22 nt, Human
ucaaaaaaaaaaaaaaaaaaaa

SEQ ID NO: 1029524 - RNA, 23 nt, Human
ucaaaaaaaaaaaaaaaaaaaaa

SEQ ID NO: 1029525 - RNA, 23 nt, Human
ucaaaaaaaaaaaaaaaaaaaaa

SEQ ID NO: 1029526 - RNA, 25 nt, Human
ucagcgauacgaugauuccauuucu

SEQ ID NO: 1029527 - RNA, 24 nt, Human
ucauuacuuuuuaguuuccuucau

SEQ ID NO: 1029528 - RNA, 23 nt, Human
uccaucucaaaaaaaaaaaaaaa

SEQ ID NO: 1029529 - RNA, 19 nt, Human
ucuccccuucuccucaaau

SEQ ID NO: 1029530 - RNA, 20 nt, Human
ugaaaaagaaaaaaugguca

SEQ ID NO: 1029531 - RNA, 21 nt, Human
ugacagaagcaggaaacucca

SEQ ID NO: 1029532 - RNA, 19 nt, Human
ugauggagagggugggagg

SEQ ID NO: 1029533 - RNA, 24 nt, Human
ugcuuuuuccucugccuugcuuca

SEQ ID NO: 1029534 - RNA, 20 nt, Human
uucaaaagcugagcagggcu

SEQ ID NO: 1029535 - RNA, 22 nt, Human
uuccauuucuucggauccuugu

SEQ ID NO: 1029536 - RNA, 19 nt, Human
uucuccucaaauaacuuuc

SEQ ID NO: 1029537 - RNA, 19 nt, Human
agcagcagccuugcgucgg

SEQ ID NO: 1029538 - RNA, 22 nt, Human
uuuuuuuuuuuuuuuuucgcag

SEQ ID NO: 1029539 - RNA, 23 nt, Human
uuuuuuuuuuuuuuuuucgcagu

SEQ ID NO: 1029540 - RNA, 23 nt, Human
uuuuuuuuuuuuuuuuuuucggg

SEQ ID NO: 1029541 - RNA, 26 nt, Human
accacaauguaagccuuccaaaucca

SEQ ID NO: 1029542 - RNA, 18 nt, Human
accguucuccuccaccaa

SEQ ID NO: 1029543 - RNA, 22 nt, Human
acucuagcacugucuccucuca

SEQ ID NO: 1029544 - RNA, 20 nt, Human
acugcagugcaccaagaccu

SEQ ID NO: 1029545 - RNA, 26 nt, Human
agaaucaaaccguucuccuccaccaa

SEQ ID NO: 1029546 - RNA, 24 nt, Human
aucugaaaguuuucugcuguugga

SEQ ID NO: 1029547 - RNA, 19 nt, Human
auguagaacaaccuuggua

SEQ ID NO: 1029548 - RNA, 18 nt, Human
auuccugacaacgaauca

SEQ ID NO: 1029549 - RNA, 19 nt, Human
caagaccggcccugcaucc

SEQ ID NO: 1029550 - RNA, 22 nt, Human
cccugcauccaugaugcucucc

SEQ ID NO: 1029551 - RNA, 21 nt, Human
cuccuguuguugcagugucuc

SEQ ID NO: 1029552 - RNA, 22 nt, Human
cucugauuuccacucgucuggu

SEQ ID NO: 1029553 - RNA, 20 nt, Human
cugcuuucuauuucagcagc

SEQ ID NO: 1029554 - RNA, 18 nt, Human
cuugcaucugcucuugau

SEQ ID NO: 1029555 - RNA, 21 nt, Human
cuugccuuugacccucuuuuc

SEQ ID NO: 1029556 - RNA, 24 nt, Human
cuuuccucuugcuuuucugcuuuu

SEQ ID NO: 1029557 - RNA, 19 nt, Human
cuuucuugcaucugcucuu

SEQ ID NO: 1029558 - RNA, 22 nt, Human
cuuucuugcaucugcucuugau

SEQ ID NO: 1029559 - RNA, 23 nt, Human
gacucuagcacugucuccucuca

SEQ ID NO: 1029560 - RNA, 22 nt, Human
gagaaguuugcacuccuguugu

SEQ ID NO: 1029561 - RNA, 21 nt, Human
gcacugcagugcaccaagacc

SEQ ID NO: 1029562 - RNA, 23 nt, Human
gcagguuuucucaucugaaaguu

SEQ ID NO: 1029563 - RNA, 21 nt, Human
gccuuugacccucuuuucagc

SEQ ID NO: 1029564 - RNA, 25 nt, Human
gcuucugucuggaccaucccugacc

SEQ ID NO: 1029565 - RNA, 25 nt, Human
uccuccaccaauguuguauuucaau

SEQ ID NO: 1029566 - RNA, 18 nt, Human
ucuagcacugucuccucu

SEQ ID NO: 1029567 - RNA, 23 nt, Human
ucucugaugaugucaauaagaau

SEQ ID NO: 1029568 - RNA, 19 nt, Human
ugaaaguuuucugcuguug

SEQ ID NO: 1029569 - RNA, 19 nt, Human
ugaaguuuuggcagguuuu

SEQ ID NO: 1029570 - RNA, 19 nt, Human
ugaccucguagaccacacc

SEQ ID NO: 1029571 - RNA, 21 nt, Human
ugcuucugucuggaccauccc

SEQ ID NO: 1029572 - RNA, 25 nt, Human
ugcuucugucuggaccaucccugac

SEQ ID NO: 1029573 - RNA, 26 nt, Human
uggcagguuuucucaucugaaaguuu

SEQ ID NO: 1029574 - RNA, 20 nt, Human
ugucuggaccaucccugacc

SEQ ID NO: 1029575 - RNA, 21 nt, Human
ugucuggaccaucccugaccu

SEQ ID NO: 1029576 - RNA, 23 nt, Human
ugucuggaccaucccugaccucg

SEQ ID NO: 1029577 - RNA, 20 nt, Human
uguuaaggggcugcuugagu

SEQ ID NO: 1029578 - RNA, 24 nt, Human
uguuuuuauuuucuugccuuugac

SEQ ID NO: 1029579 - RNA, 20 nt, Human
uuccagcacugcagugcacc

SEQ ID NO: 1029580 - RNA, 21 nt, Human
uuuguuuuuauuuucuugccu

SEQ ID NO: 1029581 - RNA, 20 nt, Human
aaaugacgucaccucuccua

SEQ ID NO: 1029582 - RNA, 20 nt, Human
aaccaaagcugcugaaacaa

SEQ ID NO: 1029583 - RNA, 19 nt, Human
aagcagacagccccuaaaa

SEQ ID NO: 1029584 - RNA, 24 nt, Human
acaaguccagccccagaaggugua

SEQ ID NO: 1029585 - RNA, 21 nt, Human
acccaauaaaccccugguacc

SEQ ID NO: 1029586 - RNA, 19 nt, Human
agaugccuucggggaaaaa

SEQ ID NO: 1029587 - RNA, 22 nt, Human
aggaagaggcagaguaggggaa

SEQ ID NO: 1029588 - RNA, 18 nt, Human
aggcaccggaagaugccu

SEQ ID NO: 1029589 - RNA, 19 nt, Human
aggcagaguaggggaaggu

SEQ ID NO: 1029590 - RNA, 18 nt, Human
aguauggaggaagaggca

SEQ ID NO: 1029591 - RNA, 22 nt, Human
agugguugugauuaucugaagg

SEQ ID NO: 1029592 - RNA, 18 nt, Human
augcuacuuaaccugaaa

SEQ ID NO: 1029593 - RNA, 22 nt, Human
caaaaaggacacugaaaaccca

SEQ ID NO: 1029594 - RNA, 24 nt, Human
cagccccuaaaauagauggggaga

SEQ ID NO: 1029595 - RNA, 18 nt, Human
caggaaacuccugcccga

SEQ ID NO: 1029596 - RNA, 19 nt, Human
ccaggccucggcccucggg

SEQ ID NO: 1029597 - RNA, 23 nt, Human
ccccugggaucgaggagccccug

SEQ ID NO: 1029598 - RNA, 23 nt, Human
cccucgggcgcuggcggccccug

SEQ ID NO: 1029599 - RNA, 21 nt, Human
cccuucaaaaaggacacugaa

SEQ ID NO: 1029600 - RNA, 23 nt, Human
ccgaacuugggugaaaggcaccg

SEQ ID NO: 1029601 - RNA, 22 nt, Human
ccucggcccucgggcgcuggcg

SEQ ID NO: 1029602 - RNA, 19 nt, Human
ccucgggcgcuggcggccc

SEQ ID NO: 1029603 - RNA, 21 nt, Human
ccuuccguguccaggccucgg

SEQ ID NO: 1029604 - RNA, 21 nt, Human
cggaauuggucgcccgcgggg

SEQ ID NO: 1029605 - RNA, 25 nt, Human
cggccccugggaucgaggagccccu

SEQ ID NO: 1029606 - RNA, 18 nt, Human
cuccuccuucccuuuucu

SEQ ID NO: 1029607 - RNA, 18 nt, Human
gaggcccggagggaaucg

SEQ ID NO: 1029608 - RNA, 22 nt, Human
gcaaaugacgucaccucuccua

SEQ ID NO: 1029609 - RNA, 22 nt, Human
gcaaccaaagcugcugaaacaa

SEQ ID NO: 1029610 - RNA, 18 nt, Human
gccacggccuuccguguc

SEQ ID NO: 1029611 - RNA, 19 nt, Human
ggaaauugaaacccugucu

SEQ ID NO: 1029612 - RNA, 23 nt, Human
ggaagaugccuucggggaaaaug

SEQ ID NO: 1029613 - RNA, 19 nt, Human
ggacacugaaaacccagug

SEQ ID NO: 1029614 - RNA, 26 nt, Human
ggaccagggcugagcguggccgggga

SEQ ID NO: 1029615 - RNA, 18 nt, Human
ggacccgagaagccggcg

SEQ ID NO: 1029616 - RNA, 23 nt, Human
ggagaaugugguacuuaaccuuc

SEQ ID NO: 1029617 - RNA, 21 nt, Human
ggcuaacggaaaccuuuugcu

SEQ ID NO: 1029618 - RNA, 18 nt, Human
gggcugagcguggccggg

SEQ ID NO: 1029619 - RNA, 19 nt, Human
gucaccucuccuaauggga

SEQ ID NO: 1029620 - RNA, 21 nt, Human
gugcagcaggagacccggguu

SEQ ID NO: 1029621 - RNA, 24 nt, Human
guggaaauugaaacccugucuuua

SEQ ID NO: 1029622 - RNA, 21 nt, Human
uaaaccccugguaccaugcag

SEQ ID NO: 1029623 - RNA, 24 nt, Human
uaaaccccugguaccaugcagcuc

SEQ ID NO: 1029624 - RNA, 24 nt, Human
uaagcaaaugacgucaccucuccu

SEQ ID NO: 1029625 - RNA, 18 nt, Human
uaaugggacuguuccaga

SEQ ID NO: 1029626 - RNA, 24 nt, Human
uaccaugcagcucccccaaauuca

SEQ ID NO: 1029627 - RNA, 20 nt, Human
uagaucccacaaugaaauga

SEQ ID NO: 1029628 - RNA, 21 nt, Human
uaguauggaggaagaggcaga

SEQ ID NO: 1029629 - RNA, 27 nt, Human
uagugagcucccugucaagagagauuu

SEQ ID NO: 1029630 - RNA, 18 nt, Human
ucagugcaaccaaagcug

SEQ ID NO: 1029631 - RNA, 22 nt, Human
ucugcaacccaauaaaccccug

SEQ ID NO: 1029632 - RNA, 21 nt, Human
ugaaaugaacguaggcagucc

SEQ ID NO: 1029633 - RNA, 20 nt, Human
ugaaaugaacguaggcagug

SEQ ID NO: 1029634 - RNA, 21 nt, Human
ugacccuucaaaaaggacacu

SEQ ID NO: 1029635 - RNA, 20 nt, Human
ugaccggagcgccaugccgg

SEQ ID NO: 1029636 - RNA, 19 nt, Human
ugaccuggggcuccuccuu

SEQ ID NO: 1029637 - RNA, 25 nt, Human
ugcaacccaauaaaccccugguacc

SEQ ID NO: 1029638 - RNA, 20 nt, Human
uggaaauugaaacccugucu

SEQ ID NO: 1029639 - RNA, 24 nt, Human
uggggagaacuuuuagcccugaua

SEQ ID NO: 1029640 - RNA, 21 nt, Human
uggggcuccuccuucccuuuu

SEQ ID NO: 1029641 - RNA, 18 nt, Human
ugguugugauuaucugaa

SEQ ID NO: 1029642 - RNA, 19 nt, Human
uguccaggccucggcccuc

SEQ ID NO: 1029643 - RNA, 23 nt, Human
ugugguguuaccuuauuuuuaau

SEQ ID NO: 1029644 - RNA, 19 nt, Human
uguuugcagagaucaugug

SEQ ID NO: 1029645 - RNA, 22 nt, Human
uuaaccuucuauagaucccaca

SEQ ID NO: 1029646 - RNA, 19 nt, Human
uucaaaaaggacacugaaa

SEQ ID NO: 1029647 - RNA, 21 nt, Human
uucaugcuacuuaaccugaaa

SEQ ID NO: 1029648 - RNA, 20 nt, Human
agcacuuugggaagcugagg

SEQ ID NO: 1029649 - RNA, 24 nt, Human
cagcacuuugggaagcugaggcgg

SEQ ID NO: 1029650 - RNA, 18 nt, Human
ccgcguccgcgcccgccc

SEQ ID NO: 1029651 - RNA, 20 nt, Human
ccuguaaucccagcacuuug

SEQ ID NO: 1029652 - RNA, 24 nt, Human
cucaggccuguaaucccagcacuu

SEQ ID NO: 1029653 - RNA, 18 nt, Human
gccggguuccgcguccgc

SEQ ID NO: 1029654 - RNA, 18 nt, Human
ggccgggcgcguggcuca

SEQ ID NO: 1029655 - RNA, 23 nt, Human
ggccuguaaucccagcacuuugg

SEQ ID NO: 1029656 - RNA, 24 nt, Human
ggccuguaaucccagcacuuuggg

SEQ ID NO: 1029657 - RNA, 22 nt, Human
ggcgcguggcucaggccuguaa

SEQ ID NO: 1029658 - RNA, 21 nt, Human
ggcucaggccuguaaucccag

SEQ ID NO: 1029659 - RNA, 23 nt, Human
gugccgccgccgcgccggguucc

SEQ ID NO: 1029660 - RNA, 23 nt, Human
guggcucaggccuguaaucccag

SEQ ID NO: 1029661 - RNA, 24 nt, Human
ucaggccgggcgcguggcucaggc

SEQ ID NO: 1029662 - RNA, 22 nt, Human
uggcucaggccuguaaucccag

SEQ ID NO: 1029663 - RNA, 24 nt, Human
uggcucaggccuguaaucccagca

SEQ ID NO: 1029664 - RNA, 20 nt, Human
uuccgcguccgcgcccgccc

SEQ ID NO: 1029665 - RNA, 18 nt, Human
uucuuuguauauuaauuu

SEQ ID NO: 1029666 - RNA, 18 nt, Human
uuuuauuuuuaaaagaag

SEQ ID NO: 1029667 - RNA, 19 nt, Human
aaccaucuccucaggccac

SEQ ID NO: 1029668 - RNA, 20 nt, Human
acccccuuacccccccgggc

SEQ ID NO: 1029669 - RNA, 21 nt, Human
agaaaaaaguccuugggucua

SEQ ID NO: 1029670 - RNA, 24 nt, Human
agaaaacaggaaaaacaaaauuag

SEQ ID NO: 1029671 - RNA, 23 nt, Human
agccuugcccacccuccagacac

SEQ ID NO: 1029672 - RNA, 23 nt, Human
agcuccuuggggaauaggcggcu

SEQ ID NO: 1029673 - RNA, 19 nt, Human
agggaugggagcugaagga

SEQ ID NO: 1029674 - RNA, 18 nt, Human
aucuccucaggccacugg

SEQ ID NO: 1029675 - RNA, 24 nt, Human
auuucaccagggcacccccuuacc

SEQ ID NO: 1029676 - RNA, 23 nt, Human
cacacugagacaauguuuggaau

SEQ ID NO: 1029677 - RNA, 25 nt, Human
caccagggcacccccuuaccccccc

SEQ ID NO: 1029678 - RNA, 21 nt, Human
cacccccuuacccccccgggc

SEQ ID NO: 1029679 - RNA, 24 nt, Human
cagcagccgcauuuugccagcacu

SEQ ID NO: 1029680 - RNA, 19 nt, Human
ccagcccucccacccaccc

SEQ ID NO: 1029681 - RNA, 24 nt, Human
ccagcccucccacccacccacaua

SEQ ID NO: 1029682 - RNA, 19 nt, Human
cccacccuccagacacacc

SEQ ID NO: 1029683 - RNA, 22 nt, Human
cccagcccucccacccacccac

SEQ ID NO: 1029684 - RNA, 20 nt, Human
cccagccuugcccacccucc

SEQ ID NO: 1029685 - RNA, 21 nt, Human
ccccagcccucccacccaccc

SEQ ID NO: 1029686 - RNA, 19 nt, Human
ccccgggcgaagcagcagc

SEQ ID NO: 1029687 - RNA, 25 nt, Human
ccccugccccagcccucccacccac

SEQ ID NO: 1029688 - RNA, 18 nt, Human
cccugccccagcccuccc

SEQ ID NO: 1029689 - RNA, 23 nt, Human
ccugccccagcccucccacccac

SEQ ID NO: 1029690 - RNA, 23 nt, Human
ccuuacccccccgggcgaagcag

SEQ ID NO: 1029691 - RNA, 19 nt, Human
cggggacaggcacagcgac

SEQ ID NO: 1029692 - RNA, 22 nt, Human
cucccagccuugcccacccucc

SEQ ID NO: 1029693 - RNA, 21 nt, Human
cuccuccaaguugauaucccu

SEQ ID NO: 1029694 - RNA, 19 nt, Human
cuggagcagugccagaagg

SEQ ID NO: 1029695 - RNA, 22 nt, Human
cuggccccugccccagcccucc

SEQ ID NO: 1029696 - RNA, 24 nt, Human
cuugcccacccuccagacacacca

SEQ ID NO: 1029697 - RNA, 21 nt, Human
gaccaugaugcaugcauaggg

SEQ ID NO: 1029698 - RNA, 20 nt, Human
gagcugaaggaaacuguguu

SEQ ID NO: 1029699 - RNA, 25 nt, Human
gccccugccccagcccucccaccca

SEQ ID NO: 1029700 - RNA, 23 nt, Human
ggaaugauccaaccaucuccuca

SEQ ID NO: 1029701 - RNA, 22 nt, Human
guccuugggucuagguguucuc

SEQ ID NO: 1029702 - RNA, 24 nt, Human
uaacaaaaccuuuauucucagaaa

SEQ ID NO: 1029703 - RNA, 22 nt, Human
uagguguucuccuccaaguuga

SEQ ID NO: 1029704 - RNA, 22 nt, Human
ucaccagggcacccccuuaccc

SEQ ID NO: 1029705 - RNA, 24 nt, Human
uccacacugagacaauguuuggaa

SEQ ID NO: 1029706 - RNA, 21 nt, Human
ucccacccacccacauauccu

SEQ ID NO: 1029707 - RNA, 23 nt, Human
uccucaggccacugacgggcccu

SEQ ID NO: 1029708 - RNA, 19 nt, Human
ugaaggaaacuguguuccu

SEQ ID NO: 1029709 - RNA, 21 nt, Human
ugagucagcaccacccccaug

SEQ ID NO: 1029710 - RNA, 20 nt, Human
ugauccaaccaucuccucag

SEQ ID NO: 1029711 - RNA, 25 nt, Human
ugccccagcuccagacucagggucc

SEQ ID NO: 1029712 - RNA, 19 nt, Human
ugcccugaagcuccuuggg

SEQ ID NO: 1029713 - RNA, 19 nt, Human
ugccucaguuuccacacug

SEQ ID NO: 1029714 - RNA, 18 nt, Human
uggccccugccccagccc

SEQ ID NO: 1029715 - RNA, 20 nt, Human
uggccccugccccagcccuc

SEQ ID NO: 1029716 - RNA, 19 nt, Human
ugggcagaaaaaaguccuu

SEQ ID NO: 1029717 - RNA, 21 nt, Human
ugggucuagguguucuccucc

SEQ ID NO: 1029718 - RNA, 22 nt, Human
uucaugaugcucagccucucuc

SEQ ID NO: 1029719 - RNA, 19 nt, Human
uugauaucccucccagccu

SEQ ID NO: 1029720 - RNA, 22 nt, Human
uuggccaggauagaaaauuuca

SEQ ID NO: 1029721 - RNA, 18 nt, Human
uuuuuuuuuuuuuuuuug

SEQ ID NO: 1029722 - RNA, 18 nt, Human
aaaaaaaaaaaaaaagcc

SEQ ID NO: 1029723 - RNA, 24 nt, Human
aaaaaaaaaaagccaacugaucca

SEQ ID NO: 1029724 - RNA, 22 nt, Human
aaaaaaaaagccaacugaucca

SEQ ID NO: 1029725 - RNA, 23 nt, Human
aaaaaaaaagccaacugauccag

SEQ ID NO: 1029726 - RNA, 24 nt, Human
aaaaaaaagccaacugauccagaa

SEQ ID NO: 1029727 - RNA, 21 nt, Human
aaaaaagccaacugauccaga

SEQ ID NO: 1029728 - RNA, 22 nt, Human
aacagcuggcccuggggucccc

SEQ ID NO: 1029729 - RNA, 23 nt, Human
aacagcuggcccugggguccccc

SEQ ID NO: 1029730 - RNA, 21 nt, Human
aaggagaccuugcauugcaaa

SEQ ID NO: 1029731 - RNA, 19 nt, Human
acaacacgaugcagcaugg

SEQ ID NO: 1029732 - RNA, 18 nt, Human
acagaucugcggugggcc

SEQ ID NO: 1029733 - RNA, 19 nt, Human
accaaaaaaaaaaaaaaag

SEQ ID NO: 1029734 - RNA, 19 nt, Human
agaaaaaacaaacuuaacc

SEQ ID NO: 1029735 - RNA, 23 nt, Human
agaaaaaacaaacuuaaccaaaa

SEQ ID NO: 1029736 - RNA, 26 nt, Human
agaaaaaacaaacuuaaccaaaaaaa

SEQ ID NO: 1029737 - RNA, 23 nt, Human
agacgggagucagaggccaagcc

SEQ ID NO: 1029738 - RNA, 19 nt, Human
agagcccgcgccgcgcccc

SEQ ID NO: 1029739 - RNA, 18 nt, Human
agaucugcggugggccaa

SEQ ID NO: 1029740 - RNA, 19 nt, Human
agccaggggcugggggagc

SEQ ID NO: 1029741 - RNA, 19 nt, Human
agccaggggcugggggagc

SEQ ID NO: 1029742 - RNA, 21 nt, Human
agcucugagcgaaacugcacc

SEQ ID NO: 1029743 - RNA, 19 nt, Human
agcuggcccuggggucccc

SEQ ID NO: 1029744 - RNA, 22 nt, Human
aggaagccaggggcugggggag

SEQ ID NO: 1029745 - RNA, 21 nt, Human
aggcagggguggacauuggga

SEQ ID NO: 1029746 - RNA, 21 nt, Human
agggaccccacggcuuccacc

SEQ ID NO: 1029747 - RNA, 23 nt, Human
agggaccccacggcuuccacccu

SEQ ID NO: 1029748 - RNA, 20 nt, Human
aggggcugggggagcugggg

SEQ ID NO: 1029749 - RNA, 22 nt, Human
aggguuggggagaagcaguggg

SEQ ID NO: 1029750 - RNA, 24 nt, Human
agguggccaagggcuccugggagg

SEQ ID NO: 1029751 - RNA, 21 nt, Human
aggugggaggugaagagcagg

SEQ ID NO: 1029752 - RNA, 21 nt, Human
aucauggucccugagaugggg

SEQ ID NO: 1029753 - RNA, 23 nt, Human
cacccugggggaggcugcaggcc

SEQ ID NO: 1029754 - RNA, 20 nt, Human
cacucugcugaggggcuccu

SEQ ID NO: 1029755 - RNA, 19 nt, Human
cagacaugaccugugccag

SEQ ID NO: 1029756 - RNA, 20 nt, Human
cagacaugaccugugccagg

SEQ ID NO: 1029757 - RNA, 23 nt, Human
cagcucagggccggugcgcgcgg

SEQ ID NO: 1029758 - RNA, 24 nt, Human
cagggacacuccaggcccagcuga

SEQ ID NO: 1029759 - RNA, 21 nt, Human
caggggacaucucugaccugg

SEQ ID NO: 1029760 - RNA, 19 nt, Human
caggggcugggggagcugg

SEQ ID NO: 1029761 - RNA, 22 nt, Human
caggggcugggggagcuggggg

SEQ ID NO: 1029762 - RNA, 24 nt, Human
ccaggcccagcugaggcuuccugc

SEQ ID NO: 1029763 - RNA, 21 nt, Human
ccaggguuggccuguggggag

SEQ ID NO: 1029764 - RNA, 20 nt, Human
cccacaaaggugggagguga

SEQ ID NO: 1029765 - RNA, 19 nt, Human
ccccacugccccggccccu

SEQ ID NO: 1029766 - RNA, 23 nt, Human
cccccacaaaggugggaggugaa

SEQ ID NO: 1029767 - RNA, 23 nt, Human
ccccuggaaagcuuaaggcccag

SEQ ID NO: 1029768 - RNA, 18 nt, Human
cccgcgccgcgcccccuc

SEQ ID NO: 1029769 - RNA, 20 nt, Human
cccugggguccccuuucaag

SEQ ID NO: 1029770 - RNA, 18 nt, Human
ccuggaggugggacagcu

SEQ ID NO: 1029771 - RNA, 21 nt, Human
ccuggaggugggacagcuggu

SEQ ID NO: 1029772 - RNA, 22 nt, Human
cgaaaaccccaguccccaguga

SEQ ID NO: 1029773 - RNA, 22 nt, Human
cggcccgggacaaugcggcuga

SEQ ID NO: 1029774 - RNA, 20 nt, Human
cugaggcgggccgggccucc

SEQ ID NO: 1029775 - RNA, 22 nt, Human
cugaggcgggccgggccuccag

SEQ ID NO: 1029776 - RNA, 21 nt, Human
cugaggggcuccuucuccucc

SEQ ID NO: 1029777 - RNA, 23 nt, Human
cugggggaucccugggguagugg

SEQ ID NO: 1029778 - RNA, 21 nt, Human
cugucccuggcagggcuggag

SEQ ID NO: 1029779 - RNA, 22 nt, Human
gaaaaaacaaacuuaaccaaaa

SEQ ID NO: 1029780 - RNA, 22 nt, Human
gaccccacggcuuccacccugg

SEQ ID NO: 1029781 - RNA, 22 nt, Human
gagaugggggcaagcacagaga

SEQ ID NO: 1029782 - RNA, 20 nt, Human
gaggcagggguggacauugg

SEQ ID NO: 1029783 - RNA, 20 nt, Human
gaggccgcgugcuguggugg

SEQ ID NO: 1029784 - RNA, 23 nt, Human
gauccagaauggcuuucagaagc

SEQ ID NO: 1029785 - RNA, 22 nt, Human
gcaggacaggugggcugccucc

SEQ ID NO: 1029786 - RNA, 22 nt, Human
gccggugcgcgcggcccgggac

SEQ ID NO: 1029787 - RNA, 19 nt, Human
gccuguggggagcguggag

SEQ ID NO: 1029788 - RNA, 19 nt, Human
gcgggccgggccuccagcg

SEQ ID NO: 1029789 - RNA, 22 nt, Human
ggacaaugcggcugaggcgggc

SEQ ID NO: 1029790 - RNA, 22 nt, Human
ggagaaaccugucccuggcagg

SEQ ID NO: 1029791 - RNA, 24 nt, Human
ggagcugggggaucccuggggucg

SEQ ID NO: 1029792 - RNA, 19 nt, Human
ggaggugaagagcaggcau

SEQ ID NO: 1029793 - RNA, 21 nt, Human
ggaggugggacagcuggugcu

SEQ ID NO: 1029794 - RNA, 21 nt, Human
ggcugggggagcugggggauc

SEQ ID NO: 1029795 - RNA, 18 nt, Human
gggacagcuggugcuaag

SEQ ID NO: 1029796 - RNA, 22 nt, Human
gggagcugggggaucccugggg

SEQ ID NO: 1029797 - RNA, 21 nt, Human
ggggagcugggggaucccugg

SEQ ID NO: 1029798 - RNA, 24 nt, Human
ggggagcugggggaucccuggggu

SEQ ID NO: 1029799 - RNA, 22 nt, Human
ggggaggcagggguggacauug

SEQ ID NO: 1029800 - RNA, 21 nt, Human
gggggagcugggggaucccug

SEQ ID NO: 1029801 - RNA, 18 nt, Human
gggguggacauugggacc

SEQ ID NO: 1029802 - RNA, 21 nt, Human
gggugcugcggcggcgcagcu

SEQ ID NO: 1029803 - RNA, 22 nt, Human
ggguuggggagaagcagugggu

SEQ ID NO: 1029804 - RNA, 25 nt, Human
uaaccaaaaaaaaaaaaaaagccaa

SEQ ID NO: 1029805 - RNA, 19 nt, Human
uacaacacgaugcagcaug

SEQ ID NO: 1029806 - RNA, 24 nt, Human
uagaaaaaacaaacuuaaccaaaa

SEQ ID NO: 1029807 - RNA, 25 nt, Human
uagaaaaaacaaacuuaaccaaaaa

SEQ ID NO: 1029808 - RNA, 19 nt, Human
ucaggacccuggagguggg

SEQ ID NO: 1029809 - RNA, 23 nt, Human
uccaggcccagcugaggcuuccu

SEQ ID NO: 1029810 - RNA, 25 nt, Human
uccccagugaaggggaggcaggggu

SEQ ID NO: 1029811 - RNA, 19 nt, Human
ucccugagaugggggcaag

SEQ ID NO: 1029812 - RNA, 20 nt, Human
ucccugggguaguggggaca

SEQ ID NO: 1029813 - RNA, 21 nt, Human
uccucagccccaucccaauac

SEQ ID NO: 1029814 - RNA, 23 nt, Human
uccucagccccaucccaauacaa

SEQ ID NO: 1029815 - RNA, 23 nt, Human
uccugggaggcaggacagguggg

SEQ ID NO: 1029816 - RNA, 21 nt, Human
ucgccgggagcccacgcgggg

SEQ ID NO: 1029817 - RNA, 22 nt, Human
ucugggguuggaagccaaggag

SEQ ID NO: 1029818 - RNA, 18 nt, Human
ugaaggggaggcaggggu

SEQ ID NO: 1029819 - RNA, 24 nt, Human
ugagcgaaacugcaccaaccccgg

SEQ ID NO: 1029820 - RNA, 23 nt, Human
ugaggcuuccugcucugcauggc

SEQ ID NO: 1029821 - RNA, 18 nt, Human
ugccaggguuggccugug

SEQ ID NO: 1029822 - RNA, 20 nt, Human
ugccccggccccuggaaagc

SEQ ID NO: 1029823 - RNA, 24 nt, Human
uggcgcgagguggccaagggcucc

SEQ ID NO: 1029824 - RNA, 24 nt, Human
ugggaggugaagagcaggcauuuu

SEQ ID NO: 1029825 - RNA, 20 nt, Human
ugggcugccuccgcucagca

SEQ ID NO: 1029826 - RNA, 22 nt, Human
uggggcgaaaaccccagucccc

SEQ ID NO: 1029827 - RNA, 21 nt, Human
ugggguuggaagccaaggaga

SEQ ID NO: 1029828 - RNA, 20 nt, Human
uggucaggacccuggaggug

SEQ ID NO: 1029829 - RNA, 22 nt, Human
ugugguggcaggccgcuaaagg

SEQ ID NO: 1029830 - RNA, 18 nt, Human
ugugguggcaggccgcuc

SEQ ID NO: 1029831 - RNA, 25 nt, Human
uuaaccaaaaaaaaaaaaaaagcca

SEQ ID NO: 1029832 - RNA, 24 nt, Human
uuccucagccccaucccaauacaa

SEQ ID NO: 1029833 - RNA, 20 nt, Human
aaaaaagaauucuuuuuaaa

SEQ ID NO: 1029834 - RNA, 26 nt, Human
aaaaagaauucuuuuuaaagccauug

SEQ ID NO: 1029835 - RNA, 19 nt, Human
aaaccacgauaagcugaua

SEQ ID NO: 1029836 - RNA, 23 nt, Human
aaacccagagggcaucccaaaac

SEQ ID NO: 1029837 - RNA, 19 nt, Human
aacauggugaaaccccguc

SEQ ID NO: 1029838 - RNA, 20 nt, Human
aacauggugaaaccccgucu

SEQ ID NO: 1029839 - RNA, 21 nt, Human
aacauggugaaaccccgucuc

SEQ ID NO: 1029840 - RNA, 25 nt, Human
aaccacaguacauugaaauuugucu

SEQ ID NO: 1029841 - RNA, 18 nt, Human
aagauaccuacacugaaa

SEQ ID NO: 1029842 - RNA, 22 nt, Human
aagccacacacgcugaggacac

SEQ ID NO: 1029843 - RNA, 25 nt, Human
aaggcggguggaucaccugagguca

SEQ ID NO: 1029844 - RNA, 24 nt, Human
aaucgcuugaacuagggaggcaaa

SEQ ID NO: 1029845 - RNA, 19 nt, Human
acaaacccagagggcaucc

SEQ ID NO: 1029846 - RNA, 21 nt, Human
acaaacccagagggcauccca

SEQ ID NO: 1029847 - RNA, 22 nt, Human
acaccacugcacuccagccagg

SEQ ID NO: 1029848 - RNA, 23 nt, Human
acaccacugcacuccagccaggc

SEQ ID NO: 1029849 - RNA, 18 nt, Human
accccgucuccacuaaaa

SEQ ID NO: 1029850 - RNA, 24 nt, Human
accugaggucaggaguucgagacc

SEQ ID NO: 1029851 - RNA, 24 nt, Human
acgucuguaaucccagcacccagg

SEQ ID NO: 1029852 - RNA, 23 nt, Human
acugcacuccagccaggcgacag

SEQ ID NO: 1029853 - RNA, 25 nt, Human
acugcacuccagccaggcgacagag

SEQ ID NO: 1029854 - RNA, 18 nt, Human
agaaaagaagaucuuuac

SEQ ID NO: 1029855 - RNA, 18 nt, Human
agaauaaugaaaaaagaa

SEQ ID NO: 1029856 - RNA, 19 nt, Human
agcacuggaagcauguggc

SEQ ID NO: 1029857 - RNA, 24 nt, Human
agcacuuugggagacugaggcggg

SEQ ID NO: 1029858 - RNA, 19 nt, Human
agccauugaaacugaagac

SEQ ID NO: 1029859 - RNA, 24 nt, Human
agcuuagccaacauggugaaaccc

SEQ ID NO: 1029860 - RNA, 23 nt, Human
aggaggccaaggcggguggauca

SEQ ID NO: 1029861 - RNA, 24 nt, Human
aggaguucgagacccagcuuagcc

SEQ ID NO: 1029862 - RNA, 20 nt, Human
aggcaaagguuuugaugagc

SEQ ID NO: 1029863 - RNA, 24 nt, Human
aggcaaagguuuugaugagcugag

SEQ ID NO: 1029864 - RNA, 21 nt, Human
aggccaaggcggguggaucac

SEQ ID NO: 1029865 - RNA, 22 nt, Human
aggcggguggaucaccugaggu

SEQ ID NO: 1029866 - RNA, 26 nt, Human
aggcggguggaucaccugaggucagg

SEQ ID NO: 1029867 - RNA, 24 nt, Human
aggcugagguaggaaaaucgcuug

SEQ ID NO: 1029868 - RNA, 24 nt, Human
agguaggaaaaucgcuugaacuag

SEQ ID NO: 1029869 - RNA, 20 nt, Human
aucacaccacugcacuccag

SEQ ID NO: 1029870 - RNA, 21 nt, Human
aucaccugaggucaggaguuc

SEQ ID NO: 1029871 - RNA, 24 nt, Human
caacauggugaaaccccgucucca

SEQ ID NO: 1029872 - RNA, 24 nt, Human
caaggcggguggaucaccugaggu

SEQ ID NO: 1029873 - RNA, 21 nt, Human
caaguggccgggggugguggc

SEQ ID NO: 1029874 - RNA, 23 nt, Human
cacacacgcugaggacacagagc

SEQ ID NO: 1029875 - RNA, 18 nt, Human
cacagagcagugaagggu

SEQ ID NO: 1029876 - RNA, 24 nt, Human
caccacugcacuccagccaggcga

SEQ ID NO: 1029877 - RNA, 23 nt, Human
caccugaggucaggaguucgaga

SEQ ID NO: 1029878 - RNA, 24 nt, Human
caccuguaaucccagcuacucagg

SEQ ID NO: 1029879 - RNA, 24 nt, Human
cacgccuguaauaccagcacuuug

SEQ ID NO: 1029880 - RNA, 19 nt, Human
cacgucuguaaucccagca

SEQ ID NO: 1029881 - RNA, 22 nt, Human
cacuccagccaggcgacagagc

SEQ ID NO: 1029882 - RNA, 18 nt, Human
cacugcacuccagccagg

SEQ ID NO: 1029883 - RNA, 19 nt, Human
cacugcacuccagccaggc

SEQ ID NO: 1029884 - RNA, 21 nt, Human
cacugcacuccagccaggcga

SEQ ID NO: 1029885 - RNA, 21 nt, Human
cacugcacuccagccaggcga

SEQ ID NO: 1029886 - RNA, 23 nt, Human
cacugcacuccagccaggcgaca

SEQ ID NO: 1029887 - RNA, 24 nt, Human
cagagcgagacuccugucucaaaa

SEQ ID NO: 1029888 - RNA, 24 nt, Human
cagcacuuugggagacugaggcgg

SEQ ID NO: 1029889 - RNA, 24 nt, Human
cagcuacucaggaggcugagguag

SEQ ID NO: 1029890 - RNA, 22 nt, Human
caggucacgaagccacacacgc

SEQ ID NO: 1029891 - RNA, 18 nt, Human
ccacuacaaacccagagg

SEQ ID NO: 1029892 - RNA, 19 nt, Human
ccacugcacuccagccagg

SEQ ID NO: 1029893 - RNA, 19 nt, Human
ccacugcacuccagccagg

SEQ ID NO: 1029894 - RNA, 20 nt, Human
ccacugcacuccagccaggc

SEQ ID NO: 1029895 - RNA, 23 nt, Human
ccacugcacuccagccaggcgac

SEQ ID NO: 1029896 - RNA, 19 nt, Human
ccagcacccaggaggccaa

SEQ ID NO: 1029897 - RNA, 24 nt, Human
ccagcacccaggaggccaaggcgg

SEQ ID NO: 1029898 - RNA, 19 nt, Human
ccagcagccuugcaaccaa

SEQ ID NO: 1029899 - RNA, 22 nt, Human
cccaaaacccuggggaacacaa

SEQ ID NO: 1029900 - RNA, 24 nt, Human
ccccacuccacuacaaacccagaa

SEQ ID NO: 1029901 - RNA, 25 nt, Human
ccccacuccacuacaaacccagaag

SEQ ID NO: 1029902 - RNA, 21 nt, Human
cccgucuccacuaaaaacaca

SEQ ID NO: 1029903 - RNA, 18 nt, Human
ccgggggugguggcucac

SEQ ID NO: 1029904 - RNA, 22 nt, Human
ccugaggucaggaguucgagac

SEQ ID NO: 1029905 - RNA, 21 nt, Human
ccuguaaucccagcuacucag

SEQ ID NO: 1029906 - RNA, 23 nt, Human
ccugucucaaaaaaaaaaaaaaa

SEQ ID NO: 1029907 - RNA, 24 nt, Human
cgagacuccugucucaaaaaaaaa

SEQ ID NO: 1029908 - RNA, 19 nt, Human
cgagguuuuuuuuuuuuuu

SEQ ID NO: 1029909 - RNA, 21 nt, Human
cgagguuuuuuuuuuuuuuuu

SEQ ID NO: 1029910 - RNA, 23 nt, Human
cgccuguaauaccagcacuuugg

SEQ ID NO: 1029911 - RNA, 24 nt, Human
cgccuguaauaccagcacuuuggg

SEQ ID NO: 1029912 - RNA, 24 nt, Human
cggguggaucaccugaggucagga

SEQ ID NO: 1029913 - RNA, 22 nt, Human
cuaaaaacacacaaaaaauuag

SEQ ID NO: 1029914 - RNA, 18 nt, Human
cucaaaaaaaaaaaaaaa

SEQ ID NO: 1029915 - RNA, 23 nt, Human
cucaaaaaaaaaaaaaaaaaaaa

SEQ ID NO: 1029916 - RNA, 24 nt, Human
cucacgccuguaauaccagcacuu

SEQ ID NO: 1029917 - RNA, 23 nt, Human
cucacgucuguaaucccagcacc

SEQ ID NO: 1029918 - RNA, 18 nt, Human
cucaggaggcugagguag

SEQ ID NO: 1029919 - RNA, 20 nt, Human
cuccacuacaaacccagagg

SEQ ID NO: 1029920 - RNA, 25 nt, Human
cuccugucucaaaaaaaaaaaaaaa

SEQ ID NO: 1029921 - RNA, 28 nt, Human
cuccugucucaaaaaaaaaaaaaaaaaa

SEQ ID NO: 1029922 - RNA, 22 nt, Human
cugauauuaagauaccuacacu

SEQ ID NO: 1029923 - RNA, 21 nt, Human
cuguaaucccagcuacucagg

SEQ ID NO: 1029924 - RNA, 24 nt, Human
cuuagccaacauggugaaaccccg

SEQ ID NO: 1029925 - RNA, 21 nt, Human
gaaaacaccacuaauaugaaa

SEQ ID NO: 1029926 - RNA, 23 nt, Human
gacuccugucucaaaaaaaaaaa

SEQ ID NO: 1029927 - RNA, 23 nt, Human
gagaucacaccacugcacuccag

SEQ ID NO: 1029928 - RNA, 21 nt, Human
gaggacacagagcagugaagg

SEQ ID NO: 1029929 - RNA, 22 nt, Human
gagggcaucccaaaacccuggg

SEQ ID NO: 1029930 - RNA, 24 nt, Human
gaucaccugaggucaggaguucga

SEQ ID NO: 1029931 - RNA, 23 nt, Human
gcacuccagccaggcgacagagc

SEQ ID NO: 1029932 - RNA, 21 nt, Human
gcagugaaggguagaccugga

SEQ ID NO: 1029933 - RNA, 26 nt, Human
gcaucccaaaacccuggggaacacaa

SEQ ID NO: 1029934 - RNA, 24 nt, Human
gccaacauggugaaaccccgucuc

SEQ ID NO: 1029935 - RNA, 20 nt, Human
gcugagaucacaccacugca

SEQ ID NO: 1029936 - RNA, 24 nt, Human
gcuggugggcaccuguaaucccag

SEQ ID NO: 1029937 - RNA, 22 nt, Human
ggaucaccugaggucaggaguu

SEQ ID NO: 1029938 - RNA, 19 nt, Human
ggcaccuguaaucccagcu

SEQ ID NO: 1029939 - RNA, 23 nt, Human
ggcgugcuggugggcaccuguaa

SEQ ID NO: 1029940 - RNA, 21 nt, Human
ggcucacgucuguaaucccag

SEQ ID NO: 1029941 - RNA, 24 nt, Human
gggcaugguggcucacgccuguaa

SEQ ID NO: 1029942 - RNA, 19 nt, Human
gggcgugcuggugggcacc

SEQ ID NO: 1029943 - RNA, 23 nt, Human
ggggugguggcucacgucuguaa

SEQ ID NO: 1029944 - RNA, 21 nt, Human
gguggaucaccugaggucagg

SEQ ID NO: 1029945 - RNA, 24 nt, Human
gguggcucacgccuguaauaccag

SEQ ID NO: 1029946 - RNA, 23 nt, Human
guggcucacgucuguaaucccag

SEQ ID NO: 1029947 - RNA, 25 nt, Human
uaaccaaaaaccacgauaagcugau

SEQ ID NO: 1029948 - RNA, 24 nt, Human
uaagauaccuacacugaaaacacc

SEQ ID NO: 1029949 - RNA, 21 nt, Human
uaccuacacugaaaacaccac

SEQ ID NO: 1029950 - RNA, 21 nt, Human
uagcacuggaagcauguggca

SEQ ID NO: 1029951 - RNA, 21 nt, Human
uagccaacauggugaaacccc

SEQ ID NO: 1029952 - RNA, 18 nt, Human
uaggcugggcaugguggc

SEQ ID NO: 1029953 - RNA, 23 nt, Human
ucaaaaaaaaaaaaaaaaaaaaa

SEQ ID NO: 1029954 - RNA, 20 nt, Human
ucaccugaggucaggaguuc

SEQ ID NO: 1029955 - RNA, 22 nt, Human
uccagccaggcgacagagcgag

SEQ ID NO: 1029956 - RNA, 23 nt, Human
uccagccaggcgacagagcgaga

SEQ ID NO: 1029957 - RNA, 21 nt, Human
ucccaaaacccuggggaacac

SEQ ID NO: 1029958 - RNA, 23 nt, Human
ucuguaaucccagcacccaggag

SEQ ID NO: 1029959 - RNA, 26 nt, Human
ugaaaacaccacuaauaugaaacugc

SEQ ID NO: 1029960 - RNA, 22 nt, Human
ugaaaccccgucuccacuaaaa

SEQ ID NO: 1029961 - RNA, 20 nt, Human
ugaacuagggaggcaaaggu

SEQ ID NO: 1029962 - RNA, 19 nt, Human
ugagaaacuuuuaauaagc

SEQ ID NO: 1029963 - RNA, 18 nt, Human
ugagaucacaccacugca

SEQ ID NO: 1029964 - RNA, 24 nt, Human
ugaugagaaacuuuuaauaagcau

SEQ ID NO: 1029965 - RNA, 24 nt, Human
uggaucaccugaggucaggaguuc

SEQ ID NO: 1029966 - RNA, 27 nt, Human
uggaucaccugaggucaggaguucgag

SEQ ID NO: 1029967 - RNA, 22 nt, Human
uggcagaauaaugaaaaaagaa

SEQ ID NO: 1029968 - RNA, 24 nt, Human
uggcagaauaaugaaaaaagaauu

SEQ ID NO: 1029969 - RNA, 22 nt, Human
uggcucacgccuguaauaccag

SEQ ID NO: 1029970 - RNA, 24 nt, Human
uggcucacgccuguaauaccagca

SEQ ID NO: 1029971 - RNA, 22 nt, Human
uggcucacgucuguaaucccag

SEQ ID NO: 1029972 - RNA, 24 nt, Human
uggcucacgucuguaaucccagca

SEQ ID NO: 1029973 - RNA, 18 nt, Human
ugguggcucacgccugua

SEQ ID NO: 1029974 - RNA, 24 nt, Human
ugguggcucacgucuguaauccca

SEQ ID NO: 1029975 - RNA, 21 nt, Human
uggugggcaccuguaauccca

SEQ ID NO: 1029976 - RNA, 22 nt, Human
uggugggcaccuguaaucccag

SEQ ID NO: 1029977 - RNA, 22 nt, Human
uguaacaugacaacuaaauaug

SEQ ID NO: 1029978 - RNA, 18 nt, Human
ugugcccuuugucaaugu

SEQ ID NO: 1029979 - RNA, 22 nt, Human
uguuugaggaauauauaaucuu

SEQ ID NO: 1029980 - RNA, 18 nt, Human
uuagcugggcgugcuggu

SEQ ID NO: 1029981 - RNA, 24 nt, Human
uuagcugggcgugcuggugggcac

SEQ ID NO: 1029982 - RNA, 24 nt, Human
uuaggcugggcaugguggcucacg

SEQ ID NO: 1029983 - RNA, 24 nt, Human
uuuuaauaagcauuuaaaagaaac

SEQ ID NO: 1029984 - RNA, 19 nt, Human
uuuuuuuuuuuuuuuguga

SEQ ID NO: 1029985 - RNA, 18 nt, Human
uuuuuuuuuuuuuuuuug

SEQ ID NO: 1029986 - RNA, 19 nt, Human
uuuuuuuuuuuuuuuuugu

SEQ ID NO: 1029987 - RNA, 23 nt, Human
aagcaagagagaggcauguucag

SEQ ID NO: 1029988 - RNA, 22 nt, Human
gcaagagagaggcauguucaga

SEQ ID NO: 1029989 - RNA, 18 nt, Human
gcugguggacagaagaca

SEQ ID NO: 1029990 - RNA, 21 nt, Human
ggccugacuguggugcuggug

SEQ ID NO: 1029991 - RNA, 20 nt, Human
gggcuaagcaaaggagugug

SEQ ID NO: 1029992 - RNA, 20 nt, Human
ucagauuccagcugcuggua

SEQ ID NO: 1029993 - RNA, 23 nt, Human
ucucuccagcaggcaguggggac

SEQ ID NO: 1029994 - RNA, 19 nt, Human
ucugcgcucagcauuugga

SEQ ID NO: 1029995 - RNA, 23 nt, Human
uggaucugcgcucagcauuugga

SEQ ID NO: 1029996 - RNA, 20 nt, Human
aaacuacuauagcaaccaca

SEQ ID NO: 1029997 - RNA, 23 nt, Human
aauacaauaaugaaaaugguaga

SEQ ID NO: 1029998 - RNA, 21 nt, Human
guaaacuacuauagcaaccac

SEQ ID NO: 1029999 - RNA, 23 nt, Human
uacaauaaugaaaaugguagaac

SEQ ID NO: 1030000 - RNA, 19 nt, Human
ugcauagaagguuauaugg

SEQ ID NO: 1030001 - RNA, 21 nt, Human
ugcauagaagguuauauggaa

SEQ ID NO: 1030002 - RNA, 21 nt, Human
uuccguuucagagagaacagc

SEQ ID NO: 1030003 - RNA, 18 nt, Human
aagcuccugccugggggc

SEQ ID NO: 1030004 - RNA, 19 nt, Human
aagcuccugccugggggcc

SEQ ID NO: 1030005 - RNA, 27 nt, Human
acacugaaaagugggcagcuaggaagc

SEQ ID NO: 1030006 - RNA, 23 nt, Human
accaccaggaggaagugagggga

SEQ ID NO: 1030007 - RNA, 18 nt, Human
acggugccugcgccaggc

SEQ ID NO: 1030008 - RNA, 18 nt, Human
agagaagcagggaggcuu

SEQ ID NO: 1030009 - RNA, 19 nt, Human
agcagaacgcggacugccc

SEQ ID NO: 1030010 - RNA, 18 nt, Human
agccugccccggggcccu

SEQ ID NO: 1030011 - RNA, 19 nt, Human
agcggggacggagcagggg

SEQ ID NO: 1030012 - RNA, 18 nt, Human
agcucugauucagcagag

SEQ ID NO: 1030013 - RNA, 18 nt, Human
aggaaggggccugggggg

SEQ ID NO: 1030014 - RNA, 18 nt, Human
aggaaggggccugggggg

SEQ ID NO: 1030015 - RNA, 20 nt, Human
aggaggaagugaggggaggc

SEQ ID NO: 1030016 - RNA, 21 nt, Human
aggcaggagaggccggccugg

SEQ ID NO: 1030017 - RNA, 23 nt, Human
auggagaccgaggaccccuguag

SEQ ID NO: 1030018 - RNA, 21 nt, Human
cacugcuggggauagagagcc

SEQ ID NO: 1030019 - RNA, 21 nt, Human
cagaacgcggacugcccgggc

SEQ ID NO: 1030020 - RNA, 23 nt, Human
cagcccccagggucaugaggccc

SEQ ID NO: 1030021 - RNA, 20 nt, Human
cagccccuccaggcaccccu

SEQ ID NO: 1030022 - RNA, 19 nt, Human
cagcucugauucagcagag

SEQ ID NO: 1030023 - RNA, 20 nt, Human
caucacuggccaggauaggg

SEQ ID NO: 1030024 - RNA, 18 nt, Human
ccagagggcccggagggg

SEQ ID NO: 1030025 - RNA, 20 nt, Human
ccaggaggaagugaggggag

SEQ ID NO: 1030026 - RNA, 18 nt, Human
ccaggaggugggagcugc

SEQ ID NO: 1030027 - RNA, 23 nt, Human
ccaggcaccccuggaacgccaga

SEQ ID NO: 1030028 - RNA, 19 nt, Human
cccaggaagcgccagggag

SEQ ID NO: 1030029 - RNA, 20 nt, Human
ccccacccaggaagcgccag

SEQ ID NO: 1030030 - RNA, 18 nt, Human
cccccgcggcugcggccu

SEQ ID NO: 1030031 - RNA, 21 nt, Human
ccccggggcccugaggagccc

SEQ ID NO: 1030032 - RNA, 22 nt, Human
cccucugcccuccuguuaagag

SEQ ID NO: 1030033 - RNA, 18 nt, Human
cccugcccucugcccucc

SEQ ID NO: 1030034 - RNA, 21 nt, Human
cccuggaacgccagagggccc

SEQ ID NO: 1030035 - RNA, 25 nt, Human
ccgaggggggcagcccccagggucc

SEQ ID NO: 1030036 - RNA, 25 nt, Human
ccuccaggcaccccuggaacgccag

SEQ ID NO: 1030037 - RNA, 19 nt, Human
ccugagcacuucccagcaa

SEQ ID NO: 1030038 - RNA, 18 nt, Human
ccugccaggaggugggag

SEQ ID NO: 1030039 - RNA, 18 nt, Human
ccuggcucuggcugaggg

SEQ ID NO: 1030040 - RNA, 23 nt, Human
ccuggcucuggcugagggugggg

SEQ ID NO: 1030041 - RNA, 20 nt, Human
ccuguagagauaccccucca

SEQ ID NO: 1030042 - RNA, 20 nt, Human
cggacugcccgggcgccccc

SEQ ID NO: 1030043 - RNA, 22 nt, Human
cggccuggccaucuguccccag

SEQ ID NO: 1030044 - RNA, 21 nt, Human
cucugauucagcagagacaac

SEQ ID NO: 1030045 - RNA, 23 nt, Human
cucugauucagcagagacaacgg

SEQ ID NO: 1030046 - RNA, 21 nt, Human
cugcggccuccugacuccggg

SEQ ID NO: 1030047 - RNA, 22 nt, Human
cugcucauucagugcugggacc

SEQ ID NO: 1030048 - RNA, 21 nt, Human
cuggaagcugcucuggcccca

SEQ ID NO: 1030049 - RNA, 21 nt, Human
cugggggccuggcucuggcug

SEQ ID NO: 1030050 - RNA, 20 nt, Human
cuguccccugcccucugccc

SEQ ID NO: 1030051 - RNA, 21 nt, Human
cuguccccugcccucugcccu

SEQ ID NO: 1030052 - RNA, 25 nt, Human
cuuccuggaagcugcucuugggggc

SEQ ID NO: 1030053 - RNA, 20 nt, Human
gacaacgggaccaccaggag

SEQ ID NO: 1030054 - RNA, 23 nt, Human
gacaacgggaccaccaggaggaa

SEQ ID NO: 1030055 - RNA, 19 nt, Human
gagcacuucccagcaaugu

SEQ ID NO: 1030056 - RNA, 19 nt, Human
gaggggucucuucacuucc

SEQ ID NO: 1030057 - RNA, 20 nt, Human
gaggguggggcuggaaacac

SEQ ID NO: 1030058 - RNA, 20 nt, Human
gcagagacaacgggaccacc

SEQ ID NO: 1030059 - RNA, 24 nt, Human
gcccugaggagcccaggucggacc

SEQ ID NO: 1030060 - RNA, 19 nt, Human
gcgccccccgcggcugcgg

SEQ ID NO: 1030061 - RNA, 20 nt, Human
gcggacugcccgggcgcccc

SEQ ID NO: 1030062 - RNA, 19 nt, Human
ggaagggaggaaggggccu

SEQ ID NO: 1030063 - RNA, 24 nt, Human
ggaccucugggucgucuguccccu

SEQ ID NO: 1030064 - RNA, 18 nt, Human
ggagcagggguccccacc

SEQ ID NO: 1030065 - RNA, 18 nt, Human
ggcccggggggccggggg

SEQ ID NO: 1030066 - RNA, 24 nt, Human
ggcugaggguggggcuggaaacac

SEQ ID NO: 1030067 - RNA, 21 nt, Human
gggaaguagauggagaccgag

SEQ ID NO: 1030068 - RNA, 23 nt, Human
gggacuuugguuuccgcugcagg

SEQ ID NO: 1030069 - RNA, 18 nt, Human
gggaggaaggggccuggg

SEQ ID NO: 1030070 - RNA, 23 nt, Human
ggggaagggaggaaggggccugg

SEQ ID NO: 1030071 - RNA, 25 nt, Human
gggggacuuugguuuccgcugcagg

SEQ ID NO: 1030072 - RNA, 19 nt, Human
gggucgucuguccccugcc

SEQ ID NO: 1030073 - RNA, 23 nt, Human
ggguggccgagccacagagggcg

SEQ ID NO: 1030074 - RNA, 22 nt, Human
gucagccccuccaggcaccccu

SEQ ID NO: 1030075 - RNA, 24 nt, Human
guuaagagagcagucagccccucc

SEQ ID NO: 1030076 - RNA, 19 nt, Human
uaccuccugagcacuuccc

SEQ ID NO: 1030077 - RNA, 18 nt, Human
ucccagagaaagaugugg

SEQ ID NO: 1030078 - RNA, 21 nt, Human
ucccagagaaagauguggggc

SEQ ID NO: 1030079 - RNA, 24 nt, Human
uccucaggccucggcuaccuccug

SEQ ID NO: 1030080 - RNA, 18 nt, Human
ucgcugggaagcuccugc

SEQ ID NO: 1030081 - RNA, 21 nt, Human
ugccaggaggugggagcugcc

SEQ ID NO: 1030082 - RNA, 21 nt, Human
ugccccggggcccugaggagc

SEQ ID NO: 1030083 - RNA, 18 nt, Human
ugccugggggccuggcuc

SEQ ID NO: 1030084 - RNA, 24 nt, Human
ugccugggggccuggcucuggcug

SEQ ID NO: 1030085 - RNA, 20 nt, Human
ugcucuggccccagagaagc

SEQ ID NO: 1030086 - RNA, 21 nt, Human
uggaagcugcucuggccccag

SEQ ID NO: 1030087 - RNA, 25 nt, Human
uggauuuuggcaccguucucagcuc

SEQ ID NO: 1030088 - RNA, 19 nt, Human
uggccaggauagggggcgc

SEQ ID NO: 1030089 - RNA, 21 nt, Human
uggccaggauagggggcgcga

SEQ ID NO: 1030090 - RNA, 25 nt, Human
uggccaggggcuagucaagggucac

SEQ ID NO: 1030091 - RNA, 19 nt, Human
uggcucuggcugagggugg

SEQ ID NO: 1030092 - RNA, 21 nt, Human
uggcucuggcugagggugggg

SEQ ID NO: 1030093 - RNA, 19 nt, Human
uggggugcugauguccagc

SEQ ID NO: 1030094 - RNA, 26 nt, Human
ugguuuccgcugcaggggaggcugac

SEQ ID NO: 1030095 - RNA, 21 nt, Human
uguccccugcccucugcccuc

SEQ ID NO: 1030096 - RNA, 18 nt, Human
uguggggcacuggggaga

SEQ ID NO: 1030097 - RNA, 21 nt, Human
uguggggugcugauguccagc

SEQ ID NO: 1030098 - RNA, 21 nt, Human
uucagugcugggaccucuggg

SEQ ID NO: 1030099 - RNA, 18 nt, Human
uuccucaggccucggcua

SEQ ID NO: 1030100 - RNA, 21 nt, Human
uucguaacacugaaaaguggg

SEQ ID NO: 1030101 - RNA, 22 nt, Human
aaacaccucccgguguccaccc

SEQ ID NO: 1030102 - RNA, 19 nt, Human
aaccaggacagggaggagc

SEQ ID NO: 1030103 - RNA, 24 nt, Human
aaggugccucuggccucccugccc

SEQ ID NO: 1030104 - RNA, 27 nt, Human
aaguaacccaggcagccacacugaauu

SEQ ID NO: 1030105 - RNA, 24 nt, Human
aaugccccccucccuccuccaccc

SEQ ID NO: 1030106 - RNA, 20 nt, Human
acacugaauuccagcccagg

SEQ ID NO: 1030107 - RNA, 25 nt, Human
accaccccaaccccaggaaggagug

SEQ ID NO: 1030108 - RNA, 20 nt, Human
acccacucugccgcuccucu

SEQ ID NO: 1030109 - RNA, 19 nt, Human
acccaggaggcccccaagc

SEQ ID NO: 1030110 - RNA, 24 nt, Human
acccuggugacucacccagggcug

SEQ ID NO: 1030111 - RNA, 22 nt, Human
accugcacccuuuggcuucaac

SEQ ID NO: 1030112 - RNA, 24 nt, Human
agaaacccaggcccccuaggcacc

SEQ ID NO: 1030113 - RNA, 21 nt, Human
agaggacaagcccucggagca

SEQ ID NO: 1030114 - RNA, 22 nt, Human
agccugggcguccugcccucug

SEQ ID NO: 1030115 - RNA, 18 nt, Human
aggacagggaggagcagg

SEQ ID NO: 1030116 - RNA, 24 nt, Human
aggagcagggaccaggggcagagc

SEQ ID NO: 1030117 - RNA, 22 nt, Human
aggcccccaagccccaccccac

SEQ ID NO: 1030118 - RNA, 23 nt, Human
aggcccccagcacaggggaaaca

SEQ ID NO: 1030119 - RNA, 21 nt, Human
agggccauacggugggggugg

SEQ ID NO: 1030120 - RNA, 20 nt, Human
agggccgugggggcccaggg

SEQ ID NO: 1030121 - RNA, 23 nt, Human
auaguuccgggacucacaggcug

SEQ ID NO: 1030122 - RNA, 19 nt, Human
caccagggcaaccagcccc

SEQ ID NO: 1030123 - RNA, 19 nt, Human
caccaugcaggccuuugcu

SEQ ID NO: 1030124 - RNA, 21 nt, Human
cacccaggaggcccccaagcc

SEQ ID NO: 1030125 - RNA, 26 nt, Human
caccccagggacagccugaccccaaa

SEQ ID NO: 1030126 - RNA, 21 nt, Human
caccuccccuaccccacaccg

SEQ ID NO: 1030127 - RNA, 23 nt, Human
cacuccuggaccaccccaacccc

SEQ ID NO: 1030128 - RNA, 18 nt, Human
cacuuggggccaggcccc

SEQ ID NO: 1030129 - RNA, 22 nt, Human
cacuuugggaaaugccccuaag

SEQ ID NO: 1030130 - RNA, 21 nt, Human
cagaaacccaggcccccuagg

SEQ ID NO: 1030131 - RNA, 22 nt, Human
cagacaacccacucugccgcuc

SEQ ID NO: 1030132 - RNA, 19 nt, Human
cagacucccccaccugcac

SEQ ID NO: 1030133 - RNA, 26 nt, Human
cagccgcccuuccugcugucccacuc

SEQ ID NO: 1030134 - RNA, 22 nt, Human
cagccugggcguccugcccucu

SEQ ID NO: 1030135 - RNA, 20 nt, Human
caggaggcccccaagcccca

SEQ ID NO: 1030136 - RNA, 22 nt, Human
caggcagccacacugaauucca

SEQ ID NO: 1030137 - RNA, 19 nt, Human
cagggcaaccagccccggc

SEQ ID NO: 1030138 - RNA, 20 nt, Human
cagggcagagcagcagggcc

SEQ ID NO: 1030139 - RNA, 25 nt, Human
cagggcuggacaggaauggcugagg

SEQ ID NO: 1030140 - RNA, 21 nt, Human
caggggcucuggcuggguggg

SEQ ID NO: 1030141 - RNA, 24 nt, Human
cauacaaguaacccaggcagccac

SEQ ID NO: 1030142 - RNA, 21 nt, Human
caugcaggccuuugcuguggc

SEQ ID NO: 1030143 - RNA, 22 nt, Human
ccacagcccccggugacccaca

SEQ ID NO: 1030144 - RNA, 23 nt, Human
ccacagggcuggacaggaauggc

SEQ ID NO: 1030145 - RNA, 18 nt, Human
ccaggacagggaggagca

SEQ ID NO: 1030146 - RNA, 20 nt, Human
ccaggcagccacacugaauu

SEQ ID NO: 1030147 - RNA, 19 nt, Human
ccagggccgugggggccca

SEQ ID NO: 1030148 - RNA, 21 nt, Human
ccaucacagccgcccuuccug

SEQ ID NO: 1030149 - RNA, 22 nt, Human
cccagcuucuggccaaggcugg

SEQ ID NO: 1030150 - RNA, 22 nt, Human
cccaggacuguggaagaaggcc

SEQ ID NO: 1030151 - RNA, 23 nt, Human
cccaucagacaccaugcaggccu

SEQ ID NO: 1030152 - RNA, 24 nt, Human
cccauggcugacacaggccggggc

SEQ ID NO: 1030153 - RNA, 20 nt, Human
cccaugugacaacuaagggu

SEQ ID NO: 1030154 - RNA, 19 nt, Human
ccccaagccccaccccacc

SEQ ID NO: 1030155 - RNA, 21 nt, Human
ccccagggacagccugacccc

SEQ ID NO: 1030156 - RNA, 18 nt, Human
ccccauggcugacacagg

SEQ ID NO: 1030157 - RNA, 19 nt, Human
cccccaagccccaccccac

SEQ ID NO: 1030158 - RNA, 21 nt, Human
cccccaagccccaccccaccg

SEQ ID NO: 1030159 - RNA, 23 nt, Human
cccccaagccccaccccaccguc

SEQ ID NO: 1030160 - RNA, 26 nt, Human
ccccccucccuccuccacccccuucc

SEQ ID NO: 1030161 - RNA, 19 nt, Human
ccccuaggcaccagcggca

SEQ ID NO: 1030162 - RNA, 18 nt, Human
ccccucccuccuccaccc

SEQ ID NO: 1030163 - RNA, 20 nt, Human
cccuaccccacaccguuguc

SEQ ID NO: 1030164 - RNA, 22 nt, Human
cccuaggcaccagcggcagcuc

SEQ ID NO: 1030165 - RNA, 21 nt, Human
cccucccuccuccacccccuu

SEQ ID NO: 1030166 - RNA, 19 nt, Human
cccucuguccccacuuugg

SEQ ID NO: 1030167 - RNA, 28 nt, Human
cccuucagugcucccagcucccuggugc

SEQ ID NO: 1030168 - RNA, 20 nt, Human
ccucccggaccacauuagcc

SEQ ID NO: 1030169 - RNA, 21 nt, Human
ccuccuccacccccuuccugc

SEQ ID NO: 1030170 - RNA, 23 nt, Human
ccucuggccucccugcccagccc

SEQ ID NO: 1030171 - RNA, 26 nt, Human
ccugaaugcaccuccccuaccccaca

SEQ ID NO: 1030172 - RNA, 23 nt, Human
ccugaccccaaagcuccuggcau

SEQ ID NO: 1030173 - RNA, 18 nt, Human
ccugcccucuguccccac

SEQ ID NO: 1030174 - RNA, 18 nt, Human
ccugcccucuguccccac

SEQ ID NO: 1030175 - RNA, 21 nt, Human
ccugcggcagacaacccacuc

SEQ ID NO: 1030176 - RNA, 21 nt, Human
ccuggaccaccccaaccccag

SEQ ID NO: 1030177 - RNA, 24 nt, Human
ccuggaccaccccaaccccaggaa

SEQ ID NO: 1030178 - RNA, 21 nt, Human
ccuggcauuagggucacccac

SEQ ID NO: 1030179 - RNA, 20 nt, Human
ccugggcugagcucagugcu

SEQ ID NO: 1030180 - RNA, 22 nt, Human
ccugguuccugggcuggccugg

SEQ ID NO: 1030181 - RNA, 19 nt, Human
ccugugugcagggcagagc

SEQ ID NO: 1030182 - RNA, 21 nt, Human
cggaccacauuagccacagcc

SEQ ID NO: 1030183 - RNA, 20 nt, Human
cggacccuggugacucaccc

SEQ ID NO: 1030184 - RNA, 21 nt, Human
cucccuccuccacccccuucc

SEQ ID NO: 1030185 - RNA, 24 nt, Human
cuccuggcauuagggucacccacu

SEQ ID NO: 1030186 - RNA, 19 nt, Human
cugacacaggcacugcucc

SEQ ID NO: 1030187 - RNA, 22 nt, Human
cuggacaggaauggcugaggcc

SEQ ID NO: 1030188 - RNA, 18 nt, Human
cuggccacccaggaggcc

SEQ ID NO: 1030189 - RNA, 22 nt, Human
cuguggccaggaggggcagggc

SEQ ID NO: 1030190 - RNA, 27 nt, Human
cuucauauuggcaacaaacagcagcug

SEQ ID NO: 1030191 - RNA, 21 nt, Human
cuucgcagggaccaggcggcc

SEQ ID NO: 1030192 - RNA, 18 nt, Human
gacagcagcugggggugg

SEQ ID NO: 1030193 - RNA, 21 nt, Human
gacaggaauggcugaggccca

SEQ ID NO: 1030194 - RNA, 18 nt, Human
gacgaaggccugggcuga

SEQ ID NO: 1030195 - RNA, 24 nt, Human
gagcagcagggccgaggggauuga

SEQ ID NO: 1030196 - RNA, 21 nt, Human
gaguaacaagguuagaaggga

SEQ ID NO: 1030197 - RNA, 22 nt, Human
gcacaaccuggacccuacggug

SEQ ID NO: 1030198 - RNA, 21 nt, Human
gcagcuccaagggccccaugg

SEQ ID NO: 1030199 - RNA, 21 nt, Human
gcccagcacuccuggaccacc

SEQ ID NO: 1030200 - RNA, 22 nt, Human
gcccaggacuguggaagaaggc

SEQ ID NO: 1030201 - RNA, 22 nt, Human
gccuggaggcucaaggucauca

SEQ ID NO: 1030202 - RNA, 20 nt, Human
gccuggaguggacccuuccu

SEQ ID NO: 1030203 - RNA, 26 nt, Human
gcugucccacucuggccacccaggag

SEQ ID NO: 1030204 - RNA, 24 nt, Human
ggaccuccuccaugcccuuggcuu

SEQ ID NO: 1030205 - RNA, 23 nt, Human
ggagaagcacgagauggucucag

SEQ ID NO: 1030206 - RNA, 22 nt, Human
ggagagcccccagccugggcgu

SEQ ID NO: 1030207 - RNA, 21 nt, Human
ggaggcccccaagccccaccc

SEQ ID NO: 1030208 - RNA, 24 nt, Human
ggaguggggugaggcccagcuggg

SEQ ID NO: 1030209 - RNA, 21 nt, Human
ggcaacaaacagcagcuggga

SEQ ID NO: 1030210 - RNA, 18 nt, Human
ggcagccagggccguggg

SEQ ID NO: 1030211 - RNA, 18 nt, Human
ggcagcuccaagggcccc

SEQ ID NO: 1030212 - RNA, 19 nt, Human
ggcucaaggucaucauggg

SEQ ID NO: 1030213 - RNA, 20 nt, Human
ggcuugggggaacugagauc

SEQ ID NO: 1030214 - RNA, 22 nt, Human
gggacucacaggcuggcauuca

SEQ ID NO: 1030215 - RNA, 21 nt, Human
gggauugacacagcaacucug

SEQ ID NO: 1030216 - RNA, 24 nt, Human
gggcagagcagcagggccgagggg

SEQ ID NO: 1030217 - RNA, 22 nt, Human
gggcagccagggccgugggggc

SEQ ID NO: 1030218 - RNA, 24 nt, Human
gggcgcauacaaguaacccaggca

SEQ ID NO: 1030219 - RNA, 19 nt, Human
ggggagagcagggcaggga

SEQ ID NO: 1030220 - RNA, 19 nt, Human
ggggccugugugcagggca

SEQ ID NO: 1030221 - RNA, 18 nt, Human
ggucagcucaccccagcu

SEQ ID NO: 1030222 - RNA, 18 nt, Human
guccugcccucugucccc

SEQ ID NO: 1030223 - RNA, 21 nt, Human
guggggugaggcccagcuggg

SEQ ID NO: 1030224 - RNA, 20 nt, Human
uacccacauaguuccgggac

SEQ ID NO: 1030225 - RNA, 22 nt, Human
ucagcgagugcagcccauguca

SEQ ID NO: 1030226 - RNA, 21 nt, Human
ucagugcugugacaucagcca

SEQ ID NO: 1030227 - RNA, 21 nt, Human
uccauguugaaccugacuggg

SEQ ID NO: 1030228 - RNA, 20 nt, Human
ucccacucuggccacccagg

SEQ ID NO: 1030229 - RNA, 21 nt, Human
ucccacucuggccacccagga

SEQ ID NO: 1030230 - RNA, 19 nt, Human
uccgcagcgcugccuggcc

SEQ ID NO: 1030231 - RNA, 21 nt, Human
uccgcagcgcugccuggccuc

SEQ ID NO: 1030232 - RNA, 19 nt, Human
uccuggaccaccccaaccc

SEQ ID NO: 1030233 - RNA, 18 nt, Human
uccugggcuggccugguc

SEQ ID NO: 1030234 - RNA, 22 nt, Human
ucuccgcagcgcugccuggccu

SEQ ID NO: 1030235 - RNA, 23 nt, Human
ucugggucagcucaccccagcuu

SEQ ID NO: 1030236 - RNA, 21 nt, Human
ucuguccccacuuugggaaau

SEQ ID NO: 1030237 - RNA, 24 nt, Human
ucugugucuggcaggcaucgcuga

SEQ ID NO: 1030238 - RNA, 20 nt, Human
ugacacagcaacucuguccc

SEQ ID NO: 1030239 - RNA, 21 nt, Human
ugaccccaaagcuccuggcau

SEQ ID NO: 1030240 - RNA, 23 nt, Human
ugagaucucaggggugugcguca

SEQ ID NO: 1030241 - RNA, 19 nt, Human
ugagcucagugcugugaca

SEQ ID NO: 1030242 - RNA, 24 nt, Human
ugaggcugucagacaccagggcgg

SEQ ID NO: 1030243 - RNA, 23 nt, Human
ugcaccuccccuaccccacaccg

SEQ ID NO: 1030244 - RNA, 23 nt, Human
ugccgcuccucuccgcagcgcug

SEQ ID NO: 1030245 - RNA, 21 nt, Human
ugccggggcuccacacgugcc

SEQ ID NO: 1030246 - RNA, 19 nt, Human
ugccugggcagaaacccag

SEQ ID NO: 1030247 - RNA, 21 nt, Human
ugccugggcagaaacccaggc

SEQ ID NO: 1030248 - RNA, 21 nt, Human
ugcugucccacucuggccacc

SEQ ID NO: 1030249 - RNA, 21 nt, Human
ugcuguggccaggaggggcag

SEQ ID NO: 1030250 - RNA, 19 nt, Human
uggaaggagaggacaagcc

SEQ ID NO: 1030251 - RNA, 21 nt, Human
uggagcgccuaucaugccaaa

SEQ ID NO: 1030252 - RNA, 21 nt, Human
uggagggaccuccuccaugcc

SEQ ID NO: 1030253 - RNA, 18 nt, Human
uggcaagggccaaggacc

SEQ ID NO: 1030254 - RNA, 25 nt, Human
uggcaagggccaaggaccugcgacg

SEQ ID NO: 1030255 - RNA, 21 nt, Human
uggccucagcgagugcagccc

SEQ ID NO: 1030256 - RNA, 20 nt, Human
ugggagggggucagacuccc

SEQ ID NO: 1030257 - RNA, 20 nt, Human
ugggggccugugugcagggc

SEQ ID NO: 1030258 - RNA, 27 nt, Human
ugggggccugugugcaggggggacacc

SEQ ID NO: 1030259 - RNA, 18 nt, Human
ugguuccugggcuggccu

SEQ ID NO: 1030260 - RNA, 22 nt, Human
uguccacccaucagacaccaug

SEQ ID NO: 1030261 - RNA, 22 nt, Human
ugugcagggcagagcagcaggg

SEQ ID NO: 1030262 - RNA, 18 nt, Human
uguggagggaccuccucc

SEQ ID NO: 1030263 - RNA, 21 nt, Human
uugccccuuuguccuggagac

SEQ ID NO: 1030264 - RNA, 21 nt, Human
uugggggaacugagaucucag

SEQ ID NO: 1030265 - RNA, 18 nt, Human
cacgcugggagcuguaga

SEQ ID NO: 1030266 - RNA, 22 nt, Human
cauucuuaucccuagacuccgg

SEQ ID NO: 1030267 - RNA, 22 nt, Human
cccuagacuccggcaaguacuc

SEQ ID NO: 1030268 - RNA, 23 nt, Human
guagugcauucuuaucccuagac

SEQ ID NO: 1030269 - RNA, 24 nt, Human
uagaaaaggucacuggucucagau

SEQ ID NO: 1030270 - RNA, 22 nt, Human
uagugcauucuuaucccuagac

SEQ ID NO: 1030271 - RNA, 24 nt, Human
ucaaugcaugccaccagcucauca

SEQ ID NO: 1030272 - RNA, 18 nt, Human
ucagauggaaaugcagaa

SEQ ID NO: 1030273 - RNA, 21 nt, Human
uuggccaucuuggcuccuccc

SEQ ID NO: 1030274 - RNA, 19 nt, Human
uuguagugcauucuuaucc

SEQ ID NO: 1030275 - RNA, 24 nt, Human
uuuguagugcauucuuaucccuag

SEQ ID NO: 1030276 - RNA, 26 nt, Human
uuuguagugcauucuuaucccuagac

SEQ ID NO: 1030277 - RNA, 24 nt, Human
aaagugcuagaauuacaggcauga

SEQ ID NO: 1030278 - RNA, 22 nt, Human
aagcucuucucucuuagccucc

SEQ ID NO: 1030279 - RNA, 19 nt, Human
aaguagcugggacuacagg

SEQ ID NO: 1030280 - RNA, 20 nt, Human
aaguagcugggacuacaggu

SEQ ID NO: 1030281 - RNA, 24 nt, Human
aaguagcugggacuacagguaugc

SEQ ID NO: 1030282 - RNA, 26 nt, Human
aagugcuagaauuacaggcaugagcc

SEQ ID NO: 1030283 - RNA, 20 nt, Human
aauuacaggcaugagccacc

SEQ ID NO: 1030284 - RNA, 25 nt, Human
acucugucacccaggaugggguaca

SEQ ID NO: 1030285 - RNA, 18 nt, Human
agccaaacuuaccgugga

SEQ ID NO: 1030286 - RNA, 23 nt, Human
agccucagccucccaaguagcug

SEQ ID NO: 1030287 - RNA, 26 nt, Human
aggcaguguuaagaaucauuggggga

SEQ ID NO: 1030288 - RNA, 21 nt, Human
agggauccuccagccucagcc

SEQ ID NO: 1030289 - RNA, 24 nt, Human
aucauguugcucagacuggucuug

SEQ ID NO: 1030290 - RNA, 25 nt, Human
aucauguugcucagacuggucuuga

SEQ ID NO: 1030291 - RNA, 19 nt, Human
auggggucucaucauguug

SEQ ID NO: 1030292 - RNA, 24 nt, Human
caaagugcuagaauuacaggcaug

SEQ ID NO: 1030293 - RNA, 21 nt, Human
caacagcuaaggccaagccaa

SEQ ID NO: 1030294 - RNA, 22 nt, Human
caagcucuucucucuuagccuc

SEQ ID NO: 1030295 - RNA, 20 nt, Human
caccaugucuggcuaauucu

SEQ ID NO: 1030296 - RNA, 22 nt, Human
caccaugucuggcuaauucuua

SEQ ID NO: 1030297 - RNA, 25 nt, Human
cagccucagccucccaaguagcugg

SEQ ID NO: 1030298 - RNA, 21 nt, Human
caggucuccugcaacagcuaa

SEQ ID NO: 1030299 - RNA, 20 nt, Human
cauguugcucagacuggucu

SEQ ID NO: 1030300 - RNA, 24 nt, Human
cauguugcucagacuggucuugaa

SEQ ID NO: 1030301 - RNA, 25 nt, Human
cauuuuuguccuggaaucagucaaa

SEQ ID NO: 1030302 - RNA, 24 nt, Human
ccaaagugcuagaauuacaggcau

SEQ ID NO: 1030303 - RNA, 23 nt, Human
cccaaguagcugggacuacaggu

SEQ ID NO: 1030304 - RNA, 24 nt, Human
cccaaguagcugggacuacaggua

SEQ ID NO: 1030305 - RNA, 26 nt, Human
ccuccagccucagccucccaaguagc

SEQ ID NO: 1030306 - RNA, 21 nt, Human
ccuggaaucagucaaagauga

SEQ ID NO: 1030307 - RNA, 20 nt, Human
ccuggguucaagggauccuc

SEQ ID NO: 1030308 - RNA, 23 nt, Human
cgugaucaaagcucacugcugcc

SEQ ID NO: 1030309 - RNA, 24 nt, Human
cucagccucccaaguagcugggac

SEQ ID NO: 1030310 - RNA, 24 nt, Human
cuccagccucagccucccaaguag

SEQ ID NO: 1030311 - RNA, 25 nt, Human
cuccagccucagccucccaaguagc

SEQ ID NO: 1030312 - RNA, 19 nt, Human
cugcugccuucaauuccug

SEQ ID NO: 1030313 - RNA, 18 nt, Human
cuuuucuucuucuucuuu

SEQ ID NO: 1030314 - RNA, 23 nt, Human
gaauuacaggcaugagccaccug

SEQ ID NO: 1030315 - RNA, 24 nt, Human
gacuacagguaugcaccaccaugu

SEQ ID NO: 1030316 - RNA, 20 nt, Human
gagauggggucucaucaugu

SEQ ID NO: 1030317 - RNA, 22 nt, Human
gauccuccagccucagccuccc

SEQ ID NO: 1030318 - RNA, 24 nt, Human
ggacuacagguaugcaccaccaug

SEQ ID NO: 1030319 - RNA, 22 nt, Human
ggauccuccagccucagccucc

SEQ ID NO: 1030320 - RNA, 23 nt, Human
ggcagggugggcccucauggggc

SEQ ID NO: 1030321 - RNA, 23 nt, Human
gggggguaaggcaguguuaagaa

SEQ ID NO: 1030322 - RNA, 22 nt, Human
ggggucucaucauguugcucag

SEQ ID NO: 1030323 - RNA, 21 nt, Human
gguacaguggcgugaucaaag

SEQ ID NO: 1030324 - RNA, 24 nt, Human
gguacaguggcgugaucaaagcuc

SEQ ID NO: 1030325 - RNA, 22 nt, Human
guagagauggggucucaucaug

SEQ ID NO: 1030326 - RNA, 18 nt, Human
gugaucaaagcucacugc

SEQ ID NO: 1030327 - RNA, 22 nt, Human
gugaucaaagcucacugcugcc

SEQ ID NO: 1030328 - RNA, 28 nt, Human
uaaggcagaguucacaggucuccugcaa

SEQ ID NO: 1030329 - RNA, 22 nt, Human
uaaggcaguguuaagaaucauu

SEQ ID NO: 1030330 - RNA, 18 nt, Human
uacagguaugcaccacca

SEQ ID NO: 1030331 - RNA, 21 nt, Human
uagaauuacaggcaugagcca

SEQ ID NO: 1030332 - RNA, 24 nt, Human
uagaauuacaggcaugagccaccu

SEQ ID NO: 1030333 - RNA, 26 nt, Human
uagaauuacaggcaugagccaccugg

SEQ ID NO: 1030334 - RNA, 25 nt, Human
ucaagcucuucucucuuagccuccu

SEQ ID NO: 1030335 - RNA, 24 nt, Human
ucacaggucuccugcaacagcuaa

SEQ ID NO: 1030336 - RNA, 18 nt, Human
ucagccucccaaguagcu

SEQ ID NO: 1030337 - RNA, 20 nt, Human
ucagccucccaaguagcugg

SEQ ID NO: 1030338 - RNA, 24 nt, Human
ucccaaagugcuagaauuacaggc

SEQ ID NO: 1030339 - RNA, 24 nt, Human
ucccaaguagcugggacuacaggu

SEQ ID NO: 1030340 - RNA, 19 nt, Human
uccuccagccucagccucc

SEQ ID NO: 1030341 - RNA, 18 nt, Human
uccuggguucaagggauc

SEQ ID NO: 1030342 - RNA, 24 nt, Human
uccuggguucaagggauccuccag

SEQ ID NO: 1030343 - RNA, 20 nt, Human
ucucacucugucacccagga

SEQ ID NO: 1030344 - RNA, 24 nt, Human
ucucacucugucacccaggauggg

SEQ ID NO: 1030345 - RNA, 25 nt, Human
ucucacucugucacccaggaugggg

SEQ ID NO: 1030346 - RNA, 26 nt, Human
ucucacucugucacccaggauggggu

SEQ ID NO: 1030347 - RNA, 19 nt, Human
ucuccugcaacagcuaagg

SEQ ID NO: 1030348 - RNA, 20 nt, Human
ucuccugcaacagcuaaggc

SEQ ID NO: 1030349 - RNA, 21 nt, Human
ucucucuuagccucccaaagu

SEQ ID NO: 1030350 - RNA, 23 nt, Human
ucucuuagccucccaaagugcua

SEQ ID NO: 1030351 - RNA, 23 nt, Human
ucuugaacuccugagcucaagcu

SEQ ID NO: 1030352 - RNA, 21 nt, Human
ugagaaagugaguccccuacc

SEQ ID NO: 1030353 - RNA, 21 nt, Human
ugcggaggugcaggcagggug

SEQ ID NO: 1030354 - RNA, 24 nt, Human
ugcucagacuggucuugaacuccu

SEQ ID NO: 1030355 - RNA, 21 nt, Human
ugggacuacagguaugcacca

SEQ ID NO: 1030356 - RNA, 24 nt, Human
ugggacuacagguaugcaccacca

SEQ ID NO: 1030357 - RNA, 19 nt, Human
ugggguacaguggcgugau

SEQ ID NO: 1030358 - RNA, 19 nt, Human
ugggguacaguggcgugau

SEQ ID NO: 1030359 - RNA, 28 nt, Human
ugggguacaguggcgugauggcucuagc

SEQ ID NO: 1030360 - RNA, 18 nt, Human
uggggucucaucauguug

SEQ ID NO: 1030361 - RNA, 24 nt, Human
uguagagauggggucucaucaugu

SEQ ID NO: 1030362 - RNA, 21 nt, Human
uguuaagaaucauuggggcug

SEQ ID NO: 1030363 - RNA, 20 nt, Human
uguugcucagacuggucuug

SEQ ID NO: 1030364 - RNA, 20 nt, Human
uuaaauuuuuuguagagaug

SEQ ID NO: 1030365 - RNA, 22 nt, Human
uuagccucccaaagugcuagaa

SEQ ID NO: 1030366 - RNA, 26 nt, Human
uucuucuucuucuuuuuuuuuuaaga

SEQ ID NO: 1030367 - RNA, 23 nt, Human
uugagggggucucacucugucac

SEQ ID NO: 1030368 - RNA, 24 nt, Human
uuguagagauggggucucaucaug

SEQ ID NO: 1030369 - RNA, 18 nt, Human
uuuguagagauggggucu

SEQ ID NO: 1030370 - RNA, 21 nt, Human
uuuguagagauggggucucau

SEQ ID NO: 1030371 - RNA, 24 nt, Human
uuuguagagauggggucucaucau

SEQ ID NO: 1030372 - RNA, 25 nt, Human
uuuuucuuuuuugagggggucucaa

SEQ ID NO: 1030373 - RNA, 24 nt, Human
uuuuuuguagagauggggucucau

SEQ ID NO: 1030374 - RNA, 21 nt, Human
aagccagcauuucuuguuuga

SEQ ID NO: 1030375 - RNA, 23 nt, Human
aagccagcauuucuuguuugaua

SEQ ID NO: 1030376 - RNA, 25 nt, Human
aagcgauucuccugccucagccucc

SEQ ID NO: 1030377 - RNA, 19 nt, Human
aaguagcugggacuacagg

SEQ ID NO: 1030378 - RNA, 20 nt, Human
aaguagcugggacuacaggc

SEQ ID NO: 1030379 - RNA, 25 nt, Human
aaguagcugggacuacaggcacaug

SEQ ID NO: 1030380 - RNA, 24 nt, Human
acagugcugggauuacaggcauga

SEQ ID NO: 1030381 - RNA, 22 nt, Human
accucuaccucuugggcucaag

SEQ ID NO: 1030382 - RNA, 21 nt, Human
acuaagcguaaauuucucaag

SEQ ID NO: 1030383 - RNA, 25 nt, Human
acucuguugcccagacuggagugca

SEQ ID NO: 1030384 - RNA, 20 nt, Human
agccaccgggccaagccagc

SEQ ID NO: 1030385 - RNA, 23 nt, Human
agugcaguggcgcgaucuuggcu

SEQ ID NO: 1030386 - RNA, 24 nt, Human
agugcaguggcgcgaucuuggcuc

SEQ ID NO: 1030387 - RNA, 18 nt, Human
agugcugggauuacaggc

SEQ ID NO: 1030388 - RNA, 21 nt, Human
agugcugggauuacaggcaug

SEQ ID NO: 1030389 - RNA, 22 nt, Human
agugcugggauuacaggcauga

SEQ ID NO: 1030390 - RNA, 18 nt, Human
augagccaccgggccaag

SEQ ID NO: 1030391 - RNA, 19 nt, Human
augagccaccgggccaagc

SEQ ID NO: 1030392 - RNA, 22 nt, Human
caaccucuaccucuugggcuca

SEQ ID NO: 1030393 - RNA, 23 nt, Human
caaccucuaccucuugggcucaa

SEQ ID NO: 1030394 - RNA, 22 nt, Human
caagcgauucuccugccucagc

SEQ ID NO: 1030395 - RNA, 23 nt, Human
cacucuguugcccagacuggagu

SEQ ID NO: 1030396 - RNA, 24 nt, Human
cacucuguugcccagacuggagug

SEQ ID NO: 1030397 - RNA, 23 nt, Human
cacugcaaccucuaccucuuggg

SEQ ID NO: 1030398 - RNA, 25 nt, Human
cagugcugggauuacaggcaugagc

SEQ ID NO: 1030399 - RNA, 19 nt, Human
caguggcgcgaucuuggcu

SEQ ID NO: 1030400 - RNA, 23 nt, Human
ccacagugcugggauuacaggca

SEQ ID NO: 1030401 - RNA, 24 nt, Human
ccacagugcugggauuacaggcau

SEQ ID NO: 1030402 - RNA, 22 nt, Human
ccaugcccggccaauuuuuuga

SEQ ID NO: 1030403 - RNA, 23 nt, Human
cccaaguagcugggacuacaggc

SEQ ID NO: 1030404 - RNA, 24 nt, Human
cccaaguagcugggacuacaggca

SEQ ID NO: 1030405 - RNA, 22 nt, Human
cccccaccguggucucccacag

SEQ ID NO: 1030406 - RNA, 24 nt, Human
ccucuugggcucaagcgauucucc

SEQ ID NO: 1030407 - RNA, 23 nt, Human
ccugccucagccucccaaguagc

SEQ ID NO: 1030408 - RNA, 20 nt, Human
ccugggcucaagggauuccc

SEQ ID NO: 1030409 - RNA, 24 nt, Human
cuauggagcugcuuucugcuggcc

SEQ ID NO: 1030410 - RNA, 24 nt, Human
cucaagcgauucuccugccucagc

SEQ ID NO: 1030411 - RNA, 19 nt, Human
cucaagggauucccccacc

SEQ ID NO: 1030412 - RNA, 25 nt, Human
cucaagggauucccccaccgugguc

SEQ ID NO: 1030413 - RNA, 24 nt, Human
cucacugcaaccucuaccucuugg

SEQ ID NO: 1030414 - RNA, 24 nt, Human
cucagccucccaaguagcugggac

SEQ ID NO: 1030415 - RNA, 21 nt, Human
cuccugggcucaagggauucc

SEQ ID NO: 1030416 - RNA, 24 nt, Human
cugcaaccucuaccucuugggcuc

SEQ ID NO: 1030417 - RNA, 23 nt, Human
cugccucagccucccaaguagcu

SEQ ID NO: 1030418 - RNA, 24 nt, Human
gacuacaggcacaugccaccaugc

SEQ ID NO: 1030419 - RNA, 18 nt, Human
gauuacaggcaugagcca

SEQ ID NO: 1030420 - RNA, 20 nt, Human
gauuacaggcaugagccacc

SEQ ID NO: 1030421 - RNA, 21 nt, Human
gauuacaggcaugagccaccg

SEQ ID NO: 1030422 - RNA, 21 nt, Human
gauucuccugccucagccucc

SEQ ID NO: 1030423 - RNA, 20 nt, Human
gcccagacuggagugcagug

SEQ ID NO: 1030424 - RNA, 24 nt, Human
gcgauucuccugccucagccuccc

SEQ ID NO: 1030425 - RNA, 21 nt, Human
gcucacugcaaccucuaccuc

SEQ ID NO: 1030426 - RNA, 22 nt, Human
ggauuacaggcaugagccaccg

SEQ ID NO: 1030427 - RNA, 20 nt, Human
gggcucaagcgauucuccug

SEQ ID NO: 1030428 - RNA, 22 nt, Human
gggcucaagcgauucuccugcc

SEQ ID NO: 1030429 - RNA, 23 nt, Human
uacaggcacaugccaccaugccc

SEQ ID NO: 1030430 - RNA, 24 nt, Human
uaguagaaaugggguguugugaug

SEQ ID NO: 1030431 - RNA, 23 nt, Human
ucacugcaaccucuaccucuugg

SEQ ID NO: 1030432 - RNA, 24 nt, Human
ucacugcaaccucuaccucuuggg

SEQ ID NO: 1030433 - RNA, 20 nt, Human
ucagccucccaaguagcugg

SEQ ID NO: 1030434 - RNA, 24 nt, Human
ucccaaguagcugggacuacaggc

SEQ ID NO: 1030435 - RNA, 24 nt, Human
ucccacagugcugggauuacaggc

SEQ ID NO: 1030436 - RNA, 19 nt, Human
uccugggcucaagggauuc

SEQ ID NO: 1030437 - RNA, 20 nt, Human
ucuaguuuguaugagcaaag

SEQ ID NO: 1030438 - RNA, 19 nt, Human
ucucaaggaucagcugguu

SEQ ID NO: 1030439 - RNA, 24 nt, Human
ucucacucuguugcccagacugga

SEQ ID NO: 1030440 - RNA, 26 nt, Human
ucucacucuguugcccagacuggagu

SEQ ID NO: 1030441 - RNA, 27 nt, Human
ucucacucuguugcccagacuggagug

SEQ ID NO: 1030442 - RNA, 22 nt, Human
ucuccaacuccugggcucaagg

SEQ ID NO: 1030443 - RNA, 26 nt, Human
ucuccugccucagccucccaaguagc

SEQ ID NO: 1030444 - RNA, 24 nt, Human
ucuguugcccagacuggagugcag

SEQ ID NO: 1030445 - RNA, 22 nt, Human
ucuugggcucaagcgauucucc

SEQ ID NO: 1030446 - RNA, 24 nt, Human
ucuugggcucaagcgauucuccug

SEQ ID NO: 1030447 - RNA, 19 nt, Human
ugacccaagagcgagaugg

SEQ ID NO: 1030448 - RNA, 20 nt, Human
ugagacagggucucacucug

SEQ ID NO: 1030449 - RNA, 22 nt, Human
ugagacagggucucacucuguu

SEQ ID NO: 1030450 - RNA, 22 nt, Human
ugagauccugcguggcucuccc

SEQ ID NO: 1030451 - RNA, 21 nt, Human
ugcccagacuggagugcagug

SEQ ID NO: 1030452 - RNA, 24 nt, Human
ugcccagacuggagugcaguggcg

SEQ ID NO: 1030453 - RNA, 23 nt, Human
ugcccggccaauuuuuugauuau

SEQ ID NO: 1030454 - RNA, 24 nt, Human
ugccucagccucccaaguagcugg

SEQ ID NO: 1030455 - RNA, 23 nt, Human
uggagugcaguggcgcgaucuug

SEQ ID NO: 1030456 - RNA, 24 nt, Human
uggagugcaguggcgcgaucuugg

SEQ ID NO: 1030457 - RNA, 22 nt, Human
uggccaggcaugacccaagagc

SEQ ID NO: 1030458 - RNA, 21 nt, Human
ugggacuacaggcacaugcca

SEQ ID NO: 1030459 - RNA, 22 nt, Human
ugggacuacaggcacaugccac

SEQ ID NO: 1030460 - RNA, 24 nt, Human
ugggacuacaggcacaugccacca

SEQ ID NO: 1030461 - RNA, 25 nt, Human
ugggacuacaggcacaugccaccau

SEQ ID NO: 1030462 - RNA, 18 nt, Human
ugggauuacaggcaugag

SEQ ID NO: 1030463 - RNA, 19 nt, Human
ugggauuacaggcaugagc

SEQ ID NO: 1030464 - RNA, 22 nt, Human
ugggauuacaggcaugagccac

SEQ ID NO: 1030465 - RNA, 23 nt, Human
ugggauuacaggcaugagccacc

SEQ ID NO: 1030466 - RNA, 24 nt, Human
ugggauuacaggcaugagccaccg

SEQ ID NO: 1030467 - RNA, 26 nt, Human
ugggauuacaggcaugagccaccggg

SEQ ID NO: 1030468 - RNA, 27 nt, Human
ugggauuacaggcaugagccaccgggc

SEQ ID NO: 1030469 - RNA, 24 nt, Human
ugggcucaagcgauucuccugccu

SEQ ID NO: 1030470 - RNA, 21 nt, Human
uuaguagaaaugggguguugu

SEQ ID NO: 1030471 - RNA, 19 nt, Human
uucccccaccguggucucc

SEQ ID NO: 1030472 - RNA, 22 nt, Human
uugagacagggucucacucugu

SEQ ID NO: 1030473 - RNA, 19 nt, Human
acaguccugggaaacaggg

SEQ ID NO: 1030474 - RNA, 22 nt, Human
ccaaagugcagcugagguccug

SEQ ID NO: 1030475 - RNA, 25 nt, Human
cgccggaagaaggggcuugggccuc

SEQ ID NO: 1030476 - RNA, 18 nt, Human
gaaccugggcccaguccc

SEQ ID NO: 1030477 - RNA, 19 nt, Human
gaucccgagggucuggagc

SEQ ID NO: 1030478 - RNA, 19 nt, Human
ggaaccugggcccaguccc

SEQ ID NO: 1030479 - RNA, 24 nt, Human
ggggcggggaccagaagguucugg

SEQ ID NO: 1030480 - RNA, 21 nt, Human
ugaacuguaaacggagauccc

SEQ ID NO: 1030481 - RNA, 18 nt, Human
uggcugaggcggacgaug

SEQ ID NO: 1030482 - RNA, 22 nt, Human
ugggaaccugggcccaguccca

SEQ ID NO: 1030483 - RNA, 19 nt, Human
ugucacaguuucauuuaca

SEQ ID NO: 1030484 - RNA, 18 nt, Human
acuugggucucgugcuuu

SEQ ID NO: 1030485 - RNA, 18 nt, Human
agcagcccucugugccuc

SEQ ID NO: 1030486 - RNA, 23 nt, Human
agccacaguuaccgccgcggucc

SEQ ID NO: 1030487 - RNA, 21 nt, Human
cauccugcucugaccgcucca

SEQ ID NO: 1030488 - RNA, 27 nt, Human
ccucuguagguccacagagauggagac

SEQ ID NO: 1030489 - RNA, 20 nt, Human
cuuccuggccuggucucugg

SEQ ID NO: 1030490 - RNA, 19 nt, Human
gugcucuccaucucgggcc

SEQ ID NO: 1030491 - RNA, 25 nt, Human
uagugcucuccaucucgggccuucc

SEQ ID NO: 1030492 - RNA, 22 nt, Human
uccuggccuggucucugggaag

SEQ ID NO: 1030493 - RNA, 22 nt, Human
ucgggccuuccuggccuggucu

SEQ ID NO: 1030494 - RNA, 20 nt, Human
ucucugggaagauaaggguc

SEQ ID NO: 1030495 - RNA, 21 nt, Human
ucugugccucuguagguccac

SEQ ID NO: 1030496 - RNA, 24 nt, Human
ugagcagcccucugugccucugua

SEQ ID NO: 1030497 - RNA, 21 nt, Human
ugugagcagcccucugugccu

SEQ ID NO: 1030498 - RNA, 19 nt, Human
uuaaauaaaaacaugaaag

SEQ ID NO: 1030499 - RNA, 21 nt, Human
uuaaauaaaaacaugaaagcc

SEQ ID NO: 1030500 - RNA, 22 nt, Human
aaaccaaggcacaaagaaggga

SEQ ID NO: 1030501 - RNA, 22 nt, Human
aagaaggacaaggaaaaccaag

SEQ ID NO: 1030502 - RNA, 19 nt, Human
aaggggcugaguggggcug

SEQ ID NO: 1030503 - RNA, 20 nt, Human
aaugagaagacaagcagaga

SEQ ID NO: 1030504 - RNA, 18 nt, Human
acaaagaagggaccuagg

SEQ ID NO: 1030505 - RNA, 20 nt, Human
acaaagaagggaccuaggcg

SEQ ID NO: 1030506 - RNA, 23 nt, Human
accaccaaguccaaaugagaaga

SEQ ID NO: 1030507 - RNA, 25 nt, Human
accccagaacucaccacggacacac

SEQ ID NO: 1030508 - RNA, 18 nt, Human
acuaaggcaaaaaguaaa

SEQ ID NO: 1030509 - RNA, 23 nt, Human
acuacaacccucugaguguggcu

SEQ ID NO: 1030510 - RNA, 21 nt, Human
acucaccacggacacacagca

SEQ ID NO: 1030511 - RNA, 24 nt, Human
agacaggacgaaccaccaagucca

SEQ ID NO: 1030512 - RNA, 21 nt, Human
aggaaaaccaaggcacaaaga

SEQ ID NO: 1030513 - RNA, 27 nt, Human
aggcaaaaaguaaaaagaaggacaagg

SEQ ID NO: 1030514 - RNA, 18 nt, Human
agggcuaagaggaggagc

SEQ ID NO: 1030515 - RNA, 22 nt, Human
caaaaaguaaaaagaaggacaa

SEQ ID NO: 1030516 - RNA, 20 nt, Human
caauacuaaggcaaaaagua

SEQ ID NO: 1030517 - RNA, 22 nt, Human
caccccagaacucaccacggac

SEQ ID NO: 1030518 - RNA, 21 nt, Human
cagagggcuucucuucauauc

SEQ ID NO: 1030519 - RNA, 19 nt, Human
ccccagaacucaccacgga

SEQ ID NO: 1030520 - RNA, 26 nt, Human
cuaaggcaaaaaguaaaaagaaggac

SEQ ID NO: 1030521 - RNA, 20 nt, Human
cucacaggcaaaggaggcag

SEQ ID NO: 1030522 - RNA, 18 nt, Human
cuggcgcggcagccccuc

SEQ ID NO: 1030523 - RNA, 20 nt, Human
gaaaaccaaggcacaaagaa

SEQ ID NO: 1030524 - RNA, 23 nt, Human
gaagaaggggcugaguggggcug

SEQ ID NO: 1030525 - RNA, 21 nt, Human
gaaggacaaggaaaaccaagg

SEQ ID NO: 1030526 - RNA, 21 nt, Human
gaaggggcugaguggggcugu

SEQ ID NO: 1030527 - RNA, 21 nt, Human
gacguagugucagaccaggag

SEQ ID NO: 1030528 - RNA, 23 nt, Human
gagguggacaacuacuacaaccc

SEQ ID NO: 1030529 - RNA, 23 nt, Human
ggacaaggcugacugucuuuugg

SEQ ID NO: 1030530 - RNA, 20 nt, Human
gggagaggagucagaggcug

SEQ ID NO: 1030531 - RNA, 23 nt, Human
gggcuguccagagguggacaacu

SEQ ID NO: 1030532 - RNA, 22 nt, Human
uaaggcaaaaaguaaaaagaag

SEQ ID NO: 1030533 - RNA, 25 nt, Human
uacaacccucugaguguggcugccu

SEQ ID NO: 1030534 - RNA, 18 nt, Human
uagugaagaaggggcuga

SEQ ID NO: 1030535 - RNA, 21 nt, Human
ucaccacggacacacagcaga

SEQ ID NO: 1030536 - RNA, 21 nt, Human
uccaaaugagaagacaagcag

SEQ ID NO: 1030537 - RNA, 18 nt, Human
uccuuugaggggagagga

SEQ ID NO: 1030538 - RNA, 18 nt, Human
ugagaagacaagcagaga

SEQ ID NO: 1030539 - RNA, 25 nt, Human
ugagacaggacgaaccaccaagucc

SEQ ID NO: 1030540 - RNA, 26 nt, Human
ugagacaggacgaaccaccaagucca

SEQ ID NO: 1030541 - RNA, 19 nt, Human
ugaggacaaggcugacugu

SEQ ID NO: 1030542 - RNA, 20 nt, Human
ugaggacaaggcugacuguc

SEQ ID NO: 1030543 - RNA, 19 nt, Human
aaacaggaaagcucccaag

SEQ ID NO: 1030544 - RNA, 23 nt, Human
accauuuacaaaugcuguuuguu

SEQ ID NO: 1030545 - RNA, 20 nt, Human
agaccauuuacaaaugcugu

SEQ ID NO: 1030546 - RNA, 18 nt, Human
augaaggcuaauagacca

SEQ ID NO: 1030547 - RNA, 22 nt, Human
caggaaagcucccaagaauuga

SEQ ID NO: 1030548 - RNA, 21 nt, Human
ccacgcuccacacucugcacc

SEQ ID NO: 1030549 - RNA, 23 nt, Human
cuccacacucugcaccucgugcc

SEQ ID NO: 1030550 - RNA, 19 nt, Human
gcuccacacucugcaccuc

SEQ ID NO: 1030551 - RNA, 22 nt, Human
ggcaaccagagcccccuggagc

SEQ ID NO: 1030552 - RNA, 19 nt, Human
uaagaucacauauuugcca

SEQ ID NO: 1030553 - RNA, 25 nt, Human
uaccagauguuuauagauggauagu

SEQ ID NO: 1030554 - RNA, 19 nt, Human
uaguccuuauaaauuuaag

SEQ ID NO: 1030555 - RNA, 22 nt, Human
uauuaaacaggaaagcucccaa

SEQ ID NO: 1030556 - RNA, 18 nt, Human
ucucucuggcuaggaccg

SEQ ID NO: 1030557 - RNA, 19 nt, Human
ucuggcuaggaccgcacug

SEQ ID NO: 1030558 - RNA, 18 nt, Human
ugaaugcguacgagccau

SEQ ID NO: 1030559 - RNA, 19 nt, Human
uggagcugccugugugcac

SEQ ID NO: 1030560 - RNA, 24 nt, Human
uggcaaauguccuuucucucuggc

SEQ ID NO: 1030561 - RNA, 19 nt, Human
uuuauagauggauaguccu

SEQ ID NO: 1030562 - RNA, 18 nt, Human
uuuuuuuuuuuuuuuuug

SEQ ID NO: 1030563 - RNA, 22 nt, Human
uuuuuuuuuuuuuuuuugcagg

SEQ ID NO: 1030564 - RNA, 23 nt, Human
uuuuuuuuuuuuuuuuugcaggu

SEQ ID NO: 1030565 - RNA, 20 nt, Human
aaccccacuccucuccucca

SEQ ID NO: 1030566 - RNA, 23 nt, Human
aaccucugggcucaagcgauccu

SEQ ID NO: 1030567 - RNA, 24 nt, Human
aagcgauccucccgccuuggccuc

SEQ ID NO: 1030568 - RNA, 25 nt, Human
aagcgauccucccgccuuggccucc

SEQ ID NO: 1030569 - RNA, 18 nt, Human
aagugcugggauuacagg

SEQ ID NO: 1030570 - RNA, 19 nt, Human
aagugcugggauuacaggc

SEQ ID NO: 1030571 - RNA, 19 nt, Human
aagugcugggauuacaggc

SEQ ID NO: 1030572 - RNA, 24 nt, Human
accacaccgggcuaacuuuuaauu

SEQ ID NO: 1030573 - RNA, 22 nt, Human
accccacuccucuccuccaccc

SEQ ID NO: 1030574 - RNA, 24 nt, Human
accccacuccucuccuccacccua

SEQ ID NO: 1030575 - RNA, 19 nt, Human
acucucuugcccagguuga

SEQ ID NO: 1030576 - RNA, 18 nt, Human
agugcugggauuacaggc

SEQ ID NO: 1030577 - RNA, 27 nt, Human
caagcgauccucccgccuuggccuccc

SEQ ID NO: 1030578 - RNA, 19 nt, Human
caagugcugggauuacagg

SEQ ID NO: 1030579 - RNA, 21 nt, Human
cacaccgggcuaacuuuuaau

SEQ ID NO: 1030580 - RNA, 24 nt, Human
cagggucucacucucuugcccagg

SEQ ID NO: 1030581 - RNA, 24 nt, Human
caucaacaaaccccacuccucucc

SEQ ID NO: 1030582 - RNA, 21 nt, Human
ccaagugcugggauuacaggc

SEQ ID NO: 1030583 - RNA, 21 nt, Human
ccaagugcugggauuacaggc

SEQ ID NO: 1030584 - RNA, 23 nt, Human
ccaagugcugggauuacaggcgu

SEQ ID NO: 1030585 - RNA, 24 nt, Human
ccaagugcugggauuacaggcgug

SEQ ID NO: 1030586 - RNA, 22 nt, Human
cccaagugcugggauuacaggc

SEQ ID NO: 1030587 - RNA, 24 nt, Human
cccaagugcugggauuacaggcgu

SEQ ID NO: 1030588 - RNA, 19 nt, Human
cccacuccucuccuccacc

SEQ ID NO: 1030589 - RNA, 23 nt, Human
ccccaagugcugggauuacaggc

SEQ ID NO: 1030590 - RNA, 25 nt, Human
ccucccgccuuggccuccccaagug

SEQ ID NO: 1030591 - RNA, 25 nt, Human
ccucugggcucaagcgauccucccg

SEQ ID NO: 1030592 - RNA, 19 nt, Human
cgauccucccgccuuggcc

SEQ ID NO: 1030593 - RNA, 22 nt, Human
cgccaccacaccgggcuaacuu

SEQ ID NO: 1030594 - RNA, 24 nt, Human
cucaagcgauccucccgccuuggc

SEQ ID NO: 1030595 - RNA, 20 nt, Human
cuccucuccuccacccuagc

SEQ ID NO: 1030596 - RNA, 21 nt, Human
ggacagcgcggcguguggucc

SEQ ID NO: 1030597 - RNA, 21 nt, Human
gggggugggguggggguggag

SEQ ID NO: 1030598 - RNA, 21 nt, Human
ggguugggugcuggggacagc

SEQ ID NO: 1030599 - RNA, 23 nt, Human
uaagccacaggugcgcgccacca

SEQ ID NO: 1030600 - RNA, 24 nt, Human
uccccaagugcugggauuacaggc

SEQ ID NO: 1030601 - RNA, 19 nt, Human
ucucacucucuugcccagg

SEQ ID NO: 1030602 - RNA, 23 nt, Human
ucucacucucuugcccagguuga

SEQ ID NO: 1030603 - RNA, 23 nt, Human
ucucgaaccucugggcucaagcg

SEQ ID NO: 1030604 - RNA, 19 nt, Human
ugcgggggugggguggggg

SEQ ID NO: 1030605 - RNA, 19 nt, Human
ugcugggauuacaggcgug

SEQ ID NO: 1030606 - RNA, 22 nt, Human
ugcugggauuacaggcgugcgg

SEQ ID NO: 1030607 - RNA, 18 nt, Human
ugggauuacaggcgugcg

SEQ ID NO: 1030608 - RNA, 18 nt, Human
ugggauuacaggcgugcg

SEQ ID NO: 1030609 - RNA, 24 nt, Human
ugggcucaagcgauccucccgccu

SEQ ID NO: 1030610 - RNA, 19 nt, Human
ugggguggggguggagguu

SEQ ID NO: 1030611 - RNA, 18 nt, Human
ugggugcuggggacagcg

SEQ ID NO: 1030612 - RNA, 21 nt, Human
uucaucaacaaaccccacucc

SEQ ID NO: 1030613 - RNA, 19 nt, Human
uugaucucgaaccucuggg

SEQ ID NO: 1030614 - RNA, 22 nt, Human
uuucaggguagcuaagccacag

SEQ ID NO: 1030615 - RNA, 23 nt, Human
uuucaggguagcuaagccacagg

SEQ ID NO: 1030616 - RNA, 25 nt, Human
uuuuuuuuuuuuuuuuuuucagggg

SEQ ID NO: 1030617 - RNA, 22 nt, Human
cccacggccgcgccccucggcc

SEQ ID NO: 1030618 - RNA, 19 nt, Human
ccccacggccgcgccccuc

SEQ ID NO: 1030619 - RNA, 18 nt, Human
ccgaggcaggacacagag

SEQ ID NO: 1030620 - RNA, 21 nt, Human
ccgcaaagagccgaggcugcc

SEQ ID NO: 1030621 - RNA, 19 nt, Human
cggccgcgccccucggccu

SEQ ID NO: 1030622 - RNA, 18 nt, Human
cugccaggcccauuuaug

SEQ ID NO: 1030623 - RNA, 26 nt, Human
gcaaagagccgaggcugccaggccca

SEQ ID NO: 1030624 - RNA, 22 nt, Human
ucucuagauuuucucgucaccc

SEQ ID NO: 1030625 - RNA, 21 nt, Human
ugccaggcccauuuauguccc

SEQ ID NO: 1030626 - RNA, 22 nt, Human
ugcuggaaguguggggagaacc

SEQ ID NO: 1030627 - RNA, 20 nt, Human
caccagcuccgagaaggaug

SEQ ID NO: 1030628 - RNA, 21 nt, Human
cagcaaugcagccccaggcac

SEQ ID NO: 1030629 - RNA, 23 nt, Human
cagcaaugcagccccaggcacca

SEQ ID NO: 1030630 - RNA, 18 nt, Human
ccaggccccggcaagccc

SEQ ID NO: 1030631 - RNA, 23 nt, Human
cccagcucuggggcggggcgggg

SEQ ID NO: 1030632 - RNA, 23 nt, Human
cccagggggcccagcucuggggc

SEQ ID NO: 1030633 - RNA, 19 nt, Human
cccccccacccugguuacc

SEQ ID NO: 1030634 - RNA, 24 nt, Human
ccucccccguuguuaggagccaga

SEQ ID NO: 1030635 - RNA, 19 nt, Human
cggacgaauaaauaggggc

SEQ ID NO: 1030636 - RNA, 24 nt, Human
cuccgagaaggaugcgguggggcg

SEQ ID NO: 1030637 - RNA, 18 nt, Human
cucuggggcggggcgggg

SEQ ID NO: 1030638 - RNA, 21 nt, Human
cugcucucuugacacaguucc

SEQ ID NO: 1030639 - RNA, 19 nt, Human
cuuucucgcucuuuaaucu

SEQ ID NO: 1030640 - RNA, 26 nt, Human
gcggggcgggggcgccuugcuggagc

SEQ ID NO: 1030641 - RNA, 21 nt, Human
ggaaccugcccagggggccca

SEQ ID NO: 1030642 - RNA, 23 nt, Human
ggacgaauaaauaggggcgguca

SEQ ID NO: 1030643 - RNA, 20 nt, Human
gggcccagcucuggggcggg

SEQ ID NO: 1030644 - RNA, 20 nt, Human
gggcggggcgggggcgccuc

SEQ ID NO: 1030645 - RNA, 18 nt, Human
ggggcgggguggggaacc

SEQ ID NO: 1030646 - RNA, 21 nt, Human
guggggcgggguggggaaccu

SEQ ID NO: 1030647 - RNA, 24 nt, Human
guggggcgggguggggaaccugcc

SEQ ID NO: 1030648 - RNA, 18 nt, Human
uaggggcggucagugguc

SEQ ID NO: 1030649 - RNA, 21 nt, Human
ucacucugcucucuugacaca

SEQ ID NO: 1030650 - RNA, 27 nt, Human
ucacucugcucucuugacacaguucca

SEQ ID NO: 1030651 - RNA, 21 nt, Human
ugcccagggggcccagcucug

SEQ ID NO: 1030652 - RNA, 24 nt, Human
ugcgguggggcgggguggggaacc

SEQ ID NO: 1030653 - RNA, 22 nt, Human
uggggaaccugcccagggggcc

SEQ ID NO: 1030654 - RNA, 27 nt, Human
uuccagcaaugcagccccaggcaccag

SEQ ID NO: 1030655 - RNA, 23 nt, Human
uuuuuugcuuucucgcucuuuaa

SEQ ID NO: 1030656 - RNA, 18 nt, Human
uuuuuuuuuuuuuuuuug

SEQ ID NO: 1030657 - RNA, 23 nt, Human
uuuuuuuuuuuuuuuuuugcuuu

SEQ ID NO: 1030658 - RNA, 19 nt, Human
aaacugguuaugguaguug

SEQ ID NO: 1030659 - RNA, 22 nt, Human
aacaagaaauucugaaaacguc

SEQ ID NO: 1030660 - RNA, 24 nt, Human
aagaaggcaucaccuucucuagcu

SEQ ID NO: 1030661 - RNA, 24 nt, Human
aagcagacagcagaaacccaacau

SEQ ID NO: 1030662 - RNA, 27 nt, Human
aagcagacagcagaaacccaacauuca

SEQ ID NO: 1030663 - RNA, 22 nt, Human
aaucucaaaaaauucaggcaug

SEQ ID NO: 1030664 - RNA, 24 nt, Human
acaaucucaaaaaauucaggcaug

SEQ ID NO: 1030665 - RNA, 18 nt, Human
acagcaaaaagucauucc

SEQ ID NO: 1030666 - RNA, 20 nt, Human
acaggcaaagcaaggggcag

SEQ ID NO: 1030667 - RNA, 20 nt, Human
agacuucugugucugagagg

SEQ ID NO: 1030668 - RNA, 21 nt, Human
aggaaggaaaaugaaacacaa

SEQ ID NO: 1030669 - RNA, 18 nt, Human
aggugaaagucuacaacc

SEQ ID NO: 1030670 - RNA, 19 nt, Human
auacaaagacaaaagaacu

SEQ ID NO: 1030671 - RNA, 20 nt, Human
auacaaagacaaaagaacuc

SEQ ID NO: 1030672 - RNA, 23 nt, Human
auacaaagacaaaagaacucuac

SEQ ID NO: 1030673 - RNA, 18 nt, Human
auagagcugcgucuaaau

SEQ ID NO: 1030674 - RNA, 24 nt, Human
caaaccaggaaggaaaaugaaaca

SEQ ID NO: 1030675 - RNA, 19 nt, Human
caaagacaaaagaacucua

SEQ ID NO: 1030676 - RNA, 23 nt, Human
caaagcaaggcucucugagaagc

SEQ ID NO: 1030677 - RNA, 24 nt, Human
caaagcaaggcucucugagaagca

SEQ ID NO: 1030678 - RNA, 24 nt, Human
caaagcaaggcucucugagaagcc

SEQ ID NO: 1030679 - RNA, 19 nt, Human
caaagcaaggggcagcaga

SEQ ID NO: 1030680 - RNA, 20 nt, Human
caaagcaaggggcagcagag

SEQ ID NO: 1030681 - RNA, 20 nt, Human
caaagcaaggggcagcagag

SEQ ID NO: 1030682 - RNA, 25 nt, Human
cacaaaccaggaaggaaaaugaaac

SEQ ID NO: 1030683 - RNA, 22 nt, Human
caccaggaggcucaccaugucu

SEQ ID NO: 1030684 - RNA, 18 nt, Human
cagacagcagaaacccaa

SEQ ID NO: 1030685 - RNA, 19 nt, Human
cagacagcagaaacccaac

SEQ ID NO: 1030686 - RNA, 25 nt, Human
cagcagaaacccaacauucaaaacc

SEQ ID NO: 1030687 - RNA, 19 nt, Human
cagcagaggcugugucacu

SEQ ID NO: 1030688 - RNA, 22 nt, Human
caggggccgccaugccugccgu

SEQ ID NO: 1030689 - RNA, 25 nt, Human
caucugcuuuucaucagcaaacaca

SEQ ID NO: 1030690 - RNA, 19 nt, Human
cauucaaaaccaucacagc

SEQ ID NO: 1030691 - RNA, 21 nt, Human
cauuucaacaagaaauucuga

SEQ ID NO: 1030692 - RNA, 22 nt, Human
ccaaagcaaggcucucugagaa

SEQ ID NO: 1030693 - RNA, 20 nt, Human
ccacacuuuaaucaccaugg

SEQ ID NO: 1030694 - RNA, 22 nt, Human
ccauacaaagacaaaagaacuc

SEQ ID NO: 1030695 - RNA, 23 nt, Human
cccauaaccacacuuuaaucacc

SEQ ID NO: 1030696 - RNA, 21 nt, Human
cuaagcagacagcagaaaccc

SEQ ID NO: 1030697 - RNA, 21 nt, Human
cucugagaagcauuugaaaaa

SEQ ID NO: 1030698 - RNA, 20 nt, Human
cuuccugcccauaaccacac

SEQ ID NO: 1030699 - RNA, 21 nt, Human
gaaaugccauuugacucgcaa

SEQ ID NO: 1030700 - RNA, 20 nt, Human
gagagagagagaauuaacac

SEQ ID NO: 1030701 - RNA, 20 nt, Human
gcaguaauggaaaaaguauc

SEQ ID NO: 1030702 - RNA, 25 nt, Human
gcaguaauggaaaaaguaucaucac

SEQ ID NO: 1030703 - RNA, 20 nt, Human
ggcagcagaggcugugucac

SEQ ID NO: 1030704 - RNA, 19 nt, Human
uaacacacacaaaccagga

SEQ ID NO: 1030705 - RNA, 20 nt, Human
uaguuucgggauuuugguug

SEQ ID NO: 1030706 - RNA, 23 nt, Human
uaugguaguugcugaugaagaag

SEQ ID NO: 1030707 - RNA, 23 nt, Human
ucaaccaaagcaaggcucucuga

SEQ ID NO: 1030708 - RNA, 22 nt, Human
uccacaucauuauaagcuucua

SEQ ID NO: 1030709 - RNA, 21 nt, Human
uccauacaaagacaaaagaac

SEQ ID NO: 1030710 - RNA, 30 nt, Human
ucuaacuccuuugauauuuacaaucucaaa

SEQ ID NO: 1030711 - RNA, 23 nt, Human
ucuacaaccaugucagaacacaa

SEQ ID NO: 1030712 - RNA, 19 nt, Human
ugaaagucuacaaccaugu

SEQ ID NO: 1030713 - RNA, 21 nt, Human
ugaagaagaugaggagccagg

SEQ ID NO: 1030714 - RNA, 24 nt, Human
ugaggagccaggaugucauuccuu

SEQ ID NO: 1030715 - RNA, 18 nt, Human
ugccguuaggaaaugcca

SEQ ID NO: 1030716 - RNA, 23 nt, Human
ugcgucuaaauguuugaguggug

SEQ ID NO: 1030717 - RNA, 19 nt, Human
uggaaaaugcaacaugaga

SEQ ID NO: 1030718 - RNA, 23 nt, Human
uggaagaaggcaucaccuucucu

SEQ ID NO: 1030719 - RNA, 19 nt, Human
ugucagaacacaaucuaac

SEQ ID NO: 1030720 - RNA, 26 nt, Human
uuaacacacacaaaccaggaaggaaa

SEQ ID NO: 1030721 - RNA, 19 nt, Human
uucaggggccgccaugccu

SEQ ID NO: 1030722 - RNA, 21 nt, Human
uuccauacaaagacaaaagaa

SEQ ID NO: 1030723 - RNA, 23 nt, Human
uuugaaaaauacgcauugaaaag

SEQ ID NO: 1030724 - RNA, 22 nt, Human
aaaacugcaaaccaucagccaa

SEQ ID NO: 1030725 - RNA, 22 nt, Human
aaaaguaaugugcuuauaaggg

SEQ ID NO: 1030726 - RNA, 20 nt, Human
aaaauaaucuaaacauggga

SEQ ID NO: 1030727 - RNA, 23 nt, Human
aacugcucuucaaaagguaccau

SEQ ID NO: 1030728 - RNA, 20 nt, Human
agagucauauuuuuucccua

SEQ ID NO: 1030729 - RNA, 21 nt, Human
aucaucccagacucuuugaug

SEQ ID NO: 1030730 - RNA, 23 nt, Human
aucucuuuuagaauuuucuguua

SEQ ID NO: 1030731 - RNA, 25 nt, Human
augguccaguacaugacauggguga

SEQ ID NO: 1030732 - RNA, 21 nt, Human
caggcaauuagaaaagggagg

SEQ ID NO: 1030733 - RNA, 20 nt, Human
ccauguaaccaucugugagc

SEQ ID NO: 1030734 - RNA, 18 nt, Human
cccggaaccugaaccgag

SEQ ID NO: 1030735 - RNA, 25 nt, Human
cucaauguccaaaaguuauacuacu

SEQ ID NO: 1030736 - RNA, 23 nt, Human
cugugagcuucuuugaauaguuc

SEQ ID NO: 1030737 - RNA, 24 nt, Human
cuuucuccaucucaauguccaaaa

SEQ ID NO: 1030738 - RNA, 19 nt, Human
gaacagauugaugaagauu

SEQ ID NO: 1030739 - RNA, 18 nt, Human
gcagaacugcucuucaaa

SEQ ID NO: 1030740 - RNA, 20 nt, Human
gcagaacugcucuucaaaag

SEQ ID NO: 1030741 - RNA, 23 nt, Human
gucauauuuuuucccuacccauu

SEQ ID NO: 1030742 - RNA, 20 nt, Human
uaaaaaguagagaaagaugg

SEQ ID NO: 1030743 - RNA, 22 nt, Human
uaaaauaaucuaaacaugggac

SEQ ID NO: 1030744 - RNA, 19 nt, Human
uauggcauauaauauauau

SEQ ID NO: 1030745 - RNA, 22 nt, Human
uaugguauauauaguauauaug

SEQ ID NO: 1030746 - RNA, 19 nt, Human
ucuagugaacuucaagcuc

SEQ ID NO: 1030747 - RNA, 26 nt, Human
ucucauguaaauguuauaugccuuac

SEQ ID NO: 1030748 - RNA, 22 nt, Human
ucuguaaucuagacauacaggc

SEQ ID NO: 1030749 - RNA, 22 nt, Human
ucuuacucugucuuaugaugaa

SEQ ID NO: 1030750 - RNA, 19 nt, Human
ugagugcacauuuaaacaa

SEQ ID NO: 1030751 - RNA, 21 nt, Human
ugucuaaccauuuugcucagu

SEQ ID NO: 1030752 - RNA, 23 nt, Human
ugugaaacuaucauucacaaauu

SEQ ID NO: 1030753 - RNA, 22 nt, Human
uguuaagagggccaugagaucg

SEQ ID NO: 1030754 - RNA, 21 nt, Human
uuaaugcaagauauaaagaag

SEQ ID NO: 1030755 - RNA, 23 nt, Human
uugugauguuuuucuaguuguau

SEQ ID NO: 1030756 - RNA, 27 nt, Human
uuugauaauuucucacuuucuccaucu

SEQ ID NO: 1030757 - RNA, 20 nt, Human
aaaaaagaaaacuaccugau

SEQ ID NO: 1030758 - RNA, 30 nt, Human
aaaaugacuuaucaaaagccugaaacaucc

SEQ ID NO: 1030759 - RNA, 24 nt, Human
aaacaggcaauccagacuccacca

SEQ ID NO: 1030760 - RNA, 20 nt, Human
aaagaggcacuaccaccccc

SEQ ID NO: 1030761 - RNA, 20 nt, Human
aaaguacaacuagcaaaaaa

SEQ ID NO: 1030762 - RNA, 18 nt, Human
aaaguacauaaaacugca

SEQ ID NO: 1030763 - RNA, 19 nt, Human
aaaguucuucaaaggacac

SEQ ID NO: 1030764 - RNA, 19 nt, Human
aacaaaagcauccucaauc

SEQ ID NO: 1030765 - RNA, 21 nt, Human
aacaaauacacagcacaccuu

SEQ ID NO: 1030766 - RNA, 23 nt, Human
aacuacaaaagugcuuucaaaua

SEQ ID NO: 1030767 - RNA, 24 nt, Human
aagcaaucuauacaccuuuggccu

SEQ ID NO: 1030768 - RNA, 20 nt, Human
aaggauguauauuuccuucc

SEQ ID NO: 1030769 - RNA, 21 nt, Human
aaggcaguuuugacccaauua

SEQ ID NO: 1030770 - RNA, 19 nt, Human
aagugcuuucaaauaucag

SEQ ID NO: 1030771 - RNA, 26 nt, Human
aauacagaaaaaagaaaacuaccuga

SEQ ID NO: 1030772 - RNA, 24 nt, Human
aaugacuuaucaaaagccugaaac

SEQ ID NO: 1030773 - RNA, 19 nt, Human
acacacacacagacacaca

SEQ ID NO: 1030774 - RNA, 26 nt, Human
acacaugcagacacacacacagacac

SEQ ID NO: 1030775 - RNA, 24 nt, Human
accauuuucuucaacagaccucaa

SEQ ID NO: 1030776 - RNA, 24 nt, Human
accccguccgccuccgccucugcc

SEQ ID NO: 1030777 - RNA, 20 nt, Human
agacacacacacagacacac

SEQ ID NO: 1030778 - RNA, 22 nt, Human
agacacacacacagacacacau

SEQ ID NO: 1030779 - RNA, 22 nt, Human
auaaggauguauauuuccuuca

SEQ ID NO: 1030780 - RNA, 23 nt, Human
auggccgagccucugcuuugggc

SEQ ID NO: 1030781 - RNA, 19 nt, Human
caaaacaggcaauccagac

SEQ ID NO: 1030782 - RNA, 22 nt, Human
caaaacaggcaauccagacucc

SEQ ID NO: 1030783 - RNA, 22 nt, Human
caacaaauacacagcacaccuu

SEQ ID NO: 1030784 - RNA, 25 nt, Human
caacagaccucaaaggcaguuuuga

SEQ ID NO: 1030785 - RNA, 29 nt, Human
caaguacaugcgugcacacaugcagugug

SEQ ID NO: 1030786 - RNA, 27 nt, Human
cacacacacagacacacauguaaagca

SEQ ID NO: 1030787 - RNA, 20 nt, Human
cacaccuuauuccuuuaaaa

SEQ ID NO: 1030788 - RNA, 19 nt, Human
cacagacacacauguaaag

SEQ ID NO: 1030789 - RNA, 19 nt, Human
cacccccuuucaagcaauc

SEQ ID NO: 1030790 - RNA, 21 nt, Human
cacccccuuucaagcaaucua

SEQ ID NO: 1030791 - RNA, 19 nt, Human
cagaaaaaagaaaacuacc

SEQ ID NO: 1030792 - RNA, 23 nt, Human
cagacacacauguaaagcaaccg

SEQ ID NO: 1030793 - RNA, 20 nt, Human
cagacuuaauaaauacaaug

SEQ ID NO: 1030794 - RNA, 20 nt, Human
caucaaaacuacaaaagugc

SEQ ID NO: 1030795 - RNA, 29 nt, Human
caugcagacacacacacagacacacaugg

SEQ ID NO: 1030796 - RNA, 24 nt, Human
cauggccgagccucugcuuugggc

SEQ ID NO: 1030797 - RNA, 23 nt, Human
cauuuuaaaaacagaugcacaga

SEQ ID NO: 1030798 - RNA, 21 nt, Human
ccagacuguagccgacucaac

SEQ ID NO: 1030799 - RNA, 18 nt, Human
ccccguccgccuccgccu

SEQ ID NO: 1030800 - RNA, 18 nt, Human
ccgccgccgccgcugucc

SEQ ID NO: 1030801 - RNA, 21 nt, Human
ccgccgccgccgcugucccgg

SEQ ID NO: 1030802 - RNA, 24 nt, Human
ccuaaagaaagcauucuuaagacu

SEQ ID NO: 1030803 - RNA, 21 nt, Human
ccugaaaguacauaaaacugc

SEQ ID NO: 1030804 - RNA, 23 nt, Human
cguaugcuuucauagcacaugug

SEQ ID NO: 1030805 - RNA, 23 nt, Human
cucaacaucaacaacuaguugcu

SEQ ID NO: 1030806 - RNA, 23 nt, Human
cuccaaaauuuuaaguaaaccaa

SEQ ID NO: 1030807 - RNA, 19 nt, Human
cuccugaaaguacauaaaa

SEQ ID NO: 1030808 - RNA, 21 nt, Human
cugauggucuucuccugaaag

SEQ ID NO: 1030809 - RNA, 23 nt, Human
cuuaaaaccucauuuuucagcag

SEQ ID NO: 1030810 - RNA, 28 nt, Human
cuuggccucuguuguaggaaggacggcc

SEQ ID NO: 1030811 - RNA, 21 nt, Human
cuuugggcugaccccguccgc

SEQ ID NO: 1030812 - RNA, 21 nt, Human
cuuuuacauugcauacaagua

SEQ ID NO: 1030813 - RNA, 21 nt, Human
gucuguccuaaagaaagcauu

SEQ ID NO: 1030814 - RNA, 22 nt, Human
uaaaccaaaugcaaugauucug

SEQ ID NO: 1030815 - RNA, 23 nt, Human
uaaagaaagcauucuuaagacaa

SEQ ID NO: 1030816 - RNA, 18 nt, Human
uaaauguuuaauuuacua

SEQ ID NO: 1030817 - RNA, 20 nt, Human
uaaucugcauuuucuuccuu

SEQ ID NO: 1030818 - RNA, 21 nt, Human
uacagaaaaaagaaaacuacc

SEQ ID NO: 1030819 - RNA, 30 nt, Human
uacaugcgugcacacaugcagacacacaca

SEQ ID NO: 1030820 - RNA, 23 nt, Human
uagcagggagcacucugcgagaa

SEQ ID NO: 1030821 - RNA, 21 nt, Human
uauaaaucacuuuccccuuuc

SEQ ID NO: 1030822 - RNA, 21 nt, Human
uauccuaccaugaauaauuuu

SEQ ID NO: 1030823 - RNA, 28 nt, Human
uauccuaccaugaauaauuuuagaauca

SEQ ID NO: 1030824 - RNA, 24 nt, Human
ucaaaaaaggauacucugcaagac

SEQ ID NO: 1030825 - RNA, 19 nt, Human
ucaaagaagggugucaaca

SEQ ID NO: 1030826 - RNA, 24 nt, Human
ucaaauaucagaggcaaauauaau

SEQ ID NO: 1030827 - RNA, 22 nt, Human
ucaacacaauuaaaauccauaa

SEQ ID NO: 1030828 - RNA, 19 nt, Human
ucauggccgagccucugcu

SEQ ID NO: 1030829 - RNA, 19 nt, Human
ucauuucuuuccuaaacag

SEQ ID NO: 1030830 - RNA, 24 nt, Human
uccgccgccgccgcugucccgggu

SEQ ID NO: 1030831 - RNA, 21 nt, Human
uccuuaaaaccucauuuuuca

SEQ ID NO: 1030832 - RNA, 24 nt, Human
ucuaauauuugcaagggcuuuaau

SEQ ID NO: 1030833 - RNA, 24 nt, Human
ucugcauuuucuuccuuaaaaccu

SEQ ID NO: 1030834 - RNA, 24 nt, Human
ugaaaaacagagguuaagggauua

SEQ ID NO: 1030835 - RNA, 21 nt, Human
ugaaacauucacacaccagau

SEQ ID NO: 1030836 - RNA, 19 nt, Human
ugaaaguacauaaaacugc

SEQ ID NO: 1030837 - RNA, 19 nt, Human
ugaaaguacauaaaacugg

SEQ ID NO: 1030838 - RNA, 24 nt, Human
ugcacacaugcagacacacacaca

SEQ ID NO: 1030839 - RNA, 28 nt, Human
ugcagacacacacacagacacacaugua

SEQ ID NO: 1030840 - RNA, 22 nt, Human
ugcauacaaguacaugcgugca

SEQ ID NO: 1030841 - RNA, 27 nt, Human
ugcauacaaguacaugcgugcacacag

SEQ ID NO: 1030842 - RNA, 22 nt, Human
ugcucucaacaucaacaacuag

SEQ ID NO: 1030843 - RNA, 21 nt, Human
uggggucuugaaaauauuuua

SEQ ID NO: 1030844 - RNA, 22 nt, Human
uguaaagcaacaaauucaaaga

SEQ ID NO: 1030845 - RNA, 24 nt, Human
uucaaagaagggugucaacacaau

SEQ ID NO: 1030846 - RNA, 19 nt, Human
uucaaagugugaaacccuu

SEQ ID NO: 1030847 - RNA, 25 nt, Human
uucaucaucaaaacuacaaaagugc

SEQ ID NO: 1030848 - RNA, 18 nt, Human
uuccuaaacagauuagaa

SEQ ID NO: 1030849 - RNA, 26 nt, Human
uuuaaaaacagaugcacagaggugag

SEQ ID NO: 1030850 - RNA, 23 nt, Human
uuugacuucuuuguccugucuuu

SEQ ID NO: 1030851 - RNA, 26 nt, Human
uuuggccuuuguuucccaauuugaug

SEQ ID NO: 1030852 - RNA, 20 nt, Human
aagagcaaugagggaacugc

SEQ ID NO: 1030853 - RNA, 21 nt, Human
aaggaggagcagaggguggug

SEQ ID NO: 1030854 - RNA, 26 nt, Human
acaccaaaacugaacuuccacccggu

SEQ ID NO: 1030855 - RNA, 19 nt, Human
agagggugguguuucgggc

SEQ ID NO: 1030856 - RNA, 19 nt, Human
agaugaauggcucuucugc

SEQ ID NO: 1030857 - RNA, 23 nt, Human
agcaaugagggaacugcuuagga

SEQ ID NO: 1030858 - RNA, 19 nt, Human
agccuggaaagcugacccu

SEQ ID NO: 1030859 - RNA, 24 nt, Human
aggagaaggaggagcagagggugg

SEQ ID NO: 1030860 - RNA, 25 nt, Human
caagcccaucccugccugcaaauaa

SEQ ID NO: 1030861 - RNA, 19 nt, Human
cacaguuucagcuucuugg

SEQ ID NO: 1030862 - RNA, 18 nt, Human
caccacgccagcucggcc

SEQ ID NO: 1030863 - RNA, 22 nt, Human
cacccggucaugggcccugcuc

SEQ ID NO: 1030864 - RNA, 23 nt, Human
cagacaccaaaacugaacuucca

SEQ ID NO: 1030865 - RNA, 22 nt, Human
cagcacccaguagugagggagg

SEQ ID NO: 1030866 - RNA, 18 nt, Human
cagggcuucugcuuggcc

SEQ ID NO: 1030867 - RNA, 19 nt, Human
caggguccuuccucauucu

SEQ ID NO: 1030868 - RNA, 19 nt, Human
cagguacaagcccaucccu

SEQ ID NO: 1030869 - RNA, 18 nt, Human
ccaaagaaggggccaacc

SEQ ID NO: 1030870 - RNA, 20 nt, Human
ccacacaggggugggugcug

SEQ ID NO: 1030871 - RNA, 19 nt, Human
cccaaagaaggggccaacc

SEQ ID NO: 1030872 - RNA, 22 nt, Human
cccaaagaaggggccaacccag

SEQ ID NO: 1030873 - RNA, 21 nt, Human
ccccuaggaugccugggccag

SEQ ID NO: 1030874 - RNA, 20 nt, Human
ccgugugcuaaggcugcuuc

SEQ ID NO: 1030875 - RNA, 23 nt, Human
ccucuugaagcagacaccaaaac

SEQ ID NO: 1030876 - RNA, 22 nt, Human
ccuugcacaggguccuuccuca

SEQ ID NO: 1030877 - RNA, 22 nt, Human
ccuuggacuugucacuuggcuu

SEQ ID NO: 1030878 - RNA, 22 nt, Human
cucggccugcagggacuggauc

SEQ ID NO: 1030879 - RNA, 23 nt, Human
cucggccugcagggacuggaucu

SEQ ID NO: 1030880 - RNA, 27 nt, Human
cucuuccagaccucuccccaacuccag

SEQ ID NO: 1030881 - RNA, 23 nt, Human
cugagccucaguuuccuugucug

SEQ ID NO: 1030882 - RNA, 21 nt, Human
cuuguguucuguauccaggag

SEQ ID NO: 1030883 - RNA, 22 nt, Human
cuuuucgacugugaaauccugg

SEQ ID NO: 1030884 - RNA, 20 nt, Human
gagggaacugcuuaggaggg

SEQ ID NO: 1030885 - RNA, 18 nt, Human
gcaugcaaaccuucucac

SEQ ID NO: 1030886 - RNA, 18 nt, Human
gcccugcucuuccugcgu

SEQ ID NO: 1030887 - RNA, 25 nt, Human
gccuggaaagcugacccugcagaau

SEQ ID NO: 1030888 - RNA, 20 nt, Human
gcugcagcucagaccuccgg

SEQ ID NO: 1030889 - RNA, 21 nt, Human
ggcccugcucuuccugcuguc

SEQ ID NO: 1030890 - RNA, 19 nt, Human
gggaggagaggcccgugug

SEQ ID NO: 1030891 - RNA, 18 nt, Human
gggcacaggcgcucaugc

SEQ ID NO: 1030892 - RNA, 22 nt, Human
gggcaguggggaggcagggagc

SEQ ID NO: 1030893 - RNA, 21 nt, Human
gggccacacaggggugggugc

SEQ ID NO: 1030894 - RNA, 19 nt, Human
gggccaggacaggagaagg

SEQ ID NO: 1030895 - RNA, 25 nt, Human
gggccaggacaggagaaggaggagc

SEQ ID NO: 1030896 - RNA, 23 nt, Human
ggugggugcugucagguacaagc

SEQ ID NO: 1030897 - RNA, 24 nt, Human
gguugaaauaagauauugguggug

SEQ ID NO: 1030898 - RNA, 20 nt, Human
gugcaggguccggcuccacc

SEQ ID NO: 1030899 - RNA, 22 nt, Human
uaggaggggucugagggugaug

SEQ ID NO: 1030900 - RNA, 22 nt, Human
uccaccacgccagcucggccug

SEQ ID NO: 1030901 - RNA, 23 nt, Human
uccacccggucaugggcccugcu

SEQ ID NO: 1030902 - RNA, 21 nt, Human
uccaggccuguguaguggcug

SEQ ID NO: 1030903 - RNA, 23 nt, Human
ucccugagccucaguuuccuugu

SEQ ID NO: 1030904 - RNA, 22 nt, Human
uccucauucuuuccucuuccuu

SEQ ID NO: 1030905 - RNA, 26 nt, Human
uccugagcccaaagaaggggccaacc

SEQ ID NO: 1030906 - RNA, 25 nt, Human
uccugggccagcuggucagccacgc

SEQ ID NO: 1030907 - RNA, 21 nt, Human
ucgacugugaaauccugggcc

SEQ ID NO: 1030908 - RNA, 19 nt, Human
ucgggcuccaagaaagucu

SEQ ID NO: 1030909 - RNA, 22 nt, Human
ucucucccccacccgccucaga

SEQ ID NO: 1030910 - RNA, 22 nt, Human
ugaaaccugggugaagagccag

SEQ ID NO: 1030911 - RNA, 23 nt, Human
ugaagcagacaccaaaacugaac

SEQ ID NO: 1030912 - RNA, 20 nt, Human
ugagcccaaagaaggggcca

SEQ ID NO: 1030913 - RNA, 21 nt, Human
ugagcccaaagaaggggccaa

SEQ ID NO: 1030914 - RNA, 24 nt, Human
ugagcccaaagaaggggccaaccc

SEQ ID NO: 1030915 - RNA, 19 nt, Human
ugagggaggagaggcccgu

SEQ ID NO: 1030916 - RNA, 19 nt, Human
uggaaagcugacccugcag

SEQ ID NO: 1030917 - RNA, 22 nt, Human
uggaaucagaguguaaaacccc

SEQ ID NO: 1030918 - RNA, 19 nt, Human
uggacucuggaccugcccc

SEQ ID NO: 1030919 - RNA, 19 nt, Human
uggcucuggcccuggaauc

SEQ ID NO: 1030920 - RNA, 24 nt, Human
uggcugcagcucagaccuccgguc

SEQ ID NO: 1030921 - RNA, 23 nt, Human
ugggaacagccuggaaagcugac

SEQ ID NO: 1030922 - RNA, 24 nt, Human
ugggacugcauggcucuggcccug

SEQ ID NO: 1030923 - RNA, 22 nt, Human
ugggcccugcucuuccugcugu

SEQ ID NO: 1030924 - RNA, 21 nt, Human
uggggagagcccuucucugcu

SEQ ID NO: 1030925 - RNA, 24 nt, Human
uggggaggcagggagcuauuuggg

SEQ ID NO: 1030926 - RNA, 21 nt, Human
ugggggccacacagggguggg

SEQ ID NO: 1030927 - RNA, 19 nt, Human
ugguagaauuccaggccug

SEQ ID NO: 1030928 - RNA, 23 nt, Human
uggucagccacgcagggcagcac

SEQ ID NO: 1030929 - RNA, 25 nt, Human
ugguguggcuauggguacccaggcu

SEQ ID NO: 1030930 - RNA, 18 nt, Human
uguguaguggcugcagcu

SEQ ID NO: 1030931 - RNA, 19 nt, Human
uuccaggccuguguagugg

SEQ ID NO: 1030932 - RNA, 19 nt, Human
uugaagcagacaccaaaac

SEQ ID NO: 1030933 - RNA, 21 nt, Human
uuuuuuuuuuuuuaaagauug

SEQ ID NO: 1030934 - RNA, 22 nt, Human
uuuuuuuuuuuuuuuuuuaaag

SEQ ID NO: 1030935 - RNA, 22 nt, Human
aaacacggccagagccaggugc

SEQ ID NO: 1030936 - RNA, 22 nt, Human
aaaggaaaaagccaacaaaaag

SEQ ID NO: 1030937 - RNA, 19 nt, Human
aacccuccguguccucuac

SEQ ID NO: 1030938 - RNA, 21 nt, Human
aagcagcccagggucagggag

SEQ ID NO: 1030939 - RNA, 23 nt, Human
acaaaggaaaaagccaacaaaaa

SEQ ID NO: 1030940 - RNA, 20 nt, Human
acacucccagcacgacgggu

SEQ ID NO: 1030941 - RNA, 18 nt, Human
acccguggucacuucccu

SEQ ID NO: 1030942 - RNA, 20 nt, Human
agagagaaggucuuggccac

SEQ ID NO: 1030943 - RNA, 22 nt, Human
agaggaaggggagcugagggag

SEQ ID NO: 1030944 - RNA, 18 nt, Human
agaggggucuggagagcc

SEQ ID NO: 1030945 - RNA, 20 nt, Human
agcugagggagggugagagg

SEQ ID NO: 1030946 - RNA, 21 nt, Human
aggaaagugggggccucuggc

SEQ ID NO: 1030947 - RNA, 21 nt, Human
aggagcccccagcaaacgggg

SEQ ID NO: 1030948 - RNA, 20 nt, Human
aggagggguggagagagaag

SEQ ID NO: 1030949 - RNA, 23 nt, Human
aggagggguggcuugugaggggu

SEQ ID NO: 1030950 - RNA, 19 nt, Human
aggccagggcaggguggga

SEQ ID NO: 1030951 - RNA, 22 nt, Human
aggcggaagggagcacgaguua

SEQ ID NO: 1030952 - RNA, 19 nt, Human
aggggcuguggaguugggg

SEQ ID NO: 1030953 - RNA, 20 nt, Human
agggggcccuggguuugagg

SEQ ID NO: 1030954 - RNA, 21 nt, Human
agggguggcuaagccccgccu

SEQ ID NO: 1030955 - RNA, 22 nt, Human
aggguggauggaggaggggugg

SEQ ID NO: 1030956 - RNA, 18 nt, Human
aguggagggagggcuucc

SEQ ID NO: 1030957 - RNA, 21 nt, Human
augaugcugaggggcccugug

SEQ ID NO: 1030958 - RNA, 23 nt, Human
caacagacacuguaaacuuuggu

SEQ ID NO: 1030959 - RNA, 22 nt, Human
caaggaaggggagcugagggug

SEQ ID NO: 1030960 - RNA, 20 nt, Human
cacccaggccagggcagggu

SEQ ID NO: 1030961 - RNA, 26 nt, Human
cacccaggccagggcagggugggagc

SEQ ID NO: 1030962 - RNA, 23 nt, Human
caccugcagaagcgcaccuggca

SEQ ID NO: 1030963 - RNA, 25 nt, Human
cagcagagggggcuguuucuucugg

SEQ ID NO: 1030964 - RNA, 26 nt, Human
cagcagcagagggggcuguuucuucu

SEQ ID NO: 1030965 - RNA, 23 nt, Human
caggaagcagcccagggucaggg

SEQ ID NO: 1030966 - RNA, 20 nt, Human
caggaagcagcccagggucu

SEQ ID NO: 1030967 - RNA, 20 nt, Human
caggguggauggaggagggg

SEQ ID NO: 1030968 - RNA, 18 nt, Human
caguccuuggccuugagu

SEQ ID NO: 1030969 - RNA, 19 nt, Human
caugaugcugaggggcccu

SEQ ID NO: 1030970 - RNA, 21 nt, Human
cauggggagggggcggagggc

SEQ ID NO: 1030971 - RNA, 19 nt, Human
ccacuugcaguugucccug

SEQ ID NO: 1030972 - RNA, 23 nt, Human
ccagaaaacacggccagagccag

SEQ ID NO: 1030973 - RNA, 20 nt, Human
ccagcagcagagggggcugu

SEQ ID NO: 1030974 - RNA, 21 nt, Human
ccagcagcagagggggcuguu

SEQ ID NO: 1030975 - RNA, 21 nt, Human
ccaggccucuucccauggggg

SEQ ID NO: 1030976 - RNA, 22 nt, Human
cccacagggcacacagacaguc

SEQ ID NO: 1030977 - RNA, 24 nt, Human
cccaggccagggcagggugggagc

SEQ ID NO: 1030978 - RNA, 21 nt, Human
cccagggucagggagaagggc

SEQ ID NO: 1030979 - RNA, 21 nt, Human
ccccgccgcugcugccaucgg

SEQ ID NO: 1030980 - RNA, 25 nt, Human
ccccgccugcgggucuccaugaugc

SEQ ID NO: 1030981 - RNA, 18 nt, Human
ccccuccuuucuccuucc

SEQ ID NO: 1030982 - RNA, 29 nt, Human
cccgcuuucuccccuccuuucuccuuccc

SEQ ID NO: 1030983 - RNA, 24 nt, Human
cccggcccaggccccgccucuggc

SEQ ID NO: 1030984 - RNA, 18 nt, Human
cccuccuuucuccuuccc

SEQ ID NO: 1030985 - RNA, 23 nt, Human
cccugggcucccggcccaggccc

SEQ ID NO: 1030986 - RNA, 24 nt, Human
cccugggcucccggcccaggcccc

SEQ ID NO: 1030987 - RNA, 19 nt, Human
cccuggguuugaggggugg

SEQ ID NO: 1030988 - RNA, 20 nt, Human
cccuggguuugagggguggc

SEQ ID NO: 1030989 - RNA, 23 nt, Human
ccuccuuucuccuucccccaggc

SEQ ID NO: 1030990 - RNA, 23 nt, Human
ccucuacugguccaagaccaggg

SEQ ID NO: 1030991 - RNA, 21 nt, Human
ccugcgggucuccaugaugcu

SEQ ID NO: 1030992 - RNA, 20 nt, Human
ccuggcacagaccucugugg

SEQ ID NO: 1030993 - RNA, 18 nt, Human
ccuggggccgggguggga

SEQ ID NO: 1030994 - RNA, 19 nt, Human
ccuggggguggggaccguc

SEQ ID NO: 1030995 - RNA, 20 nt, Human
ccuggggguggggaccgucc

SEQ ID NO: 1030996 - RNA, 24 nt, Human
ccuuucuccuucccccaggcuggg

SEQ ID NO: 1030997 - RNA, 30 nt, Human
cgccucuggccucagggagagcuuggcucu

SEQ ID NO: 1030998 - RNA, 19 nt, Human
cggaaaagaaggcggaagg

SEQ ID NO: 1030999 - RNA, 19 nt, Human
cggagggcccccugccucu

SEQ ID NO: 1031000 - RNA, 19 nt, Human
cggggugggagacugggag

SEQ ID NO: 1031001 - RNA, 22 nt, Human
cuagaauccacacucccagcac

SEQ ID NO: 1031002 - RNA, 18 nt, Human
cuccacccaggccagggc

SEQ ID NO: 1031003 - RNA, 23 nt, Human
cuccacugagccccaggguccuc

SEQ ID NO: 1031004 - RNA, 20 nt, Human
cuccccggucugaguccugg

SEQ ID NO: 1031005 - RNA, 20 nt, Human
cuccccuccuuucuccuucc

SEQ ID NO: 1031006 - RNA, 21 nt, Human
cuccugagggggugagagccc

SEQ ID NO: 1031007 - RNA, 18 nt, Human
cuccuucccccaggcugg

SEQ ID NO: 1031008 - RNA, 18 nt, Human
cugagccccaggguccuc

SEQ ID NO: 1031009 - RNA, 19 nt, Human
cuggaagggaggggucuca

SEQ ID NO: 1031010 - RNA, 18 nt, Human
cuggagagcccccaggaa

SEQ ID NO: 1031011 - RNA, 20 nt, Human
cuggggccggggugggagac

SEQ ID NO: 1031012 - RNA, 22 nt, Human
cugguucugucucagguugggg

SEQ ID NO: 1031013 - RNA, 18 nt, Human
cuugcccagagaggcugc

SEQ ID NO: 1031014 - RNA, 18 nt, Human
cuugguccuagagagggg

SEQ ID NO: 1031015 - RNA, 26 nt, Human
cuuucuccccuccuuucuccuucccc

SEQ ID NO: 1031016 - RNA, 20 nt, Human
gagcccccaggaagcagccc

SEQ ID NO: 1031017 - RNA, 22 nt, Human
gagcccccaggaagcagcccag

SEQ ID NO: 1031018 - RNA, 24 nt, Human
gagcggaagggaggggggcagggc

SEQ ID NO: 1031019 - RNA, 20 nt, Human
gagcugggguggagaguucu

SEQ ID NO: 1031020 - RNA, 25 nt, Human
gaggagcccccagcaaacgggggug

SEQ ID NO: 1031021 - RNA, 20 nt, Human
gaggcaguuucagauguggg

SEQ ID NO: 1031022 - RNA, 19 nt, Human
gaggggggcagggcccugc

SEQ ID NO: 1031023 - RNA, 26 nt, Human
gagggugagaggacugcagagaggcc

SEQ ID NO: 1031024 - RNA, 22 nt, Human
gcagagaggccugcaggcugga

SEQ ID NO: 1031025 - RNA, 21 nt, Human
gcagagggggcuguuucuucu

SEQ ID NO: 1031026 - RNA, 25 nt, Human
gcaggagcggaagggaggggggcag

SEQ ID NO: 1031027 - RNA, 22 nt, Human
gcaguuucagauguggggaggg

SEQ ID NO: 1031028 - RNA, 20 nt, Human
gccccgccugcgggucucca

SEQ ID NO: 1031029 - RNA, 25 nt, Human
gcccgcuuucuccccuccuuucucc

SEQ ID NO: 1031030 - RNA, 22 nt, Human
gccugcucacacggacccccac

SEQ ID NO: 1031031 - RNA, 21 nt, Human
gcggcggggggagaggcgggc

SEQ ID NO: 1031032 - RNA, 18 nt, Human
gcugaggggcccuguggg

SEQ ID NO: 1031033 - RNA, 25 nt, Human
gcuuucuccccuccuuucuccuucc

SEQ ID NO: 1031034 - RNA, 23 nt, Human
ggagagcuggugggggaggaggg

SEQ ID NO: 1031035 - RNA, 19 nt, Human
ggaggagggcccugcugcu

SEQ ID NO: 1031036 - RNA, 20 nt, Human
ggagggagggcuuccagccu

SEQ ID NO: 1031037 - RNA, 18 nt, Human
ggagggcaggugcugggg

SEQ ID NO: 1031038 - RNA, 20 nt, Human
ggagggguggcuugugaggg

SEQ ID NO: 1031039 - RNA, 21 nt, Human
ggcaaggaaggggagcugagg

SEQ ID NO: 1031040 - RNA, 20 nt, Human
ggcaggagcggaagggaggg

SEQ ID NO: 1031041 - RNA, 19 nt, Human
ggcagggugggagcugggg

SEQ ID NO: 1031042 - RNA, 24 nt, Human
ggccaggccagggguguuaugagc

SEQ ID NO: 1031043 - RNA, 23 nt, Human
ggccuccccggucugaguccugg

SEQ ID NO: 1031044 - RNA, 21 nt, Human
ggcgacaaaggaaaaagccaa

SEQ ID NO: 1031045 - RNA, 19 nt, Human
ggcgggcaaggaaggggag

SEQ ID NO: 1031046 - RNA, 24 nt, Human
ggcuggaggagcccccagcaaacg

SEQ ID NO: 1031047 - RNA, 21 nt, Human
gggaauacauggggagggggc

SEQ ID NO: 1031048 - RNA, 20 nt, Human
gggagagcuggugggggagg

SEQ ID NO: 1031049 - RNA, 21 nt, Human
gggagagcuggugggggagga

SEQ ID NO: 1031050 - RNA, 18 nt, Human
gggagauggggccuggau

SEQ ID NO: 1031051 - RNA, 19 nt, Human
gggagcugcuggcccgggc

SEQ ID NO: 1031052 - RNA, 27 nt, Human
gggcaggagcggaagggaggggggcag

SEQ ID NO: 1031053 - RNA, 19 nt, Human
gggccucuggccagaaaac

SEQ ID NO: 1031054 - RNA, 20 nt, Human
gggcucccgugcccacuccu

SEQ ID NO: 1031055 - RNA, 19 nt, Human
ggggagagcugguggggga

SEQ ID NO: 1031056 - RNA, 23 nt, Human
ggggaggagggcccugcugcugc

SEQ ID NO: 1031057 - RNA, 24 nt, Human
ggggaggcaguuucagaugugggg

SEQ ID NO: 1031058 - RNA, 21 nt, Human
ggggagggggcggagggcccc

SEQ ID NO: 1031059 - RNA, 21 nt, Human
ggggguggaggccuggcucag

SEQ ID NO: 1031060 - RNA, 24 nt, Human
ggggguggggguggaggccuggcu

SEQ ID NO: 1031061 - RNA, 24 nt, Human
gggguggggguggaggccuggcuc

SEQ ID NO: 1031062 - RNA, 26 nt, Human
gggguugugucccuggggguucguaa

SEQ ID NO: 1031063 - RNA, 19 nt, Human
ggucugaggaggggucuga

SEQ ID NO: 1031064 - RNA, 23 nt, Human
ggugcuggggaggcgacaaagga

SEQ ID NO: 1031065 - RNA, 20 nt, Human
gguggauggaggaggggugg

SEQ ID NO: 1031066 - RNA, 23 nt, Human
ggugguuggggggaggcaguuuc

SEQ ID NO: 1031067 - RNA, 19 nt, Human
gguugggggcgggucugga

SEQ ID NO: 1031068 - RNA, 20 nt, Human
gucacuucccugcccgugcc

SEQ ID NO: 1031069 - RNA, 25 nt, Human
gucccuggggguggggaccgucccu

SEQ ID NO: 1031070 - RNA, 19 nt, Human
gugagggguguaugugggg

SEQ ID NO: 1031071 - RNA, 20 nt, Human
guggaggccuggcucagccu

SEQ ID NO: 1031072 - RNA, 19 nt, Human
gugggggguucuugggaaa

SEQ ID NO: 1031073 - RNA, 22 nt, Human
guguaugugggggguucuuggg

SEQ ID NO: 1031074 - RNA, 23 nt, Human
guugugucccuggggguucguaa

SEQ ID NO: 1031075 - RNA, 21 nt, Human
uaaaggggccaggccaggggu

SEQ ID NO: 1031076 - RNA, 20 nt, Human
uaacugguggggcggcgggg

SEQ ID NO: 1031077 - RNA, 19 nt, Human
uacugguccaagaccaggg

SEQ ID NO: 1031078 - RNA, 19 nt, Human
uacugguccaagaccaggg

SEQ ID NO: 1031079 - RNA, 22 nt, Human
uagaauccacacucccagcacg

SEQ ID NO: 1031080 - RNA, 18 nt, Human
uaugugggggguucuugg

SEQ ID NO: 1031081 - RNA, 19 nt, Human
ucacacggacccccacagg

SEQ ID NO: 1031082 - RNA, 23 nt, Human
ucaggucacacugggagcugcug

SEQ ID NO: 1031083 - RNA, 23 nt, Human
uccagccuggggccgggguggga

SEQ ID NO: 1031084 - RNA, 18 nt, Human
ucccugcccgugccacuu

SEQ ID NO: 1031085 - RNA, 21 nt, Human
ucccuggggguggggaccguc

SEQ ID NO: 1031086 - RNA, 25 nt, Human
ucccuggggguggggaccgucccug

SEQ ID NO: 1031087 - RNA, 18 nt, Human
ucccuguggccccgccgc

SEQ ID NO: 1031088 - RNA, 23 nt, Human
ucucaguaaaggggccaggccag

SEQ ID NO: 1031089 - RNA, 19 nt, Human
ucuccuucccccaggcugg

SEQ ID NO: 1031090 - RNA, 22 nt, Human
ucuggaagggaggggucucacc

SEQ ID NO: 1031091 - RNA, 20 nt, Human
ucuguggagagucugacuuu

SEQ ID NO: 1031092 - RNA, 23 nt, Human
ucuucuggggauggaggcacagu

SEQ ID NO: 1031093 - RNA, 23 nt, Human
ugacugcagaggaaggggagcug

SEQ ID NO: 1031094 - RNA, 22 nt, Human
ugagagcccgcuuucuccccuc

SEQ ID NO: 1031095 - RNA, 18 nt, Human
ugagggagggugagagga

SEQ ID NO: 1031096 - RNA, 19 nt, Human
ugagggagggugagaggac

SEQ ID NO: 1031097 - RNA, 23 nt, Human
ugagggagggugagaggacugca

SEQ ID NO: 1031098 - RNA, 20 nt, Human
ugagggguguaugugggggg

SEQ ID NO: 1031099 - RNA, 23 nt, Human
ugagggugacugcagaggaaggg

SEQ ID NO: 1031100 - RNA, 22 nt, Human
ugcagaggaaggggagcugagg

SEQ ID NO: 1031101 - RNA, 25 nt, Human
ugcagaggaaggggagcugagggag

SEQ ID NO: 1031102 - RNA, 19 nt, Human
ugccaucggcuugcccaga

SEQ ID NO: 1031103 - RNA, 19 nt, Human
ugcccagagaggcugccca

SEQ ID NO: 1031104 - RNA, 22 nt, Human
ugcugucugcacccguggucac

SEQ ID NO: 1031105 - RNA, 22 nt, Human
uggagccgggguccagccuggc

SEQ ID NO: 1031106 - RNA, 24 nt, Human
uggaggagggguggagagagaagg

SEQ ID NO: 1031107 - RNA, 21 nt, Human
uggaguugggggagauggggc

SEQ ID NO: 1031108 - RNA, 19 nt, Human
uggccucagggagagcuug

SEQ ID NO: 1031109 - RNA, 18 nt, Human
uggcucagccugguucug

SEQ ID NO: 1031110 - RNA, 22 nt, Human
ugggagacugggagggcaggug

SEQ ID NO: 1031111 - RNA, 20 nt, Human
uggggagagcugguggggga

SEQ ID NO: 1031112 - RNA, 21 nt, Human
uggggagggggcggagggccc

SEQ ID NO: 1031113 - RNA, 21 nt, Human
uggugggggaggagggcccug

SEQ ID NO: 1031114 - RNA, 27 nt, Human
ugucucagguugggggcgggucuggag

SEQ ID NO: 1031115 - RNA, 23 nt, Human
ugugagggguguauguggggggu

SEQ ID NO: 1031116 - RNA, 19 nt, Human
uuaaaacaauaacuuaagu

SEQ ID NO: 1031117 - RNA, 20 nt, Human
uuaaaacaauaacuuaaguu

SEQ ID NO: 1031118 - RNA, 27 nt, Human
uucuccccuccuuucuccuucccccag

SEQ ID NO: 1031119 - RNA, 18 nt, Human
uucuggggauggaggcac

SEQ ID NO: 1031120 - RNA, 19 nt, Human
uucuggggauggaggcaca

SEQ ID NO: 1031121 - RNA, 20 nt, Human
uucuggggauggaggcacag

SEQ ID NO: 1031122 - RNA, 21 nt, Human
uucuggggauggaggcacagu

SEQ ID NO: 1031123 - RNA, 18 nt, Human
uugggggagauggggccu

SEQ ID NO: 1031124 - RNA, 24 nt, Human
uugguuuaaaacaauaacuuaagu

SEQ ID NO: 1031125 - RNA, 25 nt, Human
uugguuuaaaacaauaacuuaagug

SEQ ID NO: 1031126 - RNA, 22 nt, Human
uuugcuagaauccacacuccca

SEQ ID NO: 1031127 - RNA, 23 nt, Human
aauuuguuugauuguagguacuu

SEQ ID NO: 1031128 - RNA, 21 nt, Human
aucaucauuucuuucaaagca

SEQ ID NO: 1031129 - RNA, 25 nt, Human
cacagcaacuuacauuaacaccugc

SEQ ID NO: 1031130 - RNA, 21 nt, Human
ccugcuuaacugaacguaacc

SEQ ID NO: 1031131 - RNA, 18 nt, Human
cuugauggcccccagucc

SEQ ID NO: 1031132 - RNA, 18 nt, Human
gcaucaaaccaaagauac

SEQ ID NO: 1031133 - RNA, 18 nt, Human
uacccauuaugcagauuu

SEQ ID NO: 1031134 - RNA, 18 nt, Human
uagguacuuuugcagucu

SEQ ID NO: 1031135 - RNA, 18 nt, Human
uauauuuguaaacuuguc

SEQ ID NO: 1031136 - RNA, 21 nt, Human
uaugcaucaaaccaaagauac

SEQ ID NO: 1031137 - RNA, 20 nt, Human
uccacagcaacuuacauuaa

SEQ ID NO: 1031138 - RNA, 22 nt, Human
uccagauaaaggcugcaucuau

SEQ ID NO: 1031139 - RNA, 22 nt, Human
uccaggcagcacuugauggccc

SEQ ID NO: 1031140 - RNA, 21 nt, Human
ucugugcuucuauucuguuuu

SEQ ID NO: 1031141 - RNA, 23 nt, Human
uugaaaacagucauuccacagca

SEQ ID NO: 1031142 - RNA, 25 nt, Human
uugaaaacagucauuccacagcaac

SEQ ID NO: 1031143 - RNA, 19 nt, Human
uuuguaaacuugucugcau

SEQ ID NO: 1031144 - RNA, 25 nt, Human
uuuuuuuuuuuuuuuuuuuuacaag

SEQ ID NO: 1031145 - RNA, 29 nt, Human
uuuuuuuuuuuuuuuuuuuuuuacaagaa

SEQ ID NO: 1031146 - RNA, 19 nt, Human
aaagugcuggaauuacagg

SEQ ID NO: 1031147 - RNA, 24 nt, Human
aaagugcuggaauuacaggcguga

SEQ ID NO: 1031148 - RNA, 19 nt, Human
aaagugcugggauuacagg

SEQ ID NO: 1031149 - RNA, 19 nt, Human
aaagugcugggauuacagg

SEQ ID NO: 1031150 - RNA, 24 nt, Human
aaagugcugggauuacaggaguga

SEQ ID NO: 1031151 - RNA, 24 nt, Human
aagaacuggcccuggagauaguuu

SEQ ID NO: 1031152 - RNA, 26 nt, Human
aaguagcuaggacuacagaugcccgc

SEQ ID NO: 1031153 - RNA, 19 nt, Human
aaguagcugugauuacagg

SEQ ID NO: 1031154 - RNA, 20 nt, Human
aaguagcugugauuacaggc

SEQ ID NO: 1031155 - RNA, 26 nt, Human
aagugcuggaauuacaggcgugagcu

SEQ ID NO: 1031156 - RNA, 18 nt, Human
aagugcugggauuacagg

SEQ ID NO: 1031157 - RNA, 22 nt, Human
aagugcugggauuacaggaguc

SEQ ID NO: 1031158 - RNA, 26 nt, Human
aagugcugggauuacaggagugagcc

SEQ ID NO: 1031159 - RNA, 18 nt, Human
aauuacaggcgugagcua

SEQ ID NO: 1031160 - RNA, 19 nt, Human
aauuacaggcgugagcuac

SEQ ID NO: 1031161 - RNA, 21 nt, Human
aauuacaggcgugagcuacca

SEQ ID NO: 1031162 - RNA, 23 nt, Human
acacugaaaucucucaaaaugua

SEQ ID NO: 1031163 - RNA, 21 nt, Human
acagaugcccgccaugacacc

SEQ ID NO: 1031164 - RNA, 20 nt, Human
accauguuggccaggcuggu

SEQ ID NO: 1031165 - RNA, 23 nt, Human
accauguuggccaggcuggucuc

SEQ ID NO: 1031166 - RNA, 24 nt, Human
accauguuggccaggcuggucucg

SEQ ID NO: 1031167 - RNA, 18 nt, Human
acgggguuucaccauguu

SEQ ID NO: 1031168 - RNA, 19 nt, Human
acgggguuucaccauguua

SEQ ID NO: 1031169 - RNA, 20 nt, Human
acgggguuucaccauguuag

SEQ ID NO: 1031170 - RNA, 24 nt, Human
acgggguuucaccauguuagccag

SEQ ID NO: 1031171 - RNA, 24 nt, Human
acggguuuugaccauguuggccag

SEQ ID NO: 1031172 - RNA, 19 nt, Human
acucugucgccagggcugg

SEQ ID NO: 1031173 - RNA, 18 nt, Human
aggcgcccgccacuaagc

SEQ ID NO: 1031174 - RNA, 22 nt, Human
aggcgcccgccacuaagcccag

SEQ ID NO: 1031175 - RNA, 25 nt, Human
aggcuggagugcaguggcacaaucu

SEQ ID NO: 1031176 - RNA, 19 nt, Human
aggcuuguggcuggggucu

SEQ ID NO: 1031177 - RNA, 22 nt, Human
aguagagacgggguuucaccau

SEQ ID NO: 1031178 - RNA, 20 nt, Human
agucuuuuuuuuuuuuuuuu

SEQ ID NO: 1031179 - RNA, 24 nt, Human
agugauucuccugccucagccucc

SEQ ID NO: 1031180 - RNA, 20 nt, Human
agugcaguggcacaaucucg

SEQ ID NO: 1031181 - RNA, 24 nt, Human
agugcaguggcacaaucucggcuc

SEQ ID NO: 1031182 - RNA, 21 nt, Human
agugcaguggcgcaaucucag

SEQ ID NO: 1031183 - RNA, 19 nt, Human
aucaucagccaaauccagc

SEQ ID NO: 1031184 - RNA, 21 nt, Human
auucuccugccucagccuccc

SEQ ID NO: 1031185 - RNA, 23 nt, Human
caaagucuuuuuuuuuuuuuuuu

SEQ ID NO: 1031186 - RNA, 24 nt, Human
caaagugcuggaauuacaggcgug

SEQ ID NO: 1031187 - RNA, 24 nt, Human
caaagugcugggauuacaggagug

SEQ ID NO: 1031188 - RNA, 22 nt, Human
caacauuauagacacuaaaaca

SEQ ID NO: 1031189 - RNA, 24 nt, Human
caaccgccacacccagagccccca

SEQ ID NO: 1031190 - RNA, 20 nt, Human
caaccuggaaaccagacucc

SEQ ID NO: 1031191 - RNA, 19 nt, Human
caagccccgagagaggcug

SEQ ID NO: 1031192 - RNA, 20 nt, Human
caagccccgagagaggcugg

SEQ ID NO: 1031193 - RNA, 23 nt, Human
caagccccgagagaggcuggagg

SEQ ID NO: 1031194 - RNA, 22 nt, Human
caagugauucuccugccucagc

SEQ ID NO: 1031195 - RNA, 27 nt, Human
caagugauucuccugccucagccuccc

SEQ ID NO: 1031196 - RNA, 24 nt, Human
cacacccagagcccccaaaaacgg

SEQ ID NO: 1031197 - RNA, 18 nt, Human
caccauguuagccaggau

SEQ ID NO: 1031198 - RNA, 22 nt, Human
caccauguuagccaggaugguc

SEQ ID NO: 1031199 - RNA, 24 nt, Human
caccauguuagccaggauggucuc

SEQ ID NO: 1031200 - RNA, 23 nt, Human
cacccgccucagccucccaaagu

SEQ ID NO: 1031201 - RNA, 23 nt, Human
cacccgccucggccucccaaagu

SEQ ID NO: 1031202 - RNA, 22 nt, Human
cacgccauucuccugccucagc

SEQ ID NO: 1031203 - RNA, 25 nt, Human
cacuaagcccagcuaauuuuuugua

SEQ ID NO: 1031204 - RNA, 22 nt, Human
cacucugucgccagggcuggag

SEQ ID NO: 1031205 - RNA, 21 nt, Human
cacugcaaccuccgccucccg

SEQ ID NO: 1031206 - RNA, 23 nt, Human
cacugcaaccuccgccucccggg

SEQ ID NO: 1031207 - RNA, 23 nt, Human
cacugcaaucuccaccuccuggg

SEQ ID NO: 1031208 - RNA, 21 nt, Human
cagaugcccgccaugacaccc

SEQ ID NO: 1031209 - RNA, 21 nt, Human
cauaaagauaaaauauggaac

SEQ ID NO: 1031210 - RNA, 18 nt, Human
caugacacccagcaaauu

SEQ ID NO: 1031211 - RNA, 24 nt, Human
cauguuggccaggcuggucucgaa

SEQ ID NO: 1031212 - RNA, 20 nt, Human
ccaaagugcuggaauuacag

SEQ ID NO: 1031213 - RNA, 22 nt, Human
ccaaagugcuggaauuacaggc

SEQ ID NO: 1031214 - RNA, 24 nt, Human
ccaaagugcuggaauuacaggcgu

SEQ ID NO: 1031215 - RNA, 19 nt, Human
ccaaagugcugggauuaca

SEQ ID NO: 1031216 - RNA, 21 nt, Human
ccaaagugcugggauuacagg

SEQ ID NO: 1031217 - RNA, 24 nt, Human
ccaaagugcugggauuacaggagu

SEQ ID NO: 1031218 - RNA, 21 nt, Human
ccacacccagagcccccaaaa

SEQ ID NO: 1031219 - RNA, 23 nt, Human
ccacacccagagcccccaaaaac

SEQ ID NO: 1031220 - RNA, 18 nt, Human
ccaccgugcccagccuca

SEQ ID NO: 1031221 - RNA, 24 nt, Human
ccaccuccuggguucaagugauuc

SEQ ID NO: 1031222 - RNA, 22 nt, Human
ccagagcccccaaaaacggcaa

SEQ ID NO: 1031223 - RNA, 22 nt, Human
ccagggcuggagugcaguggcg

SEQ ID NO: 1031224 - RNA, 19 nt, Human
cccaaguagcugugauuac

SEQ ID NO: 1031225 - RNA, 23 nt, Human
cccaaguagcugugauuacaggc

SEQ ID NO: 1031226 - RNA, 22 nt, Human
cccccaaaaacggcaaccugga

SEQ ID NO: 1031227 - RNA, 21 nt, Human
ccccgagagaggcuggaggcu

SEQ ID NO: 1031228 - RNA, 21 nt, Human
cccgccaugacacccagcaaa

SEQ ID NO: 1031229 - RNA, 18 nt, Human
ccgccaugacacccagca

SEQ ID NO: 1031230 - RNA, 24 nt, Human
ccgccucagccucccaaagugcug

SEQ ID NO: 1031231 - RNA, 19 nt, Human
ccuccgccucccggguuca

SEQ ID NO: 1031232 - RNA, 24 nt, Human
ccuccuggguucaagugauucucc

SEQ ID NO: 1031233 - RNA, 21 nt, Human
ccugaccucgugauucacccg

SEQ ID NO: 1031234 - RNA, 20 nt, Human
ccugaccuucugauccaccc

SEQ ID NO: 1031235 - RNA, 23 nt, Human
ccugccucagccucccaaguagc

SEQ ID NO: 1031236 - RNA, 23 nt, Human
ccugccucagccucccaaguagc

SEQ ID NO: 1031237 - RNA, 24 nt, Human
ccugccucagccucccaaguagcu

SEQ ID NO: 1031238 - RNA, 23 nt, Human
ccuggguucaagugauucuccuc

SEQ ID NO: 1031239 - RNA, 23 nt, Human
ccuggguucaagugauucuccug

SEQ ID NO: 1031240 - RNA, 18 nt, Human
cgccacacccagagcccc

SEQ ID NO: 1031241 - RNA, 24 nt, Human
cgccucagccucccaaagugcugg

SEQ ID NO: 1031242 - RNA, 19 nt, Human
cgccucccggguucacgcc

SEQ ID NO: 1031243 - RNA, 24 nt, Human
cgccucggccucccaaagugcugg

SEQ ID NO: 1031244 - RNA, 24 nt, Human
cgggguuucaccauguuagccagg

SEQ ID NO: 1031245 - RNA, 24 nt, Human
cggguuuugaccauguuggccagg

SEQ ID NO: 1031246 - RNA, 22 nt, Human
cgugagcuaccacgccuggccc

SEQ ID NO: 1031247 - RNA, 19 nt, Human
cucacucugucgccagggc

SEQ ID NO: 1031248 - RNA, 24 nt, Human
cucacucugucgccagggcuggag

SEQ ID NO: 1031249 - RNA, 24 nt, Human
cucacugcaaccuccgccucccgg

SEQ ID NO: 1031250 - RNA, 24 nt, Human
cucacugcaaucuccaccuccugg

SEQ ID NO: 1031251 - RNA, 21 nt, Human
cucccggguucacgccauucu

SEQ ID NO: 1031252 - RNA, 24 nt, Human
cuccugaccuucugauccacccgc

SEQ ID NO: 1031253 - RNA, 20 nt, Human
cuccuggguucaagugauuc

SEQ ID NO: 1031254 - RNA, 21 nt, Human
cuccuggguucaagugauucu

SEQ ID NO: 1031255 - RNA, 24 nt, Human
cugauccacccgccucggccuccc

SEQ ID NO: 1031256 - RNA, 23 nt, Human
cugcaaccuccgccucccggguu

SEQ ID NO: 1031257 - RNA, 24 nt, Human
cugcaaucuccaccuccuggguuc

SEQ ID NO: 1031258 - RNA, 23 nt, Human
cugccucagccucccaaguagcu

SEQ ID NO: 1031259 - RNA, 22 nt, Human
cuggcccagaggcuuguggcug

SEQ ID NO: 1031260 - RNA, 21 nt, Human
cuugcucaguugcccaggcug

SEQ ID NO: 1031261 - RNA, 21 nt, Human
cuuuuuuuuuuuuuuuuuuuu

SEQ ID NO: 1031262 - RNA, 22 nt, Human
gaccucgugauucacccgccuc

SEQ ID NO: 1031263 - RNA, 24 nt, Human
gaccucgugauucacccgccucag

SEQ ID NO: 1031264 - RNA, 22 nt, Human
gaccuucugauccacccgccuc

SEQ ID NO: 1031265 - RNA, 22 nt, Human
gaccuucugauccacccgccuc

SEQ ID NO: 1031266 - RNA, 24 nt, Human
gaccuucugauccacccgccucgg

SEQ ID NO: 1031267 - RNA, 24 nt, Human
gacggagucucacucugucgccag

SEQ ID NO: 1031268 - RNA, 19 nt, Human
gagaaaagaacuggcccug

SEQ ID NO: 1031269 - RNA, 24 nt, Human
gagacgggguuucaccauguuagc

SEQ ID NO: 1031270 - RNA, 18 nt, Human
gauuacaggagugagcca

SEQ ID NO: 1031271 - RNA, 24 nt, Human
gauuacaggagugagccaccgugc

SEQ ID NO: 1031272 - RNA, 18 nt, Human
gauuacaggcgcccgcca

SEQ ID NO: 1031273 - RNA, 19 nt, Human
gauuacaggcgcccgccac

SEQ ID NO: 1031274 - RNA, 19 nt, Human
gauuacaggcgcccgccac

SEQ ID NO: 1031275 - RNA, 22 nt, Human
gcaaccuccgccucccggguuc

SEQ ID NO: 1031276 - RNA, 23 nt, Human
gcccagcuaauuuuuuguauuuu

SEQ ID NO: 1031277 - RNA, 19 nt, Human
gcuggagugcaguggcaca

SEQ ID NO: 1031278 - RNA, 19 nt, Human
gcuggagugcaguggcgca

SEQ ID NO: 1031279 - RNA, 18 nt, Human
gcuuguggcuggggucuu

SEQ ID NO: 1031280 - RNA, 23 nt, Human
ggaagggagagaaaagaacuggc

SEQ ID NO: 1031281 - RNA, 24 nt, Human
ggauggucucgaucuccugaccuu

SEQ ID NO: 1031282 - RNA, 20 nt, Human
ggcccagaggcuuguggcug

SEQ ID NO: 1031283 - RNA, 24 nt, Human
ggcuggagugcaguggcgcaaucu

SEQ ID NO: 1031284 - RNA, 24 nt, Human
ggcuggucucgaauuccugaccuc

SEQ ID NO: 1031285 - RNA, 23 nt, Human
gggguuucaccauguuagccagg

SEQ ID NO: 1031286 - RNA, 19 nt, Human
ggucucgaauuccugaccu

SEQ ID NO: 1031287 - RNA, 24 nt, Human
gguuucaccauguuagccaggaug

SEQ ID NO: 1031288 - RNA, 23 nt, Human
guagagacgggguuucaccaugu

SEQ ID NO: 1031289 - RNA, 24 nt, Human
gugauucacccgccucagccuccc

SEQ ID NO: 1031290 - RNA, 24 nt, Human
gugauucuccugccucagccuccc

SEQ ID NO: 1031291 - RNA, 20 nt, Human
gugcccagccucaaguccaa

SEQ ID NO: 1031292 - RNA, 21 nt, Human
uaaauugugugaguguuccuc

SEQ ID NO: 1031293 - RNA, 23 nt, Human
uaaauugugugaguguuccucug

SEQ ID NO: 1031294 - RNA, 24 nt, Human
uaauuuuuuguauuuuuaguagag

SEQ ID NO: 1031295 - RNA, 25 nt, Human
uaauuuuuuguauuuuuaguagaga

SEQ ID NO: 1031296 - RNA, 19 nt, Human
uacaauaauauuaugucca

SEQ ID NO: 1031297 - RNA, 24 nt, Human
uacaggagugagccaccgugccca

SEQ ID NO: 1031298 - RNA, 23 nt, Human
uacaggcgugagcuaccacgccu

SEQ ID NO: 1031299 - RNA, 19 nt, Human
uacccacgugcagcagcaa

SEQ ID NO: 1031300 - RNA, 19 nt, Human
uacggcaaccgccacaccc

SEQ ID NO: 1031301 - RNA, 22 nt, Human
uagagacgggguuucaccaugu

SEQ ID NO: 1031302 - RNA, 21 nt, Human
uaggacuacagaugcccgcca

SEQ ID NO: 1031303 - RNA, 24 nt, Human
uaguagagacgggguuucaccaug

SEQ ID NO: 1031304 - RNA, 26 nt, Human
uaguagagacgggguuucaccauguu

SEQ ID NO: 1031305 - RNA, 24 nt, Human
uaguagagacggguuuugaccaug

SEQ ID NO: 1031306 - RNA, 19 nt, Human
ucaagugauucuccugccu

SEQ ID NO: 1031307 - RNA, 24 nt, Human
ucaccauguuagccaggauggucu

SEQ ID NO: 1031308 - RNA, 23 nt, Human
ucacugcaaccuccgccucccgg

SEQ ID NO: 1031309 - RNA, 24 nt, Human
ucacugcaaccuccgccucccggg

SEQ ID NO: 1031310 - RNA, 25 nt, Human
ucacugcaaccuccgccucccgggu

SEQ ID NO: 1031311 - RNA, 26 nt, Human
ucacugcaaccuccgccucccggguu

SEQ ID NO: 1031312 - RNA, 23 nt, Human
ucacugcaaucuccaccuccugg

SEQ ID NO: 1031313 - RNA, 24 nt, Human
ucacugcaaucuccaccuccuggg

SEQ ID NO: 1031314 - RNA, 25 nt, Human
ucacugcaaucuccaccuccugggu

SEQ ID NO: 1031315 - RNA, 27 nt, Human
ucacugcaaucuccaccuccuggguuc

SEQ ID NO: 1031316 - RNA, 24 nt, Human
ucagcaaacaagccccgagagagg

SEQ ID NO: 1031317 - RNA, 20 nt, Human
ucagccucccaaguagcuag

SEQ ID NO: 1031318 - RNA, 20 nt, Human
ucagccucccaaguagcugg

SEQ ID NO: 1031319 - RNA, 23 nt, Human
ucagggacacagaacaaaucuga

SEQ ID NO: 1031320 - RNA, 24 nt, Human
ucaguugcccaggcuggagugcag

SEQ ID NO: 1031321 - RNA, 24 nt, Human
ucccaaagugcuggaauuacaggc

SEQ ID NO: 1031322 - RNA, 18 nt, Human
ucccaaagugcugggauu

SEQ ID NO: 1031323 - RNA, 23 nt, Human
ucccaaagugcugggauuacagg

SEQ ID NO: 1031324 - RNA, 24 nt, Human
ucccaaguagcugugauuacaggc

SEQ ID NO: 1031325 - RNA, 21 nt, Human
ucccggguucacgccauucuc

SEQ ID NO: 1031326 - RNA, 24 nt, Human
ucccggguucacgccauucuccug

SEQ ID NO: 1031327 - RNA, 21 nt, Human
uccuggguucaagugauucuc

SEQ ID NO: 1031328 - RNA, 24 nt, Human
uccuggguucaagugauucuccug

SEQ ID NO: 1031329 - RNA, 18 nt, Human
ucgccagggcuggagugc

SEQ ID NO: 1031330 - RNA, 18 nt, Human
ucggccucccaaagugcu

SEQ ID NO: 1031331 - RNA, 24 nt, Human
ucucacucugucgccagggcugga

SEQ ID NO: 1031332 - RNA, 22 nt, Human
ucuccaccuccuggguucaagu

SEQ ID NO: 1031333 - RNA, 26 nt, Human
ucuccugccucagccucccaaguagc

SEQ ID NO: 1031334 - RNA, 26 nt, Human
ucuccugccucagccucccaaguagc

SEQ ID NO: 1031335 - RNA, 24 nt, Human
ucugucgccagggcuggagugcag

SEQ ID NO: 1031336 - RNA, 22 nt, Human
ucuugcucaguugcccaggcug

SEQ ID NO: 1031337 - RNA, 23 nt, Human
ucuugcucaguugcccaggcugg

SEQ ID NO: 1031338 - RNA, 24 nt, Human
ucuugcucaguugcccaggcugga

SEQ ID NO: 1031339 - RNA, 27 nt, Human
ucuuuuuuuuuuuuuuuuuuuuugggg

SEQ ID NO: 1031340 - RNA, 22 nt, Human
ugauacccacgugcagcagcaa

SEQ ID NO: 1031341 - RNA, 20 nt, Human
ugauucuccugccucagccu

SEQ ID NO: 1031342 - RNA, 22 nt, Human
ugcaguggcacaaucucggcuc

SEQ ID NO: 1031343 - RNA, 22 nt, Human
ugcaguggcgcaaucucagcuc

SEQ ID NO: 1031344 - RNA, 23 nt, Human
ugcaguggcgcaaucucagcuca

SEQ ID NO: 1031345 - RNA, 18 nt, Human
ugcccaggcuggagugca

SEQ ID NO: 1031346 - RNA, 21 nt, Human
ugcccaggcuggagugcagug

SEQ ID NO: 1031347 - RNA, 22 nt, Human
ugcccaggcuggagugcagugg

SEQ ID NO: 1031348 - RNA, 24 nt, Human
ugcccaggcuggagugcaguggca

SEQ ID NO: 1031349 - RNA, 23 nt, Human
ugccucagccucccaaguagcua

SEQ ID NO: 1031350 - RNA, 24 nt, Human
ugccucagccucccaaguagcuag

SEQ ID NO: 1031351 - RNA, 25 nt, Human
ugccucagccucccaaguagcugug

SEQ ID NO: 1031352 - RNA, 24 nt, Human
ugcucaguugcccaggcuggagug

SEQ ID NO: 1031353 - RNA, 20 nt, Human
ugcuggaauuacaggcguga

SEQ ID NO: 1031354 - RNA, 18 nt, Human
uggaaaccagacuccaaa

SEQ ID NO: 1031355 - RNA, 22 nt, Human
uggaacuucagggacacagaac

SEQ ID NO: 1031356 - RNA, 18 nt, Human
uggaauuacaggcgugag

SEQ ID NO: 1031357 - RNA, 19 nt, Human
uggaauuacaggcgugagc

SEQ ID NO: 1031358 - RNA, 22 nt, Human
uggaauuacaggcgugagcuac

SEQ ID NO: 1031359 - RNA, 24 nt, Human
uggaauuacaggcgugagcuacca

SEQ ID NO: 1031360 - RNA, 18 nt, Human
uggaggcuggcccagagg

SEQ ID NO: 1031361 - RNA, 23 nt, Human
uggagugcaguggcacaaucucg

SEQ ID NO: 1031362 - RNA, 24 nt, Human
uggagugcaguggcacaaucucgg

SEQ ID NO: 1031363 - RNA, 18 nt, Human
uggagugcaguggcgcaa

SEQ ID NO: 1031364 - RNA, 23 nt, Human
uggagugcaguggcgcaaucuca

SEQ ID NO: 1031365 - RNA, 24 nt, Human
uggagugcaguggcgcaaucucag

SEQ ID NO: 1031366 - RNA, 24 nt, Human
uggcacaaucucggcucacugcaa

SEQ ID NO: 1031367 - RNA, 24 nt, Human
uggccaggcuggucucgaauuccu

SEQ ID NO: 1031368 - RNA, 24 nt, Human
uggcgcaaucucagcucacugcaa

SEQ ID NO: 1031369 - RNA, 22 nt, Human
ugggauuacaggagugagccac

SEQ ID NO: 1031370 - RNA, 23 nt, Human
ugggauuacaggagugagccacc

SEQ ID NO: 1031371 - RNA, 23 nt, Human
ugggauuacaggagugagccacc

SEQ ID NO: 1031372 - RNA, 24 nt, Human
ugggauuacaggagugagccaccg

SEQ ID NO: 1031373 - RNA, 23 nt, Human
uggguucaagugauucuccugcc

SEQ ID NO: 1031374 - RNA, 21 nt, Human
ugugauuacaggcgcccgcca

SEQ ID NO: 1031375 - RNA, 18 nt, Human
uuacuuggugcuucugau

SEQ ID NO: 1031376 - RNA, 18 nt, Human
uuaguagagacgggguuu

SEQ ID NO: 1031377 - RNA, 22 nt, Human
uuaguagagacgggguuucacc

SEQ ID NO: 1031378 - RNA, 24 nt, Human
uuaguagagacgggguuucaccau

SEQ ID NO: 1031379 - RNA, 24 nt, Human
uuaguagagacggguuuugaccau

SEQ ID NO: 1031380 - RNA, 21 nt, Human
uucaagugauucuccugccuc

SEQ ID NO: 1031381 - RNA, 23 nt, Human
uucaagugauucuccugccucag

SEQ ID NO: 1031382 - RNA, 24 nt, Human
uucaagugauucuccugccucagc

SEQ ID NO: 1031383 - RNA, 19 nt, Human
uucacccgccucagccucc

SEQ ID NO: 1031384 - RNA, 21 nt, Human
uucacccgccucagccuccca

SEQ ID NO: 1031385 - RNA, 24 nt, Human
uuccugaccucgugauucacccgc

SEQ ID NO: 1031386 - RNA, 23 nt, Human
uugagacagucuugcucaguugc

SEQ ID NO: 1031387 - RNA, 24 nt, Human
uugcccaggcuggagugcaguggc

SEQ ID NO: 1031388 - RNA, 24 nt, Human
uugcucaguugcccaggcuggagu

SEQ ID NO: 1031389 - RNA, 19 nt, Human
uuucaccauguuagccagg

SEQ ID NO: 1031390 - RNA, 20 nt, Human
uuucaccauguuagccagga

SEQ ID NO: 1031391 - RNA, 24 nt, Human
uuugaccauguuggccaggcuggu

SEQ ID NO: 1031392 - RNA, 23 nt, Human
uuuugaccauguuggccaggcug

SEQ ID NO: 1031393 - RNA, 23 nt, Human
uuuugagacagucuugcucaguu

SEQ ID NO: 1031394 - RNA, 24 nt, Human
uuuuuaguagagacgggguuucac

SEQ ID NO: 1031395 - RNA, 18 nt, Human
uuuuuaguagagacgggu

SEQ ID NO: 1031396 - RNA, 21 nt, Human
uuuuuguauuuuuaguagaga

SEQ ID NO: 1031397 - RNA, 21 nt, Human
uuuuuuauauuuuuaguagag

SEQ ID NO: 1031398 - RNA, 24 nt, Human
uuuuuuauauuuuuaguagagacg

SEQ ID NO: 1031399 - RNA, 24 nt, Human
uuuuuuguauuuuuaguagagacg

SEQ ID NO: 1031400 - RNA, 23 nt, Human
uuuuuuuuuuuuugagacagucu

SEQ ID NO: 1031401 - RNA, 18 nt, Human
aaaacuucugagaucuag

SEQ ID NO: 1031402 - RNA, 20 nt, Human
aaacaaaaaaggaaauaaaa

SEQ ID NO: 1031403 - RNA, 22 nt, Human
aaacacaaccagaacaguucua

SEQ ID NO: 1031404 - RNA, 22 nt, Human
aaacugcuccauucuaaaugua

SEQ ID NO: 1031405 - RNA, 24 nt, Human
aaccagugcugcucucugucauaa

SEQ ID NO: 1031406 - RNA, 26 nt, Human
aacgugcacaugugugcacgugcaca

SEQ ID NO: 1031407 - RNA, 21 nt, Human
aagauuuuaacaugugagcaa

SEQ ID NO: 1031408 - RNA, 19 nt, Human
aagcagucuaucaaauaua

SEQ ID NO: 1031409 - RNA, 20 nt, Human
aauaccagagcaacacucuc

SEQ ID NO: 1031410 - RNA, 20 nt, Human
aauaccagagcaacacucuc

SEQ ID NO: 1031411 - RNA, 26 nt, Human
acagaggccuucaauccuacuuaaag

SEQ ID NO: 1031412 - RNA, 18 nt, Human
acaggguuucauaggugc

SEQ ID NO: 1031413 - RNA, 30 nt, Human
acaugugugcacgugcacacgcacacacag

SEQ ID NO: 1031414 - RNA, 25 nt, Human
accagaauaccagacuucagaaccc

SEQ ID NO: 1031415 - RNA, 21 nt, Human
accagugcugcucucugucau

SEQ ID NO: 1031416 - RNA, 21 nt, Human
acccagaauaccagagcaaca

SEQ ID NO: 1031417 - RNA, 20 nt, Human
accucaccucgcccccgccg

SEQ ID NO: 1031418 - RNA, 19 nt, Human
acuagguguguacaggguu

SEQ ID NO: 1031419 - RNA, 22 nt, Human
agaggaacagguuacuuuugag

SEQ ID NO: 1031420 - RNA, 23 nt, Human
aggcccucuucuccccacaaaaa

SEQ ID NO: 1031421 - RNA, 20 nt, Human
aggugcuuuguaaacaucag

SEQ ID NO: 1031422 - RNA, 21 nt, Human
agucauacuuuugaacccaga

SEQ ID NO: 1031423 - RNA, 18 nt, Human
aucgcuccgcgucccccc

SEQ ID NO: 1031424 - RNA, 21 nt, Human
caaacacaaccagaacaguuc

SEQ ID NO: 1031425 - RNA, 22 nt, Human
caaacgugcacaugugugcacg

SEQ ID NO: 1031426 - RNA, 19 nt, Human
cacccccucucccucccgc

SEQ ID NO: 1031427 - RNA, 20 nt, Human
cacccccucucccucccgcc

SEQ ID NO: 1031428 - RNA, 19 nt, Human
caccucaccucgcccccgc

SEQ ID NO: 1031429 - RNA, 25 nt, Human
cagaggccuucaauccuacuuaaag

SEQ ID NO: 1031430 - RNA, 26 nt, Human
cauuuuuauuucaaguguauuuaaaa

SEQ ID NO: 1031431 - RNA, 19 nt, Human
ccaacaccucaccucgccc

SEQ ID NO: 1031432 - RNA, 21 nt, Human
ccauuuauaaguuuauuucca

SEQ ID NO: 1031433 - RNA, 23 nt, Human
cccacagaggccuucaauccuac

SEQ ID NO: 1031434 - RNA, 19 nt, Human
ccccccgagcccgaacccc

SEQ ID NO: 1031435 - RNA, 21 nt, Human
ccccccgagcccgaaccccuu

SEQ ID NO: 1031436 - RNA, 24 nt, Human
ccccccgagcccgaaccccuuucc

SEQ ID NO: 1031437 - RNA, 19 nt, Human
ccccccgccccccgagccc

SEQ ID NO: 1031438 - RNA, 23 nt, Human
cccccgagcccgaaccccuuucc

SEQ ID NO: 1031439 - RNA, 24 nt, Human
cccccgagcccgaaccccuuucca

SEQ ID NO: 1031440 - RNA, 21 nt, Human
cccccgccgccaccucgugcc

SEQ ID NO: 1031441 - RNA, 18 nt, Human
ccccgccccccgagcccg

SEQ ID NO: 1031442 - RNA, 22 nt, Human
ccccuaaaaugugcuauuccaa

SEQ ID NO: 1031443 - RNA, 18 nt, Human
ccccucucccucccgccc

SEQ ID NO: 1031444 - RNA, 19 nt, Human
ccccugcggccggcgcggg

SEQ ID NO: 1031445 - RNA, 22 nt, Human
cccgaaccccuuuccacugcca

SEQ ID NO: 1031446 - RNA, 19 nt, Human
cccgccccccgagcccgaa

SEQ ID NO: 1031447 - RNA, 19 nt, Human
cccucuucuccccacaaaa

SEQ ID NO: 1031448 - RNA, 20 nt, Human
cccuuuccacugccaacacc

SEQ ID NO: 1031449 - RNA, 18 nt, Human
ccgcccacucccgcagcu

SEQ ID NO: 1031450 - RNA, 20 nt, Human
ccucccgccaaacacaaccg

SEQ ID NO: 1031451 - RNA, 23 nt, Human
ccucggacacccccucucccucc

SEQ ID NO: 1031452 - RNA, 20 nt, Human
ccucuggagcuccuuucaac

SEQ ID NO: 1031453 - RNA, 21 nt, Human
cgccaaacacaaccagaacag

SEQ ID NO: 1031454 - RNA, 22 nt, Human
cgccccccgagcccgaaccccu

SEQ ID NO: 1031455 - RNA, 18 nt, Human
cgcuccgcguccccccgc

SEQ ID NO: 1031456 - RNA, 21 nt, Human
cuauuccaaagaggaacaggu

SEQ ID NO: 1031457 - RNA, 24 nt, Human
cuauuuuucaaaacuucugagauc

SEQ ID NO: 1031458 - RNA, 21 nt, Human
cuccaauacguccccauuuau

SEQ ID NO: 1031459 - RNA, 21 nt, Human
cuccgcguccccccgcccccc

SEQ ID NO: 1031460 - RNA, 18 nt, Human
cuccucuggagcuccuuu

SEQ ID NO: 1031461 - RNA, 20 nt, Human
gaaccccuuuccacugccaa

SEQ ID NO: 1031462 - RNA, 23 nt, Human
gaagauagguauucccucugcuc

SEQ ID NO: 1031463 - RNA, 19 nt, Human
ggaaguagcugggcugaag

SEQ ID NO: 1031464 - RNA, 18 nt, Human
gggaaguagcugggcuga

SEQ ID NO: 1031465 - RNA, 19 nt, Human
gguaacuucccucaaaugu

SEQ ID NO: 1031466 - RNA, 20 nt, Human
gguauuaaccaugccccuaa

SEQ ID NO: 1031467 - RNA, 20 nt, Human
gugagcaacacagaacucca

SEQ ID NO: 1031468 - RNA, 21 nt, Human
gugcacacgcacacacacaca

SEQ ID NO: 1031469 - RNA, 24 nt, Human
gugcacacgcacacacacacacuc

SEQ ID NO: 1031470 - RNA, 21 nt, Human
uaaaaauaacagaaccagugc

SEQ ID NO: 1031471 - RNA, 22 nt, Human
uaaaaauaacagaaccagugcu

SEQ ID NO: 1031472 - RNA, 19 nt, Human
uaaaagagaacauguaaaa

SEQ ID NO: 1031473 - RNA, 22 nt, Human
uaagaaggacugaacaaaaauu

SEQ ID NO: 1031474 - RNA, 25 nt, Human
uacacacaguaaccaucaggauuua

SEQ ID NO: 1031475 - RNA, 18 nt, Human
uaccagagcaacacucuc

SEQ ID NO: 1031476 - RNA, 18 nt, Human
uaccagagcaacacucuc

SEQ ID NO: 1031477 - RNA, 20 nt, Human
uagggaaguagcugggcuga

SEQ ID NO: 1031478 - RNA, 21 nt, Human
uauuuuaaauaaaaaugguug

SEQ ID NO: 1031479 - RNA, 21 nt, Human
ucagaauaccagagcaacacu

SEQ ID NO: 1031480 - RNA, 18 nt, Human
ucaggcccucuucucccc

SEQ ID NO: 1031481 - RNA, 23 nt, Human
uccaccuuuacuaucaagauuac

SEQ ID NO: 1031482 - RNA, 24 nt, Human
uccaccuuuacuaucaagauuaca

SEQ ID NO: 1031483 - RNA, 19 nt, Human
uccacugccaacaccucac

SEQ ID NO: 1031484 - RNA, 20 nt, Human
uccacugccaacaccucacc

SEQ ID NO: 1031485 - RNA, 28 nt, Human
uccauacauacaaacgugcacaugugug

SEQ ID NO: 1031486 - RNA, 24 nt, Human
uccccccgccccccgagcccgaac

SEQ ID NO: 1031487 - RNA, 26 nt, Human
uccccccgccccccgagcccgaaccc

SEQ ID NO: 1031488 - RNA, 22 nt, Human
uccccucccgccaaacacaacc

SEQ ID NO: 1031489 - RNA, 23 nt, Human
ucccgcccacucccgcagcgcga

SEQ ID NO: 1031490 - RNA, 23 nt, Human
uccgcguccccccgccccccgag

SEQ ID NO: 1031491 - RNA, 24 nt, Human
ugaggaaaaaagcugccuugguaa

SEQ ID NO: 1031492 - RNA, 18 nt, Human
ugauaaggguuuucugaa

SEQ ID NO: 1031493 - RNA, 25 nt, Human
ugcacgugcacacgcacacacacag

SEQ ID NO: 1031494 - RNA, 22 nt, Human
ugccaacaccucaccucgcccc

SEQ ID NO: 1031495 - RNA, 20 nt, Human
uggagcuccuuucaacucaa

SEQ ID NO: 1031496 - RNA, 22 nt, Human
uuccaaauccagucuucuuugc

SEQ ID NO: 1031497 - RNA, 26 nt, Human
uugaacccagaauaccagaauaccag

SEQ ID NO: 1031498 - RNA, 24 nt, Human
uuuaugcuugcuugguuuuuuuga

SEQ ID NO: 1031499 - RNA, 24 nt, Human
uuugacuacaauuaagagaugaaa

SEQ ID NO: 1031500 - RNA, 20 nt, Human
uuuguaaacaucagagucac

SEQ ID NO: 1031501 - RNA, 21 nt, Human
aaaaauuauccuggauccagg

SEQ ID NO: 1031502 - RNA, 24 nt, Human
aaaacccaccauuaaaauaagaca

SEQ ID NO: 1031503 - RNA, 22 nt, Human
aaaauaagacaaguucauagaa

SEQ ID NO: 1031504 - RNA, 19 nt, Human
aaacugguuuaaccucaca

SEQ ID NO: 1031505 - RNA, 22 nt, Human
aaaggccuccagagcuuucucc

SEQ ID NO: 1031506 - RNA, 22 nt, Human
aaccaaacccuccuggucucug

SEQ ID NO: 1031507 - RNA, 23 nt, Human
aacucagcccucauuccccucug

SEQ ID NO: 1031508 - RNA, 19 nt, Human
aagcaucgaaaucgccacu

SEQ ID NO: 1031509 - RNA, 22 nt, Human
aaugaaggcacuccaggaagaa

SEQ ID NO: 1031510 - RNA, 19 nt, Human
acaccaauuccucugcgua

SEQ ID NO: 1031511 - RNA, 20 nt, Human
acccuccacccauagccaaa

SEQ ID NO: 1031512 - RNA, 25 nt, Human
agaaccucuucaaacucacccucca

SEQ ID NO: 1031513 - RNA, 21 nt, Human
agagcccacccauguccagcc

SEQ ID NO: 1031514 - RNA, 22 nt, Human
agcaagaccucauuugggccug

SEQ ID NO: 1031515 - RNA, 21 nt, Human
aggaagaaggggaguuccugg

SEQ ID NO: 1031516 - RNA, 26 nt, Human
aggaauuaaaggcuauagcucaagcu

SEQ ID NO: 1031517 - RNA, 25 nt, Human
aggggugggguggggcauguugggg

SEQ ID NO: 1031518 - RNA, 20 nt, Human
agguccacaaguagcaguuu

SEQ ID NO: 1031519 - RNA, 24 nt, Human
aucugaaagaaucgggcacaaggg

SEQ ID NO: 1031520 - RNA, 26 nt, Human
caaacucacccuccacccauagccaa

SEQ ID NO: 1031521 - RNA, 23 nt, Human
cacccauagccaaaguaaggaau

SEQ ID NO: 1031522 - RNA, 21 nt, Human
cacccuccacccauagccaaa

SEQ ID NO: 1031523 - RNA, 19 nt, Human
cagaaaaaaaacccaccau

SEQ ID NO: 1031524 - RNA, 20 nt, Human
cagaagcuguagaagaggca

SEQ ID NO: 1031525 - RNA, 18 nt, Human
caguagcaguggaaccag

SEQ ID NO: 1031526 - RNA, 24 nt, Human
caguggaaccaggaaacccaaggg

SEQ ID NO: 1031527 - RNA, 23 nt, Human
cauaacucagcccucauuccccu

SEQ ID NO: 1031528 - RNA, 18 nt, Human
ccaccucccggauggcug

SEQ ID NO: 1031529 - RNA, 22 nt, Human
ccagagcuuucuccagaggaaa

SEQ ID NO: 1031530 - RNA, 19 nt, Human
cccacccauguccagccau

SEQ ID NO: 1031531 - RNA, 23 nt, Human
cccagguuacaagaaaaucagaa

SEQ ID NO: 1031532 - RNA, 21 nt, Human
cccgagacuggggaugagggc

SEQ ID NO: 1031533 - RNA, 24 nt, Human
cccucugggucaguagcaguggaa

SEQ ID NO: 1031534 - RNA, 25 nt, Human
ccucuuacuuuuuccacauuagggg

SEQ ID NO: 1031535 - RNA, 21 nt, Human
ccugugagcuaaccaaacccu

SEQ ID NO: 1031536 - RNA, 22 nt, Human
cuccaggaagaaggggaguucc

SEQ ID NO: 1031537 - RNA, 19 nt, Human
cuggcaccugccugccaaa

SEQ ID NO: 1031538 - RNA, 22 nt, Human
cuuuuuuguuuguuuguuuuuu

SEQ ID NO: 1031539 - RNA, 19 nt, Human
gaccguacuuagggguggg

SEQ ID NO: 1031540 - RNA, 21 nt, Human
gaguaguccucuuacuuuuuc

SEQ ID NO: 1031541 - RNA, 21 nt, Human
gcaaacugguuuaaccucaca

SEQ ID NO: 1031542 - RNA, 21 nt, Human
gcaagaccucauuugggccug

SEQ ID NO: 1031543 - RNA, 18 nt, Human
ggccugguucagggauag

SEQ ID NO: 1031544 - RNA, 21 nt, Human
gggccagauuuccuuccucaa

SEQ ID NO: 1031545 - RNA, 22 nt, Human
ggguggggcauguuggggaggg

SEQ ID NO: 1031546 - RNA, 21 nt, Human
ggucaguagcaguggaaccag

SEQ ID NO: 1031547 - RNA, 19 nt, Human
guccucuuacuuuuuccac

SEQ ID NO: 1031548 - RNA, 22 nt, Human
guccucuuacuuuuuccacauu

SEQ ID NO: 1031549 - RNA, 25 nt, Human
guggcagauuuucaugaaaaucagc

SEQ ID NO: 1031550 - RNA, 19 nt, Human
uaaccaaacccuccugguc

SEQ ID NO: 1031551 - RNA, 21 nt, Human
uaaccaaacccuccuggucuc

SEQ ID NO: 1031552 - RNA, 21 nt, Human
uaccagaaaaaaaacccacca

SEQ ID NO: 1031553 - RNA, 18 nt, Human
uaggggaaugcaaacugg

SEQ ID NO: 1031554 - RNA, 18 nt, Human
uaggggugggguggggca

SEQ ID NO: 1031555 - RNA, 26 nt, Human
uaggggugggguggggcauguugggg

SEQ ID NO: 1031556 - RNA, 19 nt, Human
ucacuggggucacacuuga

SEQ ID NO: 1031557 - RNA, 25 nt, Human
ucagagcccacccauguccagccau

SEQ ID NO: 1031558 - RNA, 22 nt, Human
ucaguagcaguggaaccaggaa

SEQ ID NO: 1031559 - RNA, 23 nt, Human
uccaaaucuuaccagaaaaaaaa

SEQ ID NO: 1031560 - RNA, 20 nt, Human
ucccagguuacaagaaaauc

SEQ ID NO: 1031561 - RNA, 25 nt, Human
uccucauucuugaugaauagucuca

SEQ ID NO: 1031562 - RNA, 19 nt, Human
uccucuuacuuuuuccaca

SEQ ID NO: 1031563 - RNA, 23 nt, Human
uccuggauccaggaaagugaugc

SEQ ID NO: 1031564 - RNA, 23 nt, Human
ugaaagaaucgggcacaagguca

SEQ ID NO: 1031565 - RNA, 24 nt, Human
ugacaagccuucaucccagacccu

SEQ ID NO: 1031566 - RNA, 23 nt, Human
ugaguaguccucuuacuuuuucc

SEQ ID NO: 1031567 - RNA, 24 nt, Human
ugaguaguccucuuacuuuuucca

SEQ ID NO: 1031568 - RNA, 19 nt, Human
ugcugaacuuugcucagca

SEQ ID NO: 1031569 - RNA, 19 nt, Human
uggaagugcugacaagccu

SEQ ID NO: 1031570 - RNA, 18 nt, Human
uggggugggggaaguccu

SEQ ID NO: 1031571 - RNA, 24 nt, Human
uggggugggggaaguccugugagc

SEQ ID NO: 1031572 - RNA, 21 nt, Human
ugguaaugagaagaggaaaga

SEQ ID NO: 1031573 - RNA, 18 nt, Human
uguuuguuuguuuuuuuc

SEQ ID NO: 1031574 - RNA, 21 nt, Human
uucaaaagagaaaguucugca

SEQ ID NO: 1031575 - RNA, 22 nt, Human
uucauaacucagcccucauucc

SEQ ID NO: 1031576 - RNA, 21 nt, Human
uuuaaaaauuauccuggaucc

SEQ ID NO: 1031577 - RNA, 25 nt, Human
uuuaucaucaaaacaaacagccaau

SEQ ID NO: 1031578 - RNA, 22 nt, Human
uuuucaugaaaaucagcuucug

SEQ ID NO: 1031579 - RNA, 21 nt, Human
uuuuuguuuguuuguuuuuuu

SEQ ID NO: 1031580 - RNA, 18 nt, Human
aaaagcccagcaagagaa

SEQ ID NO: 1031581 - RNA, 24 nt, Human
aaaagcccagcaagagaaacagaa

SEQ ID NO: 1031582 - RNA, 18 nt, Human
aaaccugaaagugaagca

SEQ ID NO: 1031583 - RNA, 20 nt, Human
aagagaaacagaaaucuggc

SEQ ID NO: 1031584 - RNA, 21 nt, Human
aagccacauccuggagcacca

SEQ ID NO: 1031585 - RNA, 24 nt, Human
aaggcacuucgagaaaccugaaag

SEQ ID NO: 1031586 - RNA, 19 nt, Human
aaggcaggcgaugggggcc

SEQ ID NO: 1031587 - RNA, 18 nt, Human
acaggagcaagaaggcac

SEQ ID NO: 1031588 - RNA, 24 nt, Human
acuucgagaaaccugaaagugaag

SEQ ID NO: 1031589 - RNA, 22 nt, Human
agaaacagaaaucuggcaggau

SEQ ID NO: 1031590 - RNA, 19 nt, Human
agaaaccugaaagugaagc

SEQ ID NO: 1031591 - RNA, 25 nt, Human
agaaaucuggcaggauggggaaaca

SEQ ID NO: 1031592 - RNA, 19 nt, Human
agacaggagcaagaaggca

SEQ ID NO: 1031593 - RNA, 20 nt, Human
agacugcuguguagggcugg

SEQ ID NO: 1031594 - RNA, 18 nt, Human
agauuccuccccuccacc

SEQ ID NO: 1031595 - RNA, 19 nt, Human
agauuccuccccuccaccc

SEQ ID NO: 1031596 - RNA, 22 nt, Human
agcaagaaggcacuucgagaaa

SEQ ID NO: 1031597 - RNA, 21 nt, Human
aggagccagguagccccagag

SEQ ID NO: 1031598 - RNA, 26 nt, Human
aggcuccacagauaaguccccaguga

SEQ ID NO: 1031599 - RNA, 22 nt, Human
aggcuugcccacagggccccgg

SEQ ID NO: 1031600 - RNA, 24 nt, Human
auccuggagcaccaggcuccacag

SEQ ID NO: 1031601 - RNA, 18 nt, Human
caaaagcccagcaagaga

SEQ ID NO: 1031602 - RNA, 22 nt, Human
caagagaaacagaaaucuggca

SEQ ID NO: 1031603 - RNA, 18 nt, Human
cacccccccucccccaau

SEQ ID NO: 1031604 - RNA, 20 nt, Human
cacccccccucccccaauaa

SEQ ID NO: 1031605 - RNA, 22 nt, Human
cacuguccucucuggcuggcug

SEQ ID NO: 1031606 - RNA, 21 nt, Human
cagacaggagcaagaaggcac

SEQ ID NO: 1031607 - RNA, 22 nt, Human
cagauuccuccccuccaccccc

SEQ ID NO: 1031608 - RNA, 22 nt, Human
caggaggcuugcccacagggcc

SEQ ID NO: 1031609 - RNA, 18 nt, Human
cauccuggagcaccaggc

SEQ ID NO: 1031610 - RNA, 20 nt, Human
ccaaaagcccagcaagagaa

SEQ ID NO: 1031611 - RNA, 20 nt, Human
ccaauaaguuccccuccucu

SEQ ID NO: 1031612 - RNA, 26 nt, Human
ccaggcuccacagauaaggugcuacg

SEQ ID NO: 1031613 - RNA, 19 nt, Human
ccccaauaaguuccccucc

SEQ ID NO: 1031614 - RNA, 22 nt, Human
ccccagugacgucucaggccag

SEQ ID NO: 1031615 - RNA, 23 nt, Human
cccccccucccccaauaaguucc

SEQ ID NO: 1031616 - RNA, 20 nt, Human
cccuccacccccccuccccc

SEQ ID NO: 1031617 - RNA, 21 nt, Human
ccuccacccccccucccccaa

SEQ ID NO: 1031618 - RNA, 21 nt, Human
cuccacuguccucucuggcug

SEQ ID NO: 1031619 - RNA, 19 nt, Human
cuccccuccacccccccuc

SEQ ID NO: 1031620 - RNA, 21 nt, Human
cuccccuccacccccccuccc

SEQ ID NO: 1031621 - RNA, 21 nt, Human
cuggcugggccuaggagccag

SEQ ID NO: 1031622 - RNA, 18 nt, Human
cugggcuccacuguccuc

SEQ ID NO: 1031623 - RNA, 19 nt, Human
cuguccucucuggcuggcu

SEQ ID NO: 1031624 - RNA, 24 nt, Human
gacugcuguguagggcuggggugg

SEQ ID NO: 1031625 - RNA, 25 nt, Human
gcuccacuguccucucuggcuggcu

SEQ ID NO: 1031626 - RNA, 20 nt, Human
ggagagaaggcaggcgaugg

SEQ ID NO: 1031627 - RNA, 25 nt, Human
gggaaacagacaggagcaagaaggc

SEQ ID NO: 1031628 - RNA, 24 nt, Human
gggugggguuuggcgggcuggggg

SEQ ID NO: 1031629 - RNA, 21 nt, Human
uaaguccccagugacgucuuc

SEQ ID NO: 1031630 - RNA, 22 nt, Human
uacugccaaaagcccagcaaga

SEQ ID NO: 1031631 - RNA, 22 nt, Human
uaggagccagguagccccagag

SEQ ID NO: 1031632 - RNA, 18 nt, Human
uccagauuccuccccucc

SEQ ID NO: 1031633 - RNA, 21 nt, Human
uccagauuccuccccuccacc

SEQ ID NO: 1031634 - RNA, 23 nt, Human
uccagauuccuccccuccacccc

SEQ ID NO: 1031635 - RNA, 23 nt, Human
ucccaaggagacgugucugggcu

SEQ ID NO: 1031636 - RNA, 21 nt, Human
ucccccaauaaguuccccucc

SEQ ID NO: 1031637 - RNA, 23 nt, Human
uccccuccacccccccuccccca

SEQ ID NO: 1031638 - RNA, 21 nt, Human
ugagaagccacauccuggagc

SEQ ID NO: 1031639 - RNA, 18 nt, Human
ugccaaaagcccagcaag

SEQ ID NO: 1031640 - RNA, 18 nt, Human
uggcaggauggggaaaca

SEQ ID NO: 1031641 - RNA, 20 nt, Human
uggcaggauggggaaacaga

SEQ ID NO: 1031642 - RNA, 22 nt, Human
uggggugggguuuggcgggcug

SEQ ID NO: 1031643 - RNA, 25 nt, Human
ugucugggcuccacuguccucucug

SEQ ID NO: 1031644 - RNA, 19 nt, Human
uucaugagaagccacaucc

SEQ ID NO: 1031645 - RNA, 20 nt, Human
uuccccuccucuggccagag

SEQ ID NO: 1031646 - RNA, 21 nt, Human
agagacagaaccuggagaaag

SEQ ID NO: 1031647 - RNA, 22 nt, Human
cugauaaauguuuuguaagcug

SEQ ID NO: 1031648 - RNA, 20 nt, Human
gaaccuggagaaaggcugcg

SEQ ID NO: 1031649 - RNA, 22 nt, Human
gaguggggcuccacuccuccag

SEQ ID NO: 1031650 - RNA, 19 nt, Human
ggagagacagaaccuggag

SEQ ID NO: 1031651 - RNA, 18 nt, Human
gggccugaacccacuccu

SEQ ID NO: 1031652 - RNA, 20 nt, Human
ucagaaugggagagacagaa

SEQ ID NO: 1031653 - RNA, 23 nt, Human
uccagggcuggaccugaagguuc

SEQ ID NO: 1031654 - RNA, 18 nt, Human
uggauacagucuuuaacc

SEQ ID NO: 1031655 - RNA, 18 nt, Human
ugggagagacagaaccug

SEQ ID NO: 1031656 - RNA, 24 nt, Human
uguagaaaggauucaagacagccg

SEQ ID NO: 1031657 - RNA, 23 nt, Human
uuaauuuaucuuuaauguuuucu

SEQ ID NO: 1031658 - RNA, 18 nt, Human
uuuuucaccaugauuacc

SEQ ID NO: 1031659 - RNA, 25 nt, Human
uuuuuuuuuuuuuucaccaugauua

SEQ ID NO: 1031660 - RNA, 23 nt, Human
uuuuuuuuuuuuuuucaccauga

SEQ ID NO: 1031661 - RNA, 19 nt, Human
acacugaggggcgcuguaa

SEQ ID NO: 1031662 - RNA, 19 nt, Human
accaccagucugucucugc

SEQ ID NO: 1031663 - RNA, 21 nt, Human
accagucugucucugcugugc

SEQ ID NO: 1031664 - RNA, 22 nt, Human
acccuucccauugccucccccc

SEQ ID NO: 1031665 - RNA, 23 nt, Human
acccuucccauugccuccccccc

SEQ ID NO: 1031666 - RNA, 20 nt, Human
auuuguaauuucuacccuuc

SEQ ID NO: 1031667 - RNA, 25 nt, Human
caaaaaaaacuguacaugaguuuac

SEQ ID NO: 1031668 - RNA, 25 nt, Human
caccuccagguucaaccaccagucu

SEQ ID NO: 1031669 - RNA, 18 nt, Human
cagcuggcuuuuuuggca

SEQ ID NO: 1031670 - RNA, 22 nt, Human
cccuucccauugccuccccccc

SEQ ID NO: 1031671 - RNA, 18 nt, Human
ccgccgccgccucgcgcc

SEQ ID NO: 1031672 - RNA, 19 nt, Human
ccgccgccgccucgcgccc

SEQ ID NO: 1031673 - RNA, 20 nt, Human
ccgccgccgccucgcgcccg

SEQ ID NO: 1031674 - RNA, 21 nt, Human
ccgccgccgccucgcgcccgc

SEQ ID NO: 1031675 - RNA, 23 nt, Human
ccuccuccguugucucugcugga

SEQ ID NO: 1031676 - RNA, 22 nt, Human
cgccgggacaggacgggaccgg

SEQ ID NO: 1031677 - RNA, 22 nt, Human
cggcagcgccgcucccucggga

SEQ ID NO: 1031678 - RNA, 18 nt, Human
cgggguagcagccaggcg

SEQ ID NO: 1031679 - RNA, 20 nt, Human
cguccuggugggagccuccu

SEQ ID NO: 1031680 - RNA, 20 nt, Human
cuguaaccacacagacugcc

SEQ ID NO: 1031681 - RNA, 21 nt, Human
cuucccauugccuccccccca

SEQ ID NO: 1031682 - RNA, 23 nt, Human
cuucccauugccucccccccaaa

SEQ ID NO: 1031683 - RNA, 21 nt, Human
gcccgcagcuggcuuuuuugg

SEQ ID NO: 1031684 - RNA, 21 nt, Human
gcucgggccuccgccgccgcc

SEQ ID NO: 1031685 - RNA, 22 nt, Human
gcucgggccuccgccgccgccu

SEQ ID NO: 1031686 - RNA, 22 nt, Human
gcuggcuuuuuuggcaccucca

SEQ ID NO: 1031687 - RNA, 23 nt, Human
ggaccggagccggggucggggua

SEQ ID NO: 1031688 - RNA, 18 nt, Human
ggccggggcgaggccgcg

SEQ ID NO: 1031689 - RNA, 21 nt, Human
ucccauugccucccccccaaa

SEQ ID NO: 1031690 - RNA, 24 nt, Human
uccuccguugucucugcuggagau

SEQ ID NO: 1031691 - RNA, 20 nt, Human
uccugggcccgcagcuggcu

SEQ ID NO: 1031692 - RNA, 20 nt, Human
uccugggcccgcagcuggcu

SEQ ID NO: 1031693 - RNA, 23 nt, Human
uccuggugggagccuccuccguu

SEQ ID NO: 1031694 - RNA, 23 nt, Human
ucggccggcagcgccgcucccuc

SEQ ID NO: 1031695 - RNA, 21 nt, Human
ugauucuauuuguaauuucua

SEQ ID NO: 1031696 - RNA, 23 nt, Human
ugcccaggguagagcccgggggc

SEQ ID NO: 1031697 - RNA, 21 nt, Human
uggugggagccuccuccguug

SEQ ID NO: 1031698 - RNA, 21 nt, Human
ugucucugcuggagaugaaca

SEQ ID NO: 1031699 - RNA, 22 nt, Human
uugccucccccccaaaaaaaac

SEQ ID NO: 1031700 - RNA, 21 nt, Human
uuuuuuuuuuuuuugcaaaug

SEQ ID NO: 1031701 - RNA, 18 nt, Human
uuuuuuuuuuuuuuuuug

SEQ ID NO: 1031702 - RNA, 19 nt, Human
uuuuuuuuuuuuuuuuugc

SEQ ID NO: 1031703 - RNA, 21 nt, Human
uuuuuuuuuuuuuuuuugcaa

SEQ ID NO: 1031704 - RNA, 24 nt, Human
aaaaaaaugacuacaacuuaaacu

SEQ ID NO: 1031705 - RNA, 23 nt, Human
aaacaaaccgacuccuagauucc

SEQ ID NO: 1031706 - RNA, 24 nt, Human
aaagugcugggauuacagguauga

SEQ ID NO: 1031707 - RNA, 23 nt, Human
aaccacacagccucugcauccuu

SEQ ID NO: 1031708 - RNA, 19 nt, Human
aaccgacuccuagauuccu

SEQ ID NO: 1031709 - RNA, 19 nt, Human
aaccgagccagacagcccc

SEQ ID NO: 1031710 - RNA, 24 nt, Human
aaccucaggugauccaacugccuc

SEQ ID NO: 1031711 - RNA, 21 nt, Human
aaccuccgccugccccaccuc

SEQ ID NO: 1031712 - RNA, 18 nt, Human
aagugcugggauuacagg

SEQ ID NO: 1031713 - RNA, 19 nt, Human
aagugcugggauuacaggu

SEQ ID NO: 1031714 - RNA, 26 nt, Human
aagugcugggauuacagguaugagcc

SEQ ID NO: 1031715 - RNA, 20 nt, Human
acacagccucugcauccuuc

SEQ ID NO: 1031716 - RNA, 24 nt, Human
acacagccugcaggggcgggagag

SEQ ID NO: 1031717 - RNA, 20 nt, Human
acaggguuucacccuguugg

SEQ ID NO: 1031718 - RNA, 24 nt, Human
acaggguuucacccuguuggccag

SEQ ID NO: 1031719 - RNA, 22 nt, Human
acaucaaaauaauaggaccagu

SEQ ID NO: 1031720 - RNA, 25 nt, Human
acccuguuggccaggcuggucucaa

SEQ ID NO: 1031721 - RNA, 27 nt, Human
acucugucaccuaggcuagagugcaau

SEQ ID NO: 1031722 - RNA, 24 nt, Human
acugccucggccucccaaagugcu

SEQ ID NO: 1031723 - RNA, 20 nt, Human
agacacagggccagaauaaa

SEQ ID NO: 1031724 - RNA, 25 nt, Human
aggaccaguaauggccacaauccug

SEQ ID NO: 1031725 - RNA, 20 nt, Human
aggcaugcaccaccacgccc

SEQ ID NO: 1031726 - RNA, 24 nt, Human
aggugauccaacugccucggccuc

SEQ ID NO: 1031727 - RNA, 24 nt, Human
agugauucuccugccucagccucc

SEQ ID NO: 1031728 - RNA, 23 nt, Human
agugcaauggcgcgaucuuggcu

SEQ ID NO: 1031729 - RNA, 24 nt, Human
agugcaauggcgcgaucuuggcuu

SEQ ID NO: 1031730 - RNA, 23 nt, Human
augguacaucaaaauaauaggac

SEQ ID NO: 1031731 - RNA, 22 nt, Human
auguuccuaacgcuccgcagug

SEQ ID NO: 1031732 - RNA, 18 nt, Human
auucuccugccucagccu

SEQ ID NO: 1031733 - RNA, 18 nt, Human
auuuaguuagaugcugug

SEQ ID NO: 1031734 - RNA, 19 nt, Human
caaaauaauaggaccagua

SEQ ID NO: 1031735 - RNA, 24 nt, Human
caaagugcugggauuacagguaug

SEQ ID NO: 1031736 - RNA, 27 nt, Human
caacuuaaacuuuauuuacuugauugg

SEQ ID NO: 1031737 - RNA, 20 nt, Human
caagugauucuccugccuca

SEQ ID NO: 1031738 - RNA, 22 nt, Human
caagugauucuccugccucagc

SEQ ID NO: 1031739 - RNA, 22 nt, Human
caccaccacgcccggcuaauuu

SEQ ID NO: 1031740 - RNA, 24 nt, Human
caccacgcccggcuaauuuuugua

SEQ ID NO: 1031741 - RNA, 21 nt, Human
cacccuguuggccaggcuggu

SEQ ID NO: 1031742 - RNA, 24 nt, Human
cacccuguuggccaggcuggucuc

SEQ ID NO: 1031743 - RNA, 23 nt, Human
cacucugucaccuaggcuagagu

SEQ ID NO: 1031744 - RNA, 24 nt, Human
cacucugucaccuaggcuagagug

SEQ ID NO: 1031745 - RNA, 20 nt, Human
cagccuccugaguaccuggg

SEQ ID NO: 1031746 - RNA, 19 nt, Human
cagccucugcauccuuccu

SEQ ID NO: 1031747 - RNA, 24 nt, Human
caggguuucacccuguuggccagg

SEQ ID NO: 1031748 - RNA, 22 nt, Human
caguagacacagggccagaaua

SEQ ID NO: 1031749 - RNA, 23 nt, Human
caugcaccaccacgcccggcuaa

SEQ ID NO: 1031750 - RNA, 23 nt, Human
caugcagcuuugauuugugccac

SEQ ID NO: 1031751 - RNA, 21 nt, Human
ccaaagugcugggauuacagg

SEQ ID NO: 1031752 - RNA, 21 nt, Human
ccaaagugcugggauuacagg

SEQ ID NO: 1031753 - RNA, 22 nt, Human
ccaaagugcugggauuacaggu

SEQ ID NO: 1031754 - RNA, 24 nt, Human
ccaaagugcugggauuacagguau

SEQ ID NO: 1031755 - RNA, 19 nt, Human
ccacaauccuguugacugc

SEQ ID NO: 1031756 - RNA, 22 nt, Human
ccagaauaaacuggcaaguuuu

SEQ ID NO: 1031757 - RNA, 23 nt, Human
cccccacgcgccgccgccucccg

SEQ ID NO: 1031758 - RNA, 18 nt, Human
cccgcccccacgcgccga

SEQ ID NO: 1031759 - RNA, 26 nt, Human
ccgucccgcccccacgcgccgccgcc

SEQ ID NO: 1031760 - RNA, 19 nt, Human
ccuaaccucaggugaucca

SEQ ID NO: 1031761 - RNA, 21 nt, Human
ccucggguucaagugauucuc

SEQ ID NO: 1031762 - RNA, 24 nt, Human
ccucggguucaagugauucuccug

SEQ ID NO: 1031763 - RNA, 24 nt, Human
ccugaguaccugggacuacaggca

SEQ ID NO: 1031764 - RNA, 24 nt, Human
ccugccucagccuccugaguaccu

SEQ ID NO: 1031765 - RNA, 22 nt, Human
cggaaaacaaaccgacuccuag

SEQ ID NO: 1031766 - RNA, 23 nt, Human
cucggguucaagugauucuccuc

SEQ ID NO: 1031767 - RNA, 23 nt, Human
cucuugugaauugaacuggaggc

SEQ ID NO: 1031768 - RNA, 25 nt, Human
cugcaaccuccgccugccccaccuc

SEQ ID NO: 1031769 - RNA, 22 nt, Human
gaaaaugcucuugugaauugaa

SEQ ID NO: 1031770 - RNA, 19 nt, Human
gaccaguaauggccacaau

SEQ ID NO: 1031771 - RNA, 19 nt, Human
gagagcggaaggagauggg

SEQ ID NO: 1031772 - RNA, 21 nt, Human
gaggcaagcuccacuuuucuu

SEQ ID NO: 1031773 - RNA, 24 nt, Human
gaguaccugggacuacaggcaugc

SEQ ID NO: 1031774 - RNA, 18 nt, Human
gauuacagguaugagcca

SEQ ID NO: 1031775 - RNA, 20 nt, Human
gauuacagguaugagccacc

SEQ ID NO: 1031776 - RNA, 21 nt, Human
gauuacagguaugagccaccg

SEQ ID NO: 1031777 - RNA, 19 nt, Human
gccccaauauuucuuuaag

SEQ ID NO: 1031778 - RNA, 24 nt, Human
gccccaccucggguucaagugauu

SEQ ID NO: 1031779 - RNA, 22 nt, Human
gcccggcuaauuuuuguauuuu

SEQ ID NO: 1031780 - RNA, 19 nt, Human
gccgcgccccuccccgucc

SEQ ID NO: 1031781 - RNA, 19 nt, Human
gcuagagugcaauggcgcg

SEQ ID NO: 1031782 - RNA, 23 nt, Human
gcuggucucaaacuccuaaccuc

SEQ ID NO: 1031783 - RNA, 20 nt, Human
ggaaaacaaaccgacuccua

SEQ ID NO: 1031784 - RNA, 22 nt, Human
ggaggcaagcuccacuuuucuu

SEQ ID NO: 1031785 - RNA, 19 nt, Human
gggcaaacugucuuccuuu

SEQ ID NO: 1031786 - RNA, 19 nt, Human
gggcaugggagggaaaaug

SEQ ID NO: 1031787 - RNA, 22 nt, Human
ggguucaagugauucuccugcc

SEQ ID NO: 1031788 - RNA, 23 nt, Human
ggguucaagugauucuccugccu

SEQ ID NO: 1031789 - RNA, 24 nt, Human
gugauccaacugccucggccuccc

SEQ ID NO: 1031790 - RNA, 24 nt, Human
gugauucuccugccucagccuccu

SEQ ID NO: 1031791 - RNA, 22 nt, Human
uaaaagcccuuaguuuuaaauc

SEQ ID NO: 1031792 - RNA, 20 nt, Human
uaaaccacacagccucugca

SEQ ID NO: 1031793 - RNA, 23 nt, Human
uaaacccugcauacuuccccaaa

SEQ ID NO: 1031794 - RNA, 20 nt, Human
uaacagauuuucuuaaagua

SEQ ID NO: 1031795 - RNA, 23 nt, Human
uaaccucaggugauccaacugcc

SEQ ID NO: 1031796 - RNA, 24 nt, Human
uaaccucaggugauccaacugccu

SEQ ID NO: 1031797 - RNA, 25 nt, Human
uaaccucaggugauccaacugccuc

SEQ ID NO: 1031798 - RNA, 28 nt, Human
uaacuucauuuuccuagaaagggauaau

SEQ ID NO: 1031799 - RNA, 24 nt, Human
uaauuuuuguauuuuuagacgaga

SEQ ID NO: 1031800 - RNA, 23 nt, Human
uacaggcaugcaccaccacgccc

SEQ ID NO: 1031801 - RNA, 24 nt, Human
uacagguaugagccaccgugccca

SEQ ID NO: 1031802 - RNA, 18 nt, Human
uacgacuaauuuggauaa

SEQ ID NO: 1031803 - RNA, 23 nt, Human
uagagugcaauggcgcgaucuug

SEQ ID NO: 1031804 - RNA, 24 nt, Human
uagagugcaauggcgcgaucuugg

SEQ ID NO: 1031805 - RNA, 20 nt, Human
uagcgacagccacaagaaaa

SEQ ID NO: 1031806 - RNA, 23 nt, Human
uaguaauaagguugagguuuuug

SEQ ID NO: 1031807 - RNA, 24 nt, Human
uauuucuuuaagcauuucuuaagc

SEQ ID NO: 1031808 - RNA, 19 nt, Human
ucaagugauucuccugccu

SEQ ID NO: 1031809 - RNA, 19 nt, Human
uccaacugccucggccucc

SEQ ID NO: 1031810 - RNA, 23 nt, Human
ucccaaagugcugggauuacagg

SEQ ID NO: 1031811 - RNA, 18 nt, Human
uccccaaaaauguuuagg

SEQ ID NO: 1031812 - RNA, 18 nt, Human
ucccggagaauaaauccu

SEQ ID NO: 1031813 - RNA, 24 nt, Human
uccugaguaccugggacuacaggc

SEQ ID NO: 1031814 - RNA, 21 nt, Human
ucggcacacagccugcagggg

SEQ ID NO: 1031815 - RNA, 18 nt, Human
ucggccucccaaagugcu

SEQ ID NO: 1031816 - RNA, 19 nt, Human
ucucacucugucaccuagg

SEQ ID NO: 1031817 - RNA, 23 nt, Human
ucucacucugucaccuaggcuag

SEQ ID NO: 1031818 - RNA, 24 nt, Human
ucucacucugucaccuaggcuaga

SEQ ID NO: 1031819 - RNA, 22 nt, Human
ucucccggagaauaaauccuga

SEQ ID NO: 1031820 - RNA, 24 nt, Human
ucuccugccucagccuccugagua

SEQ ID NO: 1031821 - RNA, 24 nt, Human
ucugucaccuaggcuagagugcaa

SEQ ID NO: 1031822 - RNA, 23 nt, Human
ugaaucaguaaaaauuuucccuc

SEQ ID NO: 1031823 - RNA, 21 nt, Human
ugagagaacacugucaaauga

SEQ ID NO: 1031824 - RNA, 23 nt, Human
ugagagaacacugucaaaugaug

SEQ ID NO: 1031825 - RNA, 24 nt, Human
ugccucagccuccugaguaccugg

SEQ ID NO: 1031826 - RNA, 21 nt, Human
ugccucggccucccaaagugc

SEQ ID NO: 1031827 - RNA, 24 nt, Human
ugccucggccucccaaagugcugg

SEQ ID NO: 1031828 - RNA, 24 nt, Human
ugcugggauuacagguaugagcca

SEQ ID NO: 1031829 - RNA, 24 nt, Human
uggccaggcuggucucaaacuccu

SEQ ID NO: 1031830 - RNA, 18 nt, Human
uggccgcgccccuccccg

SEQ ID NO: 1031831 - RNA, 21 nt, Human
uggccgcgccccuccccgucc

SEQ ID NO: 1031832 - RNA, 24 nt, Human
ugggaaaaaaaugacuacaacuua

SEQ ID NO: 1031833 - RNA, 21 nt, Human
ugggacuacaggcaugcacca

SEQ ID NO: 1031834 - RNA, 24 nt, Human
ugggacuacaggcaugcaccacca

SEQ ID NO: 1031835 - RNA, 19 nt, Human
ugggagggaaaaugcucuu

SEQ ID NO: 1031836 - RNA, 18 nt, Human
ugggauuacagguaugag

SEQ ID NO: 1031837 - RNA, 21 nt, Human
ugggauuacagguaugagcca

SEQ ID NO: 1031838 - RNA, 22 nt, Human
ugggauuacagguaugagccac

SEQ ID NO: 1031839 - RNA, 23 nt, Human
ugggauuacagguaugagccacc

SEQ ID NO: 1031840 - RNA, 23 nt, Human
ugggauuacagguaugagccacc

SEQ ID NO: 1031841 - RNA, 24 nt, Human
ugggauuacagguaugagccaccg

SEQ ID NO: 1031842 - RNA, 21 nt, Human
ugucaaaugaugaaugcauuu

SEQ ID NO: 1031843 - RNA, 18 nt, Human
ugugggaaaaaaaugacu

SEQ ID NO: 1031844 - RNA, 19 nt, Human
uguuccgucgaacggguca

SEQ ID NO: 1031845 - RNA, 22 nt, Human
uuaaaaccagaaauaacuucau

SEQ ID NO: 1031846 - RNA, 18 nt, Human
uuacugcaaccuccgccu

SEQ ID NO: 1031847 - RNA, 19 nt, Human
uuacugcaaccuccgccug

SEQ ID NO: 1031848 - RNA, 20 nt, Human
uuacugcaaccuccgccugc

SEQ ID NO: 1031849 - RNA, 21 nt, Human
uucaagugauucuccugccuc

SEQ ID NO: 1031850 - RNA, 23 nt, Human
uucaagugauucuccugccucag

SEQ ID NO: 1031851 - RNA, 24 nt, Human
uucaagugauucuccugccucagc

SEQ ID NO: 1031852 - RNA, 23 nt, Human
uuccuaacgcuccgcaguggccg

SEQ ID NO: 1031853 - RNA, 22 nt, Human
uuccuugcucgauuucugugcc

SEQ ID NO: 1031854 - RNA, 24 nt, Human
uugaacuggaggcaagcuccacuu

SEQ ID NO: 1031855 - RNA, 23 nt, Human
uugcacaugaaauguuuuaugug

SEQ ID NO: 1031856 - RNA, 22 nt, Human
uuucacccuguuggccaggcug

SEQ ID NO: 1031857 - RNA, 23 nt, Human
uuucacccuguuggccaggcugu

SEQ ID NO: 1031858 - RNA, 20 nt, Human
uuuuuguauuuuuagacgag

SEQ ID NO: 1031859 - RNA, 23 nt, Human
aaagugcugagauuauaggugug

SEQ ID NO: 1031860 - RNA, 21 nt, Human
aaauggcuccagcuugagaau

SEQ ID NO: 1031861 - RNA, 24 nt, Human
aaccaaauacccacuuauuugcug

SEQ ID NO: 1031862 - RNA, 23 nt, Human
aaccaaccagaaaacaccuaagu

SEQ ID NO: 1031863 - RNA, 20 nt, Human
aagauuauccaaaccugaaa

SEQ ID NO: 1031864 - RNA, 18 nt, Human
aagcagggcgccacaacc

SEQ ID NO: 1031865 - RNA, 20 nt, Human
aagcuggagagccccggcgg

SEQ ID NO: 1031866 - RNA, 23 nt, Human
aagugcugagauuauaggugugu

SEQ ID NO: 1031867 - RNA, 25 nt, Human
aauacccacuuauuugcugaguggc

SEQ ID NO: 1031868 - RNA, 24 nt, Human
acucugucgcccaggcuggagugc

SEQ ID NO: 1031869 - RNA, 20 nt, Human
acugcaagcuccgccucccg

SEQ ID NO: 1031870 - RNA, 22 nt, Human
agagagggacugaaugaggagc

SEQ ID NO: 1031871 - RNA, 20 nt, Human
agagcaaaugagggaagugg

SEQ ID NO: 1031872 - RNA, 19 nt, Human
agauuauaggugugugcca

SEQ ID NO: 1031873 - RNA, 22 nt, Human
agccacugccaguaagagggca

SEQ ID NO: 1031874 - RNA, 21 nt, Human
aggaauaccuuauaccaaguc

SEQ ID NO: 1031875 - RNA, 25 nt, Human
aggcuggagugcaguggugcgaucu

SEQ ID NO: 1031876 - RNA, 18 nt, Human
aguaacugggauuacagg

SEQ ID NO: 1031877 - RNA, 22 nt, Human
aguaguaggaucagaaaaggga

SEQ ID NO: 1031878 - RNA, 22 nt, Human
agugacauacacaaacgucuca

SEQ ID NO: 1031879 - RNA, 21 nt, Human
agugcaguggugcgaucucag

SEQ ID NO: 1031880 - RNA, 23 nt, Human
agugcaguggugcgaucucagcu

SEQ ID NO: 1031881 - RNA, 24 nt, Human
agugcaguggugcgaucucagcuc

SEQ ID NO: 1031882 - RNA, 24 nt, Human
aguggugcgaucucagcucacugc

SEQ ID NO: 1031883 - RNA, 21 nt, Human
auaauuuuucacaacaagaua

SEQ ID NO: 1031884 - RNA, 19 nt, Human
aucuggggcaagauuaucc

SEQ ID NO: 1031885 - RNA, 20 nt, Human
augagguuucacuguguuag

SEQ ID NO: 1031886 - RNA, 20 nt, Human
auguccuguugccaaaaaaa

SEQ ID NO: 1031887 - RNA, 19 nt, Human
caaaccugaaaucaaggcc

SEQ ID NO: 1031888 - RNA, 24 nt, Human
caaagugcugagauuauaggugug

SEQ ID NO: 1031889 - RNA, 22 nt, Human
cacacaagccugcugccgcagu

SEQ ID NO: 1031890 - RNA, 22 nt, Human
cacccaccucggccucccaaag

SEQ ID NO: 1031891 - RNA, 23 nt, Human
cacccaccucggccucccaaagu

SEQ ID NO: 1031892 - RNA, 24 nt, Human
caccucggccucccaaagugcuga

SEQ ID NO: 1031893 - RNA, 22 nt, Human
cacgccauucuccugccucagc

SEQ ID NO: 1031894 - RNA, 18 nt, Human
cacuguguuagccaggau

SEQ ID NO: 1031895 - RNA, 19 nt, Human
cacuguguuagccaggaug

SEQ ID NO: 1031896 - RNA, 24 nt, Human
cacuguguuagccaggauggucuc

SEQ ID NO: 1031897 - RNA, 20 nt, Human
cagccuccugaguaacuggg

SEQ ID NO: 1031898 - RNA, 24 nt, Human
cagcuugagaaucggggucacugc

SEQ ID NO: 1031899 - RNA, 21 nt, Human
caggaauaccuuauaccaagu

SEQ ID NO: 1031900 - RNA, 21 nt, Human
cagggcgccacaaccacagag

SEQ ID NO: 1031901 - RNA, 21 nt, Human
ccaaagugcugagauuauagg

SEQ ID NO: 1031902 - RNA, 21 nt, Human
ccaaagugcugagauuauagg

SEQ ID NO: 1031903 - RNA, 24 nt, Human
ccaaagugcugagauuauaggugu

SEQ ID NO: 1031904 - RNA, 20 nt, Human
ccaaccagaaaacaccuaag

SEQ ID NO: 1031905 - RNA, 20 nt, Human
cccagaugugucuccuggcu

SEQ ID NO: 1031906 - RNA, 26 nt, Human
ccccacugccucugccgcccuucuca

SEQ ID NO: 1031907 - RNA, 24 nt, Human
ccucccggguucacgccauucucc

SEQ ID NO: 1031908 - RNA, 22 nt, Human
ccugaccucgugauccacccac

SEQ ID NO: 1031909 - RNA, 19 nt, Human
ccugaguaacugggauuac

SEQ ID NO: 1031910 - RNA, 23 nt, Human
ccugaguaacugggauuacaggc

SEQ ID NO: 1031911 - RNA, 24 nt, Human
ccugaguaacugggauuacaggca

SEQ ID NO: 1031912 - RNA, 19 nt, Human
ccuugcccagcucuguuuu

SEQ ID NO: 1031913 - RNA, 20 nt, Human
ccuugggaucucuccaguga

SEQ ID NO: 1031914 - RNA, 24 nt, Human
cgcccaggcuggagugcaguggug

SEQ ID NO: 1031915 - RNA, 19 nt, Human
cgccucccggguucacgcc

SEQ ID NO: 1031916 - RNA, 21 nt, Human
cucccggguucacgccauucu

SEQ ID NO: 1031917 - RNA, 19 nt, Human
cucccucuguucaguccgc

SEQ ID NO: 1031918 - RNA, 18 nt, Human
cuccugaccucgugaucc

SEQ ID NO: 1031919 - RNA, 23 nt, Human
cugaguaacugggauuacaggca

SEQ ID NO: 1031920 - RNA, 23 nt, Human
cugccucagccuccugaguaacu

SEQ ID NO: 1031921 - RNA, 18 nt, Human
cugccucugccgcccuuc

SEQ ID NO: 1031922 - RNA, 20 nt, Human
cuucauaaaaccaaauaccc

SEQ ID NO: 1031923 - RNA, 26 nt, Human
cuugaaccauggucuagcaaagcccu

SEQ ID NO: 1031924 - RNA, 24 nt, Human
cuugagauggacauucacauucuc

SEQ ID NO: 1031925 - RNA, 20 nt, Human
cuuugcaggacuuggggguu

SEQ ID NO: 1031926 - RNA, 22 nt, Human
gaccucgugauccacccaccuc

SEQ ID NO: 1031927 - RNA, 22 nt, Human
gaccucgugauccacccaccuc

SEQ ID NO: 1031928 - RNA, 24 nt, Human
gaccucgugauccacccaccucgg

SEQ ID NO: 1031929 - RNA, 24 nt, Human
gaccucgugauccacccaccucgg

SEQ ID NO: 1031930 - RNA, 24 nt, Human
gagggaaguggggccgagacacaa

SEQ ID NO: 1031931 - RNA, 18 nt, Human
gagguuucacuguguuag

SEQ ID NO: 1031932 - RNA, 25 nt, Human
gaguaacugggauuacaggcacccg

SEQ ID NO: 1031933 - RNA, 20 nt, Human
gagugcugucuacauuucag

SEQ ID NO: 1031934 - RNA, 22 nt, Human
gccacaaccacagagcaaauga

SEQ ID NO: 1031935 - RNA, 20 nt, Human
gcccaggcuggagugcagug

SEQ ID NO: 1031936 - RNA, 23 nt, Human
gcccaggcuggagugcaguggug

SEQ ID NO: 1031937 - RNA, 23 nt, Human
gcccggcuaauuuuuuguauuuu

SEQ ID NO: 1031938 - RNA, 21 nt, Human
gcucuggaaagggagaggcca

SEQ ID NO: 1031939 - RNA, 25 nt, Human
ggagcucccucuguucaguccgccc

SEQ ID NO: 1031940 - RNA, 24 nt, Human
ggauggucucgaucuccugaccuc

SEQ ID NO: 1031941 - RNA, 23 nt, Human
ggcaagauuauccaaaccugaaa

SEQ ID NO: 1031942 - RNA, 19 nt, Human
ggcucuggaaagggagagg

SEQ ID NO: 1031943 - RNA, 24 nt, Human
gugauccacccaccucggccuccc

SEQ ID NO: 1031944 - RNA, 27 nt, Human
uaauccaaaccagaauauuuagaucaa

SEQ ID NO: 1031945 - RNA, 24 nt, Human
uaauuuuuuguauuuuuaguagag

SEQ ID NO: 1031946 - RNA, 23 nt, Human
uacaggcacccgcuaccacgccc

SEQ ID NO: 1031947 - RNA, 18 nt, Human
uaccugcucagcccucag

SEQ ID NO: 1031948 - RNA, 24 nt, Human
uacucugucgcccaggcuggagug

SEQ ID NO: 1031949 - RNA, 26 nt, Human
uaggaucagaaaagggagcaaccaac

SEQ ID NO: 1031950 - RNA, 24 nt, Human
uagggauauguugagcagaggcca

SEQ ID NO: 1031951 - RNA, 20 nt, Human
uaguagagaugagguuucac

SEQ ID NO: 1031952 - RNA, 24 nt, Human
uaguagagaugagguuucacugug

SEQ ID NO: 1031953 - RNA, 23 nt, Human
ucaaagcagggcgccacaaccac

SEQ ID NO: 1031954 - RNA, 18 nt, Human
ucacugcaagcuccgccu

SEQ ID NO: 1031955 - RNA, 19 nt, Human
ucacugcaagcuccgccuc

SEQ ID NO: 1031956 - RNA, 24 nt, Human
ucacugcaagcuccgccucccggg

SEQ ID NO: 1031957 - RNA, 24 nt, Human
ucacuguguuagccaggauggucu

SEQ ID NO: 1031958 - RNA, 21 nt, Human
ucagaacaggagcccucuuuc

SEQ ID NO: 1031959 - RNA, 19 nt, Human
ucagcucacugcaagcucc

SEQ ID NO: 1031960 - RNA, 20 nt, Human
uccaaaccugaaaucaaggc

SEQ ID NO: 1031961 - RNA, 25 nt, Human
uccaaaccugaaaucaaggccucag

SEQ ID NO: 1031962 - RNA, 23 nt, Human
ucccaaagugcugagauuauagg

SEQ ID NO: 1031963 - RNA, 21 nt, Human
ucccggguucacgccauucuc

SEQ ID NO: 1031964 - RNA, 24 nt, Human
ucccggguucacgccauucuccug

SEQ ID NO: 1031965 - RNA, 22 nt, Human
uccuagcugagacuugcagagc

SEQ ID NO: 1031966 - RNA, 24 nt, Human
uccugaguaacugggauuacaggc

SEQ ID NO: 1031967 - RNA, 24 nt, Human
ucgcccaggcuggagugcaguggu

SEQ ID NO: 1031968 - RNA, 18 nt, Human
ucggccucccaaagugcu

SEQ ID NO: 1031969 - RNA, 20 nt, Human
ucucaggagauaaacaguuc

SEQ ID NO: 1031970 - RNA, 18 nt, Human
ucucaucccucuagccac

SEQ ID NO: 1031971 - RNA, 26 nt, Human
ucuccugaccucgugauccacccacc

SEQ ID NO: 1031972 - RNA, 24 nt, Human
ucuccugccucagccuccugagua

SEQ ID NO: 1031973 - RNA, 24 nt, Human
ucugucgcccaggcuggagugcag

SEQ ID NO: 1031974 - RNA, 23 nt, Human
ucuuacucugucgcccaggcugg

SEQ ID NO: 1031975 - RNA, 24 nt, Human
ucuuacucugucgcccaggcugga

SEQ ID NO: 1031976 - RNA, 21 nt, Human
ugaaauggugccagagggagc

SEQ ID NO: 1031977 - RNA, 21 nt, Human
ugacuuagagaaaguccauau

SEQ ID NO: 1031978 - RNA, 23 nt, Human
ugacuuagagaaaguccauaucu

SEQ ID NO: 1031979 - RNA, 21 nt, Human
ugagauuauaggugugugcca

SEQ ID NO: 1031980 - RNA, 22 nt, Human
ugagauuauaggugugugccac

SEQ ID NO: 1031981 - RNA, 23 nt, Human
ugagauuauaggugugugccacc

SEQ ID NO: 1031982 - RNA, 24 nt, Human
ugagauuauaggugugugccaccg

SEQ ID NO: 1031983 - RNA, 18 nt, Human
ugagggaaguggggccga

SEQ ID NO: 1031984 - RNA, 24 nt, Human
ugagggaaguggggccgagacaca

SEQ ID NO: 1031985 - RNA, 20 nt, Human
ugaggucagaacaggagccc

SEQ ID NO: 1031986 - RNA, 24 nt, Human
ugagguuucacuguguuagccagg

SEQ ID NO: 1031987 - RNA, 24 nt, Human
ugauccacccaccucggccuccca

SEQ ID NO: 1031988 - RNA, 22 nt, Human
ugccaaaaaaauuuuaauugcc

SEQ ID NO: 1031989 - RNA, 24 nt, Human
ugccagagcauucggucaaagcag

SEQ ID NO: 1031990 - RNA, 24 nt, Human
ugccucagccuccugaguaacugg

SEQ ID NO: 1031991 - RNA, 19 nt, Human
ugccuuuacagggauggcc

SEQ ID NO: 1031992 - RNA, 19 nt, Human
ugcugaguggccagaucuc

SEQ ID NO: 1031993 - RNA, 22 nt, Human
uggaaacauauguccuguugcc

SEQ ID NO: 1031994 - RNA, 23 nt, Human
uggagugcaguggugcgaucuca

SEQ ID NO: 1031995 - RNA, 24 nt, Human
uggagugcaguggugcgaucucag

SEQ ID NO: 1031996 - RNA, 22 nt, Human
uggccagaucuaagaggaagcu

SEQ ID NO: 1031997 - RNA, 20 nt, Human
uggcucuggaaagggagagg

SEQ ID NO: 1031998 - RNA, 20 nt, Human
ugggaucucuccagugaggc

SEQ ID NO: 1031999 - RNA, 19 nt, Human
ugggauuacaggcacccgc

SEQ ID NO: 1032000 - RNA, 22 nt, Human
ugggauuacaggcacccgcuac

SEQ ID NO: 1032001 - RNA, 24 nt, Human
ugggauuacaggcacccgcuacca

SEQ ID NO: 1032002 - RNA, 24 nt, Human
uggugcgaucucagcucacugcaa

SEQ ID NO: 1032003 - RNA, 20 nt, Human
ugugugccaccgcucccagc

SEQ ID NO: 1032004 - RNA, 19 nt, Human
uuacaggcacccgcuacca

SEQ ID NO: 1032005 - RNA, 24 nt, Human
uuacucugucgcccaggcuggagu

SEQ ID NO: 1032006 - RNA, 18 nt, Human
uuaguagagaugagguuu

SEQ ID NO: 1032007 - RNA, 21 nt, Human
uuaguagagaugagguuucac

SEQ ID NO: 1032008 - RNA, 21 nt, Human
uuaguagagaugagguuucac

SEQ ID NO: 1032009 - RNA, 24 nt, Human
uuaguagagaugagguuucacugu

SEQ ID NO: 1032010 - RNA, 21 nt, Human
uucacuguguuagccaggaug

SEQ ID NO: 1032011 - RNA, 20 nt, Human
uugcaggacuuggggguucu

SEQ ID NO: 1032012 - RNA, 22 nt, Human
uuggugcuuuuguuuccucugg

SEQ ID NO: 1032013 - RNA, 19 nt, Human
uuucacuguguuagccagg

SEQ ID NO: 1032014 - RNA, 22 nt, Human
uuugaucuagaagaacaagauc

SEQ ID NO: 1032015 - RNA, 22 nt, Human
uuuuccugacuuagagaaaguc

SEQ ID NO: 1032016 - RNA, 24 nt, Human
uuuuuaguagagaugagguuucac

SEQ ID NO: 1032017 - RNA, 21 nt, Human
uuuuuguauuuuuaguagaga

SEQ ID NO: 1032018 - RNA, 24 nt, Human
uuuuuuguauuuuuaguagagaug

SEQ ID NO: 1032019 - RNA, 20 nt, Human
agcuguuucuggccuugucc

SEQ ID NO: 1032020 - RNA, 18 nt, Human
aggcuggccucagaggac

SEQ ID NO: 1032021 - RNA, 19 nt, Human
caguguccauaugaagcug

SEQ ID NO: 1032022 - RNA, 25 nt, Human
ccucucgggccaguccaggccggcc

SEQ ID NO: 1032023 - RNA, 21 nt, Human
cugggaaccgggaucccucuc

SEQ ID NO: 1032024 - RNA, 19 nt, Human
gaagcuguuucuggccuug

SEQ ID NO: 1032025 - RNA, 20 nt, Human
gccucagaggacacccaggc

SEQ ID NO: 1032026 - RNA, 19 nt, Human
gcuguuucuggccuugucc

SEQ ID NO: 1032027 - RNA, 21 nt, Human
ggccucagaggacacccaggc

SEQ ID NO: 1032028 - RNA, 20 nt, Human
gcaaauuuggaggcaacagg

SEQ ID NO: 1032029 - RNA, 18 nt, Human
uuuuuuuuuuuuuuuuug

SEQ ID NO: 1032030 - RNA, 18 nt, Human
cccagugcugggcuccuc

SEQ ID NO: 1032031 - RNA, 22 nt, Human
cggaaucccagugcugggcucc

SEQ ID NO: 1032032 - RNA, 21 nt, Human
ucuguguucagugcagaucac

SEQ ID NO: 1032033 - RNA, 23 nt, Human
uggaaacaccucggaaucccagu

SEQ ID NO: 1032034 - RNA, 19 nt, Human
aaacagacaaacccugaac

SEQ ID NO: 1032035 - RNA, 20 nt, Human
aaacagacaaacccugaacg

SEQ ID NO: 1032036 - RNA, 24 nt, Human
aaagugcugggauuacaggcguga

SEQ ID NO: 1032037 - RNA, 19 nt, Human
aagugcugggauuacaggc

SEQ ID NO: 1032038 - RNA, 19 nt, Human
aagugcugggauuacaggc

SEQ ID NO: 1032039 - RNA, 26 nt, Human
aagugcugggauuacaggcgugagcc

SEQ ID NO: 1032040 - RNA, 21 nt, Human
acaguggcgcgaucuuggcuc

SEQ ID NO: 1032041 - RNA, 21 nt, Human
acgcgguggucgccaggggca

SEQ ID NO: 1032042 - RNA, 18 nt, Human
acgggguuucaccauguu

SEQ ID NO: 1032043 - RNA, 19 nt, Human
acgggguuucaccauguua

SEQ ID NO: 1032044 - RNA, 20 nt, Human
acgggguuucaccauguuag

SEQ ID NO: 1032045 - RNA, 24 nt, Human
acgggguuucaccauguuagccag

SEQ ID NO: 1032046 - RNA, 18 nt, Human
acugcaagcuccgccucc

SEQ ID NO: 1032047 - RNA, 21 nt, Human
agaagccccccaccucggcgg

SEQ ID NO: 1032048 - RNA, 23 nt, Human
agagccggggucagugucaacau

SEQ ID NO: 1032049 - RNA, 24 nt, Human
aggaggggcaggggcacaaccuag

SEQ ID NO: 1032050 - RNA, 22 nt, Human
aggauggagacagcggcucugg

SEQ ID NO: 1032051 - RNA, 20 nt, Human
aguacaguggcgcgaucuug

SEQ ID NO: 1032052 - RNA, 24 nt, Human
aguacaguggcgcgaucuuggcuc

SEQ ID NO: 1032053 - RNA, 18 nt, Human
agugcugggauuacaggc

SEQ ID NO: 1032054 - RNA, 22 nt, Human
aucaaacagacaaacccugaac

SEQ ID NO: 1032055 - RNA, 19 nt, Human
auggagacagcggcucugg

SEQ ID NO: 1032056 - RNA, 24 nt, Human
caaagugcugggauuacaggcgug

SEQ ID NO: 1032057 - RNA, 19 nt, Human
caaccuagcagcuccaacc

SEQ ID NO: 1032058 - RNA, 19 nt, Human
caagcuccaucuccuuccu

SEQ ID NO: 1032059 - RNA, 20 nt, Human
caagcuccaucuccuuccuc

SEQ ID NO: 1032060 - RNA, 18 nt, Human
caccauguuagccaggau

SEQ ID NO: 1032061 - RNA, 22 nt, Human
caccauguuagccaggaugguc

SEQ ID NO: 1032062 - RNA, 24 nt, Human
caccauguuagccaggauggucuc

SEQ ID NO: 1032063 - RNA, 22 nt, Human
cacgccauucuccugccucagc

SEQ ID NO: 1032064 - RNA, 23 nt, Human
cagcagggcacggggcagggcuc

SEQ ID NO: 1032065 - RNA, 23 nt, Human
caggggcccaccaccacaccugc

SEQ ID NO: 1032066 - RNA, 19 nt, Human
caguggcgcgaucuuggcu

SEQ ID NO: 1032067 - RNA, 19 nt, Human
cagugggggcucccgcaag

SEQ ID NO: 1032068 - RNA, 21 nt, Human
cauccaaauucacuaccagac

SEQ ID NO: 1032069 - RNA, 22 nt, Human
ccaaagugcugggauuacaggc

SEQ ID NO: 1032070 - RNA, 22 nt, Human
ccaaagugcugggauuacaggc

SEQ ID NO: 1032071 - RNA, 24 nt, Human
ccaaagugcugggauuacaggcgu

SEQ ID NO: 1032072 - RNA, 23 nt, Human
ccccaugcugcugccacuucccu

SEQ ID NO: 1032073 - RNA, 19 nt, Human
cccugccccaugcugcugc

SEQ ID NO: 1032074 - RNA, 20 nt, Human
ccgcaagcuccaucuccuuc

SEQ ID NO: 1032075 - RNA, 24 nt, Human
ccucccggguucacgccauucucc

SEQ ID NO: 1032076 - RNA, 23 nt, Human
ccucgcucuguugcccaggcugg

SEQ ID NO: 1032077 - RNA, 24 nt, Human
ccucgcucuguugcccaggcugga

SEQ ID NO: 1032078 - RNA, 25 nt, Human
ccucgcucuguugcccaggcuggag

SEQ ID NO: 1032079 - RNA, 26 nt, Human
ccucgcucuguugcccaggcuggagu

SEQ ID NO: 1032080 - RNA, 22 nt, Human
ccugaguugggggggcugggac

SEQ ID NO: 1032081 - RNA, 19 nt, Human
cgccucccggguucacgcc

SEQ ID NO: 1032082 - RNA, 22 nt, Human
cgcucuguugcccaggcuggag

SEQ ID NO: 1032083 - RNA, 19 nt, Human
cggcgccccgccaagaaag

SEQ ID NO: 1032084 - RNA, 24 nt, Human
cgggguuucaccauguuagccagg

SEQ ID NO: 1032085 - RNA, 24 nt, Human
cucagccucccgaguagcugggac

SEQ ID NO: 1032086 - RNA, 22 nt, Human
cucaugaucuaccugccucgcc

SEQ ID NO: 1032087 - RNA, 24 nt, Human
cuccaggggcccaccaccacaccu

SEQ ID NO: 1032088 - RNA, 21 nt, Human
cucccggguucacgccauucu

SEQ ID NO: 1032089 - RNA, 24 nt, Human
cuccugaccucaugaucuaccugc

SEQ ID NO: 1032090 - RNA, 24 nt, Human
cucgcucuguugcccaggcuggag

SEQ ID NO: 1032091 - RNA, 23 nt, Human
cucuguugcccaggcuggaguac

SEQ ID NO: 1032092 - RNA, 23 nt, Human
cugccucagccucccgaguagcu

SEQ ID NO: 1032093 - RNA, 23 nt, Human
cugccucgccucccaaagugcug

SEQ ID NO: 1032094 - RNA, 18 nt, Human
gacccuuccuuucgugug

SEQ ID NO: 1032095 - RNA, 22 nt, Human
gaccucaugaucuaccugccuc

SEQ ID NO: 1032096 - RNA, 20 nt, Human
gacuuugucaguuggugugu

SEQ ID NO: 1032097 - RNA, 21 nt, Human
gagacggagccucgcucuguu

SEQ ID NO: 1032098 - RNA, 24 nt, Human
gagacgggguuucaccauguuagc

SEQ ID NO: 1032099 - RNA, 23 nt, Human
gaguagcugggacuccaggggcc

SEQ ID NO: 1032100 - RNA, 18 nt, Human
gauuacaggcgugagcca

SEQ ID NO: 1032101 - RNA, 22 nt, Human
gauuacaggcgugagccacggc

SEQ ID NO: 1032102 - RNA, 19 nt, Human
gcccaggcuggaguacagu

SEQ ID NO: 1032103 - RNA, 20 nt, Human
gccucagccucccgaguagc

SEQ ID NO: 1032104 - RNA, 19 nt, Human
gcuggaguacaguggcgcg

SEQ ID NO: 1032105 - RNA, 18 nt, Human
gggaaaggagagaaaaug

SEQ ID NO: 1032106 - RNA, 21 nt, Human
gggcagcgagagggccugagu

SEQ ID NO: 1032107 - RNA, 23 nt, Human
gggguuucaccauguuagccagg

SEQ ID NO: 1032108 - RNA, 20 nt, Human
ggucucgaucuccugaccuc

SEQ ID NO: 1032109 - RNA, 24 nt, Human
gguuucaccauguuagccaggaug

SEQ ID NO: 1032110 - RNA, 23 nt, Human
guagagacgggguuucaccaugu

SEQ ID NO: 1032111 - RNA, 25 nt, Human
gucggaguggcagugggggcucccg

SEQ ID NO: 1032112 - RNA, 20 nt, Human
uaauagagccggggucagug

SEQ ID NO: 1032113 - RNA, 22 nt, Human
uacaaggaaaaacugaaauaau

SEQ ID NO: 1032114 - RNA, 23 nt, Human
uacaaggaaaaacugaaauaaua

SEQ ID NO: 1032115 - RNA, 24 nt, Human
uacaggcgugagccacggcgcccc

SEQ ID NO: 1032116 - RNA, 19 nt, Human
uacaguggcgcgaucuugg

SEQ ID NO: 1032117 - RNA, 22 nt, Human
uaccugccucgccucccaaagu

SEQ ID NO: 1032118 - RNA, 22 nt, Human
uagagacgggguuucaccaugu

SEQ ID NO: 1032119 - RNA, 22 nt, Human
uagcagcuccaaccuaugaaag

SEQ ID NO: 1032120 - RNA, 24 nt, Human
uaguagagacgggguuucaccaug

SEQ ID NO: 1032121 - RNA, 25 nt, Human
uaguagagacgggguuucaccaugu

SEQ ID NO: 1032122 - RNA, 19 nt, Human
ucaaacagacaaacccuga

SEQ ID NO: 1032123 - RNA, 21 nt, Human
ucaaacagacaaacccugaac

SEQ ID NO: 1032124 - RNA, 23 nt, Human
ucaaacagacaaacccugaacgc

SEQ ID NO: 1032125 - RNA, 24 nt, Human
ucaccauguuagccaggauggucu

SEQ ID NO: 1032126 - RNA, 18 nt, Human
ucacugcaagcuccgccu

SEQ ID NO: 1032127 - RNA, 19 nt, Human
ucacugcaagcuccgccuc

SEQ ID NO: 1032128 - RNA, 24 nt, Human
ucacugcaagcuccgccucccggg

SEQ ID NO: 1032129 - RNA, 23 nt, Human
ucagccucccgaguagcugggac

SEQ ID NO: 1032130 - RNA, 19 nt, Human
uccaaauucacuaccagac

SEQ ID NO: 1032131 - RNA, 24 nt, Human
ucccaaagugcugggauuacaggc

SEQ ID NO: 1032132 - RNA, 23 nt, Human
uccccgagcugaagucgcucggc

SEQ ID NO: 1032133 - RNA, 23 nt, Human
ucccgaguagcugggacuccagg

SEQ ID NO: 1032134 - RNA, 25 nt, Human
ucccgaguagcugggacuccagggg

SEQ ID NO: 1032135 - RNA, 21 nt, Human
ucccggguucacgccauucuc

SEQ ID NO: 1032136 - RNA, 24 nt, Human
ucccggguucacgccauucuccug

SEQ ID NO: 1032137 - RNA, 20 nt, Human
ucccuggucucugcuggcuu

SEQ ID NO: 1032138 - RNA, 19 nt, Human
ucccuguccugcuggggag

SEQ ID NO: 1032139 - RNA, 22 nt, Human
uccuccauccaaauucacuacc

SEQ ID NO: 1032140 - RNA, 26 nt, Human
uccuccauccaaauucacuaccagac

SEQ ID NO: 1032141 - RNA, 24 nt, Human
ucgcucuguugcccaggcuggagu

SEQ ID NO: 1032142 - RNA, 24 nt, Human
ucuccugccucagccucccgagua

SEQ ID NO: 1032143 - RNA, 24 nt, Human
ucucugcuggcuucccugccaccu

SEQ ID NO: 1032144 - RNA, 18 nt, Human
ucuguugcccaggcugga

SEQ ID NO: 1032145 - RNA, 21 nt, Human
ugcccaggcuggaguacagug

SEQ ID NO: 1032146 - RNA, 21 nt, Human
ugcccaggcuggaguacagug

SEQ ID NO: 1032147 - RNA, 24 nt, Human
ugcccaggcuggaguacaguggcg

SEQ ID NO: 1032148 - RNA, 24 nt, Human
ugccucagccucccgaguagcugg

SEQ ID NO: 1032149 - RNA, 23 nt, Human
ugccucgccucccaaagugcugg

SEQ ID NO: 1032150 - RNA, 24 nt, Human
ugcugggauuacaggcgugagcca

SEQ ID NO: 1032151 - RNA, 24 nt, Human
uggaguacaguggcgcgaucuugg

SEQ ID NO: 1032152 - RNA, 18 nt, Human
uggcucacugcaagcucc

SEQ ID NO: 1032153 - RNA, 18 nt, Human
ugggauuacaggcgugag

SEQ ID NO: 1032154 - RNA, 19 nt, Human
ugggauuacaggcgugagc

SEQ ID NO: 1032155 - RNA, 21 nt, Human
ugggauuacaggcgugagcca

SEQ ID NO: 1032156 - RNA, 22 nt, Human
ugggauuacaggcgugagccac

SEQ ID NO: 1032157 - RNA, 22 nt, Human
ugggauuacaggcgugagccac

SEQ ID NO: 1032158 - RNA, 23 nt, Human
ugggauuacaggcgugagccacg

SEQ ID NO: 1032159 - RNA, 24 nt, Human
ugggauuacaggcgugagccacgg

SEQ ID NO: 1032160 - RNA, 24 nt, Human
ugggauuacaggcgugagccacgg

SEQ ID NO: 1032161 - RNA, 25 nt, Human
ugggauuacaggcgugagccacggc

SEQ ID NO: 1032162 - RNA, 21 nt, Human
uggggaagggcgcacgcggug

SEQ ID NO: 1032163 - RNA, 21 nt, Human
ugucaguuggugugucaaagc

SEQ ID NO: 1032164 - RNA, 19 nt, Human
uguuacuauauuuuuaaga

SEQ ID NO: 1032165 - RNA, 18 nt, Human
uuacuagacaguccucca

SEQ ID NO: 1032166 - RNA, 18 nt, Human
uuaguagagacgggguuu

SEQ ID NO: 1032167 - RNA, 22 nt, Human
uuaguagagacgggguuucacc

SEQ ID NO: 1032168 - RNA, 24 nt, Human
uuaguagagacgggguuucaccau

SEQ ID NO: 1032169 - RNA, 24 nt, Human
uugcccaggcuggaguacaguggc

SEQ ID NO: 1032170 - RNA, 19 nt, Human
uuucaccauguuagccagg

SEQ ID NO: 1032171 - RNA, 20 nt, Human
uuucaccauguuagccagga

SEQ ID NO: 1032172 - RNA, 24 nt, Human
uuuuuaguagagacgggguuucac

SEQ ID NO: 1032173 - RNA, 23 nt, Human
uuuuuuaguagagacgggguuuc

SEQ ID NO: 1032174 - RNA, 27 nt, Human
uuuuuuguauuuuuuuuaguagagacg

SEQ ID NO: 1032175 - RNA, 21 nt, Human
aaacaagugaacaaaggucuc

SEQ ID NO: 1032176 - RNA, 22 nt, Human
aaaccccgucuccaccaaaaaa

SEQ ID NO: 1032177 - RNA, 19 nt, Human
aaagguggacuguuuagua

SEQ ID NO: 1032178 - RNA, 19 nt, Human
aaagucucccacgucuacc

SEQ ID NO: 1032179 - RNA, 19 nt, Human
aacacagcgaaaccccguc

SEQ ID NO: 1032180 - RNA, 20 nt, Human
aacacagcgaaaccccgucu

SEQ ID NO: 1032181 - RNA, 21 nt, Human
aacacagcgaaaccccgucuc

SEQ ID NO: 1032182 - RNA, 22 nt, Human
aagaggaacagauuuucaagaa

SEQ ID NO: 1032183 - RNA, 21 nt, Human
acacagcgaaaccccgucucc

SEQ ID NO: 1032184 - RNA, 20 nt, Human
acacagcggggcauggccag

SEQ ID NO: 1032185 - RNA, 18 nt, Human
acaggacaauaggggagg

SEQ ID NO: 1032186 - RNA, 24 nt, Human
acauguuaaggagaggcaaacauu

SEQ ID NO: 1032187 - RNA, 18 nt, Human
accaaaaaaaauacgaaa

SEQ ID NO: 1032188 - RNA, 19 nt, Human
accagggguauaacucagg

SEQ ID NO: 1032189 - RNA, 19 nt, Human
acccccccaccucccuccc

SEQ ID NO: 1032190 - RNA, 20 nt, Human
accuugguacccagacacca

SEQ ID NO: 1032191 - RNA, 24 nt, Human
acgccacugcacuccagccuggac

SEQ ID NO: 1032192 - RNA, 25 nt, Human
acgccacugcacuccagccuggacu

SEQ ID NO: 1032193 - RNA, 28 nt, Human
acuuccauccccagcuugcaaucuccau

SEQ ID NO: 1032194 - RNA, 21 nt, Human
agaaagggacacagcggggca

SEQ ID NO: 1032195 - RNA, 19 nt, Human
agacugacccaccaugaca

SEQ ID NO: 1032196 - RNA, 18 nt, Human
agagaaagggacacagcg

SEQ ID NO: 1032197 - RNA, 20 nt, Human
agagacgcuccucacuuucc

SEQ ID NO: 1032198 - RNA, 18 nt, Human
aggaacauagaaaagugg

SEQ ID NO: 1032199 - RNA, 21 nt, Human
aggagaggccaaaacaccaug

SEQ ID NO: 1032200 - RNA, 21 nt, Human
aggcagaaagaggggacaggg

SEQ ID NO: 1032201 - RNA, 18 nt, Human
aggccaaaacaccaugac

SEQ ID NO: 1032202 - RNA, 22 nt, Human
aggccaaggcggguugcuggga

SEQ ID NO: 1032203 - RNA, 21 nt, Human
aggccgaggcuggcggaucac

SEQ ID NO: 1032204 - RNA, 19 nt, Human
agggagguugcagugagcc

SEQ ID NO: 1032205 - RNA, 22 nt, Human
agggagguugcagugagccgag

SEQ ID NO: 1032206 - RNA, 21 nt, Human
agggggaggagggaagaggga

SEQ ID NO: 1032207 - RNA, 18 nt, Human
agggggagggggaggagg

SEQ ID NO: 1032208 - RNA, 19 nt, Human
aggucacagaucaacagga

SEQ ID NO: 1032209 - RNA, 21 nt, Human
agguggagguuguagcgagcc

SEQ ID NO: 1032210 - RNA, 24 nt, Human
agguggagguuguagcgagccgag

SEQ ID NO: 1032211 - RNA, 23 nt, Human
agucaggcguggcggcacgcgcc

SEQ ID NO: 1032212 - RNA, 20 nt, Human
auagaaaaguggcaaggcua

SEQ ID NO: 1032213 - RNA, 24 nt, Human
aucacgccacugcacuccagccug

SEQ ID NO: 1032214 - RNA, 22 nt, Human
auggcggccgggaagaggcgcu

SEQ ID NO: 1032215 - RNA, 21 nt, Human
caaaacaccaugaccccagca

SEQ ID NO: 1032216 - RNA, 19 nt, Human
cacagaucaacaggauccc

SEQ ID NO: 1032217 - RNA, 20 nt, Human
caccagggguauaacucagg

SEQ ID NO: 1032218 - RNA, 18 nt, Human
cacucggcaggcugaggc

SEQ ID NO: 1032219 - RNA, 18 nt, Human
cacugcacuccagccugg

SEQ ID NO: 1032220 - RNA, 19 nt, Human
cacugcacuccagccugga

SEQ ID NO: 1032221 - RNA, 21 nt, Human
cacugcacuccagccuggaca

SEQ ID NO: 1032222 - RNA, 24 nt, Human
cacugcacuccagccuggacacca

SEQ ID NO: 1032223 - RNA, 18 nt, Human
cagacugacccaccauga

SEQ ID NO: 1032224 - RNA, 21 nt, Human
cagagacgcuccucacuuccc

SEQ ID NO: 1032225 - RNA, 21 nt, Human
cagcaguaccguccagcuucg

SEQ ID NO: 1032226 - RNA, 23 nt, Human
cagcaguaccguccagcuucggc

SEQ ID NO: 1032227 - RNA, 19 nt, Human
cagcucaauuccagggaua

SEQ ID NO: 1032228 - RNA, 19 nt, Human
caggacaauaggggaggga

SEQ ID NO: 1032229 - RNA, 24 nt, Human
caggaucccaaggcagaagaauuu

SEQ ID NO: 1032230 - RNA, 21 nt, Human
cagggcagagaugcuccccac

SEQ ID NO: 1032231 - RNA, 20 nt, Human
ccaaaaaaaauacgaaaacc

SEQ ID NO: 1032232 - RNA, 19 nt, Human
ccacugcacuccagccugg

SEQ ID NO: 1032233 - RNA, 19 nt, Human
ccacugcacuccagccugg

SEQ ID NO: 1032234 - RNA, 20 nt, Human
ccacugcacuccagccugga

SEQ ID NO: 1032235 - RNA, 21 nt, Human
ccacugcacuccagccuggac

SEQ ID NO: 1032236 - RNA, 19 nt, Human
ccagacaccagggguauaa

SEQ ID NO: 1032237 - RNA, 22 nt, Human
ccaggcagaggggcuccucaca

SEQ ID NO: 1032238 - RNA, 23 nt, Human
ccaucaaucagugcucuugucug

SEQ ID NO: 1032239 - RNA, 22 nt, Human
ccccaucuuuccccccuuucua

SEQ ID NO: 1032240 - RNA, 19 nt, Human
ccccccaccucccucccgg

SEQ ID NO: 1032241 - RNA, 19 nt, Human
ccccccaccucccucccgg

SEQ ID NO: 1032242 - RNA, 20 nt, Human
ccccccaccucccucccgga

SEQ ID NO: 1032243 - RNA, 21 nt, Human
cccccccaccucccucccgga

SEQ ID NO: 1032244 - RNA, 22 nt, Human
cccccccaccucccucccggac

SEQ ID NO: 1032245 - RNA, 23 nt, Human
cccggccaacacagcgaaacccc

SEQ ID NO: 1032246 - RNA, 24 nt, Human
cccggccaacacagcgaaaccccg

SEQ ID NO: 1032247 - RNA, 20 nt, Human
cccgucuccaccaaaaaaaa

SEQ ID NO: 1032248 - RNA, 22 nt, Human
ccgcccuuaauccauucaaccc

SEQ ID NO: 1032249 - RNA, 22 nt, Human
ccucacaucccagaugaugggc

SEQ ID NO: 1032250 - RNA, 19 nt, Human
ccucccucccggacggggc

SEQ ID NO: 1032251 - RNA, 20 nt, Human
ccucccucccggacggggcg

SEQ ID NO: 1032252 - RNA, 18 nt, Human
ccucgggaggccgaggcu

SEQ ID NO: 1032253 - RNA, 19 nt, Human
ccucgggaggccgaggcug

SEQ ID NO: 1032254 - RNA, 26 nt, Human
ccugcaaucgcaggcacucggcaggc

SEQ ID NO: 1032255 - RNA, 24 nt, Human
cgagaucacgccacugcacuccag

SEQ ID NO: 1032256 - RNA, 23 nt, Human
cgagccgagaucacgccacugca

SEQ ID NO: 1032257 - RNA, 24 nt, Human
cgccacugcacuccagccuggaca

SEQ ID NO: 1032258 - RNA, 21 nt, Human
cggagaugcuccucacuuccc

SEQ ID NO: 1032259 - RNA, 24 nt, Human
cggcacuuugggaggccaaggcgg

SEQ ID NO: 1032260 - RNA, 24 nt, Human
cggcaggcugaggcaagagaauca

SEQ ID NO: 1032261 - RNA, 22 nt, Human
cgggguggcugcugggcggagg

SEQ ID NO: 1032262 - RNA, 24 nt, Human
cgucugcaaucccggcaccucggg

SEQ ID NO: 1032263 - RNA, 18 nt, Human
cgugguuaggagcuggag

SEQ ID NO: 1032264 - RNA, 22 nt, Human
cuacacagacacggcaaccauc

SEQ ID NO: 1032265 - RNA, 25 nt, Human
cugaggcaagagaaucaggcaggga

SEQ ID NO: 1032266 - RNA, 23 nt, Human
cugaugacaggcauguaccauga

SEQ ID NO: 1032267 - RNA, 19 nt, Human
cugcaaucccggcaccucg

SEQ ID NO: 1032268 - RNA, 21 nt, Human
cuggacaccauugagcacuga

SEQ ID NO: 1032269 - RNA, 19 nt, Human
cuucaaacuaggcagaaag

SEQ ID NO: 1032270 - RNA, 18 nt, Human
gaacagcucaauuccagg

SEQ ID NO: 1032271 - RNA, 19 nt, Human
gagacuccgucugcaaucc

SEQ ID NO: 1032272 - RNA, 20 nt, Human
gagagaaagggacacagcgg

SEQ ID NO: 1032273 - RNA, 21 nt, Human
gagcugaguggaggcaccaag

SEQ ID NO: 1032274 - RNA, 18 nt, Human
gagcuggagaccagcccg

SEQ ID NO: 1032275 - RNA, 21 nt, Human
gagguugcagugagccgagau

SEQ ID NO: 1032276 - RNA, 20 nt, Human
gaguggaggcaccaagaccu

SEQ ID NO: 1032277 - RNA, 24 nt, Human
gaguggauacagcacauguuucag

SEQ ID NO: 1032278 - RNA, 20 nt, Human
gcaagagaaucaggcaggga

SEQ ID NO: 1032279 - RNA, 20 nt, Human
gcacuuugggaggccaaggc

SEQ ID NO: 1032280 - RNA, 21 nt, Human
gcagggagguugcagugagcc

SEQ ID NO: 1032281 - RNA, 19 nt, Human
gcauguaccaugagcuugg

SEQ ID NO: 1032282 - RNA, 19 nt, Human
gccaaaacaccaugacccc

SEQ ID NO: 1032283 - RNA, 19 nt, Human
gcgagggcacaggcugggc

SEQ ID NO: 1032284 - RNA, 22 nt, Human
gcuggugggaauguagaagccu

SEQ ID NO: 1032285 - RNA, 20 nt, Human
ggagacgcuccucacuuccc

SEQ ID NO: 1032286 - RNA, 22 nt, Human
ggaggagggaagaggaacagau

SEQ ID NO: 1032287 - RNA, 22 nt, Human
ggagggggaggagggaagagga

SEQ ID NO: 1032288 - RNA, 23 nt, Human
ggagggggaggagggaagaggaa

SEQ ID NO: 1032289 - RNA, 21 nt, Human
ggagggggagggggaggaggg

SEQ ID NO: 1032290 - RNA, 22 nt, Human
ggagggggagggggaggaggga

SEQ ID NO: 1032291 - RNA, 18 nt, Human
ggagguugcagugagccg

SEQ ID NO: 1032292 - RNA, 20 nt, Human
ggagguugcagugagccgag

SEQ ID NO: 1032293 - RNA, 22 nt, Human
ggagguugcagugagccgagau

SEQ ID NO: 1032294 - RNA, 24 nt, Human
ggagguugcagugagccgagaugg

SEQ ID NO: 1032295 - RNA, 23 nt, Human
ggagguuguagcgagccgagauc

SEQ ID NO: 1032296 - RNA, 24 nt, Human
ggagguuguagcgagccgagauca

SEQ ID NO: 1032297 - RNA, 21 nt, Human
ggcagaggcugcaaucucggc

SEQ ID NO: 1032298 - RNA, 26 nt, Human
ggcggguugcugggagguggagguug

SEQ ID NO: 1032299 - RNA, 21 nt, Human
ggcugcaaucucggcacuuug

SEQ ID NO: 1032300 - RNA, 19 nt, Human
ggcugccgggcggaggggc

SEQ ID NO: 1032301 - RNA, 18 nt, Human
ggcuggccgggcgggggg

SEQ ID NO: 1032302 - RNA, 23 nt, Human
gggaggccgaggcuggcggauca

SEQ ID NO: 1032303 - RNA, 23 nt, Human
gggagggggaggagggaagagga

SEQ ID NO: 1032304 - RNA, 22 nt, Human
gggcagagacgcuccucacuuu

SEQ ID NO: 1032305 - RNA, 22 nt, Human
gggcagaggcugcaaucucggc

SEQ ID NO: 1032306 - RNA, 20 nt, Human
gggcggcuggccgggcgggg

SEQ ID NO: 1032307 - RNA, 21 nt, Human
gggcggcuggccggguggggg

SEQ ID NO: 1032308 - RNA, 21 nt, Human
ggggacugauccccccaccuc

SEQ ID NO: 1032309 - RNA, 23 nt, Human
ggggggggggagggggaggggga

SEQ ID NO: 1032310 - RNA, 21 nt, Human
gggggggggggagggggaggg

SEQ ID NO: 1032311 - RNA, 22 nt, Human
gggggggggggagggggagggg

SEQ ID NO: 1032312 - RNA, 23 nt, Human
gguugcugggagguggagguugu

SEQ ID NO: 1032313 - RNA, 19 nt, Human
guacugaugacaggcaugu

SEQ ID NO: 1032314 - RNA, 20 nt, Human
gucacaggacaauaggggag

SEQ ID NO: 1032315 - RNA, 18 nt, Human
guugcagugagccgagau

SEQ ID NO: 1032316 - RNA, 21 nt, Human
guuguagcgagccgagaucac

SEQ ID NO: 1032317 - RNA, 24 nt, Human
uagaagccuucagaccuaugaagg

SEQ ID NO: 1032318 - RNA, 18 nt, Human
ucacaggacaauagggga

SEQ ID NO: 1032319 - RNA, 23 nt, Human
ucacgccacugcacuccagccug

SEQ ID NO: 1032320 - RNA, 19 nt, Human
ucaggcagggagguugcag

SEQ ID NO: 1032321 - RNA, 24 nt, Human
ucaggcagggagguugcagugagc

SEQ ID NO: 1032322 - RNA, 21 nt, Human
ucaggggaaguaggcgaaaag

SEQ ID NO: 1032323 - RNA, 22 nt, Human
ucauaugguccaccugcuggug

SEQ ID NO: 1032324 - RNA, 21 nt, Human
uccacaaaaccgccauuguca

SEQ ID NO: 1032325 - RNA, 22 nt, Human
uccaccaaaaaaaauacgaaaa

SEQ ID NO: 1032326 - RNA, 23 nt, Human
uccaggccaggagaggccaaaac

SEQ ID NO: 1032327 - RNA, 22 nt, Human
uccccccaccucccucccggac

SEQ ID NO: 1032328 - RNA, 22 nt, Human
ucccuggguacuugagauuagg

SEQ ID NO: 1032329 - RNA, 23 nt, Human
ucccuggguacuugagauuaggg

SEQ ID NO: 1032330 - RNA, 19 nt, Human
uccucacuuuccagacugg

SEQ ID NO: 1032331 - RNA, 25 nt, Human
ugagaacagcucaauuccagggaua

SEQ ID NO: 1032332 - RNA, 19 nt, Human
ugaggcaagagaaucaggc

SEQ ID NO: 1032333 - RNA, 18 nt, Human
ugccgggcggagaugcuc

SEQ ID NO: 1032334 - RNA, 19 nt, Human
ugcgagggcacaggcuggg

SEQ ID NO: 1032335 - RNA, 21 nt, Human
uggaaagagcggggggggggg

SEQ ID NO: 1032336 - RNA, 22 nt, Human
uggcaaggcuagugaccuuggu

SEQ ID NO: 1032337 - RNA, 18 nt, Human
ugggaggccaaggcgggu

SEQ ID NO: 1032338 - RNA, 24 nt, Human
ugggagguggagguuguagcgagc

SEQ ID NO: 1032339 - RNA, 21 nt, Human
ugggaugaccagugucuucaa

SEQ ID NO: 1032340 - RNA, 20 nt, Human
ugggggaaugaacagguugg

SEQ ID NO: 1032341 - RNA, 24 nt, Human
ugucuucaaacuaggcagaaagag

SEQ ID NO: 1032342 - RNA, 22 nt, Human
uuaggagcuggagaccagcccg

SEQ ID NO: 1032343 - RNA, 20 nt, Human
uugcagugagccgagauggc

SEQ ID NO: 1032344 - RNA, 20 nt, Human
uuguagcgagccgagaucac

SEQ ID NO: 1032345 - RNA, 21 nt, Human
uuuugagaguccaggccagga

SEQ ID NO: 1032346 - RNA, 23 nt, Human
cagcgcggagccguccucccgcc

SEQ ID NO: 1032347 - RNA, 21 nt, Human
ccagguaacgguggugcucuc

SEQ ID NO: 1032348 - RNA, 23 nt, Human
ccccgccccgcaugcagcgcgga

SEQ ID NO: 1032349 - RNA, 18 nt, Human
ccgccaccuccgggccgc

SEQ ID NO: 1032350 - RNA, 19 nt, Human
ccgggacaaaggccccucc

SEQ ID NO: 1032351 - RNA, 22 nt, Human
gagccguccucccgccaccucc

SEQ ID NO: 1032352 - RNA, 23 nt, Human
gagccuggccgggagauccacgc

SEQ ID NO: 1032353 - RNA, 18 nt, Human
ggacaaaggccccuccuc

SEQ ID NO: 1032354 - RNA, 24 nt, Human
gugcucucaaggcuggcagccuca

SEQ ID NO: 1032355 - RNA, 23 nt, Human
uggcagccucauucucuggaggc

SEQ ID NO: 1032356 - RNA, 26 nt, Human
ugguggguuuuccgggacaaaggccc

SEQ ID NO: 1032357 - RNA, 25 nt, Human
aaagagccuucaagacagguccagc

SEQ ID NO: 1032358 - RNA, 24 nt, Human
aaaggucucuucgaauccuuugcc

SEQ ID NO: 1032359 - RNA, 23 nt, Human
aacaggaaauaggaaaauucaga

SEQ ID NO: 1032360 - RNA, 25 nt, Human
aagcagcagaagucaucauucgcag

SEQ ID NO: 1032361 - RNA, 22 nt, Human
aagccccuggagcagggcccag

SEQ ID NO: 1032362 - RNA, 20 nt, Human
aaggauguuaagugcccaga

SEQ ID NO: 1032363 - RNA, 22 nt, Human
accucccugaggucaccuguug

SEQ ID NO: 1032364 - RNA, 20 nt, Human
acgcaggugacauggcuuug

SEQ ID NO: 1032365 - RNA, 19 nt, Human
acuuugugguacaggaagu

SEQ ID NO: 1032366 - RNA, 23 nt, Human
agacggaagcagcagaagucauc

SEQ ID NO: 1032367 - RNA, 18 nt, Human
aggaaguucaggacuuga

SEQ ID NO: 1032368 - RNA, 23 nt, Human
agugaggagcucccuggagcccg

SEQ ID NO: 1032369 - RNA, 22 nt, Human
augaguaaagcaggacucaccc

SEQ ID NO: 1032370 - RNA, 23 nt, Human
cacccaccaguguggguaacacu

SEQ ID NO: 1032371 - RNA, 22 nt, Human
caccgcgcguccucccuggucc

SEQ ID NO: 1032372 - RNA, 19 nt, Human
cagagacggaagcagcaga

SEQ ID NO: 1032373 - RNA, 18 nt, Human
cagcagcggcaguguggc

SEQ ID NO: 1032374 - RNA, 22 nt, Human
cauguuacuuucccaccagcaa

SEQ ID NO: 1032375 - RNA, 25 nt, Human
ccaacgaugacaccggccgucccuc

SEQ ID NO: 1032376 - RNA, 24 nt, Human
ccagcacacauuacugcuuuucca

SEQ ID NO: 1032377 - RNA, 21 nt, Human
ccaggcaugucccccugugcu

SEQ ID NO: 1032378 - RNA, 23 nt, Human
ccaggucucugugccucugugcc

SEQ ID NO: 1032379 - RNA, 23 nt, Human
ccauaaugaguagcugcugagua

SEQ ID NO: 1032380 - RNA, 18 nt, Human
cccaccagcaaucuauga

SEQ ID NO: 1032381 - RNA, 25 nt, Human
cccccugugcugauggcagaggcug

SEQ ID NO: 1032382 - RNA, 20 nt, Human
ccccuggagcagggcccagg

SEQ ID NO: 1032383 - RNA, 23 nt, Human
ccgcugacguuucacuggacaac

SEQ ID NO: 1032384 - RNA, 18 nt, Human
ccggggcagggagcaaug

SEQ ID NO: 1032385 - RNA, 18 nt, Human
ccuagcugagaaucucau

SEQ ID NO: 1032386 - RNA, 23 nt, Human
ccugaagacucaucccucagauu

SEQ ID NO: 1032387 - RNA, 25 nt, Human
ccuguugguuuccaggucucugugc

SEQ ID NO: 1032388 - RNA, 19 nt, Human
cggccaaaagagccuucaa

SEQ ID NO: 1032389 - RNA, 23 nt, Human
cguacucauuggucauuugugua

SEQ ID NO: 1032390 - RNA, 19 nt, Human
cuccaacgaugacaccggc

SEQ ID NO: 1032391 - RNA, 24 nt, Human
cuccaacgaugacaccgggguacc

SEQ ID NO: 1032392 - RNA, 23 nt, Human
cugaggucaccuguugguuuccu

SEQ ID NO: 1032393 - RNA, 19 nt, Human
cugauggcagaggcacagg

SEQ ID NO: 1032394 - RNA, 30 nt, Human
cugccaaacuguuucuacauugguugcacu

SEQ ID NO: 1032395 - RNA, 20 nt, Human
cuggauacuugucccagaug

SEQ ID NO: 1032396 - RNA, 18 nt, Human
gagccgggcggaggcggg

SEQ ID NO: 1032397 - RNA, 19 nt, Human
gauggcagaggcacaggga

SEQ ID NO: 1032398 - RNA, 21 nt, Human
gcacccaccaguguggguaac

SEQ ID NO: 1032399 - RNA, 23 nt, Human
gcagcggcaguguggcuggcucu

SEQ ID NO: 1032400 - RNA, 22 nt, Human
gcaggugcucucagaucccugc

SEQ ID NO: 1032401 - RNA, 22 nt, Human
gccccuggagcagggcccaggg

SEQ ID NO: 1032402 - RNA, 18 nt, Human
gcggaggcgggucuggga

SEQ ID NO: 1032403 - RNA, 20 nt, Human
ggagcucccuggagcccggg

SEQ ID NO: 1032404 - RNA, 20 nt, Human
gggcccagggagccgggcgg

SEQ ID NO: 1032405 - RNA, 21 nt, Human
gguccagcagugccaggaagc

SEQ ID NO: 1032406 - RNA, 21 nt, Human
guguaucuucuuuggacaaag

SEQ ID NO: 1032407 - RNA, 19 nt, Human
uaaaucucugacaugagua

SEQ ID NO: 1032408 - RNA, 21 nt, Human
uagcaggugcucucagauccc

SEQ ID NO: 1032409 - RNA, 22 nt, Human
uauuuuuuuuccugugguugua

SEQ ID NO: 1032410 - RNA, 22 nt, Human
ucacuggacaacgcaggugaca

SEQ ID NO: 1032411 - RNA, 25 nt, Human
ucagaaaacugcucagagaucucag

SEQ ID NO: 1032412 - RNA, 23 nt, Human
ucccgcaccgcgcguccucccug

SEQ ID NO: 1032413 - RNA, 20 nt, Human
ucccugaggucaccuguugg

SEQ ID NO: 1032414 - RNA, 24 nt, Human
ucccuggagcccgggcagcgccug

SEQ ID NO: 1032415 - RNA, 23 nt, Human
uccggccaaaagagccuucaaga

SEQ ID NO: 1032416 - RNA, 21 nt, Human
uccugaagacucaucccucag

SEQ ID NO: 1032417 - RNA, 23 nt, Human
uccugacaacaaacucuccugaa

SEQ ID NO: 1032418 - RNA, 19 nt, Human
uccugugguuguaugugcu

SEQ ID NO: 1032419 - RNA, 23 nt, Human
ucucagaucccugcccauccauu

SEQ ID NO: 1032420 - RNA, 19 nt, Human
ucucaggugccaagaaccc

SEQ ID NO: 1032421 - RNA, 20 nt, Human
ucugacaugaguaaagcagg

SEQ ID NO: 1032422 - RNA, 24 nt, Human
ucugcacagacucgggcauguggg

SEQ ID NO: 1032423 - RNA, 20 nt, Human
ugacccggggcagggagcaa

SEQ ID NO: 1032424 - RNA, 21 nt, Human
ugaguggaaagugguacuucc

SEQ ID NO: 1032425 - RNA, 21 nt, Human
ugauuugcaaauauuucacuc

SEQ ID NO: 1032426 - RNA, 23 nt, Human
ugcagcagcggcaguguggcugg

SEQ ID NO: 1032427 - RNA, 21 nt, Human
ugcagucuccuccgcgugggu

SEQ ID NO: 1032428 - RNA, 18 nt, Human
ugccaagaaccccaggcc

SEQ ID NO: 1032429 - RNA, 19 nt, Human
ugcccagagcucuccagag

SEQ ID NO: 1032430 - RNA, 23 nt, Human
ugcccagagcucuccagagacgg

SEQ ID NO: 1032431 - RNA, 25 nt, Human
ugcccagagcucuccagagacggaa

SEQ ID NO: 1032432 - RNA, 20 nt, Human
uggauacuugucccagaugu

SEQ ID NO: 1032433 - RNA, 24 nt, Human
ugggaaaugcagucuccuccgcgu

SEQ ID NO: 1032434 - RNA, 20 nt, Human
ugguuuccaggucucugugc

SEQ ID NO: 1032435 - RNA, 18 nt, Human
uguaucuucuuuggacaa

SEQ ID NO: 1032436 - RNA, 19 nt, Human
uucaacaggaaauaggaaa

SEQ ID NO: 1032437 - RNA, 23 nt, Human
uucacaaaccucccugaggucac

SEQ ID NO: 1032438 - RNA, 18 nt, Human
uucuccacaucuucacug

SEQ ID NO: 1032439 - RNA, 23 nt, Human
uucucuggguuuucuucucgcuu

SEQ ID NO: 1032440 - RNA, 21 nt, Human
uugguuuccaggucucugugc

SEQ ID NO: 1032441 - RNA, 21 nt, Human
uuuauacuuuuagcucuuaca

SEQ ID NO: 1032442 - RNA, 23 nt, Human
uuuguuuuagucuaaaucucuga

SEQ ID NO: 1032443 - RNA, 20 nt, Human
uuuuaaggaacugccaaacu

SEQ ID NO: 1032444 - RNA, 23 nt, Human
uuuuuuuccugugguuguaugug

SEQ ID NO: 1032445 - RNA, 25 nt, Human
aaagcaccaucauuucaauauugcc

SEQ ID NO: 1032446 - RNA, 30 nt, Human
aaauaaacaccaaaugcagaaagcaccauu

SEQ ID NO: 1032447 - RNA, 20 nt, Human
accaaaugcagaaagcacca

SEQ ID NO: 1032448 - RNA, 24 nt, Human
agaaccacuuccagggucagagcc

SEQ ID NO: 1032449 - RNA, 26 nt, Human
auaaacaccaaaugcagaaagcacca

SEQ ID NO: 1032450 - RNA, 23 nt, Human
auacccgcagccgacaaucucag

SEQ ID NO: 1032451 - RNA, 18 nt, Human
caaauaaacaccaaaugc

SEQ ID NO: 1032452 - RNA, 25 nt, Human
caaauaaacaccaaaugcagaaagc

SEQ ID NO: 1032453 - RNA, 18 nt, Human
caccaaaugcagaaagca

SEQ ID NO: 1032454 - RNA, 20 nt, Human
caugucuugauaauggaaaa

SEQ ID NO: 1032455 - RNA, 18 nt, Human
ccugcuuagaaccacuuc

SEQ ID NO: 1032456 - RNA, 18 nt, Human
gaugcauauuacuuaaaa

SEQ ID NO: 1032457 - RNA, 18 nt, Human
gcagaaagcaccaucauu

SEQ ID NO: 1032458 - RNA, 20 nt, Human
uaaacaccaaaugcagaaag

SEQ ID NO: 1032459 - RNA, 18 nt, Human
uacccgcagccgacaauc

SEQ ID NO: 1032460 - RNA, 18 nt, Human
uagauggccaugucuuga

SEQ ID NO: 1032461 - RNA, 19 nt, Human
uauuucugaaguuucugau

SEQ ID NO: 1032462 - RNA, 19 nt, Human
ucacuucauauucaugagg

SEQ ID NO: 1032463 - RNA, 20 nt, Human
uuuacaguauguaccacucu

SEQ ID NO: 1032464 - RNA, 21 nt, Human
uuuacaguauguaccacucuu

SEQ ID NO: 1032465 - RNA, 25 nt, Human
uuuuuuuuuuuuuuuuuuuuaucag

SEQ ID NO: 1032466 - RNA, 19 nt, Human
aagcaugaauaguugugac

SEQ ID NO: 1032467 - RNA, 24 nt, Human
ccaauugcagaagacucaagcuga

SEQ ID NO: 1032468 - RNA, 24 nt, Human
ugcagaagacucaagcugauucca

SEQ ID NO: 1032469 - RNA, 23 nt, Human
acuuuauggaucuaaaaaggcua

SEQ ID NO: 1032470 - RNA, 20 nt, Human
agaggcaaguuucucccugu

SEQ ID NO: 1032471 - RNA, 18 nt, Human
aggcaaguuucucccugu

SEQ ID NO: 1032472 - RNA, 21 nt, Human
cguaucugcaaacuuguuuca

SEQ ID NO: 1032473 - RNA, 22 nt, Human
cguaucugcaaacuuguuucac

SEQ ID NO: 1032474 - RNA, 19 nt, Human
gaaaauagcuuucagaggc

SEQ ID NO: 1032475 - RNA, 22 nt, Human
ggaucccuacugccuucuggac

SEQ ID NO: 1032476 - RNA, 20 nt, Human
ggaucuaaaaaggcuaagua

SEQ ID NO: 1032477 - RNA, 21 nt, Human
guaucugcaaacuuguuucac

SEQ ID NO: 1032478 - RNA, 23 nt, Human
ucagaaaauagcuuucagaggca

SEQ ID NO: 1032479 - RNA, 25 nt, Human
ucagaaaauagcuuucagaggcaag

SEQ ID NO: 1032480 - RNA, 22 nt, Human
acuggagcucagggugccccca

SEQ ID NO: 1032481 - RNA, 20 nt, Human
agcucgggggacagcagugc

SEQ ID NO: 1032482 - RNA, 26 nt, Human
ggacagcagugcggggacacccuuca

SEQ ID NO: 1032483 - RNA, 19 nt, Human
ggagcucagggugccccca

SEQ ID NO: 1032484 - RNA, 23 nt, Human
ucagggugcccccaguuccucuu

SEQ ID NO: 1032485 - RNA, 20 nt, Human
ugaguggugguacuggagcu

SEQ ID NO: 1032486 - RNA, 22 nt, Human
ugcccccaguuccucuuccggc

SEQ ID NO: 1032487 - RNA, 24 nt, Human
ugcccccaguuccucuuccggccc

SEQ ID NO: 1032488 - RNA, 18 nt, Human
uguugugaguggugguac

SEQ ID NO: 1032489 - RNA, 24 nt, Human
aaaagugcugggauuacagaggug

SEQ ID NO: 1032490 - RNA, 19 nt, Human
aaagugcugggauuacaga

SEQ ID NO: 1032491 - RNA, 24 nt, Human
aaagugcugggauuacagagguga

SEQ ID NO: 1032492 - RNA, 18 nt, Human
aagugcugggauuacaga

SEQ ID NO: 1032493 - RNA, 21 nt, Human
aagugcugggauuacagaggu

SEQ ID NO: 1032494 - RNA, 26 nt, Human
aagugcugggauuacagaggugagcc

SEQ ID NO: 1032495 - RNA, 18 nt, Human
acagaggugagccaccgc

SEQ ID NO: 1032496 - RNA, 24 nt, Human
accauguugcccaggcuggucugg

SEQ ID NO: 1032497 - RNA, 18 nt, Human
acgggguuucaccauguu

SEQ ID NO: 1032498 - RNA, 19 nt, Human
acgggguuucaccauguug

SEQ ID NO: 1032499 - RNA, 24 nt, Human
acgggguuucaccauguugcccag

SEQ ID NO: 1032500 - RNA, 19 nt, Human
agagagugcucagggagcu

SEQ ID NO: 1032501 - RNA, 25 nt, Human
agggagcugcaguggcugaucccag

SEQ ID NO: 1032502 - RNA, 18 nt, Human
aggucggggccagggauc

SEQ ID NO: 1032503 - RNA, 24 nt, Human
aggugauccgccugccucggccuc

SEQ ID NO: 1032504 - RNA, 24 nt, Human
auuuuuguauuuuuaguagagacg

SEQ ID NO: 1032505 - RNA, 22 nt, Human
caccauguugcccaggcugguc

SEQ ID NO: 1032506 - RNA, 27 nt, Human
caccauguugcccaggcuggucuggaa

SEQ ID NO: 1032507 - RNA, 22 nt, Human
caggugauccgccugccucggc

SEQ ID NO: 1032508 - RNA, 20 nt, Human
cauguugcccaggcuggucu

SEQ ID NO: 1032509 - RNA, 22 nt, Human
cauguugcccaggcuggucugg

SEQ ID NO: 1032510 - RNA, 23 nt, Human
cauguugcccaggcuggucugga

SEQ ID NO: 1032511 - RNA, 24 nt, Human
cauguugcccaggcuggucuggaa

SEQ ID NO: 1032512 - RNA, 21 nt, Human
cccggcccagcuccuccugcc

SEQ ID NO: 1032513 - RNA, 19 nt, Human
ccgcgcccggccugcuggg

SEQ ID NO: 1032514 - RNA, 19 nt, Human
ccuccugcccaggcccagg

SEQ ID NO: 1032515 - RNA, 21 nt, Human
ccugauuucaggugauccgcc

SEQ ID NO: 1032516 - RNA, 24 nt, Human
cggggccagggaucccacccuggg

SEQ ID NO: 1032517 - RNA, 24 nt, Human
cgggguuucaccauguugcccagg

SEQ ID NO: 1032518 - RNA, 21 nt, Human
cucggccucuaaaagugcugg

SEQ ID NO: 1032519 - RNA, 24 nt, Human
cuggcacccggcccagcuccuccu

SEQ ID NO: 1032520 - RNA, 18 nt, Human
cuggcucugcagccgccc

SEQ ID NO: 1032521 - RNA, 19 nt, Human
gacagggcgggggcaguga

SEQ ID NO: 1032522 - RNA, 23 nt, Human
gagacgggguuucaccauguugc

SEQ ID NO: 1032523 - RNA, 24 nt, Human
gagacgggguuucaccauguugcc

SEQ ID NO: 1032524 - RNA, 21 nt, Human
gagcugcaguggcugauccca

SEQ ID NO: 1032525 - RNA, 18 nt, Human
gauuacagaggugagcca

SEQ ID NO: 1032526 - RNA, 24 nt, Human
gauuucaggugauccgccugccuc

SEQ ID NO: 1032527 - RNA, 22 nt, Human
gcccaggccaauuggggcuuug

SEQ ID NO: 1032528 - RNA, 21 nt, Human
gcugggauuacagaggugagc

SEQ ID NO: 1032529 - RNA, 22 nt, Human
gcuggucuggaacuccugauuu

SEQ ID NO: 1032530 - RNA, 21 nt, Human
ggcccagcuccuccugcccag

SEQ ID NO: 1032531 - RNA, 20 nt, Human
ggcuggucuggaacuccuga

SEQ ID NO: 1032532 - RNA, 18 nt, Human
gggcaggguagggagggu

SEQ ID NO: 1032533 - RNA, 20 nt, Human
gggcagugauggccccugga

SEQ ID NO: 1032534 - RNA, 24 nt, Human
gggcgugucaggacagaggucggg

SEQ ID NO: 1032535 - RNA, 23 nt, Human
gggguuucaccauguugcccagg

SEQ ID NO: 1032536 - RNA, 27 nt, Human
gggucccagucccaacagccugggccu

SEQ ID NO: 1032537 - RNA, 25 nt, Human
ggucccagucccaacagccugggcc

SEQ ID NO: 1032538 - RNA, 23 nt, Human
guagagacgggguuucaccaugu

SEQ ID NO: 1032539 - RNA, 24 nt, Human
guuucaccauguugcccaggcugg

SEQ ID NO: 1032540 - RNA, 24 nt, Human
uaaaagugcugggauuacagaggu

SEQ ID NO: 1032541 - RNA, 24 nt, Human
uaauuuuuguauuuuuaguagaga

SEQ ID NO: 1032542 - RNA, 23 nt, Human
uacagaggugagccaccgcgccc

SEQ ID NO: 1032543 - RNA, 22 nt, Human
uagagacgggguuucaccaugu

SEQ ID NO: 1032544 - RNA, 21 nt, Human
uagcuggggcaggguagggag

SEQ ID NO: 1032545 - RNA, 24 nt, Human
uaguagagacgggguuucaccaug

SEQ ID NO: 1032546 - RNA, 26 nt, Human
uaguagagacgggguuucaccauguu

SEQ ID NO: 1032547 - RNA, 21 nt, Human
ucaccauguugcccaggcugg

SEQ ID NO: 1032548 - RNA, 21 nt, Human
ucaggugauccgccugccucg

SEQ ID NO: 1032549 - RNA, 25 nt, Human
ucuaaaagugcugggauuacagagg

SEQ ID NO: 1032550 - RNA, 26 nt, Human
ucuggcacccggcccagcuccuccug

SEQ ID NO: 1032551 - RNA, 22 nt, Human
ugagcggggacacccagcugcc

SEQ ID NO: 1032552 - RNA, 18 nt, Human
ugauuucaggugauccgc

SEQ ID NO: 1032553 - RNA, 24 nt, Human
ugauuucaggugauccgccugccu

SEQ ID NO: 1032554 - RNA, 25 nt, Human
ugcccaggcccaggccaauuggggc

SEQ ID NO: 1032555 - RNA, 24 nt, Human
ugcccaggcuggucuggaacuccu

SEQ ID NO: 1032556 - RNA, 22 nt, Human
ugggauuacagaggugagccac

SEQ ID NO: 1032557 - RNA, 23 nt, Human
ugggauuacagaggugagccacc

SEQ ID NO: 1032558 - RNA, 24 nt, Human
ugggauuacagaggugagccaccg

SEQ ID NO: 1032559 - RNA, 23 nt, Human
uggucuggaacuccugauuucag

SEQ ID NO: 1032560 - RNA, 21 nt, Human
uguauuuuuaguagagacggg

SEQ ID NO: 1032561 - RNA, 18 nt, Human
uuaguagagacgggguuu

SEQ ID NO: 1032562 - RNA, 22 nt, Human
uuaguagagacgggguuucacc

SEQ ID NO: 1032563 - RNA, 24 nt, Human
uuaguagagacgggguuucaccau

SEQ ID NO: 1032564 - RNA, 21 nt, Human
uucaggugauccgccugccuc

SEQ ID NO: 1032565 - RNA, 23 nt, Human
uuguauuuuuaguagagacgggg

SEQ ID NO: 1032566 - RNA, 24 nt, Human
uuucaccauguugcccaggcuggu

SEQ ID NO: 1032567 - RNA, 24 nt, Human
uuuuuaguagagacgggguuucac

SEQ ID NO: 1032568 - RNA, 20 nt, Human
uuuuuguauuuuuaguagag

SEQ ID NO: 1032569 - RNA, 19 nt, Human
aaggauggggaggauggcg

SEQ ID NO: 1032570 - RNA, 22 nt, Human
agcaguggugacugccccccac

SEQ ID NO: 1032571 - RNA, 20 nt, Human
aggaggagacaggccgucca

SEQ ID NO: 1032572 - RNA, 24 nt, Human
aggauggggaggauggcgagggcc

SEQ ID NO: 1032573 - RNA, 20 nt, Human
aggcggaugccacgcccagc

SEQ ID NO: 1032574 - RNA, 19 nt, Human
caggaggagacaggccgcc

SEQ ID NO: 1032575 - RNA, 28 nt, Human
ccagcaguggugacugccccccacuccu

SEQ ID NO: 1032576 - RNA, 23 nt, Human
cccagcaguggugacugcccccc

SEQ ID NO: 1032577 - RNA, 18 nt, Human
ccccagggcggccacacc

SEQ ID NO: 1032578 - RNA, 25 nt, Human
ccucacagcuucugaugacagcugc

SEQ ID NO: 1032579 - RNA, 22 nt, Human
cgcccagcaguggugacugccc

SEQ ID NO: 1032580 - RNA, 22 nt, Human
cucacagcuucugaugacagcu

SEQ ID NO: 1032581 - RNA, 19 nt, Human
cugugggucccucacagcu

SEQ ID NO: 1032582 - RNA, 22 nt, Human
cugugggucccucacagcuucu

SEQ ID NO: 1032583 - RNA, 19 nt, Human
ggaacaaggauggggagga

SEQ ID NO: 1032584 - RNA, 18 nt, Human
ggagaaaggcccaaggcg

SEQ ID NO: 1032585 - RNA, 18 nt, Human
ggagacaggccguccaca

SEQ ID NO: 1032586 - RNA, 18 nt, Human
gggaggauggcgagggcc

SEQ ID NO: 1032587 - RNA, 19 nt, Human
ggggaggauggcgagggcc

SEQ ID NO: 1032588 - RNA, 19 nt, Human
gugacugccccccacuccu

SEQ ID NO: 1032589 - RNA, 24 nt, Human
gugggcccugcaggaggagacagg

SEQ ID NO: 1032590 - RNA, 19 nt, Human
uccaaaaucuguggguccc

SEQ ID NO: 1032591 - RNA, 23 nt, Human
ugacagcugcuaaugccauuugc

SEQ ID NO: 1032592 - RNA, 22 nt, Human
ugccauuugcugaggaacaagg

SEQ ID NO: 1032593 - RNA, 24 nt, Human
ugcugaggaacaaggauggggagg

SEQ ID NO: 1032594 - RNA, 20 nt, Human
uggggaggauggcgagggcc

SEQ ID NO: 1032595 - RNA, 19 nt, Human
aaaaaaguguuuugccucu

SEQ ID NO: 1032596 - RNA, 21 nt, Human
aacaaaaggccaaguucuguu

SEQ ID NO: 1032597 - RNA, 21 nt, Human
aaucaggaaggaaagaauuuc

SEQ ID NO: 1032598 - RNA, 21 nt, Human
accuaauucacaacaaaaggc

SEQ ID NO: 1032599 - RNA, 24 nt, Human
acuacgcacaaaauaggcaaucac

SEQ ID NO: 1032600 - RNA, 20 nt, Human
aggaaggaaagaauuuccag

SEQ ID NO: 1032601 - RNA, 22 nt, Human
caaaauaggcaaucacuaagua

SEQ ID NO: 1032602 - RNA, 21 nt, Human
caacaaaaggccaaguucugu

SEQ ID NO: 1032603 - RNA, 20 nt, Human
cagggaaagacaauacaacg

SEQ ID NO: 1032604 - RNA, 23 nt, Human
ccauacuaugauuccaaagggug

SEQ ID NO: 1032605 - RNA, 21 nt, Human
cccauacuaugauuccaaagg

SEQ ID NO: 1032606 - RNA, 18 nt, Human
gagcaccuugcagggacu

SEQ ID NO: 1032607 - RNA, 20 nt, Human
gauaaaucauaacuucuacc

SEQ ID NO: 1032608 - RNA, 19 nt, Human
uaaaagacuucaaaugcag

SEQ ID NO: 1032609 - RNA, 18 nt, Human
uagggcaaaucaggaagg

SEQ ID NO: 1032610 - RNA, 18 nt, Human
ucagaagcuauauuucag

SEQ ID NO: 1032611 - RNA, 21 nt, Human
ucagaagcuauauuucaguca

SEQ ID NO: 1032612 - RNA, 21 nt, Human
ucaggaaggaaagaauuucca

SEQ ID NO: 1032613 - RNA, 25 nt, Human
ucaggaaggaaagaauuuccagggu

SEQ ID NO: 1032614 - RNA, 25 nt, Human
ucagucauugaaaauacuuguccau

SEQ ID NO: 1032615 - RNA, 18 nt, Human
uccaaagggugaaaaaag

SEQ ID NO: 1032616 - RNA, 20 nt, Human
uccuagggcaaaucaggaag

SEQ ID NO: 1032617 - RNA, 23 nt, Human
uguuuugccucuucuacccucca

SEQ ID NO: 1032618 - RNA, 25 nt, Human
uguuuugccucuucuacccuccaaa

SEQ ID NO: 1032619 - RNA, 18 nt, Human
uucaacuuccuuauugca

SEQ ID NO: 1032620 - RNA, 23 nt, Human
uucaacuuccuuauugcauccaa

SEQ ID NO: 1032621 - RNA, 19 nt, Human
uucuguucagaggauuuua

SEQ ID NO: 1032622 - RNA, 20 nt, Human
uugaaaauacuuguccauuu

SEQ ID NO: 1032623 - RNA, 21 nt, Human
cuagcacagcauccaauguag

SEQ ID NO: 1032624 - RNA, 21 nt, Human
aagcaaguagcauccucaaag

SEQ ID NO: 1032625 - RNA, 18 nt, Human
aagcauccgugccugaag

SEQ ID NO: 1032626 - RNA, 22 nt, Human
aggaaaggaacucagaguccca

SEQ ID NO: 1032627 - RNA, 22 nt, Human
aguacaaccaaguaaaguccag

SEQ ID NO: 1032628 - RNA, 21 nt, Human
auccaguaacacagccaaugg

SEQ ID NO: 1032629 - RNA, 23 nt, Human
caaccaguaaaacauccaguaac

SEQ ID NO: 1032630 - RNA, 28 nt, Human
cucagagucccaugcagaaaauuguucc

SEQ ID NO: 1032631 - RNA, 25 nt, Human
cucauaguucuccaacaggacagcc

SEQ ID NO: 1032632 - RNA, 21 nt, Human
cuccuggucuugugccugaag

SEQ ID NO: 1032633 - RNA, 24 nt, Human
cuugcucauaguucuccaacagga

SEQ ID NO: 1032634 - RNA, 21 nt, Human
gccgggaugcagaagagcugg

SEQ ID NO: 1032635 - RNA, 19 nt, Human
ggaaaggaacucagagucc

SEQ ID NO: 1032636 - RNA, 25 nt, Human
gucucuguuuauagugaagauucuu

SEQ ID NO: 1032637 - RNA, 20 nt, Human
guguuagaugguuuuuggcu

SEQ ID NO: 1032638 - RNA, 23 nt, Human
guucuugugaaucagacugcagu

SEQ ID NO: 1032639 - RNA, 25 nt, Human
uaaauguguuagaugguuuuuggcu

SEQ ID NO: 1032640 - RNA, 21 nt, Human
uagaugguuuuuggcuuauac

SEQ ID NO: 1032641 - RNA, 19 nt, Human
uaguuugagaaacaccaua

SEQ ID NO: 1032642 - RNA, 24 nt, Human
uccaagcaaguagcauccucaaag

SEQ ID NO: 1032643 - RNA, 25 nt, Human
uccgugccugaagcuguuuggaggc

SEQ ID NO: 1032644 - RNA, 21 nt, Human
uccuggucuugugccugaagc

SEQ ID NO: 1032645 - RNA, 22 nt, Human
ucuagaauagauaaugcagcuc

SEQ ID NO: 1032646 - RNA, 28 nt, Human
ugacccaguuucucgucaaccaguaagg

SEQ ID NO: 1032647 - RNA, 22 nt, Human
ugagaaacaccauaaugaaggc

SEQ ID NO: 1032648 - RNA, 21 nt, Human
ugaugcuucuuucuuuguugg

SEQ ID NO: 1032649 - RNA, 19 nt, Human
ugccugaagcuguuuggag

SEQ ID NO: 1032650 - RNA, 21 nt, Human
ugccugaagcuguuuggaggc

SEQ ID NO: 1032651 - RNA, 22 nt, Human
ugcuugcucauaguucuccaac

SEQ ID NO: 1032652 - RNA, 25 nt, Human
ugguuccaagcaaguagcauccuuu

SEQ ID NO: 1032653 - RNA, 23 nt, Human
uucuuuguugguaucuccuugau

SEQ ID NO: 1032654 - RNA, 21 nt, Human
uugguaucuccuugauaaaug

SEQ ID NO: 1032655 - RNA, 23 nt, Human
aaaaacauuaaggggacuguauc

SEQ ID NO: 1032656 - RNA, 20 nt, Human
aaaagaaccacuccaaggac

SEQ ID NO: 1032657 - RNA, 27 nt, Human
aaaaggagauggauuuggaucccaaaa

SEQ ID NO: 1032658 - RNA, 24 nt, Human
aaacacugaaguuacgucagagcu

SEQ ID NO: 1032659 - RNA, 20 nt, Human
aaacccucugcgggggcccc

SEQ ID NO: 1032660 - RNA, 24 nt, Human
aaagguacaauuuagaagcaaaaa

SEQ ID NO: 1032661 - RNA, 22 nt, Human
aaaucagaagcaaaagguacaa

SEQ ID NO: 1032662 - RNA, 20 nt, Human
aagaaacccaggaaaaagga

SEQ ID NO: 1032663 - RNA, 22 nt, Human
acagacagucaucgcuuggaga

SEQ ID NO: 1032664 - RNA, 19 nt, Human
acccugagguggacacagg

SEQ ID NO: 1032665 - RNA, 20 nt, Human
acgagguccuggucucccuc

SEQ ID NO: 1032666 - RNA, 21 nt, Human
acggagcuguuucuggagaac

SEQ ID NO: 1032667 - RNA, 19 nt, Human
acuuuuguguguacugccc

SEQ ID NO: 1032668 - RNA, 22 nt, Human
agaaaucagaagcaaaagguac

SEQ ID NO: 1032669 - RNA, 21 nt, Human
agacagcaaaguuggaccauu

SEQ ID NO: 1032670 - RNA, 21 nt, Human
agacuggagauuuuuaagggc

SEQ ID NO: 1032671 - RNA, 21 nt, Human
agggcgcgggcuggggggccc

SEQ ID NO: 1032672 - RNA, 18 nt, Human
aggggcaaggaggcccug

SEQ ID NO: 1032673 - RNA, 23 nt, Human
agguaguguggucagcagggcag

SEQ ID NO: 1032674 - RNA, 18 nt, Human
augggguuuccuucaagu

SEQ ID NO: 1032675 - RNA, 22 nt, Human
caaaagguacaauuuagaagca

SEQ ID NO: 1032676 - RNA, 24 nt, Human
caacccagugugggccucgggaac

SEQ ID NO: 1032677 - RNA, 23 nt, Human
cacacgguaggggcaaggaggcc

SEQ ID NO: 1032678 - RNA, 22 nt, Human
cacaggaacugaacaccagcgg

SEQ ID NO: 1032679 - RNA, 22 nt, Human
caccacggagcuguuucuggag

SEQ ID NO: 1032680 - RNA, 20 nt, Human
cacccaccgguuuccaaguc

SEQ ID NO: 1032681 - RNA, 20 nt, Human
cagagcuuccauagaaaugg

SEQ ID NO: 1032682 - RNA, 19 nt, Human
caggaaacagcaggggaga

SEQ ID NO: 1032683 - RNA, 22 nt, Human
caggagcuccugcuucagggcu

SEQ ID NO: 1032684 - RNA, 23 nt, Human
caggucacaaagagaugggcuga

SEQ ID NO: 1032685 - RNA, 21 nt, Human
cagugugggccucgggaaccu

SEQ ID NO: 1032686 - RNA, 22 nt, Human
cauucgaaguccucccaggucc

SEQ ID NO: 1032687 - RNA, 24 nt, Human
ccaggaaaaaggauucuggguuuc

SEQ ID NO: 1032688 - RNA, 24 nt, Human
cccacaccagggcgcgggcugggg

SEQ ID NO: 1032689 - RNA, 23 nt, Human
cccaugaugaagauaaugcuaag

SEQ ID NO: 1032690 - RNA, 20 nt, Human
ccccagcagucccccacacc

SEQ ID NO: 1032691 - RNA, 24 nt, Human
cccguaauccuucuccagacaguu

SEQ ID NO: 1032692 - RNA, 18 nt, Human
cccugagguggacacagg

SEQ ID NO: 1032693 - RNA, 18 nt, Human
ccguaauccuucuccaga

SEQ ID NO: 1032694 - RNA, 25 nt, Human
cgcaaaugcucugugaauguugacu

SEQ ID NO: 1032695 - RNA, 21 nt, Human
cuagcuuguucuuagcuuccc

SEQ ID NO: 1032696 - RNA, 20 nt, Human
cugcugagacacccugaggu

SEQ ID NO: 1032697 - RNA, 19 nt, Human
cugugcauuuuggggcugg

SEQ ID NO: 1032698 - RNA, 21 nt, Human
cuucccaaacagacauauuua

SEQ ID NO: 1032699 - RNA, 18 nt, Human
gacaaggauguauuuggc

SEQ ID NO: 1032700 - RNA, 21 nt, Human
gacaguggggugucuggagaa

SEQ ID NO: 1032701 - RNA, 23 nt, Human
gagagagacuugucuacguaaua

SEQ ID NO: 1032702 - RNA, 18 nt, Human
gccucgggaaccuucagc

SEQ ID NO: 1032703 - RNA, 19 nt, Human
gcgcgggcuggggggccca

SEQ ID NO: 1032704 - RNA, 20 nt, Human
gcggggcaggaggaguauug

SEQ ID NO: 1032705 - RNA, 25 nt, Human
gcggggcaggaggaguauuguagaa

SEQ ID NO: 1032706 - RNA, 18 nt, Human
ggacaagcgccggucccc

SEQ ID NO: 1032707 - RNA, 18 nt, Human
ggagaaaaacuggucucu

SEQ ID NO: 1032708 - RNA, 21 nt, Human
ggcaaagaaacccaggaaaaa

SEQ ID NO: 1032709 - RNA, 22 nt, Human
ggcauuugcauaacuggcaggu

SEQ ID NO: 1032710 - RNA, 26 nt, Human
ggccgugauggugauggaugcaaacc

SEQ ID NO: 1032711 - RNA, 19 nt, Human
ggcggggugacugagggcc

SEQ ID NO: 1032712 - RNA, 19 nt, Human
gggcggggcaggaggagua

SEQ ID NO: 1032713 - RNA, 19 nt, Human
gggcucagguguggugggg

SEQ ID NO: 1032714 - RNA, 25 nt, Human
guaaaagauuccccagggauguaaa

SEQ ID NO: 1032715 - RNA, 21 nt, Human
gucagagcuuccauagaaaug

SEQ ID NO: 1032716 - RNA, 18 nt, Human
guccuuuuccccuuuucu

SEQ ID NO: 1032717 - RNA, 18 nt, Human
gugcuggcgagggugcug

SEQ ID NO: 1032718 - RNA, 24 nt, Human
guggggugucuggagaaaaacugg

SEQ ID NO: 1032719 - RNA, 23 nt, Human
guguacugcccuguaacuccagc

SEQ ID NO: 1032720 - RNA, 19 nt, Human
uaaaaggagauggauuugg

SEQ ID NO: 1032721 - RNA, 23 nt, Human
uaaugacaaggauguauuuggcg

SEQ ID NO: 1032722 - RNA, 18 nt, Human
uacauggaggugguuucc

SEQ ID NO: 1032723 - RNA, 19 nt, Human
uagaaaacacugaaguuac

SEQ ID NO: 1032724 - RNA, 19 nt, Human
uagauugaaucuggacacu

SEQ ID NO: 1032725 - RNA, 23 nt, Human
uagcucccacauuugccaauucu

SEQ ID NO: 1032726 - RNA, 21 nt, Human
uauuggcucucuguucacuag

SEQ ID NO: 1032727 - RNA, 26 nt, Human
ucaaauauacuauaugaugacccaca

SEQ ID NO: 1032728 - RNA, 23 nt, Human
ucagcccugcacuuggggcacag

SEQ ID NO: 1032729 - RNA, 18 nt, Human
ucagccgcaccacggagc

SEQ ID NO: 1032730 - RNA, 20 nt, Human
ucaucugggagaugacuaug

SEQ ID NO: 1032731 - RNA, 25 nt, Human
uccaggucacaaagagaugggcuga

SEQ ID NO: 1032732 - RNA, 21 nt, Human
ucgcuuauuggcucucuguuc

SEQ ID NO: 1032733 - RNA, 23 nt, Human
ucuccucuuugggcggcagcuuu

SEQ ID NO: 1032734 - RNA, 24 nt, Human
ucucuagacagacagucaucgcuu

SEQ ID NO: 1032735 - RNA, 23 nt, Human
ucucugaugccgaccuggauggg

SEQ ID NO: 1032736 - RNA, 21 nt, Human
ucucugaugggcaggaaacag

SEQ ID NO: 1032737 - RNA, 21 nt, Human
ucuggagaaaaacuggucucu

SEQ ID NO: 1032738 - RNA, 20 nt, Human
ucuguuuggcuugggucagu

SEQ ID NO: 1032739 - RNA, 19 nt, Human
ugaauggacaguugguugg

SEQ ID NO: 1032740 - RNA, 21 nt, Human
ugaauggacaguugguuggca

SEQ ID NO: 1032741 - RNA, 25 nt, Human
ugacccaguacuugcgucucucaca

SEQ ID NO: 1032742 - RNA, 20 nt, Human
ugacuuauucucaucaauca

SEQ ID NO: 1032743 - RNA, 21 nt, Human
ugagcaauggcacacgguagg

SEQ ID NO: 1032744 - RNA, 21 nt, Human
ugcauaacuggcaggugcuga

SEQ ID NO: 1032745 - RNA, 21 nt, Human
ugccaauucuguguuuuccaa

SEQ ID NO: 1032746 - RNA, 20 nt, Human
ugcugagacacccugaggug

SEQ ID NO: 1032747 - RNA, 24 nt, Human
ugcugagacucagaacagucuucg

SEQ ID NO: 1032748 - RNA, 18 nt, Human
uggaaaagaaccacucca

SEQ ID NO: 1032749 - RNA, 19 nt, Human
uggaagaacagacagcaaa

SEQ ID NO: 1032750 - RNA, 20 nt, Human
uggaagaacagacagcaaag

SEQ ID NO: 1032751 - RNA, 25 nt, Human
uggaagaacagacagcagcgucgac

SEQ ID NO: 1032752 - RNA, 20 nt, Human
ugggcgccauuggccagagc

SEQ ID NO: 1032753 - RNA, 27 nt, Human
uggggacggagagagacuuccccgagg

SEQ ID NO: 1032754 - RNA, 18 nt, Human
uggggcuggcaauuugag

SEQ ID NO: 1032755 - RNA, 21 nt, Human
uggucagcagggcagccugug

SEQ ID NO: 1032756 - RNA, 24 nt, Human
uguaaacaaacuugcuuguaucag

SEQ ID NO: 1032757 - RNA, 19 nt, Human
uguaaggggcaaagaaacc

SEQ ID NO: 1032758 - RNA, 18 nt, Human
ugugggcucagaaagguc

SEQ ID NO: 1032759 - RNA, 20 nt, Human
uuacaaccaagucacagcau

SEQ ID NO: 1032760 - RNA, 21 nt, Human
uuacgaacuuccagugcuucu

SEQ ID NO: 1032761 - RNA, 24 nt, Human
uucaaauauacuauaugaugaccc

SEQ ID NO: 1032762 - RNA, 21 nt, Human
uucacuaggccaucuacucca

SEQ ID NO: 1032763 - RNA, 22 nt, Human
uuccagcgcuggccuacgaggu

SEQ ID NO: 1032764 - RNA, 24 nt, Human
uugugagcgagaaaugaacugagg

SEQ ID NO: 1032765 - RNA, 23 nt, Human
uuuccugacaguggggugucugg

SEQ ID NO: 1032766 - RNA, 19 nt, Human
uuugagguggcucaauggg

SEQ ID NO: 1032767 - RNA, 18 nt, Human
uuuggaagaacagacagc

SEQ ID NO: 1032768 - RNA, 20 nt, Human
uuugugaugccagggucucc

SEQ ID NO: 1032769 - RNA, 24 nt, Human
aaggaucuaguucuccccugggug

SEQ ID NO: 1032770 - RNA, 20 nt, Human
acaaguucuucaggaauaaa

SEQ ID NO: 1032771 - RNA, 20 nt, Human
acuccaaggacacugggaag

SEQ ID NO: 1032772 - RNA, 19 nt, Human
agcagcaucccagcauggc

SEQ ID NO: 1032773 - RNA, 24 nt, Human
aggaggauggugagaugcuguggu

SEQ ID NO: 1032774 - RNA, 27 nt, Human
aggaggauggugagaugcugugguucg

SEQ ID NO: 1032775 - RNA, 20 nt, Human
aggggcuggagggcagccuc

SEQ ID NO: 1032776 - RNA, 18 nt, Human
auggcugcggaguaaaca

SEQ ID NO: 1032777 - RNA, 24 nt, Human
caacacuccaaggacacugggaag

SEQ ID NO: 1032778 - RNA, 20 nt, Human
caaccaccccaccugucugc

SEQ ID NO: 1032779 - RNA, 21 nt, Human
cacuggcaggugggauaacag

SEQ ID NO: 1032780 - RNA, 19 nt, Human
ccaccugucugcuuaauuu

SEQ ID NO: 1032781 - RNA, 22 nt, Human
ccaccugucugcuuaauuugaa

SEQ ID NO: 1032782 - RNA, 22 nt, Human
ccagcagcaucccagcauggcu

SEQ ID NO: 1032783 - RNA, 24 nt, Human
ccccugggugcuggcugucuccuc

SEQ ID NO: 1032784 - RNA, 24 nt, Human
ccugcuuugggaagaaccaacacu

SEQ ID NO: 1032785 - RNA, 21 nt, Human
ccugucugcuuaauuugaaag

SEQ ID NO: 1032786 - RNA, 22 nt, Human
cuccaaggacacugggaagaca

SEQ ID NO: 1032787 - RNA, 21 nt, Human
cuccaaugugucagggcagcu

SEQ ID NO: 1032788 - RNA, 22 nt, Human
gaaggggcuggagggcagccuc

SEQ ID NO: 1032789 - RNA, 19 nt, Human
ggaagaaccaacacuccaa

SEQ ID NO: 1032790 - RNA, 22 nt, Human
ggaagacacacgaguugccccu

SEQ ID NO: 1032791 - RNA, 23 nt, Human
gucagggcagcugugcuccccgc

SEQ ID NO: 1032792 - RNA, 24 nt, Human
gugggauaacaggaggauggugag

SEQ ID NO: 1032793 - RNA, 21 nt, Human
uagcauucuugucuuucucca

SEQ ID NO: 1032794 - RNA, 20 nt, Human
uauccugcuuugggaagaac

SEQ ID NO: 1032795 - RNA, 23 nt, Human
ucauucuguaugacaaccacccc

SEQ ID NO: 1032796 - RNA, 21 nt, Human
ucuggcacuggcaggugggau

SEQ ID NO: 1032797 - RNA, 23 nt, Human
ucuguaugacaaccaccccaccu

SEQ ID NO: 1032798 - RNA, 23 nt, Human
ucuuucuccaggcugcauccugc

SEQ ID NO: 1032799 - RNA, 22 nt, Human
ugcuccccgccagcagcauccc

SEQ ID NO: 1032800 - RNA, 19 nt, Human
ugcuggcugucuccuccac

SEQ ID NO: 1032801 - RNA, 20 nt, Human
uggagggcagccucugucca

SEQ ID NO: 1032802 - RNA, 19 nt, Human
ugggaagaaccaacacucc

SEQ ID NO: 1032803 - RNA, 25 nt, Human
aagaaagaaauauugcucaugaaga

SEQ ID NO: 1032804 - RNA, 21 nt, Human
aagauuuuugugcccagcuuu

SEQ ID NO: 1032805 - RNA, 18 nt, Human
cacucuagaacuugacuu

SEQ ID NO: 1032806 - RNA, 23 nt, Human
uauucagaaguacagaaaauaac

SEQ ID NO: 1032807 - RNA, 25 nt, Human
ugaauaauaaaacauucuauuaaga

SEQ ID NO: 1032808 - RNA, 19 nt, Human
uugcacauuuauucagaag

SEQ ID NO: 1032809 - RNA, 24 nt, Human
aggucuuucugcuuaggaaaaucc

SEQ ID NO: 1032810 - RNA, 21 nt, Human
caccggugcccugcuugcucc

SEQ ID NO: 1032811 - RNA, 23 nt, Human
caucuggaagcccauaugcguuc

SEQ ID NO: 1032812 - RNA, 19 nt, Human
ccaccggugcccugcuugc

SEQ ID NO: 1032813 - RNA, 20 nt, Human
ccagggaccagaggcuggag

SEQ ID NO: 1032814 - RNA, 23 nt, Human
cccagaggcaccugcuccaccgg

SEQ ID NO: 1032815 - RNA, 19 nt, Human
ccccagaggcaccugcucc

SEQ ID NO: 1032816 - RNA, 24 nt, Human
ccggugcccugcuugcucccaggg

SEQ ID NO: 1032817 - RNA, 21 nt, Human
cgucugcccugcgcgcacgcg

SEQ ID NO: 1032818 - RNA, 18 nt, Human
gagacauuugauuggcag

SEQ ID NO: 1032819 - RNA, 28 nt, Human
gaggcaccugcuccaccggucgaccuac

SEQ ID NO: 1032820 - RNA, 18 nt, Human
gcaaauaugacuuucuga

SEQ ID NO: 1032821 - RNA, 20 nt, Human
uaggaaaaucccaaaagaga

SEQ ID NO: 1032822 - RNA, 19 nt, Human
uaggaugaggucuuucugc

SEQ ID NO: 1032823 - RNA, 24 nt, Human
ucaaauagaaucacccucccugcc

SEQ ID NO: 1032824 - RNA, 23 nt, Human
uccaucauuuuucuuuugaaaca

SEQ ID NO: 1032825 - RNA, 22 nt, Human
ucgucuccgcucuaccgucugc

SEQ ID NO: 1032826 - RNA, 21 nt, Human
ugaaagcauuuucuuuuugau

SEQ ID NO: 1032827 - RNA, 23 nt, Human
ugagccuuucccuccagcaaucu

SEQ ID NO: 1032828 - RNA, 18 nt, Human
ugagcgucaucuggaagc

SEQ ID NO: 1032829 - RNA, 23 nt, Human
ugcuccaccggugcccugcuugc

SEQ ID NO: 1032830 - RNA, 20 nt, Human
uggaggaacuggccuagcug

SEQ ID NO: 1032831 - RNA, 21 nt, Human
uucucauacaaaaugagacau

SEQ ID NO: 1032832 - RNA, 19 nt, Human
uuuguuaggaugaggucuu

SEQ ID NO: 1032833 - RNA, 23 nt, Human
uuuguuaggaugaggucuuucug

SEQ ID NO: 1032834 - RNA, 25 nt, Human
accaaggagacugcagucaaauaaa

SEQ ID NO: 1032835 - RNA, 18 nt, Human
augucuuauggucagaaa

SEQ ID NO: 1032836 - RNA, 18 nt, Human
caccaccugugccucugc

SEQ ID NO: 1032837 - RNA, 18 nt, Human
caccaccugugccucugc

SEQ ID NO: 1032838 - RNA, 26 nt, Human
cgccucuacugucugccaccaccugu

SEQ ID NO: 1032839 - RNA, 23 nt, Human
cuaacacauccaccuuggcaaaa

SEQ ID NO: 1032840 - RNA, 19 nt, Human
cuacugucugccaccaccu

SEQ ID NO: 1032841 - RNA, 24 nt, Human
cuagcugaauuugugauuuccuuu

SEQ ID NO: 1032842 - RNA, 24 nt, Human
cucacagcuuuggccacacacucc

SEQ ID NO: 1032843 - RNA, 20 nt, Human
gacuugggcaauguggccag

SEQ ID NO: 1032844 - RNA, 21 nt, Human
gggcaauguggccaggagggc

SEQ ID NO: 1032845 - RNA, 20 nt, Human
ggucagaaaaaucaacauuu

SEQ ID NO: 1032846 - RNA, 27 nt, Human
uaaauacauaauacagaagccugugug

SEQ ID NO: 1032847 - RNA, 19 nt, Human
uaugucuuauggucagaaa

SEQ ID NO: 1032848 - RNA, 19 nt, Human
uauuuuucccauuuuguuu

SEQ ID NO: 1032849 - RNA, 18 nt, Human
uccuaggccgaggcuaug

SEQ ID NO: 1032850 - RNA, 22 nt, Human
ugaaaaguacugaaaaugcuau

SEQ ID NO: 1032851 - RNA, 22 nt, Human
ugaaaaugcuauuacuagcuga

SEQ ID NO: 1032852 - RNA, 22 nt, Human
ugaguuauccuuauuuuuccca

SEQ ID NO: 1032853 - RNA, 24 nt, Human
ugaguuauccuuauuuuucccauu

SEQ ID NO: 1032854 - RNA, 19 nt, Human
ugccaccaccugugccucu

SEQ ID NO: 1032855 - RNA, 18 nt, Human
uguccuaggccgaggcua

SEQ ID NO: 1032856 - RNA, 21 nt, Human
uguguauuuacuuaguuuaug

SEQ ID NO: 1032857 - RNA, 24 nt, Human
uuauggucagaaaaaucaacauuu

SEQ ID NO: 1032858 - RNA, 18 nt, Human
aaacagauacuacacgca

SEQ ID NO: 1032859 - RNA, 25 nt, Human
accaaggagacugcagucaaauaaa

SEQ ID NO: 1032860 - RNA, 24 nt, Human
acuaacacauccaccuuggcaaaa

SEQ ID NO: 1032861 - RNA, 21 nt, Human
agcaggcuguacagcagcagc

SEQ ID NO: 1032862 - RNA, 20 nt, Human
agguaugcucaaagaucuau

SEQ ID NO: 1032863 - RNA, 22 nt, Human
aguugcuucuucuuauuucuac

SEQ ID NO: 1032864 - RNA, 18 nt, Human
augucuuauggucagaaa

SEQ ID NO: 1032865 - RNA, 18 nt, Human
caccaccugugccucugc

SEQ ID NO: 1032866 - RNA, 18 nt, Human
caccaccugugccucugc

SEQ ID NO: 1032867 - RNA, 18 nt, Human
cacgacaggucaguaugu

SEQ ID NO: 1032868 - RNA, 19 nt, Human
ccuggcuggaggccugccg

SEQ ID NO: 1032869 - RNA, 22 nt, Human
cgaaaaguacugaaaaugcuau

SEQ ID NO: 1032870 - RNA, 26 nt, Human
cgccucuacugucugccaccaccugu

SEQ ID NO: 1032871 - RNA, 19 nt, Human
cuacugucugccaccaccu

SEQ ID NO: 1032872 - RNA, 24 nt, Human
cuagcugaauuugugauuuccuuu

SEQ ID NO: 1032873 - RNA, 24 nt, Human
cucacagcuuuggccacgcacucc

SEQ ID NO: 1032874 - RNA, 22 nt, Human
cuccugccauccuguccucagc

SEQ ID NO: 1032875 - RNA, 20 nt, Human
gacuugggcaauguggccag

SEQ ID NO: 1032876 - RNA, 21 nt, Human
gcagucaaauaaaacagauac

SEQ ID NO: 1032877 - RNA, 21 nt, Human
gggcaauguggccaggagggc

SEQ ID NO: 1032878 - RNA, 20 nt, Human
ggucagaaaaaucaacauuu

SEQ ID NO: 1032879 - RNA, 22 nt, Human
gugcacacgacaggucaguaug

SEQ ID NO: 1032880 - RNA, 27 nt, Human
uaaauacauaauacagaagccugugug

SEQ ID NO: 1032881 - RNA, 19 nt, Human
uaugucuuauggucagaaa

SEQ ID NO: 1032882 - RNA, 19 nt, Human
uauuuuucccauuuuguuu

SEQ ID NO: 1032883 - RNA, 20 nt, Human
ucccggucacgaaccuggug

SEQ ID NO: 1032884 - RNA, 18 nt, Human
uccuaggccgaggcuaug

SEQ ID NO: 1032885 - RNA, 21 nt, Human
uccucagcuccugccuuccuc

SEQ ID NO: 1032886 - RNA, 21 nt, Human
ugaaaaugcuauuacuagcug

SEQ ID NO: 1032887 - RNA, 22 nt, Human
ugaguuauccuuauuuuuccca

SEQ ID NO: 1032888 - RNA, 24 nt, Human
ugaguuauccuuauuuuucccauu

SEQ ID NO: 1032889 - RNA, 19 nt, Human
ugccaccaccugugccucu

SEQ ID NO: 1032890 - RNA, 18 nt, Human
uguccuaggccgaggcua

SEQ ID NO: 1032891 - RNA, 23 nt, Human
ugugauaugaugagguaucucca

SEQ ID NO: 1032892 - RNA, 24 nt, Human
uuauggucagaaaaaucaacauuu

SEQ ID NO: 1032893 - RNA, 23 nt, Human
uugaugcacuccuggcuggaggc

SEQ ID NO: 1032894 - RNA, 19 nt, Human
caccacacuuccguccucc

SEQ ID NO: 1032895 - RNA, 22 nt, Human
caggagguuagacaccuccccu

SEQ ID NO: 1032896 - RNA, 21 nt, Human
ccccugaaacugcggcuucug

SEQ ID NO: 1032897 - RNA, 23 nt, Human
cccuccaggagguuagacaccuc

SEQ ID NO: 1032898 - RNA, 24 nt, Human
cuccaggagguuagacaccucccc

SEQ ID NO: 1032899 - RNA, 19 nt, Human
cuuggagcacagccucggc

SEQ ID NO: 1032900 - RNA, 19 nt, Human
gccucggccuccaugauuu

SEQ ID NO: 1032901 - RNA, 22 nt, Human
uccagaggaaacgcagccucgu

SEQ ID NO: 1032902 - RNA, 19 nt, Human
ucccugagaaacaggucug

SEQ ID NO: 1032903 - RNA, 19 nt, Human
ucugcuguguccucccucc

SEQ ID NO: 1032904 - RNA, 23 nt, Human
ugacaucauagauggcuucucca

SEQ ID NO: 1032905 - RNA, 19 nt, Human
ugagaaacaggucugcugu

SEQ ID NO: 1032906 - RNA, 19 nt, Human
uuccccaaugacaucauag

SEQ ID NO: 1032907 - RNA, 19 nt, Human
uuuccccaaugacaucaua

SEQ ID NO: 1032908 - RNA, 25 nt, Human
aaacaaaccaaucucuguucccaag

SEQ ID NO: 1032909 - RNA, 25 nt, Human
aaagagcccagauucgaauccaggc

SEQ ID NO: 1032910 - RNA, 19 nt, Human
aaagaugguugcagauggu

SEQ ID NO: 1032911 - RNA, 20 nt, Human
aacaagacgacaaacagaaa

SEQ ID NO: 1032912 - RNA, 22 nt, Human
aaccauagcaggagcagcacca

SEQ ID NO: 1032913 - RNA, 18 nt, Human
aaccugagccaacccaca

SEQ ID NO: 1032914 - RNA, 21 nt, Human
aagaggugcuggugcagcaca

SEQ ID NO: 1032915 - RNA, 21 nt, Human
aagaggugcuggugcagcaca

SEQ ID NO: 1032916 - RNA, 21 nt, Human
aagugugaagggcagccacag

SEQ ID NO: 1032917 - RNA, 21 nt, Human
acagcagcgaggugguauagc

SEQ ID NO: 1032918 - RNA, 18 nt, Human
acagccuccucccggcca

SEQ ID NO: 1032919 - RNA, 23 nt, Human
acagggcccugggcucucuggag

SEQ ID NO: 1032920 - RNA, 24 nt, Human
acaguguggaggcagcaaaucaac

SEQ ID NO: 1032921 - RNA, 23 nt, Human
acgcaggcccagggagccccccu

SEQ ID NO: 1032922 - RNA, 24 nt, Human
agaaaauguugaaugaagcccagg

SEQ ID NO: 1032923 - RNA, 19 nt, Human
agacaguggaacagcagcg

SEQ ID NO: 1032924 - RNA, 18 nt, Human
agaggagagcaauagaag

SEQ ID NO: 1032925 - RNA, 18 nt, Human
agcagcuggcagguccug

SEQ ID NO: 1032926 - RNA, 18 nt, Human
aggcagcaaaucaacaag

SEQ ID NO: 1032927 - RNA, 19 nt, Human
aggcaucaucugaguuaca

SEQ ID NO: 1032928 - RNA, 19 nt, Human
aggcuugagaaacggcacc

SEQ ID NO: 1032929 - RNA, 22 nt, Human
agggagccccccucugccaaag

SEQ ID NO: 1032930 - RNA, 23 nt, Human
agguagcagguauagcuucaggg

SEQ ID NO: 1032931 - RNA, 26 nt, Human
aucaucuccauuucacagaugagaaa

SEQ ID NO: 1032932 - RNA, 23 nt, Human
augaagcagcuggcagguccugc

SEQ ID NO: 1032933 - RNA, 25 nt, Human
augaugugugccaggaguugccccc

SEQ ID NO: 1032934 - RNA, 21 nt, Human
augcacaguaaacaaaccaau

SEQ ID NO: 1032935 - RNA, 22 nt, Human
caaagcccaugaugugugccag

SEQ ID NO: 1032936 - RNA, 18 nt, Human
cacaguguuaucaucucc

SEQ ID NO: 1032937 - RNA, 20 nt, Human
caccaacaauaugccaugcc

SEQ ID NO: 1032938 - RNA, 21 nt, Human
caccaacaauaugccaugccc

SEQ ID NO: 1032939 - RNA, 24 nt, Human
caccagggaugcacaguaaacaaa

SEQ ID NO: 1032940 - RNA, 19 nt, Human
cagaaacacuggaaguguu

SEQ ID NO: 1032941 - RNA, 19 nt, Human
cagccuccucccggccaag

SEQ ID NO: 1032942 - RNA, 19 nt, Human
cagcucuugccuuccaggg

SEQ ID NO: 1032943 - RNA, 20 nt, Human
cagcucuugccuuccagggc

SEQ ID NO: 1032944 - RNA, 22 nt, Human
cagggcccugggcucucuggag

SEQ ID NO: 1032945 - RNA, 23 nt, Human
caucuccauuucacagaugagaa

SEQ ID NO: 1032946 - RNA, 21 nt, Human
ccaaaggcuggcugcugcacc

SEQ ID NO: 1032947 - RNA, 23 nt, Human
ccaaaggcuggcugcugcaccca

SEQ ID NO: 1032948 - RNA, 19 nt, Human
ccacacaccuuucauguga

SEQ ID NO: 1032949 - RNA, 25 nt, Human
ccacacaccuuucaugugaccugaa

SEQ ID NO: 1032950 - RNA, 20 nt, Human
ccacagacucacgacuuagg

SEQ ID NO: 1032951 - RNA, 23 nt, Human
ccaccugugggccucauaagggc

SEQ ID NO: 1032952 - RNA, 27 nt, Human
ccagagcuguggucagaacacggggag

SEQ ID NO: 1032953 - RNA, 22 nt, Human
cccaaggagcugacagugugga

SEQ ID NO: 1032954 - RNA, 18 nt, Human
cccagggagccccccucu

SEQ ID NO: 1032955 - RNA, 19 nt, Human
ccugaaugccaaccuaaga

SEQ ID NO: 1032956 - RNA, 24 nt, Human
cgagaagaagcccuguggaaccau

SEQ ID NO: 1032957 - RNA, 19 nt, Human
cgaggacaucagagcagcc

SEQ ID NO: 1032958 - RNA, 21 nt, Human
cucagcuuaaccugagccaac

SEQ ID NO: 1032959 - RNA, 20 nt, Human
cucauuguagaaauggaaag

SEQ ID NO: 1032960 - RNA, 18 nt, Human
cucugccaaaggcuggcu

SEQ ID NO: 1032961 - RNA, 21 nt, Human
cucuugccuuccagggcuauu

SEQ ID NO: 1032962 - RNA, 22 nt, Human
cuggugcagcacagccuccucc

SEQ ID NO: 1032963 - RNA, 21 nt, Human
cuguggucagaacacgggagc

SEQ ID NO: 1032964 - RNA, 24 nt, Human
cuugcaauuaacaugaggcaggga

SEQ ID NO: 1032965 - RNA, 24 nt, Human
gaaugccaaaagcagcagcucugc

SEQ ID NO: 1032966 - RNA, 21 nt, Human
gaaugccaaccuaagacacag

SEQ ID NO: 1032967 - RNA, 21 nt, Human
gagaaaauggggacucagccg

SEQ ID NO: 1032968 - RNA, 22 nt, Human
gagagcaauagaagaggugccg

SEQ ID NO: 1032969 - RNA, 19 nt, Human
gagaggcaggaauggaggg

SEQ ID NO: 1032970 - RNA, 18 nt, Human
gagccaacccacagacuc

SEQ ID NO: 1032971 - RNA, 18 nt, Human
gaggcaggaauggaggga

SEQ ID NO: 1032972 - RNA, 25 nt, Human
gcaaaggaccaugacagcccccuca

SEQ ID NO: 1032973 - RNA, 26 nt, Human
gcaaaucaacaagacgacaaacagaa

SEQ ID NO: 1032974 - RNA, 20 nt, Human
gcuugugugccuccaaagcc

SEQ ID NO: 1032975 - RNA, 19 nt, Human
ggaacgguggacagaggaa

SEQ ID NO: 1032976 - RNA, 23 nt, Human
ggagggagcgaggacaucagagc

SEQ ID NO: 1032977 - RNA, 23 nt, Human
ggaguugccccugcucucugugc

SEQ ID NO: 1032978 - RNA, 22 nt, Human
ggcccagcaaggagccaugaga

SEQ ID NO: 1032979 - RNA, 19 nt, Human
gggccucuacccuggauuu

SEQ ID NO: 1032980 - RNA, 22 nt, Human
ggggaaucugggagaccucucu

SEQ ID NO: 1032981 - RNA, 24 nt, Human
ggugaugcggcugagagaggcaga

SEQ ID NO: 1032982 - RNA, 18 nt, Human
gucugcaggcagaaugcu

SEQ ID NO: 1032983 - RNA, 19 nt, Human
gucugcaggcagaaugcug

SEQ ID NO: 1032984 - RNA, 18 nt, Human
gugagaggcaggaaugga

SEQ ID NO: 1032985 - RNA, 19 nt, Human
gugcagcacagccuccucc

SEQ ID NO: 1032986 - RNA, 18 nt, Human
uaagggcaagcucggccc

SEQ ID NO: 1032987 - RNA, 21 nt, Human
uagcaggagcagcaccaugaa

SEQ ID NO: 1032988 - RNA, 22 nt, Human
uagcuugucugccauggagauc

SEQ ID NO: 1032989 - RNA, 21 nt, Human
uauagcgggguccccucugcc

SEQ ID NO: 1032990 - RNA, 20 nt, Human
uaucugguugugugugugug

SEQ ID NO: 1032991 - RNA, 20 nt, Human
ucaaaacacaucaugcaggu

SEQ ID NO: 1032992 - RNA, 18 nt, Human
ucuguucccaaggagcug

SEQ ID NO: 1032993 - RNA, 23 nt, Human
ugaagagcuagauagaaaauguu

SEQ ID NO: 1032994 - RNA, 20 nt, Human
ugaccugcgagaagaagccc

SEQ ID NO: 1032995 - RNA, 21 nt, Human
ugaccugcgagaagaagcccu

SEQ ID NO: 1032996 - RNA, 23 nt, Human
ugacucagugcucagggucugca

SEQ ID NO: 1032997 - RNA, 18 nt, Human
ugagagaggcagaggcug

SEQ ID NO: 1032998 - RNA, 24 nt, Human
ugcaaagcccaucacuuuauuuca

SEQ ID NO: 1032999 - RNA, 18 nt, Human
ugcagauggugagacaug

SEQ ID NO: 1033000 - RNA, 18 nt, Human
ugccaaaggcuggcugcc

SEQ ID NO: 1033001 - RNA, 18 nt, Human
ugccaaaggcuggcugcu

SEQ ID NO: 1033002 - RNA, 19 nt, Human
ugccaaaggcuggcugcuc

SEQ ID NO: 1033003 - RNA, 20 nt, Human
ugccaugcccuguucugggc

SEQ ID NO: 1033004 - RNA, 24 nt, Human
ugccauggagaucuuguuaauaac

SEQ ID NO: 1033005 - RNA, 19 nt, Human
ugccccugcucucugugcc

SEQ ID NO: 1033006 - RNA, 19 nt, Human
ugccuggaacgguggacag

SEQ ID NO: 1033007 - RNA, 21 nt, Human
ugccuggaacgguggacagag

SEQ ID NO: 1033008 - RNA, 20 nt, Human
ugcucagggucugcaggcag

SEQ ID NO: 1033009 - RNA, 19 nt, Human
uggaaaggaaacagcucuu

SEQ ID NO: 1033010 - RNA, 19 nt, Human
uggaaaggaaacagcucuu

SEQ ID NO: 1033011 - RNA, 22 nt, Human
uggaagcuccccaugacacugg

SEQ ID NO: 1033012 - RNA, 20 nt, Human
uggcacacagggagagugaa

SEQ ID NO: 1033013 - RNA, 19 nt, Human
uggccacuuuccacacacc

SEQ ID NO: 1033014 - RNA, 20 nt, Human
uggcugagauccccaccugc

SEQ ID NO: 1033015 - RNA, 20 nt, Human
ugggguucuggagggcuugg

SEQ ID NO: 1033016 - RNA, 20 nt, Human
uggucagaacacgggagcag

SEQ ID NO: 1033017 - RNA, 20 nt, Human
uggugagaggcaggaaugga

SEQ ID NO: 1033018 - RNA, 22 nt, Human
ugguuguguguguguggacaau

SEQ ID NO: 1033019 - RNA, 19 nt, Human
ugugugccaggaguugccc

SEQ ID NO: 1033020 - RNA, 20 nt, Human
ugugugccaggaguugcccc

SEQ ID NO: 1033021 - RNA, 23 nt, Human
uguguggacaauggaugcgugca

SEQ ID NO: 1033022 - RNA, 23 nt, Human
uguugaaugaagcccaggcuuga

SEQ ID NO: 1033023 - RNA, 25 nt, Human
uuaugcaccaacaauaugccaugcc

SEQ ID NO: 1033024 - RNA, 19 nt, Human
uucacagaugagaaaaugg

SEQ ID NO: 1033025 - RNA, 22 nt, Human
uuccagugcuuaugcuauugcc

SEQ ID NO: 1033026 - RNA, 21 nt, Human
uugaaugaagcccaggcuuga

SEQ ID NO: 1033027 - RNA, 19 nt, Human
cagcauccgcuuuuucuug

SEQ ID NO: 1033028 - RNA, 18 nt, Human
cuuuccucuucuccucca

SEQ ID NO: 1033029 - RNA, 22 nt, Human
ugucacugccugguacuuccag

SEQ ID NO: 1033030 - RNA, 18 nt, Human
uuccucuucuccuccagg

SEQ ID NO: 1033031 - RNA, 22 nt, Human
uucuccuccaggguggcuguca

SEQ ID NO: 1033032 - RNA, 21 nt, Human
aaggcuuuagugcagcugcuc

SEQ ID NO: 1033033 - RNA, 21 nt, Human
agcugauucugccauccccac

SEQ ID NO: 1033034 - RNA, 21 nt, Human
agugcuuccccuggcugggaa

SEQ ID NO: 1033035 - RNA, 27 nt, Human
cugacagugaaugaagugaccuuuuuc

SEQ ID NO: 1033036 - RNA, 20 nt, Human
gaagugaccuuuuucuuaaa

SEQ ID NO: 1033037 - RNA, 24 nt, Human
gcggaccagggcugugauuagggc

SEQ ID NO: 1033038 - RNA, 23 nt, Human
gcuucugccacugcuucugaggg

SEQ ID NO: 1033039 - RNA, 21 nt, Human
ggacagcaaacagcaaccacu

SEQ ID NO: 1033040 - RNA, 20 nt, Human
uaaaaggacagcaaacagca

SEQ ID NO: 1033041 - RNA, 21 nt, Human
uaaaaggacagcaaacagcaa

SEQ ID NO: 1033042 - RNA, 24 nt, Human
ucuacugcuucugccacugcuucu

SEQ ID NO: 1033043 - RNA, 22 nt, Human
ucuuauggcucugcauguaggu

SEQ ID NO: 1033044 - RNA, 23 nt, Human
ugaaugaagugaccuuuuucuua

SEQ ID NO: 1033045 - RNA, 19 nt, Human
ugacagugaaugaagugac

SEQ ID NO: 1033046 - RNA, 18 nt, Human
ugcagcugcucuuauggc

SEQ ID NO: 1033047 - RNA, 24 nt, Human
uuaaaaggacagcaaacagcaacc

SEQ ID NO: 1033048 - RNA, 20 nt, Human
uucugccauccccacucccc

SEQ ID NO: 1033049 - RNA, 24 nt, Human
uuugagcaaaauugcccugacagu

SEQ ID NO: 1033050 - RNA, 18 nt, Human
agggagagggagcugagg

SEQ ID NO: 1033051 - RNA, 19 nt, Human
cacuggguuucgagggaga

SEQ ID NO: 1033052 - RNA, 21 nt, Human
cagcuucugaguggcaguggg

SEQ ID NO: 1033053 - RNA, 19 nt, Human
cagcuucuuugaagaugau

SEQ ID NO: 1033054 - RNA, 20 nt, Human
ccacuggguuucgagggaga

SEQ ID NO: 1033055 - RNA, 22 nt, Human
cugcuucuucacuucugggugg

SEQ ID NO: 1033056 - RNA, 19 nt, Human
cuggacuccugauuuccua

SEQ ID NO: 1033057 - RNA, 19 nt, Human
gaaauccuuucagcuucuu

SEQ ID NO: 1033058 - RNA, 24 nt, Human
gagggagagggagcugaggccgca

SEQ ID NO: 1033059 - RNA, 18 nt, Human
ggaguauucuggguuugc

SEQ ID NO: 1033060 - RNA, 22 nt, Human
ucuuucuccuugcuggggagua

SEQ ID NO: 1033061 - RNA, 20 nt, Human
ugauuagcuucuuucuccuu

SEQ ID NO: 1033062 - RNA, 22 nt, Human
uggaagaaugaucuggacuccu

SEQ ID NO: 1033063 - RNA, 19 nt, Human
uggcagugggggguuggua

SEQ ID NO: 1033064 - RNA, 25 nt, Human
uggcagugggggguugguaggaaag

SEQ ID NO: 1033065 - RNA, 23 nt, Human
uggguuucgagggagagggagcu

SEQ ID NO: 1033066 - RNA, 21 nt, Human
uucugaguggcaguggggggu

SEQ ID NO: 1033067 - RNA, 22 nt, Human
uugaagaugauuagcuucuuuc

SEQ ID NO: 1033068 - RNA, 21 nt, Human
uuguguaucugcuucuucacu

SEQ ID NO: 1033069 - RNA, 18 nt, Human
uuuucugacagcuucuga

SEQ ID NO: 1033070 - RNA, 22 nt, Human
aagacaucauuaacaggcugaa

SEQ ID NO: 1033071 - RNA, 23 nt, Human
aagacaucauuaacaggcugaag

SEQ ID NO: 1033072 - RNA, 19 nt, Human
aaguaggcagguuuuagga

SEQ ID NO: 1033073 - RNA, 21 nt, Human
aaguauuucgauuaagucuuc

SEQ ID NO: 1033074 - RNA, 20 nt, Human
aaucuucgaggcaagcccaa

SEQ ID NO: 1033075 - RNA, 21 nt, Human
acagcagcaccacgacacagc

SEQ ID NO: 1033076 - RNA, 20 nt, Human
acgccgcagagcagccugac

SEQ ID NO: 1033077 - RNA, 24 nt, Human
agccagaaucuucggaaauggcuu

SEQ ID NO: 1033078 - RNA, 19 nt, Human
auggaucuuaaggucaaca

SEQ ID NO: 1033079 - RNA, 21 nt, Human
caaucuggaaagaagucuagg

SEQ ID NO: 1033080 - RNA, 20 nt, Human
cagcagcaccacgacacagc

SEQ ID NO: 1033081 - RNA, 19 nt, Human
cagcauuaucagcaaugag

SEQ ID NO: 1033082 - RNA, 20 nt, Human
cagccagaaucuucggaaau

SEQ ID NO: 1033083 - RNA, 24 nt, Human
cagccagaaucuucggaaauggcu

SEQ ID NO: 1033084 - RNA, 22 nt, Human
cagcugccacguaggucucugg

SEQ ID NO: 1033085 - RNA, 21 nt, Human
cccgcacgccgcagagcagcc

SEQ ID NO: 1033086 - RNA, 24 nt, Human
ccugccaaugggcccaaucuggaa

SEQ ID NO: 1033087 - RNA, 18 nt, Human
cgucacaggugagcuccu

SEQ ID NO: 1033088 - RNA, 24 nt, Human
cuccgcggacagcagcaccacgac

SEQ ID NO: 1033089 - RNA, 22 nt, Human
cugaccacgcggugcggaggau

SEQ ID NO: 1033090 - RNA, 23 nt, Human
cuucgaggcaagcccaaaccagc

SEQ ID NO: 1033091 - RNA, 20 nt, Human
gaccacgcggugcggaggau

SEQ ID NO: 1033092 - RNA, 22 nt, Human
gagucacagccagaaucuucgg

SEQ ID NO: 1033093 - RNA, 22 nt, Human
gccaaugggcccaaucuggaaa

SEQ ID NO: 1033094 - RNA, 22 nt, Human
ggaacuccucgcugucccgcac

SEQ ID NO: 1033095 - RNA, 21 nt, Human
gggcagcaaggcgggcuugug

SEQ ID NO: 1033096 - RNA, 22 nt, Human
guaaaaucacuggugaaguaca

SEQ ID NO: 1033097 - RNA, 19 nt, Human
uaggucucuggcucaucgu

SEQ ID NO: 1033098 - RNA, 23 nt, Human
uaggucucuggcucaucgucaca

SEQ ID NO: 1033099 - RNA, 23 nt, Human
ucagugacugagucacagccaga

SEQ ID NO: 1033100 - RNA, 19 nt, Human
uccgcggacagcagcacca

SEQ ID NO: 1033101 - RNA, 21 nt, Human
ucuuaaaguccugaaguaggc

SEQ ID NO: 1033102 - RNA, 21 nt, Human
ucuucauccuuuuggcaaaca

SEQ ID NO: 1033103 - RNA, 20 nt, Human
ugaagacaucauuaacaggc

SEQ ID NO: 1033104 - RNA, 24 nt, Human
ugauauggcaaauuagagguaagu

SEQ ID NO: 1033105 - RNA, 22 nt, Human
ugcuucgaguaggaaacaaccu

SEQ ID NO: 1033106 - RNA, 24 nt, Human
uggaaagaagucuaggaacuccuc

SEQ ID NO: 1033107 - RNA, 19 nt, Human
uggaaagcucucugcagca

SEQ ID NO: 1033108 - RNA, 20 nt, Human
uucccaggugaagucaccgu

SEQ ID NO: 1033109 - RNA, 23 nt, Human
uucgaggcaagcccaaaccagca

SEQ ID NO: 1033110 - RNA, 18 nt, Human
uuggugauggugaaugaa

SEQ ID NO: 1033111 - RNA, 24 nt, Human
uuggugauggugaaugaagcccuu

SEQ ID NO: 1033112 - RNA, 23 nt, Human
uuucacagcugccacguaggucu

SEQ ID NO: 1033113 - RNA, 24 nt, Human
aaaccaaaccugcgcccgaagcaa

SEQ ID NO: 1033114 - RNA, 22 nt, Human
aaccagugagaagagguggcuc

SEQ ID NO: 1033115 - RNA, 20 nt, Human
accccaaagaaaaccaaacc

SEQ ID NO: 1033116 - RNA, 22 nt, Human
accuugcucuccgccaccucca

SEQ ID NO: 1033117 - RNA, 19 nt, Human
agacagaggauccagaucu

SEQ ID NO: 1033118 - RNA, 23 nt, Human
agauaaagacagaggauccagau

SEQ ID NO: 1033119 - RNA, 23 nt, Human
agcacauaaggguuagggaaaga

SEQ ID NO: 1033120 - RNA, 27 nt, Human
aggcuacacuggguaaccugaggucuu

SEQ ID NO: 1033121 - RNA, 22 nt, Human
caccaaugacugcugcaggguc

SEQ ID NO: 1033122 - RNA, 18 nt, Human
caccagcgauugccccac

SEQ ID NO: 1033123 - RNA, 24 nt, Human
caccuccaccagcgauugccccac

SEQ ID NO: 1033124 - RNA, 23 nt, Human
caccuugcucuccgccaccucca

SEQ ID NO: 1033125 - RNA, 19 nt, Human
cacuggguaaccugagguc

SEQ ID NO: 1033126 - RNA, 20 nt, Human
cagcauccucagcacuuuuc

SEQ ID NO: 1033127 - RNA, 22 nt, Human
cauaaggguuagggaaagacag

SEQ ID NO: 1033128 - RNA, 23 nt, Human
ccaaugacugcugcagggucugc

SEQ ID NO: 1033129 - RNA, 22 nt, Human
cccaaagaaaaccaaaccugcg

SEQ ID NO: 1033130 - RNA, 19 nt, Human
ccccaaagaaaaccaaacc

SEQ ID NO: 1033131 - RNA, 19 nt, Human
ccgccaccuccaccagcga

SEQ ID NO: 1033132 - RNA, 22 nt, Human
ccucugcaacgcagauaaagac

SEQ ID NO: 1033133 - RNA, 23 nt, Human
ccugcgcccgaagcaacagugac

SEQ ID NO: 1033134 - RNA, 23 nt, Human
cgaagcaacagugaccaucaacg

SEQ ID NO: 1033135 - RNA, 21 nt, Human
cgccauccugggcgaccgcac

SEQ ID NO: 1033136 - RNA, 22 nt, Human
cggggccgaguguuugcgaacc

SEQ ID NO: 1033137 - RNA, 22 nt, Human
cuccaccagcgauugccccacu

SEQ ID NO: 1033138 - RNA, 18 nt, Human
cucuccgccaccuccacc

SEQ ID NO: 1033139 - RNA, 18 nt, Human
cugacuaugugaaagagg

SEQ ID NO: 1033140 - RNA, 21 nt, Human
cugcagggucugcuggccagc

SEQ ID NO: 1033141 - RNA, 18 nt, Human
gaaucaacaacaggggca

SEQ ID NO: 1033142 - RNA, 22 nt, Human
gacugcugcagggucugcuggc

SEQ ID NO: 1033143 - RNA, 19 nt, Human
gccaccuugcucuccgcca

SEQ ID NO: 1033144 - RNA, 21 nt, Human
gccuggacgcaggguuccagc

SEQ ID NO: 1033145 - RNA, 25 nt, Human
ggcaaccccaaagaaaagggaacgc

SEQ ID NO: 1033146 - RNA, 22 nt, Human
gguaaccugaggucuuaggaac

SEQ ID NO: 1033147 - RNA, 20 nt, Human
gguccaguucuggaauggca

SEQ ID NO: 1033148 - RNA, 19 nt, Human
gugguccaguucuggaaug

SEQ ID NO: 1033149 - RNA, 18 nt, Human
uaccuaggcaaccgggag

SEQ ID NO: 1033150 - RNA, 22 nt, Human
ucccggcugccaccuugcucuc

SEQ ID NO: 1033151 - RNA, 21 nt, Human
uccucagcacuuuucuguggu

SEQ ID NO: 1033152 - RNA, 23 nt, Human
uccucugaugggcucccggcugc

SEQ ID NO: 1033153 - RNA, 18 nt, Human
ucucagcucugauucauu

SEQ ID NO: 1033154 - RNA, 18 nt, Human
ucugugguccaguucugg

SEQ ID NO: 1033155 - RNA, 18 nt, Human
ugaaagaggggugguccc

SEQ ID NO: 1033156 - RNA, 21 nt, Human
ugaaagagggguggucccacc

SEQ ID NO: 1033157 - RNA, 18 nt, Human
ugaaauggcaaccccaaa

SEQ ID NO: 1033158 - RNA, 21 nt, Human
ugaaauggcaaccccaaagaa

SEQ ID NO: 1033159 - RNA, 20 nt, Human
ugacgccgccauccugggcg

SEQ ID NO: 1033160 - RNA, 22 nt, Human
ugacuaugugaaagaggggugg

SEQ ID NO: 1033161 - RNA, 24 nt, Human
ugacugcugcagggucugcuggcc

SEQ ID NO: 1033162 - RNA, 19 nt, Human
ugagaagagguggcuccuc

SEQ ID NO: 1033163 - RNA, 22 nt, Human
ugcuggccagcauccucagcac

SEQ ID NO: 1033164 - RNA, 18 nt, Human
uggaauggcaggugacag

SEQ ID NO: 1033165 - RNA, 22 nt, Human
uggaauggcaggugacagggca

SEQ ID NO: 1033166 - RNA, 22 nt, Human
uggcaaccccaaagaaaaccaa

SEQ ID NO: 1033167 - RNA, 18 nt, Human
ugggcucccggcugccac

SEQ ID NO: 1033168 - RNA, 23 nt, Human
uguccuccagcacauaaggguua

SEQ ID NO: 1033169 - RNA, 18 nt, Human
uugcucuccgccaccucc

SEQ ID NO: 1033170 - RNA, 19 nt, Human
uugcucuccgccaccuccc

SEQ ID NO: 1033171 - RNA, 23 nt, Human
aaaaaucagugauuuccggacaa

SEQ ID NO: 1033172 - RNA, 25 nt, Human
aaaacacuucugcucucuuccacug

SEQ ID NO: 1033173 - RNA, 24 nt, Human
aaacagaaugcaaaauuauuucau

SEQ ID NO: 1033174 - RNA, 21 nt, Human
aaacccacaggccugacacaa

SEQ ID NO: 1033175 - RNA, 24 nt, Human
aaagucacacuuggaaaagcaauu

SEQ ID NO: 1033176 - RNA, 24 nt, Human
aacguuaucuuucuugaugagcac

SEQ ID NO: 1033177 - RNA, 18 nt, Human
aaguguuggaguuggacc

SEQ ID NO: 1033178 - RNA, 22 nt, Human
acaccagaaaugauccagcccu

SEQ ID NO: 1033179 - RNA, 22 nt, Human
accacagucauccaccagauca

SEQ ID NO: 1033180 - RNA, 24 nt, Human
acggcaaaugaaaguagucucauc

SEQ ID NO: 1033181 - RNA, 20 nt, Human
agaaacccgacucaaaguca

SEQ ID NO: 1033182 - RNA, 22 nt, Human
agaaauggcucccaaccgcaga

SEQ ID NO: 1033183 - RNA, 23 nt, Human
agacugcaggcugugguccaguu

SEQ ID NO: 1033184 - RNA, 22 nt, Human
agcaacuugccacaagcugcug

SEQ ID NO: 1033185 - RNA, 23 nt, Human
agcgccuacccauacauaauaac

SEQ ID NO: 1033186 - RNA, 19 nt, Human
agcugcagcucagcugcuc

SEQ ID NO: 1033187 - RNA, 21 nt, Human
agcuuccuguugugcuuguau

SEQ ID NO: 1033188 - RNA, 18 nt, Human
aggaaaguaugcauccag

SEQ ID NO: 1033189 - RNA, 20 nt, Human
aggauugggcugaguaaggc

SEQ ID NO: 1033190 - RNA, 21 nt, Human
aggcagcacugucuugaaaag

SEQ ID NO: 1033191 - RNA, 18 nt, Human
aguguuggaguuggaccc

SEQ ID NO: 1033192 - RNA, 21 nt, Human
auccauuguugcucuuccuuc

SEQ ID NO: 1033193 - RNA, 20 nt, Human
augacauucccuauagccaa

SEQ ID NO: 1033194 - RNA, 22 nt, Human
augcgcuuuccaaacauguggu

SEQ ID NO: 1033195 - RNA, 18 nt, Human
caaaauggucaccacuaa

SEQ ID NO: 1033196 - RNA, 23 nt, Human
caaaauugagauuaagagcauac

SEQ ID NO: 1033197 - RNA, 22 nt, Human
caaccuauaaaugcgcuuucca

SEQ ID NO: 1033198 - RNA, 22 nt, Human
caagugcaaugucuccacgcug

SEQ ID NO: 1033199 - RNA, 25 nt, Human
caauagcugagaccccaucauaaau

SEQ ID NO: 1033200 - RNA, 21 nt, Human
cacacaugaauucaugaucag

SEQ ID NO: 1033201 - RNA, 21 nt, Human
cacacuuggaaaagcaauuag

SEQ ID NO: 1033202 - RNA, 20 nt, Human
caccagaucacauaaccgaa

SEQ ID NO: 1033203 - RNA, 20 nt, Human
caccuugcuguccaguuuga

SEQ ID NO: 1033204 - RNA, 24 nt, Human
cacguuuggcucugaagacaaucu

SEQ ID NO: 1033205 - RNA, 19 nt, Human
cacucaguuggaaaaucga

SEQ ID NO: 1033206 - RNA, 21 nt, Human
cacugcuacaucuccuaugua

SEQ ID NO: 1033207 - RNA, 21 nt, Human
cagaucacauaaccgaagcuu

SEQ ID NO: 1033208 - RNA, 23 nt, Human
cagaucuucugguauuaacacau

SEQ ID NO: 1033209 - RNA, 18 nt, Human
cagcccuucacagcucuc

SEQ ID NO: 1033210 - RNA, 19 nt, Human
cagccugaacugaaagaua

SEQ ID NO: 1033211 - RNA, 20 nt, Human
cagcuccuccucccaggucc

SEQ ID NO: 1033212 - RNA, 18 nt, Human
cagguuccagucaaaguc

SEQ ID NO: 1033213 - RNA, 19 nt, Human
cagguuccagucaaagucc

SEQ ID NO: 1033214 - RNA, 21 nt, Human
caucaccuccuugauccugcc

SEQ ID NO: 1033215 - RNA, 26 nt, Human
caucugaauuaucagcacaaucauuc

SEQ ID NO: 1033216 - RNA, 21 nt, Human
ccaaauaucugccacagcagc

SEQ ID NO: 1033217 - RNA, 22 nt, Human
ccagucaaaguccucaucuuuc

SEQ ID NO: 1033218 - RNA, 24 nt, Human
ccauuguugcucuuccuuccucug

SEQ ID NO: 1033219 - RNA, 22 nt, Human
cccaguccaagucauccucaga

SEQ ID NO: 1033220 - RNA, 19 nt, Human
ccccaaugccauuuccaua

SEQ ID NO: 1033221 - RNA, 22 nt, Human
ccgcagaaacccgacucaaagu

SEQ ID NO: 1033222 - RNA, 22 nt, Human
ccuaauccaucuguugccuuga

SEQ ID NO: 1033223 - RNA, 20 nt, Human
ccuacccauacauaauaacc

SEQ ID NO: 1033224 - RNA, 23 nt, Human
ccuauagccaagugggcagaaac

SEQ ID NO: 1033225 - RNA, 23 nt, Human
ccucaucuuucuccugcuuccag

SEQ ID NO: 1033226 - RNA, 19 nt, Human
ccucugaaagggcugccug

SEQ ID NO: 1033227 - RNA, 22 nt, Human
ccugcauuaaggugagugcccc

SEQ ID NO: 1033228 - RNA, 24 nt, Human
ccuggagagaaccaacgguggccc

SEQ ID NO: 1033229 - RNA, 25 nt, Human
ccuggcuccugguccaaucaaaguc

SEQ ID NO: 1033230 - RNA, 19 nt, Human
ccuugauucccaaauaucu

SEQ ID NO: 1033231 - RNA, 21 nt, Human
cgcagaaacccgacucaaagu

SEQ ID NO: 1033232 - RNA, 18 nt, Human
cucaaaaucagcagaaag

SEQ ID NO: 1033233 - RNA, 23 nt, Human
cucaaaaucagcagaaaguucac

SEQ ID NO: 1033234 - RNA, 21 nt, Human
cuccugcuuccaggaacaaag

SEQ ID NO: 1033235 - RNA, 21 nt, Human
cugaagugugcuuugucaccc

SEQ ID NO: 1033236 - RNA, 21 nt, Human
cugacguccacucacacaugu

SEQ ID NO: 1033237 - RNA, 18 nt, Human
cugcugccaauggcccag

SEQ ID NO: 1033238 - RNA, 18 nt, Human
cugggcuaagcaaagggg

SEQ ID NO: 1033239 - RNA, 22 nt, Human
cuguccaguuugagcccacaau

SEQ ID NO: 1033240 - RNA, 21 nt, Human
cugugaguugauauguuguau

SEQ ID NO: 1033241 - RNA, 19 nt, Human
cuuaacuuuccuagcagga

SEQ ID NO: 1033242 - RNA, 18 nt, Human
cuucagaucuucugguau

SEQ ID NO: 1033243 - RNA, 19 nt, Human
cuucugguauuaacacauc

SEQ ID NO: 1033244 - RNA, 18 nt, Human
cuuucccaacucuaccuu

SEQ ID NO: 1033245 - RNA, 18 nt, Human
gaaaagcaauuaguuuca

SEQ ID NO: 1033246 - RNA, 20 nt, Human
gaaauaccagaagcucaugg

SEQ ID NO: 1033247 - RNA, 21 nt, Human
gaaaucacagcgcccacugga

SEQ ID NO: 1033248 - RNA, 20 nt, Human
gaaugccuaaaaacacuucu

SEQ ID NO: 1033249 - RNA, 19 nt, Human
gacacaguaaaauuccauc

SEQ ID NO: 1033250 - RNA, 22 nt, Human
gacagauucuuuggcgaugcac

SEQ ID NO: 1033251 - RNA, 18 nt, Human
gagcaccuggagagaacc

SEQ ID NO: 1033252 - RNA, 18 nt, Human
gagcuaccacacucauuu

SEQ ID NO: 1033253 - RNA, 23 nt, Human
gcagagcaaagcuuucuggauug

SEQ ID NO: 1033254 - RNA, 25 nt, Human
gccaaccccuaaaacccaaucaaag

SEQ ID NO: 1033255 - RNA, 18 nt, Human
gcgaaaggcgcccuagcu

SEQ ID NO: 1033256 - RNA, 21 nt, Human
gcucccaaccgcagaaacccg

SEQ ID NO: 1033257 - RNA, 26 nt, Human
gcucugugccugcugcagggaugcug

SEQ ID NO: 1033258 - RNA, 21 nt, Human
gcugaaugguugccuccaacc

SEQ ID NO: 1033259 - RNA, 20 nt, Human
gcugcagcucagcugcuccc

SEQ ID NO: 1033260 - RNA, 19 nt, Human
gcuuguauaaugugcacag

SEQ ID NO: 1033261 - RNA, 18 nt, Human
ggacuugaaauucuggca

SEQ ID NO: 1033262 - RNA, 19 nt, Human
ggaguuuugccagccacac

SEQ ID NO: 1033263 - RNA, 20 nt, Human
ggaugcugcuagcuuucagg

SEQ ID NO: 1033264 - RNA, 18 nt, Human
gggcugccugcuggaaau

SEQ ID NO: 1033265 - RNA, 23 nt, Human
gggucuucaucacucucaucggg

SEQ ID NO: 1033266 - RNA, 19 nt, Human
gguggaguugggaggucug

SEQ ID NO: 1033267 - RNA, 20 nt, Human
guauaauacucuccaaauca

SEQ ID NO: 1033268 - RNA, 18 nt, Human
guccuuucucugucuuga

SEQ ID NO: 1033269 - RNA, 19 nt, Human
gugaucugcugcuggcucu

SEQ ID NO: 1033270 - RNA, 20 nt, Human
guguggauucgaaugcaggg

SEQ ID NO: 1033271 - RNA, 20 nt, Human
uaaaaacacuucugcucucu

SEQ ID NO: 1033272 - RNA, 22 nt, Human
uaaaacccaaucaaaguuguca

SEQ ID NO: 1033273 - RNA, 21 nt, Human
uaaaaugcccuugagaugcgu

SEQ ID NO: 1033274 - RNA, 25 nt, Human
uaaaaugcccuugagaugcguugag

SEQ ID NO: 1033275 - RNA, 25 nt, Human
uacaaccugcauccucaccaggcac

SEQ ID NO: 1033276 - RNA, 22 nt, Human
uacagucuuacucucaggacac

SEQ ID NO: 1033277 - RNA, 24 nt, Human
uaccuucaaauuugaguuggaagu

SEQ ID NO: 1033278 - RNA, 21 nt, Human
uagugacaaauggaagggcug

SEQ ID NO: 1033279 - RNA, 22 nt, Human
uauagaaccagaaggaaaguau

SEQ ID NO: 1033280 - RNA, 19 nt, Human
uaugcaagcccuggugugg

SEQ ID NO: 1033281 - RNA, 22 nt, Human
ucaaaaucagcagaaaguucac

SEQ ID NO: 1033282 - RNA, 24 nt, Human
ucaaaauugagauuaagagcauac

SEQ ID NO: 1033283 - RNA, 24 nt, Human
ucaaagucacacuuggaaaagcaa

SEQ ID NO: 1033284 - RNA, 20 nt, Human
ucaaauucaaacccacaggc

SEQ ID NO: 1033285 - RNA, 22 nt, Human
ucaauaucaucaauugcagcuc

SEQ ID NO: 1033286 - RNA, 24 nt, Human
ucaauugcagcuccuccucccagg

SEQ ID NO: 1033287 - RNA, 23 nt, Human
ucauuggcaggcaagcagccuga

SEQ ID NO: 1033288 - RNA, 23 nt, Human
ucauuuccaaguguguggucuuu

SEQ ID NO: 1033289 - RNA, 22 nt, Human
uccaaccauuguuugcccugau

SEQ ID NO: 1033290 - RNA, 23 nt, Human
uccaaccauuguuugcccugauu

SEQ ID NO: 1033291 - RNA, 18 nt, Human
uccagucaaaauggucac

SEQ ID NO: 1033292 - RNA, 18 nt, Human
uccagugugaaucuucug

SEQ ID NO: 1033293 - RNA, 19 nt, Human
uccagugugaaucuucugu

SEQ ID NO: 1033294 - RNA, 18 nt, Human
uccauugcauaauagaau

SEQ ID NO: 1033295 - RNA, 20 nt, Human
ucccaaauaucugccacagc

SEQ ID NO: 1033296 - RNA, 18 nt, Human
ucccaacucuaccuucaa

SEQ ID NO: 1033297 - RNA, 23 nt, Human
ucuacagugagguuaaguagaac

SEQ ID NO: 1033298 - RNA, 19 nt, Human
ucuccacaguuaucuacga

SEQ ID NO: 1033299 - RNA, 21 nt, Human
ucuccugcuuccaggaacaaa

SEQ ID NO: 1033300 - RNA, 21 nt, Human
ucucugggcuaagcaaagggg

SEQ ID NO: 1033301 - RNA, 21 nt, Human
ucugguauuaacacaucugcu

SEQ ID NO: 1033302 - RNA, 18 nt, Human
ugaaaagccuguggcucu

SEQ ID NO: 1033303 - RNA, 21 nt, Human
ugaaauacaaccugcauccuc

SEQ ID NO: 1033304 - RNA, 22 nt, Human
ugagaccccaucauaaaugccc

SEQ ID NO: 1033305 - RNA, 18 nt, Human
ugagauuaagagcauaca

SEQ ID NO: 1033306 - RNA, 20 nt, Human
ugagauuaagagcauacaac

SEQ ID NO: 1033307 - RNA, 21 nt, Human
ugagcaccuggagagaaccaa

SEQ ID NO: 1033308 - RNA, 18 nt, Human
ugaggaaacaaacucuuu

SEQ ID NO: 1033309 - RNA, 24 nt, Human
ugaggaaacaaacucuuuauaaag

SEQ ID NO: 1033310 - RNA, 19 nt, Human
ugaguaagacugcaggcug

SEQ ID NO: 1033311 - RNA, 20 nt, Human
ugaucagagucuggaauuaa

SEQ ID NO: 1033312 - RNA, 21 nt, Human
ugaucccgagguggagccugg

SEQ ID NO: 1033313 - RNA, 19 nt, Human
ugccuaaaaacacuucugc

SEQ ID NO: 1033314 - RNA, 23 nt, Human
ugcugcagggaugcugcuagcuu

SEQ ID NO: 1033315 - RNA, 21 nt, Human
ugcugcuggcucugugccugc

SEQ ID NO: 1033316 - RNA, 24 nt, Human
ugcuuucacccauuggcugugagu

SEQ ID NO: 1033317 - RNA, 18 nt, Human
uggaaaagcaauuaguuu

SEQ ID NO: 1033318 - RNA, 24 nt, Human
uggauugggucuuaaaugucuuca

SEQ ID NO: 1033319 - RNA, 18 nt, Human
uggcauuaaggauugggc

SEQ ID NO: 1033320 - RNA, 18 nt, Human
uggcugaaaguugggcuc

SEQ ID NO: 1033321 - RNA, 24 nt, Human
ugugcaccuugcuguccaguuuga

SEQ ID NO: 1033322 - RNA, 18 nt, Human
uguggcucugaagauucu

SEQ ID NO: 1033323 - RNA, 20 nt, Human
ugugguaauagaagcggaag

SEQ ID NO: 1033324 - RNA, 22 nt, Human
uguguggucuuugggaggucuu

SEQ ID NO: 1033325 - RNA, 19 nt, Human
uguuaaguguuggaguugg

SEQ ID NO: 1033326 - RNA, 21 nt, Human
uuaccaggguucugcuuacuu

SEQ ID NO: 1033327 - RNA, 27 nt, Human
uucagaaugaacauaaaaugcccuuga

SEQ ID NO: 1033328 - RNA, 20 nt, Human
uucaugugcucccuuugggc

SEQ ID NO: 1033329 - RNA, 24 nt, Human
uuccagucaaaguccucaucuuuc

SEQ ID NO: 1033330 - RNA, 19 nt, Human
uucuuuggcgaugcacugg

SEQ ID NO: 1033331 - RNA, 22 nt, Human
uugcagcuccuccucccagguc

SEQ ID NO: 1033332 - RNA, 22 nt, Human
uuggaagaggcacugccaguuc

SEQ ID NO: 1033333 - RNA, 20 nt, Human
uuggaagucuucaucaccaa

SEQ ID NO: 1033334 - RNA, 19 nt, Human
uuugaguuggaagucuuca

SEQ ID NO: 1033335 - RNA, 21 nt, Human
uuugcagauacgaaauaccag

SEQ ID NO: 1033336 - RNA, 21 nt, Human
uuuugccagccacaccagccu

SEQ ID NO: 1033337 - RNA, 22 nt, Human
aagugccccagggucggggauc

SEQ ID NO: 1033338 - RNA, 23 nt, Human
aggacaguggcuuuacucugggu

SEQ ID NO: 1033339 - RNA, 18 nt, Human
ccccucaccuggaugagg

SEQ ID NO: 1033340 - RNA, 28 nt, Human
ccgacugccgagccccagaagguuuucc

SEQ ID NO: 1033341 - RNA, 19 nt, Human
ccuucccugcuguccagcu

SEQ ID NO: 1033342 - RNA, 23 nt, Human
cugggugggaccccuucccugcu

SEQ ID NO: 1033343 - RNA, 21 nt, Human
cuugugcaggguagcaccugg

SEQ ID NO: 1033344 - RNA, 18 nt, Human
gaauaggcgagcugugcu

SEQ ID NO: 1033345 - RNA, 20 nt, Human
gaccugagggaccuggaggc

SEQ ID NO: 1033346 - RNA, 25 nt, Human
gagcacccccucaccuggaugagga

SEQ ID NO: 1033347 - RNA, 23 nt, Human
ggaucaggcuugugcaggguagc

SEQ ID NO: 1033348 - RNA, 18 nt, Human
ggcgagcugugcuuggau

SEQ ID NO: 1033349 - RNA, 22 nt, Human
uagggccgagcacccccucacc

SEQ ID NO: 1033350 - RNA, 21 nt, Human
ugaggacaguggcuuuacucu

SEQ ID NO: 1033351 - RNA, 22 nt, Human
ugaggacaguggcuuuacucug

SEQ ID NO: 1033352 - RNA, 24 nt, Human
ugagggaccuggaggccuucuugu

SEQ ID NO: 1033353 - RNA, 20 nt, Human
aaccuggauuuuuauuucca

SEQ ID NO: 1033354 - RNA, 24 nt, Human
aagacaaaccacacaagcuguaag

SEQ ID NO: 1033355 - RNA, 22 nt, Human
caaaccacacaagcuguaacuu

SEQ ID NO: 1033356 - RNA, 18 nt, Human
caaagacaaaccacacaa

SEQ ID NO: 1033357 - RNA, 20 nt, Human
cugugugccaaguucgcccc

SEQ ID NO: 1033358 - RNA, 23 nt, Human
uaaaacuucaugaaguuucacau

SEQ ID NO: 1033359 - RNA, 26 nt, Human
uauauggaauuucaaauugcaugaag

SEQ ID NO: 1033360 - RNA, 21 nt, Human
ucaugaaguuucacauuaagg

SEQ ID NO: 1033361 - RNA, 20 nt, Human
uccaaagacaaaccacacaa

SEQ ID NO: 1033362 - RNA, 22 nt, Human
uccaaagacaaaccacacaagc

SEQ ID NO: 1033363 - RNA, 18 nt, Human
uuccaaagacaaaccaca

SEQ ID NO: 1033364 - RNA, 20 nt, Human
uuccaaagacaaaccacaca

SEQ ID NO: 1033365 - RNA, 24 nt, Human
uuuuuuuuuuuuuuuuuugucauu

SEQ ID NO: 1033366 - RNA, 27 nt, Human
uuuuuuuuuuuuuuuuuuuuuuugggg

SEQ ID NO: 1033367 - RNA, 18 nt, Human
aaaaaaacagagcaagaa

SEQ ID NO: 1033368 - RNA, 23 nt, Human
aaaaaaacagagcaagaagaaga

SEQ ID NO: 1033369 - RNA, 18 nt, Human
aaaaacagagcaagaaga

SEQ ID NO: 1033370 - RNA, 20 nt, Human
aaaggcuggggcuccgagga

SEQ ID NO: 1033371 - RNA, 21 nt, Human
aagaagaagaaagauuucugg

SEQ ID NO: 1033372 - RNA, 22 nt, Human
aagaagaagaaagauuucugga

SEQ ID NO: 1033373 - RNA, 23 nt, Human
aaucauucucccaaaacuaagcc

SEQ ID NO: 1033374 - RNA, 19 nt, Human
acacauccucuggggaaac

SEQ ID NO: 1033375 - RNA, 20 nt, Human
acagagcaagaagaagaaag

SEQ ID NO: 1033376 - RNA, 22 nt, Human
acggaacagagccgggacagaa

SEQ ID NO: 1033377 - RNA, 26 nt, Human
agaagaagaaagauuucuggauagaa

SEQ ID NO: 1033378 - RNA, 18 nt, Human
agaaggaacuccugggca

SEQ ID NO: 1033379 - RNA, 24 nt, Human
agaagucaagguccaaagcuugga

SEQ ID NO: 1033380 - RNA, 24 nt, Human
agcaagaagaagaaagauuucugg

SEQ ID NO: 1033381 - RNA, 22 nt, Human
agggaggagggcgucgaaccua

SEQ ID NO: 1033382 - RNA, 24 nt, Human
cacacccccaucccaaggucaccc

SEQ ID NO: 1033383 - RNA, 23 nt, Human
cacccccaucccaaggucaccuc

SEQ ID NO: 1033384 - RNA, 19 nt, Human
cagccucuuggugcccugg

SEQ ID NO: 1033385 - RNA, 19 nt, Human
caucccaaggucacccuuc

SEQ ID NO: 1033386 - RNA, 19 nt, Human
ccacacccccaucccaagg

SEQ ID NO: 1033387 - RNA, 22 nt, Human
ccaugcagguaaggcaaccuaa

SEQ ID NO: 1033388 - RNA, 22 nt, Human
ccccaucccaaggucacccuuc

SEQ ID NO: 1033389 - RNA, 18 nt, Human
cgggcgcagccacugcga

SEQ ID NO: 1033390 - RNA, 20 nt, Human
cuuaggacccuccuccgccc

SEQ ID NO: 1033391 - RNA, 23 nt, Human
cuuaggacccuccuccgccccac

SEQ ID NO: 1033392 - RNA, 27 nt, Human
gaagaaagauuucuggauagaaauuaa

SEQ ID NO: 1033393 - RNA, 22 nt, Human
gagcaagaagaagaaagauuuc

SEQ ID NO: 1033394 - RNA, 22 nt, Human
gcacacauccucuggggaaacc

SEQ ID NO: 1033395 - RNA, 19 nt, Human
gccuggagcuucauuguuc

SEQ ID NO: 1033396 - RNA, 18 nt, Human
gcgcagccacugcgauau

SEQ ID NO: 1033397 - RNA, 24 nt, Human
gcgcugggugaaaggcuggggcuc

SEQ ID NO: 1033398 - RNA, 21 nt, Human
gcugggugaaaggcuggggcu

SEQ ID NO: 1033399 - RNA, 22 nt, Human
ggaacagagccgggacagaagg

SEQ ID NO: 1033400 - RNA, 23 nt, Human
ggaacagagccgggacagaagga

SEQ ID NO: 1033401 - RNA, 18 nt, Human
ggaggagggcgucgaacc

SEQ ID NO: 1033402 - RNA, 18 nt, Human
ggaggagggcgucgaacc

SEQ ID NO: 1033403 - RNA, 23 nt, Human
gugaaaggcuggggcuccgagga

SEQ ID NO: 1033404 - RNA, 19 nt, Human
uaaaaaaacagagcaagaa

SEQ ID NO: 1033405 - RNA, 21 nt, Human
uaaaguaacagaccacacccc

SEQ ID NO: 1033406 - RNA, 23 nt, Human
uaaaguaacagaccacaccccca

SEQ ID NO: 1033407 - RNA, 28 nt, Human
uaaaguaacagaccacacccccauccca

SEQ ID NO: 1033408 - RNA, 23 nt, Human
uaagcccagccucuuggugcccu

SEQ ID NO: 1033409 - RNA, 21 nt, Human
ucacauuaaaaacagaaacau

SEQ ID NO: 1033410 - RNA, 22 nt, Human
ucauucucccaaaacuaagccc

SEQ ID NO: 1033411 - RNA, 20 nt, Human
ucccaaggucacccuucuug

SEQ ID NO: 1033412 - RNA, 19 nt, Human
uccugggcaaagggaggag

SEQ ID NO: 1033413 - RNA, 23 nt, Human
ucuuaggacccuccuccgcccca

SEQ ID NO: 1033414 - RNA, 18 nt, Human
ugcccuggagaagagaga

SEQ ID NO: 1033415 - RNA, 23 nt, Human
uggagaagagagagccuggagcu

SEQ ID NO: 1033416 - RNA, 18 nt, Human
ugggcaaagggaggaggg

SEQ ID NO: 1033417 - RNA, 23 nt, Human
ugucaaaaauuccagccaccuug

SEQ ID NO: 1033418 - RNA, 21 nt, Human
uuaauuuaaaaaaacagagca

SEQ ID NO: 1033419 - RNA, 20 nt, Human
uucauuguucucuccaaacc

SEQ ID NO: 1033420 - RNA, 20 nt, Human
uuggaggcgcugggugaaag

SEQ ID NO: 1033421 - RNA, 23 nt, Human
agcaaggcaugguggugcagguc

SEQ ID NO: 1033422 - RNA, 19 nt, Human
agccccauggcugcagccc

SEQ ID NO: 1033423 - RNA, 23 nt, Human
agucagaagaugggggccugcaa

SEQ ID NO: 1033424 - RNA, 20 nt, Human
cagccccagccuuagcccca

SEQ ID NO: 1033425 - RNA, 25 nt, Human
cauccucgucccuagaucaggguag

SEQ ID NO: 1033426 - RNA, 20 nt, Human
ccagcaaccaggccuggggc

SEQ ID NO: 1033427 - RNA, 19 nt, Human
ccaggucggccagcaaggc

SEQ ID NO: 1033428 - RNA, 26 nt, Human
cccagccccauggcugcagccccagc

SEQ ID NO: 1033429 - RNA, 22 nt, Human
ccccagccuuagccccaggagc

SEQ ID NO: 1033430 - RNA, 27 nt, Human
ccccauggcugcagccccagccuuagc

SEQ ID NO: 1033431 - RNA, 23 nt, Human
ccugcaaucguagccggcgaagc

SEQ ID NO: 1033432 - RNA, 22 nt, Human
cucagguaagggaauuugaaaa

SEQ ID NO: 1033433 - RNA, 21 nt, Human
cugcagccccagccuuagccc

SEQ ID NO: 1033434 - RNA, 27 nt, Human
cugcagccccagccuuagccccaggag

SEQ ID NO: 1033435 - RNA, 23 nt, Human
gaccacagcugugggcagaccca

SEQ ID NO: 1033436 - RNA, 21 nt, Human
gcagacccagcaaccaggccu

SEQ ID NO: 1033437 - RNA, 20 nt, Human
gguggugcagguccacgagc

SEQ ID NO: 1033438 - RNA, 21 nt, Human
uagccccaggagcaccgggga

SEQ ID NO: 1033439 - RNA, 21 nt, Human
ucccuagaucaggguaggagc

SEQ ID NO: 1033440 - RNA, 22 nt, Human
uccuuguaaucgggcuccuucc

SEQ ID NO: 1033441 - RNA, 24 nt, Human
ucggccagcaaggcaugguggugc

SEQ ID NO: 1033442 - RNA, 19 nt, Human
aaacagaugagaccuccca

SEQ ID NO: 1033443 - RNA, 21 nt, Human
aaacaggaugcucugguucuu

SEQ ID NO: 1033444 - RNA, 21 nt, Human
aagaucugcaauugcagcagg

SEQ ID NO: 1033445 - RNA, 18 nt, Human
agugggugacuuccuaca

SEQ ID NO: 1033446 - RNA, 23 nt, Human
cacagcgccgcuuucuucacgcc

SEQ ID NO: 1033447 - RNA, 19 nt, Human
caccuugauuacucuggcc

SEQ ID NO: 1033448 - RNA, 20 nt, Human
caccuugauuacucuggcca

SEQ ID NO: 1033449 - RNA, 20 nt, Human
cacgccgccgcccccgcugc

SEQ ID NO: 1033450 - RNA, 24 nt, Human
ccaacacuuuguaaauuuccuuuu

SEQ ID NO: 1033451 - RNA, 21 nt, Human
ccaacaggccuuucauaguaa

SEQ ID NO: 1033452 - RNA, 24 nt, Human
ccaccgccuccgcccgggccccua

SEQ ID NO: 1033453 - RNA, 26 nt, Human
cccaaacagaugagaccucccaacuu

SEQ ID NO: 1033454 - RNA, 18 nt, Human
cccgccaccgccuccgcc

SEQ ID NO: 1033455 - RNA, 20 nt, Human
ccgccaccgccuccgcccgg

SEQ ID NO: 1033456 - RNA, 22 nt, Human
ccgcccccgcugccuccauuuu

SEQ ID NO: 1033457 - RNA, 18 nt, Human
ccgccgcccccgcugccu

SEQ ID NO: 1033458 - RNA, 21 nt, Human
ccgccgcccccgcugccucca

SEQ ID NO: 1033459 - RNA, 18 nt, Human
ccgcgcccacagcgccgc

SEQ ID NO: 1033460 - RNA, 18 nt, Human
ccgcgcccacagcgccgc

SEQ ID NO: 1033461 - RNA, 21 nt, Human
ccgcugaagaucugcaauugc

SEQ ID NO: 1033462 - RNA, 23 nt, Human
ccgggccccuacucccgcgccca

SEQ ID NO: 1033463 - RNA, 18 nt, Human
ccuacucccgcgcccaca

SEQ ID NO: 1033464 - RNA, 23 nt, Human
cucccgcgcccacagcgccgcuu

SEQ ID NO: 1033465 - RNA, 21 nt, Human
cuccgcccgggccccuacucc

SEQ ID NO: 1033466 - RNA, 21 nt, Human
cugguucugccugauuuggag

SEQ ID NO: 1033467 - RNA, 21 nt, Human
cuuuucaacgagaacaucugg

SEQ ID NO: 1033468 - RNA, 21 nt, Human
gaaagcagauccuuggguugg

SEQ ID NO: 1033469 - RNA, 22 nt, Human
gacaucuuuggccacuucuugc

SEQ ID NO: 1033470 - RNA, 19 nt, Human
gauaagucgaucuccccgc

SEQ ID NO: 1033471 - RNA, 18 nt, Human
gcaccaccuucucuggcu

SEQ ID NO: 1033472 - RNA, 21 nt, Human
gccugcuugauaagcuucaac

SEQ ID NO: 1033473 - RNA, 22 nt, Human
gcgguucuagugacuauagccu

SEQ ID NO: 1033474 - RNA, 23 nt, Human
gggccccuacucccgcgcccaca

SEQ ID NO: 1033475 - RNA, 23 nt, Human
gggcggcugggucggggcgagcg

SEQ ID NO: 1033476 - RNA, 23 nt, Human
ggggcgagcggcuccgugggccu

SEQ ID NO: 1033477 - RNA, 18 nt, Human
ggucugauucuccuucuu

SEQ ID NO: 1033478 - RNA, 19 nt, Human
gguggagguuuauuuccau

SEQ ID NO: 1033479 - RNA, 22 nt, Human
guccgaacuguccuuaguaggg

SEQ ID NO: 1033480 - RNA, 20 nt, Human
guggagguuuauuuccaucu

SEQ ID NO: 1033481 - RNA, 19 nt, Human
uagcuaggcauccuaaagc

SEQ ID NO: 1033482 - RNA, 22 nt, Human
uagugacuauagccuuagguga

SEQ ID NO: 1033483 - RNA, 18 nt, Human
uagugggugacuuccuac

SEQ ID NO: 1033484 - RNA, 23 nt, Human
uauggcauccacauuuuuugcuu

SEQ ID NO: 1033485 - RNA, 18 nt, Human
ucaaugaugacgugccca

SEQ ID NO: 1033486 - RNA, 21 nt, Human
ucacgccgccgcccccgcugc

SEQ ID NO: 1033487 - RNA, 18 nt, Human
ucauaguacaccaggacu

SEQ ID NO: 1033488 - RNA, 23 nt, Human
uccacauuuuuugcuugcuuuuc

SEQ ID NO: 1033489 - RNA, 21 nt, Human
ucgaucuccccgcugaagauc

SEQ ID NO: 1033490 - RNA, 18 nt, Human
ucuacuuucaguaucuac

SEQ ID NO: 1033491 - RNA, 18 nt, Human
ucucagaaguuuuuaggg

SEQ ID NO: 1033492 - RNA, 23 nt, Human
ucugaagugacaucuuuggccac

SEQ ID NO: 1033493 - RNA, 25 nt, Human
ucugcaauugcagcaggccgggguc

SEQ ID NO: 1033494 - RNA, 18 nt, Human
ucugguucugccugauuu

SEQ ID NO: 1033495 - RNA, 24 nt, Human
ucuuucaaauauuugaagugaaua

SEQ ID NO: 1033496 - RNA, 18 nt, Human
ucuuuggccacuucuugc

SEQ ID NO: 1033497 - RNA, 23 nt, Human
ugaagaucugcaauugcagcagg

SEQ ID NO: 1033498 - RNA, 19 nt, Human
ugaagugaauaguaauguc

SEQ ID NO: 1033499 - RNA, 21 nt, Human
ugaagugaauaguaaugucac

SEQ ID NO: 1033500 - RNA, 19 nt, Human
ugaauaguaaugucaccau

SEQ ID NO: 1033501 - RNA, 20 nt, Human
ugagaccucccaacuugaaa

SEQ ID NO: 1033502 - RNA, 23 nt, Human
ugggucggggcgagcggcuccgu

SEQ ID NO: 1033503 - RNA, 23 nt, Human
ugguucuuguccauuuuccuagc

SEQ ID NO: 1033504 - RNA, 22 nt, Human
uguagcuaggcauccuaaagcc

SEQ ID NO: 1033505 - RNA, 19 nt, Human
uuccguguuugauguagcu

SEQ ID NO: 1033506 - RNA, 22 nt, Human
uucuucacgccgccgcccccgc

SEQ ID NO: 1033507 - RNA, 21 nt, Human
uucuugcuuugcuaaaaauug

SEQ ID NO: 1033508 - RNA, 27 nt, Human
uugaaagcagauccuuggguugguuuu

SEQ ID NO: 1033509 - RNA, 23 nt, Human
uugaaaggaucccugcaccacaa

SEQ ID NO: 1033510 - RNA, 24 nt, Human
uuggaacacguuugggacuaugaa

SEQ ID NO: 1033511 - RNA, 23 nt, Human
uuuugaggacaucgggcggcugg

SEQ ID NO: 1033512 - RNA, 21 nt, Human
agcaauucuuccaggaauugg

SEQ ID NO: 1033513 - RNA, 24 nt, Human
ccccagagagccugcucagaagcc

SEQ ID NO: 1033514 - RNA, 23 nt, Human
cucuucccguuguuucucgggcu

SEQ ID NO: 1033515 - RNA, 22 nt, Human
cugggggcguccaguccucuuc

SEQ ID NO: 1033516 - RNA, 26 nt, Human
cugggggcguccaguccucuuccugu

SEQ ID NO: 1033517 - RNA, 21 nt, Human
cuuccaggaauuggggaugaa

SEQ ID NO: 1033518 - RNA, 24 nt, Human
gaugccagagccccauccuugggg

SEQ ID NO: 1033519 - RNA, 20 nt, Human
ucggaugccagagccccauc

SEQ ID NO: 1033520 - RNA, 30 nt, Human
ugggggcguccaguccucuuccuguggcuu

SEQ ID NO: 1033521 - RNA, 19 nt, Human
uuggugacgaagucuuucu

SEQ ID NO: 1033522 - RNA, 23 nt, Human
accucaaggcggaacuggggagu

SEQ ID NO: 1033523 - RNA, 19 nt, Human
acugaguuuugcuuucucc

SEQ ID NO: 1033524 - RNA, 20 nt, Human
agccugagacagagggacca

SEQ ID NO: 1033525 - RNA, 18 nt, Human
augggaaagggcucuucu

SEQ ID NO: 1033526 - RNA, 22 nt, Human
cuaaugggaaagggcucuucuu

SEQ ID NO: 1033527 - RNA, 19 nt, Human
gaaaaacgccggggauucu

SEQ ID NO: 1033528 - RNA, 25 nt, Human
gcaggggaggaacacgcaguccgga

SEQ ID NO: 1033529 - RNA, 21 nt, Human
gcuuucuccugcgcuugcgca

SEQ ID NO: 1033530 - RNA, 23 nt, Human
ugggaaagggcucuucuugagua

SEQ ID NO: 1033531 - RNA, 19 nt, Human
agaaaggaucccgccaagg

SEQ ID NO: 1033532 - RNA, 21 nt, Human
agaugcuuuagccaugcucag

SEQ ID NO: 1033533 - RNA, 21 nt, Human
auugcugcccagcccacacca

SEQ ID NO: 1033534 - RNA, 23 nt, Human
caagugaauugcugcccagccca

SEQ ID NO: 1033535 - RNA, 20 nt, Human
ccaaggauggccgccucucc

SEQ ID NO: 1033536 - RNA, 25 nt, Human
cccgccaaggauggccgccucucca

SEQ ID NO: 1033537 - RNA, 23 nt, Human
cuccacaccggggcuguuucucc

SEQ ID NO: 1033538 - RNA, 24 nt, Human
cuccuuagaaaggaucccgccaag

SEQ ID NO: 1033539 - RNA, 21 nt, Human
ucucccugugaaugcagagau

SEQ ID NO: 1033540 - RNA, 21 nt, Human
ucuccuucaagugaauugcug

SEQ ID NO: 1033541 - RNA, 18 nt, Human
ugaauugcugcccagccc

SEQ ID NO: 1033542 - RNA, 24 nt, Human
ugacacaaagcuugacucauggaa

SEQ ID NO: 1033543 - RNA, 27 nt, Human
ugacucauggaaggucuucugccggua

SEQ ID NO: 1033544 - RNA, 19 nt, Human
uguccauugggcuugguga

SEQ ID NO: 1033545 - RNA, 18 nt, Human
uguuagagaaucagacag

SEQ ID NO: 1033546 - RNA, 19 nt, Human
uuauuuguccuuuugacac

SEQ ID NO: 1033547 - RNA, 23 nt, Human
uucacaaacugccuguuuauuuc

SEQ ID NO: 1033548 - RNA, 27 nt, Human
aggaauauugggaggaaaccgguaccc

SEQ ID NO: 1033549 - RNA, 22 nt, Human
gggcguugcugcaaagcauccu

SEQ ID NO: 1033550 - RNA, 21 nt, Human
ugagaaggaauauugggagga

SEQ ID NO: 1033551 - RNA, 19 nt, Human
uugcugcaaagcauccugg

SEQ ID NO: 1033552 - RNA, 18 nt, Human
aacccuugugccggcccu

SEQ ID NO: 1033553 - RNA, 24 nt, Human
cacaacccuugugccggcccugac

SEQ ID NO: 1033554 - RNA, 23 nt, Human
cccuugugccggcccugacuggg

SEQ ID NO: 1033555 - RNA, 18 nt, Human
ccuugugccggcccugac

SEQ ID NO: 1033556 - RNA, 23 nt, Human
cuggcuuuggugcacaugcgaca

SEQ ID NO: 1033557 - RNA, 24 nt, Human
gugguccccauggggcacuccugc

SEQ ID NO: 1033558 - RNA, 23 nt, Human
acacucauagacgucagagccac

SEQ ID NO: 1033559 - RNA, 19 nt, Human
agaaaggaucccgccaagg

SEQ ID NO: 1033560 - RNA, 21 nt, Human
auugcugcccagcccacacca

SEQ ID NO: 1033561 - RNA, 23 nt, Human
caagugaauugcugcccagccca

SEQ ID NO: 1033562 - RNA, 18 nt, Human
cacacccuuagcuggccc

SEQ ID NO: 1033563 - RNA, 24 nt, Human
cacacucauagacgucagagccac

SEQ ID NO: 1033564 - RNA, 19 nt, Human
cacuuuguggaucucagag

SEQ ID NO: 1033565 - RNA, 23 nt, Human
cauuugugguuggcauuguggga

SEQ ID NO: 1033566 - RNA, 20 nt, Human
ccaaggauggccgccucucc

SEQ ID NO: 1033567 - RNA, 25 nt, Human
cccgccaaggauggccgccucucca

SEQ ID NO: 1033568 - RNA, 23 nt, Human
cuccacacccgggcuguuucucc

SEQ ID NO: 1033569 - RNA, 24 nt, Human
cuccuuagaaaggaucccgccaag

SEQ ID NO: 1033570 - RNA, 19 nt, Human
cuggcucccaaauucgacu

SEQ ID NO: 1033571 - RNA, 18 nt, Human
cugucaggucccucgcug

SEQ ID NO: 1033572 - RNA, 19 nt, Human
cuucugguguccaaugugc

SEQ ID NO: 1033573 - RNA, 19 nt, Human
gccgccucuccacacccgg

SEQ ID NO: 1033574 - RNA, 19 nt, Human
uagcuggccccauuugugg

SEQ ID NO: 1033575 - RNA, 24 nt, Human
uagcuggccccauuugugguuggc

SEQ ID NO: 1033576 - RNA, 18 nt, Human
ucaggucccucgcuggcu

SEQ ID NO: 1033577 - RNA, 21 nt, Human
ucuccuucaagugaauugcug

SEQ ID NO: 1033578 - RNA, 23 nt, Human
ucugcacacucauagacgucaga

SEQ ID NO: 1033579 - RNA, 24 nt, Human
ucuucugguguccaaugugcugcu

SEQ ID NO: 1033580 - RNA, 18 nt, Human
ugaauugcugcccagccc

SEQ ID NO: 1033581 - RNA, 18 nt, Human
uggaucucagagcugcag

SEQ ID NO: 1033582 - RNA, 18 nt, Human
ugggcagccuccaaagca

SEQ ID NO: 1033583 - RNA, 19 nt, Human
ugucugcacacucauagac

SEQ ID NO: 1033584 - RNA, 21 nt, Human
uguggaucucagagcugcagg

SEQ ID NO: 1033585 - RNA, 19 nt, Human
uucgacugggcagccucca

SEQ ID NO: 1033586 - RNA, 19 nt, Human
uucucccaccacacccuua

SEQ ID NO: 1033587 - RNA, 22 nt, Human
uucucccaccacacccuuagcu

SEQ ID NO: 1033588 - RNA, 22 nt, Human
ccuuugcuuccucagcugucuc

SEQ ID NO: 1033589 - RNA, 20 nt, Human
gcugccgccgccauagcgga

SEQ ID NO: 1033590 - RNA, 18 nt, Human
gggcgggcucaucacucc

SEQ ID NO: 1033591 - RNA, 22 nt, Human
ucagcaggcuccuuugcuuccu

SEQ ID NO: 1033592 - RNA, 22 nt, Human
ucgccaguacgcccucggcugc

SEQ ID NO: 1033593 - RNA, 20 nt, Human
ucggcugccgccgccauagc

SEQ ID NO: 1033594 - RNA, 18 nt, Human
uugcuuccucagcugucu

SEQ ID NO: 1033595 - RNA, 19 nt, Human
agagccccauccuugggga

SEQ ID NO: 1033596 - RNA, 23 nt, Human
aggggccacccagcccccaaguc

SEQ ID NO: 1033597 - RNA, 23 nt, Human
cagagacccugagcccaggcccu

SEQ ID NO: 1033598 - RNA, 18 nt, Human
ccacccagcccccaaguc

SEQ ID NO: 1033599 - RNA, 19 nt, Human
ccacccagcccccaaguca

SEQ ID NO: 1033600 - RNA, 21 nt, Human
ccacccagcccccaagucagg

SEQ ID NO: 1033601 - RNA, 18 nt, Human
ccagcccccaagucaggg

SEQ ID NO: 1033602 - RNA, 19 nt, Human
ccccagagacccugagccc

SEQ ID NO: 1033603 - RNA, 21 nt, Human
ccccagagacccugagcccag

SEQ ID NO: 1033604 - RNA, 22 nt, Human
ccccagagacccugagcccagg

SEQ ID NO: 1033605 - RNA, 24 nt, Human
ccccagagagccugcucagaagcc

SEQ ID NO: 1033606 - RNA, 24 nt, Human
ccccuacuggcuacaaugcugcuu

SEQ ID NO: 1033607 - RNA, 18 nt, Human
cuccuuccuggagaugaa

SEQ ID NO: 1033608 - RNA, 21 nt, Human
cuccuuccuggagaugaaggg

SEQ ID NO: 1033609 - RNA, 23 nt, Human
cucuucccguuguuucuugggcu

SEQ ID NO: 1033610 - RNA, 23 nt, Human
cuggcuacaaugcugcuucuucu

SEQ ID NO: 1033611 - RNA, 22 nt, Human
gaggggccacccagcccccaag

SEQ ID NO: 1033612 - RNA, 24 nt, Human
gaugccagagccccauccuugggg

SEQ ID NO: 1033613 - RNA, 21 nt, Human
ucagcagauggggacugauga

SEQ ID NO: 1033614 - RNA, 22 nt, Human
ucagcagauggggacugaugag

SEQ ID NO: 1033615 - RNA, 20 nt, Human
uccccagagacccugagccc

SEQ ID NO: 1033616 - RNA, 26 nt, Human
uccuuggggauuggccccagagagcc

SEQ ID NO: 1033617 - RNA, 20 nt, Human
ucggaugccagagccccauc

SEQ ID NO: 1033618 - RNA, 23 nt, Human
ucuccuuccuggagaugaagggg

SEQ ID NO: 1033619 - RNA, 22 nt, Human
ucucucagcagauggggacuga

SEQ ID NO: 1033620 - RNA, 21 nt, Human
ugagcccaggcccuggguggg

SEQ ID NO: 1033621 - RNA, 22 nt, Human
ugcuucuucuccuuccuggaga

SEQ ID NO: 1033622 - RNA, 25 nt, Human
uuccaaagagaggucgcuucuugga

SEQ ID NO: 1033623 - RNA, 21 nt, Human
aaaaacaaaaaggaaaagcca

SEQ ID NO: 1033624 - RNA, 22 nt, Human
aaaacaaaaaggaaaagccaga

SEQ ID NO: 1033625 - RNA, 22 nt, Human
aaacaaaaaggaaaagccagag

SEQ ID NO: 1033626 - RNA, 19 nt, Human
aagccaaaaauucugugau

SEQ ID NO: 1033627 - RNA, 24 nt, Human
aagccuucacacagcacaguuuuc

SEQ ID NO: 1033628 - RNA, 21 nt, Human
aaguaaucaccaaagagguga

SEQ ID NO: 1033629 - RNA, 22 nt, Human
acaaaugcaaacuggcugaaaa

SEQ ID NO: 1033630 - RNA, 20 nt, Human
agaauugacaaaugcaaacu

SEQ ID NO: 1033631 - RNA, 21 nt, Human
agagagcucccauacucaaaa

SEQ ID NO: 1033632 - RNA, 19 nt, Human
agagcucccauacucaaaa

SEQ ID NO: 1033633 - RNA, 22 nt, Human
agaggcuaugguuguuaaggaa

SEQ ID NO: 1033634 - RNA, 19 nt, Human
agccuucacacagcacagu

SEQ ID NO: 1033635 - RNA, 19 nt, Human
aggaaggaauacaagacca

SEQ ID NO: 1033636 - RNA, 22 nt, Human
caaaaggaaggaauacaagacc

SEQ ID NO: 1033637 - RNA, 25 nt, Human
ccaaaauagagauugaacuuuuccc

SEQ ID NO: 1033638 - RNA, 20 nt, Human
ccaaagaggugacccucccu

SEQ ID NO: 1033639 - RNA, 18 nt, Human
ccauaaaacugaagcucu

SEQ ID NO: 1033640 - RNA, 22 nt, Human
cccauaaaacugaagcucuaaa

SEQ ID NO: 1033641 - RNA, 24 nt, Human
ccuauucuccacaguccuuccuuu

SEQ ID NO: 1033642 - RNA, 20 nt, Human
cuaaaaaaacaaaaaggaaa

SEQ ID NO: 1033643 - RNA, 23 nt, Human
gagaaagaagaauugacaaaugc

SEQ ID NO: 1033644 - RNA, 22 nt, Human
gccagagagcucccauacucaa

SEQ ID NO: 1033645 - RNA, 18 nt, Human
ggauugccuauucuccac

SEQ ID NO: 1033646 - RNA, 20 nt, Human
uaagcacuugauccuugugg

SEQ ID NO: 1033647 - RNA, 18 nt, Human
uacaagaccacauaaagc

SEQ ID NO: 1033648 - RNA, 21 nt, Human
uauauacagcauaugaguaua

SEQ ID NO: 1033649 - RNA, 24 nt, Human
uaugccacauuaaaacaucaggag

SEQ ID NO: 1033650 - RNA, 26 nt, Human
ucaaaaggaaggaauacaagaccaca

SEQ ID NO: 1033651 - RNA, 20 nt, Human
uccaaagagcaguagcugug

SEQ ID NO: 1033652 - RNA, 23 nt, Human
uccuuguggaccaaaauagagau

SEQ ID NO: 1033653 - RNA, 21 nt, Human
ucuccaaagagcaguagcugu

SEQ ID NO: 1033654 - RNA, 21 nt, Human
ugaagcucuaaaaaaacaaaa

SEQ ID NO: 1033655 - RNA, 24 nt, Human
ugccucuuauccacucuugaucau

SEQ ID NO: 1033656 - RNA, 23 nt, Human
uuaaaaaauaaauguuaacucaa

SEQ ID NO: 1033657 - RNA, 23 nt, Human
uuaguuuaaaccauguauacaau

SEQ ID NO: 1033658 - RNA, 24 nt, Human
uucuccacaguccuuccuuuugau

SEQ ID NO: 1033659 - RNA, 24 nt, Human
uuucuuacaauucuccaaagagca

SEQ ID NO: 1033660 - RNA, 23 nt, Human
uuuuggaaguaaucaccaaagag

SEQ ID NO: 1033661 - RNA, 21 nt, Human
acucccaacaagcuggggaau

SEQ ID NO: 1033662 - RNA, 21 nt, Human
acuucaaagaaaagaaagaga

SEQ ID NO: 1033663 - RNA, 19 nt, Human
auugguucccaagacaagc

SEQ ID NO: 1033664 - RNA, 18 nt, Human
cugggggcuggcuuccuu

SEQ ID NO: 1033665 - RNA, 19 nt, Human
gacucccaacaagcugggg

SEQ ID NO: 1033666 - RNA, 25 nt, Human
ucaaagaaaagaaagagagacggau

SEQ ID NO: 1033667 - RNA, 24 nt, Human
ucccaagacaagccgugagguacc

SEQ ID NO: 1033668 - RNA, 19 nt, Human
uucaaagaaaagaaagaga

SEQ ID NO: 1033669 - RNA, 22 nt, Human
uucaaagaaaagaaagagagac

SEQ ID NO: 1033670 - RNA, 21 nt, Human
aaacuuaggaggcagaaauuu

SEQ ID NO: 1033671 - RNA, 20 nt, Human
aacguggugaaacccagucu

SEQ ID NO: 1033672 - RNA, 21 nt, Human
aacguggugaaacccagucuc

SEQ ID NO: 1033673 - RNA, 23 nt, Human
aagugccuaaguaucuuuugauu

SEQ ID NO: 1033674 - RNA, 24 nt, Human
acccagucucuacuaaaaaugcaa

SEQ ID NO: 1033675 - RNA, 24 nt, Human
accugaggucaggaguucgagacc

SEQ ID NO: 1033676 - RNA, 24 nt, Human
agagguugcagugagucaagaucg

SEQ ID NO: 1033677 - RNA, 22 nt, Human
agccuggccaacguggugaaac

SEQ ID NO: 1033678 - RNA, 24 nt, Human
agccuggccaacguggugaaaccc

SEQ ID NO: 1033679 - RNA, 22 nt, Human
aggagaauugcuggaacccgag

SEQ ID NO: 1033680 - RNA, 24 nt, Human
aggcagagguugcagugagucaag

SEQ ID NO: 1033681 - RNA, 24 nt, Human
aggcaggagaauugcuggaacccg

SEQ ID NO: 1033682 - RNA, 21 nt, Human
aggcgguggaucaccugaggu

SEQ ID NO: 1033683 - RNA, 25 nt, Human
aggcgguggaucaccugaggucagg

SEQ ID NO: 1033684 - RNA, 20 nt, Human
aggcugaggcaggagaauug

SEQ ID NO: 1033685 - RNA, 21 nt, Human
aggcugaggcaggagaauugc

SEQ ID NO: 1033686 - RNA, 20 nt, Human
aucacacuccagccaggaug

SEQ ID NO: 1033687 - RNA, 24 nt, Human
caacguggugaaacccagucucua

SEQ ID NO: 1033688 - RNA, 26 nt, Human
caccaucacacuccagccaggaugac

SEQ ID NO: 1033689 - RNA, 23 nt, Human
caccugaggucaggaguucgaga

SEQ ID NO: 1033690 - RNA, 24 nt, Human
cacuccagccaggaugacaagagc

SEQ ID NO: 1033691 - RNA, 18 nt, Human
cagauggaaauauguggu

SEQ ID NO: 1033692 - RNA, 24 nt, Human
cagcuacucgggaggcugaggcag

SEQ ID NO: 1033693 - RNA, 24 nt, Human
caucacacuccagccaggaugaca

SEQ ID NO: 1033694 - RNA, 19 nt, Human
cccuaaugguuuugggagg

SEQ ID NO: 1033695 - RNA, 24 nt, Human
ccucugagcccuaaugguuuuggg

SEQ ID NO: 1033696 - RNA, 22 nt, Human
ccugaggucaggaguucgagac

SEQ ID NO: 1033697 - RNA, 22 nt, Human
ccuggccaacguggugaaaccc

SEQ ID NO: 1033698 - RNA, 22 nt, Human
ccuggccaacguggugaaaccc

SEQ ID NO: 1033699 - RNA, 23 nt, Human
ccuggccaacguggugaaaccca

SEQ ID NO: 1033700 - RNA, 21 nt, Human
ccuguaaucucagcuacucgg

SEQ ID NO: 1033701 - RNA, 22 nt, Human
ccuguaaucucagcuacucggg

SEQ ID NO: 1033702 - RNA, 24 nt, Human
cgagaccagccuggccaacguggu

SEQ ID NO: 1033703 - RNA, 23 nt, Human
cgccuguaaucucagcuacucgg

SEQ ID NO: 1033704 - RNA, 18 nt, Human
cucaaaaaaaaaaaaaag

SEQ ID NO: 1033705 - RNA, 23 nt, Human
cucagucucaaaaaaaaaaaaaa

SEQ ID NO: 1033706 - RNA, 19 nt, Human
cuggagcaaaaaucaggaa

SEQ ID NO: 1033707 - RNA, 22 nt, Human
gagaggcagagguugcagugag

SEQ ID NO: 1033708 - RNA, 24 nt, Human
gaucaccugaggucaggaguucga

SEQ ID NO: 1033709 - RNA, 24 nt, Human
gccaacguggugaaacccagucuc

SEQ ID NO: 1033710 - RNA, 23 nt, Human
gccuguaaucucagcuacucggg

SEQ ID NO: 1033711 - RNA, 24 nt, Human
gcgguggaucaccugaggucagga

SEQ ID NO: 1033712 - RNA, 22 nt, Human
ggaucaccugaggucaggaguu

SEQ ID NO: 1033713 - RNA, 23 nt, Human
ggcaugguggcgggcgccuguaa

SEQ ID NO: 1033714 - RNA, 24 nt, Human
gguggcgggcgccuguaaucucag

SEQ ID NO: 1033715 - RNA, 18 nt, Human
guaaauggauggaaacaa

SEQ ID NO: 1033716 - RNA, 20 nt, Human
gucucaaaaaaaaaaaaaag

SEQ ID NO: 1033717 - RNA, 22 nt, Human
uaggaggcagaaauuuuuaaac

SEQ ID NO: 1033718 - RNA, 22 nt, Human
uaggcgguggaucaccugaggu

SEQ ID NO: 1033719 - RNA, 18 nt, Human
ucaaaaaaaaaaaaaagu

SEQ ID NO: 1033720 - RNA, 20 nt, Human
ucaccugaggucaggaguuc

SEQ ID NO: 1033721 - RNA, 22 nt, Human
ucagucucaaaaaaaaaaaaaa

SEQ ID NO: 1033722 - RNA, 23 nt, Human
ucgggaggcugaggcaggagaau

SEQ ID NO: 1033723 - RNA, 21 nt, Human
ucucuacuaaaaaugcaaaaa

SEQ ID NO: 1033724 - RNA, 19 nt, Human
ugaaaucuugguuuuucuc

SEQ ID NO: 1033725 - RNA, 18 nt, Human
ugacaaaucuauccaaaa

SEQ ID NO: 1033726 - RNA, 19 nt, Human
ugaggcaggagaauugcug

SEQ ID NO: 1033727 - RNA, 24 nt, Human
ugaggcaggagaauugcuggaacc

SEQ ID NO: 1033728 - RNA, 25 nt, Human
ugaggcaggagaauugcuggaaccc

SEQ ID NO: 1033729 - RNA, 22 nt, Human
ugcccaaaugacuuuuuaaaca

SEQ ID NO: 1033730 - RNA, 24 nt, Human
uggaucaccugaggucaggaguuc

SEQ ID NO: 1033731 - RNA, 27 nt, Human
uggaucaccugaggucaggaguucgag

SEQ ID NO: 1033732 - RNA, 24 nt, Human
uggccaacguggugaaacccaguc

SEQ ID NO: 1033733 - RNA, 22 nt, Human
uggcgggcgccuguaaucucag

SEQ ID NO: 1033734 - RNA, 23 nt, Human
ugggaggccuaggcgguggauca

SEQ ID NO: 1033735 - RNA, 24 nt, Human
ugguggcgggcgccuguaaucuca

SEQ ID NO: 1033736 - RNA, 23 nt, Human
uuaaaacuaguuuccagaacugc

SEQ ID NO: 1033737 - RNA, 18 nt, Human
uuagccgggcaugguggc

SEQ ID NO: 1033738 - RNA, 22 nt, Human
uucucugcggccguaaaucgau

SEQ ID NO: 1033739 - RNA, 22 nt, Human
uugcagugagucaagaucgcac

SEQ ID NO: 1033740 - RNA, 25 nt, Human
uuuaauuaccugcuagauuaucaga

SEQ ID NO: 1033741 - RNA, 18 nt, Human
uuugacaaaucuauccaa

SEQ ID NO: 1033742 - RNA, 23 nt, Human
uuuuuuuuuuuuuuuuuuuacgg

SEQ ID NO: 1033743 - RNA, 23 nt, Human
agaugcaacgccaaaaugagaug

SEQ ID NO: 1033744 - RNA, 23 nt, Human
caaauauaaaaucucacucuucc

SEQ ID NO: 1033745 - RNA, 27 nt, Human
cacaaaugcugucacagaugacaguca

SEQ ID NO: 1033746 - RNA, 23 nt, Human
cacacagaccagcgacauuuccc

SEQ ID NO: 1033747 - RNA, 19 nt, Human
cacguuaccaugcugaauu

SEQ ID NO: 1033748 - RNA, 19 nt, Human
caguuacuacucagggcug

SEQ ID NO: 1033749 - RNA, 21 nt, Human
ccaaaaugagaugaaagagaa

SEQ ID NO: 1033750 - RNA, 21 nt, Human
ccaugcugaauuguccagaga

SEQ ID NO: 1033751 - RNA, 21 nt, Human
cuacucagggcugauguacaa

SEQ ID NO: 1033752 - RNA, 18 nt, Human
uacaauagaugcaacgcc

SEQ ID NO: 1033753 - RNA, 24 nt, Human
uacaauagaugcaacgccaaaaga

SEQ ID NO: 1033754 - RNA, 23 nt, Human
uaccacacagaccagcgacauuu

SEQ ID NO: 1033755 - RNA, 20 nt, Human
ugagaccaggucagaagggu

SEQ ID NO: 1033756 - RNA, 19 nt, Human
uucccauucauuuccccaa

SEQ ID NO: 1033757 - RNA, 28 nt, Human
aaaaaaaaagaauauuuaaaaauuccuc

SEQ ID NO: 1033758 - RNA, 24 nt, Human
aaaacaaauaaacaaaacauuccc

SEQ ID NO: 1033759 - RNA, 20 nt, Human
aaaauaggaaaaaaaaaaga

SEQ ID NO: 1033760 - RNA, 23 nt, Human
aaacaaauaaacaaaacauuccc

SEQ ID NO: 1033761 - RNA, 24 nt, Human
aaagugcugggauuacaggcguga

SEQ ID NO: 1033762 - RNA, 21 nt, Human
aagcgauucuccugcuucagc

SEQ ID NO: 1033763 - RNA, 22 nt, Human
aaguauuuguugccugugaaua

SEQ ID NO: 1033764 - RNA, 19 nt, Human
aagugcugggauuacaggc

SEQ ID NO: 1033765 - RNA, 19 nt, Human
aagugcugggauuacaggc

SEQ ID NO: 1033766 - RNA, 26 nt, Human
aagugcugggauuacaggcgugagcc

SEQ ID NO: 1033767 - RNA, 24 nt, Human
aauuuuguauuucuaguagagaug

SEQ ID NO: 1033768 - RNA, 20 nt, Human
accagccugaguggcugcgc

SEQ ID NO: 1033769 - RNA, 21 nt, Human
accccaaaccuccugguucuc

SEQ ID NO: 1033770 - RNA, 21 nt, Human
agccccacccccaggaccagc

SEQ ID NO: 1033771 - RNA, 24 nt, Human
agcgauucuccugcuucagccucc

SEQ ID NO: 1033772 - RNA, 25 nt, Human
aggaaaaaaaaaagaauauuuaaaa

SEQ ID NO: 1033773 - RNA, 24 nt, Human
aggugauccaccugccuuggccuc

SEQ ID NO: 1033774 - RNA, 21 nt, Human
aguagcugggauuacaggcau

SEQ ID NO: 1033775 - RNA, 20 nt, Human
augggguuucuccauguugg

SEQ ID NO: 1033776 - RNA, 21 nt, Human
augggguuucuccauguuggu

SEQ ID NO: 1033777 - RNA, 24 nt, Human
augggguuucuccauguuggucag

SEQ ID NO: 1033778 - RNA, 21 nt, Human
auguaagcugugagaaagucc

SEQ ID NO: 1033779 - RNA, 24 nt, Human
caaagugcugggauuacaggcgug

SEQ ID NO: 1033780 - RNA, 22 nt, Human
caccaccaugccuggcuaauuu

SEQ ID NO: 1033781 - RNA, 20 nt, Human
caccauauggaugacaggac

SEQ ID NO: 1033782 - RNA, 23 nt, Human
caccugccuuggccucccaaagu

SEQ ID NO: 1033783 - RNA, 24 nt, Human
caccugccuuggccucccaaagug

SEQ ID NO: 1033784 - RNA, 24 nt, Human
cagcaaccucugccucccggauuu

SEQ ID NO: 1033785 - RNA, 24 nt, Human
cauguuggucaggcuggucuugaa

SEQ ID NO: 1033786 - RNA, 22 nt, Human
ccaaagugcugggauuacaggc

SEQ ID NO: 1033787 - RNA, 22 nt, Human
ccaaagugcugggauuacaggc

SEQ ID NO: 1033788 - RNA, 24 nt, Human
ccaaagugcugggauuacaggcgu

SEQ ID NO: 1033789 - RNA, 18 nt, Human
ccacugcaccucagcggc

SEQ ID NO: 1033790 - RNA, 19 nt, Human
ccauguuggucaggcuggu

SEQ ID NO: 1033791 - RNA, 21 nt, Human
ccauguuggucaggcuggucu

SEQ ID NO: 1033792 - RNA, 21 nt, Human
ccauguuggucaggcuggucu

SEQ ID NO: 1033793 - RNA, 19 nt, Human
ccccuacagccccaccccc

SEQ ID NO: 1033794 - RNA, 21 nt, Human
cccgaccucaggugauccacc

SEQ ID NO: 1033795 - RNA, 23 nt, Human
cccgaccucaggugauccaccug

SEQ ID NO: 1033796 - RNA, 23 nt, Human
cccgaccucaggugauccaccug

SEQ ID NO: 1033797 - RNA, 23 nt, Human
cccgaguagcugggauuacaggc

SEQ ID NO: 1033798 - RNA, 24 nt, Human
cccgaguagcugggauuacaggca

SEQ ID NO: 1033799 - RNA, 23 nt, Human
cccggauuuaagcgauucuccug

SEQ ID NO: 1033800 - RNA, 24 nt, Human
cccuacagccccacccccaggacc

SEQ ID NO: 1033801 - RNA, 23 nt, Human
ccgaguagcugggauuacaggca

SEQ ID NO: 1033802 - RNA, 24 nt, Human
ccgaguagcugggauuacaggcau

SEQ ID NO: 1033803 - RNA, 18 nt, Human
ccgcggcguguucgcccc

SEQ ID NO: 1033804 - RNA, 24 nt, Human
ccucccggauuuaagcgauucucc

SEQ ID NO: 1033805 - RNA, 24 nt, Human
cgaccucaggugauccaccugccu

SEQ ID NO: 1033806 - RNA, 18 nt, Human
cuaguagagaugggguuu

SEQ ID NO: 1033807 - RNA, 22 nt, Human
cuaguagagaugggguuucucc

SEQ ID NO: 1033808 - RNA, 24 nt, Human
cuaguagagaugggguuucuccau

SEQ ID NO: 1033809 - RNA, 24 nt, Human
cucacagcaaccucugccucccgg

SEQ ID NO: 1033810 - RNA, 24 nt, Human
cucaggugauccaccugccuuggc

SEQ ID NO: 1033811 - RNA, 24 nt, Human
cuccugguucucugaaacugauug

SEQ ID NO: 1033812 - RNA, 18 nt, Human
cucuuguugcccaggcug

SEQ ID NO: 1033813 - RNA, 20 nt, Human
cugauugucuuaaucugauu

SEQ ID NO: 1033814 - RNA, 23 nt, Human
cugccuuggccucccaaagugcu

SEQ ID NO: 1033815 - RNA, 23 nt, Human
cugcuucagccucccgaguagcu

SEQ ID NO: 1033816 - RNA, 21 nt, Human
cuggaaauggcgcgaucucgg

SEQ ID NO: 1033817 - RNA, 24 nt, Human
cuuuuuuuuuuuuuuuuuugagaa

SEQ ID NO: 1033818 - RNA, 21 nt, Human
gaaaacacauucaucugcaaa

SEQ ID NO: 1033819 - RNA, 23 nt, Human
gaccucaggugauccaccugccu

SEQ ID NO: 1033820 - RNA, 24 nt, Human
gaccucaggugauccaccugccuu

SEQ ID NO: 1033821 - RNA, 18 nt, Human
gagaaaccaaguacaaau

SEQ ID NO: 1033822 - RNA, 21 nt, Human
gagacggaguuucccucuugu

SEQ ID NO: 1033823 - RNA, 24 nt, Human
gagaugggguuucuccauguuggu

SEQ ID NO: 1033824 - RNA, 24 nt, Human
gaguagcugggauuacaggcaugc

SEQ ID NO: 1033825 - RNA, 21 nt, Human
gaucucggcucacagcaaccu

SEQ ID NO: 1033826 - RNA, 22 nt, Human
gauuacaggcaugcaccaccau

SEQ ID NO: 1033827 - RNA, 18 nt, Human
gauuacaggcgugagcca

SEQ ID NO: 1033828 - RNA, 19 nt, Human
gauuacaggcgugagccac

SEQ ID NO: 1033829 - RNA, 23 nt, Human
gauuacaggcgugagccacugca

SEQ ID NO: 1033830 - RNA, 20 nt, Human
gcaccaccaugccuggcuaa

SEQ ID NO: 1033831 - RNA, 20 nt, Human
gccccacccccaggaccagc

SEQ ID NO: 1033832 - RNA, 22 nt, Human
gccuuggccucccaaagugcug

SEQ ID NO: 1033833 - RNA, 24 nt, Human
gcgauucuccugcuucagccuccc

SEQ ID NO: 1033834 - RNA, 23 nt, Human
gcuggucuugaacucccgaccuc

SEQ ID NO: 1033835 - RNA, 24 nt, Human
ggauuacaggcaugcaccaccaug

SEQ ID NO: 1033836 - RNA, 24 nt, Human
ggcuggucuugaacucccgaccuc

SEQ ID NO: 1033837 - RNA, 22 nt, Human
gggguuucuccauguuggucag

SEQ ID NO: 1033838 - RNA, 22 nt, Human
ggguuucuccauguuggucagg

SEQ ID NO: 1033839 - RNA, 18 nt, Human
guagcugggauuacaggc

SEQ ID NO: 1033840 - RNA, 20 nt, Human
guagcugggauuacaggcau

SEQ ID NO: 1033841 - RNA, 24 nt, Human
gugauccaccugccuuggccuccc

SEQ ID NO: 1033842 - RNA, 23 nt, Human
guucgccccccaacagacggagc

SEQ ID NO: 1033843 - RNA, 21 nt, Human
uacagccccacccccaggacc

SEQ ID NO: 1033844 - RNA, 22 nt, Human
uacaggcaugcaccaccaugcc

SEQ ID NO: 1033845 - RNA, 22 nt, Human
uacaggcgugagccacugcacc

SEQ ID NO: 1033846 - RNA, 23 nt, Human
uacaggcgugagccacugcaccu

SEQ ID NO: 1033847 - RNA, 25 nt, Human
uacaggcgugagccacugcaccuca

SEQ ID NO: 1033848 - RNA, 19 nt, Human
uacuucacaugccuggcug

SEQ ID NO: 1033849 - RNA, 24 nt, Human
uaguagagaugggguuucuccaug

SEQ ID NO: 1033850 - RNA, 18 nt, Human
ucacagcaaccucugccu

SEQ ID NO: 1033851 - RNA, 23 nt, Human
ucacagcaaccucugccucccgg

SEQ ID NO: 1033852 - RNA, 24 nt, Human
ucacagcaaccucugccucccgga

SEQ ID NO: 1033853 - RNA, 20 nt, Human
ucagccucccgaguagcugg

SEQ ID NO: 1033854 - RNA, 21 nt, Human
ucagcggcuuuagcacuuucc

SEQ ID NO: 1033855 - RNA, 21 nt, Human
ucaggugauccaccugccuug

SEQ ID NO: 1033856 - RNA, 24 nt, Human
uccaaaaagcacuucuuuuugcca

SEQ ID NO: 1033857 - RNA, 24 nt, Human
ucccaaagugcugggauuacaggc

SEQ ID NO: 1033858 - RNA, 19 nt, Human
ucccccacuggcuuugcac

SEQ ID NO: 1033859 - RNA, 24 nt, Human
ucccgaguagcugggauuacaggc

SEQ ID NO: 1033860 - RNA, 21 nt, Human
ucccggauuuaagcgauucuc

SEQ ID NO: 1033861 - RNA, 24 nt, Human
ucccggauuuaagcgauucuccug

SEQ ID NO: 1033862 - RNA, 22 nt, Human
ucccucuuguugcccaggcugg

SEQ ID NO: 1033863 - RNA, 23 nt, Human
ucccucuuguugcccaggcugga

SEQ ID NO: 1033864 - RNA, 22 nt, Human
ucucuggauggcuauguaagcu

SEQ ID NO: 1033865 - RNA, 23 nt, Human
ucuuguugcccaggcuggaaaug

SEQ ID NO: 1033866 - RNA, 18 nt, Human
ucuuuuuuuuuuuuuuuu

SEQ ID NO: 1033867 - RNA, 27 nt, Human
ugaaaacacauucaucugcaaaauaac

SEQ ID NO: 1033868 - RNA, 24 nt, Human
ugaauagauacagagaaaccaagu

SEQ ID NO: 1033869 - RNA, 20 nt, Human
ugagaaagucccccacuggc

SEQ ID NO: 1033870 - RNA, 18 nt, Human
ugaguugaaaacacauuc

SEQ ID NO: 1033871 - RNA, 27 nt, Human
ugaguugaaaacacauucaucugcaau

SEQ ID NO: 1033872 - RNA, 24 nt, Human
ugaugucuaaaaauaggaaaaaaa

SEQ ID NO: 1033873 - RNA, 22 nt, Human
ugcaccucagcggcuuuagcac

SEQ ID NO: 1033874 - RNA, 24 nt, Human
ugcuucagccucccgaguagcugg

SEQ ID NO: 1033875 - RNA, 19 nt, Human
ugcuugaguccaccaauga

SEQ ID NO: 1033876 - RNA, 23 nt, Human
uggauggcuauguaagcugugag

SEQ ID NO: 1033877 - RNA, 21 nt, Human
ugggauuacaggcaugcacca

SEQ ID NO: 1033878 - RNA, 24 nt, Human
ugggauuacaggcaugcaccacca

SEQ ID NO: 1033879 - RNA, 18 nt, Human
ugggauuacaggcgugag

SEQ ID NO: 1033880 - RNA, 19 nt, Human
ugggauuacaggcgugagc

SEQ ID NO: 1033881 - RNA, 21 nt, Human
ugggauuacaggcgugagcca

SEQ ID NO: 1033882 - RNA, 22 nt, Human
ugggauuacaggcgugagccac

SEQ ID NO: 1033883 - RNA, 22 nt, Human
ugggauuacaggcgugagccac

SEQ ID NO: 1033884 - RNA, 24 nt, Human
ugggauuacaggcgugagccacug

SEQ ID NO: 1033885 - RNA, 24 nt, Human
ugggauuacaggcgugagccacug

SEQ ID NO: 1033886 - RNA, 24 nt, Human
ugggguuucuccauguuggucagg

SEQ ID NO: 1033887 - RNA, 23 nt, Human
uggucaggcuggucuugaacucc

SEQ ID NO: 1033888 - RNA, 25 nt, Human
uuacugcuuuauuuuuacaagugcu

SEQ ID NO: 1033889 - RNA, 23 nt, Human
uuauguuuucuuuucucuucuuu

SEQ ID NO: 1033890 - RNA, 24 nt, Human
uucagccucccgaguagcugggau

SEQ ID NO: 1033891 - RNA, 22 nt, Human
uuccccuacagccccaccccca

SEQ ID NO: 1033892 - RNA, 24 nt, Human
uucccucuuguugcccaggcugga

SEQ ID NO: 1033893 - RNA, 29 nt, Human
uucuuuucucuucuuuuuuuuuuuuuuuu

SEQ ID NO: 1033894 - RNA, 22 nt, Human
uugaaaacacauucaucugcaa

SEQ ID NO: 1033895 - RNA, 24 nt, Human
uugaaaacacauucaucugcaaaa

SEQ ID NO: 1033896 - RNA, 23 nt, Human
uugcuacagaauugcuugagucc

SEQ ID NO: 1033897 - RNA, 18 nt, Human
uugcuuacugcuuuauuu

SEQ ID NO: 1033898 - RNA, 23 nt, Human
uuuaagcgauucuccugcuucag

SEQ ID NO: 1033899 - RNA, 24 nt, Human
uuuaagcgauucuccugcuucagc

SEQ ID NO: 1033900 - RNA, 24 nt, Human
uuucccucuuguugcccaggcugg

SEQ ID NO: 1033901 - RNA, 22 nt, Human
uuucuaguagagaugggguuuc

SEQ ID NO: 1033902 - RNA, 21 nt, Human
uuucuccauguuggucaggcu

SEQ ID NO: 1033903 - RNA, 30 nt, Human
uuucuuuucucuucuuuuuuuuuuuuuuuu

SEQ ID NO: 1033904 - RNA, 31 nt, Human
uuuucuuuucucuucuuuuuuuuuuuuuuuu

SEQ ID NO: 1033905 - RNA, 20 nt, Human
uuuuguauuucuaguagaga

SEQ ID NO: 1033906 - RNA, 22 nt, Human
uuuuuuuuuuuuuugagacgga

SEQ ID NO: 1033907 - RNA, 18 nt, Human
uuuuuuuuuuuuuuuuug

SEQ ID NO: 1033908 - RNA, 23 nt, Human
aaaagucaagaugaccacaagca

SEQ ID NO: 1033909 - RNA, 21 nt, Human
aagaggaugcgagcugcauuu

SEQ ID NO: 1033910 - RNA, 27 nt, Human
aagcaucaaugguuccaacaccaagcu

SEQ ID NO: 1033911 - RNA, 22 nt, Human
aagcucaaagaggaugcgagcu

SEQ ID NO: 1033912 - RNA, 21 nt, Human
accacaagcaucaaugguucc

SEQ ID NO: 1033913 - RNA, 22 nt, Human
accugaaaauauacuucaaaaa

SEQ ID NO: 1033914 - RNA, 20 nt, Human
agacacaucaacccacaagg

SEQ ID NO: 1033915 - RNA, 23 nt, Human
agauagacacaucaacccacaag

SEQ ID NO: 1033916 - RNA, 23 nt, Human
aggaaaauuccaaaacagcucua

SEQ ID NO: 1033917 - RNA, 19 nt, Human
aguuauucuuccaaggccu

SEQ ID NO: 1033918 - RNA, 21 nt, Human
caacaccaagcucaaagagga

SEQ ID NO: 1033919 - RNA, 20 nt, Human
caagguuauaaucuacuaua

SEQ ID NO: 1033920 - RNA, 19 nt, Human
cacagaaaaaaagcaaacc

SEQ ID NO: 1033921 - RNA, 19 nt, Human
cagcaagccagaggcuuac

SEQ ID NO: 1033922 - RNA, 22 nt, Human
ccaacaccaagcucaaagagga

SEQ ID NO: 1033923 - RNA, 21 nt, Human
ccaguuauucuuccaaggccu

SEQ ID NO: 1033924 - RNA, 21 nt, Human
cccuccauuuggguaaaaguc

SEQ ID NO: 1033925 - RNA, 18 nt, Human
cccugaacaccaaggaac

SEQ ID NO: 1033926 - RNA, 23 nt, Human
cccugaacaccaaggaacaccuu

SEQ ID NO: 1033927 - RNA, 20 nt, Human
ccugaacaccaaggaacacc

SEQ ID NO: 1033928 - RNA, 22 nt, Human
cuggguccaacccaguuauucu

SEQ ID NO: 1033929 - RNA, 19 nt, Human
cuugacccagcuuccccag

SEQ ID NO: 1033930 - RNA, 20 nt, Human
cuugacucugaguaagaccc

SEQ ID NO: 1033931 - RNA, 19 nt, Human
gaggaugcgagcugcauuu

SEQ ID NO: 1033932 - RNA, 19 nt, Human
guuguugaacuucaggucc

SEQ ID NO: 1033933 - RNA, 26 nt, Human
uaacagauaagcuccaaaaucucucu

SEQ ID NO: 1033934 - RNA, 21 nt, Human
uaacgucaacaaaguuggcau

SEQ ID NO: 1033935 - RNA, 21 nt, Human
uacacagaaaaaaagcaaacc

SEQ ID NO: 1033936 - RNA, 22 nt, Human
uacacagaaaaaaagcaaaccc

SEQ ID NO: 1033937 - RNA, 19 nt, Human
ucaggaaaauuccaaaaca

SEQ ID NO: 1033938 - RNA, 22 nt, Human
ucaguguguuuuuaaggugcag

SEQ ID NO: 1033939 - RNA, 18 nt, Human
ucauaauuugucucagca

SEQ ID NO: 1033940 - RNA, 21 nt, Human
ucccuccauuuggguaaaagu

SEQ ID NO: 1033941 - RNA, 21 nt, Human
ugacccagcuuccccagccag

SEQ ID NO: 1033942 - RNA, 19 nt, Human
ugacucugaguaagacccu

SEQ ID NO: 1033943 - RNA, 19 nt, Human
ugccagguggaaggagaca

SEQ ID NO: 1033944 - RNA, 21 nt, Human
ugcucccaagcuguggccaau

SEQ ID NO: 1033945 - RNA, 20 nt, Human
uggaaaaauggcccagcugg

SEQ ID NO: 1033946 - RNA, 23 nt, Human
uggaaggagacacuuuucuucau

SEQ ID NO: 1033947 - RNA, 22 nt, Human
uuccccagccaggugugcuccc

SEQ ID NO: 1033948 - RNA, 19 nt, Human
uucuacacagaaaaaaagc

SEQ ID NO: 1033949 - RNA, 24 nt, Human
uuggguaaaagucaagaugaccac

SEQ ID NO: 1033950 - RNA, 25 nt, Human
uuggucuggaugccagguggaagga

SEQ ID NO: 1033951 - RNA, 19 nt, Human
uuuuuaaggugcaguuaga

SEQ ID NO: 1033952 - RNA, 25 nt, Human
uuuuuaaggugcaguuagaugaaca

SEQ ID NO: 1033953 - RNA, 22 nt, Human
aaaaaccccagagacgccagcc

SEQ ID NO: 1033954 - RNA, 22 nt, Human
aaccguucccucagcaacccca

SEQ ID NO: 1033955 - RNA, 19 nt, Human
aaccuggagaggggaaggu

SEQ ID NO: 1033956 - RNA, 21 nt, Human
acagacaccucuggggucccc

SEQ ID NO: 1033957 - RNA, 18 nt, Human
accccagagacgccagcc

SEQ ID NO: 1033958 - RNA, 23 nt, Human
accccagagacgccagccuggga

SEQ ID NO: 1033959 - RNA, 22 nt, Human
accccaggggugucagacgggg

SEQ ID NO: 1033960 - RNA, 23 nt, Human
agaagaccuguggcaaaguucuc

SEQ ID NO: 1033961 - RNA, 18 nt, Human
agagacgccagccuggga

SEQ ID NO: 1033962 - RNA, 23 nt, Human
agccagccuuaaaaaccccagag

SEQ ID NO: 1033963 - RNA, 21 nt, Human
agccagccuuaaaaacccccu

SEQ ID NO: 1033964 - RNA, 22 nt, Human
cacagacaccucuggggucccc

SEQ ID NO: 1033965 - RNA, 20 nt, Human
caccucugggguccccagaa

SEQ ID NO: 1033966 - RNA, 19 nt, Human
cagacaccucugggguccc

SEQ ID NO: 1033967 - RNA, 30 nt, Human
ccacuccaaccguucccucagcaaccccaa

SEQ ID NO: 1033968 - RNA, 19 nt, Human
ccagccagccuuaaaaacc

SEQ ID NO: 1033969 - RNA, 22 nt, Human
ccccacuccaaccguucccuca

SEQ ID NO: 1033970 - RNA, 23 nt, Human
ccccagagacgccagccugggaa

SEQ ID NO: 1033971 - RNA, 21 nt, Human
ccccaggggugucagacgggg

SEQ ID NO: 1033972 - RNA, 20 nt, Human
ccgccgccgccaggccgcgc

SEQ ID NO: 1033973 - RNA, 24 nt, Human
ccuuaaaaaccccagagacgccag

SEQ ID NO: 1033974 - RNA, 24 nt, Human
gccagccuuaaaaaccccagagac

SEQ ID NO: 1033975 - RNA, 21 nt, Human
uaaaaaccccagagacgccag

SEQ ID NO: 1033976 - RNA, 21 nt, Human
uccccagaagaccuguggcaa

SEQ ID NO: 1033977 - RNA, 20 nt, Human
ucccucagcaaccccagggg

SEQ ID NO: 1033978 - RNA, 18 nt, Human
ucgcaggccgauccccac

SEQ ID NO: 1033979 - RNA, 20 nt, Human
ucuucuccagccagccuuaa

SEQ ID NO: 1033980 - RNA, 18 nt, Human
gauggugaagcuggagac

SEQ ID NO: 1033981 - RNA, 24 nt, Human
aaaagaaaacagccucagccucca

SEQ ID NO: 1033982 - RNA, 21 nt, Human
aaacaacagugagugagucca

SEQ ID NO: 1033983 - RNA, 25 nt, Human
aagaaaacagccucagccuccagcc

SEQ ID NO: 1033984 - RNA, 23 nt, Human
aaguuauuuggauaaaugggaaa

SEQ ID NO: 1033985 - RNA, 19 nt, Human
acaaagaaaagaaaacagc

SEQ ID NO: 1033986 - RNA, 21 nt, Human
agaaaacagccucagccucca

SEQ ID NO: 1033987 - RNA, 22 nt, Human
agauucccgguuauucucccac

SEQ ID NO: 1033988 - RNA, 18 nt, Human
cacagcccacguagaugg

SEQ ID NO: 1033989 - RNA, 22 nt, Human
cacccucucuuccaggcacuuc

SEQ ID NO: 1033990 - RNA, 24 nt, Human
cacccucucuuccaggcacuucuu

SEQ ID NO: 1033991 - RNA, 20 nt, Human
cagcgacggugugccaggag

SEQ ID NO: 1033992 - RNA, 19 nt, Human
cagguuggcuugcugaguu

SEQ ID NO: 1033993 - RNA, 20 nt, Human
caguuuguaugaagguagcu

SEQ ID NO: 1033994 - RNA, 24 nt, Human
cuaccagguugguuuaauuugcau

SEQ ID NO: 1033995 - RNA, 19 nt, Human
cuccagccuucccuuuugg

SEQ ID NO: 1033996 - RNA, 25 nt, Human
cugcugcucuguccaaguuauuugg

SEQ ID NO: 1033997 - RNA, 22 nt, Human
cuugaauuacagaggaaacaac

SEQ ID NO: 1033998 - RNA, 23 nt, Human
cuugcugaguucucucacuccca

SEQ ID NO: 1033999 - RNA, 26 nt, Human
gaaaacagccucagccuccagccuuc

SEQ ID NO: 1034000 - RNA, 20 nt, Human
gaacacgaucagagauuccc

SEQ ID NO: 1034001 - RNA, 23 nt, Human
gauaaaugggaacaaagaaaaga

SEQ ID NO: 1034002 - RNA, 23 nt, Human
gcuacuaccagguugguuuaauu

SEQ ID NO: 1034003 - RNA, 23 nt, Human
gggaacaaagaaaagaaaacagc

SEQ ID NO: 1034004 - RNA, 20 nt, Human
uauggagcuacuaccagguu

SEQ ID NO: 1034005 - RNA, 21 nt, Human
uccagccuucccuuuugggac

SEQ ID NO: 1034006 - RNA, 21 nt, Human
ucccagacgagucucaagggc

SEQ ID NO: 1034007 - RNA, 20 nt, Human
ugaaaucguucagacuucca

SEQ ID NO: 1034008 - RNA, 26 nt, Human
ugaguucucucacucccaucagcuuu

SEQ ID NO: 1034009 - RNA, 26 nt, Human
ugccucacaaugcacccucucuucca

SEQ ID NO: 1034010 - RNA, 25 nt, Human
uggcuugcugaguucucucacuccc

SEQ ID NO: 1034011 - RNA, 22 nt, Human
ugggaacaaagaaaagaaaaca

SEQ ID NO: 1034012 - RNA, 22 nt, Human
uucucugcugcucuguccaagu

SEQ ID NO: 1034013 - RNA, 24 nt, Human
uucucugcugcucuguccaaguua

SEQ ID NO: 1034014 - RNA, 19 nt, Human
acucugugaccgagacgcu

SEQ ID NO: 1034015 - RNA, 23 nt, Human
caguuugcuuugaugaggaaaac

SEQ ID NO: 1034016 - RNA, 21 nt, Human
ccugcacuauuucuccaacuc

SEQ ID NO: 1034017 - RNA, 24 nt, Human
cugcacuauuucuccaacucugug

SEQ ID NO: 1034018 - RNA, 21 nt, Human
ucugugaccgagacgcugucc

SEQ ID NO: 1034019 - RNA, 19 nt, Human
ugaggaaaacgcucucccu

SEQ ID NO: 1034020 - RNA, 23 nt, Human
uugaugaggaaaacgcucucccu

SEQ ID NO: 1034021 - RNA, 20 nt, Human
uuugaugaggaaaacgcucu

SEQ ID NO: 1034022 - RNA, 21 nt, Human
aacaaagacagauuuccaaag

SEQ ID NO: 1034023 - RNA, 22 nt, Human
aagcacacacacacaaaaugcc

SEQ ID NO: 1034024 - RNA, 18 nt, Human
acacacacacaaaaugcc

SEQ ID NO: 1034025 - RNA, 21 nt, Human
auuaaaauaagcacacacaca

SEQ ID NO: 1034026 - RNA, 21 nt, Human
caacaaagacagauuuccaaa

SEQ ID NO: 1034027 - RNA, 25 nt, Human
cacacacacacaaaaugccucugug

SEQ ID NO: 1034028 - RNA, 22 nt, Human
cacagacacauuccaggagucc

SEQ ID NO: 1034029 - RNA, 19 nt, Human
cagacacauuccaggaguc

SEQ ID NO: 1034030 - RNA, 22 nt, Human
cagacacauuccaggagucccc

SEQ ID NO: 1034031 - RNA, 18 nt, Human
ccacaguaucuucggcua

SEQ ID NO: 1034032 - RNA, 21 nt, Human
cccagagcaacaaagacagau

SEQ ID NO: 1034033 - RNA, 21 nt, Human
gccacaguaucuucggcuagu

SEQ ID NO: 1034034 - RNA, 21 nt, Human
uaguagguuuaucuuuuauuc

SEQ ID NO: 1034035 - RNA, 27 nt, Human
ucccagagcaacaaagacagauuucca

SEQ ID NO: 1034036 - RNA, 22 nt, Human
uccccucucccagagcaacaaa

SEQ ID NO: 1034037 - RNA, 19 nt, Human
ucucccagagcaacaaaga

SEQ ID NO: 1034038 - RNA, 21 nt, Human
uuuuuuuuuuuuauaguaggu

SEQ ID NO: 1034039 - RNA, 26 nt, Human
aagaccccaccccacagaugcucugc

SEQ ID NO: 1034040 - RNA, 18 nt, Human
accccacagaugcucugc

SEQ ID NO: 1034041 - RNA, 21 nt, Human
accccaccccacagaugcucu

SEQ ID NO: 1034042 - RNA, 20 nt, Human
acuuuaauuaugaaaaaggg

SEQ ID NO: 1034043 - RNA, 23 nt, Human
agccccaaacuggcuggggcaga

SEQ ID NO: 1034044 - RNA, 21 nt, Human
agcggcucccgggcugggccc

SEQ ID NO: 1034045 - RNA, 22 nt, Human
agggagggacgcgacccggggc

SEQ ID NO: 1034046 - RNA, 26 nt, Human
agggauggcggagggcaggggcgugu

SEQ ID NO: 1034047 - RNA, 19 nt, Human
caagaugggggaaccagcc

SEQ ID NO: 1034048 - RNA, 24 nt, Human
caaggggaagaccccaccccacag

SEQ ID NO: 1034049 - RNA, 23 nt, Human
cacagaugcucugccccagcccu

SEQ ID NO: 1034050 - RNA, 20 nt, Human
cagcaaggggaagaccccac

SEQ ID NO: 1034051 - RNA, 21 nt, Human
ccagccccaaacuggcugggg

SEQ ID NO: 1034052 - RNA, 19 nt, Human
ccccaccccacagaugcuc

SEQ ID NO: 1034053 - RNA, 27 nt, Human
cccuucccagagaccuuaaauaauuua

SEQ ID NO: 1034054 - RNA, 20 nt, Human
cggcucccgggcugggcccu

SEQ ID NO: 1034055 - RNA, 18 nt, Human
cuccagcggcucccgggc

SEQ ID NO: 1034056 - RNA, 19 nt, Human
cugcuccagcggcucccgg

SEQ ID NO: 1034057 - RNA, 25 nt, Human
gccgacgggggcgcucagggaggga

SEQ ID NO: 1034058 - RNA, 18 nt, Human
ggcucccgggcugggccc

SEQ ID NO: 1034059 - RNA, 18 nt, Human
gggcagguugcccuggug

SEQ ID NO: 1034060 - RNA, 22 nt, Human
uacaauagcagcaaggggaaga

SEQ ID NO: 1034061 - RNA, 22 nt, Human
ugccccagcccuucccagagac

SEQ ID NO: 1034062 - RNA, 19 nt, Human
uggcuggggcagagagaga

SEQ ID NO: 1034063 - RNA, 20 nt, Human
uggcuggggcagagagagac

SEQ ID NO: 1034064 - RNA, 23 nt, Human
uggcuggggcagagagagaccag

SEQ ID NO: 1034065 - RNA, 23 nt, Human
uggggcagagagagaccaguccc

SEQ ID NO: 1034066 - RNA, 23 nt, Human
aaggguggguccccccauaacuc

SEQ ID NO: 1034067 - RNA, 21 nt, Human
aaggucccuccaccuucaccc

SEQ ID NO: 1034068 - RNA, 22 nt, Human
aaggucccuccaccuucacccu

SEQ ID NO: 1034069 - RNA, 18 nt, Human
agggaucacuggcuguga

SEQ ID NO: 1034070 - RNA, 20 nt, Human
aggucccuccaccuucaccc

SEQ ID NO: 1034071 - RNA, 21 nt, Human
cagcaaguccccucccguggc

SEQ ID NO: 1034072 - RNA, 23 nt, Human
cagcaaguccccucccguggcuu

SEQ ID NO: 1034073 - RNA, 19 nt, Human
cagggcagggaucacuggc

SEQ ID NO: 1034074 - RNA, 20 nt, Human
ccccucccguggcuuucuca

SEQ ID NO: 1034075 - RNA, 24 nt, Human
ccucggaggcaaggucccuccacc

SEQ ID NO: 1034076 - RNA, 24 nt, Human
guccccucccguggcuuucucagu

SEQ ID NO: 1034077 - RNA, 20 nt, Human
uccccauaaggaaacagggc

SEQ ID NO: 1034078 - RNA, 26 nt, Human
uccccauaaggaaacagggcagggau

SEQ ID NO: 1034079 - RNA, 19 nt, Human
ucccuccaccuucacccua

SEQ ID NO: 1034080 - RNA, 19 nt, Human
uggaagggugggucccccc

SEQ ID NO: 1034081 - RNA, 22 nt, Human
uucaaacaccaggugccagaga

SEQ ID NO: 1034082 - RNA, 24 nt, Human
aggauagugaagggagccgguacc

SEQ ID NO: 1034083 - RNA, 21 nt, Human
caggauagugaagggagcacu

SEQ ID NO: 1034084 - RNA, 18 nt, Human
gaauacgagcccagcuuc

SEQ ID NO: 1034085 - RNA, 18 nt, Human
uagcucucucccuguuag

SEQ ID NO: 1034086 - RNA, 19 nt, Human
ugccugcugcugugcagau

SEQ ID NO: 1034087 - RNA, 18 nt, Human
uggcacagauugcaggcu

SEQ ID NO: 1034088 - RNA, 24 nt, Human
uggcuugaauacgagcccagcuuc

SEQ ID NO: 1034089 - RNA, 20 nt, Human
uuggaggaaggcacaggaua

SEQ ID NO: 1034090 - RNA, 24 nt, Human
aaagaguagcauaaaagagagauu

SEQ ID NO: 1034091 - RNA, 22 nt, Human
agaaaacagaguuuguuaccau

SEQ ID NO: 1034092 - RNA, 21 nt, Human
aggcccaggccuaccuccccu

SEQ ID NO: 1034093 - RNA, 21 nt, Human
caaaagaguagcauaaaagag

SEQ ID NO: 1034094 - RNA, 23 nt, Human
caggagccaaucauuagaauuug

SEQ ID NO: 1034095 - RNA, 21 nt, Human
caggcccaggccuaccucccc

SEQ ID NO: 1034096 - RNA, 23 nt, Human
cauccuggccugggagucagaag

SEQ ID NO: 1034097 - RNA, 20 nt, Human
ccaggccuaccuccccugcc

SEQ ID NO: 1034098 - RNA, 22 nt, Human
cgcugcguggccggcgucaggc

SEQ ID NO: 1034099 - RNA, 23 nt, Human
cgucaggcccaggccuaccuccc

SEQ ID NO: 1034100 - RNA, 20 nt, Human
cgugccaaagaaaacagagu

SEQ ID NO: 1034101 - RNA, 19 nt, Human
cuccaggacgccgccgccc

SEQ ID NO: 1034102 - RNA, 25 nt, Human
gagccaaucauuagaauuuggcuaa

SEQ ID NO: 1034103 - RNA, 24 nt, Human
ggcaaaagaguagcauaaaagaga

SEQ ID NO: 1034104 - RNA, 23 nt, Human
gggucuccaggacgccgccgccc

SEQ ID NO: 1034105 - RNA, 19 nt, Human
uaaaacauccuggccuggg

SEQ ID NO: 1034106 - RNA, 19 nt, Human
uaauuuucagaaaugggac

SEQ ID NO: 1034107 - RNA, 23 nt, Human
uacuaguuaucuugauaauuuuc

SEQ ID NO: 1034108 - RNA, 22 nt, Human
uacuuuggcauucacagggaug

SEQ ID NO: 1034109 - RNA, 20 nt, Human
uagaagacucaugauucugc

SEQ ID NO: 1034110 - RNA, 23 nt, Human
uaucgugccaaagaaaacagagu

SEQ ID NO: 1034111 - RNA, 18 nt, Human
uauguauauagcaaugua

SEQ ID NO: 1034112 - RNA, 18 nt, Human
uauugcuaacacuuaaaa

SEQ ID NO: 1034113 - RNA, 26 nt, Human
uauuuuauucucuuauuguugaaauc

SEQ ID NO: 1034114 - RNA, 21 nt, Human
ucacagggaugaucuggagag

SEQ ID NO: 1034115 - RNA, 24 nt, Human
ucagaacuuaauuuuuugaacuau

SEQ ID NO: 1034116 - RNA, 18 nt, Human
ucccgccgcugcguggcc

SEQ ID NO: 1034117 - RNA, 19 nt, Human
uccucugacgaaaaacaag

SEQ ID NO: 1034118 - RNA, 26 nt, Human
ucgugccaaagaaaacagaguuuguu

SEQ ID NO: 1034119 - RNA, 20 nt, Human
ugaguggcaaaagaguagca

SEQ ID NO: 1034120 - RNA, 25 nt, Human
uggcaaaagaguagcauaaaagaga

SEQ ID NO: 1034121 - RNA, 22 nt, Human
ugguaaagaguuaugauuacuu

SEQ ID NO: 1034122 - RNA, 20 nt, Human
ugugagaaauaaaacauccu

SEQ ID NO: 1034123 - RNA, 19 nt, Human
uuacuuuggcauucacagg

SEQ ID NO: 1034124 - RNA, 23 nt, Human
uucauugaaacacuaagucauga

SEQ ID NO: 1034125 - RNA, 20 nt, Human
uugaucucaaggcugagugg

SEQ ID NO: 1034126 - RNA, 19 nt, Human
uuucauagguuuaccacua

SEQ ID NO: 1034127 - RNA, 23 nt, Human
uuuucagaacuuaauuuuuugaa

SEQ ID NO: 1034128 - RNA, 26 nt, Human
aaaagaagccaaguucauuuccagaa

SEQ ID NO: 1034129 - RNA, 24 nt, Human
aaacaaaacaaaccaggacuccca

SEQ ID NO: 1034130 - RNA, 19 nt, Human
aaaugcaaccucauuuguc

SEQ ID NO: 1034131 - RNA, 23 nt, Human
aauaacaccuguaaacugauuaa

SEQ ID NO: 1034132 - RNA, 18 nt, Human
aaugcccaucauucaagg

SEQ ID NO: 1034133 - RNA, 24 nt, Human
accaagcaacuaaugcaauaucac

SEQ ID NO: 1034134 - RNA, 21 nt, Human
aguggccgugcuguaacaauc

SEQ ID NO: 1034135 - RNA, 20 nt, Human
auaaaagaccaagcaacuaa

SEQ ID NO: 1034136 - RNA, 22 nt, Human
auagcaagacucauuuauucca

SEQ ID NO: 1034137 - RNA, 23 nt, Human
aucuucuaacaaaccagaacauc

SEQ ID NO: 1034138 - RNA, 22 nt, Human
auuuguagaagcacaccuccuu

SEQ ID NO: 1034139 - RNA, 25 nt, Human
caaaacaaaacaaaccaggacuccc

SEQ ID NO: 1034140 - RNA, 26 nt, Human
caaaacaaaccaggacucccacugga

SEQ ID NO: 1034141 - RNA, 23 nt, Human
caaaugcccaucauucaaggacc

SEQ ID NO: 1034142 - RNA, 19 nt, Human
caacagaagugacaauuac

SEQ ID NO: 1034143 - RNA, 25 nt, Human
caagaaaauaacaaaacaaaacaaa

SEQ ID NO: 1034144 - RNA, 21 nt, Human
caaggaccagaugaacccaug

SEQ ID NO: 1034145 - RNA, 26 nt, Human
caucauucaaggaccagaugaaccca

SEQ ID NO: 1034146 - RNA, 19 nt, Human
caugaaagauaaaagacca

SEQ ID NO: 1034147 - RNA, 20 nt, Human
ccaaguucauuuccagaaau

SEQ ID NO: 1034148 - RNA, 19 nt, Human
ccacuggaaaccacagcug

SEQ ID NO: 1034149 - RNA, 24 nt, Human
ccagaugaacccaugaaagauaaa

SEQ ID NO: 1034150 - RNA, 24 nt, Human
cccaugaaagauaaaagaccaagc

SEQ ID NO: 1034151 - RNA, 20 nt, Human
ccuggcaagccacuuuuuca

SEQ ID NO: 1034152 - RNA, 22 nt, Human
cuaugugcgucgucucugcacc

SEQ ID NO: 1034153 - RNA, 18 nt, Human
cucccacuggaaaccaca

SEQ ID NO: 1034154 - RNA, 18 nt, Human
cucuccaucaguugcugu

SEQ ID NO: 1034155 - RNA, 21 nt, Human
cucugcaccaaaugcaaccuc

SEQ ID NO: 1034156 - RNA, 18 nt, Human
gaccugguagcaauagug

SEQ ID NO: 1034157 - RNA, 19 nt, Human
gaccugguagcaauagugc

SEQ ID NO: 1034158 - RNA, 19 nt, Human
gcaauaucacuucugcaaa

SEQ ID NO: 1034159 - RNA, 21 nt, Human
gccaaguucauuuccagaaau

SEQ ID NO: 1034160 - RNA, 20 nt, Human
gcuguaauucugagggcaaa

SEQ ID NO: 1034161 - RNA, 22 nt, Human
gguagcaauagugcugagcaag

SEQ ID NO: 1034162 - RNA, 26 nt, Human
uaaacagaucuucuaacaaaccagaa

SEQ ID NO: 1034163 - RNA, 20 nt, Human
uaacaaaccagaacauccuu

SEQ ID NO: 1034164 - RNA, 19 nt, Human
uaacucccuggcaagccac

SEQ ID NO: 1034165 - RNA, 22 nt, Human
uaagauccauuugaaaauccau

SEQ ID NO: 1034166 - RNA, 23 nt, Human
uacuauaggugauguacccauuu

SEQ ID NO: 1034167 - RNA, 22 nt, Human
uacuuuaucagaguccuucauu

SEQ ID NO: 1034168 - RNA, 21 nt, Human
uagcgauacuauaggugaugu

SEQ ID NO: 1034169 - RNA, 22 nt, Human
uagcgauacuauaggugaugua

SEQ ID NO: 1034170 - RNA, 26 nt, Human
ucaggaguacaaucaacagaagucga

SEQ ID NO: 1034171 - RNA, 21 nt, Human
ugcaaagccuuacuguaaagg

SEQ ID NO: 1034172 - RNA, 25 nt, Human
ugcaauaucacuucugcaaagccuu

SEQ ID NO: 1034173 - RNA, 18 nt, Human
uggcaagccacuuuuuca

SEQ ID NO: 1034174 - RNA, 22 nt, Human
uggcgguauggugaaccccagu

SEQ ID NO: 1034175 - RNA, 20 nt, Human
uguaaagggaaagauuccua

SEQ ID NO: 1034176 - RNA, 20 nt, Human
uguuuuguaaauaucuccuu

SEQ ID NO: 1034177 - RNA, 22 nt, Human
uucaguggccgugcuguaacaa

SEQ ID NO: 1034178 - RNA, 22 nt, Human
uugaaaauccauuucacacuuc

SEQ ID NO: 1034179 - RNA, 19 nt, Human
uugcuguaauucugagggc

SEQ ID NO: 1034180 - RNA, 19 nt, Human
uuuauaaaccuccuucuua

SEQ ID NO: 1034181 - RNA, 19 nt, Human
uuucuccuuuauccuuauc

SEQ ID NO: 1034182 - RNA, 23 nt, Human
aaaaaaaaaaaagcacaauuuug

SEQ ID NO: 1034183 - RNA, 23 nt, Human
aaacaaacagaaauaacugagca

SEQ ID NO: 1034184 - RNA, 26 nt, Human
aaacaaacagaaauaacugagcagcu

SEQ ID NO: 1034185 - RNA, 19 nt, Human
aacauggugaaaccccauc

SEQ ID NO: 1034186 - RNA, 20 nt, Human
aacauggugaaaccccaucu

SEQ ID NO: 1034187 - RNA, 21 nt, Human
aacauggugaaaccccaucuc

SEQ ID NO: 1034188 - RNA, 21 nt, Human
aacauggugaaaccccaucuc

SEQ ID NO: 1034189 - RNA, 18 nt, Human
aacuuccucccccaccca

SEQ ID NO: 1034190 - RNA, 20 nt, Human
aagaucccaugaggguccaa

SEQ ID NO: 1034191 - RNA, 23 nt, Human
aagcaaaaaaggaaagucccuca

SEQ ID NO: 1034192 - RNA, 23 nt, Human
aagcacaguuuugggcugggcac

SEQ ID NO: 1034193 - RNA, 24 nt, Human
aaucgcuugaacccaggaggugga

SEQ ID NO: 1034194 - RNA, 24 nt, Human
aaucgcuugaacccaggaggugga

SEQ ID NO: 1034195 - RNA, 18 nt, Human
aauuuauacacaauaacu

SEQ ID NO: 1034196 - RNA, 23 nt, Human
acaaaaccaaccagauaaucaca

SEQ ID NO: 1034197 - RNA, 20 nt, Human
acaccuguaaccccagcaac

SEQ ID NO: 1034198 - RNA, 24 nt, Human
acagagcaagacucugucuugaga

SEQ ID NO: 1034199 - RNA, 22 nt, Human
accccagcaaccugggaggcug

SEQ ID NO: 1034200 - RNA, 24 nt, Human
accccaucucuacuaaaaauacaa

SEQ ID NO: 1034201 - RNA, 22 nt, Human
acgaggucaggaguuugagacc

SEQ ID NO: 1034202 - RNA, 20 nt, Human
acuaacuuuuccaacaauca

SEQ ID NO: 1034203 - RNA, 22 nt, Human
acugcacaaagccauacaagac

SEQ ID NO: 1034204 - RNA, 18 nt, Human
acuuccucccccacccac

SEQ ID NO: 1034205 - RNA, 19 nt, Human
acuuuaacuuccuccccca

SEQ ID NO: 1034206 - RNA, 22 nt, Human
agaaaaaaaaaaaaaagcacaa

SEQ ID NO: 1034207 - RNA, 22 nt, Human
agaaucgcuugaacccaggagg

SEQ ID NO: 1034208 - RNA, 19 nt, Human
agaucagagaaauugaaag

SEQ ID NO: 1034209 - RNA, 26 nt, Human
agcacaauuuugcuuuauuggcagua

SEQ ID NO: 1034210 - RNA, 21 nt, Human
agccaacuucuguagcaaugu

SEQ ID NO: 1034211 - RNA, 19 nt, Human
agccauacaagacuggcug

SEQ ID NO: 1034212 - RNA, 22 nt, Human
agccuggccaacauggugaaac

SEQ ID NO: 1034213 - RNA, 24 nt, Human
agccuggccaacauggugaaaccc

SEQ ID NO: 1034214 - RNA, 24 nt, Human
agccugggugacagagcaagacuc

SEQ ID NO: 1034215 - RNA, 23 nt, Human
aggagguggagauugcagugagc

SEQ ID NO: 1034216 - RNA, 20 nt, Human
aggaguuugagaccagccug

SEQ ID NO: 1034217 - RNA, 23 nt, Human
aggcaggagaaucgcuugaaccc

SEQ ID NO: 1034218 - RNA, 24 nt, Human
aggcaggagaaucgcuugaaccca

SEQ ID NO: 1034219 - RNA, 24 nt, Human
aggcggccguaaucugauugaagc

SEQ ID NO: 1034220 - RNA, 24 nt, Human
aggcgugguggcacacaccuguaa

SEQ ID NO: 1034221 - RNA, 20 nt, Human
aggcugaggcaggagaaucg

SEQ ID NO: 1034222 - RNA, 24 nt, Human
aggcugaggcaggagaaucgcuug

SEQ ID NO: 1034223 - RNA, 20 nt, Human
aggggaauggcugugggcuu

SEQ ID NO: 1034224 - RNA, 24 nt, Human
agguggagauugcagugagcugag

SEQ ID NO: 1034225 - RNA, 24 nt, Human
agguggauuacgaggucaggaguu

SEQ ID NO: 1034226 - RNA, 24 nt, Human
aguuuugggcugggcacgguggcu

SEQ ID NO: 1034227 - RNA, 19 nt, Human
augccuguaaucccagcac

SEQ ID NO: 1034228 - RNA, 21 nt, Human
auugcacucuagccuggguga

SEQ ID NO: 1034229 - RNA, 24 nt, Human
auugcacucuagccugggugacag

SEQ ID NO: 1034230 - RNA, 24 nt, Human
auugcagugagcugagaucaugcc

SEQ ID NO: 1034231 - RNA, 19 nt, Human
auuggcaguaccaaaauaa

SEQ ID NO: 1034232 - RNA, 19 nt, Human
caaacagaaauaacugagc

SEQ ID NO: 1034233 - RNA, 24 nt, Human
caacauggugaaaccccaucucua

SEQ ID NO: 1034234 - RNA, 19 nt, Human
caagaucccaugagggucc

SEQ ID NO: 1034235 - RNA, 20 nt, Human
cacaaacaaacagaaauaac

SEQ ID NO: 1034236 - RNA, 21 nt, Human
cacacaccuguaaccccagca

SEQ ID NO: 1034237 - RNA, 24 nt, Human
cacaccuguaaccccagcaaccug

SEQ ID NO: 1034238 - RNA, 23 nt, Human
caccuguaaccccagcaaccugg

SEQ ID NO: 1034239 - RNA, 24 nt, Human
caccuguaaccccagcaaccuggg

SEQ ID NO: 1034240 - RNA, 24 nt, Human
cacggcagguggauuacgagguca

SEQ ID NO: 1034241 - RNA, 22 nt, Human
cacucuagccugggugacagag

SEQ ID NO: 1034242 - RNA, 23 nt, Human
cacucuagccugggugacagagc

SEQ ID NO: 1034243 - RNA, 18 nt, Human
cagaaaacacaaaaccaa

SEQ ID NO: 1034244 - RNA, 21 nt, Human
cagaaaacacaaaaccaacca

SEQ ID NO: 1034245 - RNA, 24 nt, Human
cagcaaccugggaggcugaggcag

SEQ ID NO: 1034246 - RNA, 21 nt, Human
cagcacuuugggaggccacgg

SEQ ID NO: 1034247 - RNA, 24 nt, Human
cagcacuuugggaggccacggcag

SEQ ID NO: 1034248 - RNA, 20 nt, Human
cagccgaccgcaagauccca

SEQ ID NO: 1034249 - RNA, 29 nt, Human
caggagguggagauugcagugacaacggu

SEQ ID NO: 1034250 - RNA, 22 nt, Human
cagguggauuacgaggucagga

SEQ ID NO: 1034251 - RNA, 25 nt, Human
caguaccaaaauaaaguuaacugaa

SEQ ID NO: 1034252 - RNA, 20 nt, Human
caugccuguaaucccagcac

SEQ ID NO: 1034253 - RNA, 18 nt, Human
caugcucgccggcagaau

SEQ ID NO: 1034254 - RNA, 21 nt, Human
cauucagaaacacugacucau

SEQ ID NO: 1034255 - RNA, 19 nt, Human
cauugcacucuagccuggg

SEQ ID NO: 1034256 - RNA, 21 nt, Human
cauugcacucuagccugggug

SEQ ID NO: 1034257 - RNA, 22 nt, Human
cauugcacucuagccuggguga

SEQ ID NO: 1034258 - RNA, 24 nt, Human
cauugcacucuagccugggugaca

SEQ ID NO: 1034259 - RNA, 25 nt, Human
cauugcacucuagccugggugacag

SEQ ID NO: 1034260 - RNA, 27 nt, Human
ccaaauggaacccaaaaagccucaugu

SEQ ID NO: 1034261 - RNA, 18 nt, Human
ccaaugccauaugucauc

SEQ ID NO: 1034262 - RNA, 19 nt, Human
ccaaugccauaugucauca

SEQ ID NO: 1034263 - RNA, 20 nt, Human
ccauugcacucuagccuggg

SEQ ID NO: 1034264 - RNA, 21 nt, Human
ccauugcacucuagccugggu

SEQ ID NO: 1034265 - RNA, 21 nt, Human
ccauugcacucuagccugggu

SEQ ID NO: 1034266 - RNA, 22 nt, Human
ccauugcacucuagccugggug

SEQ ID NO: 1034267 - RNA, 23 nt, Human
ccauugcacucuagccuggguga

SEQ ID NO: 1034268 - RNA, 24 nt, Human
ccauugcacucuagccugggugac

SEQ ID NO: 1034269 - RNA, 23 nt, Human
cccaaaaagccucauguugcucu

SEQ ID NO: 1034270 - RNA, 20 nt, Human
cccaaaaccuucacauuagc

SEQ ID NO: 1034271 - RNA, 20 nt, Human
cccacccaccaaauggaacc

SEQ ID NO: 1034272 - RNA, 19 nt, Human
cccagccaaucugcuucca

SEQ ID NO: 1034273 - RNA, 20 nt, Human
cccagccaaucugcuuccac

SEQ ID NO: 1034274 - RNA, 23 nt, Human
cccccacccaccaaauggaaccc

SEQ ID NO: 1034275 - RNA, 24 nt, Human
cccccacccaccaaauggaaccca

SEQ ID NO: 1034276 - RNA, 22 nt, Human
cccucuuugcauuuuuagcugu

SEQ ID NO: 1034277 - RNA, 23 nt, Human
ccucaaccugucaacuuucaguu

SEQ ID NO: 1034278 - RNA, 26 nt, Human
ccucccccacccaccaaauggaaccc

SEQ ID NO: 1034279 - RNA, 23 nt, Human
ccuggccaacauggugaaacccc

SEQ ID NO: 1034280 - RNA, 24 nt, Human
ccuggccaacauggugaaacccca

SEQ ID NO: 1034281 - RNA, 22 nt, Human
ccugggugacagagcaagacuc

SEQ ID NO: 1034282 - RNA, 20 nt, Human
ccuguaaucccagcacuuug

SEQ ID NO: 1034283 - RNA, 22 nt, Human
cggccguaaucugauugaagca

SEQ ID NO: 1034284 - RNA, 24 nt, Human
cuagucuacuuuccucuuuucuua

SEQ ID NO: 1034285 - RNA, 23 nt, Human
cucaugccuguaaucccagcacu

SEQ ID NO: 1034286 - RNA, 24 nt, Human
cucaugccuguaaucccagcacuu

SEQ ID NO: 1034287 - RNA, 21 nt, Human
cuggacacacaacacguauuc

SEQ ID NO: 1034288 - RNA, 23 nt, Human
cuggccaacauggugaaacccca

SEQ ID NO: 1034289 - RNA, 24 nt, Human
cugggaggcugaggcaggagaauc

SEQ ID NO: 1034290 - RNA, 19 nt, Human
gaacccaaaaagccucaug

SEQ ID NO: 1034291 - RNA, 19 nt, Human
gacaccuuuccucugcauu

SEQ ID NO: 1034292 - RNA, 24 nt, Human
gacagagcaagacucugucuugag

SEQ ID NO: 1034293 - RNA, 19 nt, Human
gagaaaaaaaaaaaaaagc

SEQ ID NO: 1034294 - RNA, 23 nt, Human
gagaccagccuggccaacauggu

SEQ ID NO: 1034295 - RNA, 24 nt, Human
gauuacgaggucaggaguuugaga

SEQ ID NO: 1034296 - RNA, 20 nt, Human
gcacaaagccauacaagacu

SEQ ID NO: 1034297 - RNA, 24 nt, Human
gcacucuagccugggugacagagc

SEQ ID NO: 1034298 - RNA, 22 nt, Human
gcaggagaaucgcuugaaccca

SEQ ID NO: 1034299 - RNA, 24 nt, Human
gccaacauggugaaaccccaucuc

SEQ ID NO: 1034300 - RNA, 24 nt, Human
gccauugcacucuagccuggguga

SEQ ID NO: 1034301 - RNA, 19 nt, Human
gccucuuugauuguugcca

SEQ ID NO: 1034302 - RNA, 19 nt, Human
gcugggcacgguggcucau

SEQ ID NO: 1034303 - RNA, 22 nt, Human
gcugggcacgguggcucaugcc

SEQ ID NO: 1034304 - RNA, 27 nt, Human
ggaagaccacagccgaccgcaagaucc

SEQ ID NO: 1034305 - RNA, 22 nt, Human
ggagauugcagugagcugagau

SEQ ID NO: 1034306 - RNA, 24 nt, Human
ggagauugcagugagcugagauca

SEQ ID NO: 1034307 - RNA, 20 nt, Human
ggagauugcagugagcuggc

SEQ ID NO: 1034308 - RNA, 23 nt, Human
ggauuacgaggucaggaguuuga

SEQ ID NO: 1034309 - RNA, 23 nt, Human
ggcagguggauuacgaggucagg

SEQ ID NO: 1034310 - RNA, 24 nt, Human
ggccacggcagguggauuacgagg

SEQ ID NO: 1034311 - RNA, 25 nt, Human
ggcgugguggcacacaccuguaacc

SEQ ID NO: 1034312 - RNA, 23 nt, Human
ggcugggcacgguggcucaugcc

SEQ ID NO: 1034313 - RNA, 22 nt, Human
ggcugugggcuugugggugcuu

SEQ ID NO: 1034314 - RNA, 18 nt, Human
gggcacgguggcucaugc

SEQ ID NO: 1034315 - RNA, 24 nt, Human
gggcacgguggcucaugccuguaa

SEQ ID NO: 1034316 - RNA, 19 nt, Human
ggucaggaguuugagacca

SEQ ID NO: 1034317 - RNA, 24 nt, Human
gguggcacacaccuguaaccccag

SEQ ID NO: 1034318 - RNA, 23 nt, Human
gguggcucaugccuguaauccca

SEQ ID NO: 1034319 - RNA, 24 nt, Human
gguggcucaugccuguaaucccag

SEQ ID NO: 1034320 - RNA, 20 nt, Human
guggagauugcagugagcug

SEQ ID NO: 1034321 - RNA, 23 nt, Human
guggauuacgaggucaggaguuu

SEQ ID NO: 1034322 - RNA, 23 nt, Human
uaaaacccaacuauauuagauug

SEQ ID NO: 1034323 - RNA, 23 nt, Human
uaacagacaccuuuccucugcau

SEQ ID NO: 1034324 - RNA, 23 nt, Human
uaacuuuuccaacaaucauuacu

SEQ ID NO: 1034325 - RNA, 21 nt, Human
uacacaccaaugccauauguc

SEQ ID NO: 1034326 - RNA, 23 nt, Human
uacaugcaacaaugccucuuuga

SEQ ID NO: 1034327 - RNA, 24 nt, Human
uaccagaaaacacaaaaccaaccu

SEQ ID NO: 1034328 - RNA, 23 nt, Human
uaccagucaccucucaaaaacaa

SEQ ID NO: 1034329 - RNA, 24 nt, Human
uacuacuauuuucauuucauuggc

SEQ ID NO: 1034330 - RNA, 20 nt, Human
uagcugugaacauagguacc

SEQ ID NO: 1034331 - RNA, 24 nt, Human
uaugaacaaagccaacuucuguag

SEQ ID NO: 1034332 - RNA, 22 nt, Human
ucaaggauuaccagucaccucu

SEQ ID NO: 1034333 - RNA, 21 nt, Human
ucccccacccaccaaauggaa

SEQ ID NO: 1034334 - RNA, 24 nt, Human
ucuagccugggugacagagcaaga

SEQ ID NO: 1034335 - RNA, 22 nt, Human
ucucuacuaaaaauacaaaaaa

SEQ ID NO: 1034336 - RNA, 19 nt, Human
ucugcuuccacuuuucugu

SEQ ID NO: 1034337 - RNA, 19 nt, Human
ugaaaccccaucucuacua

SEQ ID NO: 1034338 - RNA, 23 nt, Human
ugaacauagguaccuacaucaag

SEQ ID NO: 1034339 - RNA, 22 nt, Human
ugagaaaaaaaaaaaaaagcac

SEQ ID NO: 1034340 - RNA, 23 nt, Human
ugagaccagccuggccaacaugg

SEQ ID NO: 1034341 - RNA, 20 nt, Human
ugaggcaggagaaucgcuug

SEQ ID NO: 1034342 - RNA, 24 nt, Human
ugaggcaggagaaucgcuugaacc

SEQ ID NO: 1034343 - RNA, 25 nt, Human
ugaggcaggagaaucgcuugaaccc

SEQ ID NO: 1034344 - RNA, 22 nt, Human
ugcaagcacauauuuguacaua

SEQ ID NO: 1034345 - RNA, 22 nt, Human
ugcacucuagccugggugacag

SEQ ID NO: 1034346 - RNA, 24 nt, Human
ugcacucuagccugggugacagag

SEQ ID NO: 1034347 - RNA, 23 nt, Human
ugccuguaaucccagcacuuugg

SEQ ID NO: 1034348 - RNA, 23 nt, Human
ugccuguaaucccagcacuuugg

SEQ ID NO: 1034349 - RNA, 24 nt, Human
ugccuguaaucccagcacuuuggg

SEQ ID NO: 1034350 - RNA, 21 nt, Human
uggauuacgaggucaggaguu

SEQ ID NO: 1034351 - RNA, 19 nt, Human
uggcacacaccuguaaccc

SEQ ID NO: 1034352 - RNA, 23 nt, Human
uggcacacaccuguaaccccagc

SEQ ID NO: 1034353 - RNA, 24 nt, Human
uggccaacauggugaaaccccauc

SEQ ID NO: 1034354 - RNA, 23 nt, Human
uggcucaaaauuacaugcaacaa

SEQ ID NO: 1034355 - RNA, 24 nt, Human
uggcucaugccuguaaucccagca

SEQ ID NO: 1034356 - RNA, 23 nt, Human
uggcugugggcuugugggugcuu

SEQ ID NO: 1034357 - RNA, 26 nt, Human
ugggacagaagcccagccaaucugcu

SEQ ID NO: 1034358 - RNA, 19 nt, Human
ugggaggcugaggcaggag

SEQ ID NO: 1034359 - RNA, 23 nt, Human
ugggaggcugaggcaggagaauc

SEQ ID NO: 1034360 - RNA, 22 nt, Human
ugggcacgguggcucaugccug

SEQ ID NO: 1034361 - RNA, 23 nt, Human
ugguggcacacaccuguaacccc

SEQ ID NO: 1034362 - RNA, 19 nt, Human
uguuauauuuccaguggaa

SEQ ID NO: 1034363 - RNA, 23 nt, Human
uuaauacugcaaggacugaugcu

SEQ ID NO: 1034364 - RNA, 24 nt, Human
uuacgaggucaggaguuugagacc

SEQ ID NO: 1034365 - RNA, 26 nt, Human
uugagaaaaaaaaaaaaaagcacaau

SEQ ID NO: 1034366 - RNA, 18 nt, Human
uugcagugagcugagauc

SEQ ID NO: 1034367 - RNA, 19 nt, Human
uugcagugagcugagauca

SEQ ID NO: 1034368 - RNA, 20 nt, Human
uugcagugagcugagaucau

SEQ ID NO: 1034369 - RNA, 23 nt, Human
uuggaugcuuaacacaaacaaac

SEQ ID NO: 1034370 - RNA, 23 nt, Human
uugugaagaaguuucuaguggaa

SEQ ID NO: 1034371 - RNA, 19 nt, Human
uuuaccagaaaacacaaaa

SEQ ID NO: 1034372 - RNA, 22 nt, Human
uuuauuggcaguaccaaaauaa

SEQ ID NO: 1034373 - RNA, 18 nt, Human
uuuccagggcacaauacu

SEQ ID NO: 1034374 - RNA, 19 nt, Human
aaagugaguugaucaaggu

SEQ ID NO: 1034375 - RNA, 18 nt, Human
aacagcuacauucaaagc

SEQ ID NO: 1034376 - RNA, 21 nt, Human
aaccugcagaaucagagcaac

SEQ ID NO: 1034377 - RNA, 24 nt, Human
aagcauuaaaauaacaacagcuac

SEQ ID NO: 1034378 - RNA, 24 nt, Human
aaggucuugcccacucaugcuccu

SEQ ID NO: 1034379 - RNA, 20 nt, Human
acaaguacuuacauauccuc

SEQ ID NO: 1034380 - RNA, 20 nt, Human
acaggcuaggauucuguaac

SEQ ID NO: 1034381 - RNA, 19 nt, Human
aggaaucagagaccaguuu

SEQ ID NO: 1034382 - RNA, 23 nt, Human
auuaugcaugugcuccucaaaau

SEQ ID NO: 1034383 - RNA, 22 nt, Human
caacagcuacauucaaagcuuc

SEQ ID NO: 1034384 - RNA, 22 nt, Human
caauaaaagucccugcugaaag

SEQ ID NO: 1034385 - RNA, 31 nt, Human
caauuuuguuucaaaagacucuguugagggg

SEQ ID NO: 1034386 - RNA, 19 nt, Human
cacauguacaaguacuuac

SEQ ID NO: 1034387 - RNA, 22 nt, Human
cacauguacaaguacuuacaua

SEQ ID NO: 1034388 - RNA, 19 nt, Human
caccaugggaaguacagag

SEQ ID NO: 1034389 - RNA, 20 nt, Human
cacccagaguuaaagcacau

SEQ ID NO: 1034390 - RNA, 24 nt, Human
cauguacaaguacuuacauauccu

SEQ ID NO: 1034391 - RNA, 19 nt, Human
cauuaugcaugugcuccuc

SEQ ID NO: 1034392 - RNA, 18 nt, Human
ccaaugugucuaauaugg

SEQ ID NO: 1034393 - RNA, 24 nt, Human
ccccaauaaaagucccugcugaaa

SEQ ID NO: 1034394 - RNA, 20 nt, Human
ccgaauuacaaaacuaauaa

SEQ ID NO: 1034395 - RNA, 20 nt, Human
cuucccauuuuuuuuaaacc

SEQ ID NO: 1034396 - RNA, 24 nt, Human
cuugcccacucaugcuccuucuuc

SEQ ID NO: 1034397 - RNA, 22 nt, Human
gacaauaacagcaacuccagaa

SEQ ID NO: 1034398 - RNA, 22 nt, Human
guacaaguacuuacauauccuc

SEQ ID NO: 1034399 - RNA, 20 nt, Human
uaaaguaauguguguguggc

SEQ ID NO: 1034400 - RNA, 21 nt, Human
uaacaacagcuacauucaaag

SEQ ID NO: 1034401 - RNA, 18 nt, Human
uaagauggggccacagua

SEQ ID NO: 1034402 - RNA, 21 nt, Human
uaagauggggccacaguaauu

SEQ ID NO: 1034403 - RNA, 20 nt, Human
uaauuugcaaaagucugacc

SEQ ID NO: 1034404 - RNA, 19 nt, Human
uacaaguacuuacauaucc

SEQ ID NO: 1034405 - RNA, 23 nt, Human
uaguagguucuuuuugaaggucu

SEQ ID NO: 1034406 - RNA, 21 nt, Human
ucaaaagacucuguugagggg

SEQ ID NO: 1034407 - RNA, 24 nt, Human
ucaaaaucaccaugggaaguacag

SEQ ID NO: 1034408 - RNA, 20 nt, Human
ucacaaacuucccauuuuuu

SEQ ID NO: 1034409 - RNA, 18 nt, Human
ucaccaugggaaguacag

SEQ ID NO: 1034410 - RNA, 22 nt, Human
ucagagaaugaaaacgaucaau

SEQ ID NO: 1034411 - RNA, 21 nt, Human
ucccaggaguacuagucaguu

SEQ ID NO: 1034412 - RNA, 22 nt, Human
uccuccaaaucauagacaacaa

SEQ ID NO: 1034413 - RNA, 20 nt, Human
uccuucucagaaacaccuua

SEQ ID NO: 1034414 - RNA, 19 nt, Human
ucucagaaacaccuuacau

SEQ ID NO: 1034415 - RNA, 24 nt, Human
ucucuccauaauuugcaaaaguug

SEQ ID NO: 1034416 - RNA, 19 nt, Human
ugaaguaugguuugaccaa

SEQ ID NO: 1034417 - RNA, 21 nt, Human
ugcuccuucuucuggguacca

SEQ ID NO: 1034418 - RNA, 21 nt, Human
uggauaaaaccgaauuacaaa

SEQ ID NO: 1034419 - RNA, 18 nt, Human
ugggaaguacagaggguc

SEQ ID NO: 1034420 - RNA, 22 nt, Human
uuaaagugaguugaucaagguc

SEQ ID NO: 1034421 - RNA, 24 nt, Human
uuauacucauuugacagaugagga

SEQ ID NO: 1034422 - RNA, 26 nt, Human
uuaugcaugugcuccucaaaaucacc

SEQ ID NO: 1034423 - RNA, 24 nt, Human
uucccauuuuuuuuaaaccugcag

SEQ ID NO: 1034424 - RNA, 18 nt, Human
uuccuggauaaaaccgaa

SEQ ID NO: 1034425 - RNA, 22 nt, Human
uucuggguaccagcccccaaua

SEQ ID NO: 1034426 - RNA, 24 nt, Human
uugacagaugaggaaucagagacc

SEQ ID NO: 1034427 - RNA, 23 nt, Human
uuuaaacauaaggaagaaaugag

SEQ ID NO: 1034428 - RNA, 19 nt, Human
uuugaaggucuugcccacu

SEQ ID NO: 1034429 - RNA, 20 nt, Human
aaaagcaaaacuccaucuca

SEQ ID NO: 1034430 - RNA, 19 nt, Human
aacacagacuuuauaguau

SEQ ID NO: 1034431 - RNA, 23 nt, Human
aacauauuucuaauaagaaagua

SEQ ID NO: 1034432 - RNA, 20 nt, Human
aacauggugaaacccugucu

SEQ ID NO: 1034433 - RNA, 21 nt, Human
aacauggugaaacccugucuc

SEQ ID NO: 1034434 - RNA, 23 nt, Human
aacauggugaaacccugucucua

SEQ ID NO: 1034435 - RNA, 19 nt, Human
aacugcaagauacacagga

SEQ ID NO: 1034436 - RNA, 18 nt, Human
aagaaugaugaccuagga

SEQ ID NO: 1034437 - RNA, 21 nt, Human
aagauacacaggaugcuguag

SEQ ID NO: 1034438 - RNA, 23 nt, Human
aaucgcuugaacccgggagaggg

SEQ ID NO: 1034439 - RNA, 20 nt, Human
acaaaagcaaaacuccaucu

SEQ ID NO: 1034440 - RNA, 24 nt, Human
acaaacauggugaaacccugucuc

SEQ ID NO: 1034441 - RNA, 30 nt, Human
acaugagaggccaggugcgguggcucacgg

SEQ ID NO: 1034442 - RNA, 22 nt, Human
acccugucucuacuaaacauaa

SEQ ID NO: 1034443 - RNA, 21 nt, Human
agaaaaacaugagaggccagg

SEQ ID NO: 1034444 - RNA, 22 nt, Human
agaaucgcuugaacccgggaga

SEQ ID NO: 1034445 - RNA, 24 nt, Human
agacugaggcaggagaaucgcuug

SEQ ID NO: 1034446 - RNA, 24 nt, Human
agagggagguugcagugagccgag

SEQ ID NO: 1034447 - RNA, 24 nt, Human
agauagaaagcaaaguguucagga

SEQ ID NO: 1034448 - RNA, 23 nt, Human
agaucaccugaggucaggaguuc

SEQ ID NO: 1034449 - RNA, 25 nt, Human
agaucaccugaggucaggaguucga

SEQ ID NO: 1034450 - RNA, 23 nt, Human
agccgggcgcgguggcaggagcc

SEQ ID NO: 1034451 - RNA, 24 nt, Human
agccugacaaacauggugaaaccc

SEQ ID NO: 1034452 - RNA, 23 nt, Human
agccugggugacaaaagcaaaac

SEQ ID NO: 1034453 - RNA, 24 nt, Human
agccuguagucccagcuacucggg

SEQ ID NO: 1034454 - RNA, 26 nt, Human
aggcagaucaccugaggucaggaguu

SEQ ID NO: 1034455 - RNA, 24 nt, Human
aggcaggagaaucgcuugaacccg

SEQ ID NO: 1034456 - RNA, 22 nt, Human
aggcaggcagaucaccugaggu

SEQ ID NO: 1034457 - RNA, 26 nt, Human
aggcaggcagaucaccugaggucagg

SEQ ID NO: 1034458 - RNA, 19 nt, Human
agggagguugcagugagcc

SEQ ID NO: 1034459 - RNA, 21 nt, Human
aggugcgguggcucacgccug

SEQ ID NO: 1034460 - RNA, 24 nt, Human
aggugcgguggcucacgccuguaa

SEQ ID NO: 1034461 - RNA, 21 nt, Human
aucaccugaggucaggaguuc

SEQ ID NO: 1034462 - RNA, 24 nt, Human
aucaccugaggucaggaguucgag

SEQ ID NO: 1034463 - RNA, 24 nt, Human
aucgcgccauugcacuccagccug

SEQ ID NO: 1034464 - RNA, 20 nt, Human
augaaggguacuauaccaac

SEQ ID NO: 1034465 - RNA, 21 nt, Human
auugcacuccagccuggguga

SEQ ID NO: 1034466 - RNA, 18 nt, Human
caaaacuccaucucaaaa

SEQ ID NO: 1034467 - RNA, 23 nt, Human
caccugaggucaggaguucgaga

SEQ ID NO: 1034468 - RNA, 24 nt, Human
cacgccuguaaucccagcacuuug

SEQ ID NO: 1034469 - RNA, 18 nt, Human
cacuccagccugggugac

SEQ ID NO: 1034470 - RNA, 19 nt, Human
cacuccagccugggugaca

SEQ ID NO: 1034471 - RNA, 24 nt, Human
cagaucaccugaggucaggaguuc

SEQ ID NO: 1034472 - RNA, 21 nt, Human
cagcacuuugggagggcgagg

SEQ ID NO: 1034473 - RNA, 24 nt, Human
cagcacuuugggagggcgaggcag

SEQ ID NO: 1034474 - RNA, 24 nt, Human
caggcagaucaccugaggucagga

SEQ ID NO: 1034475 - RNA, 24 nt, Human
cagguggaggggaugaacuccauu

SEQ ID NO: 1034476 - RNA, 21 nt, Human
cauucauuccagcugugcagu

SEQ ID NO: 1034477 - RNA, 19 nt, Human
cauugcacuccagccuggg

SEQ ID NO: 1034478 - RNA, 21 nt, Human
cauugcacuccagccugggug

SEQ ID NO: 1034479 - RNA, 22 nt, Human
cauugcacuccagccuggguga

SEQ ID NO: 1034480 - RNA, 24 nt, Human
cauugcacuccagccugggugaca

SEQ ID NO: 1034481 - RNA, 25 nt, Human
cauugcacuccagccugggugacaa

SEQ ID NO: 1034482 - RNA, 20 nt, Human
ccauugcacuccagccuggg

SEQ ID NO: 1034483 - RNA, 21 nt, Human
ccauugcacuccagccugggu

SEQ ID NO: 1034484 - RNA, 21 nt, Human
ccauugcacuccagccugggu

SEQ ID NO: 1034485 - RNA, 22 nt, Human
ccauugcacuccagccugggug

SEQ ID NO: 1034486 - RNA, 23 nt, Human
ccauugcacuccagccuggguga

SEQ ID NO: 1034487 - RNA, 24 nt, Human
ccauugcacuccagccugggugac

SEQ ID NO: 1034488 - RNA, 21 nt, Human
cccgggagagggagguugcag

SEQ ID NO: 1034489 - RNA, 22 nt, Human
ccugacaaacauggugaaaccc

SEQ ID NO: 1034490 - RNA, 24 nt, Human
ccugacaaacauggugaaacccug

SEQ ID NO: 1034491 - RNA, 25 nt, Human
ccugggugacaaaagcaaaacucca

SEQ ID NO: 1034492 - RNA, 19 nt, Human
ccuguagucccagcuacuc

SEQ ID NO: 1034493 - RNA, 21 nt, Human
ccuguagucccagcuacucgg

SEQ ID NO: 1034494 - RNA, 22 nt, Human
ccuguagucccagcuacucggg

SEQ ID NO: 1034495 - RNA, 20 nt, Human
cgaggcaggcagaucaccug

SEQ ID NO: 1034496 - RNA, 26 nt, Human
cgccauugcacuccagccugggugac

SEQ ID NO: 1034497 - RNA, 24 nt, Human
cgccuguaaucccagcacuuuggg

SEQ ID NO: 1034498 - RNA, 22 nt, Human
cucacgccuguaaucccagcac

SEQ ID NO: 1034499 - RNA, 24 nt, Human
cucacgccuguaaucccagcacuu

SEQ ID NO: 1034500 - RNA, 21 nt, Human
cuccauucauuccagcugugc

SEQ ID NO: 1034501 - RNA, 24 nt, Human
cugacaaacauggugaaacccugu

SEQ ID NO: 1034502 - RNA, 21 nt, Human
cugcgcccuccgcaucucggc

SEQ ID NO: 1034503 - RNA, 22 nt, Human
cuugaacccgggagagggaggu

SEQ ID NO: 1034504 - RNA, 18 nt, Human
gaccacagcaggcauuca

SEQ ID NO: 1034505 - RNA, 19 nt, Human
gacccuuaagaucagacca

SEQ ID NO: 1034506 - RNA, 18 nt, Human
gagaggccaggugcggug

SEQ ID NO: 1034507 - RNA, 21 nt, Human
gagagggagguugcagugagc

SEQ ID NO: 1034508 - RNA, 23 nt, Human
gagaucgcgccauugcacuccag

SEQ ID NO: 1034509 - RNA, 25 nt, Human
gaggcaggcagaucaccugagguca

SEQ ID NO: 1034510 - RNA, 23 nt, Human
gagguugcagugagccgagaucg

SEQ ID NO: 1034511 - RNA, 24 nt, Human
gaucaccugaggucaggaguucga

SEQ ID NO: 1034512 - RNA, 19 nt, Human
gccauugcacuccagccug

SEQ ID NO: 1034513 - RNA, 24 nt, Human
gccauugcacuccagccuggguga

SEQ ID NO: 1034514 - RNA, 18 nt, Human
gcuguaggccugauuucc

SEQ ID NO: 1034515 - RNA, 19 nt, Human
ggacaccugaauuaugucg

SEQ ID NO: 1034516 - RNA, 22 nt, Human
ggagggcagaacuuaagaauga

SEQ ID NO: 1034517 - RNA, 21 nt, Human
ggagggcgaggcaggcagauc

SEQ ID NO: 1034518 - RNA, 20 nt, Human
ggagguugcagugagccgag

SEQ ID NO: 1034519 - RNA, 22 nt, Human
ggagguugcagugagccgagau

SEQ ID NO: 1034520 - RNA, 24 nt, Human
ggagguugcagugagccgagaucg

SEQ ID NO: 1034521 - RNA, 21 nt, Human
ggcucacgccuguaaucccag

SEQ ID NO: 1034522 - RNA, 23 nt, Human
gguggcaggagccuguaguccca

SEQ ID NO: 1034523 - RNA, 23 nt, Human
gguggcucacgccuguaauccca

SEQ ID NO: 1034524 - RNA, 24 nt, Human
gguggcucacgccuguaaucccag

SEQ ID NO: 1034525 - RNA, 21 nt, Human
gugaaacccugucucuacuaa

SEQ ID NO: 1034526 - RNA, 21 nt, Human
gugacaaaagcaaaacuccau

SEQ ID NO: 1034527 - RNA, 23 nt, Human
guggcucacgccuguaaucccag

SEQ ID NO: 1034528 - RNA, 19 nt, Human
guugcagugagccgagauc

SEQ ID NO: 1034529 - RNA, 20 nt, Human
uaaaauaccaaagcuuguga

SEQ ID NO: 1034530 - RNA, 18 nt, Human
uaagccugacaaacaugg

SEQ ID NO: 1034531 - RNA, 18 nt, Human
uaaguuaccaaaagcagc

SEQ ID NO: 1034532 - RNA, 20 nt, Human
uacuucauuuuuccuuauga

SEQ ID NO: 1034533 - RNA, 20 nt, Human
uagacccuuaagaucagacc

SEQ ID NO: 1034534 - RNA, 22 nt, Human
uauagaaaaacaugagaggcca

SEQ ID NO: 1034535 - RNA, 24 nt, Human
ucaggaugcuguguggcuucucuu

SEQ ID NO: 1034536 - RNA, 21 nt, Human
ucccaacugcaagauacacag

SEQ ID NO: 1034537 - RNA, 19 nt, Human
uccugggcucauaccccgg

SEQ ID NO: 1034538 - RNA, 23 nt, Human
ucgcgccauugcacuccagccug

SEQ ID NO: 1034539 - RNA, 24 nt, Human
ucgcuugaacccgggagagggagg

SEQ ID NO: 1034540 - RNA, 18 nt, Human
ucuccugggcucauaccc

SEQ ID NO: 1034541 - RNA, 27 nt, Human
ucuccugggcucauaccccggauucau

SEQ ID NO: 1034542 - RNA, 21 nt, Human
ucucuacuaaacauaaaaaaa

SEQ ID NO: 1034543 - RNA, 24 nt, Human
ugacaaacauggugaaacccuguc

SEQ ID NO: 1034544 - RNA, 23 nt, Human
ugacacugaggcacaaaggccug

SEQ ID NO: 1034545 - RNA, 22 nt, Human
ugagccgagaucgcgccauugc

SEQ ID NO: 1034546 - RNA, 20 nt, Human
ugaggcaggagaaucgcuug

SEQ ID NO: 1034547 - RNA, 24 nt, Human
ugaggcaggagaaucgcuugaacc

SEQ ID NO: 1034548 - RNA, 25 nt, Human
ugaggcaggagaaucgcuugaaccc

SEQ ID NO: 1034549 - RNA, 21 nt, Human
ugcacuccagccugggugaca

SEQ ID NO: 1034550 - RNA, 21 nt, Human
ugcuuauagaaaaacaugaga

SEQ ID NO: 1034551 - RNA, 24 nt, Human
uggcucacgccuguaaucccagca

SEQ ID NO: 1034552 - RNA, 18 nt, Human
ugggacaucugcgcccuc

SEQ ID NO: 1034553 - RNA, 24 nt, Human
ugggagggcgaggcaggcagauca

SEQ ID NO: 1034554 - RNA, 21 nt, Human
uguaaagcuuuuagcaucucu

SEQ ID NO: 1034555 - RNA, 20 nt, Human
uuaaaauaccaaagcuugug

SEQ ID NO: 1034556 - RNA, 22 nt, Human
uuauaguauguuuaaaaauccc

SEQ ID NO: 1034557 - RNA, 18 nt, Human
uugacacugaggcacaaa

SEQ ID NO: 1034558 - RNA, 24 nt, Human
uugacacugaggcacaaaggccug

SEQ ID NO: 1034559 - RNA, 18 nt, Human
uugcagugagccgagauc

SEQ ID NO: 1034560 - RNA, 20 nt, Human
uugcagugagccgagaucgc

SEQ ID NO: 1034561 - RNA, 22 nt, Human
uugcagugagccgagaucgcgc

SEQ ID NO: 1034562 - RNA, 24 nt, Human
uuggcagaagagauagaaagcaaa

SEQ ID NO: 1034563 - RNA, 26 nt, Human
uuuuuuuuuaaaauaccaaagcuugu

SEQ ID NO: 1034564 - RNA, 20 nt, Human
aagacgcccgcaccugaggg

SEQ ID NO: 1034565 - RNA, 24 nt, Human
aggcaaauauacauucuuguuccc

SEQ ID NO: 1034566 - RNA, 18 nt, Human
caccaaguuggcagugac

SEQ ID NO: 1034567 - RNA, 21 nt, Human
cagugacaguggcacacagaa

SEQ ID NO: 1034568 - RNA, 21 nt, Human
caguugauaugccuccaagau

SEQ ID NO: 1034569 - RNA, 23 nt, Human
caguugauaugccuccaagaucu

SEQ ID NO: 1034570 - RNA, 19 nt, Human
ccagccagucagaacggca

SEQ ID NO: 1034571 - RNA, 25 nt, Human
ccuccgcagaaugaggaggagcgaa

SEQ ID NO: 1034572 - RNA, 21 nt, Human
cucacagcaaacgccuacacc

SEQ ID NO: 1034573 - RNA, 24 nt, Human
cugcgaggccgacucgcaagacgc

SEQ ID NO: 1034574 - RNA, 22 nt, Human
gacucgcaagacgcccgcaccu

SEQ ID NO: 1034575 - RNA, 24 nt, Human
gcagaaugaggaggagcgaaguac

SEQ ID NO: 1034576 - RNA, 23 nt, Human
ggcaaauauacauucuuguuccc

SEQ ID NO: 1034577 - RNA, 22 nt, Human
ucacagcaaacgccuacaccaa

SEQ ID NO: 1034578 - RNA, 20 nt, Human
uccaagaucuaaacugaaga

SEQ ID NO: 1034579 - RNA, 18 nt, Human
ucccagggcccgcuucuc

SEQ ID NO: 1034580 - RNA, 19 nt, Human
uccgugcugcuuuccccuc

SEQ ID NO: 1034581 - RNA, 19 nt, Human
ugaagauacacaagcggug

SEQ ID NO: 1034582 - RNA, 22 nt, Human
ugauaugccuccaagaucuaaa

SEQ ID NO: 1034583 - RNA, 22 nt, Human
ugcagacaccgaagaaccugcu

SEQ ID NO: 1034584 - RNA, 23 nt, Human
ugcagacaccgaagaaccugcua

SEQ ID NO: 1034585 - RNA, 22 nt, Human
ugcagcuuccacagagcugcga

SEQ ID NO: 1034586 - RNA, 21 nt, Human
uuaaguaucugcuaaggugcc

SEQ ID NO: 1034587 - RNA, 23 nt, Human
uucacgcguucacaaucguuucc

SEQ ID NO: 1034588 - RNA, 22 nt, Human
uucccagggcccgcuucucagu

SEQ ID NO: 1034589 - RNA, 20 nt, Human
uuccccugcauucuccauuc

SEQ ID NO: 1034590 - RNA, 25 nt, Human
uugaugcugugacuuuuauucuaau

SEQ ID NO: 1034591 - RNA, 18 nt, Human
uuuccgcugccagucaca

SEQ ID NO: 1034592 - RNA, 20 nt, Human
agcggccgccgacuccagga

SEQ ID NO: 1034593 - RNA, 18 nt, Human
cccgcggcgggacccggg

SEQ ID NO: 1034594 - RNA, 20 nt, Human
ccggaaacuucgcagaccgc

SEQ ID NO: 1034595 - RNA, 21 nt, Human
cgcgaacccgcggcgggaccc

SEQ ID NO: 1034596 - RNA, 20 nt, Human
gaacccgcggcgggacccgg

SEQ ID NO: 1034597 - RNA, 23 nt, Human
gagcacaagcgcgaacccgcggc

SEQ ID NO: 1034598 - RNA, 18 nt, Human
gagcgcgagcacaagcgc

SEQ ID NO: 1034599 - RNA, 19 nt, Human
ucugggggcggggaccggg

SEQ ID NO: 1034600 - RNA, 22 nt, Human
ugggggcggggaccggguuggg

SEQ ID NO: 1034601 - RNA, 21 nt, Human
ugucugggggcggggaccggg

SEQ ID NO: 1034602 - RNA, 19 nt, Human
uugggcaacgagcgcgcgc

SEQ ID NO: 1034603 - RNA, 23 nt, Human
uuaacagcucuguuuucagcucc

SEQ ID NO: 1034604 - RNA, 19 nt, Human
aaguagaggcaggugagaa

SEQ ID NO: 1034605 - RNA, 19 nt, Human
aggcaggugagaaaggaag

SEQ ID NO: 1034606 - RNA, 23 nt, Human
caguugaucuccucgacugaucu

SEQ ID NO: 1034607 - RNA, 19 nt, Human
cugauuugaagacugacaa

SEQ ID NO: 1034608 - RNA, 22 nt, Human
gauccugauuuucucugauuug

SEQ ID NO: 1034609 - RNA, 19 nt, Human
uagaggcaggugagaaagg

SEQ ID NO: 1034610 - RNA, 20 nt, Human
aaaaaguaaaacaauugaaa

SEQ ID NO: 1034611 - RNA, 22 nt, Human
aaauuggaaauagugacaugua

SEQ ID NO: 1034612 - RNA, 21 nt, Human
aauaauugggcguggaagaaa

SEQ ID NO: 1034613 - RNA, 22 nt, Human
acugugcuugggauauuguguu

SEQ ID NO: 1034614 - RNA, 21 nt, Human
aggcugaaagaaaugcucuga

SEQ ID NO: 1034615 - RNA, 24 nt, Human
auguaaacugugcuugggauauug

SEQ ID NO: 1034616 - RNA, 18 nt, Human
caaagcaagaauaucacc

SEQ ID NO: 1034617 - RNA, 22 nt, Human
caggcugaaagaaaugcucuga

SEQ ID NO: 1034618 - RNA, 19 nt, Human
ccgcugucaaagcaagaau

SEQ ID NO: 1034619 - RNA, 21 nt, Human
cugcugccuccggaccgcugu

SEQ ID NO: 1034620 - RNA, 24 nt, Human
gaaaugcucugaagggaaagcuaa

SEQ ID NO: 1034621 - RNA, 24 nt, Human
gaagaaauugguucaggcucaaaa

SEQ ID NO: 1034622 - RNA, 18 nt, Human
gaauuugaaagacaggug

SEQ ID NO: 1034623 - RNA, 21 nt, Human
uaaaaaacaagugaaagggaa

SEQ ID NO: 1034624 - RNA, 18 nt, Human
uaauugggcguggaagaa

SEQ ID NO: 1034625 - RNA, 24 nt, Human
uauuguaaaaaacaagugaaaggg

SEQ ID NO: 1034626 - RNA, 23 nt, Human
ucgaggcagcuugaguuuucuuc

SEQ ID NO: 1034627 - RNA, 19 nt, Human
ucugaagguaggaaucaaa

SEQ ID NO: 1034628 - RNA, 19 nt, Human
ugaaacacaacuggaaaau

SEQ ID NO: 1034629 - RNA, 20 nt, Human
ugaagggaaagcuaagacau

SEQ ID NO: 1034630 - RNA, 19 nt, Human
ugcaacugggucugaaagg

SEQ ID NO: 1034631 - RNA, 22 nt, Human
ugcagaagauggugcaacuggg

SEQ ID NO: 1034632 - RNA, 19 nt, Human
uggaagaaauugguucagg

SEQ ID NO: 1034633 - RNA, 23 nt, Human
uugaugaggacuauguuucuuuu

SEQ ID NO: 1034634 - RNA, 20 nt, Human
acaugacuuuagcacugaaa

SEQ ID NO: 1034635 - RNA, 25 nt, Human
ccaaaaugaagguccuuuaauucac

SEQ ID NO: 1034636 - RNA, 22 nt, Human
cucucaguuccuugacccccuu

SEQ ID NO: 1034637 - RNA, 22 nt, Human
uagcacugaaaacccaaaacau

SEQ ID NO: 1034638 - RNA, 24 nt, Human
uagcacugaaaacccaaaacauau

SEQ ID NO: 1034639 - RNA, 20 nt, Human
ucucucaguuccuugacccc

SEQ ID NO: 1034640 - RNA, 21 nt, Human
ugaguggugaauaauuuucuu

SEQ ID NO: 1034641 - RNA, 23 nt, Human
uuagcacugaaaacccaaaacau

SEQ ID NO: 1034642 - RNA, 24 nt, Human
uucuuaagccucuucucucaguuc

SEQ ID NO: 1034643 - RNA, 18 nt, Human
uuuuuuuuuuuuuuuuug

SEQ ID NO: 1034644 - RNA, 22 nt, Human
uuuuuuuuuuuuuuuuuuuggc

SEQ ID NO: 1034645 - RNA, 20 nt, Human
aguuccuaaaaugaguaaaa

SEQ ID NO: 1034646 - RNA, 24 nt, Human
caccuccaguaggauguccagcug

SEQ ID NO: 1034647 - RNA, 23 nt, Human
cagagauggauaaguuuagagca

SEQ ID NO: 1034648 - RNA, 23 nt, Human
cauagccuuccuccccaaacaga

SEQ ID NO: 1034649 - RNA, 25 nt, Human
ccauauugcuuccucugucccaagu

SEQ ID NO: 1034650 - RNA, 18 nt, Human
cucuugguuuugcauccc

SEQ ID NO: 1034651 - RNA, 23 nt, Human
cucuugguuuugcaucccuuauc

SEQ ID NO: 1034652 - RNA, 26 nt, Human
cuguguguggcacugguggugguguu

SEQ ID NO: 1034653 - RNA, 19 nt, Human
cuguuuuaaugaucucucc

SEQ ID NO: 1034654 - RNA, 21 nt, Human
cuuacauagccuuccucccca

SEQ ID NO: 1034655 - RNA, 22 nt, Human
gccuuccuccccaaacagauuc

SEQ ID NO: 1034656 - RNA, 19 nt, Human
gguguucacaugggugaaa

SEQ ID NO: 1034657 - RNA, 18 nt, Human
uaaaaugaguaaaacuua

SEQ ID NO: 1034658 - RNA, 20 nt, Human
uaaauuuauuuuccuuaguu

SEQ ID NO: 1034659 - RNA, 21 nt, Human
uauucugaguucagucucugu

SEQ ID NO: 1034660 - RNA, 18 nt, Human
ucccucaccuccaguagg

SEQ ID NO: 1034661 - RNA, 25 nt, Human
uccuccccaaacagauucuuuuaaa

SEQ ID NO: 1034662 - RNA, 23 nt, Human
uggcuggaaaaguaccugugagu

SEQ ID NO: 1034663 - RNA, 18 nt, Human
ugggaucugcugaucuag

SEQ ID NO: 1034664 - RNA, 22 nt, Human
ugguauagucauucuucaugaa

SEQ ID NO: 1034665 - RNA, 22 nt, Human
uguccuuacauagccuuccucc

SEQ ID NO: 1034666 - RNA, 22 nt, Human
uuaaugguaucagugauguuuu

SEQ ID NO: 1034667 - RNA, 20 nt, Human
uuaucaguugucauuguccu

SEQ ID NO: 1034668 - RNA, 22 nt, Human
uuccaguaauggacagagaugg

SEQ ID NO: 1034669 - RNA, 21 nt, Human
uuccuaaaaugaguaaaacuu

SEQ ID NO: 1034670 - RNA, 19 nt, Human
uugcuuccucugucccaag

SEQ ID NO: 1034671 - RNA, 20 nt, Human
uuuaaugaucucuccuaucu

SEQ ID NO: 1034672 - RNA, 25 nt, Human
aaacaacccaaaugucgaucaacaa

SEQ ID NO: 1034673 - RNA, 22 nt, Human
aaccuccaccuccugacgaccc

SEQ ID NO: 1034674 - RNA, 25 nt, Human
aagcaagaagacugcuauuaugauc

SEQ ID NO: 1034675 - RNA, 22 nt, Human
aagugaaauacgccagacagaa

SEQ ID NO: 1034676 - RNA, 21 nt, Human
acaucacauuuucucuaaacu

SEQ ID NO: 1034677 - RNA, 19 nt, Human
acccaggcuggaguguggu

SEQ ID NO: 1034678 - RNA, 23 nt, Human
acccaggcuggagugugguggug

SEQ ID NO: 1034679 - RNA, 20 nt, Human
agaaaaggacaaaugcugca

SEQ ID NO: 1034680 - RNA, 22 nt, Human
aggacaaaugcugcauguuccc

SEQ ID NO: 1034681 - RNA, 23 nt, Human
agugugguggugcaaucuuggcu

SEQ ID NO: 1034682 - RNA, 24 nt, Human
agugugguggugcaaucuuggcuc

SEQ ID NO: 1034683 - RNA, 19 nt, Human
augaucccacuaaguuuuc

SEQ ID NO: 1034684 - RNA, 24 nt, Human
augcauuucugggcugcacauguc

SEQ ID NO: 1034685 - RNA, 20 nt, Human
caacaaaugaauggauaaac

SEQ ID NO: 1034686 - RNA, 26 nt, Human
caaccuccaccuccugacgacccaaa

SEQ ID NO: 1034687 - RNA, 21 nt, Human
cacccaggcuggaguguggug

SEQ ID NO: 1034688 - RNA, 21 nt, Human
cacugcaaccuccaccuccug

SEQ ID NO: 1034689 - RNA, 21 nt, Human
cagucuuaaaaaugaaggaaa

SEQ ID NO: 1034690 - RNA, 24 nt, Human
ccaaaaggggaaacaacccaaaug

SEQ ID NO: 1034691 - RNA, 21 nt, Human
cuauucaaucaucaugcucag

SEQ ID NO: 1034692 - RNA, 26 nt, Human
cucacugcaaccuccaccuccugacg

SEQ ID NO: 1034693 - RNA, 21 nt, Human
cucgcucugucacccaggcug

SEQ ID NO: 1034694 - RNA, 24 nt, Human
cucgcucugucacccaggcuggag

SEQ ID NO: 1034695 - RNA, 20 nt, Human
cucugucacccaggcuggag

SEQ ID NO: 1034696 - RNA, 18 nt, Human
cugcaaccuccaccuccu

SEQ ID NO: 1034697 - RNA, 19 nt, Human
gaaaaggacaaaugcugca

SEQ ID NO: 1034698 - RNA, 23 nt, Human
gaauguuaaaaaugugccagaga

SEQ ID NO: 1034699 - RNA, 25 nt, Human
gcucugucacccaggcuggagugug

SEQ ID NO: 1034700 - RNA, 22 nt, Human
ggaauauuauucagucuuaaaa

SEQ ID NO: 1034701 - RNA, 21 nt, Human
ggacaaaugcugcauguuccc

SEQ ID NO: 1034702 - RNA, 19 nt, Human
ggacaggagcgaaugggga

SEQ ID NO: 1034703 - RNA, 19 nt, Human
ggauaaacaaaauguagua

SEQ ID NO: 1034704 - RNA, 24 nt, Human
gucucgcucugucacccaggcugg

SEQ ID NO: 1034705 - RNA, 19 nt, Human
gucuuaaaaaugaaggaaa

SEQ ID NO: 1034706 - RNA, 23 nt, Human
guuuucucucaaugagccugugg

SEQ ID NO: 1034707 - RNA, 22 nt, Human
uaaaauagucaaauucagaagg

SEQ ID NO: 1034708 - RNA, 20 nt, Human
uaagaggggaaguauccuua

SEQ ID NO: 1034709 - RNA, 22 nt, Human
uacaguagccaaaaggggaaac

SEQ ID NO: 1034710 - RNA, 21 nt, Human
uaccuaaaauagucaaauuca

SEQ ID NO: 1034711 - RNA, 18 nt, Human
uacgccagacagaaaagg

SEQ ID NO: 1034712 - RNA, 25 nt, Human
uauauuaauagaaaggguguauauc

SEQ ID NO: 1034713 - RNA, 22 nt, Human
ucacccaggcuggaguguggug

SEQ ID NO: 1034714 - RNA, 19 nt, Human
ucacugcaaccuccaccuc

SEQ ID NO: 1034715 - RNA, 20 nt, Human
ucacugcaaccuccaccucc

SEQ ID NO: 1034716 - RNA, 22 nt, Human
ucacugcaaccuccaccuccug

SEQ ID NO: 1034717 - RNA, 24 nt, Human
ucacugcaaccuccaccuccugac

SEQ ID NO: 1034718 - RNA, 24 nt, Human
ucacugcaaccuccaccuccugac

SEQ ID NO: 1034719 - RNA, 23 nt, Human
ucagaaggacagaaaauacaaug

SEQ ID NO: 1034720 - RNA, 22 nt, Human
ucagucuuaaaaaugaaggaaa

SEQ ID NO: 1034721 - RNA, 22 nt, Human
ucaucaugcucagcacuggaga

SEQ ID NO: 1034722 - RNA, 24 nt, Human
ucgcucugucacccaggcuggagu

SEQ ID NO: 1034723 - RNA, 19 nt, Human
ucucgcucugucacccagg

SEQ ID NO: 1034724 - RNA, 23 nt, Human
ucucgcucugucacccaggcugg

SEQ ID NO: 1034725 - RNA, 24 nt, Human
ucucgcucugucacccaggcugga

SEQ ID NO: 1034726 - RNA, 24 nt, Human
ucugucacccaggcuggagugugg

SEQ ID NO: 1034727 - RNA, 22 nt, Human
ugagauggagucucgcucuguc

SEQ ID NO: 1034728 - RNA, 24 nt, Human
ugaugaggguuucacaacauugua

SEQ ID NO: 1034729 - RNA, 21 nt, Human
ugccaugggccaaggacagga

SEQ ID NO: 1034730 - RNA, 23 nt, Human
ugccaugggccaaggacaggagc

SEQ ID NO: 1034731 - RNA, 24 nt, Human
uggagugugguggugcaaucuugg

SEQ ID NO: 1034732 - RNA, 23 nt, Human
ugugguggugcaaucuuggcuca

SEQ ID NO: 1034733 - RNA, 25 nt, Human
ugugguggugcaaucuuggcucaac

SEQ ID NO: 1034734 - RNA, 22 nt, Human
uucagucuuaaaaaugaaggaa

SEQ ID NO: 1034735 - RNA, 18 nt, Human
uuccuaagcaagaagacu

SEQ ID NO: 1034736 - RNA, 20 nt, Human
uuccuaagcaagaagacugc

SEQ ID NO: 1034737 - RNA, 24 nt, Human
uuuuuuuuuuugagauggagucuc

SEQ ID NO: 1034738 - RNA, 20 nt, Human
aaaaaaaagcaaaaguauac

SEQ ID NO: 1034739 - RNA, 22 nt, Human
aaaaaguaugauauugugagga

SEQ ID NO: 1034740 - RNA, 26 nt, Human
aacccauucaccccaaaccuuuccca

SEQ ID NO: 1034741 - RNA, 19 nt, Human
aacuguaaauuccucacca

SEQ ID NO: 1034742 - RNA, 22 nt, Human
aaggacaucacaaaaccaugaa

SEQ ID NO: 1034743 - RNA, 19 nt, Human
acaugugcaugcgugugua

SEQ ID NO: 1034744 - RNA, 21 nt, Human
accccaaaccuuucccaggac

SEQ ID NO: 1034745 - RNA, 18 nt, Human
agacaggaggacagcugg

SEQ ID NO: 1034746 - RNA, 19 nt, Human
agacaggaggacagcuggg

SEQ ID NO: 1034747 - RNA, 21 nt, Human
agcagagaaaaugggggaggg

SEQ ID NO: 1034748 - RNA, 18 nt, Human
aggacuccaaggcccugc

SEQ ID NO: 1034749 - RNA, 26 nt, Human
aggccuguuccuccagaggaaaccuu

SEQ ID NO: 1034750 - RNA, 24 nt, Human
augagacaggaggacagcugggag

SEQ ID NO: 1034751 - RNA, 21 nt, Human
auucaccccaaaccuuuccca

SEQ ID NO: 1034752 - RNA, 20 nt, Human
caacgggggguuugaggcca

SEQ ID NO: 1034753 - RNA, 23 nt, Human
caccaggacuuuacuugcccccu

SEQ ID NO: 1034754 - RNA, 27 nt, Human
caccccaaaccuuucccaggaccaaaa

SEQ ID NO: 1034755 - RNA, 27 nt, Human
cagcaggccuguuccuccagagcuguc

SEQ ID NO: 1034756 - RNA, 25 nt, Human
caggaccaaaaccagccucuagugu

SEQ ID NO: 1034757 - RNA, 24 nt, Human
cauaaaaauaggacgauuuccaca

SEQ ID NO: 1034758 - RNA, 23 nt, Human
caucacaaaaccaugaacaguuu

SEQ ID NO: 1034759 - RNA, 19 nt, Human
cauguacacacacaugugc

SEQ ID NO: 1034760 - RNA, 19 nt, Human
ccaaaacuguauucauacc

SEQ ID NO: 1034761 - RNA, 22 nt, Human
ccaacccauucaccccaaaccu

SEQ ID NO: 1034762 - RNA, 20 nt, Human
ccagaggccaaguccaugcu

SEQ ID NO: 1034763 - RNA, 20 nt, Human
ccaggaccaaaaccagccuc

SEQ ID NO: 1034764 - RNA, 21 nt, Human
ccaucugaauggagggauaag

SEQ ID NO: 1034765 - RNA, 24 nt, Human
ccccaaaccuuucccaggaccaaa

SEQ ID NO: 1034766 - RNA, 27 nt, Human
cccucaaccgaggcauaaaaauaggac

SEQ ID NO: 1034767 - RNA, 22 nt, Human
ccuccuagaagugaaagacaaa

SEQ ID NO: 1034768 - RNA, 23 nt, Human
cgaaauacaaucuccuccuagaa

SEQ ID NO: 1034769 - RNA, 19 nt, Human
cuccagaggccaaguccau

SEQ ID NO: 1034770 - RNA, 22 nt, Human
gaaaaugggggagggaagaucu

SEQ ID NO: 1034771 - RNA, 23 nt, Human
gagcgggagucugaaaucacugg

SEQ ID NO: 1034772 - RNA, 19 nt, Human
gcccaggacacacacagga

SEQ ID NO: 1034773 - RNA, 23 nt, Human
ggagcagagaaaaugggggaggg

SEQ ID NO: 1034774 - RNA, 22 nt, Human
ggcccaggacacacacaggaga

SEQ ID NO: 1034775 - RNA, 21 nt, Human
ggggagcagagaaaauggggg

SEQ ID NO: 1034776 - RNA, 25 nt, Human
ggggagcagagaaaaugggggaggg

SEQ ID NO: 1034777 - RNA, 18 nt, Human
uaaauaacacaaagucau

SEQ ID NO: 1034778 - RNA, 19 nt, Human
uaaauuccucaccaggacu

SEQ ID NO: 1034779 - RNA, 20 nt, Human
uaacacaaagucauguacac

SEQ ID NO: 1034780 - RNA, 19 nt, Human
uauacuuuuauucuugaug

SEQ ID NO: 1034781 - RNA, 25 nt, Human
uccaaaaguuucuaacuguaaauuc

SEQ ID NO: 1034782 - RNA, 24 nt, Human
uccaccgcugcugagaugaaggga

SEQ ID NO: 1034783 - RNA, 20 nt, Human
uccacuaagaacccugccca

SEQ ID NO: 1034784 - RNA, 21 nt, Human
ucccaaaacuguauucauacc

SEQ ID NO: 1034785 - RNA, 20 nt, Human
ucccaggaccaaaaccagcc

SEQ ID NO: 1034786 - RNA, 18 nt, Human
ucucaggacuccaaggcc

SEQ ID NO: 1034787 - RNA, 23 nt, Human
ucugccaggcuccaaauucucca

SEQ ID NO: 1034788 - RNA, 19 nt, Human
ugaaggacaucacaaaacc

SEQ ID NO: 1034789 - RNA, 24 nt, Human
ugaauggagggauaagaaaaggag

SEQ ID NO: 1034790 - RNA, 19 nt, Human
ugaccaaacaaugagacag

SEQ ID NO: 1034791 - RNA, 19 nt, Human
ugagacaggaggacagcug

SEQ ID NO: 1034792 - RNA, 19 nt, Human
ugaggacuggaguggagcg

SEQ ID NO: 1034793 - RNA, 21 nt, Human
ugcuaggugaaggcaguaagg

SEQ ID NO: 1034794 - RNA, 21 nt, Human
uggagcggggagcagagaaaa

SEQ ID NO: 1034795 - RNA, 18 nt, Human
uggagggauaagaaaagg

SEQ ID NO: 1034796 - RNA, 19 nt, Human
uggcccaggacacacacag

SEQ ID NO: 1034797 - RNA, 21 nt, Human
ugggggagggaagaucucagg

SEQ ID NO: 1034798 - RNA, 24 nt, Human
ugggggagggaagaucucaggacu

SEQ ID NO: 1034799 - RNA, 25 nt, Human
ugggggagggaagaucucaggacuc

SEQ ID NO: 1034800 - RNA, 27 nt, Human
uguacacacacaugugcaugcgugugg

SEQ ID NO: 1034801 - RNA, 23 nt, Human
ugugcaugcguguguacuuguga

SEQ ID NO: 1034802 - RNA, 18 nt, Human
ugugccagaggaaugauu

SEQ ID NO: 1034803 - RNA, 22 nt, Human
uuagcacgguuuggcuuuccuc

SEQ ID NO: 1034804 - RNA, 23 nt, Human
uuccaacccauucaccccaaacc

SEQ ID NO: 1034805 - RNA, 18 nt, Human
uugaccaaacaaugagac

SEQ ID NO: 1034806 - RNA, 26 nt, Human
aaucacucccaauggccucgucccac

SEQ ID NO: 1034807 - RNA, 19 nt, Human
acacagagaagccaaucuc

SEQ ID NO: 1034808 - RNA, 22 nt, Human
acacagagaagccaaucucgga

SEQ ID NO: 1034809 - RNA, 25 nt, Human
accaaauucaccacugguuucagug

SEQ ID NO: 1034810 - RNA, 27 nt, Human
agagaagccaaucucggaggccacagg

SEQ ID NO: 1034811 - RNA, 19 nt, Human
agccaguagggcugugcuc

SEQ ID NO: 1034812 - RNA, 20 nt, Human
agggacugagagcacagcag

SEQ ID NO: 1034813 - RNA, 29 nt, Human
auccuugcucugggaacaaaaucagaggg

SEQ ID NO: 1034814 - RNA, 22 nt, Human
caaggagcacucuuagccagua

SEQ ID NO: 1034815 - RNA, 24 nt, Human
cacagcaaggaggacacagagaag

SEQ ID NO: 1034816 - RNA, 22 nt, Human
caccacugguuucagugcucca

SEQ ID NO: 1034817 - RNA, 22 nt, Human
cacucuuagccaguagggcugu

SEQ ID NO: 1034818 - RNA, 19 nt, Human
cagcucagugccauccucc

SEQ ID NO: 1034819 - RNA, 20 nt, Human
caguguuucuagaucuuuua

SEQ ID NO: 1034820 - RNA, 23 nt, Human
ccacaggcugcgucccacuuccu

SEQ ID NO: 1034821 - RNA, 22 nt, Human
ccaguagggcugugcucccucu

SEQ ID NO: 1034822 - RNA, 20 nt, Human
cccaaaagaguccccuuggu

SEQ ID NO: 1034823 - RNA, 18 nt, Human
ccuugcucugggaacaaa

SEQ ID NO: 1034824 - RNA, 22 nt, Human
cgucacgggguccacagcaagg

SEQ ID NO: 1034825 - RNA, 18 nt, Human
cugcugccaucugcaucu

SEQ ID NO: 1034826 - RNA, 18 nt, Human
cuuagccaguagggcugu

SEQ ID NO: 1034827 - RNA, 19 nt, Human
cuucaaucacucccaaugg

SEQ ID NO: 1034828 - RNA, 24 nt, Human
gagucggucagggacugagagcac

SEQ ID NO: 1034829 - RNA, 20 nt, Human
ggccucgucccacaacacag

SEQ ID NO: 1034830 - RNA, 19 nt, Human
gggcugugcucccucuggg

SEQ ID NO: 1034831 - RNA, 20 nt, Human
uaccaaauucaccacugguu

SEQ ID NO: 1034832 - RNA, 24 nt, Human
uccacagcaaggaggacacagaga

SEQ ID NO: 1034833 - RNA, 20 nt, Human
ucccaaaagaguccccuugg

SEQ ID NO: 1034834 - RNA, 22 nt, Human
ucccaauggccucgucccacaa

SEQ ID NO: 1034835 - RNA, 19 nt, Human
uccucagcuucucccugug

SEQ ID NO: 1034836 - RNA, 20 nt, Human
uccuguggcugcgcugcugc

SEQ ID NO: 1034837 - RNA, 22 nt, Human
ugcccugaggggugcuuaaugc

SEQ ID NO: 1034838 - RNA, 23 nt, Human
uggccucgucccacaacacagcc

SEQ ID NO: 1034839 - RNA, 25 nt, Human
ugucugagcuggccgccccggggau

SEQ ID NO: 1034840 - RNA, 25 nt, Human
aaaaaaaugacauaauaaaguucuc

SEQ ID NO: 1034841 - RNA, 26 nt, Human
aaaaaaaugacauaauaaaguucuca

SEQ ID NO: 1034842 - RNA, 27 nt, Human
aacuggccucacauuauucacaaagau

SEQ ID NO: 1034843 - RNA, 26 nt, Human
aagaggagacaugcucauauuaagaa

SEQ ID NO: 1034844 - RNA, 24 nt, Human
acacaccacacacauauaauuuca

SEQ ID NO: 1034845 - RNA, 24 nt, Human
acagagugagacucugucuuagaa

SEQ ID NO: 1034846 - RNA, 24 nt, Human
acauauuuauucacacaccacaca

SEQ ID NO: 1034847 - RNA, 22 nt, Human
accagaagugggccuucucaga

SEQ ID NO: 1034848 - RNA, 24 nt, Human
acugcacuccagcuggcgcgacag

SEQ ID NO: 1034849 - RNA, 20 nt, Human
agugauucuugugcccagga

SEQ ID NO: 1034850 - RNA, 24 nt, Human
agugcaguggcacaaccucggcuc

SEQ ID NO: 1034851 - RNA, 21 nt, Human
auaaaaagcugcuagucuaca

SEQ ID NO: 1034852 - RNA, 23 nt, Human
aucauggcacugcacuccagcug

SEQ ID NO: 1034853 - RNA, 20 nt, Human
auccauaaccagccuuccuu

SEQ ID NO: 1034854 - RNA, 22 nt, Human
auucacacaccacacacauaua

SEQ ID NO: 1034855 - RNA, 19 nt, Human
caaagcucaacggcuucuc

SEQ ID NO: 1034856 - RNA, 22 nt, Human
caagugauucuugugcccagga

SEQ ID NO: 1034857 - RNA, 19 nt, Human
cacacaccacacacauaua

SEQ ID NO: 1034858 - RNA, 24 nt, Human
cacaccacacacauauaauuucau

SEQ ID NO: 1034859 - RNA, 18 nt, Human
cacauaggcgcugcuacc

SEQ ID NO: 1034860 - RNA, 23 nt, Human
cacuccagcuggcgcgacagagu

SEQ ID NO: 1034861 - RNA, 18 nt, Human
cacugcacuccagcuggc

SEQ ID NO: 1034862 - RNA, 22 nt, Human
cacugcacuccagcuggcgcga

SEQ ID NO: 1034863 - RNA, 24 nt, Human
cacugcacuccagcuggcgcgaca

SEQ ID NO: 1034864 - RNA, 21 nt, Human
caguggcacaaccucggcuca

SEQ ID NO: 1034865 - RNA, 23 nt, Human
cauaauaaaguucucagauggga

SEQ ID NO: 1034866 - RNA, 19 nt, Human
cauagagaaaagggacaga

SEQ ID NO: 1034867 - RNA, 20 nt, Human
cccaggcugcagugcagugg

SEQ ID NO: 1034868 - RNA, 21 nt, Human
ccucgccugcugucggccaga

SEQ ID NO: 1034869 - RNA, 27 nt, Human
ccucggcucacucugccuccuggguuc

SEQ ID NO: 1034870 - RNA, 19 nt, Human
cuaauggccacagauuuuc

SEQ ID NO: 1034871 - RNA, 20 nt, Human
cuccuggguucaagugauuc

SEQ ID NO: 1034872 - RNA, 21 nt, Human
cuccuggguucaagugauucu

SEQ ID NO: 1034873 - RNA, 23 nt, Human
cugccuccuggguucaagugauu

SEQ ID NO: 1034874 - RNA, 21 nt, Human
cuucacauaggcgcugcuacc

SEQ ID NO: 1034875 - RNA, 19 nt, Human
cuuuaaaugaguucugacu

SEQ ID NO: 1034876 - RNA, 22 nt, Human
cuuuaaggcauaugccaucugu

SEQ ID NO: 1034877 - RNA, 24 nt, Human
gacagagugagacucugucuuaga

SEQ ID NO: 1034878 - RNA, 23 nt, Human
gagaucauggcacugcacuccag

SEQ ID NO: 1034879 - RNA, 24 nt, Human
gcacuccagcuggcgcgacagagu

SEQ ID NO: 1034880 - RNA, 19 nt, Human
gcacugcacuccagcuggc

SEQ ID NO: 1034881 - RNA, 22 nt, Human
gcgacagagugagacucugucu

SEQ ID NO: 1034882 - RNA, 19 nt, Human
gcucaacggcuucucauca

SEQ ID NO: 1034883 - RNA, 19 nt, Human
gcucacucugccuccuggg

SEQ ID NO: 1034884 - RNA, 24 nt, Human
ggagguuacagcgaccugagauca

SEQ ID NO: 1034885 - RNA, 18 nt, Human
gggaaccuggaugacuac

SEQ ID NO: 1034886 - RNA, 20 nt, Human
uaaagaauauucaacacaca

SEQ ID NO: 1034887 - RNA, 33 nt, Human
uaaauguaaagaauauucaacacacauucuggu

SEQ ID NO: 1034888 - RNA, 21 nt, Human
uaacuucacauaggcgcugcu

SEQ ID NO: 1034889 - RNA, 24 nt, Human
uacaaaaauauugugggaggggga

SEQ ID NO: 1034890 - RNA, 23 nt, Human
uacaacagccccauaacuuuagc

SEQ ID NO: 1034891 - RNA, 18 nt, Human
uaccacaguuaaagcauu

SEQ ID NO: 1034892 - RNA, 21 nt, Human
uagcuaacuucacauaggcgc

SEQ ID NO: 1034893 - RNA, 24 nt, Human
uagcuaacuucacauaggcgcugc

SEQ ID NO: 1034894 - RNA, 24 nt, Human
uauucaacacacauucugccaagu

SEQ ID NO: 1034895 - RNA, 24 nt, Human
uauucacacaccacacacauauag

SEQ ID NO: 1034896 - RNA, 19 nt, Human
uauuuuuuuugagacagag

SEQ ID NO: 1034897 - RNA, 24 nt, Human
uccagcuggcgcgacagagugaga

SEQ ID NO: 1034898 - RNA, 21 nt, Human
uccuggguucaagugauucuu

SEQ ID NO: 1034899 - RNA, 22 nt, Human
uccuggguucaagugauucuug

SEQ ID NO: 1034900 - RNA, 22 nt, Human
ucggcucacucugccuccuggg

SEQ ID NO: 1034901 - RNA, 24 nt, Human
ucuguagcccaggcugcagugcag

SEQ ID NO: 1034902 - RNA, 22 nt, Human
ucuugcucucuguagcccaggc

SEQ ID NO: 1034903 - RNA, 22 nt, Human
ugaaaagaggagacaugcucau

SEQ ID NO: 1034904 - RNA, 19 nt, Human
ugaauauccauaaccagcc

SEQ ID NO: 1034905 - RNA, 22 nt, Human
ugaauauccauaaccagccuuc

SEQ ID NO: 1034906 - RNA, 23 nt, Human
ugacauaauaaaguucucagaug

SEQ ID NO: 1034907 - RNA, 20 nt, Human
ugagacagagucuugcucuc

SEQ ID NO: 1034908 - RNA, 23 nt, Human
ugagacagagucuugcucucugu

SEQ ID NO: 1034909 - RNA, 20 nt, Human
ugauuuuggauuuuuacgug

SEQ ID NO: 1034910 - RNA, 24 nt, Human
ugcagugcaguggcacaaccucgg

SEQ ID NO: 1034911 - RNA, 20 nt, Human
ugcaguggcacaaccucggc

SEQ ID NO: 1034912 - RNA, 20 nt, Human
ugccagguuugauaaaaagc

SEQ ID NO: 1034913 - RNA, 18 nt, Human
uggcacaaccucggcuca

SEQ ID NO: 1034914 - RNA, 22 nt, Human
uggcauagagaaaagggacaga

SEQ ID NO: 1034915 - RNA, 23 nt, Human
uggcauagagaaaagggacagga

SEQ ID NO: 1034916 - RNA, 21 nt, Human
uggcgcgacagagugagacuc

SEQ ID NO: 1034917 - RNA, 22 nt, Human
uggcgcgacagagugagacucu

SEQ ID NO: 1034918 - RNA, 21 nt, Human
uguacauuguuugaauguccc

SEQ ID NO: 1034919 - RNA, 23 nt, Human
ugucucaauaccacaguuaaagc

SEQ ID NO: 1034920 - RNA, 23 nt, Human
ugucuucaaccucauuuugauuu

SEQ ID NO: 1034921 - RNA, 18 nt, Human
uuaaaagcuuccauuucc

SEQ ID NO: 1034922 - RNA, 22 nt, Human
uucaagugauucuugugcccag

SEQ ID NO: 1034923 - RNA, 21 nt, Human
uucacacaccacacacauaua

SEQ ID NO: 1034924 - RNA, 26 nt, Human
uucacacaccacacacauauaauuuc

SEQ ID NO: 1034925 - RNA, 22 nt, Human
uuuauucacacaccacacacau

SEQ ID NO: 1034926 - RNA, 23 nt, Human
cacuuuuaucucagcagcuaaag

SEQ ID NO: 1034927 - RNA, 21 nt, Human
cuaaagcuuucccuaagacaa

SEQ ID NO: 1034928 - RNA, 25 nt, Human
cuaaagcuuucccuaagacaaccaa

SEQ ID NO: 1034929 - RNA, 22 nt, Human
ucagcagcuaaagcuuucccua

SEQ ID NO: 1034930 - RNA, 26 nt, Human
ucagcagcuaaagcuuucccuaagac

SEQ ID NO: 1034931 - RNA, 22 nt, Human
ucccuaagacaaccaauuuccc

SEQ ID NO: 1034932 - RNA, 24 nt, Human
ucccugcuacaaugcucugguacc

SEQ ID NO: 1034933 - RNA, 20 nt, Human
aaaugguccugcaaucuuaa

SEQ ID NO: 1034934 - RNA, 20 nt, Human
aaccacuggaagaauuugaa

SEQ ID NO: 1034935 - RNA, 20 nt, Human
aauaaguggggagaagagaa

SEQ ID NO: 1034936 - RNA, 18 nt, Human
acacaggccacacucgac

SEQ ID NO: 1034937 - RNA, 22 nt, Human
acagagagacagcauaacuaca

SEQ ID NO: 1034938 - RNA, 19 nt, Human
accgcuucccagccagucc

SEQ ID NO: 1034939 - RNA, 22 nt, Human
agaacaacauucccauggucag

SEQ ID NO: 1034940 - RNA, 18 nt, Human
aguaacuuaccauacuga

SEQ ID NO: 1034941 - RNA, 25 nt, Human
augauaaucaagcuuaaaauguauc

SEQ ID NO: 1034942 - RNA, 20 nt, Human
caaaguaguuugaauagggc

SEQ ID NO: 1034943 - RNA, 20 nt, Human
caaauagaggacugccuaca

SEQ ID NO: 1034944 - RNA, 20 nt, Human
caaguuuuugucccccagaa

SEQ ID NO: 1034945 - RNA, 21 nt, Human
cacccccaaaauuuuaauacc

SEQ ID NO: 1034946 - RNA, 20 nt, Human
cagcagcaagaacaacauuc

SEQ ID NO: 1034947 - RNA, 24 nt, Human
cagcagcaagaacaacauucccau

SEQ ID NO: 1034948 - RNA, 18 nt, Human
ccauacugaguaagcauc

SEQ ID NO: 1034949 - RNA, 20 nt, Human
ccaugaccuuuaagguucug

SEQ ID NO: 1034950 - RNA, 19 nt, Human
cccaaaauuuuaauaccac

SEQ ID NO: 1034951 - RNA, 21 nt, Human
cccaugaugaaaaauuagggc

SEQ ID NO: 1034952 - RNA, 19 nt, Human
ccuagauuuuaacaacaac

SEQ ID NO: 1034953 - RNA, 20 nt, Human
cuccauaguuugguaccgca

SEQ ID NO: 1034954 - RNA, 23 nt, Human
cucgaccgaccgcuucccagcca

SEQ ID NO: 1034955 - RNA, 22 nt, Human
cuuuuuuucuggcaaguaacuu

SEQ ID NO: 1034956 - RNA, 20 nt, Human
gaccgcuucccagccagucc

SEQ ID NO: 1034957 - RNA, 23 nt, Human
gaccgcuucccagccaguccccc

SEQ ID NO: 1034958 - RNA, 19 nt, Human
gcuuaacgcugacuacuga

SEQ ID NO: 1034959 - RNA, 18 nt, Human
ggaagaauuugaaagaaa

SEQ ID NO: 1034960 - RNA, 21 nt, Human
gucagcuuccacccuuuuauu

SEQ ID NO: 1034961 - RNA, 18 nt, Human
uaaacuaaaucuagguca

SEQ ID NO: 1034962 - RNA, 19 nt, Human
uaaagcacccaugaugaaa

SEQ ID NO: 1034963 - RNA, 25 nt, Human
uaaauaucuuuuaauguaaaguuuu

SEQ ID NO: 1034964 - RNA, 20 nt, Human
uaacaacaacaguuuccuua

SEQ ID NO: 1034965 - RNA, 23 nt, Human
uaaggagucuuuuuacaauccua

SEQ ID NO: 1034966 - RNA, 20 nt, Human
uacaaugugcuaacuaaaau

SEQ ID NO: 1034967 - RNA, 24 nt, Human
uacacagcagcaagaacaacauuc

SEQ ID NO: 1034968 - RNA, 21 nt, Human
uacuuguuuauauugauccag

SEQ ID NO: 1034969 - RNA, 22 nt, Human
uagauuuuaacaacaacaguuu

SEQ ID NO: 1034970 - RNA, 22 nt, Human
uauguucacggcaaacugccau

SEQ ID NO: 1034971 - RNA, 20 nt, Human
ucaaccacccccaaaauuuu

SEQ ID NO: 1034972 - RNA, 24 nt, Human
ucacaaucaugaagcauaucuguu

SEQ ID NO: 1034973 - RNA, 19 nt, Human
ucacuuccaguguuaucau

SEQ ID NO: 1034974 - RNA, 25 nt, Human
ucagugacuucuucuacaaauucau

SEQ ID NO: 1034975 - RNA, 22 nt, Human
uccaaaacaguuuaauacucaa

SEQ ID NO: 1034976 - RNA, 23 nt, Human
uccacacaggccacacucgaccg

SEQ ID NO: 1034977 - RNA, 19 nt, Human
ugaacugaauuaacagaug

SEQ ID NO: 1034978 - RNA, 18 nt, Human
ugaaguaagcacuguucc

SEQ ID NO: 1034979 - RNA, 22 nt, Human
ugcgaguccacacaggccacac

SEQ ID NO: 1034980 - RNA, 18 nt, Human
ugggaccauaaaaauggu

SEQ ID NO: 1034981 - RNA, 20 nt, Human
ugucauaugauaaucaagcu

SEQ ID NO: 1034982 - RNA, 23 nt, Human
ugucuggagguuuaggucauggg

SEQ ID NO: 1034983 - RNA, 21 nt, Human
uuaacaacaacaguuuccuua

SEQ ID NO: 1034984 - RNA, 21 nt, Human
uuuacaauccuaaucaaccac

SEQ ID NO: 1034985 - RNA, 23 nt, Human
uuuuuuuuuaaccaucacuuccu

SEQ ID NO: 1034986 - RNA, 18 nt, Human
aaccuggucgauggaacc

SEQ ID NO: 1034987 - RNA, 24 nt, Human
acacaccugcuagccccuuccccu

SEQ ID NO: 1034988 - RNA, 19 nt, Human
acccagaagccucaggccu

SEQ ID NO: 1034989 - RNA, 19 nt, Human
acugaagacauuggggacc

SEQ ID NO: 1034990 - RNA, 23 nt, Human
auggaacccucuguuuacacacc

SEQ ID NO: 1034991 - RNA, 21 nt, Human
caccaggacccagaagccuca

SEQ ID NO: 1034992 - RNA, 24 nt, Human
cagccaggagcccccuccuguggc

SEQ ID NO: 1034993 - RNA, 22 nt, Human
caggagcccccuccuguggccu

SEQ ID NO: 1034994 - RNA, 21 nt, Human
cccaagagggggccccccacu

SEQ ID NO: 1034995 - RNA, 19 nt, Human
cccagaagccucaggccuc

SEQ ID NO: 1034996 - RNA, 20 nt, Human
cccagaagccucaggccucu

SEQ ID NO: 1034997 - RNA, 21 nt, Human
cccgucaccaggacccagaag

SEQ ID NO: 1034998 - RNA, 22 nt, Human
cccgucaccaggacccagaagc

SEQ ID NO: 1034999 - RNA, 22 nt, Human
ccggccagccucaggccagcca

SEQ ID NO: 1035000 - RNA, 22 nt, Human
ccucaggccagccaggagcccc

SEQ ID NO: 1035001 - RNA, 22 nt, Human
ccucccagaggccgagucccug

SEQ ID NO: 1035002 - RNA, 23 nt, Human
ccuuccccuccggccagccucag

SEQ ID NO: 1035003 - RNA, 22 nt, Human
cugcuauggcaucaccagaccc

SEQ ID NO: 1035004 - RNA, 18 nt, Human
gacccagaagccucaggc

SEQ ID NO: 1035005 - RNA, 19 nt, Human
gccagccucaggccagccg

SEQ ID NO: 1035006 - RNA, 19 nt, Human
gcgugcaggggggcugagc

SEQ ID NO: 1035007 - RNA, 20 nt, Human
ggagcccccuccuguggccu

SEQ ID NO: 1035008 - RNA, 21 nt, Human
ggccgagucccugccgcagcc

SEQ ID NO: 1035009 - RNA, 24 nt, Human
gugcaggggggcugagcugggggc

SEQ ID NO: 1035010 - RNA, 20 nt, Human
guggccuccgagcacccucc

SEQ ID NO: 1035011 - RNA, 19 nt, Human
uauggcaucaccagacccc

SEQ ID NO: 1035012 - RNA, 18 nt, Human
ucaggccucuagacugcu

SEQ ID NO: 1035013 - RNA, 22 nt, Human
ucccagaggccgagucccugcc

SEQ ID NO: 1035014 - RNA, 20 nt, Human
ugagcugggggcacaagugg

SEQ ID NO: 1035015 - RNA, 22 nt, Human
ugagcugggggcacaagugggg

SEQ ID NO: 1035016 - RNA, 24 nt, Human
ugagcugggggcacaagugggggc

SEQ ID NO: 1035017 - RNA, 26 nt, Human
ugccgcagcccuaggcgccgcggugg

SEQ ID NO: 1035018 - RNA, 20 nt, Human
uggccuccgagcacccuccu

SEQ ID NO: 1035019 - RNA, 24 nt, Human
ugggcuccggggcccaagcaaccu

SEQ ID NO: 1035020 - RNA, 21 nt, Human
ugggggcacaagugggggcga

SEQ ID NO: 1035021 - RNA, 23 nt, Human
aggaaaauccaaucacagaaaug

SEQ ID NO: 1035022 - RNA, 24 nt, Human
gaaaauccaaucacagaaauguca

SEQ ID NO: 1035023 - RNA, 21 nt, Human
gcugagugccuuaggccgggc

SEQ ID NO: 1035024 - RNA, 20 nt, Human
ggagauggaagacagcucgg

SEQ ID NO: 1035025 - RNA, 19 nt, Human
aaccaugcacucccaaggu

SEQ ID NO: 1035026 - RNA, 19 nt, Human
acgaaccaugcacucccaa

SEQ ID NO: 1035027 - RNA, 18 nt, Human
cacgaaccaugcacuccc

SEQ ID NO: 1035028 - RNA, 23 nt, Human
gaaccaugcacucccaaggucag

SEQ ID NO: 1035029 - RNA, 24 nt, Human
aagccaacuucuugagaacaauau

SEQ ID NO: 1035030 - RNA, 19 nt, Human
agagaagccaacuucuuga

SEQ ID NO: 1035031 - RNA, 19 nt, Human
caagagaagccaacuucuu

SEQ ID NO: 1035032 - RNA, 20 nt, Human
gagaaaagcagaagagcccc

SEQ ID NO: 1035033 - RNA, 19 nt, Human
gcaagagaagccaacuucu

SEQ ID NO: 1035034 - RNA, 19 nt, Human
gccccuuuuccucuucaug

SEQ ID NO: 1035035 - RNA, 21 nt, Human
uagcacacagaucugcuucuc

SEQ ID NO: 1035036 - RNA, 23 nt, Human
uauguuauucccuuuuuaugaga

SEQ ID NO: 1035037 - RNA, 18 nt, Human
ugagaaaagcagaagagc

SEQ ID NO: 1035038 - RNA, 21 nt, Human
ugagaaaagcagaagagcccc

SEQ ID NO: 1035039 - RNA, 21 nt, Human
uuacuggauauguuauucccu

SEQ ID NO: 1035040 - RNA, 19 nt, Human
uuccucuucauguagcaca

SEQ ID NO: 1035041 - RNA, 21 nt, Human
uugcaagagaagccaacuucu

SEQ ID NO: 1035042 - RNA, 22 nt, Human
uugcaagagaagccaacuucuu

SEQ ID NO: 1035043 - RNA, 22 nt, Human
cacccggacgccgcugggcuca

SEQ ID NO: 1035044 - RNA, 25 nt, Human
cacccggacgccgcugggcucagcc

SEQ ID NO: 1035045 - RNA, 20 nt, Human
cagcccugggcccgcucguc

SEQ ID NO: 1035046 - RNA, 18 nt, Human
cagccggagacgccgggg

SEQ ID NO: 1035047 - RNA, 20 nt, Human
ccaccgcccacccggacgcc

SEQ ID NO: 1035048 - RNA, 25 nt, Human
cccugggcccgcucgucccgguaac

SEQ ID NO: 1035049 - RNA, 25 nt, Human
ccugacccggccucaauguccugac

SEQ ID NO: 1035050 - RNA, 22 nt, Human
gcagccggagacgccggggucc

SEQ ID NO: 1035051 - RNA, 23 nt, Human
gguccagcacgugcucggaagcc

SEQ ID NO: 1035052 - RNA, 23 nt, Human
ggugcagccggagacgccggggu

SEQ ID NO: 1035053 - RNA, 18 nt, Human
uccccagcacaggugagg

SEQ ID NO: 1035054 - RNA, 21 nt, Human
ucucacgcucccugacccggc

SEQ ID NO: 1035055 - RNA, 18 nt, Human
ugacccggccucaauguc

SEQ ID NO: 1035056 - RNA, 19 nt, Human
ugccccagaucaggaccca

SEQ ID NO: 1035057 - RNA, 21 nt, Human
ugccccagaucaggacccagc

SEQ ID NO: 1035058 - RNA, 19 nt, Human
aaaacaacgaacaaaacag

SEQ ID NO: 1035059 - RNA, 24 nt, Human
aaaaucuggucuucuuuucacuau

SEQ ID NO: 1035060 - RNA, 26 nt, Human
aaacacgcacacacagauuaaaaucc

SEQ ID NO: 1035061 - RNA, 22 nt, Human
aaaguagcuaacaucaaaguca

SEQ ID NO: 1035062 - RNA, 19 nt, Human
aaauaagccacaacaugag

SEQ ID NO: 1035063 - RNA, 18 nt, Human
aacugcagacgacagaac

SEQ ID NO: 1035064 - RNA, 24 nt, Human
aagcaaacaugguaagauagugau

SEQ ID NO: 1035065 - RNA, 19 nt, Human
aagcucccaacaagaaucu

SEQ ID NO: 1035066 - RNA, 25 nt, Human
aaggguaaauaacaugccugaguua

SEQ ID NO: 1035067 - RNA, 19 nt, Human
aagugagguuagugcugac

SEQ ID NO: 1035068 - RNA, 22 nt, Human
aaucuuauuccaaaucauccac

SEQ ID NO: 1035069 - RNA, 21 nt, Human
acacagcaugccagagucucc

SEQ ID NO: 1035070 - RNA, 25 nt, Human
acagucuugaguguuggcacuguuu

SEQ ID NO: 1035071 - RNA, 23 nt, Human
accaaugcacuauucuaguuuug

SEQ ID NO: 1035072 - RNA, 18 nt, Human
acuaaccaucucuuucug

SEQ ID NO: 1035073 - RNA, 18 nt, Human
acugaacugcagacgaca

SEQ ID NO: 1035074 - RNA, 23 nt, Human
acugaacugcagacgacagaaca

SEQ ID NO: 1035075 - RNA, 24 nt, Human
agaaaacaacgaacaaaacagaac

SEQ ID NO: 1035076 - RNA, 22 nt, Human
agaaaacauucagccugaguaa

SEQ ID NO: 1035077 - RNA, 20 nt, Human
agaauacauagacucaaaua

SEQ ID NO: 1035078 - RNA, 19 nt, Human
agcccauggggcugagauu

SEQ ID NO: 1035079 - RNA, 23 nt, Human
agguuaaacccauucaauaguau

SEQ ID NO: 1035080 - RNA, 21 nt, Human
aguuuuguguaauuuuuaaau

SEQ ID NO: 1035081 - RNA, 19 nt, Human
auagcaaguaacauuacaa

SEQ ID NO: 1035082 - RNA, 22 nt, Human
aucacacuuuccaccaucauga

SEQ ID NO: 1035083 - RNA, 19 nt, Human
aucauucuuuucuucucua

SEQ ID NO: 1035084 - RNA, 24 nt, Human
aucuugugagguuugaaggguaca

SEQ ID NO: 1035085 - RNA, 21 nt, Human
augagucaacagaagucugca

SEQ ID NO: 1035086 - RNA, 21 nt, Human
auguuuuaugaaagaccauuu

SEQ ID NO: 1035087 - RNA, 21 nt, Human
caaaaguaucuugcaaggccg

SEQ ID NO: 1035088 - RNA, 22 nt, Human
caaaguguucacagcagugaaa

SEQ ID NO: 1035089 - RNA, 18 nt, Human
caacuucuaaugcacccu

SEQ ID NO: 1035090 - RNA, 21 nt, Human
caaguaacauuacaaaacauc

SEQ ID NO: 1035091 - RNA, 22 nt, Human
caauuagagcccauggggcuga

SEQ ID NO: 1035092 - RNA, 20 nt, Human
cacacacagauuaaaauccc

SEQ ID NO: 1035093 - RNA, 19 nt, Human
cacugugucuucacaaagc

SEQ ID NO: 1035094 - RNA, 25 nt, Human
cacuguuugagguacauuuucucca

SEQ ID NO: 1035095 - RNA, 23 nt, Human
cagaaaacaacgaacaaaacaga

SEQ ID NO: 1035096 - RNA, 24 nt, Human
cagaauacauagacucaaauaaua

SEQ ID NO: 1035097 - RNA, 22 nt, Human
cagggagaaaaagaagauaacc

SEQ ID NO: 1035098 - RNA, 19 nt, Human
caucaacuccaagaacugc

SEQ ID NO: 1035099 - RNA, 19 nt, Human
caucacacuuuccaccauc

SEQ ID NO: 1035100 - RNA, 22 nt, Human
caucacauuucuucagaaacaa

SEQ ID NO: 1035101 - RNA, 25 nt, Human
caucacauuucuucagaaacaacag

SEQ ID NO: 1035102 - RNA, 22 nt, Human
caugucuccacagaggucacug

SEQ ID NO: 1035103 - RNA, 20 nt, Human
cauuuuuaguauucucauuu

SEQ ID NO: 1035104 - RNA, 22 nt, Human
ccaaaagacaguuuucacuaua

SEQ ID NO: 1035105 - RNA, 18 nt, Human
cccaaauaucuauuuaac

SEQ ID NO: 1035106 - RNA, 18 nt, Human
cccauggggcugagauuc

SEQ ID NO: 1035107 - RNA, 21 nt, Human
cucacuuuaccaucagcauaa

SEQ ID NO: 1035108 - RNA, 24 nt, Human
cuggcuaugagaugaagccgaagg

SEQ ID NO: 1035109 - RNA, 27 nt, Human
cuuacauaaacaaauucauacuggaga

SEQ ID NO: 1035110 - RNA, 20 nt, Human
cuuuucuucucuacuuucuc

SEQ ID NO: 1035111 - RNA, 20 nt, Human
gaaacaguacccaaaagaca

SEQ ID NO: 1035112 - RNA, 22 nt, Human
gacagaacaacuguacuaacca

SEQ ID NO: 1035113 - RNA, 23 nt, Human
gagguagaagacaaguuuaaaug

SEQ ID NO: 1035114 - RNA, 20 nt, Human
gagguuugaaggguacacug

SEQ ID NO: 1035115 - RNA, 24 nt, Human
gauuguuaaaaacgaaaucaucau

SEQ ID NO: 1035116 - RNA, 18 nt, Human
gccacaauuuucacaggu

SEQ ID NO: 1035117 - RNA, 21 nt, Human
guaaaauaagauaugugcccc

SEQ ID NO: 1035118 - RNA, 26 nt, Human
guagcccagagauaguucugagguca

SEQ ID NO: 1035119 - RNA, 21 nt, Human
uaaaaaaaaauuccccaaaua

SEQ ID NO: 1035120 - RNA, 21 nt, Human
uaaacaaauucauacuggaga

SEQ ID NO: 1035121 - RNA, 23 nt, Human
uaaaccagaugaagaaccuucca

SEQ ID NO: 1035122 - RNA, 27 nt, Human
uaaauaagccacaacaugagugagacc

SEQ ID NO: 1035123 - RNA, 25 nt, Human
uaaaucauguaguuuauauaaacug

SEQ ID NO: 1035124 - RNA, 22 nt, Human
uaacaggucaagaaugccaaag

SEQ ID NO: 1035125 - RNA, 25 nt, Human
uaaccccaaaugcuuccucuaauau

SEQ ID NO: 1035126 - RNA, 18 nt, Human
uaacugucuuaggugaua

SEQ ID NO: 1035127 - RNA, 19 nt, Human
uaagcaaacaaaaaaauga

SEQ ID NO: 1035128 - RNA, 26 nt, Human
uaauuuaaccucucaucaacuccaag

SEQ ID NO: 1035129 - RNA, 19 nt, Human
uacagaaaacaacgaacaa

SEQ ID NO: 1035130 - RNA, 22 nt, Human
uaccugaaaauacugcuuacuu

SEQ ID NO: 1035131 - RNA, 19 nt, Human
uaggugauauucaaaaaug

SEQ ID NO: 1035132 - RNA, 21 nt, Human
ucaaaagaauuaccuugucua

SEQ ID NO: 1035133 - RNA, 21 nt, Human
ucaaaguagcuaacaucaaag

SEQ ID NO: 1035134 - RNA, 23 nt, Human
ucaaaguagcuaacaucaaaguc

SEQ ID NO: 1035135 - RNA, 22 nt, Human
ucaacuccaagaacugcauuuc

SEQ ID NO: 1035136 - RNA, 19 nt, Human
ucaaugguuacaucaguua

SEQ ID NO: 1035137 - RNA, 22 nt, Human
ucacacacaaacacgcacacac

SEQ ID NO: 1035138 - RNA, 23 nt, Human
ucacacacaaacacgcacacaca

SEQ ID NO: 1035139 - RNA, 20 nt, Human
ucacacuuuuaaagugaggu

SEQ ID NO: 1035140 - RNA, 21 nt, Human
ucacagcagugaaauaacaca

SEQ ID NO: 1035141 - RNA, 18 nt, Human
ucagaauacauagacuca

SEQ ID NO: 1035142 - RNA, 19 nt, Human
ucaugaguauacucuuaag

SEQ ID NO: 1035143 - RNA, 22 nt, Human
ucauucuuuucuucucuacuuu

SEQ ID NO: 1035144 - RNA, 19 nt, Human
ucuacuccauuguaacuaa

SEQ ID NO: 1035145 - RNA, 19 nt, Human
ucucacacacaaacacgca

SEQ ID NO: 1035146 - RNA, 18 nt, Human
ucuucagaaacaacagac

SEQ ID NO: 1035147 - RNA, 19 nt, Human
ucuucagaaacaacagacc

SEQ ID NO: 1035148 - RNA, 18 nt, Human
ucuucucuacuuucucuc

SEQ ID NO: 1035149 - RNA, 25 nt, Human
ucuucugaguuucaucuugugaggu

SEQ ID NO: 1035150 - RNA, 23 nt, Human
ucuugugagguuugaaggguaca

SEQ ID NO: 1035151 - RNA, 23 nt, Human
ucuuuucuucucuacuuucucuu

SEQ ID NO: 1035152 - RNA, 22 nt, Human
ugagaccacagcauacagucca

SEQ ID NO: 1035153 - RNA, 26 nt, Human
ugaguaaacugaacgcucuguacaga

SEQ ID NO: 1035154 - RNA, 23 nt, Human
ugaguaagcacuaauguuauuuc

SEQ ID NO: 1035155 - RNA, 18 nt, Human
ugaguuacuaaaaagaga

SEQ ID NO: 1035156 - RNA, 18 nt, Human
ugauaagugucagaucug

SEQ ID NO: 1035157 - RNA, 23 nt, Human
ugcauacaaaaugaaacacuaca

SEQ ID NO: 1035158 - RNA, 18 nt, Human
uguacagaaaacaacgaa

SEQ ID NO: 1035159 - RNA, 21 nt, Human
uguacagaaaacaacgaacaa

SEQ ID NO: 1035160 - RNA, 20 nt, Human
uguacagaaaacaacgaacc

SEQ ID NO: 1035161 - RNA, 21 nt, Human
ugucagaaaacauucagccug

SEQ ID NO: 1035162 - RNA, 18 nt, Human
ugucuaaagauaaauuca

SEQ ID NO: 1035163 - RNA, 18 nt, Human
uguuuuacagacucccuc

SEQ ID NO: 1035164 - RNA, 20 nt, Human
uguuuuaugaaagaccauuu

SEQ ID NO: 1035165 - RNA, 22 nt, Human
uuaaagguuucccaaguucuuu

SEQ ID NO: 1035166 - RNA, 20 nt, Human
uuaggaaaaaaaaaauuauu

SEQ ID NO: 1035167 - RNA, 18 nt, Human
uucagaaaauucauuuaa

SEQ ID NO: 1035168 - RNA, 20 nt, Human
uuccucucucaauuuguccc

SEQ ID NO: 1035169 - RNA, 21 nt, Human
uucuccaucuacacaccccua

SEQ ID NO: 1035170 - RNA, 18 nt, Human
uucuucucuacuuucucu

SEQ ID NO: 1035171 - RNA, 19 nt, Human
uuuacagacucccuccuag

SEQ ID NO: 1035172 - RNA, 22 nt, Human
uuucagggccuuaaaacccuua

SEQ ID NO: 1035173 - RNA, 23 nt, Human
aaaaaauagcaaaaaaaaauggc

SEQ ID NO: 1035174 - RNA, 23 nt, Human
aaaauggcaaaacuuauugcaaa

SEQ ID NO: 1035175 - RNA, 22 nt, Human
aaacagaaagauuaacauuagc

SEQ ID NO: 1035176 - RNA, 22 nt, Human
agaggaaaaaaauagcaaaaaa

SEQ ID NO: 1035177 - RNA, 22 nt, Human
aggaaaaaaauagcaaaaaaaa

SEQ ID NO: 1035178 - RNA, 23 nt, Human
gaggaaaaaaauagcaaaaaaaa

SEQ ID NO: 1035179 - RNA, 21 nt, Human
ggaaaaaaauagcaaaaaaaa

SEQ ID NO: 1035180 - RNA, 18 nt, Human
uaacauuagcauaaaugg

SEQ ID NO: 1035181 - RNA, 24 nt, Human
uaaguagccgucguaauucuucuc

SEQ ID NO: 1035182 - RNA, 18 nt, Human
uagcaaaaaaaaauggca

SEQ ID NO: 1035183 - RNA, 22 nt, Human
ucuuagauauaguuguguugcu

SEQ ID NO: 1035184 - RNA, 21 nt, Human
ugaugccauugccauaaaagu

SEQ ID NO: 1035185 - RNA, 19 nt, Human
ugcaaaauuuuucaccugu

SEQ ID NO: 1035186 - RNA, 26 nt, Human
uuuagaggaaaaaaauagcaaaaaaa

SEQ ID NO: 1035187 - RNA, 19 nt, Human
aagacgaguggcaaaccug

SEQ ID NO: 1035188 - RNA, 22 nt, Human
agagacacacucucaacuugug

SEQ ID NO: 1035189 - RNA, 25 nt, Human
aucuucuuuacuucaucuccuguca

SEQ ID NO: 1035190 - RNA, 19 nt, Human
caguuuggaccuugccauc

SEQ ID NO: 1035191 - RNA, 20 nt, Human
gucaacuuauccagcaucca

SEQ ID NO: 1035192 - RNA, 20 nt, Human
uagguuauaucaguuuggac

SEQ ID NO: 1035193 - RNA, 21 nt, Human
ucuuuacuucaucuccuguca

SEQ ID NO: 1035194 - RNA, 19 nt, Human
uuccuuaggaagaugauga

SEQ ID NO: 1035195 - RNA, 24 nt, Human
aaaaaaaaaaagguuucuaucuga

SEQ ID NO: 1035196 - RNA, 18 nt, Human
aaaauacacauuuacugg

SEQ ID NO: 1035197 - RNA, 21 nt, Human
aaacucauuuggaaacuucaa

SEQ ID NO: 1035198 - RNA, 21 nt, Human
aaaugugaguacccuuuccau

SEQ ID NO: 1035199 - RNA, 18 nt, Human
aaguaacaaugaaagaga

SEQ ID NO: 1035200 - RNA, 20 nt, Human
acaagaggagagaauaauuu

SEQ ID NO: 1035201 - RNA, 23 nt, Human
acaaugaaagagauaacacugga

SEQ ID NO: 1035202 - RNA, 23 nt, Human
acagacaagaaaacaaaaaauua

SEQ ID NO: 1035203 - RNA, 20 nt, Human
acagcaacaaagagaauucc

SEQ ID NO: 1035204 - RNA, 19 nt, Human
acuggaacaaagagcucua

SEQ ID NO: 1035205 - RNA, 19 nt, Human
agaaugaagcagauuagaa

SEQ ID NO: 1035206 - RNA, 24 nt, Human
agaauuuaaaauaaaguuuaccuc

SEQ ID NO: 1035207 - RNA, 20 nt, Human
agcaacaaagagaauucaca

SEQ ID NO: 1035208 - RNA, 19 nt, Human
agcagaaaugaccucaaau

SEQ ID NO: 1035209 - RNA, 21 nt, Human
aguaacaaugaaagagauaac

SEQ ID NO: 1035210 - RNA, 19 nt, Human
aguauaauuuggaagccua

SEQ ID NO: 1035211 - RNA, 21 nt, Human
auaauuuggaagccuagggug

SEQ ID NO: 1035212 - RNA, 21 nt, Human
augacauuuccucuggcaacu

SEQ ID NO: 1035213 - RNA, 24 nt, Human
augacauuuccucuggcaacuuca

SEQ ID NO: 1035214 - RNA, 19 nt, Human
caaagacaauuccuauuuc

SEQ ID NO: 1035215 - RNA, 22 nt, Human
caacaaagagaauucacauacc

SEQ ID NO: 1035216 - RNA, 19 nt, Human
caacugaaaaguguuagau

SEQ ID NO: 1035217 - RNA, 25 nt, Human
cagcaacaaagagaauucacauacc

SEQ ID NO: 1035218 - RNA, 21 nt, Human
cauaacuaaagcuccuuucuc

SEQ ID NO: 1035219 - RNA, 22 nt, Human
cauuuccucuggcaacuucagg

SEQ ID NO: 1035220 - RNA, 29 nt, Human
cccucuacuauucuaccuccaguugucaa

SEQ ID NO: 1035221 - RNA, 18 nt, Human
ccuaaagcagaaaugacc

SEQ ID NO: 1035222 - RNA, 20 nt, Human
ccugucuuaagcacagaauu

SEQ ID NO: 1035223 - RNA, 20 nt, Human
cuccauuacagacaagaaaa

SEQ ID NO: 1035224 - RNA, 20 nt, Human
cuccuuucuccuucagcaac

SEQ ID NO: 1035225 - RNA, 21 nt, Human
cuggaucagguaauuuuccuu

SEQ ID NO: 1035226 - RNA, 24 nt, Human
cuuaagcacagaauuuaaaauaaa

SEQ ID NO: 1035227 - RNA, 18 nt, Human
gcaaauacaaaguaacaa

SEQ ID NO: 1035228 - RNA, 22 nt, Human
gcaacugaaaaguguuagauau

SEQ ID NO: 1035229 - RNA, 26 nt, Human
gcauagcuuccuuuaaaauacagaaa

SEQ ID NO: 1035230 - RNA, 25 nt, Human
ggccaaagaauuuaccgaaaguaac

SEQ ID NO: 1035231 - RNA, 19 nt, Human
gucuaggaaagacacagag

SEQ ID NO: 1035232 - RNA, 21 nt, Human
guugucaaaaugucauagagu

SEQ ID NO: 1035233 - RNA, 20 nt, Human
uaaaaugccauaaguucuga

SEQ ID NO: 1035234 - RNA, 18 nt, Human
uacaaaguaacaaugaaa

SEQ ID NO: 1035235 - RNA, 24 nt, Human
uauaauucugaaaaaaaaaaaggu

SEQ ID NO: 1035236 - RNA, 28 nt, Human
uauaccgugcagauuucuagaaaaaucg

SEQ ID NO: 1035237 - RNA, 18 nt, Human
uaucugaaugauguagga

SEQ ID NO: 1035238 - RNA, 18 nt, Human
uaugauagugcauuucga

SEQ ID NO: 1035239 - RNA, 21 nt, Human
uauuacauagguauuuggccc

SEQ ID NO: 1035240 - RNA, 23 nt, Human
ucaaacucauuuggaaacuucaa

SEQ ID NO: 1035241 - RNA, 19 nt, Human
uccuaaagcagaaaugacc

SEQ ID NO: 1035242 - RNA, 22 nt, Human
uccucauggucuugguaggagc

SEQ ID NO: 1035243 - RNA, 23 nt, Human
uccuucauacacacgagcuauuu

SEQ ID NO: 1035244 - RNA, 28 nt, Human
ucuauaauucugaaaaaaaaaaagguuu

SEQ ID NO: 1035245 - RNA, 24 nt, Human
ugaaaaacaacucuauuaugucua

SEQ ID NO: 1035246 - RNA, 21 nt, Human
ugaaauaaugaauacugguca

SEQ ID NO: 1035247 - RNA, 20 nt, Human
ugcaacagcaacaaagagaa

SEQ ID NO: 1035248 - RNA, 24 nt, Human
ugguaaaaaaaauugcaaauacaa

SEQ ID NO: 1035249 - RNA, 19 nt, Human
uuacaagaggagagaauaa

SEQ ID NO: 1035250 - RNA, 19 nt, Human
uucaaaaaaugugaguacc

SEQ ID NO: 1035251 - RNA, 25 nt, Human
uucacauaccaacaaaggacuuuau

SEQ ID NO: 1035252 - RNA, 21 nt, Human
uucauacacacgagcuauuuc

SEQ ID NO: 1035253 - RNA, 21 nt, Human
uuggaagccuaggguggcaga

SEQ ID NO: 1035254 - RNA, 20 nt, Human
uuuuaaaauaaauauuuacc

SEQ ID NO: 1035255 - RNA, 23 nt, Human
aaaaaggagacauucaaagagga

SEQ ID NO: 1035256 - RNA, 22 nt, Human
aaacaaagccauuucaggugug

SEQ ID NO: 1035257 - RNA, 22 nt, Human
aaacaggaaagaaguaaagcaa

SEQ ID NO: 1035258 - RNA, 26 nt, Human
aaacaggaaagaaguaaaggggaccc

SEQ ID NO: 1035259 - RNA, 23 nt, Human
aaagccauuucaggugugacaac

SEQ ID NO: 1035260 - RNA, 19 nt, Human
aacauggugaaacccccuc

SEQ ID NO: 1035261 - RNA, 20 nt, Human
aacauggugaaacccccucu

SEQ ID NO: 1035262 - RNA, 21 nt, Human
aacauggugaaacccccucuc

SEQ ID NO: 1035263 - RNA, 21 nt, Human
aagaaagacugauauuuggca

SEQ ID NO: 1035264 - RNA, 23 nt, Human
aagaauugcuugaauccgggagg

SEQ ID NO: 1035265 - RNA, 24 nt, Human
aagacugauauuuggcacuuaaau

SEQ ID NO: 1035266 - RNA, 20 nt, Human
aagagaaacuuuucucagga

SEQ ID NO: 1035267 - RNA, 24 nt, Human
aagcugaggcagaagaauugcuug

SEQ ID NO: 1035268 - RNA, 24 nt, Human
aauugcuugaauccgggaggugga

SEQ ID NO: 1035269 - RNA, 20 nt, Human
acaagagcaaaacuccaucu

SEQ ID NO: 1035270 - RNA, 24 nt, Human
accaugccauugcaucccagccug

SEQ ID NO: 1035271 - RNA, 21 nt, Human
acuccagcgugacuguugcag

SEQ ID NO: 1035272 - RNA, 21 nt, Human
agaaaacugguaauauucuug

SEQ ID NO: 1035273 - RNA, 21 nt, Human
agacagcgaugaaaaacuugg

SEQ ID NO: 1035274 - RNA, 21 nt, Human
agaccagacuggccaacaugg

SEQ ID NO: 1035275 - RNA, 24 nt, Human
agacuggccaacauggugaaaccc

SEQ ID NO: 1035276 - RNA, 20 nt, Human
agagaaagaaagacugauau

SEQ ID NO: 1035277 - RNA, 23 nt, Human
agagacacaacuugcaguaucau

SEQ ID NO: 1035278 - RNA, 20 nt, Human
agauuagcacugugcugcgg

SEQ ID NO: 1035279 - RNA, 20 nt, Human
agauugcuggugaccaaaua

SEQ ID NO: 1035280 - RNA, 24 nt, Human
agcacuuugggaggccaagguggg

SEQ ID NO: 1035281 - RNA, 21 nt, Human
agcagggggucaggccucuaa

SEQ ID NO: 1035282 - RNA, 24 nt, Human
agcugggcacgguggcaggcagcu

SEQ ID NO: 1035283 - RNA, 24 nt, Human
aggcagaagaauugcuugaauccg

SEQ ID NO: 1035284 - RNA, 21 nt, Human
aggccaaggugggcggaucac

SEQ ID NO: 1035285 - RNA, 20 nt, Human
agggaaaaaacggcuuuaaa

SEQ ID NO: 1035286 - RNA, 24 nt, Human
agguggagguuacagugagcugag

SEQ ID NO: 1035287 - RNA, 22 nt, Human
auacaugcaugugcgcacauau

SEQ ID NO: 1035288 - RNA, 18 nt, Human
aucagcuuuucucucucu

SEQ ID NO: 1035289 - RNA, 20 nt, Human
aucucaaaaaaaaaaaaaag

SEQ ID NO: 1035290 - RNA, 19 nt, Human
aucuugaaguuucuuucuc

SEQ ID NO: 1035291 - RNA, 22 nt, Human
augaugguguuagaugccaucu

SEQ ID NO: 1035292 - RNA, 22 nt, Human
auuccagcacuuugggaggcca

SEQ ID NO: 1035293 - RNA, 24 nt, Human
caaaaaggagacauucaaagagga

SEQ ID NO: 1035294 - RNA, 26 nt, Human
caaaaaggagacauucaaagaggaca

SEQ ID NO: 1035295 - RNA, 22 nt, Human
caaaacaggaaagaaguaaagc

SEQ ID NO: 1035296 - RNA, 24 nt, Human
caagagcaaaacuccaucucaaaa

SEQ ID NO: 1035297 - RNA, 19 nt, Human
caaggugggcggaucaccu

SEQ ID NO: 1035298 - RNA, 26 nt, Human
caaggugggcggaucaccugacguca

SEQ ID NO: 1035299 - RNA, 26 nt, Human
caaguauuuauugauaaaaacaaagc

SEQ ID NO: 1035300 - RNA, 27 nt, Human
cagacucuggacaucacuccacuccuu

SEQ ID NO: 1035301 - RNA, 22 nt, Human
cagcaaugccaucccuagcuuu

SEQ ID NO: 1035302 - RNA, 21 nt, Human
cagcacuuugggaggccaagg

SEQ ID NO: 1035303 - RNA, 24 nt, Human
cagcacuuugggaggccaaggugg

SEQ ID NO: 1035304 - RNA, 23 nt, Human
cagcuguaaucccagcuagucgg

SEQ ID NO: 1035305 - RNA, 24 nt, Human
cagcuguaaucccagcuagucggg

SEQ ID NO: 1035306 - RNA, 24 nt, Human
caggccucuaauuccagcacuuug

SEQ ID NO: 1035307 - RNA, 21 nt, Human
cagggugaaagucacccugcu

SEQ ID NO: 1035308 - RNA, 21 nt, Human
caucacuccacuccuauuuau

SEQ ID NO: 1035309 - RNA, 18 nt, Human
cauggcucucagauaagu

SEQ ID NO: 1035310 - RNA, 21 nt, Human
cauggugaaacccccucucca

SEQ ID NO: 1035311 - RNA, 18 nt, Human
cauugcaucccagccugg

SEQ ID NO: 1035312 - RNA, 19 nt, Human
cauugcaucccagccuggg

SEQ ID NO: 1035313 - RNA, 24 nt, Human
cauugcaucccagccugggcuaca

SEQ ID NO: 1035314 - RNA, 22 nt, Human
ccaaaaaggagacauucaaaga

SEQ ID NO: 1035315 - RNA, 22 nt, Human
ccagccugggcuacaagagcaa

SEQ ID NO: 1035316 - RNA, 24 nt, Human
ccauauuuuacuucuugaccuaga

SEQ ID NO: 1035317 - RNA, 20 nt, Human
ccauugcaucccagccuggg

SEQ ID NO: 1035318 - RNA, 21 nt, Human
ccauugcaucccagccugggc

SEQ ID NO: 1035319 - RNA, 24 nt, Human
ccauugcaucccagccugggcuac

SEQ ID NO: 1035320 - RNA, 20 nt, Human
cccacagacucuggacauca

SEQ ID NO: 1035321 - RNA, 19 nt, Human
cccucuccacuaaaaauac

SEQ ID NO: 1035322 - RNA, 20 nt, Human
ccuagaauucuuaagaagag

SEQ ID NO: 1035323 - RNA, 24 nt, Human
cggaucaccugacgucaggaguuc

SEQ ID NO: 1035324 - RNA, 27 nt, Human
cgggaagcugaggcagaagaauugcuu

SEQ ID NO: 1035325 - RNA, 29 nt, Human
cgggagguggagguuacagugacaacggu

SEQ ID NO: 1035326 - RNA, 24 nt, Human
cgggagguggagguuacagugagc

SEQ ID NO: 1035327 - RNA, 24 nt, Human
cuagaccagacuggccaacauggu

SEQ ID NO: 1035328 - RNA, 19 nt, Human
cuccaucucaaaaaaaaaa

SEQ ID NO: 1035329 - RNA, 22 nt, Human
cuggccaacauggugaaacccc

SEQ ID NO: 1035330 - RNA, 25 nt, Human
cugugcugcggcaugguccauggga

SEQ ID NO: 1035331 - RNA, 24 nt, Human
cuugaaguuucuuucuccuacugc

SEQ ID NO: 1035332 - RNA, 19 nt, Human
cuuugggaggugguauguu

SEQ ID NO: 1035333 - RNA, 24 nt, Human
cuuuucccucuucuuuccuguuuu

SEQ ID NO: 1035334 - RNA, 22 nt, Human
gaggacauauguguccucugaa

SEQ ID NO: 1035335 - RNA, 23 nt, Human
gaguguguuuuccaccauggcuc

SEQ ID NO: 1035336 - RNA, 18 nt, Human
gaucaccugacgucagga

SEQ ID NO: 1035337 - RNA, 20 nt, Human
gcaggcagcuguaaucccag

SEQ ID NO: 1035338 - RNA, 24 nt, Human
gccaacauggugaaacccccucuc

SEQ ID NO: 1035339 - RNA, 22 nt, Human
gccauugcaucccagccugggc

SEQ ID NO: 1035340 - RNA, 19 nt, Human
ggaagcaucucaaccaggc

SEQ ID NO: 1035341 - RNA, 18 nt, Human
ggagcagggggucaggcc

SEQ ID NO: 1035342 - RNA, 21 nt, Human
ggagguggagguuacagugag

SEQ ID NO: 1035343 - RNA, 18 nt, Human
ggagguuacagugagcug

SEQ ID NO: 1035344 - RNA, 24 nt, Human
ggagguuacagugagcugagacca

SEQ ID NO: 1035345 - RNA, 20 nt, Human
ggagguuacagugagcuggc

SEQ ID NO: 1035346 - RNA, 23 nt, Human
ggaucaccugacgucaggaguuc

SEQ ID NO: 1035347 - RNA, 24 nt, Human
ggcagauugcuggugaccaaauau

SEQ ID NO: 1035348 - RNA, 21 nt, Human
ggcuacaagagcaaaacucca

SEQ ID NO: 1035349 - RNA, 24 nt, Human
gggcggaucaccugacgucaggag

SEQ ID NO: 1035350 - RNA, 25 nt, Human
gguauacaugcaugugcgcacauau

SEQ ID NO: 1035351 - RNA, 26 nt, Human
ggugcagguauacaugcaugugcgca

SEQ ID NO: 1035352 - RNA, 19 nt, Human
gguggagguuacagugagc

SEQ ID NO: 1035353 - RNA, 21 nt, Human
guaaagcaacacuauuccuuu

SEQ ID NO: 1035354 - RNA, 26 nt, Human
guacuccagcgugacuguugcagggu

SEQ ID NO: 1035355 - RNA, 24 nt, Human
guaggaagaauaacauacauaugc

SEQ ID NO: 1035356 - RNA, 19 nt, Human
guccaugggaagcaucuca

SEQ ID NO: 1035357 - RNA, 27 nt, Human
gugacaacaguaacauaguuggcaaaa

SEQ ID NO: 1035358 - RNA, 19 nt, Human
uaaaaacaaagccauuucc

SEQ ID NO: 1035359 - RNA, 19 nt, Human
uaaucccagcuagucggga

SEQ ID NO: 1035360 - RNA, 20 nt, Human
uacaagagcaaaacuccauc

SEQ ID NO: 1035361 - RNA, 22 nt, Human
uacuccagcgugacuguugcag

SEQ ID NO: 1035362 - RNA, 26 nt, Human
uacuccagcgugacuguugcagggug

SEQ ID NO: 1035363 - RNA, 18 nt, Human
uagaagacaguaggaaga

SEQ ID NO: 1035364 - RNA, 24 nt, Human
uauacaugcaugugcgcacauaua

SEQ ID NO: 1035365 - RNA, 19 nt, Human
ucaaaaaaaaaaaaaagga

SEQ ID NO: 1035366 - RNA, 21 nt, Human
ucagcauuuaguuuuugcucc

SEQ ID NO: 1035367 - RNA, 22 nt, Human
ucaggccucuaauuccagcacu

SEQ ID NO: 1035368 - RNA, 24 nt, Human
uccacuccuauuuauaaaaugaca

SEQ ID NO: 1035369 - RNA, 22 nt, Human
uccaucucaaaaaaaaaaaaaa

SEQ ID NO: 1035370 - RNA, 23 nt, Human
uccaucucaaaaaaaaaaaaaag

SEQ ID NO: 1035371 - RNA, 18 nt, Human
uccaugggaagcaucuca

SEQ ID NO: 1035372 - RNA, 20 nt, Human
ucccaucgggcugaauuccu

SEQ ID NO: 1035373 - RNA, 21 nt, Human
uccgggagguggagguuacag

SEQ ID NO: 1035374 - RNA, 18 nt, Human
uccucuagguggcaguga

SEQ ID NO: 1035375 - RNA, 23 nt, Human
uccugcuucuucagaaucuugca

SEQ ID NO: 1035376 - RNA, 23 nt, Human
ucgggcugaauuccugcuucuuc

SEQ ID NO: 1035377 - RNA, 25 nt, Human
ucuauggccuccacauuuacuuccu

SEQ ID NO: 1035378 - RNA, 25 nt, Human
ucucaaaaaaaaaaaaaaggauuuc

SEQ ID NO: 1035379 - RNA, 24 nt, Human
ucucguucucucugucuccuccua

SEQ ID NO: 1035380 - RNA, 21 nt, Human
ucugucuccuccuacucgcuc

SEQ ID NO: 1035381 - RNA, 22 nt, Human
ugaaacccccucuccacuaaaa

SEQ ID NO: 1035382 - RNA, 20 nt, Human
ugacagagagagacacaacu

SEQ ID NO: 1035383 - RNA, 18 nt, Human
ugacugcacaguauggag

SEQ ID NO: 1035384 - RNA, 20 nt, Human
ugacugcacaguauggaguu

SEQ ID NO: 1035385 - RNA, 25 nt, Human
ugaggcagaagaauugcuugaaucc

SEQ ID NO: 1035386 - RNA, 18 nt, Human
ugcuugaauccgggaggu

SEQ ID NO: 1035387 - RNA, 24 nt, Human
uggccaacauggugaaacccccuc

SEQ ID NO: 1035388 - RNA, 21 nt, Human
uggccuccacauuuacuuccu

SEQ ID NO: 1035389 - RNA, 20 nt, Human
ugggaacauggcucucagau

SEQ ID NO: 1035390 - RNA, 19 nt, Human
ugggaggccaaggugggcg

SEQ ID NO: 1035391 - RNA, 24 nt, Human
ugggaggccaaggugggcggauca

SEQ ID NO: 1035392 - RNA, 24 nt, Human
ugggcggaucaccugacgucagga

SEQ ID NO: 1035393 - RNA, 24 nt, Human
uguggauagauuagcacugugcug

SEQ ID NO: 1035394 - RNA, 24 nt, Human
uguuuuguggauagauuagcacug

SEQ ID NO: 1035395 - RNA, 20 nt, Human
uuacagugagcugagaccau

SEQ ID NO: 1035396 - RNA, 21 nt, Human
uuacagugagcugagaccaug

SEQ ID NO: 1035397 - RNA, 18 nt, Human
uuagcugggcacgguggc

SEQ ID NO: 1035398 - RNA, 19 nt, Human
uucacaaaaaccuucugag

SEQ ID NO: 1035399 - RNA, 23 nt, Human
uucaccagaguacuccagcguga

SEQ ID NO: 1035400 - RNA, 22 nt, Human
uucuauaugcacucaauaguua

SEQ ID NO: 1035401 - RNA, 24 nt, Human
uucuauggccuccacauuuacuuc

SEQ ID NO: 1035402 - RNA, 21 nt, Human
uugaauccgggagguggaggu

SEQ ID NO: 1035403 - RNA, 24 nt, Human
uugcuugaauccgggagguggagg

SEQ ID NO: 1035404 - RNA, 25 nt, Human
uuucccucuucuuuccuguuuuucu

SEQ ID NO: 1035405 - RNA, 22 nt, Human
uuugcccauaucagcaaugcca

SEQ ID NO: 1035406 - RNA, 21 nt, Human
uuuugcuccaagaacucgaga

SEQ ID NO: 1035407 - RNA, 21 nt, Human
acaccaugaagauaacuuggc

SEQ ID NO: 1035408 - RNA, 20 nt, Human
agagugcaaaaggcuugaaa

SEQ ID NO: 1035409 - RNA, 22 nt, Human
auuggugauggcuacuucuuuc

SEQ ID NO: 1035410 - RNA, 18 nt, Human
caccaguaagagggauac

SEQ ID NO: 1035411 - RNA, 23 nt, Human
caccaguaagagggauacaccaa

SEQ ID NO: 1035412 - RNA, 25 nt, Human
caccaugaagauaacuuggcuuuca

SEQ ID NO: 1035413 - RNA, 25 nt, Human
ccuguggugugaggcacagugggac

SEQ ID NO: 1035414 - RNA, 19 nt, Human
uaacccaagaugaccuuac

SEQ ID NO: 1035415 - RNA, 23 nt, Human
ucaacuucugagagggacaauca

SEQ ID NO: 1035416 - RNA, 18 nt, Human
uccacauagagagcauuc

SEQ ID NO: 1035417 - RNA, 19 nt, Human
uggugugaggcacaguggg

SEQ ID NO: 1035418 - RNA, 20 nt, Human
uggugugaggcacaguggga

SEQ ID NO: 1035419 - RNA, 23 nt, Human
uguggugugaggcacagugggac

SEQ ID NO: 1035420 - RNA, 21 nt, Human
uuggugauggcuacuucuuuc

SEQ ID NO: 1035421 - RNA, 20 nt, Human
accgaggccuccucaggcag

SEQ ID NO: 1035422 - RNA, 19 nt, Human
agaaccagagaaaccaugg

SEQ ID NO: 1035423 - RNA, 19 nt, Human
ccaaccgaggccuccucag

SEQ ID NO: 1035424 - RNA, 30 nt, Human; identical to SEQ ID NO: 852361

SEQ ID NO: 1035425 - RNA, 19 nt, Human
ccuccucaggcaggcaggg

SEQ ID NO: 1035426 - RNA, 31 nt, Human; identical to SEQ ID NO: 852366

SEQ ID NO: 1035427 - RNA, 19 nt, Human
gaagucucuccacagcauu

SEQ ID NO: 1035428 - RNA, 18 nt, Human
uagguguaccucacccuc

SEQ ID NO: 1035429 - RNA, 23 nt, Human
ucaaacuggcagaaccagagaaa

SEQ ID NO: 1035430 - RNA, 23 nt, Human
ucuccacagcaugccuugggccu

SEQ ID NO: 1035431 - RNA, 18 nt, Human
uggcagaaccagagaaac

SEQ ID NO: 1035432 - RNA, 23 nt, Human
agggcagggacaggauugcaggg

SEQ ID NO: 1035433 - RNA, 31 nt, Human
caaaaggucacccccaagucacccaagcacc

SEQ ID NO: 1035434 - RNA, 23 nt, Human
caagucacccaagcacaucacuc

SEQ ID NO: 1035435 - RNA, 18 nt, Human
cacaucacucaagcuggc

SEQ ID NO: 1035436 - RNA, 22 nt, Human
ccaagucacccaagcacaucac

SEQ ID NO: 1035437 - RNA, 22 nt, Human
cccaagucacccaagcacauca

SEQ ID NO: 1035438 - RNA, 24 nt, Human
ccccaagucacccaagcacaucac

SEQ ID NO: 1035439 - RNA, 25 nt, Human
cccccaagucacccaagcacaucac

SEQ ID NO: 1035440 - RNA, 20 nt, Human
ccugggucugagguccccug

SEQ ID NO: 1035441 - RNA, 21 nt, Human
ggcagggacaggauugcaggg

SEQ ID NO: 1035442 - RNA, 21 nt, Human
ggggugaggagggcagggaca

SEQ ID NO: 1035443 - RNA, 22 nt, Human
gucugagguccccuggcuguuc

SEQ ID NO: 1035444 - RNA, 18 nt, Human
uaaccuucccucccaucc

SEQ ID NO: 1035445 - RNA, 22 nt, Human
ucacccccaagucacccaagca

SEQ ID NO: 1035446 - RNA, 18 nt, Human
ucagccuccucucggugg

SEQ ID NO: 1035447 - RNA, 26 nt, Human
uccccuggcuguuccugcuccugaca

SEQ ID NO: 1035448 - RNA, 19 nt, Human
uccuacugcaggaccaagg

SEQ ID NO: 1035449 - RNA, 20 nt, Human
ugcaggaccaaggagaaaac

SEQ ID NO: 1035450 - RNA, 20 nt, Human
uaagggagaagaaggaggug

SEQ ID NO: 1035451 - RNA, 24 nt, Human
ucuaagggagaagaaggaggugac

SEQ ID NO: 1035452 - RNA, 25 nt, Human
ugaagccuguacuaccuucucuaag

SEQ ID NO: 1035453 - RNA, 23 nt, Human
ugacaccaacuuugcucucacag

SEQ ID NO: 1035454 - RNA, 19 nt, Human
uugcucucacagccuuucc

SEQ ID NO: 1035455 - RNA, 21 nt, Human
aagagcacccccagggucacu

SEQ ID NO: 1035456 - RNA, 22 nt, Human
aagggcccccaaggcuggccag

SEQ ID NO: 1035457 - RNA, 19 nt, Human
aagugcuucccuagaccuc

SEQ ID NO: 1035458 - RNA, 18 nt, Human
acccgcaccuuguggcac

SEQ ID NO: 1035459 - RNA, 21 nt, Human
agaggaggggguggaagugcu

SEQ ID NO: 1035460 - RNA, 26 nt, Human
agcaguagccucacccuucccccagc

SEQ ID NO: 1035461 - RNA, 21 nt, Human
aggagaggaggggguggaagu

SEQ ID NO: 1035462 - RNA, 21 nt, Human
aggaggggguggaagugcuuc

SEQ ID NO: 1035463 - RNA, 22 nt, Human
aggaggggguggaagugcuucc

SEQ ID NO: 1035464 - RNA, 19 nt, Human
aggggacagggcgugugug

SEQ ID NO: 1035465 - RNA, 21 nt, Human
caaggaggagcuggcauuucg

SEQ ID NO: 1035466 - RNA, 19 nt, Human
cacaguaggaagcucacca

SEQ ID NO: 1035467 - RNA, 22 nt, Human
cacauccugccaggauugagga

SEQ ID NO: 1035468 - RNA, 18 nt, Human
caggauugaggagaggag

SEQ ID NO: 1035469 - RNA, 22 nt, Human
cagggcuccaagggcccccaag

SEQ ID NO: 1035470 - RNA, 21 nt, Human
ccacggcgaugcccacucuca

SEQ ID NO: 1035471 - RNA, 19 nt, Human
ccaggcucagcugugucuc

SEQ ID NO: 1035472 - RNA, 24 nt, Human
cccccaaggcuggccagaucccca

SEQ ID NO: 1035473 - RNA, 25 nt, Human
cccccaaggcuggccagauccccag

SEQ ID NO: 1035474 - RNA, 18 nt, Human
cgcuccugacagcugacc

SEQ ID NO: 1035475 - RNA, 23 nt, Human
cuccagcacccgcaccuuguggc

SEQ ID NO: 1035476 - RNA, 18 nt, Human
gaccuccagaugcauccc

SEQ ID NO: 1035477 - RNA, 23 nt, Human
gagaacaccaaggaggagcuggc

SEQ ID NO: 1035478 - RNA, 22 nt, Human
gaugcccacucucauuuccagg

SEQ ID NO: 1035479 - RNA, 23 nt, Human
ggagaacaccaaggaggagcugg

SEQ ID NO: 1035480 - RNA, 18 nt, Human
ggagagaaacgucacugu

SEQ ID NO: 1035481 - RNA, 23 nt, Human
ggagguccuagacgccgggggug

SEQ ID NO: 1035482 - RNA, 19 nt, Human
ggccagggcuccaagggcc

SEQ ID NO: 1035483 - RNA, 25 nt, Human
ggcguguguguuggggugucgaggc

SEQ ID NO: 1035484 - RNA, 20 nt, Human
gggcguguguguuggggugu

SEQ ID NO: 1035485 - RNA, 20 nt, Human
gguguguguuuguguuugug

SEQ ID NO: 1035486 - RNA, 20 nt, Human
guggagaaaggggacagggc

SEQ ID NO: 1035487 - RNA, 22 nt, Human
guguguuuguguuugugugugu

SEQ ID NO: 1035488 - RNA, 25 nt, Human
uagaccuccagaugcaucccugcuc

SEQ ID NO: 1035489 - RNA, 18 nt, Human
uagcguggccuccauguu

SEQ ID NO: 1035490 - RNA, 19 nt, Human
ucauuuccaggcucagcug

SEQ ID NO: 1035491 - RNA, 21 nt, Human
ucauuuccaggcucagcugug

SEQ ID NO: 1035492 - RNA, 21 nt, Human
uccacugggccagggcuccaa

SEQ ID NO: 1035493 - RNA, 18 nt, Human
uccagaugcaucccugcu

SEQ ID NO: 1035494 - RNA, 23 nt, Human
uccaggcucagcugugucucccc

SEQ ID NO: 1035495 - RNA, 19 nt, Human
ucccccagcgguaucaggg

SEQ ID NO: 1035496 - RNA, 20 nt, Human
uccucaggcacgagcuucca

SEQ ID NO: 1035497 - RNA, 22 nt, Human
uccugccaggauugaggagagg

SEQ ID NO: 1035498 - RNA, 19 nt, Human
ucuccagcacccgcaccuu

SEQ ID NO: 1035499 - RNA, 18 nt, Human
ucucccucccucccauug

SEQ ID NO: 1035500 - RNA, 24 nt, Human
ucuguugcugccuaaacucuuuca

SEQ ID NO: 1035501 - RNA, 19 nt, Human
ugaccacggcgaugcccac

SEQ ID NO: 1035502 - RNA, 22 nt, Human
ugagcuaaaugcaacuagcuug

SEQ ID NO: 1035503 - RNA, 18 nt, Human
ugcaggguggagaaaggg

SEQ ID NO: 1035504 - RNA, 26 nt, Human
ugcucccauguucucccucccuccca

SEQ ID NO: 1035505 - RNA, 19 nt, Human
ugucuccagcacccgcacc

SEQ ID NO: 1035506 - RNA, 23 nt, Human
uguguguuuguguuugugugugu

SEQ ID NO: 1035507 - RNA, 22 nt, Human
uguugcugccuaaacucuuuca

SEQ ID NO: 1035508 - RNA, 20 nt, Human
uuccacugggccagggcucc

SEQ ID NO: 1035509 - RNA, 19 nt, Human
uucccuagaccuccagaug

SEQ ID NO: 1035510 - RNA, 24 nt, Human
uuccucaggcacgagcuuccacug

SEQ ID NO: 1035511 - RNA, 25 nt, Human
uugaagcagcaguagccucacccuu

SEQ ID NO: 1035512 - RNA, 23 nt, Human
aggaaaaaacaaacugaugggga

SEQ ID NO: 1035513 - RNA, 20 nt, Human
gaaaaaacaaacugaugggg

SEQ ID NO: 1035514 - RNA, 24 nt, Human
gaaaaaacaaacugauggggauua

SEQ ID NO: 1035515 - RNA, 18 nt, Human
uugaggaaaaaacaaacu

SEQ ID NO: 1035516 - RNA, 21 nt, Human
aaagaaaguguacaagcuacg

SEQ ID NO: 1035517 - RNA, 22 nt, Human
aaagacgagaaaaacagggcug

SEQ ID NO: 1035518 - RNA, 21 nt, Human
aaauaccccccacuuaacguu

SEQ ID NO: 1035519 - RNA, 24 nt, Human
aaccaccauagaaaauacccccca

SEQ ID NO: 1035520 - RNA, 25 nt, Human
aagcuccccccacccacccauagaa

SEQ ID NO: 1035521 - RNA, 22 nt, Human
aaggcgaaaauacagucaaauc

SEQ ID NO: 1035522 - RNA, 18 nt, Human
acaagacgcaccagccgc

SEQ ID NO: 1035523 - RNA, 20 nt, Human
acaccaaagacgagaaaaac

SEQ ID NO: 1035524 - RNA, 20 nt, Human
accaaagacgagaaaaacag

SEQ ID NO: 1035525 - RNA, 18 nt, Human
accagccgcccaaccacc

SEQ ID NO: 1035526 - RNA, 27 nt, Human
accagcuccccccaacccccaacacca

SEQ ID NO: 1035527 - RNA, 23 nt, Human
acccaccagcuccccccaacccc

SEQ ID NO: 1035528 - RNA, 18 nt, Human
acugcgucaggacagaau

SEQ ID NO: 1035529 - RNA, 20 nt, Human
agaaaaauggcuucccucau

SEQ ID NO: 1035530 - RNA, 21 nt, Human
agacaaaaggcgaaaauacag

SEQ ID NO: 1035531 - RNA, 23 nt, Human
agagaaggaguuaauaagauggc

SEQ ID NO: 1035532 - RNA, 20 nt, Human
agcuccaagcuccccccacc

SEQ ID NO: 1035533 - RNA, 23 nt, Human
aggcaaaaaggcggcuucgcuga

SEQ ID NO: 1035534 - RNA, 21 nt, Human
aggggaggccaggcagggcug

SEQ ID NO: 1035535 - RNA, 25 nt, Human
agguagcucccuuaccugcuagagg

SEQ ID NO: 1035536 - RNA, 20 nt, Human
agugggggacagaagcagag

SEQ ID NO: 1035537 - RNA, 20 nt, Human
caaagaaaaggucuuccuuu

SEQ ID NO: 1035538 - RNA, 19 nt, Human
caaagaaaguguacaagcu

SEQ ID NO: 1035539 - RNA, 18 nt, Human
caaaucaaacaaaaggca

SEQ ID NO: 1035540 - RNA, 28 nt, Human
caagagagacaaagacauacaugcagau

SEQ ID NO: 1035541 - RNA, 24 nt, Human
caagcaucuuaacuggcuuauauu

SEQ ID NO: 1035542 - RNA, 22 nt, Human
caagguaaccggggucagauca

SEQ ID NO: 1035543 - RNA, 19 nt, Human
caagucauaaggaaaaauc

SEQ ID NO: 1035544 - RNA, 21 nt, Human
caccauagaaaauacccccca

SEQ ID NO: 1035545 - RNA, 18 nt, Human
cacccacccauagaacaa

SEQ ID NO: 1035546 - RNA, 19 nt, Human
cacucccccuuccagucac

SEQ ID NO: 1035547 - RNA, 20 nt, Human
cagaaggaaagauuguccau

SEQ ID NO: 1035548 - RNA, 19 nt, Human
cagcacuggagggcaggca

SEQ ID NO: 1035549 - RNA, 21 nt, Human
cagcuagaaaaccucuucagg

SEQ ID NO: 1035550 - RNA, 18 nt, Human
cagcuccaagcucccccc

SEQ ID NO: 1035551 - RNA, 18 nt, Human
cagcuccaagcucccccc

SEQ ID NO: 1035552 - RNA, 22 nt, Human
cagcuccaagcuccccccaccc

SEQ ID NO: 1035553 - RNA, 20 nt, Human
cagguucugggguggcuggg

SEQ ID NO: 1035554 - RNA, 27 nt, Human
caguugugcuccagccuuccaggaggu

SEQ ID NO: 1035555 - RNA, 24 nt, Human
cauaggagggcuccugacuguccu

SEQ ID NO: 1035556 - RNA, 19 nt, Human
ccagcuccccccaaccccc

SEQ ID NO: 1035557 - RNA, 18 nt, Human
cccaacaccaaagacgag

SEQ ID NO: 1035558 - RNA, 23 nt, Human
cccaacccccaacaccaaagacg

SEQ ID NO: 1035559 - RNA, 26 nt, Human
cccaacccccaacaccaaagacgaga

SEQ ID NO: 1035560 - RNA, 20 nt, Human
cccaccagcuccccccaacc

SEQ ID NO: 1035561 - RNA, 18 nt, Human
cccacccacccauagaac

SEQ ID NO: 1035562 - RNA, 21 nt, Human
cccacccauagaacaaaaaga

SEQ ID NO: 1035563 - RNA, 21 nt, Human
ccccacccacccauagaacaa

SEQ ID NO: 1035564 - RNA, 24 nt, Human
cccccaacaccaaagacgagaaaa

SEQ ID NO: 1035565 - RNA, 21 nt, Human
cccccacccacccauagaaca

SEQ ID NO: 1035566 - RNA, 23 nt, Human
ccccccacccacccauagaacaa

SEQ ID NO: 1035567 - RNA, 24 nt, Human
ccccccacccacccauagaacaaa

SEQ ID NO: 1035568 - RNA, 20 nt, Human
cccucagggugaccagggag

SEQ ID NO: 1035569 - RNA, 22 nt, Human
ccguugacagaaggaaagauug

SEQ ID NO: 1035570 - RNA, 22 nt, Human
ccucacccaccagcucccccca

SEQ ID NO: 1035571 - RNA, 20 nt, Human
cgucgccccuucuccggccc

SEQ ID NO: 1035572 - RNA, 22 nt, Human
cuccugacuguccucaaaagcc

SEQ ID NO: 1035573 - RNA, 19 nt, Human
cuggggaggcagggcuggg

SEQ ID NO: 1035574 - RNA, 19 nt, Human
gaaaguguacaagcuacgg

SEQ ID NO: 1035575 - RNA, 20 nt, Human
gaacaaaaagaggaaaaaaa

SEQ ID NO: 1035576 - RNA, 24 nt, Human
gaacaaaaagaggaaaaaaaauau

SEQ ID NO: 1035577 - RNA, 23 nt, Human
gaaccagcuaggacuuguuuucc

SEQ ID NO: 1035578 - RNA, 18 nt, Human
gacaagagagacaaagac

SEQ ID NO: 1035579 - RNA, 25 nt, Human
gaccagggaggagcugugacuggcu

SEQ ID NO: 1035580 - RNA, 23 nt, Human
gacgcaccagccgcccaaccacc

SEQ ID NO: 1035581 - RNA, 20 nt, Human
gagacaaagacauacaugca

SEQ ID NO: 1035582 - RNA, 20 nt, Human
gaggagcugugacuggcugg

SEQ ID NO: 1035583 - RNA, 23 nt, Human
gaggcaguugugcuccagccuuc

SEQ ID NO: 1035584 - RNA, 22 nt, Human
gagguuggaagcaggggaaccc

SEQ ID NO: 1035585 - RNA, 20 nt, Human
gcaccagccgcccaaccacc

SEQ ID NO: 1035586 - RNA, 19 nt, Human
gcagaaaaauggcuucccu

SEQ ID NO: 1035587 - RNA, 19 nt, Human
gccaggcuccacaggagug

SEQ ID NO: 1035588 - RNA, 18 nt, Human
gcuccaagcuccccccac

SEQ ID NO: 1035589 - RNA, 22 nt, Human
gcuccaagcuccccccacccac

SEQ ID NO: 1035590 - RNA, 23 nt, Human
ggaagcaggggaacccuuuacug

SEQ ID NO: 1035591 - RNA, 18 nt, Human
ggcccagaaccuuuuugu

SEQ ID NO: 1035592 - RNA, 22 nt, Human
ggcccagaaccuuuuuguaagu

SEQ ID NO: 1035593 - RNA, 23 nt, Human
ggcuggcacacuaggccuggcag

SEQ ID NO: 1035594 - RNA, 20 nt, Human
ggcuggggccgagguuccuc

SEQ ID NO: 1035595 - RNA, 18 nt, Human
gggggacagaagcagagc

SEQ ID NO: 1035596 - RNA, 19 nt, Human
gggggacagaagcagagca

SEQ ID NO: 1035597 - RNA, 22 nt, Human
gucagagucaaacuaggccugc

SEQ ID NO: 1035598 - RNA, 18 nt, Human
uaagacagcuccaagcuc

SEQ ID NO: 1035599 - RNA, 23 nt, Human
uaagagacaaaaggcgaaaauac

SEQ ID NO: 1035600 - RNA, 23 nt, Human
uaauuccauugcagaaaaauggc

SEQ ID NO: 1035601 - RNA, 24 nt, Human
uaggagggcuccugacuguccuca

SEQ ID NO: 1035602 - RNA, 22 nt, Human
uauacaagacaaagauggauuc

SEQ ID NO: 1035603 - RNA, 23 nt, Human
uauauacauuuaaaacauuaccu

SEQ ID NO: 1035604 - RNA, 20 nt, Human
ucaaaacuguuaacugcuga

SEQ ID NO: 1035605 - RNA, 21 nt, Human
ucaaaacuguuaacugcugac

SEQ ID NO: 1035606 - RNA, 19 nt, Human
ucaaacaaaaggcacaaga

SEQ ID NO: 1035607 - RNA, 22 nt, Human
ucaaacuaggccugccccugcc

SEQ ID NO: 1035608 - RNA, 20 nt, Human
ucacccaccagcucccccca

SEQ ID NO: 1035609 - RNA, 20 nt, Human
ucacuggagcccauaggagg

SEQ ID NO: 1035610 - RNA, 19 nt, Human
ucagggugaccagggagga

SEQ ID NO: 1035611 - RNA, 21 nt, Human
ucagguucugggguggcuggg

SEQ ID NO: 1035612 - RNA, 25 nt, Human
uccaagcuccccccacccacccaua

SEQ ID NO: 1035613 - RNA, 21 nt, Human
ucgcuaguccuaaagcuauau

SEQ ID NO: 1035614 - RNA, 21 nt, Human
ucuaagagguggaagaagagg

SEQ ID NO: 1035615 - RNA, 19 nt, Human
ucucucuacacaaagaaaa

SEQ ID NO: 1035616 - RNA, 21 nt, Human
ugccauuucgcuaguccuaaa

SEQ ID NO: 1035617 - RNA, 21 nt, Human
uggaagaagaggaccagaagc

SEQ ID NO: 1035618 - RNA, 25 nt, Human
uggaagaagaggaccagaagcuggu

SEQ ID NO: 1035619 - RNA, 19 nt, Human
uggaagcaggggaacccuu

SEQ ID NO: 1035620 - RNA, 18 nt, Human
uggagcccauaggagggc

SEQ ID NO: 1035621 - RNA, 19 nt, Human
uggcagcacuggagggcag

SEQ ID NO: 1035622 - RNA, 18 nt, Human
uggcuggggaggcagggc

SEQ ID NO: 1035623 - RNA, 21 nt, Human
ugugcuccagccuuccaggag

SEQ ID NO: 1035624 - RNA, 21 nt, Human
ugugcuccagccuuccaggag

SEQ ID NO: 1035625 - RNA, 20 nt, Human
uugugcuccagccuuccagg

SEQ ID NO: 1035626 - RNA, 20 nt, Human
aaagcauuuuuauccuuuua

SEQ ID NO: 1035627 - RNA, 18 nt, Human
acauaagauucucucucu

SEQ ID NO: 1035628 - RNA, 20 nt, Human
ccaggaaauuucauuguucu

SEQ ID NO: 1035629 - RNA, 21 nt, Human
uaaaaagguauucuuauauga

SEQ ID NO: 1035630 - RNA, 25 nt, Human
uaaaaugcuuuaguaacucauuuuc

SEQ ID NO: 1035631 - RNA, 24 nt, Human
uaacuccauuuaaaaaacauaaga

SEQ ID NO: 1035632 - RNA, 23 nt, Human
ugaaguaacuucuauuuaaaaaa

SEQ ID NO: 1035633 - RNA, 18 nt, Human
uggcauuauaaaaauaca

SEQ ID NO: 1035634 - RNA, 27 nt, Human
ugguacaaggcagguauuauuuaaaau

SEQ ID NO: 1035635 - RNA, 20 nt, Human
uguauaaauaaagcauuuuu

SEQ ID NO: 1035636 - RNA, 21 nt, Human
uuuaaaaugcuuuaguaacuc

SEQ ID NO: 1035637 - RNA, 21 nt, Human
uuuaaaauucauaacuccauu

SEQ ID NO: 1035638 - RNA, 21 nt, Human
aaaguucuuucaggaaaggcc

SEQ ID NO: 1035639 - RNA, 26 nt, Human
aaaguucuuucaggaaaggccuacuu

SEQ ID NO: 1035640 - RNA, 18 nt, Human
aucuuuugugaagcuuuc

SEQ ID NO: 1035641 - RNA, 22 nt, Human
caaaaggagcuccgaacugaug

SEQ ID NO: 1035642 - RNA, 21 nt, Human
caaagcagccccuauuaaagc

SEQ ID NO: 1035643 - RNA, 25 nt, Human
cagaaaguucuuucaggaaaggccu

SEQ ID NO: 1035644 - RNA, 20 nt, Human
cagaacgcucaguaccuucc

SEQ ID NO: 1035645 - RNA, 19 nt, Human
ccccuauuaaagcacucug

SEQ ID NO: 1035646 - RNA, 23 nt, Human
gaugccaaaaggagcuccgaacu

SEQ ID NO: 1035647 - RNA, 20 nt, Human
gugaagcuuuccuuagaaaa

SEQ ID NO: 1035648 - RNA, 18 nt, Human
ucccuuccuuugaucuuu

SEQ ID NO: 1035649 - RNA, 20 nt, Human
uccgaacugaugugagccuc

SEQ ID NO: 1035650 - RNA, 19 nt, Human
ucucgcugcucugacuggu

SEQ ID NO: 1035651 - RNA, 23 nt, Human
ugggagucccccaaagcagcccc

SEQ ID NO: 1035652 - RNA, 18 nt, Human
uuagaaaaccgaaacuca

SEQ ID NO: 1035653 - RNA, 24 nt, Human
uucagaucuuccugagucuacuuc

SEQ ID NO: 1035654 - RNA, 22 nt, Human
uuccuuugaucuuuugugaagc

SEQ ID NO: 1035655 - RNA, 20 nt, Human
agacagaaaccaaggacucu

SEQ ID NO: 1035656 - RNA, 22 nt, Human
cagaaaccaaggacucuggagc

SEQ ID NO: 1035657 - RNA, 19 nt, Human
cagacagaaaccaaggacu

SEQ ID NO: 1035658 - RNA, 23 nt, Human
caggccccugcuugguuccccaa

SEQ ID NO: 1035659 - RNA, 24 nt, Human
caguugguuuccuugcuugggucu

SEQ ID NO: 1035660 - RNA, 21 nt, Human
cuccaggccccugcuugguuc

SEQ ID NO: 1035661 - RNA, 19 nt, Human
cucuggagcugaagaugga

SEQ ID NO: 1035662 - RNA, 24 nt, Human
cugaagcugugcugagacagucuc

SEQ ID NO: 1035663 - RNA, 21 nt, Human
cugguuuccuugcuuuggcag

SEQ ID NO: 1035664 - RNA, 22 nt, Human
cugugcugagacagucuucuuc

SEQ ID NO: 1035665 - RNA, 18 nt, Human
cuuugccccacuccuuca

SEQ ID NO: 1035666 - RNA, 20 nt, Human
gcuccaggccccugcuuggu

SEQ ID NO: 1035667 - RNA, 19 nt, Human
uacacuuugccccacuccu

SEQ ID NO: 1035668 - RNA, 22 nt, Human
ucagaugagccuggcggaagca

SEQ ID NO: 1035669 - RNA, 19 nt, Human
uccccaacugaagcugugc

SEQ ID NO: 1035670 - RNA, 25 nt, Human
uccccaacugaagcugugcugagac

SEQ ID NO: 1035671 - RNA, 19 nt, Human
ucuccagguggguuaggug

SEQ ID NO: 1035672 - RNA, 19 nt, Human
ucugcuaauaucuucccca

SEQ ID NO: 1035673 - RNA, 20 nt, Human
ucuucuggguucagugauga

SEQ ID NO: 1035674 - RNA, 23 nt, Human
ugcugagacagucuucuucucca

SEQ ID NO: 1035675 - RNA, 23 nt, Human
uggcggaagcagagauguccuuc

SEQ ID NO: 1035676 - RNA, 21 nt, Human
ugggucucacuugauuuccaa

SEQ ID NO: 1035677 - RNA, 20 nt, Human
ugucugcuaauaucuucccc

SEQ ID NO: 1035678 - RNA, 23 nt, Human
uucccaguuucagccauagaccc

SEQ ID NO: 1035679 - RNA, 20 nt, Human
uugcuugggucucacuugau

SEQ ID NO: 1035680 - RNA, 22 nt, Human
aagacagacccacacaugaaca

SEQ ID NO: 1035681 - RNA, 23 nt, Human
aagauauucacgcagagccagca

SEQ ID NO: 1035682 - RNA, 24 nt, Human
aaggaagacagacccacacaugaa

SEQ ID NO: 1035683 - RNA, 23 nt, Human
accauagcuguaguggaaacaga

SEQ ID NO: 1035684 - RNA, 22 nt, Human
accucguuucuccugguuccag

SEQ ID NO: 1035685 - RNA, 28 nt, Human
agacagacccacacaugaaccggacccc

SEQ ID NO: 1035686 - RNA, 19 nt, Human
agugugaucucucagcugg

SEQ ID NO: 1035687 - RNA, 19 nt, Human
auagacuccaaccaaucag

SEQ ID NO: 1035688 - RNA, 21 nt, Human
cagaacuggugagaaaugcuc

SEQ ID NO: 1035689 - RNA, 21 nt, Human
caguaugcaagagugauacuc

SEQ ID NO: 1035690 - RNA, 24 nt, Human
ccaaaaguuuugcccaaagaacuc

SEQ ID NO: 1035691 - RNA, 23 nt, Human
ccaaccaaucagaauggauuuca

SEQ ID NO: 1035692 - RNA, 18 nt, Human
cccacacaugaacaaggu

SEQ ID NO: 1035693 - RNA, 21 nt, Human
ccucaucuuucuagggauggg

SEQ ID NO: 1035694 - RNA, 18 nt, Human
cugauuggcauaaggaag

SEQ ID NO: 1035695 - RNA, 18 nt, Human
cugcagaaauuuucagag

SEQ ID NO: 1035696 - RNA, 21 nt, Human
cugccaguaccacucuccucu

SEQ ID NO: 1035697 - RNA, 20 nt, Human
gcaguguggguucuagggcu

SEQ ID NO: 1035698 - RNA, 20 nt, Human
gccuuaauagaaccuucagu

SEQ ID NO: 1035699 - RNA, 24 nt, Human
ggaagacagacccacacaugaaca

SEQ ID NO: 1035700 - RNA, 18 nt, Human
ggccacugggguucagga

SEQ ID NO: 1035701 - RNA, 18 nt, Human
gggaguaggaauaauggg

SEQ ID NO: 1035702 - RNA, 19 nt, Human
gggccagggcuauuugggg

SEQ ID NO: 1035703 - RNA, 22 nt, Human
ggguaaaaagguuauuuuuuca

SEQ ID NO: 1035704 - RNA, 18 nt, Human
guuuugcccaaagaacuc

SEQ ID NO: 1035705 - RNA, 18 nt, Human
uaacaguaugcaagagug

SEQ ID NO: 1035706 - RNA, 20 nt, Human
uagcaccggcugauagacuu

SEQ ID NO: 1035707 - RNA, 22 nt, Human
uaggaugcauugcuucccaaaa

SEQ ID NO: 1035708 - RNA, 22 nt, Human
ucaggcugaauaucagcccaug

SEQ ID NO: 1035709 - RNA, 20 nt, Human
ucaguugggucuacugcaga

SEQ ID NO: 1035710 - RNA, 21 nt, Human
ucucuuguuuccuuguuacuc

SEQ ID NO: 1035711 - RNA, 23 nt, Human
ugcauugcuucccaaaaguuuug

SEQ ID NO: 1035712 - RNA, 19 nt, Human
uggcagugacuccugguag

SEQ ID NO: 1035713 - RNA, 18 nt, Human
uggccauugcugggaccu

SEQ ID NO: 1035714 - RNA, 25 nt, Human
ugugugggccagggcuauuugggga

SEQ ID NO: 1035715 - RNA, 21 nt, Human
uuccaggaugaucccaugccc

SEQ ID NO: 1035716 - RNA, 20 nt, Human
uuucagccauaaacugccag

SEQ ID NO: 1035717 - RNA, 26 nt, Human
uuucauuucccccuuuucuucacaca

SEQ ID NO: 1035718 - RNA, 21 nt, Human
uuuucugugugggccagggcu

SEQ ID NO: 1035719 - RNA, 19 nt, Human
acugcugguucuggauggu

SEQ ID NO: 1035720 - RNA, 23 nt, Human
augguccuguugcaugagcccac

SEQ ID NO: 1035721 - RNA, 18 nt, Human
cgaccacuuucucauuuu

SEQ ID NO: 1035722 - RNA, 18 nt, Human
cuggaugguccuguugca

SEQ ID NO: 1035723 - RNA, 20 nt, Human
gagcccacgaccacuuucuc

SEQ ID NO: 1035724 - RNA, 22 nt, Human
uggacauggacaaucugaaacc

SEQ ID NO: 1035725 - RNA, 18 nt, Human
uuucucauuuuugaaaag

SEQ ID NO: 1035726 - RNA, 24 nt, Human
aaaagggagggugaagggaugagg

SEQ ID NO: 1035727 - RNA, 21 nt, Human
aacacaacagcaaacugaaca

SEQ ID NO: 1035728 - RNA, 22 nt, Human
aacugcggcucucagcucugcc

SEQ ID NO: 1035729 - RNA, 21 nt, Human
aagcugccuuccuucuuugcc

SEQ ID NO: 1035730 - RNA, 21 nt, Human
acaacagcaaacugaacagag

SEQ ID NO: 1035731 - RNA, 23 nt, Human
acacaacagcaaacugaacagag

SEQ ID NO: 1035732 - RNA, 26 nt, Human
acaguuccaagaauuuuuuuuuuuuu

SEQ ID NO: 1035733 - RNA, 18 nt, Human
agaaaaacacaacagcaa

SEQ ID NO: 1035734 - RNA, 18 nt, Human
agcugcuucuagcaucag

SEQ ID NO: 1035735 - RNA, 21 nt, Human
aggcaggcagucugcagcugc

SEQ ID NO: 1035736 - RNA, 21 nt, Human
aggggccugggagaaagcauu

SEQ ID NO: 1035737 - RNA, 22 nt, Human
agucagguuccuuccuucccug

SEQ ID NO: 1035738 - RNA, 19 nt, Human
caaaauggaucaaugagcc

SEQ ID NO: 1035739 - RNA, 24 nt, Human
caaacugaacagagcagaggccga

SEQ ID NO: 1035740 - RNA, 23 nt, Human
caagaacccaaagacggaagcug

SEQ ID NO: 1035741 - RNA, 22 nt, Human
cacaacagcaaacugaacagag

SEQ ID NO: 1035742 - RNA, 20 nt, Human
cagagcagaggccgaggcag

SEQ ID NO: 1035743 - RNA, 21 nt, Human
cagcagcuuugagccugaugc

SEQ ID NO: 1035744 - RNA, 20 nt, Human
cagcccccacgccacagccc

SEQ ID NO: 1035745 - RNA, 22 nt, Human
cagcccccacgccacagccccc

SEQ ID NO: 1035746 - RNA, 23 nt, Human
caggcagucugcagcugcucacc

SEQ ID NO: 1035747 - RNA, 19 nt, Human
cauggggaaggauuagggg

SEQ ID NO: 1035748 - RNA, 30 nt, Human
ccaccacccccacaugggggagaaaaacaa

SEQ ID NO: 1035749 - RNA, 18 nt, Human
ccaggaugcaacugcggc

SEQ ID NO: 1035750 - RNA, 21 nt, Human
cccacauggcgaaaagggagg

SEQ ID NO: 1035751 - RNA, 27 nt, Human
cccaccacccccacaugggggagaaaa

SEQ ID NO: 1035752 - RNA, 20 nt, Human
ccccaccacccccacauggg

SEQ ID NO: 1035753 - RNA, 26 nt, Human
ccccacgccacagcccccccuuucuc

SEQ ID NO: 1035754 - RNA, 24 nt, Human
cccccaaaugcccucaaaauggau

SEQ ID NO: 1035755 - RNA, 25 nt, Human
cccccacaugggggagaaaaacaca

SEQ ID NO: 1035756 - RNA, 22 nt, Human
cccgccuuagccccuccucagc

SEQ ID NO: 1035757 - RNA, 23 nt, Human
cccucccgccuuagccccuccuc

SEQ ID NO: 1035758 - RNA, 21 nt, Human
cccuguaccccaccaccccca

SEQ ID NO: 1035759 - RNA, 19 nt, Human
ccgccuuagccccuccuca

SEQ ID NO: 1035760 - RNA, 19 nt, Human
ccucccgccuuagccccuc

SEQ ID NO: 1035761 - RNA, 25 nt, Human
ccucccgccuuagccccuccucagc

SEQ ID NO: 1035762 - RNA, 28 nt, Human
cgacugacuucuaaauggagcagauugc

SEQ ID NO: 1035763 - RNA, 22 nt, Human
cgaggcagcaagaacccaaaga

SEQ ID NO: 1035764 - RNA, 22 nt, Human
cgccuuagccccuccucagccc

SEQ ID NO: 1035765 - RNA, 25 nt, Human
cgccuuagccccuccucagccccca

SEQ ID NO: 1035766 - RNA, 21 nt, Human
cggaagcugcuucuagcauca

SEQ ID NO: 1035767 - RNA, 20 nt, Human
cucaacuuugacccccaaau

SEQ ID NO: 1035768 - RNA, 18 nt, Human
cucauuucacuucuguuc

SEQ ID NO: 1035769 - RNA, 21 nt, Human
cuccaccucaacaaaccuuua

SEQ ID NO: 1035770 - RNA, 25 nt, Human
cuccucagcccccacgccacagccc

SEQ ID NO: 1035771 - RNA, 24 nt, Human
gagcagaggccgaggcagcaagaa

SEQ ID NO: 1035772 - RNA, 21 nt, Human
gaguaaggaggcuguucuagg

SEQ ID NO: 1035773 - RNA, 20 nt, Human
gccgaggcagcaagaaccca

SEQ ID NO: 1035774 - RNA, 30 nt, Human
gccgaggcagcaagaacccaaagacggaag

SEQ ID NO: 1035775 - RNA, 19 nt, Human
gccugaugcaggcaugggg

SEQ ID NO: 1035776 - RNA, 19 nt, Human
gccuuagccccuccucagc

SEQ ID NO: 1035777 - RNA, 23 nt, Human
gcuggaguaaggaggcuguucua

SEQ ID NO: 1035778 - RNA, 22 nt, Human
ggcgaaaagggagggugaaggg

SEQ ID NO: 1035779 - RNA, 23 nt, Human
ggcgaaaagggagggugaaggga

SEQ ID NO: 1035780 - RNA, 20 nt, Human
uaagaaaugcuaauuuuaua

SEQ ID NO: 1035781 - RNA, 19 nt, Human
uagccccuccucagccccc

SEQ ID NO: 1035782 - RNA, 18 nt, Human
ucacuucuguuccuccac

SEQ ID NO: 1035783 - RNA, 23 nt, Human
ucagcagcuuugagccugaugca

SEQ ID NO: 1035784 - RNA, 19 nt, Human
ucagguuccuuccuucccu

SEQ ID NO: 1035785 - RNA, 18 nt, Human
ucccucgaccucuucugg

SEQ ID NO: 1035786 - RNA, 21 nt, Human
ucccuguaccccaccaccccc

SEQ ID NO: 1035787 - RNA, 22 nt, Human
ucugcccuuccuccuggccccc

SEQ ID NO: 1035788 - RNA, 23 nt, Human
ugauaagaaaugcuaauuuuaua

SEQ ID NO: 1035789 - RNA, 23 nt, Human
ugaugcaggcauggggaaggauu

SEQ ID NO: 1035790 - RNA, 18 nt, Human
ugcccuuccuccuggcca

SEQ ID NO: 1035791 - RNA, 21 nt, Human
uggaacaagcugccuuccuuc

SEQ ID NO: 1035792 - RNA, 19 nt, Human
uggaaugaacagccgaagc

SEQ ID NO: 1035793 - RNA, 27 nt, Human
uggccagaagagaauuuggucgacacg

SEQ ID NO: 1035794 - RNA, 18 nt, Human
ugggcagggcuggaaggu

SEQ ID NO: 1035795 - RNA, 18 nt, Human
uucuaggcaggcagucug

SEQ ID NO: 1035796 - RNA, 19 nt, Human
uugagccugaugcaggcau

SEQ ID NO: 1035797 - RNA, 20 nt, Human
uuuuuuuuuuucauauuugu

SEQ ID NO: 1035798 - RNA, 18 nt, Human
aaaaaagcaacaggaaaa

SEQ ID NO: 1035799 - RNA, 23 nt, Human
aaaaagcaacaggaaaauauuaa

SEQ ID NO: 1035800 - RNA, 22 nt, Human
aaaggagacagacuuguggaga

SEQ ID NO: 1035801 - RNA, 20 nt, Human
aaagguuuguuuuuuguuuu

SEQ ID NO: 1035802 - RNA, 18 nt, Human
aacaaacauaaccaauuu

SEQ ID NO: 1035803 - RNA, 20 nt, Human
aagcuucacuuaaccuaaaa

SEQ ID NO: 1035804 - RNA, 25 nt, Human
aagguuuguuuuuuguuuuuuuuuu

SEQ ID NO: 1035805 - RNA, 20 nt, Human
aauacaccauguaggcaaaa

SEQ ID NO: 1035806 - RNA, 23 nt, Human
acaagaagguaaccaagucagua

SEQ ID NO: 1035807 - RNA, 18 nt, Human
acaccauguaggcaaaac

SEQ ID NO: 1035808 - RNA, 24 nt, Human
accagauagcucuugucgaguccu

SEQ ID NO: 1035809 - RNA, 22 nt, Human
acuaaaaaacaaacauaaccaa

SEQ ID NO: 1035810 - RNA, 24 nt, Human
acuucaucaaguuaacaaaauaau

SEQ ID NO: 1035811 - RNA, 21 nt, Human
agaaacccauaaaguuaguga

SEQ ID NO: 1035812 - RNA, 18 nt, Human
agcccccccaagcuucac

SEQ ID NO: 1035813 - RNA, 23 nt, Human
aggcaauuugucaaucaaaaaua

SEQ ID NO: 1035814 - RNA, 21 nt, Human
aguuaaugauaaagaccacaa

SEQ ID NO: 1035815 - RNA, 24 nt, Human
auacacaguacagaaagaauuaaa

SEQ ID NO: 1035816 - RNA, 18 nt, Human
auacaccauguaggcaaa

SEQ ID NO: 1035817 - RNA, 21 nt, Human
aucccaucauccuuuuacucu

SEQ ID NO: 1035818 - RNA, 20 nt, Human
augcuauaaaccacacuggg

SEQ ID NO: 1035819 - RNA, 24 nt, Human
auggggcagaagagcuauacaaag

SEQ ID NO: 1035820 - RNA, 22 nt, Human
auuccuguuuuuauuuuuggaa

SEQ ID NO: 1035821 - RNA, 23 nt, Human
auuccuguuuuuauuuuuggaag

SEQ ID NO: 1035822 - RNA, 24 nt, Human
caaaauaauuacuagccaacccua

SEQ ID NO: 1035823 - RNA, 21 nt, Human
caagagacaagaagguaacca

SEQ ID NO: 1035824 - RNA, 24 nt, Human
caccauguaggcaaaacacacuaa

SEQ ID NO: 1035825 - RNA, 21 nt, Human
cagaagagcuauacaaaggua

SEQ ID NO: 1035826 - RNA, 20 nt, Human
cagcacaccccacaaggcuc

SEQ ID NO: 1035827 - RNA, 22 nt, Human
cagcacaccccacaaggcuccg

SEQ ID NO: 1035828 - RNA, 22 nt, Human
caguacaaauguaugcuauaaa

SEQ ID NO: 1035829 - RNA, 18 nt, Human
cauaaucugucaggaaaa

SEQ ID NO: 1035830 - RNA, 22 nt, Human
ccauguaggcaaaacacacuaa

SEQ ID NO: 1035831 - RNA, 23 nt, Human
cccaagcuucacuuaaccuaaaa

SEQ ID NO: 1035832 - RNA, 21 nt, Human
cccaucauccuuuuacucuua

SEQ ID NO: 1035833 - RNA, 23 nt, Human
ccccaagcuucacuuaaccuaaa

SEQ ID NO: 1035834 - RNA, 19 nt, Human
cccccaagcuucacuuaac

SEQ ID NO: 1035835 - RNA, 20 nt, Human
cccccaagcuucacuuaacc

SEQ ID NO: 1035836 - RNA, 23 nt, Human
cgcgaccccggcccgcgccuccc

SEQ ID NO: 1035837 - RNA, 21 nt, Human
cgggaggugcgcgaccccggc

SEQ ID NO: 1035838 - RNA, 21 nt, Human
cuuaaaaauuuccaucacuuc

SEQ ID NO: 1035839 - RNA, 21 nt, Human
cuugagguugacaaaaaagga

SEQ ID NO: 1035840 - RNA, 23 nt, Human
gaaguacaauauaguaacauaaa

SEQ ID NO: 1035841 - RNA, 20 nt, Human
gcaaaacacacuaauauuua

SEQ ID NO: 1035842 - RNA, 21 nt, Human
gcgcgaccccggcccgcgccu

SEQ ID NO: 1035843 - RNA, 20 nt, Human
guaaaaugcauccaaguacc

SEQ ID NO: 1035844 - RNA, 18 nt, Human
guuuguuuuuuguuuuuu

SEQ ID NO: 1035845 - RNA, 20 nt, Human
uaaaaaacaaacauaaccaa

SEQ ID NO: 1035846 - RNA, 21 nt, Human
uaaaaaagcaacaggaaaaua

SEQ ID NO: 1035847 - RNA, 24 nt, Human
uaaaaugcauccaaguaccugcca

SEQ ID NO: 1035848 - RNA, 22 nt, Human
uaacaaaauaauuacuagccaa

SEQ ID NO: 1035849 - RNA, 23 nt, Human
uaaccaagucaguagccccccca

SEQ ID NO: 1035850 - RNA, 20 nt, Human
uacugauucuauguaguucu

SEQ ID NO: 1035851 - RNA, 22 nt, Human
uauaaaaauauuauacacaguu

SEQ ID NO: 1035852 - RNA, 19 nt, Human
uauacaucuaucuauugcc

SEQ ID NO: 1035853 - RNA, 19 nt, Human
uauuuggaaaaagaaaauu

SEQ ID NO: 1035854 - RNA, 23 nt, Human
ucaguagcccccccaagcuucac

SEQ ID NO: 1035855 - RNA, 23 nt, Human
ucaucuguacacauaauuacuaa

SEQ ID NO: 1035856 - RNA, 22 nt, Human
uccaaguaccugccaaaagaaa

SEQ ID NO: 1035857 - RNA, 21 nt, Human
ucccuauaugcuucaguacaa

SEQ ID NO: 1035858 - RNA, 21 nt, Human
ucuauguaguucuguguugcc

SEQ ID NO: 1035859 - RNA, 19 nt, Human
ugacaaaaaaggagacaga

SEQ ID NO: 1035860 - RNA, 20 nt, Human
ugacuucaucaaguuaacaa

SEQ ID NO: 1035861 - RNA, 21 nt, Human
ugcgcgaccccggcccgcgcc

SEQ ID NO: 1035862 - RNA, 19 nt, Human
ugcuauaaaccacacuggg

SEQ ID NO: 1035863 - RNA, 24 nt, Human
uggcuaaagcuuucaaaaaauaaa

SEQ ID NO: 1035864 - RNA, 19 nt, Human
uggguagaugacauacugu

SEQ ID NO: 1035865 - RNA, 20 nt, Human
uguagaucauaguagguaga

SEQ ID NO: 1035866 - RNA, 20 nt, Human
uuagaaacaccaauugccau

SEQ ID NO: 1035867 - RNA, 20 nt, Human
uuaguaccuaauaugaaauc

SEQ ID NO: 1035868 - RNA, 23 nt, Human
uuaguggauggcuaaagcuuuca

SEQ ID NO: 1035869 - RNA, 20 nt, Human
uuccaaaaauugucuuauca

SEQ ID NO: 1035870 - RNA, 22 nt, Human
uucccaaauuacagaacauuaa

SEQ ID NO: 1035871 - RNA, 22 nt, Human
uugcaguacaacguugcauguu

SEQ ID NO: 1035872 - RNA, 22 nt, Human
uuguugguauaaaaucccauca

SEQ ID NO: 1035873 - RNA, 22 nt, Human
uuuaaaucucaacuagccccaa

SEQ ID NO: 1035874 - RNA, 23 nt, Human
uuugacaaccuuucuaaauaauu

SEQ ID NO: 1035875 - RNA, 23 nt, Human
aaacucaugucuaacacaguugg

SEQ ID NO: 1035876 - RNA, 18 nt, Human
aaagauauuucaaagauu

SEQ ID NO: 1035877 - RNA, 24 nt, Human
aaaguagagaaauauuuuuaaaga

SEQ ID NO: 1035878 - RNA, 19 nt, Human
aaagugcuaggauuacagg

SEQ ID NO: 1035879 - RNA, 24 nt, Human
aaagugcuaggauuacagguguga

SEQ ID NO: 1035880 - RNA, 24 nt, Human
aacacaguuggaaccuaaaacuca

SEQ ID NO: 1035881 - RNA, 18 nt, Human
aacccacagcgccuucca

SEQ ID NO: 1035882 - RNA, 20 nt, Human
aagauauuucaaagauuuau

SEQ ID NO: 1035883 - RNA, 26 nt, Human
aagugcuaggauuacaggugugagcc

SEQ ID NO: 1035884 - RNA, 19 nt, Human
aauacucuuuauuagcccc

SEQ ID NO: 1035885 - RNA, 20 nt, Human
acaggguuucacccuguuag

SEQ ID NO: 1035886 - RNA, 21 nt, Human
acauaauuccuaagaaaggcc

SEQ ID NO: 1035887 - RNA, 18 nt, Human
acccuguuagccagaugg

SEQ ID NO: 1035888 - RNA, 23 nt, Human
accucggccucccaaagugcuag

SEQ ID NO: 1035889 - RNA, 18 nt, Human
acuggcugaggcaggcac

SEQ ID NO: 1035890 - RNA, 18 nt, Human
agacauagguuugaaaau

SEQ ID NO: 1035891 - RNA, 18 nt, Human
agacuuggcaccgcccag

SEQ ID NO: 1035892 - RNA, 19 nt, Human
agagcccagccccuucccu

SEQ ID NO: 1035893 - RNA, 24 nt, Human
agauggucuugaucuccugacuuc

SEQ ID NO: 1035894 - RNA, 19 nt, Human
aggaggggcaggacgaagg

SEQ ID NO: 1035895 - RNA, 23 nt, Human
aguagagacaggguuucacccug

SEQ ID NO: 1035896 - RNA, 23 nt, Human
augaugauguucauuaaugcuuu

SEQ ID NO: 1035897 - RNA, 23 nt, Human
caaaaacuaaaauguuucccagg

SEQ ID NO: 1035898 - RNA, 24 nt, Human
caaagugcuaggauuacaggugug

SEQ ID NO: 1035899 - RNA, 18 nt, Human
caccagggggagcaggac

SEQ ID NO: 1035900 - RNA, 23 nt, Human
cacccuguuagccagauggucuu

SEQ ID NO: 1035901 - RNA, 18 nt, Human
caccgcccagagcccagc

SEQ ID NO: 1035902 - RNA, 20 nt, Human
caccgcccagagcccagccc

SEQ ID NO: 1035903 - RNA, 21 nt, Human
cagcuucuucaccagggggag

SEQ ID NO: 1035904 - RNA, 19 nt, Human
caggguuucacccuguuag

SEQ ID NO: 1035905 - RNA, 24 nt, Human
cauggaucuagcaaacucaugucu

SEQ ID NO: 1035906 - RNA, 21 nt, Human
ccaaagugcuaggauuacagg

SEQ ID NO: 1035907 - RNA, 24 nt, Human
ccaaagugcuaggauuacaggugu

SEQ ID NO: 1035908 - RNA, 22 nt, Human
ccaaccaaccugacaguaaguu

SEQ ID NO: 1035909 - RNA, 21 nt, Human
ccacugcgccuggccuauuua

SEQ ID NO: 1035910 - RNA, 20 nt, Human
ccagagcccagccccuuccc

SEQ ID NO: 1035911 - RNA, 19 nt, Human
ccaggcucucccucaggca

SEQ ID NO: 1035912 - RNA, 23 nt, Human
ccauggaucuagcaaacucaugu

SEQ ID NO: 1035913 - RNA, 19 nt, Human
cccacagcgccuuccacug

SEQ ID NO: 1035914 - RNA, 19 nt, Human
ccccuggagacaucaauau

SEQ ID NO: 1035915 - RNA, 20 nt, Human
cccuaggagaggugggcggc

SEQ ID NO: 1035916 - RNA, 21 nt, Human
ccgaggaaauucaaacucccg

SEQ ID NO: 1035917 - RNA, 19 nt, Human
ccgcccagagcccagccuc

SEQ ID NO: 1035918 - RNA, 22 nt, Human
cuccugacuucgugaucugccc

SEQ ID NO: 1035919 - RNA, 23 nt, Human
cugggcggugaccgcgcccccuc

SEQ ID NO: 1035920 - RNA, 26 nt, Human
cuuaacaaaaacuaaaauguuuccca

SEQ ID NO: 1035921 - RNA, 24 nt, Human
cuuuaaaaaacauuaaaaauauua

SEQ ID NO: 1035922 - RNA, 18 nt, Human
gaaaggccuuauguaaga

SEQ ID NO: 1035923 - RNA, 19 nt, Human
gacauagguuugaaaaugg

SEQ ID NO: 1035924 - RNA, 22 nt, Human
gacuucgugaucugcccaccuc

SEQ ID NO: 1035925 - RNA, 24 nt, Human
gacuucgugaucugcccaccucgg

SEQ ID NO: 1035926 - RNA, 21 nt, Human
gagucuuucagcugccagcuc

SEQ ID NO: 1035927 - RNA, 18 nt, Human
gauuacaggugugagcca

SEQ ID NO: 1035928 - RNA, 22 nt, Human
gauuacaggugugagccacugc

SEQ ID NO: 1035929 - RNA, 22 nt, Human
gauuacaggugugagccacugc

SEQ ID NO: 1035930 - RNA, 18 nt, Human
gcacauuaccaaccaacc

SEQ ID NO: 1035931 - RNA, 21 nt, Human
gcccagagcccagccccuucc

SEQ ID NO: 1035932 - RNA, 24 nt, Human
ggaggaggggcaggacgaaggggu

SEQ ID NO: 1035933 - RNA, 22 nt, Human
ggauuacaggugugagccacug

SEQ ID NO: 1035934 - RNA, 18 nt, Human
ggcaccgcccagagccca

SEQ ID NO: 1035935 - RNA, 18 nt, Human
ggcauccucguugcuuca

SEQ ID NO: 1035936 - RNA, 22 nt, Human
ggcguaucaaaguaacucaaaa

SEQ ID NO: 1035937 - RNA, 24 nt, Human
gugaucugcccaccucggccuccc

SEQ ID NO: 1035938 - RNA, 23 nt, Human
guggauucuuaaccugcagugaa

SEQ ID NO: 1035939 - RNA, 21 nt, Human
uaaaaagauaagcuuugauua

SEQ ID NO: 1035940 - RNA, 23 nt, Human
uaaaauguuucccaggcuuuaga

SEQ ID NO: 1035941 - RNA, 24 nt, Human
uaacaaaaacuaaaauguuuccca

SEQ ID NO: 1035942 - RNA, 22 nt, Human
uaagaacauacuuacucugauu

SEQ ID NO: 1035943 - RNA, 26 nt, Human
uaaguaaaccaucuagagaccaugga

SEQ ID NO: 1035944 - RNA, 18 nt, Human
uacaauauaauaggugaa

SEQ ID NO: 1035945 - RNA, 22 nt, Human
uacaggugugagccacugcgcc

SEQ ID NO: 1035946 - RNA, 22 nt, Human
uacaggugugagccacugcgcc

SEQ ID NO: 1035947 - RNA, 23 nt, Human
uacaggugugagccacugcgccu

SEQ ID NO: 1035948 - RNA, 21 nt, Human
uagaaccuuaacaaaaacuaa

SEQ ID NO: 1035949 - RNA, 22 nt, Human
uagagacaggguuucacccugu

SEQ ID NO: 1035950 - RNA, 24 nt, Human
uagcaaaggcaccaggcucucccu

SEQ ID NO: 1035951 - RNA, 18 nt, Human
uaggagaggugggcggcg

SEQ ID NO: 1035952 - RNA, 19 nt, Human
uaggauuacaggugugagc

SEQ ID NO: 1035953 - RNA, 21 nt, Human
uaggauuacaggugugagcca

SEQ ID NO: 1035954 - RNA, 22 nt, Human
uaggauuacaggugugagccac

SEQ ID NO: 1035955 - RNA, 22 nt, Human
uaggauuacaggugugagccac

SEQ ID NO: 1035956 - RNA, 24 nt, Human
uaggauuacaggugugagccacug

SEQ ID NO: 1035957 - RNA, 19 nt, Human
ucacugagucuuucagcug

SEQ ID NO: 1035958 - RNA, 19 nt, Human
ucagcugccagcuccauag

SEQ ID NO: 1035959 - RNA, 19 nt, Human
uccaaauccgaggaaauuc

SEQ ID NO: 1035960 - RNA, 23 nt, Human
ucccaaagugcuaggauuacagg

SEQ ID NO: 1035961 - RNA, 19 nt, Human
uccccggcauccucguugc

SEQ ID NO: 1035962 - RNA, 19 nt, Human
ucccgggcgcgcgcaggcc

SEQ ID NO: 1035963 - RNA, 22 nt, Human
ucccucaggcauguuaucuuuu

SEQ ID NO: 1035964 - RNA, 18 nt, Human
ucggccucccaaagugcu

SEQ ID NO: 1035965 - RNA, 23 nt, Human
ucuccccggcauccucguugcuu

SEQ ID NO: 1035966 - RNA, 21 nt, Human
ugacaguaaguucaggugaca

SEQ ID NO: 1035967 - RNA, 21 nt, Human
ugacaguaaguucaggugaca

SEQ ID NO: 1035968 - RNA, 23 nt, Human
ugaggcaggcacauuaccaacca

SEQ ID NO: 1035969 - RNA, 24 nt, Human
ugaucugcccaccucggccuccca

SEQ ID NO: 1035970 - RNA, 24 nt, Human
ugcuaggauuacaggugugagcca

SEQ ID NO: 1035971 - RNA, 22 nt, Human
uggauucuuaaccugcagugaa

SEQ ID NO: 1035972 - RNA, 22 nt, Human
uggguacaauauaauaggugaa

SEQ ID NO: 1035973 - RNA, 21 nt, Human
uuaaguaaaccaucuagagac

SEQ ID NO: 1035974 - RNA, 22 nt, Human
uuagaaccuuaacaaaaacuaa

SEQ ID NO: 1035975 - RNA, 18 nt, Human
uuagccccuggagacauc

SEQ ID NO: 1035976 - RNA, 19 nt, Human
uuauguggauaauccauuu

SEQ ID NO: 1035977 - RNA, 20 nt, Human
uuccuaagaaaggccuuaug

SEQ ID NO: 1035978 - RNA, 26 nt, Human
uugguuguguggauucuuaaccugca

SEQ ID NO: 1035979 - RNA, 19 nt, Human
uuuauuagccccuggagac

SEQ ID NO: 1035980 - RNA, 22 nt, Human
uuucccaggcuuuagaguuuuc

SEQ ID NO: 1035981 - RNA, 24 nt, Human
aaaaaaaaaaaaaauacaaaaauu

SEQ ID NO: 1035982 - RNA, 23 nt, Human
aaaaaaaaccccaaaaccaugaa

SEQ ID NO: 1035983 - RNA, 24 nt, Human
aaaaauaaaaaaaaaccccaaaac

SEQ ID NO: 1035984 - RNA, 18 nt, Human
aaaaccccaaaaccauga

SEQ ID NO: 1035985 - RNA, 22 nt, Human
aaaccccguaucuaccaaaaaa

SEQ ID NO: 1035986 - RNA, 23 nt, Human
aaacuccuggccuccagcaaucc

SEQ ID NO: 1035987 - RNA, 18 nt, Human
aaagugcuggcauuauag

SEQ ID NO: 1035988 - RNA, 18 nt, Human
aacaaaacacaaacaaaa

SEQ ID NO: 1035989 - RNA, 23 nt, Human
aacagcucuuucugugacaguuu

SEQ ID NO: 1035990 - RNA, 18 nt, Human
aacauggugaaaccccgu

SEQ ID NO: 1035991 - RNA, 20 nt, Human
aacauggugaaaccccguau

SEQ ID NO: 1035992 - RNA, 21 nt, Human
aacauggugaaaccccguauc

SEQ ID NO: 1035993 - RNA, 22 nt, Human
aacauggugaaaccccguaucu

SEQ ID NO: 1035994 - RNA, 24 nt, Human
aacuccuggccuccagcaauccua

SEQ ID NO: 1035995 - RNA, 21 nt, Human
aacuucagaaaaucuugaucg

SEQ ID NO: 1035996 - RNA, 24 nt, Human
aagaacaaaacacaaacaaaaaaa

SEQ ID NO: 1035997 - RNA, 26 nt, Human
aagaacaaaacacaaacaaaaaaaua

SEQ ID NO: 1035998 - RNA, 21 nt, Human
aagaagaggcaaaugucaaga

SEQ ID NO: 1035999 - RNA, 22 nt, Human
aagaagaggcaaaugucaagaa

SEQ ID NO: 1036000 - RNA, 22 nt, Human
aagcgugguggcucacgccuga

SEQ ID NO: 1036001 - RNA, 24 nt, Human
aagcugaggcaggugaaucgcuug

SEQ ID NO: 1036002 - RNA, 24 nt, Human
aaucacuugaggccaggaguucaa

SEQ ID NO: 1036003 - RNA, 24 nt, Human
aaucgcuugaacccgggaggcgga

SEQ ID NO: 1036004 - RNA, 22 nt, Human
aaugacacgucagcaaaaagga

SEQ ID NO: 1036005 - RNA, 18 nt, Human
acaaaaaaauaacuaugc

SEQ ID NO: 1036006 - RNA, 21 nt, Human
acaaaaauaaaaaaaaacccc

SEQ ID NO: 1036007 - RNA, 24 nt, Human
acaaaaauaaaaaaaaaccccaaa

SEQ ID NO: 1036008 - RNA, 26 nt, Human
acaaacaaaaaaauaacuaugcuaca

SEQ ID NO: 1036009 - RNA, 26 nt, Human
accccaaaaccaugaaauugaggggu

SEQ ID NO: 1036010 - RNA, 25 nt, Human
accccguaucuaccaaaaaaaaaaa

SEQ ID NO: 1036011 - RNA, 18 nt, Human
acugcacuccagccucgg

SEQ ID NO: 1036012 - RNA, 21 nt, Human
acugcacuccagccucggugg

SEQ ID NO: 1036013 - RNA, 24 nt, Human
acugcacuccagccucgguggcag

SEQ ID NO: 1036014 - RNA, 25 nt, Human
acugccucagccuucccaaagugcu

SEQ ID NO: 1036015 - RNA, 18 nt, Human
acuucagcccaccgcacc

SEQ ID NO: 1036016 - RNA, 24 nt, Human
agaacaaaacacaaacaaaaaaau

SEQ ID NO: 1036017 - RNA, 20 nt, Human
agacaaaaauaaauauuucu

SEQ ID NO: 1036018 - RNA, 24 nt, Human
agaccaagcgugguggcucacgcc

SEQ ID NO: 1036019 - RNA, 24 nt, Human
agaccacuacaaaaauaaaaaaaa

SEQ ID NO: 1036020 - RNA, 24 nt, Human
agcacuuugggaggcggaggcggg

SEQ ID NO: 1036021 - RNA, 23 nt, Human
agccaggcgugguggcgcaggcc

SEQ ID NO: 1036022 - RNA, 22 nt, Human
agccuggccaacauggugaaac

SEQ ID NO: 1036023 - RNA, 24 nt, Human
agccuggccaacauggugaaaccc

SEQ ID NO: 1036024 - RNA, 18 nt, Human
aggcaggugaaucgcuug

SEQ ID NO: 1036025 - RNA, 24 nt, Human
aggcaggugaaucgcuugaacccg

SEQ ID NO: 1036026 - RNA, 19 nt, Human
aggccaggaguucaagacc

SEQ ID NO: 1036027 - RNA, 21 nt, Human
aggcggaggcgggugaaucac

SEQ ID NO: 1036028 - RNA, 18 nt, Human
aggcgggugaaucacuug

SEQ ID NO: 1036029 - RNA, 23 nt, Human
aggcgggugaaucacuugaggcc

SEQ ID NO: 1036030 - RNA, 26 nt, Human
aggcgggugaaucacuugaggccagg

SEQ ID NO: 1036031 - RNA, 24 nt, Human
aggcgugguggcgcaggccuguaa

SEQ ID NO: 1036032 - RNA, 21 nt, Human
aucaaguucuuuaacauuuuu

SEQ ID NO: 1036033 - RNA, 20 nt, Human
aucacagcgccuacucagca

SEQ ID NO: 1036034 - RNA, 23 nt, Human
aucgugccacugcacuccagccu

SEQ ID NO: 1036035 - RNA, 21 nt, Human
augacacgucagcaaaaagga

SEQ ID NO: 1036036 - RNA, 20 nt, Human
auggaguaggagaaaguacu

SEQ ID NO: 1036037 - RNA, 20 nt, Human
auggggucucacuauguugg

SEQ ID NO: 1036038 - RNA, 24 nt, Human
auggggucucacuauguuggccau

SEQ ID NO: 1036039 - RNA, 22 nt, Human
caaaacacaaacaaaaaaauaa

SEQ ID NO: 1036040 - RNA, 18 nt, Human
caaagugcuggcauuaua

SEQ ID NO: 1036041 - RNA, 21 nt, Human
caaauaucuacaguauuucua

SEQ ID NO: 1036042 - RNA, 24 nt, Human
caacauggugaaaccccguaucua

SEQ ID NO: 1036043 - RNA, 24 nt, Human
caagaccaagcgugguggcucacg

SEQ ID NO: 1036044 - RNA, 24 nt, Human
caagaccagccuggccaacauggu

SEQ ID NO: 1036045 - RNA, 21 nt, Human
caccccgccccccucauucac

SEQ ID NO: 1036046 - RNA, 24 nt, Human
cacgccugaaaugccagcacuuug

SEQ ID NO: 1036047 - RNA, 30 nt, Human
cacuacaaaaauaaaaaaaaaccccaaaaa

SEQ ID NO: 1036048 - RNA, 21 nt, Human
cacuauguuggccaugcuggu

SEQ ID NO: 1036049 - RNA, 24 nt, Human
cacuauguuggccaugcuggucuc

SEQ ID NO: 1036050 - RNA, 19 nt, Human
cacuccagccucgguggca

SEQ ID NO: 1036051 - RNA, 23 nt, Human
cacuccagccucgguggcagagc

SEQ ID NO: 1036052 - RNA, 19 nt, Human
cacugcacuccagccucgg

SEQ ID NO: 1036053 - RNA, 19 nt, Human
cacugcacuccagccucgg

SEQ ID NO: 1036054 - RNA, 23 nt, Human
cacugcacuccagccucgguggc

SEQ ID NO: 1036055 - RNA, 24 nt, Human
cacugcacuccagccucgguggca

SEQ ID NO: 1036056 - RNA, 24 nt, Human
cacugcacuccagccucgguggca

SEQ ID NO: 1036057 - RNA, 24 nt, Human
cagcacuuugggaggcggaggcgg

SEQ ID NO: 1036058 - RNA, 23 nt, Human
cauacaaauaucuacaguauuuc

SEQ ID NO: 1036059 - RNA, 21 nt, Human
caugcuggucucaaacuccug

SEQ ID NO: 1036060 - RNA, 24 nt, Human
cauuacagaguuuuaaaucaaggg

SEQ ID NO: 1036061 - RNA, 18 nt, Human
ccaaagugcuggcauuau

SEQ ID NO: 1036062 - RNA, 23 nt, Human
ccaccgcaccaaggaagcuauau

SEQ ID NO: 1036063 - RNA, 20 nt, Human
ccacugcacuccagccucgg

SEQ ID NO: 1036064 - RNA, 20 nt, Human
ccacugcacuccagccucgg

SEQ ID NO: 1036065 - RNA, 21 nt, Human
ccacugcacuccagccucggu

SEQ ID NO: 1036066 - RNA, 22 nt, Human
ccacugcacuccagccucggug

SEQ ID NO: 1036067 - RNA, 24 nt, Human
ccacugcacuccagccucgguggc

SEQ ID NO: 1036068 - RNA, 27 nt, Human
ccagcaauccuacugccucagccuucc

SEQ ID NO: 1036069 - RNA, 24 nt, Human
ccagcuggguuccaaucuugacuc

SEQ ID NO: 1036070 - RNA, 18 nt, Human
cccaccccgccccccuca

SEQ ID NO: 1036071 - RNA, 22 nt, Human
cccaccccgccccccucauuca

SEQ ID NO: 1036072 - RNA, 19 nt, Human
cccccaccccgccccccuc

SEQ ID NO: 1036073 - RNA, 21 nt, Human
ccggaagcugaggcaggugaa

SEQ ID NO: 1036074 - RNA, 26 nt, Human
ccuacugccucagccuucccaaagug

SEQ ID NO: 1036075 - RNA, 23 nt, Human
ccuggccaacauggugaaacccc

SEQ ID NO: 1036076 - RNA, 24 nt, Human
ccuggccaacauggugaaaccccg

SEQ ID NO: 1036077 - RNA, 22 nt, Human
ccuguaaucccagcuacuccgg

SEQ ID NO: 1036078 - RNA, 23 nt, Human
ccuguaaucccagcuacuccgga

SEQ ID NO: 1036079 - RNA, 24 nt, Human
cgggugaaucacuugaggccagga

SEQ ID NO: 1036080 - RNA, 26 nt, Human
cuacaaaaauaaaaaaaaaccccaaa

SEQ ID NO: 1036081 - RNA, 24 nt, Human
cucacgccugaaaugccagcacuu

SEQ ID NO: 1036082 - RNA, 19 nt, Human
cuccagcaauccuacugcc

SEQ ID NO: 1036083 - RNA, 19 nt, Human
cuggccuccagcaauccua

SEQ ID NO: 1036084 - RNA, 20 nt, Human
cuuagaaauuaaacuaacac

SEQ ID NO: 1036085 - RNA, 20 nt, Human
gaacccgggaggcggaggcg

SEQ ID NO: 1036086 - RNA, 24 nt, Human
gaauugagaccacuacaaaaauaa

SEQ ID NO: 1036087 - RNA, 23 nt, Human
gagaucgugccacugcacuccag

SEQ ID NO: 1036088 - RNA, 25 nt, Human
gaggcgggugaaucacuugaggcca

SEQ ID NO: 1036089 - RNA, 23 nt, Human
gcaacaaauaucgagggcacgaa

SEQ ID NO: 1036090 - RNA, 24 nt, Human
gcacuccagccucgguggcagagc

SEQ ID NO: 1036091 - RNA, 18 nt, Human
gccaacauggugaaaccc

SEQ ID NO: 1036092 - RNA, 22 nt, Human
gccacccccaccccgccccccu

SEQ ID NO: 1036093 - RNA, 23 nt, Human
gccaugcuggucucaaacuccug

SEQ ID NO: 1036094 - RNA, 19 nt, Human
gcgagaucgugccacugca

SEQ ID NO: 1036095 - RNA, 23 nt, Human
gcuggucucaaacuccuggccuc

SEQ ID NO: 1036096 - RNA, 24 nt, Human
ggaaaagaggcauuaaacaaaugu

SEQ ID NO: 1036097 - RNA, 20 nt, Human
ggacucagagucacagacaa

SEQ ID NO: 1036098 - RNA, 24 nt, Human
ggccuguaaucccagcuacuccgg

SEQ ID NO: 1036099 - RNA, 20 nt, Human
gggaggcggaggcgagaucg

SEQ ID NO: 1036100 - RNA, 18 nt, Human
ggggucucacuauguugg

SEQ ID NO: 1036101 - RNA, 24 nt, Human
gguggcgcaggccuguaaucccag

SEQ ID NO: 1036102 - RNA, 24 nt, Human
gguggcucacgccugaaaugccag

SEQ ID NO: 1036103 - RNA, 22 nt, Human
guucuuuaaccccuggggcugg

SEQ ID NO: 1036104 - RNA, 19 nt, Human
uaaaaaaaaaccccaaaac

SEQ ID NO: 1036105 - RNA, 22 nt, Human
uaaaaaaaaaccccaaaaccau

SEQ ID NO: 1036106 - RNA, 26 nt, Human
uaaaaaaaaaccccaaaaccaugaaa

SEQ ID NO: 1036107 - RNA, 18 nt, Human
uaacagcucuuucuguga

SEQ ID NO: 1036108 - RNA, 25 nt, Human
uaaccccuggggcugggaaacuccc

SEQ ID NO: 1036109 - RNA, 19 nt, Human
uacaguauuucuauccucc

SEQ ID NO: 1036110 - RNA, 20 nt, Human
uaccaaaaaaaaaaaaaaua

SEQ ID NO: 1036111 - RNA, 21 nt, Human
uacuauaccauaggacucaga

SEQ ID NO: 1036112 - RNA, 26 nt, Human
uagaauagcuagagcaagaccaagcg

SEQ ID NO: 1036113 - RNA, 22 nt, Human
uagagauggggucucacuaugu

SEQ ID NO: 1036114 - RNA, 23 nt, Human
uaguaaacuucagaaaaucuuga

SEQ ID NO: 1036115 - RNA, 24 nt, Human
uauguuggccaugcuggucucaaa

SEQ ID NO: 1036116 - RNA, 23 nt, Human
uauuuuauguagagauggggucu

SEQ ID NO: 1036117 - RNA, 23 nt, Human
ucacuugaggccaggaguucaag

SEQ ID NO: 1036118 - RNA, 22 nt, Human
uccaucggggcccuaacuuuca

SEQ ID NO: 1036119 - RNA, 23 nt, Human
ucccaaagugcuggcauuauagc

SEQ ID NO: 1036120 - RNA, 19 nt, Human
uccguuaucuaggaagugu

SEQ ID NO: 1036121 - RNA, 24 nt, Human
uccuacugccucagccuucccaaa

SEQ ID NO: 1036122 - RNA, 24 nt, Human
ucgcuugaacccgggaggcggagg

SEQ ID NO: 1036123 - RNA, 24 nt, Human
ucuaaucaaagaauugagaccacu

SEQ ID NO: 1036124 - RNA, 20 nt, Human
ucuaccaaaaaaaaaaaaaa

SEQ ID NO: 1036125 - RNA, 24 nt, Human
ucucacuauguuggccaugcuggu

SEQ ID NO: 1036126 - RNA, 20 nt, Human
ucuuuaaccccuggggcugg

SEQ ID NO: 1036127 - RNA, 25 nt, Human
ucuuucugugacaguuugggggccc

SEQ ID NO: 1036128 - RNA, 24 nt, Human
ugaaacccaaaaucacucauuugg

SEQ ID NO: 1036129 - RNA, 19 nt, Human
ugaaaugccagcacuuugg

SEQ ID NO: 1036130 - RNA, 24 nt, Human
ugaaucacuugaggccaggaguuc

SEQ ID NO: 1036131 - RNA, 27 nt, Human
ugaaucacuugaggccaggaguucaag

SEQ ID NO: 1036132 - RNA, 21 nt, Human
ugacaguuugggggcccugaa

SEQ ID NO: 1036133 - RNA, 26 nt, Human
ugacuucagcccaccgcaccaaggaa

SEQ ID NO: 1036134 - RNA, 24 nt, Human
ugaggcaggugaaucgcuugaacc

SEQ ID NO: 1036135 - RNA, 25 nt, Human
ugaggcaggugaaucgcuugaaccc

SEQ ID NO: 1036136 - RNA, 25 nt, Human
ugccucagccuucccaaagugcugg

SEQ ID NO: 1036137 - RNA, 22 nt, Human
ugcuacaagggaaaauauaagu

SEQ ID NO: 1036138 - RNA, 23 nt, Human
uggagucuguagagaagcugugg

SEQ ID NO: 1036139 - RNA, 21 nt, Human
uggcagagcuagacuuggucc

SEQ ID NO: 1036140 - RNA, 19 nt, Human
uggcauuauagccaccccc

SEQ ID NO: 1036141 - RNA, 18 nt, Human
uggccaacauggugaaac

SEQ ID NO: 1036142 - RNA, 24 nt, Human
uggccaugcuggucucaaacuccu

SEQ ID NO: 1036143 - RNA, 24 nt, Human
uggccuccagcaauccuacugccu

SEQ ID NO: 1036144 - RNA, 19 nt, Human
uggcucacgccugaaaugc

SEQ ID NO: 1036145 - RNA, 24 nt, Human
uggcucacgccugaaaugccagca

SEQ ID NO: 1036146 - RNA, 24 nt, Human
ugggaggcggaggcgggugaauca

SEQ ID NO: 1036147 - RNA, 24 nt, Human
ugggggcccugaaaagggccuuuu

SEQ ID NO: 1036148 - RNA, 22 nt, Human
uggggucucacuauguuggcca

SEQ ID NO: 1036149 - RNA, 24 nt, Human
uggggucucacuauguuggccaug

SEQ ID NO: 1036150 - RNA, 24 nt, Human
ugguggcgcaggccuguaauccca

SEQ ID NO: 1036151 - RNA, 20 nt, Human
ugguggcucacgccugaaau

SEQ ID NO: 1036152 - RNA, 23 nt, Human
uguagagauggggucucacuaug

SEQ ID NO: 1036153 - RNA, 24 nt, Human
uguagagauggggucucacuaugu

SEQ ID NO: 1036154 - RNA, 20 nt, Human
uucaaaagggaugacuuugc

SEQ ID NO: 1036155 - RNA, 24 nt, Human
aaauuuaaaagaaggaagaagaga

SEQ ID NO: 1036156 - RNA, 20 nt, Human
aagagaaaacgagauuuuaa

SEQ ID NO: 1036157 - RNA, 22 nt, Human
aagagaaaacgagauuuuaaga

SEQ ID NO: 1036158 - RNA, 19 nt, Human
aaugcacgauaagaaggaa

SEQ ID NO: 1036159 - RNA, 19 nt, Human
acccuggacuuuguguugg

SEQ ID NO: 1036160 - RNA, 18 nt, Human
accuuaaaagagcaggaa

SEQ ID NO: 1036161 - RNA, 19 nt, Human
agaagguagaguuucaacc

SEQ ID NO: 1036162 - RNA, 31 nt, Human
agccuuuaacuucuggcaaaaagacaauuuu

SEQ ID NO: 1036163 - RNA, 19 nt, Human
agggacaaugcuaggguuc

SEQ ID NO: 1036164 - RNA, 20 nt, Human
agggacuuggagacagccuu

SEQ ID NO: 1036165 - RNA, 19 nt, Human
aguuucaacccuuagguaa

SEQ ID NO: 1036166 - RNA, 30 nt, Human
augaagcucugugugugugugugugugugg

SEQ ID NO: 1036167 - RNA, 25 nt, Human
auuggaacaaucuuucucuaggaau

SEQ ID NO: 1036168 - RNA, 23 nt, Human
caaauuggaacaaucuuucucua

SEQ ID NO: 1036169 - RNA, 23 nt, Human
caagguagaaagggaguuucaug

SEQ ID NO: 1036170 - RNA, 21 nt, Human
caggccgggcgugguggcuca

SEQ ID NO: 1036171 - RNA, 21 nt, Human
ccaggcauugauccuagcgcu

SEQ ID NO: 1036172 - RNA, 22 nt, Human
ccucuccugcuccugcuccaac

SEQ ID NO: 1036173 - RNA, 21 nt, Human
cgugcgugcgugugugcacgu

SEQ ID NO: 1036174 - RNA, 33 nt, Human
cuaaagcacaggccgggcgugguggcucauagu

SEQ ID NO: 1036175 - RNA, 31 nt, Human
cuaaagcacaggccgggcgugguggcucauu

SEQ ID NO: 1036176 - RNA, 26 nt, Human
cugagauaaaagaccaagguuaguaa

SEQ ID NO: 1036177 - RNA, 21 nt, Human
cuucuggcaaaaagacaauuu

SEQ ID NO: 1036178 - RNA, 21 nt, Human
gaggaugccggagcagaguuc

SEQ ID NO: 1036179 - RNA, 24 nt, Human
gaguaugaaugcacgauaagaagg

SEQ ID NO: 1036180 - RNA, 18 nt, Human
gcugaguucagggacuug

SEQ ID NO: 1036181 - RNA, 19 nt, Human
ggaggccgacucagggcag

SEQ ID NO: 1036182 - RNA, 23 nt, Human
ggcgugguggcucauaccuguaa

SEQ ID NO: 1036183 - RNA, 18 nt, Human
gggaggccgacucagggc

SEQ ID NO: 1036184 - RNA, 21 nt, Human
gggcuuugggaacuuugcagc

SEQ ID NO: 1036185 - RNA, 19 nt, Human
gguggcucauaccuguaau

SEQ ID NO: 1036186 - RNA, 22 nt, Human
guagaguuucaacccuuaggua

SEQ ID NO: 1036187 - RNA, 27 nt, Human
uaaaaaauguaaauaugcuaugccagg

SEQ ID NO: 1036188 - RNA, 22 nt, Human
uaaagaacuaaagcacaggccg

SEQ ID NO: 1036189 - RNA, 18 nt, Human
uaagacaggaaaugaagc

SEQ ID NO: 1036190 - RNA, 21 nt, Human
uaaggguauuagggacaaugc

SEQ ID NO: 1036191 - RNA, 19 nt, Human
uaaguaagauuuugccagg

SEQ ID NO: 1036192 - RNA, 18 nt, Human
ucagaacauauccaacca

SEQ ID NO: 1036193 - RNA, 23 nt, Human
ucauguaaagaacuaaagcacag

SEQ ID NO: 1036194 - RNA, 21 nt, Human
uccugagucagagacggacau

SEQ ID NO: 1036195 - RNA, 23 nt, Human
uccugcuccugcuccaacccugg

SEQ ID NO: 1036196 - RNA, 24 nt, Human
ucucuaggaaugccucucuuucau

SEQ ID NO: 1036197 - RNA, 18 nt, Human
ugauuggcugugggguug

SEQ ID NO: 1036198 - RNA, 22 nt, Human
ugcgugugugugugcacgcgug

SEQ ID NO: 1036199 - RNA, 18 nt, Human
ugcuaaccaagcauggag

SEQ ID NO: 1036200 - RNA, 21 nt, Human
ugcuccaacccuggacuuugu

SEQ ID NO: 1036201 - RNA, 19 nt, Human
uggcaggccuagugauccu

SEQ ID NO: 1036202 - RNA, 18 nt, Human
uggcucauaccuguaauc

SEQ ID NO: 1036203 - RNA, 18 nt, Human
ugggagagaugggcaagu

SEQ ID NO: 1036204 - RNA, 18 nt, Human
ugguggcucauaccugua

SEQ ID NO: 1036205 - RNA, 18 nt, Human
ugugcacgcgugcgugcg

SEQ ID NO: 1036206 - RNA, 18 nt, Human
ugugcacgugcgugugug

SEQ ID NO: 1036207 - RNA, 22 nt, Human
ugugcacgugcgugugugugug

SEQ ID NO: 1036208 - RNA, 21 nt, Human
ugugcgugugugugugcacgc

SEQ ID NO: 1036209 - RNA, 24 nt, Human
ugugggguuguuagggcuuuggga

SEQ ID NO: 1036210 - RNA, 24 nt, Human
ugugugcacgcgugcgugcgugug

SEQ ID NO: 1036211 - RNA, 26 nt, Human
ugugugcacgcgugcgugcgugugug

SEQ ID NO: 1036212 - RNA, 31 nt, Human
ugugugcgugugugugugcacgcgugcggug

SEQ ID NO: 1036213 - RNA, 25 nt, Human
ugugugugugcacgcgugcgugcgg

SEQ ID NO: 1036214 - RNA, 21 nt, Human
ugugugugugcgugugugugu

SEQ ID NO: 1036215 - RNA, 21 nt, Human
ugugugugugcgugugugugu

SEQ ID NO: 1036216 - RNA, 20 nt, Human
ugugugugugugcgugugug

SEQ ID NO: 1036217 - RNA, 22 nt, Human
ugugugugugugcgugugugug

SEQ ID NO: 1036218 - RNA, 22 nt, Human
ugugugugugugcgugugugug

SEQ ID NO: 1036219 - RNA, 21 nt, Human
ugugugugugugugcgugugu

SEQ ID NO: 1036220 - RNA, 21 nt, Human
ugugugugugugugcgugugu

SEQ ID NO: 1036221 - RNA, 18 nt, Human
ugugugugugugugugug

SEQ ID NO: 1036222 - RNA, 19 nt, Human
ugugugugugugugugugu

SEQ ID NO: 1036223 - RNA, 22 nt, Human
ugugugugugugugugugugag

SEQ ID NO: 1036224 - RNA, 21 nt, Human
ugugugugugugugugugugc

SEQ ID NO: 1036225 - RNA, 24 nt, Human
ugugugugugugugugugugcgug

SEQ ID NO: 1036226 - RNA, 23 nt, Human
uuaacuucuggcaaaaagacaau

SEQ ID NO: 1036227 - RNA, 19 nt, Human
uugauccuagcgcuaagaa

SEQ ID NO: 1036228 - RNA, 22 nt, Human
uuggagaugcuaaccaagcaug

SEQ ID NO: 1036229 - RNA, 20 nt, Human
uuuaaaagaaggaagaagag

SEQ ID NO: 1036230 - RNA, 20 nt, Human
aacuuuaucgguagaaugac

SEQ ID NO: 1036231 - RNA, 22 nt, Human
accauggcugguccuggaggag

SEQ ID NO: 1036232 - RNA, 21 nt, Human
agagcugggaaugucuugagc

SEQ ID NO: 1036233 - RNA, 22 nt, Human
agcaagguggaacuaaagcgau

SEQ ID NO: 1036234 - RNA, 21 nt, Human
aggcuccccugcuuuccccac

SEQ ID NO: 1036235 - RNA, 24 nt, Human
caccauggcugguccuggaggagu

SEQ ID NO: 1036236 - RNA, 21 nt, Human
cagauguguaagaagagcugg

SEQ ID NO: 1036237 - RNA, 22 nt, Human
cauuuguucuuccagcgagcca

SEQ ID NO: 1036238 - RNA, 23 nt, Human
ccaaagcaagccucccauuaacc

SEQ ID NO: 1036239 - RNA, 20 nt, Human
ccccugcuuuccccacuucc

SEQ ID NO: 1036240 - RNA, 20 nt, Human
cuccacaccauggcuggucc

SEQ ID NO: 1036241 - RNA, 24 nt, Human
cucccauuaacccgguccauugca

SEQ ID NO: 1036242 - RNA, 25 nt, Human
cucuucuucagauacauucucacca

SEQ ID NO: 1036243 - RNA, 24 nt, Human
cuucagauacauucucaccaacca

SEQ ID NO: 1036244 - RNA, 22 nt, Human
gcagcugaguguuuugcuggcc

SEQ ID NO: 1036245 - RNA, 20 nt, Human
gccagaagucacaaaugguu

SEQ ID NO: 1036246 - RNA, 21 nt, Human
gcugaguguuuugcuggccug

SEQ ID NO: 1036247 - RNA, 24 nt, Human
ggcuuuggacuugcagcugagugu

SEQ ID NO: 1036248 - RNA, 20 nt, Human
uaaaacucccuucauuuguu

SEQ ID NO: 1036249 - RNA, 19 nt, Human
uaacccgguccauugcaga

SEQ ID NO: 1036250 - RNA, 18 nt, Human
uaagaagagcugggaaug

SEQ ID NO: 1036251 - RNA, 23 nt, Human
uaagaagagcugggaaugucuug

SEQ ID NO: 1036252 - RNA, 20 nt, Human
uagcagauguguaagaagag

SEQ ID NO: 1036253 - RNA, 23 nt, Human
uauuucaaaacuuuaucgguaga

SEQ ID NO: 1036254 - RNA, 26 nt, Human
ucuugagcuguaaguccugagaccuc

SEQ ID NO: 1036255 - RNA, 23 nt, Human
ugcagcugaguguuuugcuggcc

SEQ ID NO: 1036256 - RNA, 18 nt, Human
ugccuggggguuuggugu

SEQ ID NO: 1036257 - RNA, 21 nt, Human
ugcuggccuguucccauuuac

SEQ ID NO: 1036258 - RNA, 18 nt, Human
ugugguugugcugcuugu

SEQ ID NO: 1036259 - RNA, 18 nt, Human
uguguaagaagagcuggg

SEQ ID NO: 1036260 - RNA, 23 nt, Human
uuguggcuuuggacuugcagcug

SEQ ID NO: 1036261 - RNA, 19 nt, Human
aaaaaaaaaaaaaaaaaga

SEQ ID NO: 1036262 - RNA, 24 nt, Human
aaaaaaaaaaaaaaaaagaagggg

SEQ ID NO: 1036263 - RNA, 21 nt, Human
aaaaaaaaaagcagcuuaaag

SEQ ID NO: 1036264 - RNA, 24 nt, Human
aaaaaaaagcagcuuaaagcagca

SEQ ID NO: 1036265 - RNA, 23 nt, Human
aaaagaaaaaaaaaagcagcuua

SEQ ID NO: 1036266 - RNA, 22 nt, Human
aaaagaaaacaacaaaaaaaga

SEQ ID NO: 1036267 - RNA, 23 nt, Human
aaaagaacaaaagagauugcaga

SEQ ID NO: 1036268 - RNA, 18 nt, Human
aaaagaacacaaauggca

SEQ ID NO: 1036269 - RNA, 18 nt, Human
aaagaacacaaauggcaa

SEQ ID NO: 1036270 - RNA, 24 nt, Human
aaagugauuuuauuuuccuuuuca

SEQ ID NO: 1036271 - RNA, 19 nt, Human
aacaguaguacauaguccc

SEQ ID NO: 1036272 - RNA, 25 nt, Human
aagaaaaaacaacucaaaaaccaaa

SEQ ID NO: 1036273 - RNA, 25 nt, Human
aagaaaacaacaaaaaaagaaaaca

SEQ ID NO: 1036274 - RNA, 19 nt, Human
aagcaaaagaaaacaacaa

SEQ ID NO: 1036275 - RNA, 20 nt, Human
aagcagcaaaaggauuauga

SEQ ID NO: 1036276 - RNA, 18 nt, Human
aaggaucacgaaaucugg

SEQ ID NO: 1036277 - RNA, 18 nt, Human
aauucuggacaacagacu

SEQ ID NO: 1036278 - RNA, 20 nt, Human
acaaauggcaaccaaucaca

SEQ ID NO: 1036279 - RNA, 23 nt, Human
acaaauuaaaauuuucacacuua

SEQ ID NO: 1036280 - RNA, 21 nt, Human
acaacaaaaaaagaaaacaca

SEQ ID NO: 1036281 - RNA, 21 nt, Human
acaaguuauaaagcuagcuca

SEQ ID NO: 1036282 - RNA, 22 nt, Human
acacuuuuaaauuuuuuaaagc

SEQ ID NO: 1036283 - RNA, 22 nt, Human
accaaucacaucuauuuaucau

SEQ ID NO: 1036284 - RNA, 22 nt, Human
accagacauacugcaacacucu

SEQ ID NO: 1036285 - RNA, 19 nt, Human
acgcugcugcuacugcugc

SEQ ID NO: 1036286 - RNA, 25 nt, Human
agaaaacaacaaaaaaagaaaacac

SEQ ID NO: 1036287 - RNA, 20 nt, Human
agagcuccuccaggucggcc

SEQ ID NO: 1036288 - RNA, 22 nt, Human
agcaaaagaaaacaacaaaaaa

SEQ ID NO: 1036289 - RNA, 23 nt, Human
agcaaaagaaaacaacaaaaaaa

SEQ ID NO: 1036290 - RNA, 23 nt, Human
aggaguauuuucugcaguuucac

SEQ ID NO: 1036291 - RNA, 20 nt, Human
agggaagaaaagaaaaaaaa

SEQ ID NO: 1036292 - RNA, 20 nt, Human
agucccuuaagucugugaaa

SEQ ID NO: 1036293 - RNA, 19 nt, Human
aguuauauagguaaauauu

SEQ ID NO: 1036294 - RNA, 20 nt, Human
auuuaacuuucaugccucua

SEQ ID NO: 1036295 - RNA, 21 nt, Human
caaaaaaagaaaacacacugc

SEQ ID NO: 1036296 - RNA, 19 nt, Human
caacaaaaaaagaaaacac

SEQ ID NO: 1036297 - RNA, 20 nt, Human
caacaaaaaaagaaaacaca

SEQ ID NO: 1036298 - RNA, 20 nt, Human
caacaucagauaagcagcaa

SEQ ID NO: 1036299 - RNA, 22 nt, Human
caacaucagauaagcagcaaaa

SEQ ID NO: 1036300 - RNA, 25 nt, Human
caagcaaggucuacaaucauugguc

SEQ ID NO: 1036301 - RNA, 18 nt, Human
caagcugccccgccggcc

SEQ ID NO: 1036302 - RNA, 19 nt, Human
caaggucuacaaucauugg

SEQ ID NO: 1036303 - RNA, 21 nt, Human
cacccccgccgcugcugcugc

SEQ ID NO: 1036304 - RNA, 18 nt, Human
caccgccucggccuccgc

SEQ ID NO: 1036305 - RNA, 24 nt, Human
cacuccuccgccgccgccuccgcc

SEQ ID NO: 1036306 - RNA, 23 nt, Human
cagcacuagugaaguacaauauc

SEQ ID NO: 1036307 - RNA, 22 nt, Human
cagcagcgccgccaccgccucg

SEQ ID NO: 1036308 - RNA, 22 nt, Human
cagcgccgccaccgccucggcc

SEQ ID NO: 1036309 - RNA, 19 nt, Human
caggcucucggcgcuacuc

SEQ ID NO: 1036310 - RNA, 22 nt, Human
cauccccgcugcugcugcuggc

SEQ ID NO: 1036311 - RNA, 20 nt, Human
ccaacaucagauaagcagca

SEQ ID NO: 1036312 - RNA, 18 nt, Human
ccccacuccuccgccgcc

SEQ ID NO: 1036313 - RNA, 22 nt, Human
cccccacuccuccgccgccgcc

SEQ ID NO: 1036314 - RNA, 21 nt, Human
ccccgccgccgcccuggcugc

SEQ ID NO: 1036315 - RNA, 24 nt, Human
ccccgccgcugcugcugcucucau

SEQ ID NO: 1036316 - RNA, 25 nt, Human
ccccggaggucgcgcugcuuccgcc

SEQ ID NO: 1036317 - RNA, 23 nt, Human
cccgcggucccuugggcuccucc

SEQ ID NO: 1036318 - RNA, 23 nt, Human
cccucgucgccgccgcuggagac

SEQ ID NO: 1036319 - RNA, 20 nt, Human
cccuggcugccccgcggucc

SEQ ID NO: 1036320 - RNA, 18 nt, Human
ccgcccccgccgccgccc

SEQ ID NO: 1036321 - RNA, 23 nt, Human
ccgccgcccccaccgcugccgcc

SEQ ID NO: 1036322 - RNA, 23 nt, Human
ccgccgcccccaccgcugccgcc

SEQ ID NO: 1036323 - RNA, 24 nt, Human
ccgccgcccccaccgcugccgccg

SEQ ID NO: 1036324 - RNA, 26 nt, Human
ccgccgcccccaccgcugccgccguu

SEQ ID NO: 1036325 - RNA, 19 nt, Human
ccgccgccgcccuggcugc

SEQ ID NO: 1036326 - RNA, 20 nt, Human
ccgccgccgcccuggcugcc

SEQ ID NO: 1036327 - RNA, 21 nt, Human
ccgccgccgcccuggcugccc

SEQ ID NO: 1036328 - RNA, 20 nt, Human
ccgccgccgccuccgccgcc

SEQ ID NO: 1036329 - RNA, 22 nt, Human
ccgccgccgccuccgccgcccc

SEQ ID NO: 1036330 - RNA, 24 nt, Human
ccgccgccgccuccgccgccccca

SEQ ID NO: 1036331 - RNA, 18 nt, Human
ccgcugccgccguucagc

SEQ ID NO: 1036332 - RNA, 21 nt, Human
ccgcugccgccguucagcagc

SEQ ID NO: 1036333 - RNA, 20 nt, Human
ccgcugcugcugcucucauc

SEQ ID NO: 1036334 - RNA, 22 nt, Human
ccguagcccucgucgccgccgc

SEQ ID NO: 1036335 - RNA, 22 nt, Human
ccuccaggcccuccuugccccg

SEQ ID NO: 1036336 - RNA, 23 nt, Human
ccucccucaaagacuuucuggaa

SEQ ID NO: 1036337 - RNA, 21 nt, Human
ccuccgccgcccccaccgcug

SEQ ID NO: 1036338 - RNA, 18 nt, Human
ccuccgccgccgccuccg

SEQ ID NO: 1036339 - RNA, 24 nt, Human
ccuccgccgccgccuccgccgccc

SEQ ID NO: 1036340 - RNA, 19 nt, Human
ccuccucgucguccuccuc

SEQ ID NO: 1036341 - RNA, 18 nt, Human
ccuccucuuccuccuccu

SEQ ID NO: 1036342 - RNA, 20 nt, Human
ccuccucuuccuccuccucc

SEQ ID NO: 1036343 - RNA, 20 nt, Human
ccuccucuuccuccuccucc

SEQ ID NO: 1036344 - RNA, 21 nt, Human
ccucgccgccccccacuccuc

SEQ ID NO: 1036345 - RNA, 21 nt, Human
ccuugggcuccuccaggcccu

SEQ ID NO: 1036346 - RNA, 21 nt, Human
cgcccccaccgcugccgccgu

SEQ ID NO: 1036347 - RNA, 18 nt, Human
cgccgcccccaccgcugc

SEQ ID NO: 1036348 - RNA, 18 nt, Human
cgcugcugcugcuggcgg

SEQ ID NO: 1036349 - RNA, 22 nt, Human
cguucagcagcagcgccgccac

SEQ ID NO: 1036350 - RNA, 21 nt, Human
cuaagacugcagguguccccg

SEQ ID NO: 1036351 - RNA, 21 nt, Human
cuacgcugcugcuacugcugc

SEQ ID NO: 1036352 - RNA, 26 nt, Human
cuagaaaacaucuacaguacauuuca

SEQ ID NO: 1036353 - RNA, 23 nt, Human
cucagcccggccccgcgccgguu

SEQ ID NO: 1036354 - RNA, 21 nt, Human
cuccgccgcccccaccgcugc

SEQ ID NO: 1036355 - RNA, 19 nt, Human
cuccuccgccgccgccucc

SEQ ID NO: 1036356 - RNA, 23 nt, Human
cuccuccuccucuuccuccuccu

SEQ ID NO: 1036357 - RNA, 19 nt, Human
cuccucuuccuccuccucc

SEQ ID NO: 1036358 - RNA, 23 nt, Human
cuccuugccguccccauccccgc

SEQ ID NO: 1036359 - RNA, 19 nt, Human
cucugccucgccgcccccc

SEQ ID NO: 1036360 - RNA, 22 nt, Human
cugccgcccccgccgccgcccu

SEQ ID NO: 1036361 - RNA, 24 nt, Human
cugcugcucccgccgcugcugccc

SEQ ID NO: 1036362 - RNA, 21 nt, Human
cugcugcucucaucuuccucc

SEQ ID NO: 1036363 - RNA, 24 nt, Human
cugcugcugcuggcggcgccgggg

SEQ ID NO: 1036364 - RNA, 22 nt, Human
cugguuuugacaucuaaguauu

SEQ ID NO: 1036365 - RNA, 20 nt, Human
cuuccuccuccucgucgucc

SEQ ID NO: 1036366 - RNA, 24 nt, Human
gaaaaaauacucaagcaaggucua

SEQ ID NO: 1036367 - RNA, 20 nt, Human
gaaaucugguuuugacaucu

SEQ ID NO: 1036368 - RNA, 19 nt, Human
gaagaaaagaaaaaaaaaa

SEQ ID NO: 1036369 - RNA, 19 nt, Human
gacauacugcaacacucuu

SEQ ID NO: 1036370 - RNA, 18 nt, Human
gauguuauguguauauau

SEQ ID NO: 1036371 - RNA, 19 nt, Human
gcagagggcucaggcggga

SEQ ID NO: 1036372 - RNA, 21 nt, Human
gccggcccccggaggucgcgc

SEQ ID NO: 1036373 - RNA, 21 nt, Human
gcgcugcuuccgccuccccca

SEQ ID NO: 1036374 - RNA, 18 nt, Human
gcucucggggcucggcuc

SEQ ID NO: 1036375 - RNA, 19 nt, Human
gcugccgcccccgccgccg

SEQ ID NO: 1036376 - RNA, 22 nt, Human
gcugccgcccccgccgccgccc

SEQ ID NO: 1036377 - RNA, 23 nt, Human
gcugccgcccccgccgccgcccu

SEQ ID NO: 1036378 - RNA, 22 nt, Human
gcugcucccgccgcugcugccc

SEQ ID NO: 1036379 - RNA, 18 nt, Human
gcugcugcuggcggcgcc

SEQ ID NO: 1036380 - RNA, 24 nt, Human
gcugcuuccgccucccccaguccc

SEQ ID NO: 1036381 - RNA, 24 nt, Human
ggcuccuccaggcccuccuugccg

SEQ ID NO: 1036382 - RNA, 23 nt, Human
gggaagaaaagaaaaaaaaaagc

SEQ ID NO: 1036383 - RNA, 22 nt, Human
guaaauauuaacauacuguacu

SEQ ID NO: 1036384 - RNA, 19 nt, Human
guauauauguauacauaca

SEQ ID NO: 1036385 - RNA, 18 nt, Human
gucucugccucgccgccc

SEQ ID NO: 1036386 - RNA, 18 nt, Human
guguauauauguauacau

SEQ ID NO: 1036387 - RNA, 19 nt, Human
uaaaaauacagguacaaac

SEQ ID NO: 1036388 - RNA, 21 nt, Human
uaaagcagcaagcaugcaaag

SEQ ID NO: 1036389 - RNA, 22 nt, Human
uaaagcagcaagcaugcaaagc

SEQ ID NO: 1036390 - RNA, 24 nt, Human
uaacaaaucaaauuuuaaaaagaa

SEQ ID NO: 1036391 - RNA, 25 nt, Human
uaagaaaaaacaacucaaaaaccaa

SEQ ID NO: 1036392 - RNA, 25 nt, Human
uaagaaugacuuacaagaacaugag

SEQ ID NO: 1036393 - RNA, 18 nt, Human
uaagcaaaagaaaacaac

SEQ ID NO: 1036394 - RNA, 23 nt, Human
uacaaacuauguaucugaaacac

SEQ ID NO: 1036395 - RNA, 22 nt, Human
uacaagcaauguucuauuaucu

SEQ ID NO: 1036396 - RNA, 19 nt, Human
uacauuaagaaaaaacaac

SEQ ID NO: 1036397 - RNA, 23 nt, Human
uacuaaguugccaaaagaguguu

SEQ ID NO: 1036398 - RNA, 26 nt, Human
uacugcugccgcccccgccgccgccc

SEQ ID NO: 1036399 - RNA, 28 nt, Human
uacuggauuuaaaaaaaaaaaaaaaaaa

SEQ ID NO: 1036400 - RNA, 19 nt, Human
uagaucaaauggauaauac

SEQ ID NO: 1036401 - RNA, 20 nt, Human
uagguuaaaugaaaauauga

SEQ ID NO: 1036402 - RNA, 23 nt, Human
uauauguauacauacaaguuaua

SEQ ID NO: 1036403 - RNA, 18 nt, Human
uaucacuguaguaaagug

SEQ ID NO: 1036404 - RNA, 20 nt, Human
uauguguauauauguauaau

SEQ ID NO: 1036405 - RNA, 24 nt, Human
uauguguauauauguauacauaca

SEQ ID NO: 1036406 - RNA, 23 nt, Human
ucauguauauagcucuuuacccc

SEQ ID NO: 1036407 - RNA, 21 nt, Human
ucauuuucauguauauagcuc

SEQ ID NO: 1036408 - RNA, 23 nt, Human
uccaugagaaagcccuaguccug

SEQ ID NO: 1036409 - RNA, 21 nt, Human
uccccgcugcugcugcuggcg

SEQ ID NO: 1036410 - RNA, 18 nt, Human
ucccgccgcugcugccca

SEQ ID NO: 1036411 - RNA, 21 nt, Human
ucccgccgcugcugcccacca

SEQ ID NO: 1036412 - RNA, 21 nt, Human
uccgccgcccccaccgcugcc

SEQ ID NO: 1036413 - RNA, 19 nt, Human
uccuccgccgccgccuccg

SEQ ID NO: 1036414 - RNA, 20 nt, Human
uccucuggcagcacuaguga

SEQ ID NO: 1036415 - RNA, 21 nt, Human
uccucuggcagcacuagugaa

SEQ ID NO: 1036416 - RNA, 18 nt, Human
ucgccgccccccacuccu

SEQ ID NO: 1036417 - RNA, 24 nt, Human
ucgcugcugcucccgccgcugcug

SEQ ID NO: 1036418 - RNA, 19 nt, Human
ucucaucuuccuccuccuc

SEQ ID NO: 1036419 - RNA, 26 nt, Human
ucucccacaguaccauuccaugaaaa

SEQ ID NO: 1036420 - RNA, 20 nt, Human
ucuccuccucacccccgccg

SEQ ID NO: 1036421 - RNA, 21 nt, Human
ucuuccuccuccuccucuucc

SEQ ID NO: 1036422 - RNA, 21 nt, Human
ucuuccuccuccucgucgucc

SEQ ID NO: 1036423 - RNA, 24 nt, Human
ugaaaaccacaaauuaaaauuuuc

SEQ ID NO: 1036424 - RNA, 22 nt, Human
ugaaagguuuuucaaaaaccgu

SEQ ID NO: 1036425 - RNA, 24 nt, Human
ugagaaagcccuaguccugaaaag

SEQ ID NO: 1036426 - RNA, 23 nt, Human
ugagugccauaauucuauuaugg

SEQ ID NO: 1036427 - RNA, 23 nt, Human
ugcauauaaccacauacuuuaca

SEQ ID NO: 1036428 - RNA, 20 nt, Human
ugccccgcggucccuugggc

SEQ ID NO: 1036429 - RNA, 24 nt, Human
ugcuauagaucaaauggauaauac

SEQ ID NO: 1036430 - RNA, 22 nt, Human
ugcucccgccgcugcugcccac

SEQ ID NO: 1036431 - RNA, 20 nt, Human
uggauuuaaaaaaaaaaaaa

SEQ ID NO: 1036432 - RNA, 21 nt, Human
uggguauagguccucccucaa

SEQ ID NO: 1036433 - RNA, 18 nt, Human
ugguauuuguaagggcac

SEQ ID NO: 1036434 - RNA, 18 nt, Human
uguguauauauguauaca

SEQ ID NO: 1036435 - RNA, 20 nt, Human
uguguauauauguauacaua

SEQ ID NO: 1036436 - RNA, 22 nt, Human
uguuaacaguaucaaaccaaca

SEQ ID NO: 1036437 - RNA, 20 nt, Human
uuaaaaaaaaaaaaaaaaaa

SEQ ID NO: 1036438 - RNA, 22 nt, Human
uuaaagcagcaagcaugcaaag

SEQ ID NO: 1036439 - RNA, 23 nt, Human
uuaaauuuuuuaaagcaaaugag

SEQ ID NO: 1036440 - RNA, 24 nt, Human
uucuauuuggcaauuuuauaacaa

SEQ ID NO: 1036441 - RNA, 18 nt, Human
uuggcaauuuuauaacaa

SEQ ID NO: 1036442 - RNA, 19 nt, Human
uuuuaaaauucaauugaau

SEQ ID NO: 1036443 - RNA, 26 nt, Human
uuuuccuuuucaagaccaacuuuggu

SEQ ID NO: 1036444 - RNA, 26 nt, Human
aacuuuuccuucuccucauaugggga

SEQ ID NO: 1036445 - RNA, 20 nt, Human
cauugaugcugccaauucuc

SEQ ID NO: 1036446 - RNA, 20 nt, Human
gagaaaaacuuuuccuucuc

SEQ ID NO: 1036447 - RNA, 19 nt, Human
gcugccaauucucugugcc

SEQ ID NO: 1036448 - RNA, 19 nt, Human
uaagucauuuacaaaggcc

SEQ ID NO: 1036449 - RNA, 23 nt, Human
uaauaagucauuuacaaaggccu

SEQ ID NO: 1036450 - RNA, 23 nt, Human
acauucaguggccugguuuucag

SEQ ID NO: 1036451 - RNA, 20 nt, Human
cagcuguuuggcugccccag

SEQ ID NO: 1036452 - RNA, 20 nt, Human
cuggagcacaguagcuggcc

SEQ ID NO: 1036453 - RNA, 21 nt, Human
cuggagcacaguagcuggccu

SEQ ID NO: 1036454 - RNA, 24 nt, Human
cuggagcacaguagcuggccuuug

SEQ ID NO: 1036455 - RNA, 22 nt, Human
cuucacagacaugcuggccacc

SEQ ID NO: 1036456 - RNA, 20 nt, Human
uggcugccccaguuucugcc

SEQ ID NO: 1036457 - RNA, 20 nt, Human
uucacagacaugcuggccac

SEQ ID NO: 1036458 - RNA, 25 nt, Human
uucaguggccugguuuuucccagag

SEQ ID NO: 1036459 - RNA, 24 nt, Human
uucccaccuggagcacaguagcug

SEQ ID NO: 1036460 - RNA, 21 nt, Human
uuugccagcuguuuggcugcc

SEQ ID NO: 1036461 - RNA, 18 nt, Human
aaagccaaugcggcagga

SEQ ID NO: 1036462 - RNA, 19 nt, Human
aaagccaaugcggcaggag

SEQ ID NO: 1036463 - RNA, 19 nt, Human
acggugaaguccuccaacu

SEQ ID NO: 1036464 - RNA, 20 nt, Human
agccaaaaacaggugccagg

SEQ ID NO: 1036465 - RNA, 22 nt, Human
aguccuuuguuuuucaacagga

SEQ ID NO: 1036466 - RNA, 24 nt, Human
cacagccucaccaauuugcuacca

SEQ ID NO: 1036467 - RNA, 18 nt, Human
cagcuccuuggcccagcc

SEQ ID NO: 1036468 - RNA, 24 nt, Human
caucauuugucggcuugcuggaga

SEQ ID NO: 1036469 - RNA, 22 nt, Human
ccuccaacugucaaccuggaac

SEQ ID NO: 1036470 - RNA, 23 nt, Human
cuccuuggcccagccaaaaacag

SEQ ID NO: 1036471 - RNA, 20 nt, Human
gaccaguggaaaguccuuug

SEQ ID NO: 1036472 - RNA, 20 nt, Human
gacccagcugaucugaucug

SEQ ID NO: 1036473 - RNA, 20 nt, Human
ggagcaguagaggcagcucc

SEQ ID NO: 1036474 - RNA, 19 nt, Human
gggagcaguagaggcagcc

SEQ ID NO: 1036475 - RNA, 19 nt, Human
uaaaaaaguucccaccccu

SEQ ID NO: 1036476 - RNA, 21 nt, Human
ucacagccucaccaauuugcu

SEQ ID NO: 1036477 - RNA, 20 nt, Human
ucacuggacagugguccccg

SEQ ID NO: 1036478 - RNA, 19 nt, Human
ucggcuugcuggagaggag

SEQ ID NO: 1036479 - RNA, 20 nt, Human
ucggcuugcuggagaggagu

SEQ ID NO: 1036480 - RNA, 23 nt, Human
ugaucugaucugcagaccagugg

SEQ ID NO: 1036481 - RNA, 23 nt, Human
uggaaaguucccgggaagcauuc

SEQ ID NO: 1036482 - RNA, 21 nt, Human
uggacagugguccccggcagu

SEQ ID NO: 1036483 - RNA, 18 nt, Human
ugggagcaguagaggcag

SEQ ID NO: 1036484 - RNA, 23 nt, Human
uuaauguguaauacaaucucuuc

SEQ ID NO: 1036485 - RNA, 20 nt, Human
uucaacaggaacacguggga

SEQ ID NO: 1036486 - RNA, 22 nt, Human
uucaaugguccuaggggugcuu

SEQ ID NO: 1036487 - RNA, 21 nt, Human
aaaccaugaaauaugaaagua

SEQ ID NO: 1036488 - RNA, 23 nt, Human
agaggaggaaaaaaagagaggga

SEQ ID NO: 1036489 - RNA, 19 nt, Human
cagaggaggaaaaaaagag

SEQ ID NO: 1036490 - RNA, 18 nt, Human
ccgaugccaguaaaccau

SEQ ID NO: 1036491 - RNA, 18 nt, Human
gaugccaguaaaccauga

SEQ ID NO: 1036492 - RNA, 19 nt, Human
ucagaacgguaaauucaac

SEQ ID NO: 1036493 - RNA, 24 nt, Human
ucagaggaggaaaaaaagagaggg

SEQ ID NO: 1036494 - RNA, 19 nt, Human
ugaagaaaauaaaauaaaa

SEQ ID NO: 1036495 - RNA, 20 nt, Human
uucagaggaggaaaaaaaga

SEQ ID NO: 1036496 - RNA, 22 nt, Human
cagaagaaguaaacagaauuca

SEQ ID NO: 1036497 - RNA, 21 nt, Human
cagaauucagguccuuggccu

SEQ ID NO: 1036498 - RNA, 19 nt, Human
cuaaaggucuccuccacug

SEQ ID NO: 1036499 - RNA, 22 nt, Human
gaaguaaacagaauucaggucc

SEQ ID NO: 1036500 - RNA, 25 nt, Human
uaagcauacaccaagcgagggauaa

SEQ ID NO: 1036501 - RNA, 23 nt, Human
ucauucacuugagugugcuuuug

SEQ ID NO: 1036502 - RNA, 21 nt, Human
uccuuggccugcacaaggucc

SEQ ID NO: 1036503 - RNA, 22 nt, Human
ugacaaauuuguaagcaucaag

SEQ ID NO: 1036504 - RNA, 19 nt, Human
ugcuaggggaaaagcugcc

SEQ ID NO: 1036505 - RNA, 19 nt, Human
uggaaagggacuauuuuau

SEQ ID NO: 1036506 - RNA, 20 nt, Human
uggaaagggacuauuuuaug

SEQ ID NO: 1036507 - RNA, 18 nt, Human
ugugauaacagagagaau

SEQ ID NO: 1036508 - RNA, 23 nt, Human
uucaagaauuccauaccaaauuc

SEQ ID NO: 1036509 - RNA, 24 nt, Human
uuccaaugccuucaagaauuccau

SEQ ID NO: 1036510 - RNA, 22 nt, Human
auagcacuuucuucaaguucug

SEQ ID NO: 1036511 - RNA, 19 nt, Human
cccuggagccucuugugac

SEQ ID NO: 1036512 - RNA, 19 nt, Human
cuggagccucuugugaccc

SEQ ID NO: 1036513 - RNA, 19 nt, Human
ggcaggggauagcacuuuc

SEQ ID NO: 1036514 - RNA, 26 nt, Human
uagacaggcaggggauagcacuuucu

SEQ ID NO: 1036515 - RNA, 26 nt, Human
aaaaaucuguuuguccaaggggucuc

SEQ ID NO: 1036516 - RNA, 24 nt, Human
aaaacccagaggucugcacuccac

SEQ ID NO: 1036517 - RNA, 19 nt, Human
aagaagggacgucaguggc

SEQ ID NO: 1036518 - RNA, 24 nt, Human
agaaauugcucaaguucuaucccc

SEQ ID NO: 1036519 - RNA, 19 nt, Human
agaagggacgucaguggcg

SEQ ID NO: 1036520 - RNA, 18 nt, Human
agcaacauuccuaguuuc

SEQ ID NO: 1036521 - RNA, 19 nt, Human
agccggaagggacccuagg

SEQ ID NO: 1036522 - RNA, 24 nt, Human
agcuggcuagcuugcaaaaaccca

SEQ ID NO: 1036523 - RNA, 20 nt, Human
agggucucccacguccaccc

SEQ ID NO: 1036524 - RNA, 25 nt, Human
agugcaaaaaucuguuuguccaagg

SEQ ID NO: 1036525 - RNA, 22 nt, Human
cauuuucauuuuaaaguuuaaa

SEQ ID NO: 1036526 - RNA, 21 nt, Human
ccuguccccacaggaaagaag

SEQ ID NO: 1036527 - RNA, 27 nt, Human
cgaggccaagacagaaauugcucaagu

SEQ ID NO: 1036528 - RNA, 20 nt, Human
gauguuaaagccggaaggga

SEQ ID NO: 1036529 - RNA, 18 nt, Human
ggaaacagaagauguuag

SEQ ID NO: 1036530 - RNA, 19 nt, Human
uagcuugcaaaaacccaga

SEQ ID NO: 1036531 - RNA, 21 nt, Human
ucuauccccagugcaaaaauc

SEQ ID NO: 1036532 - RNA, 22 nt, Human
uggcgaggccaagacagaaauu

SEQ ID NO: 1036533 - RNA, 18 nt, Human
uucauuuuaaaguuuaaa

SEQ ID NO: 1036534 - RNA, 22 nt, Human
uuccuaguuucacauuuucauu

SEQ ID NO: 1036535 - RNA, 21 nt, Human
aggggccgagcacacugagcc

SEQ ID NO: 1036536 - RNA, 23 nt, Human
agguucuucuuccaggagaacuc

SEQ ID NO: 1036537 - RNA, 21 nt, Human
caucagguucuucuuccagga

SEQ ID NO: 1036538 - RNA, 18 nt, Human
cugcacuguuacuuccug

SEQ ID NO: 1036539 - RNA, 19 nt, Human
gacagauggcuggcaucag

SEQ ID NO: 1036540 - RNA, 19 nt, Human
uuccuugacagauggcugg

SEQ ID NO: 1036541 - RNA, 24 nt, Human
aaaacauuucaauaguauaaccaa

SEQ ID NO: 1036542 - RNA, 24 nt, Human
aaaaggacuugaccucuaugacuc

SEQ ID NO: 1036543 - RNA, 18 nt, Human
aaacacagucagaucgua

SEQ ID NO: 1036544 - RNA, 18 nt, Human
aaaggaccucaugugaga

SEQ ID NO: 1036545 - RNA, 23 nt, Human
aagcaagaaaggacagaagaaau

SEQ ID NO: 1036546 - RNA, 23 nt, Human
aagcaagaaaggacagaagggac

SEQ ID NO: 1036547 - RNA, 18 nt, Human
aaggaccucaugugagag

SEQ ID NO: 1036548 - RNA, 20 nt, Human
aauaguggaaacaacuagaa

SEQ ID NO: 1036549 - RNA, 18 nt, Human
acaagaaaaggacuugac

SEQ ID NO: 1036550 - RNA, 30 nt, Human
acauggccuuuucucugcguguguacccuu

SEQ ID NO: 1036551 - RNA, 24 nt, Human
acccuauccccaaauacagucaca

SEQ ID NO: 1036552 - RNA, 22 nt, Human
agaaaacucuauuaggugccga

SEQ ID NO: 1036553 - RNA, 23 nt, Human
agaacacauacgcccugugacag

SEQ ID NO: 1036554 - RNA, 19 nt, Human
agacagaaagaacuacaag

SEQ ID NO: 1036555 - RNA, 20 nt, Human
agagggagaggccccacagg

SEQ ID NO: 1036556 - RNA, 21 nt, Human
aggaaaagagaaauaacagaa

SEQ ID NO: 1036557 - RNA, 20 nt, Human
aggacaucaugguuagccuc

SEQ ID NO: 1036558 - RNA, 29 nt, Human
aggugguuugcuugaagaagcagccauag

SEQ ID NO: 1036559 - RNA, 19 nt, Human
aguaauuaguggaaaauaa

SEQ ID NO: 1036560 - RNA, 24 nt, Human
augacucugugguggggaugaagg

SEQ ID NO: 1036561 - RNA, 18 nt, Human
augccaucucuguguuuu

SEQ ID NO: 1036562 - RNA, 19 nt, Human
augggauaaaaugaauggu

SEQ ID NO: 1036563 - RNA, 26 nt, Human
caaauuccaccccacuguagucauac

SEQ ID NO: 1036564 - RNA, 23 nt, Human
caacauaugaauuugaggaacac

SEQ ID NO: 1036565 - RNA, 23 nt, Human
caaucccuaagcaagaaaggaca

SEQ ID NO: 1036566 - RNA, 22 nt, Human
cacaagaaaaggacuugaccuc

SEQ ID NO: 1036567 - RNA, 22 nt, Human
cacacaacuccuacuggaauag

SEQ ID NO: 1036568 - RNA, 20 nt, Human
cacauuugguacuugggguu

SEQ ID NO: 1036569 - RNA, 18 nt, Human
cacccccaaucccuaagc

SEQ ID NO: 1036570 - RNA, 21 nt, Human
cagaaagguagcccuucacua

SEQ ID NO: 1036571 - RNA, 22 nt, Human
cagcaagcggguuuuauccccu

SEQ ID NO: 1036572 - RNA, 18 nt, Human
cagggguccugcugagcc

SEQ ID NO: 1036573 - RNA, 24 nt, Human
caguucuggagacuggaccuccaa

SEQ ID NO: 1036574 - RNA, 20 nt, Human
cauacgcccugugacagggc

SEQ ID NO: 1036575 - RNA, 19 nt, Human
caugaagucccaaauucca

SEQ ID NO: 1036576 - RNA, 20 nt, Human
cauggccuuuucucugcgug

SEQ ID NO: 1036577 - RNA, 21 nt, Human
ccaaauacagucacauuuggu

SEQ ID NO: 1036578 - RNA, 23 nt, Human
ccaacaccuaauccaauaugacu

SEQ ID NO: 1036579 - RNA, 23 nt, Human
ccaagagagggagaggccccaca

SEQ ID NO: 1036580 - RNA, 23 nt, Human
cccaacaccuaauccaauaugac

SEQ ID NO: 1036581 - RNA, 18 nt, Human
cccacagaaagguagccc

SEQ ID NO: 1036582 - RNA, 21 nt, Human
ccuugcgcucaucuucuccuc

SEQ ID NO: 1036583 - RNA, 20 nt, Human
cucagagcuuaggcuaggcc

SEQ ID NO: 1036584 - RNA, 24 nt, Human
cugcguguguacccucuggugccu

SEQ ID NO: 1036585 - RNA, 24 nt, Human
cuucagcccauccucaacuacccc

SEQ ID NO: 1036586 - RNA, 19 nt, Human
cuucagggacccuaucccc

SEQ ID NO: 1036587 - RNA, 21 nt, Human
cuucagggacccuauccccaa

SEQ ID NO: 1036588 - RNA, 20 nt, Human
cuucugugccuucagcccau

SEQ ID NO: 1036589 - RNA, 24 nt, Human
cuugauuucucccuuggccagcca

SEQ ID NO: 1036590 - RNA, 20 nt, Human
cuuggcauaauuuagcagca

SEQ ID NO: 1036591 - RNA, 21 nt, Human
gaaaagagaaauaacagaaaa

SEQ ID NO: 1036592 - RNA, 23 nt, Human
gaaccaacuuauuggagcaguaa

SEQ ID NO: 1036593 - RNA, 21 nt, Human
gaccuccaagaucaaggugca

SEQ ID NO: 1036594 - RNA, 21 nt, Human
gaggccccacagggguccugc

SEQ ID NO: 1036595 - RNA, 23 nt, Human
gaucaaggaaaagagaaauaaca

SEQ ID NO: 1036596 - RNA, 19 nt, Human
gauuuccacccccaauccc

SEQ ID NO: 1036597 - RNA, 22 nt, Human
gcccauccucaacuacccccuc

SEQ ID NO: 1036598 - RNA, 21 nt, Human
gccuuuccuucaccuuuagau

SEQ ID NO: 1036599 - RNA, 22 nt, Human
gcugguuucuucugugccuuca

SEQ ID NO: 1036600 - RNA, 21 nt, Human
ggaacaugcuuagauugccag

SEQ ID NO: 1036601 - RNA, 22 nt, Human
ggcaugaagucccaaauuccac

SEQ ID NO: 1036602 - RNA, 21 nt, Human
ggugcaggcaaggcugguuuc

SEQ ID NO: 1036603 - RNA, 20 nt, Human
gguuucuucugagguuuccc

SEQ ID NO: 1036604 - RNA, 23 nt, Human
guauaacagaacacauacgcccu

SEQ ID NO: 1036605 - RNA, 23 nt, Human
gugacagggcaugucacugugac

SEQ ID NO: 1036606 - RNA, 23 nt, Human
gugauugaaguuauuccauugua

SEQ ID NO: 1036607 - RNA, 21 nt, Human
gugccuacagcucgccuuuaa

SEQ ID NO: 1036608 - RNA, 18 nt, Human
uaaaccuucuagagcaau

SEQ ID NO: 1036609 - RNA, 18 nt, Human
uaacugccauaacuuugg

SEQ ID NO: 1036610 - RNA, 24 nt, Human
uacaagauauaaguaggugugagg

SEQ ID NO: 1036611 - RNA, 19 nt, Human
uacagcucgccuuuaacag

SEQ ID NO: 1036612 - RNA, 26 nt, Human
uacucacaacuacacccaguuuuuua

SEQ ID NO: 1036613 - RNA, 21 nt, Human
uagaauuuaaugaccaacccc

SEQ ID NO: 1036614 - RNA, 23 nt, Human
uagcagcaaccuuggaauuugca

SEQ ID NO: 1036615 - RNA, 19 nt, Human
uagcagcagcaagcggguu

SEQ ID NO: 1036616 - RNA, 20 nt, Human
uaguuuucuugaauuuuugg

SEQ ID NO: 1036617 - RNA, 19 nt, Human
uauuuugcccuucccuguu

SEQ ID NO: 1036618 - RNA, 21 nt, Human
ucaacauaugaauuugaggaa

SEQ ID NO: 1036619 - RNA, 21 nt, Human
ucagagcuuaggcuaggcccu

SEQ ID NO: 1036620 - RNA, 21 nt, Human
ucagcccauccucaacuaccc

SEQ ID NO: 1036621 - RNA, 19 nt, Human
ucagggacccuauccccaa

SEQ ID NO: 1036622 - RNA, 23 nt, Human
ucaguccauaauagguuuuuugg

SEQ ID NO: 1036623 - RNA, 19 nt, Human
ucauauuggauuagggucc

SEQ ID NO: 1036624 - RNA, 25 nt, Human
uccaagaucaaggugcaggcaaggc

SEQ ID NO: 1036625 - RNA, 26 nt, Human
uccacacauggccuuuucucugcgug

SEQ ID NO: 1036626 - RNA, 21 nt, Human
uccaccccacuguagucauac

SEQ ID NO: 1036627 - RNA, 20 nt, Human
uccaugccuuuaagcaccaa

SEQ ID NO: 1036628 - RNA, 21 nt, Human
uccccuggauaguguggugag

SEQ ID NO: 1036629 - RNA, 23 nt, Human
ucccuuggccagccaauucccaa

SEQ ID NO: 1036630 - RNA, 22 nt, Human
uccuaaacucacaauucuuuaa

SEQ ID NO: 1036631 - RNA, 22 nt, Human
ucuaugacucugugguggggau

SEQ ID NO: 1036632 - RNA, 20 nt, Human
ugaaaugcuauaacgaauga

SEQ ID NO: 1036633 - RNA, 21 nt, Human
ugaaugguugcacaaucccau

SEQ ID NO: 1036634 - RNA, 20 nt, Human
ugaauuaacaugccaaaggc

SEQ ID NO: 1036635 - RNA, 23 nt, Human
ugaauuaacaugccaaaggcaca

SEQ ID NO: 1036636 - RNA, 19 nt, Human
ugaauuuuugggggauugu

SEQ ID NO: 1036637 - RNA, 20 nt, Human
ugacacucgugauuaugaua

SEQ ID NO: 1036638 - RNA, 18 nt, Human
ugacauugcuaauugaac

SEQ ID NO: 1036639 - RNA, 19 nt, Human
ugaccaacccccaccuguu

SEQ ID NO: 1036640 - RNA, 23 nt, Human
ugacuucucagagcuuaggcuag

SEQ ID NO: 1036641 - RNA, 22 nt, Human
ugagagcagcaaguuguggcua

SEQ ID NO: 1036642 - RNA, 21 nt, Human
ugaggaacacaauucagucca

SEQ ID NO: 1036643 - RNA, 18 nt, Human
ugaggaagaagggucugc

SEQ ID NO: 1036644 - RNA, 24 nt, Human
ugaggugguuugcuugaagaagca

SEQ ID NO: 1036645 - RNA, 18 nt, Human
ugaugaaacacagucaga

SEQ ID NO: 1036646 - RNA, 19 nt, Human
ugcuaguggggagaggggc

SEQ ID NO: 1036647 - RNA, 18 nt, Human
ugggaaaggacaucaugg

SEQ ID NO: 1036648 - RNA, 18 nt, Human
ugggcaugaagucccaaa

SEQ ID NO: 1036649 - RNA, 18 nt, Human
uggugaggugguuugcuu

SEQ ID NO: 1036650 - RNA, 22 nt, Human
ugguuguuuauuuugcccuucc

SEQ ID NO: 1036651 - RNA, 21 nt, Human
uuacccacagaaagguagccc

SEQ ID NO: 1036652 - RNA, 20 nt, Human
uuaguucauccuuuuucuua

SEQ ID NO: 1036653 - RNA, 21 nt, Human
uucacaguucuggagacugga

SEQ ID NO: 1036654 - RNA, 22 nt, Human
uugaggagaaauaucagaaugu

SEQ ID NO: 1036655 - RNA, 24 nt, Human
uuggauuaggguccagggaacagg

SEQ ID NO: 1036656 - RNA, 20 nt, Human
uuucccugauaaaggagaga

SEQ ID NO: 1036657 - RNA, 21 nt, Human
gcaggcguaaagggagcuuuu

SEQ ID NO: 1036658 - RNA, 20 nt, Human
ucuuugguguccgcauuugc

SEQ ID NO: 1036659 - RNA, 22 nt, Human
acauuccuuuucuucagaugua

SEQ ID NO: 1036660 - RNA, 21 nt, Human
uaaaacaauggcaaagaugag

SEQ ID NO: 1036661 - RNA, 22 nt, Human
uaaaacaauggcaaagaugagc

SEQ ID NO: 1036662 - RNA, 18 nt, Human
uaucuucaaaguuacauu

SEQ ID NO: 1036663 - RNA, 21 nt, Human
ugagaauaaaauucuaucuuc

SEQ ID NO: 1036664 - RNA, 23 nt, Human
ugaucuucacuuucacuaguacc

SEQ ID NO: 1036665 - RNA, 18 nt, Human
ugaugaaguaauucuuuu

SEQ ID NO: 1036666 - RNA, 24 nt, Human
uucacuuucacuaguaccugacca

SEQ ID NO: 1036667 - RNA, 24 nt, Human
uucucugucuggaugcucuguaug

SEQ ID NO: 1036668 - RNA, 19 nt, Human
cagacaccauguuccacuc

SEQ ID NO: 1036669 - RNA, 23 nt, Human
caggagccagcuuaggcuccagu

SEQ ID NO: 1036670 - RNA, 20 nt, Human
ccacugagaucuaggcgcag

SEQ ID NO: 1036671 - RNA, 21 nt, Human
ccacugagaucuaggcgcagg

SEQ ID NO: 1036672 - RNA, 24 nt, Human
ccccaggagccagcuuaggcuccu

SEQ ID NO: 1036673 - RNA, 21 nt, Human
cugaagguuccuguaggcugg

SEQ ID NO: 1036674 - RNA, 18 nt, Human
gaagguuccuguaggcug

SEQ ID NO: 1036675 - RNA, 18 nt, Human
ggacagacaccauguucc

SEQ ID NO: 1036676 - RNA, 19 nt, Human
ggacagacaccauguucca

SEQ ID NO: 1036677 - RNA, 28 nt, Human
ggacagacaccauguuccagcuucccag

SEQ ID NO: 1036678 - RNA, 23 nt, Human
uccccaggagccagcuuaggcuc

SEQ ID NO: 1036679 - RNA, 28 nt, Human
ucgucccaugaacaaggugaacagagau

SEQ ID NO: 1036680 - RNA, 18 nt, Human
uggcagggagaggacaga

SEQ ID NO: 1036681 - RNA, 21 nt, Human
uggcagggagaggacagacac

SEQ ID NO: 1036682 - RNA, 19 nt, Human
aagcggagcaaaagacaca

SEQ ID NO: 1036683 - RNA, 18 nt, Human
auuuguacuauuuucccu

SEQ ID NO: 1036684 - RNA, 23 nt, Human
uaaagcggagcaaaagacacaaa

SEQ ID NO: 1036685 - RNA, 18 nt, Human
uccauugauuuucagauu

SEQ ID NO: 1036686 - RNA, 18 nt, Human
ugacuaggaauguccucg

SEQ ID NO: 1036687 - RNA, 23 nt, Human
ugagaaaaugacuaggaaugucc

SEQ ID NO: 1036688 - RNA, 18 nt, Human
aaaguuccucaaaaccag

SEQ ID NO: 1036689 - RNA, 18 nt, Human
aacaguaugaccaaagaa

SEQ ID NO: 1036690 - RNA, 19 nt, Human
aagacacagcacucugugg

SEQ ID NO: 1036691 - RNA, 24 nt, Human
accuuagucccucuucccaacccc

SEQ ID NO: 1036692 - RNA, 20 nt, Human
acugcaaaaguaaaguuccu

SEQ ID NO: 1036693 - RNA, 20 nt, Human
aguaaaguuccucaaaacca

SEQ ID NO: 1036694 - RNA, 18 nt, Human
agucuaccagggcaaaua

SEQ ID NO: 1036695 - RNA, 19 nt, Human
aucuuauuuacaaucucuc

SEQ ID NO: 1036696 - RNA, 21 nt, Human
auucccauuuuuuuuacccag

SEQ ID NO: 1036697 - RNA, 19 nt, Human
caacugcaacacaaaaugu

SEQ ID NO: 1036698 - RNA, 23 nt, Human
caagagggcaacaaaauauaaga

SEQ ID NO: 1036699 - RNA, 26 nt, Human
caaucuguuauucaauccuccaucuc

SEQ ID NO: 1036700 - RNA, 22 nt, Human
caccuuagucccucuucccaac

SEQ ID NO: 1036701 - RNA, 23 nt, Human
cacuaauaucuuugggauguuau

SEQ ID NO: 1036702 - RNA, 22 nt, Human
cacuccuacuccaaaaguccca

SEQ ID NO: 1036703 - RNA, 22 nt, Human
caguaugaccaaagaauccacu

SEQ ID NO: 1036704 - RNA, 21 nt, Human
cagucuaccagggcaaauaau

SEQ ID NO: 1036705 - RNA, 18 nt, Human
cauugagggagucaacug

SEQ ID NO: 1036706 - RNA, 23 nt, Human
ccaaaagucccacuaugcuccaa

SEQ ID NO: 1036707 - RNA, 22 nt, Human
ccauccacaauguaaauaucuc

SEQ ID NO: 1036708 - RNA, 25 nt, Human
cccaagagggcaacaaaauauaaga

SEQ ID NO: 1036709 - RNA, 22 nt, Human
ccucaugucaggugcuucgggc

SEQ ID NO: 1036710 - RNA, 19 nt, Human
ccuccaucuccauccacaa

SEQ ID NO: 1036711 - RNA, 19 nt, Human
ccugcuugucuccccacua

SEQ ID NO: 1036712 - RNA, 20 nt, Human
cgugugcauuucgggguccc

SEQ ID NO: 1036713 - RNA, 23 nt, Human
cucaaaaccagggcgaaugaaaa

SEQ ID NO: 1036714 - RNA, 18 nt, Human
cucaaauucacuucuccu

SEQ ID NO: 1036715 - RNA, 22 nt, Human
cuuaggccaacccacauccagc

SEQ ID NO: 1036716 - RNA, 19 nt, Human
gaaguauccaugauucccu

SEQ ID NO: 1036717 - RNA, 20 nt, Human
gcgaaguauccaugauuccc

SEQ ID NO: 1036718 - RNA, 23 nt, Human
ggaaauauccauccucugugaac

SEQ ID NO: 1036719 - RNA, 20 nt, Human
ggcgaaugaaaaucacagaa

SEQ ID NO: 1036720 - RNA, 20 nt, Human
uaaauucuugugcuugaaca

SEQ ID NO: 1036721 - RNA, 18 nt, Human
uaagucccaagagggcaa

SEQ ID NO: 1036722 - RNA, 23 nt, Human
uaagucccaagagggcaacaaaa

SEQ ID NO: 1036723 - RNA, 24 nt, Human
uacaaauaaaacuaagucccaaga

SEQ ID NO: 1036724 - RNA, 18 nt, Human
uacccaagacuugaacaa

SEQ ID NO: 1036725 - RNA, 23 nt, Human
uacccagggagaaucagucuacc

SEQ ID NO: 1036726 - RNA, 19 nt, Human
ucaacugcaacacaaaaug

SEQ ID NO: 1036727 - RNA, 20 nt, Human
ucauuuuuaagucgucaaga

SEQ ID NO: 1036728 - RNA, 22 nt, Human
uccaaaagucccacuaugcucc

SEQ ID NO: 1036729 - RNA, 19 nt, Human
ucugagcucaaauucacuu

SEQ ID NO: 1036730 - RNA, 18 nt, Human
ucuuugggauguuauccc

SEQ ID NO: 1036731 - RNA, 20 nt, Human
ugcuccaaggucgcuuuugc

SEQ ID NO: 1036732 - RNA, 21 nt, Human
uggguuaucaaacugcaaagg

SEQ ID NO: 1036733 - RNA, 22 nt, Human
uguaaauaucuccuguguccuc

SEQ ID NO: 1036734 - RNA, 23 nt, Human
uugagggagucaacugcaacaca

SEQ ID NO: 1036735 - RNA, 24 nt, Human
uugagggagucaacugcaacacaa

SEQ ID NO: 1036736 - RNA, 19 nt, Human
uuuaacaguaugaccaaag

SEQ ID NO: 1036737 - RNA, 22 nt, Human
ccacgugcuggguuuccccuuc

SEQ ID NO: 1036738 - RNA, 19 nt, Human
cucucucaccccgucaaag

SEQ ID NO: 1036739 - RNA, 18 nt, Human
gcuggguuuccccuuccu

SEQ ID NO: 1036740 - RNA, 18 nt, Human
auguggaaugguucagag

SEQ ID NO: 1036741 - RNA, 19 nt, Human
cccuguuccggaggcuggu

SEQ ID NO: 1036742 - RNA, 25 nt, Human
gugggcgugugcacacaagugcccu

SEQ ID NO: 1036743 - RNA, 20 nt, Human
guucuagcaggcuccucucc

SEQ ID NO: 1036744 - RNA, 18 nt, Human
uagcaggcuccucuccug

SEQ ID NO: 1036745 - RNA, 21 nt, Human
uagcaggcuccucuccugcgc

SEQ ID NO: 1036746 - RNA, 25 nt, Human
ugguggguggggguucuagcaggcu

SEQ ID NO: 1036747 - RNA, 18 nt, Human
uguuccggaggcuggugg

SEQ ID NO: 1036748 - RNA, 21 nt, Human
uguuccggaggcuggugggug

SEQ ID NO: 1036749 - RNA, 21 nt, Human
uuccggaggcugguggguggg

SEQ ID NO: 1036750 - RNA, 21 nt, Human
uuuauguggaaugguucagag

SEQ ID NO: 1036751 - RNA, 21 nt, Human
uuuuccuuuauguggaauggu

SEQ ID NO: 1036752 - RNA, 18 nt, Human
acccgcaguuuuauguug

SEQ ID NO: 1036753 - RNA, 22 nt, Human
acugauaauggucauuucucuu

SEQ ID NO: 1036754 - RNA, 23 nt, Human
agguuuuggucucguggggaagg

SEQ ID NO: 1036755 - RNA, 22 nt, Human
cacagucaaaggccagaagucc

SEQ ID NO: 1036756 - RNA, 21 nt, Human
cacuggacugcuccuggcucu

SEQ ID NO: 1036757 - RNA, 23 nt, Human
cucuuugcugacagagccaggag

SEQ ID NO: 1036758 - RNA, 21 nt, Human
cugauaauggucauuucucuu

SEQ ID NO: 1036759 - RNA, 18 nt, Human
gacacuggaagccccuuu

SEQ ID NO: 1036760 - RNA, 21 nt, Human
gcaaguuucucgaccucucca

SEQ ID NO: 1036761 - RNA, 23 nt, Human
uaacaacacugcuaccagcagaa

SEQ ID NO: 1036762 - RNA, 18 nt, Human
ucgaccucuccagccacc

SEQ ID NO: 1036763 - RNA, 20 nt, Human
ucugucucugcugcucugga

SEQ ID NO: 1036764 - RNA, 22 nt, Human
ugauaaauauugcccuuccucc

SEQ ID NO: 1036765 - RNA, 24 nt, Human
ugauaaauauugcccuuccuccca

SEQ ID NO: 1036766 - RNA, 18 nt, Human
uggacugcuccuggcucu

SEQ ID NO: 1036767 - RNA, 25 nt, Human
uggggaaggcagaaccugcucuuug

SEQ ID NO: 1036768 - RNA, 24 nt, Human
ugucuuuccuucugucccguucca

SEQ ID NO: 1036769 - RNA, 27 nt, Human
uuugugcuggcaccagaccacuggacu

SEQ ID NO: 1036770 - RNA, 19 nt, Human
agguguggacgugaacacc

SEQ ID NO: 1036771 - RNA, 23 nt, Human
cagagagguguggacgugaacac

SEQ ID NO: 1036772 - RNA, 24 nt, Human
cccgcugcugcuggccgugcgggg

SEQ ID NO: 1036773 - RNA, 24 nt, Human
cuggccgugcggggcaggcauccg

SEQ ID NO: 1036774 - RNA, 22 nt, Human
gcugcugcagagagguguggac

SEQ ID NO: 1036775 - RNA, 21 nt, Human
uggcuucagcccgcugcugcu

SEQ ID NO: 1036776 - RNA, 25 nt, Human
aaaaacaccacucucugacuaucac

SEQ ID NO: 1036777 - RNA, 18 nt, Human
aaaagaagaaagaaaagg

SEQ ID NO: 1036778 - RNA, 24 nt, Human
aaacacaccugaauuuggauauuc

SEQ ID NO: 1036779 - RNA, 18 nt, Human
aacacagauaagcuaugg

SEQ ID NO: 1036780 - RNA, 25 nt, Human
aagaaaaggccuuuaggaugcagug

SEQ ID NO: 1036781 - RNA, 20 nt, Human
aagaagaaagaaaaggccuu

SEQ ID NO: 1036782 - RNA, 21 nt, Human
aagaagaaagaaaaggccuuu

SEQ ID NO: 1036783 - RNA, 22 nt, Human
acccaaagagaaaagaagaaag

SEQ ID NO: 1036784 - RNA, 19 nt, Human
agacuguaacacccagaca

SEQ ID NO: 1036785 - RNA, 19 nt, Human
agucugcggagggagccug

SEQ ID NO: 1036786 - RNA, 21 nt, Human
caaaaacaccacucucugacu

SEQ ID NO: 1036787 - RNA, 25 nt, Human
caaaauacagcucuuuauccaaaca

SEQ ID NO: 1036788 - RNA, 24 nt, Human
caauccuucccaccugaacaaaaa

SEQ ID NO: 1036789 - RNA, 20 nt, Human
caccugaacaaaaacaccac

SEQ ID NO: 1036790 - RNA, 18 nt, Human
cacugauaaugacagagu

SEQ ID NO: 1036791 - RNA, 21 nt, Human
cagaggaaagucagucugcgg

SEQ ID NO: 1036792 - RNA, 21 nt, Human
ccaaagagaaaagaagaaaga

SEQ ID NO: 1036793 - RNA, 23 nt, Human
ccaaagagaaaagaagaaagaaa

SEQ ID NO: 1036794 - RNA, 22 nt, Human
ccaauccuucccaccugaacaa

SEQ ID NO: 1036795 - RNA, 20 nt, Human
cuacugguuuaaaucacugu

SEQ ID NO: 1036796 - RNA, 18 nt, Human
cuaucacccaaagagaaa

SEQ ID NO: 1036797 - RNA, 18 nt, Human
cugaacaaaaacaccacu

SEQ ID NO: 1036798 - RNA, 30 nt, Human
cugauaaugacagaguugaugcucuccuuu

SEQ ID NO: 1036799 - RNA, 22 nt, Human
cuucucaauccaaacacaccug

SEQ ID NO: 1036800 - RNA, 22 nt, Human
gcaaaauacagcucuuuaucca

SEQ ID NO: 1036801 - RNA, 23 nt, Human
uaacacccagacacagaggaaag

SEQ ID NO: 1036802 - RNA, 21 nt, Human
uaucacccaaagagaaaagaa

SEQ ID NO: 1036803 - RNA, 22 nt, Human
ucacccaaagagaaaagaagaa

SEQ ID NO: 1036804 - RNA, 20 nt, Human
ucacuguaacagaacagaau

SEQ ID NO: 1036805 - RNA, 20 nt, Human
uccaaaaugugaaccaagaa

SEQ ID NO: 1036806 - RNA, 18 nt, Human
ucccaccugaacaaaaac

SEQ ID NO: 1036807 - RNA, 19 nt, Human
ucccucauggaaaaaaaaa

SEQ ID NO: 1036808 - RNA, 28 nt, Human
ucccucauggaaaaaaaaaucagaaaau

SEQ ID NO: 1036809 - RNA, 24 nt, Human
uccuucccaccugaacaaaaacac

SEQ ID NO: 1036810 - RNA, 23 nt, Human
ucucaauccaaacacaccugaau

SEQ ID NO: 1036811 - RNA, 24 nt, Human
ucucuggugaaggucuucaggggc

SEQ ID NO: 1036812 - RNA, 26 nt, Human
uggugaaggucuucaggggcgucacu

SEQ ID NO: 1036813 - RNA, 19 nt, Human
uucccaccugaacaaaaac

SEQ ID NO: 1036814 - RNA, 24 nt, Human
uucccaccugaacaaaaacaccac

SEQ ID NO: 1036815 - RNA, 18 nt, Human
uuccugaggggugugcug

SEQ ID NO: 1036816 - RNA, 21 nt, Human
uugaugcucuccuucucaauc

SEQ ID NO: 1036817 - RNA, 24 nt, Human
aaaauaguuuugucccaaaaucca

SEQ ID NO: 1036818 - RNA, 21 nt, Human
agaauugguggggacccccaa

SEQ ID NO: 1036819 - RNA, 21 nt, Human
agguccccugcgucucaguuu

SEQ ID NO: 1036820 - RNA, 19 nt, Human
agucccuggccgagccuca

SEQ ID NO: 1036821 - RNA, 20 nt, Human
agucugccauccucuucagg

SEQ ID NO: 1036822 - RNA, 20 nt, Human
auccucuucaggucccauag

SEQ ID NO: 1036823 - RNA, 22 nt, Human
auggaucccgcgaaggcacacc

SEQ ID NO: 1036824 - RNA, 24 nt, Human
cacaagcuucuccaauucuccaag

SEQ ID NO: 1036825 - RNA, 20 nt, Human
caccgcacugcacagucugc

SEQ ID NO: 1036826 - RNA, 22 nt, Human
ccagcagggcacaagcuucucc

SEQ ID NO: 1036827 - RNA, 28 nt, Human
cccauaccucucuugaucuccccgacua

SEQ ID NO: 1036828 - RNA, 20 nt, Human
ccuagaacucagguccccug

SEQ ID NO: 1036829 - RNA, 19 nt, Human
ccuaguuccggggaugugg

SEQ ID NO: 1036830 - RNA, 20 nt, Human
ccugcaccgcgaucaccuag

SEQ ID NO: 1036831 - RNA, 19 nt, Human
ccugguuccugcaccgcga

SEQ ID NO: 1036832 - RNA, 18 nt, Human
cgccuagggugcuccggg

SEQ ID NO: 1036833 - RNA, 20 nt, Human
cuagaacucagguccccugc

SEQ ID NO: 1036834 - RNA, 25 nt, Human
cuccaaggucagcaagccacggcag

SEQ ID NO: 1036835 - RNA, 22 nt, Human
cuugaucuccccgacuacuaga

SEQ ID NO: 1036836 - RNA, 18 nt, Human
gagccucagcuuuaucug

SEQ ID NO: 1036837 - RNA, 23 nt, Human
gcacaccugguuccugcaccgcg

SEQ ID NO: 1036838 - RNA, 21 nt, Human
gccuggggcguggcaccagcc

SEQ ID NO: 1036839 - RNA, 20 nt, Human
ggagggguggacgacggcug

SEQ ID NO: 1036840 - RNA, 25 nt, Human
ggcagagccaggccuagaacucagg

SEQ ID NO: 1036841 - RNA, 20 nt, Human
gggaggagauaggaggguga

SEQ ID NO: 1036842 - RNA, 18 nt, Human
ggggagggguggacgacg

SEQ ID NO: 1036843 - RNA, 21 nt, Human
uaccucucuugaucuccccga

SEQ ID NO: 1036844 - RNA, 19 nt, Human
ucccaaaauccagcgccua

SEQ ID NO: 1036845 - RNA, 21 nt, Human
ucccuggccgagccucagcuu

SEQ ID NO: 1036846 - RNA, 18 nt, Human
ucuguaagaaaggggagg

SEQ ID NO: 1036847 - RNA, 23 nt, Human
ugcgggcggggugagccuggggc

SEQ ID NO: 1036848 - RNA, 25 nt, Human
ugggaggagauaggagggugaaaac

SEQ ID NO: 1036849 - RNA, 27 nt, Human
uucuccaaggucagcaagccacggcag

SEQ ID NO: 1036850 - RNA, 21 nt, Human
aaagcaaauggagcgaaagcc

SEQ ID NO: 1036851 - RNA, 20 nt, Human
aauaaagaggccuuccugaa

SEQ ID NO: 1036852 - RNA, 21 nt, Human
acuuccuuuaguuccuuguug

SEQ ID NO: 1036853 - RNA, 21 nt, Human
aggaagauuuaaaaaugcuug

SEQ ID NO: 1036854 - RNA, 20 nt, Human
cagaauucucacaugguguu

SEQ ID NO: 1036855 - RNA, 20 nt, Human
cauuauuuuugugcugcugu

SEQ ID NO: 1036856 - RNA, 23 nt, Human
ccaaagcaaauggagcgaaagcc

SEQ ID NO: 1036857 - RNA, 25 nt, Human
cccauaguacauccaacguucaggu

SEQ ID NO: 1036858 - RNA, 20 nt, Human
cucagaagagcucaaggaaa

SEQ ID NO: 1036859 - RNA, 20 nt, Human
ggaaaugcuugggacccagg

SEQ ID NO: 1036860 - RNA, 24 nt, Human
guagaucuuuguucccagaauucu

SEQ ID NO: 1036861 - RNA, 19 nt, Human
uaacacaaauggcugugcc

SEQ ID NO: 1036862 - RNA, 20 nt, Human
uagaucuuuguucccagaau

SEQ ID NO: 1036863 - RNA, 27 nt, Human
ucacaugguguucauuucugccaguag

SEQ ID NO: 1036864 - RNA, 19 nt, Human
ucaggucauuggccuucug

SEQ ID NO: 1036865 - RNA, 21 nt, Human
ucccagaauucucacauggug

SEQ ID NO: 1036866 - RNA, 21 nt, Human
ugaccucagaaaaaagagucu

SEQ ID NO: 1036867 - RNA, 23 nt, Human
ugguguucauuucugccaguagu

SEQ ID NO: 1036868 - RNA, 20 nt, Human
uguaaugcccauaguacauc

SEQ ID NO: 1036869 - RNA, 21 nt, Human
uguccaaagcaaauggagcga

SEQ ID NO: 1036870 - RNA, 18 nt, Human
uuccugaaaauaugugcc

SEQ ID NO: 1036871 - RNA, 22 nt, Human
uuccuuguuguucuguguagau

SEQ ID NO: 1036872 - RNA, 21 nt, Human
uucuucagugcuucaucuggc

SEQ ID NO: 1036873 - RNA, 22 nt, Human
aaguuacuuucuuuuccuuucu

SEQ ID NO: 1036874 - RNA, 19 nt, Human
agagcgucauaaggauaaa

SEQ ID NO: 1036875 - RNA, 21 nt, Human
agcagaguggaagaggggcag

SEQ ID NO: 1036876 - RNA, 19 nt, Human
ccgagagcagaguggaaga

SEQ ID NO: 1036877 - RNA, 22 nt, Human
cgagagcagaguggaagagggg

SEQ ID NO: 1036878 - RNA, 22 nt, Human
gagcagaguggaagaggggcag

SEQ ID NO: 1036879 - RNA, 19 nt, Human
uccucacggcaaaauaagg

SEQ ID NO: 1036880 - RNA, 23 nt, Human
ugugaaaccagugagaagaauaa

SEQ ID NO: 1036881 - RNA, 27 nt, Human
uuacuuucuuuuccuuucucugugaaa

SEQ ID NO: 1036882 - RNA, 22 nt, Human
uucucugugaaaccagugagaa

SEQ ID NO: 1036883 - RNA, 20 nt, Human
aagcauuuuucaaagcaauu

SEQ ID NO: 1036884 - RNA, 18 nt, Human
auagaauauuugucuaca

SEQ ID NO: 1036885 - RNA, 24 nt, Human
cauuucaaauauaguuuuaaugac

SEQ ID NO: 1036886 - RNA, 24 nt, Human
cugguugcuaaggugaaagcgcca

SEQ ID NO: 1036887 - RNA, 24 nt, Human
uaaaauauuaaaucaguauuuguc

SEQ ID NO: 1036888 - RNA, 20 nt, Human
ucuacaauauauagucugau

SEQ ID NO: 1036889 - RNA, 25 nt, Human
ucucaugagcuaugcacaaaugucu

SEQ ID NO: 1036890 - RNA, 18 nt, Human
ugagcuaugcacaaaugu

SEQ ID NO: 1036891 - RNA, 24 nt, Human
ugggagccgcgcugguugcuaagg

SEQ ID NO: 1036892 - RNA, 18 nt, Human
uucaauuuauuuccauuu

SEQ ID NO: 1036893 - RNA, 23 nt, Human
acagaauuucaccuucuccggcc

SEQ ID NO: 1036894 - RNA, 24 nt, Human
accagcaucuuuauuuuucaugcu

SEQ ID NO: 1036895 - RNA, 24 nt, Human
caggaucugguuuggauaaagguu

SEQ ID NO: 1036896 - RNA, 21 nt, Human
ggaaagucaucuccaccaaga

SEQ ID NO: 1036897 - RNA, 22 nt, Human
ggugagccuccacucggauucu

SEQ ID NO: 1036898 - RNA, 22 nt, Human
gguuuggauaaagguuacugug

SEQ ID NO: 1036899 - RNA, 24 nt, Human
ucccaagcuggcaggaguaaagcu

SEQ ID NO: 1036900 - RNA, 25 nt, Human
ucccaagcuggcaggaguaaagcuu

SEQ ID NO: 1036901 - RNA, 22 nt, Human
uuacugugcgggagcugacaaa

SEQ ID NO: 1036902 - RNA, 21 nt, Human
uuuggaagauugucauccaga

SEQ ID NO: 1036903 - RNA, 20 nt, Human
uuuugggaguaggagacuug

SEQ ID NO: 1036904 - RNA, 24 nt, Human
aaaaguacccaacaaaacuuuuga

SEQ ID NO: 1036905 - RNA, 21 nt, Human
acccaacaaaacuuuugagcc

SEQ ID NO: 1036906 - RNA, 26 nt, Human
cuacuucaaguuaaaaagaaagcaau

SEQ ID NO: 1036907 - RNA, 18 nt, Human
gagccuucaugcuacuuc

SEQ ID NO: 1036908 - RNA, 21 nt, Human
gcaaccaaaacuacuucucaa

SEQ ID NO: 1036909 - RNA, 18 nt, Human
uacuguguaaucaagagc

SEQ ID NO: 1036910 - RNA, 19 nt, Human
ucaagagcaaccaaaacua

SEQ ID NO: 1036911 - RNA, 22 nt, Human
ugcaguacaaguuucaccacca

SEQ ID NO: 1036912 - RNA, 22 nt, Human
uguaaucaagagcaaccaaaac

SEQ ID NO: 1036913 - RNA, 19 nt, Human
uucaaguuaaaaagaaagc

SEQ ID NO: 1036914 - RNA, 23 nt, Human
aaaauacuuuuaccuagguuuua

SEQ ID NO: 1036915 - RNA, 27 nt, Human
aaacacugaaaauacacuucugaaacu

SEQ ID NO: 1036916 - RNA, 24 nt, Human
acacugaaaauacacuucugaaac

SEQ ID NO: 1036917 - RNA, 21 nt, Human
acagucagauauauuuugaac

SEQ ID NO: 1036918 - RNA, 19 nt, Human
acauucaaauccauacuag

SEQ ID NO: 1036919 - RNA, 18 nt, Human
agcgcccaggcccaaucu

SEQ ID NO: 1036920 - RNA, 23 nt, Human
auacacuucugaaacuaguauag

SEQ ID NO: 1036921 - RNA, 22 nt, Human
auucaaauccauacuagaucaa

SEQ ID NO: 1036922 - RNA, 24 nt, Human
caaguauacacaaaauaaaagccc

SEQ ID NO: 1036923 - RNA, 18 nt, Human
cagcagcuccagcgccca

SEQ ID NO: 1036924 - RNA, 25 nt, Human
cccgucgccgccgccgccugcucau

SEQ ID NO: 1036925 - RNA, 20 nt, Human
ccgcacccgucgccgccgcc

SEQ ID NO: 1036926 - RNA, 24 nt, Human
ccgccgcacccgucgccgccgccg

SEQ ID NO: 1036927 - RNA, 26 nt, Human
ccgccgcacccgucgccgccgccgcc

SEQ ID NO: 1036928 - RNA, 27 nt, Human
ccgccgcacccgucgccgccgccgccu

SEQ ID NO: 1036929 - RNA, 22 nt, Human
ccgccgccgccgccgccgccgc

SEQ ID NO: 1036930 - RNA, 22 nt, Human
ccgccgccgccgccgccgccgc

SEQ ID NO: 1036931 - RNA, 23 nt, Human
ccgccgccgccgccgccgccgcu

SEQ ID NO: 1036932 - RNA, 26 nt, Human
ccgccgccgccgccgccgccgcugcc

SEQ ID NO: 1036933 - RNA, 24 nt, Human
ccgccggcugucucggccuccccc

SEQ ID NO: 1036934 - RNA, 23 nt, Human
cucacuggacccacggagccagg

SEQ ID NO: 1036935 - RNA, 18 nt, Human
cuggacccacggagccag

SEQ ID NO: 1036936 - RNA, 22 nt, Human
gaguucugggcucuggcauggc

SEQ ID NO: 1036937 - RNA, 22 nt, Human
gccgccgccgccgccgccgccg

SEQ ID NO: 1036938 - RNA, 22 nt, Human
gcugccgccgccgccgccgccg

SEQ ID NO: 1036939 - RNA, 19 nt, Human
ggaccgaaaacugccggug

SEQ ID NO: 1036940 - RNA, 20 nt, Human
uaaaaaauugcugcagggau

SEQ ID NO: 1036941 - RNA, 23 nt, Human
uacaaacauuuuugcacagaucc

SEQ ID NO: 1036942 - RNA, 21 nt, Human
uaguauaguugaacuauuuuc

SEQ ID NO: 1036943 - RNA, 27 nt, Human
uauuccaacauaaaauaugcucauugu

SEQ ID NO: 1036944 - RNA, 22 nt, Human
ugccauuauaaagaaauaguuu

SEQ ID NO: 1036945 - RNA, 22 nt, Human
ugggagagcaugggcaggaggg

SEQ ID NO: 1036946 - RNA, 22 nt, Human
ugggcaggagggaaaacaacuu

SEQ ID NO: 1036947 - RNA, 25 nt, Human
uuaaacacugaaaauacacuucuga

SEQ ID NO: 1036948 - RNA, 23 nt, Human
uuuauaauacuuuaggaaguagu

SEQ ID NO: 1036949 - RNA, 20 nt, Human
aaaagaaaaaaaaaaugggg

SEQ ID NO: 1036950 - RNA, 22 nt, Human
aaacauaaagaagguacaguaa

SEQ ID NO: 1036951 - RNA, 25 nt, Human
aaaggguaauaaauaaaugggaaac

SEQ ID NO: 1036952 - RNA, 23 nt, Human
aacaaaaaguccaaagguaaagc

SEQ ID NO: 1036953 - RNA, 22 nt, Human
aacaugcaagauucuaacaaaa

SEQ ID NO: 1036954 - RNA, 21 nt, Human
aaccuguacagcauauuauug

SEQ ID NO: 1036955 - RNA, 24 nt, Human
aagaauaucucacauaacaaaaag

SEQ ID NO: 1036956 - RNA, 18 nt, Human
aagagaaaguaaguagaa

SEQ ID NO: 1036957 - RNA, 18 nt, Human
aagcaaauggaacaauau

SEQ ID NO: 1036958 - RNA, 25 nt, Human
aagcaaauggaacaauauaaagaau

SEQ ID NO: 1036959 - RNA, 21 nt, Human
aaguucucuauuguguucuau

SEQ ID NO: 1036960 - RNA, 18 nt, Human
acaaacaucgaacaaugu

SEQ ID NO: 1036961 - RNA, 20 nt, Human
acacuguugaagccuugcau

SEQ ID NO: 1036962 - RNA, 21 nt, Human
acacuguugaagccuugcauu

SEQ ID NO: 1036963 - RNA, 18 nt, Human
accaggacuuccaugcac

SEQ ID NO: 1036964 - RNA, 22 nt, Human
acccagcuuuuucacacacaca

SEQ ID NO: 1036965 - RNA, 21 nt, Human
accuuuaaguuucuccccacc

SEQ ID NO: 1036966 - RNA, 21 nt, Human
acucucccuuuguuucuacua

SEQ ID NO: 1036967 - RNA, 27 nt, Human
acugaccccaaaccacuaagaugauau

SEQ ID NO: 1036968 - RNA, 19 nt, Human
acuguacccuuccaugaaa

SEQ ID NO: 1036969 - RNA, 22 nt, Human
acuuguccuuucauggccauca

SEQ ID NO: 1036970 - RNA, 18 nt, Human
agaaaaaggcauauucaa

SEQ ID NO: 1036971 - RNA, 18 nt, Human
agaaaaaggcauauucaa

SEQ ID NO: 1036972 - RNA, 18 nt, Human
aggaaagaagggaauaaa

SEQ ID NO: 1036973 - RNA, 24 nt, Human
aggaaugaaaccuauuaaagaaaa

SEQ ID NO: 1036974 - RNA, 21 nt, Human
aggcuacaaaccuguacagca

SEQ ID NO: 1036975 - RNA, 19 nt, Human
auauacacacauacaaugu

SEQ ID NO: 1036976 - RNA, 23 nt, Human
auauauguauuuauauauacaca

SEQ ID NO: 1036977 - RNA, 24 nt, Human
caaaucccuaacuuguaucaauug

SEQ ID NO: 1036978 - RNA, 19 nt, Human
caauauacauauacccaaa

SEQ ID NO: 1036979 - RNA, 25 nt, Human
cacaaauacaugcaaaaaggguuuc

SEQ ID NO: 1036980 - RNA, 23 nt, Human
cacaauucaggugcuuucuaucu

SEQ ID NO: 1036981 - RNA, 22 nt, Human
caccuaagcuauggccuauugc

SEQ ID NO: 1036982 - RNA, 21 nt, Human
cagaaucuaaucaacacucac

SEQ ID NO: 1036983 - RNA, 19 nt, Human
cagaguguacuuacacaaa

SEQ ID NO: 1036984 - RNA, 19 nt, Human
cauucuaucccuguggcua

SEQ ID NO: 1036985 - RNA, 20 nt, Human
ccacugccauauaugagguc

SEQ ID NO: 1036986 - RNA, 25 nt, Human
ccccaaaccacuaagaugauauggu

SEQ ID NO: 1036987 - RNA, 19 nt, Human
cccugcugcagaguucccu

SEQ ID NO: 1036988 - RNA, 19 nt, Human
cccuucaucuccuuugauc

SEQ ID NO: 1036989 - RNA, 18 nt, Human
ccuaaaguacauuuuuaa

SEQ ID NO: 1036990 - RNA, 21 nt, Human
cucagcgacuucgccggcgcc

SEQ ID NO: 1036991 - RNA, 19 nt, Human
cuucggggcuaccaaaucc

SEQ ID NO: 1036992 - RNA, 21 nt, Human
cuuuguaauacuguacccuuc

SEQ ID NO: 1036993 - RNA, 19 nt, Human
gaaugucccuucaucuccu

SEQ ID NO: 1036994 - RNA, 22 nt, Human
gagaagcagaagagggaugcug

SEQ ID NO: 1036995 - RNA, 22 nt, Human
gauccuuuaccaggacuuccau

SEQ ID NO: 1036996 - RNA, 19 nt, Human
gcagaguucccugucacac

SEQ ID NO: 1036997 - RNA, 22 nt, Human
gcagaguucccugucacacaaa

SEQ ID NO: 1036998 - RNA, 19 nt, Human
gccuugcauuucaguaugu

SEQ ID NO: 1036999 - RNA, 20 nt, Human
ggagcucuaaccaaagccaa

SEQ ID NO: 1037000 - RNA, 23 nt, Human
ggccgaacgaaagucugacggga

SEQ ID NO: 1037001 - RNA, 23 nt, Human
gucacccccugcugcagaguucc

SEQ ID NO: 1037002 - RNA, 28 nt, Human
guuuuaggccaaaaaaaaagaaaaaaaa

SEQ ID NO: 1037003 - RNA, 24 nt, Human
uaaagcaguuccuggauugguuaa

SEQ ID NO: 1037004 - RNA, 27 nt, Human
uaaauacauaucacucuaaccaaauaa

SEQ ID NO: 1037005 - RNA, 19 nt, Human
uaacaggaauaaauacaaa

SEQ ID NO: 1037006 - RNA, 23 nt, Human
uacacaaaccuagaugguaugau

SEQ ID NO: 1037007 - RNA, 21 nt, Human
uacacacauacaauguauaua

SEQ ID NO: 1037008 - RNA, 20 nt, Human
uaccuaauauucuuuggccc

SEQ ID NO: 1037009 - RNA, 23 nt, Human
uagagucacugaauucacauuua

SEQ ID NO: 1037010 - RNA, 22 nt, Human
uagcuucaaacauccauaucac

SEQ ID NO: 1037011 - RNA, 23 nt, Human
uauauacacacauacaauguaua

SEQ ID NO: 1037012 - RNA, 25 nt, Human
uauauacacacauacaauguauaua

SEQ ID NO: 1037013 - RNA, 19 nt, Human
uauauguauuuauauauac

SEQ ID NO: 1037014 - RNA, 20 nt, Human
uaugaaauccuuauacaggu

SEQ ID NO: 1037015 - RNA, 21 nt, Human
uauuuuguguuuuuaauauaa

SEQ ID NO: 1037016 - RNA, 20 nt, Human
ucacugagaagcagaagagg

SEQ ID NO: 1037017 - RNA, 21 nt, Human
ucagcuggaagaggaaagaag

SEQ ID NO: 1037018 - RNA, 19 nt, Human
uccaacucugcucagcugg

SEQ ID NO: 1037019 - RNA, 18 nt, Human
ucccaaaggcugguacuu

SEQ ID NO: 1037020 - RNA, 19 nt, Human
uccccaaaacaugugagaa

SEQ ID NO: 1037021 - RNA, 18 nt, Human
uccccaccuacucccgca

SEQ ID NO: 1037022 - RNA, 18 nt, Human
ucuacaucccacuauucu

SEQ ID NO: 1037023 - RNA, 23 nt, Human
ucuauagcacaaggcagccauac

SEQ ID NO: 1037024 - RNA, 24 nt, Human
ucucaugcuaauucaacaaacccu

SEQ ID NO: 1037025 - RNA, 25 nt, Human
ugaaaggaaaaugguaugcuucuaa

SEQ ID NO: 1037026 - RNA, 22 nt, Human
ugaaggaaugaaaccuauuaaa

SEQ ID NO: 1037027 - RNA, 25 nt, Human
ugagaagcagaagagggaugcuggc

SEQ ID NO: 1037028 - RNA, 22 nt, Human
uggcaaaucccuaacuuguauc

SEQ ID NO: 1037029 - RNA, 19 nt, Human
uggcuaagagaccgaggua

SEQ ID NO: 1037030 - RNA, 21 nt, Human
uggcucccguuugagcugguc

SEQ ID NO: 1037031 - RNA, 19 nt, Human
ugucacacaaauacaugca

SEQ ID NO: 1037032 - RNA, 21 nt, Human
ugucagaaugacuaauucaau

SEQ ID NO: 1037033 - RNA, 24 nt, Human
uguuuggugugucagucacccccu

SEQ ID NO: 1037034 - RNA, 22 nt, Human
uuacaugaauaauuuaucucuu

SEQ ID NO: 1037035 - RNA, 21 nt, Human
uuagcuucaaacauccauauc

SEQ ID NO: 1037036 - RNA, 28 nt, Human
uuauauauacacacauacaauguauaua

SEQ ID NO: 1037037 - RNA, 20 nt, Human
uucaaagccuucagacuucc

SEQ ID NO: 1037038 - RNA, 20 nt, Human
uucaaagccuucagacuucc

SEQ ID NO: 1037039 - RNA, 21 nt, Human
uucauggccaucagaaggcug

SEQ ID NO: 1037040 - RNA, 21 nt, Human
uugcuccuaggcuacaaaccu

SEQ ID NO: 1037041 - RNA, 18 nt, Human
uuugaaguucucuauugu

SEQ ID NO: 1037042 - RNA, 25 nt, Human
uuugaauaaccuaacucucccuuug

SEQ ID NO: 1037043 - RNA, 18 nt, Human
accuaacaauaaaaaucu

SEQ ID NO: 1037044 - RNA, 22 nt, Human
auccucccagcugaucacaguu

SEQ ID NO: 1037045 - RNA, 19 nt, Human
caauccucccagcugauca

SEQ ID NO: 1037046 - RNA, 22 nt, Human
ccagcugaucacaguucuucuc

SEQ ID NO: 1037047 - RNA, 21 nt, Human
ccucccagcugaucacaguuc

SEQ ID NO: 1037048 - RNA, 18 nt, Human
ugcagcaauccucccagc

SEQ ID NO: 1037049 - RNA, 18 nt, Human
ggaggccuucccacggcc

SEQ ID NO: 1037050 - RNA, 20 nt, Human
ucccacggcacuccuugaag

SEQ ID NO: 1037051 - RNA, 19 nt, Human
ugggaggccuucccacggc

SEQ ID NO: 1037052 - RNA, 21 nt, Human
aaauggccaacagagccauga

SEQ ID NO: 1037053 - RNA, 23 nt, Human
aagauaagggacauuuguuacac

SEQ ID NO: 1037054 - RNA, 19 nt, Human
aaggagcuggcaaaauugg

SEQ ID NO: 1037055 - RNA, 21 nt, Human
aaugucgaagaucaaggagcu

SEQ ID NO: 1037056 - RNA, 21 nt, Human
aggauuggguggcuuaaacaa

SEQ ID NO: 1037057 - RNA, 22 nt, Human
caccagggcugguuucagagac

SEQ ID NO: 1037058 - RNA, 21 nt, Human
caggagacagagcuaacagag

SEQ ID NO: 1037059 - RNA, 22 nt, Human
ccucagggggcugcuucucccu

SEQ ID NO: 1037060 - RNA, 19 nt, Human
gcugcuucucccuccagga

SEQ ID NO: 1037061 - RNA, 19 nt, Human
uaagaagacaacaggauug

SEQ ID NO: 1037062 - RNA, 20 nt, Human
ucaaaaauggccaacagagc

SEQ ID NO: 1037063 - RNA, 20 nt, Human
ucagagaccaugcucaaaaa

SEQ ID NO: 1037064 - RNA, 20 nt, Human
ugucgaagaucaaggagcug

SEQ ID NO: 1037065 - RNA, 22 nt, Human
acugccucagcucagcacagcu

SEQ ID NO: 1037066 - RNA, 24 nt, Human
acugccucagcucagcacagcugc

SEQ ID NO: 1037067 - RNA, 20 nt, Human
aggaaaugggcucacaugug

SEQ ID NO: 1037068 - RNA, 21 nt, Human
aggagcugugcucuaggggau

SEQ ID NO: 1037069 - RNA, 22 nt, Human
augggcucacaugugucuggag

SEQ ID NO: 1037070 - RNA, 24 nt, Human
cacugccucagcucagcacagcug

SEQ ID NO: 1037071 - RNA, 19 nt, Human
cagcucagcacagcugccu

SEQ ID NO: 1037072 - RNA, 24 nt, Human
cagcugccucccacaucaggauuu

SEQ ID NO: 1037073 - RNA, 18 nt, Human
cuaacaaaguggcuucuc

SEQ ID NO: 1037074 - RNA, 21 nt, Human
cuuugcuaacaaaguggcuuc

SEQ ID NO: 1037075 - RNA, 18 nt, Human
ggaugucgaugcaaaaug

SEQ ID NO: 1037076 - RNA, 19 nt, Human
uauuccacauucuuggcua

SEQ ID NO: 1037077 - RNA, 20 nt, Human
ucaguuaagcaaagagcagg

SEQ ID NO: 1037078 - RNA, 19 nt, Human
ugccucagcucagcacagc

SEQ ID NO: 1037079 - RNA, 21 nt, Human
ugucuggagcagggcauggcu

SEQ ID NO: 1037080 - RNA, 22 nt, Human
uuaagcaaagagcaggaaaugg

SEQ ID NO: 1037081 - RNA, 20 nt, Human
aaagaggcuucagcaucucu

SEQ ID NO: 1037082 - RNA, 25 nt, Human
aagcccaggccggggucagagggga

SEQ ID NO: 1037083 - RNA, 22 nt, Human
aggccuggccugugggccagga

SEQ ID NO: 1037084 - RNA, 21 nt, Human
cacggggcaggcucggugcug

SEQ ID NO: 1037085 - RNA, 18 nt, Human
cccgggcggucgcaggcg

SEQ ID NO: 1037086 - RNA, 22 nt, Human
cucacggggcaggcucggugcu

SEQ ID NO: 1037087 - RNA, 23 nt, Human
cucccuggaggagguggggcuca

SEQ ID NO: 1037088 - RNA, 18 nt, Human
cugcuugcgggaggaagc

SEQ ID NO: 1037089 - RNA, 20 nt, Human
gcggacccgggcugcuugcg

SEQ ID NO: 1037090 - RNA, 21 nt, Human
gcggucgcaggcggcuccugg

SEQ ID NO: 1037091 - RNA, 20 nt, Human
ggaaggggcuuccuggaggg

SEQ ID NO: 1037092 - RNA, 23 nt, Human
ggaggaagcggcugaagcccagg

SEQ ID NO: 1037093 - RNA, 19 nt, Human
ggagggcucccuggaggag

SEQ ID NO: 1037094 - RNA, 22 nt, Human
ggagguggggcucagggggggc

SEQ ID NO: 1037095 - RNA, 18 nt, Human
ggccggggucagagggga

SEQ ID NO: 1037096 - RNA, 19 nt, Human
gggucgccgagagaaaaag

SEQ ID NO: 1037097 - RNA, 22 nt, Human
gugggggccacugcugcuuucc

SEQ ID NO: 1037098 - RNA, 21 nt, Human
ucagagagcaggcgggcgguu

SEQ ID NO: 1037099 - RNA, 25 nt, Human
ucgccgagagaaaaagaggcccccc

SEQ ID NO: 1037100 - RNA, 20 nt, Human
uggaggagguggggcucagg

SEQ ID NO: 1037101 - RNA, 26 nt, Human
uggaggagguggggcucagggggggg

SEQ ID NO: 1037102 - RNA, 24 nt, Human
ugggccaggagucagggaaggggc

SEQ ID NO: 1037103 - RNA, 21 nt, Human
ugugggggccacugcugcuuu

SEQ ID NO: 1037104 - RNA, 19 nt, Human
uuccagccgcagacugcag

SEQ ID NO: 1037105 - RNA, 19 nt, Human
uuuuuuaggccuggccugu

SEQ ID NO: 1037106 - RNA, 18 nt, Human
uuuuuuuuuuuuuuuuug

SEQ ID NO: 1037107 - RNA, 19 nt, Human
acacaaggcuggcuuucca

SEQ ID NO: 1037108 - RNA, 20 nt, Human
cagguugaacagaaauauaa

SEQ ID NO: 1037109 - RNA, 18 nt, Human
gaggaacgugacugcugc

SEQ ID NO: 1037110 - RNA, 20 nt, Human
gaggaacgugacugcugcug

SEQ ID NO: 1037111 - RNA, 22 nt, Human
uacacaaguccagacgcugcca

SEQ ID NO: 1037112 - RNA, 18 nt, Human
ucucugagcacuuuggcu

SEQ ID NO: 1037113 - RNA, 19 nt, Human
ugaacagaaauauaaaagu

SEQ ID NO: 1037114 - RNA, 18 nt, Human
ugagcacuuuggcucauu

SEQ ID NO: 1037115 - RNA, 25 nt, Human
ugccagggccuguugggaucagcuc

SEQ ID NO: 1037116 - RNA, 18 nt, Human
acaagaagagguccuucu

SEQ ID NO: 1037117 - RNA, 20 nt, Human
ccaguuagaauaaauaauca

SEQ ID NO: 1037118 - RNA, 21 nt, Human
cccaaaauuccaugccugcuc

SEQ ID NO: 1037119 - RNA, 19 nt, Human
cuggugacacccaaaauuc

SEQ ID NO: 1037120 - RNA, 25 nt, Human
uaguaagacccuaguccuaaagcuc

SEQ ID NO: 1037121 - RNA, 23 nt, Human
ucagauguaguguaaucucuucu

SEQ ID NO: 1037122 - RNA, 25 nt, Human
uuagaauaaauaaucaggaguucac

SEQ ID NO: 1037123 - RNA, 21 nt, Human
uuucuauucagaugcugaggg

SEQ ID NO: 1037124 - RNA, 19 nt, Human
uuuggauuuuucacuccuc

SEQ ID NO: 1037125 - RNA, 25 nt, Human
uuuuuugucagucauaacuuuuaau

SEQ ID NO: 1037126 - RNA, 20 nt, Human
uuuuuuuuuuuuuuugucag

SEQ ID NO: 1037127 - RNA, 20 nt, Human
uuuuuuuuuuuuuuugucag

SEQ ID NO: 1037128 - RNA, 24 nt, Human
agaagggggagggaggacuuagag

SEQ ID NO: 1037129 - RNA, 19 nt, Human
ccaagcucccugguguuaa

SEQ ID NO: 1037130 - RNA, 24 nt, Human
ccggaugguggucugacccuuccc

SEQ ID NO: 1037131 - RNA, 20 nt, Human
ggacuuagaguacccggaug

SEQ ID NO: 1037132 - RNA, 21 nt, Human
ggggagggaggacuuagagua

SEQ ID NO: 1037133 - RNA, 22 nt, Human
ggugaaggagaagggggaggga

SEQ ID NO: 1037134 - RNA, 18 nt, Human
gugaaggagaagggggag

SEQ ID NO: 1037135 - RNA, 19 nt, Human
uagcaggcugagaugaagc

SEQ ID NO: 1037136 - RNA, 21 nt, Human
uagcaggcugagaugaagcuc

SEQ ID NO: 1037137 - RNA, 24 nt, Human
ucccucacagacagagauuuuggc

SEQ ID NO: 1037138 - RNA, 26 nt, Human
uuuuccaagcucccugguguuaaaca

SEQ ID NO: 1037139 - RNA, 19 nt, Human
aaaagguaaagaaagucaa

SEQ ID NO: 1037140 - RNA, 20 nt, Human
aaagguaaagaaagucaaaa

SEQ ID NO: 1037141 - RNA, 20 nt, Human
aacuagccuggagcuggccc

SEQ ID NO: 1037142 - RNA, 21 nt, Human
aagaaaaagugguuuggcuag

SEQ ID NO: 1037143 - RNA, 19 nt, Human
aagcaguuaggacauaaac

SEQ ID NO: 1037144 - RNA, 20 nt, Human
acaaagaagucagaagccaa

SEQ ID NO: 1037145 - RNA, 19 nt, Human
acagguaacuagccuggag

SEQ ID NO: 1037146 - RNA, 27 nt, Human
accccccuuccccaggacuuuugucuu

SEQ ID NO: 1037147 - RNA, 25 nt, Human
acccgcucuucuucucccaaggccu

SEQ ID NO: 1037148 - RNA, 19 nt, Human
acuucaaaagguaaagaaa

SEQ ID NO: 1037149 - RNA, 27 nt, Human
acuuuugucuucccaucaagcuggagg

SEQ ID NO: 1037150 - RNA, 23 nt, Human
aggaaugaagcugugaaccuguu

SEQ ID NO: 1037151 - RNA, 23 nt, Human
caaaaggaacaaaacaucauuuu

SEQ ID NO: 1037152 - RNA, 26 nt, Human
cacccgcucuucuucucccaaggccu

SEQ ID NO: 1037153 - RNA, 25 nt, Human
cacuuucuacuucaaaagguaaaga

SEQ ID NO: 1037154 - RNA, 20 nt, Human
cauaaaccccccuuccccag

SEQ ID NO: 1037155 - RNA, 24 nt, Human
cauaaaccccccuuccccaggacu

SEQ ID NO: 1037156 - RNA, 24 nt, Human
caucaagcuggaggaugagcuggg

SEQ ID NO: 1037157 - RNA, 24 nt, Human
ccccccuuccccaggacuuuuguc

SEQ ID NO: 1037158 - RNA, 19 nt, Human
ccuggagcuggcccugggg

SEQ ID NO: 1037159 - RNA, 23 nt, Human
cuagcagccauuuuaacaaggcu

SEQ ID NO: 1037160 - RNA, 22 nt, Human
gagcuggcccuggggccugagc

SEQ ID NO: 1037161 - RNA, 22 nt, Human
ggacauaaaccccccuucccca

SEQ ID NO: 1037162 - RNA, 21 nt, Human
gguaaagaaagucaaaaggaa

SEQ ID NO: 1037163 - RNA, 18 nt, Human
uagauaaaagggcacccg

SEQ ID NO: 1037164 - RNA, 24 nt, Human
uaggacauaaaccccccuucccca

SEQ ID NO: 1037165 - RNA, 26 nt, Human
uaucacuuguaggaguaaaaaaagag

SEQ ID NO: 1037166 - RNA, 21 nt, Human
ucacuuguaggaguaaaaaaa

SEQ ID NO: 1037167 - RNA, 23 nt, Human
uccccaggacuuuugucuuccca

SEQ ID NO: 1037168 - RNA, 20 nt, Human
uguaggaguaaaaaaagagu

SEQ ID NO: 1037169 - RNA, 19 nt, Human
uugagcagagccuuccaug

SEQ ID NO: 1037170 - RNA, 18 nt, Human
aaacugggaaaacugcug

SEQ ID NO: 1037171 - RNA, 24 nt, Human
aaagugcugggauuacaggcguga

SEQ ID NO: 1037172 - RNA, 21 nt, Human
aagcgauucuccugccucagc

SEQ ID NO: 1037173 - RNA, 19 nt, Human
aagugcugggauuacaggc

SEQ ID NO: 1037174 - RNA, 19 nt, Human
aagugcugggauuacaggc

SEQ ID NO: 1037175 - RNA, 26 nt, Human
aagugcugggauuacaggcgugagcc

SEQ ID NO: 1037176 - RNA, 18 nt, Human
acaggguuucaccauguu

SEQ ID NO: 1037177 - RNA, 19 nt, Human
acaggguuucaccauguug

SEQ ID NO: 1037178 - RNA, 24 nt, Human
acaggguuucaccauguugaccag

SEQ ID NO: 1037179 - RNA, 22 nt, Human
acccagcuaggagguaaaaauu

SEQ ID NO: 1037180 - RNA, 22 nt, Human
accucccgaguuuaagcgauuc

SEQ ID NO: 1037181 - RNA, 18 nt, Human
agaaaagaaauccagaga

SEQ ID NO: 1037182 - RNA, 18 nt, Human
agaaaagaaauccagaga

SEQ ID NO: 1037183 - RNA, 23 nt, Human
agacagggugaggaagggaggca

SEQ ID NO: 1037184 - RNA, 21 nt, Human
agagacagggugaggaaggga

SEQ ID NO: 1037185 - RNA, 24 nt, Human
agcgauucuccugccucagccucc

SEQ ID NO: 1037186 - RNA, 24 nt, Human
agcugggauuacaagcgcacccca

SEQ ID NO: 1037187 - RNA, 25 nt, Human
aggagguaaauuuuuuuuuuuuuuu

SEQ ID NO: 1037188 - RNA, 19 nt, Human
aguagcugggauuacaagc

SEQ ID NO: 1037189 - RNA, 20 nt, Human
agugcaauggugugaccuug

SEQ ID NO: 1037190 - RNA, 24 nt, Human
agugcaauggugugaccuuggcuc

SEQ ID NO: 1037191 - RNA, 18 nt, Human
agugcugggauuacaggc

SEQ ID NO: 1037192 - RNA, 24 nt, Human
aucuugugaucugcccgccucagc

SEQ ID NO: 1037193 - RNA, 24 nt, Human
caaagugcugggauuacaggcgug

SEQ ID NO: 1037194 - RNA, 20 nt, Human
caaccucuaccucccgaguu

SEQ ID NO: 1037195 - RNA, 24 nt, Human
caaccucuaccucccgaguuuaag

SEQ ID NO: 1037196 - RNA, 21 nt, Human
caagcgcaccccaccacgccc

SEQ ID NO: 1037197 - RNA, 18 nt, Human
caccauguugaccaggcu

SEQ ID NO: 1037198 - RNA, 19 nt, Human
caccauguugaccaggcug

SEQ ID NO: 1037199 - RNA, 22 nt, Human
caccauguugaccaggcugggu

SEQ ID NO: 1037200 - RNA, 26 nt, Human
caccauguugaccaggcuggguuggc

SEQ ID NO: 1037201 - RNA, 25 nt, Human
caccccaccacgcccggcuaauugu

SEQ ID NO: 1037202 - RNA, 21 nt, Human
cacugcaaccucuaccucccg

SEQ ID NO: 1037203 - RNA, 20 nt, Human
cagccuccugaguagcuggg

SEQ ID NO: 1037204 - RNA, 24 nt, Human
caggguuucaccauguugaccagg

SEQ ID NO: 1037205 - RNA, 19 nt, Human
ccaaaacugggaaaacugc

SEQ ID NO: 1037206 - RNA, 20 nt, Human
ccaaagugcugggauuacag

SEQ ID NO: 1037207 - RNA, 22 nt, Human
ccaaagugcugggauuacaggc

SEQ ID NO: 1037208 - RNA, 22 nt, Human
ccaaagugcugggauuacaggc

SEQ ID NO: 1037209 - RNA, 24 nt, Human
ccaaagugcugggauuacaggcgu

SEQ ID NO: 1037210 - RNA, 20 nt, Human
ccauguugaccaggcugggu

SEQ ID NO: 1037211 - RNA, 23 nt, Human
cccgaguuuaagcgauucuccug

SEQ ID NO: 1037212 - RNA, 18 nt, Human
cccugucgcccagguugg

SEQ ID NO: 1037213 - RNA, 19 nt, Human
ccgcacccagcuaggaggu

SEQ ID NO: 1037214 - RNA, 24 nt, Human
ccgccucagccucccaaagugcug

SEQ ID NO: 1037215 - RNA, 24 nt, Human
ccucccgaguuuaagcgauucucc

SEQ ID NO: 1037216 - RNA, 19 nt, Human
ccugaguagcugggauuac

SEQ ID NO: 1037217 - RNA, 23 nt, Human
ccugccucagccuccugaguagc

SEQ ID NO: 1037218 - RNA, 24 nt, Human
ccugccucagccuccugaguagcu

SEQ ID NO: 1037219 - RNA, 24 nt, Human
ccugucgcccagguuggagugcaa

SEQ ID NO: 1037220 - RNA, 24 nt, Human
cgcccugucgcccagguuggagug

SEQ ID NO: 1037221 - RNA, 24 nt, Human
cucacugcaaccucuaccucccga

SEQ ID NO: 1037222 - RNA, 23 nt, Human
cucagccuccugaguagcuggga

SEQ ID NO: 1037223 - RNA, 20 nt, Human
cugcaaccucuaccucccga

SEQ ID NO: 1037224 - RNA, 24 nt, Human
cugcaaccucuaccucccgaguuu

SEQ ID NO: 1037225 - RNA, 31 nt, Human
cuggguuggccaggcuggucucgaacuccuu

SEQ ID NO: 1037226 - RNA, 21 nt, Human
cuugugaucugcccgccucag

SEQ ID NO: 1037227 - RNA, 28 nt, Human
gaccaggcuggguuggccaggcuggucu

SEQ ID NO: 1037228 - RNA, 19 nt, Human
gaccuuggcucacugcaac

SEQ ID NO: 1037229 - RNA, 24 nt, Human
gaguagcugggauuacaagcgcac

SEQ ID NO: 1037230 - RNA, 24 nt, Human
gaucuugugaucugcccgccucag

SEQ ID NO: 1037231 - RNA, 18 nt, Human
gauuacaggcgugagcca

SEQ ID NO: 1037232 - RNA, 22 nt, Human
gauuacaggcgugagccaccgc

SEQ ID NO: 1037233 - RNA, 23 nt, Human
gauuacaggcgugagccaccgca

SEQ ID NO: 1037234 - RNA, 21 nt, Human
gcaaccucuaccucccgaguu

SEQ ID NO: 1037235 - RNA, 23 nt, Human
gccucagccucccaaagugcugg

SEQ ID NO: 1037236 - RNA, 23 nt, Human
gcgauucuccugccucagccucc

SEQ ID NO: 1037237 - RNA, 21 nt, Human
gcucacugcaaccucuaccuc

SEQ ID NO: 1037238 - RNA, 22 nt, Human
gcucuuuuucucugaagacaga

SEQ ID NO: 1037239 - RNA, 23 nt, Human
ggcuggucucgaacuccugaucu

SEQ ID NO: 1037240 - RNA, 24 nt, Human
ggugauagaaaagaaauccagaga

SEQ ID NO: 1037241 - RNA, 18 nt, Human
guagcugggauuacaagc

SEQ ID NO: 1037242 - RNA, 24 nt, Human
gugaucugcccgccucagccuccc

SEQ ID NO: 1037243 - RNA, 19 nt, Human
guuggccaggcuggucucg

SEQ ID NO: 1037244 - RNA, 18 nt, Human
uaagcgauucuccugccu

SEQ ID NO: 1037245 - RNA, 22 nt, Human
uaauuguuuguaucuuuaguag

SEQ ID NO: 1037246 - RNA, 24 nt, Human
uacaggcgugagccaccgcaccca

SEQ ID NO: 1037247 - RNA, 22 nt, Human
uagggacaggguuucaccaugu

SEQ ID NO: 1037248 - RNA, 24 nt, Human
uaguagggacaggguuucaccaug

SEQ ID NO: 1037249 - RNA, 21 nt, Human
ucacguucacagaacagcuau

SEQ ID NO: 1037250 - RNA, 18 nt, Human
ucacugcaaccucuaccu

SEQ ID NO: 1037251 - RNA, 22 nt, Human
ucacugcaaccucuaccucccg

SEQ ID NO: 1037252 - RNA, 24 nt, Human
ucacugcaaccucuaccucccgag

SEQ ID NO: 1037253 - RNA, 20 nt, Human
ucagccuccugaguagcugg

SEQ ID NO: 1037254 - RNA, 24 nt, Human
ucccaaagugcugggauuacaggc

SEQ ID NO: 1037255 - RNA, 26 nt, Human
ucccagcucuuuuucucuggggccgc

SEQ ID NO: 1037256 - RNA, 21 nt, Human
ucccgaguuuaagcgauucuc

SEQ ID NO: 1037257 - RNA, 24 nt, Human
ucccgaguuuaagcgauucuccug

SEQ ID NO: 1037258 - RNA, 18 nt, Human
uccugaguagcugggauu

SEQ ID NO: 1037259 - RNA, 18 nt, Human
ucgcccagguuggagugc

SEQ ID NO: 1037260 - RNA, 24 nt, Human
ucuccugccucagccuccugagua

SEQ ID NO: 1037261 - RNA, 19 nt, Human
ucucgaacuccugaucuug

SEQ ID NO: 1037262 - RNA, 23 nt, Human
ucucgcccugucgcccagguugg

SEQ ID NO: 1037263 - RNA, 24 nt, Human
ucucgcccugucgcccagguugga

SEQ ID NO: 1037264 - RNA, 21 nt, Human
ucugcccgccucagccuccca

SEQ ID NO: 1037265 - RNA, 18 nt, Human
ucuuggugucccagcucu

SEQ ID NO: 1037266 - RNA, 24 nt, Human
ucuuuaguagggacaggguuucac

SEQ ID NO: 1037267 - RNA, 22 nt, Human
ugagacggagucucgcccuguc

SEQ ID NO: 1037268 - RNA, 20 nt, Human
ugcaauggugugaccuuggc

SEQ ID NO: 1037269 - RNA, 24 nt, Human
ugccucagccuccugaguagcugg

SEQ ID NO: 1037270 - RNA, 19 nt, Human
ugccuggccaaaacuggga

SEQ ID NO: 1037271 - RNA, 21 nt, Human
ugccuggccaaaacugggaaa

SEQ ID NO: 1037272 - RNA, 24 nt, Human
ugcugggauuacaggcgugagcca

SEQ ID NO: 1037273 - RNA, 22 nt, Human
uggaaccagagaugagaguacu

SEQ ID NO: 1037274 - RNA, 19 nt, Human
uggaauggaaccagagaug

SEQ ID NO: 1037275 - RNA, 23 nt, Human
uggagugcaauggugugaccuug

SEQ ID NO: 1037276 - RNA, 24 nt, Human
uggagugcaauggugugaccuugg

SEQ ID NO: 1037277 - RNA, 19 nt, Human
ugggauuacaagcgcaccc

SEQ ID NO: 1037278 - RNA, 24 nt, Human
ugggauuacaagcgcaccccacca

SEQ ID NO: 1037279 - RNA, 18 nt, Human
ugggauuacaggcgugag

SEQ ID NO: 1037280 - RNA, 19 nt, Human
ugggauuacaggcgugagc

SEQ ID NO: 1037281 - RNA, 21 nt, Human
ugggauuacaggcgugagcca

SEQ ID NO: 1037282 - RNA, 22 nt, Human
ugggauuacaggcgugagccac

SEQ ID NO: 1037283 - RNA, 23 nt, Human
ugggauuacaggcgugagccacc

SEQ ID NO: 1037284 - RNA, 24 nt, Human
ugggauuacaggcgugagccaccg

SEQ ID NO: 1037285 - RNA, 21 nt, Human
ugucccagcucuuuuucucug

SEQ ID NO: 1037286 - RNA, 23 nt, Human
uuaaagcaagacuuagcugaacu

SEQ ID NO: 1037287 - RNA, 24 nt, Human
uuaguagggacaggguuucaccau

SEQ ID NO: 1037288 - RNA, 21 nt, Human
uucacagaacagcuauuucuc

SEQ ID NO: 1037289 - RNA, 24 nt, Human
uuguuuguaucuuuaguagggaca

SEQ ID NO: 1037290 - RNA, 23 nt, Human
uuuaagcgauucuccugccucag

SEQ ID NO: 1037291 - RNA, 24 nt, Human
uuuaagcgauucuccugccucagc

SEQ ID NO: 1037292 - RNA, 21 nt, Human
uuucaccauguugaccaggcu

SEQ ID NO: 1037293 - RNA, 25 nt, Human
uuuuuuuuuuuugagacggagucuc

SEQ ID NO: 1037294 - RNA, 22 nt, Human
uuuuuuuuuuuuuugagacgga

SEQ ID NO: 1037295 - RNA, 18 nt, Human
acaucaucaucugcugcu

SEQ ID NO: 1037296 - RNA, 20 nt, Human
accauauucccaagcacaca

SEQ ID NO: 1037297 - RNA, 18 nt, Human
agacauuuuacaucauca

SEQ ID NO: 1037298 - RNA, 21 nt, Human
aguuuuguugcuuguucccau

SEQ ID NO: 1037299 - RNA, 24 nt, Human
cagcagugccaucacucuuucuga

SEQ ID NO: 1037300 - RNA, 18 nt, Human
cagcuuuggaagccccag

SEQ ID NO: 1037301 - RNA, 24 nt, Human
cauuuugcauguguaucuucccaa

SEQ ID NO: 1037302 - RNA, 21 nt, Human
cccagcuuuggaagccccagc

SEQ ID NO: 1037303 - RNA, 19 nt, Human
ccucagcagugccaucacu

SEQ ID NO: 1037304 - RNA, 22 nt, Human
cuucccaagccucaguguuucc

SEQ ID NO: 1037305 - RNA, 24 nt, Human
gccaucacucuuucugaagugcug

SEQ ID NO: 1037306 - RNA, 18 nt, Human
uaaaaaauaggauuccca

SEQ ID NO: 1037307 - RNA, 21 nt, Human
uaauaaaaaauaggauuccca

SEQ ID NO: 1037308 - RNA, 20 nt, Human
uacaucaucaucugcugcuu

SEQ ID NO: 1037309 - RNA, 20 nt, Human
uaccugaugccuuguaagac

SEQ ID NO: 1037310 - RNA, 18 nt, Human
uaggauucccagcuuugg

SEQ ID NO: 1037311 - RNA, 23 nt, Human
ucagcagugccaucacucuuucu

SEQ ID NO: 1037312 - RNA, 27 nt, Human
ucuccuugccaucguuacuucaaccaa

SEQ ID NO: 1037313 - RNA, 26 nt, Human
ucucuccuugccaucguuacuucaac

SEQ ID NO: 1037314 - RNA, 23 nt, Human
ugcagugggaugcucagugcgcc

SEQ ID NO: 1037315 - RNA, 21 nt, Human
ugccaucacucuuucugaagu

SEQ ID NO: 1037316 - RNA, 23 nt, Human
uggccaucuuccacuugggcuuu

SEQ ID NO: 1037317 - RNA, 19 nt, Human
uguguaucuucccaagccu

SEQ ID NO: 1037318 - RNA, 18 nt, Human
uguuucaaugcuagcuug

SEQ ID NO: 1037319 - RNA, 26 nt, Human
uucccaagccucaguguuuccugcag

SEQ ID NO: 1037320 - RNA, 18 nt, Human
uugcauguguaucuuccc

SEQ ID NO: 1037321 - RNA, 24 nt, Human
uugcauguguaucuucccaagccu

SEQ ID NO: 1037322 - RNA, 22 nt, Human
uuuacaucaucaucugcugcuu

SEQ ID NO: 1037323 - RNA, 25 nt, Human
aaaauacacaccaccacgagugcaa

SEQ ID NO: 1037324 - RNA, 22 nt, Human
aaauacacaccaccacgagugc

SEQ ID NO: 1037325 - RNA, 23 nt, Human
aaauacacaccaccacgagugca

SEQ ID NO: 1037326 - RNA, 18 nt, Human
aaggucccaaaauacaca

SEQ ID NO: 1037327 - RNA, 22 nt, Human
accaccacgagugcaaaaaccg

SEQ ID NO: 1037328 - RNA, 28 nt, Human
accacgagugcaaaaaccgaggcugguc

SEQ ID NO: 1037329 - RNA, 20 nt, Human
agcugcacaguaaagguccc

SEQ ID NO: 1037330 - RNA, 20 nt, Human
cacaccaccacgagugcaaa

SEQ ID NO: 1037331 - RNA, 19 nt, Human
cacaguaaaggucccaaaa

SEQ ID NO: 1037332 - RNA, 20 nt, Human
caccaccacgagugcaaaaa

SEQ ID NO: 1037333 - RNA, 19 nt, Human
cacgagugcaaaaaccgag

SEQ ID NO: 1037334 - RNA, 27 nt, Human
ccaaaauacacaccaccacgagugcaa

SEQ ID NO: 1037335 - RNA, 22 nt, Human
ucucccaacgugauguuuuuuu

SEQ ID NO: 1037336 - RNA, 18 nt, Human
ugccaagcacggggcucc

SEQ ID NO: 1037337 - RNA, 18 nt, Human
ugccaagcacggggcucc

SEQ ID NO: 1037338 - RNA, 21 nt, Human
uugaauguucacaagugucuc

SEQ ID NO: 1037339 - RNA, 19 nt, Human
aagagccaauaaagagagg

SEQ ID NO: 1037340 - RNA, 23 nt, Human
agagccaauaaagagaggcggga

SEQ ID NO: 1037341 - RNA, 21 nt, Human
cacacacagcgcacacagggu

SEQ ID NO: 1037342 - RNA, 19 nt, Human
cacacaggguuuacagcag

SEQ ID NO: 1037343 - RNA, 23 nt, Human
cacacaggguuuacagcaggucc

SEQ ID NO: 1037344 - RNA, 18 nt, Human
cacagcgcacacaggguu

SEQ ID NO: 1037345 - RNA, 21 nt, Human
cacaggguuuacagcaggucc

SEQ ID NO: 1037346 - RNA, 24 nt, Human
ccccgccgccgccaucuucucccc

SEQ ID NO: 1037347 - RNA, 18 nt, Human
ccuacaaagcggacacug

SEQ ID NO: 1037348 - RNA, 20 nt, Human
cucccccgccgccgccaucu

SEQ ID NO: 1037349 - RNA, 23 nt, Human
cucccccgccgccgccaucuucu

SEQ ID NO: 1037350 - RNA, 24 nt, Human
cucuaaagagccaauaaagagagg

SEQ ID NO: 1037351 - RNA, 21 nt, Human
cugggcucacacacagcgcac

SEQ ID NO: 1037352 - RNA, 24 nt, Human
gacucggcgcuccuccggcugcuc

SEQ ID NO: 1037353 - RNA, 18 nt, Human
gcgggaagugagugugag

SEQ ID NO: 1037354 - RNA, 18 nt, Human
ggaagugagugugaggug

SEQ ID NO: 1037355 - RNA, 23 nt, Human
gugguguccuacaaagcggacac

SEQ ID NO: 1037356 - RNA, 22 nt, Human
ucacacacagcgcacacagggu

SEQ ID NO: 1037357 - RNA, 23 nt, Human
ucccccgccgccgccaucuucuc

SEQ ID NO: 1037358 - RNA, 22 nt, Human
uccuccggcugcucacgcugcc

SEQ ID NO: 1037359 - RNA, 20 nt, Human
ugaucaccuugacugucugg

SEQ ID NO: 1037360 - RNA, 23 nt, Human
agcaaguauacagaaaucuuccc

SEQ ID NO: 1037361 - RNA, 20 nt, Human
agcuggcuuugaaacuuccu

SEQ ID NO: 1037362 - RNA, 22 nt, Human
augaagcccgcgggaaacggcu

SEQ ID NO: 1037363 - RNA, 23 nt, Human
caacggccacaaccacgucaagc

SEQ ID NO: 1037364 - RNA, 19 nt, Human
caugcaccccaaacugauc

SEQ ID NO: 1037365 - RNA, 23 nt, Human
ccaacggccacaaccacgucaag

SEQ ID NO: 1037366 - RNA, 18 nt, Human
cccaacggccacaaccac

SEQ ID NO: 1037367 - RNA, 24 nt, Human
ccggcgccgccaucgggguccucg

SEQ ID NO: 1037368 - RNA, 19 nt, Human
ccuguuggacugguccgcg

SEQ ID NO: 1037369 - RNA, 18 nt, Human
cgcccgggaaaccggcag

SEQ ID NO: 1037370 - RNA, 28 nt, Human
cgcgggaaacggcuucccuucucccuua

SEQ ID NO: 1037371 - RNA, 21 nt, Human
cgcugcaaaaucauacaugca

SEQ ID NO: 1037372 - RNA, 18 nt, Human
cuauacacauuccuccuc

SEQ ID NO: 1037373 - RNA, 22 nt, Human
cuccuucccgccacccggcgcc

SEQ ID NO: 1037374 - RNA, 23 nt, Human
cugaccaccuggauccgggcucg

SEQ ID NO: 1037375 - RNA, 21 nt, Human
cugguccgcgacucgggcugu

SEQ ID NO: 1037376 - RNA, 25 nt, Human
gaaacuuccuccuucccgccacccg

SEQ ID NO: 1037377 - RNA, 19 nt, Human
gcgggaaacggcuucccuu

SEQ ID NO: 1037378 - RNA, 18 nt, Human
gggccggguucucgccgu

SEQ ID NO: 1037379 - RNA, 18 nt, Human
ucaucuaaaugaguaacu

SEQ ID NO: 1037380 - RNA, 25 nt, Human
ucggcgggggcgcaacgucuuuucc

SEQ ID NO: 1037381 - RNA, 19 nt, Human
ucuccagcaaguauacaga

SEQ ID NO: 1037382 - RNA, 22 nt, Human
ugcaaaaucauacaugcacccc

SEQ ID NO: 1037383 - RNA, 25 nt, Human
uugaaacuuccuccuucccgccacc

SEQ ID NO: 1037384 - RNA, 22 nt, Human
uugguuuuaauaaaaguuuugg

SEQ ID NO: 1037385 - RNA, 21 nt, Human
uuugaaacuuccuccuucccg

SEQ ID NO: 1037386 - RNA, 26 nt, Human
uuugaaacuuccuccuucccgccacc

SEQ ID NO: 1037387 - RNA, 20 nt, Human
aaaaaagaaaacaguaauua

SEQ ID NO: 1037388 - RNA, 24 nt, Human
aaaaaguuaaaacauacuaaauau

SEQ ID NO: 1037389 - RNA, 18 nt, Human
aauacaguacauauauau

SEQ ID NO: 1037390 - RNA, 18 nt, Human
aauggagagacaacugaa

SEQ ID NO: 1037391 - RNA, 23 nt, Human
agcuuuacacauccaaaauacag

SEQ ID NO: 1037392 - RNA, 22 nt, Human
agguaacuuuaaaaugacuuga

SEQ ID NO: 1037393 - RNA, 23 nt, Human
agguaagugucgaaaaggucagg

SEQ ID NO: 1037394 - RNA, 20 nt, Human
caaaauacaguacauauaua

SEQ ID NO: 1037395 - RNA, 18 nt, Human
ccgcgccacaaccccugc

SEQ ID NO: 1037396 - RNA, 22 nt, Human
ccucuauucgaauaaaggugag

SEQ ID NO: 1037397 - RNA, 21 nt, Human
cgcgccacaaccccugcccgc

SEQ ID NO: 1037398 - RNA, 21 nt, Human
cgcuggcccgccgcuugccgc

SEQ ID NO: 1037399 - RNA, 23 nt, Human
cuagguaagugucgaaaagguca

SEQ ID NO: 1037400 - RNA, 19 nt, Human
cucaaaaaguuaauaaaaa

SEQ ID NO: 1037401 - RNA, 22 nt, Human
gaagacauuuauuccucuauuc

SEQ ID NO: 1037402 - RNA, 19 nt, Human
gaugaugccuaagaauacu

SEQ ID NO: 1037403 - RNA, 22 nt, Human
gcuggcccgccgcuugccgcgc

SEQ ID NO: 1037404 - RNA, 21 nt, Human
guaugauaaauaaaccuccac

SEQ ID NO: 1037405 - RNA, 24 nt, Human
uaacuguacuuacuuucagaaaga

SEQ ID NO: 1037406 - RNA, 21 nt, Human
uaauguuucaaagccuguaug

SEQ ID NO: 1037407 - RNA, 24 nt, Human
uacaacucuguagaaugguggggg

SEQ ID NO: 1037408 - RNA, 22 nt, Human
uacacugacaaaaaagaaaaca

SEQ ID NO: 1037409 - RNA, 18 nt, Human
uacuagauuaccauccca

SEQ ID NO: 1037410 - RNA, 19 nt, Human
ucccauggcauauagucac

SEQ ID NO: 1037411 - RNA, 21 nt, Human
ucgaaaaggucaggaguucaa

SEQ ID NO: 1037412 - RNA, 19 nt, Human
ugaaaguguauauguagug

SEQ ID NO: 1037413 - RNA, 24 nt, Human
ugaaauacuacaaacuacuauaau

SEQ ID NO: 1037414 - RNA, 24 nt, Human
ugacaaaaaagaaaacaguaauua

SEQ ID NO: 1037415 - RNA, 22 nt, Human
ugacauacauacauguauuuau

SEQ ID NO: 1037416 - RNA, 19 nt, Human
ugauaaauaaaccuccacu

SEQ ID NO: 1037417 - RNA, 22 nt, Human
ugcaugguaauauuguggagaa

SEQ ID NO: 1037418 - RNA, 21 nt, Human
uggaagggcaugauugugaua

SEQ ID NO: 1037419 - RNA, 20 nt, Human
ugggaguguaaauguauagu

SEQ ID NO: 1037420 - RNA, 30 nt, Human
uguaguguuuugacauacauacauguagug

SEQ ID NO: 1037421 - RNA, 19 nt, Human
uguucugcaguuuguaagg

SEQ ID NO: 1037422 - RNA, 24 nt, Human
uugcaugguaauauuguggagaau

SEQ ID NO: 1037423 - RNA, 18 nt, Human
uuuguaaggaaauuuguu

SEQ ID NO: 1037424 - RNA, 21 nt, Human
uuuuaaauuucagagauaacu

SEQ ID NO: 1037425 - RNA, 23 nt, Human
aaaagauagucauggaagccaaa

SEQ ID NO: 1037426 - RNA, 23 nt, Human
aaacaaauaaagcaucaccaagg

SEQ ID NO: 1037427 - RNA, 18 nt, Human
aaacacaccacacuccaa

SEQ ID NO: 1037428 - RNA, 21 nt, Human
aaacacaccacacuccaauau

SEQ ID NO: 1037429 - RNA, 22 nt, Human
aaacugggcagauagaaaaaaa

SEQ ID NO: 1037430 - RNA, 24 nt, Human
aaagaacaugugcaaaaccaccaa

SEQ ID NO: 1037431 - RNA, 21 nt, Human
aacagguaacugucuuaaaaa

SEQ ID NO: 1037432 - RNA, 23 nt, Human
aacagguaacugucuuaaaaaug

SEQ ID NO: 1037433 - RNA, 18 nt, Human
aagaaacucuaagggcua

SEQ ID NO: 1037434 - RNA, 21 nt, Human
aagaucacaaaagaggacaug

SEQ ID NO: 1037435 - RNA, 21 nt, Human
aagcaaaacaauuuugugacc

SEQ ID NO: 1037436 - RNA, 21 nt, Human
aaguaauauguaaagaacuua

SEQ ID NO: 1037437 - RNA, 21 nt, Human
aaugugauguuacauguaacu

SEQ ID NO: 1037438 - RNA, 23 nt, Human
acaaauguuguaaaauacuaaau

SEQ ID NO: 1037439 - RNA, 21 nt, Human
acaggcaucacagcaugcacu

SEQ ID NO: 1037440 - RNA, 21 nt, Human
accaacguuuucuaagacauu

SEQ ID NO: 1037441 - RNA, 25 nt, Human
acucuauggaacuuuuuuuccuuuu

SEQ ID NO: 1037442 - RNA, 21 nt, Human
acugagcgggaugaaggaguc

SEQ ID NO: 1037443 - RNA, 22 nt, Human
acugguuuuguaaacuccacaa

SEQ ID NO: 1037444 - RNA, 20 nt, Human
acuuccauacauuccaauau

SEQ ID NO: 1037445 - RNA, 24 nt, Human
acuucugguuuucugcuuauugcu

SEQ ID NO: 1037446 - RNA, 18 nt, Human
agaaucauggccaaaggc

SEQ ID NO: 1037447 - RNA, 19 nt, Human
agacauaguaagcuuuaaa

SEQ ID NO: 1037448 - RNA, 20 nt, Human
agagaaucuucccucuuucc

SEQ ID NO: 1037449 - RNA, 22 nt, Human
agcaaaaccucaaagaucugau

SEQ ID NO: 1037450 - RNA, 24 nt, Human
agcacaggagggacagcacagaca

SEQ ID NO: 1037451 - RNA, 22 nt, Human
aggcacaugagaaaacagucau

SEQ ID NO: 1037452 - RNA, 23 nt, Human
agggugaagaagauauggcacaa

SEQ ID NO: 1037453 - RNA, 19 nt, Human
agguaucauucacucagug

SEQ ID NO: 1037454 - RNA, 21 nt, Human
auaaagcaucaccaagcacca

SEQ ID NO: 1037455 - RNA, 21 nt, Human
auuuuuuaaaagcucccccca

SEQ ID NO: 1037456 - RNA, 22 nt, Human
caaaaccaccaacaaugucagc

SEQ ID NO: 1037457 - RNA, 24 nt, Human
caaaccucaccaggcuuaagcauc

SEQ ID NO: 1037458 - RNA, 20 nt, Human
caaagccaagcucgccuccu

SEQ ID NO: 1037459 - RNA, 22 nt, Human
caaagccaagcucgccuccucc

SEQ ID NO: 1037460 - RNA, 23 nt, Human
caacaaugucagcaaaaccucaa

SEQ ID NO: 1037461 - RNA, 22 nt, Human
caacagguaacugucuuaaaaa

SEQ ID NO: 1037462 - RNA, 19 nt, Human
caagcucgccuccucauca

SEQ ID NO: 1037463 - RNA, 18 nt, Human
caauaucugcaacuuugg

SEQ ID NO: 1037464 - RNA, 21 nt, Human
cacaaaaugcauuacaacaug

SEQ ID NO: 1037465 - RNA, 18 nt, Human
cacaggagggacagcaca

SEQ ID NO: 1037466 - RNA, 18 nt, Human
cacugagcgggaugaagg

SEQ ID NO: 1037467 - RNA, 19 nt, Human
cagguaucauucacucagu

SEQ ID NO: 1037468 - RNA, 18 nt, Human
caguguucacuuugggac

SEQ ID NO: 1037469 - RNA, 19 nt, Human
cauauaucaacugacuguc

SEQ ID NO: 1037470 - RNA, 19 nt, Human
cauuuccuucugaaggauc

SEQ ID NO: 1037471 - RNA, 22 nt, Human
ccaacaaugucagcaaaaccuc

SEQ ID NO: 1037472 - RNA, 22 nt, Human
ccagcacaggagggacagcaca

SEQ ID NO: 1037473 - RNA, 22 nt, Human
ccuguacagcugcacacagacg

SEQ ID NO: 1037474 - RNA, 22 nt, Human
cgacccagcacaggagggacag

SEQ ID NO: 1037475 - RNA, 21 nt, Human
cuacacauccgcgacccagca

SEQ ID NO: 1037476 - RNA, 22 nt, Human
cuacacauccgcgacccagcac

SEQ ID NO: 1037477 - RNA, 18 nt, Human
cucagguucccagcacuc

SEQ ID NO: 1037478 - RNA, 19 nt, Human
cuccaauauucugaaggcu

SEQ ID NO: 1037479 - RNA, 21 nt, Human
cuuauagaaagacauugugcu

SEQ ID NO: 1037480 - RNA, 23 nt, Human
cuuaugauuuugaccacuccauc

SEQ ID NO: 1037481 - RNA, 18 nt, Human
cuucccucuuuccucucc

SEQ ID NO: 1037482 - RNA, 19 nt, Human
cuugcuguacauuuucugu

SEQ ID NO: 1037483 - RNA, 21 nt, Human
cuuucuggaagaucacaaaag

SEQ ID NO: 1037484 - RNA, 18 nt, Human
gaacuaaaaagcaucaga

SEQ ID NO: 1037485 - RNA, 19 nt, Human
gaaggaucagugaacuucc

SEQ ID NO: 1037486 - RNA, 19 nt, Human
gagaaucauggccaaaggc

SEQ ID NO: 1037487 - RNA, 20 nt, Human
gagcaaacacaccacacucc

SEQ ID NO: 1037488 - RNA, 19 nt, Human
gcauccucuagcaaacagu

SEQ ID NO: 1037489 - RNA, 22 nt, Human
gccaagcucgccuccucaucac

SEQ ID NO: 1037490 - RNA, 26 nt, Human
ggacagccucagggaggagggaacgc

SEQ ID NO: 1037491 - RNA, 24 nt, Human
gggcacucugguggucagggcugg

SEQ ID NO: 1037492 - RNA, 24 nt, Human
gugcaaaaccaccaacaaugucag

SEQ ID NO: 1037493 - RNA, 28 nt, Human
uaaaagaagagagaaucuucccucuuuc

SEQ ID NO: 1037494 - RNA, 18 nt, Human
uaacaagacacccccagg

SEQ ID NO: 1037495 - RNA, 21 nt, Human
uaagcagaaacuagcauugcc

SEQ ID NO: 1037496 - RNA, 19 nt, Human
uacaguaauuaaauauguu

SEQ ID NO: 1037497 - RNA, 22 nt, Human
uagaaagaacaugugcaaaacc

SEQ ID NO: 1037498 - RNA, 25 nt, Human
uauagacauacacaaucccauguag

SEQ ID NO: 1037499 - RNA, 23 nt, Human
uauauauguauaauauauacaca

SEQ ID NO: 1037500 - RNA, 19 nt, Human
uauaucaacugacugucug

SEQ ID NO: 1037501 - RNA, 21 nt, Human
uauguaaagaacuuaugacuu

SEQ ID NO: 1037502 - RNA, 25 nt, Human
uaugugcuucugucacauacguagu

SEQ ID NO: 1037503 - RNA, 20 nt, Human
ucacucagugacauauucuc

SEQ ID NO: 1037504 - RNA, 23 nt, Human
ucagcaaaaccucaaagaucuga

SEQ ID NO: 1037505 - RNA, 18 nt, Human
ucagggaggaagcaaugg

SEQ ID NO: 1037506 - RNA, 24 nt, Human
uccacuguacccuacaucuauuuc

SEQ ID NO: 1037507 - RNA, 18 nt, Human
ucccucuuuccucuccca

SEQ ID NO: 1037508 - RNA, 18 nt, Human
uccucagguucccagcac

SEQ ID NO: 1037509 - RNA, 21 nt, Human
uccuggagcuuucuggaagau

SEQ ID NO: 1037510 - RNA, 19 nt, Human
ucgcauccucuagcaaaca

SEQ ID NO: 1037511 - RNA, 19 nt, Human
ucuaacaucuuucacguga

SEQ ID NO: 1037512 - RNA, 19 nt, Human
ucucauacacuacgucuuc

SEQ ID NO: 1037513 - RNA, 22 nt, Human
ucugguuuucugcuuauugcuu

SEQ ID NO: 1037514 - RNA, 23 nt, Human
ucuucccucuuuccucucccaaa

SEQ ID NO: 1037515 - RNA, 20 nt, Human
ugaaggcuuugcaaucagua

SEQ ID NO: 1037516 - RNA, 22 nt, Human
ugagcaaacacaccacacucca

SEQ ID NO: 1037517 - RNA, 26 nt, Human
ugagcaaacacaccacacuccaauau

SEQ ID NO: 1037518 - RNA, 20 nt, Human
ugagcgggaugaaggaguca

SEQ ID NO: 1037519 - RNA, 24 nt, Human
ugagcgggaugaaggagucacagg

SEQ ID NO: 1037520 - RNA, 23 nt, Human
ugcaaacaguggaucaaaaagca

SEQ ID NO: 1037521 - RNA, 22 nt, Human
ugcuaugaaguucucuccugaa

SEQ ID NO: 1037522 - RNA, 23 nt, Human
ugcuaugaaguucucuccugaag

SEQ ID NO: 1037523 - RNA, 19 nt, Human
ugcuuauguuccacuguac

SEQ ID NO: 1037524 - RNA, 19 nt, Human
uggaagccaaaaugaagac

SEQ ID NO: 1037525 - RNA, 22 nt, Human
uggaagccaaaaugaagacaua

SEQ ID NO: 1037526 - RNA, 23 nt, Human
uggaagccaaaaugaagacauag

SEQ ID NO: 1037527 - RNA, 24 nt, Human
ugguggucagggcugggcucuggg

SEQ ID NO: 1037528 - RNA, 24 nt, Human
uguuccacuguacccuacaucuau

SEQ ID NO: 1037529 - RNA, 19 nt, Human
uguuccagcucaccauuug

SEQ ID NO: 1037530 - RNA, 22 nt, Human
uguugagaaucauggccaaagg

SEQ ID NO: 1037531 - RNA, 26 nt, Human
uuagcaugauucaucuuugaaaaccc

SEQ ID NO: 1037532 - RNA, 19 nt, Human
uucaaaauuaacaagacac

SEQ ID NO: 1037533 - RNA, 18 nt, Human
uuccaaaguuuuaacaga

SEQ ID NO: 1037534 - RNA, 21 nt, Human
uuguuccaaggcuuuuguuuc

SEQ ID NO: 1037535 - RNA, 18 nt, Human
uuuaaaagcuccccccaa

SEQ ID NO: 1037536 - RNA, 24 nt, Human
uuuguaaacuccacaaaaugcauu

SEQ ID NO: 1037537 - RNA, 18 nt, Human
uuuuccaaaguuuuaaca

SEQ ID NO: 1037538 - RNA, 21 nt, Human
aaaaaaauaaugcuacauugg

SEQ ID NO: 1037539 - RNA, 19 nt, Human
aaaagaaaggaaauuacac

SEQ ID NO: 1037540 - RNA, 23 nt, Human
aaaagaaaggaaauuacacaaaa

SEQ ID NO: 1037541 - RNA, 27 nt, Human
aaaagaaaggaaauuacacaaaaaugu

SEQ ID NO: 1037542 - RNA, 20 nt, Human
aaaccaucagugucaucuau

SEQ ID NO: 1037543 - RNA, 21 nt, Human
aaauacacuagagucucccac

SEQ ID NO: 1037544 - RNA, 27 nt, Human
aagcacuugguacuauaaaucaaaacg

SEQ ID NO: 1037545 - RNA, 21 nt, Human
aaggaaaaaagggcuggacaa

SEQ ID NO: 1037546 - RNA, 23 nt, Human
aaggaagcaauaauuagaucaag

SEQ ID NO: 1037547 - RNA, 25 nt, Human
aaugcaaaaaggaaagucacucgaa

SEQ ID NO: 1037548 - RNA, 23 nt, Human
acacuagagucucccacaaauca

SEQ ID NO: 1037549 - RNA, 21 nt, Human
agaaaggaaauuacacaaaaa

SEQ ID NO: 1037550 - RNA, 19 nt, Human
agacagggaagaggagggu

SEQ ID NO: 1037551 - RNA, 21 nt, Human
agagucucccacaaaucaccu

SEQ ID NO: 1037552 - RNA, 21 nt, Human
agccggaacaaucucacagaa

SEQ ID NO: 1037553 - RNA, 20 nt, Human
auaaaacuuguaaagcaugu

SEQ ID NO: 1037554 - RNA, 19 nt, Human
caaacuaaaacauagccaa

SEQ ID NO: 1037555 - RNA, 24 nt, Human
caaaggaaaaaagggcuggacaac

SEQ ID NO: 1037556 - RNA, 21 nt, Human
caaauaauuuacuaauauuuc

SEQ ID NO: 1037557 - RNA, 18 nt, Human
caaguccaaaauucuugg

SEQ ID NO: 1037558 - RNA, 20 nt, Human
cacacaaacuaaaacauagc

SEQ ID NO: 1037559 - RNA, 19 nt, Human
cagcggcggcggcgaagac

SEQ ID NO: 1037560 - RNA, 25 nt, Human
cagcggcggcggcgaagacagggaa

SEQ ID NO: 1037561 - RNA, 19 nt, Human
ccaugccgcugccgucucc

SEQ ID NO: 1037562 - RNA, 22 nt, Human
cccacaaaucaccuuccccaaa

SEQ ID NO: 1037563 - RNA, 19 nt, Human
ccccaaagaaaagcuucug

SEQ ID NO: 1037564 - RNA, 19 nt, Human
ccccagagucuccgcggac

SEQ ID NO: 1037565 - RNA, 19 nt, Human
ccggccgccaugccgcugc

SEQ ID NO: 1037566 - RNA, 21 nt, Human
cggcgaagacagggaagagga

SEQ ID NO: 1037567 - RNA, 21 nt, Human
cuaaaacauagccaaaaaucc

SEQ ID NO: 1037568 - RNA, 24 nt, Human
cuaaagcaaauuauggggcagauc

SEQ ID NO: 1037569 - RNA, 19 nt, Human
cucuaugauguugcucuuc

SEQ ID NO: 1037570 - RNA, 21 nt, Human
cugaaaagaacaaauacaacg

SEQ ID NO: 1037571 - RNA, 23 nt, Human
gaaggaaggagggccggcggagc

SEQ ID NO: 1037572 - RNA, 24 nt, Human
gaaggaaggagggccggcggagcg

SEQ ID NO: 1037573 - RNA, 23 nt, Human
gauuaaaaugcuaauuuaaaaua

SEQ ID NO: 1037574 - RNA, 22 nt, Human
ggaaaguaauaagaaaggaagc

SEQ ID NO: 1037575 - RNA, 21 nt, Human
ggcgaagacagggaagaggag

SEQ ID NO: 1037576 - RNA, 19 nt, Human
ggcuggugggugggguggg

SEQ ID NO: 1037577 - RNA, 19 nt, Human
gggaagaggagggucgggc

SEQ ID NO: 1037578 - RNA, 20 nt, Human
ggggcuucauuuagaaaaaa

SEQ ID NO: 1037579 - RNA, 18 nt, Human
uaaaaaagaaauguggca

SEQ ID NO: 1037580 - RNA, 20 nt, Human
uaaaaacacuccucucuucc

SEQ ID NO: 1037581 - RNA, 19 nt, Human
uaaaacauagccaaaaauc

SEQ ID NO: 1037582 - RNA, 18 nt, Human
uaaagcaaauuauggggc

SEQ ID NO: 1037583 - RNA, 27 nt, Human
uacuaaaaaagaaauguggcagauucc

SEQ ID NO: 1037584 - RNA, 23 nt, Human
uacuaaagcaaauuauggggcag

SEQ ID NO: 1037585 - RNA, 26 nt, Human
uacugccaaaaaaugcaaaaaggaaa

SEQ ID NO: 1037586 - RNA, 21 nt, Human
uauagaaaaauuaggaaagua

SEQ ID NO: 1037587 - RNA, 27 nt, Human
uauguuaaaaauguaauauauagaaca

SEQ ID NO: 1037588 - RNA, 19 nt, Human
ucaccuuccccaaagaaaa

SEQ ID NO: 1037589 - RNA, 19 nt, Human
uccaaauaauuuacuaaua

SEQ ID NO: 1037590 - RNA, 18 nt, Human
ucccacaaaucaccuucc

SEQ ID NO: 1037591 - RNA, 21 nt, Human
uccuuguguuuaagcacuugg

SEQ ID NO: 1037592 - RNA, 19 nt, Human
ucuaacacuauccuugugu

SEQ ID NO: 1037593 - RNA, 23 nt, Human
ucucccacaaaucaccuucccca

SEQ ID NO: 1037594 - RNA, 28 nt, Human
ucucccacaaaucaccuuccccaaagaa

SEQ ID NO: 1037595 - RNA, 22 nt, Human
ucuuccagccucguacuuucag

SEQ ID NO: 1037596 - RNA, 18 nt, Human
ugaaaagaacaaauacaa

SEQ ID NO: 1037597 - RNA, 21 nt, Human
ugaaaagugcauuauugcaau

SEQ ID NO: 1037598 - RNA, 18 nt, Human
ugacuccagcagcggcgg

SEQ ID NO: 1037599 - RNA, 20 nt, Human
ugagaaaaguuagauacaaa

SEQ ID NO: 1037600 - RNA, 18 nt, Human
ugagccggaacaaucuca

SEQ ID NO: 1037601 - RNA, 21 nt, Human
ugagccggaacaaucucacag

SEQ ID NO: 1037602 - RNA, 22 nt, Human
ugagccggaacaaucucacaga

SEQ ID NO: 1037603 - RNA, 18 nt, Human
ugcaaaaaggaaagucac

SEQ ID NO: 1037604 - RNA, 23 nt, Human
ugcaaaaaggaaagucacucgaa

SEQ ID NO: 1037605 - RNA, 24 nt, Human
ugccgcugccgucucccuccccca

SEQ ID NO: 1037606 - RNA, 18 nt, Human
uggggcuucauuuagaaa

SEQ ID NO: 1037607 - RNA, 20 nt, Human
ugguggguggggugggagag

SEQ ID NO: 1037608 - RNA, 18 nt, Human
uguaauugaaaaaaaaac

SEQ ID NO: 1037609 - RNA, 24 nt, Human
ugugugcgcgcgcauguguuuuua

SEQ ID NO: 1037610 - RNA, 20 nt, Human
ugugugugugcgcgcgcaug

SEQ ID NO: 1037611 - RNA, 21 nt, Human
uuacuguauuaucacaucaua

SEQ ID NO: 1037612 - RNA, 23 nt, Human
uuauacuaaaaaagaaauguggc

SEQ ID NO: 1037613 - RNA, 18 nt, Human
uucaaguaugaaaagugc

SEQ ID NO: 1037614 - RNA, 19 nt, Human
uucacacucuaugauguug

SEQ ID NO: 1037615 - RNA, 21 nt, Human
uuccccaaagaaaagcuucug

SEQ ID NO: 1037616 - RNA, 22 nt, Human
uuccugcauuuuguuaauguuu

SEQ ID NO: 1037617 - RNA, 19 nt, Human
uugcaaguccaaaauucuu

SEQ ID NO: 1037618 - RNA, 22 nt, Human
uuuaauuaaucuccacucuccc

SEQ ID NO: 1037619 - RNA, 20 nt, Human
uuugcaaguccaaaauucuu

SEQ ID NO: 1037620 - RNA, 21 nt, Human
uuuucaguguucuacauacua

SEQ ID NO: 1037621 - RNA, 23 nt, Human
uuuuuuuuuuuuuuaacucuuaa

SEQ ID NO: 1037622 - RNA, 22 nt, Human
aaaaaaaaaaaaaaagcaacaa

SEQ ID NO: 1037623 - RNA, 21 nt, Human
aaaaaaaaaaaaagcaacaaa

SEQ ID NO: 1037624 - RNA, 18 nt, Human
aaaaaggaaaacauuuuc

SEQ ID NO: 1037625 - RNA, 20 nt, Human
aaaaagugcaucuaaacccc

SEQ ID NO: 1037626 - RNA, 23 nt, Human
aaacaauauggcaaccaucugac

SEQ ID NO: 1037627 - RNA, 18 nt, Human
aaacacaauguaacuaau

SEQ ID NO: 1037628 - RNA, 23 nt, Human
aaagcucccccaagaauuugcuc

SEQ ID NO: 1037629 - RNA, 20 nt, Human
aaaggccuuaaagaaaagga

SEQ ID NO: 1037630 - RNA, 25 nt, Human
aacccacagaacucauuccaaaaaa

SEQ ID NO: 1037631 - RNA, 27 nt, Human
aagaaaaacaacagccuauuaucaaaa

SEQ ID NO: 1037632 - RNA, 18 nt, Human
aagaaaacccacagaacu

SEQ ID NO: 1037633 - RNA, 25 nt, Human
aagcaaauauauguucaucaaccau

SEQ ID NO: 1037634 - RNA, 19 nt, Human
aagcauuuuaagaaaugaa

SEQ ID NO: 1037635 - RNA, 20 nt, Human
aagcauuuuaagaaaugaaa

SEQ ID NO: 1037636 - RNA, 19 nt, Human
aaggaaaaagggacuucua

SEQ ID NO: 1037637 - RNA, 18 nt, Human
accaacugccaaaccagu

SEQ ID NO: 1037638 - RNA, 20 nt, Human
accccauuaaaagaaaguug

SEQ ID NO: 1037639 - RNA, 22 nt, Human
acuuuuuagucacacaguuaac

SEQ ID NO: 1037640 - RNA, 21 nt, Human
agacacugacagguaagagcu

SEQ ID NO: 1037641 - RNA, 23 nt, Human
agccaagugaacccaugcuacca

SEQ ID NO: 1037642 - RNA, 22 nt, Human
agguuuugugugaaauguuagu

SEQ ID NO: 1037643 - RNA, 20 nt, Human
aucacagguuuacugacuca

SEQ ID NO: 1037644 - RNA, 24 nt, Human
augaagacaaauauacuuaucuac

SEQ ID NO: 1037645 - RNA, 23 nt, Human
auuaaauaacaaaagcaucacug

SEQ ID NO: 1037646 - RNA, 22 nt, Human
caaaacacaauguaacuaauaa

SEQ ID NO: 1037647 - RNA, 23 nt, Human
caaaacuucccuuacucucaaaa

SEQ ID NO: 1037648 - RNA, 19 nt, Human
caaaccaaauacuagagca

SEQ ID NO: 1037649 - RNA, 19 nt, Human
caagaauuugcucauacaa

SEQ ID NO: 1037650 - RNA, 25 nt, Human
caagaccaagaaccugaagugaagc

SEQ ID NO: 1037651 - RNA, 21 nt, Human
cacaggcacuggcagacaaaa

SEQ ID NO: 1037652 - RNA, 20 nt, Human
caccuugaaauuuauuucca

SEQ ID NO: 1037653 - RNA, 20 nt, Human
cacuauacugagcaaagagc

SEQ ID NO: 1037654 - RNA, 24 nt, Human
cacuuucaaaacacuauacugagc

SEQ ID NO: 1037655 - RNA, 20 nt, Human
cagacuuugcaaaugaacac

SEQ ID NO: 1037656 - RNA, 21 nt, Human
cagcaccccauuaaaagaaag

SEQ ID NO: 1037657 - RNA, 23 nt, Human
cagccgcggcagccuccacagcc

SEQ ID NO: 1037658 - RNA, 20 nt, Human
caguaauuagagccacaaaa

SEQ ID NO: 1037659 - RNA, 24 nt, Human
cauauuccaaacaauauggcaacc

SEQ ID NO: 1037660 - RNA, 24 nt, Human
ccacaaaauauauuccaaaccaaa

SEQ ID NO: 1037661 - RNA, 23 nt, Human
ccagcaagucaaauauaaagaag

SEQ ID NO: 1037662 - RNA, 18 nt, Human
ccccagcaauucccggcu

SEQ ID NO: 1037663 - RNA, 26 nt, Human
ccccgccgccgcugccgccacuccuc

SEQ ID NO: 1037664 - RNA, 19 nt, Human
ccgccgccgccuccuucgc

SEQ ID NO: 1037665 - RNA, 18 nt, Human
ccgccgccgcugccgcca

SEQ ID NO: 1037666 - RNA, 19 nt, Human
ccuaaagaggcagcacccc

SEQ ID NO: 1037667 - RNA, 20 nt, Human
ccuccgccaccgccgccgcc

SEQ ID NO: 1037668 - RNA, 24 nt, Human
ccuuuaaaaaaaaaaaaaaagcaa

SEQ ID NO: 1037669 - RNA, 19 nt, Human
cgccaagguucucacucag

SEQ ID NO: 1037670 - RNA, 27 nt, Human
cguagcaguaauuuugauuaaauaaaa

SEQ ID NO: 1037671 - RNA, 23 nt, Human
cuaaaccccagcaauucccggcu

SEQ ID NO: 1037672 - RNA, 18 nt, Human
cuggcagaagaaaagcaa

SEQ ID NO: 1037673 - RNA, 18 nt, Human
cuggguuuucaugcuaga

SEQ ID NO: 1037674 - RNA, 26 nt, Human
cuuuaaaaaaaaaaaaaaagcaacaa

SEQ ID NO: 1037675 - RNA, 23 nt, Human
gaagacaaauauacuuaucuaca

SEQ ID NO: 1037676 - RNA, 21 nt, Human
gcaaagagcagcuuuccuuua

SEQ ID NO: 1037677 - RNA, 18 nt, Human
gcaaagcucccccaagaa

SEQ ID NO: 1037678 - RNA, 19 nt, Human
gcuccaucaacuuuucuua

SEQ ID NO: 1037679 - RNA, 26 nt, Human
ggaaaaagggacuucuaaaguaaacc

SEQ ID NO: 1037680 - RNA, 24 nt, Human
ggaugauaguuguuccuugauguc

SEQ ID NO: 1037681 - RNA, 20 nt, Human
gguggcuguuaagaaaaccc

SEQ ID NO: 1037682 - RNA, 23 nt, Human
guccccgccgccgcugccgccac

SEQ ID NO: 1037683 - RNA, 18 nt, Human
guuucaucccaauguaca

SEQ ID NO: 1037684 - RNA, 24 nt, Human
uaaaaaaaaaaaaaaagcaacaaa

SEQ ID NO: 1037685 - RNA, 20 nt, Human
uaaaaccuaaaacugaagcg

SEQ ID NO: 1037686 - RNA, 23 nt, Human
uaaaaccuaaaacugaagcgucu

SEQ ID NO: 1037687 - RNA, 24 nt, Human
uaaaccccagcaauucccggcucc

SEQ ID NO: 1037688 - RNA, 22 nt, Human
uaaagacauaaggcauacacug

SEQ ID NO: 1037689 - RNA, 27 nt, Human
uaaaguaaaccauucuuucauucaccu

SEQ ID NO: 1037690 - RNA, 23 nt, Human
uaaauaacaaaagcaucacugug

SEQ ID NO: 1037691 - RNA, 26 nt, Human
uagguuuuccaguuaaauaaauuauc

SEQ ID NO: 1037692 - RNA, 23 nt, Human
uaucacagguuuacugacucaau

SEQ ID NO: 1037693 - RNA, 23 nt, Human
uauucaagaauggaaaauuuaau

SEQ ID NO: 1037694 - RNA, 22 nt, Human
uauucugcucauuaaacuuuca

SEQ ID NO: 1037695 - RNA, 18 nt, Human
ucaaaaaguaaauuacug

SEQ ID NO: 1037696 - RNA, 18 nt, Human
ucaaaugaaaacaacaac

SEQ ID NO: 1037697 - RNA, 21 nt, Human
uccaaaccaaauacuagagca

SEQ ID NO: 1037698 - RNA, 23 nt, Human
uccacuuacugguucugugauaa

SEQ ID NO: 1037699 - RNA, 24 nt, Human
uccccgccgccgcugccgccacuc

SEQ ID NO: 1037700 - RNA, 21 nt, Human
uccgccaccgccgccgccucc

SEQ ID NO: 1037701 - RNA, 22 nt, Human
uccgccaccgccgccgccuccu

SEQ ID NO: 1037702 - RNA, 18 nt, Human
uccuccgccaccgccgcc

SEQ ID NO: 1037703 - RNA, 23 nt, Human
uccuccgccaccgccgccgccuc

SEQ ID NO: 1037704 - RNA, 19 nt, Human
ucugguuucugaucugugg

SEQ ID NO: 1037705 - RNA, 22 nt, Human
ucuuccuccgccaccgccgcua

SEQ ID NO: 1037706 - RNA, 25 nt, Human
ugaaaaaaguauccaaauuauaaaa

SEQ ID NO: 1037707 - RNA, 24 nt, Human
ugaaaaaauaaaaccuaaaacuga

SEQ ID NO: 1037708 - RNA, 19 nt, Human
ugaaagcaauuaacuguaa

SEQ ID NO: 1037709 - RNA, 19 nt, Human
ugagcaaagagcagcuuuc

SEQ ID NO: 1037710 - RNA, 19 nt, Human
ugcaaaggucgauucugug

SEQ ID NO: 1037711 - RNA, 23 nt, Human
ugcacugauuggccaaaacacaa

SEQ ID NO: 1037712 - RNA, 23 nt, Human
ugccuaaaugaaguuugaccaaa

SEQ ID NO: 1037713 - RNA, 23 nt, Human
uggagucuuucaguguuggugcu

SEQ ID NO: 1037714 - RNA, 18 nt, Human
uggcaaaaacacuaaaau

SEQ ID NO: 1037715 - RNA, 21 nt, Human
uggcaaccaucugacuuuuua

SEQ ID NO: 1037716 - RNA, 19 nt, Human
uguaaggaaaaagggacuu

SEQ ID NO: 1037717 - RNA, 21 nt, Human
ugugugguuaccauauuuuua

SEQ ID NO: 1037718 - RNA, 25 nt, Human
uguuaagaaaacccacagaacucag

SEQ ID NO: 1037719 - RNA, 22 nt, Human
uguuacauugcacugauuggcc

SEQ ID NO: 1037720 - RNA, 22 nt, Human
uucaacuucaaaaacuaccguc

SEQ ID NO: 1037721 - RNA, 23 nt, Human
uucugcucauuaaacuuucaaga

SEQ ID NO: 1037722 - RNA, 22 nt, Human
uugaaagcaauuaacuguaaaa

SEQ ID NO: 1037723 - RNA, 22 nt, Human
uugguaccaaaagaacuccuga

SEQ ID NO: 1037724 - RNA, 20 nt, Human
uuuaaaaaaaaaaaaaaagc

SEQ ID NO: 1037725 - RNA, 24 nt, Human
uuucauucacuaaucacugaggua

SEQ ID NO: 1037726 - RNA, 18 nt, Human
agaucugcuuuuugguca

SEQ ID NO: 1037727 - RNA, 22 nt, Human
gagcagaagaucugcuuuuugg

SEQ ID NO: 1037728 - RNA, 19 nt, Human
uauagaauccauuuucuaa

SEQ ID NO: 1037729 - RNA, 20 nt, Human
uccaggagcagaagaucugc

SEQ ID NO: 1037730 - RNA, 20 nt, Human
ugcaaaaauagauaauaauu

SEQ ID NO: 1037731 - RNA, 19 nt, Human
aacacaguguccuuuggac

SEQ ID NO: 1037732 - RNA, 20 nt, Human
acauggucucccauuuccuc

SEQ ID NO: 1037733 - RNA, 21 nt, Human
aggcacagacaucuucaugcc

SEQ ID NO: 1037734 - RNA, 20 nt, Human
cauucugcuucuuggaggua

SEQ ID NO: 1037735 - RNA, 21 nt, Human
cuccuggagccgggcaccguc

SEQ ID NO: 1037736 - RNA, 22 nt, Human
gacaucuucaugccuguguuca

SEQ ID NO: 1037737 - RNA, 22 nt, Human
ggagaaccucuguggguuggaa

SEQ ID NO: 1037738 - RNA, 24 nt, Human
gggacuggguggagucucuggggg

SEQ ID NO: 1037739 - RNA, 19 nt, Human
guuggaaggcacagacauc

SEQ ID NO: 1037740 - RNA, 19 nt, Human
uaaaagagucagugugaug

SEQ ID NO: 1037741 - RNA, 21 nt, Human
uaaaagagucagugugaugua

SEQ ID NO: 1037742 - RNA, 19 nt, Human
uaaauaaugcugccucucu

SEQ ID NO: 1037743 - RNA, 23 nt, Human
uagccugcuucguacucacacug

SEQ ID NO: 1037744 - RNA, 20 nt, Human
uaguuucuggguccaggacc

SEQ ID NO: 1037745 - RNA, 19 nt, Human
ugaaguaggagaaccucug

SEQ ID NO: 1037746 - RNA, 26 nt, Human
ugaaguaggagaaccucuguggguug

SEQ ID NO: 1037747 - RNA, 22 nt, Human
uggaacuccuggagccgggcac

SEQ ID NO: 1037748 - RNA, 18 nt, Human
uggagguaagcacuggua

SEQ ID NO: 1037749 - RNA, 20 nt, Human
uggcugguuugguaagaggu

SEQ ID NO: 1037750 - RNA, 23 nt, Human
uggcugguuugguaagaggucca

SEQ ID NO: 1037751 - RNA, 22 nt, Human
uggguuggaaggcacagacauc

SEQ ID NO: 1037752 - RNA, 23 nt, Human
ugguuugguaagagguccaagga

SEQ ID NO: 1037753 - RNA, 22 nt, Human
ugucuguucuucuagucgguca

SEQ ID NO: 1037754 - RNA, 23 nt, Human
cacugguugcgguuuugaaacac

SEQ ID NO: 1037755 - RNA, 19 nt, Human
aaacuucuagaauucuacu

SEQ ID NO: 1037756 - RNA, 18 nt, Human
aaagauaagucaaguggc

SEQ ID NO: 1037757 - RNA, 20 nt, Human
acccaaucugugacccugau

SEQ ID NO: 1037758 - RNA, 22 nt, Human
auuccaaauuuuagagccaugg

SEQ ID NO: 1037759 - RNA, 26 nt, Human
caauaaagauaagucaaguggcacag

SEQ ID NO: 1037760 - RNA, 22 nt, Human
ccugauccacaacacaauaaga

SEQ ID NO: 1037761 - RNA, 22 nt, Human
cugaaaauaauaguggcaaaac

SEQ ID NO: 1037762 - RNA, 25 nt, Human
gaaaauaauaguggcaaaacauaac

SEQ ID NO: 1037763 - RNA, 20 nt, Human
gcauagacaauaaagauaag

SEQ ID NO: 1037764 - RNA, 19 nt, Human
ggaaauaaaauugagaggg

SEQ ID NO: 1037765 - RNA, 22 nt, Human
uaacagcaucuggaggcucagc

SEQ ID NO: 1037766 - RNA, 21 nt, Human
uacaagcagcucuuaaggcaa

SEQ ID NO: 1037767 - RNA, 22 nt, Human
uaguggcaaaacauaacacucc

SEQ ID NO: 1037768 - RNA, 21 nt, Human
ucaaccagugauuaaaucuga

SEQ ID NO: 1037769 - RNA, 23 nt, Human
uccaagcuacccaaucugugacc

SEQ ID NO: 1037770 - RNA, 20 nt, Human
ugaaaaagagaacauuucau

SEQ ID NO: 1037771 - RNA, 23 nt, Human
ugagagggacaugauuagaagua

SEQ ID NO: 1037772 - RNA, 19 nt, Human
ugagguaacagcaucugga

SEQ ID NO: 1037773 - RNA, 21 nt, Human
ugagguaacagcaucuggagg

SEQ ID NO: 1037774 - RNA, 22 nt, Human
uggcagggugaagugaaaaaga

SEQ ID NO: 1037775 - RNA, 24 nt, Human
uucaaauugguacaacuggugaca

SEQ ID NO: 1037776 - RNA, 22 nt, Human
uuuauacauagcuauccacaua

SEQ ID NO: 1037777 - RNA, 28 nt, Human
uuuauacauagcuauccacauauguaca

SEQ ID NO: 1037778 - RNA, 22 nt, Human
agcccuugacaggagaugguuc

SEQ ID NO: 1037779 - RNA, 21 nt, Human
ugacaggagaugguucucagu

SEQ ID NO: 1037780 - RNA, 22 nt, Human
ugggaauaaucaaagcccuuga

SEQ ID NO: 1037781 - RNA, 24 nt, Human
uugacaggagaugguuccggacuc

SEQ ID NO: 1037782 - RNA, 19 nt, Human
aaaggucgaggcccgagac

SEQ ID NO: 1037783 - RNA, 24 nt, Human
aaaguacugggauuacagguguga

SEQ ID NO: 1037784 - RNA, 19 nt, Human
aagccauggccagcaagga

SEQ ID NO: 1037785 - RNA, 18 nt, Human
aaguacugggauuacagg

SEQ ID NO: 1037786 - RNA, 26 nt, Human
aaguacugggauuacaggugugagcc

SEQ ID NO: 1037787 - RNA, 23 nt, Human
accauguuuggcuaauuuuugua

SEQ ID NO: 1037788 - RNA, 24 nt, Human
accugugacucaaaacauuaacua

SEQ ID NO: 1037789 - RNA, 20 nt, Human
acggggucucgcuguguuac

SEQ ID NO: 1037790 - RNA, 23 nt, Human
acggggucucgcuguguuaccug

SEQ ID NO: 1037791 - RNA, 22 nt, Human
acuacagguguguaccauguuu

SEQ ID NO: 1037792 - RNA, 20 nt, Human
agaaagccccugggacuuca

SEQ ID NO: 1037793 - RNA, 20 nt, Human
agacaucugauucacauagg

SEQ ID NO: 1037794 - RNA, 22 nt, Human
agagcagccccaugggcucgag

SEQ ID NO: 1037795 - RNA, 20 nt, Human
agcaauaugccccccuugac

SEQ ID NO: 1037796 - RNA, 23 nt, Human
aguagcugggacuacaggugugu

SEQ ID NO: 1037797 - RNA, 20 nt, Human
agugcaguggugcaaucacg

SEQ ID NO: 1037798 - RNA, 20 nt, Human
augacaaagacauggcuuua

SEQ ID NO: 1037799 - RNA, 19 nt, Human
auggccagcaaggaggcug

SEQ ID NO: 1037800 - RNA, 24 nt, Human
caaaguacugggauuacaggugug

SEQ ID NO: 1037801 - RNA, 18 nt, Human
caagaggcccccuccaau

SEQ ID NO: 1037802 - RNA, 21 nt, Human
caauaccaaagaugucaauga

SEQ ID NO: 1037803 - RNA, 22 nt, Human
caaugaucccugggaagggucc

SEQ ID NO: 1037804 - RNA, 21 nt, Human
cacccggcccgcucgcaccga

SEQ ID NO: 1037805 - RNA, 21 nt, Human
cagcaaacauuaagugaccau

SEQ ID NO: 1037806 - RNA, 21 nt, Human
cagcagcagcggccugggggc

SEQ ID NO: 1037807 - RNA, 22 nt, Human
cagcggccugggggcuccagga

SEQ ID NO: 1037808 - RNA, 24 nt, Human
cauguugccuaagcuggucaugaa

SEQ ID NO: 1037809 - RNA, 21 nt, Human
ccaaaguacugggauuacagg

SEQ ID NO: 1037810 - RNA, 24 nt, Human
ccaaaguacugggauuacaggugu

SEQ ID NO: 1037811 - RNA, 24 nt, Human
ccugagcucaagcaauaugccccc

SEQ ID NO: 1037812 - RNA, 21 nt, Human
ccuuggaagagaguacagacu

SEQ ID NO: 1037813 - RNA, 18 nt, Human
cgcaccgacuggcgccgc

SEQ ID NO: 1037814 - RNA, 22 nt, Human
cgcaccggcucguuccagcagc

SEQ ID NO: 1037815 - RNA, 23 nt, Human
cgcgcagcguaacccgcugcucc

SEQ ID NO: 1037816 - RNA, 19 nt, Human
cggcucguuccagcagcag

SEQ ID NO: 1037817 - RNA, 21 nt, Human
cguccaggcucggggucgugg

SEQ ID NO: 1037818 - RNA, 20 nt, Human
cuaaaaaaaucuagaaggaa

SEQ ID NO: 1037819 - RNA, 22 nt, Human
cucaagcaauaugccccccuug

SEQ ID NO: 1037820 - RNA, 23 nt, Human
cucgaguagcugggacuacaggu

SEQ ID NO: 1037821 - RNA, 24 nt, Human
cucgaguagcugggacuacaggug

SEQ ID NO: 1037822 - RNA, 23 nt, Human
cucggguuccagggcccagagca

SEQ ID NO: 1037823 - RNA, 18 nt, Human
cugagcucaagcaauaug

SEQ ID NO: 1037824 - RNA, 23 nt, Human
cuguguuaccugggcuggagugc

SEQ ID NO: 1037825 - RNA, 24 nt, Human
cuuagagaggaagugagagggaaa

SEQ ID NO: 1037826 - RNA, 20 nt, Human
gacuacagguguguaccaug

SEQ ID NO: 1037827 - RNA, 25 nt, Human
gaguagcugggacuacaggugugua

SEQ ID NO: 1037828 - RNA, 24 nt, Human
gagugcaguggugcaaucacggcu

SEQ ID NO: 1037829 - RNA, 18 nt, Human
gauuacaggugugagcca

SEQ ID NO: 1037830 - RNA, 21 nt, Human
gauuacaggugugagccacug

SEQ ID NO: 1037831 - RNA, 24 nt, Human
gauuacaggugugagccacuguac

SEQ ID NO: 1037832 - RNA, 22 nt, Human
gcaccgacuggcgccgcacccc

SEQ ID NO: 1037833 - RNA, 23 nt, Human
gccaaaaaggcuucucggguucc

SEQ ID NO: 1037834 - RNA, 20 nt, Human
gccacuguacucggccccag

SEQ ID NO: 1037835 - RNA, 20 nt, Human
gccauguugccuaagcuggu

SEQ ID NO: 1037836 - RNA, 20 nt, Human
gcucggggucguggccgucc

SEQ ID NO: 1037837 - RNA, 21 nt, Human
ggaagcgccaaaaaggcuucu

SEQ ID NO: 1037838 - RNA, 20 nt, Human
ggacuacagguguguaccau

SEQ ID NO: 1037839 - RNA, 21 nt, Human
ggacuacagguguguaccaug

SEQ ID NO: 1037840 - RNA, 23 nt, Human
ggcucguuccagcagcagcggcc

SEQ ID NO: 1037841 - RNA, 21 nt, Human
gggacgcgcgcagcguaaccc

SEQ ID NO: 1037842 - RNA, 22 nt, Human
ggggcuccaggaucagcguugc

SEQ ID NO: 1037843 - RNA, 18 nt, Human
ggucugcucuuagagagg

SEQ ID NO: 1037844 - RNA, 23 nt, Human
ggugccggaagcugccgguggcu

SEQ ID NO: 1037845 - RNA, 21 nt, Human
guagggauuggguuuugccau

SEQ ID NO: 1037846 - RNA, 25 nt, Human
uaacgacaaagcuuauucaacaaag

SEQ ID NO: 1037847 - RNA, 18 nt, Human
uaacuaaaaaaaucuaga

SEQ ID NO: 1037848 - RNA, 22 nt, Human
uacaggugugagccacuguacu

SEQ ID NO: 1037849 - RNA, 21 nt, Human
uacauuaguaaaacuaacgac

SEQ ID NO: 1037850 - RNA, 19 nt, Human
uaccugggcuggagugcag

SEQ ID NO: 1037851 - RNA, 24 nt, Human
uaccugggcuggagugcaguggug

SEQ ID NO: 1037852 - RNA, 24 nt, Human
uacugggauuacaggugugagcca

SEQ ID NO: 1037853 - RNA, 22 nt, Human
uagggauuggguuuugccaugu

SEQ ID NO: 1037854 - RNA, 19 nt, Human
uauccaggagacaucugau

SEQ ID NO: 1037855 - RNA, 18 nt, Human
uccagcaccuccaacucc

SEQ ID NO: 1037856 - RNA, 23 nt, Human
ucccaaaguacugggauuacagg

SEQ ID NO: 1037857 - RNA, 21 nt, Human
ucccgcuucaggaagcgccaa

SEQ ID NO: 1037858 - RNA, 18 nt, Human
ucccgggcucaagcaauc

SEQ ID NO: 1037859 - RNA, 19 nt, Human
ucccgggcucaagcaaucg

SEQ ID NO: 1037860 - RNA, 22 nt, Human
uccggcguccccuggugccgga

SEQ ID NO: 1037861 - RNA, 24 nt, Human
ucgcuguguuaccugggcuggagu

SEQ ID NO: 1037862 - RNA, 18 nt, Human
ucucaucuccuccuguca

SEQ ID NO: 1037863 - RNA, 23 nt, Human
ucucgaguagcugggacuacagg

SEQ ID NO: 1037864 - RNA, 24 nt, Human
ucucgaguagcugggacuacaggu

SEQ ID NO: 1037865 - RNA, 19 nt, Human
ucuugaccucccgggcuca

SEQ ID NO: 1037866 - RNA, 21 nt, Human
ugaggcaaaaguagccaggcu

SEQ ID NO: 1037867 - RNA, 22 nt, Human
ugcaguggugcaaucacggcuc

SEQ ID NO: 1037868 - RNA, 22 nt, Human
ugccauguugccuaagcugguc

SEQ ID NO: 1037869 - RNA, 24 nt, Human
ugccgguggcugagcagucccaga

SEQ ID NO: 1037870 - RNA, 18 nt, Human
ugcgcgcuccagguccag

SEQ ID NO: 1037871 - RNA, 21 nt, Human
uggagugcaguggugcaauca

SEQ ID NO: 1037872 - RNA, 24 nt, Human
uggagugcaguggugcaaucacgg

SEQ ID NO: 1037873 - RNA, 18 nt, Human
uggccaaagaaaauucua

SEQ ID NO: 1037874 - RNA, 24 nt, Human
uggccguccagcaccuccaacucc

SEQ ID NO: 1037875 - RNA, 25 nt, Human
uggcggcaggaagagcguggcgcgc

SEQ ID NO: 1037876 - RNA, 23 nt, Human
ugggaaggguccagguccuggcg

SEQ ID NO: 1037877 - RNA, 25 nt, Human
ugggaaggguccagguccuggcggc

SEQ ID NO: 1037878 - RNA, 21 nt, Human
ugggacuacagguguguacca

SEQ ID NO: 1037879 - RNA, 21 nt, Human
ugggacuacagguguguacca

SEQ ID NO: 1037880 - RNA, 22 nt, Human
ugggacuacagguguguaccau

SEQ ID NO: 1037881 - RNA, 18 nt, Human
ugggauuacaggugugag

SEQ ID NO: 1037882 - RNA, 21 nt, Human
ugggauuacaggugugagcca

SEQ ID NO: 1037883 - RNA, 22 nt, Human
ugggauuacaggugugagccac

SEQ ID NO: 1037884 - RNA, 22 nt, Human
ugggauuacaggugugagccac

SEQ ID NO: 1037885 - RNA, 22 nt, Human
ugggauuacaggugugagccac

SEQ ID NO: 1037886 - RNA, 24 nt, Human
ugggauuacaggugugagccacug

SEQ ID NO: 1037887 - RNA, 24 nt, Human
uguagggauuggguuuugccaugu

SEQ ID NO: 1037888 - RNA, 18 nt, Human
uguccggacggcguccgg

SEQ ID NO: 1037889 - RNA, 24 nt, Human
uguguuaccugggcuggagugcag

SEQ ID NO: 1037890 - RNA, 24 nt, Human
uuaccugggcuggagugcaguggu

SEQ ID NO: 1037891 - RNA, 18 nt, Human
uuccagcagcagcggccu

SEQ ID NO: 1037892 - RNA, 20 nt, Human
uuccagggcccagagcagcc

SEQ ID NO: 1037893 - RNA, 24 nt, Human
uuuguagggauuggguuuugccau

SEQ ID NO: 1037894 - RNA, 23 nt, Human
uuuugccauguugccuaagcugg

SEQ ID NO: 1037895 - RNA, 19 nt, Human
uaaaaggaacuguugcagg

SEQ ID NO: 1037896 - RNA, 21 nt, Human
uaaaaggaacuguugcaggua

SEQ ID NO: 1037897 - RNA, 19 nt, Human
aaguagcugggacuauagg

SEQ ID NO: 1037898 - RNA, 20 nt, Human
aaguagcugggacuauaggc

SEQ ID NO: 1037899 - RNA, 25 nt, Human
aaguagcugggacuauaggcacaug

SEQ ID NO: 1037900 - RNA, 19 nt, Human
aggcacaugcuaccacacc

SEQ ID NO: 1037901 - RNA, 21 nt, Human
auaauccucccaccuccaccu

SEQ ID NO: 1037902 - RNA, 23 nt, Human
caccuccaccucccaaguagcug

SEQ ID NO: 1037903 - RNA, 24 nt, Human
caccuccaccucccaaguagcugg

SEQ ID NO: 1037904 - RNA, 22 nt, Human
caccuuaacuaauaucaaggac

SEQ ID NO: 1037905 - RNA, 23 nt, Human
cauucugugucacccuuaugugu

SEQ ID NO: 1037906 - RNA, 23 nt, Human
ccaccucccaaguagcugggacu

SEQ ID NO: 1037907 - RNA, 19 nt, Human
cccaaguagcugggacuau

SEQ ID NO: 1037908 - RNA, 24 nt, Human
cccaaguagcugggacuauaggca

SEQ ID NO: 1037909 - RNA, 23 nt, Human
ccucccaccuccaccucccaagu

SEQ ID NO: 1037910 - RNA, 26 nt, Human
ccucccaccuccaccucccaaguagc

SEQ ID NO: 1037911 - RNA, 24 nt, Human
cuaccacaccuggcuuaaaggugc

SEQ ID NO: 1037912 - RNA, 25 nt, Human
cuauauacauacauacacagacaua

SEQ ID NO: 1037913 - RNA, 20 nt, Human
cucccaccuccaccucccaa

SEQ ID NO: 1037914 - RNA, 19 nt, Human
cucuauuuauaauccuccc

SEQ ID NO: 1037915 - RNA, 24 nt, Human
gccggugcggccagcgaaggccca

SEQ ID NO: 1037916 - RNA, 21 nt, Human
ggaaagucucuauuuauaauc

SEQ ID NO: 1037917 - RNA, 20 nt, Human
uacacaaugauuuauuuuaa

SEQ ID NO: 1037918 - RNA, 23 nt, Human
uacauacauacacagacauagug

SEQ ID NO: 1037919 - RNA, 24 nt, Human
uauaaacaaacaucuacuauauaa

SEQ ID NO: 1037920 - RNA, 24 nt, Human
uauuuauaauccucccaccuccac

SEQ ID NO: 1037921 - RNA, 23 nt, Human
ucagacuccuuaagcuacaugau

SEQ ID NO: 1037922 - RNA, 23 nt, Human
uccaccucccaaguagcugggac

SEQ ID NO: 1037923 - RNA, 24 nt, Human
ucccaaguagcugggacuauaggc

SEQ ID NO: 1037924 - RNA, 23 nt, Human
uccucccaccuccaccucccaag

SEQ ID NO: 1037925 - RNA, 22 nt, Human
ugggacuauaggcacaugcuac

SEQ ID NO: 1037926 - RNA, 24 nt, Human
ugggacuauaggcacaugcuacca

SEQ ID NO: 1037927 - RNA, 25 nt, Human
uuuauaauccucccaccuccaccuc

SEQ ID NO: 1037928 - RNA, 19 nt, Human
aaaaaggcuuaaguaaaca

SEQ ID NO: 1037929 - RNA, 21 nt, Human
aaacuuucuccaaauauagaa

SEQ ID NO: 1037930 - RNA, 22 nt, Human
aaccuacaacugcucuaaaaaa

SEQ ID NO: 1037931 - RNA, 23 nt, Human
aagagguaaacaguggagccaag

SEQ ID NO: 1037932 - RNA, 22 nt, Human
aagcugaaauuauuuccaaaua

SEQ ID NO: 1037933 - RNA, 22 nt, Human
aagcuucaaggaaauaaccagc

SEQ ID NO: 1037934 - RNA, 23 nt, Human
aaggguuuucuuuuuauuguuuu

SEQ ID NO: 1037935 - RNA, 22 nt, Human
aagguauacuccuggccuaaaa

SEQ ID NO: 1037936 - RNA, 21 nt, Human
aaucugcuggaggcagugggc

SEQ ID NO: 1037937 - RNA, 23 nt, Human
aaugggggcagaaaaaaagggaa

SEQ ID NO: 1037938 - RNA, 24 nt, Human
aauuucugaaauccuucauaagca

SEQ ID NO: 1037939 - RNA, 23 nt, Human
acauagcaagagguaaacagugg

SEQ ID NO: 1037940 - RNA, 19 nt, Human
accuggcuguugaguacau

SEQ ID NO: 1037941 - RNA, 26 nt, Human
acuccaaauaaaacaaauaguaaaau

SEQ ID NO: 1037942 - RNA, 18 nt, Human
acuggaaagaaaacugca

SEQ ID NO: 1037943 - RNA, 23 nt, Human
agaaacugagaagucauagcuuu

SEQ ID NO: 1037944 - RNA, 23 nt, Human
agaaauauauauuuuugaaaugu

SEQ ID NO: 1037945 - RNA, 23 nt, Human
agaagucauagcuuucccuuaaa

SEQ ID NO: 1037946 - RNA, 21 nt, Human
agagaaaccagcuaaaacaaa

SEQ ID NO: 1037947 - RNA, 20 nt, Human
agcaaaagacacaaacuucc

SEQ ID NO: 1037948 - RNA, 21 nt, Human
agcaaaggggauauaagaugu

SEQ ID NO: 1037949 - RNA, 20 nt, Human
agccaaaacugcaaacauuu

SEQ ID NO: 1037950 - RNA, 23 nt, Human
auagaacagagaaaccagcuaaa

SEQ ID NO: 1037951 - RNA, 20 nt, Human
aucagauacauuauauacca

SEQ ID NO: 1037952 - RNA, 19 nt, Human
aucucauuuuuuacuacca

SEQ ID NO: 1037953 - RNA, 19 nt, Human
auuauuuauuguaaucaug

SEQ ID NO: 1037954 - RNA, 19 nt, Human
auuugggaaaauguuaaug

SEQ ID NO: 1037955 - RNA, 18 nt, Human
caaaaucagagcaguaga

SEQ ID NO: 1037956 - RNA, 23 nt, Human
caaaaugaacaugguacuucaua

SEQ ID NO: 1037957 - RNA, 18 nt, Human
caaaguaagaaugggggc

SEQ ID NO: 1037958 - RNA, 21 nt, Human
caaguaaauccacuguuagga

SEQ ID NO: 1037959 - RNA, 28 nt, Human
cacaaaaucagagcaguagaggacauac

SEQ ID NO: 1037960 - RNA, 25 nt, Human
cacaauaugcauaccuauuagcagg

SEQ ID NO: 1037961 - RNA, 19 nt, Human
cacuuacccccuccccucc

SEQ ID NO: 1037962 - RNA, 23 nt, Human
cagagaaaccagcuaaaacaaag

SEQ ID NO: 1037963 - RNA, 22 nt, Human
cagcaaaagacacaaacuucca

SEQ ID NO: 1037964 - RNA, 23 nt, Human
cagcaaaagacacaaacuuccaa

SEQ ID NO: 1037965 - RNA, 23 nt, Human
caggugauuuaucuuaaaaaucc

SEQ ID NO: 1037966 - RNA, 18 nt, Human
caguggcagagaguacug

SEQ ID NO: 1037967 - RNA, 21 nt, Human
cauucaucuuccuacaauucu

SEQ ID NO: 1037968 - RNA, 18 nt, Human
ccagcaaaagacacaaac

SEQ ID NO: 1037969 - RNA, 19 nt, Human
ccagcauuaguaccuccuc

SEQ ID NO: 1037970 - RNA, 18 nt, Human
cccccuccccuccacuuc

SEQ ID NO: 1037971 - RNA, 20 nt, Human
cccccuccccuccacuuccc

SEQ ID NO: 1037972 - RNA, 22 nt, Human
ccccuccccuccacuucccucc

SEQ ID NO: 1037973 - RNA, 26 nt, Human
cgcucugcugucgccgccugcgggaa

SEQ ID NO: 1037974 - RNA, 24 nt, Human
cggccgcgccucgagguccugccu

SEQ ID NO: 1037975 - RNA, 20 nt, Human
cgggagaaaauacauagcaa

SEQ ID NO: 1037976 - RNA, 19 nt, Human
cguaaguggguaaagguca

SEQ ID NO: 1037977 - RNA, 22 nt, Human
cuaaaugccaauaguacuaaca

SEQ ID NO: 1037978 - RNA, 19 nt, Human
cuccucaccugaaaaaggc

SEQ ID NO: 1037979 - RNA, 21 nt, Human
cucgagguccugccuuuccca

SEQ ID NO: 1037980 - RNA, 22 nt, Human
cugcgggaacugugacuccggu

SEQ ID NO: 1037981 - RNA, 21 nt, Human
cuucauaugggcccacuuuuc

SEQ ID NO: 1037982 - RNA, 23 nt, Human
cuuccaaucuuaauauuaaucug

SEQ ID NO: 1037983 - RNA, 20 nt, Human
cuuccucucaauuuuucugu

SEQ ID NO: 1037984 - RNA, 20 nt, Human
gaccacaauuauauaacuug

SEQ ID NO: 1037985 - RNA, 18 nt, Human
gcaaauaugaagagaagu

SEQ ID NO: 1037986 - RNA, 21 nt, Human
gccgcgccucgagguccugcc

SEQ ID NO: 1037987 - RNA, 21 nt, Human
gccgcgccucgagguccugcc

SEQ ID NO: 1037988 - RNA, 19 nt, Human
ggagauggcaccuagggaa

SEQ ID NO: 1037989 - RNA, 21 nt, Human
gggaggcuguugagggcuuug

SEQ ID NO: 1037990 - RNA, 21 nt, Human
gucauagcuuucccuuaaauu

SEQ ID NO: 1037991 - RNA, 21 nt, Human
guugcauuugcagaggauguu

SEQ ID NO: 1037992 - RNA, 22 nt, Human
uaaaaaaaacuccacuaggaga

SEQ ID NO: 1037993 - RNA, 19 nt, Human
uaaaacacagggcacaaac

SEQ ID NO: 1037994 - RNA, 24 nt, Human
uaaaacacagggcacaaacuuucu

SEQ ID NO: 1037995 - RNA, 19 nt, Human
uaaaauaaacaauaaagcc

SEQ ID NO: 1037996 - RNA, 21 nt, Human
uaagaaugggggcagaaaaaa

SEQ ID NO: 1037997 - RNA, 19 nt, Human
uaaguggguaaaggucaag

SEQ ID NO: 1037998 - RNA, 19 nt, Human
uaaucaauaaugccuagca

SEQ ID NO: 1037999 - RNA, 19 nt, Human
uacacccaaccaaacacag

SEQ ID NO: 1038000 - RNA, 26 nt, Human
uacauuauauaccauaauuauagccc

SEQ ID NO: 1038001 - RNA, 24 nt, Human
uacugcuuuuaaaaaucaugcaaa

SEQ ID NO: 1038002 - RNA, 23 nt, Human
uacuucauaugggcccacuuuuc

SEQ ID NO: 1038003 - RNA, 21 nt, Human
uagaacagagaaaccagcuaa

SEQ ID NO: 1038004 - RNA, 24 nt, Human
uagcaggagauuggauuuuuauuu

SEQ ID NO: 1038005 - RNA, 26 nt, Human
uaggagcuggaauaaagaaggcaugc

SEQ ID NO: 1038006 - RNA, 24 nt, Human
uaggaguacugcuuuuaaaaauca

SEQ ID NO: 1038007 - RNA, 22 nt, Human
uauagaaagaacuaucuauggu

SEQ ID NO: 1038008 - RNA, 22 nt, Human
uauagauuaaaaaacuuaaaac

SEQ ID NO: 1038009 - RNA, 22 nt, Human
uaugcuaucaaaagcugacauu

SEQ ID NO: 1038010 - RNA, 19 nt, Human
uauuugagggaagaaaaca

SEQ ID NO: 1038011 - RNA, 20 nt, Human
uauuugggaaaauguuaaug

SEQ ID NO: 1038012 - RNA, 21 nt, Human
ucaaaauauuaucacacaggu

SEQ ID NO: 1038013 - RNA, 25 nt, Human
ucaauuaagcugaaauuauuuccaa

SEQ ID NO: 1038014 - RNA, 22 nt, Human
ucacuuacccccuccccuccaa

SEQ ID NO: 1038015 - RNA, 24 nt, Human
ucaugguuuauagaaaucacauuu

SEQ ID NO: 1038016 - RNA, 21 nt, Human
ucauugguagcaaauugaaau

SEQ ID NO: 1038017 - RNA, 24 nt, Human
uccaaauauagaaaauaguugaaa

SEQ ID NO: 1038018 - RNA, 23 nt, Human
uccacuucccuccccguacccac

SEQ ID NO: 1038019 - RNA, 19 nt, Human
uccagcaaaagacacaaac

SEQ ID NO: 1038020 - RNA, 19 nt, Human
uccccuacccuaucacuua

SEQ ID NO: 1038021 - RNA, 22 nt, Human
uccugccaaaauguaguuuucu

SEQ ID NO: 1038022 - RNA, 21 nt, Human
ucuauuucugaaguuuuuugg

SEQ ID NO: 1038023 - RNA, 23 nt, Human
ucuucacccacaaaauaaaaucc

SEQ ID NO: 1038024 - RNA, 21 nt, Human
ucuuccuacaauucuucaccc

SEQ ID NO: 1038025 - RNA, 20 nt, Human
ugaaaucauaagucuucuaa

SEQ ID NO: 1038026 - RNA, 24 nt, Human
ugaagagaaguuauuuuggcauag

SEQ ID NO: 1038027 - RNA, 25 nt, Human
ugagaaaauacucaaacacgguaaa

SEQ ID NO: 1038028 - RNA, 22 nt, Human
ugagaacacagagcacuuaguc

SEQ ID NO: 1038029 - RNA, 21 nt, Human
ugauauacacagaacauagga

SEQ ID NO: 1038030 - RNA, 22 nt, Human
ugcaauagaaaauauuuguuac

SEQ ID NO: 1038031 - RNA, 19 nt, Human
ugcauacauaucaucauaa

SEQ ID NO: 1038032 - RNA, 20 nt, Human
ugcauacauaucaucauaua

SEQ ID NO: 1038033 - RNA, 18 nt, Human
ugcaugccugggacaaag

SEQ ID NO: 1038034 - RNA, 27 nt, Human
ugccugggacaaaguaagaaugggggc

SEQ ID NO: 1038035 - RNA, 23 nt, Human
uggaaagaaaacugcaauagaaa

SEQ ID NO: 1038036 - RNA, 23 nt, Human
uggauaucugauaaaauucauua

SEQ ID NO: 1038037 - RNA, 21 nt, Human
uggcagagaguacugguacca

SEQ ID NO: 1038038 - RNA, 24 nt, Human
uuaaaaaacuuaaaacuaaaaaag

SEQ ID NO: 1038039 - RNA, 24 nt, Human
uuaagcugaaauuauuuccaaaua

SEQ ID NO: 1038040 - RNA, 22 nt, Human
uuagccaaaacugcaaacauuu

SEQ ID NO: 1038041 - RNA, 22 nt, Human
uuuaaaauaaacaauaaagccc

SEQ ID NO: 1038042 - RNA, 19 nt, Human
uuuacuucuuugguaccca

SEQ ID NO: 1038043 - RNA, 19 nt, Human
uuugccucuucucauuggu

SEQ ID NO: 1038044 - RNA, 19 nt, Human
aacauaguagaccuacagc

SEQ ID NO: 1038045 - RNA, 21 nt, Human
aauagcacuuccaguuucucu

SEQ ID NO: 1038046 - RNA, 22 nt, Human
aguaaauaauuaagaagacuaa

SEQ ID NO: 1038047 - RNA, 23 nt, Human
caggcacaacuguuuugucucuu

SEQ ID NO: 1038048 - RNA, 23 nt, Human
gugaaaaguaagugagaaauuaa

SEQ ID NO: 1038049 - RNA, 22 nt, Human
uaaaguauuuaaaaucuguacu

SEQ ID NO: 1038050 - RNA, 21 nt, Human
uauacagugucuccucauuug

SEQ ID NO: 1038051 - RNA, 19 nt, Human
ucuggauacuccuugauuc

SEQ ID NO: 1038052 - RNA, 23 nt, Human
ugagaaauuaagaguuguggaag

SEQ ID NO: 1038053 - RNA, 23 nt, Human
uguacuaaaguuacuucaggcac

SEQ ID NO: 1038054 - RNA, 18 nt, Human
ugucuccucauuugauau

SEQ ID NO: 1038055 - RNA, 20 nt, Human
aauuuccaaccccucagcuc

SEQ ID NO: 1038056 - RNA, 21 nt, Human
caccauaggacaaggagcaga

SEQ ID NO: 1038057 - RNA, 19 nt, Human
ggacaaggagcagaugcuu

SEQ ID NO: 1038058 - RNA, 20 nt, Human
uaaaauguccaaauguuacc

SEQ ID NO: 1038059 - RNA, 21 nt, Human
uaccgcaucuuccguaaaaug

SEQ ID NO: 1038060 - RNA, 18 nt, Human
ccccuguggcuccacguc

SEQ ID NO: 1038061 - RNA, 25 nt, Human
ccgggcccacguagagaggggcugg

SEQ ID NO: 1038062 - RNA, 22 nt, Human
cucccgggcccacguagagagg

SEQ ID NO: 1038063 - RNA, 23 nt, Human
cuugcugucauucaaagccaaac

SEQ ID NO: 1038064 - RNA, 20 nt, Human
gaguauaggguaccacacag

SEQ ID NO: 1038065 - RNA, 21 nt, Human
gcuggggcacgcccugcaggg

SEQ ID NO: 1038066 - RNA, 18 nt, Human
gggcuggggcacgcccug

SEQ ID NO: 1038067 - RNA, 18 nt, Human
guagagaggggcuggggc

SEQ ID NO: 1038068 - RNA, 23 nt, Human
gucauucaaagccaaaccaccgg

SEQ ID NO: 1038069 - RNA, 20 nt, Human
guggcuccacgucuuuaccc

SEQ ID NO: 1038070 - RNA, 21 nt, Human
uggcugaauaaacucagacac

SEQ ID NO: 1038071 - RNA, 21 nt, Human
ugucuuagucuucugggagua

SEQ ID NO: 1038072 - RNA, 25 nt, Human
aaaacaaagaacacuuuauucccuu

SEQ ID NO: 1038073 - RNA, 24 nt, Human
aacacagaccagagggguggccca

SEQ ID NO: 1038074 - RNA, 20 nt, Human
aacuagccaccccugugccc

SEQ ID NO: 1038075 - RNA, 18 nt, Human
aagcccuggcacugagaa

SEQ ID NO: 1038076 - RNA, 18 nt, Human
aagcugggguaugcagag

SEQ ID NO: 1038077 - RNA, 24 nt, Human
aaggagcccuggggaaggagggcg

SEQ ID NO: 1038078 - RNA, 23 nt, Human
aaggggcuggagugucugccuca

SEQ ID NO: 1038079 - RNA, 26 nt, Human
acacagaccagagggguggcccacca

SEQ ID NO: 1038080 - RNA, 21 nt, Human
acagugugggcaugagggucc

SEQ ID NO: 1038081 - RNA, 19 nt, Human
accaggcugugcaaagccc

SEQ ID NO: 1038082 - RNA, 22 nt, Human
accaggcugugcaaagcccagu

SEQ ID NO: 1038083 - RNA, 18 nt, Human
acccgcgcuggucccucg

SEQ ID NO: 1038084 - RNA, 19 nt, Human
agccaggccaggugcuggc

SEQ ID NO: 1038085 - RNA, 23 nt, Human
agcccuccucugccccaggcccc

SEQ ID NO: 1038086 - RNA, 21 nt, Human
agcugaucagcaaaauucagc

SEQ ID NO: 1038087 - RNA, 19 nt, Human
aggcagccugaggcccaga

SEQ ID NO: 1038088 - RNA, 27 nt, Human
aggcugugcaaagcccagucgguuccc

SEQ ID NO: 1038089 - RNA, 18 nt, Human
agggugcaggguccccag

SEQ ID NO: 1038090 - RNA, 26 nt, Human
agugcaguucucggccaaaacuaccc

SEQ ID NO: 1038091 - RNA, 23 nt, Human
aucacacuugaacuguccagacc

SEQ ID NO: 1038092 - RNA, 21 nt, Human
augguggggauggcggcagca

SEQ ID NO: 1038093 - RNA, 25 nt, Human
auuucuccuugccacagcuucgagg

SEQ ID NO: 1038094 - RNA, 26 nt, Human
cacuuuauucccuugacaguuucugu

SEQ ID NO: 1038095 - RNA, 22 nt, Human
cagagggguggcccaccacccc

SEQ ID NO: 1038096 - RNA, 21 nt, Human
cagcaaaauucagcccacguc

SEQ ID NO: 1038097 - RNA, 23 nt, Human
cagcgacaccaggcugugcaaag

SEQ ID NO: 1038098 - RNA, 22 nt, Human
caggguccccaguucacccucc

SEQ ID NO: 1038099 - RNA, 25 nt, Human
caguggcauguggagaagcuggggu

SEQ ID NO: 1038100 - RNA, 21 nt, Human
caucacacuugaacuguccag

SEQ ID NO: 1038101 - RNA, 23 nt, Human
caucagagacccccgggagccag

SEQ ID NO: 1038102 - RNA, 24 nt, Human
ccaacuagccaccccugugcccac

SEQ ID NO: 1038103 - RNA, 19 nt, Human
ccaggccaggugcuggcug

SEQ ID NO: 1038104 - RNA, 18 nt, Human
ccaggugcuggcugcugc

SEQ ID NO: 1038105 - RNA, 26 nt, Human
ccccaacuagccaccccugugcccac

SEQ ID NO: 1038106 - RNA, 21 nt, Human
ccccaggccccaacuagccac

SEQ ID NO: 1038107 - RNA, 21 nt, Human
ccccaggccccaacuagccac

SEQ ID NO: 1038108 - RNA, 18 nt, Human
cccccgggagccagccug

SEQ ID NO: 1038109 - RNA, 21 nt, Human
ccccugaggccccucgccggg

SEQ ID NO: 1038110 - RNA, 22 nt, Human
ccccugaggccccucgccgggc

SEQ ID NO: 1038111 - RNA, 20 nt, Human
cccugaggccccucgccggg

SEQ ID NO: 1038112 - RNA, 19 nt, Human
ccggcgaggccgccuuucc

SEQ ID NO: 1038113 - RNA, 23 nt, Human
cgacucaggggccaauuuauguc

SEQ ID NO: 1038114 - RNA, 21 nt, Human
cgagcgcgcggugccggggcu

SEQ ID NO: 1038115 - RNA, 24 nt, Human
cgcagcaucccagcaggaagcagg

SEQ ID NO: 1038116 - RNA, 18 nt, Human
cgggagccagccugcagg

SEQ ID NO: 1038117 - RNA, 19 nt, Human
cuaacacagaccagagggg

SEQ ID NO: 1038118 - RNA, 21 nt, Human
cuagacccgcgcuggucccuc

SEQ ID NO: 1038119 - RNA, 23 nt, Human
cucgcagcaucccagcaggaagc

SEQ ID NO: 1038120 - RNA, 18 nt, Human
cucgcuggauccccuccg

SEQ ID NO: 1038121 - RNA, 21 nt, Human
cuggagguguuccaggccugg

SEQ ID NO: 1038122 - RNA, 19 nt, Human
gaauaaucucugagcuucg

SEQ ID NO: 1038123 - RNA, 24 nt, Human
gaguggcagcagcugggguacccc

SEQ ID NO: 1038124 - RNA, 20 nt, Human
gcacugagaaugccugggag

SEQ ID NO: 1038125 - RNA, 22 nt, Human
gcagcagcuagacccgcgcugg

SEQ ID NO: 1038126 - RNA, 24 nt, Human
gcccacgucugauagacuccacag

SEQ ID NO: 1038127 - RNA, 21 nt, Human
gccgggcugggcgccgucggg

SEQ ID NO: 1038128 - RNA, 20 nt, Human
gccucaguuuccaggauaac

SEQ ID NO: 1038129 - RNA, 22 nt, Human
gcggcagcagcuagacccgcgc

SEQ ID NO: 1038130 - RNA, 18 nt, Human
gcuggagugucugccuca

SEQ ID NO: 1038131 - RNA, 20 nt, Human
gcugggcgccgucggggucc

SEQ ID NO: 1038132 - RNA, 21 nt, Human
ggaagcagggcaaucgacuca

SEQ ID NO: 1038133 - RNA, 19 nt, Human
ggaaggagggcggggugag

SEQ ID NO: 1038134 - RNA, 23 nt, Human
ggacaggcagccugaggcccaga

SEQ ID NO: 1038135 - RNA, 19 nt, Human
ggagggugcagggucccca

SEQ ID NO: 1038136 - RNA, 20 nt, Human
ggggauccuggcuggcggug

SEQ ID NO: 1038137 - RNA, 19 nt, Human
gggggucccauacuguucu

SEQ ID NO: 1038138 - RNA, 18 nt, Human
gguggcccaccacccccc

SEQ ID NO: 1038139 - RNA, 18 nt, Human
guccucccccugaggccc

SEQ ID NO: 1038140 - RNA, 18 nt, Human
gugcagcccuccucugcc

SEQ ID NO: 1038141 - RNA, 18 nt, Human
uacagugugggcaugagg

SEQ ID NO: 1038142 - RNA, 21 nt, Human
uauggacaggcagccugaggc

SEQ ID NO: 1038143 - RNA, 22 nt, Human
uauuucauagaugagaacacug

SEQ ID NO: 1038144 - RNA, 23 nt, Human
ucagccaggccaggugcuggcug

SEQ ID NO: 1038145 - RNA, 20 nt, Human
ucagggaugguggggauggc

SEQ ID NO: 1038146 - RNA, 20 nt, Human
uccauggcuucccggagggu

SEQ ID NO: 1038147 - RNA, 25 nt, Human
uccauggcuucccggagggugcagg

SEQ ID NO: 1038148 - RNA, 19 nt, Human
ucccagcaggaagcagggc

SEQ ID NO: 1038149 - RNA, 20 nt, Human
uccccgagcgcgcggugccg

SEQ ID NO: 1038150 - RNA, 23 nt, Human
ucccucggcggcagcugacucgc

SEQ ID NO: 1038151 - RNA, 19 nt, Human
uccuccucguccucccccu

SEQ ID NO: 1038152 - RNA, 19 nt, Human
uccuccuggcgcggagccc

SEQ ID NO: 1038153 - RNA, 22 nt, Human
uccuuauuucauagaugagaac

SEQ ID NO: 1038154 - RNA, 22 nt, Human
ucggcggcagcugacucgcugg

SEQ ID NO: 1038155 - RNA, 18 nt, Human
ucugcugagcccucugca

SEQ ID NO: 1038156 - RNA, 19 nt, Human
ugacucgcuggauccccuc

SEQ ID NO: 1038157 - RNA, 23 nt, Human
ugagaaggagcccuggggaagga

SEQ ID NO: 1038158 - RNA, 24 nt, Human
ugagaaggagcccuggggaaggag

SEQ ID NO: 1038159 - RNA, 22 nt, Human
ugaggccccucgccgggcuggg

SEQ ID NO: 1038160 - RNA, 21 nt, Human
ugcaauggccucagccaggcc

SEQ ID NO: 1038161 - RNA, 28 nt, Human
ugcagcccuccucugccccaggccccaa

SEQ ID NO: 1038162 - RNA, 20 nt, Human
ugccccaggccccaacuagc

SEQ ID NO: 1038163 - RNA, 21 nt, Human
ugccccaggccccaacuagcc

SEQ ID NO: 1038164 - RNA, 21 nt, Human
ugcugggaauaaucucugagc

SEQ ID NO: 1038165 - RNA, 21 nt, Human
uggacaggcagccugaggccc

SEQ ID NO: 1038166 - RNA, 21 nt, Human
uggagguguuccaggccuggu

SEQ ID NO: 1038167 - RNA, 23 nt, Human
uggagguguuccaggccugguga

SEQ ID NO: 1038168 - RNA, 25 nt, Human
ugguaggugggccggagacucaguu

SEQ ID NO: 1038169 - RNA, 20 nt, Human
uggugcagcccuccucugcc

SEQ ID NO: 1038170 - RNA, 23 nt, Human
uucauagaugagaacacugaggc

SEQ ID NO: 1038171 - RNA, 18 nt, Human
uuccaggccuggugaggg

SEQ ID NO: 1038172 - RNA, 21 nt, Human
uuccucugucccuaacacaga

SEQ ID NO: 1038173 - RNA, 19 nt, Human
uucucugcugagcccucug

SEQ ID NO: 1038174 - RNA, 19 nt, Human
uugcuccccacccuagucc

SEQ ID NO: 1038175 - RNA, 21 nt, Human
uuugcuggggagcagagggac

SEQ ID NO: 1038176 - RNA, 20 nt, Human
uuuuauggacaggcagccug

SEQ ID NO: 1038177 - RNA, 22 nt, Human
acggagcccugcagcccacacu

SEQ ID NO: 1038178 - RNA, 22 nt, Human
agaagucagcuccgugggaacc

SEQ ID NO: 1038179 - RNA, 18 nt, Human
agcuucucagugcugggg

SEQ ID NO: 1038180 - RNA, 19 nt, Human
caaacgccggguuuaaugu

SEQ ID NO: 1038181 - RNA, 22 nt, Human
cacaggaaggaaauguagcuuc

SEQ ID NO: 1038182 - RNA, 19 nt, Human
caccaggaggcagcccggg

SEQ ID NO: 1038183 - RNA, 23 nt, Human
cagggccaggccucaccugggga

SEQ ID NO: 1038184 - RNA, 21 nt, Human
caugguggggcagggccaggc

SEQ ID NO: 1038185 - RNA, 18 nt, Human
ccaggccucaccugggga

SEQ ID NO: 1038186 - RNA, 18 nt, Human
ccgcggcgcggaaccagc

SEQ ID NO: 1038187 - RNA, 20 nt, Human
ccugcagcccacacugcugu

SEQ ID NO: 1038188 - RNA, 22 nt, Human
cugcaccugucgcggcggccgc

SEQ ID NO: 1038189 - RNA, 22 nt, Human
cugcugcaccugucgcggcggc

SEQ ID NO: 1038190 - RNA, 22 nt, Human
gcccugcagcccacacugcugu

SEQ ID NO: 1038191 - RNA, 18 nt, Human
ggacaagggcagcagucc

SEQ ID NO: 1038192 - RNA, 22 nt, Human
ggacacuccucggggacaaggg

SEQ ID NO: 1038193 - RNA, 20 nt, Human
ggccaccaccaggaggcagc

SEQ ID NO: 1038194 - RNA, 20 nt, Human
guggcugcgcgggacacucc

SEQ ID NO: 1038195 - RNA, 24 nt, Human
ugaaacaaacgccggguuuaaugu

SEQ ID NO: 1038196 - RNA, 22 nt, Human
ugcaccugucgcggcggccgcg

SEQ ID NO: 1038197 - RNA, 22 nt, Human
uggcugcgcgggacacuccucg

SEQ ID NO: 1038198 - RNA, 22 nt, Human
uggggcagggccaggccucacc

SEQ ID NO: 1038199 - RNA, 21 nt, Human
cucucuggaucccuguaaaca

SEQ ID NO: 1038200 - RNA, 19 nt, Human
uaugaaaauggggaagggu

SEQ ID NO: 1038201 - RNA, 20 nt, Human
ucuauguagcuagugucuga

SEQ ID NO: 1038202 - RNA, 18 nt, Human
uguaaacauagucuaugu

SEQ ID NO: 1038203 - RNA, 20 nt, Human
uucccacauacacguauucc

SEQ ID NO: 1038204 - RNA, 22 nt, Human
uuuuuuuuuuuuuuuugcuuuu

SEQ ID NO: 1038205 - RNA, 24 nt, Human
uuuuuuuuuuuuuuuugcuuuuaa

SEQ ID NO: 1038206 - RNA, 22 nt, Human
aaaacagcagacuggguaaaag

SEQ ID NO: 1038207 - RNA, 23 nt, Human
aaaagcaaugaggaaggaaaugc

SEQ ID NO: 1038208 - RNA, 23 nt, Human
aaacagcagacuggguaaaagca

SEQ ID NO: 1038209 - RNA, 19 nt, Human
aggaaggaaaugcaaugaa

SEQ ID NO: 1038210 - RNA, 22 nt, Human
aggaaggaaaugcaaugaauaa

SEQ ID NO: 1038211 - RNA, 18 nt, Human
aggcaaaggaggugaggc

SEQ ID NO: 1038212 - RNA, 19 nt, Human
aggcaaaggaggugaggcu

SEQ ID NO: 1038213 - RNA, 24 nt, Human
caaaacagcagacuggguaaaagc

SEQ ID NO: 1038214 - RNA, 23 nt, Human
cagaaagcucaggcagaaaauca

SEQ ID NO: 1038215 - RNA, 23 nt, Human
cagaagauaaaauauguaggcac

SEQ ID NO: 1038216 - RNA, 18 nt, Human
ccaaaacagcagacuggg

SEQ ID NO: 1038217 - RNA, 20 nt, Human
gaacucagaaagcucaggca

SEQ ID NO: 1038218 - RNA, 21 nt, Human
gaacucagaaagcucaggcag

SEQ ID NO: 1038219 - RNA, 19 nt, Human
gagaggcaaaggaggugag

SEQ ID NO: 1038220 - RNA, 22 nt, Human
gcagacuggguaaaagcaauga

SEQ ID NO: 1038221 - RNA, 19 nt, Human
gcuucccaaaacagcagac

SEQ ID NO: 1038222 - RNA, 20 nt, Human
gcuucuuugguucagagagg

SEQ ID NO: 1038223 - RNA, 24 nt, Human
uaaaagcaaugaggaaggaaaugc

SEQ ID NO: 1038224 - RNA, 18 nt, Human
ucagugagaucagaagau

SEQ ID NO: 1038225 - RNA, 23 nt, Human
uccugucuaucuuccucuugagg

SEQ ID NO: 1038226 - RNA, 19 nt, Human
ugaggaaggaaaugcaaug

SEQ ID NO: 1038227 - RNA, 23 nt, Human
uugguucagagaggcaaaggagg

SEQ ID NO: 1038228 - RNA, 18 nt, Human
aaacagaagguguccucc

SEQ ID NO: 1038229 - RNA, 22 nt, Human
aacagcacgagcccaccaucca

SEQ ID NO: 1038230 - RNA, 21 nt, Human
aagguuggggggcuugggccu

SEQ ID NO: 1038231 - RNA, 21 nt, Human
accauccaugcuccucagagc

SEQ ID NO: 1038232 - RNA, 23 nt, Human
accgcccacugcacuacccaccc

SEQ ID NO: 1038233 - RNA, 23 nt, Human
accggcuccccaggcuggucucg

SEQ ID NO: 1038234 - RNA, 19 nt, Human
accucagugcccggcaccg

SEQ ID NO: 1038235 - RNA, 19 nt, Human
acucagcauccuccacccc

SEQ ID NO: 1038236 - RNA, 19 nt, Human
acugggcccucuagggcaa

SEQ ID NO: 1038237 - RNA, 22 nt, Human
agaaaacucuucagcacagccc

SEQ ID NO: 1038238 - RNA, 26 nt, Human
agaggccaaaguggauggugggcacc

SEQ ID NO: 1038239 - RNA, 19 nt, Human
agaugcucuuccaccucuc

SEQ ID NO: 1038240 - RNA, 19 nt, Human
agcaauacaguacccuggc

SEQ ID NO: 1038241 - RNA, 21 nt, Human
agcaccagcuggucagaggug

SEQ ID NO: 1038242 - RNA, 18 nt, Human
agcagaaggugcugaggg

SEQ ID NO: 1038243 - RNA, 20 nt, Human
agcaggagguggucagcugg

SEQ ID NO: 1038244 - RNA, 21 nt, Human
agcccugggccagaugcagcc

SEQ ID NO: 1038245 - RNA, 18 nt, Human
agcucaccugcaccugca

SEQ ID NO: 1038246 - RNA, 20 nt, Human
agcugcgcaccucagugccc

SEQ ID NO: 1038247 - RNA, 22 nt, Human
agcugggccucagcaaagcccg

SEQ ID NO: 1038248 - RNA, 21 nt, Human
aggaaggacagauugcucagg

SEQ ID NO: 1038249 - RNA, 21 nt, Human
aggacaggcaugucuggguca

SEQ ID NO: 1038250 - RNA, 23 nt, Human
aggagguccuggugggucagcac

SEQ ID NO: 1038251 - RNA, 19 nt, Human
aggcagccagagaguggga

SEQ ID NO: 1038252 - RNA, 23 nt, Human
aggcauggcuccgggccucaggg

SEQ ID NO: 1038253 - RNA, 25 nt, Human
aggccgaggccacauccagcgagaa

SEQ ID NO: 1038254 - RNA, 21 nt, Human
aggggggcucccaggacuaca

SEQ ID NO: 1038255 - RNA, 26 nt, Human
aggguugaccuggaugggcaggaggu

SEQ ID NO: 1038256 - RNA, 27 nt, Human
agguaccuggcacuguugagacucuug

SEQ ID NO: 1038257 - RNA, 21 nt, Human
aggugggcuguggugagggcc

SEQ ID NO: 1038258 - RNA, 19 nt, Human
aguccaggucauaggccug

SEQ ID NO: 1038259 - RNA, 21 nt, Human
agugcugugggucagugcuca

SEQ ID NO: 1038260 - RNA, 18 nt, Human
aguguccggcugcccucc

SEQ ID NO: 1038261 - RNA, 18 nt, Human
auaggccuggagaaccuc

SEQ ID NO: 1038262 - RNA, 22 nt, Human
auccagcgagaaggcauggcuc

SEQ ID NO: 1038263 - RNA, 19 nt, Human
caaagcccgaaucagcauu

SEQ ID NO: 1038264 - RNA, 20 nt, Human
caaccaagccaucacugaca

SEQ ID NO: 1038265 - RNA, 22 nt, Human
caagaugggcauggcagagccc

SEQ ID NO: 1038266 - RNA, 19 nt, Human
caaggcccgggagaguggg

SEQ ID NO: 1038267 - RNA, 24 nt, Human
cacacccaccacccucgggcacca

SEQ ID NO: 1038268 - RNA, 18 nt, Human
caccacucagcauccucc

SEQ ID NO: 1038269 - RNA, 27 nt, Human
caccagguagccggcacucggugggcu

SEQ ID NO: 1038270 - RNA, 25 nt, Human
cacccaggccgaggccacauccagc

SEQ ID NO: 1038271 - RNA, 26 nt, Human
caccccaccagcccccugcuucugca

SEQ ID NO: 1038272 - RNA, 23 nt, Human
caccggcuccccaggcuggucuc

SEQ ID NO: 1038273 - RNA, 19 nt, Human
caccugcaccugcagaucc

SEQ ID NO: 1038274 - RNA, 24 nt, Human
cacgcagcaccaucaccagguagc

SEQ ID NO: 1038275 - RNA, 24 nt, Human
cacgccaagucaaccucccauggc

SEQ ID NO: 1038276 - RNA, 22 nt, Human
cacugcacuacccacccauugc

SEQ ID NO: 1038277 - RNA, 23 nt, Human
cagaggcuucuguguguguucca

SEQ ID NO: 1038278 - RNA, 19 nt, Human
cagaguaaccauccaugcu

SEQ ID NO: 1038279 - RNA, 20 nt, Human
cagaugcucuuccaccucuc

SEQ ID NO: 1038280 - RNA, 18 nt, Human
cagcagaaggugcugagg

SEQ ID NO: 1038281 - RNA, 22 nt, Human
cagcagaaggugcugagggucc

SEQ ID NO: 1038282 - RNA, 18 nt, Human
cagcaggagaacucaguc

SEQ ID NO: 1038283 - RNA, 20 nt, Human
cagcaggagaacucagucac

SEQ ID NO: 1038284 - RNA, 20 nt, Human
cagcccccugcuucugcagc

SEQ ID NO: 1038285 - RNA, 18 nt, Human
cagccgccaccuacccca

SEQ ID NO: 1038286 - RNA, 20 nt, Human
cagccgccaccuaccccagg

SEQ ID NO: 1038287 - RNA, 21 nt, Human
cagcugggccucagcaaagcc

SEQ ID NO: 1038288 - RNA, 21 nt, Human
cagcugggucugcaugaagcu

SEQ ID NO: 1038289 - RNA, 20 nt, Human
cagcuggucccuucugaucu

SEQ ID NO: 1038290 - RNA, 22 nt, Human
caggaucaccauaaggcugcca

SEQ ID NO: 1038291 - RNA, 18 nt, Human
caggcaggcaaggcagcc

SEQ ID NO: 1038292 - RNA, 21 nt, Human
cagggccaucguggaugaagc

SEQ ID NO: 1038293 - RNA, 19 nt, Human
caggguuccuucauccuga

SEQ ID NO: 1038294 - RNA, 21 nt, Human
cagguucuccacgguguccuc

SEQ ID NO: 1038295 - RNA, 27 nt, Human
cauccuccaccccaccagcccccugcu

SEQ ID NO: 1038296 - RNA, 19 nt, Human
cauccugggugaagcccug

SEQ ID NO: 1038297 - RNA, 22 nt, Human
caugaagcugcgcaccucaguc

SEQ ID NO: 1038298 - RNA, 21 nt, Human
cauggaccacagguggcccuc

SEQ ID NO: 1038299 - RNA, 18 nt, Human
ccaccuaccccaggccac

SEQ ID NO: 1038300 - RNA, 21 nt, Human
ccacgaggacaggcaugucug

SEQ ID NO: 1038301 - RNA, 18 nt, Human
ccacugcacuacccaccc

SEQ ID NO: 1038302 - RNA, 19 nt, Human
ccagaugcagcccugugcu

SEQ ID NO: 1038303 - RNA, 23 nt, Human
ccaggcaggcaaggcagccagag

SEQ ID NO: 1038304 - RNA, 24 nt, Human
cccaccacucagcauccuccaccc

SEQ ID NO: 1038305 - RNA, 20 nt, Human
ccccaugccgggguggcucc

SEQ ID NO: 1038306 - RNA, 20 nt, Human
cccccugcuucugcagcucc

SEQ ID NO: 1038307 - RNA, 26 nt, Human
cccccugcuucugcagcucccugaac

SEQ ID NO: 1038308 - RNA, 25 nt, Human
cccgcaccacaugguagagcaggag

SEQ ID NO: 1038309 - RNA, 21 nt, Human
cccuccgcaggcaugagggca

SEQ ID NO: 1038310 - RNA, 19 nt, Human
cccugaccgucugacagca

SEQ ID NO: 1038311 - RNA, 18 nt, Human
ccgaggccacauccagcg

SEQ ID NO: 1038312 - RNA, 18 nt, Human
ccggccuccaacucccag

SEQ ID NO: 1038313 - RNA, 23 nt, Human
ccggcuccccaggcuggucucgg

SEQ ID NO: 1038314 - RNA, 27 nt, Human
ccguccagggccccucuggccuaaugg

SEQ ID NO: 1038315 - RNA, 19 nt, Human
ccucaggccccagaggcuu

SEQ ID NO: 1038316 - RNA, 23 nt, Human
ccuccgggugguucucuugaucu

SEQ ID NO: 1038317 - RNA, 19 nt, Human
ccuccguccagggccccuc

SEQ ID NO: 1038318 - RNA, 23 nt, Human
ccugaaccaccucacaguggaag

SEQ ID NO: 1038319 - RNA, 25 nt, Human
ccugugcugcgguggauuuguaugg

SEQ ID NO: 1038320 - RNA, 18 nt, Human
ccuugugcugggccagcu

SEQ ID NO: 1038321 - RNA, 20 nt, Human
ccuugugcugggccagcuuc

SEQ ID NO: 1038322 - RNA, 19 nt, Human
cgccaccuaccccaggcca

SEQ ID NO: 1038323 - RNA, 20 nt, Human
cggggggcuggccugcaguc

SEQ ID NO: 1038324 - RNA, 21 nt, Human
cggggggcuggccugcagucc

SEQ ID NO: 1038325 - RNA, 18 nt, Human
cucagcauccuccacccc

SEQ ID NO: 1038326 - RNA, 26 nt, Human
cucagggcgggagugcagguagagga

SEQ ID NO: 1038327 - RNA, 18 nt, Human
cuccaccccaccagcccc

SEQ ID NO: 1038328 - RNA, 25 nt, Human
cuccagcaccugcaggccaaggccc

SEQ ID NO: 1038329 - RNA, 20 nt, Human
cuccagguagcugaggacuc

SEQ ID NO: 1038330 - RNA, 18 nt, Human
cucccagcaggagaacuc

SEQ ID NO: 1038331 - RNA, 19 nt, Human
cuccgcaggcaugagggca

SEQ ID NO: 1038332 - RNA, 19 nt, Human
cuccuccuggcccaggaca

SEQ ID NO: 1038333 - RNA, 19 nt, Human
cuccugggcuaccuccagc

SEQ ID NO: 1038334 - RNA, 21 nt, Human
cugaggacuccucaguucgug

SEQ ID NO: 1038335 - RNA, 22 nt, Human
cugcaccugcagauccagguuc

SEQ ID NO: 1038336 - RNA, 23 nt, Human
cugcagccucagcuccuccuggc

SEQ ID NO: 1038337 - RNA, 24 nt, Human
cugcgguggauuuguauggccagc

SEQ ID NO: 1038338 - RNA, 24 nt, Human
cugcuggcggcacugccuccuggg

SEQ ID NO: 1038339 - RNA, 24 nt, Human
cugcuggcucugaggcucuggcug

SEQ ID NO: 1038340 - RNA, 20 nt, Human
cugcuggggucugcagccuc

SEQ ID NO: 1038341 - RNA, 19 nt, Human
cuggaggccccgcaccaca

SEQ ID NO: 1038342 - RNA, 22 nt, Human
cuggaggccccgcaccacaugg

SEQ ID NO: 1038343 - RNA, 21 nt, Human
cugggugaagcccugaccguc

SEQ ID NO: 1038344 - RNA, 24 nt, Human
cuuguccugugucccacgccaagu

SEQ ID NO: 1038345 - RNA, 19 nt, Human
gaacagcacgagcccacca

SEQ ID NO: 1038346 - RNA, 23 nt, Human
gaacucagucaccggcuccccag

SEQ ID NO: 1038347 - RNA, 21 nt, Human
gaagagccggccuagcuggag

SEQ ID NO: 1038348 - RNA, 24 nt, Human
gaaggugcugaggguccuggcuug

SEQ ID NO: 1038349 - RNA, 19 nt, Human
gacuucuaggggggcuccc

SEQ ID NO: 1038350 - RNA, 22 nt, Human
gagaaggagggcuucggguugg

SEQ ID NO: 1038351 - RNA, 20 nt, Human
gagacucuugaugaagagcu

SEQ ID NO: 1038352 - RNA, 22 nt, Human
gagagugggacccagagaagcc

SEQ ID NO: 1038353 - RNA, 20 nt, Human
gagccauggccacagucacc

SEQ ID NO: 1038354 - RNA, 23 nt, Human
gaggagucugcggccauugagag

SEQ ID NO: 1038355 - RNA, 19 nt, Human
gaggccagagggggugcca

SEQ ID NO: 1038356 - RNA, 22 nt, Human
gagggccuccugcuggguguuc

SEQ ID NO: 1038357 - RNA, 19 nt, Human
gaggguccuggcuugaggc

SEQ ID NO: 1038358 - RNA, 24 nt, Human
gcaccgcccacugcacuacccacc

SEQ ID NO: 1038359 - RNA, 18 nt, Human
gcacugccuccugggcua

SEQ ID NO: 1038360 - RNA, 21 nt, Human
gcagaaaacucuucagcacag

SEQ ID NO: 1038361 - RNA, 18 nt, Human
gcagcaggagguggucag

SEQ ID NO: 1038362 - RNA, 22 nt, Human
gcaggccaagucucccagugcu

SEQ ID NO: 1038363 - RNA, 23 nt, Human
gccagaugcagcccugugcugcg

SEQ ID NO: 1038364 - RNA, 18 nt, Human
gcccugcuccacauccug

SEQ ID NO: 1038365 - RNA, 19 nt, Human
gcccugggccagaugcagc

SEQ ID NO: 1038366 - RNA, 19 nt, Human
gccugcugccuggaaggcc

SEQ ID NO: 1038367 - RNA, 18 nt, Human
gcugcauggaggcaaccc

SEQ ID NO: 1038368 - RNA, 22 nt, Human
gcugggccagcuucaguggggc

SEQ ID NO: 1038369 - RNA, 24 nt, Human
ggaagagccggccuagcuggaggc

SEQ ID NO: 1038370 - RNA, 20 nt, Human
ggacacacccaccacccucg

SEQ ID NO: 1038371 - RNA, 23 nt, Human
ggacccagagaagcccagggcca

SEQ ID NO: 1038372 - RNA, 21 nt, Human
ggaggcauucagaaacccauu

SEQ ID NO: 1038373 - RNA, 24 nt, Human
ggcaaccaagccaucacugacacc

SEQ ID NO: 1038374 - RNA, 21 nt, Human
ggcauggcuccgggccucagg

SEQ ID NO: 1038375 - RNA, 24 nt, Human
gggacuucuaggggggcucccagg

SEQ ID NO: 1038376 - RNA, 21 nt, Human
gggagaguggggaaguagggg

SEQ ID NO: 1038377 - RNA, 23 nt, Human
gggcuugggccugccuccuccag

SEQ ID NO: 1038378 - RNA, 20 nt, Human
ggggagaaauaugguggagc

SEQ ID NO: 1038379 - RNA, 22 nt, Human
ggggggugggcaguugaagagg

SEQ ID NO: 1038380 - RNA, 23 nt, Human
ggggggugggcaguugaagaggg

SEQ ID NO: 1038381 - RNA, 19 nt, Human
gggggucagaggcuggagg

SEQ ID NO: 1038382 - RNA, 19 nt, Human
ggggugccaaggagcugga

SEQ ID NO: 1038383 - RNA, 18 nt, Human
gguagagcaggagcuggg

SEQ ID NO: 1038384 - RNA, 21 nt, Human
ggucagagguguccucagggc

SEQ ID NO: 1038385 - RNA, 21 nt, Human
guagaauuucugcuggggucu

SEQ ID NO: 1038386 - RNA, 20 nt, Human
gucugcaugaagcugcgcac

SEQ ID NO: 1038387 - RNA, 20 nt, Human
gugaagcacuugcuucuggg

SEQ ID NO: 1038388 - RNA, 19 nt, Human
gugaagcccugaccgucug

SEQ ID NO: 1038389 - RNA, 18 nt, Human
gugcugggccagcuucag

SEQ ID NO: 1038390 - RNA, 20 nt, Human
guggaacgccugugugaccc

SEQ ID NO: 1038391 - RNA, 24 nt, Human
guggaacgccugugugacccacca

SEQ ID NO: 1038392 - RNA, 19 nt, Human
uaaugguguacaccagguc

SEQ ID NO: 1038393 - RNA, 23 nt, Human
uacaguacccuggcccuucucaa

SEQ ID NO: 1038394 - RNA, 23 nt, Human
uaccccaggccacguggaagacu

SEQ ID NO: 1038395 - RNA, 19 nt, Human
uacccuggcccuucucaac

SEQ ID NO: 1038396 - RNA, 21 nt, Human
uaccucacguggcccugcucc

SEQ ID NO: 1038397 - RNA, 21 nt, Human
uacugguccauggagauuucu

SEQ ID NO: 1038398 - RNA, 23 nt, Human
uagaauuucugcuggggucugca

SEQ ID NO: 1038399 - RNA, 24 nt, Human
uagaauuucugcuggggucugcag

SEQ ID NO: 1038400 - RNA, 22 nt, Human
ucaccugcaccugcagauccag

SEQ ID NO: 1038401 - RNA, 23 nt, Human
ucacgucagagaggccaaagugg

SEQ ID NO: 1038402 - RNA, 21 nt, Human
ucagcaaagcccgaaucagca

SEQ ID NO: 1038403 - RNA, 19 nt, Human
ucagcaccagcugggccuc

SEQ ID NO: 1038404 - RNA, 20 nt, Human
ucagcauccuccaccccacc

SEQ ID NO: 1038405 - RNA, 24 nt, Human
ucagcauccuccaccccaccagcc

SEQ ID NO: 1038406 - RNA, 26 nt, Human
ucagcauccuccaccccaccagcccc

SEQ ID NO: 1038407 - RNA, 24 nt, Human
ucaguggggcuacugggcccucua

SEQ ID NO: 1038408 - RNA, 19 nt, Human
ucaguguccggcugcccuc

SEQ ID NO: 1038409 - RNA, 23 nt, Human
uccagcaccugcaggccaaggcc

SEQ ID NO: 1038410 - RNA, 27 nt, Human
ucccaacaaagagcccauaggguaccc

SEQ ID NO: 1038411 - RNA, 23 nt, Human
ucccugagugaaguucaccaggu

SEQ ID NO: 1038412 - RNA, 23 nt, Human
ucccuucugaucucagcugccuc

SEQ ID NO: 1038413 - RNA, 18 nt, Human
uccucagggccaucgugg

SEQ ID NO: 1038414 - RNA, 19 nt, Human
uccucgguguagugcugug

SEQ ID NO: 1038415 - RNA, 19 nt, Human
uccuugggcccagaguaac

SEQ ID NO: 1038416 - RNA, 18 nt, Human
uccuuuuucugccccucu

SEQ ID NO: 1038417 - RNA, 21 nt, Human
ucugcacgggguccaggcugg

SEQ ID NO: 1038418 - RNA, 20 nt, Human
ucugccccucuuacacucuc

SEQ ID NO: 1038419 - RNA, 18 nt, Human
ucugucuuggagguaguc

SEQ ID NO: 1038420 - RNA, 19 nt, Human
ugaaguccccaugccagcc

SEQ ID NO: 1038421 - RNA, 21 nt, Human
ugaauguugauguggaugcug

SEQ ID NO: 1038422 - RNA, 19 nt, Human
ugacagcaucgugcccugu

SEQ ID NO: 1038423 - RNA, 18 nt, Human
ugacaggguugaccugga

SEQ ID NO: 1038424 - RNA, 24 nt, Human
ugaccucauagagguaccuggcac

SEQ ID NO: 1038425 - RNA, 24 nt, Human
ugaccuggaugggcaggaggucug

SEQ ID NO: 1038426 - RNA, 21 nt, Human
ugagaaaacgaugucugcugg

SEQ ID NO: 1038427 - RNA, 23 nt, Human
ugagaacagcacgagcccaccau

SEQ ID NO: 1038428 - RNA, 22 nt, Human
ugaggacuccucaguucgugug

SEQ ID NO: 1038429 - RNA, 20 nt, Human
ugaggggcugcaguugcaag

SEQ ID NO: 1038430 - RNA, 21 nt, Human
ugagugaaguucaccaggucc

SEQ ID NO: 1038431 - RNA, 22 nt, Human
ugauguggggugggucauugaa

SEQ ID NO: 1038432 - RNA, 25 nt, Human
ugauguggggugggucauugacagg

SEQ ID NO: 1038433 - RNA, 26 nt, Human
ugcaccugcagauccagguucuccac

SEQ ID NO: 1038434 - RNA, 22 nt, Human
ugcacgggguccaggcugggug

SEQ ID NO: 1038435 - RNA, 24 nt, Human
ugcagguacuggaucagaugcucu

SEQ ID NO: 1038436 - RNA, 22 nt, Human
ugccaaggagcuggaaggcgag

SEQ ID NO: 1038437 - RNA, 21 nt, Human
ugccaggagaaggagggcuuc

SEQ ID NO: 1038438 - RNA, 20 nt, Human
ugccccucuuacacucucug

SEQ ID NO: 1038439 - RNA, 25 nt, Human
ugccuggaaggccaagggugccugc

SEQ ID NO: 1038440 - RNA, 23 nt, Human
ugcucuuccaccucucuccagca

SEQ ID NO: 1038441 - RNA, 20 nt, Human
ugcugaccuuguggggcugu

SEQ ID NO: 1038442 - RNA, 20 nt, Human
uggagaacugcagcugcagg

SEQ ID NO: 1038443 - RNA, 21 nt, Human
uggaucagaugcucuuccacc

SEQ ID NO: 1038444 - RNA, 18 nt, Human
uggauggagaagguacag

SEQ ID NO: 1038445 - RNA, 25 nt, Human
uggcccaggacaagccugaccugca

SEQ ID NO: 1038446 - RNA, 23 nt, Human
uggggaggccagagggggugcca

SEQ ID NO: 1038447 - RNA, 19 nt, Human
ugggucagcaccagcuggg

SEQ ID NO: 1038448 - RNA, 18 nt, Human
ugguagagcaggagcugg

SEQ ID NO: 1038449 - RNA, 19 nt, Human
ugguagagcaggagcuggg

SEQ ID NO: 1038450 - RNA, 18 nt, Human
uggucagagguguccuca

SEQ ID NO: 1038451 - RNA, 20 nt, Human
uggugaguguaaacuccagg

SEQ ID NO: 1038452 - RNA, 21 nt, Human
ugguucucuugaucuccuuuu

SEQ ID NO: 1038453 - RNA, 25 nt, Human
ugugagaacagcacgagcccaccau

SEQ ID NO: 1038454 - RNA, 20 nt, Human
ugugggaagaugaugugggg

SEQ ID NO: 1038455 - RNA, 18 nt, Human
uguggggugggucauuga

SEQ ID NO: 1038456 - RNA, 22 nt, Human
uucaguggggcuacugggcccu

SEQ ID NO: 1038457 - RNA, 18 nt, Human
uucugagugugcaguggc

SEQ ID NO: 1038458 - RNA, 24 nt, Human
uucugagugugcaguggcuccagc

SEQ ID NO: 1038459 - RNA, 23 nt, Human
uugauguggaugcugaccuugug

SEQ ID NO: 1038460 - RNA, 22 nt, Human
uugcugggcugcuuaauggugu

SEQ ID NO: 1038461 - RNA, 22 nt, Human
aaaaaaaaaagaaagaaagaaa

SEQ ID NO: 1038462 - RNA, 23 nt, Human
aaagaaagaaaaagaaaaaagcg

SEQ ID NO: 1038463 - RNA, 21 nt, Human
aagaaaaaaaaaaagaaagaa

SEQ ID NO: 1038464 - RNA, 23 nt, Human
aagaaagaaaaagaaaaaagcgg

SEQ ID NO: 1038465 - RNA, 21 nt, Human
aagcggcuucuugggagagac

SEQ ID NO: 1038466 - RNA, 19 nt, Human
acuugagcucucccaggca

SEQ ID NO: 1038467 - RNA, 21 nt, Human
agaaaaaaaaaaagaaagaaa

SEQ ID NO: 1038468 - RNA, 24 nt, Human
agaaaaaaaaaaagaaagaaagaa

SEQ ID NO: 1038469 - RNA, 25 nt, Human
agaaaaagaaaaaagcggcuucuug

SEQ ID NO: 1038470 - RNA, 19 nt, Human
agagccugcggcagcugga

SEQ ID NO: 1038471 - RNA, 19 nt, Human
agccccagcagcccuccug

SEQ ID NO: 1038472 - RNA, 19 nt, Human
agguuucaggccacugagc

SEQ ID NO: 1038473 - RNA, 19 nt, Human
aguucauucauuguaucug

SEQ ID NO: 1038474 - RNA, 21 nt, Human
aguuccugacgacugccuuga

SEQ ID NO: 1038475 - RNA, 21 nt, Human
cagcuggacccaucugguagc

SEQ ID NO: 1038476 - RNA, 21 nt, Human
caguucauucauuguaucugc

SEQ ID NO: 1038477 - RNA, 19 nt, Human
ccaccugcucccuuccagg

SEQ ID NO: 1038478 - RNA, 25 nt, Human
ccacugagcugagcccacaucaugu

SEQ ID NO: 1038479 - RNA, 22 nt, Human
ccagcagcccuccuggccuccu

SEQ ID NO: 1038480 - RNA, 22 nt, Human
ccccagcagcccuccuggccuc

SEQ ID NO: 1038481 - RNA, 22 nt, Human
ccccccggauccugaguuccug

SEQ ID NO: 1038482 - RNA, 21 nt, Human
cccccggauccugaguuccug

SEQ ID NO: 1038483 - RNA, 18 nt, Human
ccccugggcagagaagcc

SEQ ID NO: 1038484 - RNA, 19 nt, Human
cccuuagccccagcagccc

SEQ ID NO: 1038485 - RNA, 19 nt, Human
ccuuagaccccuuagcccc

SEQ ID NO: 1038486 - RNA, 22 nt, Human
ccuuagaccccuuagccccagc

SEQ ID NO: 1038487 - RNA, 19 nt, Human
cgauuucuguaucuuccuu

SEQ ID NO: 1038488 - RNA, 18 nt, Human
cuccucgguucuggcccc

SEQ ID NO: 1038489 - RNA, 21 nt, Human
cugcucccuuccaggagcauu

SEQ ID NO: 1038490 - RNA, 24 nt, Human
cuuagccccagcagcccuccuggc

SEQ ID NO: 1038491 - RNA, 22 nt, Human
gaccccuuagccccagcagccc

SEQ ID NO: 1038492 - RNA, 20 nt, Human
gagacucuaaaaccugagag

SEQ ID NO: 1038493 - RNA, 22 nt, Human
gccgugaagaccccccggaucc

SEQ ID NO: 1038494 - RNA, 20 nt, Human
ggacagugccuggagagccu

SEQ ID NO: 1038495 - RNA, 21 nt, Human
ggagagacucuaaaaccugag

SEQ ID NO: 1038496 - RNA, 20 nt, Human
gggcagagaagccgugaaga

SEQ ID NO: 1038497 - RNA, 21 nt, Human
uagaccccuuagccccagcag

SEQ ID NO: 1038498 - RNA, 24 nt, Human
uagcucuggccuuagcacacgccc

SEQ ID NO: 1038499 - RNA, 24 nt, Human
uaucugcuaagaaaaaaaaaaaga

SEQ ID NO: 1038500 - RNA, 19 nt, Human
uccucgguucuggccccug

SEQ ID NO: 1038501 - RNA, 20 nt, Human
uccuggccuccucgguucug

SEQ ID NO: 1038502 - RNA, 24 nt, Human
uccuggccuccucgguucuggccc

SEQ ID NO: 1038503 - RNA, 26 nt, Human
uccuuagaccccuuagccccagcagc

SEQ ID NO: 1038504 - RNA, 21 nt, Human
ucucccaggcaguaacagcug

SEQ ID NO: 1038505 - RNA, 20 nt, Human
ucugcuaagaaaaaaaaaaa

SEQ ID NO: 1038506 - RNA, 23 nt, Human
ucugcuaagaaaaaaaaaaagaa

SEQ ID NO: 1038507 - RNA, 25 nt, Human
ucugcuaagaaaaaaaaaaagaaag

SEQ ID NO: 1038508 - RNA, 21 nt, Human
ugaagaccccccggauccuga

SEQ ID NO: 1038509 - RNA, 18 nt, Human
ugaguuccugacgacugc

SEQ ID NO: 1038510 - RNA, 23 nt, Human
uggcuuaggauggggcuucucug

SEQ ID NO: 1038511 - RNA, 21 nt, Human
uuagccccagcagcccuccug

SEQ ID NO: 1038512 - RNA, 26 nt, Human
uuccuuuuccuccucuuuaugggaga

SEQ ID NO: 1038513 - RNA, 28 nt, Human
uuccuuuuccuccucuuuaugggagaac

SEQ ID NO: 1038514 - RNA, 22 nt, Human
aaacaaaguuacacagaagcaa

SEQ ID NO: 1038515 - RNA, 23 nt, Human
aaacugaauuccuuugucaguaa

SEQ ID NO: 1038516 - RNA, 21 nt, Human
accagauuccacaaaacugaa

SEQ ID NO: 1038517 - RNA, 19 nt, Human
agcugcugcuuuugugguu

SEQ ID NO: 1038518 - RNA, 21 nt, Human
aguagaagucauaaaaauacc

SEQ ID NO: 1038519 - RNA, 23 nt, Human
auagugcaaacaccagauuccac

SEQ ID NO: 1038520 - RNA, 19 nt, Human
caugaguggacccaucagg

SEQ ID NO: 1038521 - RNA, 19 nt, Human
cccgcgacugcggcgaggg

SEQ ID NO: 1038522 - RNA, 19 nt, Human
cccucaggcaccgacgccg

SEQ ID NO: 1038523 - RNA, 20 nt, Human
ccugagacauacuagaaaau

SEQ ID NO: 1038524 - RNA, 20 nt, Human
gacugcggcgagggcgacgc

SEQ ID NO: 1038525 - RNA, 22 nt, Human
gcggcgagggcgacgcggacac

SEQ ID NO: 1038526 - RNA, 18 nt, Human
gcuggaaaauuucccacg

SEQ ID NO: 1038527 - RNA, 22 nt, Human
uaaaaauaccugagacauacua

SEQ ID NO: 1038528 - RNA, 21 nt, Human
uaaccuauagugcaaacacca

SEQ ID NO: 1038529 - RNA, 24 nt, Human
ucacuaacauuucauaaucauuuc

SEQ ID NO: 1038530 - RNA, 25 nt, Human
ucccccguggacaugaguaaauuaa

SEQ ID NO: 1038531 - RNA, 20 nt, Human
ucuccuuucucagcugaggc

SEQ ID NO: 1038532 - RNA, 19 nt, Human
ugaguggacccaucagugg

SEQ ID NO: 1038533 - RNA, 20 nt, Human
ugcaugucagcuacacguuc

SEQ ID NO: 1038534 - RNA, 19 nt, Human
ugcccucuaaacguccccc

SEQ ID NO: 1038535 - RNA, 21 nt, Human
uggcaacucuuaaccuauagu

SEQ ID NO: 1038536 - RNA, 21 nt, Human
uuaaauggcaacucuuaaccu

SEQ ID NO: 1038537 - RNA, 25 nt, Human
uuaaguuucucaaggcauugauugc

SEQ ID NO: 1038538 - RNA, 21 nt, Human
uuaguaguagcugcugcuuuu

SEQ ID NO: 1038539 - RNA, 26 nt, Human
uuaguuaaaauuaaguaaugauucca

SEQ ID NO: 1038540 - RNA, 22 nt, Human
uucucgaugaauaauauuuccc

SEQ ID NO: 1038541 - RNA, 18 nt, Human
acuccgaagcagcaccgg

SEQ ID NO: 1038542 - RNA, 22 nt, Human
agccccugccagcuccgcuucc

SEQ ID NO: 1038543 - RNA, 21 nt, Human
caccgggccgcuccggucccc

SEQ ID NO: 1038544 - RNA, 23 nt, Human
cagcaccgggccgcuccgguccc

SEQ ID NO: 1038545 - RNA, 19 nt, Human
cagccccugccagcuccgc

SEQ ID NO: 1038546 - RNA, 18 nt, Human
ccagccccugccagcucc

SEQ ID NO: 1038547 - RNA, 22 nt, Human
ccgcccuccgcagccuggacuu

SEQ ID NO: 1038548 - RNA, 19 nt, Human
ccgcugugcgccucccgcc

SEQ ID NO: 1038549 - RNA, 19 nt, Human
ccgggccgcuccggucccc

SEQ ID NO: 1038550 - RNA, 18 nt, Human
ccgguccccgccagcccc

SEQ ID NO: 1038551 - RNA, 22 nt, Human
cgccgacucugacccagggacc

SEQ ID NO: 1038552 - RNA, 18 nt, Human
cggcugaggggagucggg

SEQ ID NO: 1038553 - RNA, 20 nt, Human
cggggggucgggggagaggg

SEQ ID NO: 1038554 - RNA, 22 nt, Human
cgggguucgguggguccuggga

SEQ ID NO: 1038555 - RNA, 22 nt, Human
gccagccccugccagcuccgcu

SEQ ID NO: 1038556 - RNA, 23 nt, Human
gcgccucccgccgacucugaccc

SEQ ID NO: 1038557 - RNA, 20 nt, Human
ggaaaggaagggggacgggg

SEQ ID NO: 1038558 - RNA, 20 nt, Human
ggagucggggggucggggga

SEQ ID NO: 1038559 - RNA, 20 nt, Human
ggaugggagggaacgugggc

SEQ ID NO: 1038560 - RNA, 18 nt, Human
gggacggggaugggaggg

SEQ ID NO: 1038561 - RNA, 19 nt, Human
ggggaugggagggaacgug

SEQ ID NO: 1038562 - RNA, 20 nt, Human
ggggaugggagggaacgugg

SEQ ID NO: 1038563 - RNA, 25 nt, Human
uccccgccagccccugccagcuccc

SEQ ID NO: 1038564 - RNA, 20 nt, Human
ucccgggucuccggaaagga

SEQ ID NO: 1038565 - RNA, 25 nt, Human
uccgcagccuggacuuuccuggccu

SEQ ID NO: 1038566 - RNA, 21 nt, Human
uccugggacggggaugggagg

SEQ ID NO: 1038567 - RNA, 19 nt, Human
ucuccggggucccucggcc

SEQ ID NO: 1038568 - RNA, 23 nt, Human
ugacccagggacccggagaccaa

SEQ ID NO: 1038569 - RNA, 22 nt, Human
ugcccggaggaggagaacggag

SEQ ID NO: 1038570 - RNA, 20 nt, Human
ugccgagagccuggcgcccc

SEQ ID NO: 1038571 - RNA, 18 nt, Human
aaaaccuuccaggcuuca

SEQ ID NO: 1038572 - RNA, 22 nt, Human
acagcugacuuaucuguccuuu

SEQ ID NO: 1038573 - RNA, 20 nt, Human
agaaaaucaucugacuccuu

SEQ ID NO: 1038574 - RNA, 24 nt, Human
aucaaagaaaaccuuccaggcuuc

SEQ ID NO: 1038575 - RNA, 23 nt, Human
cacuccaccauuagauuucacuu

SEQ ID NO: 1038576 - RNA, 22 nt, Human
cauaacgcauagcaaauucauc

SEQ ID NO: 1038577 - RNA, 25 nt, Human
ccacucaagguccucacuucuacaa

SEQ ID NO: 1038578 - RNA, 22 nt, Human
cuguaauaauggucugagucuu

SEQ ID NO: 1038579 - RNA, 18 nt, Human
gaagcaucaucaaagaaa

SEQ ID NO: 1038580 - RNA, 19 nt, Human
ggaacagauucucauguaa

SEQ ID NO: 1038581 - RNA, 19 nt, Human
uaaauggauucaauuccau

SEQ ID NO: 1038582 - RNA, 18 nt, Human
uaacgcauagcaaauuca

SEQ ID NO: 1038583 - RNA, 21 nt, Human
uaacgcauagcaaauucauca

SEQ ID NO: 1038584 - RNA, 22 nt, Human
uacucugacuuugauucgaucu

SEQ ID NO: 1038585 - RNA, 22 nt, Human
uaucuguccuuuucucuaaguu

SEQ ID NO: 1038586 - RNA, 23 nt, Human
uaugauauggagcaaccuucucu

SEQ ID NO: 1038587 - RNA, 20 nt, Human
uauggccccagauacagcug

SEQ ID NO: 1038588 - RNA, 22 nt, Human
ucuguccuuuucucuaaguugu

SEQ ID NO: 1038589 - RNA, 20 nt, Human
ugaaauguugcuugacucug

SEQ ID NO: 1038590 - RNA, 18 nt, Human
ugaauaugauauggagca

SEQ ID NO: 1038591 - RNA, 20 nt, Human
ugacuucugggauuuucacu

SEQ ID NO: 1038592 - RNA, 19 nt, Human
uggucugagucuugucuuc

SEQ ID NO: 1038593 - RNA, 22 nt, Human
uguaccagacauccauuucucc

SEQ ID NO: 1038594 - RNA, 19 nt, Human
uuagaacucuuuucugcug

SEQ ID NO: 1038595 - RNA, 23 nt, Human
uucacuccaccauuagauuucac

SEQ ID NO: 1038596 - RNA, 19 nt, Human
uucucauguaaacauguau

SEQ ID NO: 1038597 - RNA, 19 nt, Human
uucuccuuuuaucuccaca

SEQ ID NO: 1038598 - RNA, 25 nt, Human
uucucuaaguuguaccagacaucca

SEQ ID NO: 1038599 - RNA, 23 nt, Human
uuuucacuccaccauuagauuuc

SEQ ID NO: 1038600 - RNA, 18 nt, Human
aaaggagaggagagagua

SEQ ID NO: 1038601 - RNA, 20 nt, Human
aagaaggacugaauuaaaug

SEQ ID NO: 1038602 - RNA, 19 nt, Human
acaguggaaagugccaaca

SEQ ID NO: 1038603 - RNA, 20 nt, Human
agaaagaaauucuccgccga

SEQ ID NO: 1038604 - RNA, 21 nt, Human
agguggcuggccuaccagcca

SEQ ID NO: 1038605 - RNA, 22 nt, Human
augcagauuagagucagggcag

SEQ ID NO: 1038606 - RNA, 19 nt, Human
cagaccacggcgaggggug

SEQ ID NO: 1038607 - RNA, 19 nt, Human
ccccgcuuccucacagucc

SEQ ID NO: 1038608 - RNA, 23 nt, Human
ccccgcuuccucacaguccucca

SEQ ID NO: 1038609 - RNA, 23 nt, Human
cucccccaacgacacagggaccu

SEQ ID NO: 1038610 - RNA, 19 nt, Human
gaacaguggaaagugccaa

SEQ ID NO: 1038611 - RNA, 23 nt, Human
gagaaagaaauucuccgccgaaa

SEQ ID NO: 1038612 - RNA, 18 nt, Human
gccagugguugcuccugg

SEQ ID NO: 1038613 - RNA, 18 nt, Human
guggaaagugccaacaga

SEQ ID NO: 1038614 - RNA, 18 nt, Human
uaaaggcagcgaguggcu

SEQ ID NO: 1038615 - RNA, 22 nt, Human
uaaggcgagaaagaaauucucc

SEQ ID NO: 1038616 - RNA, 25 nt, Human
uagagucagggcaggguaagguggc

SEQ ID NO: 1038617 - RNA, 20 nt, Human
uagcuaaggcgagaaagaaa

SEQ ID NO: 1038618 - RNA, 18 nt, Human
uaugguuacaggaagggu

SEQ ID NO: 1038619 - RNA, 18 nt, Human
ucccccaacgacacaggg

SEQ ID NO: 1038620 - RNA, 20 nt, Human
ucccccaacgacacagggac

SEQ ID NO: 1038621 - RNA, 26 nt, Human
ucuuucaguuaugguuacaggaaggg

SEQ ID NO: 1038622 - RNA, 22 nt, Human
uggaacaguggaaagugccaac

SEQ ID NO: 1038623 - RNA, 18 nt, Human
ugguagggccagugguug

SEQ ID NO: 1038624 - RNA, 18 nt, Human
uguuaggggcuucucggg

SEQ ID NO: 1038625 - RNA, 21 nt, Human
uucaguuaugguuacaggaag

SEQ ID NO: 1038626 - RNA, 18 nt, Human
uuccuucccccgcuuccu

SEQ ID NO: 1038627 - RNA, 26 nt, Human
uuccuucccccgcuuccucacagucc

SEQ ID NO: 1038628 - RNA, 22 nt, Human
caccucugcccugaggauauuu

SEQ ID NO: 1038629 - RNA, 21 nt, Human
ccuucuuucucuucucuuugc

SEQ ID NO: 1038630 - RNA, 22 nt, Human
ccuucuuucucuucucuuugca

SEQ ID NO: 1038631 - RNA, 21 nt, Human
cugcuggccacaggugaacgg

SEQ ID NO: 1038632 - RNA, 19 nt, Human
gaggauauuuggagugcaa

SEQ ID NO: 1038633 - RNA, 21 nt, Human
gccugcuucucacuuaacacc

SEQ ID NO: 1038634 - RNA, 23 nt, Human
ucucuucucuuugcauaccuucu

SEQ ID NO: 1038635 - RNA, 26 nt, Human
ucuucugcugcuggccacaggugaac

SEQ ID NO: 1038636 - RNA, 24 nt, Human
ucuuucucuucucuuugcauaccu

SEQ ID NO: 1038637 - RNA, 18 nt, Human
gaaagccagcgacgagug

SEQ ID NO: 1038638 - RNA, 22 nt, Human
uccacagcagggcagggaaagc

SEQ ID NO: 1038639 - RNA, 27 nt, Human
aaaaauaaaaaacaccuuucuagagag

SEQ ID NO: 1038640 - RNA, 25 nt, Human
aaaagagcaggacaauaaacaggca

SEQ ID NO: 1038641 - RNA, 21 nt, Human
aaacaggcaaauacacaaacc

SEQ ID NO: 1038642 - RNA, 25 nt, Human
aaacaggcaaauacacaaacccugg

SEQ ID NO: 1038643 - RNA, 18 nt, Human
aacccuggagcaaagccg

SEQ ID NO: 1038644 - RNA, 20 nt, Human
aagcaucuuuguugcagccc

SEQ ID NO: 1038645 - RNA, 18 nt, Human
acacacacacacacacac

SEQ ID NO: 1038646 - RNA, 21 nt, Human
acacacacacacacacgcaca

SEQ ID NO: 1038647 - RNA, 21 nt, Human
acacacacacacacgcacagu

SEQ ID NO: 1038648 - RNA, 21 nt, Human
acacacacacacacgcacagu

SEQ ID NO: 1038649 - RNA, 21 nt, Human
acacgcacacacgugcacaca

SEQ ID NO: 1038650 - RNA, 19 nt, Human
acagagcagaggaacaaca

SEQ ID NO: 1038651 - RNA, 25 nt, Human
acaggcaaauacacaaacccuggag

SEQ ID NO: 1038652 - RNA, 23 nt, Human
acgcacacacgugcacacacaca

SEQ ID NO: 1038653 - RNA, 20 nt, Human
agacugacuucaaauauagu

SEQ ID NO: 1038654 - RNA, 23 nt, Human
aggaacaacaaaaaagcacaaag

SEQ ID NO: 1038655 - RNA, 19 nt, Human
aggcaaauacacaaacccu

SEQ ID NO: 1038656 - RNA, 21 nt, Human
aguggcaagcaccuggcagau

SEQ ID NO: 1038657 - RNA, 25 nt, Human
aguugucgaaaacccugugugagcc

SEQ ID NO: 1038658 - RNA, 19 nt, Human
caaaaaaaaaaagagcagg

SEQ ID NO: 1038659 - RNA, 24 nt, Human
caaaaaaaaaaagagcaggacaau

SEQ ID NO: 1038660 - RNA, 24 nt, Human
caaacccuggagcaaagccaggaa

SEQ ID NO: 1038661 - RNA, 20 nt, Human
cacacacacacacacacaca

SEQ ID NO: 1038662 - RNA, 26 nt, Human
cacacacacacacacacacacgcaca

SEQ ID NO: 1038663 - RNA, 31 nt, Human
cacacacgugcacacgcacacacgugcacag

SEQ ID NO: 1038664 - RNA, 21 nt, Human
caccucuagccugggaacacc

SEQ ID NO: 1038665 - RNA, 26 nt, Human
cacgugcacacacacacacacacaca

SEQ ID NO: 1038666 - RNA, 25 nt, Human
cacuucaccagcucagaggugagcc

SEQ ID NO: 1038667 - RNA, 22 nt, Human
cagaggaacaacaaaaaagcac

SEQ ID NO: 1038668 - RNA, 18 nt, Human
cagcagcagaucccuggg

SEQ ID NO: 1038669 - RNA, 18 nt, Human
cagccaaucaccucuagc

SEQ ID NO: 1038670 - RNA, 23 nt, Human
cagccgccauuucugccaggaag

SEQ ID NO: 1038671 - RNA, 23 nt, Human
ccugacagugugauuuuuuccag

SEQ ID NO: 1038672 - RNA, 21 nt, Human
ccugagaagucagcccaaggc

SEQ ID NO: 1038673 - RNA, 18 nt, Human
ccuguggggucuccuggg

SEQ ID NO: 1038674 - RNA, 20 nt, Human
ccuguggggucuccuggguc

SEQ ID NO: 1038675 - RNA, 22 nt, Human
cgcacacacgugcacacacaca

SEQ ID NO: 1038676 - RNA, 25 nt, Human
cgugcacacacacacacacacacac

SEQ ID NO: 1038677 - RNA, 20 nt, Human
cgugcacacgcacacacgug

SEQ ID NO: 1038678 - RNA, 25 nt, Human
cgugcacacgcacacacgugcacac

SEQ ID NO: 1038679 - RNA, 24 nt, Human
cucaccugaaccucugccuuccgg

SEQ ID NO: 1038680 - RNA, 25 nt, Human
cuccagaagccagcagcagaucccu

SEQ ID NO: 1038681 - RNA, 20 nt, Human
cuccuggguccugugggguc

SEQ ID NO: 1038682 - RNA, 22 nt, Human
cuuucuagagagagcaaaaucc

SEQ ID NO: 1038683 - RNA, 23 nt, Human
gaaggagaaacuguuuuauagga

SEQ ID NO: 1038684 - RNA, 20 nt, Human
gacaauaaacaggcaaauac

SEQ ID NO: 1038685 - RNA, 18 nt, Human
gagaaggagaaacuguuu

SEQ ID NO: 1038686 - RNA, 27 nt, Human
gagagcaaaaucccagggucccgaagg

SEQ ID NO: 1038687 - RNA, 20 nt, Human
gaggaacaacaaaaaagcac

SEQ ID NO: 1038688 - RNA, 24 nt, Human
gaggaacaacaaaaaagcacaaag

SEQ ID NO: 1038689 - RNA, 23 nt, Human
gcaaaaucccagggucccgaagg

SEQ ID NO: 1038690 - RNA, 23 nt, Human
gcacacgcacacacgugcacaca

SEQ ID NO: 1038691 - RNA, 26 nt, Human
gcacuuuccuuucccuucagagaagg

SEQ ID NO: 1038692 - RNA, 24 nt, Human
ggaacaacaaaaaagcacaaagaa

SEQ ID NO: 1038693 - RNA, 23 nt, Human
ggcagauggagcccggguguuuc

SEQ ID NO: 1038694 - RNA, 18 nt, Human
ggcccugucuccagaagc

SEQ ID NO: 1038695 - RNA, 19 nt, Human
ggcugccuagcacuuuccu

SEQ ID NO: 1038696 - RNA, 18 nt, Human
gucuccuggguccaggug

SEQ ID NO: 1038697 - RNA, 23 nt, Human
gugcacacacacacacacacagg

SEQ ID NO: 1038698 - RNA, 23 nt, Human
uaaacaggcaaauacacaaaccc

SEQ ID NO: 1038699 - RNA, 21 nt, Human
uaaggcaaacaacguagaacc

SEQ ID NO: 1038700 - RNA, 23 nt, Human
ucacaggcaaguccucacuucac

SEQ ID NO: 1038701 - RNA, 18 nt, Human
ucacaggcugccuagcac

SEQ ID NO: 1038702 - RNA, 20 nt, Human
uccuggguccagguggguuc

SEQ ID NO: 1038703 - RNA, 23 nt, Human
uccuggguccagguggguuccua

SEQ ID NO: 1038704 - RNA, 21 nt, Human
uccuggguccuguggggucuc

SEQ ID NO: 1038705 - RNA, 24 nt, Human
ucuccagaagccagcagcagaucc

SEQ ID NO: 1038706 - RNA, 24 nt, Human
ugacagagcagaggaacaacaaaa

SEQ ID NO: 1038707 - RNA, 20 nt, Human
ugacuucaaauauagucccc

SEQ ID NO: 1038708 - RNA, 21 nt, Human
ugagccacucucaccugaacc

SEQ ID NO: 1038709 - RNA, 20 nt, Human
ugcacacacacacacacaca

SEQ ID NO: 1038710 - RNA, 25 nt, Human
ugcacacacacacacacacacacgc

SEQ ID NO: 1038711 - RNA, 18 nt, Human
uggagcaaagccaggaaa

SEQ ID NO: 1038712 - RNA, 18 nt, Human
uggcaagcaccuggcaga

SEQ ID NO: 1038713 - RNA, 24 nt, Human
uggcagauggagcccggguguuuc

SEQ ID NO: 1038714 - RNA, 25 nt, Human
uggcagauggagcccggguguuucu

SEQ ID NO: 1038715 - RNA, 21 nt, Human
ugugauuuuuuccagccagcc

SEQ ID NO: 1038716 - RNA, 22 nt, Human
uuccagccagccaaaucaccgu

SEQ ID NO: 1038717 - RNA, 23 nt, Human
uuccggcagggaccuccuggguc

SEQ ID NO: 1038718 - RNA, 23 nt, Human
agcuucaucauuucucccugaag

SEQ ID NO: 1038719 - RNA, 18 nt, Human
caggauccuucagcacug

SEQ ID NO: 1038720 - RNA, 22 nt, Human
cauucagugggacagcuuugcu

SEQ ID NO: 1038721 - RNA, 19 nt, Human
cauuuggaauccauuaauu

SEQ ID NO: 1038722 - RNA, 22 nt, Human
ccacacagcuuccauaucugaa

SEQ ID NO: 1038723 - RNA, 21 nt, Human
gauuuucuucugauagcuuca

SEQ ID NO: 1038724 - RNA, 19 nt, Human
uaucaugaagugaagcacu

SEQ ID NO: 1038725 - RNA, 27 nt, Human
ucauucaauuuaucauuuucauugggg

SEQ ID NO: 1038726 - RNA, 23 nt, Human
ucugaaacuuugcugcuggaucu

SEQ ID NO: 1038727 - RNA, 22 nt, Human
ugccucauuccacacagcuucc

SEQ ID NO: 1038728 - RNA, 18 nt, Human
ugcuuagaugcauucagu

SEQ ID NO: 1038729 - RNA, 23 nt, Human
uguggcgugggcccgucuugcuu

SEQ ID NO: 1038730 - RNA, 19 nt, Human
uucaguaucaugaagugaa

SEQ ID NO: 1038731 - RNA, 18 nt, Human
uucaugagguuuugccuc

SEQ ID NO: 1038732 - RNA, 21 nt, Human
uuccacacagcuuccauaucu

SEQ ID NO: 1038733 - RNA, 20 nt, Human
uuccugguuagacucuguuc

SEQ ID NO: 1038734 - RNA, 21 nt, Human
uuuuguuuuguuuggguuuuc

SEQ ID NO: 1038735 - RNA, 20 nt, Human
auucuuaucguccugcagcc

SEQ ID NO: 1038736 - RNA, 19 nt, Human
cagacuccagcugcuggca

SEQ ID NO: 1038737 - RNA, 18 nt, Human
cagcugcuggcacugccu

SEQ ID NO: 1038738 - RNA, 22 nt, Human
ccguuuaacagacuccagcugc

SEQ ID NO: 1038739 - RNA, 23 nt, Human
cugcuggcacugccuucugaguu

SEQ ID NO: 1038740 - RNA, 24 nt, Human
ucacuuccgaauucuuaucguccu

SEQ ID NO: 1038741 - RNA, 24 nt, Human
ugaguucuuucacuuccgaauucu

SEQ ID NO: 1038742 - RNA, 20 nt, Human
ugccccguuuaacagacucc

SEQ ID NO: 1038743 - RNA, 23 nt, Human
ugccccguuuaacagacuccagc

SEQ ID NO: 1038744 - RNA, 21 nt, Human
ugccuucugaguucuuucacu

SEQ ID NO: 1038745 - RNA, 21 nt, Human
ugcuggcacugccuucugagu

SEQ ID NO: 1038746 - RNA, 24 nt, Human
aaagaaaacccagccacgagcacc

SEQ ID NO: 1038747 - RNA, 18 nt, Human
aagcccuccugguucuuc

SEQ ID NO: 1038748 - RNA, 19 nt, Human
accacccuccccugagcag

SEQ ID NO: 1038749 - RNA, 21 nt, Human
acccagggcccccgucccagc

SEQ ID NO: 1038750 - RNA, 22 nt, Human
acccagggcccccgucccagcc

SEQ ID NO: 1038751 - RNA, 26 nt, Human
accccaaggggugcucgacaacauga

SEQ ID NO: 1038752 - RNA, 21 nt, Human
acccugagggaggccaggugg

SEQ ID NO: 1038753 - RNA, 22 nt, Human
acccugagggaggccagguggg

SEQ ID NO: 1038754 - RNA, 19 nt, Human
agacucagaaacgcucaug

SEQ ID NO: 1038755 - RNA, 25 nt, Human
agaugugugaccccaaggggugcuc

SEQ ID NO: 1038756 - RNA, 21 nt, Human
agccacgagcaccacccuccc

SEQ ID NO: 1038757 - RNA, 23 nt, Human
agccacgagcaccacccuccccc

SEQ ID NO: 1038758 - RNA, 21 nt, Human
aggaacgaaggcaacgcaaga

SEQ ID NO: 1038759 - RNA, 30 nt, Human
aggcaggcagcacccugagggaggccaggg

SEQ ID NO: 1038760 - RNA, 18 nt, Human
aggccugaucugaaagac

SEQ ID NO: 1038761 - RNA, 18 nt, Human
agggguggggcuggacag

SEQ ID NO: 1038762 - RNA, 21 nt, Human
caagaggcugagcuggccccc

SEQ ID NO: 1038763 - RNA, 20 nt, Human
cacccagggcccccguccca

SEQ ID NO: 1038764 - RNA, 23 nt, Human
cagcaugggcacagugggcugga

SEQ ID NO: 1038765 - RNA, 24 nt, Human
cagccuccagggucccaggagagc

SEQ ID NO: 1038766 - RNA, 18 nt, Human
caggaacgaaggcaacgc

SEQ ID NO: 1038767 - RNA, 18 nt, Human
caggagagcuuugagaug

SEQ ID NO: 1038768 - RNA, 21 nt, Human
caggagcccugggugcaaaaa

SEQ ID NO: 1038769 - RNA, 18 nt, Human
cagggucccaggagagcu

SEQ ID NO: 1038770 - RNA, 20 nt, Human
caggugccuugcagucuggc

SEQ ID NO: 1038771 - RNA, 19 nt, Human
ccacacucuacccugcuga

SEQ ID NO: 1038772 - RNA, 19 nt, Human
ccaccucuagguugauccc

SEQ ID NO: 1038773 - RNA, 18 nt, Human
ccagguccugcugcgcca

SEQ ID NO: 1038774 - RNA, 24 nt, Human
cccauccuggcgucacugcccgcu

SEQ ID NO: 1038775 - RNA, 18 nt, Human
cccccccacacucuaccc

SEQ ID NO: 1038776 - RNA, 25 nt, Human
cccccccacacucuacccugcugaa

SEQ ID NO: 1038777 - RNA, 21 nt, Human
ccccgucccagccugggggac

SEQ ID NO: 1038778 - RNA, 20 nt, Human
cccuagaguccagggugggc

SEQ ID NO: 1038779 - RNA, 22 nt, Human
cccucaucucacccagcccaug

SEQ ID NO: 1038780 - RNA, 22 nt, Human
cccucuaggacccucccaccca

SEQ ID NO: 1038781 - RNA, 19 nt, Human
cccugagggaggccaggug

SEQ ID NO: 1038782 - RNA, 19 nt, Human
ccgccgucuccucguccca

SEQ ID NO: 1038783 - RNA, 19 nt, Human
ccgugugauuguguuggac

SEQ ID NO: 1038784 - RNA, 20 nt, Human
ccucagggacccugugcagg

SEQ ID NO: 1038785 - RNA, 23 nt, Human
ccuccagcaugggcacagugggc

SEQ ID NO: 1038786 - RNA, 27 nt, Human
ccuccccugagcagggcgagaagaggc

SEQ ID NO: 1038787 - RNA, 19 nt, Human
ccuccuggccuggcgucgc

SEQ ID NO: 1038788 - RNA, 21 nt, Human
ccuccuggccuggcgucgccu

SEQ ID NO: 1038789 - RNA, 23 nt, Human
ccucuaggacccucccacccacc

SEQ ID NO: 1038790 - RNA, 21 nt, Human
ccucugggcgcuuugcuccug

SEQ ID NO: 1038791 - RNA, 23 nt, Human
ccugcaugggggcggggugggga

SEQ ID NO: 1038792 - RNA, 27 nt, Human
cgagcaccacccuccccugagcagggc

SEQ ID NO: 1038793 - RNA, 25 nt, Human
cggcuggcugagcacgugcggggcc

SEQ ID NO: 1038794 - RNA, 19 nt, Human
cgggagaggaaacacaacg

SEQ ID NO: 1038795 - RNA, 23 nt, Human
cuaggacccucccacccaccucu

SEQ ID NO: 1038796 - RNA, 20 nt, Human
cuagguugaucccuuuauau

SEQ ID NO: 1038797 - RNA, 18 nt, Human
cuccccucaucucaccca

SEQ ID NO: 1038798 - RNA, 19 nt, Human
cugaagcugggccacaggc

SEQ ID NO: 1038799 - RNA, 18 nt, Human
cugaagcuuguggccucc

SEQ ID NO: 1038800 - RNA, 24 nt, Human
cugaccucugggcgcuuugcuccu

SEQ ID NO: 1038801 - RNA, 19 nt, Human
cugcagcuccuccacgacg

SEQ ID NO: 1038802 - RNA, 25 nt, Human
cugcugaagcugggccacaggcugg

SEQ ID NO: 1038803 - RNA, 23 nt, Human
cugggccacaggcugguuuuugu

SEQ ID NO: 1038804 - RNA, 22 nt, Human
cuuagggguggggcuggacagc

SEQ ID NO: 1038805 - RNA, 19 nt, Human
cuuugaggucugaagcuug

SEQ ID NO: 1038806 - RNA, 18 nt, Human
gaaagacggcuuaggggu

SEQ ID NO: 1038807 - RNA, 18 nt, Human
gacccucccacccaccuc

SEQ ID NO: 1038808 - RNA, 21 nt, Human
gaggcaggcagcacccugagg

SEQ ID NO: 1038809 - RNA, 24 nt, Human
gagggaggccaggugggcuccugg

SEQ ID NO: 1038810 - RNA, 22 nt, Human
gagucaggagcccugggugcaa

SEQ ID NO: 1038811 - RNA, 20 nt, Human
gcagcuccuccacgacgcuc

SEQ ID NO: 1038812 - RNA, 25 nt, Human
gcccauggcaggcucuaggccucag

SEQ ID NO: 1038813 - RNA, 23 nt, Human
gcccccgucccagccugggggac

SEQ ID NO: 1038814 - RNA, 19 nt, Human
ggcccccccacacucuacc

SEQ ID NO: 1038815 - RNA, 20 nt, Human
ggccugaucugaaagacagu

SEQ ID NO: 1038816 - RNA, 22 nt, Human
ggcugagcacgugcggggccug

SEQ ID NO: 1038817 - RNA, 22 nt, Human
gggcaaggcugaaucagcggcg

SEQ ID NO: 1038818 - RNA, 28 nt, Human
gggcccccgucccagccugggggacccc

SEQ ID NO: 1038819 - RNA, 22 nt, Human
gggcgggguggggaggacuggg

SEQ ID NO: 1038820 - RNA, 18 nt, Human
gguggggaggacugggcu

SEQ ID NO: 1038821 - RNA, 22 nt, Human
uaaaaagaaaacccagccacga

SEQ ID NO: 1038822 - RNA, 19 nt, Human
ucagugcagcugguuuuua

SEQ ID NO: 1038823 - RNA, 21 nt, Human
uccagggucccaggagagcuu

SEQ ID NO: 1038824 - RNA, 20 nt, Human
ucccacgugccggccuccaa

SEQ ID NO: 1038825 - RNA, 18 nt, Human
uccugcugcgccaggugc

SEQ ID NO: 1038826 - RNA, 22 nt, Human
uccugggccccgcguguggccc

SEQ ID NO: 1038827 - RNA, 19 nt, Human
ucgucuugaagagacucag

SEQ ID NO: 1038828 - RNA, 23 nt, Human
ucuaggacccucccacccaccuc

SEQ ID NO: 1038829 - RNA, 18 nt, Human
ucucccagcaucgcgguu

SEQ ID NO: 1038830 - RNA, 18 nt, Human
ucuuacgguugcggagcc

SEQ ID NO: 1038831 - RNA, 19 nt, Human
ugaagcuuguggccuccug

SEQ ID NO: 1038832 - RNA, 18 nt, Human
ugaaucagcggcgagggg

SEQ ID NO: 1038833 - RNA, 19 nt, Human
ugagauggcugucuccccu

SEQ ID NO: 1038834 - RNA, 19 nt, Human
ugcccucuaggacccuccc

SEQ ID NO: 1038835 - RNA, 20 nt, Human
ugcggagggagacgggcaag

SEQ ID NO: 1038836 - RNA, 25 nt, Human
ugcggagggagacgggcaaggcugg

SEQ ID NO: 1038837 - RNA, 21 nt, Human
uggacggggagucaggagccc

SEQ ID NO: 1038838 - RNA, 19 nt, Human
uggcugagcacgugcgggg

SEQ ID NO: 1038839 - RNA, 22 nt, Human
uggcugagcacgugcggggccu

SEQ ID NO: 1038840 - RNA, 18 nt, Human
ugggaaagacggcuuagg

SEQ ID NO: 1038841 - RNA, 24 nt, Human
ugggggcgggguggggaggacugg

SEQ ID NO: 1038842 - RNA, 20 nt, Human
ugggggcgggguggggaggg

SEQ ID NO: 1038843 - RNA, 19 nt, Human
uguccuccagcaugggcac

SEQ ID NO: 1038844 - RNA, 19 nt, Human
uuaaagccaagguuggaaa

SEQ ID NO: 1038845 - RNA, 22 nt, Human
uucagaacaggaaaccucagga

SEQ ID NO: 1038846 - RNA, 21 nt, Human
uucgcccagaugugugacccc

SEQ ID NO: 1038847 - RNA, 20 nt, Human
uucgucuugaagagacucag

SEQ ID NO: 1038848 - RNA, 21 nt, Human
aagcaacauuaauguuuaacc

SEQ ID NO: 1038849 - RNA, 20 nt, Human
aauaugauucaggguccugg

SEQ ID NO: 1038850 - RNA, 22 nt, Human
agccuguccacaucuucagccc

SEQ ID NO: 1038851 - RNA, 21 nt, Human
aggcacagaagcccaacauuu

SEQ ID NO: 1038852 - RNA, 19 nt, Human
auaaaggacacccuuaguc

SEQ ID NO: 1038853 - RNA, 18 nt, Human
augcuuccaagacuauaa

SEQ ID NO: 1038854 - RNA, 22 nt, Human
auuucauuuucucucccuuuaa

SEQ ID NO: 1038855 - RNA, 21 nt, Human
caacaaagcaacauuaauguu

SEQ ID NO: 1038856 - RNA, 18 nt, Human
caagaaaagcugggggug

SEQ ID NO: 1038857 - RNA, 21 nt, Human
cacauaacagcagugagcaca

SEQ ID NO: 1038858 - RNA, 18 nt, Human
cacaucuucagcccuuca

SEQ ID NO: 1038859 - RNA, 22 nt, Human
cauaugcguauauuugugugug

SEQ ID NO: 1038860 - RNA, 24 nt, Human
cucaacuuucuuucuuuccaaacc

SEQ ID NO: 1038861 - RNA, 18 nt, Human
ggacacccuuagucaaau

SEQ ID NO: 1038862 - RNA, 19 nt, Human
guguuugucuauaugucca

SEQ ID NO: 1038863 - RNA, 23 nt, Human
guuugugucuacacgucugugua

SEQ ID NO: 1038864 - RNA, 21 nt, Human
uaaaagagacagaaugcuucc

SEQ ID NO: 1038865 - RNA, 19 nt, Human
uaagagaggaagugaccau

SEQ ID NO: 1038866 - RNA, 26 nt, Human
uacguguauacacaucuguguauaug

SEQ ID NO: 1038867 - RNA, 19 nt, Human
uauauguuugugucuacau

SEQ ID NO: 1038868 - RNA, 21 nt, Human
uaucaaggggauucuuuagcc

SEQ ID NO: 1038869 - RNA, 18 nt, Human
uauguccauaugcguaua

SEQ ID NO: 1038870 - RNA, 23 nt, Human
ucccuggauuagaaguuggaaaa

SEQ ID NO: 1038871 - RNA, 21 nt, Human
ucucccuuuaacaacaaagca

SEQ ID NO: 1038872 - RNA, 23 nt, Human
ucuguauacguguauacacaucu

SEQ ID NO: 1038873 - RNA, 25 nt, Human
uggcuuugacuuuguuucaaaguuc

SEQ ID NO: 1038874 - RNA, 21 nt, Human
uguauacacaucuguguauau

SEQ ID NO: 1038875 - RNA, 24 nt, Human
uguauacacgucuaggcguauaug

SEQ ID NO: 1038876 - RNA, 21 nt, Human
uguauacguguauacacaucu

SEQ ID NO: 1038877 - RNA, 22 nt, Human
ugucuacacgucuguguauaug

SEQ ID NO: 1038878 - RNA, 18 nt, Human
ugucuacaugugucuaug

SEQ ID NO: 1038879 - RNA, 19 nt, Human
ugucuacaugugucuaugu

SEQ ID NO: 1038880 - RNA, 18 nt, Human
uguguacgugucuguaua

SEQ ID NO: 1038881 - RNA, 19 nt, Human
uguguacgugucuguauac

SEQ ID NO: 1038882 - RNA, 28 nt, Human
uguguacgugucuguauacguguauaca

SEQ ID NO: 1038883 - RNA, 23 nt, Human
uguguauauguuugugucuacau

SEQ ID NO: 1038884 - RNA, 24 nt, Human
uguguauauguuugugucuacaug

SEQ ID NO: 1038885 - RNA, 25 nt, Human
uguguauauguuugugucuacaugu

SEQ ID NO: 1038886 - RNA, 20 nt, Human
ugugucuacacauguauaca

SEQ ID NO: 1038887 - RNA, 22 nt, Human
ugugucugcgugugugugcaug

SEQ ID NO: 1038888 - RNA, 18 nt, Human
uguguguacgugucugua

SEQ ID NO: 1038889 - RNA, 20 nt, Human
ugugugugucugcgugugug

SEQ ID NO: 1038890 - RNA, 21 nt, Human
ugugugugucugcgugugugu

SEQ ID NO: 1038891 - RNA, 21 nt, Human
ugugugugucugcgugugugu

SEQ ID NO: 1038892 - RNA, 22 nt, Human
ugugugugucugcgugugugug

SEQ ID NO: 1038893 - RNA, 23 nt, Human
uuaggcacagaagcccaacauuu

SEQ ID NO: 1038894 - RNA, 19 nt, Human
uucuacgaagaggauccca

SEQ ID NO: 1038895 - RNA, 22 nt, Human
agccuggcugggcuggcacggc

SEQ ID NO: 1038896 - RNA, 18 nt, Human
cccucccucucuggccac

SEQ ID NO: 1038897 - RNA, 19 nt, Human
cccuguggugaaacagagc

SEQ ID NO: 1038898 - RNA, 26 nt, Human
ccggggcaguuugggagauuccuucu

SEQ ID NO: 1038899 - RNA, 20 nt, Human
ccugugcagccuggcugggc

SEQ ID NO: 1038900 - RNA, 18 nt, Human
cuggccacagugagggau

SEQ ID NO: 1038901 - RNA, 24 nt, Human
cuguggugaaacagagcccucccu

SEQ ID NO: 1038902 - RNA, 21 nt, Human
gggauccagcaggaacccugc

SEQ ID NO: 1038903 - RNA, 22 nt, Human
gugcagccuggcugggcuggca

SEQ ID NO: 1038904 - RNA, 24 nt, Human
ugaaacagagcccucccucucugg

SEQ ID NO: 1038905 - RNA, 24 nt, Human
ugccugugcagccuggcugggcug

SEQ ID NO: 1038906 - RNA, 18 nt, Human
aaaagggguauggacaga

SEQ ID NO: 1038907 - RNA, 21 nt, Human
aaauccacaacaggaucaaag

SEQ ID NO: 1038908 - RNA, 18 nt, Human
aaggauggcuugaaggca

SEQ ID NO: 1038909 - RNA, 19 nt, Human
aucucacuuccuccucuua

SEQ ID NO: 1038910 - RNA, 21 nt, Human
caaaacauacagcagaaagga

SEQ ID NO: 1038911 - RNA, 23 nt, Human
ccacauuaucuguuguguaucua

SEQ ID NO: 1038912 - RNA, 23 nt, Human
ccuugaggaggaaguaaaagggg

SEQ ID NO: 1038913 - RNA, 21 nt, Human
cucuccacauuaucuguugug

SEQ ID NO: 1038914 - RNA, 21 nt, Human
cuuccuccucuuaugucuuuu

SEQ ID NO: 1038915 - RNA, 21 nt, Human
gcugacagugccacagugccu

SEQ ID NO: 1038916 - RNA, 21 nt, Human
gcugugucuucuacuucuugu

SEQ ID NO: 1038917 - RNA, 19 nt, Human
uaaaagggguauggacaga

SEQ ID NO: 1038918 - RNA, 21 nt, Human
uaaauaaauccacaacaggau

SEQ ID NO: 1038919 - RNA, 22 nt, Human
uagaaggcugcaaaacauacag

SEQ ID NO: 1038920 - RNA, 20 nt, Human
uccaaaugauguuuucuggc

SEQ ID NO: 1038921 - RNA, 21 nt, Human
uccacauuaucuguuguguau

SEQ ID NO: 1038922 - RNA, 20 nt, Human
ucuccacauuaucuguugug

SEQ ID NO: 1038923 - RNA, 21 nt, Human
ugagcuuucuguccuccacag

SEQ ID NO: 1038924 - RNA, 19 nt, Human
uggcuugaaggcaauugau

SEQ ID NO: 1038925 - RNA, 18 nt, Human
aagucugccaggaguccu

SEQ ID NO: 1038926 - RNA, 20 nt, Human
aggcugaauuauuaaacacc

SEQ ID NO: 1038927 - RNA, 19 nt, Human
auccugugaugcugcugag

SEQ ID NO: 1038928 - RNA, 22 nt, Human
cacggcccccucggcacuggcc

SEQ ID NO: 1038929 - RNA, 19 nt, Human
cagauccagaaacaaggac

SEQ ID NO: 1038930 - RNA, 26 nt, Human
cagggaagcccagucuuuuccccuca

SEQ ID NO: 1038931 - RNA, 23 nt, Human
cagucuuuuccccucaggggcuu

SEQ ID NO: 1038932 - RNA, 23 nt, Human
ccagacagcuugaagucugccag

SEQ ID NO: 1038933 - RNA, 22 nt, Human
ccaugagccccagccucagcuc

SEQ ID NO: 1038934 - RNA, 20 nt, Human
cccacuuuuucuucuguguc

SEQ ID NO: 1038935 - RNA, 25 nt, Human
cccucggcacuggccgacacacuag

SEQ ID NO: 1038936 - RNA, 23 nt, Human
ccgcuccuugcccugccgccugg

SEQ ID NO: 1038937 - RNA, 19 nt, Human
ccucaggggcuucaucuaa

SEQ ID NO: 1038938 - RNA, 23 nt, Human
ccucaggggcuucaucuaacuuc

SEQ ID NO: 1038939 - RNA, 24 nt, Human
ccucucaccaggcaaugcagggag

SEQ ID NO: 1038940 - RNA, 24 nt, Human
ccugccgccuggagccaugagccc

SEQ ID NO: 1038941 - RNA, 18 nt, Human
ccuggagccaugagcccc

SEQ ID NO: 1038942 - RNA, 19 nt, Human
ccuuggagacagaggcgag

SEQ ID NO: 1038943 - RNA, 25 nt, Human
cuggcgacugcgaugaccuaucccc

SEQ ID NO: 1038944 - RNA, 21 nt, Human
cugugucuuuugucuuugggg

SEQ ID NO: 1038945 - RNA, 19 nt, Human
gagcugccggugcuggugg

SEQ ID NO: 1038946 - RNA, 21 nt, Human
gccaugagccccagccucagc

SEQ ID NO: 1038947 - RNA, 25 nt, Human
gccuggagccaugagccccagccuc

SEQ ID NO: 1038948 - RNA, 22 nt, Human
gcugguggggauggcuucuucu

SEQ ID NO: 1038949 - RNA, 21 nt, Human
ggagacagaggcgagggaaca

SEQ ID NO: 1038950 - RNA, 19 nt, Human
ggaguccugucauccugcu

SEQ ID NO: 1038951 - RNA, 20 nt, Human
ggggcaacccggcucuccuc

SEQ ID NO: 1038952 - RNA, 20 nt, Human
guggccaccaaggggcaacc

SEQ ID NO: 1038953 - RNA, 19 nt, Human
ucaccaggcaaugcaggga

SEQ ID NO: 1038954 - RNA, 22 nt, Human
ucaucuaacuucucacucucua

SEQ ID NO: 1038955 - RNA, 23 nt, Human
uccagaaacaaggacuuguggcc

SEQ ID NO: 1038956 - RNA, 23 nt, Human
ucccacuuuuucuucugugucuu

SEQ ID NO: 1038957 - RNA, 19 nt, Human
ucuuguuucucguuucugg

SEQ ID NO: 1038958 - RNA, 23 nt, Human
ucuuuggggguggccagacagcu

SEQ ID NO: 1038959 - RNA, 20 nt, Human
ucuuuugucuuugggggugg

SEQ ID NO: 1038960 - RNA, 24 nt, Human
ugagggacacucguguggacaggg

SEQ ID NO: 1038961 - RNA, 19 nt, Human
ugccaagagcugccggugc

SEQ ID NO: 1038962 - RNA, 18 nt, Human
ugcccugccgccuggagc

SEQ ID NO: 1038963 - RNA, 18 nt, Human
ugccggugcuggugggga

SEQ ID NO: 1038964 - RNA, 23 nt, Human
ugccggugcugguggggauggcu

SEQ ID NO: 1038965 - RNA, 21 nt, Human
ugcugagggcuggggagccuu

SEQ ID NO: 1038966 - RNA, 18 nt, Human
uggagacagaggcgaggg

SEQ ID NO: 1038967 - RNA, 18 nt, Human
uggccgacacacuagaaa

SEQ ID NO: 1038968 - RNA, 24 nt, Human
uggggcagauccagaaacaaggac

SEQ ID NO: 1038969 - RNA, 24 nt, Human
uggggcagauccagaaacaaggac

SEQ ID NO: 1038970 - RNA, 21 nt, Human
uggguugugaggagucaggac

SEQ ID NO: 1038971 - RNA, 21 nt, Human
ugucuuuugucuuugggggug

SEQ ID NO: 1038972 - RNA, 21 nt, Human
ugugucuuuugucuuuggggg

SEQ ID NO: 1038973 - RNA, 19 nt, Human
caucuugcaucccauccaa

SEQ ID NO: 1038974 - RNA, 19 nt, Human
ccccucacaagagaugagg

SEQ ID NO: 1038975 - RNA, 21 nt, Human
ccucacaagagaugaggugga

SEQ ID NO: 1038976 - RNA, 19 nt, Human
cuguggacugggugaaggc

SEQ ID NO: 1038977 - RNA, 22 nt, Human
uuccuguggacugggugaaggc

SEQ ID NO: 1038978 - RNA, 22 nt, Human
acugggucuucuaggggccugg

SEQ ID NO: 1038979 - RNA, 21 nt, Human
caacagaucuuuacugggucu

SEQ ID NO: 1038980 - RNA, 20 nt, Human
gaucccgcuuucccgcagac

SEQ ID NO: 1038981 - RNA, 23 nt, Human
gcagcgacccgacguccuggggu

SEQ ID NO: 1038982 - RNA, 21 nt, Human
gugcggccucggccgcgcacc

SEQ ID NO: 1038983 - RNA, 19 nt, Human
uacugggucuucuaggggc

SEQ ID NO: 1038984 - RNA, 21 nt, Human
uacugggucuucuaggggccu

SEQ ID NO: 1038985 - RNA, 24 nt, Human
uuuauucaacagaucuuuacuggg

SEQ ID NO: 1038986 - RNA, 18 nt, Human
aaggcagagaaagcucaa

SEQ ID NO: 1038987 - RNA, 22 nt, Human
aaguguccucuucaaauccucc

SEQ ID NO: 1038988 - RNA, 21 nt, Human
acaaccuccuuggaggaccaa

SEQ ID NO: 1038989 - RNA, 22 nt, Human
acaccgaggccagcaggccaaa

SEQ ID NO: 1038990 - RNA, 21 nt, Human
agaaagcucaacccacacuga

SEQ ID NO: 1038991 - RNA, 21 nt, Human
caaguguccucuucaaauccu

SEQ ID NO: 1038992 - RNA, 23 nt, Human
cacacugacaggaggaagagaca

SEQ ID NO: 1038993 - RNA, 23 nt, Human
caccgaggccagcaggccaaagc

SEQ ID NO: 1038994 - RNA, 20 nt, Human
cagcucuggaucugcagucu

SEQ ID NO: 1038995 - RNA, 21 nt, Human
cccacaccgaggccagcaggc

SEQ ID NO: 1038996 - RNA, 20 nt, Human
cccagcuugcaacugcugac

SEQ ID NO: 1038997 - RNA, 22 nt, Human
cucaaagccccacaccgaggcc

SEQ ID NO: 1038998 - RNA, 26 nt, Human
cucaaagccccacaccgaggccagca

SEQ ID NO: 1038999 - RNA, 23 nt, Human
cugacguaugcucaaagccccuc

SEQ ID NO: 1039000 - RNA, 18 nt, Human
cuggaucugcagucugga

SEQ ID NO: 1039001 - RNA, 21 nt, Human
gcagagaaagcucaacccaca

SEQ ID NO: 1039002 - RNA, 19 nt, Human
gccagcaggccaaagcuga

SEQ ID NO: 1039003 - RNA, 20 nt, Human
uccucuucaaauccuccuug

SEQ ID NO: 1039004 - RNA, 22 nt, Human
ugagaguaccgcacagaccagu

SEQ ID NO: 1039005 - RNA, 22 nt, Human
ugcucaaagccccacaccgagg

SEQ ID NO: 1039006 - RNA, 23 nt, Human
aagguccacauugaaaaaugaca

SEQ ID NO: 1039007 - RNA, 22 nt, Human
aggcuucuggacuuucagccuc

SEQ ID NO: 1039008 - RNA, 22 nt, Human
aucuucuuugguggaacuguua

SEQ ID NO: 1039009 - RNA, 19 nt, Human
cgccccggcugcagcugca

SEQ ID NO: 1039010 - RNA, 21 nt, Human
cgggaugcccacaacagacuc

SEQ ID NO: 1039011 - RNA, 23 nt, Human
cuaauagaaugccaaucuucuuu

SEQ ID NO: 1039012 - RNA, 22 nt, Human
cuuucagccucuucacagcucc

SEQ ID NO: 1039013 - RNA, 23 nt, Human
gcugcagcugcaccacggacucg

SEQ ID NO: 1039014 - RNA, 24 nt, Human
ucuuugguggaacuguuauucuua

SEQ ID NO: 1039015 - RNA, 25 nt, Human
uggacuuucagccucuucacagcuc

SEQ ID NO: 1039016 - RNA, 24 nt, Human
uggaguuguucuguugugcagaaa

SEQ ID NO: 1039017 - RNA, 24 nt, Human
aacaccauggggagagaggugccu

SEQ ID NO: 1039018 - RNA, 21 nt, Human
acaccaccaaauguggaaaac

SEQ ID NO: 1039019 - RNA, 26 nt, Human
accacucccugcugccagacacauac

SEQ ID NO: 1039020 - RNA, 18 nt, Human
agguagaugggcaggggg

SEQ ID NO: 1039021 - RNA, 21 nt, Human
aguacccacaccacucccugc

SEQ ID NO: 1039022 - RNA, 22 nt, Human
cccacaccacucccugcugcca

SEQ ID NO: 1039023 - RNA, 24 nt, Human
cccauacuucugcaggcccaccuc

SEQ ID NO: 1039024 - RNA, 20 nt, Human
ccccauacuucugcaggccc

SEQ ID NO: 1039025 - RNA, 22 nt, Human
gagcucggaggggaugaaggcc

SEQ ID NO: 1039026 - RNA, 20 nt, Human
ggcaggggguucuggccgca

SEQ ID NO: 1039027 - RNA, 23 nt, Human
ucccugcugccagacacauacag

SEQ ID NO: 1039028 - RNA, 19 nt, Human
ugaguuaaguacccacacc

SEQ ID NO: 1039029 - RNA, 22 nt, Human
uggggagagaggugccuggccc

SEQ ID NO: 1039030 - RNA, 19 nt, Human
uggggccaacuucuaccug

SEQ ID NO: 1039031 - RNA, 18 nt, Human
uugacauugauggugagg

SEQ ID NO: 1039032 - RNA, 21 nt, Human
uugauggugagguagaugggc

SEQ ID NO: 1039033 - RNA, 23 nt, Human
aaaaaaaaaauggaggaaaagaa

SEQ ID NO: 1039034 - RNA, 20 nt, Human
aacacgcuccgcuacuaaaa

SEQ ID NO: 1039035 - RNA, 27 nt, Human
agaaagagagagugggggguggguggg

SEQ ID NO: 1039036 - RNA, 20 nt, Human
agaagaaagagaaaggaugg

SEQ ID NO: 1039037 - RNA, 21 nt, Human
agagaaagagagagugggggg

SEQ ID NO: 1039038 - RNA, 23 nt, Human
agagaagaaagagaaaggauggc

SEQ ID NO: 1039039 - RNA, 20 nt, Human
aggcaggaucaacacgcucc

SEQ ID NO: 1039040 - RNA, 24 nt, Human
caaaaaaaaaauggaggaaaagaa

SEQ ID NO: 1039041 - RNA, 19 nt, Human
caaacggugcuuauuccca

SEQ ID NO: 1039042 - RNA, 22 nt, Human
cccagggguucuaccgcgaccg

SEQ ID NO: 1039043 - RNA, 24 nt, Human
ccccgagacagcuagucccggccu

SEQ ID NO: 1039044 - RNA, 19 nt, Human
gagagaaagagagaguggg

SEQ ID NO: 1039045 - RNA, 22 nt, Human
gaguggggggugggugggaaau

SEQ ID NO: 1039046 - RNA, 19 nt, Human
gccccgagacagcuagucc

SEQ ID NO: 1039047 - RNA, 22 nt, Human
uacaaaaaaaaaauggaggaaa

SEQ ID NO: 1039048 - RNA, 18 nt, Human
uggcaagagcuacucagg

SEQ ID NO: 1039049 - RNA, 18 nt, Human
uggcugcaucucaaacgg

SEQ ID NO: 1039050 - RNA, 20 nt, Human
uggggggugggugggaaaug

SEQ ID NO: 1039051 - RNA, 21 nt, Human
uggggggugggugggaaauga

SEQ ID NO: 1039052 - RNA, 22 nt, Human
ugggugggaaaugagagagaag

SEQ ID NO: 1039053 - RNA, 19 nt, Human
uuguacuacaaaaaaaaaa

SEQ ID NO: 1039054 - RNA, 22 nt, Human
agccgggccucaguguugaacc

SEQ ID NO: 1039055 - RNA, 20 nt, Human
agggugugagcugcugcacc

SEQ ID NO: 1039056 - RNA, 23 nt, Human
caccucacagccugguacacgcc

SEQ ID NO: 1039057 - RNA, 20 nt, Human
cacuccacagccggagcaca

SEQ ID NO: 1039058 - RNA, 24 nt, Human
cagcaguucaugggcaccaccuug

SEQ ID NO: 1039059 - RNA, 20 nt, Human
cagcugcccagcggcguccg

SEQ ID NO: 1039060 - RNA, 23 nt, Human
ccagcggcguccgcgggcccucc

SEQ ID NO: 1039061 - RNA, 25 nt, Human
ccagcggcguccgcgggcccuccuc

SEQ ID NO: 1039062 - RNA, 20 nt, Human
ccgcgggcccuccucacucu

SEQ ID NO: 1039063 - RNA, 20 nt, Human
cucaguguugaaccugaggu

SEQ ID NO: 1039064 - RNA, 26 nt, Human
cucaguguugaaccugagguucugga

SEQ ID NO: 1039065 - RNA, 21 nt, Human
cuccuggcuguggggcuucuc

SEQ ID NO: 1039066 - RNA, 21 nt, Human
gccccagcaguucaugggcac

SEQ ID NO: 1039067 - RNA, 22 nt, Human
gccugguacacgccccagcagu

SEQ ID NO: 1039068 - RNA, 25 nt, Human
uccacagccggagcacaccgggguc

SEQ ID NO: 1039069 - RNA, 23 nt, Human
uccuggcuguggggcuucuccag

SEQ ID NO: 1039070 - RNA, 23 nt, Human
ucuccaggaccccuccuggccuc

SEQ ID NO: 1039071 - RNA, 24 nt, Human
ugaagacccgcggccucaccaggg

SEQ ID NO: 1039072 - RNA, 22 nt, Human
ugagcugcugcaccugcuccug

SEQ ID NO: 1039073 - RNA, 25 nt, Human
uucaugggcaccaccuugccaggcc

SEQ ID NO: 1039074 - RNA, 20 nt, Human
uucuggauggucuuguuggc

SEQ ID NO: 1039075 - RNA, 21 nt, Human
aagcugcuccuccggaccccg

SEQ ID NO: 1039076 - RNA, 19 nt, Human
aggcggccgcccaggcagg

SEQ ID NO: 1039077 - RNA, 21 nt, Human
ccccccgcuuugcagccccgg

SEQ ID NO: 1039078 - RNA, 23 nt, Human
ccccccgcuuugcagccccgggc

SEQ ID NO: 1039079 - RNA, 20 nt, Human
ccccgggccgcccgccgccc

SEQ ID NO: 1039080 - RNA, 21 nt, Human
cccgggccgcccgccgccccc

SEQ ID NO: 1039081 - RNA, 18 nt, Human
ccgccgcccccgccccuc

SEQ ID NO: 1039082 - RNA, 21 nt, Human
ccuccggaccccgaucuugaa

SEQ ID NO: 1039083 - RNA, 22 nt, Human
gcggccccccgcuuugcagccc

SEQ ID NO: 1039084 - RNA, 19 nt, Human
gcggccgcccaggcaggcc

SEQ ID NO: 1039085 - RNA, 18 nt, Human
ggcccagggaggcggcgg

SEQ ID NO: 1039086 - RNA, 19 nt, Human
uaagugaaugucaucuucu

SEQ ID NO: 1039087 - RNA, 20 nt, Human
acacagguagccaccaggcc

SEQ ID NO: 1039088 - RNA, 19 nt, Human
agcccagcucucugcaggc

SEQ ID NO: 1039089 - RNA, 22 nt, Human
aggaacaggggcagccgggcca

SEQ ID NO: 1039090 - RNA, 20 nt, Human
aggaaggggaagaagggcuc

SEQ ID NO: 1039091 - RNA, 24 nt, Human
cacaggccuggcacgaggggcagg

SEQ ID NO: 1039092 - RNA, 19 nt, Human
caccagggucccacacucc

SEQ ID NO: 1039093 - RNA, 23 nt, Human
cacgcaagcaccgaugaucagcu

SEQ ID NO: 1039094 - RNA, 19 nt, Human
cagccccacagauguagca

SEQ ID NO: 1039095 - RNA, 18 nt, Human
caggcugcaggccagaug

SEQ ID NO: 1039096 - RNA, 22 nt, Human
caugugaguccugggaagaucu

SEQ ID NO: 1039097 - RNA, 20 nt, Human
cccgcacacaccaggguccc

SEQ ID NO: 1039098 - RNA, 22 nt, Human
cccgcacacaccagggucccac

SEQ ID NO: 1039099 - RNA, 22 nt, Human
cccgcacacaccagggucccac

SEQ ID NO: 1039100 - RNA, 19 nt, Human
cccggggcccagcucagcc

SEQ ID NO: 1039101 - RNA, 23 nt, Human
ccucaugcugcagccacugggcc

SEQ ID NO: 1039102 - RNA, 18 nt, Human
cgccaggagcuccagagc

SEQ ID NO: 1039103 - RNA, 23 nt, Human
cgccaggagcuccagagcuagag

SEQ ID NO: 1039104 - RNA, 24 nt, Human
cuggggcugcugggagguccucug

SEQ ID NO: 1039105 - RNA, 21 nt, Human
cuucccggggcccagcucagc

SEQ ID NO: 1039106 - RNA, 21 nt, Human
gcacacaccagggucccacac

SEQ ID NO: 1039107 - RNA, 18 nt, Human
gcagccacugggccagca

SEQ ID NO: 1039108 - RNA, 18 nt, Human
gcaggcggggacacagcc

SEQ ID NO: 1039109 - RNA, 19 nt, Human
gcaggcugcaggccagaug

SEQ ID NO: 1039110 - RNA, 18 nt, Human
gcuggaacuccuucccgg

SEQ ID NO: 1039111 - RNA, 24 nt, Human
ggaggugacuucugggggggaucc

SEQ ID NO: 1039112 - RNA, 20 nt, Human
ggcaggcggggacacagcuc

SEQ ID NO: 1039113 - RNA, 23 nt, Human
ggcgggguucacguugagcugga

SEQ ID NO: 1039114 - RNA, 26 nt, Human
gggcaggcggggacacagcucuggcc

SEQ ID NO: 1039115 - RNA, 24 nt, Human
guagcagagcacacagguagccac

SEQ ID NO: 1039116 - RNA, 19 nt, Human
uauuccaagcgugcucagc

SEQ ID NO: 1039117 - RNA, 21 nt, Human
uauuccaagcgugcucagccc

SEQ ID NO: 1039118 - RNA, 19 nt, Human
uccaccaacaggcuguggc

SEQ ID NO: 1039119 - RNA, 24 nt, Human
uccagagcuagagcuuagugagaa

SEQ ID NO: 1039120 - RNA, 20 nt, Human
uccaguggguauuccaagcg

SEQ ID NO: 1039121 - RNA, 22 nt, Human
ucccacacuccacgcaagcacc

SEQ ID NO: 1039122 - RNA, 24 nt, Human
ucccacacuccacgcaagcaccga

SEQ ID NO: 1039123 - RNA, 21 nt, Human
ucccggggcccagcucagccc

SEQ ID NO: 1039124 - RNA, 18 nt, Human
uccugggaagaucuggcc

SEQ ID NO: 1039125 - RNA, 21 nt, Human
ucuccugcugacaaaagaagc

SEQ ID NO: 1039126 - RNA, 23 nt, Human
ucuucuccugcugacaaaagaag

SEQ ID NO: 1039127 - RNA, 23 nt, Human
ugagcccuuggcccgcacacacc

SEQ ID NO: 1039128 - RNA, 19 nt, Human
ugcauggaggugacuucug

SEQ ID NO: 1039129 - RNA, 18 nt, Human
ugccaagggcaggcgggg

SEQ ID NO: 1039130 - RNA, 18 nt, Human
ugcugggagguccucugc

SEQ ID NO: 1039131 - RNA, 20 nt, Human
uucccggggcccagcucagc

SEQ ID NO: 1039132 - RNA, 24 nt, Human
uucccggggcccagcucagccccc

SEQ ID NO: 1039133 - RNA, 19 nt, Human
aacgcuuccccggucgccc

SEQ ID NO: 1039134 - RNA, 23 nt, Human
aauccagcucugcugcaccaccu

SEQ ID NO: 1039135 - RNA, 18 nt, Human
acgccgggcuccugcgcg

SEQ ID NO: 1039136 - RNA, 21 nt, Human
agacuccuccacgccgggcuc

SEQ ID NO: 1039137 - RNA, 21 nt, Human
agccagagacagcgcagcccu

SEQ ID NO: 1039138 - RNA, 21 nt, Human
caacucaguuugggccuccag

SEQ ID NO: 1039139 - RNA, 26 nt, Human
cagaagaacccacacauauuuccuua

SEQ ID NO: 1039140 - RNA, 23 nt, Human
cagcccaacgcuuccccggucgc

SEQ ID NO: 1039141 - RNA, 21 nt, Human
cauuaucaccacucuguuucu

SEQ ID NO: 1039142 - RNA, 22 nt, Human
ccacacauauuuccuuaggauc

SEQ ID NO: 1039143 - RNA, 22 nt, Human
cccacacauauuuccuuaggau

SEQ ID NO: 1039144 - RNA, 26 nt, Human
cccagcccagccagagaguacccucu

SEQ ID NO: 1039145 - RNA, 23 nt, Human
cccauuaucaccacucuguuucu

SEQ ID NO: 1039146 - RNA, 22 nt, Human
cccgcagacuccuccacgccgg

SEQ ID NO: 1039147 - RNA, 19 nt, Human
cccucuuuccuucuucgcc

SEQ ID NO: 1039148 - RNA, 20 nt, Human
ccuccacgccgggcuccugc

SEQ ID NO: 1039149 - RNA, 21 nt, Human
ccugucgcaggcuccgagggc

SEQ ID NO: 1039150 - RNA, 18 nt, Human
cucaauuuuacggagcaa

SEQ ID NO: 1039151 - RNA, 19 nt, Human
cuccuccacgccgggcucc

SEQ ID NO: 1039152 - RNA, 24 nt, Human
gagagguuuucaauggucuugaug

SEQ ID NO: 1039153 - RNA, 21 nt, Human
gcagcccccucggccugcgcu

SEQ ID NO: 1039154 - RNA, 21 nt, Human
gccccagcccagccagagagu

SEQ ID NO: 1039155 - RNA, 20 nt, Human
gcgaagugaccaccugaccc

SEQ ID NO: 1039156 - RNA, 21 nt, Human
ggacugggaggcaggagaggu

SEQ ID NO: 1039157 - RNA, 19 nt, Human
gggcccagguucgcggcgg

SEQ ID NO: 1039158 - RNA, 18 nt, Human
gggcuccugcgcgcaauc

SEQ ID NO: 1039159 - RNA, 22 nt, Human
guguacucuuccagguucucaa

SEQ ID NO: 1039160 - RNA, 23 nt, Human
guugcugagguuaagagcaucca

SEQ ID NO: 1039161 - RNA, 26 nt, Human
uaagagcauccaguuucugcagaggu

SEQ ID NO: 1039162 - RNA, 21 nt, Human
uaauuucuuccuugcagcccc

SEQ ID NO: 1039163 - RNA, 19 nt, Human
uacagcccaacgcuucccc

SEQ ID NO: 1039164 - RNA, 22 nt, Human
uacccucuuuccuucuucgcca

SEQ ID NO: 1039165 - RNA, 23 nt, Human
uacggccccagcccagccagaga

SEQ ID NO: 1039166 - RNA, 27 nt, Human
uauaaagcuugugcugcuugcagaguu

SEQ ID NO: 1039167 - RNA, 19 nt, Human
uaugcuacauauaacuggg

SEQ ID NO: 1039168 - RNA, 21 nt, Human
uccuccacgccgggcuccugc

SEQ ID NO: 1039169 - RNA, 22 nt, Human
uccuugcagcccccucggccug

SEQ ID NO: 1039170 - RNA, 19 nt, Human
ucgcaggcuccgagggcuc

SEQ ID NO: 1039171 - RNA, 23 nt, Human
ucucaaugcgaucaaaaccuuua

SEQ ID NO: 1039172 - RNA, 23 nt, Human
ucugcagccagagacagcgcagc

SEQ ID NO: 1039173 - RNA, 24 nt, Human
ugcgaagugaccaccugacccauu

SEQ ID NO: 1039174 - RNA, 21 nt, Human
ugcgcgcaauccagcucugcu

SEQ ID NO: 1039175 - RNA, 18 nt, Human
ugggugugcgaagugacc

SEQ ID NO: 1039176 - RNA, 21 nt, Human
ugucagaagaacccacacaua

SEQ ID NO: 1039177 - RNA, 18 nt, Human
uugcagcccccucggccu

SEQ ID NO: 1039178 - RNA, 25 nt, Human
aaagagaaagaagaggggaauccaa

SEQ ID NO: 1039179 - RNA, 21 nt, Human
aaagaugagaccugcucgaau

SEQ ID NO: 1039180 - RNA, 23 nt, Human
aagaagaggggaauccaaaugaa

SEQ ID NO: 1039181 - RNA, 23 nt, Human
aagguuuggggugacuuguggau

SEQ ID NO: 1039182 - RNA, 21 nt, Human
aauauuuauaaguuuuccucu

SEQ ID NO: 1039183 - RNA, 19 nt, Human
acgcugcaggccacaggcu

SEQ ID NO: 1039184 - RNA, 19 nt, Human
acuucauccccagcaacaa

SEQ ID NO: 1039185 - RNA, 21 nt, Human
acuuccuucucuucuuuucuu

SEQ ID NO: 1039186 - RNA, 24 nt, Human
auaaagaugagaccugcucgaaug

SEQ ID NO: 1039187 - RNA, 23 nt, Human
auaacaucaaaaacaugagauau

SEQ ID NO: 1039188 - RNA, 22 nt, Human
aucaguuucuuuuacuauuuuu

SEQ ID NO: 1039189 - RNA, 25 nt, Human
aucuggaugguuccaggcauaaagg

SEQ ID NO: 1039190 - RNA, 22 nt, Human
augguuccaggcauaaagauga

SEQ ID NO: 1039191 - RNA, 19 nt, Human
caagacaaaacuuauauuc

SEQ ID NO: 1039192 - RNA, 20 nt, Human
caauugcuuucccuugcagu

SEQ ID NO: 1039193 - RNA, 26 nt, Human
cacacagugaugagugguggaugcuc

SEQ ID NO: 1039194 - RNA, 18 nt, Human
caccacagggcugggcuu

SEQ ID NO: 1039195 - RNA, 21 nt, Human
caccacugccacacgaucccc

SEQ ID NO: 1039196 - RNA, 20 nt, Human
cagcaccacugccacacgau

SEQ ID NO: 1039197 - RNA, 22 nt, Human
cagccaccacucaggcacucgg

SEQ ID NO: 1039198 - RNA, 18 nt, Human
caggaucaccagccacca

SEQ ID NO: 1039199 - RNA, 19 nt, Human
caggugaaacaacguggua

SEQ ID NO: 1039200 - RNA, 24 nt, Human
caguggauuucaucuggaugguuc

SEQ ID NO: 1039201 - RNA, 18 nt, Human
ccaaagggaaaagaaaga

SEQ ID NO: 1039202 - RNA, 21 nt, Human
ccaaagggaaaagaaagagaa

SEQ ID NO: 1039203 - RNA, 22 nt, Human
ccaaagggaaaagaaagagaaa

SEQ ID NO: 1039204 - RNA, 22 nt, Human
ccaaaugaaugucucuuagaug

SEQ ID NO: 1039205 - RNA, 19 nt, Human
ccaaggcaagacaaaacuu

SEQ ID NO: 1039206 - RNA, 19 nt, Human
ccaagggcccaaagggaaa

SEQ ID NO: 1039207 - RNA, 19 nt, Human
ccaggaucaccagccacca

SEQ ID NO: 1039208 - RNA, 18 nt, Human
cccacgcugcaggccaca

SEQ ID NO: 1039209 - RNA, 20 nt, Human
cccacgcugcaggccacagg

SEQ ID NO: 1039210 - RNA, 21 nt, Human
ccccacacacaagucuuccug

SEQ ID NO: 1039211 - RNA, 21 nt, Human
cccgagaggacguuggcugcc

SEQ ID NO: 1039212 - RNA, 24 nt, Human
cccucuccuuuucacucucucuca

SEQ ID NO: 1039213 - RNA, 19 nt, Human
cccucucuuucuuucuugu

SEQ ID NO: 1039214 - RNA, 22 nt, Human
cccucucuuucuuucuuguguu

SEQ ID NO: 1039215 - RNA, 28 nt, Human
cccuuucaucuccucuuuccuuucuucc

SEQ ID NO: 1039216 - RNA, 19 nt, Human
cccuuucucccucucuuuc

SEQ ID NO: 1039217 - RNA, 18 nt, Human
ccucucuccuucuuuccc

SEQ ID NO: 1039218 - RNA, 19 nt, Human
ccucucuuucucccucucu

SEQ ID NO: 1039219 - RNA, 22 nt, Human
ccugcucgaaugcagcccagga

SEQ ID NO: 1039220 - RNA, 19 nt, Human
ccuucccauucacccacca

SEQ ID NO: 1039221 - RNA, 19 nt, Human
ccuucuuucccuacuuuau

SEQ ID NO: 1039222 - RNA, 21 nt, Human
ccuucuuucccuacuuuauuu

SEQ ID NO: 1039223 - RNA, 18 nt, Human
ccuuucuuccuccuuccc

SEQ ID NO: 1039224 - RNA, 18 nt, Human
ccuuuuuuucuguuaccc

SEQ ID NO: 1039225 - RNA, 22 nt, Human
cgcugcaggccacaggcucccg

SEQ ID NO: 1039226 - RNA, 18 nt, Human
cggggcagcaccacugcc

SEQ ID NO: 1039227 - RNA, 21 nt, Human
cuaaugucccaaccccacaca

SEQ ID NO: 1039228 - RNA, 19 nt, Human
cucccuuucucccucucuu

SEQ ID NO: 1039229 - RNA, 22 nt, Human
cuccuuuucacucucucucauu

SEQ ID NO: 1039230 - RNA, 23 nt, Human
cucucuuucuuucuuguguucuu

SEQ ID NO: 1039231 - RNA, 18 nt, Human
cucugacccugacaguuc

SEQ ID NO: 1039232 - RNA, 20 nt, Human
cugcuggcuguuuucacuca

SEQ ID NO: 1039233 - RNA, 22 nt, Human
cuuucccuacuuuauuucuuuu

SEQ ID NO: 1039234 - RNA, 25 nt, Human
cuuucccuacuuuauuucuuuuuca

SEQ ID NO: 1039235 - RNA, 26 nt, Human
cuuuccuuucuucucuuuauuuuucu

SEQ ID NO: 1039236 - RNA, 25 nt, Human
cuuuccuuuuuuucuguuacccucu

SEQ ID NO: 1039237 - RNA, 20 nt, Human
cuuucucccucucuuucuuu

SEQ ID NO: 1039238 - RNA, 19 nt, Human
gaggacguuggcugccugc

SEQ ID NO: 1039239 - RNA, 21 nt, Human
gcagcccaggaucaccagcca

SEQ ID NO: 1039240 - RNA, 18 nt, Human
gcaguuuuaauauuuccc

SEQ ID NO: 1039241 - RNA, 23 nt, Human
gcucuuucuucuuucucuuucuc

SEQ ID NO: 1039242 - RNA, 19 nt, Human
gggcugggcuugggagucg

SEQ ID NO: 1039243 - RNA, 20 nt, Human
guagauaacaucaaaaacau

SEQ ID NO: 1039244 - RNA, 21 nt, Human
guuggcugccugcuggcuguu

SEQ ID NO: 1039245 - RNA, 22 nt, Human
uaacaucaaaaacaugagauau

SEQ ID NO: 1039246 - RNA, 18 nt, Human
uaauuccuuccccuuccc

SEQ ID NO: 1039247 - RNA, 30 nt, Human
uagaugccacacacaggugaaacaacgugg

SEQ ID NO: 1039248 - RNA, 27 nt, Human
uagccuuggccuuagacaucugcaacc

SEQ ID NO: 1039249 - RNA, 18 nt, Human
uaguaguuucuugaaguu

SEQ ID NO: 1039250 - RNA, 23 nt, Human
uauuuuuacaauuuuuuucucuc

SEQ ID NO: 1039251 - RNA, 19 nt, Human
ucacucaguucucugaaau

SEQ ID NO: 1039252 - RNA, 21 nt, Human
ucauaggaaggccaagggccc

SEQ ID NO: 1039253 - RNA, 21 nt, Human
uccaggcauaaagaugagacc

SEQ ID NO: 1039254 - RNA, 19 nt, Human
uccccagcaacaauagccu

SEQ ID NO: 1039255 - RNA, 25 nt, Human
uccccagcaacaauagccuuggccu

SEQ ID NO: 1039256 - RNA, 23 nt, Human
ucuaacaugguaaaguuuugugc

SEQ ID NO: 1039257 - RNA, 24 nt, Human
ucucagacaccaguagcuuaauuc

SEQ ID NO: 1039258 - RNA, 24 nt, Human
ucucauuccuucccuuucuucuuu

SEQ ID NO: 1039259 - RNA, 20 nt, Human
ucucccuuucucccucucuu

SEQ ID NO: 1039260 - RNA, 26 nt, Human
ucucccuuucucccucucuuucuccc

SEQ ID NO: 1039261 - RNA, 24 nt, Human
ucucucauuccuucccuuucuucu

SEQ ID NO: 1039262 - RNA, 24 nt, Human
ucucuucuuuucuuccugucuucc

SEQ ID NO: 1039263 - RNA, 19 nt, Human
ucuuuauuucuuuccuuuc

SEQ ID NO: 1039264 - RNA, 22 nt, Human
ucuuucuucuuucucuuucucu

SEQ ID NO: 1039265 - RNA, 19 nt, Human
ucuuuucuuccugucuucc

SEQ ID NO: 1039266 - RNA, 19 nt, Human
ugacuucauccccagcaac

SEQ ID NO: 1039267 - RNA, 21 nt, Human
ugauucuaaugucccaacccc

SEQ ID NO: 1039268 - RNA, 22 nt, Human
ugccacacacaggugaaacaac

SEQ ID NO: 1039269 - RNA, 24 nt, Human
ugccugcuggcuguuuucacucag

SEQ ID NO: 1039270 - RNA, 22 nt, Human
ugcuaauaaccaaggcaagaca

SEQ ID NO: 1039271 - RNA, 18 nt, Human
uggcugccugcuggcugu

SEQ ID NO: 1039272 - RNA, 23 nt, Human
ugguauuuauaaugcaucugggu

SEQ ID NO: 1039273 - RNA, 23 nt, Human
uuaauuccuuccccuucccauuc

SEQ ID NO: 1039274 - RNA, 23 nt, Human
uuagacaucugcaaccuauacag

SEQ ID NO: 1039275 - RNA, 23 nt, Human
uucuaucuuuucucccccuuuca

SEQ ID NO: 1039276 - RNA, 18 nt, Human
uucucccucucuuucucc

SEQ ID NO: 1039277 - RNA, 21 nt, Human
uucucuuuauuuuucugauuc

SEQ ID NO: 1039278 - RNA, 23 nt, Human
uuuccucuuuacuuccuucucuu

SEQ ID NO: 1039279 - RNA, 22 nt, Human
uuuuuuucucucccuuucuccc

SEQ ID NO: 1039280 - RNA, 19 nt, Human
aaaccaccuaccauccccg

SEQ ID NO: 1039281 - RNA, 18 nt, Human
acaaaggugucaaagaga

SEQ ID NO: 1039282 - RNA, 21 nt, Human
accugagugaaguuaaggaac

SEQ ID NO: 1039283 - RNA, 23 nt, Human
auccucuuguuuggcuucuguua

SEQ ID NO: 1039284 - RNA, 20 nt, Human
auggugcugguggccuggcc

SEQ ID NO: 1039285 - RNA, 19 nt, Human
caaaccaccuaccaucccc

SEQ ID NO: 1039286 - RNA, 21 nt, Human
caaagagacuuggccaggccu

SEQ ID NO: 1039287 - RNA, 22 nt, Human
cacuccacaaaggugucaaaga

SEQ ID NO: 1039288 - RNA, 24 nt, Human
caucagccagaggagccagccaac

SEQ ID NO: 1039289 - RNA, 23 nt, Human
ccaaaccaccuaccauccccgcu

SEQ ID NO: 1039290 - RNA, 18 nt, Human
ccaggccaaacugaaaug

SEQ ID NO: 1039291 - RNA, 21 nt, Human
ccaggccaaacugaaauguaa

SEQ ID NO: 1039292 - RNA, 21 nt, Human
ccccgccgccgccgccucuuc

SEQ ID NO: 1039293 - RNA, 24 nt, Human
ccccgccgccgccgccucuucuuc

SEQ ID NO: 1039294 - RNA, 19 nt, Human
ccgcugcccuucuucagag

SEQ ID NO: 1039295 - RNA, 22 nt, Human
cggcggguccaaaccaccuacc

SEQ ID NO: 1039296 - RNA, 20 nt, Human
cuacccccgccgccgccgcc

SEQ ID NO: 1039297 - RNA, 20 nt, Human
cucuagaguggaccccucug

SEQ ID NO: 1039298 - RNA, 22 nt, Human
cuggguaaagacuaguuuccac

SEQ ID NO: 1039299 - RNA, 25 nt, Human
cuuucuggaaacgacggcggcccgg

SEQ ID NO: 1039300 - RNA, 20 nt, Human
gcagugaccgcugcccuucu

SEQ ID NO: 1039301 - RNA, 21 nt, Human
gcagugaccgcugcccuucuu

SEQ ID NO: 1039302 - RNA, 22 nt, Human
gcccauguaccucaacaugcca

SEQ ID NO: 1039303 - RNA, 20 nt, Human
gcuggcccauguaccucaac

SEQ ID NO: 1039304 - RNA, 19 nt, Human
ggugcugguggccuggccu

SEQ ID NO: 1039305 - RNA, 28 nt, Human
uacccccgccgccgccgccucuucuucc

SEQ ID NO: 1039306 - RNA, 20 nt, Human
uccaggcucccuacccccgc

SEQ ID NO: 1039307 - RNA, 20 nt, Human
ucgcugccgcuggcccaugu

SEQ ID NO: 1039308 - RNA, 22 nt, Human
ugaggucagggccaaucaccuc

SEQ ID NO: 1039309 - RNA, 21 nt, Human
ugcagugaccgcugcccuucu

SEQ ID NO: 1039310 - RNA, 19 nt, Human
ugccaucagccagaggagc

SEQ ID NO: 1039311 - RNA, 23 nt, Human
ugcccuugauccccgagggguuc

SEQ ID NO: 1039312 - RNA, 24 nt, Human
ugcuccagagguuccuccagucaa

SEQ ID NO: 1039313 - RNA, 19 nt, Human
uggaccccucuggauugga

SEQ ID NO: 1039314 - RNA, 21 nt, Human
uggccucuagaguggaccccu

SEQ ID NO: 1039315 - RNA, 22 nt, Human
uuaaggaacauguuccaagugu

SEQ ID NO: 1039316 - RNA, 20 nt, Human
uugcugcccagggucgauga

SEQ ID NO: 1039317 - RNA, 22 nt, Human
aagcagcccccuggaaacuucc

SEQ ID NO: 1039318 - RNA, 20 nt, Human
caaagcagcccccuggaaac

SEQ ID NO: 1039319 - RNA, 18 nt, Human
ugcaaagcagcccccugg

SEQ ID NO: 1039320 - RNA, 20 nt, Human
uuagugauaagggaguucuu

SEQ ID NO: 1039321 - RNA, 24 nt, Human
uuggauggggguuagugauaaggg

SEQ ID NO: 1039322 - RNA, 21 nt, Human
agagccuagugcaggagcuag

SEQ ID NO: 1039323 - RNA, 18 nt, Human
agcccccggagggaggga

SEQ ID NO: 1039324 - RNA, 18 nt, Human
agcccguccgcccagccc

SEQ ID NO: 1039325 - RNA, 28 nt, Human
cagcccccggagggagggacggugauug

SEQ ID NO: 1039326 - RNA, 21 nt, Human
ccguccgcccagcccccggag

SEQ ID NO: 1039327 - RNA, 21 nt, Human
ggcuggagguacgggcgcugc

SEQ ID NO: 1039328 - RNA, 21 nt, Human
ucugcagagccuggacaacca

SEQ ID NO: 1039329 - RNA, 18 nt, Human
ugauuggaugggagcugg

SEQ ID NO: 1039330 - RNA, 21 nt, Human
ugcagagccuggacaaccacc

SEQ ID NO: 1039331 - RNA, 25 nt, Human
ugcagagccuggacaaccaccgcca

SEQ ID NO: 1039332 - RNA, 18 nt, Human
uuggaugggagcuggggg

SEQ ID NO: 1039333 - RNA, 18 nt, Human
agaccaaagucccaagug

SEQ ID NO: 1039334 - RNA, 18 nt, Human
agagggccuaggcccaca

SEQ ID NO: 1039335 - RNA, 18 nt, Human
aggggcuggaugguggcc

SEQ ID NO: 1039336 - RNA, 21 nt, Human
caagaccaaagucccaagugg

SEQ ID NO: 1039337 - RNA, 22 nt, Human
ccaccagagggccuaggcccac

SEQ ID NO: 1039338 - RNA, 24 nt, Human
ccagcaagcgagggcagagcuggg

SEQ ID NO: 1039339 - RNA, 21 nt, Human
ccccgcgcugaccccggagac

SEQ ID NO: 1039340 - RNA, 22 nt, Human
ccccgcgcugaccccggagacc

SEQ ID NO: 1039341 - RNA, 18 nt, Human
ccccggagaccggccagc

SEQ ID NO: 1039342 - RNA, 18 nt, Human
ccccggagaccggccagc

SEQ ID NO: 1039343 - RNA, 21 nt, Human
ccccggagaccggccagcaag

SEQ ID NO: 1039344 - RNA, 20 nt, Human
cuggaugguggccccgcgcu

SEQ ID NO: 1039345 - RNA, 24 nt, Human
uggaaggaggggagccaccagugg

SEQ ID NO: 1039346 - RNA, 21 nt, Human
uggggcgggccccaaggggcu

SEQ ID NO: 1039347 - RNA, 19 nt, Human
uucagcaagaccaaagucc

SEQ ID NO: 1039348 - RNA, 22 nt, Human
uucagcaagaccaaagucccaa

SEQ ID NO: 1039349 - RNA, 18 nt, Human
acaauagaaggcaacugg

SEQ ID NO: 1039350 - RNA, 21 nt, Human
agaaaaaauauucacaccugu

SEQ ID NO: 1039351 - RNA, 25 nt, Human
agaaggcaacuggaaaagaggcaag

SEQ ID NO: 1039352 - RNA, 25 nt, Human
gacaauagaaggcaacuggaaaaga

SEQ ID NO: 1039353 - RNA, 20 nt, Human
uagaaggcaacuggaaaaga

SEQ ID NO: 1039354 - RNA, 19 nt, Human
aacccccugcugugcccag

SEQ ID NO: 1039355 - RNA, 18 nt, Human
aagcaggcucagcuucca

SEQ ID NO: 1039356 - RNA, 24 nt, Human
accccgccgccugggcgggcuguc

SEQ ID NO: 1039357 - RNA, 19 nt, Human
agacccgaggguagggcag

SEQ ID NO: 1039358 - RNA, 18 nt, Human
agagcuuggggugggggg

SEQ ID NO: 1039359 - RNA, 20 nt, Human
agagcuugggguggggggag

SEQ ID NO: 1039360 - RNA, 23 nt, Human
agccgugcacccggcagagcccc

SEQ ID NO: 1039361 - RNA, 19 nt, Human
aggcaaccagaggcccaga

SEQ ID NO: 1039362 - RNA, 21 nt, Human
aggcaccuccucgccagccug

SEQ ID NO: 1039363 - RNA, 22 nt, Human
aggcuggaccccucuacccagc

SEQ ID NO: 1039364 - RNA, 18 nt, Human
agggagcaggccaggagc

SEQ ID NO: 1039365 - RNA, 18 nt, Human
aggguggggaaaugugga

SEQ ID NO: 1039366 - RNA, 24 nt, Human
caaggcaaccagaggcccagaccc

SEQ ID NO: 1039367 - RNA, 20 nt, Human
caaguccugagccccguacu

SEQ ID NO: 1039368 - RNA, 19 nt, Human
caccacgggagcugucucc

SEQ ID NO: 1039369 - RNA, 18 nt, Human
cacccugcccucucccuc

SEQ ID NO: 1039370 - RNA, 21 nt, Human
caccuccucgccagccugugg

SEQ ID NO: 1039371 - RNA, 18 nt, Human
cacugcccguuccugcgc

SEQ ID NO: 1039372 - RNA, 20 nt, Human
cacuggacccaccaagaccc

SEQ ID NO: 1039373 - RNA, 20 nt, Human
cagccacugcccguuccugg

SEQ ID NO: 1039374 - RNA, 23 nt, Human
cagccugugggcugcacccacag

SEQ ID NO: 1039375 - RNA, 21 nt, Human
cagggaguugugggcccagag

SEQ ID NO: 1039376 - RNA, 22 nt, Human
caguggaugcacccugcccucu

SEQ ID NO: 1039377 - RNA, 19 nt, Human
caucugguuugaggucagg

SEQ ID NO: 1039378 - RNA, 24 nt, Human
caucugguuugaggucaggucauu

SEQ ID NO: 1039379 - RNA, 28 nt, Human
ccaccaagaccccgccgccugggcgggg

SEQ ID NO: 1039380 - RNA, 18 nt, Human
ccacgggccuuggggcac

SEQ ID NO: 1039381 - RNA, 21 nt, Human
ccagcaaagagaagcaccacg

SEQ ID NO: 1039382 - RNA, 20 nt, Human
ccagcagcagugacgcucag

SEQ ID NO: 1039383 - RNA, 25 nt, Human
cccaaggggagggccggcguccccg

SEQ ID NO: 1039384 - RNA, 23 nt, Human
cccagcaaagagaagcaccacgg

SEQ ID NO: 1039385 - RNA, 24 nt, Human
cccagcugcugugacacccaaggg

SEQ ID NO: 1039386 - RNA, 22 nt, Human
cccagcugucagccacugcccg

SEQ ID NO: 1039387 - RNA, 19 nt, Human
ccccagggacaaggcaacc

SEQ ID NO: 1039388 - RNA, 22 nt, Human
ccccgccgccugggcgggcugu

SEQ ID NO: 1039389 - RNA, 26 nt, Human
ccccgcgcgccgcgcgcuuccgccgg

SEQ ID NO: 1039390 - RNA, 19 nt, Human
ccgccgccugggcgggcug

SEQ ID NO: 1039391 - RNA, 22 nt, Human
ccucgccagacccgaggguagg

SEQ ID NO: 1039392 - RNA, 21 nt, Human
ccucugaguguucuggggagg

SEQ ID NO: 1039393 - RNA, 19 nt, Human
ccuuccauauacagagagu

SEQ ID NO: 1039394 - RNA, 18 nt, Human
cgggccuccccgcgcgcc

SEQ ID NO: 1039395 - RNA, 21 nt, Human
cgucuggguuccgaggguggg

SEQ ID NO: 1039396 - RNA, 23 nt, Human
cgugcacccggcagagccccgca

SEQ ID NO: 1039397 - RNA, 23 nt, Human
cuuccauauacagagagucccac

SEQ ID NO: 1039398 - RNA, 24 nt, Human
cuucccagcugucagccacugccc

SEQ ID NO: 1039399 - RNA, 18 nt, Human
gaaagcaggcucagcucc

SEQ ID NO: 1039400 - RNA, 19 nt, Human
gaccccgccgccugggcgg

SEQ ID NO: 1039401 - RNA, 22 nt, Human
gaggaggggguggggcggaggg

SEQ ID NO: 1039402 - RNA, 19 nt, Human
gaggggcaccauuaccacu

SEQ ID NO: 1039403 - RNA, 24 nt, Human
gagucccaccuccagcaaggguug

SEQ ID NO: 1039404 - RNA, 21 nt, Human
gaguguucuggggaggagggg

SEQ ID NO: 1039405 - RNA, 19 nt, Human
gcaccauuaccacuggacc

SEQ ID NO: 1039406 - RNA, 19 nt, Human
gcagcagugacgcucaggg

SEQ ID NO: 1039407 - RNA, 19 nt, Human
gcuccagcagagcuugggg

SEQ ID NO: 1039408 - RNA, 26 nt, Human
ggaaauguggaaaggcuccugcuggc

SEQ ID NO: 1039409 - RNA, 22 nt, Human
ggacccccaaguccugagcccc

SEQ ID NO: 1039410 - RNA, 20 nt, Human
ggaggggguggggcggaggg

SEQ ID NO: 1039411 - RNA, 21 nt, Human
ggcaccauuaccacuggaccc

SEQ ID NO: 1039412 - RNA, 19 nt, Human
ggccuggacucuccaaccc

SEQ ID NO: 1039413 - RNA, 23 nt, Human
gggagcugucucccaagagcccu

SEQ ID NO: 1039414 - RNA, 19 nt, Human
ggggaggaggggguggggc

SEQ ID NO: 1039415 - RNA, 20 nt, Human
ggggggagcucggugucacc

SEQ ID NO: 1039416 - RNA, 20 nt, Human
guccccgaagccaggucagc

SEQ ID NO: 1039417 - RNA, 19 nt, Human
gucccucugaguguucugg

SEQ ID NO: 1039418 - RNA, 23 nt, Human
gugcccaggacucccccagggac

SEQ ID NO: 1039419 - RNA, 19 nt, Human
uacagagagucccaccucc

SEQ ID NO: 1039420 - RNA, 18 nt, Human
ucagggccuucccagcug

SEQ ID NO: 1039421 - RNA, 25 nt, Human
ucaguucgggccuccccgcgcgccg

SEQ ID NO: 1039422 - RNA, 21 nt, Human
uccccagcggucuccggccgc

SEQ ID NO: 1039423 - RNA, 27 nt, Human
ucccccagggacaaggcaaccagaggc

SEQ ID NO: 1039424 - RNA, 22 nt, Human
uccccgaagccaggucagccgu

SEQ ID NO: 1039425 - RNA, 23 nt, Human
uccccgcgcgccgcgcgcuuccg

SEQ ID NO: 1039426 - RNA, 21 nt, Human
ucccucgccagacccgagggu

SEQ ID NO: 1039427 - RNA, 21 nt, Human
ucccucugaguguucugggga

SEQ ID NO: 1039428 - RNA, 22 nt, Human
ucccucugaguguucuggggag

SEQ ID NO: 1039429 - RNA, 26 nt, Human
ucccugggacacguggaggaccccca

SEQ ID NO: 1039430 - RNA, 27 nt, Human
uccguacugcagggagcaggccaggag

SEQ ID NO: 1039431 - RNA, 18 nt, Human
ucuccaacccccugcugu

SEQ ID NO: 1039432 - RNA, 22 nt, Human
ugacacccaaggggagggccgg

SEQ ID NO: 1039433 - RNA, 21 nt, Human
ugcugugcccaggacuccccc

SEQ ID NO: 1039434 - RNA, 22 nt, Human
ugcugugcccaggacuccccca

SEQ ID NO: 1039435 - RNA, 18 nt, Human
uggaggggaggggcacca

SEQ ID NO: 1039436 - RNA, 18 nt, Human
uggaugcacccugcccuc

SEQ ID NO: 1039437 - RNA, 20 nt, Human
ugggcugcacccacagggaa

SEQ ID NO: 1039438 - RNA, 18 nt, Human
uggggaggaggggguggg

SEQ ID NO: 1039439 - RNA, 19 nt, Human
ugggguggggggagcucgg

SEQ ID NO: 1039440 - RNA, 23 nt, Human
uggguuccgaggguggggaaaug

SEQ ID NO: 1039441 - RNA, 19 nt, Human
ugugacacccaaggggagg

SEQ ID NO: 1039442 - RNA, 20 nt, Human
ugugggcccagcugcuguga

SEQ ID NO: 1039443 - RNA, 19 nt, Human
ugugggcugcacccacagg

SEQ ID NO: 1039444 - RNA, 24 nt, Human
uuccugucugugggcccagcugcu

SEQ ID NO: 1039445 - RNA, 19 nt, Human
uugugggcccagaggggcu

SEQ ID NO: 1039446 - RNA, 22 nt, Human
aaaagcacuggagaaggggcca

SEQ ID NO: 1039447 - RNA, 26 nt, Human
acuaauuuauucauuuaucaauacca

SEQ ID NO: 1039448 - RNA, 21 nt, Human
acucugguggacaccccuggc

SEQ ID NO: 1039449 - RNA, 21 nt, Human
agaaagacaggacagcgcugg

SEQ ID NO: 1039450 - RNA, 25 nt, Human
agaaagacaggacagcgcuggcaag

SEQ ID NO: 1039451 - RNA, 18 nt, Human
agcagcucuggggaaggc

SEQ ID NO: 1039452 - RNA, 25 nt, Human
agcauuggagaagggggcugcaggu

SEQ ID NO: 1039453 - RNA, 22 nt, Human
agcccuggugcacccuccccga

SEQ ID NO: 1039454 - RNA, 21 nt, Human
aggccuggugcacccuccccc

SEQ ID NO: 1039455 - RNA, 20 nt, Human
caagccaauggcagaucaca

SEQ ID NO: 1039456 - RNA, 24 nt, Human
caagccaauggcagaucacaugga

SEQ ID NO: 1039457 - RNA, 22 nt, Human
cacacugucacuaaaugcauca

SEQ ID NO: 1039458 - RNA, 24 nt, Human
cacccucccccagagcacuggaga

SEQ ID NO: 1039459 - RNA, 19 nt, Human
cacuggagaaggggacugc

SEQ ID NO: 1039460 - RNA, 19 nt, Human
cacuggagaagggggcugc

SEQ ID NO: 1039461 - RNA, 19 nt, Human
cacuggagaagggggcugc

SEQ ID NO: 1039462 - RNA, 20 nt, Human
cagguucucacagggugggg

SEQ ID NO: 1039463 - RNA, 18 nt, Human
cagugacucugggccucu

SEQ ID NO: 1039464 - RNA, 19 nt, Human
cauggaaagccugcuggcc

SEQ ID NO: 1039465 - RNA, 23 nt, Human
ccacuuccaacaugaacauacua

SEQ ID NO: 1039466 - RNA, 24 nt, Human
ccagacuagaaacuaacaaagcua

SEQ ID NO: 1039467 - RNA, 26 nt, Human
ccagacuagaaacuaacaaagcuaac

SEQ ID NO: 1039468 - RNA, 25 nt, Human
cccccagagcacuggagaagggggg

SEQ ID NO: 1039469 - RNA, 24 nt, Human
cccgcugccaccucagaagucugu

SEQ ID NO: 1039470 - RNA, 22 nt, Human
cccucccgcugccaccucagaa

SEQ ID NO: 1039471 - RNA, 21 nt, Human
cccuggugcacccuccccaaa

SEQ ID NO: 1039472 - RNA, 18 nt, Human
cccugguguacccucccc

SEQ ID NO: 1039473 - RNA, 21 nt, Human
cccuuccguggccuuccacaa

SEQ ID NO: 1039474 - RNA, 24 nt, Human
ccucccgcugccaccucagaaguc

SEQ ID NO: 1039475 - RNA, 18 nt, Human
ccugagcugaggguugcu

SEQ ID NO: 1039476 - RNA, 22 nt, Human
ccuggcuccacuggccacugaa

SEQ ID NO: 1039477 - RNA, 24 nt, Human
cgaaagcacuggagaagggggcca

SEQ ID NO: 1039478 - RNA, 24 nt, Human
cgaaagcacuggagaagggggcug

SEQ ID NO: 1039479 - RNA, 24 nt, Human
cgagagcacuggagaaggggacug

SEQ ID NO: 1039480 - RNA, 22 nt, Human
cgagagcacuggagaagggggc

SEQ ID NO: 1039481 - RNA, 22 nt, Human
cgagagcacuggagaagggggu

SEQ ID NO: 1039482 - RNA, 20 nt, Human
cgcagggaguagcgagugcc

SEQ ID NO: 1039483 - RNA, 21 nt, Human
cgggagaagggggccacggcu

SEQ ID NO: 1039484 - RNA, 18 nt, Human
cucaaggcgggggcaggc

SEQ ID NO: 1039485 - RNA, 21 nt, Human
cucugagccagucacucuugc

SEQ ID NO: 1039486 - RNA, 18 nt, Human
cuuacagcguggggcagc

SEQ ID NO: 1039487 - RNA, 18 nt, Human
cuuucuucuuuggggccu

SEQ ID NO: 1039488 - RNA, 18 nt, Human
gaccgagcugcuagcagc

SEQ ID NO: 1039489 - RNA, 18 nt, Human
gagaagggggccacggcu

SEQ ID NO: 1039490 - RNA, 18 nt, Human
gagaagggggccacggcu

SEQ ID NO: 1039491 - RNA, 18 nt, Human
gagaagggggccacggcu

SEQ ID NO: 1039492 - RNA, 18 nt, Human
gagaagggggcggcggcu

SEQ ID NO: 1039493 - RNA, 18 nt, Human
gagaagggggcgguggcu

SEQ ID NO: 1039494 - RNA, 22 nt, Human
gagaagggggcugcagguucuc

SEQ ID NO: 1039495 - RNA, 19 nt, Human
gagagcacuggagaagggg

SEQ ID NO: 1039496 - RNA, 22 nt, Human
gccagacuagaaacuaacaaag

SEQ ID NO: 1039497 - RNA, 19 nt, Human
gcuccacuggccacugaag

SEQ ID NO: 1039498 - RNA, 18 nt, Human
ggagaagggggccacggc

SEQ ID NO: 1039499 - RNA, 18 nt, Human
ggagaagggggccacggc

SEQ ID NO: 1039500 - RNA, 18 nt, Human
ggagaagggggccacggc

SEQ ID NO: 1039501 - RNA, 19 nt, Human
ggagaagggggcggcggcu

SEQ ID NO: 1039502 - RNA, 19 nt, Human
ggagaagggggcgguggcu

SEQ ID NO: 1039503 - RNA, 22 nt, Human
ggagagcacuggagaagggggc

SEQ ID NO: 1039504 - RNA, 23 nt, Human
ggccagaaagacaggacagcgcu

SEQ ID NO: 1039505 - RNA, 22 nt, Human
ggcccuggugcacccuccccaa

SEQ ID NO: 1039506 - RNA, 18 nt, Human
gggcugcaguuucucaag

SEQ ID NO: 1039507 - RNA, 23 nt, Human
ggggcggcggcuucuuacagcgu

SEQ ID NO: 1039508 - RNA, 25 nt, Human
gggggcugcagguucucacagggug

SEQ ID NO: 1039509 - RNA, 18 nt, Human
ggguggggcgggccuggu

SEQ ID NO: 1039510 - RNA, 18 nt, Human
ggguggggcgggccuggu

SEQ ID NO: 1039511 - RNA, 19 nt, Human
ggguggggcgggccuggug

SEQ ID NO: 1039512 - RNA, 22 nt, Human
ggugcacccuccccaaaagcac

SEQ ID NO: 1039513 - RNA, 22 nt, Human
ggugcacccuccccgagagcac

SEQ ID NO: 1039514 - RNA, 22 nt, Human
ggugcacccuccccgagagcac

SEQ ID NO: 1039515 - RNA, 22 nt, Human
ggugcacccuccccgagagcac

SEQ ID NO: 1039516 - RNA, 22 nt, Human
ggugcacccucccugagagcac

SEQ ID NO: 1039517 - RNA, 22 nt, Human
ggugcacccucccugagagcac

SEQ ID NO: 1039518 - RNA, 18 nt, Human
gguggggcgggccuggug

SEQ ID NO: 1039519 - RNA, 21 nt, Human
gugcacccuccccgaaagcac

SEQ ID NO: 1039520 - RNA, 19 nt, Human
gugggccagaaagacagga

SEQ ID NO: 1039521 - RNA, 24 nt, Human
uaaaugcaucaggcuuccacacag

SEQ ID NO: 1039522 - RNA, 27 nt, Human
uaacaaagcuaacacacugucacuaaa

SEQ ID NO: 1039523 - RNA, 23 nt, Human
uauauacuacauaggccuguaug

SEQ ID NO: 1039524 - RNA, 21 nt, Human
uauguguguauauacuacaua

SEQ ID NO: 1039525 - RNA, 21 nt, Human
uauucauuuaucaauaccaca

SEQ ID NO: 1039526 - RNA, 20 nt, Human
ucacaggguggggugggccu

SEQ ID NO: 1039527 - RNA, 20 nt, Human
ucacaggguggggugggccu

SEQ ID NO: 1039528 - RNA, 23 nt, Human
ucacauugucuccuucugaaacg

SEQ ID NO: 1039529 - RNA, 22 nt, Human
ucagugccauggcugucccaug

SEQ ID NO: 1039530 - RNA, 23 nt, Human
ucauaagcugacucagauuacac

SEQ ID NO: 1039531 - RNA, 24 nt, Human
uccacaaucaggagcccucaucug

SEQ ID NO: 1039532 - RNA, 23 nt, Human
uccacuggccacugaagcaagcc

SEQ ID NO: 1039533 - RNA, 20 nt, Human
uccccaaaagcacuggagaa

SEQ ID NO: 1039534 - RNA, 24 nt, Human
uccccaaaagcacuggagaagggg

SEQ ID NO: 1039535 - RNA, 24 nt, Human
ucccccagagcacuggagaagggg

SEQ ID NO: 1039536 - RNA, 24 nt, Human
uccccgaaagcacuggagaagggg

SEQ ID NO: 1039537 - RNA, 24 nt, Human
uccccgaaagcacuggagaagggg

SEQ ID NO: 1039538 - RNA, 24 nt, Human
uccccgagagcacuggagaagggg

SEQ ID NO: 1039539 - RNA, 24 nt, Human
uccccgagagcacuggagaagggg

SEQ ID NO: 1039540 - RNA, 24 nt, Human
uccccgagagcacuggagaagggg

SEQ ID NO: 1039541 - RNA, 24 nt, Human
uccccgagagcacuggagaagggg

SEQ ID NO: 1039542 - RNA, 24 nt, Human
uccccgagagcauuggagaagggg

SEQ ID NO: 1039543 - RNA, 24 nt, Human
ucccugagagcacgggagaagggg

SEQ ID NO: 1039544 - RNA, 24 nt, Human
ucccugagagcacuggagaagggg

SEQ ID NO: 1039545 - RNA, 21 nt, Human
ucucacaggguggggcaaccc

SEQ ID NO: 1039546 - RNA, 18 nt, Human
ucucacaggguggggcgg

SEQ ID NO: 1039547 - RNA, 18 nt, Human
ucucacaggguggggcgg

SEQ ID NO: 1039548 - RNA, 18 nt, Human
ucucacaggguggggcgg

SEQ ID NO: 1039549 - RNA, 22 nt, Human
ucuguguccaagacucuggugg

SEQ ID NO: 1039550 - RNA, 23 nt, Human
ugaagcaagccaauggcagauca

SEQ ID NO: 1039551 - RNA, 21 nt, Human
ugacucagauuacacucaagc

SEQ ID NO: 1039552 - RNA, 18 nt, Human
ugagagcacgggagaagg

SEQ ID NO: 1039553 - RNA, 18 nt, Human
ugagagcacuggagaagg

SEQ ID NO: 1039554 - RNA, 24 nt, Human
ugagagcacuggagaagggggcca

SEQ ID NO: 1039555 - RNA, 18 nt, Human
ugcguauguguguauaua

SEQ ID NO: 1039556 - RNA, 24 nt, Human
uggcaaggccacuuccaaagucuc

SEQ ID NO: 1039557 - RNA, 19 nt, Human
uggugcacccuccccgaaa

SEQ ID NO: 1039558 - RNA, 19 nt, Human
uggugcacccuccccgaga

SEQ ID NO: 1039559 - RNA, 19 nt, Human
uggugcacccuccccgaga

SEQ ID NO: 1039560 - RNA, 19 nt, Human
uggugcacccuccccgaga

SEQ ID NO: 1039561 - RNA, 19 nt, Human
uggugcacccucccugaga

SEQ ID NO: 1039562 - RNA, 19 nt, Human
uggugcacccucccugaga

SEQ ID NO: 1039563 - RNA, 19 nt, Human
uguuuuaacugugcaccac

SEQ ID NO: 1039564 - RNA, 19 nt, Human
uucacauugucuccuucug

SEQ ID NO: 1039565 - RNA, 22 nt, Human
uucauaagcugacucagauuac

SEQ ID NO: 1039566 - RNA, 18 nt, Human
uuccacacagggcagggc

SEQ ID NO: 1039567 - RNA, 22 nt, Human
uuccacacagggcagggcauuc

SEQ ID NO: 1039568 - RNA, 19 nt, Human
uuggagaagggggcugcag

SEQ ID NO: 1039569 - RNA, 21 nt, Human
uuguacguguguggcagggag

SEQ ID NO: 1039570 - RNA, 21 nt, Human
agcugcacagcaccacagccu

SEQ ID NO: 1039571 - RNA, 21 nt, Human
agcuggccuuggcagcugcac

SEQ ID NO: 1039572 - RNA, 19 nt, Human
aggcucagcaggcccacga

SEQ ID NO: 1039573 - RNA, 22 nt, Human
cacagcaccacagccugugugg

SEQ ID NO: 1039574 - RNA, 18 nt, Human
cacagccuguguggccag

SEQ ID NO: 1039575 - RNA, 18 nt, Human
cagggguucucucugcuc

SEQ ID NO: 1039576 - RNA, 18 nt, Human
ccagcuccgagcccggug

SEQ ID NO: 1039577 - RNA, 24 nt, Human
cccggcugcccuggccuccucucg

SEQ ID NO: 1039578 - RNA, 21 nt, Human
cccugaagacacgggggugag

SEQ ID NO: 1039579 - RNA, 21 nt, Human
ccggcugcccuggccuccucu

SEQ ID NO: 1039580 - RNA, 21 nt, Human
ccugacggagcuggccuuggc

SEQ ID NO: 1039581 - RNA, 22 nt, Human
ccuguguggccagucgcugccc

SEQ ID NO: 1039582 - RNA, 23 nt, Human
ccuucaguuucuugagcugcagc

SEQ ID NO: 1039583 - RNA, 23 nt, Human
cggcccaggguugcccugaagac

SEQ ID NO: 1039584 - RNA, 19 nt, Human
cucucgggcucccugcagc

SEQ ID NO: 1039585 - RNA, 21 nt, Human
cugacggagcuggccuuggca

SEQ ID NO: 1039586 - RNA, 19 nt, Human
cugcagcugcagccgggca

SEQ ID NO: 1039587 - RNA, 21 nt, Human
cugcagcugccggcccagggu

SEQ ID NO: 1039588 - RNA, 23 nt, Human
cuggccuuggcagcugcacagca

SEQ ID NO: 1039589 - RNA, 24 nt, Human
cuggccuuggcagcugcacagcac

SEQ ID NO: 1039590 - RNA, 23 nt, Human
gccuccacgcccggcuuccccau

SEQ ID NO: 1039591 - RNA, 23 nt, Human
gcugcugcugccacuggcacugc

SEQ ID NO: 1039592 - RNA, 25 nt, Human
gggaacccuggccagcuccgagccc

SEQ ID NO: 1039593 - RNA, 26 nt, Human
gggguucucucugcuccaggaugggg

SEQ ID NO: 1039594 - RNA, 23 nt, Human
guucucucugcuccaggaugggg

SEQ ID NO: 1039595 - RNA, 23 nt, Human
ugcacagcaccacagccugugug

SEQ ID NO: 1039596 - RNA, 27 nt, Human
ugcagccgggcauuuucagccucugcc

SEQ ID NO: 1039597 - RNA, 18 nt, Human
ugcccugaagacacgggg

SEQ ID NO: 1039598 - RNA, 22 nt, Human
ugcccugaagacacggggguga

SEQ ID NO: 1039599 - RNA, 23 nt, Human
ugcccuggccuccucucgggcuc

SEQ ID NO: 1039600 - RNA, 21 nt, Human
ugcuccaggauggggccccag

SEQ ID NO: 1039601 - RNA, 21 nt, Human
uggccagcuccgagcccggug

SEQ ID NO: 1039602 - RNA, 21 nt, Human
uggcugcugcugccacuggca

SEQ ID NO: 1039603 - RNA, 22 nt, Human
aaaacacugacaauacuccuug

SEQ ID NO: 1039604 - RNA, 21 nt, Human
aaacacaaaacacugacaaua

SEQ ID NO: 1039605 - RNA, 22 nt, Human
aaacgacaggcgagaaagaaac

SEQ ID NO: 1039606 - RNA, 19 nt, Human
aacaaggaaaucccagaac

SEQ ID NO: 1039607 - RNA, 22 nt, Human
aacaaggaaaucccagaacagu

SEQ ID NO: 1039608 - RNA, 22 nt, Human
aacaaucaagcaucuuauuacc

SEQ ID NO: 1039609 - RNA, 23 nt, Human
aagaaaaaaaaucaauuuaagac

SEQ ID NO: 1039610 - RNA, 21 nt, Human
aaggccaagaaaaaaaaucaa

SEQ ID NO: 1039611 - RNA, 20 nt, Human
aaguaauaaaaauaaaggcc

SEQ ID NO: 1039612 - RNA, 26 nt, Human
aauauuaagguuuauuuuuucuucca

SEQ ID NO: 1039613 - RNA, 20 nt, Human
accccauaccccaucacuuu

SEQ ID NO: 1039614 - RNA, 31 nt, Human
agaaugcuccugagaguccauaacuguuugg

SEQ ID NO: 1039615 - RNA, 21 nt, Human
aggcgagaaagaaacaaucga

SEQ ID NO: 1039616 - RNA, 24 nt, Human
agguguuuauaucugaguauauca

SEQ ID NO: 1039617 - RNA, 27 nt, Human
aguaauaaaaauaaaggccaagaaaaa

SEQ ID NO: 1039618 - RNA, 22 nt, Human
auauugcaucucugguggcaaa

SEQ ID NO: 1039619 - RNA, 23 nt, Human
caaaacacugacaauacuccuug

SEQ ID NO: 1039620 - RNA, 23 nt, Human
caaggaaaucccagaacagucca

SEQ ID NO: 1039621 - RNA, 23 nt, Human
cagaaugcuccugagaguccaua

SEQ ID NO: 1039622 - RNA, 25 nt, Human
cagauaaaacauuacugcuuaaaag

SEQ ID NO: 1039623 - RNA, 20 nt, Human
cagcagcgacggcucgggcu

SEQ ID NO: 1039624 - RNA, 21 nt, Human
cagcauuuuuguugguuuuuu

SEQ ID NO: 1039625 - RNA, 25 nt, Human
caguuuauauucuuaauuccccauu

SEQ ID NO: 1039626 - RNA, 20 nt, Human
ccaaacacaaaacacugaca

SEQ ID NO: 1039627 - RNA, 21 nt, Human
ccauccagcauuuuuguuggu

SEQ ID NO: 1039628 - RNA, 23 nt, Human
cggcagcccggccuccgcccgcc

SEQ ID NO: 1039629 - RNA, 22 nt, Human
cggcggcagcagcgacggcucg

SEQ ID NO: 1039630 - RNA, 23 nt, Human
cuccuccccucacacuucggcag

SEQ ID NO: 1039631 - RNA, 23 nt, Human
cuuuuuauccuuuaacauccauc

SEQ ID NO: 1039632 - RNA, 22 nt, Human
gagcaguuuguuuuuuuuuuuu

SEQ ID NO: 1039633 - RNA, 20 nt, Human
gcaguuuguuuuuuuuuuuu

SEQ ID NO: 1039634 - RNA, 20 nt, Human
gccaauuuaauaaaaguaaa

SEQ ID NO: 1039635 - RNA, 18 nt, Human
gcgacugaaaauaagggg

SEQ ID NO: 1039636 - RNA, 18 nt, Human
ggggaagagcgacugaaa

SEQ ID NO: 1039637 - RNA, 25 nt, Human
uaaaagggggcuaaaucuaacugau

SEQ ID NO: 1039638 - RNA, 21 nt, Human
uaaaauauaacucauaccuua

SEQ ID NO: 1039639 - RNA, 22 nt, Human
uaaaggccaagaaaaaaaauca

SEQ ID NO: 1039640 - RNA, 20 nt, Human
uaaauugauaugccaaaaug

SEQ ID NO: 1039641 - RNA, 18 nt, Human
uaacugaugacuaucuuc

SEQ ID NO: 1039642 - RNA, 18 nt, Human
uaagguuuauuuuuucuu

SEQ ID NO: 1039643 - RNA, 21 nt, Human
uaauaaaaauaaaggccaaga

SEQ ID NO: 1039644 - RNA, 19 nt, Human
uaccccaucacuuuuuauc

SEQ ID NO: 1039645 - RNA, 24 nt, Human
uagaaacaaauauccauucagaua

SEQ ID NO: 1039646 - RNA, 22 nt, Human
uagcacugaaaaucugaaauau

SEQ ID NO: 1039647 - RNA, 24 nt, Human
uaucccaaacacaaaacacugacu

SEQ ID NO: 1039648 - RNA, 24 nt, Human
ucugaguauaucauuaaauguuuu

SEQ ID NO: 1039649 - RNA, 25 nt, Human
ugagagcaguuuguuuuuuuuuuuu

SEQ ID NO: 1039650 - RNA, 20 nt, Human
uggcacaggcuaaacgacag

SEQ ID NO: 1039651 - RNA, 20 nt, Human
ugguaaacaaggaaauccca

SEQ ID NO: 1039652 - RNA, 24 nt, Human
uguaagaaggcuuuaaaaggauuu

SEQ ID NO: 1039653 - RNA, 22 nt, Human
ugucuagaaaguaucuccuaaa

SEQ ID NO: 1039654 - RNA, 20 nt, Human
uguuauccugacagaaguuu

SEQ ID NO: 1039655 - RNA, 20 nt, Human
uucauaccuaccccauaccc

SEQ ID NO: 1039656 - RNA, 25 nt, Human
uucauauagcacccaaacuucaaac

SEQ ID NO: 1039657 - RNA, 20 nt, Human
uuccagauugaaaguaacaa

SEQ ID NO: 1039658 - RNA, 20 nt, Human
uugcucccgaaguguggcac

SEQ ID NO: 1039659 - RNA, 24 nt, Human
uuuauccuuuaacauccauccagc

SEQ ID NO: 1039660 - RNA, 20 nt, Human
uuucauguuuagguuaacag

SEQ ID NO: 1039661 - RNA, 24 nt, Human
uuucauguuuagguuaacaggcac

SEQ ID NO: 1039662 - RNA, 22 nt, Human
aacaggagguuuuagcacucac

SEQ ID NO: 1039663 - RNA, 20 nt, Human
acacucaacaaaaguuaacc

SEQ ID NO: 1039664 - RNA, 18 nt, Human
agcauaaauggaauaauc

SEQ ID NO: 1039665 - RNA, 26 nt, Human
augaagauuaaauacauuaaggaaaa

SEQ ID NO: 1039666 - RNA, 21 nt, Human
cacaacugaauaaaccauuua

SEQ ID NO: 1039667 - RNA, 18 nt, Human
cacgugagagccagcucc

SEQ ID NO: 1039668 - RNA, 20 nt, Human
cagcauaaauggaauaauca

SEQ ID NO: 1039669 - RNA, 19 nt, Human
caguucauccaagcccauc

SEQ ID NO: 1039670 - RNA, 18 nt, Human
cauaaauggaauaaucaa

SEQ ID NO: 1039671 - RNA, 23 nt, Human
ccaagaucugauuuuuucacaaa

SEQ ID NO: 1039672 - RNA, 21 nt, Human
ccccaguucauccaagcccau

SEQ ID NO: 1039673 - RNA, 19 nt, Human
ccugcuaaacacucaacaa

SEQ ID NO: 1039674 - RNA, 21 nt, Human
cuaguaccugcuaaacacuca

SEQ ID NO: 1039675 - RNA, 18 nt, Human
gaagauuaaauacauuaa

SEQ ID NO: 1039676 - RNA, 21 nt, Human
ggggcuaauaauagcacccau

SEQ ID NO: 1039677 - RNA, 21 nt, Human
uaguaugucccuaguaccugc

SEQ ID NO: 1039678 - RNA, 26 nt, Human
ucaauauaguuguccucguccuuaau

SEQ ID NO: 1039679 - RNA, 24 nt, Human
uccagcauaaauggaauaaucaaa

SEQ ID NO: 1039680 - RNA, 20 nt, Human
uccauuacuggaacgcuaag

SEQ ID NO: 1039681 - RNA, 18 nt, Human
ucccugaaccucaguugc

SEQ ID NO: 1039682 - RNA, 19 nt, Human
ucccugaaccucaguugcc

SEQ ID NO: 1039683 - RNA, 21 nt, Human
ugccccaguucauccaagccc

SEQ ID NO: 1039684 - RNA, 21 nt, Human
uggggggacaaaacucuagag

SEQ ID NO: 1039685 - RNA, 20 nt, Human
uuugcacaacugaauaaacc

SEQ ID NO: 1039686 - RNA, 23 nt, Human
aaaauaaaggcuuuacuauuuac

SEQ ID NO: 1039687 - RNA, 20 nt, Human
aagauacgucuuagcuaugg

SEQ ID NO: 1039688 - RNA, 19 nt, Human
aaggucuuuuuuauaaaga

SEQ ID NO: 1039689 - RNA, 24 nt, Human
aaucacaagagagagagcaucauu

SEQ ID NO: 1039690 - RNA, 20 nt, Human
acuagaguucauuguacauu

SEQ ID NO: 1039691 - RNA, 24 nt, Human
agaaaucacaagagagagagccgg

SEQ ID NO: 1039692 - RNA, 18 nt, Human
aggcggccacaaguggga

SEQ ID NO: 1039693 - RNA, 23 nt, Human
agucacuagguaaacuuaaaacc

SEQ ID NO: 1039694 - RNA, 20 nt, Human
aucauuuggacauuuuccuu

SEQ ID NO: 1039695 - RNA, 22 nt, Human
aucuucccccggcugacuguug

SEQ ID NO: 1039696 - RNA, 23 nt, Human
auuacaaauuuaaaaggcuguaa

SEQ ID NO: 1039697 - RNA, 19 nt, Human
caaaacaacccagugcaac

SEQ ID NO: 1039698 - RNA, 19 nt, Human
ccacaagugggaaaacugg

SEQ ID NO: 1039699 - RNA, 21 nt, Human
cuggaugaaugaauaaaaugu

SEQ ID NO: 1039700 - RNA, 23 nt, Human
cuuuguuacaucugucuggguuu

SEQ ID NO: 1039701 - RNA, 19 nt, Human
gaaugaauaaaaugugggg

SEQ ID NO: 1039702 - RNA, 21 nt, Human
gcacugaagaaguaaucugga

SEQ ID NO: 1039703 - RNA, 24 nt, Human
uaaaaccaaauucagagguugggg

SEQ ID NO: 1039704 - RNA, 23 nt, Human
uaagguaauaaguuuacccauaa

SEQ ID NO: 1039705 - RNA, 21 nt, Human
uagcuugucaaaacaacccag

SEQ ID NO: 1039706 - RNA, 23 nt, Human
ucagucacuagguaaacuuaaaa

SEQ ID NO: 1039707 - RNA, 18 nt, Human
ucuuuuuuauaaagagag

SEQ ID NO: 1039708 - RNA, 20 nt, Human
uggaugaaugaauaaaaugu

SEQ ID NO: 1039709 - RNA, 21 nt, Human
uggucuccuuuggaaaugauc

SEQ ID NO: 1039710 - RNA, 25 nt, Human
ugucaaaacaacccagugcaacuaa

SEQ ID NO: 1039711 - RNA, 18 nt, Human
uuaaagcuuguuugcaau

SEQ ID NO: 1039712 - RNA, 25 nt, Human
uuauuuucaaaaugcuguucuuaac

SEQ ID NO: 1039713 - RNA, 27 nt, Human
uucaagacaaucaauauguaccauaaa

SEQ ID NO: 1039714 - RNA, 22 nt, Human
uucuuaacacaaaaauaaaggc

SEQ ID NO: 1039715 - RNA, 27 nt, Human
uucuuaacacaaaaauaaaggcuuuac

SEQ ID NO: 1039716 - RNA, 21 nt, Human
uugcaguaaaaguuaaggagu

SEQ ID NO: 1039717 - RNA, 22 nt, Human
uugcauacuuauaaaaaagaag

SEQ ID NO: 1039718 - RNA, 21 nt, Human
uuugcacauguuccaagucuu

SEQ ID NO: 1039719 - RNA, 19 nt, Human
ccucuuuccauugauuuug

SEQ ID NO: 1039720 - RNA, 21 nt, Human
uaacuuuuguuuccacaugcc

SEQ ID NO: 1039721 - RNA, 20 nt, Human
uccacaugccuccguagagu

SEQ ID NO: 1039722 - RNA, 23 nt, Human
ucuguuuucuggcggucuuccuc

SEQ ID NO: 1039723 - RNA, 19 nt, Human
ugcuauuacaaauauggaa

SEQ ID NO: 1039724 - RNA, 20 nt, Human
aagaugccccagcccggcca

SEQ ID NO: 1039725 - RNA, 23 nt, Human
aaggugggcggaucacgagguca

SEQ ID NO: 1039726 - RNA, 18 nt, Human
acucgugguaucaucuuc

SEQ ID NO: 1039727 - RNA, 24 nt, Human
agcacuuugggaggccaagguggg

SEQ ID NO: 1039728 - RNA, 21 nt, Human
agcagcauuuguggccauaau

SEQ ID NO: 1039729 - RNA, 23 nt, Human
agcugugugugguggugcaugcc

SEQ ID NO: 1039730 - RNA, 21 nt, Human
aggccaaggugggcggaucac

SEQ ID NO: 1039731 - RNA, 22 nt, Human
agggugcucuucuucccacggg

SEQ ID NO: 1039732 - RNA, 18 nt, Human
agguggccaggaagccag

SEQ ID NO: 1039733 - RNA, 24 nt, Human
aggugggcggaucacgaggucagg

SEQ ID NO: 1039734 - RNA, 18 nt, Human
aucacgaggucaggaguu

SEQ ID NO: 1039735 - RNA, 20 nt, Human
aucacgaggucaggaguuuc

SEQ ID NO: 1039736 - RNA, 22 nt, Human
aucccagcacuuugggaggcca

SEQ ID NO: 1039737 - RNA, 25 nt, Human
aucuuccuccgcgaggucuuuguua

SEQ ID NO: 1039738 - RNA, 22 nt, Human
augcaauucauuaaagagcaac

SEQ ID NO: 1039739 - RNA, 21 nt, Human
augccccagcccggccaugcc

SEQ ID NO: 1039740 - RNA, 18 nt, Human
auuggcuggguguggugg

SEQ ID NO: 1039741 - RNA, 22 nt, Human
caacauggugaaaccaucucua

SEQ ID NO: 1039742 - RNA, 19 nt, Human
caacuucuccccagcaacu

SEQ ID NO: 1039743 - RNA, 18 nt, Human
caagccccaccacaccuc

SEQ ID NO: 1039744 - RNA, 24 nt, Human
cacaucuguaaucccagcacuuug

SEQ ID NO: 1039745 - RNA, 20 nt, Human
caccggaagaguccggcuuu

SEQ ID NO: 1039746 - RNA, 22 nt, Human
cacgaggucaggaguuugagac

SEQ ID NO: 1039747 - RNA, 24 nt, Human
cagcacuuugggaggccaaggugg

SEQ ID NO: 1039748 - RNA, 22 nt, Human
cagcagcauuuguggccauaau

SEQ ID NO: 1039749 - RNA, 23 nt, Human
caucuguaaucccagcacuuugg

SEQ ID NO: 1039750 - RNA, 24 nt, Human
caucuguaaucccagcacuuuggg

SEQ ID NO: 1039751 - RNA, 24 nt, Human
ccaccacaccuccgcuucaccgga

SEQ ID NO: 1039752 - RNA, 18 nt, Human
ccuauccaaacacaugua

SEQ ID NO: 1039753 - RNA, 19 nt, Human
ccucucuccuggccacuac

SEQ ID NO: 1039754 - RNA, 19 nt, Human
ccuggccaacauggugaaa

SEQ ID NO: 1039755 - RNA, 21 nt, Human
ccuggccaacauggugaaacc

SEQ ID NO: 1039756 - RNA, 22 nt, Human
ccuggccaacauggugaaacca

SEQ ID NO: 1039757 - RNA, 19 nt, Human
ccuguucagagacuggugg

SEQ ID NO: 1039758 - RNA, 23 nt, Human
cgccuguuucauccugcccaagg

SEQ ID NO: 1039759 - RNA, 21 nt, Human
cggaucacgaggucaggaguu

SEQ ID NO: 1039760 - RNA, 24 nt, Human
cggaucacgaggucaggaguuuga

SEQ ID NO: 1039761 - RNA, 24 nt, Human
cucacaucuguaaucccagcacuu

SEQ ID NO: 1039762 - RNA, 21 nt, Human
cuuacacaaccagcacaggcu

SEQ ID NO: 1039763 - RNA, 22 nt, Human
cuuccugcgggcccggcgugag

SEQ ID NO: 1039764 - RNA, 25 nt, Human
cuuccugcgggcccggcgugagggu

SEQ ID NO: 1039765 - RNA, 22 nt, Human
cuuuugccauuaaauacucucc

SEQ ID NO: 1039766 - RNA, 24 nt, Human
gaucacgaggucaggaguuugaga

SEQ ID NO: 1039767 - RNA, 23 nt, Human
gcaagccccaccacaccuccgcu

SEQ ID NO: 1039768 - RNA, 21 nt, Human
gccuggccaacauggugaaac

SEQ ID NO: 1039769 - RNA, 22 nt, Human
gccuggccaacauggugaaacc

SEQ ID NO: 1039770 - RNA, 19 nt, Human
gcgggccgggcgugggggu

SEQ ID NO: 1039771 - RNA, 18 nt, Human
gcugggugugguggcuca

SEQ ID NO: 1039772 - RNA, 20 nt, Human
ggaagccagcgggaugcugc

SEQ ID NO: 1039773 - RNA, 22 nt, Human
ggagugggguugcucuucuuca

SEQ ID NO: 1039774 - RNA, 20 nt, Human
ggaucacgaggucaggaguu

SEQ ID NO: 1039775 - RNA, 23 nt, Human
ggaucacgaggucaggaguuuga

SEQ ID NO: 1039776 - RNA, 21 nt, Human
ggccacuacaucacauucaga

SEQ ID NO: 1039777 - RNA, 23 nt, Human
ggcggaucacgaggucaggaguu

SEQ ID NO: 1039778 - RNA, 19 nt, Human
ggcugggugugguggcuca

SEQ ID NO: 1039779 - RNA, 19 nt, Human
gggcgugggggugcucuuc

SEQ ID NO: 1039780 - RNA, 22 nt, Human
ggggugcucuucuuccugcggg

SEQ ID NO: 1039781 - RNA, 20 nt, Human
gggugaggagagguggccag

SEQ ID NO: 1039782 - RNA, 21 nt, Human
ggugaggagagguggccagga

SEQ ID NO: 1039783 - RNA, 24 nt, Human
gguggcucacaucuguaaucccag

SEQ ID NO: 1039784 - RNA, 24 nt, Human
gguggugcaugccuguaaucccag

SEQ ID NO: 1039785 - RNA, 23 nt, Human
ggugugguggcucacaucuguaa

SEQ ID NO: 1039786 - RNA, 21 nt, Human
guugauucuccccucccuguu

SEQ ID NO: 1039787 - RNA, 23 nt, Human
uaagacagcccuaauuggcuggg

SEQ ID NO: 1039788 - RNA, 22 nt, Human
uacacaaccagcacaggcugcg

SEQ ID NO: 1039789 - RNA, 25 nt, Human
uaucaucuuccuccgcgaggucuuu

SEQ ID NO: 1039790 - RNA, 24 nt, Human
ucacgaggucaggaguuugagacu

SEQ ID NO: 1039791 - RNA, 20 nt, Human
ucagcacaggcccaaaguag

SEQ ID NO: 1039792 - RNA, 23 nt, Human
ucccacgggcggggagugggguu

SEQ ID NO: 1039793 - RNA, 22 nt, Human
ucucuacuaaaaauauaaaacu

SEQ ID NO: 1039794 - RNA, 19 nt, Human
ucucugugacagcagcagc

SEQ ID NO: 1039795 - RNA, 22 nt, Human
ucuguagcuucccccauuuuua

SEQ ID NO: 1039796 - RNA, 23 nt, Human
ucugugacagcagcagcauuugu

SEQ ID NO: 1039797 - RNA, 21 nt, Human
ugaagaaacaagucauuugca

SEQ ID NO: 1039798 - RNA, 23 nt, Human
ugacucgugguaucaucuuccuc

SEQ ID NO: 1039799 - RNA, 23 nt, Human
ugagacuggccuggccaacaugg

SEQ ID NO: 1039800 - RNA, 24 nt, Human
ugagacuggccuggccaacauggu

SEQ ID NO: 1039801 - RNA, 18 nt, Human
ugccuguaaucccagcua

SEQ ID NO: 1039802 - RNA, 19 nt, Human
ugccuguaaucccagcuac

SEQ ID NO: 1039803 - RNA, 18 nt, Human
ugcgggccgggcgugggg

SEQ ID NO: 1039804 - RNA, 18 nt, Human
uggccaacauggugaaac

SEQ ID NO: 1039805 - RNA, 18 nt, Human
uggccaggaagccagcgg

SEQ ID NO: 1039806 - RNA, 24 nt, Human
uggccuggccaacauggugaaacc

SEQ ID NO: 1039807 - RNA, 21 nt, Human
uggcucacaucuguaauccca

SEQ ID NO: 1039808 - RNA, 24 nt, Human
uggcucacaucuguaaucccagca

SEQ ID NO: 1039809 - RNA, 19 nt, Human
ugggaggccaaggugggcg

SEQ ID NO: 1039810 - RNA, 24 nt, Human
ugggaggccaaggugggcggauca

SEQ ID NO: 1039811 - RNA, 20 nt, Human
ugggcggaucacgaggucau

SEQ ID NO: 1039812 - RNA, 21 nt, Human
uggugcaugccuguaauccca

SEQ ID NO: 1039813 - RNA, 24 nt, Human
ugguggcucacaucuguaauccca

SEQ ID NO: 1039814 - RNA, 24 nt, Human
ugguggugcaugccuguaauccca

SEQ ID NO: 1039815 - RNA, 24 nt, Human
uuagcugugugugguggugcaugc

SEQ ID NO: 1039816 - RNA, 22 nt, Human
uucagcacaggcccaaaguagg

SEQ ID NO: 1039817 - RNA, 22 nt, Human
uuggcugggugugguggcucac

SEQ ID NO: 1039818 - RNA, 23 nt, Human
uuggcugggugugguggcucaca

SEQ ID NO: 1039819 - RNA, 20 nt, Human
uuguugaacaugguccucuc

SEQ ID NO: 1039820 - RNA, 22 nt, Human
uuuuuuuuuuuguaagacagcc

SEQ ID NO: 1039821 - RNA, 21 nt, Human
accaccacacagauggccuca

SEQ ID NO: 1039822 - RNA, 23 nt, Human
cagcucggauggccccauacccc

SEQ ID NO: 1039823 - RNA, 21 nt, Human
caguaccaucagccaccacca

SEQ ID NO: 1039824 - RNA, 23 nt, Human
ccgggcacccuccacaucgccuu

SEQ ID NO: 1039825 - RNA, 21 nt, Human
ccucuggccggugcaucccag

SEQ ID NO: 1039826 - RNA, 24 nt, Human
ccucuggccggugcaucccagggc

SEQ ID NO: 1039827 - RNA, 19 nt, Human
ccugggcccccauccagaa

SEQ ID NO: 1039828 - RNA, 23 nt, Human
cgccuuuauacucuccugggccc

SEQ ID NO: 1039829 - RNA, 20 nt, Human
cuccaguaccaucagccacc

SEQ ID NO: 1039830 - RNA, 18 nt, Human
cuccugggcccccugggc

SEQ ID NO: 1039831 - RNA, 18 nt, Human
gacucaguuacuccagua

SEQ ID NO: 1039832 - RNA, 20 nt, Human
ucagcucggauggccccaua

SEQ ID NO: 1039833 - RNA, 19 nt, Human
ucccagggcucucgccugu

SEQ ID NO: 1039834 - RNA, 19 nt, Human
uccugggcccccugggccc

SEQ ID NO: 1039835 - RNA, 19 nt, Human
uccugggcccccugggccc

SEQ ID NO: 1039836 - RNA, 23 nt, Human
ucuccugggcccccugggccccc

SEQ ID NO: 1039837 - RNA, 24 nt, Human
ucuccugggcccccugggccccca

SEQ ID NO: 1039838 - RNA, 24 nt, Human
ugggcccccugggcccccauccag

SEQ ID NO: 1039839 - RNA, 24 nt, Human
ugugacugggcgucugguugugcc

SEQ ID NO: 1039840 - RNA, 23 nt, Human
caucaggugagccucugcccucu

SEQ ID NO: 1039841 - RNA, 18 nt, Human
ccaccuccugaaggacac

SEQ ID NO: 1039842 - RNA, 20 nt, Human
ccuccugaaggacacucgcc

SEQ ID NO: 1039843 - RNA, 21 nt, Human
ccucugcccucucaccuguga

SEQ ID NO: 1039844 - RNA, 20 nt, Human
gccugagcccaccucaagcc

SEQ ID NO: 1039845 - RNA, 22 nt, Human
guccccaucaggugagccucug

SEQ ID NO: 1039846 - RNA, 25 nt, Human
uaccagaaaggggaucccggacucc

SEQ ID NO: 1039847 - RNA, 21 nt, Human
ucaggugagccucugcccucu

SEQ ID NO: 1039848 - RNA, 18 nt, Human
ucccggacuccauggcuc

SEQ ID NO: 1039849 - RNA, 19 nt, Human
aaaauaggagcuuggaggg

SEQ ID NO: 1039850 - RNA, 18 nt, Human
aaauaggagcuuggaggg

SEQ ID NO: 1039851 - RNA, 23 nt, Human
aagcagguccaggggcuggggug

SEQ ID NO: 1039852 - RNA, 22 nt, Human
aaggagccagccccuugcagac

SEQ ID NO: 1039853 - RNA, 21 nt, Human
acaagacggguccacgccccc

SEQ ID NO: 1039854 - RNA, 27 nt, Human
accccagagucccucucuggucuaacc

SEQ ID NO: 1039855 - RNA, 24 nt, Human
accuaagugacaucaacucagagc

SEQ ID NO: 1039856 - RNA, 21 nt, Human
acucccuagcccuggacaccc

SEQ ID NO: 1039857 - RNA, 18 nt, Human
agacggguccacgccccc

SEQ ID NO: 1039858 - RNA, 18 nt, Human
agccuggagccugcacag

SEQ ID NO: 1039859 - RNA, 22 nt, Human
agcugacacaguaaaauaggag

SEQ ID NO: 1039860 - RNA, 19 nt, Human
aggaagacuggccacaggc

SEQ ID NO: 1039861 - RNA, 23 nt, Human
aggaggcugcugugggcaggcug

SEQ ID NO: 1039862 - RNA, 21 nt, Human
aggcagggaaggaaguuggag

SEQ ID NO: 1039863 - RNA, 20 nt, Human
aggcagggaaggaaguuggg

SEQ ID NO: 1039864 - RNA, 20 nt, Human
aggcccaucacugccuggcg

SEQ ID NO: 1039865 - RNA, 22 nt, Human
aggccuucacucuccccugagg

SEQ ID NO: 1039866 - RNA, 24 nt, Human
agggacagagcugguuucauccgg

SEQ ID NO: 1039867 - RNA, 20 nt, Human
auagucucugggcagaggga

SEQ ID NO: 1039868 - RNA, 19 nt, Human
aucaggaagacuggccaca

SEQ ID NO: 1039869 - RNA, 19 nt, Human
auugucccugacuguggcu

SEQ ID NO: 1039870 - RNA, 21 nt, Human
caacauggcccuuccuguccc

SEQ ID NO: 1039871 - RNA, 23 nt, Human
caacauggcccuuccugucccuu

SEQ ID NO: 1039872 - RNA, 23 nt, Human
caaggcagacgcgccgcagggac

SEQ ID NO: 1039873 - RNA, 24 nt, Human
cacaggccuggugggaggaacagg

SEQ ID NO: 1039874 - RNA, 22 nt, Human
cacaucccccgguggguaccug

SEQ ID NO: 1039875 - RNA, 19 nt, Human
cacccuagacccaaccuga

SEQ ID NO: 1039876 - RNA, 21 nt, Human
caccuccaccccccggagcag

SEQ ID NO: 1039877 - RNA, 22 nt, Human
cagagggggccuuggagugcag

SEQ ID NO: 1039878 - RNA, 20 nt, Human
cagcagcugaagccccaugc

SEQ ID NO: 1039879 - RNA, 21 nt, Human
caggcacaucccccggugggu

SEQ ID NO: 1039880 - RNA, 20 nt, Human
cauccagggucuuaacgccc

SEQ ID NO: 1039881 - RNA, 19 nt, Human
cauggcccuuccugucccu

SEQ ID NO: 1039882 - RNA, 20 nt, Human
ccagcugacacaguaaaaua

SEQ ID NO: 1039883 - RNA, 23 nt, Human
ccaggggcuggggugggcagggc

SEQ ID NO: 1039884 - RNA, 22 nt, Human
cccacaggucacagaggguaaa

SEQ ID NO: 1039885 - RNA, 22 nt, Human
ccccccggagcaggugcacacc

SEQ ID NO: 1039886 - RNA, 21 nt, Human
cccccgcgccggggcggaggc

SEQ ID NO: 1039887 - RNA, 23 nt, Human
ccccgguggguaccuggagcugu

SEQ ID NO: 1039888 - RNA, 19 nt, Human
ccccucgggaacucccaug

SEQ ID NO: 1039889 - RNA, 19 nt, Human
ccccugaggcugagcccug

SEQ ID NO: 1039890 - RNA, 21 nt, Human
ccccugaggcuguccuggccc

SEQ ID NO: 1039891 - RNA, 22 nt, Human
ccccuugcagacgaguugggag

SEQ ID NO: 1039892 - RNA, 24 nt, Human
ccccuugcagacgaguugggagga

SEQ ID NO: 1039893 - RNA, 18 nt, Human
cccgcgccggggcggagg

SEQ ID NO: 1039894 - RNA, 18 nt, Human
cccgcgccggggcggagg

SEQ ID NO: 1039895 - RNA, 21 nt, Human
cccggcgcccacccaucgccc

SEQ ID NO: 1039896 - RNA, 21 nt, Human
cccuagacccaaccugagccc

SEQ ID NO: 1039897 - RNA, 22 nt, Human
cccuagacccaaccugagcccc

SEQ ID NO: 1039898 - RNA, 26 nt, Human
cccugcugcagaacccagcgcuccug

SEQ ID NO: 1039899 - RNA, 22 nt, Human
cccuggaccuaagugacaucaa

SEQ ID NO: 1039900 - RNA, 19 nt, Human
ccgagccuccuccucagug

SEQ ID NO: 1039901 - RNA, 19 nt, Human
ccgcagcgcgggaaggccc

SEQ ID NO: 1039902 - RNA, 20 nt, Human
ccgcgccccuccggcgcugc

SEQ ID NO: 1039903 - RNA, 23 nt, Human
ccuagcccuggacacccuccuug

SEQ ID NO: 1039904 - RNA, 18 nt, Human
ccuccugcaggccuucac

SEQ ID NO: 1039905 - RNA, 18 nt, Human
ccuccuuugagccucgga

SEQ ID NO: 1039906 - RNA, 24 nt, Human
ccugccuguuugucaggcgggagc

SEQ ID NO: 1039907 - RNA, 18 nt, Human
ccugcuguccccgagccu

SEQ ID NO: 1039908 - RNA, 20 nt, Human
ccugcuguccccgagccucc

SEQ ID NO: 1039909 - RNA, 24 nt, Human
ccuugggccagcagcugaagcccc

SEQ ID NO: 1039910 - RNA, 20 nt, Human
ccuugucucgccugcccucc

SEQ ID NO: 1039911 - RNA, 23 nt, Human
ccuuuuguccugaaugccuuacu

SEQ ID NO: 1039912 - RNA, 23 nt, Human
cgcccacccaucgcccugcgcuc

SEQ ID NO: 1039913 - RNA, 19 nt, Human
cgcgcgaguccgucgcccc

SEQ ID NO: 1039914 - RNA, 25 nt, Human
cgcggcggcggcggcggcgguggcc

SEQ ID NO: 1039915 - RNA, 18 nt, Human
cggcgcugcgcacgcgcg

SEQ ID NO: 1039916 - RNA, 24 nt, Human
cgguggguaccuggagcuguuggg

SEQ ID NO: 1039917 - RNA, 19 nt, Human
cgucgcccccgcgccgggg

SEQ ID NO: 1039918 - RNA, 19 nt, Human
cuccaccccccggagcagg

SEQ ID NO: 1039919 - RNA, 23 nt, Human
cucccgucgcccuugaaagcugg

SEQ ID NO: 1039920 - RNA, 22 nt, Human
cucgcggcggcggcggcggcuu

SEQ ID NO: 1039921 - RNA, 18 nt, Human
cugaggcuguccuggccc

SEQ ID NO: 1039922 - RNA, 22 nt, Human
cugcggucggcuccgccaaggc

SEQ ID NO: 1039923 - RNA, 18 nt, Human
cuguguggagcaaagagg

SEQ ID NO: 1039924 - RNA, 19 nt, Human
cuuggagugcagccagaug

SEQ ID NO: 1039925 - RNA, 18 nt, Human
gacacaguaaaauaggag

SEQ ID NO: 1039926 - RNA, 21 nt, Human
gagcaccuccaccccccggag

SEQ ID NO: 1039927 - RNA, 18 nt, Human
gcaacauggcccuuccug

SEQ ID NO: 1039928 - RNA, 22 nt, Human
gcaggcacaucccccggugggu

SEQ ID NO: 1039929 - RNA, 19 nt, Human
gcaggccuucacucucccc

SEQ ID NO: 1039930 - RNA, 18 nt, Human
gccagcagcugaagcccc

SEQ ID NO: 1039931 - RNA, 23 nt, Human
gccagccccuugcagacgaguug

SEQ ID NO: 1039932 - RNA, 23 nt, Human
gcccuggacacccuccuugucuc

SEQ ID NO: 1039933 - RNA, 19 nt, Human
gcggcggcggcggcggcgg

SEQ ID NO: 1039934 - RNA, 19 nt, Human
gcggcggcggcggcggcgg

SEQ ID NO: 1039935 - RNA, 20 nt, Human
gcggcggcggcggcggcggu

SEQ ID NO: 1039936 - RNA, 19 nt, Human
ggaagaggucaguccacag

SEQ ID NO: 1039937 - RNA, 19 nt, Human
ggcggcggcggcggcggug

SEQ ID NO: 1039938 - RNA, 20 nt, Human
ggcggcggcggcggcggugg

SEQ ID NO: 1039939 - RNA, 19 nt, Human
gggcaggcuggcauggcag

SEQ ID NO: 1039940 - RNA, 21 nt, Human
gggcuggggugggcagggcua

SEQ ID NO: 1039941 - RNA, 24 nt, Human
gggugggcagggcuagcuuuugga

SEQ ID NO: 1039942 - RNA, 22 nt, Human
gguaaagaggucccaagaggga

SEQ ID NO: 1039943 - RNA, 21 nt, Human
guaaagaggucccaagaggga

SEQ ID NO: 1039944 - RNA, 18 nt, Human
uaacucuaggaggcugcu

SEQ ID NO: 1039945 - RNA, 26 nt, Human
uaagugacaucaacucagagccuccu

SEQ ID NO: 1039946 - RNA, 19 nt, Human
uagcccuggacacccuccu

SEQ ID NO: 1039947 - RNA, 21 nt, Human
uagggugaggaggcucugggc

SEQ ID NO: 1039948 - RNA, 24 nt, Human
ucaaaucugccuccaaguccaugu

SEQ ID NO: 1039949 - RNA, 18 nt, Human
ucaagguggagggcaggc

SEQ ID NO: 1039950 - RNA, 18 nt, Human
ucaagguggagggcaggc

SEQ ID NO: 1039951 - RNA, 30 nt, Human
ucccagcccgcgccccuccggcgcugcgcc

SEQ ID NO: 1039952 - RNA, 20 nt, Human
ucccuagcccuggacacccu

SEQ ID NO: 1039953 - RNA, 24 nt, Human
ucccugacuguggcucccugccug

SEQ ID NO: 1039954 - RNA, 23 nt, Human
ucccugccuguuugucaggcggg

SEQ ID NO: 1039955 - RNA, 19 nt, Human
uccugcuguccccgagccu

SEQ ID NO: 1039956 - RNA, 20 nt, Human
uccuuuuguccugaaugccu

SEQ ID NO: 1039957 - RNA, 19 nt, Human
ucucaugagcuggaagcau

SEQ ID NO: 1039958 - RNA, 22 nt, Human
ugaaaaggacagagggggccuu

SEQ ID NO: 1039959 - RNA, 22 nt, Human
ugaaagcuggggccccucggga

SEQ ID NO: 1039960 - RNA, 24 nt, Human
ugacuguggcucccugccuguuug

SEQ ID NO: 1039961 - RNA, 26 nt, Human
ugagcuggaagcauccaaggagccaa

SEQ ID NO: 1039962 - RNA, 18 nt, Human
ugaggaggcucugggcug

SEQ ID NO: 1039963 - RNA, 19 nt, Human
ugaggaggcucugggcugg

SEQ ID NO: 1039964 - RNA, 22 nt, Human
ugaggcugagcccugcugcaga

SEQ ID NO: 1039965 - RNA, 26 nt, Human
ugcacagggacagagcugguuucauc

SEQ ID NO: 1039966 - RNA, 22 nt, Human
ugcagcccuugugccuguggcc

SEQ ID NO: 1039967 - RNA, 21 nt, Human
ugccuccaaguccauguguuc

SEQ ID NO: 1039968 - RNA, 23 nt, Human
uggaagaagcagcugcagcccuu

SEQ ID NO: 1039969 - RNA, 22 nt, Human
uggagggaaaaggcagggaagg

SEQ ID NO: 1039970 - RNA, 23 nt, Human
uggauccugagugucacuacucu

SEQ ID NO: 1039971 - RNA, 18 nt, Human
uggcaggacuugaacucu

SEQ ID NO: 1039972 - RNA, 18 nt, Human
ugggaggaacaccuggug

SEQ ID NO: 1039973 - RNA, 19 nt, Human
ugggaggaacaggauaggg

SEQ ID NO: 1039974 - RNA, 19 nt, Human
ugggagggcugguaugcag

SEQ ID NO: 1039975 - RNA, 20 nt, Human
ugggaguauggcacucaagg

SEQ ID NO: 1039976 - RNA, 24 nt, Human
ugggcagagggagccagggcgggc

SEQ ID NO: 1039977 - RNA, 19 nt, Human
ugucaguuuccuggaagaa

SEQ ID NO: 1039978 - RNA, 30 nt, Human
ugucucgccugcccuccugcaggccuucaa

SEQ ID NO: 1039979 - RNA, 21 nt, Human
uuccuuccagcugacacagua

SEQ ID NO: 1039980 - RNA, 22 nt, Human
uugaaggcuguccaagugcugc

SEQ ID NO: 1039981 - RNA, 21 nt, Human
cacagccuggcucagccaccc

SEQ ID NO: 1039982 - RNA, 21 nt, Human
caggcacuccgugcacagccu

SEQ ID NO: 1039983 - RNA, 18 nt, Human
ccuggcucagccacccgg

SEQ ID NO: 1039984 - RNA, 22 nt, Human
gcacagccuggcucagccaccc

SEQ ID NO: 1039985 - RNA, 18 nt, Human
gcuuguuucucaggcugg

SEQ ID NO: 1039986 - RNA, 24 nt, Human
uccgugcacagccuggcucagcca

SEQ ID NO: 1039987 - RNA, 19 nt, Human
aaaacaauuugaugcuuaa

SEQ ID NO: 1039988 - RNA, 18 nt, Human
aaaauccaaaauggcugc

SEQ ID NO: 1039989 - RNA, 24 nt, Human
aagaaucacagccaaaauaagaca

SEQ ID NO: 1039990 - RNA, 19 nt, Human
aagagaaggcggggcuggc

SEQ ID NO: 1039991 - RNA, 19 nt, Human
aauauuuccugaugagacu

SEQ ID NO: 1039992 - RNA, 25 nt, Human
aaucacagccaaaauaagacauuaa

SEQ ID NO: 1039993 - RNA, 26 nt, Human
acuuuuuuuucuuuuuuacuuuuuaa

SEQ ID NO: 1039994 - RNA, 19 nt, Human
agaggaggccacggcuccc

SEQ ID NO: 1039995 - RNA, 19 nt, Human
aggaggaggaagagaaggc

SEQ ID NO: 1039996 - RNA, 18 nt, Human
aggcugggauucagcguc

SEQ ID NO: 1039997 - RNA, 18 nt, Human
agggaagaagauggagga

SEQ ID NO: 1039998 - RNA, 22 nt, Human
cagcgucguugucauuuccugu

SEQ ID NO: 1039999 - RNA, 21 nt, Human
caggggcgggggaggagaagg

SEQ ID NO: 1040000 - RNA, 22 nt, Human
cauccuccacggccuucagcug

SEQ ID NO: 1040001 - RNA, 21 nt, Human
cccgggcuagggacccagagc

SEQ ID NO: 1040002 - RNA, 19 nt, Human
cccggggaucuuggcccgc

SEQ ID NO: 1040003 - RNA, 22 nt, Human
ccgggggcgggugaucaggggc

SEQ ID NO: 1040004 - RNA, 24 nt, Human
ccuguguggcuucuuuuccagcug

SEQ ID NO: 1040005 - RNA, 20 nt, Human
ccuuggcccuuccgcucuuc

SEQ ID NO: 1040006 - RNA, 23 nt, Human
cuggagucggagcggcguggaga

SEQ ID NO: 1040007 - RNA, 20 nt, Human
gaagauggaggaggaggaaa

SEQ ID NO: 1040008 - RNA, 19 nt, Human
gaggaagagaaggcggggc

SEQ ID NO: 1040009 - RNA, 28 nt, Human
gaggaggaggaagagaaggcggggcugg

SEQ ID NO: 1040010 - RNA, 21 nt, Human
gcucuggggagggaggcuggg

SEQ ID NO: 1040011 - RNA, 19 nt, Human
gcuuaaaauaaaagacagg

SEQ ID NO: 1040012 - RNA, 18 nt, Human
ggaagaagauggaggagg

SEQ ID NO: 1040013 - RNA, 19 nt, Human
gggaagaagauggaggagg

SEQ ID NO: 1040014 - RNA, 20 nt, Human
gggaagaagauggaggagga

SEQ ID NO: 1040015 - RNA, 23 nt, Human
gggcggagaggaggccacggcuc

SEQ ID NO: 1040016 - RNA, 20 nt, Human
gggcgggggaggagaaggau

SEQ ID NO: 1040017 - RNA, 20 nt, Human
gggcgggggaggagaaggau

SEQ ID NO: 1040018 - RNA, 20 nt, Human
uagcauccuccacggccuuc

SEQ ID NO: 1040019 - RNA, 24 nt, Human
ugagaaccgugcuggucacuagcg

SEQ ID NO: 1040020 - RNA, 25 nt, Human
ugauccgggggcgggugaucagggg

SEQ ID NO: 1040021 - RNA, 19 nt, Human
ugcaaaauccaaaauggcu

SEQ ID NO: 1040022 - RNA, 24 nt, Human
ugccaccagugguucgcgagguuc

SEQ ID NO: 1040023 - RNA, 22 nt, Human
ugccuggacccgggcuagggac

SEQ ID NO: 1040024 - RNA, 23 nt, Human
uggaggaggaggaagagaaggcg

SEQ ID NO: 1040025 - RNA, 20 nt, Human
ugucugugucugucuguccu

SEQ ID NO: 1040026 - RNA, 23 nt, Human
uuaaaauaaaagacaggaaauau

SEQ ID NO: 1040027 - RNA, 22 nt, Human
uucccggggaucuuggcccgcu

SEQ ID NO: 1040028 - RNA, 18 nt, Human
aaagcaaggaaaacaagc

SEQ ID NO: 1040029 - RNA, 24 nt, Human
caagcaaacuuacccaguugcaaa

SEQ ID NO: 1040030 - RNA, 23 nt, Human
cagcccuucucucugccaucucc

SEQ ID NO: 1040031 - RNA, 20 nt, Human
caugaugagugccauaccua

SEQ ID NO: 1040032 - RNA, 22 nt, Human
cauuucugucauaauuaguggg

SEQ ID NO: 1040033 - RNA, 18 nt, Human
ccacuggguggggaugaa

SEQ ID NO: 1040034 - RNA, 22 nt, Human
ccuggcagacuauguccaaaag

SEQ ID NO: 1040035 - RNA, 20 nt, Human
cugcagggcuugagcacaga

SEQ ID NO: 1040036 - RNA, 18 nt, Human
cuggcagacuauguccaa

SEQ ID NO: 1040037 - RNA, 19 nt, Human
gaaccucugacacuuagaa

SEQ ID NO: 1040038 - RNA, 22 nt, Human
ggaaaacaagcaaacuuaccca

SEQ ID NO: 1040039 - RNA, 20 nt, Human
ggguggggaugaagguguuu

SEQ ID NO: 1040040 - RNA, 22 nt, Human
uauacaguucugugccugaaac

SEQ ID NO: 1040041 - RNA, 21 nt, Human
ucugcagggcuugagcacaga

SEQ ID NO: 1040042 - RNA, 23 nt, Human
ugaagguguuuuugcgcaacacg

SEQ ID NO: 1040043 - RNA, 18 nt, Human
ugccauaccuauaaaaca

SEQ ID NO: 1040044 - RNA, 23 nt, Human
ugguaguccucugcccgccgcca

SEQ ID NO: 1040045 - RNA, 26 nt, Human
uguccaaaagcaaggaaaacaagcaa

SEQ ID NO: 1040046 - RNA, 21 nt, Human
uuggauauacaguucugugcc

SEQ ID NO: 1040047 - RNA, 22 nt, Human
aggaaggggcagggaaggaggg

SEQ ID NO: 1040048 - RNA, 23 nt, Human
aggggcagggaaggagggccagc

SEQ ID NO: 1040049 - RNA, 19 nt, Human
cacagccugcagcuccccc

SEQ ID NO: 1040050 - RNA, 19 nt, Human
cccccugcaggcgauucag

SEQ ID NO: 1040051 - RNA, 18 nt, Human
ccccggaggccugcgcgg

SEQ ID NO: 1040052 - RNA, 26 nt, Human
ccccggaggccugcgcggaggggcgg

SEQ ID NO: 1040053 - RNA, 24 nt, Human
ccccuacaugguaagccccggccc

SEQ ID NO: 1040054 - RNA, 18 nt, Human
cccggggucccgaagccc

SEQ ID NO: 1040055 - RNA, 23 nt, Human
cccugcggccucuuacagacccc

SEQ ID NO: 1040056 - RNA, 18 nt, Human
ccgaagccccaccccgcg

SEQ ID NO: 1040057 - RNA, 18 nt, Human
cgcucgaggaaggggcag

SEQ ID NO: 1040058 - RNA, 18 nt, Human
cuaacaccagucucacac

SEQ ID NO: 1040059 - RNA, 21 nt, Human
cuccccuacaugguaagcccc

SEQ ID NO: 1040060 - RNA, 19 nt, Human
cugcagcucccccugcagg

SEQ ID NO: 1040061 - RNA, 20 nt, Human
gaccuggcccggcucauccc

SEQ ID NO: 1040062 - RNA, 22 nt, Human
gccagcagagucuguuacuagg

SEQ ID NO: 1040063 - RNA, 23 nt, Human
gccccggccccccggaggccugc

SEQ ID NO: 1040064 - RNA, 18 nt, Human
gcuaacaccagucucaca

SEQ ID NO: 1040065 - RNA, 19 nt, Human
ggaaggagggccagcagag

SEQ ID NO: 1040066 - RNA, 20 nt, Human
ggcagggaaggagggccagc

SEQ ID NO: 1040067 - RNA, 22 nt, Human
ggcagggaaggagggccagcag

SEQ ID NO: 1040068 - RNA, 18 nt, Human
uaacaccagucucacaca

SEQ ID NO: 1040069 - RNA, 21 nt, Human
uaagccccggccccccggagg

SEQ ID NO: 1040070 - RNA, 23 nt, Human
ucccgaagccccaccccgcgcuc

SEQ ID NO: 1040071 - RNA, 18 nt, Human
ucuuacagaccccggagg

SEQ ID NO: 1040072 - RNA, 23 nt, Human
ugcagugagcgguggcuaacacc

SEQ ID NO: 1040073 - RNA, 19 nt, Human
uggcccggcucauccccgg

SEQ ID NO: 1040074 - RNA, 21 nt, Human
uggcuaacaccagucucacac

SEQ ID NO: 1040075 - RNA, 18 nt, Human
aagggggcccgcagagac

SEQ ID NO: 1040076 - RNA, 20 nt, Human
acaauccuuuucucugcaag

SEQ ID NO: 1040077 - RNA, 20 nt, Human
accccugggcugggcugggc

SEQ ID NO: 1040078 - RNA, 18 nt, Human
acuaacaugcaaagucca

SEQ ID NO: 1040079 - RNA, 19 nt, Human
aggaaggcugcguggucuc

SEQ ID NO: 1040080 - RNA, 22 nt, Human
aggcaggcgcugggaggcggug

SEQ ID NO: 1040081 - RNA, 18 nt, Human
aggcagggcccuggggag

SEQ ID NO: 1040082 - RNA, 22 nt, Human
agggggcugggggcucacacua

SEQ ID NO: 1040083 - RNA, 21 nt, Human
cacgggguccuggccuccggg

SEQ ID NO: 1040084 - RNA, 22 nt, Human
cagcugccccaggaacuagguu

SEQ ID NO: 1040085 - RNA, 23 nt, Human
caugcaaaguccagcugccccag

SEQ ID NO: 1040086 - RNA, 24 nt, Human
ccagggaucagcaaugucuccgcc

SEQ ID NO: 1040087 - RNA, 18 nt, Human
cccaggccgcucugaacc

SEQ ID NO: 1040088 - RNA, 23 nt, Human
cccgcagagacguccucuccccc

SEQ ID NO: 1040089 - RNA, 18 nt, Human
cccgcuccggccucccuc

SEQ ID NO: 1040090 - RNA, 21 nt, Human
cccuggggagggggcggcggg

SEQ ID NO: 1040091 - RNA, 19 nt, Human
ccgcccgcgccuccgccuc

SEQ ID NO: 1040092 - RNA, 24 nt, Human
ccgccgcgcugcccgcuccggccu

SEQ ID NO: 1040093 - RNA, 23 nt, Human
ccgcgccuccgccucacgcgucc

SEQ ID NO: 1040094 - RNA, 22 nt, Human
ccuccgccgcccgcgccuccgc

SEQ ID NO: 1040095 - RNA, 18 nt, Human
ccuggaguuucccacaau

SEQ ID NO: 1040096 - RNA, 18 nt, Human
ccuggccuccgggagggg

SEQ ID NO: 1040097 - RNA, 22 nt, Human
cgccaggcacccaggccgcucu

SEQ ID NO: 1040098 - RNA, 25 nt, Human
cgccgcccgcgccuccgccucacgc

SEQ ID NO: 1040099 - RNA, 23 nt, Human
cgcgcucuccccuccagggcucc

SEQ ID NO: 1040100 - RNA, 21 nt, Human
cgggcagggggcugggggcuc

SEQ ID NO: 1040101 - RNA, 23 nt, Human
cuaacaugcaaaguccagcugcc

SEQ ID NO: 1040102 - RNA, 24 nt, Human
cuccggccucccuccgccgcccgc

SEQ ID NO: 1040103 - RNA, 18 nt, Human
cuccgggaggggggaggg

SEQ ID NO: 1040104 - RNA, 23 nt, Human
cuggcaccagacgugucccugcc

SEQ ID NO: 1040105 - RNA, 20 nt, Human
gaggccugccggcccccaag

SEQ ID NO: 1040106 - RNA, 23 nt, Human
gaggcggugggaagaguccugga

SEQ ID NO: 1040107 - RNA, 19 nt, Human
gaggggguggggaggaggc

SEQ ID NO: 1040108 - RNA, 23 nt, Human
gaggggguggggaggaggcaggg

SEQ ID NO: 1040109 - RNA, 22 nt, Human
gccaugaccuugcgugugggca

SEQ ID NO: 1040110 - RNA, 18 nt, Human
gccuccgccucacgcguc

SEQ ID NO: 1040111 - RNA, 22 nt, Human
gcucugaaccacuccaugugcc

SEQ ID NO: 1040112 - RNA, 20 nt, Human
ggaagaguccuggaguuucc

SEQ ID NO: 1040113 - RNA, 24 nt, Human
ggaggcagggcccuggggaggggg

SEQ ID NO: 1040114 - RNA, 20 nt, Human
ggcgggcagggggcuggggg

SEQ ID NO: 1040115 - RNA, 21 nt, Human
gggaagaguccuggaguuucc

SEQ ID NO: 1040116 - RNA, 22 nt, Human
gggaggaggcagggcccugggg

SEQ ID NO: 1040117 - RNA, 20 nt, Human
gggagggggcggcgggcagg

SEQ ID NO: 1040118 - RNA, 21 nt, Human
gggcugggcaggugcgucuuc

SEQ ID NO: 1040119 - RNA, 20 nt, Human
gggcugggcugggcaggugc

SEQ ID NO: 1040120 - RNA, 25 nt, Human
gggcugggcugggcaggugcgucuu

SEQ ID NO: 1040121 - RNA, 23 nt, Human
ggggaggaggcagggcccugggg

SEQ ID NO: 1040122 - RNA, 23 nt, Human
ggggagggggcggcgggcagggg

SEQ ID NO: 1040123 - RNA, 20 nt, Human
ggggguggggaggaggcagg

SEQ ID NO: 1040124 - RNA, 23 nt, Human
ggggugaagggggcccgcagaga

SEQ ID NO: 1040125 - RNA, 20 nt, Human
ggucgaggccugccggcccc

SEQ ID NO: 1040126 - RNA, 28 nt, Human
uacacagacacggccacgcgcacacaug

SEQ ID NO: 1040127 - RNA, 21 nt, Human
ucccccgccccacgggguccu

SEQ ID NO: 1040128 - RNA, 23 nt, Human
ucccccgccccacgggguccugg

SEQ ID NO: 1040129 - RNA, 22 nt, Human
uccgccgcccgcgccuccgccu

SEQ ID NO: 1040130 - RNA, 18 nt, Human
uccgcgcucuccccucca

SEQ ID NO: 1040131 - RNA, 22 nt, Human
ucucccccgccccacggggucc

SEQ ID NO: 1040132 - RNA, 19 nt, Human
ugggcugggcugggcaggu

SEQ ID NO: 1040133 - RNA, 18 nt, Human
uggggaggaggcagggcc

SEQ ID NO: 1040134 - RNA, 19 nt, Human
uggggaggaggcagggccc

SEQ ID NO: 1040135 - RNA, 27 nt, Human
uggggagggggcggcgggcagggggcu

SEQ ID NO: 1040136 - RNA, 23 nt, Human
uuuguuaaaagggggaaaggaag

SEQ ID NO: 1040137 - RNA, 22 nt, Human
uuuuuuuuuuuuuugguuugga

SEQ ID NO: 1040138 - RNA, 18 nt, Human
uuuuuuuuuuuuuuuuug

SEQ ID NO: 1040139 - RNA, 24 nt, Human
uuuuuuuuuuuuuuuuugguuugg

SEQ ID NO: 1040140 - RNA, 23 nt, Human
uuuuuuuuuuuuuuuuuugguuu

SEQ ID NO: 1040141 - RNA, 22 nt, Human
aagcaguccuuuugcacuuuuc

SEQ ID NO: 1040142 - RNA, 22 nt, Human
agacugagcucuuacugcagcc

SEQ ID NO: 1040143 - RNA, 22 nt, Human
cagaacgcgaagccgccuuggc

SEQ ID NO: 1040144 - RNA, 19 nt, Human
cagagguucugucuauucu

SEQ ID NO: 1040145 - RNA, 20 nt, Human
cccggugugggccucugggg

SEQ ID NO: 1040146 - RNA, 23 nt, Human
cgaagccgccuuggccucccaga

SEQ ID NO: 1040147 - RNA, 24 nt, Human
cuagaguucccccaucugagcugg

SEQ ID NO: 1040148 - RNA, 25 nt, Human
cugaagugguaguggguggucuccu

SEQ ID NO: 1040149 - RNA, 22 nt, Human
gacugagcucuuacugcagcca

SEQ ID NO: 1040150 - RNA, 19 nt, Human
gagagugucuuaucuuuuc

SEQ ID NO: 1040151 - RNA, 18 nt, Human
gagcucagacagcugcuc

SEQ ID NO: 1040152 - RNA, 23 nt, Human
gauuucucucuuccuagaguucc

SEQ ID NO: 1040153 - RNA, 19 nt, Human
gcgaagccgccuuggccuc

SEQ ID NO: 1040154 - RNA, 21 nt, Human
ggaaggacugggagccccugg

SEQ ID NO: 1040155 - RNA, 19 nt, Human
gggauguccuggcgucuga

SEQ ID NO: 1040156 - RNA, 19 nt, Human
gggccucuggggguccccc

SEQ ID NO: 1040157 - RNA, 19 nt, Human
gugcagagaggucaccagg

SEQ ID NO: 1040158 - RNA, 20 nt, Human
gugcagagaggucaccaggc

SEQ ID NO: 1040159 - RNA, 22 nt, Human
ucagaggccuuugguuucuuuu

SEQ ID NO: 1040160 - RNA, 18 nt, Human
uccaaagucaagcagucc

SEQ ID NO: 1040161 - RNA, 23 nt, Human
uccauggaauggauuucucucuu

SEQ ID NO: 1040162 - RNA, 21 nt, Human
ucuuacugcagccaacaaagg

SEQ ID NO: 1040163 - RNA, 22 nt, Human
ugauguguacagugucagaggc

SEQ ID NO: 1040164 - RNA, 18 nt, Human
ugcccggugugggccucu

SEQ ID NO: 1040165 - RNA, 24 nt, Human
uggcgucugagcuacggaucuccc

SEQ ID NO: 1040166 - RNA, 21 nt, Human
ugggccgcucgcugugcccgg

SEQ ID NO: 1040167 - RNA, 18 nt, Human
uguguugugauaaauggc

SEQ ID NO: 1040168 - RNA, 19 nt, Human
uuacugcagccaacaaagg

SEQ ID NO: 1040169 - RNA, 21 nt, Human
uugugauaaauggcuucagau

SEQ ID NO: 1040170 - RNA, 21 nt, Human
uuucuucugauggucuuuccu

SEQ ID NO: 1040171 - RNA, 18 nt, Human
uaacagcaauggaucaga

SEQ ID NO: 1040172 - RNA, 22 nt, Human
aaaaccuuuuccaacucagagc

SEQ ID NO: 1040173 - RNA, 19 nt, Human
aaaagaagggagccacgga

SEQ ID NO: 1040174 - RNA, 21 nt, Human
aaacggcuagaucugaauccc

SEQ ID NO: 1040175 - RNA, 20 nt, Human
aaagggaggggagggcagag

SEQ ID NO: 1040176 - RNA, 20 nt, Human
aaccccgccuccugcuucca

SEQ ID NO: 1040177 - RNA, 21 nt, Human
aagcucagagaagacaaagga

SEQ ID NO: 1040178 - RNA, 19 nt, Human
agacaaaggacuucccaag

SEQ ID NO: 1040179 - RNA, 22 nt, Human
agagaaaagaaagcucagagaa

SEQ ID NO: 1040180 - RNA, 18 nt, Human
agagaagacaaaggacuu

SEQ ID NO: 1040181 - RNA, 23 nt, Human
agagaagacaaaggacuucccaa

SEQ ID NO: 1040182 - RNA, 20 nt, Human
agggagaaugggacaagagc

SEQ ID NO: 1040183 - RNA, 20 nt, Human
agggaggggagggcagaguc

SEQ ID NO: 1040184 - RNA, 21 nt, Human
aggguccgccgccgcuggugc

SEQ ID NO: 1040185 - RNA, 23 nt, Human
aguaaguggcagagccagaacaa

SEQ ID NO: 1040186 - RNA, 18 nt, Human
auccaugaaaugggaguu

SEQ ID NO: 1040187 - RNA, 19 nt, Human
aucccuuucuguuauucac

SEQ ID NO: 1040188 - RNA, 23 nt, Human
aucugaaccccgccuccugcuuc

SEQ ID NO: 1040189 - RNA, 22 nt, Human
auggaaaagaacuucuggaagg

SEQ ID NO: 1040190 - RNA, 22 nt, Human
caaaaaauacugugagggaaac

SEQ ID NO: 1040191 - RNA, 19 nt, Human
caaaggacuucccaaggcc

SEQ ID NO: 1040192 - RNA, 19 nt, Human
caaaggacuucccaaggcc

SEQ ID NO: 1040193 - RNA, 24 nt, Human
caaaggacuucccaaggccacaca

SEQ ID NO: 1040194 - RNA, 20 nt, Human
caaaugcucagcccugcccc

SEQ ID NO: 1040195 - RNA, 20 nt, Human
caacucagagccaaggccca

SEQ ID NO: 1040196 - RNA, 22 nt, Human
caaggcccaagaaguugauuca

SEQ ID NO: 1040197 - RNA, 18 nt, Human
cacaguaaguggcagagc

SEQ ID NO: 1040198 - RNA, 19 nt, Human
cacccccuccccggaaagc

SEQ ID NO: 1040199 - RNA, 26 nt, Human
cacccccuccccggaaagcccccgcc

SEQ ID NO: 1040200 - RNA, 18 nt, Human
caccgcuuuuacgcaaag

SEQ ID NO: 1040201 - RNA, 24 nt, Human
cacugugcagcuaaacggcuagau

SEQ ID NO: 1040202 - RNA, 19 nt, Human
cagagccaaggcccaagaa

SEQ ID NO: 1040203 - RNA, 22 nt, Human
cagccagagcccagacaaggga

SEQ ID NO: 1040204 - RNA, 19 nt, Human
caggagggguagggccaag

SEQ ID NO: 1040205 - RNA, 22 nt, Human
caggggucgggggaaaagaagg

SEQ ID NO: 1040206 - RNA, 19 nt, Human
ccaagaucugaaccccgcc

SEQ ID NO: 1040207 - RNA, 20 nt, Human
ccaaguggggugcuccuucc

SEQ ID NO: 1040208 - RNA, 21 nt, Human
cccaagaaguugauucacacc

SEQ ID NO: 1040209 - RNA, 18 nt, Human
cccacauuccagcucuuc

SEQ ID NO: 1040210 - RNA, 19 nt, Human
ccccgaacgauugcaacgc

SEQ ID NO: 1040211 - RNA, 21 nt, Human
ccccuccccggaaagcccccg

SEQ ID NO: 1040212 - RNA, 26 nt, Human
cccuccccggaaagcccccgccccga

SEQ ID NO: 1040213 - RNA, 21 nt, Human
ccgaacgauugcaacgcccuc

SEQ ID NO: 1040214 - RNA, 21 nt, Human
ccgccgccgcuggugcaccug

SEQ ID NO: 1040215 - RNA, 18 nt, Human
ccggaaagcccccgcccc

SEQ ID NO: 1040216 - RNA, 19 nt, Human
ccguccggcuggaaggggg

SEQ ID NO: 1040217 - RNA, 22 nt, Human
ccucaaaaccggguaaggcgag

SEQ ID NO: 1040218 - RNA, 18 nt, Human
ccuccggggagagccugc

SEQ ID NO: 1040219 - RNA, 19 nt, Human
ccuccggggagagccugcu

SEQ ID NO: 1040220 - RNA, 23 nt, Human
ccugagcacccccuccccggaaa

SEQ ID NO: 1040221 - RNA, 18 nt, Human
cgacuccaaaaguucaac

SEQ ID NO: 1040222 - RNA, 22 nt, Human
cgcccucguccccucccggucu

SEQ ID NO: 1040223 - RNA, 23 nt, Human
cggaaagcccccgccccgaacga

SEQ ID NO: 1040224 - RNA, 18 nt, Human
cucagagccaaggcccaa

SEQ ID NO: 1040225 - RNA, 21 nt, Human
cucagagccaaggcccaagaa

SEQ ID NO: 1040226 - RNA, 23 nt, Human
cucagagccaaggcccaagaagu

SEQ ID NO: 1040227 - RNA, 22 nt, Human
cuccccggaaagcccccgcccc

SEQ ID NO: 1040228 - RNA, 23 nt, Human
cucccugcacugcuggauaaaua

SEQ ID NO: 1040229 - RNA, 24 nt, Human
cugcuggauaaauauuugcugcau

SEQ ID NO: 1040230 - RNA, 21 nt, Human
cuguuauucacugacucugug

SEQ ID NO: 1040231 - RNA, 19 nt, Human
gaaacugaaagggagacuu

SEQ ID NO: 1040232 - RNA, 24 nt, Human
gaacgauugcaacgcccucguccc

SEQ ID NO: 1040233 - RNA, 22 nt, Human
gaagacucuggagaagaacucc

SEQ ID NO: 1040234 - RNA, 18 nt, Human
gaaugggacaagagcacc

SEQ ID NO: 1040235 - RNA, 22 nt, Human
gacaaaggacuucccaaggcca

SEQ ID NO: 1040236 - RNA, 24 nt, Human
gacaagggaagacucuggagaaga

SEQ ID NO: 1040237 - RNA, 23 nt, Human
gagaaacaggaagcacuguucug

SEQ ID NO: 1040238 - RNA, 20 nt, Human
gcgacggccugauggaaaag

SEQ ID NO: 1040239 - RNA, 18 nt, Human
ggagacuucucagcugga

SEQ ID NO: 1040240 - RNA, 18 nt, Human
ggggagagccugcuggaa

SEQ ID NO: 1040241 - RNA, 19 nt, Human
ggggagcagagggggcuga

SEQ ID NO: 1040242 - RNA, 22 nt, Human
ggggguuaaagggaggggaggg

SEQ ID NO: 1040243 - RNA, 22 nt, Human
gguuaaagggaggggagggcag

SEQ ID NO: 1040244 - RNA, 22 nt, Human
guccacuuccuuucucuuucuc

SEQ ID NO: 1040245 - RNA, 25 nt, Human
uaaagggaggggagggcagagucug

SEQ ID NO: 1040246 - RNA, 20 nt, Human
uaacacaggagggguagggc

SEQ ID NO: 1040247 - RNA, 21 nt, Human
uaauaaggauuaaacguggcg

SEQ ID NO: 1040248 - RNA, 24 nt, Human
ucacugacucugugagcuuaagaa

SEQ ID NO: 1040249 - RNA, 23 nt, Human
ucagcccugccccgccucccguc

SEQ ID NO: 1040250 - RNA, 24 nt, Human
uccaaaaguucaacucccugcacu

SEQ ID NO: 1040251 - RNA, 19 nt, Human
uccccggaaagcccccgcc

SEQ ID NO: 1040252 - RNA, 19 nt, Human
uccggggagagccugcugg

SEQ ID NO: 1040253 - RNA, 20 nt, Human
ugaaagggagacuucucagc

SEQ ID NO: 1040254 - RNA, 24 nt, Human
ugaaccccgccuccugcuuccaag

SEQ ID NO: 1040255 - RNA, 26 nt, Human
ugagcacccccuccccggaaagcccc

SEQ ID NO: 1040256 - RNA, 20 nt, Human
ugagccuccggggagagccu

SEQ ID NO: 1040257 - RNA, 18 nt, Human
ugagggaaacugaggcuc

SEQ ID NO: 1040258 - RNA, 23 nt, Human
ugagggaaacugaggcucgcgga

SEQ ID NO: 1040259 - RNA, 18 nt, Human
ugcaacgcccucgucccc

SEQ ID NO: 1040260 - RNA, 23 nt, Human
ugccccgccucccguccggcugg

SEQ ID NO: 1040261 - RNA, 23 nt, Human
uggaagaaggaaacugaaaggga

SEQ ID NO: 1040262 - RNA, 24 nt, Human
uggaaggcgaagagauaaacaggg

SEQ ID NO: 1040263 - RNA, 19 nt, Human
uggagaaacaggaagcacu

SEQ ID NO: 1040264 - RNA, 20 nt, Human
uggccaugcaggaauucaac

SEQ ID NO: 1040265 - RNA, 22 nt, Human
uuacgcaaagagaaaagaaagc

SEQ ID NO: 1040266 - RNA, 20 nt, Human
uucccaaggccacacaguaa

SEQ ID NO: 1040267 - RNA, 23 nt, Human
uuuccaacucagagccaaggccc

SEQ ID NO: 1040268 - RNA, 24 nt, Human
aaaaggacauaugggucaaagugu

SEQ ID NO: 1040269 - RNA, 24 nt, Human
aaacaggaaacaggcugugugacc

SEQ ID NO: 1040270 - RNA, 22 nt, Human
aaaccagaacugaggaugccga

SEQ ID NO: 1040271 - RNA, 19 nt, Human
aaagcugaaaccaggccca

SEQ ID NO: 1040272 - RNA, 19 nt, Human
aaaguguuugcagcagugu

SEQ ID NO: 1040273 - RNA, 23 nt, Human
aaauauguagaagucaaaaaagu

SEQ ID NO: 1040274 - RNA, 20 nt, Human
aagcucagggaggcuagcgg

SEQ ID NO: 1040275 - RNA, 21 nt, Human
aagucaaaaaagugucuauga

SEQ ID NO: 1040276 - RNA, 18 nt, Human
aaguguuugcagcagugu

SEQ ID NO: 1040277 - RNA, 18 nt, Human
aauacaguuuuugucaac

SEQ ID NO: 1040278 - RNA, 20 nt, Human
acaaaaaggacauauggguc

SEQ ID NO: 1040279 - RNA, 21 nt, Human
accccuaagagcuuccuggaa

SEQ ID NO: 1040280 - RNA, 25 nt, Human
accccuaggcccagcuggaugaccc

SEQ ID NO: 1040281 - RNA, 24 nt, Human
acucaaggacauacugcggcuuca

SEQ ID NO: 1040282 - RNA, 21 nt, Human
agaacugaggaugccgagggu

SEQ ID NO: 1040283 - RNA, 20 nt, Human
agaugaggagcucacaagga

SEQ ID NO: 1040284 - RNA, 25 nt, Human
agccagaaagcucagggaggcuagc

SEQ ID NO: 1040285 - RNA, 19 nt, Human
agcuagauggguagggggg

SEQ ID NO: 1040286 - RNA, 24 nt, Human
agcuauggggacagccacuagaga

SEQ ID NO: 1040287 - RNA, 18 nt, Human
agcucagggaggcuagcg

SEQ ID NO: 1040288 - RNA, 25 nt, Human
aggacaucauucugucccagcuucc

SEQ ID NO: 1040289 - RNA, 20 nt, Human
aggcuagcggcccugcccag

SEQ ID NO: 1040290 - RNA, 21 nt, Human
aggcuccagucuccagggcug

SEQ ID NO: 1040291 - RNA, 23 nt, Human
agggaccaguucuguccugguca

SEQ ID NO: 1040292 - RNA, 22 nt, Human
agggguccgggaggagugucau

SEQ ID NO: 1040293 - RNA, 18 nt, Human
aggguguggcgucaggag

SEQ ID NO: 1040294 - RNA, 18 nt, Human
agugggcaaucaaagcug

SEQ ID NO: 1040295 - RNA, 23 nt, Human
aucaggguguggcgucaggagcc

SEQ ID NO: 1040296 - RNA, 24 nt, Human
augcagccagggcucccaggguga

SEQ ID NO: 1040297 - RNA, 20 nt, Human
augcucauaauauauaguga

SEQ ID NO: 1040298 - RNA, 18 nt, Human
caaaacaauaugccaaga

SEQ ID NO: 1040299 - RNA, 20 nt, Human
caaaacaauaugccaagaca

SEQ ID NO: 1040300 - RNA, 23 nt, Human
caacaccaacacgcuggggacau

SEQ ID NO: 1040301 - RNA, 20 nt, Human
caacuuagcccuaccagcag

SEQ ID NO: 1040302 - RNA, 27 nt, Human
caauaugccaagacaugauuucugccc

SEQ ID NO: 1040303 - RNA, 20 nt, Human
cacagggcugaacacucgag

SEQ ID NO: 1040304 - RNA, 18 nt, Human
cacugcuguauccccagc

SEQ ID NO: 1040305 - RNA, 22 nt, Human
cagaacugaggaugccgagggu

SEQ ID NO: 1040306 - RNA, 20 nt, Human
cagauggucugcagcaacgc

SEQ ID NO: 1040307 - RNA, 23 nt, Human
cagauuacaaaacaauaugccaa

SEQ ID NO: 1040308 - RNA, 18 nt, Human
cagcaacgcacgggcaac

SEQ ID NO: 1040309 - RNA, 22 nt, Human
cagcagguggaacuaguuuugc

SEQ ID NO: 1040310 - RNA, 19 nt, Human
cagccagggcucccagggu

SEQ ID NO: 1040311 - RNA, 19 nt, Human
cagcgcuacguggugagaa

SEQ ID NO: 1040312 - RNA, 23 nt, Human
cagcggccucaggcucagggccu

SEQ ID NO: 1040313 - RNA, 21 nt, Human
cagcuagaucaagguucccaa

SEQ ID NO: 1040314 - RNA, 21 nt, Human
caucacaaacuuagagacuuu

SEQ ID NO: 1040315 - RNA, 18 nt, Human
cauuuugcaacauugugg

SEQ ID NO: 1040316 - RNA, 25 nt, Human
ccaacaccaacacgcuggggacaug

SEQ ID NO: 1040317 - RNA, 19 nt, Human
ccagggaucuuugguuacu

SEQ ID NO: 1040318 - RNA, 22 nt, Human
cccacgacuuaggagcuggaga

SEQ ID NO: 1040319 - RNA, 19 nt, Human
cccagccacugggcuccuc

SEQ ID NO: 1040320 - RNA, 21 nt, Human
cccagccugaagccagaaagc

SEQ ID NO: 1040321 - RNA, 21 nt, Human
cccaugcagccagggcuccca

SEQ ID NO: 1040322 - RNA, 26 nt, Human
cccaugcagccagggcucccaggguu

SEQ ID NO: 1040323 - RNA, 22 nt, Human
cccccaccccagccacugggcu

SEQ ID NO: 1040324 - RNA, 23 nt, Human
cccuaggcccagcuggaugaccc

SEQ ID NO: 1040325 - RNA, 21 nt, Human
cccucugagaagccuucccug

SEQ ID NO: 1040326 - RNA, 18 nt, Human
cccugcaccccuaggccc

SEQ ID NO: 1040327 - RNA, 18 nt, Human
ccgagggugguggggggg

SEQ ID NO: 1040328 - RNA, 24 nt, Human
ccucagggcugugcuccugcuacc

SEQ ID NO: 1040329 - RNA, 22 nt, Human
ccucagggcugugcuccugcuc

SEQ ID NO: 1040330 - RNA, 18 nt, Human
ccugaagccagaaagcuc

SEQ ID NO: 1040331 - RNA, 21 nt, Human
ccugacacuucacuuccguga

SEQ ID NO: 1040332 - RNA, 20 nt, Human
ccugcuccuggacuuuacag

SEQ ID NO: 1040333 - RNA, 23 nt, Human
ccugcuccuggacuuuacagaua

SEQ ID NO: 1040334 - RNA, 21 nt, Human
cgacaagccgaggggcugcca

SEQ ID NO: 1040335 - RNA, 18 nt, Human
cgcccccucugagaagcc

SEQ ID NO: 1040336 - RNA, 20 nt, Human
cucagcacugacccugcacc

SEQ ID NO: 1040337 - RNA, 26 nt, Human
cucagcacugacccugcaccgguucc

SEQ ID NO: 1040338 - RNA, 26 nt, Human
cucagcccccaccccagccacugggc

SEQ ID NO: 1040339 - RNA, 22 nt, Human
cucauaauauauagugacaauu

SEQ ID NO: 1040340 - RNA, 23 nt, Human
cuccaggccuugauuuccccauc

SEQ ID NO: 1040341 - RNA, 21 nt, Human
cuccagggcugugugugucca

SEQ ID NO: 1040342 - RNA, 26 nt, Human
cuccagggcuguguguguccaggggu

SEQ ID NO: 1040343 - RNA, 19 nt, Human
cuccggcgacaagccgagg

SEQ ID NO: 1040344 - RNA, 23 nt, Human
cugaagcucccgcguggucaugc

SEQ ID NO: 1040345 - RNA, 19 nt, Human
cugcacggcccacacacag

SEQ ID NO: 1040346 - RNA, 23 nt, Human
cugugugugcugccucucagagc

SEQ ID NO: 1040347 - RNA, 21 nt, Human
cuuagagacuuuucucuccuc

SEQ ID NO: 1040348 - RNA, 24 nt, Human
cuuucuaaguuccccguuugaaaa

SEQ ID NO: 1040349 - RNA, 26 nt, Human
gacaagccgaggggcugccacuuucu

SEQ ID NO: 1040350 - RNA, 23 nt, Human
gacuugccaugcuccaaggcucc

SEQ ID NO: 1040351 - RNA, 21 nt, Human
gagcuggagagcacacagggc

SEQ ID NO: 1040352 - RNA, 20 nt, Human
gaggugacaagugugggucc

SEQ ID NO: 1040353 - RNA, 23 nt, Human
gcagagcuaaguccaugcuaugc

SEQ ID NO: 1040354 - RNA, 18 nt, Human
gcaggguuauucugugug

SEQ ID NO: 1040355 - RNA, 24 nt, Human
gccagaaagcucagggaggcuagg

SEQ ID NO: 1040356 - RNA, 18 nt, Human
gcccacacacaggcuccc

SEQ ID NO: 1040357 - RNA, 22 nt, Human
gcccccaccccagccacugggc

SEQ ID NO: 1040358 - RNA, 19 nt, Human
gcccugcccaggccucagc

SEQ ID NO: 1040359 - RNA, 20 nt, Human
gccucccagccugaagccag

SEQ ID NO: 1040360 - RNA, 18 nt, Human
gccuccugacacuucacu

SEQ ID NO: 1040361 - RNA, 22 nt, Human
gcgucaggagccggagccuacg

SEQ ID NO: 1040362 - RNA, 21 nt, Human
gcugaaaccaggcccacgacu

SEQ ID NO: 1040363 - RNA, 21 nt, Human
ggaaacaggcugugugaccug

SEQ ID NO: 1040364 - RNA, 24 nt, Human
ggcguggggacuuuuggaggggag

SEQ ID NO: 1040365 - RNA, 24 nt, Human
gggggccgagccugggagcugaca

SEQ ID NO: 1040366 - RNA, 18 nt, Human
gggucuugauaucagggu

SEQ ID NO: 1040367 - RNA, 18 nt, Human
gguagggggggacccacu

SEQ ID NO: 1040368 - RNA, 25 nt, Human
gguuaugggucccaugcagccaggg

SEQ ID NO: 1040369 - RNA, 20 nt, Human
gguucccaacaccaacacgc

SEQ ID NO: 1040370 - RNA, 24 nt, Human
guccggguguguccuggaccuacc

SEQ ID NO: 1040371 - RNA, 23 nt, Human
gugucauauggccccuucgagcu

SEQ ID NO: 1040372 - RNA, 21 nt, Human
uaaaaagcagauuacaaaaca

SEQ ID NO: 1040373 - RNA, 24 nt, Human
uaagaagagacagagaaagcgaaa

SEQ ID NO: 1040374 - RNA, 22 nt, Human
uaagugcccgucagguccuggg

SEQ ID NO: 1040375 - RNA, 26 nt, Human
uaccuccuuuugcaggacaacauuuu

SEQ ID NO: 1040376 - RNA, 24 nt, Human
uacguggugagaaacuuaccuccu

SEQ ID NO: 1040377 - RNA, 24 nt, Human
uagaaguugccauaagagugcacu

SEQ ID NO: 1040378 - RNA, 19 nt, Human
uagaauacaaugaaaccau

SEQ ID NO: 1040379 - RNA, 19 nt, Human
uagugagggggccgagccu

SEQ ID NO: 1040380 - RNA, 21 nt, Human
uaguuuccugccucagggcug

SEQ ID NO: 1040381 - RNA, 23 nt, Human
ucacaaggacccuggauggggga

SEQ ID NO: 1040382 - RNA, 21 nt, Human
ucagguccugggugcgggagg

SEQ ID NO: 1040383 - RNA, 23 nt, Human
ucagguccugggugcgggagguc

SEQ ID NO: 1040384 - RNA, 19 nt, Human
ucauucugucccagcuucc

SEQ ID NO: 1040385 - RNA, 24 nt, Human
uccagggcuguguguguccagggg

SEQ ID NO: 1040386 - RNA, 25 nt, Human
ucccaacaccaacacgcuggggaca

SEQ ID NO: 1040387 - RNA, 18 nt, Human
ucccugaccaccuggcug

SEQ ID NO: 1040388 - RNA, 21 nt, Human
ucccugaccaccuggcugagg

SEQ ID NO: 1040389 - RNA, 20 nt, Human
uccggguguguccuggaccu

SEQ ID NO: 1040390 - RNA, 24 nt, Human
uccuggaccuacccccuuucuggg

SEQ ID NO: 1040391 - RNA, 25 nt, Human
ucuaggccaaggggucacaguccac

SEQ ID NO: 1040392 - RNA, 24 nt, Human
ucuccaggccuugauuuccccauc

SEQ ID NO: 1040393 - RNA, 18 nt, Human
ucuccagggugcuugggc

SEQ ID NO: 1040394 - RNA, 18 nt, Human
ucucugucucucucucuu

SEQ ID NO: 1040395 - RNA, 26 nt, Human
ucucugucucucucucuuuuaacaaa

SEQ ID NO: 1040396 - RNA, 18 nt, Human
ucugucucugucucucuc

SEQ ID NO: 1040397 - RNA, 20 nt, Human
ugaccccuaagagcuuccuu

SEQ ID NO: 1040398 - RNA, 22 nt, Human
ugagaagccuucccugaccacc

SEQ ID NO: 1040399 - RNA, 18 nt, Human
ugagagcgaaggcacagu

SEQ ID NO: 1040400 - RNA, 20 nt, Human
ugaggcagggaccaguucug

SEQ ID NO: 1040401 - RNA, 22 nt, Human
ugaggcagggaccaguucuguc

SEQ ID NO: 1040402 - RNA, 21 nt, Human
ugagggcauaggggcugcccc

SEQ ID NO: 1040403 - RNA, 19 nt, Human
ugagggggccgagccuggg

SEQ ID NO: 1040404 - RNA, 20 nt, Human
ugcaaggcuucucuguuagu

SEQ ID NO: 1040405 - RNA, 18 nt, Human
ugccaagacaugauuucu

SEQ ID NO: 1040406 - RNA, 22 nt, Human
ugccucagggcugugcuccugc

SEQ ID NO: 1040407 - RNA, 20 nt, Human
ugcuggagcugcugcagcca

SEQ ID NO: 1040408 - RNA, 22 nt, Human
uggagcccacucucucagcugg

SEQ ID NO: 1040409 - RNA, 23 nt, Human
uggaggggagggcauuuucuuga

SEQ ID NO: 1040410 - RNA, 23 nt, Human
uggauaagucaucucuccaggcc

SEQ ID NO: 1040411 - RNA, 18 nt, Human
uggggugguuaaaauaac

SEQ ID NO: 1040412 - RNA, 18 nt, Human
uggguccuugccgugcac

SEQ ID NO: 1040413 - RNA, 20 nt, Human
uguccagggguccgggagga

SEQ ID NO: 1040414 - RNA, 18 nt, Human
ugucccagcuuccauuug

SEQ ID NO: 1040415 - RNA, 27 nt, Human
uuaggagcuggagagcacacagggcug

SEQ ID NO: 1040416 - RNA, 26 nt, Human
uuaguggugccuggagcccacucucu

SEQ ID NO: 1040417 - RNA, 20 nt, Human
uucucuguuaguggugccug

SEQ ID NO: 1040418 - RNA, 21 nt, Human
uucuugaucuuaccauggggg

SEQ ID NO: 1040419 - RNA, 19 nt, Human
uugcuggagcugcugcagc

SEQ ID NO: 1040420 - RNA, 21 nt, Human
uuugccuaaaauucuccccuc

SEQ ID NO: 1040421 - RNA, 21 nt, Human
aaaaacagaucugccaaagca

SEQ ID NO: 1040422 - RNA, 23 nt, Human
aaaagcccaaggcagggagagca

SEQ ID NO: 1040423 - RNA, 24 nt, Human
aaaaggaaaacaugacggaaagaa

SEQ ID NO: 1040424 - RNA, 25 nt, Human
aaaaggaaaacaugacggaaagaaa

SEQ ID NO: 1040425 - RNA, 23 nt, Human
aaagaaaagcccaaggcagggag

SEQ ID NO: 1040426 - RNA, 23 nt, Human
aacaauucugagaaccgggaauu

SEQ ID NO: 1040427 - RNA, 24 nt, Human
aacuggcuuacccugccugaccuc

SEQ ID NO: 1040428 - RNA, 21 nt, Human
aagaacacuggaaagguucug

SEQ ID NO: 1040429 - RNA, 24 nt, Human
aagccaaacgcaacggccccugug

SEQ ID NO: 1040430 - RNA, 22 nt, Human
aaggaacacgaaaaggaaaaca

SEQ ID NO: 1040431 - RNA, 23 nt, Human
acaaagccaaacgcaacggcccc

SEQ ID NO: 1040432 - RNA, 18 nt, Human
acgaaaaggaaaacauga

SEQ ID NO: 1040433 - RNA, 19 nt, Human
acucguuccuuggaaacau

SEQ ID NO: 1040434 - RNA, 20 nt, Human
acucguuccuuggaaacauu

SEQ ID NO: 1040435 - RNA, 21 nt, Human
agaaaaacagaucugccaaag

SEQ ID NO: 1040436 - RNA, 19 nt, Human
agaaggaacacgaaaagga

SEQ ID NO: 1040437 - RNA, 21 nt, Human
agagaaggaacacgaaaagga

SEQ ID NO: 1040438 - RNA, 18 nt, Human
agaucugccaaagcagcu

SEQ ID NO: 1040439 - RNA, 22 nt, Human
agcagagacaagagaaaucaga

SEQ ID NO: 1040440 - RNA, 19 nt, Human
aggaaaacaugacggaaag

SEQ ID NO: 1040441 - RNA, 25 nt, Human
aggaacacgaaaaggaaaacaugac

SEQ ID NO: 1040442 - RNA, 28 nt, Human
aggcagcccgggcugggucuccugggca

SEQ ID NO: 1040443 - RNA, 18 nt, Human
agguccugccccucugcu

SEQ ID NO: 1040444 - RNA, 19 nt, Human
agugggagggcccaucccc

SEQ ID NO: 1040445 - RNA, 21 nt, Human
aucuuuuuuuguuuuuccccu

SEQ ID NO: 1040446 - RNA, 18 nt, Human
augacggaaagaaaagcc

SEQ ID NO: 1040447 - RNA, 22 nt, Human
auucugcuuaaagcccccucca

SEQ ID NO: 1040448 - RNA, 27 nt, Human
caaagcagcucacagcauggaggagcc

SEQ ID NO: 1040449 - RNA, 20 nt, Human
caacauacacacauauucac

SEQ ID NO: 1040450 - RNA, 20 nt, Human
cacaaagccaaacgcaacgg

SEQ ID NO: 1040451 - RNA, 20 nt, Human
caccaccugcuguggagccg

SEQ ID NO: 1040452 - RNA, 22 nt, Human
cagagacaagagaaaucagaga

SEQ ID NO: 1040453 - RNA, 22 nt, Human
cagauccuuccagacacuccuc

SEQ ID NO: 1040454 - RNA, 19 nt, Human
cagcauggaggagcaggca

SEQ ID NO: 1040455 - RNA, 19 nt, Human
cagcccgggcugggucucc

SEQ ID NO: 1040456 - RNA, 22 nt, Human
caggaugacuuccuggugcuga

SEQ ID NO: 1040457 - RNA, 19 nt, Human
caggcuccguggaugcccc

SEQ ID NO: 1040458 - RNA, 21 nt, Human
caucccagccauuucccccaa

SEQ ID NO: 1040459 - RNA, 22 nt, Human
ccagacacugaguaucuguacu

SEQ ID NO: 1040460 - RNA, 23 nt, Human
ccccaaagagucagaauucugcu

SEQ ID NO: 1040461 - RNA, 25 nt, Human
ccccaaagcaguggugacaccaaca

SEQ ID NO: 1040462 - RNA, 21 nt, Human
ccccaggacagcuuguuccca

SEQ ID NO: 1040463 - RNA, 24 nt, Human
ccccaguuccuaaucccccacccc

SEQ ID NO: 1040464 - RNA, 22 nt, Human
cccccaggacagcuuguuccca

SEQ ID NO: 1040465 - RNA, 23 nt, Human
cccccaggacagcuuguucccaa

SEQ ID NO: 1040466 - RNA, 24 nt, Human
cccccaguuccuaaucccccaccc

SEQ ID NO: 1040467 - RNA, 23 nt, Human
cccccugaaaauauaaauauugc

SEQ ID NO: 1040468 - RNA, 22 nt, Human
ccuaaucucucuuggacaacau

SEQ ID NO: 1040469 - RNA, 21 nt, Human
ccugacuccugccucgugggu

SEQ ID NO: 1040470 - RNA, 18 nt, Human
cggagggugguuaaugag

SEQ ID NO: 1040471 - RNA, 19 nt, Human
cuccccaccaccugcugug

SEQ ID NO: 1040472 - RNA, 18 nt, Human
cucuuggacaacauacac

SEQ ID NO: 1040473 - RNA, 19 nt, Human
cugaugaaaucagaaccaa

SEQ ID NO: 1040474 - RNA, 20 nt, Human
cugggguuugcggagggugg

SEQ ID NO: 1040475 - RNA, 22 nt, Human
cugugacagcaugcaccagagu

SEQ ID NO: 1040476 - RNA, 22 nt, Human
cuuccuggugcugagcuggugc

SEQ ID NO: 1040477 - RNA, 18 nt, Human
gaaaaggaaaacaugacg

SEQ ID NO: 1040478 - RNA, 19 nt, Human
gaacacuggaaagguucug

SEQ ID NO: 1040479 - RNA, 22 nt, Human
gacaagagaaaucagagaagga

SEQ ID NO: 1040480 - RNA, 19 nt, Human
gagcagcagagacaagaga

SEQ ID NO: 1040481 - RNA, 23 nt, Human
gcagagacaagagaaaucagaga

SEQ ID NO: 1040482 - RNA, 21 nt, Human
gccaacuggcuuacccugccu

SEQ ID NO: 1040483 - RNA, 21 nt, Human
gcccgggcugggucuccuggg

SEQ ID NO: 1040484 - RNA, 21 nt, Human
ggaaaacaugacggaaagaaa

SEQ ID NO: 1040485 - RNA, 20 nt, Human
gggaaagugggagggcccau

SEQ ID NO: 1040486 - RNA, 19 nt, Human
guccugagugcccuggaac

SEQ ID NO: 1040487 - RNA, 18 nt, Human
uaacucgagguucuccuc

SEQ ID NO: 1040488 - RNA, 23 nt, Human
uacaaaggagccccucgaggcag

SEQ ID NO: 1040489 - RNA, 19 nt, Human
uacagagaugaggcgaggg

SEQ ID NO: 1040490 - RNA, 21 nt, Human
uagccucaucccagccauuuc

SEQ ID NO: 1040491 - RNA, 20 nt, Human
uccaaaggcugcuucuuccc

SEQ ID NO: 1040492 - RNA, 21 nt, Human
uccacaaagccaaacgcaacg

SEQ ID NO: 1040493 - RNA, 18 nt, Human
ucccugcagguccugccc

SEQ ID NO: 1040494 - RNA, 21 nt, Human
ucccugcagguccugccccuc

SEQ ID NO: 1040495 - RNA, 22 nt, Human
ucccugcagguccugccccucu

SEQ ID NO: 1040496 - RNA, 18 nt, Human
uccguggaugccccuugc

SEQ ID NO: 1040497 - RNA, 20 nt, Human
uccuaaucccccaccccaaa

SEQ ID NO: 1040498 - RNA, 21 nt, Human
uccugacuccugccucguggg

SEQ ID NO: 1040499 - RNA, 21 nt, Human
uccugccccucugcuccccac

SEQ ID NO: 1040500 - RNA, 19 nt, Human
uccuggguccaggaugacu

SEQ ID NO: 1040501 - RNA, 20 nt, Human
uccuggguccaggaugacuu

SEQ ID NO: 1040502 - RNA, 20 nt, Human
uccuggugcugagcuggugc

SEQ ID NO: 1040503 - RNA, 25 nt, Human
ucucccucugccugccuuuccacug

SEQ ID NO: 1040504 - RNA, 21 nt, Human
ucugccaaagcagcucacagc

SEQ ID NO: 1040505 - RNA, 20 nt, Human
ucugcuuaaagcccccucca

SEQ ID NO: 1040506 - RNA, 21 nt, Human
ugaaaucagaaccaaaagaac

SEQ ID NO: 1040507 - RNA, 18 nt, Human
ugccccuugcagaacuca

SEQ ID NO: 1040508 - RNA, 21 nt, Human
ugcccuggaaccucggguguu

SEQ ID NO: 1040509 - RNA, 22 nt, Human
ugccugccuuuccacuguccug

SEQ ID NO: 1040510 - RNA, 23 nt, Human
ugcuuaaagcccccuccacggag

SEQ ID NO: 1040511 - RNA, 20 nt, Human
uggaaagguucugccacugu

SEQ ID NO: 1040512 - RNA, 19 nt, Human
ugugacagcaugcaccaga

SEQ ID NO: 1040513 - RNA, 18 nt, Human
uguucaguggacaucugc

SEQ ID NO: 1040514 - RNA, 22 nt, Human
uuacaaguucucuacucccuag

SEQ ID NO: 1040515 - RNA, 25 nt, Human
uuccuggucgacucguuccuuggaa

SEQ ID NO: 1040516 - RNA, 21 nt, Human
uuuuuccccugacuacacaga

SEQ ID NO: 1040517 - RNA, 21 nt, Human
aaagguacacauuaaaacugc

SEQ ID NO: 1040518 - RNA, 22 nt, Human
aacuauacucaaccaaaaccua

SEQ ID NO: 1040519 - RNA, 21 nt, Human
acaaaaaagaaagccaaaaga

SEQ ID NO: 1040520 - RNA, 21 nt, Human
acacuccauaauguauucuuu

SEQ ID NO: 1040521 - RNA, 20 nt, Human
accacagagaaaugagggac

SEQ ID NO: 1040522 - RNA, 19 nt, Human
accccagagacacuguuga

SEQ ID NO: 1040523 - RNA, 20 nt, Human
accuauuuggcauuuauuga

SEQ ID NO: 1040524 - RNA, 19 nt, Human
acucugcucauuugaaaua

SEQ ID NO: 1040525 - RNA, 22 nt, Human
agcaaagaaaagaguuugccaa

SEQ ID NO: 1040526 - RNA, 23 nt, Human
caacauacucugcucauuugaaa

SEQ ID NO: 1040527 - RNA, 24 nt, Human
cagugcaaaggaugccaccccaga

SEQ ID NO: 1040528 - RNA, 18 nt, Human
cucacagaauacuguaaa

SEQ ID NO: 1040529 - RNA, 18 nt, Human
cucacccucgccgccucg

SEQ ID NO: 1040530 - RNA, 20 nt, Human
gagaacaauaggaguccaca

SEQ ID NO: 1040531 - RNA, 25 nt, Human
uaagaaaacacuacacuccauaaug

SEQ ID NO: 1040532 - RNA, 23 nt, Human
uacaaaaaagaaagccaaaagac

SEQ ID NO: 1040533 - RNA, 19 nt, Human
ucacagaauacuguaaauu

SEQ ID NO: 1040534 - RNA, 22 nt, Human
uccauaaaguuuaaguucaaca

SEQ ID NO: 1040535 - RNA, 21 nt, Human
ugaaauaaaccaguaucuucc

SEQ ID NO: 1040536 - RNA, 23 nt, Human
ugaagaacuaagaaaacacuaca

SEQ ID NO: 1040537 - RNA, 22 nt, Human
uguagcaaagaaaagaguuugc

SEQ ID NO: 1040538 - RNA, 24 nt, Human
uucaaaaugaagaaaaggcugaga

SEQ ID NO: 1040539 - RNA, 21 nt, Human
uugagaacaauaggaguccac

SEQ ID NO: 1040540 - RNA, 18 nt, Human
uuuuuuuuuuuuuuccug

SEQ ID NO: 1040541 - RNA, 24 nt, Human
uuuuuuuuuuuuuuuuccugcuuu

SEQ ID NO: 1040542 - RNA, 20 nt, Human
aaaaucuaaggcaaacagac

SEQ ID NO: 1040543 - RNA, 23 nt, Human
aacagacuugaccaucuucagac

SEQ ID NO: 1040544 - RNA, 22 nt, Human
aagcccggagcaaggcgaaaga

SEQ ID NO: 1040545 - RNA, 18 nt, Human
acccugccgcgcugcgag

SEQ ID NO: 1040546 - RNA, 18 nt, Human
agcgaagaaagcccggag

SEQ ID NO: 1040547 - RNA, 22 nt, Human
aggcgaaagagacucacacgcg

SEQ ID NO: 1040548 - RNA, 23 nt, Human
caccugcgggacguggaccucca

SEQ ID NO: 1040549 - RNA, 22 nt, Human
caucaaaaucuaaggcaaacag

SEQ ID NO: 1040550 - RNA, 26 nt, Human
caucuucagacccacugcauucucaa

SEQ ID NO: 1040551 - RNA, 21 nt, Human
ccagaacagguuguagguaua

SEQ ID NO: 1040552 - RNA, 18 nt, Human
cccagaacagguuguagg

SEQ ID NO: 1040553 - RNA, 21 nt, Human
ccccgucggcccccggacccg

SEQ ID NO: 1040554 - RNA, 21 nt, Human
cccggagcaaggcgaaagaga

SEQ ID NO: 1040555 - RNA, 24 nt, Human
ccuccaggacagccccgucggccc

SEQ ID NO: 1040556 - RNA, 24 nt, Human
cgagcgaagaaagcccggagcaag

SEQ ID NO: 1040557 - RNA, 18 nt, Human
cgcugggcccggaccccc

SEQ ID NO: 1040558 - RNA, 18 nt, Human
cggagcaaggcgaaagag

SEQ ID NO: 1040559 - RNA, 20 nt, Human
cggcaagaaggggaaagccc

SEQ ID NO: 1040560 - RNA, 21 nt, Human
cggcccccggacccggcuccu

SEQ ID NO: 1040561 - RNA, 23 nt, Human
cggcccccggacccggcuccucc

SEQ ID NO: 1040562 - RNA, 20 nt, Human
cguugggccccgggcgggcg

SEQ ID NO: 1040563 - RNA, 22 nt, Human
cuaaggcaaacagacuugacca

SEQ ID NO: 1040564 - RNA, 23 nt, Human
gagcgaagaaagcccggagcaag

SEQ ID NO: 1040565 - RNA, 19 nt, Human
gccagguugcucaucagua

SEQ ID NO: 1040566 - RNA, 19 nt, Human
gcgcugcgagcgaagaaag

SEQ ID NO: 1040567 - RNA, 18 nt, Human
gcggaaggcuccgggcug

SEQ ID NO: 1040568 - RNA, 19 nt, Human
ggcaagaaggggaaagccc

SEQ ID NO: 1040569 - RNA, 22 nt, Human
ggcaagaaggggaaagcccaga

SEQ ID NO: 1040570 - RNA, 20 nt, Human
ggcaagaaggggaaagcccg

SEQ ID NO: 1040571 - RNA, 21 nt, Human
ucaaaaucuaaggcaaacaga

SEQ ID NO: 1040572 - RNA, 22 nt, Human
ucaggcgccuccuggcgggugc

SEQ ID NO: 1040573 - RNA, 19 nt, Human
uccuggcgggugcugcugc

SEQ ID NO: 1040574 - RNA, 24 nt, Human
ugaaguggucugcucauaguuugu

SEQ ID NO: 1040575 - RNA, 25 nt, Human
ugaccaucuucagacccacugcauu

SEQ ID NO: 1040576 - RNA, 21 nt, Human
ugcaggaccucaggcgccucc

SEQ ID NO: 1040577 - RNA, 21 nt, Human
uggccguagcaccugacggca

SEQ ID NO: 1040578 - RNA, 25 nt, Human
uggcgggugcugcugcacgcaccug

SEQ ID NO: 1040579 - RNA, 18 nt, Human
ugugccagguugcucauc

SEQ ID NO: 1040580 - RNA, 20 nt, Human
uugggccccgggcgggcggg

SEQ ID NO: 1040581 - RNA, 20 nt, Human
aaaaggaaauauugggaaga

SEQ ID NO: 1040582 - RNA, 24 nt, Human
aagaaaaugaaccacagacacaga

SEQ ID NO: 1040583 - RNA, 21 nt, Human
aagcaaauuggugagggagaa

SEQ ID NO: 1040584 - RNA, 20 nt, Human
aagggaaaacaaagccaaag

SEQ ID NO: 1040585 - RNA, 20 nt, Human
acaaagccaaagagaagaaa

SEQ ID NO: 1040586 - RNA, 23 nt, Human
accaagguuuuaggcccauauga

SEQ ID NO: 1040587 - RNA, 24 nt, Human
agaaauguucgcacaggggaaaug

SEQ ID NO: 1040588 - RNA, 26 nt, Human
agagaaaaagcuugaauacucauaau

SEQ ID NO: 1040589 - RNA, 24 nt, Human
agagcaaagguaguagcucccucu

SEQ ID NO: 1040590 - RNA, 18 nt, Human
agccaaagagaagaaacc

SEQ ID NO: 1040591 - RNA, 20 nt, Human
agggaaaacaaagccaaaga

SEQ ID NO: 1040592 - RNA, 19 nt, Human
aguagcucccucuccacuu

SEQ ID NO: 1040593 - RNA, 21 nt, Human
caaaaggaaauauugggaaga

SEQ ID NO: 1040594 - RNA, 18 nt, Human
caaagggaaaacaaagcc

SEQ ID NO: 1040595 - RNA, 27 nt, Human
caacacacuaugaagagagcaaaggua

SEQ ID NO: 1040596 - RNA, 18 nt, Human
caacccagacucacacca

SEQ ID NO: 1040597 - RNA, 21 nt, Human
caagaaaagcuggguggcuua

SEQ ID NO: 1040598 - RNA, 22 nt, Human
cacagauacaugaagucacuac

SEQ ID NO: 1040599 - RNA, 22 nt, Human
caccugaagaaaaugaaccuug

SEQ ID NO: 1040600 - RNA, 22 nt, Human
caggggcucagaaccaagguuu

SEQ ID NO: 1040601 - RNA, 19 nt, Human
cauuuuuaaaagcuuggaa

SEQ ID NO: 1040602 - RNA, 19 nt, Human
ccaagaaaagcuggguggc

SEQ ID NO: 1040603 - RNA, 18 nt, Human
ccagacucacaccaaaag

SEQ ID NO: 1040604 - RNA, 23 nt, Human
ccagacucacaccaaaaggaaau

SEQ ID NO: 1040605 - RNA, 22 nt, Human
cccugcuaugaugaaccucaac

SEQ ID NO: 1040606 - RNA, 18 nt, Human
cucaaaauacggaaaaua

SEQ ID NO: 1040607 - RNA, 21 nt, Human
cucaaaauacggaaaauagaa

SEQ ID NO: 1040608 - RNA, 20 nt, Human
gaaccacagacacagauaca

SEQ ID NO: 1040609 - RNA, 24 nt, Human
gacucacaccaaaaggaaauauug

SEQ ID NO: 1040610 - RNA, 21 nt, Human
gauaacauauaguuauaugau

SEQ ID NO: 1040611 - RNA, 20 nt, Human
gcuaugaugaaccucaacac

SEQ ID NO: 1040612 - RNA, 28 nt, Human
ggaaauauugggaagagagccgguaccc

SEQ ID NO: 1040613 - RNA, 19 nt, Human
ggucaaugaugggucaggg

SEQ ID NO: 1040614 - RNA, 21 nt, Human
uaacaaacauagaauauuuua

SEQ ID NO: 1040615 - RNA, 19 nt, Human
ucgcacaggggaaaugcug

SEQ ID NO: 1040616 - RNA, 25 nt, Human
ugaaccacagacacagauacaugaa

SEQ ID NO: 1040617 - RNA, 22 nt, Human
ugaagaaaaugaaccacagaca

SEQ ID NO: 1040618 - RNA, 19 nt, Human
ugcaugcauugcccaugau

SEQ ID NO: 1040619 - RNA, 20 nt, Human
uggaauauacauuccugaaa

SEQ ID NO: 1040620 - RNA, 24 nt, Human
uguccaccaagaaggugaaaagga

SEQ ID NO: 1040621 - RNA, 25 nt, Human
uguucccaacaacccagacucacac

SEQ ID NO: 1040622 - RNA, 21 nt, Human
uuaagacuccaaauucugugc

SEQ ID NO: 1040623 - RNA, 18 nt, Human
uuacaagugggugcugga

SEQ ID NO: 1040624 - RNA, 24 nt, Human
accucgagaccccaccauagguug

SEQ ID NO: 1040625 - RNA, 19 nt, Human
caagaccccucagaacugg

SEQ ID NO: 1040626 - RNA, 18 nt, Human
caccauagguuguggcaa

SEQ ID NO: 1040627 - RNA, 23 nt, Human
cacccucagcuucaaggugcaga

SEQ ID NO: 1040628 - RNA, 21 nt, Human
cagcguggcacgggagacgcu

SEQ ID NO: 1040629 - RNA, 21 nt, Human
caggccggggcggguaaacag

SEQ ID NO: 1040630 - RNA, 19 nt, Human
ccaggccacacccucagcu

SEQ ID NO: 1040631 - RNA, 23 nt, Human
ccuccaggccacacccucagcuu

SEQ ID NO: 1040632 - RNA, 19 nt, Human
ccuccgagugggcaggcuc

SEQ ID NO: 1040633 - RNA, 20 nt, Human
ccucgagaccccaccauagg

SEQ ID NO: 1040634 - RNA, 20 nt, Human
cucagggccuucaagacccc

SEQ ID NO: 1040635 - RNA, 23 nt, Human
cuugccccucuggugccuccagg

SEQ ID NO: 1040636 - RNA, 19 nt, Human
gcaggccucccccaagucu

SEQ ID NO: 1040637 - RNA, 20 nt, Human
gcaggccucccccaagucua

SEQ ID NO: 1040638 - RNA, 24 nt, Human
gcuccuggggaagggggcugcagg

SEQ ID NO: 1040639 - RNA, 18 nt, Human
ggaacauucucuugcccc

SEQ ID NO: 1040640 - RNA, 22 nt, Human
gggcugcagggcuggcaacugu

SEQ ID NO: 1040641 - RNA, 19 nt, Human
ggggaagggggcugcaggg

SEQ ID NO: 1040642 - RNA, 22 nt, Human
ucaaaggagucgccccaacugg

SEQ ID NO: 1040643 - RNA, 21 nt, Human
uccaggccacacccucagcuu

SEQ ID NO: 1040644 - RNA, 19 nt, Human
uccggaacauucucuugcc

SEQ ID NO: 1040645 - RNA, 23 nt, Human
ucucuugccccucuggugccucc

SEQ ID NO: 1040646 - RNA, 21 nt, Human
ugcccaggccggggcggguaa

SEQ ID NO: 1040647 - RNA, 21 nt, Human
ugcuccuggggaagggggcug

SEQ ID NO: 1040648 - RNA, 22 nt, Human
aaccugcucacccuguccccua

SEQ ID NO: 1040649 - RNA, 24 nt, Human
aacgugcugagauuacagguguga

SEQ ID NO: 1040650 - RNA, 18 nt, Human
accagggcugcaaugcuc

SEQ ID NO: 1040651 - RNA, 20 nt, Human
accaugaguugcugguccuu

SEQ ID NO: 1040652 - RNA, 20 nt, Human
acccacucuccuuguccccc

SEQ ID NO: 1040653 - RNA, 19 nt, Human
acccugcccgcugugcagc

SEQ ID NO: 1040654 - RNA, 20 nt, Human
acccuggacaccuucugcuu

SEQ ID NO: 1040655 - RNA, 18 nt, Human
acgggauuucgccauguu

SEQ ID NO: 1040656 - RNA, 20 nt, Human
acgggauuucgccauguugg

SEQ ID NO: 1040657 - RNA, 24 nt, Human
acgggauuucgccauguuggccag

SEQ ID NO: 1040658 - RNA, 24 nt, Human
acucuccuuguccccccaaacccu

SEQ ID NO: 1040659 - RNA, 20 nt, Human
agacguucaggagguucugc

SEQ ID NO: 1040660 - RNA, 18 nt, Human
agagaguccuucaggagc

SEQ ID NO: 1040661 - RNA, 22 nt, Human
agauuacaggugugagucacug

SEQ ID NO: 1040662 - RNA, 22 nt, Human
agcacuccuuucgcugcuccuc

SEQ ID NO: 1040663 - RNA, 19 nt, Human
agcuugcugucgcgauagu

SEQ ID NO: 1040664 - RNA, 23 nt, Human
aggugugagucacugugcccagc

SEQ ID NO: 1040665 - RNA, 20 nt, Human
auuauaacauuaguuaccau

SEQ ID NO: 1040666 - RNA, 24 nt, Human
caacgugcugagauuacaggugug

SEQ ID NO: 1040667 - RNA, 19 nt, Human
cacaggauuuguggccuga

SEQ ID NO: 1040668 - RNA, 21 nt, Human
cacccuguccccuaaacccac

SEQ ID NO: 1040669 - RNA, 22 nt, Human
cacccuguccccuaaacccacu

SEQ ID NO: 1040670 - RNA, 25 nt, Human
cacccuguccccuaaacccacucuc

SEQ ID NO: 1040671 - RNA, 22 nt, Human
cacugugcccagccugaaaaac

SEQ ID NO: 1040672 - RNA, 24 nt, Human
cagccgcacccccaccgccuccgg

SEQ ID NO: 1040673 - RNA, 19 nt, Human
cagccugaaaaacccuaau

SEQ ID NO: 1040674 - RNA, 18 nt, Human
cagccuucucacccugcc

SEQ ID NO: 1040675 - RNA, 20 nt, Human
cagcugcuagcugcccgccg

SEQ ID NO: 1040676 - RNA, 18 nt, Human
caggagccgggugagcuu

SEQ ID NO: 1040677 - RNA, 21 nt, Human
caggagccgggugagcuugcu

SEQ ID NO: 1040678 - RNA, 20 nt, Human
caugccagccuucucacccu

SEQ ID NO: 1040679 - RNA, 24 nt, Human
cauguuggccaggcuggucucgaa

SEQ ID NO: 1040680 - RNA, 21 nt, Human
ccaacgugcugagauuacagg

SEQ ID NO: 1040681 - RNA, 21 nt, Human
ccaacgugcugagauuacagg

SEQ ID NO: 1040682 - RNA, 24 nt, Human
ccaacgugcugagauuacaggugu

SEQ ID NO: 1040683 - RNA, 20 nt, Human
ccaccgccuccgggucgcgu

SEQ ID NO: 1040684 - RNA, 24 nt, Human
ccaccgggcauggcucagccgcac

SEQ ID NO: 1040685 - RNA, 19 nt, Human
ccagggcugcaaugcucuc

SEQ ID NO: 1040686 - RNA, 19 nt, Human
ccauguuggccaggcuggu

SEQ ID NO: 1040687 - RNA, 22 nt, Human
ccauguuggccaggcuggucuc

SEQ ID NO: 1040688 - RNA, 23 nt, Human
ccauguuggccaggcuggucucg

SEQ ID NO: 1040689 - RNA, 22 nt, Human
cccacucuccuuguccccccaa

SEQ ID NO: 1040690 - RNA, 23 nt, Human
cccacucuccuuguccccccaaa

SEQ ID NO: 1040691 - RNA, 25 nt, Human
ccccaccgccuccgggucgcguccg

SEQ ID NO: 1040692 - RNA, 27 nt, Human
cccccaccgccuccgggucgcguccgc

SEQ ID NO: 1040693 - RNA, 18 nt, Human
ccccgggccuggccccgc

SEQ ID NO: 1040694 - RNA, 20 nt, Human
cccgccgccucgcgcgcugc

SEQ ID NO: 1040695 - RNA, 18 nt, Human
cccugccgcaccuccugc

SEQ ID NO: 1040696 - RNA, 19 nt, Human
ccgcacccccaccgccucc

SEQ ID NO: 1040697 - RNA, 21 nt, Human
ccgcacccccaccgccucccc

SEQ ID NO: 1040698 - RNA, 20 nt, Human
ccgccgccucgcgcgcugcc

SEQ ID NO: 1040699 - RNA, 23 nt, Human
ccgccgccucgcgcgcugccuga

SEQ ID NO: 1040700 - RNA, 23 nt, Human
ccggccccgggccuggccccgcc

SEQ ID NO: 1040701 - RNA, 20 nt, Human
ccuccgccuugccucucaaa

SEQ ID NO: 1040702 - RNA, 19 nt, Human
ccucucaaaccugcucacc

SEQ ID NO: 1040703 - RNA, 20 nt, Human
ccucucaaaccugcucaccc

SEQ ID NO: 1040704 - RNA, 19 nt, Human
ccugcccgcugugcagcug

SEQ ID NO: 1040705 - RNA, 23 nt, Human
ccuggccccuccgccuugccucu

SEQ ID NO: 1040706 - RNA, 18 nt, Human
ccuggccucaagugaucu

SEQ ID NO: 1040707 - RNA, 24 nt, Human
ccuggccucaagugaucugccuac

SEQ ID NO: 1040708 - RNA, 18 nt, Human
ccuuucgcugcuccuccc

SEQ ID NO: 1040709 - RNA, 21 nt, Human
ccuuucgcugcuccucccgcc

SEQ ID NO: 1040710 - RNA, 27 nt, Human
cgccauguuggccaggcuggucucgaa

SEQ ID NO: 1040711 - RNA, 19 nt, Human
cgccgccucgcgcgcugcc

SEQ ID NO: 1040712 - RNA, 24 nt, Human
cgccuugccucucaaaccugcuca

SEQ ID NO: 1040713 - RNA, 19 nt, Human
cggccccgggccuggcccc

SEQ ID NO: 1040714 - RNA, 21 nt, Human
cggcuacccccacccuggccc

SEQ ID NO: 1040715 - RNA, 24 nt, Human
cgggauuucgccauguuggccagg

SEQ ID NO: 1040716 - RNA, 19 nt, Human
cgugcugagauuacaggug

SEQ ID NO: 1040717 - RNA, 24 nt, Human
cucaagugaucugccuaccucaac

SEQ ID NO: 1040718 - RNA, 18 nt, Human
cucccgggcugcggccac

SEQ ID NO: 1040719 - RNA, 23 nt, Human
cuccuggguccucugccgguucc

SEQ ID NO: 1040720 - RNA, 19 nt, Human
cucugccgguuccccuuca

SEQ ID NO: 1040721 - RNA, 24 nt, Human
cugccacgcugaugggccggaccc

SEQ ID NO: 1040722 - RNA, 20 nt, Human
cuggccccuccgccuugccu

SEQ ID NO: 1040723 - RNA, 21 nt, Human
cuggccccuccgccuugccuc

SEQ ID NO: 1040724 - RNA, 22 nt, Human
gaagcgccaccaugaguugcug

SEQ ID NO: 1040725 - RNA, 21 nt, Human
gaagcugucccaugccagccu

SEQ ID NO: 1040726 - RNA, 22 nt, Human
gagcaggugucgggagguguca

SEQ ID NO: 1040727 - RNA, 20 nt, Human
gaugcaguugcccagugcca

SEQ ID NO: 1040728 - RNA, 18 nt, Human
gauuacaggugugaguca

SEQ ID NO: 1040729 - RNA, 24 nt, Human
gauuacaggugugagucacugugc

SEQ ID NO: 1040730 - RNA, 24 nt, Human
gcccgccgccucgcgcgcugccug

SEQ ID NO: 1040731 - RNA, 21 nt, Human
gccggccccgggccuggcccc

SEQ ID NO: 1040732 - RNA, 20 nt, Human
gccugaaaaacccuaauuau

SEQ ID NO: 1040733 - RNA, 22 nt, Human
gccuugccucucaaaccugcuc

SEQ ID NO: 1040734 - RNA, 18 nt, Human
gcggccgugggcuccugg

SEQ ID NO: 1040735 - RNA, 22 nt, Human
gcucacccuguccccuaaaccc

SEQ ID NO: 1040736 - RNA, 19 nt, Human
gcucagggcguugaugcag

SEQ ID NO: 1040737 - RNA, 23 nt, Human
gcuggucucgaacuccuggccuc

SEQ ID NO: 1040738 - RNA, 20 nt, Human
ggagguucugcuucacccua

SEQ ID NO: 1040739 - RNA, 20 nt, Human
ggcccggccggcguagguca

SEQ ID NO: 1040740 - RNA, 24 nt, Human
ggccucaagugaucugccuaccuc

SEQ ID NO: 1040741 - RNA, 24 nt, Human
ggcuggucucgaacuccuggccuc

SEQ ID NO: 1040742 - RNA, 23 nt, Human
gggauuucgccauguuggccagg

SEQ ID NO: 1040743 - RNA, 22 nt, Human
gggccuggccccgcccagucug

SEQ ID NO: 1040744 - RNA, 23 nt, Human
gguggcuccaggaugucugguug

SEQ ID NO: 1040745 - RNA, 24 nt, Human
gugaucugccuaccucaacuuccc

SEQ ID NO: 1040746 - RNA, 21 nt, Human
gugcugagauuacagguguga

SEQ ID NO: 1040747 - RNA, 22 nt, Human
uaaagacgggauuucgccaugu

SEQ ID NO: 1040748 - RNA, 19 nt, Human
uaacauuaguuaccauuuu

SEQ ID NO: 1040749 - RNA, 24 nt, Human
uaccucaacuucccaacgugcuga

SEQ ID NO: 1040750 - RNA, 20 nt, Human
uagcugcccgccgccucgcg

SEQ ID NO: 1040751 - RNA, 24 nt, Human
uaguaaagacgggauuucgccaug

SEQ ID NO: 1040752 - RNA, 27 nt, Human
ucaaaccugcucacccuguccccuaaa

SEQ ID NO: 1040753 - RNA, 20 nt, Human
ucacugugcccagccugaaa

SEQ ID NO: 1040754 - RNA, 19 nt, Human
ucacugugcggcuguuucc

SEQ ID NO: 1040755 - RNA, 23 nt, Human
ucccaacgugcugagauuacagg

SEQ ID NO: 1040756 - RNA, 21 nt, Human
ucccaagucucacggcuaccc

SEQ ID NO: 1040757 - RNA, 22 nt, Human
ucccagcaaccccaugagggcu

SEQ ID NO: 1040758 - RNA, 22 nt, Human
uccccccaaacccuggacaccu

SEQ ID NO: 1040759 - RNA, 20 nt, Human
uccuugguaugugccaggca

SEQ ID NO: 1040760 - RNA, 20 nt, Human
ucgcaggacugaugugagcg

SEQ ID NO: 1040761 - RNA, 22 nt, Human
ucgccauguuggccaggcuggu

SEQ ID NO: 1040762 - RNA, 24 nt, Human
ucgccauguuggccaggcuggucu

SEQ ID NO: 1040763 - RNA, 18 nt, Human
ucgcugcuccucccgcca

SEQ ID NO: 1040764 - RNA, 27 nt, Human
ucucacccugcccgcugugcagcugga

SEQ ID NO: 1040765 - RNA, 23 nt, Human
ucuccagcuccagcaggcgccuc

SEQ ID NO: 1040766 - RNA, 21 nt, Human
ucucgaacuccuggccucaag

SEQ ID NO: 1040767 - RNA, 18 nt, Human
ucugguuggcggccgugg

SEQ ID NO: 1040768 - RNA, 20 nt, Human
ugaacaggcggcccugccgc

SEQ ID NO: 1040769 - RNA, 21 nt, Human
ugagauuacaggugugaguca

SEQ ID NO: 1040770 - RNA, 22 nt, Human
ugagauuacaggugugagucac

SEQ ID NO: 1040771 - RNA, 22 nt, Human
ugagauuacaggugugagucac

SEQ ID NO: 1040772 - RNA, 22 nt, Human
ugagauuacaggugugagucac

SEQ ID NO: 1040773 - RNA, 24 nt, Human
ugagauuacaggugugagucacug

SEQ ID NO: 1040774 - RNA, 18 nt, Human
ugaguccuugguaugugc

SEQ ID NO: 1040775 - RNA, 19 nt, Human
ugaguugcugguccuugga

SEQ ID NO: 1040776 - RNA, 23 nt, Human
ugaucugccuaccucaacuuccc

SEQ ID NO: 1040777 - RNA, 24 nt, Human
ugccaggcauuuauguaaucuucc

SEQ ID NO: 1040778 - RNA, 19 nt, Human
ugcccgccgccucgcgcgc

SEQ ID NO: 1040779 - RNA, 24 nt, Human
ugcugagauuacaggugugaguca

SEQ ID NO: 1040780 - RNA, 24 nt, Human
uggccaggcuggucucgaacuccu

SEQ ID NO: 1040781 - RNA, 18 nt, Human
uggccucaagugaucugc

SEQ ID NO: 1040782 - RNA, 19 nt, Human
uggccucaagugaucugcc

SEQ ID NO: 1040783 - RNA, 20 nt, Human
uggccucaagugaucugccu

SEQ ID NO: 1040784 - RNA, 24 nt, Human
ugggcgaugaggguagcuccuucc

SEQ ID NO: 1040785 - RNA, 22 nt, Human
uguccccuaaacccacucuccu

SEQ ID NO: 1040786 - RNA, 19 nt, Human
ugugcagcuggaccucagc

SEQ ID NO: 1040787 - RNA, 18 nt, Human
uguuuccucccagagagu

SEQ ID NO: 1040788 - RNA, 22 nt, Human
uuacagguggggaaugugacgc

SEQ ID NO: 1040789 - RNA, 23 nt, Human
uuacagguggggaaugugacgca

SEQ ID NO: 1040790 - RNA, 24 nt, Human
uuaguaaagacgggauuucgccau

SEQ ID NO: 1040791 - RNA, 21 nt, Human
uucccaacgugcugagauuac

SEQ ID NO: 1040792 - RNA, 20 nt, Human
uuccgggacuccucgaaggc

SEQ ID NO: 1040793 - RNA, 19 nt, Human
uuggcggccgugggcuccu

SEQ ID NO: 1040794 - RNA, 24 nt, Human
uuucgccauguuggccaggcuggu

SEQ ID NO: 1040795 - RNA, 24 nt, Human
cugggugauguaaaaauucuccuc

SEQ ID NO: 1040796 - RNA, 24 nt, Human
ucaggccuggugagucuggaugug

SEQ ID NO: 1040797 - RNA, 21 nt, Human
ugaccgcuuccugggugaugu

SEQ ID NO: 1040798 - RNA, 19 nt, Human
ugauguaaaaauucuccuc

SEQ ID NO: 1040799 - RNA, 21 nt, Human
uggaugugaccgcuuccuggg

SEQ ID NO: 1040800 - RNA, 23 nt, Human
uucuccucauacuucaacuucaa

SEQ ID NO: 1040801 - RNA, 23 nt, Human
aaaccacacaacagcuagcgcaa

SEQ ID NO: 1040802 - RNA, 20 nt, Human
aaugcauguuuuccaguggu

SEQ ID NO: 1040803 - RNA, 18 nt, Human
accuccccaccuccucca

SEQ ID NO: 1040804 - RNA, 20 nt, Human
agaaaugccauguuaaccau

SEQ ID NO: 1040805 - RNA, 19 nt, Human
agcccuggcccaacaccuc

SEQ ID NO: 1040806 - RNA, 28 nt, Human
aggacuaaaagucgcaggacuacaaacc

SEQ ID NO: 1040807 - RNA, 23 nt, Human
agggacagacucccuccuaccuc

SEQ ID NO: 1040808 - RNA, 21 nt, Human
caaagccuggucgacagcuau

SEQ ID NO: 1040809 - RNA, 23 nt, Human
caacaccuccccaccuccuccac

SEQ ID NO: 1040810 - RNA, 18 nt, Human
cacagugcggagcagaac

SEQ ID NO: 1040811 - RNA, 27 nt, Human
caccucuaaucuucauauugcugauuu

SEQ ID NO: 1040812 - RNA, 23 nt, Human
ccaacaccuccccaccuccucca

SEQ ID NO: 1040813 - RNA, 22 nt, Human
cccaacaccuccccaccuccuc

SEQ ID NO: 1040814 - RNA, 21 nt, Human
cccuccuaccucagcccuggc

SEQ ID NO: 1040815 - RNA, 20 nt, Human
ccuccacagugcggagcaga

SEQ ID NO: 1040816 - RNA, 24 nt, Human
cgcaggacuacaaaccacacaaca

SEQ ID NO: 1040817 - RNA, 21 nt, Human
cguucauuuuuuccaaagccu

SEQ ID NO: 1040818 - RNA, 22 nt, Human
cuacuugcaaacugugguccac

SEQ ID NO: 1040819 - RNA, 26 nt, Human
cuacuugcaaacugugguccacaaaa

SEQ ID NO: 1040820 - RNA, 26 nt, Human
cucagcccuggcccaacaccgguucc

SEQ ID NO: 1040821 - RNA, 18 nt, Human
cucccuccuaccucagcc

SEQ ID NO: 1040822 - RNA, 19 nt, Human
cuugcaaacugugguccac

SEQ ID NO: 1040823 - RNA, 22 nt, Human
gcagaacgccggggucgccucc

SEQ ID NO: 1040824 - RNA, 31 nt, Human
uagaaagcuuaaaauccauacagauaaggag

SEQ ID NO: 1040825 - RNA, 29 nt, Human
uagcuccauagguaaggacgggggaaccc

SEQ ID NO: 1040826 - RNA, 23 nt, Human
ucagcccuggcccaacaccuccc

SEQ ID NO: 1040827 - RNA, 20 nt, Human
uccacagugcggagcagaac

SEQ ID NO: 1040828 - RNA, 28 nt, Human
uccacagugcggagcagaaccggggucc

SEQ ID NO: 1040829 - RNA, 20 nt, Human
uccauacagauaaggacugg

SEQ ID NO: 1040830 - RNA, 23 nt, Human
ucuccugugaggcaccagagcug

SEQ ID NO: 1040831 - RNA, 21 nt, Human
ugaaaaucaucuuaugucccc

SEQ ID NO: 1040832 - RNA, 20 nt, Human
uggcccaacaccuccccacc

SEQ ID NO: 1040833 - RNA, 24 nt, Human
ugugaggcaccagagcaccgcgga

SEQ ID NO: 1040834 - RNA, 20 nt, Human
uuaaaguuuccaaaaugcaa

SEQ ID NO: 1040835 - RNA, 18 nt, Human
uuggcuccgaaaaaaguc

SEQ ID NO: 1040836 - RNA, 26 nt, Human
uuuguaaacaauaaaacauuucauua

SEQ ID NO: 1040837 - RNA, 19 nt, Human
ggagggggacggcgggggc

SEQ ID NO: 1040838 - RNA, 18 nt, Human
gguggguggggguggugc

SEQ ID NO: 1040839 - RNA, 18 nt, Human
ugccgacuuccuucuugu

SEQ ID NO: 1040840 - RNA, 20 nt, Human
ugggagagaguuggaggggg

SEQ ID NO: 1040841 - RNA, 22 nt, Human
uggguggggguggugcgacggc

SEQ ID NO: 1040842 - RNA, 23 nt, Human
uggguggggguggugcgacggcc

SEQ ID NO: 1040843 - RNA, 19 nt, Human
uuggagggggacggcgggg

SEQ ID NO: 1040844 - RNA, 18 nt, Human
agagcucuggggccccuc

SEQ ID NO: 1040845 - RNA, 19 nt, Human
aaaccgacagaccuggguu

SEQ ID NO: 1040846 - RNA, 19 nt, Human
aaagucccaagaaugccag

SEQ ID NO: 1040847 - RNA, 19 nt, Human
accuagaggaagcugagcu

SEQ ID NO: 1040848 - RNA, 22 nt, Human
acggaccucagaagggugagug

SEQ ID NO: 1040849 - RNA, 19 nt, Human
agagagcugggggcugacc

SEQ ID NO: 1040850 - RNA, 22 nt, Human
agaggaagcugagcugauggug

SEQ ID NO: 1040851 - RNA, 18 nt, Human
aggaagcugagcugaugg

SEQ ID NO: 1040852 - RNA, 21 nt, Human
aggcaguggggacaagucaag

SEQ ID NO: 1040853 - RNA, 20 nt, Human
aggccccuggccaggacccu

SEQ ID NO: 1040854 - RNA, 20 nt, Human
aggcggagagagcugggggc

SEQ ID NO: 1040855 - RNA, 20 nt, Human
auccugagggcaggagguga

SEQ ID NO: 1040856 - RNA, 23 nt, Human
caccuguggagagaccucugccc

SEQ ID NO: 1040857 - RNA, 19 nt, Human
ccccuggccaggcccucug

SEQ ID NO: 1040858 - RNA, 19 nt, Human
cccgccacucaccagggag

SEQ ID NO: 1040859 - RNA, 21 nt, Human
cccugcuggcuuuacgaggga

SEQ ID NO: 1040860 - RNA, 20 nt, Human
cccuggccaggcccucuggg

SEQ ID NO: 1040861 - RNA, 20 nt, Human
ccucagggcugccacugugc

SEQ ID NO: 1040862 - RNA, 20 nt, Human
ccuccuguucuccuucuucc

SEQ ID NO: 1040863 - RNA, 22 nt, Human
ccucugggauccugagggcagg

SEQ ID NO: 1040864 - RNA, 24 nt, Human
ccucugggauccugagggcaggag

SEQ ID NO: 1040865 - RNA, 18 nt, Human
ccugagggcaggagguga

SEQ ID NO: 1040866 - RNA, 25 nt, Human
ccuggccaggcccucugggauccug

SEQ ID NO: 1040867 - RNA, 21 nt, Human
cggccaggccaacccgcagga

SEQ ID NO: 1040868 - RNA, 21 nt, Human
cgggaugaacccuccaggucc

SEQ ID NO: 1040869 - RNA, 22 nt, Human
cguaaaccgacagaccuggguu

SEQ ID NO: 1040870 - RNA, 21 nt, Human
cuauauugugcuugaaagugg

SEQ ID NO: 1040871 - RNA, 23 nt, Human
cucucugaaaggugccauaagaa

SEQ ID NO: 1040872 - RNA, 22 nt, Human
cucugaaaggugccauaagaag

SEQ ID NO: 1040873 - RNA, 22 nt, Human
cugauggugacaggcaguucuc

SEQ ID NO: 1040874 - RNA, 29 nt, Human
cugauggugacaggcaguucucagagguu

SEQ ID NO: 1040875 - RNA, 23 nt, Human
cugccuacaguugcuuggcaaag

SEQ ID NO: 1040876 - RNA, 25 nt, Human
cugcuccccuggaacaguccuuugu

SEQ ID NO: 1040877 - RNA, 22 nt, Human
gaaaggaucaaagguguugcuc

SEQ ID NO: 1040878 - RNA, 22 nt, Human
gagccggcugcccaggccccug

SEQ ID NO: 1040879 - RNA, 21 nt, Human
gccauaagaagccugcucccc

SEQ ID NO: 1040880 - RNA, 22 nt, Human
gcccaggccccuggccaggccc

SEQ ID NO: 1040881 - RNA, 21 nt, Human
gcccgccacucaccagggaga

SEQ ID NO: 1040882 - RNA, 19 nt, Human
gccuggagccugcccgucc

SEQ ID NO: 1040883 - RNA, 22 nt, Human
ggaaacugcauucucguaaacc

SEQ ID NO: 1040884 - RNA, 23 nt, Human
ggcaguggggacaagucaaggaa

SEQ ID NO: 1040885 - RNA, 19 nt, Human
ggcggagagagcugggggc

SEQ ID NO: 1040886 - RNA, 23 nt, Human
gggaagaccaaggugacacucaa

SEQ ID NO: 1040887 - RNA, 18 nt, Human
gggcccugcuggcuuuac

SEQ ID NO: 1040888 - RNA, 24 nt, Human
ggggacaagucaaggaagaucuau

SEQ ID NO: 1040889 - RNA, 24 nt, Human
guaagguuuucuuucgaccuaaag

SEQ ID NO: 1040890 - RNA, 19 nt, Human
gugacacucaagaaccucg

SEQ ID NO: 1040891 - RNA, 22 nt, Human
uaagaagccugcuccccuggaa

SEQ ID NO: 1040892 - RNA, 19 nt, Human
uacaagacaacggguuucc

SEQ ID NO: 1040893 - RNA, 18 nt, Human
uacacgauccagcaacca

SEQ ID NO: 1040894 - RNA, 18 nt, Human
uagaggaagcugagcuga

SEQ ID NO: 1040895 - RNA, 20 nt, Human
uagggacacacacaggaaag

SEQ ID NO: 1040896 - RNA, 28 nt, Human
uccauggcagggcucagcccgccacucu

SEQ ID NO: 1040897 - RNA, 18 nt, Human
uccucagggcugccacug

SEQ ID NO: 1040898 - RNA, 19 nt, Human
uccucagggcugccacugu

SEQ ID NO: 1040899 - RNA, 19 nt, Human
ucgaccuaaagaaagagug

SEQ ID NO: 1040900 - RNA, 24 nt, Human
ucucgagccggcugcccaggcccc

SEQ ID NO: 1040901 - RNA, 22 nt, Human
ugaaaguggcuuugcacaaagc

SEQ ID NO: 1040902 - RNA, 24 nt, Human
ugacaugcccagugcacugccucu

SEQ ID NO: 1040903 - RNA, 18 nt, Human
ugagccuggagccugccc

SEQ ID NO: 1040904 - RNA, 22 nt, Human
ugcugggaauugccuuggaacu

SEQ ID NO: 1040905 - RNA, 28 nt, Human
uggccaggcccucugggauccugagggc

SEQ ID NO: 1040906 - RNA, 20 nt, Human
ugggauccugagggcaggag

SEQ ID NO: 1040907 - RNA, 24 nt, Human
ugggauccugagggcaggagguga

SEQ ID NO: 1040908 - RNA, 22 nt, Human
uggguuucgccgcugcuccugu

SEQ ID NO: 1040909 - RNA, 18 nt, Human
uggugacaggcaguucuc

SEQ ID NO: 1040910 - RNA, 18 nt, Human
ccuccuccucuuccucac

SEQ ID NO: 1040911 - RNA, 22 nt, Human
cgggggcuucgggcaaaaaugg

SEQ ID NO: 1040912 - RNA, 26 nt, Human
cuccucgccggaccccgggggcuucc

SEQ ID NO: 1040913 - RNA, 20 nt, Human
cuccucuuccucacgcuccc

SEQ ID NO: 1040914 - RNA, 23 nt, Human
ggcaaaaauggagagcaggcaga

SEQ ID NO: 1040915 - RNA, 22 nt, Human
ggcagaggucacauccuccucc

SEQ ID NO: 1040916 - RNA, 19 nt, Human
gguuuggaggugugaagug

SEQ ID NO: 1040917 - RNA, 21 nt, Human
uccuccuccucuuccucacgc

SEQ ID NO: 1040918 - RNA, 18 nt, Human
ugugaagugggcggugga

SEQ ID NO: 1040919 - RNA, 21 nt, Human
auagucuuggggccugggcua

SEQ ID NO: 1040920 - RNA, 23 nt, Human
cauauagucuuggggccugggcu

SEQ ID NO: 1040921 - RNA, 19 nt, Human
ggcuaaagagcagcuucag

SEQ ID NO: 1040922 - RNA, 22 nt, Human
ugccacagggaccauauagucu

SEQ ID NO: 1040923 - RNA, 25 nt, Human
aagcagggaagagauagaaaucuag

SEQ ID NO: 1040924 - RNA, 23 nt, Human
aagcuuaaggcaggacccucuga

SEQ ID NO: 1040925 - RNA, 24 nt, Human
aaggaggggcaaaagacagaaggu

SEQ ID NO: 1040926 - RNA, 20 nt, Human
aaucaguagucaccaggaca

SEQ ID NO: 1040927 - RNA, 22 nt, Human
acccugagaacagauggggagu

SEQ ID NO: 1040928 - RNA, 18 nt, Human
accugggucccagacgcc

SEQ ID NO: 1040929 - RNA, 19 nt, Human
agaaaucuaggagauucug

SEQ ID NO: 1040930 - RNA, 19 nt, Human
agaagaaaaggauccggga

SEQ ID NO: 1040931 - RNA, 21 nt, Human
agaagaaaaggauccgggaga

SEQ ID NO: 1040932 - RNA, 22 nt, Human
agaagaaaaggauccgggagaa

SEQ ID NO: 1040933 - RNA, 26 nt, Human
agagaagaaaaggauccgggagaaga

SEQ ID NO: 1040934 - RNA, 22 nt, Human
agauggaagccagggaggcagg

SEQ ID NO: 1040935 - RNA, 19 nt, Human
agauggggagugggguugg

SEQ ID NO: 1040936 - RNA, 27 nt, Human
agcaacgagaucucgauccgagaaaga

SEQ ID NO: 1040937 - RNA, 22 nt, Human
agcaagugagagaagaaaagga

SEQ ID NO: 1040938 - RNA, 20 nt, Human
agcacgggaguagaggaggg

SEQ ID NO: 1040939 - RNA, 21 nt, Human
agcacgggaguagaggaggga

SEQ ID NO: 1040940 - RNA, 26 nt, Human
agcgucccugagcguccccaggcagc

SEQ ID NO: 1040941 - RNA, 21 nt, Human
aggcaggaagaagaaagccag

SEQ ID NO: 1040942 - RNA, 23 nt, Human
agggaagagauagaaaucuagga

SEQ ID NO: 1040943 - RNA, 19 nt, Human
auagcuguagcaggaacug

SEQ ID NO: 1040944 - RNA, 20 nt, Human
auuugcagucaaggguguca

SEQ ID NO: 1040945 - RNA, 21 nt, Human
caccaggacauagugguggag

SEQ ID NO: 1040946 - RNA, 23 nt, Human
caccugggucccagacgccuggg

SEQ ID NO: 1040947 - RNA, 23 nt, Human
caggaagaagaaagccagcaagu

SEQ ID NO: 1040948 - RNA, 21 nt, Human
caggacaccugggucccagac

SEQ ID NO: 1040949 - RNA, 19 nt, Human
caggacccucugaggucaa

SEQ ID NO: 1040950 - RNA, 22 nt, Human
caggagggacucaaggguggca

SEQ ID NO: 1040951 - RNA, 19 nt, Human
cagggaauggguagggaag

SEQ ID NO: 1040952 - RNA, 23 nt, Human
cagggaggcaggaagaagaaagc

SEQ ID NO: 1040953 - RNA, 23 nt, Human
ccaaggaaagaagggaaacucau

SEQ ID NO: 1040954 - RNA, 24 nt, Human
ccagcaacgagaucucgauccgag

SEQ ID NO: 1040955 - RNA, 18 nt, Human
ccaggcagccaccggagc

SEQ ID NO: 1040956 - RNA, 22 nt, Human
ccucugaggucaaggaggggca

SEQ ID NO: 1040957 - RNA, 26 nt, Human
cgggagaagagccggugauuuccucg

SEQ ID NO: 1040958 - RNA, 18 nt, Human
gaaagaagucaggacucu

SEQ ID NO: 1040959 - RNA, 19 nt, Human
gaagguugcaggugggaug

SEQ ID NO: 1040960 - RNA, 19 nt, Human
gacccucugaggucaagga

SEQ ID NO: 1040961 - RNA, 26 nt, Human
gagaacagauggggagugggguuggc

SEQ ID NO: 1040962 - RNA, 22 nt, Human
gagauggaagccagggaggcag

SEQ ID NO: 1040963 - RNA, 21 nt, Human
gagcacgggaguagaggaggg

SEQ ID NO: 1040964 - RNA, 22 nt, Human
gaggcaggaagaagaaagccag

SEQ ID NO: 1040965 - RNA, 19 nt, Human
gcaagugagagaagaaaag

SEQ ID NO: 1040966 - RNA, 21 nt, Human
gcuguagcaggaacugaccca

SEQ ID NO: 1040967 - RNA, 25 nt, Human
ggaaacucaucucuuguagugauuc

SEQ ID NO: 1040968 - RNA, 19 nt, Human
ggacaccugggucccagac

SEQ ID NO: 1040969 - RNA, 18 nt, Human
ggagauggaagccaggga

SEQ ID NO: 1040970 - RNA, 23 nt, Human
ggagauggaagccagggaggcag

SEQ ID NO: 1040971 - RNA, 20 nt, Human
ggagcaggagggacucaagg

SEQ ID NO: 1040972 - RNA, 23 nt, Human
ggcaaaagacagaagguugcagg

SEQ ID NO: 1040973 - RNA, 23 nt, Human
gggaagagauagaaaucuaggag

SEQ ID NO: 1040974 - RNA, 23 nt, Human
gggagcacgggaguagaggaggg

SEQ ID NO: 1040975 - RNA, 23 nt, Human
uaagaaaguaaaaauggguguca

SEQ ID NO: 1040976 - RNA, 21 nt, Human
uaaggcaggacccucugaggu

SEQ ID NO: 1040977 - RNA, 21 nt, Human
uaaucucugugccuuugaauc

SEQ ID NO: 1040978 - RNA, 21 nt, Human
uagaggagggaaucgcggggu

SEQ ID NO: 1040979 - RNA, 18 nt, Human
uccccaggcagccaccgg

SEQ ID NO: 1040980 - RNA, 24 nt, Human
uccccaggcagccaccggagcucu

SEQ ID NO: 1040981 - RNA, 19 nt, Human
ucccugagcguccccaggc

SEQ ID NO: 1040982 - RNA, 22 nt, Human
ucccugagcguccccaggcagc

SEQ ID NO: 1040983 - RNA, 22 nt, Human
uccgggagaagagccggugauu

SEQ ID NO: 1040984 - RNA, 20 nt, Human
ugagugggaggaaauacacu

SEQ ID NO: 1040985 - RNA, 20 nt, Human
ugauucaacccugagaacag

SEQ ID NO: 1040986 - RNA, 23 nt, Human
ugauucaacccugagaacagaug

SEQ ID NO: 1040987 - RNA, 27 nt, Human
ugcaggugggauggcucaggauggcgg

SEQ ID NO: 1040988 - RNA, 20 nt, Human
ugcagucaagggugucaggg

SEQ ID NO: 1040989 - RNA, 19 nt, Human
uggaagacagggggaaggc

SEQ ID NO: 1040990 - RNA, 19 nt, Human
uggaauuugggagucaaga

SEQ ID NO: 1040991 - RNA, 23 nt, Human
uggcucaggauggcgggcgacgg

SEQ ID NO: 1040992 - RNA, 21 nt, Human
ugggguuggcugucccccaug

SEQ ID NO: 1040993 - RNA, 22 nt, Human
ugggucucucaauucccuuugg

SEQ ID NO: 1040994 - RNA, 20 nt, Human
uuacccagggaauggguagg

SEQ ID NO: 1040995 - RNA, 23 nt, Human
uugggagauggaagccagggagg

SEQ ID NO: 1040996 - RNA, 22 nt, Human
uugggaugacucguucagcccu

SEQ ID NO: 1040997 - RNA, 18 nt, Human
agggacccgaggccgagg

SEQ ID NO: 1040998 - RNA, 19 nt, Human
cccgaggccgagggcggaa

SEQ ID NO: 1040999 - RNA, 19 nt, Human
cgagggcggaaacgcggug

SEQ ID NO: 1041000 - RNA, 19 nt, Human
cucugagagccaggacaag

SEQ ID NO: 1041001 - RNA, 21 nt, Human
cuuuuuggucuccauuccccg

SEQ ID NO: 1041002 - RNA, 23 nt, Human
ggacccgaggccgagggcggaaa

SEQ ID NO: 1041003 - RNA, 23 nt, Human
gucacccgcgagcccuccaggga

SEQ ID NO: 1041004 - RNA, 23 nt, Human
ucacccgcgagcccuccagggac

SEQ ID NO: 1041005 - RNA, 22 nt, Human
ucccaccucauuuauuccuaau

SEQ ID NO: 1041006 - RNA, 20 nt, Human
ucucuagcagggcuggcgcu

SEQ ID NO: 1041007 - RNA, 21 nt, Human
uggcgcuggagcuugucucca

SEQ ID NO: 1041008 - RNA, 22 nt, Human
uuugauaaggacaauucuuuuc

SEQ ID NO: 1041009 - RNA, 19 nt, Human
gcucuguccuggaggcggg

SEQ ID NO: 1041010 - RNA, 21 nt, Human
ucuuuggcugagggacuggug

SEQ ID NO: 1041011 - RNA, 19 nt, Human
aaaaaaaaaaaaaagaaaa

SEQ ID NO: 1041012 - RNA, 24 nt, Human
aaaaaaaaaaggaaggggaaagag

SEQ ID NO: 1041013 - RNA, 24 nt, Human
aaaaagaaaaaaaaaggaaaagaa

SEQ ID NO: 1041014 - RNA, 18 nt, Human
aaaaagaaaaaagaaaaa

SEQ ID NO: 1041015 - RNA, 23 nt, Human
aaaagaaaaaaaaaggaaaagaa

SEQ ID NO: 1041016 - RNA, 23 nt, Human
aaacagaauggcaggaacaaacu

SEQ ID NO: 1041017 - RNA, 19 nt, Human
aaaggacagcaggagaaga

SEQ ID NO: 1041018 - RNA, 21 nt, Human
aagaaucucuugcaccaaguc

SEQ ID NO: 1041019 - RNA, 26 nt, Human
aauggcaggaacaaacuaggaaagga

SEQ ID NO: 1041020 - RNA, 19 nt, Human
aauuaaaaaaaaaaggaag

SEQ ID NO: 1041021 - RNA, 24 nt, Human
acaacuagcaaaaacagucugccu

SEQ ID NO: 1041022 - RNA, 27 nt, Human
agaaaaaaaaaggaaaagaaaacaaaa

SEQ ID NO: 1041023 - RNA, 21 nt, Human
agaaaaaagaaaaaaaaagga

SEQ ID NO: 1041024 - RNA, 18 nt, Human
agaggcacaggagaaagg

SEQ ID NO: 1041025 - RNA, 23 nt, Human
agcaaaaggacagcaggagaaga

SEQ ID NO: 1041026 - RNA, 24 nt, Human
agcgggcgaaagccgggcccccag

SEQ ID NO: 1041027 - RNA, 25 nt, Human
aggcagagggagaauccugagguuu

SEQ ID NO: 1041028 - RNA, 19 nt, Human
aggggaguugggguggggc

SEQ ID NO: 1041029 - RNA, 22 nt, Human
aggugacuguuccagaagaggg

SEQ ID NO: 1041030 - RNA, 21 nt, Human
agguuuucugcucauuggcug

SEQ ID NO: 1041031 - RNA, 24 nt, Human
caaaaggacagcaggagaagagaa

SEQ ID NO: 1041032 - RNA, 21 nt, Human
caaaguucgcagcaagaaucu

SEQ ID NO: 1041033 - RNA, 23 nt, Human
caacaggacauauaggaucccuu

SEQ ID NO: 1041034 - RNA, 25 nt, Human
caaccagacaaacuggugggcuaaa

SEQ ID NO: 1041035 - RNA, 24 nt, Human
caagccaugcccugugcaaaaaaa

SEQ ID NO: 1041036 - RNA, 18 nt, Human
cacuggcucuacaaaguu

SEQ ID NO: 1041037 - RNA, 19 nt, Human
cagaggcacaggagaaagg

SEQ ID NO: 1041038 - RNA, 23 nt, Human
cagcaagaaucucuugcaccaag

SEQ ID NO: 1041039 - RNA, 21 nt, Human
caggagacugccugaaggcac

SEQ ID NO: 1041040 - RNA, 22 nt, Human
caucaggaacccucaaagccaa

SEQ ID NO: 1041041 - RNA, 25 nt, Human
cauuuuuauuuucagagggaugagg

SEQ ID NO: 1041042 - RNA, 20 nt, Human
ccacccccaaagcucuagcc

SEQ ID NO: 1041043 - RNA, 19 nt, Human
cccaccccacccccaaagc

SEQ ID NO: 1041044 - RNA, 21 nt, Human
ccccaaagcucuagccaguca

SEQ ID NO: 1041045 - RNA, 23 nt, Human
ccccaccccacccccaaagcucu

SEQ ID NO: 1041046 - RNA, 24 nt, Human
ccccaccccacccccaaagcucua

SEQ ID NO: 1041047 - RNA, 18 nt, Human
ccccagugagcgccgcga

SEQ ID NO: 1041048 - RNA, 23 nt, Human
cccugugcaaaaaaaaaaaaaaa

SEQ ID NO: 1041049 - RNA, 21 nt, Human
ccgcggccggcggcggcggcg

SEQ ID NO: 1041050 - RNA, 20 nt, Human
ccugggcuaguggcucugga

SEQ ID NO: 1041051 - RNA, 26 nt, Human
cgcggccggcggcggcggcggcagca

SEQ ID NO: 1041052 - RNA, 25 nt, Human
cggcggcggcggcagcagcgggcga

SEQ ID NO: 1041053 - RNA, 19 nt, Human
cuaaaguccagaaauucuu

SEQ ID NO: 1041054 - RNA, 22 nt, Human
cuaaauaauacuaaaaaaaaaa

SEQ ID NO: 1041055 - RNA, 25 nt, Human
cuaucugcacacuggcucuacaaag

SEQ ID NO: 1041056 - RNA, 18 nt, Human
cuccgcugaagccaccac

SEQ ID NO: 1041057 - RNA, 25 nt, Human
cugaagccaccaccagcgccuccuu

SEQ ID NO: 1041058 - RNA, 22 nt, Human
cugccuccgcugaagccaccac

SEQ ID NO: 1041059 - RNA, 23 nt, Human
cugugcaaaaaaaaaaaaaaaaa

SEQ ID NO: 1041060 - RNA, 20 nt, Human
cuguuagucaaguaaugauu

SEQ ID NO: 1041061 - RNA, 20 nt, Human
cuuauaaaaacagaauggca

SEQ ID NO: 1041062 - RNA, 25 nt, Human
cuucauaggcauuuguauugucacu

SEQ ID NO: 1041063 - RNA, 26 nt, Human
gaaaaaaaaaggaaaagaaaacaaaa

SEQ ID NO: 1041064 - RNA, 25 nt, Human
gaaauucuuuccagguuuucugcuc

SEQ ID NO: 1041065 - RNA, 18 nt, Human
gaaggcagggcuugaauu

SEQ ID NO: 1041066 - RNA, 18 nt, Human
gaauggcaggaacaaacu

SEQ ID NO: 1041067 - RNA, 22 nt, Human
gagcacauacaaacugucauaa

SEQ ID NO: 1041068 - RNA, 22 nt, Human
gagcgugcuugcgucacacgcc

SEQ ID NO: 1041069 - RNA, 24 nt, Human
gcaagaagcagaaaauauuuagag

SEQ ID NO: 1041070 - RNA, 20 nt, Human
gccacuuauaaaaacagaau

SEQ ID NO: 1041071 - RNA, 21 nt, Human
gccggcggcggcggcggcagc

SEQ ID NO: 1041072 - RNA, 25 nt, Human
gccugccuccgcugaagccaccacc

SEQ ID NO: 1041073 - RNA, 19 nt, Human
gccuggcgcugguuggggc

SEQ ID NO: 1041074 - RNA, 19 nt, Human
gcggccggcggcggcggcg

SEQ ID NO: 1041075 - RNA, 19 nt, Human
gcggcggcagcagcgggcg

SEQ ID NO: 1041076 - RNA, 24 nt, Human
gcuaaaguccagaaauucuuucca

SEQ ID NO: 1041077 - RNA, 19 nt, Human
gcucuacaaaguucgcagc

SEQ ID NO: 1041078 - RNA, 25 nt, Human
ggaagaacagccaugaucuaguaaa

SEQ ID NO: 1041079 - RNA, 19 nt, Human
ggacuccagguuucuuauc

SEQ ID NO: 1041080 - RNA, 18 nt, Human
ggcguaagagcaaaagga

SEQ ID NO: 1041081 - RNA, 20 nt, Human
gugagacguuugcugcucug

SEQ ID NO: 1041082 - RNA, 24 nt, Human
gugcaaaaaaaaaaaaaaaaaaaa

SEQ ID NO: 1041083 - RNA, 21 nt, Human
guucuuccugcagaggcacag

SEQ ID NO: 1041084 - RNA, 21 nt, Human
uaaaaagagaccugcaagaag

SEQ ID NO: 1041085 - RNA, 31 nt, Human
uaaaaagccaucaggaacccucaaagccaaa

SEQ ID NO: 1041086 - RNA, 19 nt, Human
uaacccccaccccaccccc

SEQ ID NO: 1041087 - RNA, 23 nt, Human
uaagacaggcagagggagaaucc

SEQ ID NO: 1041088 - RNA, 22 nt, Human
uaagagccaacaggacauauag

SEQ ID NO: 1041089 - RNA, 18 nt, Human
uaaggggaguuggggugg

SEQ ID NO: 1041090 - RNA, 22 nt, Human
uaggaucccuucccucccccgg

SEQ ID NO: 1041091 - RNA, 22 nt, Human
ucaaaaauaaaauuaacaaggu

SEQ ID NO: 1041092 - RNA, 21 nt, Human
ucaaagccaaauucuaucugc

SEQ ID NO: 1041093 - RNA, 20 nt, Human
ucaaccagacaaacuggugg

SEQ ID NO: 1041094 - RNA, 22 nt, Human
ucaaccagacaaacuggugggc

SEQ ID NO: 1041095 - RNA, 23 nt, Human
ucaaucauucagaaggcaagugu

SEQ ID NO: 1041096 - RNA, 18 nt, Human
ucagugccugauauucgg

SEQ ID NO: 1041097 - RNA, 21 nt, Human
ucauuuugaaggcagggcuug

SEQ ID NO: 1041098 - RNA, 20 nt, Human
uccacgguuccacaacuagc

SEQ ID NO: 1041099 - RNA, 20 nt, Human
uccagaagagggcugugaaa

SEQ ID NO: 1041100 - RNA, 19 nt, Human
uccuguuucuucauaggca

SEQ ID NO: 1041101 - RNA, 21 nt, Human
ucuaagauuuggaaaugcuga

SEQ ID NO: 1041102 - RNA, 18 nt, Human
ucuacaaaguucgcagcc

SEQ ID NO: 1041103 - RNA, 23 nt, Human
ugacuguuccagaagagggcugu

SEQ ID NO: 1041104 - RNA, 23 nt, Human
ugagcacauacaaacugucauaa

SEQ ID NO: 1041105 - RNA, 19 nt, Human
ugaggagcugagaugugcc

SEQ ID NO: 1041106 - RNA, 19 nt, Human
ugaggugggaagaacagcc

SEQ ID NO: 1041107 - RNA, 24 nt, Human
ugcaaaaaaaaaaaaaaaaaagaa

SEQ ID NO: 1041108 - RNA, 18 nt, Human
ugccuauuuccaaggacg

SEQ ID NO: 1041109 - RNA, 25 nt, Human
uggcaggaacaaacuaggaaaggaa

SEQ ID NO: 1041110 - RNA, 20 nt, Human
uggcauacucugccccagga

SEQ ID NO: 1041111 - RNA, 22 nt, Human
uggcauacucugccccaggaga

SEQ ID NO: 1041112 - RNA, 19 nt, Human
uggccuggcgcugguuggg

SEQ ID NO: 1041113 - RNA, 21 nt, Human
uggccuggcgcugguuggggc

SEQ ID NO: 1041114 - RNA, 21 nt, Human
uggccuggcuaugauggaugg

SEQ ID NO: 1041115 - RNA, 20 nt, Human
uggcgaggaaggucuucuag

SEQ ID NO: 1041116 - RNA, 21 nt, Human
ugggcuaaaguccagaaauuc

SEQ ID NO: 1041117 - RNA, 23 nt, Human
uggggcgggauccugauccuguu

SEQ ID NO: 1041118 - RNA, 23 nt, Human
uggugggcuaaaguccagaaauu

SEQ ID NO: 1041119 - RNA, 22 nt, Human
uguagccacuuauaaaaacaga

SEQ ID NO: 1041120 - RNA, 24 nt, Human
uguagccacuuauaaaaacagaau

SEQ ID NO: 1041121 - RNA, 21 nt, Human
ugugcaaaaaaaaaaaaaaaa

SEQ ID NO: 1041122 - RNA, 18 nt, Human
uuaaaaaaaaaaggaagg

SEQ ID NO: 1041123 - RNA, 22 nt, Human
uuaaaaaaaaaaggaaggggaa

SEQ ID NO: 1041124 - RNA, 23 nt, Human
uuaaaaaaaaaaggaaggggaaa

SEQ ID NO: 1041125 - RNA, 20 nt, Human
uuaacccccaccccaccccc

SEQ ID NO: 1041126 - RNA, 21 nt, Human
uuaacccccaccccaccccca

SEQ ID NO: 1041127 - RNA, 19 nt, Human
uucaagucuaagauuugga

SEQ ID NO: 1041128 - RNA, 24 nt, Human
uucagaaggcaaguguagccacuu

SEQ ID NO: 1041129 - RNA, 20 nt, Human
uuccugggcuaguggcucug

SEQ ID NO: 1041130 - RNA, 18 nt, Human
uuggcuggaugcuggaag

SEQ ID NO: 1041131 - RNA, 18 nt, Human
uuguauugucacuucuug

SEQ ID NO: 1041132 - RNA, 19 nt, Human
uuugcugcucuggucucaa

SEQ ID NO: 1041133 - RNA, 18 nt, Human
aaaaucaauucagccgcc

SEQ ID NO: 1041134 - RNA, 23 nt, Human
aaauggcugugggaugggguagg

SEQ ID NO: 1041135 - RNA, 18 nt, Human
aagcugcaggggcaggga

SEQ ID NO: 1041136 - RNA, 20 nt, Human
aaggagguccccaggccucu

SEQ ID NO: 1041137 - RNA, 23 nt, Human
aaggggcccuggcccucccuggg

SEQ ID NO: 1041138 - RNA, 20 nt, Human
aauggcugugggauggggua

SEQ ID NO: 1041139 - RNA, 24 nt, Human
agcauucccuggugcccucuacuc

SEQ ID NO: 1041140 - RNA, 19 nt, Human
agccaagcugcaggggcag

SEQ ID NO: 1041141 - RNA, 21 nt, Human
aggaaggugccuggcuuggca

SEQ ID NO: 1041142 - RNA, 21 nt, Human
aggacagaaaucccugaauau

SEQ ID NO: 1041143 - RNA, 24 nt, Human
aggggcccuggcccucccuggggg

SEQ ID NO: 1041144 - RNA, 23 nt, Human
aguaguguugaccuugcuguggg

SEQ ID NO: 1041145 - RNA, 20 nt, Human
agucagcucccagguccugg

SEQ ID NO: 1041146 - RNA, 24 nt, Human
agucagcucccagguccugggagg

SEQ ID NO: 1041147 - RNA, 19 nt, Human
caaaaucaauucagccgcc

SEQ ID NO: 1041148 - RNA, 20 nt, Human
caaaaucaauucagccgccc

SEQ ID NO: 1041149 - RNA, 21 nt, Human
caagacccccacagaaccccc

SEQ ID NO: 1041150 - RNA, 19 nt, Human
cacaagacccccacagaac

SEQ ID NO: 1041151 - RNA, 20 nt, Human
cacagcauucccuggugccc

SEQ ID NO: 1041152 - RNA, 21 nt, Human
cacagcauucccuggugcccu

SEQ ID NO: 1041153 - RNA, 21 nt, Human
cacccugaagucccucacagc

SEQ ID NO: 1041154 - RNA, 23 nt, Human
caccuccagucugaccgcuucca

SEQ ID NO: 1041155 - RNA, 23 nt, Human
cacucuuggggcaggggguugcu

SEQ ID NO: 1041156 - RNA, 25 nt, Human
cagcagcuccgaggucacaugccac

SEQ ID NO: 1041157 - RNA, 19 nt, Human
cagcucccagguccuggga

SEQ ID NO: 1041158 - RNA, 19 nt, Human
cagcugccaccuccccacc

SEQ ID NO: 1041159 - RNA, 24 nt, Human
cagggcaggcagcugccaccuccc

SEQ ID NO: 1041160 - RNA, 22 nt, Human
ccacagaacccccugcacaggg

SEQ ID NO: 1041161 - RNA, 22 nt, Human
ccagcagaugcuacaacugucc

SEQ ID NO: 1041162 - RNA, 19 nt, Human
cccacagaacccccugcac

SEQ ID NO: 1041163 - RNA, 21 nt, Human
cccaccugaccccaagcugga

SEQ ID NO: 1041164 - RNA, 23 nt, Human
ccccaagcuggaccuccuugccu

SEQ ID NO: 1041165 - RNA, 24 nt, Human
ccccaagcuggaccuccuugccuc

SEQ ID NO: 1041166 - RNA, 23 nt, Human
ccccacagaacccccugcacagg

SEQ ID NO: 1041167 - RNA, 22 nt, Human
cccccacagaacccccugcaca

SEQ ID NO: 1041168 - RNA, 18 nt, Human
ccccguuggggggggggg

SEQ ID NO: 1041169 - RNA, 18 nt, Human
cccuggggggcaggggug

SEQ ID NO: 1041170 - RNA, 18 nt, Human
cccuuggggcagaggugg

SEQ ID NO: 1041171 - RNA, 19 nt, Human
ccguugggggggggggucc

SEQ ID NO: 1041172 - RNA, 21 nt, Human
ccucacucuuggggcaggggg

SEQ ID NO: 1041173 - RNA, 23 nt, Human
ccuccagucugaccgcuuccauu

SEQ ID NO: 1041174 - RNA, 22 nt, Human
ccuccccacccugcaggacagg

SEQ ID NO: 1041175 - RNA, 19 nt, Human
ccucccuggggggcagggg

SEQ ID NO: 1041176 - RNA, 22 nt, Human
ccucucuguagagucagcuccc

SEQ ID NO: 1041177 - RNA, 22 nt, Human
ccuggggggcaggggugugcuc

SEQ ID NO: 1041178 - RNA, 26 nt, Human
ccugugacacaagacccccacagaac

SEQ ID NO: 1041179 - RNA, 20 nt, Human
ccugugcugcagagggaagu

SEQ ID NO: 1041180 - RNA, 20 nt, Human
cgagggaaggcccagacacu

SEQ ID NO: 1041181 - RNA, 24 nt, Human
cuccaaggggcccuggcccucccu

SEQ ID NO: 1041182 - RNA, 20 nt, Human
cucccuggggggcaggggug

SEQ ID NO: 1041183 - RNA, 26 nt, Human
cucccuggggggcaggggugugcucu

SEQ ID NO: 1041184 - RNA, 19 nt, Human
cugcugcccccaccuccag

SEQ ID NO: 1041185 - RNA, 22 nt, Human
cuuggcagggcaggcagcugcc

SEQ ID NO: 1041186 - RNA, 20 nt, Human
gacacagcgugggcccaccu

SEQ ID NO: 1041187 - RNA, 18 nt, Human
gagcugcugcccccaccu

SEQ ID NO: 1041188 - RNA, 22 nt, Human
gagucagcucccagguccuggg

SEQ ID NO: 1041189 - RNA, 26 nt, Human
gcagaacagaggcugggguugcuuuc

SEQ ID NO: 1041190 - RNA, 18 nt, Human
gcaggcagcugccaccuc

SEQ ID NO: 1041191 - RNA, 19 nt, Human
gcagucagcagggugacgg

SEQ ID NO: 1041192 - RNA, 22 nt, Human
gcccaccugaccccaagcugga

SEQ ID NO: 1041193 - RNA, 23 nt, Human
gcccuuggggcagaggugggagu

SEQ ID NO: 1041194 - RNA, 24 nt, Human
gccucuggcucuggggugugauuu

SEQ ID NO: 1041195 - RNA, 21 nt, Human
gcuacaacugucccccuaacc

SEQ ID NO: 1041196 - RNA, 20 nt, Human
ggaguacaaaaucaauucag

SEQ ID NO: 1041197 - RNA, 22 nt, Human
ggaugggguaggggcgacacug

SEQ ID NO: 1041198 - RNA, 21 nt, Human
ggcagaggugggaguccugag

SEQ ID NO: 1041199 - RNA, 19 nt, Human
ggcgggcccgggacacagc

SEQ ID NO: 1041200 - RNA, 21 nt, Human
ggggcaggggugugcucugag

SEQ ID NO: 1041201 - RNA, 18 nt, Human
ggggcccuggcccucccu

SEQ ID NO: 1041202 - RNA, 22 nt, Human
ggggcccuggcccucccugggg

SEQ ID NO: 1041203 - RNA, 22 nt, Human
gguggcuaaggcguaguagugu

SEQ ID NO: 1041204 - RNA, 19 nt, Human
gguuccgucuuguggggca

SEQ ID NO: 1041205 - RNA, 21 nt, Human
gucgcagucagcagggugacg

SEQ ID NO: 1041206 - RNA, 21 nt, Human
uaagaaaaauccgacacagug

SEQ ID NO: 1041207 - RNA, 21 nt, Human
uaggucccugcccaaagcccu

SEQ ID NO: 1041208 - RNA, 19 nt, Human
ucagcagggugacgggugg

SEQ ID NO: 1041209 - RNA, 23 nt, Human
uccacgguggcuguugagugccg

SEQ ID NO: 1041210 - RNA, 23 nt, Human
uccagcugcaagaucuccaaggg

SEQ ID NO: 1041211 - RNA, 22 nt, Human
ucccagguccugggaggcaccc

SEQ ID NO: 1041212 - RNA, 20 nt, Human
uccccaggccucuggcucug

SEQ ID NO: 1041213 - RNA, 23 nt, Human
ucccggguuccgucuuguggggc

SEQ ID NO: 1041214 - RNA, 18 nt, Human
ucccugcccaaagcccuu

SEQ ID NO: 1041215 - RNA, 19 nt, Human
ucuccaaggggcccuggcc

SEQ ID NO: 1041216 - RNA, 19 nt, Human
ucuuggggcaggggguugc

SEQ ID NO: 1041217 - RNA, 21 nt, Human
ugaagucccucacagcauucc

SEQ ID NO: 1041218 - RNA, 22 nt, Human
ugacacaagacccccacagaac

SEQ ID NO: 1041219 - RNA, 25 nt, Human
ugacacaagacccccacagaacccc

SEQ ID NO: 1041220 - RNA, 21 nt, Human
ugaccccaagcuggaccuccu

SEQ ID NO: 1041221 - RNA, 22 nt, Human
ugaccccguugggggggggggu

SEQ ID NO: 1041222 - RNA, 18 nt, Human
ugcagagggaagucgcag

SEQ ID NO: 1041223 - RNA, 18 nt, Human
ugcuacaacugucccccu

SEQ ID NO: 1041224 - RNA, 22 nt, Human
uggaaagggcagaacagaggcu

SEQ ID NO: 1041225 - RNA, 19 nt, Human
uggaggaagagcccuccac

SEQ ID NO: 1041226 - RNA, 19 nt, Human
uggcagggcaggcagcugc

SEQ ID NO: 1041227 - RNA, 19 nt, Human
uggcugccugcccugugcu

SEQ ID NO: 1041228 - RNA, 19 nt, Human
uggcugugggaugggguag

SEQ ID NO: 1041229 - RNA, 25 nt, Human
ugggagcugcugcccccaccuccag

SEQ ID NO: 1041230 - RNA, 21 nt, Human
ugggaggagguuuggaaaggg

SEQ ID NO: 1041231 - RNA, 20 nt, Human
uggggcagaggugggagucc

SEQ ID NO: 1041232 - RNA, 19 nt, Human
ugggggacggggaaggcaa

SEQ ID NO: 1041233 - RNA, 22 nt, Human
uuccccuuuaggucccugccca

SEQ ID NO: 1041234 - RNA, 23 nt, Human
uuugcccacccugaagucccuca

SEQ ID NO: 1041235 - RNA, 26 nt, Human
uuugcccacccugaagucccucacag

SEQ ID NO: 1041236 - RNA, 23 nt, Human
aaaaaaaaaaaaagaagcuggaa

SEQ ID NO: 1041237 - RNA, 20 nt, Human
aaaaaaaaaagaagcuggaa

SEQ ID NO: 1041238 - RNA, 23 nt, Human
aaggggggaaaaaaaaaaaaaga

SEQ ID NO: 1041239 - RNA, 19 nt, Human
aggggcugcagacaccugc

SEQ ID NO: 1041240 - RNA, 18 nt, Human
cacaggcaggcugcuggc

SEQ ID NO: 1041241 - RNA, 24 nt, Human
caccagggccuucuucucaggggc

SEQ ID NO: 1041242 - RNA, 22 nt, Human
cagcagguuuccugcucaggcu

SEQ ID NO: 1041243 - RNA, 20 nt, Human
ccacagcaggggcccgcgcc

SEQ ID NO: 1041244 - RNA, 20 nt, Human
ccagcagguuuccugcucag

SEQ ID NO: 1041245 - RNA, 23 nt, Human
ccagggccuucuucucaggggcu

SEQ ID NO: 1041246 - RNA, 21 nt, Human
ccuccccugaaacgaugccag

SEQ ID NO: 1041247 - RNA, 23 nt, Human
ccugucacaggcaggcugcuggc

SEQ ID NO: 1041248 - RNA, 26 nt, Human
cgcccggauuuauauccugggcgcgc

SEQ ID NO: 1041249 - RNA, 18 nt, Human
cugccgggcugugcggcu

SEQ ID NO: 1041250 - RNA, 24 nt, Human
cugcucugccgcugcugccuccac

SEQ ID NO: 1041251 - RNA, 24 nt, Human
cuggggcggcuagagaccuccccu

SEQ ID NO: 1041252 - RNA, 22 nt, Human
gaagcuggaagcaguuuaggca

SEQ ID NO: 1041253 - RNA, 18 nt, Human
gacuuauugcagaagggg

SEQ ID NO: 1041254 - RNA, 23 nt, Human
uauugcagaaggggggaaaaaaa

SEQ ID NO: 1041255 - RNA, 21 nt, Human
ucacaggcaggcugcuggcgc

SEQ ID NO: 1041256 - RNA, 18 nt, Human
ugcagacaccugcccucc

SEQ ID NO: 1041257 - RNA, 21 nt, Human
ugcagggagaggagccacagc

SEQ ID NO: 1041258 - RNA, 18 nt, Human
ugccagggucuggggccc

SEQ ID NO: 1041259 - RNA, 28 nt, Human
uggggcccaccagggccuucccuggggg

SEQ ID NO: 1041260 - RNA, 27 nt, Human
ugugcagggagaggagccacagcaggg

SEQ ID NO: 1041261 - RNA, 19 nt, Human
uuccugcucaggcugcugc

SEQ ID NO: 1041262 - RNA, 23 nt, Human
uuccugcucaggcugcugcucag

SEQ ID NO: 1041263 - RNA, 19 nt, Human
aacauagugagacccgucu

SEQ ID NO: 1041264 - RNA, 20 nt, Human
aacauagugagacccgucuc

SEQ ID NO: 1041265 - RNA, 24 nt, Human
aacuugagaccagccugggcaaca

SEQ ID NO: 1041266 - RNA, 23 nt, Human
acuuugagaagccaaggcaagaa

SEQ ID NO: 1041267 - RNA, 22 nt, Human
agccugggcaacauagugagac

SEQ ID NO: 1041268 - RNA, 23 nt, Human
agccugggcaacauagugagacc

SEQ ID NO: 1041269 - RNA, 24 nt, Human
agccugggcaacauagugagaccc

SEQ ID NO: 1041270 - RNA, 23 nt, Human
aggaacuugagaccagccugggc

SEQ ID NO: 1041271 - RNA, 20 nt, Human
aggcaagaacauugaaucca

SEQ ID NO: 1041272 - RNA, 24 nt, Human
aguggcucaugccuauaauccugg

SEQ ID NO: 1041273 - RNA, 22 nt, Human
auccugguacuuugagaagcca

SEQ ID NO: 1041274 - RNA, 19 nt, Human
augccuauaauccugguac

SEQ ID NO: 1041275 - RNA, 23 nt, Human
caacauagugagacccgucucuu

SEQ ID NO: 1041276 - RNA, 24 nt, Human
caugccuauaauccugguacuuug

SEQ ID NO: 1041277 - RNA, 26 nt, Human
cccugccuggacaucguucuccucuu

SEQ ID NO: 1041278 - RNA, 18 nt, Human
ccggccccugccuggaca

SEQ ID NO: 1041279 - RNA, 20 nt, Human
ccggccccugccuggacauc

SEQ ID NO: 1041280 - RNA, 18 nt, Human
ccugccuggacaucguuc

SEQ ID NO: 1041281 - RNA, 19 nt, Human
cguauuaucucugcaucac

SEQ ID NO: 1041282 - RNA, 24 nt, Human
cucaugccuauaauccugguacuu

SEQ ID NO: 1041283 - RNA, 20 nt, Human
cugaagcugguggggcagca

SEQ ID NO: 1041284 - RNA, 26 nt, Human
cugaagcugguggggcagcagaaauu

SEQ ID NO: 1041285 - RNA, 25 nt, Human
cugguggggcagcagaaauuuuucc

SEQ ID NO: 1041286 - RNA, 22 nt, Human
gaaauuuuuccacucagggcac

SEQ ID NO: 1041287 - RNA, 20 nt, Human
gacaucguucuccucuucac

SEQ ID NO: 1041288 - RNA, 20 nt, Human
gagaagccaaggcaagaaca

SEQ ID NO: 1041289 - RNA, 24 nt, Human
gccuggacaucguucuccucuuca

SEQ ID NO: 1041290 - RNA, 19 nt, Human
gccuggcacaguggcucau

SEQ ID NO: 1041291 - RNA, 20 nt, Human
ucagugccuuggcacgagcu

SEQ ID NO: 1041292 - RNA, 18 nt, Human
uccugguacuuugagaag

SEQ ID NO: 1041293 - RNA, 23 nt, Human
ucucugcaucaccacagugacua

SEQ ID NO: 1041294 - RNA, 23 nt, Human
ugaauccaggaacuugagaccag

SEQ ID NO: 1041295 - RNA, 21 nt, Human
ugagaagccaaggcaagaaca

SEQ ID NO: 1041296 - RNA, 24 nt, Human
ugagaccagccugggcaacauagu

SEQ ID NO: 1041297 - RNA, 18 nt, Human
uggcacaguggcucaugc

SEQ ID NO: 1041298 - RNA, 24 nt, Human
uggcacaguggcucaugccuauaa

SEQ ID NO: 1041299 - RNA, 22 nt, Human
uggcucaugccuauaauccugg

SEQ ID NO: 1041300 - RNA, 24 nt, Human
uggcucaugccuauaauccuggua

SEQ ID NO: 1041301 - RNA, 19 nt, Human
ugggccuggcacaguggcu

SEQ ID NO: 1041302 - RNA, 22 nt, Human
uggggcagcagaaauuuuucca

SEQ ID NO: 1041303 - RNA, 22 nt, Human
uuuuccacucagaagcuagguu

SEQ ID NO: 1041304 - RNA, 19 nt, Human
uuccgcacgcgccgucacc

SEQ ID NO: 1041305 - RNA, 20 nt, Human
ucccuuggccacccccuccc

SEQ ID NO: 1041306 - RNA, 21 nt, Human
aagcagcucuguggucucccg

SEQ ID NO: 1041307 - RNA, 25 nt, Human
aaggcgggggauguggcggcucugg

SEQ ID NO: 1041308 - RNA, 18 nt, Human
acuccgugaguaaaggcc

SEQ ID NO: 1041309 - RNA, 25 nt, Human
agcuggauuuuuuuuuuuuuuuuuu

SEQ ID NO: 1041310 - RNA, 18 nt, Human
aggugccagaagccgagu

SEQ ID NO: 1041311 - RNA, 20 nt, Human
caaccucuaggcggcgcccu

SEQ ID NO: 1041312 - RNA, 20 nt, Human
ccacgccgucccccgcgcgu

SEQ ID NO: 1041313 - RNA, 20 nt, Human
ccaugcuggaggguuuagag

SEQ ID NO: 1041314 - RNA, 20 nt, Human
cccaaggcgggggauguggc

SEQ ID NO: 1041315 - RNA, 27 nt, Human
cccagcuggauuuuuuuuuuuuuuuuu

SEQ ID NO: 1041316 - RNA, 23 nt, Human
ccccaaacguuuuccaaacacuu

SEQ ID NO: 1041317 - RNA, 18 nt, Human
cccuuucuuccuugaaga

SEQ ID NO: 1041318 - RNA, 22 nt, Human
cccuuucuuccuugaagauaaa

SEQ ID NO: 1041319 - RNA, 19 nt, Human
cggcucugggucgccgccu

SEQ ID NO: 1041320 - RNA, 24 nt, Human
cgggggauguggcggcucuggguc

SEQ ID NO: 1041321 - RNA, 23 nt, Human
cuccccacucccuuucuuccuug

SEQ ID NO: 1041322 - RNA, 21 nt, Human
cucggggcucggccuggagcu

SEQ ID NO: 1041323 - RNA, 24 nt, Human
cugggucgccgccuucugcccccg

SEQ ID NO: 1041324 - RNA, 22 nt, Human
gaguccagggcgucuggggacu

SEQ ID NO: 1041325 - RNA, 26 nt, Human
gcagaacacaaguuccuuaaagaaac

SEQ ID NO: 1041326 - RNA, 21 nt, Human
gcggcuggggaagcagcucug

SEQ ID NO: 1041327 - RNA, 18 nt, Human
ggaguccagggcgucugg

SEQ ID NO: 1041328 - RNA, 18 nt, Human
ggauuuuuuuuuuuuuuu

SEQ ID NO: 1041329 - RNA, 19 nt, Human
ggcucggccuggagcuggc

SEQ ID NO: 1041330 - RNA, 19 nt, Human
gggcucggccuggagcugg

SEQ ID NO: 1041331 - RNA, 19 nt, Human
gggggauguggcggcucug

SEQ ID NO: 1041332 - RNA, 18 nt, Human
guuuuccaaacacuuuuc

SEQ ID NO: 1041333 - RNA, 21 nt, Human
uaacuggaggggggcuagaca

SEQ ID NO: 1041334 - RNA, 18 nt, Human
uaacuucuccccacuccc

SEQ ID NO: 1041335 - RNA, 21 nt, Human
ucacuccgugaguaaaggcca

SEQ ID NO: 1041336 - RNA, 22 nt, Human
ucccggcgggugaggccgagac

SEQ ID NO: 1041337 - RNA, 19 nt, Human
ucccuuucuuccuugaaga

SEQ ID NO: 1041338 - RNA, 19 nt, Human
uccuuaaagaaacaaaaau

SEQ ID NO: 1041339 - RNA, 21 nt, Human
ucuccccacucccuuucuucc

SEQ ID NO: 1041340 - RNA, 19 nt, Human
ucuucguagacugcaggag

SEQ ID NO: 1041341 - RNA, 21 nt, Human
ugaggccgagacagagaccaa

SEQ ID NO: 1041342 - RNA, 19 nt, Human
ugaggccucucgaggcagu

SEQ ID NO: 1041343 - RNA, 25 nt, Human
ugaguaaaggccaguuaggcaacau

SEQ ID NO: 1041344 - RNA, 22 nt, Human
ugcccccgccucugugaggccu

SEQ ID NO: 1041345 - RNA, 25 nt, Human
uucacccccaaacguuuuccaaaca

SEQ ID NO: 1041346 - RNA, 24 nt, Human
uuuagagguaacuucuccccacuc

SEQ ID NO: 1041347 - RNA, 23 nt, Human
uuuccaaacacuuuuccaaaagc

SEQ ID NO: 1041348 - RNA, 23 nt, Human
uuucugggacuuccuggccuguc

SEQ ID NO: 1041349 - RNA, 26 nt, Human
uuuuuuuuuuuuuuuuuuuccaauuu

SEQ ID NO: 1041350 - RNA, 23 nt, Human
uuuuuuuuuuuuuuuuuuuucca

SEQ ID NO: 1041351 - RNA, 24 nt, Human
uuuuuuuuuuuuuuuuuuuuuccu

SEQ ID NO: 1041352 - RNA, 24 nt, Human
aagccuaggucaggaaccaaacca

SEQ ID NO: 1041353 - RNA, 18 nt, Human
acauuucccagccugcug

SEQ ID NO: 1041354 - RNA, 21 nt, Human
aguggcucaaaacccugcuuc

SEQ ID NO: 1041355 - RNA, 23 nt, Human
caggaaccaaaccacauuuccca

SEQ ID NO: 1041356 - RNA, 20 nt, Human
ccaaaccacauuucccagcc

SEQ ID NO: 1041357 - RNA, 24 nt, Human
ccaaaccacauuucccagccugcu

SEQ ID NO: 1041358 - RNA, 22 nt, Human
ccaagccuaggucaggaaccaa

SEQ ID NO: 1041359 - RNA, 20 nt, Human
cccagccugcugugcauggu

SEQ ID NO: 1041360 - RNA, 24 nt, Human
cucaaaacccugcuucagcucaag

SEQ ID NO: 1041361 - RNA, 20 nt, Human
gcucaaaacccugcuucagc

SEQ ID NO: 1041362 - RNA, 24 nt, Human
ucaaccauccuuuauucgcuggcu

SEQ ID NO: 1041363 - RNA, 23 nt, Human
uggcagcagcagcaguggcucaa

SEQ ID NO: 1041364 - RNA, 20 nt, Human
uggcucaaaacccugcuuca

SEQ ID NO: 1041365 - RNA, 24 nt, Human
uggcuugucuucccaagccuaggu

SEQ ID NO: 1041366 - RNA, 20 nt, Human
uucaaccauccuuuauucgc

SEQ ID NO: 1041367 - RNA, 24 nt, Human
aggaagccguaggagacuugccaa

SEQ ID NO: 1041368 - RNA, 20 nt, Human
aggcagccgugcaggcccag

SEQ ID NO: 1041369 - RNA, 19 nt, Human
aggcccaggaagccguagg

SEQ ID NO: 1041370 - RNA, 27 nt, Human
caagaagaaggcagccgugcaggccca

SEQ ID NO: 1041371 - RNA, 19 nt, Human
cacuggauccccagggccc

SEQ ID NO: 1041372 - RNA, 22 nt, Human
cagaagaggccaggaaugcggc

SEQ ID NO: 1041373 - RNA, 25 nt, Human
cagcuuggaaaacucacggacgaug

SEQ ID NO: 1041374 - RNA, 21 nt, Human
cagggccaagaagaaggcagc

SEQ ID NO: 1041375 - RNA, 25 nt, Human
ccccagggcccagcuuggaaaacuc

SEQ ID NO: 1041376 - RNA, 22 nt, Human
ccuccaggagggggccagcccu

SEQ ID NO: 1041377 - RNA, 19 nt, Human
gccagcccuggacccugca

SEQ ID NO: 1041378 - RNA, 18 nt, Human
gggcagggccaagaagaa

SEQ ID NO: 1041379 - RNA, 22 nt, Human
guaggagacuugccaaccucca

SEQ ID NO: 1041380 - RNA, 18 nt, Human
uccaggagggggccagcc

SEQ ID NO: 1041381 - RNA, 21 nt, Human
cagugcgccugucugaagcuc

SEQ ID NO: 1041382 - RNA, 21 nt, Human
cuccuuguugccacuggccga

SEQ ID NO: 1041383 - RNA, 25 nt, Human
gaggcgguggcggacaggugggcga

SEQ ID NO: 1041384 - RNA, 20 nt, Human
ggcgggggcggggccucggc

SEQ ID NO: 1041385 - RNA, 22 nt, Human
ucucguucuucaugcucagcuc

SEQ ID NO: 1041386 - RNA, 19 nt, Human
ugcaaggcgggggcggggc

SEQ ID NO: 1041387 - RNA, 18 nt, Human
ugccacuggccgaacagu

SEQ ID NO: 1041388 - RNA, 19 nt, Human
ugccacuggccgaacagug

SEQ ID NO: 1041389 - RNA, 21 nt, Human
uggauuggcuagggcagccgg

SEQ ID NO: 1041390 - RNA, 18 nt, Human
uggcccaggauuggaggc

SEQ ID NO: 1041391 - RNA, 20 nt, Human
uggcccaggauuggaggcgg

SEQ ID NO: 1041392 - RNA, 23 nt, Human
ugucugaagcuccuggcccagga

SEQ ID NO: 1041393 - RNA, 18 nt, Human
uucuucaugcucagcucc

SEQ ID NO: 1041394 - RNA, 21 nt, Human
uucuucaugcucagcuccuug

SEQ ID NO: 1041395 - RNA, 23 nt, Human
aaaaaaaaaaaaaaugugccuug

SEQ ID NO: 1041396 - RNA, 20 nt, Human
aagcagugacacagcacgcg

SEQ ID NO: 1041397 - RNA, 21 nt, Human
aaggagaagcuggaaccaccc

SEQ ID NO: 1041398 - RNA, 24 nt, Human
acacucccugaucacaaaaaaaaa

SEQ ID NO: 1041399 - RNA, 26 nt, Human
agagagcagccucuccuccaaaaccc

SEQ ID NO: 1041400 - RNA, 18 nt, Human
agcagggggaccaggccg

SEQ ID NO: 1041401 - RNA, 19 nt, Human
agccucuccuccaaaaccc

SEQ ID NO: 1041402 - RNA, 25 nt, Human
aggaacaggggagggaaccgguacc

SEQ ID NO: 1041403 - RNA, 22 nt, Human
aggagaagcuggaaccacccug

SEQ ID NO: 1041404 - RNA, 23 nt, Human
aggcccgggacaagggugugcgg

SEQ ID NO: 1041405 - RNA, 20 nt, Human
aggcgcgcaggccgggguuu

SEQ ID NO: 1041406 - RNA, 23 nt, Human
agggguggggguggcgccagggc

SEQ ID NO: 1041407 - RNA, 26 nt, Human
agguggggcaggggagagccgggggu

SEQ ID NO: 1041408 - RNA, 19 nt, Human
auacagcaaagcaggggga

SEQ ID NO: 1041409 - RNA, 25 nt, Human
aucuuggacaccaggggcacuggug

SEQ ID NO: 1041410 - RNA, 22 nt, Human
caaagcagggggaccaggccgu

SEQ ID NO: 1041411 - RNA, 19 nt, Human
caauaugcuccccacucuc

SEQ ID NO: 1041412 - RNA, 20 nt, Human
caauaugcuccccacucucc

SEQ ID NO: 1041413 - RNA, 21 nt, Human
cacccugagacccaggacggg

SEQ ID NO: 1041414 - RNA, 20 nt, Human
cagaagagcaaccugagguc

SEQ ID NO: 1041415 - RNA, 21 nt, Human
cagggcccugggcgagcccuu

SEQ ID NO: 1041416 - RNA, 19 nt, Human
cagguucuggccgcucuuc

SEQ ID NO: 1041417 - RNA, 18 nt, Human
caucucccccucaggacc

SEQ ID NO: 1041418 - RNA, 24 nt, Human
ccacagaggcuagcagcagcuggu

SEQ ID NO: 1041419 - RNA, 18 nt, Human
ccauacucacacagaaga

SEQ ID NO: 1041420 - RNA, 19 nt, Human
ccaugccgaaucccucccc

SEQ ID NO: 1041421 - RNA, 18 nt, Human
cccaggagugaagagcag

SEQ ID NO: 1041422 - RNA, 21 nt, Human
cccucagguucuggccgcucu

SEQ ID NO: 1041423 - RNA, 18 nt, Human
ccggccagaaggagcaag

SEQ ID NO: 1041424 - RNA, 18 nt, Human
ccgugccugcugugcugc

SEQ ID NO: 1041425 - RNA, 19 nt, Human
ccgugugggggcaaguggg

SEQ ID NO: 1041426 - RNA, 20 nt, Human
ccucaggaccgccuggcucc

SEQ ID NO: 1041427 - RNA, 19 nt, Human
ccuccaaaacccccucccu

SEQ ID NO: 1041428 - RNA, 24 nt, Human
ccugaucacaaaaaaaaaaaaaaa

SEQ ID NO: 1041429 - RNA, 22 nt, Human
cgaggcgguggcuccagucucc

SEQ ID NO: 1041430 - RNA, 20 nt, Human
cggggucugugcuucucugg

SEQ ID NO: 1041431 - RNA, 18 nt, Human
cucagguucuggccgcuc

SEQ ID NO: 1041432 - RNA, 22 nt, Human
cuccaaaacccccucccuggcc

SEQ ID NO: 1041433 - RNA, 19 nt, Human
cuccuggcccugggcgugg

SEQ ID NO: 1041434 - RNA, 23 nt, Human
cugaagagagagcagccucuccu

SEQ ID NO: 1041435 - RNA, 18 nt, Human
cuggugccccuggcauca

SEQ ID NO: 1041436 - RNA, 22 nt, Human
cuggugggaaggggugggggug

SEQ ID NO: 1041437 - RNA, 22 nt, Human
cuuccaucccucuuuguguccc

SEQ ID NO: 1041438 - RNA, 21 nt, Human
cuucugagccucacuggcuga

SEQ ID NO: 1041439 - RNA, 25 nt, Human
cuuuguguccagucuacuugggucu

SEQ ID NO: 1041440 - RNA, 19 nt, Human
gaagccucuuuuauuugug

SEQ ID NO: 1041441 - RNA, 19 nt, Human
gaagcggagguuggaggug

SEQ ID NO: 1041442 - RNA, 20 nt, Human
gagcaaccugaggucgggac

SEQ ID NO: 1041443 - RNA, 24 nt, Human
gcagcagcuggugggaaggggugg

SEQ ID NO: 1041444 - RNA, 21 nt, Human
gccagucccagacaggcccgg

SEQ ID NO: 1041445 - RNA, 23 nt, Human
gccccuggcggggucugugcuuc

SEQ ID NO: 1041446 - RNA, 21 nt, Human
ggaaccacccugagacccagg

SEQ ID NO: 1041447 - RNA, 18 nt, Human
ggcaggggagagccgggg

SEQ ID NO: 1041448 - RNA, 20 nt, Human
ggcaugggguuugggauccg

SEQ ID NO: 1041449 - RNA, 23 nt, Human
gggagcucagcugccccccagga

SEQ ID NO: 1041450 - RNA, 22 nt, Human
gggcaugggguuugggauccgu

SEQ ID NO: 1041451 - RNA, 18 nt, Human
gggcguggcgcgcguggc

SEQ ID NO: 1041452 - RNA, 18 nt, Human
ggggagcggguuggggaa

SEQ ID NO: 1041453 - RNA, 23 nt, Human
gggguggcgccagggcccugggc

SEQ ID NO: 1041454 - RNA, 22 nt, Human
ggguggggguggcgccagggcc

SEQ ID NO: 1041455 - RNA, 22 nt, Human
gggugugcggugggccccugcc

SEQ ID NO: 1041456 - RNA, 20 nt, Human
uacacggccuggaccagcuc

SEQ ID NO: 1041457 - RNA, 21 nt, Human
uagcaccauuggaugaagggu

SEQ ID NO: 1041458 - RNA, 23 nt, Human
uaggacaggacagaucugagccc

SEQ ID NO: 1041459 - RNA, 18 nt, Human
ucagaaucagucuggugc

SEQ ID NO: 1041460 - RNA, 26 nt, Human
ucccugaucacaaaaaaaaaaaaaaa

SEQ ID NO: 1041461 - RNA, 23 nt, Human
uccuccaaaacccccucccuggc

SEQ ID NO: 1041462 - RNA, 19 nt, Human
uccuggcccugggcguggc

SEQ ID NO: 1041463 - RNA, 18 nt, Human
ucuagugcuuaccccagc

SEQ ID NO: 1041464 - RNA, 19 nt, Human
ucugcaggcgcgcaggccg

SEQ ID NO: 1041465 - RNA, 20 nt, Human
ucugugcuucucuggguggg

SEQ ID NO: 1041466 - RNA, 23 nt, Human
ucuuccaucccucuuuguguccc

SEQ ID NO: 1041467 - RNA, 18 nt, Human
ugcaaaggcuucaggggc

SEQ ID NO: 1041468 - RNA, 18 nt, Human
ugcccaaggagaagcugg

SEQ ID NO: 1041469 - RNA, 18 nt, Human
ugccugcugugcugcugc

SEQ ID NO: 1041470 - RNA, 20 nt, Human
uggaagcggagguuggaggu

SEQ ID NO: 1041471 - RNA, 20 nt, Human
uggacaccaggggcacuggu

SEQ ID NO: 1041472 - RNA, 19 nt, Human
uggagguggcuuugacugg

SEQ ID NO: 1041473 - RNA, 23 nt, Human
uggaugaaggguuuuagagucag

SEQ ID NO: 1041474 - RNA, 19 nt, Human
uggcgcuggcgaggguccc

SEQ ID NO: 1041475 - RNA, 22 nt, Human
uggcugcccaaggagaagcugg

SEQ ID NO: 1041476 - RNA, 18 nt, Human
ugggaaggggugggggug

SEQ ID NO: 1041477 - RNA, 21 nt, Human
ugggaagggguggggguggcg

SEQ ID NO: 1041478 - RNA, 20 nt, Human
uggggaaucagaauacagca

SEQ ID NO: 1041479 - RNA, 25 nt, Human
uggggcaggggagagccggggguua

SEQ ID NO: 1041480 - RNA, 20 nt, Human
ugggggaugggacuccaacu

SEQ ID NO: 1041481 - RNA, 20 nt, Human
ugggggcugggggagccggg

SEQ ID NO: 1041482 - RNA, 24 nt, Human
uggggguggcgccagggcccuggg

SEQ ID NO: 1041483 - RNA, 22 nt, Human
ugggugggugagguggggcagg

SEQ ID NO: 1041484 - RNA, 24 nt, Human
ugguggaagcggagguuggaggug

SEQ ID NO: 1041485 - RNA, 21 nt, Human
uggugggaaggggugggggug

SEQ ID NO: 1041486 - RNA, 21 nt, Human
uggugggaaggggugggggug

SEQ ID NO: 1041487 - RNA, 21 nt, Human
ugugccuugggggaugggacu

SEQ ID NO: 1041488 - RNA, 19 nt, Human
ugugggggcugggggagcc

SEQ ID NO: 1041489 - RNA, 22 nt, Human
ugugggggcugggggagccggg

SEQ ID NO: 1041490 - RNA, 22 nt, Human
uuagugaacagaaaugcggacc

SEQ ID NO: 1041491 - RNA, 23 nt, Human
uuccacacuuuguaggugucacu

SEQ ID NO: 1041492 - RNA, 19 nt, Human
uugucuggcuccuggcccu

SEQ ID NO: 1041493 - RNA, 26 nt, Human
uugucuggcuccuggcccugggcgug

SEQ ID NO: 1041494 - RNA, 25 nt, Human
aagcacagacacagggcugaagaga

SEQ ID NO: 1041495 - RNA, 19 nt, Human
acacggugcagggagucuu

SEQ ID NO: 1041496 - RNA, 20 nt, Human
acauugaaaaauauuccgag

SEQ ID NO: 1041497 - RNA, 20 nt, Human
accacggagagcagggagac

SEQ ID NO: 1041498 - RNA, 18 nt, Human
acuucguaaaccccuccc

SEQ ID NO: 1041499 - RNA, 18 nt, Human
agcggauaggcucaaccc

SEQ ID NO: 1041500 - RNA, 18 nt, Human
aggagaggaggaucagca

SEQ ID NO: 1041501 - RNA, 21 nt, Human
aggaggaucagcagaggucau

SEQ ID NO: 1041502 - RNA, 19 nt, Human
aggcaccugaccucauguu

SEQ ID NO: 1041503 - RNA, 20 nt, Human
agggguugggggcagaugcc

SEQ ID NO: 1041504 - RNA, 20 nt, Human
agucccgcccuccccgcagc

SEQ ID NO: 1041505 - RNA, 19 nt, Human
agucuuuaaauagaggagg

SEQ ID NO: 1041506 - RNA, 21 nt, Human
caagcacagacacagggcuga

SEQ ID NO: 1041507 - RNA, 19 nt, Human
cacagcgaaggguggagaa

SEQ ID NO: 1041508 - RNA, 19 nt, Human
cacuucguaaaccccuccc

SEQ ID NO: 1041509 - RNA, 21 nt, Human
cagccccccagccucagcccu

SEQ ID NO: 1041510 - RNA, 25 nt, Human
cagcccucucucgugcaggccuugc

SEQ ID NO: 1041511 - RNA, 19 nt, Human
cauuaucuggaaaagggga

SEQ ID NO: 1041512 - RNA, 23 nt, Human
ccagcagccuuucagcccucucu

SEQ ID NO: 1041513 - RNA, 22 nt, Human
cccagcagccuuucagcccucu

SEQ ID NO: 1041514 - RNA, 29 nt, Human
cccagccucagcccucuccacgggggccu

SEQ ID NO: 1041515 - RNA, 20 nt, Human
ccccagccucagcccucucc

SEQ ID NO: 1041516 - RNA, 20 nt, Human
cccccagccucagcccucuc

SEQ ID NO: 1041517 - RNA, 24 nt, Human
ccccccagccucagcccucuccac

SEQ ID NO: 1041518 - RNA, 25 nt, Human
ccccgcgcaggaagucccgcccucc

SEQ ID NO: 1041519 - RNA, 20 nt, Human
ccuagcgcaccauguauucc

SEQ ID NO: 1041520 - RNA, 19 nt, Human
ccugcagcgaugaaacagu

SEQ ID NO: 1041521 - RNA, 20 nt, Human
cgaccucuagucucagcccc

SEQ ID NO: 1041522 - RNA, 21 nt, Human
cgccgccgccgccgcuacacg

SEQ ID NO: 1041523 - RNA, 22 nt, Human
cggcggcuccccgccccaucag

SEQ ID NO: 1041524 - RNA, 26 nt, Human
cggcucgggcccccgcgcaggaaguc

SEQ ID NO: 1041525 - RNA, 23 nt, Human
cgggggccggaugccagagaugg

SEQ ID NO: 1041526 - RNA, 22 nt, Human
cguaaaccccucccauuuccaa

SEQ ID NO: 1041527 - RNA, 21 nt, Human
gagcggcucgggcccccgcgc

SEQ ID NO: 1041528 - RNA, 19 nt, Human
gcagaaagagaagccuccg

SEQ ID NO: 1041529 - RNA, 23 nt, Human
gcccccacucaagcacagacaca

SEQ ID NO: 1041530 - RNA, 18 nt, Human
gccccccagccucagccc

SEQ ID NO: 1041531 - RNA, 25 nt, Human
gccccccagccucagcccucuccac

SEQ ID NO: 1041532 - RNA, 20 nt, Human
gccuccgaggaggagguaaa

SEQ ID NO: 1041533 - RNA, 20 nt, Human
gcgccggggcccuagcgcac

SEQ ID NO: 1041534 - RNA, 18 nt, Human
gcuacaacacccgagccu

SEQ ID NO: 1041535 - RNA, 21 nt, Human
gcucggagucccaggagaucc

SEQ ID NO: 1041536 - RNA, 23 nt, Human
ggaacagccccccagccucagcc

SEQ ID NO: 1041537 - RNA, 23 nt, Human
ggaggagguaaaggccugcagcg

SEQ ID NO: 1041538 - RNA, 21 nt, Human
ggcagaaagagaagccuccga

SEQ ID NO: 1041539 - RNA, 19 nt, Human
gggaaacgcgccggggccc

SEQ ID NO: 1041540 - RNA, 26 nt, Human
gggaauagcgagguggcagccccagc

SEQ ID NO: 1041541 - RNA, 21 nt, Human
gggcccccgcgcaggaagucc

SEQ ID NO: 1041542 - RNA, 24 nt, Human
gggccggaugccagagaugggaga

SEQ ID NO: 1041543 - RNA, 19 nt, Human
uacaacacccgagccugag

SEQ ID NO: 1041544 - RNA, 20 nt, Human
uacacgcgagccgggaccac

SEQ ID NO: 1041545 - RNA, 22 nt, Human
uagacuguugaauucaggcacc

SEQ ID NO: 1041546 - RNA, 20 nt, Human
uagaggaggggcuggagcgg

SEQ ID NO: 1041547 - RNA, 21 nt, Human
ucaacccggcggcuccccgcc

SEQ ID NO: 1041548 - RNA, 19 nt, Human
ucagagguggaaggcucag

SEQ ID NO: 1041549 - RNA, 21 nt, Human
ucagagguggaaggcucagca

SEQ ID NO: 1041550 - RNA, 19 nt, Human
ucagaugaaggucaaaggg

SEQ ID NO: 1041551 - RNA, 20 nt, Human
ucagaugaaggucaaagggg

SEQ ID NO: 1041552 - RNA, 23 nt, Human
ucagcccucuccacgggggccgg

SEQ ID NO: 1041553 - RNA, 19 nt, Human
ucccgcccuccccgcagcg

SEQ ID NO: 1041554 - RNA, 23 nt, Human
uccgagcauuaucuggaaaaggg

SEQ ID NO: 1041555 - RNA, 22 nt, Human
ugaagagagcagauucucuuua

SEQ ID NO: 1041556 - RNA, 19 nt, Human
uggaaaaggggaaugggua

SEQ ID NO: 1041557 - RNA, 18 nt, Human
uggaaggcucagcaggag

SEQ ID NO: 1041558 - RNA, 22 nt, Human
uggcagaaagagaagccuccga

SEQ ID NO: 1041559 - RNA, 22 nt, Human
ugggggccauucucaaaaucuu

SEQ ID NO: 1041560 - RNA, 18 nt, Human
uugagauacgggacacag

SEQ ID NO: 1041561 - RNA, 26 nt, Human
aaacagaaggaaaagagaagggaccc

SEQ ID NO: 1041562 - RNA, 22 nt, Human
aaccaacuauuuaaaaucagug

SEQ ID NO: 1041563 - RNA, 21 nt, Human
aagucgaagagggaggcaaac

SEQ ID NO: 1041564 - RNA, 24 nt, Human
acucccaaguaagucgaagaggga

SEQ ID NO: 1041565 - RNA, 23 nt, Human
cccgcagcuguugucccgguguc

SEQ ID NO: 1041566 - RNA, 18 nt, Human
ccucaucuucuucaacca

SEQ ID NO: 1041567 - RNA, 21 nt, Human
ccugagauaucuggguaagac

SEQ ID NO: 1041568 - RNA, 22 nt, Human
cucacaaucgcaggccgcuacu

SEQ ID NO: 1041569 - RNA, 21 nt, Human
cucgcacagagcccgcagcug

SEQ ID NO: 1041570 - RNA, 22 nt, Human
gagcccgcagcuguugucccgg

SEQ ID NO: 1041571 - RNA, 25 nt, Human
gcauagcuucaaaaauucugaaggg

SEQ ID NO: 1041572 - RNA, 25 nt, Human
gcguauauguaccuaauaagauaca

SEQ ID NO: 1041573 - RNA, 19 nt, Human
ggaggacagaggagguucu

SEQ ID NO: 1041574 - RNA, 20 nt, Human
gggaggacagaggagguucu

SEQ ID NO: 1041575 - RNA, 21 nt, Human
uaaugggucuaaaauuaagac

SEQ ID NO: 1041576 - RNA, 22 nt, Human
uaaugggucuaaaauuaagaca

SEQ ID NO: 1041577 - RNA, 22 nt, Human
uaccagucacgacuguggucag

SEQ ID NO: 1041578 - RNA, 21 nt, Human
uacugccccgcgcucgcucac

SEQ ID NO: 1041579 - RNA, 21 nt, Human
ucagaugcugacucccaagua

SEQ ID NO: 1041580 - RNA, 20 nt, Human
ucagugggaggacagaggag

SEQ ID NO: 1041581 - RNA, 19 nt, Human
ucgcaggccgcuacugccc

SEQ ID NO: 1041582 - RNA, 19 nt, Human
ucugaaggguauuucuggg

SEQ ID NO: 1041583 - RNA, 27 nt, Human
ugagguuaaggauuugcguauauguac

SEQ ID NO: 1041584 - RNA, 20 nt, Human
uguggucagaugcugacucc

SEQ ID NO: 1041585 - RNA, 27 nt, Human
uuuaaaaucagugggaggacagaggag

SEQ ID NO: 1041586 - RNA, 18 nt, Human
uuugcacaaaucaucauu

SEQ ID NO: 1041587 - RNA, 22 nt, Human
aagcagcagcagcggcagcagc

SEQ ID NO: 1041588 - RNA, 19 nt, Human
agcagcggcagcagcuugg

SEQ ID NO: 1041589 - RNA, 27 nt, Human
cacaucucaggccaggcccagucgccc

SEQ ID NO: 1041590 - RNA, 19 nt, Human
cagcagcagcggcagcagc

SEQ ID NO: 1041591 - RNA, 22 nt, Human
cagcagcagcggcagcagcuug

SEQ ID NO: 1041592 - RNA, 21 nt, Human
cagcagcggcagcagcuuggc

SEQ ID NO: 1041593 - RNA, 18 nt, Human
cagcagcuuggcuccugc

SEQ ID NO: 1041594 - RNA, 20 nt, Human
cagcggcagcagcuuggcuc

SEQ ID NO: 1041595 - RNA, 24 nt, Human
caggcccagucgccccagggaccc

SEQ ID NO: 1041596 - RNA, 24 nt, Human
ccaggcccagucgccccagggacc

SEQ ID NO: 1041597 - RNA, 22 nt, Human
ccccagggacccccgcugguca

SEQ ID NO: 1041598 - RNA, 19 nt, Human
cccgcagaagcagcagcag

SEQ ID NO: 1041599 - RNA, 18 nt, Human
cgggagagagcggcggcg

SEQ ID NO: 1041600 - RNA, 18 nt, Human
gagcggcggcggcggcgc

SEQ ID NO: 1041601 - RNA, 19 nt, Human
gcagcagcuuggcuccugc

SEQ ID NO: 1041602 - RNA, 18 nt, Human
gccccagggacccccgcu

SEQ ID NO: 1041603 - RNA, 24 nt, Human
gccccagggacccccgcuggucac

SEQ ID NO: 1041604 - RNA, 22 nt, Human
gcccgcagaagcagcagcagcg

SEQ ID NO: 1041605 - RNA, 24 nt, Human
gcggcagcagcuuggcuccugcgc

SEQ ID NO: 1041606 - RNA, 22 nt, Human
ggcagcagcuuggcuccugcgc

SEQ ID NO: 1041607 - RNA, 21 nt, Human
gggagagagcggcggcggcgg

SEQ ID NO: 1041608 - RNA, 26 nt, Human
gggagagagcggcggcggcggcgacg

SEQ ID NO: 1041609 - RNA, 20 nt, Human
uaauagcaagaggugggacu

SEQ ID NO: 1041610 - RNA, 20 nt, Human
ucagagaagcuuuaauagca

SEQ ID NO: 1041611 - RNA, 18 nt, Human
ucaggccaggcccagucg

SEQ ID NO: 1041612 - RNA, 19 nt, Human
ucgcccgcagaagcagcag

SEQ ID NO: 1041613 - RNA, 21 nt, Human
ugaaaccagucgcccgcagaa

SEQ ID NO: 1041614 - RNA, 21 nt, Human
uggcccgggagagagcggcgg

SEQ ID NO: 1041615 - RNA, 23 nt, Human
uggcuccugcgccccgcuccauc

SEQ ID NO: 1041616 - RNA, 22 nt, Human
aagaggaggcaacacucggacc

SEQ ID NO: 1041617 - RNA, 19 nt, Human
aauaaaggagcaguuuggc

SEQ ID NO: 1041618 - RNA, 22 nt, Human
accucccagacgaggugggagu

SEQ ID NO: 1041619 - RNA, 22 nt, Human
agcaaguugugugggaaagucc

SEQ ID NO: 1041620 - RNA, 23 nt, Human
agcccccuggcccuucguuccag

SEQ ID NO: 1041621 - RNA, 23 nt, Human
agcccuggcuacugccccaugga

SEQ ID NO: 1041622 - RNA, 23 nt, Human
agcucuaaaaaauaaaggagcag

SEQ ID NO: 1041623 - RNA, 19 nt, Human
aggccugggccagagaggg

SEQ ID NO: 1041624 - RNA, 23 nt, Human
agggagugggugacgcagggggc

SEQ ID NO: 1041625 - RNA, 21 nt, Human
caacccgagacagugagacag

SEQ ID NO: 1041626 - RNA, 26 nt, Human
caccagaaccaccuugauugcagcag

SEQ ID NO: 1041627 - RNA, 23 nt, Human
cacccacuuggggcugucuucuu

SEQ ID NO: 1041628 - RNA, 19 nt, Human
caccccauccucuugucag

SEQ ID NO: 1041629 - RNA, 22 nt, Human
caccccccaccccacccccgca

SEQ ID NO: 1041630 - RNA, 23 nt, Human
caccccccaccccacccccgcac

SEQ ID NO: 1041631 - RNA, 18 nt, Human
cagcagccaguguuuggg

SEQ ID NO: 1041632 - RNA, 21 nt, Human
cagcagcucuaaaaaauaaag

SEQ ID NO: 1041633 - RNA, 24 nt, Human
cagcaggccugggccagagagggu

SEQ ID NO: 1041634 - RNA, 20 nt, Human
cagccucagcucuggggcag

SEQ ID NO: 1041635 - RNA, 22 nt, Human
cagcuugucagaacagucccca

SEQ ID NO: 1041636 - RNA, 18 nt, Human
cagggccuucaccccugg

SEQ ID NO: 1041637 - RNA, 20 nt, Human
caguuuggcuuccggaagga

SEQ ID NO: 1041638 - RNA, 18 nt, Human
caucugggaccuccaggc

SEQ ID NO: 1041639 - RNA, 18 nt, Human
cauggaugggaggugggu

SEQ ID NO: 1041640 - RNA, 22 nt, Human
cauuugccagguugcguccaau

SEQ ID NO: 1041641 - RNA, 25 nt, Human
ccacccccaccccauccucuuguca

SEQ ID NO: 1041642 - RNA, 19 nt, Human
ccagcccccuggcccuucg

SEQ ID NO: 1041643 - RNA, 26 nt, Human
ccaggguaacugaggacacagccucu

SEQ ID NO: 1041644 - RNA, 20 nt, Human
ccccaagguccgaggcccag

SEQ ID NO: 1041645 - RNA, 23 nt, Human
ccccaccccacccccgcaccaga

SEQ ID NO: 1041646 - RNA, 18 nt, Human
ccccacccccgcaccaga

SEQ ID NO: 1041647 - RNA, 20 nt, Human
ccccaggggcccugcggccc

SEQ ID NO: 1041648 - RNA, 22 nt, Human
ccccaggggcccugcggcccaa

SEQ ID NO: 1041649 - RNA, 23 nt, Human
ccccauuggccacaaggccucac

SEQ ID NO: 1041650 - RNA, 18 nt, Human
cccccaccccacccccgc

SEQ ID NO: 1041651 - RNA, 22 nt, Human
cccccaccccacccccgcaccc

SEQ ID NO: 1041652 - RNA, 27 nt, Human
ccccccaccccacccccgcaccagaac

SEQ ID NO: 1041653 - RNA, 19 nt, Human
cccccgcaccagaaccacc

SEQ ID NO: 1041654 - RNA, 21 nt, Human
ccccuggaaaaggcucagcuc

SEQ ID NO: 1041655 - RNA, 20 nt, Human
cccggggccucagccucagc

SEQ ID NO: 1041656 - RNA, 19 nt, Human
cccuggggucacuuggugg

SEQ ID NO: 1041657 - RNA, 24 nt, Human
ccgcaccagaaccaccuugauugc

SEQ ID NO: 1041658 - RNA, 23 nt, Human
ccggaaggaagaggaggcaacaa

SEQ ID NO: 1041659 - RNA, 24 nt, Human
ccucagcucuggggcaggaagcuu

SEQ ID NO: 1041660 - RNA, 23 nt, Human
ccuccaggcugggagccaacccu

SEQ ID NO: 1041661 - RNA, 21 nt, Human
ccugcggcccaaaccuagggc

SEQ ID NO: 1041662 - RNA, 22 nt, Human
ccugcggcccaaaccuagggcu

SEQ ID NO: 1041663 - RNA, 19 nt, Human
ccugggccaccugcucucc

SEQ ID NO: 1041664 - RNA, 23 nt, Human
ccuuggccccaggggcccugcgg

SEQ ID NO: 1041665 - RNA, 21 nt, Human
cgagacagugagacagugucc

SEQ ID NO: 1041666 - RNA, 24 nt, Human
cguguggcuccaacacacacaucc

SEQ ID NO: 1041667 - RNA, 18 nt, Human
cuccguaugguccagggu

SEQ ID NO: 1041668 - RNA, 18 nt, Human
cuccugggcccugccccu

SEQ ID NO: 1041669 - RNA, 26 nt, Human
cugaagccacagccagccaguaacua

SEQ ID NO: 1041670 - RNA, 18 nt, Human
gagacaguguccuccagg

SEQ ID NO: 1041671 - RNA, 23 nt, Human
gagcaguuuggcuuccggaagga

SEQ ID NO: 1041672 - RNA, 23 nt, Human
gcaccagaaccaccuugauugca

SEQ ID NO: 1041673 - RNA, 18 nt, Human
gcccugaggccugggccc

SEQ ID NO: 1041674 - RNA, 22 nt, Human
gccggagcccuggcuacugccc

SEQ ID NO: 1041675 - RNA, 20 nt, Human
gccucucccggggccucagc

SEQ ID NO: 1041676 - RNA, 20 nt, Human
gccugggccaccugcucucc

SEQ ID NO: 1041677 - RNA, 18 nt, Human
gcugcuuccuccagcagc

SEQ ID NO: 1041678 - RNA, 20 nt, Human
ggaguggggguggaggcugg

SEQ ID NO: 1041679 - RNA, 21 nt, Human
ggcagcugcauccuggugugu

SEQ ID NO: 1041680 - RNA, 18 nt, Human
ggccagagagggugggug

SEQ ID NO: 1041681 - RNA, 22 nt, Human
ggccuggccccccccugggguc

SEQ ID NO: 1041682 - RNA, 19 nt, Human
gggaaggagugggguccug

SEQ ID NO: 1041683 - RNA, 20 nt, Human
gggaaggagugggguccugg

SEQ ID NO: 1041684 - RNA, 21 nt, Human
gguggaaugccagcagccagu

SEQ ID NO: 1041685 - RNA, 22 nt, Human
ggugguggcagggagagaagcc

SEQ ID NO: 1041686 - RNA, 18 nt, Human
guccaagcuggcucuugg

SEQ ID NO: 1041687 - RNA, 24 nt, Human
gugcagggagugggugacgcaggg

SEQ ID NO: 1041688 - RNA, 19 nt, Human
gugggugaguauuccaccu

SEQ ID NO: 1041689 - RNA, 27 nt, Human
uaacugaggacacagccucuucuugau

SEQ ID NO: 1041690 - RNA, 22 nt, Human
uaccaggcccucgcgugagccu

SEQ ID NO: 1041691 - RNA, 22 nt, Human
uaccccagagcuugguggguga

SEQ ID NO: 1041692 - RNA, 20 nt, Human
ucaccccccaccccaccccc

SEQ ID NO: 1041693 - RNA, 25 nt, Human
ucaccccccaccccacccccgcacc

SEQ ID NO: 1041694 - RNA, 25 nt, Human
uccaggcugggagccaacccgagac

SEQ ID NO: 1041695 - RNA, 20 nt, Human
uccagggaguacccagagac

SEQ ID NO: 1041696 - RNA, 18 nt, Human
uccccaagguccgaggcc

SEQ ID NO: 1041697 - RNA, 20 nt, Human
uccccggacacccacuuggg

SEQ ID NO: 1041698 - RNA, 23 nt, Human
uccuccagcagccggagcccugg

SEQ ID NO: 1041699 - RNA, 18 nt, Human
uccuggcuuggggggugg

SEQ ID NO: 1041700 - RNA, 21 nt, Human
uccuuccaggguaacugagga

SEQ ID NO: 1041701 - RNA, 20 nt, Human
uccuuggccccaggggcccu

SEQ ID NO: 1041702 - RNA, 18 nt, Human
ucgcuggggccccgcuga

SEQ ID NO: 1041703 - RNA, 21 nt, Human
ucuccugggcccugccccugg

SEQ ID NO: 1041704 - RNA, 19 nt, Human
ucuuccuuggccccagggg

SEQ ID NO: 1041705 - RNA, 21 nt, Human
ucuuguacaacaagaaaacau

SEQ ID NO: 1041706 - RNA, 21 nt, Human
ugcauaccaggcccucgcgug

SEQ ID NO: 1041707 - RNA, 20 nt, Human
uggaaugccagcagccagug

SEQ ID NO: 1041708 - RNA, 19 nt, Human
uggaggcuggucuuuggag

SEQ ID NO: 1041709 - RNA, 18 nt, Human
uggaguggggguggaggc

SEQ ID NO: 1041710 - RNA, 19 nt, Human
uggaguggggguggaggcu

SEQ ID NO: 1041711 - RNA, 18 nt, Human
uggaucacacagaaagcu

SEQ ID NO: 1041712 - RNA, 19 nt, Human
uggccccaggggcccugcg

SEQ ID NO: 1041713 - RNA, 27 nt, Human
uggcuuccggaaggaagaggaggcaac

SEQ ID NO: 1041714 - RNA, 21 nt, Human
ugggaaaguccagcccccugg

SEQ ID NO: 1041715 - RNA, 21 nt, Human
ugggaggugggugaucgaagg

SEQ ID NO: 1041716 - RNA, 23 nt, Human
ugggugaucgaaggccuggcccc

SEQ ID NO: 1041717 - RNA, 21 nt, Human
ugguggcaggccaggcucucc

SEQ ID NO: 1041718 - RNA, 21 nt, Human
ugguggcagggagagaagccc

SEQ ID NO: 1041719 - RNA, 19 nt, Human
ugguguacagcugcagcca

SEQ ID NO: 1041720 - RNA, 22 nt, Human
uguccaagcuggcucuuggggg

SEQ ID NO: 1041721 - RNA, 23 nt, Human
ugucuucuuccuuggccccaggg

SEQ ID NO: 1041722 - RNA, 24 nt, Human
ugugugcauggaugggaggugggu

SEQ ID NO: 1041723 - RNA, 20 nt, Human
uucauugucccaauggcacc

SEQ ID NO: 1041724 - RNA, 21 nt, Human
uugaugccagggccacucagc

SEQ ID NO: 1041725 - RNA, 22 nt, Human
uugaugccagggccacucagca

SEQ ID NO: 1041726 - RNA, 21 nt, Human
uugcccagcaaguuguguggg

SEQ ID NO: 1041727 - RNA, 18 nt, Human
acggcagcuucaccagug

SEQ ID NO: 1041728 - RNA, 22 nt, Human
agcagaaacuugggggcccaga

SEQ ID NO: 1041729 - RNA, 26 nt, Human
cacccccacccuggggacuggacaac

SEQ ID NO: 1041730 - RNA, 26 nt, Human
cagugcgauuuccccaucgucagccu

SEQ ID NO: 1041731 - RNA, 18 nt, Human
cccagaaccccagggcuc

SEQ ID NO: 1041732 - RNA, 28 nt, Human
cccagaaccccagggcuccagucacaaa

SEQ ID NO: 1041733 - RNA, 20 nt, Human
cccccacccuggggacugga

SEQ ID NO: 1041734 - RNA, 20 nt, Human
cccgugaaccacgcgugccu

SEQ ID NO: 1041735 - RNA, 20 nt, Human
ccucugagaccugcuacgga

SEQ ID NO: 1041736 - RNA, 26 nt, Human
ccucugagaccugcuacggaggacaa

SEQ ID NO: 1041737 - RNA, 22 nt, Human
ccugcagcucuuggccugagac

SEQ ID NO: 1041738 - RNA, 21 nt, Human
ccugcuacggaggacaagggc

SEQ ID NO: 1041739 - RNA, 22 nt, Human
ccuggcacccccacccugggga

SEQ ID NO: 1041740 - RNA, 23 nt, Human
cgaaacuccaguuuuuccccagg

SEQ ID NO: 1041741 - RNA, 21 nt, Human
cuggacaacucuguggucccc

SEQ ID NO: 1041742 - RNA, 19 nt, Human
gccagccugcagcucuugg

SEQ ID NO: 1041743 - RNA, 22 nt, Human
gcuccuggcacccccacccugg

SEQ ID NO: 1041744 - RNA, 18 nt, Human
ggacaagggcuccuggca

SEQ ID NO: 1041745 - RNA, 19 nt, Human
gggcuccuggcacccccac

SEQ ID NO: 1041746 - RNA, 21 nt, Human
gggcuccuggcacccccaccc

SEQ ID NO: 1041747 - RNA, 26 nt, Human
gggggcccagaaccccagggcuccag

SEQ ID NO: 1041748 - RNA, 21 nt, Human
gucccaggcuccaaaccucaa

SEQ ID NO: 1041749 - RNA, 24 nt, Human
ucccaggcuccaaaccucaaagca

SEQ ID NO: 1041750 - RNA, 24 nt, Human
uccuggaagcagggaggcugcagc

SEQ ID NO: 1041751 - RNA, 21 nt, Human
uccuguggggucccaggcucc

SEQ ID NO: 1041752 - RNA, 22 nt, Human
ugaagcaacauuagcucagcac

SEQ ID NO: 1041753 - RNA, 21 nt, Human
ugaccccacggcagcuucacc

SEQ ID NO: 1041754 - RNA, 18 nt, Human
ugcagcccgugaaccacg

SEQ ID NO: 1041755 - RNA, 22 nt, Human
ugcugcacggcuccuggaagca

SEQ ID NO: 1041756 - RNA, 21 nt, Human
uggcacccccacccuggggac

SEQ ID NO: 1041757 - RNA, 24 nt, Human
uggcacccccacccuggggacugg

SEQ ID NO: 1041758 - RNA, 19 nt, Human
uggcugcagugaggaaggg

SEQ ID NO: 1041759 - RNA, 21 nt, Human
uggggacuggacaacucugug

SEQ ID NO: 1041760 - RNA, 22 nt, Human
ugggggcccagaaccccagggc

SEQ ID NO: 1041761 - RNA, 23 nt, Human
uggggucccaggcuccaaaccuc

SEQ ID NO: 1041762 - RNA, 19 nt, Human
uguggggucccaggcucca

SEQ ID NO: 1041763 - RNA, 21 nt, Human
uuagcucagcacgaagucacu

SEQ ID NO: 1041764 - RNA, 20 nt, Human
uuccccagguaucugacguc

SEQ ID NO: 1041765 - RNA, 20 nt, Human
acggggcggggcgagggcgg

SEQ ID NO: 1041766 - RNA, 25 nt, Human
acucugugugcagcugccccuuggc

SEQ ID NO: 1041767 - RNA, 20 nt, Human
agggcgguggggccaauggg

SEQ ID NO: 1041768 - RNA, 18 nt, Human
aguuguccagaaaggcug

SEQ ID NO: 1041769 - RNA, 20 nt, Human
aguuguccagaaaggcuggg

SEQ ID NO: 1041770 - RNA, 24 nt, Human
cacacuggaagauguccacauuca

SEQ ID NO: 1041771 - RNA, 22 nt, Human
cagggcccuucuugcgcuccuc

SEQ ID NO: 1041772 - RNA, 22 nt, Human
ccacguccuccucugagcuccg

SEQ ID NO: 1041773 - RNA, 20 nt, Human
ccuucuugcgcuccucucuu

SEQ ID NO: 1041774 - RNA, 21 nt, Human
cuaggcccaucagaggcuuuc

SEQ ID NO: 1041775 - RNA, 26 nt, Human
cuucucuguucuaggcccaucagagg

SEQ ID NO: 1041776 - RNA, 19 nt, Human
cuugcgcuccucucuucug

SEQ ID NO: 1041777 - RNA, 18 nt, Human
gagcaaaagcagcccagg

SEQ ID NO: 1041778 - RNA, 18 nt, Human
gcccggggcuggggagcc

SEQ ID NO: 1041779 - RNA, 23 nt, Human
gcggggcgagggcgguugcuggg

SEQ ID NO: 1041780 - RNA, 18 nt, Human
ggcggggcgagggcggug

SEQ ID NO: 1041781 - RNA, 19 nt, Human
ggcgguggggccaaugggg

SEQ ID NO: 1041782 - RNA, 26 nt, Human
ggcgguggggccaauggggcgggggg

SEQ ID NO: 1041783 - RNA, 23 nt, Human
gggcggggcgagggcgguggggc

SEQ ID NO: 1041784 - RNA, 24 nt, Human
gggcggggcgagggcgguggggcc

SEQ ID NO: 1041785 - RNA, 21 nt, Human
ggggccaauggggcggggggc

SEQ ID NO: 1041786 - RNA, 21 nt, Human
ggggcgagggcgguggggcca

SEQ ID NO: 1041787 - RNA, 19 nt, Human
ggggcggggcgagggcggu

SEQ ID NO: 1041788 - RNA, 24 nt, Human
ggggcggggcgagggcgguggggc

SEQ ID NO: 1041789 - RNA, 22 nt, Human
ggucaguuggguccccaggaag

SEQ ID NO: 1041790 - RNA, 18 nt, Human
uaggccgaccccgcaggg

SEQ ID NO: 1041791 - RNA, 18 nt, Human
uccacauucaucuucaca

SEQ ID NO: 1041792 - RNA, 25 nt, Human
ucccaaucuccuccuuucccagcgc

SEQ ID NO: 1041793 - RNA, 19 nt, Human
uccgcgacggggcggggcg

SEQ ID NO: 1041794 - RNA, 26 nt, Human
ucgccgcccggggcuggggagccucc

SEQ ID NO: 1041795 - RNA, 19 nt, Human
ucuucugaaucacacugga

SEQ ID NO: 1041796 - RNA, 21 nt, Human
ugcaaggaacuugccaucugc

SEQ ID NO: 1041797 - RNA, 21 nt, Human
ugccgugugcaaagugaaggg

SEQ ID NO: 1041798 - RNA, 22 nt, Human
uuccgcgacggggcggggcgag

SEQ ID NO: 1041799 - RNA, 19 nt, Human
uucuucagggucaguuggg

SEQ ID NO: 1041800 - RNA, 21 nt, Human
uuuggccugcaaggaacuugc

SEQ ID NO: 1041801 - RNA, 22 nt, Human
auaauagugaugguuuuuucuu

SEQ ID NO: 1041802 - RNA, 21 nt, Human
ccugccccugcccgccuaaga

SEQ ID NO: 1041803 - RNA, 20 nt, Human
gaaaaagacugaaaauuuac

SEQ ID NO: 1041804 - RNA, 24 nt, Human
gauguguucagaugcagucaccuu

SEQ ID NO: 1041805 - RNA, 20 nt, Human
uaauagugaugguuuuuucu

SEQ ID NO: 1041806 - RNA, 19 nt, Human
uaucuauaauagugauggu

SEQ ID NO: 1041807 - RNA, 21 nt, Human
ucagucuauucauaagaaauc

SEQ ID NO: 1041808 - RNA, 23 nt, Human
uccaagaugaaaaagacugaaaa

SEQ ID NO: 1041809 - RNA, 21 nt, Human
ugauuuugcuugccauccaag

SEQ ID NO: 1041810 - RNA, 20 nt, Human
ugcccaauaguucuugccuc

SEQ ID NO: 1041811 - RNA, 20 nt, Human
ugccccugcccgccuaagac

SEQ ID NO: 1041812 - RNA, 24 nt, Human
uuuucuucagucuauucauaagaa

SEQ ID NO: 1041813 - RNA, 20 nt, Human
aagggcagcaggaucuccag

SEQ ID NO: 1041814 - RNA, 24 nt, Human
aagucuuccucuggcagagacccg

SEQ ID NO: 1041815 - RNA, 20 nt, Human
accagcucgcgccccugggc

SEQ ID NO: 1041816 - RNA, 18 nt, Human
acccuugcccggccagcu

SEQ ID NO: 1041817 - RNA, 20 nt, Human
agccuccuucuuccuucccg

SEQ ID NO: 1041818 - RNA, 22 nt, Human
aggaggaugaaucugugcagug

SEQ ID NO: 1041819 - RNA, 18 nt, Human
agggguucagggcccaga

SEQ ID NO: 1041820 - RNA, 20 nt, Human
cagcugaaggcacaaacacu

SEQ ID NO: 1041821 - RNA, 18 nt, Human
cagcugcugccacagagc

SEQ ID NO: 1041822 - RNA, 21 nt, Human
cagcuucccuguccuagaggg

SEQ ID NO: 1041823 - RNA, 21 nt, Human
ccacuuaaaccccagacccaa

SEQ ID NO: 1041824 - RNA, 21 nt, Human
ccagacccaagcccuuaacuc

SEQ ID NO: 1041825 - RNA, 23 nt, Human
cccaagcccuuaacuccuggacc

SEQ ID NO: 1041826 - RNA, 21 nt, Human
ccccacuccauuugcaggccc

SEQ ID NO: 1041827 - RNA, 23 nt, Human
ccccagacccaagcccuuaacuc

SEQ ID NO: 1041828 - RNA, 22 nt, Human
cccccugcuccuagccuccuuc

SEQ ID NO: 1041829 - RNA, 24 nt, Human
cccugcuccuagccuccuucuucc

SEQ ID NO: 1041830 - RNA, 19 nt, Human
ccucuggcagagacccgag

SEQ ID NO: 1041831 - RNA, 18 nt, Human
ccuucccgucccgguccc

SEQ ID NO: 1041832 - RNA, 19 nt, Human
cgccccugggccucguccu

SEQ ID NO: 1041833 - RNA, 19 nt, Human
cucccccacuccauuugca

SEQ ID NO: 1041834 - RNA, 19 nt, Human
cugccacagagcaaacacc

SEQ ID NO: 1041835 - RNA, 20 nt, Human
cugcccccucagcugaaggc

SEQ ID NO: 1041836 - RNA, 22 nt, Human
cuggcagagacccgaggugcag

SEQ ID NO: 1041837 - RNA, 24 nt, Human
cuggcaggcuugguggcucuggug

SEQ ID NO: 1041838 - RNA, 20 nt, Human
cugugcagugccgggaagua

SEQ ID NO: 1041839 - RNA, 24 nt, Human
cuugcuaggagcccugugucccca

SEQ ID NO: 1041840 - RNA, 24 nt, Human
gaaggcacaaacacugugguaggg

SEQ ID NO: 1041841 - RNA, 21 nt, Human
gaccacggccagccuuccuua

SEQ ID NO: 1041842 - RNA, 23 nt, Human
gaccggcugggcagggccagucu

SEQ ID NO: 1041843 - RNA, 23 nt, Human
gagaccccucuggcaggcuuggu

SEQ ID NO: 1041844 - RNA, 18 nt, Human
gcagggccagucucccuu

SEQ ID NO: 1041845 - RNA, 22 nt, Human
gcgcccgcagaugucuucccac

SEQ ID NO: 1041846 - RNA, 19 nt, Human
gcugcugcucagggaacag

SEQ ID NO: 1041847 - RNA, 18 nt, Human
ggccaggacucccccacu

SEQ ID NO: 1041848 - RNA, 20 nt, Human
gggcagagcuggggagaagu

SEQ ID NO: 1041849 - RNA, 18 nt, Human
gucgcagggaugcuuaag

SEQ ID NO: 1041850 - RNA, 19 nt, Human
gugagcggacacgcgcccg

SEQ ID NO: 1041851 - RNA, 22 nt, Human
guucagggcccagaggcugccc

SEQ ID NO: 1041852 - RNA, 22 nt, Human
uaagucuuccucuggcagagac

SEQ ID NO: 1041853 - RNA, 23 nt, Human
uaggcuggaauccaagcaccauc

SEQ ID NO: 1041854 - RNA, 23 nt, Human
uauugcaaauugugagaaggcag

SEQ ID NO: 1041855 - RNA, 18 nt, Human
ucagggaacagggugagc

SEQ ID NO: 1041856 - RNA, 23 nt, Human
ucagggcccagaggcugcccccu

SEQ ID NO: 1041857 - RNA, 18 nt, Human
ucauguggacccagaggg

SEQ ID NO: 1041858 - RNA, 22 nt, Human
uccccaagccaugaaugagacc

SEQ ID NO: 1041859 - RNA, 23 nt, Human
uccccaagccaugaaugagaccc

SEQ ID NO: 1041860 - RNA, 22 nt, Human
ucccuggagggagcugcugcuc

SEQ ID NO: 1041861 - RNA, 22 nt, Human
uccucauguggacccagagggc

SEQ ID NO: 1041862 - RNA, 19 nt, Human
uccucuggcagagacccga

SEQ ID NO: 1041863 - RNA, 21 nt, Human
uccuggaccacggccagccuu

SEQ ID NO: 1041864 - RNA, 22 nt, Human
ucuuccuucccgucccgguccc

SEQ ID NO: 1041865 - RNA, 19 nt, Human
ugaagguagcaacgcuucc

SEQ ID NO: 1041866 - RNA, 23 nt, Human
ugccacagagcaaacaccagcuc

SEQ ID NO: 1041867 - RNA, 18 nt, Human
ugcccagcgggggcugag

SEQ ID NO: 1041868 - RNA, 19 nt, Human
ugcccuggaccaggccagc

SEQ ID NO: 1041869 - RNA, 18 nt, Human
ugccugguacaggaggau

SEQ ID NO: 1041870 - RNA, 19 nt, Human
uggaccaggccagcuuccc

SEQ ID NO: 1041871 - RNA, 20 nt, Human
uggagggagcugcugcucag

SEQ ID NO: 1041872 - RNA, 21 nt, Human
uggcaggcuugguggcucugg

SEQ ID NO: 1041873 - RNA, 19 nt, Human
uggccagggccuggauggg

SEQ ID NO: 1041874 - RNA, 22 nt, Human
uggcucuggugauucaggggcc

SEQ ID NO: 1041875 - RNA, 24 nt, Human
ugggacccagggccucccuggagg

SEQ ID NO: 1041876 - RNA, 20 nt, Human
uuaacuccuggaccacggcc

SEQ ID NO: 1041877 - RNA, 20 nt, Human
uucaggggccaggacucccc

SEQ ID NO: 1041878 - RNA, 21 nt, Human
uucaggggccaggacuccccc

SEQ ID NO: 1041879 - RNA, 24 nt, Human
uucccacccuugcccggccagcuc

SEQ ID NO: 1041880 - RNA, 22 nt, Human
uuccucuggcagagacccgagg

SEQ ID NO: 1041881 - RNA, 19 nt, Human
uuggcaggccaugugggca

SEQ ID NO: 1041882 - RNA, 22 nt, Human
aaacggauaaacauuacaagcg

SEQ ID NO: 1041883 - RNA, 21 nt, Human
acccccagcaaagaaaaaggc

SEQ ID NO: 1041884 - RNA, 21 nt, Human
accuuaaacaacgccaaggaa

SEQ ID NO: 1041885 - RNA, 22 nt, Human
agaagacccccagcaaagaaaa

SEQ ID NO: 1041886 - RNA, 18 nt, Human
agaggaagugugucuggc

SEQ ID NO: 1041887 - RNA, 23 nt, Human
agcccagccagccugcgucucag

SEQ ID NO: 1041888 - RNA, 24 nt, Human
agccccacccccucccgugcccag

SEQ ID NO: 1041889 - RNA, 23 nt, Human
aggaggacgaaauguuuaaacgg

SEQ ID NO: 1041890 - RNA, 21 nt, Human
aggcuccugggcagacaguuc

SEQ ID NO: 1041891 - RNA, 20 nt, Human
augccuuuccaucggcaucc

SEQ ID NO: 1041892 - RNA, 23 nt, Human
caaccccuguccggugucggggg

SEQ ID NO: 1041893 - RNA, 19 nt, Human
caacgccaaggaaccucac

SEQ ID NO: 1041894 - RNA, 23 nt, Human
cacccccucccgugcccagggcc

SEQ ID NO: 1041895 - RNA, 19 nt, Human
cacgcccagccccaccccc

SEQ ID NO: 1041896 - RNA, 20 nt, Human
cacgcccagccccacccccu

SEQ ID NO: 1041897 - RNA, 24 nt, Human
cagaugccuuuccaucggcauccc

SEQ ID NO: 1041898 - RNA, 18 nt, Human
cagcaggagagcccagcc

SEQ ID NO: 1041899 - RNA, 19 nt, Human
cagcuccucaagccugacu

SEQ ID NO: 1041900 - RNA, 23 nt, Human
caggcuccugggcagacaguucc

SEQ ID NO: 1041901 - RNA, 18 nt, Human
cagugggugagugaggcc

SEQ ID NO: 1041902 - RNA, 21 nt, Human
caucccagcuguggcugggga

SEQ ID NO: 1041903 - RNA, 22 nt, Human
ccacccccucccgugcccaggg

SEQ ID NO: 1041904 - RNA, 23 nt, Human
ccagcaaagaaaaaggcaucaga

SEQ ID NO: 1041905 - RNA, 22 nt, Human
ccagccccacccccucccgugc

SEQ ID NO: 1041906 - RNA, 18 nt, Human
ccagcuguggcuggggac

SEQ ID NO: 1041907 - RNA, 18 nt, Human
ccccacccccucccgugc

SEQ ID NO: 1041908 - RNA, 23 nt, Human
ccccacccccucccgugcccagg

SEQ ID NO: 1041909 - RNA, 19 nt, Human
cccccucccgugcccaggg

SEQ ID NO: 1041910 - RNA, 20 nt, Human
ccccuguccccuucacgccc

SEQ ID NO: 1041911 - RNA, 19 nt, Human
cccgcuguguucugcagcc

SEQ ID NO: 1041912 - RNA, 24 nt, Human
ccucuccugucucugcuuuccuca

SEQ ID NO: 1041913 - RNA, 24 nt, Human
ccucugaggagguccccucaaccc

SEQ ID NO: 1041914 - RNA, 21 nt, Human
ccucuggguggcuguagaucu

SEQ ID NO: 1041915 - RNA, 22 nt, Human
cgacgcagugggugagugaggc

SEQ ID NO: 1041916 - RNA, 20 nt, Human
cucaagccugacugcucuuc

SEQ ID NO: 1041917 - RNA, 24 nt, Human
cuucacgcccagccccacccccuc

SEQ ID NO: 1041918 - RNA, 22 nt, Human
gacugcucuuccgccucucuau

SEQ ID NO: 1041919 - RNA, 22 nt, Human
gagaacgaggucucaagaggaa

SEQ ID NO: 1041920 - RNA, 18 nt, Human
gaggagguccccucaacc

SEQ ID NO: 1041921 - RNA, 18 nt, Human
gcccagccccacccccuc

SEQ ID NO: 1041922 - RNA, 20 nt, Human
gcccgggcagggcucgucaa

SEQ ID NO: 1041923 - RNA, 20 nt, Human
ggagagcccagccagccugc

SEQ ID NO: 1041924 - RNA, 21 nt, Human
gggccucugaggagguccccu

SEQ ID NO: 1041925 - RNA, 20 nt, Human
gguggaguugaccuuaaaca

SEQ ID NO: 1041926 - RNA, 21 nt, Human
uacaagcgccagcuccucaag

SEQ ID NO: 1041927 - RNA, 23 nt, Human
uagaagacccccagcaaagaaaa

SEQ ID NO: 1041928 - RNA, 19 nt, Human
uauggcagaugccuuucca

SEQ ID NO: 1041929 - RNA, 28 nt, Human
uccccuguccccuucacgcccagcccca

SEQ ID NO: 1041930 - RNA, 18 nt, Human
uccugggcagacaguucc

SEQ ID NO: 1041931 - RNA, 21 nt, Human
ucuccugucucugcuuuccuc

SEQ ID NO: 1041932 - RNA, 23 nt, Human
ugacuucugucacuuccagacuc

SEQ ID NO: 1041933 - RNA, 20 nt, Human
ugaggagguccccucaaccc

SEQ ID NO: 1041934 - RNA, 18 nt, Human
ugcaaagaugucccuggg

SEQ ID NO: 1041935 - RNA, 20 nt, Human
ugcaaagaugucccugggcc

SEQ ID NO: 1041936 - RNA, 21 nt, Human
ugcccagggccucugaggagg

SEQ ID NO: 1041937 - RNA, 20 nt, Human
uggcuugcaaagaugucccu

SEQ ID NO: 1041938 - RNA, 21 nt, Human
ugggaaguguguuuggcucac

SEQ ID NO: 1041939 - RNA, 19 nt, Human
uguauuugguggaguugac

SEQ ID NO: 1041940 - RNA, 23 nt, Human
uugaccuuaaacaacgccaagga

SEQ ID NO: 1041941 - RNA, 19 nt, Human
uugcuguauuugguggagu

SEQ ID NO: 1041942 - RNA, 21 nt, Human
acucuugccgggcagacagac

SEQ ID NO: 1041943 - RNA, 23 nt, Human
agaauggacucuugccgggcaga

SEQ ID NO: 1041944 - RNA, 22 nt, Human
agacagacacagcaaggcucuc

SEQ ID NO: 1041945 - RNA, 18 nt, Human
agcagguagaugggccag

SEQ ID NO: 1041946 - RNA, 22 nt, Human
ccagcagugagaauggacucuu

SEQ ID NO: 1041947 - RNA, 18 nt, Human
cccagcccuggagcucca

SEQ ID NO: 1041948 - RNA, 21 nt, Human
ccgggcaucucugagcauuga

SEQ ID NO: 1041949 - RNA, 18 nt, Human
cuggagcuccauccaggc

SEQ ID NO: 1041950 - RNA, 22 nt, Human
gacguggagauuuucaugagug

SEQ ID NO: 1041951 - RNA, 24 nt, Human
gagcauugacuugcggacguuccc

SEQ ID NO: 1041952 - RNA, 22 nt, Human
gggugcugggggaaacugaagc

SEQ ID NO: 1041953 - RNA, 18 nt, Human
gugcugggggaaacugaa

SEQ ID NO: 1041954 - RNA, 21 nt, Human
uccccagcccuggagcuccau

SEQ ID NO: 1041955 - RNA, 22 nt, Human
ugacuugcggacguuccccagc

SEQ ID NO: 1041956 - RNA, 22 nt, Human
ugggaugcacguggaccaggcu

SEQ ID NO: 1041957 - RNA, 24 nt, Human
ugggggaaacugaagcugucagug

SEQ ID NO: 1041958 - RNA, 23 nt, Human
agaaagucagcuuuauuagccca

SEQ ID NO: 1041959 - RNA, 18 nt, Human
agcuggugggcaggaggc

SEQ ID NO: 1041960 - RNA, 23 nt, Human
agcuggugggcaggaggcugugg

SEQ ID NO: 1041961 - RNA, 21 nt, Human
aggagcagggagacagcuggg

SEQ ID NO: 1041962 - RNA, 24 nt, Human
aggugaggccagcuggugggcagg

SEQ ID NO: 1041963 - RNA, 19 nt, Human
caccucacugcggcugcuc

SEQ ID NO: 1041964 - RNA, 24 nt, Human
cagcuggugggcaggaggcugugg

SEQ ID NO: 1041965 - RNA, 18 nt, Human
caggcccuggaacacccu

SEQ ID NO: 1041966 - RNA, 18 nt, Human
cuuuauuagcccaucacc

SEQ ID NO: 1041967 - RNA, 19 nt, Human
gagcagggagacagcuggg

SEQ ID NO: 1041968 - RNA, 21 nt, Human
gaggugaggccagcugguggg

SEQ ID NO: 1041969 - RNA, 24 nt, Human
gcccuggaacacccucuggagcuc

SEQ ID NO: 1041970 - RNA, 25 nt, Human
gcuccgucaccucacugcggcugcu

SEQ ID NO: 1041971 - RNA, 20 nt, Human
ggagacagcugggaacugcg

SEQ ID NO: 1041972 - RNA, 18 nt, Human
ggcaggaggcugugguag

SEQ ID NO: 1041973 - RNA, 22 nt, Human
gggagacagcugggaacugcgc

SEQ ID NO: 1041974 - RNA, 23 nt, Human
ggugggcaggaggcugugguaga

SEQ ID NO: 1041975 - RNA, 18 nt, Human
ugcgcugggagagcaggg

SEQ ID NO: 1041976 - RNA, 19 nt, Human
ugcggcugcucuguaccag

SEQ ID NO: 1041977 - RNA, 20 nt, Human
auucauauauauauauauau

SEQ ID NO: 1041978 - RNA, 22 nt, Human
cauuuugggacagagggaguug

SEQ ID NO: 1041979 - RNA, 19 nt, Human
ccauccuccaccuuggcua

SEQ ID NO: 1041980 - RNA, 20 nt, Human
cccauccuccaccuuggcua

SEQ ID NO: 1041981 - RNA, 18 nt, Human
ccuuggcuaacugaaccu

SEQ ID NO: 1041982 - RNA, 23 nt, Human
cucauucauauauauauauauau

SEQ ID NO: 1041983 - RNA, 24 nt, Human
ucucauucauauauauauauauau

SEQ ID NO: 1041984 - RNA, 19 nt, Human
uucauauauauauauauau

SEQ ID NO: 1041985 - RNA, 22 nt, Human
uugguccauccuaacauuuucc

SEQ ID NO: 1041986 - RNA, 20 nt, Human
uuucccauccuccaccuugg

SEQ ID NO: 1041987 - RNA, 23 nt, Human
uuuugggacagagggaguuggua

SEQ ID NO: 1041988 - RNA, 22 nt, Human
acugcagucagcuucagggcag

SEQ ID NO: 1041989 - RNA, 22 nt, Human
agccgugcgacucugucucccu

SEQ ID NO: 1041990 - RNA, 19 nt, Human
aggaagccaauuggauuuc

SEQ ID NO: 1041991 - RNA, 22 nt, Human
caaauuggccuaauacuggaaa

SEQ ID NO: 1041992 - RNA, 18 nt, Human
cacagcagcauuaaauga

SEQ ID NO: 1041993 - RNA, 22 nt, Human
cacgugacacgccugacugccc

SEQ ID NO: 1041994 - RNA, 19 nt, Human
ccuguggcugcgacccgga

SEQ ID NO: 1041995 - RNA, 21 nt, Human
cuagagcucacgguucagggc

SEQ ID NO: 1041996 - RNA, 22 nt, Human
cugccuggcgucucagccgugc

SEQ ID NO: 1041997 - RNA, 20 nt, Human
cuggaauuucuagagcucac

SEQ ID NO: 1041998 - RNA, 20 nt, Human
cuguccgcgauccaggcuua

SEQ ID NO: 1041999 - RNA, 19 nt, Human
gaagccaauuggauuucaa

SEQ ID NO: 1042000 - RNA, 20 nt, Human
gaaguuggaauuuacaaacu

SEQ ID NO: 1042001 - RNA, 19 nt, Human
ggcaggugagguguggacc

SEQ ID NO: 1042002 - RNA, 21 nt, Human
uccgcgauccaggcuuagggc

SEQ ID NO: 1042003 - RNA, 19 nt, Human
ucugcacuacugcugaaag

SEQ ID NO: 1042004 - RNA, 18 nt, Human
ugccacagcagcauuaaa

SEQ ID NO: 1042005 - RNA, 20 nt, Human
ugcccuguggcugcgacccg

SEQ ID NO: 1042006 - RNA, 24 nt, Human
uggcgucucagccgugcgacucug

SEQ ID NO: 1042007 - RNA, 23 nt, Human
aaaaaaacccaaaaaaacucaag

SEQ ID NO: 1042008 - RNA, 20 nt, Human
aaacccaaaaaaacucaaga

SEQ ID NO: 1042009 - RNA, 20 nt, Human
aaagaacuuugcccaccaac

SEQ ID NO: 1042010 - RNA, 19 nt, Human
aaagcuacaacuuggccug

SEQ ID NO: 1042011 - RNA, 21 nt, Human
aagaauugacacccaagacca

SEQ ID NO: 1042012 - RNA, 24 nt, Human
aagcugaggcaggaggaccaucug

SEQ ID NO: 1042013 - RNA, 28 nt, Human
acagcaagacugucucaaaaaaaaaaaa

SEQ ID NO: 1042014 - RNA, 26 nt, Human
accacacuccagccugggcaauacag

SEQ ID NO: 1042015 - RNA, 20 nt, Human
agccugggcaacauagagaa

SEQ ID NO: 1042016 - RNA, 23 nt, Human
agccugggcaacauagagaaucc

SEQ ID NO: 1042017 - RNA, 23 nt, Human
aggaggaauuuacaauuuccagc

SEQ ID NO: 1042018 - RNA, 18 nt, Human
aggcaggaggaccaucug

SEQ ID NO: 1042019 - RNA, 18 nt, Human
aggcaggaggaccaucug

SEQ ID NO: 1042020 - RNA, 24 nt, Human
aggcaggaggaccaucugagccca

SEQ ID NO: 1042021 - RNA, 19 nt, Human
aggcaggaggaccaucugg

SEQ ID NO: 1042022 - RNA, 22 nt, Human
aggugggaggauugcuuaggcc

SEQ ID NO: 1042023 - RNA, 20 nt, Human
auagaaccucuuguugggca

SEQ ID NO: 1042024 - RNA, 19 nt, Human
auugcuuaggccuggguga

SEQ ID NO: 1042025 - RNA, 24 nt, Human
auugugccaccacacuccagccug

SEQ ID NO: 1042026 - RNA, 24 nt, Human
caacauagagaauccgucucaaca

SEQ ID NO: 1042027 - RNA, 22 nt, Human
caagaccauccuuuauuguagu

SEQ ID NO: 1042028 - RNA, 25 nt, Human
caccacacuccagccugggcaauac

SEQ ID NO: 1042029 - RNA, 20 nt, Human
cagcuuaaagaacuuugccc

SEQ ID NO: 1042030 - RNA, 25 nt, Human
cagcuuaaagaacuuugcccaccaa

SEQ ID NO: 1042031 - RNA, 24 nt, Human
ccaaaaaaacucaagaauguaaug

SEQ ID NO: 1042032 - RNA, 18 nt, Human
cccccagcuacuacuccc

SEQ ID NO: 1042033 - RNA, 20 nt, Human
ccucugauacauaaggcaag

SEQ ID NO: 1042034 - RNA, 22 nt, Human
ccugagaccagccugggcaaca

SEQ ID NO: 1042035 - RNA, 19 nt, Human
ccuuuauuguaguauuagu

SEQ ID NO: 1042036 - RNA, 18 nt, Human
cucaaaaaaaaaaaaaaa

SEQ ID NO: 1042037 - RNA, 24 nt, Human
cucaaaaaaaaaaaaaaaaaccca

SEQ ID NO: 1042038 - RNA, 23 nt, Human
cugggcaacauagagaauccguc

SEQ ID NO: 1042039 - RNA, 22 nt, Human
cugucucaaaaaaaaaaaaaaa

SEQ ID NO: 1042040 - RNA, 24 nt, Human
cuuaggccugggugauugaggaug

SEQ ID NO: 1042041 - RNA, 24 nt, Human
gaccaucugagcccaggagccuga

SEQ ID NO: 1042042 - RNA, 19 nt, Human
gcaugauggcaagggacaa

SEQ ID NO: 1042043 - RNA, 22 nt, Human
gccaccacacuccagccugggc

SEQ ID NO: 1042044 - RNA, 22 nt, Human
gcccaggagccugagaccagcc

SEQ ID NO: 1042045 - RNA, 19 nt, Human
gccugggugauugaggaug

SEQ ID NO: 1042046 - RNA, 19 nt, Human
gccugugccuuuggaagcu

SEQ ID NO: 1042047 - RNA, 24 nt, Human
gcuguagucccagcuacaaggugg

SEQ ID NO: 1042048 - RNA, 19 nt, Human
gggacugacauccucuggu

SEQ ID NO: 1042049 - RNA, 22 nt, Human
gucucaaaaaaaaaaaaaaaaa

SEQ ID NO: 1042050 - RNA, 21 nt, Human
uacaacuuggccugugccuuu

SEQ ID NO: 1042051 - RNA, 28 nt, Human
uaguuuucagaauccaaacugauggagu

SEQ ID NO: 1042052 - RNA, 22 nt, Human
uccccagagaccacagaagcuc

SEQ ID NO: 1042053 - RNA, 20 nt, Human
ucucuuggaucugcugagca

SEQ ID NO: 1042054 - RNA, 18 nt, Human
ucuuuauuugcucuugcc

SEQ ID NO: 1042055 - RNA, 19 nt, Human
ugaaaaaacauuucaggag

SEQ ID NO: 1042056 - RNA, 21 nt, Human
ugaaaaaacauuucaggagga

SEQ ID NO: 1042057 - RNA, 23 nt, Human
ugagcccaggagccugagaccag

SEQ ID NO: 1042058 - RNA, 20 nt, Human
ugaggcaggaggaccaucug

SEQ ID NO: 1042059 - RNA, 24 nt, Human
ugaggcaggaggaccaucugagcc

SEQ ID NO: 1042060 - RNA, 25 nt, Human
ugaggcaggaggaccaucugagccc

SEQ ID NO: 1042061 - RNA, 22 nt, Human
ugcaaugagcugugauugugcc

SEQ ID NO: 1042062 - RNA, 24 nt, Human
ugccaccacacuccagccugggca

SEQ ID NO: 1042063 - RNA, 19 nt, Human
ugccuuuggaagcugaggc

SEQ ID NO: 1042064 - RNA, 21 nt, Human
uggcaagggacaaagcuacaa

SEQ ID NO: 1042065 - RNA, 25 nt, Human
uguagucccagcuacaaggugggag

SEQ ID NO: 1042066 - RNA, 21 nt, Human
uuccagcuuaaagaacuuugc

SEQ ID NO: 1042067 - RNA, 21 nt, Human
uucuagaaaaaguugccaaau

SEQ ID NO: 1042068 - RNA, 24 nt, Human
uuggaagcugaggcaggaggacca

SEQ ID NO: 1042069 - RNA, 19 nt, Human
uuugcccaccaacauaacc

SEQ ID NO: 1042070 - RNA, 24 nt, Human
aaacccuccacagcccacggcucc

SEQ ID NO: 1042071 - RNA, 19 nt, Human
agcugacugcgccuaccug

SEQ ID NO: 1042072 - RNA, 21 nt, Human
aggacacgcccuccacgaccg

SEQ ID NO: 1042073 - RNA, 21 nt, Human
aggauccugaccccccgccgg

SEQ ID NO: 1042074 - RNA, 20 nt, Human
auccugaccccccgccgggg

SEQ ID NO: 1042075 - RNA, 19 nt, Human
cacaaacccuccacagccc

SEQ ID NO: 1042076 - RNA, 22 nt, Human
cacaaacccuccacagcccacg

SEQ ID NO: 1042077 - RNA, 23 nt, Human
ccaacccacagcaccuccugcag

SEQ ID NO: 1042078 - RNA, 21 nt, Human
ccauccagggacauuuuuuac

SEQ ID NO: 1042079 - RNA, 21 nt, Human
cccacagcaccuccugcaguc

SEQ ID NO: 1042080 - RNA, 22 nt, Human
ccuccacagcccacggcuccaa

SEQ ID NO: 1042081 - RNA, 22 nt, Human
cuccacagcccacggcuccaac

SEQ ID NO: 1042082 - RNA, 23 nt, Human
gggcuucucaucauacacaaacc

SEQ ID NO: 1042083 - RNA, 21 nt, Human
ggguauuucuugacaagacug

SEQ ID NO: 1042084 - RNA, 20 nt, Human
guggaggauccugacccccc

SEQ ID NO: 1042085 - RNA, 19 nt, Human
uaccgaagcgucucagaga

SEQ ID NO: 1042086 - RNA, 25 nt, Human
ucagagacuggcucaggguauuucu

SEQ ID NO: 1042087 - RNA, 23 nt, Human
uccacagcccacggcuccaaccc

SEQ ID NO: 1042088 - RNA, 20 nt, Human
ugauuccauccagggacauu

SEQ ID NO: 1042089 - RNA, 18 nt, Human
uggcucaggguauuucuu

SEQ ID NO: 1042090 - RNA, 23 nt, Human
uggcucaggguauuucuugacaa

SEQ ID NO: 1042091 - RNA, 20 nt, Human
uguggaggauccugaccccc

SEQ ID NO: 1042092 - RNA, 21 nt, Human
aacacagcgagacacccaucu

SEQ ID NO: 1042093 - RNA, 19 nt, Human
aagcacugggaguagugca

SEQ ID NO: 1042094 - RNA, 20 nt, Human
acacagcgagacacccaucu

SEQ ID NO: 1042095 - RNA, 21 nt, Human
acagcgagacacccaucuaaa

SEQ ID NO: 1042096 - RNA, 23 nt, Human
acugcagcuuccaagcuguuggc

SEQ ID NO: 1042097 - RNA, 19 nt, Human
agacucaaagauucggcag

SEQ ID NO: 1042098 - RNA, 24 nt, Human
agcacuuugggaggccaauauggg

SEQ ID NO: 1042099 - RNA, 20 nt, Human
aggaguuugagaucagccug

SEQ ID NO: 1042100 - RNA, 24 nt, Human
aggaucacuugaagccaggaguuu

SEQ ID NO: 1042101 - RNA, 24 nt, Human
aggcaggagaagguuucucucuag

SEQ ID NO: 1042102 - RNA, 22 nt, Human
aucccagcacuuugggaggcca

SEQ ID NO: 1042103 - RNA, 19 nt, Human
aucuaaagcacuuauagag

SEQ ID NO: 1042104 - RNA, 24 nt, Human
cacaccuguaaucccagcacuuug

SEQ ID NO: 1042105 - RNA, 19 nt, Human
caccuguaaucccagcacu

SEQ ID NO: 1042106 - RNA, 24 nt, Human
caccuguaaucccagcacuuuggg

SEQ ID NO: 1042107 - RNA, 21 nt, Human
cacuugaagccaggaguuuga

SEQ ID NO: 1042108 - RNA, 24 nt, Human
cagcacuuugggaggccaauaugg

SEQ ID NO: 1042109 - RNA, 23 nt, Human
cagcgagacacccaucuaaagca

SEQ ID NO: 1042110 - RNA, 23 nt, Human
ccaggcaccauuccaagcacugg

SEQ ID NO: 1042111 - RNA, 19 nt, Human
cccaggcaccauuccaagc

SEQ ID NO: 1042112 - RNA, 19 nt, Human
ccccucucucccucucccc

SEQ ID NO: 1042113 - RNA, 25 nt, Human
cccucucucccucuccccuucuccc

SEQ ID NO: 1042114 - RNA, 19 nt, Human
ccuucucucccccucucuc

SEQ ID NO: 1042115 - RNA, 22 nt, Human
cgaaacccccugccuccaugaa

SEQ ID NO: 1042116 - RNA, 18 nt, Human
cgagacacccaucuaaag

SEQ ID NO: 1042117 - RNA, 24 nt, Human
cguggcucacaccuguaaucccag

SEQ ID NO: 1042118 - RNA, 22 nt, Human
cucacaccuguaaucccagcac

SEQ ID NO: 1042119 - RNA, 24 nt, Human
cucacaccuguaaucccagcacuu

SEQ ID NO: 1042120 - RNA, 18 nt, Human
cugcggcaggcaggagaa

SEQ ID NO: 1042121 - RNA, 25 nt, Human
gaggaucacuugaagccaggaguuu

SEQ ID NO: 1042122 - RNA, 19 nt, Human
gauaacacagcgagacacc

SEQ ID NO: 1042123 - RNA, 24 nt, Human
gaucacuugaagccaggaguuuga

SEQ ID NO: 1042124 - RNA, 22 nt, Human
ggaucacuugaagccaggaguu

SEQ ID NO: 1042125 - RNA, 23 nt, Human
ggugccguggcucacaccuguaa

SEQ ID NO: 1042126 - RNA, 21 nt, Human
uaauuacugcagcuuccaagc

SEQ ID NO: 1042127 - RNA, 21 nt, Human
uagagucccaggcaccauucc

SEQ ID NO: 1042128 - RNA, 21 nt, Human
uagugcaaugaacgaaacccc

SEQ ID NO: 1042129 - RNA, 19 nt, Human
ucacuugaagccaggaguu

SEQ ID NO: 1042130 - RNA, 22 nt, Human
uccccuucuaauuacugcagcu

SEQ ID NO: 1042131 - RNA, 21 nt, Human
ucuagagcuugcuuucgcucu

SEQ ID NO: 1042132 - RNA, 22 nt, Human
ugacagaaaaggaaauugucuu

SEQ ID NO: 1042133 - RNA, 21 nt, Human
uggcucacaccuguaauccca

SEQ ID NO: 1042134 - RNA, 22 nt, Human
uggcucacaccuguaaucccag

SEQ ID NO: 1042135 - RNA, 24 nt, Human
uggcucacaccuguaaucccagca

SEQ ID NO: 1042136 - RNA, 18 nt, Human
ugggaggccaauauggga

SEQ ID NO: 1042137 - RNA, 24 nt, Human
ugggaggccaauaugggaggauca

SEQ ID NO: 1042138 - RNA, 18 nt, Human
uuacugcagcuuccaagc

SEQ ID NO: 1042139 - RNA, 21 nt, Human
uugaagccaggaguuugagau

SEQ ID NO: 1042140 - RNA, 20 nt, Human
cccaugagggaaaugggugg

SEQ ID NO: 1042141 - RNA, 19 nt, Human
gcugacugcuuuggugcug

SEQ ID NO: 1042142 - RNA, 19 nt, Human
ggcucccgcuuugcuggcu

SEQ ID NO: 1042143 - RNA, 22 nt, Human
ugacugcuuuggugcuguuuuu

SEQ ID NO: 1042144 - RNA, 23 nt, Human
ugcuggcuuggccaguucuuggg

SEQ ID NO: 1042145 - RNA, 22 nt, Human
ugcuuuggugcuguuuuugaaa

SEQ ID NO: 1042146 - RNA, 21 nt, Human
uuugcuggcuuggccaguucu

SEQ ID NO: 1042147 - RNA, 21 nt, Human
caccagggccuccgggccccc

SEQ ID NO: 1042148 - RNA, 18 nt, Human
ccaccagggccuccgggc

SEQ ID NO: 1042149 - RNA, 18 nt, Human
ccuccgggcccccccgcu

SEQ ID NO: 1042150 - RNA, 19 nt, Human
aaacaaggcauaugcugug

SEQ ID NO: 1042151 - RNA, 24 nt, Human
aaggaaacuuuuucuuugguuucu

SEQ ID NO: 1042152 - RNA, 19 nt, Human
agaaagacuaaacaccuua

SEQ ID NO: 1042153 - RNA, 27 nt, Human
agaaagacuaaacaccuuauuuacagg

SEQ ID NO: 1042154 - RNA, 18 nt, Human
agagcagcccgacaaagc

SEQ ID NO: 1042155 - RNA, 24 nt, Human
agagguuuauguuugaggugauca

SEQ ID NO: 1042156 - RNA, 20 nt, Human
agcagagcagcccgacaaag

SEQ ID NO: 1042157 - RNA, 18 nt, Human
agcccccugccgcccccg

SEQ ID NO: 1042158 - RNA, 20 nt, Human
aggcaccuuauuccacuuuu

SEQ ID NO: 1042159 - RNA, 24 nt, Human
aguauauuucggcaacuaaccaaa

SEQ ID NO: 1042160 - RNA, 33 nt, Human
caaagcguggguccgcgugcaggaacccgccuu

SEQ ID NO: 1042161 - RNA, 21 nt, Human
caaauucuuaaacuggguuca

SEQ ID NO: 1042162 - RNA, 23 nt, Human
caacuaaccaaaaaaauaaucag

SEQ ID NO: 1042163 - RNA, 22 nt, Human
cacauguaucuuugcccauagu

SEQ ID NO: 1042164 - RNA, 18 nt, Human
cacuggauauucaaggag

SEQ ID NO: 1042165 - RNA, 22 nt, Human
caggcuggaccacagcucccuc

SEQ ID NO: 1042166 - RNA, 21 nt, Human
cagugagucuaucuuuuguuu

SEQ ID NO: 1042167 - RNA, 22 nt, Human
cauccuguccugcagauacucc

SEQ ID NO: 1042168 - RNA, 23 nt, Human
ccacagcucccucggaaugccac

SEQ ID NO: 1042169 - RNA, 18 nt, Human
cccauaguuuccaaaggg

SEQ ID NO: 1042170 - RNA, 23 nt, Human
cccccugccgcccccggccccgc

SEQ ID NO: 1042171 - RNA, 24 nt, Human
ccccgccagccgcgcccacuagca

SEQ ID NO: 1042172 - RNA, 20 nt, Human
ccccugccgcccccggcccc

SEQ ID NO: 1042173 - RNA, 22 nt, Human
ccgccgccgccgcuucccgccg

SEQ ID NO: 1042174 - RNA, 19 nt, Human
ccgccgcuucccgccgcgc

SEQ ID NO: 1042175 - RNA, 21 nt, Human
ccggacgcuagcccccugccg

SEQ ID NO: 1042176 - RNA, 19 nt, Human
ccggccccgccagccgcgc

SEQ ID NO: 1042177 - RNA, 30 nt, Human
cgcagauacuucacagugacagauguuccu

SEQ ID NO: 1042178 - RNA, 19 nt, Human
cgcccccggccccgccagc

SEQ ID NO: 1042179 - RNA, 20 nt, Human
cgcuggagccgccgccgccg

SEQ ID NO: 1042180 - RNA, 23 nt, Human
cuccuugacggguggcggcgugg

SEQ ID NO: 1042181 - RNA, 24 nt, Human
cucugugauaagcuccuuugucuc

SEQ ID NO: 1042182 - RNA, 18 nt, Human
gcaaauucuuaaacuggg

SEQ ID NO: 1042183 - RNA, 19 nt, Human
gcaaucuuaaacaaggcau

SEQ ID NO: 1042184 - RNA, 22 nt, Human
gugaagcuucugcaugccgcgc

SEQ ID NO: 1042185 - RNA, 22 nt, Human
guuaaagugcaggaauuuucua

SEQ ID NO: 1042186 - RNA, 23 nt, Human
guugauagguuucagcuuccucu

SEQ ID NO: 1042187 - RNA, 18 nt, Human
uaacugcucuauucuguu

SEQ ID NO: 1042188 - RNA, 25 nt, Human
uaugggucacacuggauauucaagg

SEQ ID NO: 1042189 - RNA, 19 nt, Human
ucagcugccuaguaugugu

SEQ ID NO: 1042190 - RNA, 18 nt, Human
ucccgccgcgcaggcugg

SEQ ID NO: 1042191 - RNA, 19 nt, Human
ucuauacugcuauauaagg

SEQ ID NO: 1042192 - RNA, 20 nt, Human
ugauggcaaauucuuaaacu

SEQ ID NO: 1042193 - RNA, 19 nt, Human
ugcaacaaaacagaaauca

SEQ ID NO: 1042194 - RNA, 20 nt, Human
ugcgcagauacuucacaguu

SEQ ID NO: 1042195 - RNA, 21 nt, Human
ugggucacacuggauauucaa

SEQ ID NO: 1042196 - RNA, 23 nt, Human
uguagccaugacugcgcagauac

SEQ ID NO: 1042197 - RNA, 22 nt, Human
ugugagggcauuuccacucugg

SEQ ID NO: 1042198 - RNA, 23 nt, Human
ugugagggcauuuccacucuggg

SEQ ID NO: 1042199 - RNA, 18 nt, Human
ugugguucugaagaccuu

SEQ ID NO: 1042200 - RNA, 26 nt, Human
uucccgccgcgcaggcuggaccacag

SEQ ID NO: 1042201 - RNA, 20 nt, Human
uugcccauaguuuccaaagg

SEQ ID NO: 1042202 - RNA, 21 nt, Human
aaauccaccuccaccagggcc

SEQ ID NO: 1042203 - RNA, 21 nt, Human
aaauccaccuccaccagggcc

SEQ ID NO: 1042204 - RNA, 19 nt, Human
aacgagagccccucccaca

SEQ ID NO: 1042205 - RNA, 20 nt, Human
aagggcgccguccaggcagg

SEQ ID NO: 1042206 - RNA, 21 nt, Human
aauagagccagcugcuuggcg

SEQ ID NO: 1042207 - RNA, 20 nt, Human
aaugcucuguccugagccuc

SEQ ID NO: 1042208 - RNA, 19 nt, Human
aauguccacuagaaggugg

SEQ ID NO: 1042209 - RNA, 19 nt, Human
acacugauagugaggcugg

SEQ ID NO: 1042210 - RNA, 19 nt, Human
accaccucaaucccgagcc

SEQ ID NO: 1042211 - RNA, 22 nt, Human
acggagcugugugcacauggcc

SEQ ID NO: 1042212 - RNA, 19 nt, Human
agaaaauccaccuccacca

SEQ ID NO: 1042213 - RNA, 19 nt, Human
agaaaauccaccuccacca

SEQ ID NO: 1042214 - RNA, 24 nt, Human
agacaccaagggccccguagcccc

SEQ ID NO: 1042215 - RNA, 23 nt, Human
agaccaccaucacagacgugcga

SEQ ID NO: 1042216 - RNA, 18 nt, Human
agaccugccagccuccag

SEQ ID NO: 1042217 - RNA, 22 nt, Human
agcagugcugcuggaacaggcc

SEQ ID NO: 1042218 - RNA, 23 nt, Human
agccgguaccagugcucguggca

SEQ ID NO: 1042219 - RNA, 22 nt, Human
aggacuagaaacugagcaggac

SEQ ID NO: 1042220 - RNA, 23 nt, Human
aggcauuggcaguucuucagaag

SEQ ID NO: 1042221 - RNA, 21 nt, Human
agggaacuggagagcagaggg

SEQ ID NO: 1042222 - RNA, 21 nt, Human
agggaggggagaagacuguuu

SEQ ID NO: 1042223 - RNA, 23 nt, Human
aggggcucugaagugagcauugc

SEQ ID NO: 1042224 - RNA, 21 nt, Human
aggggcugggagggggugggg

SEQ ID NO: 1042225 - RNA, 18 nt, Human
aggugguguaggcugggc

SEQ ID NO: 1042226 - RNA, 22 nt, Human
aggugguguaggcugggcagag

SEQ ID NO: 1042227 - RNA, 18 nt, Human
augaucguccugacugau

SEQ ID NO: 1042228 - RNA, 19 nt, Human
auggagcugcagagcgggc

SEQ ID NO: 1042229 - RNA, 24 nt, Human
caaagugaggaauaccugucucuc

SEQ ID NO: 1042230 - RNA, 23 nt, Human
caaggccgaguccaaaagccaca

SEQ ID NO: 1042231 - RNA, 18 nt, Human
caagggccccguagcccc

SEQ ID NO: 1042232 - RNA, 21 nt, Human
cacagcccugccuggggcccu

SEQ ID NO: 1042233 - RNA, 24 nt, Human
cacagcccugccuggggcccugac

SEQ ID NO: 1042234 - RNA, 21 nt, Human
caccaagggccccguagcccc

SEQ ID NO: 1042235 - RNA, 20 nt, Human
caccuccaccagggccucca

SEQ ID NO: 1042236 - RNA, 21 nt, Human
caccuccaccagggccuccac

SEQ ID NO: 1042237 - RNA, 20 nt, Human
caccuccaccagggccugac

SEQ ID NO: 1042238 - RNA, 19 nt, Human
cagcagcaucugagcagcc

SEQ ID NO: 1042239 - RNA, 18 nt, Human
cagcagggagcccccguc

SEQ ID NO: 1042240 - RNA, 22 nt, Human
cagccaggcccaggucuagcca

SEQ ID NO: 1042241 - RNA, 20 nt, Human
caggcaccuggccaguucuc

SEQ ID NO: 1042242 - RNA, 18 nt, Human
caggccaccuggucucuc

SEQ ID NO: 1042243 - RNA, 18 nt, Human
caugacucagcccagcag

SEQ ID NO: 1042244 - RNA, 22 nt, Human
ccacagcagagccuggagacac

SEQ ID NO: 1042245 - RNA, 23 nt, Human
ccacagcagagccuggagacaca

SEQ ID NO: 1042246 - RNA, 18 nt, Human
ccaccagggccuccaccu

SEQ ID NO: 1042247 - RNA, 22 nt, Human
ccacgcaucuggcuucugugcc

SEQ ID NO: 1042248 - RNA, 18 nt, Human
ccacugggugggcaggag

SEQ ID NO: 1042249 - RNA, 23 nt, Human
ccagcagcaucugagcagccagg

SEQ ID NO: 1042250 - RNA, 18 nt, Human
ccagcagggccccagagu

SEQ ID NO: 1042251 - RNA, 23 nt, Human
ccagcaguccaagugcuagacgg

SEQ ID NO: 1042252 - RNA, 21 nt, Human
ccaggacucuggccucagcuc

SEQ ID NO: 1042253 - RNA, 18 nt, Human
ccaugcgugccugggaga

SEQ ID NO: 1042254 - RNA, 21 nt, Human
cccccaggucuccacugccac

SEQ ID NO: 1042255 - RNA, 25 nt, Human
cccccaggucuccacugccacaacc

SEQ ID NO: 1042256 - RNA, 24 nt, Human
ccccguagccccgugccaggacuc

SEQ ID NO: 1042257 - RNA, 23 nt, Human
ccccgugccaggacucuggccuc

SEQ ID NO: 1042258 - RNA, 18 nt, Human
ccccuggcuucggugugg

SEQ ID NO: 1042259 - RNA, 19 nt, Human
cccugaguccgaggcucug

SEQ ID NO: 1042260 - RNA, 20 nt, Human
cccugaguccgaggcucugg

SEQ ID NO: 1042261 - RNA, 18 nt, Human
cccuggaugugcggaugg

SEQ ID NO: 1042262 - RNA, 18 nt, Human
ccgcuggccaccccccag

SEQ ID NO: 1042263 - RNA, 18 nt, Human
ccgugcaggggcugggag

SEQ ID NO: 1042264 - RNA, 24 nt, Human
ccucuggccagaggugggugaggc

SEQ ID NO: 1042265 - RNA, 18 nt, Human
ccuggagacacagaggcu

SEQ ID NO: 1042266 - RNA, 19 nt, Human
ccugugcgaggccagggag

SEQ ID NO: 1042267 - RNA, 21 nt, Human
cgagcagagcggaaagugagc

SEQ ID NO: 1042268 - RNA, 25 nt, Human
cgcacggcucccacguggcuuccca

SEQ ID NO: 1042269 - RNA, 20 nt, Human
cgcagccuggugagaaugga

SEQ ID NO: 1042270 - RNA, 18 nt, Human
cggcauggguaagcuugg

SEQ ID NO: 1042271 - RNA, 24 nt, Human
cgguacaccacuggccucuccgau

SEQ ID NO: 1042272 - RNA, 27 nt, Human
cucacuuccaaaacuuccuugacugcu

SEQ ID NO: 1042273 - RNA, 20 nt, Human
cuccaaguaacgcagcugga

SEQ ID NO: 1042274 - RNA, 25 nt, Human
cuccacacuggugccaguuggcccc

SEQ ID NO: 1042275 - RNA, 21 nt, Human
cuccaccaccuccaucaggac

SEQ ID NO: 1042276 - RNA, 23 nt, Human
cuccugcccacaucuccugggcu

SEQ ID NO: 1042277 - RNA, 19 nt, Human
cucuccacacuggugccag

SEQ ID NO: 1042278 - RNA, 21 nt, Human
cugcagcccccgacucagcgg

SEQ ID NO: 1042279 - RNA, 20 nt, Human
cugcaguggcaccugggaga

SEQ ID NO: 1042280 - RNA, 26 nt, Human
cugcgucuugaaggggggagagaucu

SEQ ID NO: 1042281 - RNA, 21 nt, Human
cugcugggugcaggggggcag

SEQ ID NO: 1042282 - RNA, 27 nt, Human
cuggaacaggccaccuggucucucugu

SEQ ID NO: 1042283 - RNA, 22 nt, Human
cugggugcaggggggcagucca

SEQ ID NO: 1042284 - RNA, 21 nt, Human
gaaccccuggccugugcacag

SEQ ID NO: 1042285 - RNA, 18 nt, Human
gagcaggguuccagcagc

SEQ ID NO: 1042286 - RNA, 18 nt, Human
gagggcccuccggcgggg

SEQ ID NO: 1042287 - RNA, 19 nt, Human
gaguuuccugacugcugac

SEQ ID NO: 1042288 - RNA, 20 nt, Human
gcaaugcucuguccugagcc

SEQ ID NO: 1042289 - RNA, 18 nt, Human
gcaugcugcaggugggac

SEQ ID NO: 1042290 - RNA, 18 nt, Human
gccggaaaacagaacuca

SEQ ID NO: 1042291 - RNA, 21 nt, Human
gccggccccaguggccucccu

SEQ ID NO: 1042292 - RNA, 23 nt, Human
gcuccugcccacaucuccugggc

SEQ ID NO: 1042293 - RNA, 19 nt, Human
gcuggaggcaggagacgca

SEQ ID NO: 1042294 - RNA, 23 nt, Human
gcugggugcaggggggcagucca

SEQ ID NO: 1042295 - RNA, 22 nt, Human
ggaaaucaggggcagaggacac

SEQ ID NO: 1042296 - RNA, 19 nt, Human
ggagaagcgcaccugcucc

SEQ ID NO: 1042297 - RNA, 18 nt, Human
ggagacccugauguggug

SEQ ID NO: 1042298 - RNA, 19 nt, Human
ggagaugggaccucagucc

SEQ ID NO: 1042299 - RNA, 18 nt, Human
ggcgaggccgagccccuc

SEQ ID NO: 1042300 - RNA, 21 nt, Human
gggcagaggacacuguguucu

SEQ ID NO: 1042301 - RNA, 24 nt, Human
gggcaggaguggggcaggcgaggg

SEQ ID NO: 1042302 - RNA, 20 nt, Human
gggcaguccagggacugagc

SEQ ID NO: 1042303 - RNA, 21 nt, Human
gggcaguccagggacugagca

SEQ ID NO: 1042304 - RNA, 20 nt, Human
ggggaaagcuccugcccaca

SEQ ID NO: 1042305 - RNA, 20 nt, Human
gggugcugucucauggaugg

SEQ ID NO: 1042306 - RNA, 19 nt, Human
ggugcugucucauggaugg

SEQ ID NO: 1042307 - RNA, 20 nt, Human
gucacagcagugaaagacac

SEQ ID NO: 1042308 - RNA, 22 nt, Human
gucacagcagugaaagacacca

SEQ ID NO: 1042309 - RNA, 20 nt, Human
gugaucuuuggccuucaugg

SEQ ID NO: 1042310 - RNA, 21 nt, Human
gugcaggggcugggagggggu

SEQ ID NO: 1042311 - RNA, 20 nt, Human
gugcggcaucacuugcugcu

SEQ ID NO: 1042312 - RNA, 19 nt, Human
guggcggaggggcucugaa

SEQ ID NO: 1042313 - RNA, 23 nt, Human
guuucagguucuuuuuuucacag

SEQ ID NO: 1042314 - RNA, 20 nt, Human
uaaauaagcacaguggagac

SEQ ID NO: 1042315 - RNA, 19 nt, Human
uaccagugcucguggcagg

SEQ ID NO: 1042316 - RNA, 19 nt, Human
uagaaggacuuaaccucac

SEQ ID NO: 1042317 - RNA, 21 nt, Human
uagacggagagcugcucccau

SEQ ID NO: 1042318 - RNA, 20 nt, Human
ucacuuucagccagcagggc

SEQ ID NO: 1042319 - RNA, 20 nt, Human
ucauggcagcgagugcaggc

SEQ ID NO: 1042320 - RNA, 22 nt, Human
uccaaaaaaggaaaaagaaaca

SEQ ID NO: 1042321 - RNA, 22 nt, Human
uccaaaacuuccuugacugcuc

SEQ ID NO: 1042322 - RNA, 19 nt, Human
uccacacugauagugaggc

SEQ ID NO: 1042323 - RNA, 25 nt, Human
uccaccagggccuccaccaccucca

SEQ ID NO: 1042324 - RNA, 22 nt, Human
uccccugcaaugcucuguccug

SEQ ID NO: 1042325 - RNA, 21 nt, Human
ucccuccaggugcaaagcccc

SEQ ID NO: 1042326 - RNA, 22 nt, Human
ucccuccgugcaggggcuggga

SEQ ID NO: 1042327 - RNA, 24 nt, Human
ucccuccgugcaggggcugggagg

SEQ ID NO: 1042328 - RNA, 20 nt, Human
ucccugcaguggcaccuggg

SEQ ID NO: 1042329 - RNA, 19 nt, Human
uccugcccacaucuccugg

SEQ ID NO: 1042330 - RNA, 28 nt, Human
uccugcccacaucuccugggcucugcgg

SEQ ID NO: 1042331 - RNA, 22 nt, Human
uccugcuucuccaaguaacgca

SEQ ID NO: 1042332 - RNA, 18 nt, Human
ucucucugggcccccagc

SEQ ID NO: 1042333 - RNA, 20 nt, Human
ucugcagcccccgacucagc

SEQ ID NO: 1042334 - RNA, 21 nt, Human
ucugugccucuggugaccagg

SEQ ID NO: 1042335 - RNA, 19 nt, Human
ugaaagacaccaagggccc

SEQ ID NO: 1042336 - RNA, 20 nt, Human
ugaaagacaccaagggcccc

SEQ ID NO: 1042337 - RNA, 23 nt, Human
ugaagugagcauugcugaugccc

SEQ ID NO: 1042338 - RNA, 24 nt, Human
ugacauaaaaugugaagagggagu

SEQ ID NO: 1042339 - RNA, 22 nt, Human
ugacucccacuugcuguccaag

SEQ ID NO: 1042340 - RNA, 20 nt, Human
ugacugcucaggguucaggc

SEQ ID NO: 1042341 - RNA, 20 nt, Human
ugagcagccaggcccagguc

SEQ ID NO: 1042342 - RNA, 23 nt, Human
ugagcaggacugugccacgguga

SEQ ID NO: 1042343 - RNA, 20 nt, Human
ugagggaggugguguaggcu

SEQ ID NO: 1042344 - RNA, 19 nt, Human
ugauguggugguggucaag

SEQ ID NO: 1042345 - RNA, 24 nt, Human
ugccaggacucuggccucagcucc

SEQ ID NO: 1042346 - RNA, 28 nt, Human
ugccaggacucuggccucagcuccugca

SEQ ID NO: 1042347 - RNA, 19 nt, Human
ugccccgggugcugccgcg

SEQ ID NO: 1042348 - RNA, 22 nt, Human
ugccuggggcccugacacgcac

SEQ ID NO: 1042349 - RNA, 22 nt, Human
ugcucccagcaggcgcacacgu

SEQ ID NO: 1042350 - RNA, 18 nt, Human
ugcugccgcgggugcugc

SEQ ID NO: 1042351 - RNA, 20 nt, Human
ugcugggugcaggggggcag

SEQ ID NO: 1042352 - RNA, 19 nt, Human
uggaauggggcggcuuccu

SEQ ID NO: 1042353 - RNA, 19 nt, Human
uggagacccugauguggug

SEQ ID NO: 1042354 - RNA, 20 nt, Human
uggagagcagagggagagac

SEQ ID NO: 1042355 - RNA, 19 nt, Human
uggagccguguggcaacug

SEQ ID NO: 1042356 - RNA, 19 nt, Human
uggaugggcuugaguucug

SEQ ID NO: 1042357 - RNA, 19 nt, Human
uggcaggcaggagggccug

SEQ ID NO: 1042358 - RNA, 20 nt, Human
uggcaggcaggagggccugu

SEQ ID NO: 1042359 - RNA, 19 nt, Human
uggccaaggcccgcaggug

SEQ ID NO: 1042360 - RNA, 19 nt, Human
uggccacgcaucuggcuuc

SEQ ID NO: 1042361 - RNA, 22 nt, Human
uggccacgcaucuggcuucugu

SEQ ID NO: 1042362 - RNA, 18 nt, Human
uggcccaucgcuguagcu

SEQ ID NO: 1042363 - RNA, 21 nt, Human
uggcggaggggcucugaagug

SEQ ID NO: 1042364 - RNA, 18 nt, Human
ugggacaggaauuaccug

SEQ ID NO: 1042365 - RNA, 18 nt, Human
ugggaggggguggggcag

SEQ ID NO: 1042366 - RNA, 18 nt, Human
ugggcucugcggccugug

SEQ ID NO: 1042367 - RNA, 24 nt, Human
ugggugcaggggggcaguccaggg

SEQ ID NO: 1042368 - RNA, 21 nt, Human
ugggugcugucucauggaugg

SEQ ID NO: 1042369 - RNA, 19 nt, Human
uggucucucuguaccuguc

SEQ ID NO: 1042370 - RNA, 25 nt, Human
ugguggaauggggcggcuuccuuuu

SEQ ID NO: 1042371 - RNA, 19 nt, Human
uguagaaggacuuaaccuc

SEQ ID NO: 1042372 - RNA, 23 nt, Human
ugucucauggaugggcuugaguu

SEQ ID NO: 1042373 - RNA, 20 nt, Human
ugugaagggacucagacgca

SEQ ID NO: 1042374 - RNA, 25 nt, Human
ugugcacaggacauggagccgugug

SEQ ID NO: 1042375 - RNA, 21 nt, Human
ugugcacauggccacgucgug

SEQ ID NO: 1042376 - RNA, 20 nt, Human
ugugggugcacgugggcggc

SEQ ID NO: 1042377 - RNA, 19 nt, Human
uguggugguggucaagagc

SEQ ID NO: 1042378 - RNA, 22 nt, Human
uuacuggaaaagaggccacuuu

SEQ ID NO: 1042379 - RNA, 20 nt, Human
uucaugggucgggggcaggg

SEQ ID NO: 1042380 - RNA, 21 nt, Human
uucccggggggcacugugagg

SEQ ID NO: 1042381 - RNA, 23 nt, Human
uugcugcuuggcaggcaggaggg

SEQ ID NO: 1042382 - RNA, 23 nt, Human
uuguguccacaccagccuggguc

SEQ ID NO: 1042383 - RNA, 20 nt, Human
uuucauaucaggugggcuuc

SEQ ID NO: 1042384 - RNA, 22 nt, Human
uuuccagcgcuggccacggagc

SEQ ID NO: 1042385 - RNA, 18 nt, Human
uuuugcugcugauguggu

SEQ ID NO: 1042386 - RNA, 23 nt, Human
caggaagggcuggaggagaggcg

SEQ ID NO: 1042387 - RNA, 19 nt, Human
ggcuggaggagaggcgugg

SEQ ID NO: 1042388 - RNA, 25 nt, Human
ggcuggaggagaggcguggguccca

SEQ ID NO: 1042389 - RNA, 22 nt, Human
gggcuggaggagaggcgugggu

SEQ ID NO: 1042390 - RNA, 18 nt, Human
ucccugacauggcucugg

SEQ ID NO: 1042391 - RNA, 19 nt, Human
ugacauggcucuggaucuc

SEQ ID NO: 1042392 - RNA, 23 nt, Human
aacaguuuuccaaaauaagggca

SEQ ID NO: 1042393 - RNA, 26 nt, Human
uccaaaauaagggcacguggugagaa

SEQ ID NO: 1042394 - RNA, 18 nt, Human
ugaaaugaacaguuuucc

SEQ ID NO: 1042395 - RNA, 21 nt, Human
ugaaaugaacaguuuuccaaa

SEQ ID NO: 1042396 - RNA, 18 nt, Human
uggaagcuugccgauguu

SEQ ID NO: 1042397 - RNA, 23 nt, Human
uggugagaaauccuaaguccguu

SEQ ID NO: 1042398 - RNA, 18 nt, Human
uuccaaaauaagggcacg

SEQ ID NO: 1042399 - RNA, 19 nt, Human
aagggcgccuccuccuuga

SEQ ID NO: 1042400 - RNA, 22 nt, Human
cccgcgcggccaggggcgccuc

SEQ ID NO: 1042401 - RNA, 19 nt, Human
cgccuccuccuugaugccc

SEQ ID NO: 1042402 - RNA, 24 nt, Human
cugcccggggcggcggcugggcug

SEQ ID NO: 1042403 - RNA, 18 nt, Human
gccuccuccuugaugccc

SEQ ID NO: 1042404 - RNA, 20 nt, Human
ggcggcggcugggcuguccg

SEQ ID NO: 1042405 - RNA, 24 nt, Human
aaaaaaggaaaaagaaagacaaaa

SEQ ID NO: 1042406 - RNA, 25 nt, Human
aaaaagaaagacaaaggaaaaaaga

SEQ ID NO: 1042407 - RNA, 21 nt, Human
aaaaaggaaaaagaaagacaa

SEQ ID NO: 1042408 - RNA, 19 nt, Human
aaaaauuguaggaaagcag

SEQ ID NO: 1042409 - RNA, 21 nt, Human
aaaccaccaccaccgcaucca

SEQ ID NO: 1042410 - RNA, 21 nt, Human
aaaguucacaucugugaggug

SEQ ID NO: 1042411 - RNA, 19 nt, Human
aagaagaggcagggggucg

SEQ ID NO: 1042412 - RNA, 24 nt, Human
aagcagcagacuugaacuggagca

SEQ ID NO: 1042413 - RNA, 21 nt, Human
accaccaccaccgcauccaca

SEQ ID NO: 1042414 - RNA, 19 nt, Human
agacaaaggaaaaaagaaa

SEQ ID NO: 1042415 - RNA, 22 nt, Human
aggaaaaaagaaauauggaugg

SEQ ID NO: 1042416 - RNA, 21 nt, Human
aggaaaaagaaagacaaagga

SEQ ID NO: 1042417 - RNA, 20 nt, Human
aggcccaggacacuucacgg

SEQ ID NO: 1042418 - RNA, 19 nt, Human
caccaccgcauccacaggc

SEQ ID NO: 1042419 - RNA, 18 nt, Human
caccuuuuuuuuuuuucu

SEQ ID NO: 1042420 - RNA, 21 nt, Human
cacggaaaccaccaccaccgc

SEQ ID NO: 1042421 - RNA, 20 nt, Human
cacuucacggccaucacagc

SEQ ID NO: 1042422 - RNA, 25 nt, Human
ccacauguguguuucacacagaccu

SEQ ID NO: 1042423 - RNA, 18 nt, Human
ccaccaccaccgcaucca

SEQ ID NO: 1042424 - RNA, 23 nt, Human
ccaggacacuucacggccaucac

SEQ ID NO: 1042425 - RNA, 23 nt, Human
cccccacauguguguuucacaca

SEQ ID NO: 1042426 - RNA, 20 nt, Human
ccuaaagaaagacguggaac

SEQ ID NO: 1042427 - RNA, 20 nt, Human
cuggagcaauucuaacaagg

SEQ ID NO: 1042428 - RNA, 22 nt, Human
cuguacaaacuacauuuaaaau

SEQ ID NO: 1042429 - RNA, 23 nt, Human
gaaguccugccuggucccugccu

SEQ ID NO: 1042430 - RNA, 24 nt, Human
gaggguuuuucugaaguccugccu

SEQ ID NO: 1042431 - RNA, 21 nt, Human
gccuaaagaaagacguggaac

SEQ ID NO: 1042432 - RNA, 25 nt, Human
gcugucaccuuuuuuuuuuuucuuu

SEQ ID NO: 1042433 - RNA, 25 nt, Human
gcuuguuuauuugucagaggccucg

SEQ ID NO: 1042434 - RNA, 23 nt, Human
ggaaaaagaaagacaaaggaaaa

SEQ ID NO: 1042435 - RNA, 23 nt, Human
ggaaacuguaaggagacuguguc

SEQ ID NO: 1042436 - RNA, 18 nt, Human
ggaagaagaggcaggggg

SEQ ID NO: 1042437 - RNA, 18 nt, Human
gggggaaacaauagcagg

SEQ ID NO: 1042438 - RNA, 23 nt, Human
guuuguuuuguuuuuuuaaaaaa

SEQ ID NO: 1042439 - RNA, 23 nt, Human
uaaagaaagacguggaaccucca

SEQ ID NO: 1042440 - RNA, 22 nt, Human
uagcaggugaaacuauuguggg

SEQ ID NO: 1042441 - RNA, 23 nt, Human
ucacggaaaccaccaccaccgca

SEQ ID NO: 1042442 - RNA, 20 nt, Human
ucugaaguccugccuggucc

SEQ ID NO: 1042443 - RNA, 19 nt, Human
ugaguuauugguugugugu

SEQ ID NO: 1042444 - RNA, 20 nt, Human
ugcauuuccuaccuuuugac

SEQ ID NO: 1042445 - RNA, 19 nt, Human
ugccuaaagaaagacgugg

SEQ ID NO: 1042446 - RNA, 21 nt, Human
ugccuaaagaaagacguggaa

SEQ ID NO: 1042447 - RNA, 21 nt, Human
uggaagaagaggcaggggguc

SEQ ID NO: 1042448 - RNA, 22 nt, Human
uggcaaaacugaucaguuuuaa

SEQ ID NO: 1042449 - RNA, 19 nt, Human
uggcuuguuuauuugucag

SEQ ID NO: 1042450 - RNA, 24 nt, Human
uggcuuguuuauuugucagaggcc

SEQ ID NO: 1042451 - RNA, 22 nt, Human
ugguuugcugucccaacugcac

SEQ ID NO: 1042452 - RNA, 20 nt, Human
ugucagaggccucggaaggc

SEQ ID NO: 1042453 - RNA, 22 nt, Human
ugucccaacugcacauaaaugu

SEQ ID NO: 1042454 - RNA, 22 nt, Human
uguccugggugggggaaacaau

SEQ ID NO: 1042455 - RNA, 19 nt, Human
uguuuguuuuguuuuuuua

SEQ ID NO: 1042456 - RNA, 25 nt, Human
uuaauccagccucacccccacaugu

SEQ ID NO: 1042457 - RNA, 18 nt, Human
uucacggaaaccaccacc

SEQ ID NO: 1042458 - RNA, 18 nt, Human
uucacggaaaccaccacc

SEQ ID NO: 1042459 - RNA, 26 nt, Human
uucccauaugaauacagguguggucu

SEQ ID NO: 1042460 - RNA, 27 nt, Human
uugguuguguguguuuuccuuuuugca

SEQ ID NO: 1042461 - RNA, 20 nt, Human
uuugacauauauauauauau

SEQ ID NO: 1042462 - RNA, 24 nt, Human
uuuuccuuuuugcauaagaaauau

SEQ ID NO: 1042463 - RNA, 21 nt, Human
uuuugacauauauauauauau

SEQ ID NO: 1042464 - RNA, 18 nt, Human
uuuuguuuguuuuguuuu

SEQ ID NO: 1042465 - RNA, 21 nt, Human
uuuuguuuguuuuguuuuuuu

SEQ ID NO: 1042466 - RNA, 23 nt, Human
uuuuucuuuuuugcauuuccuac

SEQ ID NO: 1042467 - RNA, 24 nt, Human
uuuuuuuuuuucuuuuuugcauuu

SEQ ID NO: 1042468 - RNA, 21 nt, Human
uuuuuuuuuuuucuuuuuugg

SEQ ID NO: 1042469 - RNA, 19 nt, Human
agcgcagcucuaaaacacu

SEQ ID NO: 1042470 - RNA, 19 nt, Human
cagcgcaagaaguguccag

SEQ ID NO: 1042471 - RNA, 19 nt, Human
cagcuccugacuuggcacu

SEQ ID NO: 1042472 - RNA, 19 nt, Human
ccuuuaaaaugggaacaag

SEQ ID NO: 1042473 - RNA, 22 nt, Human
cgacagaagcagaugggccaaa

SEQ ID NO: 1042474 - RNA, 21 nt, Human
cuuggcacugaggcaccgaca

SEQ ID NO: 1042475 - RNA, 24 nt, Human
gaaccuggcagcacuucccuuuaa

SEQ ID NO: 1042476 - RNA, 22 nt, Human
gacagaagcagaugggccaaac

SEQ ID NO: 1042477 - RNA, 18 nt, Human
gaggcaccgacagaagca

SEQ ID NO: 1042478 - RNA, 22 nt, Human
ugaggaaccuggcagcacuucc

SEQ ID NO: 1042479 - RNA, 19 nt, Human
ugggaacaagcagcuccug

SEQ ID NO: 1042480 - RNA, 24 nt, Human
uucccuuuaaaaugggaacaagca

SEQ ID NO: 1042481 - RNA, 23 nt, Human
uuuaaaaugggaacaagcagcuc

SEQ ID NO: 1042482 - RNA, 23 nt, Human
uuuagaacugcagcgcaagaagu

SEQ ID NO: 1042483 - RNA, 19 nt, Human
aagccaaacauucuuucca

SEQ ID NO: 1042484 - RNA, 21 nt, Human
acacuaaaaaaaaaaaaaacc

SEQ ID NO: 1042485 - RNA, 20 nt, Human
acccuuaaauuaaagccaaa

SEQ ID NO: 1042486 - RNA, 20 nt, Human
accuuuuucccagcgcgggc

SEQ ID NO: 1042487 - RNA, 21 nt, Human
agccaaacauucuuuccaagg

SEQ ID NO: 1042488 - RNA, 21 nt, Human
cagcgcgggccuuggaacuuc

SEQ ID NO: 1042489 - RNA, 22 nt, Human
cagcgcgggccuuggaacuucc

SEQ ID NO: 1042490 - RNA, 19 nt, Human
ccccccaccuuuuucccag

SEQ ID NO: 1042491 - RNA, 21 nt, Human
ccccccaccuuuuucccagcg

SEQ ID NO: 1042492 - RNA, 18 nt, Human
cuuaaauuaaagccaaac

SEQ ID NO: 1042493 - RNA, 18 nt, Human
gugaaacaaaaucaugag

SEQ ID NO: 1042494 - RNA, 23 nt, Human
uaaagccaaacauucuuuccaag

SEQ ID NO: 1042495 - RNA, 22 nt, Human
uccagagucuguuuuugaaaca

SEQ ID NO: 1042496 - RNA, 19 nt, Human
uccccugguccccccaccu

SEQ ID NO: 1042497 - RNA, 19 nt, Human
ugaaacaaaaucaugaguc

SEQ ID NO: 1042498 - RNA, 23 nt, Human
uuccuuuccgcuguuacuuccgu

SEQ ID NO: 1042499 - RNA, 18 nt, Human
uugaggcaacaacugaag

SEQ ID NO: 1042500 - RNA, 18 nt, Human
aaaagaggagaucuuuaa

SEQ ID NO: 1042501 - RNA, 18 nt, Human
aaagcccaucuucacaag

SEQ ID NO: 1042502 - RNA, 23 nt, Human
aaagcccaucuucacaagagcuu

SEQ ID NO: 1042503 - RNA, 19 nt, Human
aagagcuuuguccucugcu

SEQ ID NO: 1042504 - RNA, 19 nt, Human
aaguuccaaagcagugugg

SEQ ID NO: 1042505 - RNA, 21 nt, Human
agaaaagcccaucuucacaag

SEQ ID NO: 1042506 - RNA, 21 nt, Human
caaaacacaaauauaaaugcu

SEQ ID NO: 1042507 - RNA, 22 nt, Human
caaaacuaaaacguuugagcaa

SEQ ID NO: 1042508 - RNA, 20 nt, Human
caaguuccaaagcagugugg

SEQ ID NO: 1042509 - RNA, 23 nt, Human
caaguuccaaagcaguguggaaa

SEQ ID NO: 1042510 - RNA, 24 nt, Human
cacaaaacuaaaacguuugagcaa

SEQ ID NO: 1042511 - RNA, 22 nt, Human
cagaagaaaagcccaucuucac

SEQ ID NO: 1042512 - RNA, 18 nt, Human
cagcuuaacugggaaaau

SEQ ID NO: 1042513 - RNA, 20 nt, Human
caucaucauccuccucaaca

SEQ ID NO: 1042514 - RNA, 23 nt, Human
ccaaagcaguguggaaagauguc

SEQ ID NO: 1042515 - RNA, 23 nt, Human
ccuccucaacaucauuauuacuu

SEQ ID NO: 1042516 - RNA, 20 nt, Human
ccuggcacaggugguuuuca

SEQ ID NO: 1042517 - RNA, 23 nt, Human
ccuugcucaggugguaagggcuc

SEQ ID NO: 1042518 - RNA, 18 nt, Human
cuacugcaaguuccaaag

SEQ ID NO: 1042519 - RNA, 23 nt, Human
cuccuuugcucagguguuaaggg

SEQ ID NO: 1042520 - RNA, 19 nt, Human
cucgcgccgccuucuccuc

SEQ ID NO: 1042521 - RNA, 20 nt, Human
cucgcgccgccuucuccucc

SEQ ID NO: 1042522 - RNA, 22 nt, Human
gaaaagcccaucuucacaagag

SEQ ID NO: 1042523 - RNA, 20 nt, Human
gucacuuaacccucucccca

SEQ ID NO: 1042524 - RNA, 20 nt, Human
uaugugcuuaagguaggugu

SEQ ID NO: 1042525 - RNA, 22 nt, Human
ugcaaguuccaaagcagugugg

SEQ ID NO: 1042526 - RNA, 19 nt, Human
ugggaaaaugugucccugg

SEQ ID NO: 1042527 - RNA, 21 nt, Human
uggggagggacggagcgggug

SEQ ID NO: 1042528 - RNA, 22 nt, Human
uugcucaggugguaagggcuca

SEQ ID NO: 1042529 - RNA, 20 nt, Human
uuuaaaagaggagaucuuua

SEQ ID NO: 1042530 - RNA, 21 nt, Human
uuugacacucuccuugcucag

SEQ ID NO: 1042531 - RNA, 24 nt, Human
uuuuacagguaccucaucauguua

SEQ ID NO: 1042532 - RNA, 26 nt, Human
uuuuacagguaccucaucauguuacc

SEQ ID NO: 1042533 - RNA, 21 nt, Human
uuuucagaagaaaagcccauc

SEQ ID NO: 1042534 - RNA, 21 nt, Human
uggaagccacuagcugcucuu

SEQ ID NO: 1042535 - RNA, 18 nt, Human
uguggaagccacuagcug

SEQ ID NO: 1042536 - RNA, 27 nt, Human
aaacagucaaagaaauugcagucuuca

SEQ ID NO: 1042537 - RNA, 18 nt, Human
aacacacucaccugccca

SEQ ID NO: 1042538 - RNA, 21 nt, Human
aacacgcuggaggcugcucuc

SEQ ID NO: 1042539 - RNA, 19 nt, Human
aaccagguacaagugcucu

SEQ ID NO: 1042540 - RNA, 21 nt, Human
aagcuuccagaacacgcugga

SEQ ID NO: 1042541 - RNA, 24 nt, Human
acacacaugcagacacucaugggc

SEQ ID NO: 1042542 - RNA, 19 nt, Human
acacgcuggaggcugcucu

SEQ ID NO: 1042543 - RNA, 18 nt, Human
acaggaaagaacagcugg

SEQ ID NO: 1042544 - RNA, 21 nt, Human
accacacucaccugugcacac

SEQ ID NO: 1042545 - RNA, 23 nt, Human
accagguacaagugcucucccau

SEQ ID NO: 1042546 - RNA, 21 nt, Human
accccagagagcacaggggaa

SEQ ID NO: 1042547 - RNA, 20 nt, Human
acccuaacccacauccccaa

SEQ ID NO: 1042548 - RNA, 21 nt, Human
acccuaacccacauccccaac

SEQ ID NO: 1042549 - RNA, 21 nt, Human
accugugcacacucacacaca

SEQ ID NO: 1042550 - RNA, 22 nt, Human
acucaccugugcacacucacac

SEQ ID NO: 1042551 - RNA, 22 nt, Human
acuccucaugagcacaccacac

SEQ ID NO: 1042552 - RNA, 23 nt, Human
acuccucaugagcacaccacacu

SEQ ID NO: 1042553 - RNA, 25 nt, Human
agaacacgcuggaggcugcucuccg

SEQ ID NO: 1042554 - RNA, 18 nt, Human
agaacggcaccccagaga

SEQ ID NO: 1042555 - RNA, 18 nt, Human
agaagaaauccagccaag

SEQ ID NO: 1042556 - RNA, 20 nt, Human
agaggcgcggaaaaccaaug

SEQ ID NO: 1042557 - RNA, 18 nt, Human
agcacaccacacucaccu

SEQ ID NO: 1042558 - RNA, 25 nt, Human
agcauguuuaaggccagagaguggc

SEQ ID NO: 1042559 - RNA, 22 nt, Human
aggaaagaacagcuggaacucg

SEQ ID NO: 1042560 - RNA, 20 nt, Human
aggccagagaguggcuacuu

SEQ ID NO: 1042561 - RNA, 20 nt, Human
aggcgacaggucagaggcca

SEQ ID NO: 1042562 - RNA, 22 nt, Human
aggcgacaggucagaggccagg

SEQ ID NO: 1042563 - RNA, 21 nt, Human
agggaggucuguaccuccucc

SEQ ID NO: 1042564 - RNA, 22 nt, Human
caaggcgacaggucagaggcca

SEQ ID NO: 1042565 - RNA, 23 nt, Human
caauguggagaccagaacggcac

SEQ ID NO: 1042566 - RNA, 20 nt, Human
cacaauguggagaccagaac

SEQ ID NO: 1042567 - RNA, 23 nt, Human
cacacaaucacauacacaugccc

SEQ ID NO: 1042568 - RNA, 21 nt, Human
cacaccacacucaccugugca

SEQ ID NO: 1042569 - RNA, 28 nt, Human
cacaggcauacacaucauuuguaugcac

SEQ ID NO: 1042570 - RNA, 21 nt, Human
cacagguccucgcagaggucc

SEQ ID NO: 1042571 - RNA, 24 nt, Human
cacaugcucacaugcucauuugca

SEQ ID NO: 1042572 - RNA, 18 nt, Human
cacccuaacccacauccc

SEQ ID NO: 1042573 - RNA, 20 nt, Human
cacccuaacccacaucccca

SEQ ID NO: 1042574 - RNA, 22 nt, Human
caccugcccacacucacacaau

SEQ ID NO: 1042575 - RNA, 19 nt, Human
cacucacacaugcucacau

SEQ ID NO: 1042576 - RNA, 18 nt, Human
cacuccccacccuaaccc

SEQ ID NO: 1042577 - RNA, 24 nt, Human
cagaggccagggugggacgagagc

SEQ ID NO: 1042578 - RNA, 19 nt, Human
cagcacccagcccgcgguc

SEQ ID NO: 1042579 - RNA, 22 nt, Human
cagcacccagcccgcgguccac

SEQ ID NO: 1042580 - RNA, 23 nt, Human
cagcagcgcggccgccagcaccc

SEQ ID NO: 1042581 - RNA, 20 nt, Human
caggcauacacaucauuugu

SEQ ID NO: 1042582 - RNA, 26 nt, Human
cauacacaugcccacacuuauauaca

SEQ ID NO: 1042583 - RNA, 26 nt, Human
cauccccaacacacucaccugcccac

SEQ ID NO: 1042584 - RNA, 18 nt, Human
ccacccuaacccacaucc

SEQ ID NO: 1042585 - RNA, 21 nt, Human
ccacuccccacccuaacccac

SEQ ID NO: 1042586 - RNA, 25 nt, Human
ccagaacggcaccccagagagcaca

SEQ ID NO: 1042587 - RNA, 22 nt, Human
ccaggaugcgccggcucuucuc

SEQ ID NO: 1042588 - RNA, 20 nt, Human
cccacacucacacaaucaca

SEQ ID NO: 1042589 - RNA, 22 nt, Human
cccacccuaacccacaucccca

SEQ ID NO: 1042590 - RNA, 20 nt, Human
ccccaacacacucaccugcc

SEQ ID NO: 1042591 - RNA, 25 nt, Human
ccccacccuaacccacauccccaac

SEQ ID NO: 1042592 - RNA, 24 nt, Human
ccccagagagcacaggggaaaugg

SEQ ID NO: 1042593 - RNA, 19 nt, Human
ccccgcgcgcccgccgccc

SEQ ID NO: 1042594 - RNA, 20 nt, Human
ccccggccagcgugccgccc

SEQ ID NO: 1042595 - RNA, 20 nt, Human
cccggccagcgugccgcccu

SEQ ID NO: 1042596 - RNA, 18 nt, Human
ccgcgccagucggccugc

SEQ ID NO: 1042597 - RNA, 19 nt, Human
ccgcgccagucggccugca

SEQ ID NO: 1042598 - RNA, 21 nt, Human
ccuccccugccuccucuucca

SEQ ID NO: 1042599 - RNA, 20 nt, Human
ccugcaccacccggcagggc

SEQ ID NO: 1042600 - RNA, 21 nt, Human
ccugcagcaccuucuugccuc

SEQ ID NO: 1042601 - RNA, 24 nt, Human
ccugugcacacucaccugugcaca

SEQ ID NO: 1042602 - RNA, 19 nt, Human
cgcccugguaguccuggca

SEQ ID NO: 1042603 - RNA, 18 nt, Human
cgcggcgaaggcgaggag

SEQ ID NO: 1042604 - RNA, 26 nt, Human
cggcaccccagagagcacaggggaaa

SEQ ID NO: 1042605 - RNA, 22 nt, Human
cuaacccacauccccaacacac

SEQ ID NO: 1042606 - RNA, 28 nt, Human
cuaacccacauccccaacacacucaccu

SEQ ID NO: 1042607 - RNA, 21 nt, Human
cucacacaaucacauacacau

SEQ ID NO: 1042608 - RNA, 21 nt, Human
cucacacacaugcagacacuc

SEQ ID NO: 1042609 - RNA, 23 nt, Human
cucaugagcacaccacacucacc

SEQ ID NO: 1042610 - RNA, 22 nt, Human
cucccucaucucauuuuacaca

SEQ ID NO: 1042611 - RNA, 23 nt, Human
cucccucaucucauuuuacacaa

SEQ ID NO: 1042612 - RNA, 22 nt, Human
cugaagcuggaaagagaccgca

SEQ ID NO: 1042613 - RNA, 24 nt, Human
cugcagcucccucaguguggcuug

SEQ ID NO: 1042614 - RNA, 21 nt, Human
cuggaaagagaccgcagagcc

SEQ ID NO: 1042615 - RNA, 21 nt, Human
cuguaacugcagcugaagcug

SEQ ID NO: 1042616 - RNA, 19 nt, Human
cuucucugccuccugcagc

SEQ ID NO: 1042617 - RNA, 22 nt, Human
cuuuaaaacaauggcagaagaa

SEQ ID NO: 1042618 - RNA, 21 nt, Human
gaacggcaccccagagagcac

SEQ ID NO: 1042619 - RNA, 26 nt, Human
gaagcuuccagaacacgcuggaggcu

SEQ ID NO: 1042620 - RNA, 18 nt, Human
gagcagcagcgcggccgc

SEQ ID NO: 1042621 - RNA, 18 nt, Human
gaggggcgggaagcugga

SEQ ID NO: 1042622 - RNA, 20 nt, Human
gcagcaccuucuugccucug

SEQ ID NO: 1042623 - RNA, 21 nt, Human
gcccgcgccuccugcaccacc

SEQ ID NO: 1042624 - RNA, 19 nt, Human
gcccugguaguccuggcac

SEQ ID NO: 1042625 - RNA, 18 nt, Human
gccgccagcacccagccc

SEQ ID NO: 1042626 - RNA, 18 nt, Human
gcuacuucucugccuccu

SEQ ID NO: 1042627 - RNA, 18 nt, Human
ggaagcuggagaaggccu

SEQ ID NO: 1042628 - RNA, 21 nt, Human
ggcauacacaucauuuguaug

SEQ ID NO: 1042629 - RNA, 18 nt, Human
ggcgggaagcuggagaag

SEQ ID NO: 1042630 - RNA, 20 nt, Human
gggaggucuguaccuccucc

SEQ ID NO: 1042631 - RNA, 26 nt, Human
ggggaccccagggucugcacauuccu

SEQ ID NO: 1042632 - RNA, 21 nt, Human
gguaacgauuuacaggaaaga

SEQ ID NO: 1042633 - RNA, 18 nt, Human
uaaccagguacaagugcu

SEQ ID NO: 1042634 - RNA, 23 nt, Human
uaacccacauccccaacacacuc

SEQ ID NO: 1042635 - RNA, 23 nt, Human
uaacugcagcugaagcuggaaag

SEQ ID NO: 1042636 - RNA, 24 nt, Human
uauacacaugcugacacccgugca

SEQ ID NO: 1042637 - RNA, 26 nt, Human
uauauacacaugcugacacccgugca

SEQ ID NO: 1042638 - RNA, 23 nt, Human
ucacaugcucauuugcacccaga

SEQ ID NO: 1042639 - RNA, 19 nt, Human
ucccacuggggaccccagg

SEQ ID NO: 1042640 - RNA, 24 nt, Human
uccccaacacacucaccugcccac

SEQ ID NO: 1042641 - RNA, 22 nt, Human
uccccacccuaacccacauccc

SEQ ID NO: 1042642 - RNA, 21 nt, Human
uccucuuccaacaggcugagg

SEQ ID NO: 1042643 - RNA, 23 nt, Human
uccuuggacuugaggaccacggg

SEQ ID NO: 1042644 - RNA, 25 nt, Human
ucucuggcagcagcacuugccacuc

SEQ ID NO: 1042645 - RNA, 19 nt, Human
ugaaaaacagucaaagaaa

SEQ ID NO: 1042646 - RNA, 22 nt, Human
ugaaaaacagucaaagaaauug

SEQ ID NO: 1042647 - RNA, 23 nt, Human
ugaagcuggaaagagaccgcaga

SEQ ID NO: 1042648 - RNA, 25 nt, Human
ugcacacucacacacaugcagacac

SEQ ID NO: 1042649 - RNA, 19 nt, Human
ugcaggcagcguuggaaca

SEQ ID NO: 1042650 - RNA, 25 nt, Human
ugcccacacuuauauacacaugcug

SEQ ID NO: 1042651 - RNA, 22 nt, Human
ugcuagguaggcaagauguucc

SEQ ID NO: 1042652 - RNA, 21 nt, Human
uggagaccagaacggcacccc

SEQ ID NO: 1042653 - RNA, 21 nt, Human
uggccacccuccccugccucc

SEQ ID NO: 1042654 - RNA, 18 nt, Human
ugggauaaccagguacaa

SEQ ID NO: 1042655 - RNA, 21 nt, Human
ugggauaaccagguacaagug

SEQ ID NO: 1042656 - RNA, 21 nt, Human
uguaccuccucccucaucuca

SEQ ID NO: 1042657 - RNA, 22 nt, Human
ugugcacacucacacacaugca

SEQ ID NO: 1042658 - RNA, 25 nt, Human
ugugcacacucacacacaugcagac

SEQ ID NO: 1042659 - RNA, 20 nt, Human
ugugcacacucaccugugca

SEQ ID NO: 1042660 - RNA, 19 nt, Human
ugugcaguuuugcucaagg

SEQ ID NO: 1042661 - RNA, 24 nt, Human
uuaacgugguaacgauuuacagga

SEQ ID NO: 1042662 - RNA, 23 nt, Human
uucaucuccugugcaguuuugcu

SEQ ID NO: 1042663 - RNA, 18 nt, Human
uuuaaggccagagagugg

SEQ ID NO: 1042664 - RNA, 20 nt, Human
uuuacaggaaagaacagcug

SEQ ID NO: 1042665 - RNA, 23 nt, Human
aaaagccguuccuuuauucugcc

SEQ ID NO: 1042666 - RNA, 21 nt, Human
aaccuccucccuccagaccuc

SEQ ID NO: 1042667 - RNA, 27 nt, Human
aaccugucuucccagagaccucccccg

SEQ ID NO: 1042668 - RNA, 20 nt, Human
aauguccuccccagacaccc

SEQ ID NO: 1042669 - RNA, 19 nt, Human
accccccucccucaacaac

SEQ ID NO: 1042670 - RNA, 25 nt, Human
accccgaggcccccagcugaggagc

SEQ ID NO: 1042671 - RNA, 18 nt, Human
acuccugccugagguccc

SEQ ID NO: 1042672 - RNA, 27 nt, Human
agacaccccuccacacaggcccaccuu

SEQ ID NO: 1042673 - RNA, 22 nt, Human
agccgaacgcccuuucagccca

SEQ ID NO: 1042674 - RNA, 20 nt, Human
cacacaggcccaccuaagug

SEQ ID NO: 1042675 - RNA, 20 nt, Human
caccccuccacacaggccca

SEQ ID NO: 1042676 - RNA, 21 nt, Human
cagcccagccuguucaauguc

SEQ ID NO: 1042677 - RNA, 23 nt, Human
cagccuguucaauguccucccca

SEQ ID NO: 1042678 - RNA, 26 nt, Human
caggaugggcccaggccuuuccuacc

SEQ ID NO: 1042679 - RNA, 21 nt, Human
ccaccuaagugacucacaccc

SEQ ID NO: 1042680 - RNA, 22 nt, Human
ccagacaccccuccacacaggc

SEQ ID NO: 1042681 - RNA, 24 nt, Human
ccagagaccucccccgacagccga

SEQ ID NO: 1042682 - RNA, 22 nt, Human
cccagccuguucaauguccucc

SEQ ID NO: 1042683 - RNA, 22 nt, Human
cccuccacacaggcccaccuaa

SEQ ID NO: 1042684 - RNA, 19 nt, Human
cccuuucagcccagccugu

SEQ ID NO: 1042685 - RNA, 19 nt, Human
ccuccucccuccagaccuc

SEQ ID NO: 1042686 - RNA, 22 nt, Human
ccucugagaccuucaccacagg

SEQ ID NO: 1042687 - RNA, 22 nt, Human
ccugaggauccacaaccuccuc

SEQ ID NO: 1042688 - RNA, 19 nt, Human
ccuggagaccccccucccu

SEQ ID NO: 1042689 - RNA, 21 nt, Human
ccuggagaccccccucccuca

SEQ ID NO: 1042690 - RNA, 26 nt, Human
ccuggagaccccccucccucaacaac

SEQ ID NO: 1042691 - RNA, 19 nt, Human
cuccacacaggcccaccuu

SEQ ID NO: 1042692 - RNA, 20 nt, Human
cucccccgacagccgaacgc

SEQ ID NO: 1042693 - RNA, 21 nt, Human
cugaggcugcagccgggggcc

SEQ ID NO: 1042694 - RNA, 20 nt, Human
cuggagaccccccucccuca

SEQ ID NO: 1042695 - RNA, 21 nt, Human
cuggagaccccccucccucaa

SEQ ID NO: 1042696 - RNA, 19 nt, Human
gauccacaaccuccucccu

SEQ ID NO: 1042697 - RNA, 23 nt, Human
gauccacaaccuccucccuccag

SEQ ID NO: 1042698 - RNA, 19 nt, Human
gcccccagcugaggagccc

SEQ ID NO: 1042699 - RNA, 21 nt, Human
gcccccagcugaggagcccgc

SEQ ID NO: 1042700 - RNA, 23 nt, Human
gcugcagccgggggccacaaggg

SEQ ID NO: 1042701 - RNA, 20 nt, Human
ggagaccuugagacuucccc

SEQ ID NO: 1042702 - RNA, 19 nt, Human
ggcaggaugggcccaggcc

SEQ ID NO: 1042703 - RNA, 24 nt, Human
ggcugcagccgggggccacaaggg

SEQ ID NO: 1042704 - RNA, 18 nt, Human
gggcaggaugggcccagg

SEQ ID NO: 1042705 - RNA, 23 nt, Human
gggcaggaugggcccaggccuuu

SEQ ID NO: 1042706 - RNA, 18 nt, Human
uaccccgaggcccccagc

SEQ ID NO: 1042707 - RNA, 20 nt, Human
uccacaaccuccucccucca

SEQ ID NO: 1042708 - RNA, 24 nt, Human
uccacaaccuccucccuccagacc

SEQ ID NO: 1042709 - RNA, 30 nt, Human
uccccagacaccccuccacacaggcccacu

SEQ ID NO: 1042710 - RNA, 19 nt, Human
uccccugguacuccugccu

SEQ ID NO: 1042711 - RNA, 23 nt, Human
uccccugguacuccugccugagg

SEQ ID NO: 1042712 - RNA, 19 nt, Human
ucccuccagaccucguucc

SEQ ID NO: 1042713 - RNA, 20 nt, Human
uccugccugaggucccugcu

SEQ ID NO: 1042714 - RNA, 21 nt, Human
ugaggucccugcuucugggga

SEQ ID NO: 1042715 - RNA, 22 nt, Human
ugcccuagggcuccuuagacac

SEQ ID NO: 1042716 - RNA, 23 nt, Human
uguccuccccagacaccccucca

SEQ ID NO: 1042717 - RNA, 28 nt, Human
uucagcccagccuguucaauguccuccu

SEQ ID NO: 1042718 - RNA, 22 nt, Human
uuccuccacacuccuccccugg

SEQ ID NO: 1042719 - RNA, 23 nt, Human
uuugcugugaggaaccugucuuc

SEQ ID NO: 1042720 - RNA, 19 nt, Human
ccuggguuaauuuugccaa

SEQ ID NO: 1042721 - RNA, 22 nt, Human
aaguauaugauggcauugaagg

SEQ ID NO: 1042722 - RNA, 19 nt, Human
caguaugaauucucugaug

SEQ ID NO: 1042723 - RNA, 21 nt, Human
cauaggaugaagcuugacuga

SEQ ID NO: 1042724 - RNA, 19 nt, Human
cucuccuguaugaauucua

SEQ ID NO: 1042725 - RNA, 23 nt, Human
gaacaugaaguaaaggcuuugcc

SEQ ID NO: 1042726 - RNA, 24 nt, Human
gaaguauaugauggcauugaaggg

SEQ ID NO: 1042727 - RNA, 18 nt, Human
gaccacagagugaagacc

SEQ ID NO: 1042728 - RNA, 18 nt, Human
ugaaguaaaggcuuugcc

SEQ ID NO: 1042729 - RNA, 20 nt, Human
ugcauggaaugaccacagag

SEQ ID NO: 1042730 - RNA, 18 nt, Human
ugucacagucaugauauu

SEQ ID NO: 1042731 - RNA, 22 nt, Human
ugucacauucuucacauuugua

SEQ ID NO: 1042732 - RNA, 19 nt, Human
uguccaguaugaauucucu

SEQ ID NO: 1042733 - RNA, 21 nt, Human
ugugagguuucucuccuguau

SEQ ID NO: 1042734 - RNA, 19 nt, Human
uuuguaagguuucucucca

SEQ ID NO: 1042735 - RNA, 19 nt, Human
uuuguaagguuucucucca

SEQ ID NO: 1042736 - RNA, 23 nt, Human
auaaaguuucucuccaaugugaa

SEQ ID NO: 1042737 - RNA, 19 nt, Human
caaugugaauuuuccagug

SEQ ID NO: 1042738 - RNA, 24 nt, Human
caguguauaauaaggugugcuuuu

SEQ ID NO: 1042739 - RNA, 22 nt, Human
aaagacguuggcugaacugaag

SEQ ID NO: 1042740 - RNA, 22 nt, Human
aacacagaugaaguagugaccc

SEQ ID NO: 1042741 - RNA, 24 nt, Human
aacuacaaccacuaccacaaaacc

SEQ ID NO: 1042742 - RNA, 19 nt, Human
aagcagccuccaaggucac

SEQ ID NO: 1042743 - RNA, 19 nt, Human
aagccucuaucaucuggaa

SEQ ID NO: 1042744 - RNA, 26 nt, Human
acacagcacugccucugccacacccu

SEQ ID NO: 1042745 - RNA, 19 nt, Human
auggaaaaccuggguacua

SEQ ID NO: 1042746 - RNA, 24 nt, Human
caacacagaugaaguagugaccuu

SEQ ID NO: 1042747 - RNA, 23 nt, Human
caaccacuaccacaaaaccaccc

SEQ ID NO: 1042748 - RNA, 27 nt, Human
cacuaccacaaaaccacccauuuguca

SEQ ID NO: 1042749 - RNA, 21 nt, Human
caucccaauuagaauuuccuu

SEQ ID NO: 1042750 - RNA, 21 nt, Human
ccacuaccacaaaaccaccca

SEQ ID NO: 1042751 - RNA, 22 nt, Human
ccagucuggaauaagcagccuc

SEQ ID NO: 1042752 - RNA, 19 nt, Human
cccacaggcugaguaagcc

SEQ ID NO: 1042753 - RNA, 21 nt, Human
ccuccacgauucugggguaag

SEQ ID NO: 1042754 - RNA, 20 nt, Human
ccucccacaggcugaguaag

SEQ ID NO: 1042755 - RNA, 25 nt, Human
ccuugccuggcacacuucagugcug

SEQ ID NO: 1042756 - RNA, 23 nt, Human
cuagaacucaaucacaugggcac

SEQ ID NO: 1042757 - RNA, 23 nt, Human
cugggguaagaaccugugucagg

SEQ ID NO: 1042758 - RNA, 23 nt, Human
cuuauuugcaaggaaauggaacc

SEQ ID NO: 1042759 - RNA, 22 nt, Human
cuucacugagggaaacaucuuc

SEQ ID NO: 1042760 - RNA, 23 nt, Human
cuuccuggacacacccuuuaaug

SEQ ID NO: 1042761 - RNA, 19 nt, Human
gaaaugccugcccacucuu

SEQ ID NO: 1042762 - RNA, 21 nt, Human
gagaagccugaggauguuugu

SEQ ID NO: 1042763 - RNA, 20 nt, Human
gagaaucucauggaaaaccu

SEQ ID NO: 1042764 - RNA, 23 nt, Human
gcagggauagagaagccugagga

SEQ ID NO: 1042765 - RNA, 18 nt, Human
gcuuuccuccacgauucu

SEQ ID NO: 1042766 - RNA, 18 nt, Human
gucaccuuggcagggaua

SEQ ID NO: 1042767 - RNA, 20 nt, Human
uaacuacaaccacuaccaca

SEQ ID NO: 1042768 - RNA, 21 nt, Human
uagacuucuuauuugcaagga

SEQ ID NO: 1042769 - RNA, 22 nt, Human
ucaaaugccacuucuauggagc

SEQ ID NO: 1042770 - RNA, 27 nt, Human
ucaacccagucuggaauaagcagccuc

SEQ ID NO: 1042771 - RNA, 18 nt, Human
ucacacuccauuggcuag

SEQ ID NO: 1042772 - RNA, 24 nt, Human
ucacaugggcacacucuuaacugc

SEQ ID NO: 1042773 - RNA, 19 nt, Human
ucagugcugcaggcugaca

SEQ ID NO: 1042774 - RNA, 22 nt, Human
uccaacacagaugaaguaguga

SEQ ID NO: 1042775 - RNA, 24 nt, Human
ucccacaggcugaguaagccucua

SEQ ID NO: 1042776 - RNA, 21 nt, Human
ucuggaauaagcagccuccaa

SEQ ID NO: 1042777 - RNA, 22 nt, Human
ucugggguaagaaccuguguca

SEQ ID NO: 1042778 - RNA, 24 nt, Human
ucuuuugcuccccuagcccuccca

SEQ ID NO: 1042779 - RNA, 19 nt, Human
ugccugcccacucuucacu

SEQ ID NO: 1042780 - RNA, 24 nt, Human
uggaauaagcagccuccaagguca

SEQ ID NO: 1042781 - RNA, 19 nt, Human
uggcuagaacucaaucaca

SEQ ID NO: 1042782 - RNA, 19 nt, Human
uggcugaacugaagaccuu

SEQ ID NO: 1042783 - RNA, 23 nt, Human
ugugauaaacacagcacugccuc

SEQ ID NO: 1042784 - RNA, 23 nt, Human
aaccccggcccuucccacuucac

SEQ ID NO: 1042785 - RNA, 25 nt, Human
aagauaucuguccccagcccuagcc

SEQ ID NO: 1042786 - RNA, 24 nt, Human
accaugaaaaguacuuuauugagg

SEQ ID NO: 1042787 - RNA, 24 nt, Human
caauggcuucuuuuccgcggugac

SEQ ID NO: 1042788 - RNA, 19 nt, Human
ccccagcccuagccucagc

SEQ ID NO: 1042789 - RNA, 24 nt, Human
ccccagcccuagccucagccucuc

SEQ ID NO: 1042790 - RNA, 23 nt, Human
cuguccccagcccuagccucagc

SEQ ID NO: 1042791 - RNA, 20 nt, Human
cuguggggcgcaauggcuuc

SEQ ID NO: 1042792 - RNA, 24 nt, Human
cuguggggcgcaauggcuucuuuu

SEQ ID NO: 1042793 - RNA, 18 nt, Human
gccccaacgaaccccggc

SEQ ID NO: 1042794 - RNA, 24 nt, Human
uaucuguccccagcccuagccuca

SEQ ID NO: 1042795 - RNA, 21 nt, Human
ucucgccccaacgaaccccgg

SEQ ID NO: 1042796 - RNA, 18 nt, Human
cagcagcagggugagacu

SEQ ID NO: 1042797 - RNA, 18 nt, Human
cagcuggaaucuccggga

SEQ ID NO: 1042798 - RNA, 22 nt, Human
cugcagaaccuggaucuugcgc

SEQ ID NO: 1042799 - RNA, 20 nt, Human
gagcagcagcagggugagac

SEQ ID NO: 1042800 - RNA, 19 nt, Human
gggaagagggaggagcagc

SEQ ID NO: 1042801 - RNA, 23 nt, Human
ugcucagccucuagcccagcugg

SEQ ID NO: 1042802 - RNA, 24 nt, Human
uuaaagacauuaugcauugugcuc

SEQ ID NO: 1042803 - RNA, 21 nt, Human
aagauucuccacucucugccc

SEQ ID NO: 1042804 - RNA, 23 nt, Human
accaagauucuccacucucugcc

SEQ ID NO: 1042805 - RNA, 21 nt, Human
acgcaacacaaccagaaagaa

SEQ ID NO: 1042806 - RNA, 20 nt, Human
agguccccaagccuccugcc

SEQ ID NO: 1042807 - RNA, 20 nt, Human
ccaggaaggggaaggguucc

SEQ ID NO: 1042808 - RNA, 18 nt, Human
ccccaagccuccugccug

SEQ ID NO: 1042809 - RNA, 27 nt, Human
cccuggaagguccccaagccuccugcc

SEQ ID NO: 1042810 - RNA, 22 nt, Human
ccucauccaccaagauucucca

SEQ ID NO: 1042811 - RNA, 22 nt, Human
cgcccgaagagcgguggccagg

SEQ ID NO: 1042812 - RNA, 21 nt, Human
cuccugccgccgccgcagccu

SEQ ID NO: 1042813 - RNA, 21 nt, Human
gguccccaagccuccugccug

SEQ ID NO: 1042814 - RNA, 19 nt, Human
uccccaagccuccugccug

SEQ ID NO: 1042815 - RNA, 20 nt, Human
uccccaagccuccugccugc

SEQ ID NO: 1042816 - RNA, 19 nt, Human
ucucguccuacgauccccc

SEQ ID NO: 1042817 - RNA, 22 nt, Human
ugccgccgccgcagccucaucc

SEQ ID NO: 1042818 - RNA, 21 nt, Human
ugcuccugccgccgccgcagc

SEQ ID NO: 1042819 - RNA, 18 nt, Human
uggccaggaaggggaagg

SEQ ID NO: 1042820 - RNA, 21 nt, Human
uggccaggaaggggaaggguu

SEQ ID NO: 1042821 - RNA, 18 nt, Human
aaggcugucugggaaaug

SEQ ID NO: 1042822 - RNA, 25 nt, Human
agagaagggcugcggucucgcagcg

SEQ ID NO: 1042823 - RNA, 22 nt, Human
ccucggaguggggucccagucc

SEQ ID NO: 1042824 - RNA, 24 nt, Human
ccugucgcggcgccgcagaggcug

SEQ ID NO: 1042825 - RNA, 18 nt, Human
cgcaagguccucugggag

SEQ ID NO: 1042826 - RNA, 23 nt, Human
cggaguggggucccaguccggag

SEQ ID NO: 1042827 - RNA, 18 nt, Human
cgggagcugcccucggag

SEQ ID NO: 1042828 - RNA, 20 nt, Human
cggggcaggcggccccugcu

SEQ ID NO: 1042829 - RNA, 22 nt, Human
cucgcccgccgcuuccugucgc

SEQ ID NO: 1042830 - RNA, 21 nt, Human
cucugagacuccagagaaggg

SEQ ID NO: 1042831 - RNA, 21 nt, Human
gaaaacaagucagagcccgag

SEQ ID NO: 1042832 - RNA, 18 nt, Human
gcagcggagggccgcugg

SEQ ID NO: 1042833 - RNA, 20 nt, Human
gcggcgccgcagaggccucu

SEQ ID NO: 1042834 - RNA, 21 nt, Human
gcucugagacuccagagaagg

SEQ ID NO: 1042835 - RNA, 21 nt, Human
ggccgggagcugcccucggag

SEQ ID NO: 1042836 - RNA, 23 nt, Human
ggggucccaguccggagucuuca

SEQ ID NO: 1042837 - RNA, 19 nt, Human
ucaggucaguggcagcccu

SEQ ID NO: 1042838 - RNA, 23 nt, Human
uccggagucuucaggucaguggc

SEQ ID NO: 1042839 - RNA, 23 nt, Human
ugaagccugaaggugacccgaaa

SEQ ID NO: 1042840 - RNA, 19 nt, Human
ugacccgaaaacaagucag

SEQ ID NO: 1042841 - RNA, 20 nt, Human
ugccuggcugaagccugaag

SEQ ID NO: 1042842 - RNA, 21 nt, Human
uggugucuugcggcucugaga

SEQ ID NO: 1042843 - RNA, 19 nt, Human
caggaaccgcagcagucug

SEQ ID NO: 1042844 - RNA, 19 nt, Human
ccgcagcagucugcucggc

SEQ ID NO: 1042845 - RNA, 20 nt, Human
agccuccggcaaguacccca

SEQ ID NO: 1042846 - RNA, 23 nt, Human
cagaaguacucacacuccaccac

SEQ ID NO: 1042847 - RNA, 18 nt, Human
ccccagaaguacucacac

SEQ ID NO: 1042848 - RNA, 21 nt, Human
ccccagaaguacucacacucc

SEQ ID NO: 1042849 - RNA, 24 nt, Human
ccccagaaguacucacacuccacc

SEQ ID NO: 1042850 - RNA, 23 nt, Human
cccuccacaaauccccagccucc

SEQ ID NO: 1042851 - RNA, 19 nt, Human
ccuccggcaaguaccccag

SEQ ID NO: 1042852 - RNA, 22 nt, Human
cucgagggugguggucuucccu

SEQ ID NO: 1042853 - RNA, 19 nt, Human
ggucuucccuccacaaauc

SEQ ID NO: 1042854 - RNA, 20 nt, Human
uaccccagaaguacucacac

SEQ ID NO: 1042855 - RNA, 24 nt, Human
uaccccagaaguacucacacucca

SEQ ID NO: 1042856 - RNA, 22 nt, Human
uccacaaauccccagccuccgg

SEQ ID NO: 1042857 - RNA, 24 nt, Human
uccccagccuccggcaaguacccc

SEQ ID NO: 1042858 - RNA, 30 nt, Human
ucccuccacaaauccccagccuccggcaaa

SEQ ID NO: 1042859 - RNA, 18 nt, Human
ucugugaucgcaacagcc

SEQ ID NO: 1042860 - RNA, 24 nt, Human
ugaggguucagccucgaggguggu

SEQ ID NO: 1042861 - RNA, 22 nt, Human
accccagggacucucaggugug

SEQ ID NO: 1042862 - RNA, 20 nt, Human
accucgcugugcccagcagc

SEQ ID NO: 1042863 - RNA, 21 nt, Human
augguggguagggggcagggg

SEQ ID NO: 1042864 - RNA, 24 nt, Human
caaauccccagcucaugccccauc

SEQ ID NO: 1042865 - RNA, 27 nt, Human
caagcuuaagccccauaaagaucaucc

SEQ ID NO: 1042866 - RNA, 20 nt, Human
cacccaagcuuaagccccau

SEQ ID NO: 1042867 - RNA, 20 nt, Human
ccagauaauuguuugcccac

SEQ ID NO: 1042868 - RNA, 23 nt, Human
cccaaauccccagcucaugcccc

SEQ ID NO: 1042869 - RNA, 23 nt, Human
cccagugccagagagggccuuuu

SEQ ID NO: 1042870 - RNA, 23 nt, Human
ccccaaauccccagcucaugccc

SEQ ID NO: 1042871 - RNA, 20 nt, Human
ccccauccccaaauccccag

SEQ ID NO: 1042872 - RNA, 21 nt, Human
ccccauccccaaauccccagc

SEQ ID NO: 1042873 - RNA, 24 nt, Human
cccccauccccaaauccccagcuc

SEQ ID NO: 1042874 - RNA, 18 nt, Human
ccccccauccccaaaucc

SEQ ID NO: 1042875 - RNA, 18 nt, Human
ccucugccccggcccagu

SEQ ID NO: 1042876 - RNA, 19 nt, Human
cuggcaugguggguagggg

SEQ ID NO: 1042877 - RNA, 19 nt, Human
gacccaggaugccucaggc

SEQ ID NO: 1042878 - RNA, 21 nt, Human
gagcuuggaccucgcugugcc

SEQ ID NO: 1042879 - RNA, 21 nt, Human
gcagggcgaccugagcuugga

SEQ ID NO: 1042880 - RNA, 20 nt, Human
ggggcagggcgaccugagcu

SEQ ID NO: 1042881 - RNA, 23 nt, Human
guggauuccccccauccccaaau

SEQ ID NO: 1042882 - RNA, 23 nt, Human
uccagucacuuuucugcuggccu

SEQ ID NO: 1042883 - RNA, 19 nt, Human
ucugcucccacccaagcuu

SEQ ID NO: 1042884 - RNA, 19 nt, Human
ugacuggaccccagggacu

SEQ ID NO: 1042885 - RNA, 22 nt, Human
ugagacccaggaugccucagaa

SEQ ID NO: 1042886 - RNA, 19 nt, Human
ugcuggccucugccccggc

SEQ ID NO: 1042887 - RNA, 26 nt, Human
ugcuggccucugccccggcccagugc

SEQ ID NO: 1042888 - RNA, 19 nt, Human
uggaccucgcugugcccag

SEQ ID NO: 1042889 - RNA, 25 nt, Human
uggauuccccccauccccaaauccc

SEQ ID NO: 1042890 - RNA, 21 nt, Human
ugguggguagggggcagggcg

SEQ ID NO: 1042891 - RNA, 24 nt, Human
uguuuuauucuuuuaucaguuuuu

SEQ ID NO: 1042892 - RNA, 24 nt, Human
uuaagccccauaaagaucauccag

SEQ ID NO: 1042893 - RNA, 19 nt, Human
uuccccccauccccaaauc

SEQ ID NO: 1042894 - RNA, 23 nt, Human
uuccccccauccccaaaucccca

SEQ ID NO: 1042895 - RNA, 18 nt, Human
uuggaccucgcugugccc

SEQ ID NO: 1042896 - RNA, 25 nt, Human
uuuuauucuuuuaucaguuuuuggg

SEQ ID NO: 1042897 - RNA, 20 nt, Human
accaggaggaacgucugaga

SEQ ID NO: 1042898 - RNA, 23 nt, Human
accccccacauucugcagaacga

SEQ ID NO: 1042899 - RNA, 18 nt, Human
agcgggcagcggaagggc

SEQ ID NO: 1042900 - RNA, 22 nt, Human
aggugcgggagggggcggaggu

SEQ ID NO: 1042901 - RNA, 22 nt, Human
cacggccgcccccagccccagc

SEQ ID NO: 1042902 - RNA, 23 nt, Human
cagccagaccacucccgcccccu

SEQ ID NO: 1042903 - RNA, 20 nt, Human
caggaugagcuugggaggug

SEQ ID NO: 1042904 - RNA, 19 nt, Human
ccacugcccgcgggcccug

SEQ ID NO: 1042905 - RNA, 19 nt, Human
ccagaccacucccgccccc

SEQ ID NO: 1042906 - RNA, 20 nt, Human
ccagccugcggcacccugcc

SEQ ID NO: 1042907 - RNA, 18 nt, Human
ccagggccuggcagccag

SEQ ID NO: 1042908 - RNA, 19 nt, Human
cccaccccccacauucugc

SEQ ID NO: 1042909 - RNA, 21 nt, Human
cccagccccagcacuggagga

SEQ ID NO: 1042910 - RNA, 25 nt, Human
cccagccccagcacuggaggagggc

SEQ ID NO: 1042911 - RNA, 20 nt, Human
ccccaccccccacauucugc

SEQ ID NO: 1042912 - RNA, 21 nt, Human
ccccaccccccacauucugca

SEQ ID NO: 1042913 - RNA, 21 nt, Human
ccccacugcccgcgggcccug

SEQ ID NO: 1042914 - RNA, 18 nt, Human
cccuagacccccagggcc

SEQ ID NO: 1042915 - RNA, 21 nt, Human
cccugccuccccaccccccac

SEQ ID NO: 1042916 - RNA, 18 nt, Human
ccgcuuuccccacugccc

SEQ ID NO: 1042917 - RNA, 18 nt, Human
ccggcuggcagugagucg

SEQ ID NO: 1042918 - RNA, 19 nt, Human
ccgugccccccgccaccuc

SEQ ID NO: 1042919 - RNA, 25 nt, Human
ccuccccaccccccacauucugcag

SEQ ID NO: 1042920 - RNA, 21 nt, Human
ccugucccgcuggccccagcc

SEQ ID NO: 1042921 - RNA, 20 nt, Human
ccuguggcccugccucccca

SEQ ID NO: 1042922 - RNA, 18 nt, Human
ccuugcacggccgccccc

SEQ ID NO: 1042923 - RNA, 25 nt, Human
cuccccaccccccacauucugcuga

SEQ ID NO: 1042924 - RNA, 19 nt, Human
cucccgcccccuggcccgc

SEQ ID NO: 1042925 - RNA, 21 nt, Human
cugcaccccuagacccccagg

SEQ ID NO: 1042926 - RNA, 24 nt, Human
cugcaccccuagacccccagggcc

SEQ ID NO: 1042927 - RNA, 21 nt, Human
cuggccccaagcucggggccu

SEQ ID NO: 1042928 - RNA, 22 nt, Human
cuggccccaagcucggggccug

SEQ ID NO: 1042929 - RNA, 24 nt, Human
cuggccccaagcucggggccuggg

SEQ ID NO: 1042930 - RNA, 18 nt, Human
gcagcaggaugagcuugg

SEQ ID NO: 1042931 - RNA, 18 nt, Human
gcccugccuccccacccc

SEQ ID NO: 1042932 - RNA, 19 nt, Human
gcgcuggccgcucccugca

SEQ ID NO: 1042933 - RNA, 21 nt, Human
gcguggccuggagguggggca

SEQ ID NO: 1042934 - RNA, 21 nt, Human
ggagagcguggccuggaggug

SEQ ID NO: 1042935 - RNA, 22 nt, Human
ggccuggagguggggcaggacg

SEQ ID NO: 1042936 - RNA, 20 nt, Human
ggggcccgcgcagcagcagg

SEQ ID NO: 1042937 - RNA, 24 nt, Human
ggguggcuggcggggcccgcgcag

SEQ ID NO: 1042938 - RNA, 21 nt, Human
ucccugcaccccuagaccccc

SEQ ID NO: 1042939 - RNA, 22 nt, Human
ucccugcaccccuagaccccca

SEQ ID NO: 1042940 - RNA, 18 nt, Human
ugagcuugggaggugcgg

SEQ ID NO: 1042941 - RNA, 19 nt, Human
ugcaccccuagacccccag

SEQ ID NO: 1042942 - RNA, 21 nt, Human
ugcccugucccgcuggcccca

SEQ ID NO: 1042943 - RNA, 20 nt, Human
uggaggagggcagcaggaug

SEQ ID NO: 1042944 - RNA, 26 nt, Human
uggcagccagaccacucccgcccccu

SEQ ID NO: 1042945 - RNA, 18 nt, Human
uggcccugccuccccacc

SEQ ID NO: 1042946 - RNA, 21 nt, Human
uggcccugccuccccaccccc

SEQ ID NO: 1042947 - RNA, 22 nt, Human
uggcccugccuccccacccccc

SEQ ID NO: 1042948 - RNA, 18 nt, Human
uggcggggcccgcgcagc

SEQ ID NO: 1042949 - RNA, 18 nt, Human
uggguggcuggcggggcc

SEQ ID NO: 1042950 - RNA, 21 nt, Human
uguagggggcugcacgcugcu

SEQ ID NO: 1042951 - RNA, 21 nt, Human
uguagggggcugcacgcugcu

SEQ ID NO: 1042952 - RNA, 18 nt, Human
uuggaggagugggugaag

SEQ ID NO: 1042953 - RNA, 28 nt, Human
cuuacgcacgcgcacacauacacacagu

SEQ ID NO: 1042954 - RNA, 25 nt, Human
gcacgcgcacacauacacacacuca

SEQ ID NO: 1042955 - RNA, 22 nt, Human
gccuuacgcacgcgcacacaua

SEQ ID NO: 1042956 - RNA, 20 nt, Human
uuuucugacgccagccaagg

SEQ ID NO: 1042957 - RNA, 22 nt, Human
aaguucacagccacauccucaa

SEQ ID NO: 1042958 - RNA, 19 nt, Human
aggcaggauuucccccaug

SEQ ID NO: 1042959 - RNA, 19 nt, Human
cagaggaugcuacagacac

SEQ ID NO: 1042960 - RNA, 22 nt, Human
ccagugugacagaggaugcuac

SEQ ID NO: 1042961 - RNA, 21 nt, Human
cccaugacccucuaguggccc

SEQ ID NO: 1042962 - RNA, 20 nt, Human
ccccauacucgaggcaggau

SEQ ID NO: 1042963 - RNA, 21 nt, Human
cccccguacaaucaauuccug

SEQ ID NO: 1042964 - RNA, 18 nt, Human
cccuacggcuccugcugc

SEQ ID NO: 1042965 - RNA, 19 nt, Human
cuccucucacacgaacccc

SEQ ID NO: 1042966 - RNA, 20 nt, Human
cugggaaggacccagcaaag

SEQ ID NO: 1042967 - RNA, 23 nt, Human
gucagcuccucucacacgaaccc

SEQ ID NO: 1042968 - RNA, 23 nt, Human
gucccagugugacagaggaugcu

SEQ ID NO: 1042969 - RNA, 22 nt, Human
ucacacgaaccccauacucgag

SEQ ID NO: 1042970 - RNA, 21 nt, Human
ucugggaaggacccagcaaag

SEQ ID NO: 1042971 - RNA, 27 nt, Human
uggcuuccaggugucccaguccucccu

SEQ ID NO: 1042972 - RNA, 20 nt, Human
ugggaaggacccagcaaagc

SEQ ID NO: 1042973 - RNA, 23 nt, Human
ugggaaggacccagcaaagccca

SEQ ID NO: 1042974 - RNA, 25 nt, Human
ugggaaggacccagcaaagcccacu

SEQ ID NO: 1042975 - RNA, 18 nt, Human
ugugacagaggaugcuac

SEQ ID NO: 1042976 - RNA, 18 nt, Human
uucccccaugacccucua

SEQ ID NO: 1042977 - RNA, 22 nt, Human
uucccccaugacccucuagugg

SEQ ID NO: 1042978 - RNA, 18 nt, Human
caagauaaugcuauacuu

SEQ ID NO: 1042979 - RNA, 24 nt, Human
uacaagauaaugcuauacuuuuaa

SEQ ID NO: 1042980 - RNA, 19 nt, Human
uaugucccugagguaagua

SEQ ID NO: 1042981 - RNA, 20 nt, Human
ucugcauaugucccugaggu

SEQ ID NO: 1042982 - RNA, 26 nt, Human
ugggaaacugaagcacagagagguag

SEQ ID NO: 1042983 - RNA, 28 nt, Human
ugggaaacugaagcacagagagguaguc

SEQ ID NO: 1042984 - RNA, 22 nt, Human
gggucuucagggagagcagucc

SEQ ID NO: 1042985 - RNA, 24 nt, Human
uggaggggucuucagggagagcag

SEQ ID NO: 1042986 - RNA, 18 nt, Human
cugcccgcugcacaaggc

SEQ ID NO: 1042987 - RNA, 19 nt, Human
ggccuggcucccugggcug

SEQ ID NO: 1042988 - RNA, 24 nt, Human
gggggaggcagcggugaucuuuac

SEQ ID NO: 1042989 - RNA, 26 nt, Human
ggggggaggcagcggugaucuuuacu

SEQ ID NO: 1042990 - RNA, 22 nt, Human
ucccugggcugcucgcugcccg

SEQ ID NO: 1042991 - RNA, 21 nt, Human
ugcggugucuggggccuggcu

SEQ ID NO: 1042992 - RNA, 21 nt, Human
agcagaaagggaggccccugg

SEQ ID NO: 1042993 - RNA, 21 nt, Human
aggcagaggacaaggggcugg

SEQ ID NO: 1042994 - RNA, 22 nt, Human
cagcagaaggcagaggacaagg

SEQ ID NO: 1042995 - RNA, 21 nt, Human
cagccugggcccucaccggcc

SEQ ID NO: 1042996 - RNA, 20 nt, Human
ccagcagaaagggaggcccc

SEQ ID NO: 1042997 - RNA, 21 nt, Human
ccccugggugugcaagacggg

SEQ ID NO: 1042998 - RNA, 20 nt, Human
ggcccagguggccucguggg

SEQ ID NO: 1042999 - RNA, 21 nt, Human
gggacggggggaaaggaggga

SEQ ID NO: 1043000 - RNA, 18 nt, Human
gggggaaaggagggacca

SEQ ID NO: 1043001 - RNA, 19 nt, Human
gugggacggggggaaagga

SEQ ID NO: 1043002 - RNA, 21 nt, Human
uugggauggcugaggacacag

SEQ ID NO: 1043003 - RNA, 19 nt, Human
agccuccgggggcgcccaa

SEQ ID NO: 1043004 - RNA, 22 nt, Human
cagcacggccccggcgcgcgcc

SEQ ID NO: 1043005 - RNA, 21 nt, Human
cugcaggcagccccagccucc

SEQ ID NO: 1043006 - RNA, 18 nt, Human
gcgcgcgccugcagcugc

SEQ ID NO: 1043007 - RNA, 19 nt, Human
gcggagcgcaggugaccca

SEQ ID NO: 1043008 - RNA, 21 nt, Human
ggggaugagggcggagcgcag

SEQ ID NO: 1043009 - RNA, 19 nt, Human
uuacccccaaaccaccguc

SEQ ID NO: 1043010 - RNA, 18 nt, Human
uuuccuuucuccuuaccc

SEQ ID NO: 1043011 - RNA, 19 nt, Human
accccgagaucaccgucac

SEQ ID NO: 1043012 - RNA, 18 nt, Human
ccaaacccgaguccaccu

SEQ ID NO: 1043013 - RNA, 24 nt, Human
cccgagaucaccgucacccagaaa

SEQ ID NO: 1043014 - RNA, 22 nt, Human
ccgcuugcauauguccaauccc

SEQ ID NO: 1043015 - RNA, 20 nt, Human
ccugcccaccccgagaucac

SEQ ID NO: 1043016 - RNA, 21 nt, Human
ccuuuggaguccugcccaccc

SEQ ID NO: 1043017 - RNA, 23 nt, Human
cgagaucaccgucacccagaaac

SEQ ID NO: 1043018 - RNA, 25 nt, Human
cgagaucaccgucacccagaaaccc

SEQ ID NO: 1043019 - RNA, 22 nt, Human
cggccccaaaucucccgcuugc

SEQ ID NO: 1043020 - RNA, 21 nt, Human
cugcccaccccgagaucaccg

SEQ ID NO: 1043021 - RNA, 23 nt, Human
uccaaacccgaguccacccccgc

SEQ ID NO: 1043022 - RNA, 18 nt, Human
ucccagugcaaggagucc

SEQ ID NO: 1043023 - RNA, 20 nt, Human
uccugcccaccccgagauca

SEQ ID NO: 1043024 - RNA, 20 nt, Human
ucuuuauuggccuggaugug

SEQ ID NO: 1043025 - RNA, 19 nt, Human
uugccaaaccaguugcccc

SEQ ID NO: 1043026 - RNA, 19 nt, Human
aaaaaaaaaaaaaagaaaa

SEQ ID NO: 1043027 - RNA, 21 nt, Human
aaccagaaggggaaaguccca

SEQ ID NO: 1043028 - RNA, 20 nt, Human
aagaagauaugagaguccua

SEQ ID NO: 1043029 - RNA, 20 nt, Human
aagcacagcuaggguugguc

SEQ ID NO: 1043030 - RNA, 24 nt, Human
acagagccagacguugucucaaaa

SEQ ID NO: 1043031 - RNA, 22 nt, Human
acagcagccgcuggugcuucug

SEQ ID NO: 1043032 - RNA, 28 nt, Human
acguugucucaaaaaaaaaaaaaaaaaa

SEQ ID NO: 1043033 - RNA, 24 nt, Human
acugcgcuccagccugggugacag

SEQ ID NO: 1043034 - RNA, 26 nt, Human
acugcgcuccagccugggugacagag

SEQ ID NO: 1043035 - RNA, 18 nt, Human
agcaccgguccugggugu

SEQ ID NO: 1043036 - RNA, 21 nt, Human
agccaggugugguggugcaug

SEQ ID NO: 1043037 - RNA, 24 nt, Human
aggcugaggcaugaggaucccuug

SEQ ID NO: 1043038 - RNA, 22 nt, Human
aggcugcagugggccgagauug

SEQ ID NO: 1043039 - RNA, 24 nt, Human
aggucgaggcugcagugggccgag

SEQ ID NO: 1043040 - RNA, 20 nt, Human
augagaguccuaaggcccug

SEQ ID NO: 1043041 - RNA, 23 nt, Human
auucacauaguggcccaagcacc

SEQ ID NO: 1043042 - RNA, 24 nt, Human
auugugccacugcgcuccagccug

SEQ ID NO: 1043043 - RNA, 20 nt, Human
caaaaugcaguagguggcgg

SEQ ID NO: 1043044 - RNA, 23 nt, Human
cacagcaccgugcuggagccggc

SEQ ID NO: 1043045 - RNA, 21 nt, Human
caccgguccguacuccagcga

SEQ ID NO: 1043046 - RNA, 19 nt, Human
cacugcgcuccagccuggg

SEQ ID NO: 1043047 - RNA, 19 nt, Human
cacugcgcuccagccuggg

SEQ ID NO: 1043048 - RNA, 21 nt, Human
cacugcgcuccagccugggug

SEQ ID NO: 1043049 - RNA, 22 nt, Human
cacugcgcuccagccuggguga

SEQ ID NO: 1043050 - RNA, 23 nt, Human
cacugcgcuccagccugggugac

SEQ ID NO: 1043051 - RNA, 24 nt, Human
cacugcgcuccagccugggugaca

SEQ ID NO: 1043052 - RNA, 24 nt, Human
cacugcgcuccagccugggugaca

SEQ ID NO: 1043053 - RNA, 18 nt, Human
cagaagcacagcuagggu

SEQ ID NO: 1043054 - RNA, 18 nt, Human
cagaaggggaaaguccca

SEQ ID NO: 1043055 - RNA, 24 nt, Human
cagaggucgaggcugcagugggcc

SEQ ID NO: 1043056 - RNA, 19 nt, Human
cauaugaggcugaggcaug

SEQ ID NO: 1043057 - RNA, 20 nt, Human
ccacugcgcuccagccuggg

SEQ ID NO: 1043058 - RNA, 20 nt, Human
ccacugcgcuccagccuggg

SEQ ID NO: 1043059 - RNA, 21 nt, Human
ccacugcgcuccagccugggu

SEQ ID NO: 1043060 - RNA, 21 nt, Human
ccacugcgcuccagccugggu

SEQ ID NO: 1043061 - RNA, 24 nt, Human
ccacugcgcuccagccugggugac

SEQ ID NO: 1043062 - RNA, 18 nt, Human
ccaggccagugcgcaugg

SEQ ID NO: 1043063 - RNA, 24 nt, Human
cccagccugccagugccuccuccu

SEQ ID NO: 1043064 - RNA, 20 nt, Human
cccgaacgcuuuccgcgaag

SEQ ID NO: 1043065 - RNA, 20 nt, Human
cccugcacgcgucgcagcca

SEQ ID NO: 1043066 - RNA, 23 nt, Human
ccggcuccugagcugcucaaccu

SEQ ID NO: 1043067 - RNA, 19 nt, Human
ccucggccagccugugaug

SEQ ID NO: 1043068 - RNA, 21 nt, Human
ccugccagugccuccuccugg

SEQ ID NO: 1043069 - RNA, 24 nt, Human
ccugugaugggauccuggcaaggc

SEQ ID NO: 1043070 - RNA, 19 nt, Human
cgaacagcccgcccaguca

SEQ ID NO: 1043071 - RNA, 22 nt, Human
cgcuccagccugggugacagag

SEQ ID NO: 1043072 - RNA, 19 nt, Human
cggcuccugagcugcucaa

SEQ ID NO: 1043073 - RNA, 22 nt, Human
cggcuccugagcugcucaaccu

SEQ ID NO: 1043074 - RNA, 23 nt, Human
cggcuccugagcugcucaaccuc

SEQ ID NO: 1043075 - RNA, 18 nt, Human
cucaaaaaaaaaaaaaaa

SEQ ID NO: 1043076 - RNA, 19 nt, Human
cucaaaaaaaaaaaaaaag

SEQ ID NO: 1043077 - RNA, 18 nt, Human
cuccagccugggugacag

SEQ ID NO: 1043078 - RNA, 20 nt, Human
cuccagccugggugacagag

SEQ ID NO: 1043079 - RNA, 19 nt, Human
cucgaaccucucgaacagc

SEQ ID NO: 1043080 - RNA, 22 nt, Human
cugcagugggccgagauugugc

SEQ ID NO: 1043081 - RNA, 19 nt, Human
cuugagccccagaggucga

SEQ ID NO: 1043082 - RNA, 24 nt, Human
gaaccucucgaacagcccgcccag

SEQ ID NO: 1043083 - RNA, 18 nt, Human
gagaguccuaaggcccug

SEQ ID NO: 1043084 - RNA, 23 nt, Human
gagauugugccacugcgcuccag

SEQ ID NO: 1043085 - RNA, 21 nt, Human
gaggcugcagugggccgagau

SEQ ID NO: 1043086 - RNA, 24 nt, Human
gaggcugcagugggccgagauugg

SEQ ID NO: 1043087 - RNA, 25 nt, Human
gcacagcuaggguuggucagagagu

SEQ ID NO: 1043088 - RNA, 24 nt, Human
gccaccagauggagaagacaagaa

SEQ ID NO: 1043089 - RNA, 19 nt, Human
gccacugcgcuccagccug

SEQ ID NO: 1043090 - RNA, 24 nt, Human
gccacugcgcuccagccuggguga

SEQ ID NO: 1043091 - RNA, 24 nt, Human
gccccagaggucgaggcugcagug

SEQ ID NO: 1043092 - RNA, 20 nt, Human
gccuaccccgaacgcuuucc

SEQ ID NO: 1043093 - RNA, 19 nt, Human
gcgcggggcccugcacgcg

SEQ ID NO: 1043094 - RNA, 24 nt, Human
gcgcuccagccugggugacagagc

SEQ ID NO: 1043095 - RNA, 21 nt, Human
gcuggugcuucuggaucaccu

SEQ ID NO: 1043096 - RNA, 19 nt, Human
ggggugcaucuccccuugg

SEQ ID NO: 1043097 - RNA, 18 nt, Human
gucccaggugucuguggg

SEQ ID NO: 1043098 - RNA, 21 nt, Human
uaaaauggccucgagccaggu

SEQ ID NO: 1043099 - RNA, 18 nt, Human
uaugagaguccuaaggcc

SEQ ID NO: 1043100 - RNA, 20 nt, Human
uaugaggcugaggcaugagg

SEQ ID NO: 1043101 - RNA, 23 nt, Human
ucaaaaaaaaaaaaaaaaaagaa

SEQ ID NO: 1043102 - RNA, 24 nt, Human
uccagccugggugacagagccaga

SEQ ID NO: 1043103 - RNA, 19 nt, Human
ucccaggugucuguggggu

SEQ ID NO: 1043104 - RNA, 18 nt, Human
uccguacuccagcgaggu

SEQ ID NO: 1043105 - RNA, 21 nt, Human
uccuaaggcccugucuggggu

SEQ ID NO: 1043106 - RNA, 20 nt, Human
uccucggggguccccuuucu

SEQ ID NO: 1043107 - RNA, 18 nt, Human
uccugagcugcucaaccu

SEQ ID NO: 1043108 - RNA, 24 nt, Human
ucgagccaggugugguggugcaug

SEQ ID NO: 1043109 - RNA, 19 nt, Human
ucucaaaaaaaaaaaaaaa

SEQ ID NO: 1043110 - RNA, 23 nt, Human
ugagaguccuaaggcccugucug

SEQ ID NO: 1043111 - RNA, 23 nt, Human
ugcagugggccgagauugugcca

SEQ ID NO: 1043112 - RNA, 20 nt, Human
ugccuccuccuggguggaug

SEQ ID NO: 1043113 - RNA, 19 nt, Human
ugcucaaccucagaacuaa

SEQ ID NO: 1043114 - RNA, 22 nt, Human
ugggccgagauugugccacugc

SEQ ID NO: 1043115 - RNA, 21 nt, Human
ugggguccucggggguccccu

SEQ ID NO: 1043116 - RNA, 24 nt, Human
ugguggugcaugucuguggcccca

SEQ ID NO: 1043117 - RNA, 18 nt, Human
uguccaaaaugcaguagg

SEQ ID NO: 1043118 - RNA, 21 nt, Human
ugucugggguccucggggguc

SEQ ID NO: 1043119 - RNA, 19 nt, Human
ugucuguggccccagcuac

SEQ ID NO: 1043120 - RNA, 19 nt, Human
ugugaugggauccuggcaa

SEQ ID NO: 1043121 - RNA, 23 nt, Human
ugugguggugcaugucuguggcc

SEQ ID NO: 1043122 - RNA, 20 nt, Human
uucacaaacacagcaccgug

SEQ ID NO: 1043123 - RNA, 23 nt, Human
uugugccacugcgcuccagccug

SEQ ID NO: 1043124 - RNA, 24 nt, Human
aaacuccagacgaccccagcuccu

SEQ ID NO: 1043125 - RNA, 21 nt, Human
aaaugucccuccugaugaccc

SEQ ID NO: 1043126 - RNA, 19 nt, Human
aacccagcgagcuccgcag

SEQ ID NO: 1043127 - RNA, 21 nt, Human
aacccagcgagcuccgcagcc

SEQ ID NO: 1043128 - RNA, 22 nt, Human
aacccagcgagcuccgcagccc

SEQ ID NO: 1043129 - RNA, 20 nt, Human
aaggagaucacauuuggcuu

SEQ ID NO: 1043130 - RNA, 24 nt, Human
acacucucuuccuuccccaucgca

SEQ ID NO: 1043131 - RNA, 19 nt, Human
agcuggucugaaauguccc

SEQ ID NO: 1043132 - RNA, 24 nt, Human
auuuggcuuaguaucagaaagccc

SEQ ID NO: 1043133 - RNA, 20 nt, Human
caccgcccccuucggcgucc

SEQ ID NO: 1043134 - RNA, 22 nt, Human
cagggcucuuucuucugcucca

SEQ ID NO: 1043135 - RNA, 19 nt, Human
ccaaacucccaaucuggac

SEQ ID NO: 1043136 - RNA, 18 nt, Human
ccauccagggcucuuucu

SEQ ID NO: 1043137 - RNA, 19 nt, Human
ccaucgcacagcccugacc

SEQ ID NO: 1043138 - RNA, 21 nt, Human
cccuguugucucuccaccugg

SEQ ID NO: 1043139 - RNA, 27 nt, Human
ccugaugacccuguugucucuccaccu

SEQ ID NO: 1043140 - RNA, 22 nt, Human
ccuguugucucuccaccuggca

SEQ ID NO: 1043141 - RNA, 26 nt, Human
cucccaaucuggacaccauucuuuug

SEQ ID NO: 1043142 - RNA, 19 nt, Human
gcacagcccugaccucccc

SEQ ID NO: 1043143 - RNA, 19 nt, Human
gcccgggacguuccagccc

SEQ ID NO: 1043144 - RNA, 21 nt, Human
gcgagcuccgcagcccgggac

SEQ ID NO: 1043145 - RNA, 23 nt, Human
uaggacaugacugguaccuaaaa

SEQ ID NO: 1043146 - RNA, 18 nt, Human
ucacaggauuucucucca

SEQ ID NO: 1043147 - RNA, 19 nt, Human
ucaggucugaacgagucca

SEQ ID NO: 1043148 - RNA, 22 nt, Human
ucaugaagcgucugaugcuuaa

SEQ ID NO: 1043149 - RNA, 23 nt, Human
ucccaacccagcgagcuccgcag

SEQ ID NO: 1043150 - RNA, 22 nt, Human
ucugauaacucuggccuucucc

SEQ ID NO: 1043151 - RNA, 20 nt, Human
ucuugguuucucuuccaaac

SEQ ID NO: 1043152 - RNA, 24 nt, Human
ugaaaugucccuccugaugacccu

SEQ ID NO: 1043153 - RNA, 22 nt, Human
ugaacgaguccaucccaaccca

SEQ ID NO: 1043154 - RNA, 19 nt, Human
ugaagccacugauauucuc

SEQ ID NO: 1043155 - RNA, 19 nt, Human
uucacaggauuucucucca

SEQ ID NO: 1043156 - RNA, 24 nt, Human
uuccucuuaaccauccagggcucu

SEQ ID NO: 1043157 - RNA, 20 nt, Human
agggcuuugugagaaucaga

SEQ ID NO: 1043158 - RNA, 18 nt, Human
caacguagagugaacaca

SEQ ID NO: 1043159 - RNA, 19 nt, Human
gagggcuuugugagaauca

SEQ ID NO: 1043160 - RNA, 21 nt, Human
gggugugaguggggcagguuu

SEQ ID NO: 1043161 - RNA, 23 nt, Human
uagccuucaaauccaguaaccaa

SEQ ID NO: 1043162 - RNA, 18 nt, Human
ucuccaucuuugagaaga

SEQ ID NO: 1043163 - RNA, 22 nt, Human
uuaaaguuccuccaucagaugg

SEQ ID NO: 1043164 - RNA, 22 nt, Human
aaaagaaaauucuaaaagagaa

SEQ ID NO: 1043165 - RNA, 19 nt, Human
accccccacccccgccccg

SEQ ID NO: 1043166 - RNA, 22 nt, Human
accccccacccccgccccggac

SEQ ID NO: 1043167 - RNA, 24 nt, Human
acgccccagugcccccccacggac

SEQ ID NO: 1043168 - RNA, 18 nt, Human
agagaaaagggccccugg

SEQ ID NO: 1043169 - RNA, 24 nt, Human
agaggagggcggggagccggggau

SEQ ID NO: 1043170 - RNA, 18 nt, Human
aggaagagcagggaaaau

SEQ ID NO: 1043171 - RNA, 21 nt, Human
aggaagagcagggaaaauggc

SEQ ID NO: 1043172 - RNA, 18 nt, Human
aggcagaaaaaaauaaug

SEQ ID NO: 1043173 - RNA, 19 nt, Human
agugcccccccacggacgg

SEQ ID NO: 1043174 - RNA, 19 nt, Human
caccacgcccaggccuggg

SEQ ID NO: 1043175 - RNA, 22 nt, Human
cacccccgccccggacaacuga

SEQ ID NO: 1043176 - RNA, 23 nt, Human
caccccuuccuccaccacgccca

SEQ ID NO: 1043177 - RNA, 22 nt, Human
cagcaccccccacccccgcccc

SEQ ID NO: 1043178 - RNA, 26 nt, Human
ccacccccgccccggacaacugagga

SEQ ID NO: 1043179 - RNA, 21 nt, Human
cccacccccgccccggacaac

SEQ ID NO: 1043180 - RNA, 19 nt, Human
ccccagugcccccccacgg

SEQ ID NO: 1043181 - RNA, 22 nt, Human
ccccccacggacggcgcaggga

SEQ ID NO: 1043182 - RNA, 19 nt, Human
cccgcccccccccccgggc

SEQ ID NO: 1043183 - RNA, 19 nt, Human
cccguccgcuucucccugg

SEQ ID NO: 1043184 - RNA, 18 nt, Human
cccugggucucuuggucu

SEQ ID NO: 1043185 - RNA, 24 nt, Human
ccucugcuacccggaauccaggag

SEQ ID NO: 1043186 - RNA, 25 nt, Human
cgccccagugcccccccacggacgg

SEQ ID NO: 1043187 - RNA, 19 nt, Human
cgcuuggggccuggucgcc

SEQ ID NO: 1043188 - RNA, 20 nt, Human
cggcgcugccucugcuaccc

SEQ ID NO: 1043189 - RNA, 19 nt, Human
cucgagcucuaaggauggg

SEQ ID NO: 1043190 - RNA, 19 nt, Human
cucuuggucuugcacgucu

SEQ ID NO: 1043191 - RNA, 23 nt, Human
cugggauccucuaaagggccugg

SEQ ID NO: 1043192 - RNA, 19 nt, Human
gaagggcgggccaggcuga

SEQ ID NO: 1043193 - RNA, 22 nt, Human
gacaaacgggcacccgccuccu

SEQ ID NO: 1043194 - RNA, 23 nt, Human
gacggcgcagggacagaggaggg

SEQ ID NO: 1043195 - RNA, 18 nt, Human
gcaccccuuccuccacca

SEQ ID NO: 1043196 - RNA, 22 nt, Human
gcccccccccccgggccccucc

SEQ ID NO: 1043197 - RNA, 21 nt, Human
gcccgcccccccccccgggcc

SEQ ID NO: 1043198 - RNA, 23 nt, Human
ggacaaacgggcacccgccuccu

SEQ ID NO: 1043199 - RNA, 21 nt, Human
ggccugguuucuccauuccuc

SEQ ID NO: 1043200 - RNA, 21 nt, Human
gggagccggggaugccgcggg

SEQ ID NO: 1043201 - RNA, 19 nt, Human
gggcggggagccggggaug

SEQ ID NO: 1043202 - RNA, 23 nt, Human
uaaaagaaaauucuaaaagagaa

SEQ ID NO: 1043203 - RNA, 20 nt, Human
uaauacgccccagugccccc

SEQ ID NO: 1043204 - RNA, 19 nt, Human
uauuguuccagcaccccuu

SEQ ID NO: 1043205 - RNA, 19 nt, Human
ucccucucugggauccucu

SEQ ID NO: 1043206 - RNA, 22 nt, Human
ucccucucugggauccucuaaa

SEQ ID NO: 1043207 - RNA, 19 nt, Human
ucccugggucucuuggucu

SEQ ID NO: 1043208 - RNA, 22 nt, Human
ucgcagcaccccccacccccgc

SEQ ID NO: 1043209 - RNA, 18 nt, Human
ucgcucccgccaagcccg

SEQ ID NO: 1043210 - RNA, 19 nt, Human
ucuccauugucucuccggc

SEQ ID NO: 1043211 - RNA, 26 nt, Human
ugcaguucucuccauugucucuccgg

SEQ ID NO: 1043212 - RNA, 24 nt, Human
ugcccgcccccccccccgggcccc

SEQ ID NO: 1043213 - RNA, 20 nt, Human
ugccgcgggguccaucgcac

SEQ ID NO: 1043214 - RNA, 21 nt, Human
ugggacaaacgggcacccgcc

SEQ ID NO: 1043215 - RNA, 26 nt, Human
ugggauccucuaaagggccugguuuc

SEQ ID NO: 1043216 - RNA, 27 nt, Human
ugggauccucuaaagggccugguuucu

SEQ ID NO: 1043217 - RNA, 19 nt, Human
uuguuccagcaccccuucc

SEQ ID NO: 1043218 - RNA, 26 nt, Human
aacguucccucacggguuggccgcuc

SEQ ID NO: 1043219 - RNA, 24 nt, Human
acuaauuccugaaacuucaggagg

SEQ ID NO: 1043220 - RNA, 21 nt, Human
aucauuucucaccagugugga

SEQ ID NO: 1043221 - RNA, 20 nt, Human
cagguuccacucagacucgc

SEQ ID NO: 1043222 - RNA, 23 nt, Human
cccuguauaagucccucugauua

SEQ ID NO: 1043223 - RNA, 22 nt, Human
cgagagaagucuauggccacau

SEQ ID NO: 1043224 - RNA, 21 nt, Human
cuagcgucagaaacguucccu

SEQ ID NO: 1043225 - RNA, 20 nt, Human
cugaaacuucaggaguuuau

SEQ ID NO: 1043226 - RNA, 22 nt, Human
cugaugaugaauggcgcgcucu

SEQ ID NO: 1043227 - RNA, 21 nt, Human
gaaugucacuaauuccugaaa

SEQ ID NO: 1043228 - RNA, 20 nt, Human
ggcaagaucugcauuuugaa

SEQ ID NO: 1043229 - RNA, 20 nt, Human
uaagaacacaggaacaccgc

SEQ ID NO: 1043230 - RNA, 22 nt, Human
uaagaacacaggaacaccgccc

SEQ ID NO: 1043231 - RNA, 22 nt, Human
uaccuauaagacuaacauucca

SEQ ID NO: 1043232 - RNA, 25 nt, Human
uagcgucagaaacguucccucacgg

SEQ ID NO: 1043233 - RNA, 21 nt, Human
uccagguauucccacuccugc

SEQ ID NO: 1043234 - RNA, 23 nt, Human
ucccugaaugucacuaauuccug

SEQ ID NO: 1043235 - RNA, 21 nt, Human
ucccuguauaagucccucuga

SEQ ID NO: 1043236 - RNA, 19 nt, Human
ucggggucacagcacugau

SEQ ID NO: 1043237 - RNA, 27 nt, Human
ucuauggccacaucccugaaugucacu

SEQ ID NO: 1043238 - RNA, 21 nt, Human
uuaaaacaggacugacauuga

SEQ ID NO: 1043239 - RNA, 19 nt, Human
agaaagccccugcaaagcc

SEQ ID NO: 1043240 - RNA, 21 nt, Human
agggcuuggguccugccccag

SEQ ID NO: 1043241 - RNA, 19 nt, Human
aggggccuguggcugucag

SEQ ID NO: 1043242 - RNA, 21 nt, Human
augaaaacggaaaguguucac

SEQ ID NO: 1043243 - RNA, 21 nt, Human
caaagccccgaaaccuacaug

SEQ ID NO: 1043244 - RNA, 22 nt, Human
caagagaaagccccugcaaagc

SEQ ID NO: 1043245 - RNA, 25 nt, Human
cacuccccaagcugagagcugagga

SEQ ID NO: 1043246 - RNA, 19 nt, Human
ccagccagggcuugggucc

SEQ ID NO: 1043247 - RNA, 19 nt, Human
ccccagucugacaggccug

SEQ ID NO: 1043248 - RNA, 20 nt, Human
ccccugcaaagccccgaaac

SEQ ID NO: 1043249 - RNA, 19 nt, Human
ccgaugaugaugaugacga

SEQ ID NO: 1043250 - RNA, 23 nt, Human
ccugugcuggagucacucaaagg

SEQ ID NO: 1043251 - RNA, 19 nt, Human
cgcccgcgcccgcgcccgc

SEQ ID NO: 1043252 - RNA, 20 nt, Human
cugcaaagccccgaaaccua

SEQ ID NO: 1043253 - RNA, 18 nt, Human
cugucagucauccuugcu

SEQ ID NO: 1043254 - RNA, 18 nt, Human
gaggugucacucuugaag

SEQ ID NO: 1043255 - RNA, 19 nt, Human
gcaaagccccgaaaccuac

SEQ ID NO: 1043256 - RNA, 18 nt, Human
gcacugugcugaguccag

SEQ ID NO: 1043257 - RNA, 21 nt, Human
gcuuccccuuggcggcgguga

SEQ ID NO: 1043258 - RNA, 19 nt, Human
ucagagcaagucaaaugca

SEQ ID NO: 1043259 - RNA, 26 nt, Human
ucgaagcccgguccgccgguggccgc

SEQ ID NO: 1043260 - RNA, 21 nt, Human
ugagccugggaggggcccaag

SEQ ID NO: 1043261 - RNA, 21 nt, Human
ugcugagccugggaggggccc

SEQ ID NO: 1043262 - RNA, 21 nt, Human
uggagucacucaaaggggccu

SEQ ID NO: 1043263 - RNA, 22 nt, Human
uucagaagaggugucacucuug

SEQ ID NO: 1043264 - RNA, 20 nt, Human
uugcuuccccuuggcggcgg

SEQ ID NO: 1043265 - RNA, 19 nt, Human
acgcugcaccuggaagacc

SEQ ID NO: 1043266 - RNA, 18 nt, Human
agccacugggccuggccu

SEQ ID NO: 1043267 - RNA, 21 nt, Human
agccggucugcaaggggccug

SEQ ID NO: 1043268 - RNA, 20 nt, Human
agcuggggguggucgggcag

SEQ ID NO: 1043269 - RNA, 20 nt, Human
aucacagucuccgguggugg

SEQ ID NO: 1043270 - RNA, 23 nt, Human
cagaaugccuuuauuccugggcu

SEQ ID NO: 1043271 - RNA, 22 nt, Human
ccgagagcgccacgcugcaccg

SEQ ID NO: 1043272 - RNA, 21 nt, Human
ccgccgucccagcuccuccag

SEQ ID NO: 1043273 - RNA, 22 nt, Human
ccgucccagcuccuccagcugc

SEQ ID NO: 1043274 - RNA, 25 nt, Human
ccucacgcugcaccuggaagaccuc

SEQ ID NO: 1043275 - RNA, 19 nt, Human
cgcagccgggcggccuccu

SEQ ID NO: 1043276 - RNA, 23 nt, Human
cgcagccgggcggccuccuugcc

SEQ ID NO: 1043277 - RNA, 24 nt, Human
cgcuccagcuccgcgcgcagccgg

SEQ ID NO: 1043278 - RNA, 21 nt, Human
cugcacacacgcucccgcucc

SEQ ID NO: 1043279 - RNA, 22 nt, Human
cugcaccuggaagaccucugcc

SEQ ID NO: 1043280 - RNA, 23 nt, Human
cugggccacguuggccugcaggg

SEQ ID NO: 1043281 - RNA, 22 nt, Human
cuucucaugccgccgucccagc

SEQ ID NO: 1043282 - RNA, 19 nt, Human
gcaccuggaagaccucugc

SEQ ID NO: 1043283 - RNA, 22 nt, Human
gcagccgggcggccuccuugcc

SEQ ID NO: 1043284 - RNA, 19 nt, Human
gcuggggguggucgggcag

SEQ ID NO: 1043285 - RNA, 21 nt, Human
ggggccugcaggggggugagg

SEQ ID NO: 1043286 - RNA, 24 nt, Human
ggggccugcaggggggugaggucc

SEQ ID NO: 1043287 - RNA, 19 nt, Human
gguggugggggaggggcag

SEQ ID NO: 1043288 - RNA, 19 nt, Human
uccgcgcgcagccgggcgg

SEQ ID NO: 1043289 - RNA, 20 nt, Human
uccgcgcgcagccgggcggc

SEQ ID NO: 1043290 - RNA, 20 nt, Human
ucugcgcuggucuucucaug

SEQ ID NO: 1043291 - RNA, 26 nt, Human
ugcagagaccagguggggugauggag

SEQ ID NO: 1043292 - RNA, 22 nt, Human
ugcguggguguggucaguguag

SEQ ID NO: 1043293 - RNA, 18 nt, Human
uggagccagcugggggug

SEQ ID NO: 1043294 - RNA, 21 nt, Human
uggauguggaggacacaggga

SEQ ID NO: 1043295 - RNA, 22 nt, Human
uggauguggaggacacagggaa

SEQ ID NO: 1043296 - RNA, 23 nt, Human
uggugggggaggggcagucacgg

SEQ ID NO: 1043297 - RNA, 18 nt, Human
uguagccacugggccugg

SEQ ID NO: 1043298 - RNA, 19 nt, Human
ucaugcugcugucugcugu

SEQ ID NO: 1043299 - RNA, 19 nt, Human
ugcgaaugaucaagaucua

SEQ ID NO: 1043300 - RNA, 20 nt, Human
aaaguccucucaauagccuu

SEQ ID NO: 1043301 - RNA, 22 nt, Human
aacaaaaaacaaguuuauucca

SEQ ID NO: 1043302 - RNA, 20 nt, Human
aacaaguuuauuccacaccu

SEQ ID NO: 1043303 - RNA, 23 nt, Human
acaaaaaacaaguuuauuccaca

SEQ ID NO: 1043304 - RNA, 21 nt, Human
accaaugucaucaucacagcc

SEQ ID NO: 1043305 - RNA, 20 nt, Human
agacuugaaaacacugauca

SEQ ID NO: 1043306 - RNA, 24 nt, Human
agcacuuugggaggccgaagcggg

SEQ ID NO: 1043307 - RNA, 22 nt, Human
agcgggaggaucgcucgggucc

SEQ ID NO: 1043308 - RNA, 20 nt, Human
aggccgaagcgggaggaucg

SEQ ID NO: 1043309 - RNA, 23 nt, Human
agucagaagugucuugggaccug

SEQ ID NO: 1043310 - RNA, 24 nt, Human
auggguucuguuauuggcauuuuu

SEQ ID NO: 1043311 - RNA, 25 nt, Human
auuucggagugugcuuccuccuuca

SEQ ID NO: 1043312 - RNA, 23 nt, Human
caaaguccucucaauagccuucc

SEQ ID NO: 1043313 - RNA, 21 nt, Human
caaagugcuaagucagaagug

SEQ ID NO: 1043314 - RNA, 19 nt, Human
cacagccugccuguucuuu

SEQ ID NO: 1043315 - RNA, 24 nt, Human
cagcacuuugggaggccgaagcgg

SEQ ID NO: 1043316 - RNA, 21 nt, Human
cccuuccaguuugcauucccc

SEQ ID NO: 1043317 - RNA, 23 nt, Human
ccuguucuuuugaucccaaaagg

SEQ ID NO: 1043318 - RNA, 26 nt, Human
ccuucaauugcacauugccguauucc

SEQ ID NO: 1043319 - RNA, 18 nt, Human
cgcucggguccaagcguu

SEQ ID NO: 1043320 - RNA, 30 nt, Human
cucacgccuguaaaguaaucccagcacuuu

SEQ ID NO: 1043321 - RNA, 24 nt, Human
cuguaaaguaaucccagcacuuug

SEQ ID NO: 1043322 - RNA, 28 nt, Human
cuucacaaaugcaggaaaaugcauugcu

SEQ ID NO: 1043323 - RNA, 20 nt, Human
cuuccaguuugcauucccuu

SEQ ID NO: 1043324 - RNA, 27 nt, Human
ggcucacgccuguaaaguaaucccagg

SEQ ID NO: 1043325 - RNA, 24 nt, Human
gggcgcgguggcucacgccuguaa

SEQ ID NO: 1043326 - RNA, 30 nt, Human
gguggcucacgccuguaaaguaaucccagg

SEQ ID NO: 1043327 - RNA, 20 nt, Human
gugaaagucaugaaggauuc

SEQ ID NO: 1043328 - RNA, 20 nt, Human
uaacucagguacaccuggau

SEQ ID NO: 1043329 - RNA, 24 nt, Human
ucaaaguccucucaauagccuucc

SEQ ID NO: 1043330 - RNA, 21 nt, Human
ucaacagucuugucuguuucc

SEQ ID NO: 1043331 - RNA, 21 nt, Human
ucuaaaguaccucagaaaaca

SEQ ID NO: 1043332 - RNA, 18 nt, Human
ugaaagucaugaaggauu

SEQ ID NO: 1043333 - RNA, 22 nt, Human
ugaguuaacuaaacuggcacag

SEQ ID NO: 1043334 - RNA, 20 nt, Human
ugccuguucuuuugauccca

SEQ ID NO: 1043335 - RNA, 23 nt, Human
ugccuguucuuuugaucccaaaa

SEQ ID NO: 1043336 - RNA, 22 nt, Human
uggcacagccugccuguucuuu

SEQ ID NO: 1043337 - RNA, 30 nt, Human
uggcucacgccuguaaaguaaucccagcaa

SEQ ID NO: 1043338 - RNA, 28 nt, Human
uggcucacgccuguaaaguaaucccagg

SEQ ID NO: 1043339 - RNA, 19 nt, Human
ugggaggccgaagcgggag

SEQ ID NO: 1043340 - RNA, 23 nt, Human
ugggaggccgaagcgggaggauc

SEQ ID NO: 1043341 - RNA, 24 nt, Human
ugggaggccgaagcgggaggaucg

SEQ ID NO: 1043342 - RNA, 18 nt, Human
uguuuucuuucaucacuu

SEQ ID NO: 1043343 - RNA, 30 nt, Human
uucaaaguccucucaauagccuuccaaucu

SEQ ID NO: 1043344 - RNA, 21 nt, Human
uucaucacuuagguucauuuc

SEQ ID NO: 1043345 - RNA, 24 nt, Human
uucggccgggcgcgguggcucacg

SEQ ID NO: 1043346 - RNA, 24 nt, Human
uugggaggccgaagcgggaggauc

SEQ ID NO: 1043347 - RNA, 19 nt, Human
aaaaaacccacaaacccca

SEQ ID NO: 1043348 - RNA, 21 nt, Human
aaaaacccacaaaccccaccc

SEQ ID NO: 1043349 - RNA, 23 nt, Human
aaaccccacccgcgcccagcagg

SEQ ID NO: 1043350 - RNA, 24 nt, Human
aaagugcuggaauuagaguaguga

SEQ ID NO: 1043351 - RNA, 24 nt, Human
aaagugcugggauuacaggcguga

SEQ ID NO: 1043352 - RNA, 24 nt, Human
aaagugcugggauuacagguguga

SEQ ID NO: 1043353 - RNA, 21 nt, Human
aaccuccgccucccugcaacc

SEQ ID NO: 1043354 - RNA, 25 nt, Human
aagcaaucuuccugccucggccucc

SEQ ID NO: 1043355 - RNA, 19 nt, Human
aagcagaguccguacgucc

SEQ ID NO: 1043356 - RNA, 21 nt, Human
aagcgacccaggggucggcgu

SEQ ID NO: 1043357 - RNA, 25 nt, Human
aagcgauucuccugccucagccucc

SEQ ID NO: 1043358 - RNA, 19 nt, Human
aaguagcugggacuacagg

SEQ ID NO: 1043359 - RNA, 20 nt, Human
aaguagcugggacuacaggc

SEQ ID NO: 1043360 - RNA, 24 nt, Human
aaguagcugggacuacaggcacgc

SEQ ID NO: 1043361 - RNA, 22 nt, Human
aaguagcugggauuauacgugu

SEQ ID NO: 1043362 - RNA, 26 nt, Human
aagugcuggaauuagaguagugagcc

SEQ ID NO: 1043363 - RNA, 18 nt, Human
aagugcugggauuacagg

SEQ ID NO: 1043364 - RNA, 19 nt, Human
aagugcugggauuacaggc

SEQ ID NO: 1043365 - RNA, 19 nt, Human
aagugcugggauuacaggc

SEQ ID NO: 1043366 - RNA, 26 nt, Human
aagugcugggauuacaggcgugagcc

SEQ ID NO: 1043367 - RNA, 19 nt, Human
aagugcugggauuacaggu

SEQ ID NO: 1043368 - RNA, 26 nt, Human
aagugcugggauuacaggugugagcc

SEQ ID NO: 1043369 - RNA, 18 nt, Human
aauuagaguagugagcca

SEQ ID NO: 1043370 - RNA, 23 nt, Human
aauuagaguagugagccacugca

SEQ ID NO: 1043371 - RNA, 27 nt, Human
accacagucacuuuuuuuuuuuuuuuu

SEQ ID NO: 1043372 - RNA, 25 nt, Human
accauguugcccagacuggucuuga

SEQ ID NO: 1043373 - RNA, 24 nt, Human
accauguuggccaggauggucucg

SEQ ID NO: 1043374 - RNA, 24 nt, Human
acccaagcuggagugcaguggcau

SEQ ID NO: 1043375 - RNA, 22 nt, Human
acccacaaaccccacccgcgcc

SEQ ID NO: 1043376 - RNA, 19 nt, Human
acccaggcuggagugcagu

SEQ ID NO: 1043377 - RNA, 24 nt, Human
accuugugaucugcccgccucagc

SEQ ID NO: 1043378 - RNA, 22 nt, Human
acgcccggcccaccacgauaau

SEQ ID NO: 1043379 - RNA, 18 nt, Human
acgggguuucaccauguu

SEQ ID NO: 1043380 - RNA, 23 nt, Human
acgggguuucaccauguuggcca

SEQ ID NO: 1043381 - RNA, 24 nt, Human
acgggguuucaccauguuggccag

SEQ ID NO: 1043382 - RNA, 18 nt, Human
acgugaguuuauggaagg

SEQ ID NO: 1043383 - RNA, 28 nt, Human
acuugcccccuaacacuucccuuccccc

SEQ ID NO: 1043384 - RNA, 22 nt, Human
acuuuuuuuuuuuuuuuuuuuu

SEQ ID NO: 1043385 - RNA, 27 nt, Human
agaaaagagguggaaaaaaagggaccc

SEQ ID NO: 1043386 - RNA, 22 nt, Human
agaaaguacaaacgggugaaag

SEQ ID NO: 1043387 - RNA, 19 nt, Human
agagaugggguuucaccgu

SEQ ID NO: 1043388 - RNA, 18 nt, Human
agaggugacauugguguu

SEQ ID NO: 1043389 - RNA, 18 nt, Human
agaugccucagcauccuc

SEQ ID NO: 1043390 - RNA, 24 nt, Human
agcgauucuccugccucagccucc

SEQ ID NO: 1043391 - RNA, 22 nt, Human
aggcagcagcuuuuggcuuuua

SEQ ID NO: 1043392 - RNA, 26 nt, Human
aggcgacaugauccaagugggaggca

SEQ ID NO: 1043393 - RNA, 24 nt, Human
aggcugaagugcaguggugcaauc

SEQ ID NO: 1043394 - RNA, 25 nt, Human
aggcuggagugcaguggcacaaucu

SEQ ID NO: 1043395 - RNA, 19 nt, Human
aguagcugggacuacaggc

SEQ ID NO: 1043396 - RNA, 23 nt, Human
aguagcugggacuacaggcaugu

SEQ ID NO: 1043397 - RNA, 23 nt, Human
agucacuuuuuuuuuuuuuuuuu

SEQ ID NO: 1043398 - RNA, 24 nt, Human
agugauuauccugccucagccucc

SEQ ID NO: 1043399 - RNA, 20 nt, Human
agugcaguggcacaaucucg

SEQ ID NO: 1043400 - RNA, 24 nt, Human
agugcaguggcacaaucucggcuc

SEQ ID NO: 1043401 - RNA, 18 nt, Human
agugcaguggcaugauca

SEQ ID NO: 1043402 - RNA, 20 nt, Human
agugcaguggcaugaucauc

SEQ ID NO: 1043403 - RNA, 21 nt, Human
agugcaguggcaugaucaucg

SEQ ID NO: 1043404 - RNA, 20 nt, Human
agugcaguggugcaaucucg

SEQ ID NO: 1043405 - RNA, 24 nt, Human
agugcaguggugcaaucucggcuc

SEQ ID NO: 1043406 - RNA, 18 nt, Human
agugcugggauuacaggc

SEQ ID NO: 1043407 - RNA, 18 nt, Human
augggguuucaccguguu

SEQ ID NO: 1043408 - RNA, 19 nt, Human
augggguuucaccguguua

SEQ ID NO: 1043409 - RNA, 20 nt, Human
augggguuucaccguguuag

SEQ ID NO: 1043410 - RNA, 24 nt, Human
augggguuucaccguguuagccag

SEQ ID NO: 1043411 - RNA, 20 nt, Human
caaaccccacccgcgcccag

SEQ ID NO: 1043412 - RNA, 21 nt, Human
caaagugcuggaauuagagua

SEQ ID NO: 1043413 - RNA, 19 nt, Human
caaagugcugggauuacag

SEQ ID NO: 1043414 - RNA, 21 nt, Human
caaagugcugggauuacaggc

SEQ ID NO: 1043415 - RNA, 24 nt, Human
caaagugcugggauuacaggcgug

SEQ ID NO: 1043416 - RNA, 24 nt, Human
caaagugcugggauuacaggugug

SEQ ID NO: 1043417 - RNA, 23 nt, Human
caaccuccuccuccugguucaag

SEQ ID NO: 1043418 - RNA, 22 nt, Human
caagcaaucuuccugccucggc

SEQ ID NO: 1043419 - RNA, 27 nt, Human
caagcaaucuuccugccucggccuccc

SEQ ID NO: 1043420 - RNA, 22 nt, Human
caagcgauucuccugccucagc

SEQ ID NO: 1043421 - RNA, 24 nt, Human
caagugaucuucccucgucaucuc

SEQ ID NO: 1043422 - RNA, 22 nt, Human
caagugauuauccugccucagc

SEQ ID NO: 1043423 - RNA, 19 nt, Human
cacagucacuuuuuuuuuu

SEQ ID NO: 1043424 - RNA, 24 nt, Human
caccaugcccggcuaauuuuugua

SEQ ID NO: 1043425 - RNA, 22 nt, Human
caccauguugcccagacugguc

SEQ ID NO: 1043426 - RNA, 23 nt, Human
caccauguugcccagacuggucu

SEQ ID NO: 1043427 - RNA, 24 nt, Human
caccauguugcccagacuggucuu

SEQ ID NO: 1043428 - RNA, 18 nt, Human
caccauguuggccaggau

SEQ ID NO: 1043429 - RNA, 22 nt, Human
caccauguuggccaggaugguc

SEQ ID NO: 1043430 - RNA, 24 nt, Human
caccauguuggccaggauggucuc

SEQ ID NO: 1043431 - RNA, 19 nt, Human
caccgugugaacccguagu

SEQ ID NO: 1043432 - RNA, 18 nt, Human
caccguguuagccaggau

SEQ ID NO: 1043433 - RNA, 24 nt, Human
caccguguuagccaggauggucuc

SEQ ID NO: 1043434 - RNA, 20 nt, Human
cacucucacccaagcuggag

SEQ ID NO: 1043435 - RNA, 21 nt, Human
cacugcaaccuccuccuccug

SEQ ID NO: 1043436 - RNA, 19 nt, Human
cagaguagggccccaaauu

SEQ ID NO: 1043437 - RNA, 18 nt, Human
cagcaggagagccccaaa

SEQ ID NO: 1043438 - RNA, 21 nt, Human
cagccucuuaacuccugggcu

SEQ ID NO: 1043439 - RNA, 24 nt, Human
cagccucuuaacuccugggcucaa

SEQ ID NO: 1043440 - RNA, 21 nt, Human
caggcacgcaacaccaugccc

SEQ ID NO: 1043441 - RNA, 21 nt, Human
caguagagaugggguuucacc

SEQ ID NO: 1043442 - RNA, 24 nt, Human
caguagagaugggguuucaccgug

SEQ ID NO: 1043443 - RNA, 26 nt, Human
caguagagaugggguuucaccguguu

SEQ ID NO: 1043444 - RNA, 20 nt, Human
cauguugcccagacuggucu

SEQ ID NO: 1043445 - RNA, 24 nt, Human
cauguugcccagacuggucuugaa

SEQ ID NO: 1043446 - RNA, 21 nt, Human
cauugguguuugaaacagcug

SEQ ID NO: 1043447 - RNA, 20 nt, Human
ccaaagugcuggaauuagag

SEQ ID NO: 1043448 - RNA, 21 nt, Human
ccaaagugcuggaauuagagu

SEQ ID NO: 1043449 - RNA, 21 nt, Human
ccaaagugcugggauuacagg

SEQ ID NO: 1043450 - RNA, 21 nt, Human
ccaaagugcugggauuacagg

SEQ ID NO: 1043451 - RNA, 24 nt, Human
ccaaagugcugggauuacaggugu

SEQ ID NO: 1043452 - RNA, 23 nt, Human
ccacccuacuccaagaugagauc

SEQ ID NO: 1043453 - RNA, 20 nt, Human
ccacgcccggcccaccacga

SEQ ID NO: 1043454 - RNA, 22 nt, Human
ccaucuguaaugauccuauuuc

SEQ ID NO: 1043455 - RNA, 21 nt, Human
ccauugggcgggggccaggag

SEQ ID NO: 1043456 - RNA, 23 nt, Human
cccaagcuggagugcaguggcau

SEQ ID NO: 1043457 - RNA, 23 nt, Human
cccaaguagcugggacuacaggc

SEQ ID NO: 1043458 - RNA, 24 nt, Human
cccaaguagcugggacuacaggca

SEQ ID NO: 1043459 - RNA, 22 nt, Human
cccacaaaccccacccgcgccc

SEQ ID NO: 1043460 - RNA, 25 nt, Human
cccacaaaccccacccgcgcccagc

SEQ ID NO: 1043461 - RNA, 21 nt, Human
cccacccgcgcccagcaggag

SEQ ID NO: 1043462 - RNA, 24 nt, Human
cccacccuacuccaagaugagauc

SEQ ID NO: 1043463 - RNA, 20 nt, Human
cccagguucaagcgauucuc

SEQ ID NO: 1043464 - RNA, 23 nt, Human
cccagguucaagcgauucuccug

SEQ ID NO: 1043465 - RNA, 21 nt, Human
ccccaaaaggcgcgaggggcg

SEQ ID NO: 1043466 - RNA, 19 nt, Human
cccccuaacacuucccuuc

SEQ ID NO: 1043467 - RNA, 21 nt, Human
cccccuuuuuuuaaggacccc

SEQ ID NO: 1043468 - RNA, 22 nt, Human
ccccuaacacuucccuuccccc

SEQ ID NO: 1043469 - RNA, 24 nt, Human
ccccuaacacuucccuucccccag

SEQ ID NO: 1043470 - RNA, 23 nt, Human
cccgaguagcugggacuacaggc

SEQ ID NO: 1043471 - RNA, 24 nt, Human
cccgaguagcugggacuacaggca

SEQ ID NO: 1043472 - RNA, 22 nt, Human
cccgcgcccagcaggagagccc

SEQ ID NO: 1043473 - RNA, 19 nt, Human
ccgcccgccucagccucuc

SEQ ID NO: 1043474 - RNA, 24 nt, Human
ccgccucagccucccaaagugcug

SEQ ID NO: 1043475 - RNA, 23 nt, Human
ccgccucagccucucaaagugcu

SEQ ID NO: 1043476 - RNA, 26 nt, Human
ccgcgacuugcccccuaacacuuccc

SEQ ID NO: 1043477 - RNA, 20 nt, Human
ccgcggcggugggagcagcg

SEQ ID NO: 1043478 - RNA, 24 nt, Human
ccucccagguucaagcgauucucc

SEQ ID NO: 1043479 - RNA, 22 nt, Human
ccucuccccauugggcgggggc

SEQ ID NO: 1043480 - RNA, 22 nt, Human
ccugcaaccugcgccucccagg

SEQ ID NO: 1043481 - RNA, 23 nt, Human
ccugccucagccucccaaguagc

SEQ ID NO: 1043482 - RNA, 23 nt, Human
ccugccucagccucccgaguagc

SEQ ID NO: 1043483 - RNA, 24 nt, Human
ccugccucagccucccgaguagcu

SEQ ID NO: 1043484 - RNA, 22 nt, Human
ccugggcucaagugaucuuccc

SEQ ID NO: 1043485 - RNA, 19 nt, Human
ccugguucaagugauuauc

SEQ ID NO: 1043486 - RNA, 22 nt, Human
ccugguucaagugauuauccug

SEQ ID NO: 1043487 - RNA, 21 nt, Human
cgcaacaccaugcccggcuaa

SEQ ID NO: 1043488 - RNA, 24 nt, Human
cgggguuucaccauguuggccagg

SEQ ID NO: 1043489 - RNA, 22 nt, Human
cguccaaccgucggggguccgu

SEQ ID NO: 1043490 - RNA, 24 nt, Human
cgugauccgcccgccucagccucu

SEQ ID NO: 1043491 - RNA, 20 nt, Human
cucaaaggagacaggucacc

SEQ ID NO: 1043492 - RNA, 20 nt, Human
cucaagugaucuucccucgu

SEQ ID NO: 1043493 - RNA, 19 nt, Human
cucacugcaaccuccuccu

SEQ ID NO: 1043494 - RNA, 23 nt, Human
cucacugcaaccuccuccuccug

SEQ ID NO: 1043495 - RNA, 24 nt, Human
cucacugcaaccuccuccuccugg

SEQ ID NO: 1043496 - RNA, 25 nt, Human
cucagcauccucucaaaggagacag

SEQ ID NO: 1043497 - RNA, 24 nt, Human
cucagccucccaaguagcugggac

SEQ ID NO: 1043498 - RNA, 24 nt, Human
cucagccucccgaguagcugggac

SEQ ID NO: 1043499 - RNA, 24 nt, Human
cuccugaccucgugauccgcccgc

SEQ ID NO: 1043500 - RNA, 23 nt, Human
cuccugggcucaagugaucuucc

SEQ ID NO: 1043501 - RNA, 22 nt, Human
cucgcucugucaccaggcugaa

SEQ ID NO: 1043502 - RNA, 18 nt, Human
cugcaaccuccgccuccc

SEQ ID NO: 1043503 - RNA, 23 nt, Human
cugcaaccuccuccuccugguuc

SEQ ID NO: 1043504 - RNA, 23 nt, Human
cugcaaccugcgccucccagguu

SEQ ID NO: 1043505 - RNA, 24 nt, Human
cugcagccucuuaacuccugggcu

SEQ ID NO: 1043506 - RNA, 23 nt, Human
cugccucagccucccaaguagcu

SEQ ID NO: 1043507 - RNA, 23 nt, Human
cugccucggccucccaaagugcu

SEQ ID NO: 1043508 - RNA, 19 nt, Human
cugucaccaggcugaagug

SEQ ID NO: 1043509 - RNA, 18 nt, Human
cugucacccaggcuggag

SEQ ID NO: 1043510 - RNA, 25 nt, Human
cuuuuggcuuuuacaucaagcgacc

SEQ ID NO: 1043511 - RNA, 23 nt, Human
gacccaggggucggcguggccca

SEQ ID NO: 1043512 - RNA, 22 nt, Human
gaccucgugauccgcccgccuc

SEQ ID NO: 1043513 - RNA, 24 nt, Human
gaccucgugauccgcccgccucag

SEQ ID NO: 1043514 - RNA, 24 nt, Human
gaccuugugaucugcccgccucag

SEQ ID NO: 1043515 - RNA, 22 nt, Human
gacuacaggcacgcaacaccau

SEQ ID NO: 1043516 - RNA, 24 nt, Human
gacuacaggcaugugccaccaugc

SEQ ID NO: 1043517 - RNA, 24 nt, Human
gacuugcccccuaacacuucccuu

SEQ ID NO: 1043518 - RNA, 24 nt, Human
gagacgggguuucaccauguuggc

SEQ ID NO: 1043519 - RNA, 18 nt, Human
gagaugggguuucaccgu

SEQ ID NO: 1043520 - RNA, 24 nt, Human
gagaugggguuucaccguguuagc

SEQ ID NO: 1043521 - RNA, 20 nt, Human
gagcagcgccggagccgggg

SEQ ID NO: 1043522 - RNA, 25 nt, Human
gaguagcugggacuacaggcaugug

SEQ ID NO: 1043523 - RNA, 18 nt, Human
gagugcaguggcaugauc

SEQ ID NO: 1043524 - RNA, 20 nt, Human
gaguucaagcaaucuuccug

SEQ ID NO: 1043525 - RNA, 18 nt, Human
gauuacaggcgugagcca

SEQ ID NO: 1043526 - RNA, 22 nt, Human
gauuacaggcgugagccaccgc

SEQ ID NO: 1043527 - RNA, 22 nt, Human
gauuacaggcgugagccaccgc

SEQ ID NO: 1043528 - RNA, 18 nt, Human
gauuacaggugugagcca

SEQ ID NO: 1043529 - RNA, 21 nt, Human
gauuacaggugugagccacca

SEQ ID NO: 1043530 - RNA, 22 nt, Human
gauuacaggugugagccaccac

SEQ ID NO: 1043531 - RNA, 20 nt, Human
gauugggagaaaagaggugg

SEQ ID NO: 1043532 - RNA, 21 nt, Human
gcaaccuccuccuccugguuc

SEQ ID NO: 1043533 - RNA, 21 nt, Human
gcaaccugcgccucccagguu

SEQ ID NO: 1043534 - RNA, 22 nt, Human
gcaaccugcgccucccagguuc

SEQ ID NO: 1043535 - RNA, 23 nt, Human
gcccagcuaauuuuuuguauuuu

SEQ ID NO: 1043536 - RNA, 18 nt, Human
gccccaaaaggcgcgagg

SEQ ID NO: 1043537 - RNA, 22 nt, Human
gcccggcccaccacgauaauuu

SEQ ID NO: 1043538 - RNA, 22 nt, Human
gcccggcuaauuuuuguauuuu

SEQ ID NO: 1043539 - RNA, 23 nt, Human
gccucagccucccaaagugcugg

SEQ ID NO: 1043540 - RNA, 23 nt, Human
gccucagccucucaaagugcugg

SEQ ID NO: 1043541 - RNA, 24 nt, Human
gcgauucuccugccucagccuccc

SEQ ID NO: 1043542 - RNA, 20 nt, Human
gcucacugcaaccuccuccu

SEQ ID NO: 1043543 - RNA, 22 nt, Human
gcucacugcaaccuccuccucc

SEQ ID NO: 1043544 - RNA, 25 nt, Human
gcucugucacccaggcuggagugca

SEQ ID NO: 1043545 - RNA, 19 nt, Human
gcuggagugcaguggcaca

SEQ ID NO: 1043546 - RNA, 24 nt, Human
ggacuacaggcaugugccaccaug

SEQ ID NO: 1043547 - RNA, 27 nt, Human
ggagagccccaaaaggcgcgaggggcg

SEQ ID NO: 1043548 - RNA, 24 nt, Human
ggauggucucgaucuccugaccuc

SEQ ID NO: 1043549 - RNA, 20 nt, Human
ggccaggaggagaggugaca

SEQ ID NO: 1043550 - RNA, 22 nt, Human
ggcggugggagcagcgccggaa

SEQ ID NO: 1043551 - RNA, 19 nt, Human
gggcucaagugaucuuccc

SEQ ID NO: 1043552 - RNA, 24 nt, Human
ggggccaggaggagaggugacauu

SEQ ID NO: 1043553 - RNA, 19 nt, Human
ggggcccacccuacuccaa

SEQ ID NO: 1043554 - RNA, 23 nt, Human
gggguuucaccauguuggccagg

SEQ ID NO: 1043555 - RNA, 22 nt, Human
gggguuucaccguguuagccag

SEQ ID NO: 1043556 - RNA, 22 nt, Human
ggguuucaccguguuagccagg

SEQ ID NO: 1043557 - RNA, 24 nt, Human
gguuucaccauguuggccaggaug

SEQ ID NO: 1043558 - RNA, 23 nt, Human
guagagacgagggucucaccaug

SEQ ID NO: 1043559 - RNA, 23 nt, Human
guagagacgggguuucaccaugu

SEQ ID NO: 1043560 - RNA, 23 nt, Human
gucccacucucacccaagcugga

SEQ ID NO: 1043561 - RNA, 24 nt, Human
gucucgcucugucaccaggcugaa

SEQ ID NO: 1043562 - RNA, 24 nt, Human
gucuugcucugucacccaggcugg

SEQ ID NO: 1043563 - RNA, 22 nt, Human
gugagccacugcacguggccuc

SEQ ID NO: 1043564 - RNA, 22 nt, Human
gugauccgcccgccucagccuc

SEQ ID NO: 1043565 - RNA, 24 nt, Human
gugaucugcccgccucagccuccc

SEQ ID NO: 1043566 - RNA, 24 nt, Human
gugauuauccugccucagccuccc

SEQ ID NO: 1043567 - RNA, 24 nt, Human
guggaaaaaaacccacaaacccca

SEQ ID NO: 1043568 - RNA, 18 nt, Human
guggcccagaaaguacaa

SEQ ID NO: 1043569 - RNA, 21 nt, Human
guucaagugauuauccugccu

SEQ ID NO: 1043570 - RNA, 24 nt, Human
uaauuuuuguauuuuuaguagaga

SEQ ID NO: 1043571 - RNA, 24 nt, Human
uaauuuuuuguauuuucaguagag

SEQ ID NO: 1043572 - RNA, 25 nt, Human
uaauuuuuuguauuuucaguagaga

SEQ ID NO: 1043573 - RNA, 23 nt, Human
uacaggcacgcaacaccaugccc

SEQ ID NO: 1043574 - RNA, 24 nt, Human
uacaggcaugugccaccaugccca

SEQ ID NO: 1043575 - RNA, 23 nt, Human
uacaggcgugagccaccgcgccc

SEQ ID NO: 1043576 - RNA, 24 nt, Human
uacaggcgugagccaccgcgcccu

SEQ ID NO: 1043577 - RNA, 23 nt, Human
uacaggugugagccaccacgccc

SEQ ID NO: 1043578 - RNA, 22 nt, Human
uagagacgggguuucaccaugu

SEQ ID NO: 1043579 - RNA, 24 nt, Human
uaguagagacgggguuucaccaug

SEQ ID NO: 1043580 - RNA, 26 nt, Human
uaguagagacgggguuucaccauguu

SEQ ID NO: 1043581 - RNA, 22 nt, Human
ucaaagugcugggauuacaggc

SEQ ID NO: 1043582 - RNA, 24 nt, Human
ucaaagugcugggauuacaggcgu

SEQ ID NO: 1043583 - RNA, 24 nt, Human
ucaccauguuggccaggauggucu

SEQ ID NO: 1043584 - RNA, 22 nt, Human
ucacccaggcuggagugcagug

SEQ ID NO: 1043585 - RNA, 24 nt, Human
ucaccguguuagccaggauggucu

SEQ ID NO: 1043586 - RNA, 19 nt, Human
ucacugcaaccuccgccuc

SEQ ID NO: 1043587 - RNA, 21 nt, Human
ucacugcaaccuccgccuccc

SEQ ID NO: 1043588 - RNA, 23 nt, Human
ucacugcaaccuccgccucccug

SEQ ID NO: 1043589 - RNA, 24 nt, Human
ucacugcaaccuccgccucccugc

SEQ ID NO: 1043590 - RNA, 24 nt, Human
ucacugcaaccuccgccucccugc

SEQ ID NO: 1043591 - RNA, 23 nt, Human
ucacugcaaccuccuccuccugg

SEQ ID NO: 1043592 - RNA, 24 nt, Human
ucacugcaaccuccuccuccuggu

SEQ ID NO: 1043593 - RNA, 27 nt, Human
ucacugcaaccuccuccuccugguuca

SEQ ID NO: 1043594 - RNA, 25 nt, Human
ucacugcagccucuuaacuccuggg

SEQ ID NO: 1043595 - RNA, 18 nt, Human
ucagccucccaaguagcu

SEQ ID NO: 1043596 - RNA, 20 nt, Human
ucagccucccaaguagcugg

SEQ ID NO: 1043597 - RNA, 23 nt, Human
ucagccucccgaguagcugggac

SEQ ID NO: 1043598 - RNA, 18 nt, Human
ucaguagagaugggguuu

SEQ ID NO: 1043599 - RNA, 22 nt, Human
ucaguagagaugggguuucacc

SEQ ID NO: 1043600 - RNA, 24 nt, Human
ucaguagagaugggguuucaccgu

SEQ ID NO: 1043601 - RNA, 22 nt, Human
uccaagugggaggcagcagcuu

SEQ ID NO: 1043602 - RNA, 18 nt, Human
ucccaaagugcuggaauu

SEQ ID NO: 1043603 - RNA, 23 nt, Human
ucccaaagugcugggauuacagg

SEQ ID NO: 1043604 - RNA, 24 nt, Human
ucccaaguagcugggacuacaggc

SEQ ID NO: 1043605 - RNA, 22 nt, Human
ucccacucucacccaagcugga

SEQ ID NO: 1043606 - RNA, 21 nt, Human
ucccagguucaagcgauucuc

SEQ ID NO: 1043607 - RNA, 24 nt, Human
ucccagguucaagcgauucuccug

SEQ ID NO: 1043608 - RNA, 24 nt, Human
ucccgaguagcugggacuacaggc

SEQ ID NO: 1043609 - RNA, 24 nt, Human
ucccugcaaccugcgccucccagg

SEQ ID NO: 1043610 - RNA, 21 nt, Human
uccgcccgccucagccucuca

SEQ ID NO: 1043611 - RNA, 20 nt, Human
uccugggcucaagugaucuu

SEQ ID NO: 1043612 - RNA, 23 nt, Human
uccugguucaagugauuauccuc

SEQ ID NO: 1043613 - RNA, 23 nt, Human
uccugguucaagugauuauccug

SEQ ID NO: 1043614 - RNA, 22 nt, Human
uccuugugcgagggaugaaaau

SEQ ID NO: 1043615 - RNA, 24 nt, Human
ucucaaagugcugggauuacaggc

SEQ ID NO: 1043616 - RNA, 18 nt, Human
ucucaaguagcugggauu

SEQ ID NO: 1043617 - RNA, 22 nt, Human
ucucaaguagcugggauuauac

SEQ ID NO: 1043618 - RNA, 26 nt, Human
ucucaccauguugcccagacuggucu

SEQ ID NO: 1043619 - RNA, 26 nt, Human
ucuccugccucagccucccaaguagc

SEQ ID NO: 1043620 - RNA, 23 nt, Human
ucucgcucugucaccaggcugaa

SEQ ID NO: 1043621 - RNA, 23 nt, Human
ucugaguucaagcaaucuuccug

SEQ ID NO: 1043622 - RNA, 21 nt, Human
ucugcccgccucagccuccca

SEQ ID NO: 1043623 - RNA, 24 nt, Human
ucugucacccaggcuggagugcag

SEQ ID NO: 1043624 - RNA, 22 nt, Human
ucuuaacuccugggcucaagug

SEQ ID NO: 1043625 - RNA, 18 nt, Human
ucuugaacuucugaguuc

SEQ ID NO: 1043626 - RNA, 23 nt, Human
ucuugaacuucugaguucaagca

SEQ ID NO: 1043627 - RNA, 23 nt, Human
ucuugcucugucacccaggcugg

SEQ ID NO: 1043628 - RNA, 24 nt, Human
ucuugcucugucacccaggcugga

SEQ ID NO: 1043629 - RNA, 18 nt, Human
ucuuuuuuugagacagag

SEQ ID NO: 1043630 - RNA, 19 nt, Human
ugaaaggugguccccagag

SEQ ID NO: 1043631 - RNA, 24 nt, Human
ugaacuucugaguucaagcaaucu

SEQ ID NO: 1043632 - RNA, 19 nt, Human
ugaagugcaguggugcaau

SEQ ID NO: 1043633 - RNA, 24 nt, Human
ugaagugcaguggugcaaucucgg

SEQ ID NO: 1043634 - RNA, 18 nt, Human
ugagacagagucuugcuc

SEQ ID NO: 1043635 - RNA, 22 nt, Human
ugagacagagucuugcucuguc

SEQ ID NO: 1043636 - RNA, 21 nt, Human
ugaguucaagcaaucuuccug

SEQ ID NO: 1043637 - RNA, 24 nt, Human
ugaguucaagcaaucuuccugccu

SEQ ID NO: 1043638 - RNA, 18 nt, Human
ugcacguggccucaaucc

SEQ ID NO: 1043639 - RNA, 22 nt, Human
ugcaguggugcaaucucggcuc

SEQ ID NO: 1043640 - RNA, 24 nt, Human
ugcccagacuggucuugaacuucu

SEQ ID NO: 1043641 - RNA, 24 nt, Human
ugcccggcuaauuuuuguauuuuu

SEQ ID NO: 1043642 - RNA, 24 nt, Human
ugccucagccucccaaguagcugg

SEQ ID NO: 1043643 - RNA, 24 nt, Human
ugccucagccucccgaguagcugg

SEQ ID NO: 1043644 - RNA, 21 nt, Human
ugccucggccucccaaagugc

SEQ ID NO: 1043645 - RNA, 24 nt, Human
ugccucggccucccaaagugcugg

SEQ ID NO: 1043646 - RNA, 24 nt, Human
ugcucugucacccaggcuggagug

SEQ ID NO: 1043647 - RNA, 24 nt, Human
ugcugggauuacaggcgugagcca

SEQ ID NO: 1043648 - RNA, 24 nt, Human
ugcugggauuacaggugugagcca

SEQ ID NO: 1043649 - RNA, 19 nt, Human
uggaaaaaaacccacaaac

SEQ ID NO: 1043650 - RNA, 20 nt, Human
uggaaaaaaacccacaaacc

SEQ ID NO: 1043651 - RNA, 23 nt, Human
uggaaaaaaacccacaaacccca

SEQ ID NO: 1043652 - RNA, 24 nt, Human
uggaaaaaaacccacaaaccccac

SEQ ID NO: 1043653 - RNA, 22 nt, Human
uggaauuagaguagugagccac

SEQ ID NO: 1043654 - RNA, 22 nt, Human
uggaauuagaguagugagccac

SEQ ID NO: 1043655 - RNA, 24 nt, Human
uggaauuagaguagugagccacug

SEQ ID NO: 1043656 - RNA, 23 nt, Human
uggagugcaguggcacaaucucg

SEQ ID NO: 1043657 - RNA, 24 nt, Human
uggagugcaguggcacaaucucgg

SEQ ID NO: 1043658 - RNA, 19 nt, Human
uggagugcaguggcaugau

SEQ ID NO: 1043659 - RNA, 25 nt, Human
uggagugcaguggcaugaucaucgg

SEQ ID NO: 1043660 - RNA, 24 nt, Human
uggcacaaucucggcucacugcaa

SEQ ID NO: 1043661 - RNA, 24 nt, Human
uggccaggauggucucgaucucuu

SEQ ID NO: 1043662 - RNA, 22 nt, Human
uggcccagaaaguacaaacggg

SEQ ID NO: 1043663 - RNA, 21 nt, Human
uggccucaaucccccacuccc

SEQ ID NO: 1043664 - RNA, 24 nt, Human
ugggacuacaggcacgcaacacca

SEQ ID NO: 1043665 - RNA, 18 nt, Human
ugggacuacaggcaugug

SEQ ID NO: 1043666 - RNA, 21 nt, Human
ugggacuacaggcaugugcca

SEQ ID NO: 1043667 - RNA, 22 nt, Human
ugggacuacaggcaugugccac

SEQ ID NO: 1043668 - RNA, 24 nt, Human
ugggacuacaggcaugugccacca

SEQ ID NO: 1043669 - RNA, 20 nt, Human
ugggagcagcgccggagccg

SEQ ID NO: 1043670 - RNA, 18 nt, Human
ugggauuacaggcgugag

SEQ ID NO: 1043671 - RNA, 19 nt, Human
ugggauuacaggcgugagc

SEQ ID NO: 1043672 - RNA, 21 nt, Human
ugggauuacaggcgugagcca

SEQ ID NO: 1043673 - RNA, 22 nt, Human
ugggauuacaggcgugagccac

SEQ ID NO: 1043674 - RNA, 23 nt, Human
ugggauuacaggcgugagccacc

SEQ ID NO: 1043675 - RNA, 24 nt, Human
ugggauuacaggcgugagccaccg

SEQ ID NO: 1043676 - RNA, 18 nt, Human
ugggauuacaggugugag

SEQ ID NO: 1043677 - RNA, 19 nt, Human
ugggauuacaggugugagc

SEQ ID NO: 1043678 - RNA, 22 nt, Human
ugggauuacaggugugagccac

SEQ ID NO: 1043679 - RNA, 23 nt, Human
ugggauuacaggugugagccacc

SEQ ID NO: 1043680 - RNA, 24 nt, Human
ugggauuacaggugugagccacca

SEQ ID NO: 1043681 - RNA, 22 nt, Human
ugggauuauacgugugcaccac

SEQ ID NO: 1043682 - RNA, 24 nt, Human
ugggauuauacgugugcaccacca

SEQ ID NO: 1043683 - RNA, 20 nt, Human
ugggcucaagugaucuuccc

SEQ ID NO: 1043684 - RNA, 24 nt, Human
ugggguuucaccguguuagccagg

SEQ ID NO: 1043685 - RNA, 25 nt, Human
uguagagacgagggucucaccaugu

SEQ ID NO: 1043686 - RNA, 21 nt, Human
uguauuuuuaguagagacggg

SEQ ID NO: 1043687 - RNA, 22 nt, Human
ugugagccaccacgcccggccc

SEQ ID NO: 1043688 - RNA, 18 nt, Human
uuaguagagacgggguuu

SEQ ID NO: 1043689 - RNA, 22 nt, Human
uuaguagagacgggguuucacc

SEQ ID NO: 1043690 - RNA, 24 nt, Human
uuaguagagacgggguuucaccau

SEQ ID NO: 1043691 - RNA, 21 nt, Human
uucaagcaaucuuccugccuc

SEQ ID NO: 1043692 - RNA, 24 nt, Human
uucaagcaaucuuccugccucggc

SEQ ID NO: 1043693 - RNA, 21 nt, Human
uucaagcgauucuccugccuc

SEQ ID NO: 1043694 - RNA, 23 nt, Human
uucaagcgauucuccugccucag

SEQ ID NO: 1043695 - RNA, 24 nt, Human
uucaagcgauucuccugccucagc

SEQ ID NO: 1043696 - RNA, 18 nt, Human
uucaagugauuauccugc

SEQ ID NO: 1043697 - RNA, 21 nt, Human
uucaagugauuauccugccuc

SEQ ID NO: 1043698 - RNA, 23 nt, Human
uucaagugauuauccugccucag

SEQ ID NO: 1043699 - RNA, 24 nt, Human
uugcucugucacccaggcuggagu

SEQ ID NO: 1043700 - RNA, 19 nt, Human
uuucaccauguuggccagg

SEQ ID NO: 1043701 - RNA, 20 nt, Human
uuucaccauguuggccagga

SEQ ID NO: 1043702 - RNA, 19 nt, Human
uuucaccguguuagccagg

SEQ ID NO: 1043703 - RNA, 24 nt, Human
uuuucaguagagaugggguuucac

SEQ ID NO: 1043704 - RNA, 21 nt, Human
uuuuguauuuuuaguagagac

SEQ ID NO: 1043705 - RNA, 24 nt, Human
uuuuuaguagagacgggguuucac

SEQ ID NO: 1043706 - RNA, 21 nt, Human
uuuuuguauuuucaguagaga

SEQ ID NO: 1043707 - RNA, 20 nt, Human
uuuuuguauuuuuaguagag

SEQ ID NO: 1043708 - RNA, 24 nt, Human
uuuuuuguauuuucaguagagaug

SEQ ID NO: 1043709 - RNA, 28 nt, Human
uuuuuuuuuuguagagacgagggucuca

SEQ ID NO: 1043710 - RNA, 25 nt, Human
uuuuuuuuuuuuugagacgagucuc

SEQ ID NO: 1043711 - RNA, 18 nt, Human
uuuuuuuuuuuuuuuuug

SEQ ID NO: 1043712 - RNA, 19 nt, Human
aagagcuggaaauucacga

SEQ ID NO: 1043713 - RNA, 19 nt, Human
cagcugaaagguacaggua

SEQ ID NO: 1043714 - RNA, 19 nt, Human
cccugcuccugggcucucc

SEQ ID NO: 1043715 - RNA, 22 nt, Human
cuuguaagauuucucuccuggu

SEQ ID NO: 1043716 - RNA, 21 nt, Human
gaauuuucuggagcauuauac

SEQ ID NO: 1043717 - RNA, 21 nt, Human
uauuuuugaaagagcuggaaa

SEQ ID NO: 1043718 - RNA, 18 nt, Human
uccguggccucgcggccg

SEQ ID NO: 1043719 - RNA, 24 nt, Human
ugaauuuucuggagcauuauacau

SEQ ID NO: 1043720 - RNA, 24 nt, Human
ugugaauuuucuggagcauuauac

SEQ ID NO: 1043721 - RNA, 21 nt, Human
uugaaagagcuggaaauucac

SEQ ID NO: 1043722 - RNA, 21 nt, Human
uuuauuuuugaaagagcugga

SEQ ID NO: 1043723 - RNA, 22 nt, Human
aacccuaggccuccccaacccc

SEQ ID NO: 1043724 - RNA, 19 nt, Human
agcaguccugggaccugau

SEQ ID NO: 1043725 - RNA, 23 nt, Human
agugcaauggcgcgaucuuggcu

SEQ ID NO: 1043726 - RNA, 24 nt, Human
agugcaauggcgcgaucuuggcuc

SEQ ID NO: 1043727 - RNA, 18 nt, Human
caaccuccaccucccgag

SEQ ID NO: 1043728 - RNA, 21 nt, Human
cacugcaaccuccaccucccg

SEQ ID NO: 1043729 - RNA, 23 nt, Human
ccaccucccgaguagcugcgauc

SEQ ID NO: 1043730 - RNA, 19 nt, Human
ccacucccuggcuucaacc

SEQ ID NO: 1043731 - RNA, 23 nt, Human
cccaaccccacaacuuccuggga

SEQ ID NO: 1043732 - RNA, 18 nt, Human
cccaggcuggagugcaau

SEQ ID NO: 1043733 - RNA, 22 nt, Human
cccaggcuggagugcaauggcg

SEQ ID NO: 1043734 - RNA, 19 nt, Human
ccccaaccccacaacuucc

SEQ ID NO: 1043735 - RNA, 19 nt, Human
cccuaggccuccccaaccc

SEQ ID NO: 1043736 - RNA, 23 nt, Human
cccucugugggauggggacaggc

SEQ ID NO: 1043737 - RNA, 22 nt, Human
ccuaacccuaggccuccccaac

SEQ ID NO: 1043738 - RNA, 22 nt, Human
ccucaaggucuugccuaacccu

SEQ ID NO: 1043739 - RNA, 24 nt, Human
cucacugcaaccuccaccucccga

SEQ ID NO: 1043740 - RNA, 22 nt, Human
cuccccaaccccacaacuuccu

SEQ ID NO: 1043741 - RNA, 18 nt, Human
cucccuggcuucaacccc

SEQ ID NO: 1043742 - RNA, 18 nt, Human
cugaggacaaauggggac

SEQ ID NO: 1043743 - RNA, 18 nt, Human
cugcaaccuccaccuccc

SEQ ID NO: 1043744 - RNA, 18 nt, Human
gccuccccaaccccacaa

SEQ ID NO: 1043745 - RNA, 19 nt, Human
gcuggagugcaauggcgcg

SEQ ID NO: 1043746 - RNA, 24 nt, Human
ggaguugcccaggcuggagugcaa

SEQ ID NO: 1043747 - RNA, 19 nt, Human
gggauggggacaggcaggg

SEQ ID NO: 1043748 - RNA, 20 nt, Human
gucucuuucuuuuuuuucuu

SEQ ID NO: 1043749 - RNA, 21 nt, Human
ucacacuacauuaucuuccuc

SEQ ID NO: 1043750 - RNA, 18 nt, Human
ucacugcaaccuccaccu

SEQ ID NO: 1043751 - RNA, 19 nt, Human
ucacugcaaccuccaccuc

SEQ ID NO: 1043752 - RNA, 22 nt, Human
ucacugcaaccuccaccucccg

SEQ ID NO: 1043753 - RNA, 26 nt, Human
ucacugcaaccuccaccucccgagua

SEQ ID NO: 1043754 - RNA, 24 nt, Human
uccccaaccccacaacuuccuggg

SEQ ID NO: 1043755 - RNA, 24 nt, Human
ucccgaguagcugcgaucacaggc

SEQ ID NO: 1043756 - RNA, 19 nt, Human
uccuugcccucugugggau

SEQ ID NO: 1043757 - RNA, 20 nt, Human
ucucuuucuuuuuuuucuuu

SEQ ID NO: 1043758 - RNA, 20 nt, Human
ucuuuauaggcacacgggga

SEQ ID NO: 1043759 - RNA, 18 nt, Human
ugaugcagcccuuguagg

SEQ ID NO: 1043760 - RNA, 18 nt, Human
ugcccaggcuggagugca

SEQ ID NO: 1043761 - RNA, 21 nt, Human
ugcccaggcuggagugcaaug

SEQ ID NO: 1043762 - RNA, 21 nt, Human
ugcccaggcuggagugcaaug

SEQ ID NO: 1043763 - RNA, 24 nt, Human
ugccuaacccuaggccuccccaac

SEQ ID NO: 1043764 - RNA, 19 nt, Human
ugccucaaggucuugccua

SEQ ID NO: 1043765 - RNA, 23 nt, Human
uggagugcaauggcgcgaucuug

SEQ ID NO: 1043766 - RNA, 24 nt, Human
uggagugcaauggcgcgaucuugg

SEQ ID NO: 1043767 - RNA, 24 nt, Human
ugggauggucucuuucuuuuuuuu

SEQ ID NO: 1043768 - RNA, 18 nt, Human
uuccugggauggucucuu

SEQ ID NO: 1043769 - RNA, 22 nt, Human
uuucuuuuuuuucuuucuuuuu

SEQ ID NO: 1043770 - RNA, 20 nt, Human
uuuuuuuucuuucuuuucuu

SEQ ID NO: 1043771 - RNA, 23 nt, Human
acaacacagaccggcaguacccc

SEQ ID NO: 1043772 - RNA, 25 nt, Human
acacaucuacuucuaagacaacaca

SEQ ID NO: 1043773 - RNA, 20 nt, Human
acaucuacuucuaagacaac

SEQ ID NO: 1043774 - RNA, 18 nt, Human
accacugucacaacccca

SEQ ID NO: 1043775 - RNA, 18 nt, Human
accccaccccuucugcca

SEQ ID NO: 1043776 - RNA, 21 nt, Human
agacaggagcagagcagcagc

SEQ ID NO: 1043777 - RNA, 19 nt, Human
agcccccuccucccacccc

SEQ ID NO: 1043778 - RNA, 18 nt, Human
aggagacaggagcagagc

SEQ ID NO: 1043779 - RNA, 21 nt, Human
caaccccaauuuccucagccc

SEQ ID NO: 1043780 - RNA, 18 nt, Human
cacaaccccaauuuccuc

SEQ ID NO: 1043781 - RNA, 26 nt, Human
cacagaccggcaguaccccauccccc

SEQ ID NO: 1043782 - RNA, 21 nt, Human
caccccaccccuucugccaag

SEQ ID NO: 1043783 - RNA, 22 nt, Human
caccccuucugccaagcucccc

SEQ ID NO: 1043784 - RNA, 20 nt, Human
cacgcccagccucugcgccu

SEQ ID NO: 1043785 - RNA, 22 nt, Human
cagccacaccuccggccacaag

SEQ ID NO: 1043786 - RNA, 24 nt, Human
cagcccccuccucccaccccaccc

SEQ ID NO: 1043787 - RNA, 18 nt, Human
cagcugagcagcgucccu

SEQ ID NO: 1043788 - RNA, 19 nt, Human
ccccaccccuucugccaag

SEQ ID NO: 1043789 - RNA, 18 nt, Human
cccccuccucccacccca

SEQ ID NO: 1043790 - RNA, 19 nt, Human
ccccuccucccaccccacc

SEQ ID NO: 1043791 - RNA, 24 nt, Human
cccgcggcccaaaggaaccggggc

SEQ ID NO: 1043792 - RNA, 24 nt, Human
ccggcaguaccccaucccccauga

SEQ ID NO: 1043793 - RNA, 27 nt, Human
ccucccaccccaccccuucugccaagc

SEQ ID NO: 1043794 - RNA, 18 nt, Human
cgcugugggaagaggggc

SEQ ID NO: 1043795 - RNA, 19 nt, Human
cgcugugggaagaggggcu

SEQ ID NO: 1043796 - RNA, 18 nt, Human
cggcccaaaggaacaaga

SEQ ID NO: 1043797 - RNA, 26 nt, Human
cuccucccaccccaccccuucugcca

SEQ ID NO: 1043798 - RNA, 20 nt, Human
gacaggagacaggagcagag

SEQ ID NO: 1043799 - RNA, 24 nt, Human
gaccacugucacaaccccaauuuc

SEQ ID NO: 1043800 - RNA, 18 nt, Human
gagcagcagcugagcagc

SEQ ID NO: 1043801 - RNA, 18 nt, Human
gcaaguaggguaggacag

SEQ ID NO: 1043802 - RNA, 20 nt, Human
gcccccuccucccaccccac

SEQ ID NO: 1043803 - RNA, 24 nt, Human
gcggcccaaaggaacaagaagcug

SEQ ID NO: 1043804 - RNA, 22 nt, Human
gcgucgggccgucgacgagacc

SEQ ID NO: 1043805 - RNA, 22 nt, Human
ggaagaggggcuaugcgcgucg

SEQ ID NO: 1043806 - RNA, 18 nt, Human
ggcggcccccgcuccggc

SEQ ID NO: 1043807 - RNA, 19 nt, Human
guacagcccgcggcccaaa

SEQ ID NO: 1043808 - RNA, 26 nt, Human
uacagcccgcggcccaaaggaacaag

SEQ ID NO: 1043809 - RNA, 23 nt, Human
uccacagccacaccuccggccac

SEQ ID NO: 1043810 - RNA, 21 nt, Human
ucccaccccaccccuucugcc

SEQ ID NO: 1043811 - RNA, 22 nt, Human
ucccccaugaccacugucacaa

SEQ ID NO: 1043812 - RNA, 20 nt, Human
uccccggccagcucuccaca

SEQ ID NO: 1043813 - RNA, 21 nt, Human
uccucagcccccuccucccac

SEQ ID NO: 1043814 - RNA, 23 nt, Human
uccucagcccccuccucccaccc

SEQ ID NO: 1043815 - RNA, 24 nt, Human
uccucagcccccuccucccacccc

SEQ ID NO: 1043816 - RNA, 25 nt, Human
uccucccaccccaccccuucugcca

SEQ ID NO: 1043817 - RNA, 19 nt, Human
ucuccacagccacaccucc

SEQ ID NO: 1043818 - RNA, 19 nt, Human
ugaccacugucacaacccc

SEQ ID NO: 1043819 - RNA, 21 nt, Human
ugagcagcgucccuccccggc

SEQ ID NO: 1043820 - RNA, 26 nt, Human
ugccaagcuccccguaugggggcucu

SEQ ID NO: 1043821 - RNA, 24 nt, Human
ugguacagcccgcggcccaaagga

SEQ ID NO: 1043822 - RNA, 19 nt, Human
uguagcgcugugggaagag

SEQ ID NO: 1043823 - RNA, 24 nt, Human
ugucacaaccccaauuuccucagc

SEQ ID NO: 1043824 - RNA, 21 nt, Human
uuuccucagcccccuccuccc

SEQ ID NO: 1043825 - RNA, 21 nt, Human
aagaacauggucaagcaugug

SEQ ID NO: 1043826 - RNA, 23 nt, Human
aaguguccugcacucaugaaagu

SEQ ID NO: 1043827 - RNA, 21 nt, Human
aauugcucuucaucggggcac

SEQ ID NO: 1043828 - RNA, 21 nt, Human
acucacccacagucucugcag

SEQ ID NO: 1043829 - RNA, 18 nt, Human
aggcucuggagggagagc

SEQ ID NO: 1043830 - RNA, 19 nt, Human
auugggcuucucaugauga

SEQ ID NO: 1043831 - RNA, 21 nt, Human
caaaaagcaugugaaagaaca

SEQ ID NO: 1043832 - RNA, 21 nt, Human
caaaguaggugugcucaaagc

SEQ ID NO: 1043833 - RNA, 24 nt, Human
caagaaugaggugugugagcccug

SEQ ID NO: 1043834 - RNA, 20 nt, Human
caagcucaaccaagugcuuu

SEQ ID NO: 1043835 - RNA, 20 nt, Human
caaguaacucacccacaguc

SEQ ID NO: 1043836 - RNA, 24 nt, Human
caaguaacucacccacagucucug

SEQ ID NO: 1043837 - RNA, 23 nt, Human
caccuccaccuuauaggugagaa

SEQ ID NO: 1043838 - RNA, 24 nt, Human
cacugggccacugcugugucccaa

SEQ ID NO: 1043839 - RNA, 22 nt, Human
cagagccuggccuacuaacugu

SEQ ID NO: 1043840 - RNA, 18 nt, Human
caucggggcacgacaugg

SEQ ID NO: 1043841 - RNA, 19 nt, Human
caucucguugaauccucac

SEQ ID NO: 1043842 - RNA, 20 nt, Human
caugaguccgcaacgcccuc

SEQ ID NO: 1043843 - RNA, 19 nt, Human
cauggucaagcaugugcac

SEQ ID NO: 1043844 - RNA, 22 nt, Human
cauguguuuaggaggugggguu

SEQ ID NO: 1043845 - RNA, 22 nt, Human
ccagagccuggccuacuaacug

SEQ ID NO: 1043846 - RNA, 24 nt, Human
cccaaguacuaaauguucaucucg

SEQ ID NO: 1043847 - RNA, 24 nt, Human
ccuccaggaagucuucccugaucu

SEQ ID NO: 1043848 - RNA, 19 nt, Human
ccuccugcuucuuuuugcc

SEQ ID NO: 1043849 - RNA, 21 nt, Human
ccuccugcuucuuuuugccag

SEQ ID NO: 1043850 - RNA, 27 nt, Human
ccucgcccugcuucgaugucuccuucc

SEQ ID NO: 1043851 - RNA, 20 nt, Human
ccugcacucaugaaaguguc

SEQ ID NO: 1043852 - RNA, 22 nt, Human
ccuugugcuccuuccucccuca

SEQ ID NO: 1043853 - RNA, 21 nt, Human
cuaaaggaucccaucucuaug

SEQ ID NO: 1043854 - RNA, 27 nt, Human
cucaaguaacucacccacagucucugc

SEQ ID NO: 1043855 - RNA, 24 nt, Human
cucccucagaccuuuguccaggcu

SEQ ID NO: 1043856 - RNA, 19 nt, Human
cuccuugugcuccuuccuc

SEQ ID NO: 1043857 - RNA, 19 nt, Human
cucuguaggcugaaugcug

SEQ ID NO: 1043858 - RNA, 18 nt, Human
cugaaugguggagcuggg

SEQ ID NO: 1043859 - RNA, 24 nt, Human
cugcuucuuuuugccagcuacuau

SEQ ID NO: 1043860 - RNA, 21 nt, Human
cuguuuugcccuccccgggga

SEQ ID NO: 1043861 - RNA, 21 nt, Human
cuuacuuuuuugcuucucuca

SEQ ID NO: 1043862 - RNA, 22 nt, Human
cuuauugggcuucucaugauga

SEQ ID NO: 1043863 - RNA, 26 nt, Human
cuuccgaaacuacacgcggaacccaa

SEQ ID NO: 1043864 - RNA, 19 nt, Human
gaacauggucaagcaugug

SEQ ID NO: 1043865 - RNA, 20 nt, Human
gagggagagcacaggaagcc

SEQ ID NO: 1043866 - RNA, 23 nt, Human
gcccugcuucgaugucuccuucc

SEQ ID NO: 1043867 - RNA, 24 nt, Human
gcccugcuucgaugucuccuuccg

SEQ ID NO: 1043868 - RNA, 19 nt, Human
gccuuguguguuuuucugu

SEQ ID NO: 1043869 - RNA, 19 nt, Human
gcgcuuccuccugcuucuu

SEQ ID NO: 1043870 - RNA, 24 nt, Human
gggugccuggugccuggcuggugc

SEQ ID NO: 1043871 - RNA, 20 nt, Human
guccccagcauccuggaggg

SEQ ID NO: 1043872 - RNA, 20 nt, Human
uaaagacaucauuguauagc

SEQ ID NO: 1043873 - RNA, 21 nt, Human
uaacucacccacagucucugc

SEQ ID NO: 1043874 - RNA, 21 nt, Human
uacugugaaguaguucuuguc

SEQ ID NO: 1043875 - RNA, 21 nt, Human
ucaaaggggccaaaguaggug

SEQ ID NO: 1043876 - RNA, 20 nt, Human
uccaguuucuuccaguacug

SEQ ID NO: 1043877 - RNA, 21 nt, Human
uccccagcauccuggaggggc

SEQ ID NO: 1043878 - RNA, 18 nt, Human
ucguggggcugggaaucu

SEQ ID NO: 1043879 - RNA, 19 nt, Human
ucugcaggcugaauggugg

SEQ ID NO: 1043880 - RNA, 19 nt, Human
ucugcaggcugaauggugg

SEQ ID NO: 1043881 - RNA, 22 nt, Human
ucugcaggcugaaugguggagc

SEQ ID NO: 1043882 - RNA, 22 nt, Human
ucuguaggcugaaugcuggagc

SEQ ID NO: 1043883 - RNA, 21 nt, Human
ugaaaguguccugcacuccuu

SEQ ID NO: 1043884 - RNA, 21 nt, Human
ugaagcagcaagaaugaggug

SEQ ID NO: 1043885 - RNA, 19 nt, Human
ugaaugguggagcugggau

SEQ ID NO: 1043886 - RNA, 19 nt, Human
ugaaugguggagcugggau

SEQ ID NO: 1043887 - RNA, 22 nt, Human
ugagaaaauauuggcacagaga

SEQ ID NO: 1043888 - RNA, 20 nt, Human
ugagcccuguccccagcauc

SEQ ID NO: 1043889 - RNA, 18 nt, Human
ugaguccgcaacgcccuc

SEQ ID NO: 1043890 - RNA, 20 nt, Human
ugauaggggcugaagcagca

SEQ ID NO: 1043891 - RNA, 26 nt, Human
ugcacagagaacaugcuaaaggaucc

SEQ ID NO: 1043892 - RNA, 22 nt, Human
ugccuggcuggugcucagugag

SEQ ID NO: 1043893 - RNA, 23 nt, Human
uggcaaaaagcaugugaaagaaa

SEQ ID NO: 1043894 - RNA, 22 nt, Human
uggcacagagagcucaaguaac

SEQ ID NO: 1043895 - RNA, 23 nt, Human
ugucccaaguacuaaauguucau

SEQ ID NO: 1043896 - RNA, 19 nt, Human
ugucuccuuccgaaacuac

SEQ ID NO: 1043897 - RNA, 19 nt, Human
ugugagcccuguccccagc

SEQ ID NO: 1043898 - RNA, 20 nt, Human
uucaugcaguuaugaaagug

SEQ ID NO: 1043899 - RNA, 22 nt, Human
uuccuccugcuucuuuuugcca

SEQ ID NO: 1043900 - RNA, 21 nt, Human
uucuuacuuuaacaucauuuu

SEQ ID NO: 1043901 - RNA, 19 nt, Human
uugcuucucucacugaguu

SEQ ID NO: 1043902 - RNA, 24 nt, Human
uuuccagugagcuaugugauaggg

SEQ ID NO: 1043903 - RNA, 20 nt, Human
uuuguccaggcugucuccuc

SEQ ID NO: 1043904 - RNA, 23 nt, Human
cggggcccguggcagguuguacc

SEQ ID NO: 1043905 - RNA, 18 nt, Human
uaccaggcuucccaggcg

SEQ ID NO: 1043906 - RNA, 20 nt, Human
aacuccaggcaagcuuggcc

SEQ ID NO: 1043907 - RNA, 20 nt, Human
acucccaaggacacugacag

SEQ ID NO: 1043908 - RNA, 19 nt, Human
agagggugcccugaacucc

SEQ ID NO: 1043909 - RNA, 21 nt, Human
auugccagguuuuuagcaagg

SEQ ID NO: 1043910 - RNA, 23 nt, Human
auuugaaaacuuuuugacuguuc

SEQ ID NO: 1043911 - RNA, 27 nt, Human
caaggacacugacagcaguuggagacc

SEQ ID NO: 1043912 - RNA, 23 nt, Human
caggcaagcuuggccaagucuug

SEQ ID NO: 1043913 - RNA, 21 nt, Human
guggcuuucugucuccauucu

SEQ ID NO: 1043914 - RNA, 19 nt, Human
uaaaaacaaacaagaacac

SEQ ID NO: 1043915 - RNA, 18 nt, Human
uagggucccccugcaggg

SEQ ID NO: 1043916 - RNA, 20 nt, Human
uccaggcaagcuuggccaag

SEQ ID NO: 1043917 - RNA, 19 nt, Human
ucccaaggacacugacagc

SEQ ID NO: 1043918 - RNA, 21 nt, Human
ugccagaaauccagaucuuug

SEQ ID NO: 1043919 - RNA, 21 nt, Human
ugcccugaacuccaggcaagc

SEQ ID NO: 1043920 - RNA, 23 nt, Human
ugcccugaacuccaggcaagcuu

SEQ ID NO: 1043921 - RNA, 22 nt, Human
ugcuguacaggcccggccacgc

SEQ ID NO: 1043922 - RNA, 22 nt, Human
ugcuuagacaggacuuuggcuc

SEQ ID NO: 1043923 - RNA, 22 nt, Human
uggccaagucuugccagaaauc

SEQ ID NO: 1043924 - RNA, 20 nt, Human
uggcucugccguaggguccc

SEQ ID NO: 1043925 - RNA, 19 nt, Human
uggguuaaacgucugcacc

SEQ ID NO: 1043926 - RNA, 19 nt, Human
uucaaagcuuaaaaacaaa

SEQ ID NO: 1043927 - RNA, 20 nt, Human
uucaaagcuuaaaaacaaac

SEQ ID NO: 1043928 - RNA, 18 nt, Human
agugcagacagauuucgc

SEQ ID NO: 1043929 - RNA, 28 nt, Human
caggccgauuccuagagggugaaacuga

SEQ ID NO: 1043930 - RNA, 25 nt, Human
cauggacauggaucgcgcgcacgcg

SEQ ID NO: 1043931 - RNA, 23 nt, Human
ccgcaccacggaccccgccagcu

SEQ ID NO: 1043932 - RNA, 22 nt, Human
cgcaaucucgaucccgcaccac

SEQ ID NO: 1043933 - RNA, 23 nt, Human
cgcaaucucgaucccgcaccacg

SEQ ID NO: 1043934 - RNA, 20 nt, Human
cgcgcacgcgccggggaccg

SEQ ID NO: 1043935 - RNA, 18 nt, Human
gcgggccggcaacaagug

SEQ ID NO: 1043936 - RNA, 20 nt, Human
uagagggugaaacugaggac

SEQ ID NO: 1043937 - RNA, 20 nt, Human
ucagugcagacagauuucgc

SEQ ID NO: 1043938 - RNA, 23 nt, Human
ucucgggcugcgcgcgcaaccuu

SEQ ID NO: 1043939 - RNA, 25 nt, Human
aaacccaacagucccaaaugugccc

SEQ ID NO: 1043940 - RNA, 21 nt, Human
aagcagaaagaaucagcaggg

SEQ ID NO: 1043941 - RNA, 23 nt, Human
aaggaagauagaaacggaaacga

SEQ ID NO: 1043942 - RNA, 18 nt, Human
agacccagggcauuuggc

SEQ ID NO: 1043943 - RNA, 21 nt, Human
cacagggacccccagcacugg

SEQ ID NO: 1043944 - RNA, 26 nt, Human
cacccucuuugaccggucccucugcc

SEQ ID NO: 1043945 - RNA, 22 nt, Human
caccugaaaguggaggagcggg

SEQ ID NO: 1043946 - RNA, 22 nt, Human
cagacccgcagccccucaaggu

SEQ ID NO: 1043947 - RNA, 24 nt, Human
caggugaaggggaccauccucaug

SEQ ID NO: 1043948 - RNA, 25 nt, Human
cccaaaagcuuuagaccccaaaggc

SEQ ID NO: 1043949 - RNA, 20 nt, Human
cccacgagggucagggcagg

SEQ ID NO: 1043950 - RNA, 18 nt, Human
cccaggguuggaaagggg

SEQ ID NO: 1043951 - RNA, 22 nt, Human
ccccaaaggcagaaacauuucu

SEQ ID NO: 1043952 - RNA, 19 nt, Human
cccucugcccucagacuag

SEQ ID NO: 1043953 - RNA, 19 nt, Human
ccgcagccccucaaggugc

SEQ ID NO: 1043954 - RNA, 23 nt, Human
ccucagacccgcagccccucaag

SEQ ID NO: 1043955 - RNA, 21 nt, Human
ccucagacuagcggaagcaaa

SEQ ID NO: 1043956 - RNA, 19 nt, Human
ccuccagcuccuaaacugg

SEQ ID NO: 1043957 - RNA, 18 nt, Human
ccuccucccucagacugg

SEQ ID NO: 1043958 - RNA, 20 nt, Human
ccucugggcuuacugccggc

SEQ ID NO: 1043959 - RNA, 20 nt, Human
cgaaaaacccaacaguccca

SEQ ID NO: 1043960 - RNA, 19 nt, Human
cggcucccggcuccacagu

SEQ ID NO: 1043961 - RNA, 19 nt, Human
cucagacccgcagccccuc

SEQ ID NO: 1043962 - RNA, 21 nt, Human
cuuuguguccaccaggugugg

SEQ ID NO: 1043963 - RNA, 23 nt, Human
gaaaaacccaacagucccaaagg

SEQ ID NO: 1043964 - RNA, 19 nt, Human
gacccagggcauuuggcaa

SEQ ID NO: 1043965 - RNA, 24 nt, Human
gcaccaaggugaaggguuugaggg

SEQ ID NO: 1043966 - RNA, 19 nt, Human
gcagggcagggggugggcg

SEQ ID NO: 1043967 - RNA, 21 nt, Human
gcagggggugggcgccccauc

SEQ ID NO: 1043968 - RNA, 22 nt, Human
gcaguuugggggugggggacaa

SEQ ID NO: 1043969 - RNA, 22 nt, Human
gggcagggcagggggugggcgc

SEQ ID NO: 1043970 - RNA, 19 nt, Human
gggguggagaccucugggc

SEQ ID NO: 1043971 - RNA, 19 nt, Human
ggugcaccaaggugaaggg

SEQ ID NO: 1043972 - RNA, 19 nt, Human
uagacccagggcauuuggc

SEQ ID NO: 1043973 - RNA, 24 nt, Human
ucagacccgcagccccucaaggug

SEQ ID NO: 1043974 - RNA, 21 nt, Human
ucagacuggaugguuucccag

SEQ ID NO: 1043975 - RNA, 27 nt, Human
uccagguuuauuucagggcaguuuggg

SEQ ID NO: 1043976 - RNA, 22 nt, Human
ucccgugggguggagaccucug

SEQ ID NO: 1043977 - RNA, 21 nt, Human
uccucccucagacuggauggu

SEQ ID NO: 1043978 - RNA, 20 nt, Human
ucucagagggaggagcugag

SEQ ID NO: 1043979 - RNA, 21 nt, Human
uggcaaagucuuagaagcaga

SEQ ID NO: 1043980 - RNA, 18 nt, Human
uggcaguucccacgaggg

SEQ ID NO: 1043981 - RNA, 23 nt, Human
ugggaguuuggccuccucccuca

SEQ ID NO: 1043982 - RNA, 26 nt, Human
ugggauuguuggcagaugagcugugg

SEQ ID NO: 1043983 - RNA, 22 nt, Human
ugggguggagaccucugggcuu

SEQ ID NO: 1043984 - RNA, 21 nt, Human
ugugccacccucuuugaccgg

SEQ ID NO: 1043985 - RNA, 22 nt, Human
uucuuagacccagggcauuugg

SEQ ID NO: 1043986 - RNA, 19 nt, Human
uuggcaaagucuuagaagc

SEQ ID NO: 1043987 - RNA, 21 nt, Human
uuucuaaaggaagauagaaac

SEQ ID NO: 1043988 - RNA, 20 nt, Human
aaaaaaaaacagggauggga

SEQ ID NO: 1043989 - RNA, 25 nt, Human
aaacaaacaaacaaacaacaacaac

SEQ ID NO: 1043990 - RNA, 28 nt, Human
aaacaaacaacaacaacaaaaaaaaaca

SEQ ID NO: 1043991 - RNA, 23 nt, Human
aaacaacaacaacaaaaaaaaac

SEQ ID NO: 1043992 - RNA, 19 nt, Human
aaauacaaaaauuagcucg

SEQ ID NO: 1043993 - RNA, 24 nt, Human
aacaaacaaacaaacaacaacaac

SEQ ID NO: 1043994 - RNA, 22 nt, Human
aacaaacaaacaacaacaacaa

SEQ ID NO: 1043995 - RNA, 21 nt, Human
aacaaacaacaacaacaaaaa

SEQ ID NO: 1043996 - RNA, 21 nt, Human
aacaacaaaaaaaaacaggga

SEQ ID NO: 1043997 - RNA, 19 nt, Human
aacauggcgaaaccccauc

SEQ ID NO: 1043998 - RNA, 20 nt, Human
aacauggcgaaaccccaucu

SEQ ID NO: 1043999 - RNA, 21 nt, Human
aacauggcgaaaccccaucuc

SEQ ID NO: 1044000 - RNA, 21 nt, Human
aacauggcgaaaccccaucuc

SEQ ID NO: 1044001 - RNA, 21 nt, Human
aagcaaccuuuugggucccac

SEQ ID NO: 1044002 - RNA, 24 nt, Human
aaucacuugaacccaggaggcgga

SEQ ID NO: 1044003 - RNA, 23 nt, Human
acaacaacaaaaaaaaacaggga

SEQ ID NO: 1044004 - RNA, 31 nt, Human
acacucaguuucaaaaacaaacaaacaaacc

SEQ ID NO: 1044005 - RNA, 20 nt, Human
acagugaccguccugucccc

SEQ ID NO: 1044006 - RNA, 22 nt, Human
acccacgcacccugagccagca

SEQ ID NO: 1044007 - RNA, 24 nt, Human
accgcagcauugcacuccagccug

SEQ ID NO: 1044008 - RNA, 19 nt, Human
accguccuguccccuuguu

SEQ ID NO: 1044009 - RNA, 24 nt, Human
acuccagccugggugacagaguga

SEQ ID NO: 1044010 - RNA, 19 nt, Human
agaucagggaccugggaag

SEQ ID NO: 1044011 - RNA, 23 nt, Human
agaucgcuugaggucaggaguuc

SEQ ID NO: 1044012 - RNA, 22 nt, Human
agccagcagccucaucagccuc

SEQ ID NO: 1044013 - RNA, 24 nt, Human
agccuggccaacauggcgaaaccc

SEQ ID NO: 1044014 - RNA, 24 nt, Human
agccugggugacagagugacacuc

SEQ ID NO: 1044015 - RNA, 20 nt, Human
agcguccaugccagggugcc

SEQ ID NO: 1044016 - RNA, 23 nt, Human
agcucggcaugguggcgggugcu

SEQ ID NO: 1044017 - RNA, 24 nt, Human
aggaccucaagcuucugcaggugg

SEQ ID NO: 1044018 - RNA, 22 nt, Human
aggaggccgaggcgggcagauc

SEQ ID NO: 1044019 - RNA, 23 nt, Human
aggaggcugaggcaggagaauca

SEQ ID NO: 1044020 - RNA, 18 nt, Human
aggcacguggcacugaac

SEQ ID NO: 1044021 - RNA, 18 nt, Human
aggcaggagaaucacuug

SEQ ID NO: 1044022 - RNA, 23 nt, Human
aggcaggagaaucacuugaaccc

SEQ ID NO: 1044023 - RNA, 24 nt, Human
aggcaggagaaucacuugaaccca

SEQ ID NO: 1044024 - RNA, 21 nt, Human
aggccgaggcgggcagaucgc

SEQ ID NO: 1044025 - RNA, 24 nt, Human
aggccgaggcgggcagaucgcuug

SEQ ID NO: 1044026 - RNA, 24 nt, Human
aggcggagguugcagugagcugag

SEQ ID NO: 1044027 - RNA, 21 nt, Human
aggcgggcagaucgcuugagg

SEQ ID NO: 1044028 - RNA, 22 nt, Human
aggcgggcagaucgcuugaggu

SEQ ID NO: 1044029 - RNA, 26 nt, Human
aggcgggcagaucgcuugaggucagg

SEQ ID NO: 1044030 - RNA, 24 nt, Human
aggcugaggcaggagaaucacuug

SEQ ID NO: 1044031 - RNA, 18 nt, Human
aggcugggaagccagguc

SEQ ID NO: 1044032 - RNA, 19 nt, Human
agggaugggagguggggag

SEQ ID NO: 1044033 - RNA, 21 nt, Human
agggaugggagguggggagca

SEQ ID NO: 1044034 - RNA, 18 nt, Human
aggggcccugagaggggc

SEQ ID NO: 1044035 - RNA, 24 nt, Human
agggugccccccauucaagcaacc

SEQ ID NO: 1044036 - RNA, 23 nt, Human
aguggccacgccuguaaucccag

SEQ ID NO: 1044037 - RNA, 20 nt, Human
auagucgggaguggaggggc

SEQ ID NO: 1044038 - RNA, 24 nt, Human
aucgcuugaggucaggaguucgag

SEQ ID NO: 1044039 - RNA, 18 nt, Human
auugcacuccagccuggg

SEQ ID NO: 1044040 - RNA, 21 nt, Human
auugcacuccagccuggguga

SEQ ID NO: 1044041 - RNA, 24 nt, Human
auugcacuccagccugggugacag

SEQ ID NO: 1044042 - RNA, 27 nt, Human
caaaaacaaacaaacaaacaacaaccg

SEQ ID NO: 1044043 - RNA, 21 nt, Human
caacaaaaaaaaacagggaug

SEQ ID NO: 1044044 - RNA, 22 nt, Human
cacagugaccguccuguccccu

SEQ ID NO: 1044045 - RNA, 22 nt, Human
cacgcacccugagccagcagcc

SEQ ID NO: 1044046 - RNA, 23 nt, Human
cacgccuguaaucccagcacuuc

SEQ ID NO: 1044047 - RNA, 22 nt, Human
cacuccagccugggugacagag

SEQ ID NO: 1044048 - RNA, 24 nt, Human
cacuccagccugggugacagagug

SEQ ID NO: 1044049 - RNA, 19 nt, Human
cacugccacgcuuuugccu

SEQ ID NO: 1044050 - RNA, 24 nt, Human
cagaucgcuugaggucaggaguuc

SEQ ID NO: 1044051 - RNA, 24 nt, Human
cagcacuucaggaggccgaggcgg

SEQ ID NO: 1044052 - RNA, 23 nt, Human
cagcagcagcggcaacagcagcg

SEQ ID NO: 1044053 - RNA, 27 nt, Human
cagcagccucaucagccucgaagcauu

SEQ ID NO: 1044054 - RNA, 23 nt, Human
cagcggcaacagcagcguccaug

SEQ ID NO: 1044055 - RNA, 24 nt, Human
cagcuacucaggaggcugaggcag

SEQ ID NO: 1044056 - RNA, 21 nt, Human
cagguuacaguagacaggcug

SEQ ID NO: 1044057 - RNA, 24 nt, Human
caguggccacgccuguaaucccag

SEQ ID NO: 1044058 - RNA, 19 nt, Human
cauugcacuccagccuggg

SEQ ID NO: 1044059 - RNA, 19 nt, Human
cauugcacuccagccuggg

SEQ ID NO: 1044060 - RNA, 19 nt, Human
cauugcacuccagccuggg

SEQ ID NO: 1044061 - RNA, 20 nt, Human
cauugcacuccagccugggu

SEQ ID NO: 1044062 - RNA, 21 nt, Human
cauugcacuccagccugggug

SEQ ID NO: 1044063 - RNA, 22 nt, Human
cauugcacuccagccuggguga

SEQ ID NO: 1044064 - RNA, 23 nt, Human
cauugcacuccagccugggugac

SEQ ID NO: 1044065 - RNA, 24 nt, Human
cauugcacuccagccugggugaca

SEQ ID NO: 1044066 - RNA, 24 nt, Human
cauugcacuccagccugggugaca

SEQ ID NO: 1044067 - RNA, 21 nt, Human
ccaccuggacacgggggccgc

SEQ ID NO: 1044068 - RNA, 19 nt, Human
ccacgccuguaaucccagc

SEQ ID NO: 1044069 - RNA, 23 nt, Human
ccacgccuguaaucccagcacuu

SEQ ID NO: 1044070 - RNA, 22 nt, Human
ccaggaggcggagguugcagug

SEQ ID NO: 1044071 - RNA, 22 nt, Human
ccaggucgauguccuuguaguu

SEQ ID NO: 1044072 - RNA, 24 nt, Human
cccacgcacccugagccagcagcc

SEQ ID NO: 1044073 - RNA, 18 nt, Human
cccauucuucagaugggg

SEQ ID NO: 1044074 - RNA, 24 nt, Human
cccgcagagacugguugugaggca

SEQ ID NO: 1044075 - RNA, 21 nt, Human
cccggggaucacguacuccuc

SEQ ID NO: 1044076 - RNA, 20 nt, Human
ccgcagcauugcacuccagc

SEQ ID NO: 1044077 - RNA, 18 nt, Human
ccgcagcggccacggcca

SEQ ID NO: 1044078 - RNA, 21 nt, Human
ccguggcugcaagccuaaacc

SEQ ID NO: 1044079 - RNA, 20 nt, Human
ccucuucccccucuaggagc

SEQ ID NO: 1044080 - RNA, 24 nt, Human
ccuggccaacauggcgaaacccca

SEQ ID NO: 1044081 - RNA, 18 nt, Human
ccuggcccagugacugca

SEQ ID NO: 1044082 - RNA, 22 nt, Human
ccugggugacagagugacacuc

SEQ ID NO: 1044083 - RNA, 21 nt, Human
cgagaccagccuggccaacau

SEQ ID NO: 1044084 - RNA, 24 nt, Human
cgaggcgggcagaucgcuugaggu

SEQ ID NO: 1044085 - RNA, 26 nt, Human
cgaggcgggcagaucgcuugagguca

SEQ ID NO: 1044086 - RNA, 22 nt, Human
cgccuguaaucccagcacuuca

SEQ ID NO: 1044087 - RNA, 23 nt, Human
cgcuccggcugccguaccguggc

SEQ ID NO: 1044088 - RNA, 26 nt, Human
cgcuuuugccucugcgaugcuggaaa

SEQ ID NO: 1044089 - RNA, 24 nt, Human
cgggcagaucgcuugaggucagga

SEQ ID NO: 1044090 - RNA, 23 nt, Human
cgguucuaggcugucugacuccc

SEQ ID NO: 1044091 - RNA, 22 nt, Human
cguccaugccagggugcccccc

SEQ ID NO: 1044092 - RNA, 19 nt, Human
cucgaagcauuuauugagc

SEQ ID NO: 1044093 - RNA, 23 nt, Human
cugcucuggaggccaagccugga

SEQ ID NO: 1044094 - RNA, 23 nt, Human
cuggccaacauggcgaaacccca

SEQ ID NO: 1044095 - RNA, 20 nt, Human
cuggcccgcagagacugguu

SEQ ID NO: 1044096 - RNA, 21 nt, Human
cuguaaucccagcuacucagg

SEQ ID NO: 1044097 - RNA, 24 nt, Human
cugucugacucccgcagcagcagc

SEQ ID NO: 1044098 - RNA, 19 nt, Human
cuugggggcgcuccggcug

SEQ ID NO: 1044099 - RNA, 22 nt, Human
gacagggagggggcggcagagc

SEQ ID NO: 1044100 - RNA, 23 nt, Human
gagaaucacuugaacccaggagg

SEQ ID NO: 1044101 - RNA, 19 nt, Human
gagcggcaugagggacagg

SEQ ID NO: 1044102 - RNA, 22 nt, Human
gagcuuccuggggccucaagga

SEQ ID NO: 1044103 - RNA, 23 nt, Human
gagguugcagugagcugagaccg

SEQ ID NO: 1044104 - RNA, 24 nt, Human
gaucgcuugaggucaggaguucga

SEQ ID NO: 1044105 - RNA, 23 nt, Human
gcacuccagccugggugacagag

SEQ ID NO: 1044106 - RNA, 24 nt, Human
gcacuccagccugggugacagagu

SEQ ID NO: 1044107 - RNA, 18 nt, Human
gcagcagcggcaacagca

SEQ ID NO: 1044108 - RNA, 22 nt, Human
gcaggagaaucacuugaaccca

SEQ ID NO: 1044109 - RNA, 18 nt, Human
gcauugcacuccagccug

SEQ ID NO: 1044110 - RNA, 21 nt, Human
gcauugcacuccagccugggu

SEQ ID NO: 1044111 - RNA, 24 nt, Human
gcauugcacuccagccugggugac

SEQ ID NO: 1044112 - RNA, 24 nt, Human
gccaacauggcgaaaccccaucuc

SEQ ID NO: 1044113 - RNA, 19 nt, Human
gcgcaguggccacgccugu

SEQ ID NO: 1044114 - RNA, 24 nt, Human
gcuugaggucaggaguucgagacc

SEQ ID NO: 1044115 - RNA, 20 nt, Human
ggaggacacggugcacgacg

SEQ ID NO: 1044116 - RNA, 22 nt, Human
ggaggcggagguugcagugagc

SEQ ID NO: 1044117 - RNA, 22 nt, Human
ggagguugcagugagcugagac

SEQ ID NO: 1044118 - RNA, 23 nt, Human
ggagguugcagugagcugagacc

SEQ ID NO: 1044119 - RNA, 24 nt, Human
ggagguugcagugagcugagaccg

SEQ ID NO: 1044120 - RNA, 25 nt, Human
ggcagaucgcuugaggucaggaguu

SEQ ID NO: 1044121 - RNA, 18 nt, Human
ggcccacaaacauguucu

SEQ ID NO: 1044122 - RNA, 23 nt, Human
ggcugcuggcuggcccacaaaca

SEQ ID NO: 1044123 - RNA, 21 nt, Human
gggacugaagggguucugggu

SEQ ID NO: 1044124 - RNA, 18 nt, Human
gggagggggcggcagagc

SEQ ID NO: 1044125 - RNA, 26 nt, Human
gggugccccccauucaagcaaccuuu

SEQ ID NO: 1044126 - RNA, 19 nt, Human
ggugaugacaggauuggca

SEQ ID NO: 1044127 - RNA, 19 nt, Human
guacccauucuucagaugg

SEQ ID NO: 1044128 - RNA, 24 nt, Human
gugcuguaaucccagcuacucagg

SEQ ID NO: 1044129 - RNA, 24 nt, Human
guggccacgccuguaaucccagca

SEQ ID NO: 1044130 - RNA, 18 nt, Human
guucuggguggagguuag

SEQ ID NO: 1044131 - RNA, 19 nt, Human
guugcagugagcugagacc

SEQ ID NO: 1044132 - RNA, 22 nt, Human
uaaaagucauuguccucugaag

SEQ ID NO: 1044133 - RNA, 19 nt, Human
uagacaggcugggaagcca

SEQ ID NO: 1044134 - RNA, 21 nt, Human
uaggagcugagggagcugagg

SEQ ID NO: 1044135 - RNA, 26 nt, Human
ucaaaaacaaacaaacaaacaacaac

SEQ ID NO: 1044136 - RNA, 22 nt, Human
uccagccugggugacagaguga

SEQ ID NO: 1044137 - RNA, 21 nt, Human
uccccaccuugaggaacccac

SEQ ID NO: 1044138 - RNA, 21 nt, Human
uccgcagcgcugcuggggucg

SEQ ID NO: 1044139 - RNA, 21 nt, Human
ucucagauggagacuuggucu

SEQ ID NO: 1044140 - RNA, 18 nt, Human
ucucauagucgggagugg

SEQ ID NO: 1044141 - RNA, 20 nt, Human
ugaaauucaggcacguggca

SEQ ID NO: 1044142 - RNA, 23 nt, Human
ugaaauucaggcacguggcacug

SEQ ID NO: 1044143 - RNA, 18 nt, Human
ugacagagugacacucag

SEQ ID NO: 1044144 - RNA, 18 nt, Human
ugacucccgcagcagcag

SEQ ID NO: 1044145 - RNA, 21 nt, Human
ugagaggggcagaagggagga

SEQ ID NO: 1044146 - RNA, 20 nt, Human
ugaggcaggagaaucacuug

SEQ ID NO: 1044147 - RNA, 24 nt, Human
ugaggcaggagaaucacuugaacc

SEQ ID NO: 1044148 - RNA, 25 nt, Human
ugaggcaggagaaucacuugaaccc

SEQ ID NO: 1044149 - RNA, 20 nt, Human
ugagggacagggagggggcg

SEQ ID NO: 1044150 - RNA, 21 nt, Human
ugagggagcugaggagcggca

SEQ ID NO: 1044151 - RNA, 22 nt, Human
ugagucacccagcagggacuga

SEQ ID NO: 1044152 - RNA, 21 nt, Human
ugaugacaggauuggcacagu

SEQ ID NO: 1044153 - RNA, 21 nt, Human
ugaugacaggauuggcacagu

SEQ ID NO: 1044154 - RNA, 24 nt, Human
ugcacuccagccugggugacagag

SEQ ID NO: 1044155 - RNA, 22 nt, Human
ugcaggugggcaaagaagguca

SEQ ID NO: 1044156 - RNA, 22 nt, Human
ugccucugcgaugcuggaaaag

SEQ ID NO: 1044157 - RNA, 19 nt, Human
ugcgaugcuggaaaagcga

SEQ ID NO: 1044158 - RNA, 23 nt, Human
ugcuguaaucccagcuacucagg

SEQ ID NO: 1044159 - RNA, 30 nt, Human
uggaaaagcgacggcgcccagaggcugcgg

SEQ ID NO: 1044160 - RNA, 23 nt, Human
uggcacggccacuuggggcuugg

SEQ ID NO: 1044161 - RNA, 20 nt, Human
uggccacgccuguaauccca

SEQ ID NO: 1044162 - RNA, 21 nt, Human
uggccacgccuguaaucccag

SEQ ID NO: 1044163 - RNA, 23 nt, Human
uggcgggugcuguaaucccagcu

SEQ ID NO: 1044164 - RNA, 22 nt, Human
ugggagguggggagcaauuugg

SEQ ID NO: 1044165 - RNA, 23 nt, Human
ugggcaaagaaggucacuggaag

SEQ ID NO: 1044166 - RNA, 24 nt, Human
ugggcgcaguggccacgccuguaa

SEQ ID NO: 1044167 - RNA, 19 nt, Human
uggggaaacugaggccaug

SEQ ID NO: 1044168 - RNA, 23 nt, Human
ugguggcgggugcuguaauccca

SEQ ID NO: 1044169 - RNA, 24 nt, Human
ugguggcgggugcuguaaucccag

SEQ ID NO: 1044170 - RNA, 24 nt, Human
uuagcucggcaugguggcgggugc

SEQ ID NO: 1044171 - RNA, 24 nt, Human
uucaagcaaccuuuugggucccac

SEQ ID NO: 1044172 - RNA, 18 nt, Human
uucaggaggccgaggcgg

SEQ ID NO: 1044173 - RNA, 26 nt, Human
uuccuggggccucaaggacaauccuu

SEQ ID NO: 1044174 - RNA, 24 nt, Human
uugaacccaggaggcggagguugc

SEQ ID NO: 1044175 - RNA, 19 nt, Human
uugcagugagcugagaccg

SEQ ID NO: 1044176 - RNA, 20 nt, Human
uugcagugagcugagaccgc

SEQ ID NO: 1044177 - RNA, 24 nt, Human
uugggagucucagauggagacuug

SEQ ID NO: 1044178 - RNA, 19 nt, Human
uuggucuuagaacucagaa

SEQ ID NO: 1044179 - RNA, 24 nt, Human
aacugauuggagggagcuccccug

SEQ ID NO: 1044180 - RNA, 25 nt, Human
acccggaguacaggaaguccuccug

SEQ ID NO: 1044181 - RNA, 19 nt, Human
cacccacacccaccccggc

SEQ ID NO: 1044182 - RNA, 21 nt, Human
ccacacccaccccggcccagg

SEQ ID NO: 1044183 - RNA, 19 nt, Human
cccacacccaccccggccc

SEQ ID NO: 1044184 - RNA, 24 nt, Human
cccacacccaccccggcccaggga

SEQ ID NO: 1044185 - RNA, 21 nt, Human
cccacgcgggcccucccucca

SEQ ID NO: 1044186 - RNA, 19 nt, Human
ccccugcagacagcagcuc

SEQ ID NO: 1044187 - RNA, 20 nt, Human
ccccugcagacagcagcucg

SEQ ID NO: 1044188 - RNA, 21 nt, Human
cccucccuccacacccacacc

SEQ ID NO: 1044189 - RNA, 19 nt, Human
ccggccccugcagacagca

SEQ ID NO: 1044190 - RNA, 20 nt, Human
ccuccacacccacacccacc

SEQ ID NO: 1044191 - RNA, 30 nt, Human
cgcgggcccucccuccacacccacacccaa

SEQ ID NO: 1044192 - RNA, 21 nt, Human
cggcccagggacggguuuucc

SEQ ID NO: 1044193 - RNA, 25 nt, Human
cuccacacccacacccaccccggcc

SEQ ID NO: 1044194 - RNA, 28 nt, Human
cucggugggaaacugauuggagggagcu

SEQ ID NO: 1044195 - RNA, 21 nt, Human
cugcuggaacccggaguacag

SEQ ID NO: 1044196 - RNA, 19 nt, Human
gcccucccuccacacccac

SEQ ID NO: 1044197 - RNA, 20 nt, Human
gcuggaacccggaguacagg

SEQ ID NO: 1044198 - RNA, 21 nt, Human
ggccccugcagacagcagcuc

SEQ ID NO: 1044199 - RNA, 19 nt, Human
gggaaacugauuggaggga

SEQ ID NO: 1044200 - RNA, 26 nt, Human
uccacacacgcugcauuugucggccg

SEQ ID NO: 1044201 - RNA, 18 nt, Human
ucccacacgagucgcagg

SEQ ID NO: 1044202 - RNA, 22 nt, Human
aggccaggccuuucacaggaaa

SEQ ID NO: 1044203 - RNA, 18 nt, Human
cacaagaccucgcagggc

SEQ ID NO: 1044204 - RNA, 21 nt, Human
cagggcuuaggauugggcaca

SEQ ID NO: 1044205 - RNA, 24 nt, Human
cagggcuuaggauugggcacagcc

SEQ ID NO: 1044206 - RNA, 19 nt, Human
cccgcggguuucgggggcg

SEQ ID NO: 1044207 - RNA, 21 nt, Human
ccucgcccaccccaguccuaa

SEQ ID NO: 1044208 - RNA, 18 nt, Human
cgaauagcucuuggagcc

SEQ ID NO: 1044209 - RNA, 18 nt, Human
cgggggcgguggcuuuuu

SEQ ID NO: 1044210 - RNA, 25 nt, Human
gaaccgccacucccucgcccacccc

SEQ ID NO: 1044211 - RNA, 19 nt, Human
gccuugguucgaaucccgg

SEQ ID NO: 1044212 - RNA, 24 nt, Human
ucaccuguaacuugggacgagaac

SEQ ID NO: 1044213 - RNA, 27 nt, Human
ucgcagggcuuaggauugggcacagcc

SEQ ID NO: 1044214 - RNA, 20 nt, Human
ugggagagaggaucagggaa

SEQ ID NO: 1044215 - RNA, 23 nt, Human
uucacaggaaacagauuucccgc

SEQ ID NO: 1044216 - RNA, 21 nt, Human
uuucccgcggguuucgggggc

SEQ ID NO: 1044217 - RNA, 21 nt, Human
agggaggguccgggcuccgcg

SEQ ID NO: 1044218 - RNA, 19 nt, Human
cgggucuggcggccgcugg

SEQ ID NO: 1044219 - RNA, 19 nt, Human
aagagcgcugucugccccu

SEQ ID NO: 1044220 - RNA, 21 nt, Human
aagggcugcgagggcaucugu

SEQ ID NO: 1044221 - RNA, 18 nt, Human
accugcggccaggcccuc

SEQ ID NO: 1044222 - RNA, 20 nt, Human
agaguucuccccguccaccu

SEQ ID NO: 1044223 - RNA, 22 nt, Human
agguggugcagacggcccaccu

SEQ ID NO: 1044224 - RNA, 19 nt, Human
cagcuccacugggaagcgc

SEQ ID NO: 1044225 - RNA, 22 nt, Human
caggagccuggccgggccccau

SEQ ID NO: 1044226 - RNA, 23 nt, Human
cauccugggcccccagccacagc

SEQ ID NO: 1044227 - RNA, 19 nt, Human
ccccauccugggcccccag

SEQ ID NO: 1044228 - RNA, 18 nt, Human
ccuggccgggccccaucc

SEQ ID NO: 1044229 - RNA, 18 nt, Human
cgagaggaagagcgcugu

SEQ ID NO: 1044230 - RNA, 18 nt, Human
cucuuggagcccagcucc

SEQ ID NO: 1044231 - RNA, 19 nt, Human
gcgcgaaagggcugcgagg

SEQ ID NO: 1044232 - RNA, 24 nt, Human
ggagccuggccgggccccauccug

SEQ ID NO: 1044233 - RNA, 18 nt, Human
uccgcaggagccuggccg

SEQ ID NO: 1044234 - RNA, 21 nt, Human
ucuagaucccucuuggagccc

SEQ ID NO: 1044235 - RNA, 21 nt, Human
ucugccccucagaguucuccc

SEQ ID NO: 1044236 - RNA, 23 nt, Human
ugcggccaggcccucaccucucc

SEQ ID NO: 1044237 - RNA, 22 nt, Human
uggccgggccccauccugggcc

SEQ ID NO: 1044238 - RNA, 18 nt, Human
ugggaagcgcgaaagggc

SEQ ID NO: 1044239 - RNA, 20 nt, Human
aaagacacacaacucuuucc

SEQ ID NO: 1044240 - RNA, 20 nt, Human
aagcauacugucagcuuugu

SEQ ID NO: 1044241 - RNA, 23 nt, Human
aggcggagcggaagggaccccaa

SEQ ID NO: 1044242 - RNA, 21 nt, Human
auggucccugcuuggucucuc

SEQ ID NO: 1044243 - RNA, 20 nt, Human
caugcuuuucagcuccucuu

SEQ ID NO: 1044244 - RNA, 18 nt, Human
ccccaaagacacacaacu

SEQ ID NO: 1044245 - RNA, 22 nt, Human
ccccaaagacacacaacucuuu

SEQ ID NO: 1044246 - RNA, 22 nt, Human
ccccaacgcguguguccuggcu

SEQ ID NO: 1044247 - RNA, 21 nt, Human
ccccgcagcuugacgcucugc

SEQ ID NO: 1044248 - RNA, 23 nt, Human
ccgggaacccuaggcggagcgga

SEQ ID NO: 1044249 - RNA, 21 nt, Human
cucucuccauuuuccucuuca

SEQ ID NO: 1044250 - RNA, 19 nt, Human
gcgcacuucgcugagccug

SEQ ID NO: 1044251 - RNA, 19 nt, Human
gcguguguccuggcugcgc

SEQ ID NO: 1044252 - RNA, 23 nt, Human
uaggcggagcggaagggacccca

SEQ ID NO: 1044253 - RNA, 19 nt, Human
uggcugcgcucagccgggg

SEQ ID NO: 1044254 - RNA, 20 nt, Human
ugggccuguagccccgcagc

SEQ ID NO: 1044255 - RNA, 19 nt, Human
uguccuggcugcgcucagc

SEQ ID NO: 1044256 - RNA, 25 nt, Human
uucucccauguaagcauacugucag

SEQ ID NO: 1044257 - RNA, 18 nt, Human
uuuccauaucucucucca

SEQ ID NO: 1044258 - RNA, 22 nt, Human
caggacaggugcgagaagucag

SEQ ID NO: 1044259 - RNA, 19 nt, Human
caggugcgagaagucaggg

SEQ ID NO: 1044260 - RNA, 20 nt, Human
gacaggugcgagaagucagg

SEQ ID NO: 1044261 - RNA, 19 nt, Human
gcccucgggaucuuugggg

SEQ ID NO: 1044262 - RNA, 25 nt, Human
ggagccuugccuugaggggcguggc

SEQ ID NO: 1044263 - RNA, 22 nt, Human
ggccuggacccucgggagccgc

SEQ ID NO: 1044264 - RNA, 23 nt, Human
gggcggggccugagcccaagggg

SEQ ID NO: 1044265 - RNA, 24 nt, Human
gggcggggccugagcccaaggggg

SEQ ID NO: 1044266 - RNA, 22 nt, Human
uaccaccaggcugcucaacagc

SEQ ID NO: 1044267 - RNA, 21 nt, Human
ucaggcccccuaaggggagga

SEQ ID NO: 1044268 - RNA, 21 nt, Human
ucauccaggagcugaaccuga

SEQ ID NO: 1044269 - RNA, 20 nt, Human
uccuuugggggcggggccug

SEQ ID NO: 1044270 - RNA, 21 nt, Human
ucgacccuggucccucaaaca

SEQ ID NO: 1044271 - RNA, 20 nt, Human
ucuuuggggcgaguccuggu

SEQ ID NO: 1044272 - RNA, 20 nt, Human
uggccaguaccaccaggcug

SEQ ID NO: 1044273 - RNA, 21 nt, Human
aaaaugcuuugccacauucuu

SEQ ID NO: 1044274 - RNA, 22 nt, Human
aaaaugcuuugccacauucuuc

SEQ ID NO: 1044275 - RNA, 22 nt, Human
cugacacucauccacacuuuua

SEQ ID NO: 1044276 - RNA, 23 nt, Human
guaaaguuuuucuucagcacaaa

SEQ ID NO: 1044277 - RNA, 21 nt, Human
guaaggguugaguguugcuua

SEQ ID NO: 1044278 - RNA, 22 nt, Human
ugccacauucuucacauuugua

SEQ ID NO: 1044279 - RNA, 26 nt, Human
uuuuacagccauuucucaacaguaau

SEQ ID NO: 1044280 - RNA, 19 nt, Human
aaaaggccagggugcgggg

SEQ ID NO: 1044281 - RNA, 18 nt, Human
aagucccugacacccuuc

SEQ ID NO: 1044282 - RNA, 21 nt, Human
accucacggcuggcaccccca

SEQ ID NO: 1044283 - RNA, 21 nt, Human
agagcaccccaggaggccacc

SEQ ID NO: 1044284 - RNA, 19 nt, Human
agagcagggugcgacaggg

SEQ ID NO: 1044285 - RNA, 19 nt, Human
aggaacgaucggcgccccc

SEQ ID NO: 1044286 - RNA, 18 nt, Human
aggaggccaccucacggc

SEQ ID NO: 1044287 - RNA, 25 nt, Human
caaccgccagccaggaaaaggccag

SEQ ID NO: 1044288 - RNA, 27 nt, Human
caccaaauaccuuggcgagagcacccc

SEQ ID NO: 1044289 - RNA, 18 nt, Human
caggaaaaggccagggug

SEQ ID NO: 1044290 - RNA, 19 nt, Human
cauggcaagucccugacac

SEQ ID NO: 1044291 - RNA, 19 nt, Human
cauggcaagucccugacac

SEQ ID NO: 1044292 - RNA, 21 nt, Human
ccaaauaccuuggcgagagca

SEQ ID NO: 1044293 - RNA, 19 nt, Human
cccccauggcaagucccug

SEQ ID NO: 1044294 - RNA, 20 nt, Human
cccgcugcccccucgacgcc

SEQ ID NO: 1044295 - RNA, 18 nt, Human
ccgcugcccccucgacgc

SEQ ID NO: 1044296 - RNA, 19 nt, Human
ccucgacgccaguguccuc

SEQ ID NO: 1044297 - RNA, 18 nt, Human
cugcccccucgacgccag

SEQ ID NO: 1044298 - RNA, 18 nt, Human
ggaagaucaaauccgcag

SEQ ID NO: 1044299 - RNA, 22 nt, Human
ggccacaacacaaccgccagcc

SEQ ID NO: 1044300 - RNA, 23 nt, Human
ucggcgcccccauggcaaguccc

SEQ ID NO: 1044301 - RNA, 23 nt, Human
uggcgagagcaccccaggaggcc

SEQ ID NO: 1044302 - RNA, 23 nt, Human
uuuccugugugccuuagguggua

SEQ ID NO: 1044303 - RNA, 24 nt, Human
aaaauguugggauuacaggcauga

SEQ ID NO: 1044304 - RNA, 19 nt, Human
aaauguugggauuacaggc

SEQ ID NO: 1044305 - RNA, 25 nt, Human
aagcaauccucccaccuuggccucc

SEQ ID NO: 1044306 - RNA, 18 nt, Human
acuguuuugcccaggcug

SEQ ID NO: 1044307 - RNA, 18 nt, Human
aggcgggggcggggcucu

SEQ ID NO: 1044308 - RNA, 20 nt, Human
auccucguccuucuugggga

SEQ ID NO: 1044309 - RNA, 24 nt, Human
caaaauguugggauuacaggcaug

SEQ ID NO: 1044310 - RNA, 25 nt, Human
caaacuccugggcucaagcaauccu

SEQ ID NO: 1044311 - RNA, 19 nt, Human
caagaggagcgccaccuug

SEQ ID NO: 1044312 - RNA, 27 nt, Human
caagcaauccucccaccuuggccuccc

SEQ ID NO: 1044313 - RNA, 27 nt, Human
caagcaauccucccaccuuggccuccc

SEQ ID NO: 1044314 - RNA, 22 nt, Human
cacaccuccaagaggagcgcca

SEQ ID NO: 1044315 - RNA, 24 nt, Human
cacuguuuugcccaggcuggucuc

SEQ ID NO: 1044316 - RNA, 25 nt, Human
caucucugcacaccuccaagagggg

SEQ ID NO: 1044317 - RNA, 23 nt, Human
ccaaaauguugggauuacaggca

SEQ ID NO: 1044318 - RNA, 24 nt, Human
ccaaaauguugggauuacaggcau

SEQ ID NO: 1044319 - RNA, 24 nt, Human
cccaaaauguugggauuacaggca

SEQ ID NO: 1044320 - RNA, 21 nt, Human
cccaggaccccugcuuccaaa

SEQ ID NO: 1044321 - RNA, 19 nt, Human
cccccaggggaucuugguu

SEQ ID NO: 1044322 - RNA, 20 nt, Human
cccccggaggccccgccccc

SEQ ID NO: 1044323 - RNA, 18 nt, Human
ccccugcuuccaaagaca

SEQ ID NO: 1044324 - RNA, 21 nt, Human
cccguggggacccccagaauc

SEQ ID NO: 1044325 - RNA, 20 nt, Human
cccugugcccccggaggccc

SEQ ID NO: 1044326 - RNA, 20 nt, Human
ccgcaaggcgggggcggggc

SEQ ID NO: 1044327 - RNA, 24 nt, Human
ccgcauagacaucucugcacaccu

SEQ ID NO: 1044328 - RNA, 20 nt, Human
ccgggcuccagaugaguucc

SEQ ID NO: 1044329 - RNA, 22 nt, Human
ccuccaagaggagcgccaccuu

SEQ ID NO: 1044330 - RNA, 19 nt, Human
ccucccaccuuggccuccc

SEQ ID NO: 1044331 - RNA, 19 nt, Human
ccugaagcagcuccguggc

SEQ ID NO: 1044332 - RNA, 18 nt, Human
ccuggaggucaguaagga

SEQ ID NO: 1044333 - RNA, 19 nt, Human
ccuggauccucguccuucu

SEQ ID NO: 1044334 - RNA, 24 nt, Human
ccuggauccucguccuucuugggg

SEQ ID NO: 1044335 - RNA, 18 nt, Human
cgcggggcgcaggcagcg

SEQ ID NO: 1044336 - RNA, 19 nt, Human
cguggccggguccccagac

SEQ ID NO: 1044337 - RNA, 24 nt, Human
cucaagcaauccucccaccuuggc

SEQ ID NO: 1044338 - RNA, 20 nt, Human
cuccaagaggagcgccaccu

SEQ ID NO: 1044339 - RNA, 23 nt, Human
cuccugggcucaagcaauccucc

SEQ ID NO: 1044340 - RNA, 22 nt, Human
cuucaggggcgccagcaccgcc

SEQ ID NO: 1044341 - RNA, 24 nt, Human
gaccccugcuuccaaagacagccc

SEQ ID NO: 1044342 - RNA, 25 nt, Human
gcacaccuccaagaggaggggaacc

SEQ ID NO: 1044343 - RNA, 24 nt, Human
gcgcggggcgcaggcagcguggag

SEQ ID NO: 1044344 - RNA, 18 nt, Human
ggauuacaggcaugaacg

SEQ ID NO: 1044345 - RNA, 20 nt, Human
gggcgcaggcagcguggagg

SEQ ID NO: 1044346 - RNA, 18 nt, Human
guggccggguccccagac

SEQ ID NO: 1044347 - RNA, 27 nt, Human
guuuuuuuuuuuuuuugguagaugggg

SEQ ID NO: 1044348 - RNA, 24 nt, Human
ucaagcaauccucccaccuuggcc

SEQ ID NO: 1044349 - RNA, 18 nt, Human
uccaagaggagcgccacc

SEQ ID NO: 1044350 - RNA, 24 nt, Human
ucccaaaauguugggauuacaggc

SEQ ID NO: 1044351 - RNA, 19 nt, Human
ucccacuguuuugcccagg

SEQ ID NO: 1044352 - RNA, 23 nt, Human
ucccacuguuuugcccaggcugg

SEQ ID NO: 1044353 - RNA, 21 nt, Human
uccccagacccguggggaccc

SEQ ID NO: 1044354 - RNA, 23 nt, Human
uccccagacccguggggaccccc

SEQ ID NO: 1044355 - RNA, 21 nt, Human
uccguggccggguccccagac

SEQ ID NO: 1044356 - RNA, 18 nt, Human
uccugggcucaagcaauc

SEQ ID NO: 1044357 - RNA, 21 nt, Human
uccugggcucaagcaauccuc

SEQ ID NO: 1044358 - RNA, 24 nt, Human
uccugggcucaagcaauccuccca

SEQ ID NO: 1044359 - RNA, 18 nt, Human
ucgccgccgcagccgccg

SEQ ID NO: 1044360 - RNA, 27 nt, Human
ucgccgccgcagccgccgcagcuccgg

SEQ ID NO: 1044361 - RNA, 23 nt, Human
ucucaaacuccugggcucaagca

SEQ ID NO: 1044362 - RNA, 25 nt, Human
ucugcacaccuccaagaggagcgcc

SEQ ID NO: 1044363 - RNA, 24 nt, Human
ugcccaggcuggucucaaacuccu

SEQ ID NO: 1044364 - RNA, 28 nt, Human
ugcccaggcuggucucaaacuccugggc

SEQ ID NO: 1044365 - RNA, 23 nt, Human
ugcggagucguguccacagggcc

SEQ ID NO: 1044366 - RNA, 19 nt, Human
ugggauuacaggcaugaac

SEQ ID NO: 1044367 - RNA, 19 nt, Human
ugggauuacaggcaugaac

SEQ ID NO: 1044368 - RNA, 19 nt, Human
ugggauuacaggcaugaac

SEQ ID NO: 1044369 - RNA, 20 nt, Human
ugggauuacaggcaugaacg

SEQ ID NO: 1044370 - RNA, 21 nt, Human
ugggauuacaggcaugaacgg

SEQ ID NO: 1044371 - RNA, 22 nt, Human
ugggauuacaggcaugaacgga

SEQ ID NO: 1044372 - RNA, 18 nt, Human
uggggagcccaggacccc

SEQ ID NO: 1044373 - RNA, 24 nt, Human
uguuuugcccaggcuggucucaaa

SEQ ID NO: 1044374 - RNA, 19 nt, Human
ccaacgcccacguccuugc

SEQ ID NO: 1044375 - RNA, 18 nt, Human
ucugaaagaaaagccucc

SEQ ID NO: 1044376 - RNA, 21 nt, Human
ugaaagaaaagccuccaugug

SEQ ID NO: 1044377 - RNA, 19 nt, Human
aggcaccuggacagagccc

SEQ ID NO: 1044378 - RNA, 22 nt, Human
caccuggacagagcccagggac

SEQ ID NO: 1044379 - RNA, 22 nt, Human
aaaaggaagagaucccagcaaa

SEQ ID NO: 1044380 - RNA, 24 nt, Human
aacccaccucccgugugcccccca

SEQ ID NO: 1044381 - RNA, 25 nt, Human
aacccaccucccgugugccccccag

SEQ ID NO: 1044382 - RNA, 23 nt, Human
aagaacccaccucccgugugccc

SEQ ID NO: 1044383 - RNA, 24 nt, Human
aagaacccaccucccgugugcccc

SEQ ID NO: 1044384 - RNA, 18 nt, Human
aaggcgcccuugccgauc

SEQ ID NO: 1044385 - RNA, 23 nt, Human
acgcuccaccuuucccugcgggc

SEQ ID NO: 1044386 - RNA, 23 nt, Human
agacaaccucaggguccaggaag

SEQ ID NO: 1044387 - RNA, 19 nt, Human
agccacccggccccagccc

SEQ ID NO: 1044388 - RNA, 18 nt, Human
aggaaggcggcgaccagg

SEQ ID NO: 1044389 - RNA, 19 nt, Human
aggcaagaacccaccuccc

SEQ ID NO: 1044390 - RNA, 20 nt, Human
agucccaggucuccaaucuu

SEQ ID NO: 1044391 - RNA, 20 nt, Human
caaggcaagaacccaccucc

SEQ ID NO: 1044392 - RNA, 20 nt, Human
cacaggaauggaaauggagc

SEQ ID NO: 1044393 - RNA, 21 nt, Human
cacgauguugcggggucgcag

SEQ ID NO: 1044394 - RNA, 23 nt, Human
cacgugggccaaagacuggcggc

SEQ ID NO: 1044395 - RNA, 23 nt, Human
cacuucuggcuccgucaggaucu

SEQ ID NO: 1044396 - RNA, 23 nt, Human
cagccgggccgagaccaccgcgc

SEQ ID NO: 1044397 - RNA, 18 nt, Human
ccaccgcgcugcggccgc

SEQ ID NO: 1044398 - RNA, 19 nt, Human
ccaccgcgcugcggccgcu

SEQ ID NO: 1044399 - RNA, 18 nt, Human
ccacucugacccucaggg

SEQ ID NO: 1044400 - RNA, 23 nt, Human
ccagcccucccccaggacagccc

SEQ ID NO: 1044401 - RNA, 23 nt, Human
cccaggucuccaaucuucaccuc

SEQ ID NO: 1044402 - RNA, 23 nt, Human
cccccuggccccaccuuggccgc

SEQ ID NO: 1044403 - RNA, 25 nt, Human
cccggccccagccccgccacacggc

SEQ ID NO: 1044404 - RNA, 19 nt, Human
ccgccgccgcggccggggc

SEQ ID NO: 1044405 - RNA, 21 nt, Human
ccucccgugugccccccagcc

SEQ ID NO: 1044406 - RNA, 23 nt, Human
ccugcgccgccgccgcggccggg

SEQ ID NO: 1044407 - RNA, 24 nt, Human
ccugcgggcgaagccacccggccc

SEQ ID NO: 1044408 - RNA, 20 nt, Human
ccuggccccaccuuggccgc

SEQ ID NO: 1044409 - RNA, 21 nt, Human
ccuugagggcgaacacggcgc

SEQ ID NO: 1044410 - RNA, 21 nt, Human
cgcgcccucagcacgugggcc

SEQ ID NO: 1044411 - RNA, 18 nt, Human
cgcugaccaggccccgca

SEQ ID NO: 1044412 - RNA, 23 nt, Human
cggcccccuggccccaccuuggc

SEQ ID NO: 1044413 - RNA, 20 nt, Human
cggccgcuccggggccgcuc

SEQ ID NO: 1044414 - RNA, 27 nt, Human
cggggucgcaggcggcuaugcagggca

SEQ ID NO: 1044415 - RNA, 23 nt, Human
cuccaaucuucaccuccauguuc

SEQ ID NO: 1044416 - RNA, 21 nt, Human
cuccugcgccgccgccgcggc

SEQ ID NO: 1044417 - RNA, 21 nt, Human
cugcaguacuccagcaccaug

SEQ ID NO: 1044418 - RNA, 21 nt, Human
cuguacacgcggcccgagccc

SEQ ID NO: 1044419 - RNA, 21 nt, Human
gaacagucaugccacaaggca

SEQ ID NO: 1044420 - RNA, 22 nt, Human
gcuaugcagggcaaucucacgc

SEQ ID NO: 1044421 - RNA, 23 nt, Human
ggcccccuggccccaccuuggcc

SEQ ID NO: 1044422 - RNA, 18 nt, Human
uacacguggucgcgguca

SEQ ID NO: 1044423 - RNA, 21 nt, Human
ucaugccacaaggcaagaacc

SEQ ID NO: 1044424 - RNA, 18 nt, Human
uccaccuuucccugcggg

SEQ ID NO: 1044425 - RNA, 22 nt, Human
uccugcgccgccgccgcggccg

SEQ ID NO: 1044426 - RNA, 22 nt, Human
ugaccaggccccgcagguaguc

SEQ ID NO: 1044427 - RNA, 19 nt, Human
uggaaagccacgauguugc

SEQ ID NO: 1044428 - RNA, 21 nt, Human
uggagccugggucccuggcac

SEQ ID NO: 1044429 - RNA, 23 nt, Human
uggagccugggucccuggcacua

SEQ ID NO: 1044430 - RNA, 22 nt, Human
uggcaggagugaccguuucugg

SEQ ID NO: 1044431 - RNA, 19 nt, Human
ugggucccuggcacuacca

SEQ ID NO: 1044432 - RNA, 18 nt, Human
uggugcagguagcgcagg

SEQ ID NO: 1044433 - RNA, 23 nt, Human
ugugccccccagcccucccccag

SEQ ID NO: 1044434 - RNA, 20 nt, Human
uguugcggggucgcaggcgg

SEQ ID NO: 1044435 - RNA, 23 nt, Human
aaaaguggguucugccaaggcca

SEQ ID NO: 1044436 - RNA, 21 nt, Human
aaacagaagagaaaugaacaa

SEQ ID NO: 1044437 - RNA, 23 nt, Human
aaacagaagagaaaugaacaaag

SEQ ID NO: 1044438 - RNA, 23 nt, Human
aagaaggggaauguaggagagga

SEQ ID NO: 1044439 - RNA, 20 nt, Human
accacccgccauacacuuuc

SEQ ID NO: 1044440 - RNA, 21 nt, Human
accaucgucucccuggcccug

SEQ ID NO: 1044441 - RNA, 23 nt, Human
accgggcccgcgcccacucgcgc

SEQ ID NO: 1044442 - RNA, 21 nt, Human
agaaagcacagaggacaugag

SEQ ID NO: 1044443 - RNA, 21 nt, Human
agagagagaagucacagcagu

SEQ ID NO: 1044444 - RNA, 21 nt, Human
agaggacaugagagaagggga

SEQ ID NO: 1044445 - RNA, 19 nt, Human
aggaagaagcccccuggca

SEQ ID NO: 1044446 - RNA, 21 nt, Human
aggcagcagacccugcucagg

SEQ ID NO: 1044447 - RNA, 23 nt, Human
aggcgugaugaagccaggagccu

SEQ ID NO: 1044448 - RNA, 24 nt, Human
aggggaagaaggggaauguaggag

SEQ ID NO: 1044449 - RNA, 19 nt, Human
agggggccgcugggaggcc

SEQ ID NO: 1044450 - RNA, 19 nt, Human
aguggggagugggggaagg

SEQ ID NO: 1044451 - RNA, 18 nt, Human
aguggggggaggcgcaga

SEQ ID NO: 1044452 - RNA, 23 nt, Human
auacacuuucagagacagaugcc

SEQ ID NO: 1044453 - RNA, 19 nt, Human
caacaggcucgacgccacc

SEQ ID NO: 1044454 - RNA, 21 nt, Human
cacagccagagaagaaagcac

SEQ ID NO: 1044455 - RNA, 22 nt, Human
cagaugcccgcaggcucugcug

SEQ ID NO: 1044456 - RNA, 20 nt, Human
caggagccuggggcggccag

SEQ ID NO: 1044457 - RNA, 18 nt, Human
caggagcuggugggaggc

SEQ ID NO: 1044458 - RNA, 19 nt, Human
caggcuaggagaaaugggg

SEQ ID NO: 1044459 - RNA, 21 nt, Human
ccaccacccgccauacacuuu

SEQ ID NO: 1044460 - RNA, 24 nt, Human
ccaggccagcugcgacgaccaucc

SEQ ID NO: 1044461 - RNA, 18 nt, Human
ccagggcaggaaaacgga

SEQ ID NO: 1044462 - RNA, 18 nt, Human
cccagugccccuugcccc

SEQ ID NO: 1044463 - RNA, 24 nt, Human
cccccgaaugcucgggccuagcuc

SEQ ID NO: 1044464 - RNA, 24 nt, Human
cccgccauacacuuucagagacag

SEQ ID NO: 1044465 - RNA, 19 nt, Human
cccugacacugcucccugg

SEQ ID NO: 1044466 - RNA, 20 nt, Human
cccuggcccugacacugcuc

SEQ ID NO: 1044467 - RNA, 24 nt, Human
ccgcgcccacucgcgccgcccgcc

SEQ ID NO: 1044468 - RNA, 23 nt, Human
cgcccucccucccggcggcgcca

SEQ ID NO: 1044469 - RNA, 18 nt, Human
cuaggagaaaugggguga

SEQ ID NO: 1044470 - RNA, 21 nt, Human
cucccuggcccugacacugcu

SEQ ID NO: 1044471 - RNA, 18 nt, Human
cugcaccccgcccacagg

SEQ ID NO: 1044472 - RNA, 19 nt, Human
cuucacucuaggcacuggc

SEQ ID NO: 1044473 - RNA, 19 nt, Human
cuucccagugccccuugcc

SEQ ID NO: 1044474 - RNA, 22 nt, Human
cuugcccaccacccgccauaca

SEQ ID NO: 1044475 - RNA, 20 nt, Human
gaagaagcccccuggcacuu

SEQ ID NO: 1044476 - RNA, 20 nt, Human
gaagccaggagccuggggcg

SEQ ID NO: 1044477 - RNA, 21 nt, Human
gaggcgugaugaagccaggag

SEQ ID NO: 1044478 - RNA, 18 nt, Human
gaggcugaugagcugggg

SEQ ID NO: 1044479 - RNA, 22 nt, Human
gcacuugggagagguagaaaag

SEQ ID NO: 1044480 - RNA, 22 nt, Human
gcccagggcaggaaaacggaug

SEQ ID NO: 1044481 - RNA, 19 nt, Human
gcccgcgcccacucgcgcc

SEQ ID NO: 1044482 - RNA, 23 nt, Human
ggaagaaggggaauguaggagag

SEQ ID NO: 1044483 - RNA, 20 nt, Human
ggaagggaggcccaccaggu

SEQ ID NO: 1044484 - RNA, 20 nt, Human
ggagagagagaagucacagc

SEQ ID NO: 1044485 - RNA, 20 nt, Human
ggagagguagaaaagugggu

SEQ ID NO: 1044486 - RNA, 18 nt, Human
ggcccaccaggugacacc

SEQ ID NO: 1044487 - RNA, 23 nt, Human
ggcucugcugccugcaccccgcc

SEQ ID NO: 1044488 - RNA, 19 nt, Human
gggaagaaggggaauguag

SEQ ID NO: 1044489 - RNA, 18 nt, Human
gggaagggaggcccacca

SEQ ID NO: 1044490 - RNA, 19 nt, Human
gggaauguaggagaggaag

SEQ ID NO: 1044491 - RNA, 23 nt, Human
gggaauguaggagaggaagaagc

SEQ ID NO: 1044492 - RNA, 24 nt, Human
gggacagggaggcugaugagcugg

SEQ ID NO: 1044493 - RNA, 22 nt, Human
gggaggcccaccaggugacacc

SEQ ID NO: 1044494 - RNA, 20 nt, Human
gggagugggggaagggaggc

SEQ ID NO: 1044495 - RNA, 21 nt, Human
gggcagaugcccgcaggcucu

SEQ ID NO: 1044496 - RNA, 21 nt, Human
ggggaagggaggcccaccagg

SEQ ID NO: 1044497 - RNA, 20 nt, Human
ggggacagggaggcugauga

SEQ ID NO: 1044498 - RNA, 19 nt, Human
gggggaggcgcagaggagu

SEQ ID NO: 1044499 - RNA, 24 nt, Human
uagucacggagaccaucgucuccc

SEQ ID NO: 1044500 - RNA, 24 nt, Human
ucacagcaguggggggaggcgccg

SEQ ID NO: 1044501 - RNA, 21 nt, Human
ucacggagaccaucgucuccc

SEQ ID NO: 1044502 - RNA, 19 nt, Human
ucaguggggagugggggaa

SEQ ID NO: 1044503 - RNA, 19 nt, Human
uccaggagcuggugggagg

SEQ ID NO: 1044504 - RNA, 20 nt, Human
ucgacgccaccgccgacgag

SEQ ID NO: 1044505 - RNA, 23 nt, Human
ucucccuggcccugacacugcuc

SEQ ID NO: 1044506 - RNA, 18 nt, Human
ugagggaggucagugggg

SEQ ID NO: 1044507 - RNA, 19 nt, Human
ugccaaggccacagccaga

SEQ ID NO: 1044508 - RNA, 21 nt, Human
ugccacggggacagaaaacag

SEQ ID NO: 1044509 - RNA, 19 nt, Human
ugcccagggcaggaaaacg

SEQ ID NO: 1044510 - RNA, 21 nt, Human
ugcugccugcaccccgcccac

SEQ ID NO: 1044511 - RNA, 23 nt, Human
uggcacuugggagagguagaaaa

SEQ ID NO: 1044512 - RNA, 18 nt, Human
uggcccugacacugcucc

SEQ ID NO: 1044513 - RNA, 19 nt, Human
ugggagagguagaaaagug

SEQ ID NO: 1044514 - RNA, 22 nt, Human
ugggagagguagaaaagugggu

SEQ ID NO: 1044515 - RNA, 19 nt, Human
ugggaggccggagguacag

SEQ ID NO: 1044516 - RNA, 19 nt, Human
ugggaggccggagguacag

SEQ ID NO: 1044517 - RNA, 25 nt, Human
ugggaggccggagguacaggagggu

SEQ ID NO: 1044518 - RNA, 20 nt, Human
uggggagugggggaagggag

SEQ ID NO: 1044519 - RNA, 24 nt, Human
aaaggacaccuggcagggaaaaug

SEQ ID NO: 1044520 - RNA, 19 nt, Human
aaccagagcaacaaaaaac

SEQ ID NO: 1044521 - RNA, 22 nt, Human
acagugggagaaguguaggcac

SEQ ID NO: 1044522 - RNA, 23 nt, Human
accagagcaacaaaaaacgucug

SEQ ID NO: 1044523 - RNA, 25 nt, Human
accccacccacgggcaccacguaca

SEQ ID NO: 1044524 - RNA, 26 nt, Human
agacucagagaucagaggccgguggu

SEQ ID NO: 1044525 - RNA, 20 nt, Human
agagugaggugccuuaagga

SEQ ID NO: 1044526 - RNA, 22 nt, Human
agauuuuaaagguuuaagagcu

SEQ ID NO: 1044527 - RNA, 25 nt, Human
aggacaccuggcagggaaaauggcc

SEQ ID NO: 1044528 - RNA, 19 nt, Human
aggaggacuggagaccccu

SEQ ID NO: 1044529 - RNA, 18 nt, Human
aggcccggcagcucaggg

SEQ ID NO: 1044530 - RNA, 22 nt, Human
agggcuaaagauucggagaacu

SEQ ID NO: 1044531 - RNA, 19 nt, Human
aggucaaaaaggacaccug

SEQ ID NO: 1044532 - RNA, 24 nt, Human
agguguugagagguucagaaagcg

SEQ ID NO: 1044533 - RNA, 24 nt, Human
aguacccccucacaucccaggccc

SEQ ID NO: 1044534 - RNA, 18 nt, Human
auagugccaacucuugcc

SEQ ID NO: 1044535 - RNA, 20 nt, Human
augcgacuuagggacccagg

SEQ ID NO: 1044536 - RNA, 18 nt, Human
caaaaaggacaccuggca

SEQ ID NO: 1044537 - RNA, 18 nt, Human
caccacguacacccggcc

SEQ ID NO: 1044538 - RNA, 18 nt, Human
cagaggucaagaggucaa

SEQ ID NO: 1044539 - RNA, 19 nt, Human
cagcagguagacagcuccc

SEQ ID NO: 1044540 - RNA, 19 nt, Human
cagcucccggggagcccuc

SEQ ID NO: 1044541 - RNA, 21 nt, Human
cagcucccggggagcccuccu

SEQ ID NO: 1044542 - RNA, 23 nt, Human
cagcugauagugccaacucuugc

SEQ ID NO: 1044543 - RNA, 23 nt, Human
cagggcuaaagauucggagaacu

SEQ ID NO: 1044544 - RNA, 22 nt, Human
ccagggcuaaagauucggagaa

SEQ ID NO: 1044545 - RNA, 23 nt, Human
cccacgggcaccacguacacccg

SEQ ID NO: 1044546 - RNA, 22 nt, Human
ccccugagaccuagcuucaauc

SEQ ID NO: 1044547 - RNA, 22 nt, Human
ccgcagccgcagcuaauggcug

SEQ ID NO: 1044548 - RNA, 24 nt, Human
ccuggaaccagagcaacaaaaaac

SEQ ID NO: 1044549 - RNA, 23 nt, Human
cgaguucggaaccuuugagcuga

SEQ ID NO: 1044550 - RNA, 22 nt, Human
cggaaccggaucugugguaccg

SEQ ID NO: 1044551 - RNA, 23 nt, Human
cggaaccggaucugugguaccgg

SEQ ID NO: 1044552 - RNA, 22 nt, Human
cguaccccacccacgggcacca

SEQ ID NO: 1044553 - RNA, 19 nt, Human
cuagagggaccagcuggug

SEQ ID NO: 1044554 - RNA, 24 nt, Human
cucccuagagggaccagcuggugc

SEQ ID NO: 1044555 - RNA, 21 nt, Human
cuggagaccccugagaccuag

SEQ ID NO: 1044556 - RNA, 21 nt, Human
cuggcagggauggugguuggc

SEQ ID NO: 1044557 - RNA, 22 nt, Human
cuguugucaaucucucccuaga

SEQ ID NO: 1044558 - RNA, 21 nt, Human
gaaucuggggacugagcagug

SEQ ID NO: 1044559 - RNA, 22 nt, Human
gaccccugagaccuagcuucaa

SEQ ID NO: 1044560 - RNA, 18 nt, Human
gagggaccagcuggugcu

SEQ ID NO: 1044561 - RNA, 21 nt, Human
gagugaggugccuuaaggaug

SEQ ID NO: 1044562 - RNA, 21 nt, Human
gaucagaggccggugggcgcc

SEQ ID NO: 1044563 - RNA, 19 nt, Human
gcagggauggugguuggca

SEQ ID NO: 1044564 - RNA, 18 nt, Human
gccagcccguaccccacc

SEQ ID NO: 1044565 - RNA, 21 nt, Human
gcugcaguccuguggugugag

SEQ ID NO: 1044566 - RNA, 19 nt, Human
ggaaccagagcaacaaaaa

SEQ ID NO: 1044567 - RNA, 20 nt, Human
ggaaccggaucugugguacg

SEQ ID NO: 1044568 - RNA, 18 nt, Human
ggaaggauccuccaacgg

SEQ ID NO: 1044569 - RNA, 18 nt, Human
ggacaccuggcagggaaa

SEQ ID NO: 1044570 - RNA, 25 nt, Human
ggcuaaagauucggagaacuuaggu

SEQ ID NO: 1044571 - RNA, 21 nt, Human
gucagaggucaagaggucaaa

SEQ ID NO: 1044572 - RNA, 22 nt, Human
uaauauuugaaaccacgggagc

SEQ ID NO: 1044573 - RNA, 24 nt, Human
ucccaggcccgaguucggaaccuu

SEQ ID NO: 1044574 - RNA, 21 nt, Human
uccuccaacggagaacggucu

SEQ ID NO: 1044575 - RNA, 20 nt, Human
ucggaaccuuugagcugacc

SEQ ID NO: 1044576 - RNA, 21 nt, Human
ugaccuuugagucagagguca

SEQ ID NO: 1044577 - RNA, 21 nt, Human
ugagaccgcagccgcagcuaa

SEQ ID NO: 1044578 - RNA, 18 nt, Human
ugagcagugggugugaaa

SEQ ID NO: 1044579 - RNA, 25 nt, Human
ugagcagugggugugaaaggaccag

SEQ ID NO: 1044580 - RNA, 19 nt, Human
ugagucagaggucaagagg

SEQ ID NO: 1044581 - RNA, 18 nt, Human
uggaaccagagcaacaaa

SEQ ID NO: 1044582 - RNA, 21 nt, Human
uggacagcagguagacagcuc

SEQ ID NO: 1044583 - RNA, 21 nt, Human
uggagaccccugagaccuagc

SEQ ID NO: 1044584 - RNA, 19 nt, Human
uggcagggauggugguugg

SEQ ID NO: 1044585 - RNA, 19 nt, Human
uggggucuacaggaggugu

SEQ ID NO: 1044586 - RNA, 23 nt, Human
uggugugaggagcagggccuggc

SEQ ID NO: 1044587 - RNA, 25 nt, Human
uuaaauccggaaccggaucuguggu

SEQ ID NO: 1044588 - RNA, 19 nt, Human
uugagucagaggucaagag

SEQ ID NO: 1044589 - RNA, 22 nt, Human
uugcgaggcugacucaagucau

SEQ ID NO: 1044590 - RNA, 21 nt, Human
uuggcagggcgugcccagcac

SEQ ID NO: 1044591 - RNA, 23 nt, Human
agacacauuugcugaaaucuuca

SEQ ID NO: 1044592 - RNA, 20 nt, Human
caaaauguuuccugggagga

SEQ ID NO: 1044593 - RNA, 22 nt, Human
cacagcucaaggcuuguugucc

SEQ ID NO: 1044594 - RNA, 21 nt, Human
caucuuuguccuguuuuccga

SEQ ID NO: 1044595 - RNA, 22 nt, Human
caucuuuguccuguuuuccgau

SEQ ID NO: 1044596 - RNA, 18 nt, Human
ccucccugggccagggau

SEQ ID NO: 1044597 - RNA, 22 nt, Human
ccucuggcuggacucuugguuc

SEQ ID NO: 1044598 - RNA, 19 nt, Human
ccugcccguguccucuccu

SEQ ID NO: 1044599 - RNA, 18 nt, Human
ccuggaauccucccuggg

SEQ ID NO: 1044600 - RNA, 23 nt, Human
cucuccuggaauccucccugggc

SEQ ID NO: 1044601 - RNA, 24 nt, Human
cugcccguguccucuccuggaauc

SEQ ID NO: 1044602 - RNA, 23 nt, Human
cuggcuggacucuugguucuggc

SEQ ID NO: 1044603 - RNA, 23 nt, Human
uagccgccucuggcuggacucuu

SEQ ID NO: 1044604 - RNA, 21 nt, Human
uagcugccugcuuacuucauu

SEQ ID NO: 1044605 - RNA, 21 nt, Human
ucagcaacuuauucaaaaugu

SEQ ID NO: 1044606 - RNA, 26 nt, Human
ucagcaacuuauucaaaauguuuccu

SEQ ID NO: 1044607 - RNA, 22 nt, Human
uccaucaggcacuucagcaacu

SEQ ID NO: 1044608 - RNA, 18 nt, Human
ucuccuggaauccucccu

SEQ ID NO: 1044609 - RNA, 24 nt, Human
ucuccuggaauccucccugggcca

SEQ ID NO: 1044610 - RNA, 18 nt, Human
ucuugguucuggcucugg

SEQ ID NO: 1044611 - RNA, 24 nt, Human
ugaagaggugaugcucuagccgcc

SEQ ID NO: 1044612 - RNA, 24 nt, Human
ugcuuacuucauugaugaggcacu

SEQ ID NO: 1044613 - RNA, 20 nt, Human
uggcucugggccagggcucc

SEQ ID NO: 1044614 - RNA, 21 nt, Human
uggcucugggccagggcuccu

SEQ ID NO: 1044615 - RNA, 22 nt, Human
uggcuggacucuugguucuggc

SEQ ID NO: 1044616 - RNA, 18 nt, Human
ugggacaccaccaagcuc

SEQ ID NO: 1044617 - RNA, 18 nt, Human
uuccugggaggaccgucc

SEQ ID NO: 1044618 - RNA, 19 nt, Human
uuguccuguuuuccgauga

SEQ ID NO: 1044619 - RNA, 20 nt, Human
uuuccugggaggaccguccu

SEQ ID NO: 1044620 - RNA, 21 nt, Human
aacaccgcaaccacuggccca

SEQ ID NO: 1044621 - RNA, 24 nt, Human
acaccgcaaccacuggcccagaug

SEQ ID NO: 1044622 - RNA, 20 nt, Human
acagcgaccacgugcuggaa

SEQ ID NO: 1044623 - RNA, 21 nt, Human
accgcaaccacuggcccagau

SEQ ID NO: 1044624 - RNA, 21 nt, Human
agacacaguggagacuggccg

SEQ ID NO: 1044625 - RNA, 25 nt, Human
agcuagacuucacgacccccucccg

SEQ ID NO: 1044626 - RNA, 18 nt, Human
aguucuaggcugugcccu

SEQ ID NO: 1044627 - RNA, 20 nt, Human
auacacgccucccguguaua

SEQ ID NO: 1044628 - RNA, 24 nt, Human
aucccuagggcuuccacaauacac

SEQ ID NO: 1044629 - RNA, 21 nt, Human
aucugggcuucuuccagcugc

SEQ ID NO: 1044630 - RNA, 21 nt, Human
caacaccgcaaccacuggccc

SEQ ID NO: 1044631 - RNA, 22 nt, Human
caacaccgcaaccacuggccca

SEQ ID NO: 1044632 - RNA, 24 nt, Human
caacaccgcaaccacuggcccaga

SEQ ID NO: 1044633 - RNA, 22 nt, Human
cacaauacacgccucccgugua

SEQ ID NO: 1044634 - RNA, 25 nt, Human
caccgcaaccacuggcccagauguc

SEQ ID NO: 1044635 - RNA, 19 nt, Human
caccuuggggcaggccugg

SEQ ID NO: 1044636 - RNA, 26 nt, Human
caccuuggggcaggccugguggggcu

SEQ ID NO: 1044637 - RNA, 21 nt, Human
cagcaacuccaagucagacac

SEQ ID NO: 1044638 - RNA, 21 nt, Human
cagugcccuugcuucugguug

SEQ ID NO: 1044639 - RNA, 23 nt, Human
ccaagucagacacaguggagacu

SEQ ID NO: 1044640 - RNA, 18 nt, Human
ccaccuccuggcaggauc

SEQ ID NO: 1044641 - RNA, 18 nt, Human
cccccucccgccaccucc

SEQ ID NO: 1044642 - RNA, 22 nt, Human
cccguccgcagggcugcagcca

SEQ ID NO: 1044643 - RNA, 22 nt, Human
cccuagggcuuccacaauacac

SEQ ID NO: 1044644 - RNA, 20 nt, Human
ccgcagggcugcagccaguu

SEQ ID NO: 1044645 - RNA, 24 nt, Human
ccucccgccaccuccuggcaggau

SEQ ID NO: 1044646 - RNA, 21 nt, Human
ccucccguguauaagccucca

SEQ ID NO: 1044647 - RNA, 20 nt, Human
ccuggcaggaucuggcugcu

SEQ ID NO: 1044648 - RNA, 21 nt, Human
cgacccccucccgccaccucc

SEQ ID NO: 1044649 - RNA, 21 nt, Human
cgcccauggugaccaagggcc

SEQ ID NO: 1044650 - RNA, 21 nt, Human
cucccguguauaagccuccac

SEQ ID NO: 1044651 - RNA, 23 nt, Human
cugugcccugaaaacucugggcc

SEQ ID NO: 1044652 - RNA, 22 nt, Human
gacacaguggagacuggcaggu

SEQ ID NO: 1044653 - RNA, 19 nt, Human
gacccccucccgccaccuc

SEQ ID NO: 1044654 - RNA, 18 nt, Human
gagacuggcaggugccgg

SEQ ID NO: 1044655 - RNA, 23 nt, Human
gcagccaguucuaggcugugccc

SEQ ID NO: 1044656 - RNA, 21 nt, Human
gccuggacaucuggaauacag

SEQ ID NO: 1044657 - RNA, 24 nt, Human
gccuggugaagggugugauggggu

SEQ ID NO: 1044658 - RNA, 19 nt, Human
ggagucccuucagcaacuc

SEQ ID NO: 1044659 - RNA, 26 nt, Human
gggccaggagcaaucugggcuucuuc

SEQ ID NO: 1044660 - RNA, 19 nt, Human
gguccugagucucccuggg

SEQ ID NO: 1044661 - RNA, 20 nt, Human
ggugguacaacugccuggug

SEQ ID NO: 1044662 - RNA, 23 nt, Human
gugaagcuagacuucacgacccc

SEQ ID NO: 1044663 - RNA, 22 nt, Human
gugagaaggcucgggcuggcag

SEQ ID NO: 1044664 - RNA, 19 nt, Human
guggagacuggcaggugcc

SEQ ID NO: 1044665 - RNA, 20 nt, Human
uauggccgggcccucguccc

SEQ ID NO: 1044666 - RNA, 19 nt, Human
ugcccugaaaacucugggc

SEQ ID NO: 1044667 - RNA, 22 nt, Human
ugcucggagucccuucagcaac

SEQ ID NO: 1044668 - RNA, 19 nt, Human
ugcuggaagcaauguaggg

SEQ ID NO: 1044669 - RNA, 18 nt, Human
ugcugggccagcgcgucu

SEQ ID NO: 1044670 - RNA, 20 nt, Human
uggaucccuagggcuuccac

SEQ ID NO: 1044671 - RNA, 21 nt, Human
uggcaggugccggcaagggcc

SEQ ID NO: 1044672 - RNA, 19 nt, Human
uggggcuguuuucuugacc

SEQ ID NO: 1044673 - RNA, 25 nt, Human
uguagagcuugccucauccucuguc

SEQ ID NO: 1044674 - RNA, 24 nt, Human
uguauaagccuccacagcgaccac

SEQ ID NO: 1044675 - RNA, 21 nt, Human
uucugguuggugagcgucugg

SEQ ID NO: 1044676 - RNA, 22 nt, Human
agccaguaacagugguggcacg

SEQ ID NO: 1044677 - RNA, 18 nt, Human
agcuugggguuggcuccu

SEQ ID NO: 1044678 - RNA, 21 nt, Human
agugguggcacggcggccuuu

SEQ ID NO: 1044679 - RNA, 18 nt, Human
cccagagcuugggguugg

SEQ ID NO: 1044680 - RNA, 19 nt, Human
ccugcacagccaguaacag

SEQ ID NO: 1044681 - RNA, 28 nt, Human
aaccacgaagucuccuucaaacacagaa

SEQ ID NO: 1044682 - RNA, 18 nt, Human
aagcagugacaaagaggc

SEQ ID NO: 1044683 - RNA, 24 nt, Human
acacagaaaguggagcuugcagga

SEQ ID NO: 1044684 - RNA, 21 nt, Human
acacgauggggagugaaccuc

SEQ ID NO: 1044685 - RNA, 19 nt, Human
acgaagucuccuucaaaca

SEQ ID NO: 1044686 - RNA, 25 nt, Human
acgaagucuccuucaaacacagaaa

SEQ ID NO: 1044687 - RNA, 24 nt, Human
acugcgcuggggaccaaagccauu

SEQ ID NO: 1044688 - RNA, 19 nt, Human
agcgaagcagugacaaaga

SEQ ID NO: 1044689 - RNA, 20 nt, Human
aggagaugauacuucacaaa

SEQ ID NO: 1044690 - RNA, 18 nt, Human
aggagcugaaggagauga

SEQ ID NO: 1044691 - RNA, 22 nt, Human
aggaucagcgaagcagugacaa

SEQ ID NO: 1044692 - RNA, 20 nt, Human
agugcucugaagcuuguggg

SEQ ID NO: 1044693 - RNA, 21 nt, Human
auccucaugauaaaacaccuc

SEQ ID NO: 1044694 - RNA, 24 nt, Human
cacugcgcuggggaccaaagcugg

SEQ ID NO: 1044695 - RNA, 24 nt, Human
cacugugcugggggccaaagcugg

SEQ ID NO: 1044696 - RNA, 21 nt, Human
cagaggguguugagcugcucc

SEQ ID NO: 1044697 - RNA, 21 nt, Human
cagcgaagcagugacaaagga

SEQ ID NO: 1044698 - RNA, 21 nt, Human
cagugcucugaagcuuguggg

SEQ ID NO: 1044699 - RNA, 24 nt, Human
cccucaaaauucaaguccuuagca

SEQ ID NO: 1044700 - RNA, 21 nt, Human
ccucagaaccacgaagucucc

SEQ ID NO: 1044701 - RNA, 22 nt, Human
cugaaggacacucuucccacag

SEQ ID NO: 1044702 - RNA, 18 nt, Human
cuucacagugaagugucc

SEQ ID NO: 1044703 - RNA, 22 nt, Human
gaagucuccuucaaacacagaa

SEQ ID NO: 1044704 - RNA, 19 nt, Human
gacaggaugagacacgggg

SEQ ID NO: 1044705 - RNA, 22 nt, Human
gagaugauacuucacaaaacca

SEQ ID NO: 1044706 - RNA, 19 nt, Human
gagcugaaggagaugauac

SEQ ID NO: 1044707 - RNA, 23 nt, Human
gaggguguugagcugcuccccag

SEQ ID NO: 1044708 - RNA, 20 nt, Human
gccacuccucuccccagggu

SEQ ID NO: 1044709 - RNA, 23 nt, Human
gccuuugcccggcaccucagaac

SEQ ID NO: 1044710 - RNA, 27 nt, Human
gcgaagcagugacaaagaggcucacca

SEQ ID NO: 1044711 - RNA, 22 nt, Human
ggagugaaccucucugggcuuc

SEQ ID NO: 1044712 - RNA, 21 nt, Human
ggccacuccucuccccagggu

SEQ ID NO: 1044713 - RNA, 20 nt, Human
gggagugaaccucucugggc

SEQ ID NO: 1044714 - RNA, 21 nt, Human
guggagcuugcaggaucagcg

SEQ ID NO: 1044715 - RNA, 18 nt, Human
uaaaacaccucacugugc

SEQ ID NO: 1044716 - RNA, 22 nt, Human
uaccauaacaguguccaggaag

SEQ ID NO: 1044717 - RNA, 18 nt, Human
uaugacaguuccauggcu

SEQ ID NO: 1044718 - RNA, 19 nt, Human
uccuuagcagagcugaggg

SEQ ID NO: 1044719 - RNA, 18 nt, Human
uccuucagucagagagaa

SEQ ID NO: 1044720 - RNA, 23 nt, Human
ucucugggcuucacagucgacuu

SEQ ID NO: 1044721 - RNA, 24 nt, Human
ugaagugucaccuuggcucccuca

SEQ ID NO: 1044722 - RNA, 23 nt, Human
ugacaggagcugaaggagaugau

SEQ ID NO: 1044723 - RNA, 18 nt, Human
ugaggacaggaugagaca

SEQ ID NO: 1044724 - RNA, 18 nt, Human
uggaaagaauguaaaaug

SEQ ID NO: 1044725 - RNA, 18 nt, Human
uguggccagugcucugaa

SEQ ID NO: 1044726 - RNA, 20 nt, Human
uguggccagugcucugaagc

SEQ ID NO: 1044727 - RNA, 20 nt, Human
uugcaggaucagcgaagcag

SEQ ID NO: 1044728 - RNA, 20 nt, Human
uuugcccggcaccucagaac

SEQ ID NO: 1044729 - RNA, 22 nt, Human
aaaaaaaaaaaaggauaagaca

SEQ ID NO: 1044730 - RNA, 21 nt, Human
aagaaauaaacaugcaaauua

SEQ ID NO: 1044731 - RNA, 21 nt, Human
aauuugcagaugcuaauccuc

SEQ ID NO: 1044732 - RNA, 21 nt, Human
acaacuugccuuuguucccgg

SEQ ID NO: 1044733 - RNA, 20 nt, Human
agaagaggcacacggcugcg

SEQ ID NO: 1044734 - RNA, 20 nt, Human
agggagccaggcagccagag

SEQ ID NO: 1044735 - RNA, 22 nt, Human
cacggcugcggcaccguagaaa

SEQ ID NO: 1044736 - RNA, 24 nt, Human
cagaagaggcacacggcugcggca

SEQ ID NO: 1044737 - RNA, 20 nt, Human
cauaaagaauaauaauagcu

SEQ ID NO: 1044738 - RNA, 23 nt, Human
ccuuuguucccggacacuugggg

SEQ ID NO: 1044739 - RNA, 24 nt, Human
gguuuuuuuuuuaaaaaaaaaaaa

SEQ ID NO: 1044740 - RNA, 21 nt, Human
uaaaaaaaaaaaaggauaaga

SEQ ID NO: 1044741 - RNA, 24 nt, Human
uaacugcaugucagucacccaagu

SEQ ID NO: 1044742 - RNA, 20 nt, Human
ucagucacccaaguuuuaag

SEQ ID NO: 1044743 - RNA, 21 nt, Human
uccuagggagccaggcagcca

SEQ ID NO: 1044744 - RNA, 22 nt, Human
ucuaagaaauaaacaugcaaau

SEQ ID NO: 1044745 - RNA, 21 nt, Human
ugcaugucagucacccaaguu

SEQ ID NO: 1044746 - RNA, 20 nt, Human
uguacaaaugaaauggaaaa

SEQ ID NO: 1044747 - RNA, 24 nt, Human
uuucccuuagaaggaaacuugguc

SEQ ID NO: 1044748 - RNA, 24 nt, Human
agggcccaucuauuccuguagagc

SEQ ID NO: 1044749 - RNA, 19 nt, Human
ggagcagcugcugagggcc

SEQ ID NO: 1044750 - RNA, 25 nt, Human
uccuguagagccuucuccuaauccu

SEQ ID NO: 1044751 - RNA, 21 nt, Human
uguagagccuucuccuaaucc

SEQ ID NO: 1044752 - RNA, 22 nt, Human
aaaaaaaaaaaaaaaggcagaa

SEQ ID NO: 1044753 - RNA, 20 nt, Human
aaaaaaaaggcagaagcugg

SEQ ID NO: 1044754 - RNA, 19 nt, Human
aaacagacauggugaaggu

SEQ ID NO: 1044755 - RNA, 20 nt, Human
aacauggugaaaaccugucu

SEQ ID NO: 1044756 - RNA, 19 nt, Human
aacauggugaaaccccauc

SEQ ID NO: 1044757 - RNA, 20 nt, Human
aacauggugaaaccccaucu

SEQ ID NO: 1044758 - RNA, 21 nt, Human
aacauggugaaaccccaucuc

SEQ ID NO: 1044759 - RNA, 21 nt, Human
aacauggugaaaccccaucuc

SEQ ID NO: 1044760 - RNA, 24 nt, Human
aaccugugccagugacaacugccg

SEQ ID NO: 1044761 - RNA, 27 nt, Human
aacugccgccgccggguucaaaacuuc

SEQ ID NO: 1044762 - RNA, 25 nt, Human
aagagaccagggaagaggcugcuac

SEQ ID NO: 1044763 - RNA, 23 nt, Human
aagaucaugccacugcacuccag

SEQ ID NO: 1044764 - RNA, 20 nt, Human
aagaugcugggcuccagguu

SEQ ID NO: 1044765 - RNA, 19 nt, Human
aagcaguagaagcuggggc

SEQ ID NO: 1044766 - RNA, 22 nt, Human
aagcaguagaagcuggggcuag

SEQ ID NO: 1044767 - RNA, 24 nt, Human
aagcggaggcugcagugagccaag

SEQ ID NO: 1044768 - RNA, 18 nt, Human
aaggugccagaaccuggu

SEQ ID NO: 1044769 - RNA, 24 nt, Human
aauugcuugaaccugggaggcgga

SEQ ID NO: 1044770 - RNA, 18 nt, Human
acagggccuuggagggga

SEQ ID NO: 1044771 - RNA, 24 nt, Human
accccaucucuacuaaaaauacaa

SEQ ID NO: 1044772 - RNA, 18 nt, Human
accucauucuacucacca

SEQ ID NO: 1044773 - RNA, 28 nt, Human
accuugccucaaaaaaaaaaaaaaaaaa

SEQ ID NO: 1044774 - RNA, 18 nt, Human
acugcacuccagccuggg

SEQ ID NO: 1044775 - RNA, 22 nt, Human
acugcacuccagccugggcaac

SEQ ID NO: 1044776 - RNA, 26 nt, Human
acugcacuccagccugggcaacugag

SEQ ID NO: 1044777 - RNA, 24 nt, Human
acuggccaacauggugaaacccca

SEQ ID NO: 1044778 - RNA, 23 nt, Human
agaaguucaagaccagacuggcc

SEQ ID NO: 1044779 - RNA, 20 nt, Human
agacauggugaagguagugg

SEQ ID NO: 1044780 - RNA, 21 nt, Human
agaccagacuggccaacaugg

SEQ ID NO: 1044781 - RNA, 18 nt, Human
agacugaaagaagagacc

SEQ ID NO: 1044782 - RNA, 18 nt, Human
agacugaaagaagagacc

SEQ ID NO: 1044783 - RNA, 24 nt, Human
agacuggccaacauggugaaaccc

SEQ ID NO: 1044784 - RNA, 25 nt, Human
agaucacuugaggucagaaguucaa

SEQ ID NO: 1044785 - RNA, 20 nt, Human
agaugccaaagagagccuca

SEQ ID NO: 1044786 - RNA, 19 nt, Human
agaugcugggcuccagguu

SEQ ID NO: 1044787 - RNA, 24 nt, Human
agauggggggcaaggaugggcagg

SEQ ID NO: 1044788 - RNA, 21 nt, Human
agcaguagaagcuggggcuag

SEQ ID NO: 1044789 - RNA, 23 nt, Human
agccaggcaugauagcgugugcc

SEQ ID NO: 1044790 - RNA, 19 nt, Human
agccugggcaacaugguga

SEQ ID NO: 1044791 - RNA, 24 nt, Human
agccugggcaacauggugaaaacc

SEQ ID NO: 1044792 - RNA, 25 nt, Human
agccugggcaacauggugaaaaccu

SEQ ID NO: 1044793 - RNA, 24 nt, Human
agccugggcaacugaguaagaccu

SEQ ID NO: 1044794 - RNA, 21 nt, Human
agcgcacaccuguaaucccag

SEQ ID NO: 1044795 - RNA, 23 nt, Human
agcugagauggggggcaaggaug

SEQ ID NO: 1044796 - RNA, 18 nt, Human
agcuugcacucagaaggu

SEQ ID NO: 1044797 - RNA, 23 nt, Human
aggaguucgagaccagccugggc

SEQ ID NO: 1044798 - RNA, 22 nt, Human
aggcaggacaauugcuugaacc

SEQ ID NO: 1044799 - RNA, 24 nt, Human
aggcaggacaauugcuugaaccug

SEQ ID NO: 1044800 - RNA, 20 nt, Human
aggcggagguugcagugagc

SEQ ID NO: 1044801 - RNA, 24 nt, Human
aggcggagguugcagugagcugag

SEQ ID NO: 1044802 - RNA, 21 nt, Human
aggcgggcagaucacuugagg

SEQ ID NO: 1044803 - RNA, 21 nt, Human
aggcgggcagaucacuugagg

SEQ ID NO: 1044804 - RNA, 22 nt, Human
aggcgggcagaucacuugaggu

SEQ ID NO: 1044805 - RNA, 23 nt, Human
aggcgggcagaucacuugagguc

SEQ ID NO: 1044806 - RNA, 26 nt, Human
aggcgggcagaucacuugaggucaga

SEQ ID NO: 1044807 - RNA, 21 nt, Human
aggcugaggcaggacaauugc

SEQ ID NO: 1044808 - RNA, 24 nt, Human
aggcugaggcaggacaauugcuug

SEQ ID NO: 1044809 - RNA, 23 nt, Human
aggcugcagugagccaagaucau

SEQ ID NO: 1044810 - RNA, 24 nt, Human
agggaaguggggaugcaacacugg

SEQ ID NO: 1044811 - RNA, 21 nt, Human
agggccuuggaggggagggug

SEQ ID NO: 1044812 - RNA, 23 nt, Human
agggccuuggaggggaggguggg

SEQ ID NO: 1044813 - RNA, 18 nt, Human
agugacaacugccgccgc

SEQ ID NO: 1044814 - RNA, 22 nt, Human
aguugagcccaggaguucgaga

SEQ ID NO: 1044815 - RNA, 24 nt, Human
aucaugccacugcacuccagccug

SEQ ID NO: 1044816 - RNA, 22 nt, Human
aucugaacacuuugggaggcca

SEQ ID NO: 1044817 - RNA, 24 nt, Human
augccacugcacuccagccugggc

SEQ ID NO: 1044818 - RNA, 22 nt, Human
caacauggugaaaaccugucuc

SEQ ID NO: 1044819 - RNA, 24 nt, Human
caacauggugaaaaccugucucua

SEQ ID NO: 1044820 - RNA, 24 nt, Human
caacauggugaaaccccaucucua

SEQ ID NO: 1044821 - RNA, 23 nt, Human
caacuguaaucccagcacuuugg

SEQ ID NO: 1044822 - RNA, 24 nt, Human
caacuguaaucccagcacuuuggg

SEQ ID NO: 1044823 - RNA, 24 nt, Human
caagaccagacuggccaacauggu

SEQ ID NO: 1044824 - RNA, 24 nt, Human
caaguucaacugagcuugcacuca

SEQ ID NO: 1044825 - RNA, 24 nt, Human
cacaacuguaaucccagcacuuug

SEQ ID NO: 1044826 - RNA, 21 nt, Human
cacacauauuuacuaggucac

SEQ ID NO: 1044827 - RNA, 24 nt, Human
cacaccuguaaucccagcuacuug

SEQ ID NO: 1044828 - RNA, 24 nt, Human
cacaccuguaaucugaacacuuug

SEQ ID NO: 1044829 - RNA, 23 nt, Human
cacagccaaaaaauucuuaaagc

SEQ ID NO: 1044830 - RNA, 23 nt, Human
caccuguaaucccagcuacuugg

SEQ ID NO: 1044831 - RNA, 24 nt, Human
caccuguaaucccagcuacuuggg

SEQ ID NO: 1044832 - RNA, 23 nt, Human
caccuguaaucugaacacuuugg

SEQ ID NO: 1044833 - RNA, 24 nt, Human
caccuguaaucugaacacuuuggg

SEQ ID NO: 1044834 - RNA, 19 nt, Human
cacuacugcccuagagcag

SEQ ID NO: 1044835 - RNA, 18 nt, Human
cacucagaagguacagcu

SEQ ID NO: 1044836 - RNA, 22 nt, Human
cacuccagccugggcaacugag

SEQ ID NO: 1044837 - RNA, 18 nt, Human
cacugcacuccagccugg

SEQ ID NO: 1044838 - RNA, 19 nt, Human
cacugcacuccagccuggg

SEQ ID NO: 1044839 - RNA, 21 nt, Human
cacugcacuccagccugggca

SEQ ID NO: 1044840 - RNA, 23 nt, Human
cacugcacuccagccugggcaac

SEQ ID NO: 1044841 - RNA, 25 nt, Human
cacugcacuccagccugggcaacug

SEQ ID NO: 1044842 - RNA, 24 nt, Human
cagcacuuugggagggcgaggcgg

SEQ ID NO: 1044843 - RNA, 21 nt, Human
cagcgccaccugggaaacuga

SEQ ID NO: 1044844 - RNA, 24 nt, Human
cagcuacuugggaggcugaggcag

SEQ ID NO: 1044845 - RNA, 21 nt, Human
caggaaaggccaccacguuag

SEQ ID NO: 1044846 - RNA, 21 nt, Human
caguagaagcuggggcuaggc

SEQ ID NO: 1044847 - RNA, 22 nt, Human
ccaccugggaaacugaggucgc

SEQ ID NO: 1044848 - RNA, 20 nt, Human
ccacugcacuccagccuggg

SEQ ID NO: 1044849 - RNA, 20 nt, Human
ccacugcacuccagccuggg

SEQ ID NO: 1044850 - RNA, 21 nt, Human
ccacugcacuccagccugggc

SEQ ID NO: 1044851 - RNA, 23 nt, Human
ccacugcacuccagccugggcaa

SEQ ID NO: 1044852 - RNA, 24 nt, Human
ccacugcacuccagccugggcaac

SEQ ID NO: 1044853 - RNA, 19 nt, Human
ccacuggauuagaggcaga

SEQ ID NO: 1044854 - RNA, 18 nt, Human
ccagaaccugguugagac

SEQ ID NO: 1044855 - RNA, 27 nt, Human
ccagaaccugguugagaccuccccaga

SEQ ID NO: 1044856 - RNA, 25 nt, Human
ccaggaguucgagaccagccugggc

SEQ ID NO: 1044857 - RNA, 21 nt, Human
ccaggcaugauagcgugugcc

SEQ ID NO: 1044858 - RNA, 19 nt, Human
cccaaaggaauagguccuc

SEQ ID NO: 1044859 - RNA, 23 nt, Human
cccauauauuauuacuugggggg

SEQ ID NO: 1044860 - RNA, 20 nt, Human
cccauuacuuuccaaguuca

SEQ ID NO: 1044861 - RNA, 23 nt, Human
ccccagcacuacugcccuagagc

SEQ ID NO: 1044862 - RNA, 19 nt, Human
ccugggaggcggagguugc

SEQ ID NO: 1044863 - RNA, 22 nt, Human
ccugggcaacauggugaaaacc

SEQ ID NO: 1044864 - RNA, 24 nt, Human
ccugggcaacauggugaaaaccug

SEQ ID NO: 1044865 - RNA, 21 nt, Human
ccuguaaucccagcuacuugg

SEQ ID NO: 1044866 - RNA, 24 nt, Human
ccuguaaucugaacacuuugggag

SEQ ID NO: 1044867 - RNA, 24 nt, Human
ccugugacuagggaaaggaaggac

SEQ ID NO: 1044868 - RNA, 24 nt, Human
ccuugccucaaaaaaaaaaaaaaa

SEQ ID NO: 1044869 - RNA, 24 nt, Human
cgagaccagccugggcaacauggu

SEQ ID NO: 1044870 - RNA, 24 nt, Human
cgaggcgggcagaucacuugaggu

SEQ ID NO: 1044871 - RNA, 26 nt, Human
cgaggcgggcagaucacuugagguca

SEQ ID NO: 1044872 - RNA, 19 nt, Human
cgcagcgccaccugggaaa

SEQ ID NO: 1044873 - RNA, 24 nt, Human
cgggcagaucacuugaggucagaa

SEQ ID NO: 1044874 - RNA, 22 nt, Human
cuaggcaugguagcagcucaca

SEQ ID NO: 1044875 - RNA, 18 nt, Human
cucaaaaaaaaaaaaaaa

SEQ ID NO: 1044876 - RNA, 24 nt, Human
cucacaacuguaaucccagcacuu

SEQ ID NO: 1044877 - RNA, 20 nt, Human
cucacaccuguaaucugaac

SEQ ID NO: 1044878 - RNA, 24 nt, Human
cucacaccuguaaucugaacacuu

SEQ ID NO: 1044879 - RNA, 20 nt, Human
cuccucuggggaucuggcuu

SEQ ID NO: 1044880 - RNA, 21 nt, Human
cucuccuagcgggggauaccc

SEQ ID NO: 1044881 - RNA, 23 nt, Human
cuggccaacauggugaaacccca

SEQ ID NO: 1044882 - RNA, 22 nt, Human
cuggcucccuggugucuugugc

SEQ ID NO: 1044883 - RNA, 22 nt, Human
cugggaaacugaggucgccucu

SEQ ID NO: 1044884 - RNA, 21 nt, Human
cuguaaucccagcuacuuggg

SEQ ID NO: 1044885 - RNA, 19 nt, Human
cuugaaccugggaggcgga

SEQ ID NO: 1044886 - RNA, 25 nt, Human
cuuuccaaguucaacugagcuugca

SEQ ID NO: 1044887 - RNA, 21 nt, Human
gaagaaacagacauggugaag

SEQ ID NO: 1044888 - RNA, 19 nt, Human
gaccagggaagaggcugcu

SEQ ID NO: 1044889 - RNA, 18 nt, Human
gaggcugcagugagccaa

SEQ ID NO: 1044890 - RNA, 19 nt, Human
gaggcugcagugagccaag

SEQ ID NO: 1044891 - RNA, 21 nt, Human
gagguugcagugagcugagau

SEQ ID NO: 1044892 - RNA, 23 nt, Human
gaucacuugaggucagaaguuca

SEQ ID NO: 1044893 - RNA, 24 nt, Human
gaucacuugaggucagaaguucaa

SEQ ID NO: 1044894 - RNA, 24 nt, Human
gaucaguugagcccaggaguucga

SEQ ID NO: 1044895 - RNA, 21 nt, Human
gcagugaaaagccucaguaga

SEQ ID NO: 1044896 - RNA, 24 nt, Human
gccaacauggugaaaccccaucuc

SEQ ID NO: 1044897 - RNA, 20 nt, Human
gccaagaucaugccacugca

SEQ ID NO: 1044898 - RNA, 22 nt, Human
gccacugcacuccagccugggc

SEQ ID NO: 1044899 - RNA, 24 nt, Human
gccacugcacuccagccugggcaa

SEQ ID NO: 1044900 - RNA, 22 nt, Human
gcccaggaguucgagaccagcc

SEQ ID NO: 1044901 - RNA, 18 nt, Human
gccucaguagauaagaca

SEQ ID NO: 1044902 - RNA, 18 nt, Human
gcuaggcaugguagcagc

SEQ ID NO: 1044903 - RNA, 24 nt, Human
ggaaggacgcucuuggggaacugg

SEQ ID NO: 1044904 - RNA, 20 nt, Human
ggaggcugcagugagccaag

SEQ ID NO: 1044905 - RNA, 24 nt, Human
ggaggcugcagugagccaagauca

SEQ ID NO: 1044906 - RNA, 22 nt, Human
ggagguugcagugagcugagau

SEQ ID NO: 1044907 - RNA, 23 nt, Human
ggagguugcagugagcugagaug

SEQ ID NO: 1044908 - RNA, 24 nt, Human
ggagguugcagugagcugagaugg

SEQ ID NO: 1044909 - RNA, 20 nt, Human
gggcaaggaugggcaggcag

SEQ ID NO: 1044910 - RNA, 24 nt, Human
gggcaugguggcucacaacuguaa

SEQ ID NO: 1044911 - RNA, 18 nt, Human
gggcgggcagcccagaac

SEQ ID NO: 1044912 - RNA, 20 nt, Human
gggcuaaggugggaggauug

SEQ ID NO: 1044913 - RNA, 23 nt, Human
ggggucuggcucccuggugucuu

SEQ ID NO: 1044914 - RNA, 20 nt, Human
ggugaagguagugggcagag

SEQ ID NO: 1044915 - RNA, 24 nt, Human
gguggaucaguugagcccaggagu

SEQ ID NO: 1044916 - RNA, 24 nt, Human
gguggcucacaacuguaaucccag

SEQ ID NO: 1044917 - RNA, 19 nt, Human
guaguacacuggcgccacc

SEQ ID NO: 1044918 - RNA, 18 nt, Human
guugcagugagcugagau

SEQ ID NO: 1044919 - RNA, 24 nt, Human
uaaggaugauguguggagaugcca

SEQ ID NO: 1044920 - RNA, 18 nt, Human
uaaggugggaggauugcu

SEQ ID NO: 1044921 - RNA, 23 nt, Human
uagaaagggugcuccucugggga

SEQ ID NO: 1044922 - RNA, 22 nt, Human
uagccaggcaugauagcgugug

SEQ ID NO: 1044923 - RNA, 22 nt, Human
uagcgcacaccuguaaucccag

SEQ ID NO: 1044924 - RNA, 22 nt, Human
uagcgugugccuguagucccau

SEQ ID NO: 1044925 - RNA, 23 nt, Human
uaggcugggcaugguggcucaca

SEQ ID NO: 1044926 - RNA, 18 nt, Human
uaggucacaauguaaauu

SEQ ID NO: 1044927 - RNA, 23 nt, Human
uaucagaccaaaacugcgauccu

SEQ ID NO: 1044928 - RNA, 24 nt, Human
uaucucauccuccuuugcaucccc

SEQ ID NO: 1044929 - RNA, 26 nt, Human
uaucucauccuccuuugcauccccca

SEQ ID NO: 1044930 - RNA, 27 nt, Human
uaucucauccuccuuugcaucccccag

SEQ ID NO: 1044931 - RNA, 23 nt, Human
ucaguugagcccaggaguucgag

SEQ ID NO: 1044932 - RNA, 23 nt, Human
ucaugccacugcacuccagccug

SEQ ID NO: 1044933 - RNA, 24 nt, Human
ucauucuacucaccagaaugggaa

SEQ ID NO: 1044934 - RNA, 25 nt, Human
ucccaccagaauaucucauccuccu

SEQ ID NO: 1044935 - RNA, 21 nt, Human
ucuacucaccagaaugggaac

SEQ ID NO: 1044936 - RNA, 21 nt, Human
ucucuacuaaaaauacaaaaa

SEQ ID NO: 1044937 - RNA, 19 nt, Human
ucuggcucccuggugucuu

SEQ ID NO: 1044938 - RNA, 19 nt, Human
ugaaaccccaucucuacua

SEQ ID NO: 1044939 - RNA, 24 nt, Human
ugaaagaagagaccagggaagagg

SEQ ID NO: 1044940 - RNA, 24 nt, Human
ugaaccugggaggcggagguugca

SEQ ID NO: 1044941 - RNA, 23 nt, Human
ugagcccaggaguucgagaccag

SEQ ID NO: 1044942 - RNA, 21 nt, Human
ugaggaaagguagccuccuac

SEQ ID NO: 1044943 - RNA, 24 nt, Human
ugaggcaggacaauugcuugaacc

SEQ ID NO: 1044944 - RNA, 25 nt, Human
ugaggcaggacaauugcuugaaccu

SEQ ID NO: 1044945 - RNA, 19 nt, Human
ugaguaagaccuugccuca

SEQ ID NO: 1044946 - RNA, 24 nt, Human
ugauagcgugugccuguaguccca

SEQ ID NO: 1044947 - RNA, 18 nt, Human
ugcagugagcugagaugg

SEQ ID NO: 1044948 - RNA, 24 nt, Human
ugccacugcacuccagccugggca

SEQ ID NO: 1044949 - RNA, 20 nt, Human
ugccagugacaacugccgcc

SEQ ID NO: 1044950 - RNA, 18 nt, Human
ugccgcagcgccaccugg

SEQ ID NO: 1044951 - RNA, 20 nt, Human
ugccgcagcgccaccuggga

SEQ ID NO: 1044952 - RNA, 21 nt, Human
ugcuaaggaugauguguggag

SEQ ID NO: 1044953 - RNA, 24 nt, Human
uggagcugaaagaugcugggccgg

SEQ ID NO: 1044954 - RNA, 24 nt, Human
uggaucaguugagcccaggaguuc

SEQ ID NO: 1044955 - RNA, 23 nt, Human
uggaugaagaaacagacauggug

SEQ ID NO: 1044956 - RNA, 24 nt, Human
uggccaacauggugaaaccccauc

SEQ ID NO: 1044957 - RNA, 24 nt, Human
uggcucacaacuguaaucccagca

SEQ ID NO: 1044958 - RNA, 21 nt, Human
uggcuuccauaaaaguucccu

SEQ ID NO: 1044959 - RNA, 24 nt, Human
ugggaggccaaaguugguggauca

SEQ ID NO: 1044960 - RNA, 29 nt, Human
ugggaggcggagguugcagugacaacggu

SEQ ID NO: 1044961 - RNA, 24 nt, Human
ugggaggcggagguugcagugagc

SEQ ID NO: 1044962 - RNA, 20 nt, Human
ugggaggcugaggcaggaca

SEQ ID NO: 1044963 - RNA, 22 nt, Human
ugggaggcugaggcaggacaau

SEQ ID NO: 1044964 - RNA, 24 nt, Human
ugggagggcgaggcgggcagauca

SEQ ID NO: 1044965 - RNA, 22 nt, Human
uggggggcuaaggugggaggau

SEQ ID NO: 1044966 - RNA, 23 nt, Human
ugggguagguggaugcacuauca

SEQ ID NO: 1044967 - RNA, 24 nt, Human
ugguggcucacaacuguaauccca

SEQ ID NO: 1044968 - RNA, 24 nt, Human
ugugcuugcucuccuagcggggga

SEQ ID NO: 1044969 - RNA, 26 nt, Human
uuacuaggucacaauguaaauuguau

SEQ ID NO: 1044970 - RNA, 21 nt, Human
uuagauggaaagagggaagug

SEQ ID NO: 1044971 - RNA, 22 nt, Human
uuccaaguucaacugagcuugc

SEQ ID NO: 1044972 - RNA, 24 nt, Human
uugaaccugggaggcggagguugc

SEQ ID NO: 1044973 - RNA, 22 nt, Human
uugagcccaggaguucgagacc

SEQ ID NO: 1044974 - RNA, 18 nt, Human
uugcagugagcugagaug

SEQ ID NO: 1044975 - RNA, 24 nt, Human
uugcagugagcugagauggggggc

SEQ ID NO: 1044976 - RNA, 24 nt, Human
uugcuugaaccugggaggcggagg

SEQ ID NO: 1044977 - RNA, 23 nt, Human
uugggaggcugaggcaggacaau

SEQ ID NO: 1044978 - RNA, 25 nt, Human
uuggggggcuaaggugggaggauug

SEQ ID NO: 1044979 - RNA, 23 nt, Human
uuuggacuggcugccgcagcgcc

SEQ ID NO: 1044980 - RNA, 23 nt, Human
aaacaggagagggaacaugcuga

SEQ ID NO: 1044981 - RNA, 21 nt, Human
aaagaagagacacaagaaaga

SEQ ID NO: 1044982 - RNA, 19 nt, Human
aaagaccaucccagcugcc

SEQ ID NO: 1044983 - RNA, 20 nt, Human
aagaagagacacaagaaaga

SEQ ID NO: 1044984 - RNA, 21 nt, Human
aaguuggggaacugaagacac

SEQ ID NO: 1044985 - RNA, 26 nt, Human
acagucuggccuuuuucaccucccag

SEQ ID NO: 1044986 - RNA, 21 nt, Human
agaaagaccaucccagcugcc

SEQ ID NO: 1044987 - RNA, 25 nt, Human
agggaacaugcugagggaagccccc

SEQ ID NO: 1044988 - RNA, 22 nt, Human
aucagggguccucuuggggggc

SEQ ID NO: 1044989 - RNA, 22 nt, Human
cacagucuggccuuuuucaccu

SEQ ID NO: 1044990 - RNA, 22 nt, Human
cagggguccucuuggggggccu

SEQ ID NO: 1044991 - RNA, 22 nt, Human
ccucccaggccucaagagugaa

SEQ ID NO: 1044992 - RNA, 21 nt, Human
ccucuggauccguggcaaaca

SEQ ID NO: 1044993 - RNA, 24 nt, Human
cucuuuugagagggaagcugggag

SEQ ID NO: 1044994 - RNA, 19 nt, Human
gaguuuaccauucagcucc

SEQ ID NO: 1044995 - RNA, 22 nt, Human
gcacagucuggccuuuuucacc

SEQ ID NO: 1044996 - RNA, 21 nt, Human
ggaaugccaggaaaaccagca

SEQ ID NO: 1044997 - RNA, 22 nt, Human
ggccucuggauccguggcaaac

SEQ ID NO: 1044998 - RNA, 24 nt, Human
uaaaagcaaaauugaaucaauccu

SEQ ID NO: 1044999 - RNA, 24 nt, Human
ucaagagugaaagggguacgagaa

SEQ ID NO: 1045000 - RNA, 19 nt, Human
ucaccucccaggccucaag

SEQ ID NO: 1045001 - RNA, 30 nt, Human
uccauuauccagaaucuguuaggaccacuu

SEQ ID NO: 1045002 - RNA, 22 nt, Human
ucuggccuuuuucaccucccag

SEQ ID NO: 1045003 - RNA, 23 nt, Human
ugacaaaugagacuucacucucu

SEQ ID NO: 1045004 - RNA, 25 nt, Human
ugcaaagaagagacacaagaaagac

SEQ ID NO: 1045005 - RNA, 24 nt, Human
uggccuuuuucaccucccaggccu

SEQ ID NO: 1045006 - RNA, 23 nt, Human
uggggugcaaagaagagacacaa

SEQ ID NO: 1045007 - RNA, 18 nt, Human
uuaaauauucucuaccua

SEQ ID NO: 1045008 - RNA, 24 nt, Human
aaaaacuccuggcugccccuauca

SEQ ID NO: 1045009 - RNA, 23 nt, Human
aaacaaaacaaaucacucucuga

SEQ ID NO: 1045010 - RNA, 22 nt, Human
aaagacauucuucucaccagag

SEQ ID NO: 1045011 - RNA, 18 nt, Human
aaaguaaauagcaagguc

SEQ ID NO: 1045012 - RNA, 20 nt, Human
aaauauuaaagccccugaca

SEQ ID NO: 1045013 - RNA, 24 nt, Human
aaauuguugggauuacgugcauga

SEQ ID NO: 1045014 - RNA, 20 nt, Human
aacacagcgagacuucgucu

SEQ ID NO: 1045015 - RNA, 21 nt, Human
aacacagcgagacuucgucuc

SEQ ID NO: 1045016 - RNA, 27 nt, Human
aaccaggucauaaggcccuggaacgcc

SEQ ID NO: 1045017 - RNA, 20 nt, Human
aaccuccaccuccugggcuc

SEQ ID NO: 1045018 - RNA, 19 nt, Human
aaccugggguaucuuccuu

SEQ ID NO: 1045019 - RNA, 22 nt, Human
aacuaaccccacuuaacccgca

SEQ ID NO: 1045020 - RNA, 23 nt, Human
aagaaaauagcucacuaacgccc

SEQ ID NO: 1045021 - RNA, 18 nt, Human
aagacaaaaugacaaaaa

SEQ ID NO: 1045022 - RNA, 20 nt, Human
aagacaaaaugacaaaaagc

SEQ ID NO: 1045023 - RNA, 19 nt, Human
aagacggcgaaaccccauc

SEQ ID NO: 1045024 - RNA, 20 nt, Human
aagacggcgaaaccccaucu

SEQ ID NO: 1045025 - RNA, 23 nt, Human
aagauugcgccauugcacuccag

SEQ ID NO: 1045026 - RNA, 22 nt, Human
aagcaaaucuaauuuuagagac

SEQ ID NO: 1045027 - RNA, 18 nt, Human
aagcaaguauuuuuuuua

SEQ ID NO: 1045028 - RNA, 18 nt, Human
aaucacuuuaagaccaaa

SEQ ID NO: 1045029 - RNA, 21 nt, Human
aaugaaccaauacacacugaa

SEQ ID NO: 1045030 - RNA, 22 nt, Human
aaugacacuucugcccccaaca

SEQ ID NO: 1045031 - RNA, 23 nt, Human
acacagcgagacuucgucucaaa

SEQ ID NO: 1045032 - RNA, 23 nt, Human
acacuucugcccccaacagagag

SEQ ID NO: 1045033 - RNA, 19 nt, Human
acagacaggguuucaccau

SEQ ID NO: 1045034 - RNA, 18 nt, Human
acaggguuucaccauguu

SEQ ID NO: 1045035 - RNA, 23 nt, Human
acaggguuucaccauguuggcca

SEQ ID NO: 1045036 - RNA, 24 nt, Human
acaggguuucaccauguuggccag

SEQ ID NO: 1045037 - RNA, 21 nt, Human
accagguauuccagguaacaa

SEQ ID NO: 1045038 - RNA, 18 nt, Human
accauguuggccaggcug

SEQ ID NO: 1045039 - RNA, 21 nt, Human
accccagagcuggaggcaaca

SEQ ID NO: 1045040 - RNA, 24 nt, Human
accccaucucuacuaaaaauacaa

SEQ ID NO: 1045041 - RNA, 19 nt, Human
accuugugaugauaguugu

SEQ ID NO: 1045042 - RNA, 18 nt, Human
acggcgaaaccccaucuc

SEQ ID NO: 1045043 - RNA, 19 nt, Human
acucaggcuggagugcaau

SEQ ID NO: 1045044 - RNA, 18 nt, Human
acucugucacucaggcug

SEQ ID NO: 1045045 - RNA, 18 nt, Human
agaauacagacacaucug

SEQ ID NO: 1045046 - RNA, 21 nt, Human
agaauacagacacaucugcug

SEQ ID NO: 1045047 - RNA, 22 nt, Human
agacaaaaugacaaaaagccag

SEQ ID NO: 1045048 - RNA, 23 nt, Human
agacaaaaugacaaaaagccaga

SEQ ID NO: 1045049 - RNA, 24 nt, Human
agacaaaaugacaaaaagccagag

SEQ ID NO: 1045050 - RNA, 18 nt, Human
agagaccagguauuccag

SEQ ID NO: 1045051 - RNA, 21 nt, Human
agaggugauccaccuaccuca

SEQ ID NO: 1045052 - RNA, 24 nt, Human
agauguugcagugagccaagauug

SEQ ID NO: 1045053 - RNA, 18 nt, Human
agccaccgcacccagccu

SEQ ID NO: 1045054 - RNA, 18 nt, Human
agccucccgaauagcugg

SEQ ID NO: 1045055 - RNA, 22 nt, Human
agccugggcaacacagcgagac

SEQ ID NO: 1045056 - RNA, 24 nt, Human
agccugggcaacacagcgagacuu

SEQ ID NO: 1045057 - RNA, 20 nt, Human
aggaguuugagaccagccug

SEQ ID NO: 1045058 - RNA, 22 nt, Human
aggggugcggggaagggaaaug

SEQ ID NO: 1045059 - RNA, 18 nt, Human
aggugauccaccuaccuc

SEQ ID NO: 1045060 - RNA, 24 nt, Human
aggugauccaccuaccucagccuc

SEQ ID NO: 1045061 - RNA, 23 nt, Human
agguggguggaucauuugagguc

SEQ ID NO: 1045062 - RNA, 24 nt, Human
agucagauguugcagugagccaag

SEQ ID NO: 1045063 - RNA, 24 nt, Human
agugauucucgugccucagccucc

SEQ ID NO: 1045064 - RNA, 20 nt, Human
agugcaauggugcgaucaug

SEQ ID NO: 1045065 - RNA, 23 nt, Human
agugcaauggugcgaucauggcu

SEQ ID NO: 1045066 - RNA, 24 nt, Human
agugcagugacauaaucuuggcuc

SEQ ID NO: 1045067 - RNA, 23 nt, Human
aguggcucaugccuguaauccag

SEQ ID NO: 1045068 - RNA, 22 nt, Human
auaaaggcuuucuaaaaugcuu

SEQ ID NO: 1045069 - RNA, 24 nt, Human
aucauuugaggucaggaguuugag

SEQ ID NO: 1045070 - RNA, 18 nt, Human
aucuggccuguuuucaag

SEQ ID NO: 1045071 - RNA, 21 nt, Human
augaaacaaaagacaucgaag

SEQ ID NO: 1045072 - RNA, 24 nt, Human
augaaacaaaagacaucgaaguuc

SEQ ID NO: 1045073 - RNA, 21 nt, Human
augaacuccagagcugaauua

SEQ ID NO: 1045074 - RNA, 18 nt, Human
auuagcugggaguggugg

SEQ ID NO: 1045075 - RNA, 23 nt, Human
auugcacuccagccugggcaaca

SEQ ID NO: 1045076 - RNA, 25 nt, Human
auugcacuccagccugggcaacaca

SEQ ID NO: 1045077 - RNA, 24 nt, Human
auugcgccauugcacuccagccug

SEQ ID NO: 1045078 - RNA, 24 nt, Human
auuugaggucaggaguuugagacc

SEQ ID NO: 1045079 - RNA, 22 nt, Human
caaaacaaaacaaaucacucuc

SEQ ID NO: 1045080 - RNA, 26 nt, Human
caaaauaauccuuaggccacacucug

SEQ ID NO: 1045081 - RNA, 20 nt, Human
caaacugaacggcuaagaac

SEQ ID NO: 1045082 - RNA, 19 nt, Human
caaaguaaauagcaagguc

SEQ ID NO: 1045083 - RNA, 21 nt, Human
caaaugaccaaccccagaaua

SEQ ID NO: 1045084 - RNA, 20 nt, Human
caacaaaauaauccuuaggc

SEQ ID NO: 1045085 - RNA, 24 nt, Human
caacaaaauaauccuuaggccaca

SEQ ID NO: 1045086 - RNA, 24 nt, Human
caaccuccaccuccugggcucaag

SEQ ID NO: 1045087 - RNA, 25 nt, Human
caacuguaaagcaacuggacaauau

SEQ ID NO: 1045088 - RNA, 22 nt, Human
caagguccuuuacucucucuuc

SEQ ID NO: 1045089 - RNA, 22 nt, Human
caagugauucucgugccucagc

SEQ ID NO: 1045090 - RNA, 21 nt, Human
caccauguuggccaggcuggu

SEQ ID NO: 1045091 - RNA, 24 nt, Human
caccauguuggccaggcuggucuc

SEQ ID NO: 1045092 - RNA, 27 nt, Human
caccauguuggccaggcuggucucaaa

SEQ ID NO: 1045093 - RNA, 18 nt, Human
caccgcacccagccuaca

SEQ ID NO: 1045094 - RNA, 24 nt, Human
caccgugcccagcuaauuuuugua

SEQ ID NO: 1045095 - RNA, 23 nt, Human
cacucugucacucaggcuggagu

SEQ ID NO: 1045096 - RNA, 24 nt, Human
cacucugucacucaggcuggagug

SEQ ID NO: 1045097 - RNA, 21 nt, Human
cacugcaaccuccaccuccug

SEQ ID NO: 1045098 - RNA, 23 nt, Human
cacugcaaccuccaccuccuggg

SEQ ID NO: 1045099 - RNA, 26 nt, Human
cacuuuaagaccaaagacuuggccgg

SEQ ID NO: 1045100 - RNA, 21 nt, Human
cagaacagaaacuaaccccac

SEQ ID NO: 1045101 - RNA, 18 nt, Human
cagccugacgaagacggc

SEQ ID NO: 1045102 - RNA, 24 nt, Human
caggguuucaccauguuggccagg

SEQ ID NO: 1045103 - RNA, 19 nt, Human
caggugcccgccaccgugc

SEQ ID NO: 1045104 - RNA, 19 nt, Human
cauacaaucuucaaacauu

SEQ ID NO: 1045105 - RNA, 18 nt, Human
caucgcaagcaaguauuu

SEQ ID NO: 1045106 - RNA, 21 nt, Human
caucucucuucacacaggguc

SEQ ID NO: 1045107 - RNA, 24 nt, Human
caucugacagaacagaaacuaacc

SEQ ID NO: 1045108 - RNA, 23 nt, Human
cauggcucgcugcagccuugacc

SEQ ID NO: 1045109 - RNA, 24 nt, Human
cauguuggccaggcuggucucaaa

SEQ ID NO: 1045110 - RNA, 18 nt, Human
cauugcacuccagccugg

SEQ ID NO: 1045111 - RNA, 19 nt, Human
cauugcacuccagccuggg

SEQ ID NO: 1045112 - RNA, 21 nt, Human
cauugcacuccagccugggca

SEQ ID NO: 1045113 - RNA, 24 nt, Human
cauugcacuccagccugggcaaca

SEQ ID NO: 1045114 - RNA, 25 nt, Human
cauugcacuccagccugggcaacac

SEQ ID NO: 1045115 - RNA, 20 nt, Human
ccaaauuguugggauuacgu

SEQ ID NO: 1045116 - RNA, 24 nt, Human
ccaaauuguugggauuacgugcau

SEQ ID NO: 1045117 - RNA, 22 nt, Human
ccacacagcugugaacucccug

SEQ ID NO: 1045118 - RNA, 21 nt, Human
ccauucaccauaguacucuuc

SEQ ID NO: 1045119 - RNA, 20 nt, Human
ccauugcacuccagccuggg

SEQ ID NO: 1045120 - RNA, 21 nt, Human
ccauugcacuccagccugggc

SEQ ID NO: 1045121 - RNA, 22 nt, Human
ccauugcacuccagccugggca

SEQ ID NO: 1045122 - RNA, 23 nt, Human
ccauugcacuccagccugggcaa

SEQ ID NO: 1045123 - RNA, 24 nt, Human
ccauugcacuccagccugggcaac

SEQ ID NO: 1045124 - RNA, 20 nt, Human
cccaccaccugccucaaaaa

SEQ ID NO: 1045125 - RNA, 21 nt, Human
cccagaauacagacacaucug

SEQ ID NO: 1045126 - RNA, 19 nt, Human
cccaugguuuuuuucacag

SEQ ID NO: 1045127 - RNA, 19 nt, Human
cccuaaacccuggaaggag

SEQ ID NO: 1045128 - RNA, 19 nt, Human
ccucaaaaacuccuggcug

SEQ ID NO: 1045129 - RNA, 22 nt, Human
ccuccaccuccugggcucaagu

SEQ ID NO: 1045130 - RNA, 21 nt, Human
ccucuccucuacuuuuaauuc

SEQ ID NO: 1045131 - RNA, 21 nt, Human
ccucugagaugcugguugugc

SEQ ID NO: 1045132 - RNA, 23 nt, Human
ccugaccucacgugaucugccug

SEQ ID NO: 1045133 - RNA, 24 nt, Human
ccugagcagaggugauccaccuac

SEQ ID NO: 1045134 - RNA, 21 nt, Human
ccuggcuuuugucagcuugug

SEQ ID NO: 1045135 - RNA, 20 nt, Human
ccugggcaacacagcgagac

SEQ ID NO: 1045136 - RNA, 20 nt, Human
ccugggcucaagugauucuc

SEQ ID NO: 1045137 - RNA, 20 nt, Human
ccugggcucaagugauucuc

SEQ ID NO: 1045138 - RNA, 19 nt, Human
cgaaaccccaucucuacua

SEQ ID NO: 1045139 - RNA, 18 nt, Human
cgacucucucugcauccc

SEQ ID NO: 1045140 - RNA, 19 nt, Human
cgacucucucugcaucccu

SEQ ID NO: 1045141 - RNA, 31 nt, Human
cgcaagcaaguauuuuuuuuaaagaaggugg

SEQ ID NO: 1045142 - RNA, 24 nt, Human
cgugaucugccugccucagccucc

SEQ ID NO: 1045143 - RNA, 23 nt, Human
cuaauaaugaugccaaugccuaa

SEQ ID NO: 1045144 - RNA, 24 nt, Human
cucaagacaaaaugacaaaaagcc

SEQ ID NO: 1045145 - RNA, 23 nt, Human
cucaagugauucucgugccucag

SEQ ID NO: 1045146 - RNA, 24 nt, Human
cucacucugucacucaggcuggag

SEQ ID NO: 1045147 - RNA, 24 nt, Human
cucacugcaaccuccaccuccugg

SEQ ID NO: 1045148 - RNA, 27 nt, Human
cucacugcaaccuccaccuccugggcu

SEQ ID NO: 1045149 - RNA, 18 nt, Human
cucaugccuguaauccag

SEQ ID NO: 1045150 - RNA, 26 nt, Human
cuccugaccucacgugaucugccugc

SEQ ID NO: 1045151 - RNA, 20 nt, Human
cuccugggcucaagugauuc

SEQ ID NO: 1045152 - RNA, 21 nt, Human
cuccugggcucaagugauucu

SEQ ID NO: 1045153 - RNA, 20 nt, Human
cugaaaaaaacauuccuuuu

SEQ ID NO: 1045154 - RNA, 23 nt, Human
cugcaaccuccaccuccugggcu

SEQ ID NO: 1045155 - RNA, 24 nt, Human
cugcaaccuccaccuccugggcuc

SEQ ID NO: 1045156 - RNA, 19 nt, Human
cugccucagccucccaaau

SEQ ID NO: 1045157 - RNA, 21 nt, Human
cuggaaggagggagaaacaag

SEQ ID NO: 1045158 - RNA, 22 nt, Human
cuucagaaagcccuacccuuaa

SEQ ID NO: 1045159 - RNA, 21 nt, Human
cuuguccucugagaugcuggu

SEQ ID NO: 1045160 - RNA, 26 nt, Human
gaccucacgugaucugccugccucag

SEQ ID NO: 1045161 - RNA, 19 nt, Human
gagacccaaaugaccaacc

SEQ ID NO: 1045162 - RNA, 23 nt, Human
gagguggguggaucauuugaggu

SEQ ID NO: 1045163 - RNA, 19 nt, Human
gaucauggcucgcugcagc

SEQ ID NO: 1045164 - RNA, 24 nt, Human
gaucauuugaggucaggaguuuga

SEQ ID NO: 1045165 - RNA, 18 nt, Human
gauuacgugcaugagcca

SEQ ID NO: 1045166 - RNA, 21 nt, Human
gauucuaaauuacacgaucca

SEQ ID NO: 1045167 - RNA, 24 nt, Human
gcagaggcuaguacacaaauacca

SEQ ID NO: 1045168 - RNA, 22 nt, Human
gccauugcacuccagccugggc

SEQ ID NO: 1045169 - RNA, 24 nt, Human
gccauugcacuccagccugggcaa

SEQ ID NO: 1045170 - RNA, 22 nt, Human
gcccagcuaauuuuuguauuuu

SEQ ID NO: 1045171 - RNA, 19 nt, Human
gcccagggcuugcaguggc

SEQ ID NO: 1045172 - RNA, 21 nt, Human
gccuguaauccaggcacucgg

SEQ ID NO: 1045173 - RNA, 20 nt, Human
gcucgcugcagccuugaccu

SEQ ID NO: 1045174 - RNA, 20 nt, Human
gcuggaaccacaggcaucca

SEQ ID NO: 1045175 - RNA, 25 nt, Human
ggaaaaguuccucuuaaauuuuuaa

SEQ ID NO: 1045176 - RNA, 23 nt, Human
ggacaggccacaaacaaaguguc

SEQ ID NO: 1045177 - RNA, 23 nt, Human
ggaguuucgcucuugucacccag

SEQ ID NO: 1045178 - RNA, 22 nt, Human
ggaucauuugaggucaggaguu

SEQ ID NO: 1045179 - RNA, 18 nt, Human
ggcaacacagcgagacuu

SEQ ID NO: 1045180 - RNA, 24 nt, Human
ggcuggucucaaacuccugaccuc

SEQ ID NO: 1045181 - RNA, 23 nt, Human
gggcaguuuugagacccaaauga

SEQ ID NO: 1045182 - RNA, 22 nt, Human
gggcucaagugauucucgugcc

SEQ ID NO: 1045183 - RNA, 24 nt, Human
gggugcaguggcucaugccuguaa

SEQ ID NO: 1045184 - RNA, 22 nt, Human
ggguuucaccauguuggccagg

SEQ ID NO: 1045185 - RNA, 19 nt, Human
ggucaggaguuugagacca

SEQ ID NO: 1045186 - RNA, 21 nt, Human
gguggaucauuugaggucagg

SEQ ID NO: 1045187 - RNA, 23 nt, Human
gucagcuugugucacaaccucaa

SEQ ID NO: 1045188 - RNA, 24 nt, Human
gugauccaccuaccucagccuccc

SEQ ID NO: 1045189 - RNA, 24 nt, Human
gugaucugccugccucagccuccc

SEQ ID NO: 1045190 - RNA, 24 nt, Human
gugauucucgugccucagccuccc

SEQ ID NO: 1045191 - RNA, 19 nt, Human
guggggcacaaaaauugga

SEQ ID NO: 1045192 - RNA, 24 nt, Human
uaaaaaaugagaaaauccacagag

SEQ ID NO: 1045193 - RNA, 21 nt, Human
uaacaacagccaauaacagac

SEQ ID NO: 1045194 - RNA, 19 nt, Human
uaacaaguaggcacauuuc

SEQ ID NO: 1045195 - RNA, 21 nt, Human
uaaccaggucauaaggccaaa

SEQ ID NO: 1045196 - RNA, 19 nt, Human
uaacugcuguauucccuuu

SEQ ID NO: 1045197 - RNA, 21 nt, Human
uaaguaaugguauuuaagaga

SEQ ID NO: 1045198 - RNA, 24 nt, Human
uaauuuuuguauuuuuacuacaga

SEQ ID NO: 1045199 - RNA, 22 nt, Human
uacagacaggguuucaccaugu

SEQ ID NO: 1045200 - RNA, 18 nt, Human
uaccccagagcuggaggc

SEQ ID NO: 1045201 - RNA, 23 nt, Human
uaccccagagcuggaggcaacag

SEQ ID NO: 1045202 - RNA, 24 nt, Human
uaccccagagcuggaggcaacagc

SEQ ID NO: 1045203 - RNA, 27 nt, Human
uaccucagccucccgaauagcuggaac

SEQ ID NO: 1045204 - RNA, 24 nt, Human
uacgugcaugagccaccgcaccca

SEQ ID NO: 1045205 - RNA, 27 nt, Human
uacuugggaggcugauggggaagaaaa

SEQ ID NO: 1045206 - RNA, 22 nt, Human
uagaagaagcauaauacugggc

SEQ ID NO: 1045207 - RNA, 22 nt, Human
uagagaacucugaugcuccuga

SEQ ID NO: 1045208 - RNA, 22 nt, Human
uaggucuuuucaaacacuucug

SEQ ID NO: 1045209 - RNA, 23 nt, Human
uauggaaaaauaggagacaacua

SEQ ID NO: 1045210 - RNA, 22 nt, Human
uauuaacacuucuccauuauuu

SEQ ID NO: 1045211 - RNA, 22 nt, Human
ucaaacaaaacaaaacaaauca

SEQ ID NO: 1045212 - RNA, 25 nt, Human
ucacacaaccuuuuggccgguccuc

SEQ ID NO: 1045213 - RNA, 19 nt, Human
ucacaccauaaaaagaaca

SEQ ID NO: 1045214 - RNA, 18 nt, Human
ucacucaggcuggagugc

SEQ ID NO: 1045215 - RNA, 24 nt, Human
ucacucugucacucaggcuggagu

SEQ ID NO: 1045216 - RNA, 23 nt, Human
ucacugcaaccuccaccuccugg

SEQ ID NO: 1045217 - RNA, 24 nt, Human
ucacugcaaccuccaccuccuggg

SEQ ID NO: 1045218 - RNA, 25 nt, Human
ucacugcaaccuccaccuccugggc

SEQ ID NO: 1045219 - RNA, 27 nt, Human
ucacugcaaccuccaccuccugggcuc

SEQ ID NO: 1045220 - RNA, 18 nt, Human
ucacugcacucccuaaac

SEQ ID NO: 1045221 - RNA, 20 nt, Human
ucagaauucuaauaaugaug

SEQ ID NO: 1045222 - RNA, 18 nt, Human
ucagccucccaagcagcu

SEQ ID NO: 1045223 - RNA, 20 nt, Human
ucagccucccaagcagcugg

SEQ ID NO: 1045224 - RNA, 20 nt, Human
ucagccucccgaauagcugg

SEQ ID NO: 1045225 - RNA, 24 nt, Human
uccagccugggcaacacagcgaga

SEQ ID NO: 1045226 - RNA, 20 nt, Human
ucccaaauuguugggauuac

SEQ ID NO: 1045227 - RNA, 20 nt, Human
ucccgaauagcuggaaccac

SEQ ID NO: 1045228 - RNA, 21 nt, Human
uccugggcucaagugauucuc

SEQ ID NO: 1045229 - RNA, 24 nt, Human
uccugggcucaagugauucucgug

SEQ ID NO: 1045230 - RNA, 19 nt, Human
ucgcugcagccuugaccug

SEQ ID NO: 1045231 - RNA, 23 nt, Human
ucucacucugucacucaggcugg

SEQ ID NO: 1045232 - RNA, 24 nt, Human
ucucacucugucacucaggcugga

SEQ ID NO: 1045233 - RNA, 27 nt, Human
ucucuacuaaaaauacaaaaaaaaaaa

SEQ ID NO: 1045234 - RNA, 24 nt, Human
ucugcccccaacagagaguagaua

SEQ ID NO: 1045235 - RNA, 20 nt, Human
ucugccucuccucuacuuuu

SEQ ID NO: 1045236 - RNA, 21 nt, Human
ugaaacuaaccaacugaacuu

SEQ ID NO: 1045237 - RNA, 24 nt, Human
ugaaagacauucuucucaccagag

SEQ ID NO: 1045238 - RNA, 19 nt, Human
ugaacagaaggcccacugc

SEQ ID NO: 1045239 - RNA, 20 nt, Human
ugaacuccagagcugaauua

SEQ ID NO: 1045240 - RNA, 21 nt, Human
ugaauggaugcugaaaaaacc

SEQ ID NO: 1045241 - RNA, 24 nt, Human
ugaccaaccccagaauacagacac

SEQ ID NO: 1045242 - RNA, 18 nt, Human
ugaccucacgugaucugc

SEQ ID NO: 1045243 - RNA, 24 nt, Human
ugaccucacgugaucugccugccu

SEQ ID NO: 1045244 - RNA, 20 nt, Human
ugagacagggucucacucug

SEQ ID NO: 1045245 - RNA, 22 nt, Human
ugagacccaaaugaccaacccc

SEQ ID NO: 1045246 - RNA, 22 nt, Human
ugagccaagauugcgccauugc

SEQ ID NO: 1045247 - RNA, 18 nt, Human
ugaggucaggaguuugag

SEQ ID NO: 1045248 - RNA, 23 nt, Human
ugagguggguggaucauuugagg

SEQ ID NO: 1045249 - RNA, 24 nt, Human
ugagguggguggaucauuugaggu

SEQ ID NO: 1045250 - RNA, 18 nt, Human
ugaugaugaaacaaaaga

SEQ ID NO: 1045251 - RNA, 22 nt, Human
ugcagugacauaaucuuggcuc

SEQ ID NO: 1045252 - RNA, 23 nt, Human
ugcagugacauaaucuuggcuca

SEQ ID NO: 1045253 - RNA, 23 nt, Human
ugccagaggcccagggcuugcag

SEQ ID NO: 1045254 - RNA, 24 nt, Human
ugccucagccucccaaauuguugg

SEQ ID NO: 1045255 - RNA, 22 nt, Human
ugccucagccucccaagcagcu

SEQ ID NO: 1045256 - RNA, 24 nt, Human
ugccucagccucccaagcagcugg

SEQ ID NO: 1045257 - RNA, 22 nt, Human
ugccuguaauccaggcacucgg

SEQ ID NO: 1045258 - RNA, 23 nt, Human
ugccuguaauccaggcacucggg

SEQ ID NO: 1045259 - RNA, 24 nt, Human
uggaaaaauaggagacaacuagug

SEQ ID NO: 1045260 - RNA, 24 nt, Human
uggaaccacaggcauccaccacca

SEQ ID NO: 1045261 - RNA, 24 nt, Human
uggaacuacaggugcccgccaccg

SEQ ID NO: 1045262 - RNA, 21 nt, Human
uggagugcaauggugcgauca

SEQ ID NO: 1045263 - RNA, 24 nt, Human
uggagugcaauggugcgaucaugg

SEQ ID NO: 1045264 - RNA, 23 nt, Human
uggagugcagugacauaaucuug

SEQ ID NO: 1045265 - RNA, 24 nt, Human
uggagugcagugacauaaucuugg

SEQ ID NO: 1045266 - RNA, 23 nt, Human
uggaucauuugaggucaggaguu

SEQ ID NO: 1045267 - RNA, 24 nt, Human
uggaucauuugaggucaggaguuu

SEQ ID NO: 1045268 - RNA, 24 nt, Human
uggccaggcuggucucaaacuccu

SEQ ID NO: 1045269 - RNA, 24 nt, Human
uggccgggugcaguggcucaugcc

SEQ ID NO: 1045270 - RNA, 24 nt, Human
uggcucaugccuguaauccaggca

SEQ ID NO: 1045271 - RNA, 20 nt, Human
uggcugagaucuuaucugaa

SEQ ID NO: 1045272 - RNA, 22 nt, Human
ugggauuacgugcaugagccac

SEQ ID NO: 1045273 - RNA, 23 nt, Human
ugggauuacgugcaugagccacc

SEQ ID NO: 1045274 - RNA, 24 nt, Human
ugggauuacgugcaugagccaccg

SEQ ID NO: 1045275 - RNA, 18 nt, Human
ugggcucaagugauucuc

SEQ ID NO: 1045276 - RNA, 22 nt, Human
uggggaagaacugcuugaaccc

SEQ ID NO: 1045277 - RNA, 24 nt, Human
uggugcgaucauggcucgcugcag

SEQ ID NO: 1045278 - RNA, 24 nt, Human
uguaauccaggcacucggggagac

SEQ ID NO: 1045279 - RNA, 21 nt, Human
uguauacauauuaacacuucu

SEQ ID NO: 1045280 - RNA, 20 nt, Human
ugucacagagcuucagauca

SEQ ID NO: 1045281 - RNA, 20 nt, Human
ugucacagagcuucagaucc

SEQ ID NO: 1045282 - RNA, 22 nt, Human
ugucacucaggcuggagugcaa

SEQ ID NO: 1045283 - RNA, 21 nt, Human
ugucucaagacaaaaugacaa

SEQ ID NO: 1045284 - RNA, 20 nt, Human
uuagcugggagugguggugc

SEQ ID NO: 1045285 - RNA, 20 nt, Human
uuagcugggagugguggugc

SEQ ID NO: 1045286 - RNA, 24 nt, Human
uucgcucuugucacccaggaugga

SEQ ID NO: 1045287 - RNA, 21 nt, Human
uucgucucaaacaaaacaaaa

SEQ ID NO: 1045288 - RNA, 19 nt, Human
uucuuaaaccugggguauc

SEQ ID NO: 1045289 - RNA, 18 nt, Human
uugaacccaggagucaga

SEQ ID NO: 1045290 - RNA, 22 nt, Human
uugacccuuuguccguuuggca

SEQ ID NO: 1045291 - RNA, 22 nt, Human
uugagacagggucucacucugu

SEQ ID NO: 1045292 - RNA, 22 nt, Human
uugcagugagccaagauugcgc

SEQ ID NO: 1045293 - RNA, 23 nt, Human
uugcgccauugcacuccagccug

SEQ ID NO: 1045294 - RNA, 23 nt, Human
uugucacccaggauggagugcag

SEQ ID NO: 1045295 - RNA, 24 nt, Human
uuguccagucaucgcaagcaagua

SEQ ID NO: 1045296 - RNA, 18 nt, Human
uuguccguuuggcaucau

SEQ ID NO: 1045297 - RNA, 19 nt, Human
uuguugguuuguuuagaga

SEQ ID NO: 1045298 - RNA, 23 nt, Human
uuuauaagcuacaaagguuaacu

SEQ ID NO: 1045299 - RNA, 24 nt, Human
uuucaccauguuggccaggcuggu

SEQ ID NO: 1045300 - RNA, 23 nt, Human
uuugaggucaggaguuugagacc

SEQ ID NO: 1045301 - RNA, 20 nt, Human
uuuuuguauuuuuacuacag

SEQ ID NO: 1045302 - RNA, 23 nt, Human
uuuuuguauuuuuacuacagaca

SEQ ID NO: 1045303 - RNA, 22 nt, Human
agcaggaaggaaggggcccugg

SEQ ID NO: 1045304 - RNA, 25 nt, Human
aggguucacucccagaagguaaugc

SEQ ID NO: 1045305 - RNA, 21 nt, Human
auagagugggcccugcccacc

SEQ ID NO: 1045306 - RNA, 22 nt, Human
aucagccaagaaccagaaccaa

SEQ ID NO: 1045307 - RNA, 22 nt, Human
cagagugggcacugcuucaggu

SEQ ID NO: 1045308 - RNA, 20 nt, Human
caggaggagccagagugggc

SEQ ID NO: 1045309 - RNA, 22 nt, Human
caggccaccugaagaccaugag

SEQ ID NO: 1045310 - RNA, 22 nt, Human
caggucuaagccucucccacag

SEQ ID NO: 1045311 - RNA, 23 nt, Human
caugaucaggccaccugaagacc

SEQ ID NO: 1045312 - RNA, 20 nt, Human
ccaugagcaggaaggaaggg

SEQ ID NO: 1045313 - RNA, 22 nt, Human
cccagaagguaaugccuaacuc

SEQ ID NO: 1045314 - RNA, 22 nt, Human
cccagugaaaugcacauggucc

SEQ ID NO: 1045315 - RNA, 22 nt, Human
cccugcccaccccccaauacaa

SEQ ID NO: 1045316 - RNA, 18 nt, Human
cugcccaccccccaauac

SEQ ID NO: 1045317 - RNA, 18 nt, Human
gaaggaaggggcccuggc

SEQ ID NO: 1045318 - RNA, 24 nt, Human
gaccagcuggggaugcaaggagau

SEQ ID NO: 1045319 - RNA, 22 nt, Human
gagcaggaaggaaggggcccug

SEQ ID NO: 1045320 - RNA, 25 nt, Human
gaucagaccagcuggggaugcaagg

SEQ ID NO: 1045321 - RNA, 19 nt, Human
gccaugcuucucccagaaa

SEQ ID NO: 1045322 - RNA, 23 nt, Human
gcccugcccaccccccaauacaa

SEQ ID NO: 1045323 - RNA, 22 nt, Human
ggaaggaaggggcccuggcagg

SEQ ID NO: 1045324 - RNA, 22 nt, Human
ggagauguagaucccauggccc

SEQ ID NO: 1045325 - RNA, 19 nt, Human
ggguucacucccagaaggu

SEQ ID NO: 1045326 - RNA, 18 nt, Human
uaacauaacauagagugg

SEQ ID NO: 1045327 - RNA, 23 nt, Human
uaagccucucccacagggguucc

SEQ ID NO: 1045328 - RNA, 24 nt, Human
uagagugggcccugcccacccccc

SEQ ID NO: 1045329 - RNA, 22 nt, Human
uccaugaucaggccaccugaag

SEQ ID NO: 1045330 - RNA, 22 nt, Human
ucccagaaaggguguggcagcu

SEQ ID NO: 1045331 - RNA, 19 nt, Human
uggcagcugggccuggcag

SEQ ID NO: 1045332 - RNA, 22 nt, Human
uggcagggaucagaccagcugg

SEQ ID NO: 1045333 - RNA, 21 nt, Human
ugguuaggguggcaauagggg

SEQ ID NO: 1045334 - RNA, 19 nt, Human
uguggcagcugggccuggc

SEQ ID NO: 1045335 - RNA, 19 nt, Human
uguggcagcugggccuggc

SEQ ID NO: 1045336 - RNA, 18 nt, Human
uguggucauguuaagaua

SEQ ID NO: 1045337 - RNA, 23 nt, Human
uucaggucuaagccucucccaca

SEQ ID NO: 1045338 - RNA, 22 nt, Human
aaaagaauacugaacuguaagc

SEQ ID NO: 1045339 - RNA, 23 nt, Human
aaaauaaaacaaucuuuuacaaa

SEQ ID NO: 1045340 - RNA, 21 nt, Human
aaccuugcauaaucaguuggu

SEQ ID NO: 1045341 - RNA, 19 nt, Human
aacugucugcccuacugcc

SEQ ID NO: 1045342 - RNA, 24 nt, Human
aacugucugcccuacugccgaggu

SEQ ID NO: 1045343 - RNA, 19 nt, Human
aagagacccucgcccagcc

SEQ ID NO: 1045344 - RNA, 21 nt, Human
aagagacccucgcccagccca

SEQ ID NO: 1045345 - RNA, 25 nt, Human
accuuauaagaauaucaaagauuua

SEQ ID NO: 1045346 - RNA, 22 nt, Human
auggaaucaguaguagugcuga

SEQ ID NO: 1045347 - RNA, 19 nt, Human
caaaacggcauauaaggaa

SEQ ID NO: 1045348 - RNA, 19 nt, Human
cccuaaaaaaaaccuugca

SEQ ID NO: 1045349 - RNA, 26 nt, Human
ccgccgccucgagcgccagccgcucc

SEQ ID NO: 1045350 - RNA, 18 nt, Human
cuaaaaaaaaccuugcau

SEQ ID NO: 1045351 - RNA, 21 nt, Human
cucgagcgccagccgcuccuc

SEQ ID NO: 1045352 - RNA, 19 nt, Human
cuuuugaugguuuuuguuu

SEQ ID NO: 1045353 - RNA, 21 nt, Human
gagguaggugaccaauauuca

SEQ ID NO: 1045354 - RNA, 25 nt, Human
gguuuuuguuuuguuuuuccuuuca

SEQ ID NO: 1045355 - RNA, 21 nt, Human
uaauaggcucuaccuaagcuu

SEQ ID NO: 1045356 - RNA, 22 nt, Human
uauucaucaaaauaaaacaauc

SEQ ID NO: 1045357 - RNA, 23 nt, Human
ucaggaacuagcaaaguucuacu

SEQ ID NO: 1045358 - RNA, 23 nt, Human
ugaacuguaagcaucuguugcca

SEQ ID NO: 1045359 - RNA, 19 nt, Human
ugcacuucgucuauuggaa

SEQ ID NO: 1045360 - RNA, 23 nt, Human
ugguuucuuaaaccuguguccgu

SEQ ID NO: 1045361 - RNA, 24 nt, Human
uguacacacauauuguguugugug

SEQ ID NO: 1045362 - RNA, 26 nt, Human
uguacacacauauuguguugugugca

SEQ ID NO: 1045363 - RNA, 22 nt, Human
uguuuuuccuuucagucauuua

SEQ ID NO: 1045364 - RNA, 23 nt, Human
uuaaauaucacaaucuacauaaa

SEQ ID NO: 1045365 - RNA, 18 nt, Human
uuuuuuuuuuuuuuuuug

SEQ ID NO: 1045366 - RNA, 22 nt, Human
aacaaaguccuccacacucugg

SEQ ID NO: 1045367 - RNA, 25 nt, Human
cagugaugggccccucggggucacu

SEQ ID NO: 1045368 - RNA, 23 nt, Human
cgggaacaaaguccuccacacuc

SEQ ID NO: 1045369 - RNA, 19 nt, Human
cuggcucaaucucagcagg

SEQ ID NO: 1045370 - RNA, 20 nt, Human
cuggcucaaucucagcaggg

SEQ ID NO: 1045371 - RNA, 23 nt, Human
cuggggccucugcggcugggacu

SEQ ID NO: 1045372 - RNA, 22 nt, Human
cuguugcuggggccucugcggc

SEQ ID NO: 1045373 - RNA, 22 nt, Human
gaggaggccugcucacccuucc

SEQ ID NO: 1045374 - RNA, 18 nt, Human
gccucugcggcugggacu

SEQ ID NO: 1045375 - RNA, 21 nt, Human
gucggggucauccaugacgaa

SEQ ID NO: 1045376 - RNA, 18 nt, Human
ugcuggggccucugcggc

SEQ ID NO: 1045377 - RNA, 21 nt, Human
uggacuguugcuggggccucu

SEQ ID NO: 1045378 - RNA, 30 nt, Human
aaacaacagacauuuauuuauuucucccaa

SEQ ID NO: 1045379 - RNA, 21 nt, Human
aaagccccaccuccaaauacc

SEQ ID NO: 1045380 - RNA, 19 nt, Human
aagcauugaaggggugaag

SEQ ID NO: 1045381 - RNA, 18 nt, Human
agcauugaaggggugaag

SEQ ID NO: 1045382 - RNA, 21 nt, Human
agccccaccuccaaauaccau

SEQ ID NO: 1045383 - RNA, 19 nt, Human
aggcaggagggaggaggug

SEQ ID NO: 1045384 - RNA, 23 nt, Human
aggucagaaaaagaauggcguaa

SEQ ID NO: 1045385 - RNA, 19 nt, Human
aucugggugccagcauggc

SEQ ID NO: 1045386 - RNA, 18 nt, Human
auuuucagcauuucccuc

SEQ ID NO: 1045387 - RNA, 31 nt, Human
caaacaacagacauuuauuuauuucucccaa

SEQ ID NO: 1045388 - RNA, 20 nt, Human
caugggcagcugauuucuug

SEQ ID NO: 1045389 - RNA, 20 nt, Human
cauuugggccccauccucau

SEQ ID NO: 1045390 - RNA, 23 nt, Human
ccagcagguguacccaggggcca

SEQ ID NO: 1045391 - RNA, 20 nt, Human
cccaaaagccccaccuccaa

SEQ ID NO: 1045392 - RNA, 25 nt, Human
cccaaaagccccaccuccaaauacc

SEQ ID NO: 1045393 - RNA, 22 nt, Human
cccaggggccaagacacggaac

SEQ ID NO: 1045394 - RNA, 18 nt, Human
cccuccauccuuccuggg

SEQ ID NO: 1045395 - RNA, 19 nt, Human
ccggccgcggcgagaagga

SEQ ID NO: 1045396 - RNA, 24 nt, Human
ccucccaaaagccccaccuccaaa

SEQ ID NO: 1045397 - RNA, 19 nt, Human
ccucgaucugagaggcagg

SEQ ID NO: 1045398 - RNA, 21 nt, Human
ccuuccugggcuucugugcuc

SEQ ID NO: 1045399 - RNA, 20 nt, Human
cggcgagaaggaagcggcuc

SEQ ID NO: 1045400 - RNA, 19 nt, Human
cuaaacucugagaucagug

SEQ ID NO: 1045401 - RNA, 21 nt, Human
cuaaucaccucccaaaagccc

SEQ ID NO: 1045402 - RNA, 18 nt, Human
cucccaaaagccccaccu

SEQ ID NO: 1045403 - RNA, 24 nt, Human
cucccccaacacacaccucgaucu

SEQ ID NO: 1045404 - RNA, 19 nt, Human
cugguucggugcuggagag

SEQ ID NO: 1045405 - RNA, 18 nt, Human
cuguucaguucacagaug

SEQ ID NO: 1045406 - RNA, 23 nt, Human
gagaguaagaggcaggagggagg

SEQ ID NO: 1045407 - RNA, 24 nt, Human
gccccaccuccaaauaccaucaca

SEQ ID NO: 1045408 - RNA, 18 nt, Human
ggcuggguucuggugagg

SEQ ID NO: 1045409 - RNA, 24 nt, Human
gguucggugcuggagaguaagagg

SEQ ID NO: 1045410 - RNA, 20 nt, Human
gguucuggugagggccugcu

SEQ ID NO: 1045411 - RNA, 19 nt, Human
gugcuuuuccauuuucagc

SEQ ID NO: 1045412 - RNA, 21 nt, Human
guguacccaggggccaagaca

SEQ ID NO: 1045413 - RNA, 20 nt, Human
guucaguucacagauggugg

SEQ ID NO: 1045414 - RNA, 20 nt, Human
uaaaccuaaucaccucccaa

SEQ ID NO: 1045415 - RNA, 25 nt, Human
uaagaggcaggagggaggagguggc

SEQ ID NO: 1045416 - RNA, 21 nt, Human
ucccaaaagccccaccuccaa

SEQ ID NO: 1045417 - RNA, 22 nt, Human
ucccagcagguguacccagggg

SEQ ID NO: 1045418 - RNA, 20 nt, Human
ucccccaacacacaccucga

SEQ ID NO: 1045419 - RNA, 23 nt, Human
ucccccaacacacaccucgaucu

SEQ ID NO: 1045420 - RNA, 18 nt, Human
ucccuccauccuuccugg

SEQ ID NO: 1045421 - RNA, 21 nt, Human
ucccucucgucuuggagagag

SEQ ID NO: 1045422 - RNA, 18 nt, Human
uccugggcuucugugcuc

SEQ ID NO: 1045423 - RNA, 26 nt, Human
ucuaaaccuaaucaccucccaaaagc

SEQ ID NO: 1045424 - RNA, 21 nt, Human
ucucccaguucuggaggcugg

SEQ ID NO: 1045425 - RNA, 22 nt, Human
ucucccaguucuggaggcugga

SEQ ID NO: 1045426 - RNA, 24 nt, Human
ugagaucaguggucccagcaggug

SEQ ID NO: 1045427 - RNA, 22 nt, Human
ugagggccugcuucucgguuca

SEQ ID NO: 1045428 - RNA, 21 nt, Human
uggagagagcuucugguucgg

SEQ ID NO: 1045429 - RNA, 18 nt, Human
ugggggaacauaaacauu

SEQ ID NO: 1045430 - RNA, 24 nt, Human
uucagcauuucccucucgucuugg

SEQ ID NO: 1045431 - RNA, 19 nt, Human
uuccugggcuucugugcuc

SEQ ID NO: 1045432 - RNA, 24 nt, Human
aaccucuaccuccucccuagcccc

SEQ ID NO: 1045433 - RNA, 18 nt, Human
acaucaggagcaugcauu

SEQ ID NO: 1045434 - RNA, 20 nt, Human
accaccaccaccucacagca

SEQ ID NO: 1045435 - RNA, 23 nt, Human
accaccaccaccucacagcagcc

SEQ ID NO: 1045436 - RNA, 21 nt, Human
accacguccucuggacaucag

SEQ ID NO: 1045437 - RNA, 19 nt, Human
accuccucccuagccccac

SEQ ID NO: 1045438 - RNA, 23 nt, Human
accucuaccuccucccuagcccc

SEQ ID NO: 1045439 - RNA, 20 nt, Human
accucuaccuccucccuagg

SEQ ID NO: 1045440 - RNA, 20 nt, Human
acucccacaaauggccacug

SEQ ID NO: 1045441 - RNA, 20 nt, Human
acucccaccuccaaaccugu

SEQ ID NO: 1045442 - RNA, 21 nt, Human
agaaacagcgggaaaagucac

SEQ ID NO: 1045443 - RNA, 22 nt, Human
agaacacucaggcugcugcgag

SEQ ID NO: 1045444 - RNA, 24 nt, Human
agcccagguuuucccaacagagaa

SEQ ID NO: 1045445 - RNA, 21 nt, Human
aggcugagaaacagcgggaaa

SEQ ID NO: 1045446 - RNA, 21 nt, Human
caaaugacccacagagugacc

SEQ ID NO: 1045447 - RNA, 18 nt, Human
caaccgcugcagggaugu

SEQ ID NO: 1045448 - RNA, 22 nt, Human
caagucaaauggacgaaaguca

SEQ ID NO: 1045449 - RNA, 24 nt, Human
cacaugcugcuuccagcucagagc

SEQ ID NO: 1045450 - RNA, 28 nt, Human
caccaccaccaccaccucacagcagccu

SEQ ID NO: 1045451 - RNA, 25 nt, Human
caccaccaccaccucacagcagccu

SEQ ID NO: 1045452 - RNA, 25 nt, Human
caccaccaccucacagcagccuaga

SEQ ID NO: 1045453 - RNA, 19 nt, Human
caccaccucacagcagccu

SEQ ID NO: 1045454 - RNA, 21 nt, Human
cagagaauagagacagccaca

SEQ ID NO: 1045455 - RNA, 20 nt, Human
cagcaacagagagcccugug

SEQ ID NO: 1045456 - RNA, 22 nt, Human
cagcagcuggaagaugcaaugg

SEQ ID NO: 1045457 - RNA, 23 nt, Human
cagccacacucccaccuccaaac

SEQ ID NO: 1045458 - RNA, 24 nt, Human
cagccacacucccaccuccaaacc

SEQ ID NO: 1045459 - RNA, 22 nt, Human
cagcucagagcgggcugagagg

SEQ ID NO: 1045460 - RNA, 28 nt, Human
ccacaaauggccacugaauauugucagc

SEQ ID NO: 1045461 - RNA, 23 nt, Human
ccaccaccaccaccaccucacag

SEQ ID NO: 1045462 - RNA, 21 nt, Human
ccagaggcugagaaacagcgg

SEQ ID NO: 1045463 - RNA, 27 nt, Human
ccagcccagacagugaagacucugauc

SEQ ID NO: 1045464 - RNA, 23 nt, Human
ccuaaaucagcaacagagagccc

SEQ ID NO: 1045465 - RNA, 18 nt, Human
ccuccucccuagccccac

SEQ ID NO: 1045466 - RNA, 21 nt, Human
ccucuaccuccucccuagccc

SEQ ID NO: 1045467 - RNA, 21 nt, Human
ccugaacugccccuuagagag

SEQ ID NO: 1045468 - RNA, 22 nt, Human
ccuggaccagaaaggugacagc

SEQ ID NO: 1045469 - RNA, 23 nt, Human
ccugucuuuucuaccacguccuc

SEQ ID NO: 1045470 - RNA, 21 nt, Human
cucacagcagccuagagcauc

SEQ ID NO: 1045471 - RNA, 23 nt, Human
cuccaaaccugucuuuucuacca

SEQ ID NO: 1045472 - RNA, 18 nt, Human
cuggaccagaaaggugac

SEQ ID NO: 1045473 - RNA, 25 nt, Human
gaauccacaccgcaguaccagcaga

SEQ ID NO: 1045474 - RNA, 19 nt, Human
gagaauagagacagccaca

SEQ ID NO: 1045475 - RNA, 23 nt, Human
gaggacucucaguuucacagggu

SEQ ID NO: 1045476 - RNA, 22 nt, Human
gagugaccccuagugagaacac

SEQ ID NO: 1045477 - RNA, 18 nt, Human
gaucccagaggcugagaa

SEQ ID NO: 1045478 - RNA, 19 nt, Human
gcccagacagugaagacuc

SEQ ID NO: 1045479 - RNA, 22 nt, Human
gggugaagccaguuucuccacc

SEQ ID NO: 1045480 - RNA, 23 nt, Human
gugacagcaaccucuaccuccuc

SEQ ID NO: 1045481 - RNA, 19 nt, Human
ucacagcagccuagagcau

SEQ ID NO: 1045482 - RNA, 19 nt, Human
uccacaccgcaguaccagc

SEQ ID NO: 1045483 - RNA, 21 nt, Human
uccacaccgcaguaccagcag

SEQ ID NO: 1045484 - RNA, 19 nt, Human
uccaccaccaccaccaccu

SEQ ID NO: 1045485 - RNA, 20 nt, Human
uccaccaccaccaccaccuc

SEQ ID NO: 1045486 - RNA, 22 nt, Human
uccaccaccaccaccaccucac

SEQ ID NO: 1045487 - RNA, 18 nt, Human
ucccaacagagaauagag

SEQ ID NO: 1045488 - RNA, 19 nt, Human
ucccacaugcugcuuccag

SEQ ID NO: 1045489 - RNA, 24 nt, Human
ucccuagccccacuaugcaccacc

SEQ ID NO: 1045490 - RNA, 24 nt, Human
ugaacugccccuuagagaggcuga

SEQ ID NO: 1045491 - RNA, 19 nt, Human
ugacccacagagugacccc

SEQ ID NO: 1045492 - RNA, 20 nt, Human
ugacccacagagugaccccu

SEQ ID NO: 1045493 - RNA, 19 nt, Human
ugaccccuagugagaacac

SEQ ID NO: 1045494 - RNA, 19 nt, Human
ugagaacacucaggcugcu

SEQ ID NO: 1045495 - RNA, 21 nt, Human
ugagaacacucaggcugcugc

SEQ ID NO: 1045496 - RNA, 18 nt, Human
ugggaaagccucgugaag

SEQ ID NO: 1045497 - RNA, 19 nt, Human
ugggagccugaacugcccc

SEQ ID NO: 1045498 - RNA, 24 nt, Human
ugucuuuucuaccacguccucugg

SEQ ID NO: 1045499 - RNA, 20 nt, Human
uucacaggguggccaaccgc

SEQ ID NO: 1045500 - RNA, 19 nt, Human
uuucuccaccaccaccacc

SEQ ID NO: 1045501 - RNA, 19 nt, Human
aaaaucccuucugcaggcu

SEQ ID NO: 1045502 - RNA, 20 nt, Human
cagggggugggagaacacag

SEQ ID NO: 1045503 - RNA, 21 nt, Human
ccaccucggcccacugcgucc

SEQ ID NO: 1045504 - RNA, 19 nt, Human
cccugggccaggcugaggc

SEQ ID NO: 1045505 - RNA, 20 nt, Human
ccgaggcucagccuggugac

SEQ ID NO: 1045506 - RNA, 22 nt, Human
ccuggggcaggucccccucagg

SEQ ID NO: 1045507 - RNA, 21 nt, Human
cucagccuggugacccucuuc

SEQ ID NO: 1045508 - RNA, 19 nt, Human
cuuucugcucuggcugagg

SEQ ID NO: 1045509 - RNA, 19 nt, Human
gcagaguggggcuggcccc

SEQ ID NO: 1045510 - RNA, 21 nt, Human
gcagcuucagccuugcagggg

SEQ ID NO: 1045511 - RNA, 18 nt, Human
gcaggucccccucaggca

SEQ ID NO: 1045512 - RNA, 21 nt, Human
gcccugccuucgggcacagcc

SEQ ID NO: 1045513 - RNA, 22 nt, Human
gcucuggcugaggguccucugu

SEQ ID NO: 1045514 - RNA, 27 nt, Human
ggaaggcccugccuucgggcacagccc

SEQ ID NO: 1045515 - RNA, 22 nt, Human
ggcagcuucagccuugcagggg

SEQ ID NO: 1045516 - RNA, 18 nt, Human
gggggugggagaacacag

SEQ ID NO: 1045517 - RNA, 19 nt, Human
ggggugggagaacacagcu

SEQ ID NO: 1045518 - RNA, 24 nt, Human
ggguucuggccgaggcucagccug

SEQ ID NO: 1045519 - RNA, 23 nt, Human
uagacggguucuggccgaggcuc

SEQ ID NO: 1045520 - RNA, 19 nt, Human
ucccccucaggcaucuggg

SEQ ID NO: 1045521 - RNA, 19 nt, Human
ucugcaggcuuuggggugg

SEQ ID NO: 1045522 - RNA, 20 nt, Human
ucugcaggcuuuggggugga

SEQ ID NO: 1045523 - RNA, 21 nt, Human
ucugcaggcuuugggguggag

SEQ ID NO: 1045524 - RNA, 18 nt, Human
ucuggccgaggcucagcc

SEQ ID NO: 1045525 - RNA, 23 nt, Human
ucuggcugaggguccucuguaga

SEQ ID NO: 1045526 - RNA, 24 nt, Human
ugaaaagcugaaugguggcagcuu

SEQ ID NO: 1045527 - RNA, 23 nt, Human
ugcucuggcugaggguccucugu

SEQ ID NO: 1045528 - RNA, 20 nt, Human
uggagugucugcugcugaaa

SEQ ID NO: 1045529 - RNA, 19 nt, Human
ugggguggagugucugcug

SEQ ID NO: 1045530 - RNA, 22 nt, Human
ugguggcagcuucagccuugca

SEQ ID NO: 1045531 - RNA, 23 nt, Human
agggugcugggacccgggcaggg

SEQ ID NO: 1045532 - RNA, 18 nt, Human
cagcacaggguugggccu

SEQ ID NO: 1045533 - RNA, 21 nt, Human
caggugguccuagacagcagu

SEQ ID NO: 1045534 - RNA, 21 nt, Human
ccagggugcugggacccgggc

SEQ ID NO: 1045535 - RNA, 20 nt, Human
ccgccugggacagagacggg

SEQ ID NO: 1045536 - RNA, 18 nt, Human
ccuuuauuccugguuagg

SEQ ID NO: 1045537 - RNA, 19 nt, Human
gcuacuguggagaccaggc

SEQ ID NO: 1045538 - RNA, 20 nt, Human
ggugguccuagacagcaguu

SEQ ID NO: 1045539 - RNA, 18 nt, Human
gugguccuagacagcagu

SEQ ID NO: 1045540 - RNA, 19 nt, Human
uccagggugcugggacccg

SEQ ID NO: 1045541 - RNA, 18 nt, Human
uccuagacagcaguuucc

SEQ ID NO: 1045542 - RNA, 21 nt, Human
uccugcacugugccccauccc

SEQ ID NO: 1045543 - RNA, 21 nt, Human
ucucuucuugguguacauggc

SEQ ID NO: 1045544 - RNA, 24 nt, Human
ugaccagcacaggguugggccugg

SEQ ID NO: 1045545 - RNA, 20 nt, Human
ugggccccaagcagcuguga

SEQ ID NO: 1045546 - RNA, 25 nt, Human
ugggccccaagcagcugugacugcc

SEQ ID NO: 1045547 - RNA, 21 nt, Human
ugguguggccuaacuuuggcu

SEQ ID NO: 1045548 - RNA, 24 nt, Human
uguacauggcuguguccugcacug

SEQ ID NO: 1045549 - RNA, 20 nt, Human
uguggagaccaggcagcagu

SEQ ID NO: 1045550 - RNA, 18 nt, Human
ugagccuaugggccaagg

SEQ ID NO: 1045551 - RNA, 20 nt, Human
agacuuccgaaguccuucac

SEQ ID NO: 1045552 - RNA, 21 nt, Human
agccagacuuccgaaguccuu

SEQ ID NO: 1045553 - RNA, 19 nt, Human
uagccagacuuccgaaguc

SEQ ID NO: 1045554 - RNA, 19 nt, Human
acaaagcaaaacaaaacga

SEQ ID NO: 1045555 - RNA, 18 nt, Human
agccugagccugcggccc

SEQ ID NO: 1045556 - RNA, 18 nt, Human
agggccgcacagugaccu

SEQ ID NO: 1045557 - RNA, 22 nt, Human
auaccgcccucccggccagcca

SEQ ID NO: 1045558 - RNA, 22 nt, Human
caacaaagcaaaacaaaacgag

SEQ ID NO: 1045559 - RNA, 21 nt, Human
caacgcccguccacgggugcc

SEQ ID NO: 1045560 - RNA, 20 nt, Human
caccacgcagagccaacgcc

SEQ ID NO: 1045561 - RNA, 19 nt, Human
caccguaucgcugcugggc

SEQ ID NO: 1045562 - RNA, 18 nt, Human
cagccaccugcagcucuc

SEQ ID NO: 1045563 - RNA, 20 nt, Human
caggcccagccugagccugc

SEQ ID NO: 1045564 - RNA, 23 nt, Human
cagugcggucacuguggccaagc

SEQ ID NO: 1045565 - RNA, 26 nt, Human
cccaccacgcagagccaacgcccguc

SEQ ID NO: 1045566 - RNA, 24 nt, Human
cccagccugagccugcggcccgac

SEQ ID NO: 1045567 - RNA, 21 nt, Human
ccccgggaaccucccccuacc

SEQ ID NO: 1045568 - RNA, 18 nt, Human
ccccgggcucccaaucgu

SEQ ID NO: 1045569 - RNA, 21 nt, Human
ccccggggagagggagggcgg

SEQ ID NO: 1045570 - RNA, 23 nt, Human
cccgacccgggggcacggccacc

SEQ ID NO: 1045571 - RNA, 18 nt, Human
ccgcgucguggugacugc

SEQ ID NO: 1045572 - RNA, 21 nt, Human
ccuccaggcccagccugagcc

SEQ ID NO: 1045573 - RNA, 24 nt, Human
ccuuccgcgggcuuccccgggaac

SEQ ID NO: 1045574 - RNA, 19 nt, Human
cgccacuggccuccaggcc

SEQ ID NO: 1045575 - RNA, 25 nt, Human
cuagcugggucgaaaaccaccguau

SEQ ID NO: 1045576 - RNA, 23 nt, Human
cuccaggcccagccugagccugc

SEQ ID NO: 1045577 - RNA, 18 nt, Human
cucccggccagccaccug

SEQ ID NO: 1045578 - RNA, 20 nt, Human
cucucgcuccuccugcuagg

SEQ ID NO: 1045579 - RNA, 24 nt, Human
cucucucgcuccuccugcuaggag

SEQ ID NO: 1045580 - RNA, 20 nt, Human
cuggaugggguccaggaguu

SEQ ID NO: 1045581 - RNA, 20 nt, Human
cuguggccaagcggcgagac

SEQ ID NO: 1045582 - RNA, 20 nt, Human
gagccugcggcccgacccgg

SEQ ID NO: 1045583 - RNA, 22 nt, Human
gagcgugaggcuguguggcagc

SEQ ID NO: 1045584 - RNA, 20 nt, Human
gcagggccgcacagugaccu

SEQ ID NO: 1045585 - RNA, 22 nt, Human
gccaugggccccggggagaggg

SEQ ID NO: 1045586 - RNA, 18 nt, Human
gggcgguggggucugcgg

SEQ ID NO: 1045587 - RNA, 19 nt, Human
ggggagagggagggcggug

SEQ ID NO: 1045588 - RNA, 22 nt, Human
gggugcaggugugacuacugag

SEQ ID NO: 1045589 - RNA, 22 nt, Human
ggucagagauucgggugcaggu

SEQ ID NO: 1045590 - RNA, 21 nt, Human
gugaagcagauagcucuggug

SEQ ID NO: 1045591 - RNA, 21 nt, Human
gugcaugaauggaaagcucua

SEQ ID NO: 1045592 - RNA, 18 nt, Human
gugcgggcgcuggggucc

SEQ ID NO: 1045593 - RNA, 19 nt, Human
uaccggacgccagccgggg

SEQ ID NO: 1045594 - RNA, 21 nt, Human
uagcugaugaccuggaugggg

SEQ ID NO: 1045595 - RNA, 19 nt, Human
uccacgccucccacacacc

SEQ ID NO: 1045596 - RNA, 19 nt, Human
uccauagcgucgcugagug

SEQ ID NO: 1045597 - RNA, 18 nt, Human
ucccacacaccgcgcucu

SEQ ID NO: 1045598 - RNA, 18 nt, Human
ucccagccgcccaccacg

SEQ ID NO: 1045599 - RNA, 18 nt, Human
ucccaugacuccaaugcc

SEQ ID NO: 1045600 - RNA, 19 nt, Human
ucugcggcuuggaacgagc

SEQ ID NO: 1045601 - RNA, 18 nt, Human
ugaagugaagcagauagc

SEQ ID NO: 1045602 - RNA, 20 nt, Human
ugaagugaagcagauagcuc

SEQ ID NO: 1045603 - RNA, 23 nt, Human
ugcaacaaagcaaaacaaaacga

SEQ ID NO: 1045604 - RNA, 22 nt, Human
ugccccgggcucccaaucguac

SEQ ID NO: 1045605 - RNA, 19 nt, Human
uggaacgagccccuacaug

SEQ ID NO: 1045606 - RNA, 25 nt, Human
uggcaggccaggcaccucgccuucc

SEQ ID NO: 1045607 - RNA, 19 nt, Human
uggccuccaggcccagccu

SEQ ID NO: 1045608 - RNA, 19 nt, Human
uggggucugcggcuuggaa

SEQ ID NO: 1045609 - RNA, 18 nt, Human
uguggcagccuucuugcu

SEQ ID NO: 1045610 - RNA, 22 nt, Human
uucuugcuuguagcaauaggug

SEQ ID NO: 1045611 - RNA, 20 nt, Human
cagaauccugaaacccuggc

SEQ ID NO: 1045612 - RNA, 20 nt, Human
cagagccggacauccaccgc

SEQ ID NO: 1045613 - RNA, 23 nt, Human
caggggacagaauccugaaaccc

SEQ ID NO: 1045614 - RNA, 19 nt, Human
ccuggcucugggguccggg

SEQ ID NO: 1045615 - RNA, 20 nt, Human
cucaggggacagaauccuga

SEQ ID NO: 1045616 - RNA, 21 nt, Human
cuggcucugggguccggggca

SEQ ID NO: 1045617 - RNA, 24 nt, Human
gcucugggguccggggcaggggug

SEQ ID NO: 1045618 - RNA, 24 nt, Human
ucaggacagacggugaaacugagg

SEQ ID NO: 1045619 - RNA, 25 nt, Human
ugaaacugagguccagagccggaca

SEQ ID NO: 1045620 - RNA, 21 nt, Human
accauagcuuauuggaaaacc

SEQ ID NO: 1045621 - RNA, 21 nt, Human
gggcaagucuuccagaauggu

SEQ ID NO: 1045622 - RNA, 24 nt, Human
uauuggaaaacccagagccuucug

SEQ ID NO: 1045623 - RNA, 23 nt, Human
uggaaaacccagagccuucugga

SEQ ID NO: 1045624 - RNA, 22 nt, Human
uggaugggcaagucuuccagaa

SEQ ID NO: 1045625 - RNA, 20 nt, Human
uuccagaaugguauccccau

SEQ ID NO: 1045626 - RNA, 19 nt, Human
aaacaagaaacagacuugg

SEQ ID NO: 1045627 - RNA, 25 nt, Human
aacaagaaacagacuugguuucaaa

SEQ ID NO: 1045628 - RNA, 23 nt, Human
agagagaaaauacaaaacaagaa

SEQ ID NO: 1045629 - RNA, 20 nt, Human
caaaugcauaaccaggugcu

SEQ ID NO: 1045630 - RNA, 27 nt, Human
caacuuccagagagaaaauacaaaaca

SEQ ID NO: 1045631 - RNA, 19 nt, Human
caagaaacagacuugguuu

SEQ ID NO: 1045632 - RNA, 19 nt, Human
ccagagagaaaauacaaaa

SEQ ID NO: 1045633 - RNA, 19 nt, Human
ccccacccgcgccuccagc

SEQ ID NO: 1045634 - RNA, 24 nt, Human
gaccaccuccuuacaacuuccaga

SEQ ID NO: 1045635 - RNA, 18 nt, Human
gcgccuccagcuuuccuc

SEQ ID NO: 1045636 - RNA, 26 nt, Human
uccagagagaaaauacaaaacaagaa

SEQ ID NO: 1045637 - RNA, 27 nt, Human
uccagagagaaaauacaaaacaagaaa

SEQ ID NO: 1045638 - RNA, 19 nt, Human
uccccacccgcgccuccag

SEQ ID NO: 1045639 - RNA, 19 nt, Human
ugcauaaccaggugcugga

SEQ ID NO: 1045640 - RNA, 19 nt, Human
uuccccacccgcgccucca

SEQ ID NO: 1045641 - RNA, 26 nt, Human
aaaacccccaaaaacaggagacagag

SEQ ID NO: 1045642 - RNA, 21 nt, Human
aaagauauaucugucacccuc

SEQ ID NO: 1045643 - RNA, 20 nt, Human
aaagucucccuggguggggc

SEQ ID NO: 1045644 - RNA, 20 nt, Human
aacacagugaggcucugccu

SEQ ID NO: 1045645 - RNA, 19 nt, Human
aaccccagccucaugacca

SEQ ID NO: 1045646 - RNA, 23 nt, Human
aacccccaaaaacaggagacaga

SEQ ID NO: 1045647 - RNA, 21 nt, Human
aagaagccaauauacaggaua

SEQ ID NO: 1045648 - RNA, 20 nt, Human
aagcaagcggucagggaggc

SEQ ID NO: 1045649 - RNA, 18 nt, Human
aagcaugugguggagagg

SEQ ID NO: 1045650 - RNA, 23 nt, Human
aagcugcucauggguguggauga

SEQ ID NO: 1045651 - RNA, 21 nt, Human
aaggagcugaggggucagagg

SEQ ID NO: 1045652 - RNA, 18 nt, Human
aaggaucccuccgccccc

SEQ ID NO: 1045653 - RNA, 22 nt, Human
aauggguuccauucaauccagc

SEQ ID NO: 1045654 - RNA, 18 nt, Human
acacagcccacccugagc

SEQ ID NO: 1045655 - RNA, 24 nt, Human
acacagugcccuucaacgcagucc

SEQ ID NO: 1045656 - RNA, 24 nt, Human
accaaccagggagccaaaaggaug

SEQ ID NO: 1045657 - RNA, 19 nt, Human
acccacccaguccccucca

SEQ ID NO: 1045658 - RNA, 21 nt, Human
acccacccccucagaucccca

SEQ ID NO: 1045659 - RNA, 23 nt, Human
acccacccccucagauccccacc

SEQ ID NO: 1045660 - RNA, 20 nt, Human
accccuguccuaggaaaccc

SEQ ID NO: 1045661 - RNA, 22 nt, Human
acccugcuucucuccugccagc

SEQ ID NO: 1045662 - RNA, 21 nt, Human
acccuguaaccuuuagaacaa

SEQ ID NO: 1045663 - RNA, 20 nt, Human
acgaggccgggggacaggaa

SEQ ID NO: 1045664 - RNA, 22 nt, Human
acugcagcccaggcuuggccug

SEQ ID NO: 1045665 - RNA, 25 nt, Human
agaaaauucuaaaauaccaguguca

SEQ ID NO: 1045666 - RNA, 22 nt, Human
agaccagagucagaguaacuaa

SEQ ID NO: 1045667 - RNA, 23 nt, Human
agagaagggagggcagagaaagu

SEQ ID NO: 1045668 - RNA, 19 nt, Human
agagggcagcgcaggagag

SEQ ID NO: 1045669 - RNA, 22 nt, Human
agcaccccaagcuccaggccga

SEQ ID NO: 1045670 - RNA, 24 nt, Human
agccaaaagcaggcaacugccgga

SEQ ID NO: 1045671 - RNA, 22 nt, Human
agcggucagggaggccagugcc

SEQ ID NO: 1045672 - RNA, 18 nt, Human
agcuccuccucccaccuc

SEQ ID NO: 1045673 - RNA, 21 nt, Human
aggaaacggaaaaucuuuuua

SEQ ID NO: 1045674 - RNA, 22 nt, Human
aggaauaauucuuuggagcuca

SEQ ID NO: 1045675 - RNA, 19 nt, Human
aggagaauggggugaagug

SEQ ID NO: 1045676 - RNA, 21 nt, Human
aggaggaagggagggcauagc

SEQ ID NO: 1045677 - RNA, 19 nt, Human
aggcaaggcagagggaccc

SEQ ID NO: 1045678 - RNA, 18 nt, Human
aggcaggcaggcaggcag

SEQ ID NO: 1045679 - RNA, 18 nt, Human
aggcaggcaggcaggcag

SEQ ID NO: 1045680 - RNA, 22 nt, Human
aggcaggcaggcaggccggacc

SEQ ID NO: 1045681 - RNA, 22 nt, Human
aggcaggcaggccggacccagg

SEQ ID NO: 1045682 - RNA, 19 nt, Human
aggcaggccggacccagga

SEQ ID NO: 1045683 - RNA, 24 nt, Human
agggcccacugacauuaacugaaa

SEQ ID NO: 1045684 - RNA, 23 nt, Human
agggccuccagagaagggagggc

SEQ ID NO: 1045685 - RNA, 19 nt, Human
aggggucagaggagaggag

SEQ ID NO: 1045686 - RNA, 24 nt, Human
agggugagugaggagagagaaggg

SEQ ID NO: 1045687 - RNA, 18 nt, Human
agguauguuugaacccug

SEQ ID NO: 1045688 - RNA, 22 nt, Human
agucaaacccagagcccccucc

SEQ ID NO: 1045689 - RNA, 23 nt, Human
auaauaauaaagcaaagccugcu

SEQ ID NO: 1045690 - RNA, 18 nt, Human
auacaggauauaaagggc

SEQ ID NO: 1045691 - RNA, 21 nt, Human
auuacaucacacauagucacu

SEQ ID NO: 1045692 - RNA, 24 nt, Human
caaacccagagcccccuccuucug

SEQ ID NO: 1045693 - RNA, 25 nt, Human
caaagccugcucagcuggcuccaag

SEQ ID NO: 1045694 - RNA, 19 nt, Human
caacccucucccaacgcaa

SEQ ID NO: 1045695 - RNA, 19 nt, Human
caagaccaccaggcucgca

SEQ ID NO: 1045696 - RNA, 18 nt, Human
cacagcccacccugagcc

SEQ ID NO: 1045697 - RNA, 22 nt, Human
cacagugcccuucaacgcaguc

SEQ ID NO: 1045698 - RNA, 23 nt, Human
caccaagaccaccaggcucgcag

SEQ ID NO: 1045699 - RNA, 19 nt, Human
caccccaagcuccaggccg

SEQ ID NO: 1045700 - RNA, 19 nt, Human
cacccccucagauccccac

SEQ ID NO: 1045701 - RNA, 21 nt, Human
cacccccucagauccccaccc

SEQ ID NO: 1045702 - RNA, 22 nt, Human
cacccccucagauccccacccc

SEQ ID NO: 1045703 - RNA, 19 nt, Human
cacccccucuccucccacu

SEQ ID NO: 1045704 - RNA, 24 nt, Human
cacccccucuccucccacuccaag

SEQ ID NO: 1045705 - RNA, 30 nt, Human
cacccucccaccaccuuggggaacaacccc

SEQ ID NO: 1045706 - RNA, 23 nt, Human
caccgauaaccacaguaaccuuu

SEQ ID NO: 1045707 - RNA, 24 nt, Human
cacgacacgccggggcccugcacg

SEQ ID NO: 1045708 - RNA, 18 nt, Human
cacuagagggagcuccug

SEQ ID NO: 1045709 - RNA, 18 nt, Human
cacuccgaggggccuucc

SEQ ID NO: 1045710 - RNA, 19 nt, Human
cagaaaccacauuacacca

SEQ ID NO: 1045711 - RNA, 21 nt, Human
cagaaagaggauggcccucac

SEQ ID NO: 1045712 - RNA, 18 nt, Human
cagagcaccccaagcucc

SEQ ID NO: 1045713 - RNA, 20 nt, Human
cagcaaaagaaaacaaagga

SEQ ID NO: 1045714 - RNA, 21 nt, Human
cagcagcccacccugcuucuc

SEQ ID NO: 1045715 - RNA, 19 nt, Human
cagccagaagggacucuca

SEQ ID NO: 1045716 - RNA, 22 nt, Human
cagccagacugccacaggggac

SEQ ID NO: 1045717 - RNA, 20 nt, Human
cagcgagcguuggggucuuu

SEQ ID NO: 1045718 - RNA, 18 nt, Human
cagcuggcagacaacagc

SEQ ID NO: 1045719 - RNA, 18 nt, Human
caggaaccagcccaggag

SEQ ID NO: 1045720 - RNA, 22 nt, Human
caggaaccagcccaggaggcag

SEQ ID NO: 1045721 - RNA, 19 nt, Human
cagggcccuggggggaaca

SEQ ID NO: 1045722 - RNA, 24 nt, Human
caguuaacacugcaaaguccgcac

SEQ ID NO: 1045723 - RNA, 18 nt, Human
cauaguaguuuaaacaca

SEQ ID NO: 1045724 - RNA, 21 nt, Human
caugaccaaccucggccaaac

SEQ ID NO: 1045725 - RNA, 18 nt, Human
cauuuugcuaccuugacc

SEQ ID NO: 1045726 - RNA, 20 nt, Human
ccaacccucucccaacgcaa

SEQ ID NO: 1045727 - RNA, 21 nt, Human
ccacacagaucacccuaaccc

SEQ ID NO: 1045728 - RNA, 26 nt, Human
ccacccccucuccucccacuccaagc

SEQ ID NO: 1045729 - RNA, 24 nt, Human
ccaccugccccaaguccucacucc

SEQ ID NO: 1045730 - RNA, 22 nt, Human
ccacgauggauuuggcccuuca

SEQ ID NO: 1045731 - RNA, 18 nt, Human
ccaggccuagaaagcuca

SEQ ID NO: 1045732 - RNA, 19 nt, Human
ccaggccuagaaagcucac

SEQ ID NO: 1045733 - RNA, 21 nt, Human
ccagggggaagccaggagccc

SEQ ID NO: 1045734 - RNA, 18 nt, Human
ccauucaauccagcaaca

SEQ ID NO: 1045735 - RNA, 23 nt, Human
cccacgaaacucccauaccacaa

SEQ ID NO: 1045736 - RNA, 23 nt, Human
cccacgccgucggggugcaccca

SEQ ID NO: 1045737 - RNA, 27 nt, Human
cccagcacccugaucccuccccccagg

SEQ ID NO: 1045738 - RNA, 21 nt, Human
ccccaaguccucacucccaag

SEQ ID NO: 1045739 - RNA, 23 nt, Human
ccccaauccucuguuuguauaaa

SEQ ID NO: 1045740 - RNA, 22 nt, Human
ccccacccaccacauuucugaa

SEQ ID NO: 1045741 - RNA, 19 nt, Human
ccccacccccucuccuccc

SEQ ID NO: 1045742 - RNA, 21 nt, Human
ccccacccccucuccucccac

SEQ ID NO: 1045743 - RNA, 23 nt, Human
ccccacuccgaggggccuuccug

SEQ ID NO: 1045744 - RNA, 25 nt, Human
ccccagagcccagcuuguucccucc

SEQ ID NO: 1045745 - RNA, 21 nt, Human
cccccaccccacccccucucc

SEQ ID NO: 1045746 - RNA, 22 nt, Human
cccccaccccacccccucuccc

SEQ ID NO: 1045747 - RNA, 24 nt, Human
cccccagcacccugaucccucccc

SEQ ID NO: 1045748 - RNA, 25 nt, Human
cccccagcacccugaucccuccccc

SEQ ID NO: 1045749 - RNA, 21 nt, Human
cccccucuccucccacuccaa

SEQ ID NO: 1045750 - RNA, 23 nt, Human
cccgcaaaggcccaggcuccaag

SEQ ID NO: 1045751 - RNA, 19 nt, Human
cccuaggucaucugagcuc

SEQ ID NO: 1045752 - RNA, 20 nt, Human
cccuaggucaucugagcucu

SEQ ID NO: 1045753 - RNA, 24 nt, Human
cccucagauccccaccccaagacc

SEQ ID NO: 1045754 - RNA, 18 nt, Human
cccuccagacuccccacu

SEQ ID NO: 1045755 - RNA, 21 nt, Human
cccuccgcccccgcccugaac

SEQ ID NO: 1045756 - RNA, 19 nt, Human
cccucuccucccacuccaa

SEQ ID NO: 1045757 - RNA, 18 nt, Human
cccugaucccucccccca

SEQ ID NO: 1045758 - RNA, 21 nt, Human
ccgcaaaggcccaggcuccaa

SEQ ID NO: 1045759 - RNA, 18 nt, Human
ccgcccccgcccugaacc

SEQ ID NO: 1045760 - RNA, 26 nt, Human
ccgccgccgcccgugcgccgcaccug

SEQ ID NO: 1045761 - RNA, 19 nt, Human
ccggacccaggaaccagcc

SEQ ID NO: 1045762 - RNA, 24 nt, Human
ccggacccaggaaccagcccagga

SEQ ID NO: 1045763 - RNA, 25 nt, Human
ccggcccucagcuuagaguucugua

SEQ ID NO: 1045764 - RNA, 21 nt, Human
ccuaggaaacccccagcaccc

SEQ ID NO: 1045765 - RNA, 18 nt, Human
ccuccuucccuuccuucc

SEQ ID NO: 1045766 - RNA, 18 nt, Human
ccuccuucccuuccuucc

SEQ ID NO: 1045767 - RNA, 19 nt, Human
ccuuccuuccaccuuucuc

SEQ ID NO: 1045768 - RNA, 18 nt, Human
cgaaacucccauaccaca

SEQ ID NO: 1045769 - RNA, 20 nt, Human
cgagcuccuccucccaccuc

SEQ ID NO: 1045770 - RNA, 25 nt, Human
cgagcuccuccucccaccuccgcuu

SEQ ID NO: 1045771 - RNA, 22 nt, Human
cgccgccgccgcccgugcgccg

SEQ ID NO: 1045772 - RNA, 22 nt, Human
cggaucuccggcgugauggugu

SEQ ID NO: 1045773 - RNA, 24 nt, Human
cgggaaccccagccucaugaccaa

SEQ ID NO: 1045774 - RNA, 23 nt, Human
cuagaguacccuaguccucaaag

SEQ ID NO: 1045775 - RNA, 19 nt, Human
cucagaacuaacacacagc

SEQ ID NO: 1045776 - RNA, 20 nt, Human
cucccccaccccacccccuc

SEQ ID NO: 1045777 - RNA, 21 nt, Human
cuccgcccccgcccugaaccu

SEQ ID NO: 1045778 - RNA, 23 nt, Human
cuccuacccaccugccccaaguc

SEQ ID NO: 1045779 - RNA, 19 nt, Human
cuccugggacaauaaaaaa

SEQ ID NO: 1045780 - RNA, 21 nt, Human
cuccuuccuggggguuggcag

SEQ ID NO: 1045781 - RNA, 22 nt, Human
cucuccuacccaccugccccaa

SEQ ID NO: 1045782 - RNA, 18 nt, Human
cucuccucccacuccaag

SEQ ID NO: 1045783 - RNA, 25 nt, Human
cucugccuuccccucacagugccuu

SEQ ID NO: 1045784 - RNA, 21 nt, Human
cugcagcccacccacccccuc

SEQ ID NO: 1045785 - RNA, 21 nt, Human
cugcauuuguaauguggagaa

SEQ ID NO: 1045786 - RNA, 22 nt, Human
cugccucccaacccucucccaa

SEQ ID NO: 1045787 - RNA, 24 nt, Human
cugcugccucccaacccucuccca

SEQ ID NO: 1045788 - RNA, 20 nt, Human
cuuaaaggccacggaccccu

SEQ ID NO: 1045789 - RNA, 22 nt, Human
cuuccaaaaccauugucccucc

SEQ ID NO: 1045790 - RNA, 23 nt, Human
cuuccuggccccaugaggagagg

SEQ ID NO: 1045791 - RNA, 19 nt, Human
cuuccuggggguuggcaga

SEQ ID NO: 1045792 - RNA, 24 nt, Human
cuuggcgagcuccuccucccaccu

SEQ ID NO: 1045793 - RNA, 21 nt, Human
cuuugccucauuucuuugagg

SEQ ID NO: 1045794 - RNA, 22 nt, Human
gaacauagcaaggacugcagcc

SEQ ID NO: 1045795 - RNA, 18 nt, Human
gaagugggaccuacacuc

SEQ ID NO: 1045796 - RNA, 21 nt, Human
gaccacuagagggagcuccug

SEQ ID NO: 1045797 - RNA, 18 nt, Human
gagagguccugccuucca

SEQ ID NO: 1045798 - RNA, 20 nt, Human
gaggagcagaaagaggaugg

SEQ ID NO: 1045799 - RNA, 26 nt, Human
gaggcaggcaggcaggcaggcaggcc

SEQ ID NO: 1045800 - RNA, 20 nt, Human
gagggacccaaguucuaguc

SEQ ID NO: 1045801 - RNA, 20 nt, Human
gaggggucagaggagaggag

SEQ ID NO: 1045802 - RNA, 23 nt, Human
gagugugugugugugugugugug

SEQ ID NO: 1045803 - RNA, 20 nt, Human
gcaggagagcccaucugaga

SEQ ID NO: 1045804 - RNA, 18 nt, Human
gccaaucagaggagcagg

SEQ ID NO: 1045805 - RNA, 18 nt, Human
gccagcagcccacccugc

SEQ ID NO: 1045806 - RNA, 23 nt, Human
gccuugucccuucccccacccac

SEQ ID NO: 1045807 - RNA, 21 nt, Human
gcggguagaagggagcagaga

SEQ ID NO: 1045808 - RNA, 20 nt, Human
gcucagcuggcuccaagcug

SEQ ID NO: 1045809 - RNA, 19 nt, Human
gcuccuccucccaccuccg

SEQ ID NO: 1045810 - RNA, 22 nt, Human
gcuccuuccuggggguuggcag

SEQ ID NO: 1045811 - RNA, 21 nt, Human
ggaaaaucuuuuuagcagcug

SEQ ID NO: 1045812 - RNA, 19 nt, Human
ggcccaucacacucuggcu

SEQ ID NO: 1045813 - RNA, 24 nt, Human
ggcccucacuccagcuccugcacu

SEQ ID NO: 1045814 - RNA, 18 nt, Human
gggaaacagaaaagagag

SEQ ID NO: 1045815 - RNA, 20 nt, Human
gggaagggucuuggugaggg

SEQ ID NO: 1045816 - RNA, 19 nt, Human
gggauggagacggggcacc

SEQ ID NO: 1045817 - RNA, 20 nt, Human
gggcugggcuaugagcaucu

SEQ ID NO: 1045818 - RNA, 18 nt, Human
ggggaugcuggcucagau

SEQ ID NO: 1045819 - RNA, 24 nt, Human
gggucuuucuuggcaagcuguggg

SEQ ID NO: 1045820 - RNA, 19 nt, Human
ggucuuucuuggcaagcug

SEQ ID NO: 1045821 - RNA, 18 nt, Human
gucacccucccaccaccu

SEQ ID NO: 1045822 - RNA, 18 nt, Human
guggaugaccaaaaguga

SEQ ID NO: 1045823 - RNA, 18 nt, Human
guggaugaccaaaaguga

SEQ ID NO: 1045824 - RNA, 20 nt, Human
gugugugugugugugugugu

SEQ ID NO: 1045825 - RNA, 24 nt, Human
uaaaaaauuaaaauuggcaacaga

SEQ ID NO: 1045826 - RNA, 18 nt, Human
uaaaauuggcaacagacc

SEQ ID NO: 1045827 - RNA, 18 nt, Human
uaacaagagaugcugacu

SEQ ID NO: 1045828 - RNA, 23 nt, Human
uaagacauuucacuuuauuuaaa

SEQ ID NO: 1045829 - RNA, 19 nt, Human
uacaacaguacaguaaaca

SEQ ID NO: 1045830 - RNA, 20 nt, Human
uaccacaacugccuacccua

SEQ ID NO: 1045831 - RNA, 19 nt, Human
uaccacauuguccaaugcc

SEQ ID NO: 1045832 - RNA, 21 nt, Human
uaccacauuguccaaugccuc

SEQ ID NO: 1045833 - RNA, 20 nt, Human
uacccaggccuagaaagcuc

SEQ ID NO: 1045834 - RNA, 21 nt, Human
uacccuaguccucaaagacaa

SEQ ID NO: 1045835 - RNA, 24 nt, Human
uacucgucgcgcucgcgcuucacc

SEQ ID NO: 1045836 - RNA, 18 nt, Human
uagaaagcucacagaggc

SEQ ID NO: 1045837 - RNA, 21 nt, Human
uagaugcaaaaacauccacaa

SEQ ID NO: 1045838 - RNA, 22 nt, Human
uaggaaacccccagcacccuga

SEQ ID NO: 1045839 - RNA, 23 nt, Human
uauaaaaacaccugcuaggaaua

SEQ ID NO: 1045840 - RNA, 21 nt, Human
uauaaaacccccaaaaacagg

SEQ ID NO: 1045841 - RNA, 21 nt, Human
ucaaagacaaaugaccuaugu

SEQ ID NO: 1045842 - RNA, 20 nt, Human
ucaacaacaauaacaacaag

SEQ ID NO: 1045843 - RNA, 19 nt, Human
ucacacucuggcuuucccu

SEQ ID NO: 1045844 - RNA, 21 nt, Human
ucacagaggcaagcggcuccu

SEQ ID NO: 1045845 - RNA, 24 nt, Human
ucacagaggcaagcggcuccuucc

SEQ ID NO: 1045846 - RNA, 19 nt, Human
ucagggaggccagugccuu

SEQ ID NO: 1045847 - RNA, 20 nt, Human
uccaaaaccauugucccucc

SEQ ID NO: 1045848 - RNA, 18 nt, Human
uccaagcugagauuugga

SEQ ID NO: 1045849 - RNA, 26 nt, Human
uccacaaugauauaaggcaagcugcu

SEQ ID NO: 1045850 - RNA, 22 nt, Human
uccacgccgccgccgcccgugc

SEQ ID NO: 1045851 - RNA, 23 nt, Human
uccacgccgccgccgcccgugcg

SEQ ID NO: 1045852 - RNA, 21 nt, Human
uccacuucugcuccagcugcc

SEQ ID NO: 1045853 - RNA, 22 nt, Human
uccagacuccccacuccaggag

SEQ ID NO: 1045854 - RNA, 21 nt, Human
uccagggggaagccaggagcc

SEQ ID NO: 1045855 - RNA, 19 nt, Human
uccaugaguauaaaucccc

SEQ ID NO: 1045856 - RNA, 20 nt, Human
uccccagagcccagcuuguu

SEQ ID NO: 1045857 - RNA, 19 nt, Human
ucccuagaguacccuaguc

SEQ ID NO: 1045858 - RNA, 21 nt, Human
uccuccuucccuuccuucccc

SEQ ID NO: 1045859 - RNA, 21 nt, Human
uccuggccccaugaggagagg

SEQ ID NO: 1045860 - RNA, 19 nt, Human
ucgaucugcacgcccacgc

SEQ ID NO: 1045861 - RNA, 18 nt, Human
ucgcgcucgcgcuucacc

SEQ ID NO: 1045862 - RNA, 22 nt, Human
ucuccacgccgccgccgcccgu

SEQ ID NO: 1045863 - RNA, 18 nt, Human
ucucccccaccccacccc

SEQ ID NO: 1045864 - RNA, 19 nt, Human
ucucccccaccccaccccc

SEQ ID NO: 1045865 - RNA, 22 nt, Human
ucucuuucuggcuccugcaguu

SEQ ID NO: 1045866 - RNA, 18 nt, Human
ugaggagagagaagggcc

SEQ ID NO: 1045867 - RNA, 20 nt, Human
ugagggauuugcucagaacu

SEQ ID NO: 1045868 - RNA, 20 nt, Human
ugaggggucagaggagagga

SEQ ID NO: 1045869 - RNA, 21 nt, Human
ugaggggucagaggagaggag

SEQ ID NO: 1045870 - RNA, 21 nt, Human
ugagguccaagcccaacuggc

SEQ ID NO: 1045871 - RNA, 19 nt, Human
ugcagcccacccacccccu

SEQ ID NO: 1045872 - RNA, 22 nt, Human
ugccacaggggacccgugggag

SEQ ID NO: 1045873 - RNA, 23 nt, Human
ugcccacgaaacucccauaccac

SEQ ID NO: 1045874 - RNA, 20 nt, Human
ugccccagcgagcguugggg

SEQ ID NO: 1045875 - RNA, 24 nt, Human
ugccuacccuagauuaaaaaaccc

SEQ ID NO: 1045876 - RNA, 23 nt, Human
ugccuuacagucuuaagucuaaa

SEQ ID NO: 1045877 - RNA, 20 nt, Human
ugccuugcgggaaccccagc

SEQ ID NO: 1045878 - RNA, 20 nt, Human
ugccuugucccuucaacuuu

SEQ ID NO: 1045879 - RNA, 20 nt, Human
uggagaggcaggcaggcagg

SEQ ID NO: 1045880 - RNA, 21 nt, Human
uggcaagcugugggcucaugg

SEQ ID NO: 1045881 - RNA, 20 nt, Human
uggcagagcaccccaagcuc

SEQ ID NO: 1045882 - RNA, 22 nt, Human
uggcgagcuccuccucccaccu

SEQ ID NO: 1045883 - RNA, 21 nt, Human
uggcucagaucaauaccccga

SEQ ID NO: 1045884 - RNA, 20 nt, Human
uggcucagcuuaagggagaa

SEQ ID NO: 1045885 - RNA, 25 nt, Human
uggcuccugcaguuuucaaacuccc

SEQ ID NO: 1045886 - RNA, 23 nt, Human
uggcuggcgagggagggaagaac

SEQ ID NO: 1045887 - RNA, 19 nt, Human
uggcuucgaaccccacucc

SEQ ID NO: 1045888 - RNA, 24 nt, Human
ugggcuggcucaggaggaagggag

SEQ ID NO: 1045889 - RNA, 22 nt, Human
uggggaccacaaucccagucaa

SEQ ID NO: 1045890 - RNA, 25 nt, Human
uggguguggaugaccaaaagugagg

SEQ ID NO: 1045891 - RNA, 20 nt, Human
uggguuggaaauggaucucg

SEQ ID NO: 1045892 - RNA, 22 nt, Human
uggguuggaaauggaucucggc

SEQ ID NO: 1045893 - RNA, 21 nt, Human
uggugaggggacaagcagggc

SEQ ID NO: 1045894 - RNA, 22 nt, Human
ugguguggcuucgaaccccacu

SEQ ID NO: 1045895 - RNA, 24 nt, Human
uguauacaaggaggaaaguaaaaa

SEQ ID NO: 1045896 - RNA, 21 nt, Human
ugucaaagggaacuguuuggc

SEQ ID NO: 1045897 - RNA, 21 nt, Human
ugucaauaugacacugggcuu

SEQ ID NO: 1045898 - RNA, 21 nt, Human
ugucgaucugcacgcccacgc

SEQ ID NO: 1045899 - RNA, 22 nt, Human
ugugucgaggagcagaaagagg

SEQ ID NO: 1045900 - RNA, 18 nt, Human
ugugugugugugugugug

SEQ ID NO: 1045901 - RNA, 18 nt, Human
ugugugugugugugugug

SEQ ID NO: 1045902 - RNA, 18 nt, Human
ugugugugugugugugug

SEQ ID NO: 1045903 - RNA, 18 nt, Human
ugugugugugugugugug

SEQ ID NO: 1045904 - RNA, 18 nt, Human
ugugugugugugugugug

SEQ ID NO: 1045905 - RNA, 18 nt, Human
ugugugugugugugugug

SEQ ID NO: 1045906 - RNA, 18 nt, Human
ugugugugugugugugug

SEQ ID NO: 1045907 - RNA, 21 nt, Human
ugugugugugugugugugugu

SEQ ID NO: 1045908 - RNA, 21 nt, Human
ugugugugugugugugugugu

SEQ ID NO: 1045909 - RNA, 21 nt, Human
ugugugugugugugugugugu

SEQ ID NO: 1045910 - RNA, 21 nt, Human
ugugugugugugugugugugu

SEQ ID NO: 1045911 - RNA, 21 nt, Human
ugugugugugugugugugugu

SEQ ID NO: 1045912 - RNA, 21 nt, Human
ugugugugugugugugugugu

SEQ ID NO: 1045913 - RNA, 21 nt, Human
ugugugugugugugugugugu

SEQ ID NO: 1045914 - RNA, 21 nt, Human
ugugugugugugugugugugu

SEQ ID NO: 1045915 - RNA, 21 nt, Human
ugugugugugugugugugugu

SEQ ID NO: 1045916 - RNA, 21 nt, Human
ugugugugugugugugugugu

SEQ ID NO: 1045917 - RNA, 21 nt, Human
ugugugugugugugugugugu

SEQ ID NO: 1045918 - RNA, 22 nt, Human
ugugugugugugugugugugua

SEQ ID NO: 1045919 - RNA, 22 nt, Human
ugugugugugugugugugugug

SEQ ID NO: 1045920 - RNA, 22 nt, Human
ugugugugugugugugugugug

SEQ ID NO: 1045921 - RNA, 22 nt, Human
ugugugugugugugugugugug

SEQ ID NO: 1045922 - RNA, 22 nt, Human
ugugugugugugugugugugug

SEQ ID NO: 1045923 - RNA, 22 nt, Human
ugugugugugugugugugugug

SEQ ID NO: 1045924 - RNA, 22 nt, Human
uguuguuuguuuuguuuuuugc

SEQ ID NO: 1045925 - RNA, 18 nt, Human
uguuuuccugcccucgag

SEQ ID NO: 1045926 - RNA, 18 nt, Human
uguuuuguuuuuugcaua

SEQ ID NO: 1045927 - RNA, 18 nt, Human
uuaaaauguguccuccuu

SEQ ID NO: 1045928 - RNA, 18 nt, Human
uucaacuuugccacucga

SEQ ID NO: 1045929 - RNA, 19 nt, Human
uucaagucuugggggaugc

SEQ ID NO: 1045930 - RNA, 21 nt, Human
uucauagaaaauucccuucca

SEQ ID NO: 1045931 - RNA, 22 nt, Human
uucauagaaaauucccuuccag

SEQ ID NO: 1045932 - RNA, 19 nt, Human
uuccacgcugcccacgaaa

SEQ ID NO: 1045933 - RNA, 22 nt, Human
uuccacgcugcccacgaaacuc

SEQ ID NO: 1045934 - RNA, 19 nt, Human
uucucuccugccagcagcc

SEQ ID NO: 1045935 - RNA, 19 nt, Human
uucucuguucggagucuca

SEQ ID NO: 1045936 - RNA, 20 nt, Human
uucuuuggagcucaaagugg

SEQ ID NO: 1045937 - RNA, 22 nt, Human
uugggagggaagggucuuggug

SEQ ID NO: 1045938 - RNA, 20 nt, Human
uugguuaaaauaaaaauuca

SEQ ID NO: 1045939 - RNA, 27 nt, Human
uuguucccucccuaaugcgccuugucc

SEQ ID NO: 1045940 - RNA, 21 nt, Human
uuucuuggcaagcugugggcu

SEQ ID NO: 1045941 - RNA, 20 nt, Human
uuugccacucgaucccccca

SEQ ID NO: 1045942 - RNA, 22 nt, Human
uuuguauaaaacccccaaaaac

SEQ ID NO: 1045943 - RNA, 25 nt, Human
aaaauuccgcccacaccccgugccc

SEQ ID NO: 1045944 - RNA, 23 nt, Human
aaacaacguaaaggaacuacuga

SEQ ID NO: 1045945 - RNA, 21 nt, Human
aaacagaaaaccgaagcccug

SEQ ID NO: 1045946 - RNA, 22 nt, Human
aagcccgcgagccggcgcccag

SEQ ID NO: 1045947 - RNA, 18 nt, Human
acagcuucuuccaagugc

SEQ ID NO: 1045948 - RNA, 19 nt, Human
acuucccagcucccagaga

SEQ ID NO: 1045949 - RNA, 19 nt, Human
agccggaccgccaaagccc

SEQ ID NO: 1045950 - RNA, 23 nt, Human
agcucaagacggcaccgcagcag

SEQ ID NO: 1045951 - RNA, 24 nt, Human
aggaacuacugagucuggacagaa

SEQ ID NO: 1045952 - RNA, 19 nt, Human
aggcuuaccagcgcagcgg

SEQ ID NO: 1045953 - RNA, 23 nt, Human
augaaacaaacagaaaaccgaag

SEQ ID NO: 1045954 - RNA, 20 nt, Human
caaaacacaggcuuaccagc

SEQ ID NO: 1045955 - RNA, 23 nt, Human
caaaacacaggcuuaccagcgca

SEQ ID NO: 1045956 - RNA, 20 nt, Human
caaagcccgcgagccggcgc

SEQ ID NO: 1045957 - RNA, 18 nt, Human
caaaggccagccgcgcuc

SEQ ID NO: 1045958 - RNA, 18 nt, Human
caaauaaaugaccgagaa

SEQ ID NO: 1045959 - RNA, 22 nt, Human
caccccgugcccccgggaauuu

SEQ ID NO: 1045960 - RNA, 20 nt, Human
caggauauggggguuaccac

SEQ ID NO: 1045961 - RNA, 19 nt, Human
ccagugcggauaggccaau

SEQ ID NO: 1045962 - RNA, 21 nt, Human
ccccccgccacgcagggcccc

SEQ ID NO: 1045963 - RNA, 22 nt, Human
cccccgccacgcagggccccgg

SEQ ID NO: 1045964 - RNA, 21 nt, Human
ccccuagugaccccuggccuc

SEQ ID NO: 1045965 - RNA, 20 nt, Human
cccuucuccccucuuaauuc

SEQ ID NO: 1045966 - RNA, 21 nt, Human
cccuucuccccucuuaauucu

SEQ ID NO: 1045967 - RNA, 19 nt, Human
ccgcccacaccccgugccc

SEQ ID NO: 1045968 - RNA, 26 nt, Human
ccgcccacaccccgugcccccgggaa

SEQ ID NO: 1045969 - RNA, 21 nt, Human
ccggcccccccgccacgcagg

SEQ ID NO: 1045970 - RNA, 20 nt, Human
ccgucucuccugccccggcc

SEQ ID NO: 1045971 - RNA, 19 nt, Human
ccuccugucacgauuuccu

SEQ ID NO: 1045972 - RNA, 18 nt, Human
ccucgugcccgacgcccc

SEQ ID NO: 1045973 - RNA, 20 nt, Human
cgaaaacaacguaaaggaac

SEQ ID NO: 1045974 - RNA, 24 nt, Human
cgccacgcagggccccggucacgc

SEQ ID NO: 1045975 - RNA, 22 nt, Human
cggaggcccacguucuuccugu

SEQ ID NO: 1045976 - RNA, 21 nt, Human
cucaggaccgcgagcccugag

SEQ ID NO: 1045977 - RNA, 21 nt, Human
cuccggccgaaccgccacuuc

SEQ ID NO: 1045978 - RNA, 24 nt, Human
cugcaagacccugccucacuuucc

SEQ ID NO: 1045979 - RNA, 23 nt, Human
cuuccccgcucuaaugccggagg

SEQ ID NO: 1045980 - RNA, 23 nt, Human
cuucuaagaggaccgagugccuu

SEQ ID NO: 1045981 - RNA, 21 nt, Human
gaaaacaacguaaaggaaccg

SEQ ID NO: 1045982 - RNA, 21 nt, Human
gacccugccucacuuucccac

SEQ ID NO: 1045983 - RNA, 21 nt, Human
gagaagguguuaucuaagacc

SEQ ID NO: 1045984 - RNA, 24 nt, Human
gagcuucauuugcccaacggaggc

SEQ ID NO: 1045985 - RNA, 19 nt, Human
gccgggugaggccgguuug

SEQ ID NO: 1045986 - RNA, 18 nt, Human
gcgaaccaaaacacaggc

SEQ ID NO: 1045987 - RNA, 23 nt, Human
gcucaggaccgcgagcccugagc

SEQ ID NO: 1045988 - RNA, 22 nt, Human
gcugcagugaaugcuuuuaacc

SEQ ID NO: 1045989 - RNA, 18 nt, Human
ggaggagcacggagggca

SEQ ID NO: 1045990 - RNA, 24 nt, Human
ggccguguguagagugggcucugc

SEQ ID NO: 1045991 - RNA, 23 nt, Human
ggucacgcgcggggggagccgga

SEQ ID NO: 1045992 - RNA, 24 nt, Human
uacgauggaaccuccggccgaacc

SEQ ID NO: 1045993 - RNA, 18 nt, Human
uagugaaucuccuucugu

SEQ ID NO: 1045994 - RNA, 19 nt, Human
uaucuggccguguguagag

SEQ ID NO: 1045995 - RNA, 25 nt, Human
uauuccauuuccccuucuccccucu

SEQ ID NO: 1045996 - RNA, 18 nt, Human
ucacgcgcggggggagcc

SEQ ID NO: 1045997 - RNA, 22 nt, Human
uccagacauaccaugcagcuuc

SEQ ID NO: 1045998 - RNA, 24 nt, Human
ucccagagacuguagagaucaccu

SEQ ID NO: 1045999 - RNA, 21 nt, Human
uccgcaaaggccagccgcgcu

SEQ ID NO: 1046000 - RNA, 21 nt, Human
uccgcagaaccccggcgaggc

SEQ ID NO: 1046001 - RNA, 24 nt, Human
uccgcagaaccccggcgaggccga

SEQ ID NO: 1046002 - RNA, 24 nt, Human
ucgauaaagcccagauucacaaaa

SEQ ID NO: 1046003 - RNA, 21 nt, Human
ucggcaaagcucaagacggca

SEQ ID NO: 1046004 - RNA, 22 nt, Human
ucuaagaccucuacagccauuu

SEQ ID NO: 1046005 - RNA, 24 nt, Human
ucuacugucuucccaaggaucuga

SEQ ID NO: 1046006 - RNA, 20 nt, Human
ucugcaagacccugccucac

SEQ ID NO: 1046007 - RNA, 26 nt, Human
ucuguggccuccugucacgauuuccu

SEQ ID NO: 1046008 - RNA, 18 nt, Human
ugaaacaaacagaaaacc

SEQ ID NO: 1046009 - RNA, 25 nt, Human
ugaaacaaacagaaaaccgaagccc

SEQ ID NO: 1046010 - RNA, 20 nt, Human
ugaccccuggccucgugccc

SEQ ID NO: 1046011 - RNA, 22 nt, Human
ugagcgucccccuagugacccc

SEQ ID NO: 1046012 - RNA, 27 nt, Human
ugcccgacgccccgucucuccugcccc

SEQ ID NO: 1046013 - RNA, 18 nt, Human
ugccggaggagcacggag

SEQ ID NO: 1046014 - RNA, 23 nt, Human
ugcuuuuaaccugucaacuguga

SEQ ID NO: 1046015 - RNA, 23 nt, Human
uggacauggacagggaacggcuc

SEQ ID NO: 1046016 - RNA, 21 nt, Human
uggguggcucugaaaagagcc

SEQ ID NO: 1046017 - RNA, 21 nt, Human
uuaccacugugcuaguggagg

SEQ ID NO: 1046018 - RNA, 19 nt, Human
uugggcgcgaagcacgggc

SEQ ID NO: 1046019 - RNA, 26 nt, Human
uuugggcgcgaagcacgggcgugugg

SEQ ID NO: 1046020 - RNA, 20 nt, Human
aaaaagcuauaaggccuaaa

SEQ ID NO: 1046021 - RNA, 21 nt, Human
aaaaagcuauaaggccuaaag

SEQ ID NO: 1046022 - RNA, 23 nt, Human
aaaagagaaauccaaacacagaa

SEQ ID NO: 1046023 - RNA, 18 nt, Human
aaacaaacaugauacaag

SEQ ID NO: 1046024 - RNA, 19 nt, Human
aaacaaauacaauuaaaga

SEQ ID NO: 1046025 - RNA, 19 nt, Human
aaagcuauaaggccuaaag

SEQ ID NO: 1046026 - RNA, 25 nt, Human
aacccaguaaccaagauaaauacua

SEQ ID NO: 1046027 - RNA, 23 nt, Human
aagaaaaaggaaaauuggcccag

SEQ ID NO: 1046028 - RNA, 24 nt, Human
aagaaccacuuaaguaggagggaa

SEQ ID NO: 1046029 - RNA, 20 nt, Human
aaguuccucccuuucccauc

SEQ ID NO: 1046030 - RNA, 26 nt, Human
aauguuuuugcuugcuggggucuuuu

SEQ ID NO: 1046031 - RNA, 22 nt, Human
acaugacggcuguucucaccac

SEQ ID NO: 1046032 - RNA, 19 nt, Human
acccaguaacgacaugggc

SEQ ID NO: 1046033 - RNA, 26 nt, Human
acccccaccuccuaacaggcacccau

SEQ ID NO: 1046034 - RNA, 28 nt, Human
acccuaagaauuaauagccauaggaaau

SEQ ID NO: 1046035 - RNA, 24 nt, Human
acuaucuccuauaaaaaauaucca

SEQ ID NO: 1046036 - RNA, 21 nt, Human
acuuagaugaggaaaagacag

SEQ ID NO: 1046037 - RNA, 24 nt, Human
agagagcacagcagggagggagua

SEQ ID NO: 1046038 - RNA, 23 nt, Human
agaggaaaaggauuucccucuua

SEQ ID NO: 1046039 - RNA, 18 nt, Human
agauuuggaaaauaggug

SEQ ID NO: 1046040 - RNA, 21 nt, Human
aggaaauaaaccuuaagagga

SEQ ID NO: 1046041 - RNA, 21 nt, Human
aggaacuaagugcacuuaaau

SEQ ID NO: 1046042 - RNA, 20 nt, Human
aggcgcacacagugguguuc

SEQ ID NO: 1046043 - RNA, 23 nt, Human
aggugagcugugcaaauucaggg

SEQ ID NO: 1046044 - RNA, 23 nt, Human
agguuuuucaaugccucaauaaa

SEQ ID NO: 1046045 - RNA, 22 nt, Human
auacugcauuuuuuauaguauc

SEQ ID NO: 1046046 - RNA, 24 nt, Human
aucaaaaagggaaaaacaagaacc

SEQ ID NO: 1046047 - RNA, 19 nt, Human
augaggaaaagacaggggg

SEQ ID NO: 1046048 - RNA, 23 nt, Human
augucuguccucccaccccuccc

SEQ ID NO: 1046049 - RNA, 20 nt, Human
caaaauaccacaaaccaagc

SEQ ID NO: 1046050 - RNA, 24 nt, Human
caaaauaccacaaaccaagcugaa

SEQ ID NO: 1046051 - RNA, 21 nt, Human
caaacggaauugggauuggcu

SEQ ID NO: 1046052 - RNA, 24 nt, Human
cacaaaauuuaaggagugccaaag

SEQ ID NO: 1046053 - RNA, 18 nt, Human
cacacuucucacuccacc

SEQ ID NO: 1046054 - RNA, 20 nt, Human
caccaaaacccuccccgaaa

SEQ ID NO: 1046055 - RNA, 24 nt, Human
caccacacucuucccuuuaaacaa

SEQ ID NO: 1046056 - RNA, 23 nt, Human
caccccuagaccaccccucaaaa

SEQ ID NO: 1046057 - RNA, 21 nt, Human
caccccuccuuaacuaaggaa

SEQ ID NO: 1046058 - RNA, 19 nt, Human
cagcagccacagaggccug

SEQ ID NO: 1046059 - RNA, 22 nt, Human
cagccccuagagaacagggaag

SEQ ID NO: 1046060 - RNA, 24 nt, Human
cagggaaagggagaaaccuaaaga

SEQ ID NO: 1046061 - RNA, 19 nt, Human
caguuaauacucuggacac

SEQ ID NO: 1046062 - RNA, 24 nt, Human
caucccaccaaaacccuccccgaa

SEQ ID NO: 1046063 - RNA, 27 nt, Human
cauuaaaaacuucaguagguaccccag

SEQ ID NO: 1046064 - RNA, 21 nt, Human
cauuuuuuaaauguuuuugcu

SEQ ID NO: 1046065 - RNA, 19 nt, Human
cccaaaauaccacaaacca

SEQ ID NO: 1046066 - RNA, 28 nt, Human
cccaucccaccaaaacccuccccgaaag

SEQ ID NO: 1046067 - RNA, 23 nt, Human
ccccaccuccuaacaggcaccca

SEQ ID NO: 1046068 - RNA, 22 nt, Human
ccccauuuuaccauauucaccc

SEQ ID NO: 1046069 - RNA, 21 nt, Human
ccccuucuucacaugcacccg

SEQ ID NO: 1046070 - RNA, 23 nt, Human
cccucaaaauuuccaucuuuuuu

SEQ ID NO: 1046071 - RNA, 19 nt, Human
cccucuuaaguuccucccu

SEQ ID NO: 1046072 - RNA, 23 nt, Human
ccgaaagaaugaagcaaaacaaa

SEQ ID NO: 1046073 - RNA, 18 nt, Human
ccgcauccccacucccag

SEQ ID NO: 1046074 - RNA, 23 nt, Human
ccuacaguaauacuuacuccauu

SEQ ID NO: 1046075 - RNA, 20 nt, Human
ccucacuucccuccuccuaa

SEQ ID NO: 1046076 - RNA, 21 nt, Human
ccuccccccaucccaccaaaa

SEQ ID NO: 1046077 - RNA, 20 nt, Human
ccugaaaaucuccccucucc

SEQ ID NO: 1046078 - RNA, 21 nt, Human
ccuggauuaaaggaacuaagu

SEQ ID NO: 1046079 - RNA, 25 nt, Human
cggaaaaaaauauaaagaaaaagga

SEQ ID NO: 1046080 - RNA, 27 nt, Human
cuagaccaccccucaaaauuuccaucu

SEQ ID NO: 1046081 - RNA, 22 nt, Human
cuagagaacagggaagggucag

SEQ ID NO: 1046082 - RNA, 21 nt, Human
cucaucuucccaaaauaccac

SEQ ID NO: 1046083 - RNA, 24 nt, Human
cucccaaauaaaaaaaauaauuua

SEQ ID NO: 1046084 - RNA, 22 nt, Human
cuccccccaucccaccaaaacc

SEQ ID NO: 1046085 - RNA, 23 nt, Human
cuguuguuuggugugugaugggg

SEQ ID NO: 1046086 - RNA, 24 nt, Human
cuuccccuccacacuucucacucc

SEQ ID NO: 1046087 - RNA, 18 nt, Human
gacacauuacugccuugu

SEQ ID NO: 1046088 - RNA, 20 nt, Human
gagcacagcagggagggagu

SEQ ID NO: 1046089 - RNA, 19 nt, Human
gcccuggauuaaaggaacu

SEQ ID NO: 1046090 - RNA, 20 nt, Human
ggagaagcggaggccuaucc

SEQ ID NO: 1046091 - RNA, 25 nt, Human
ggagcucccccuacuguguccgcau

SEQ ID NO: 1046092 - RNA, 18 nt, Human
ggaggaaaaacuucuggu

SEQ ID NO: 1046093 - RNA, 22 nt, Human
ggcauuauuccuucaccucccc

SEQ ID NO: 1046094 - RNA, 25 nt, Human
gggaaaaaaaucauuuuuuaaaugu

SEQ ID NO: 1046095 - RNA, 24 nt, Human
gggagugcucaucucauaccaggu

SEQ ID NO: 1046096 - RNA, 20 nt, Human
gucagggaaagggagaaacc

SEQ ID NO: 1046097 - RNA, 18 nt, Human
gucuaccuucccccuuca

SEQ ID NO: 1046098 - RNA, 19 nt, Human
gucuguccucccaccccuc

SEQ ID NO: 1046099 - RNA, 19 nt, Human
gucuuuuuauuucuuuucc

SEQ ID NO: 1046100 - RNA, 19 nt, Human
uaaagcaaacggaauuggg

SEQ ID NO: 1046101 - RNA, 23 nt, Human
uaacaacagaucaaauccaaaca

SEQ ID NO: 1046102 - RNA, 19 nt, Human
uaacuaaggaauuuuucug

SEQ ID NO: 1046103 - RNA, 19 nt, Human
uaaguucauucuccaaaag

SEQ ID NO: 1046104 - RNA, 22 nt, Human
uaaguuccucccuuucccaucc

SEQ ID NO: 1046105 - RNA, 21 nt, Human
uacagaaacgcagcagccaca

SEQ ID NO: 1046106 - RNA, 26 nt, Human
uaccucaaaagagaaauccaaacaca

SEQ ID NO: 1046107 - RNA, 18 nt, Human
uaggaaagcuaggugagc

SEQ ID NO: 1046108 - RNA, 21 nt, Human
uagguaccccaguugcccugg

SEQ ID NO: 1046109 - RNA, 20 nt, Human
uauaaagaaaaaggaaaauu

SEQ ID NO: 1046110 - RNA, 24 nt, Human
ucaaaaagggaaaaacaagaaccc

SEQ ID NO: 1046111 - RNA, 26 nt, Human
ucaaacuguaacagauggugggaaac

SEQ ID NO: 1046112 - RNA, 20 nt, Human
ucaccccuagaccaccccuc

SEQ ID NO: 1046113 - RNA, 23 nt, Human
ucacucacacaccccuccuuaac

SEQ ID NO: 1046114 - RNA, 21 nt, Human
uccaguggagaaucaaaacuu

SEQ ID NO: 1046115 - RNA, 23 nt, Human
ucccaaaauaccacaaaccaagc

SEQ ID NO: 1046116 - RNA, 19 nt, Human
ucccaccaaaacccucccc

SEQ ID NO: 1046117 - RNA, 22 nt, Human
uccccccaucccaccaaaaccc

SEQ ID NO: 1046118 - RNA, 26 nt, Human
ucccucaucuucccaaaauaccacaa

SEQ ID NO: 1046119 - RNA, 23 nt, Human
uccgcauccccacucccagcccc

SEQ ID NO: 1046120 - RNA, 23 nt, Human
ucuaacaacagaucaaauccaaa

SEQ ID NO: 1046121 - RNA, 23 nt, Human
ucuauucccucaucuucccaaaa

SEQ ID NO: 1046122 - RNA, 22 nt, Human
ucucaccacacucuucccuuua

SEQ ID NO: 1046123 - RNA, 24 nt, Human
ucucaccacacucuucccuuuaaa

SEQ ID NO: 1046124 - RNA, 23 nt, Human
ucuccauuaaaaacuucaguagg

SEQ ID NO: 1046125 - RNA, 20 nt, Human
ucucucauccuuagaaugga

SEQ ID NO: 1046126 - RNA, 22 nt, Human
ucucugggaaaaccccuggucu

SEQ ID NO: 1046127 - RNA, 20 nt, Human
ugaaaauaaagcaaacggaa

SEQ ID NO: 1046128 - RNA, 22 nt, Human
ugaaaaucuccccucuccauua

SEQ ID NO: 1046129 - RNA, 25 nt, Human
ugaaaaucuccccucuccauuaaaa

SEQ ID NO: 1046130 - RNA, 23 nt, Human
ugaaucuauauuaauuucccagg

SEQ ID NO: 1046131 - RNA, 19 nt, Human
ugaggagaaaauaaccuuu

SEQ ID NO: 1046132 - RNA, 22 nt, Human
ugaggugagcaaagcacucacc

SEQ ID NO: 1046133 - RNA, 21 nt, Human
ugccaaaaaacccaguaacca

SEQ ID NO: 1046134 - RNA, 25 nt, Human
ugccaaaaaacccaguaaccaagau

SEQ ID NO: 1046135 - RNA, 24 nt, Human
ugccuugucuuuccagauccuuca

SEQ ID NO: 1046136 - RNA, 22 nt, Human
ugcuuggaaggaaauaaaccuu

SEQ ID NO: 1046137 - RNA, 21 nt, Human
uggaaaauaggugacuucuga

SEQ ID NO: 1046138 - RNA, 21 nt, Human
uggacaauguaucaaaaauuu

SEQ ID NO: 1046139 - RNA, 23 nt, Human
uggggguggaggcgcacacagug

SEQ ID NO: 1046140 - RNA, 22 nt, Human
ugguuuuguuugaaacagccuc

SEQ ID NO: 1046141 - RNA, 23 nt, Human
uguccucccaccccucccaaggu

SEQ ID NO: 1046142 - RNA, 22 nt, Human
uguccuuaguuuuuaaaaacaa

SEQ ID NO: 1046143 - RNA, 18 nt, Human
uguugaggagaaaauaac

SEQ ID NO: 1046144 - RNA, 25 nt, Human
uuaaacaaauacaauuaaagacuua

SEQ ID NO: 1046145 - RNA, 22 nt, Human
uucccaaaauaccacaaaccaa

SEQ ID NO: 1046146 - RNA, 31 nt, Human
uucccacuuccccuccacacuucucacuccc

SEQ ID NO: 1046147 - RNA, 19 nt, Human
uucccaucuaaacaaacgg

SEQ ID NO: 1046148 - RNA, 25 nt, Human
uucccggaaaaaaauauaaagaaaa

SEQ ID NO: 1046149 - RNA, 21 nt, Human
uuccuucaccuccccccaucc

SEQ ID NO: 1046150 - RNA, 23 nt, Human
uugguuuuguuugaaacagccuc

SEQ ID NO: 1046151 - RNA, 18 nt, Human
uuuggugugugauggggg

SEQ ID NO: 1046152 - RNA, 20 nt, Human
uuuugcuugcuggggucuuu

SEQ ID NO: 1046153 - RNA, 20 nt, Human
uuuuuuguucauuuguccuu

SEQ ID NO: 1046154 - RNA, 21 nt, Human
aaacaauaaugacaaagacaa

SEQ ID NO: 1046155 - RNA, 20 nt, Human
aaacaccuggaggugcaccu

SEQ ID NO: 1046156 - RNA, 24 nt, Human
aaugacaaagacaaugaggaagaa

SEQ ID NO: 1046157 - RNA, 19 nt, Human
accuggaggugcaccugag

SEQ ID NO: 1046158 - RNA, 21 nt, Human
caccuggaggugcaccugagg

SEQ ID NO: 1046159 - RNA, 19 nt, Human
cccagcacuggagcagggu

SEQ ID NO: 1046160 - RNA, 19 nt, Human
cccccgccuccgccccagc

SEQ ID NO: 1046161 - RNA, 18 nt, Human
cucccccgccuccgcccc

SEQ ID NO: 1046162 - RNA, 21 nt, Human
gaccccaaguuugcgccccgc

SEQ ID NO: 1046163 - RNA, 23 nt, Human
gaggacgaccccaaguuugcgcc

SEQ ID NO: 1046164 - RNA, 19 nt, Human
guguacuuuguaaguugau

SEQ ID NO: 1046165 - RNA, 22 nt, Human
ucaaacaauaaugacaaagaca

SEQ ID NO: 1046166 - RNA, 21 nt, Human
ugacaaagacaaugaggaaga

SEQ ID NO: 1046167 - RNA, 28 nt, Human
uggagcaggguccagguuccuccccgcc

SEQ ID NO: 1046168 - RNA, 18 nt, Human
aaaguuauaaaaagcggc

SEQ ID NO: 1046169 - RNA, 23 nt, Human
aacaggccuggguccccaucacc

SEQ ID NO: 1046170 - RNA, 20 nt, Human
aagaggacagagggaaggga

SEQ ID NO: 1046171 - RNA, 20 nt, Human
acagaacagggagacagucu

SEQ ID NO: 1046172 - RNA, 21 nt, Human
accuggaagggccaaaaggga

SEQ ID NO: 1046173 - RNA, 19 nt, Human
acucgcucaacccccuucu

SEQ ID NO: 1046174 - RNA, 23 nt, Human
agacagagagacugcucccaagg

SEQ ID NO: 1046175 - RNA, 19 nt, Human
agagggaagggaaggacag

SEQ ID NO: 1046176 - RNA, 19 nt, Human
agagggaagggaaggacag

SEQ ID NO: 1046177 - RNA, 20 nt, Human
agguauuuuaaagagcuuuu

SEQ ID NO: 1046178 - RNA, 20 nt, Human
aguaggggcauccuugaacc

SEQ ID NO: 1046179 - RNA, 22 nt, Human
aguaggggcauccuugaaccug

SEQ ID NO: 1046180 - RNA, 31 nt, Human
auaaaaagcggcagcagccuggggcccggag

SEQ ID NO: 1046181 - RNA, 22 nt, Human
auagcagcaacagaacagggag

SEQ ID NO: 1046182 - RNA, 27 nt, Human
cagaguaggggcauccuugaaccugcc

SEQ ID NO: 1046183 - RNA, 22 nt, Human
cagcagccuggggcccggaucu

SEQ ID NO: 1046184 - RNA, 23 nt, Human
cagcagccuggggcccggaucug

SEQ ID NO: 1046185 - RNA, 19 nt, Human
cccagccccuucaccuccc

SEQ ID NO: 1046186 - RNA, 20 nt, Human
ccucccagccccuuccuccu

SEQ ID NO: 1046187 - RNA, 22 nt, Human
ccugccgagcucaaagagcagg

SEQ ID NO: 1046188 - RNA, 21 nt, Human
cggcagcagccuggggcccgg

SEQ ID NO: 1046189 - RNA, 22 nt, Human
cuccccagccccuucaccuccc

SEQ ID NO: 1046190 - RNA, 21 nt, Human
cucuccccagccccuucaccu

SEQ ID NO: 1046191 - RNA, 24 nt, Human
cucuggucagcccagucaacucgc

SEQ ID NO: 1046192 - RNA, 22 nt, Human
cugcagggcaaucagaagagga

SEQ ID NO: 1046193 - RNA, 24 nt, Human
cuuucucguuaaugggcuuuugac

SEQ ID NO: 1046194 - RNA, 18 nt, Human
gaggacagagggaaggga

SEQ ID NO: 1046195 - RNA, 22 nt, Human
gaguaagagacagagagacugc

SEQ ID NO: 1046196 - RNA, 25 nt, Human
gcagggcaaucagaagaggacagag

SEQ ID NO: 1046197 - RNA, 21 nt, Human
ggaggaggcccgggaccugga

SEQ ID NO: 1046198 - RNA, 21 nt, Human
ggaggugcuggcggcuccguu

SEQ ID NO: 1046199 - RNA, 24 nt, Human
ggcaaucagaagaggacagaggga

SEQ ID NO: 1046200 - RNA, 20 nt, Human
ggcccgggaccuggaagggc

SEQ ID NO: 1046201 - RNA, 21 nt, Human
ggcggcuccguugcagugggc

SEQ ID NO: 1046202 - RNA, 21 nt, Human
ucaaagagcagggcaccaggg

SEQ ID NO: 1046203 - RNA, 26 nt, Human
ucagcccagucaacucgcucaacccc

SEQ ID NO: 1046204 - RNA, 22 nt, Human
uccccagccccuucaccuccca

SEQ ID NO: 1046205 - RNA, 26 nt, Human
uccccagccccuucaccucccagccc

SEQ ID NO: 1046206 - RNA, 20 nt, Human
uccccaucaccaccacaggg

SEQ ID NO: 1046207 - RNA, 18 nt, Human
uccguugcagugggcagg

SEQ ID NO: 1046208 - RNA, 19 nt, Human
ucuccccagccccuucacc

SEQ ID NO: 1046209 - RNA, 19 nt, Human
ugggcuuuugacuugcugc

SEQ ID NO: 1046210 - RNA, 19 nt, Human
uggguccccaucaccacca

SEQ ID NO: 1046211 - RNA, 25 nt, Human
uuccuccucaggggauaaucugcug

SEQ ID NO: 1046212 - RNA, 23 nt, Human
uuccugugagccugucugugagc

SEQ ID NO: 1046213 - RNA, 19 nt, Human
uucuugcaucacauauucc

SEQ ID NO: 1046214 - RNA, 21 nt, Human
aaaauaaccccuggcccgaaa

SEQ ID NO: 1046215 - RNA, 20 nt, Human
cacuguguucuucacacgag

SEQ ID NO: 1046216 - RNA, 20 nt, Human
ccccgggccugccuguuggg

SEQ ID NO: 1046217 - RNA, 19 nt, Human
cgaaagggcaguagaaaaa

SEQ ID NO: 1046218 - RNA, 23 nt, Human
gccccgggccugccuguugggcc

SEQ ID NO: 1046219 - RNA, 22 nt, Human
uaaaauaaccccuggcccgaaa

SEQ ID NO: 1046220 - RNA, 24 nt, Human
uaaaauaaccccuggcccgaaagg

SEQ ID NO: 1046221 - RNA, 23 nt, Human
uggaagugggccgcaguauguuu

SEQ ID NO: 1046222 - RNA, 24 nt, Human
cauuaacaaaucacucuugauuca

SEQ ID NO: 1046223 - RNA, 25 nt, Human
ucacuuuucacaaagacauuacacu

SEQ ID NO: 1046224 - RNA, 18 nt, Human
uucacaaagacauuacac

SEQ ID NO: 1046225 - RNA, 22 nt, Human
uuggcaguaaaaaucacuuuuc

SEQ ID NO: 1046226 - RNA, 24 nt, Human
aaaacaaaacaaaagugcaugugg

SEQ ID NO: 1046227 - RNA, 24 nt, Human
aaacaaaaacaaaacaaaagugca

SEQ ID NO: 1046228 - RNA, 22 nt, Human
acaaaacaaaaacaaaacaaaa

SEQ ID NO: 1046229 - RNA, 22 nt, Human
acaaaacaaaagugcauguguu

SEQ ID NO: 1046230 - RNA, 18 nt, Human
acccggacccaucagcaa

SEQ ID NO: 1046231 - RNA, 21 nt, Human
accuuccacaaacccucauca

SEQ ID NO: 1046232 - RNA, 27 nt, Human
agaaagaauacuuucaaucuuuaugaa

SEQ ID NO: 1046233 - RNA, 24 nt, Human
cauccucuaauuaaaaacaaaaca

SEQ ID NO: 1046234 - RNA, 21 nt, Human
caucugccuacuacccauccu

SEQ ID NO: 1046235 - RNA, 24 nt, Human
ccacgcgcgccccacccggaccca

SEQ ID NO: 1046236 - RNA, 22 nt, Human
ccccacccggacccaucagcaa

SEQ ID NO: 1046237 - RNA, 21 nt, Human
cccucaucauuucucacuugg

SEQ ID NO: 1046238 - RNA, 22 nt, Human
cgccccacccggacccaucagc

SEQ ID NO: 1046239 - RNA, 24 nt, Human
cuuauaaaccuuccacaaacccuc

SEQ ID NO: 1046240 - RNA, 21 nt, Human
cuucugguucuugaucaucuu

SEQ ID NO: 1046241 - RNA, 21 nt, Human
gccccacccggacccaucagc

SEQ ID NO: 1046242 - RNA, 25 nt, Human
uaaaaacaaaacaaaaacaaaacaa

SEQ ID NO: 1046243 - RNA, 28 nt, Human
uaaguucacccuucuuccuuauaaaccu

SEQ ID NO: 1046244 - RNA, 19 nt, Human
uccacgcgcgccccacccg

SEQ ID NO: 1046245 - RNA, 23 nt, Human
uccucuaauuaaaaacaaaacaa

SEQ ID NO: 1046246 - RNA, 25 nt, Human
uuaaaaacaaaacaaaaacaaaaca

SEQ ID NO: 1046247 - RNA, 22 nt, Human
uucaauguccagaaagaauacu

SEQ ID NO: 1046248 - RNA, 21 nt, Human
uuuaaguucacccuucuuccu

SEQ ID NO: 1046249 - RNA, 22 nt, Human
aaagaggcauacaucaauucuu

SEQ ID NO: 1046250 - RNA, 21 nt, Human
acaaagcagaggcaaagaggc

SEQ ID NO: 1046251 - RNA, 23 nt, Human
accagaauacagaacucagucuc

SEQ ID NO: 1046252 - RNA, 19 nt, Human
cacagcauggcaacagcuu

SEQ ID NO: 1046253 - RNA, 21 nt, Human
cacauuugagaauuaaaucuc

SEQ ID NO: 1046254 - RNA, 20 nt, Human
caccagaauacagaacucag

SEQ ID NO: 1046255 - RNA, 23 nt, Human
cagaauacagaacucagucucac

SEQ ID NO: 1046256 - RNA, 18 nt, Human
cccagggcaaauauggaa

SEQ ID NO: 1046257 - RNA, 23 nt, Human
cccguuaacucaccagaauacag

SEQ ID NO: 1046258 - RNA, 24 nt, Human
cuccucucaaacguuuuccucaaa

SEQ ID NO: 1046259 - RNA, 18 nt, Human
cucucaaacguuuuccuc

SEQ ID NO: 1046260 - RNA, 25 nt, Human
gauaacagcauuuccuaauuuuaaa

SEQ ID NO: 1046261 - RNA, 19 nt, Human
gcaacagcuuugcagaugc

SEQ ID NO: 1046262 - RNA, 25 nt, Human
uaacucaccagaauacagaacucag

SEQ ID NO: 1046263 - RNA, 21 nt, Human
uaagagaagaaggcuauccac

SEQ ID NO: 1046264 - RNA, 19 nt, Human
uaccuguuauuucuucguu

SEQ ID NO: 1046265 - RNA, 21 nt, Human
uauucagaaguauuccaagca

SEQ ID NO: 1046266 - RNA, 18 nt, Human
ucagagcuuccacagcau

SEQ ID NO: 1046267 - RNA, 20 nt, Human
ucccagggcaaauauggaag

SEQ ID NO: 1046268 - RNA, 24 nt, Human
ugaaauagcaaagcccaguaaagg

SEQ ID NO: 1046269 - RNA, 18 nt, Human
ugacaaagcagaggcaaa

SEQ ID NO: 1046270 - RNA, 20 nt, Human
ugacaaagcagaggcaaaga

SEQ ID NO: 1046271 - RNA, 18 nt, Human
ugagauaacagcauuucc

SEQ ID NO: 1046272 - RNA, 20 nt, Human
ugugauuaagagaagaaggc

SEQ ID NO: 1046273 - RNA, 23 nt, Human
uuaaaucucaguuuacaauuggu

SEQ ID NO: 1046274 - RNA, 22 nt, Human
uuuaagagauugauaaauuaaa

SEQ ID NO: 1046275 - RNA, 24 nt, Human
uuucuucguuauugugggcuuaau

SEQ ID NO: 1046276 - RNA, 25 nt, Human
uuugcagaugcccacaucgugauag

SEQ ID NO: 1046277 - RNA, 19 nt, Human
gggaauagguuccagcagc

SEQ ID NO: 1046278 - RNA, 23 nt, Human
aaaaaaguagggauaacuauagc

SEQ ID NO: 1046279 - RNA, 19 nt, Human
aagacacaucagaaccaaa

SEQ ID NO: 1046280 - RNA, 26 nt, Human
agaaacugguaaaaaaguagggauaa

SEQ ID NO: 1046281 - RNA, 23 nt, Human
caacugcacauccucugggcaac

SEQ ID NO: 1046282 - RNA, 24 nt, Human
caacugcacauccucugggcaaca

SEQ ID NO: 1046283 - RNA, 19 nt, Human
caagacacaucagaaccaa

SEQ ID NO: 1046284 - RNA, 21 nt, Human
caagacacaucagaaccaaag

SEQ ID NO: 1046285 - RNA, 25 nt, Human
ccucugggcaacaaaguuauaguuu

SEQ ID NO: 1046286 - RNA, 19 nt, Human
gcuuagaugacaacugcac

SEQ ID NO: 1046287 - RNA, 24 nt, Human
uacugcugagagcuuagaugacaa

SEQ ID NO: 1046288 - RNA, 23 nt, Human
ucuuugauuuauuaagcaggugc

SEQ ID NO: 1046289 - RNA, 23 nt, Human
uuacggccaagacacaucagaac

SEQ ID NO: 1046290 - RNA, 22 nt, Human
cagaggccccucuucacugucu

SEQ ID NO: 1046291 - RNA, 21 nt, Human
ccagaggccccucuucacuga

SEQ ID NO: 1046292 - RNA, 21 nt, Human
ccccuguagguggggagugga

SEQ ID NO: 1046293 - RNA, 23 nt, Human
cuugaagggccagaggccccucu

SEQ ID NO: 1046294 - RNA, 20 nt, Human
gaagggccagaggccccucu

SEQ ID NO: 1046295 - RNA, 21 nt, Human
gaguggauuuuucccaaaggg

SEQ ID NO: 1046296 - RNA, 21 nt, Human
uccucuggcaacaucagcccc

SEQ ID NO: 1046297 - RNA, 22 nt, Human
uggaagaaauagcucagacuug

SEQ ID NO: 1046298 - RNA, 24 nt, Human
uggauccucuggcaacaucagccc

SEQ ID NO: 1046299 - RNA, 23 nt, Human
uggggaguggauuuuucccaaag

SEQ ID NO: 1046300 - RNA, 19 nt, Human
uuccuaggccuuguccugg

SEQ ID NO: 1046301 - RNA, 23 nt, Human
aaagaugcgacauccucuuuacc

SEQ ID NO: 1046302 - RNA, 18 nt, Human
aacauccaaguucuccag

SEQ ID NO: 1046303 - RNA, 24 nt, Human
aacuaugaccccaagcaaauacuc

SEQ ID NO: 1046304 - RNA, 18 nt, Human
aagacaacauccaaguuc

SEQ ID NO: 1046305 - RNA, 20 nt, Human
acaaaaugagacagugcccc

SEQ ID NO: 1046306 - RNA, 19 nt, Human
acugcaagcuauugaaauu

SEQ ID NO: 1046307 - RNA, 21 nt, Human
agccccaacacagucagacaa

SEQ ID NO: 1046308 - RNA, 19 nt, Human
auaaaaaauucuuccaaua

SEQ ID NO: 1046309 - RNA, 20 nt, Human
caaaaugagacagugccccc

SEQ ID NO: 1046310 - RNA, 23 nt, Human
cacaaaaugagacagugccccaa

SEQ ID NO: 1046311 - RNA, 23 nt, Human
caccacaauuucauguccaacaa

SEQ ID NO: 1046312 - RNA, 23 nt, Human
caccucaugacucauuugcuguc

SEQ ID NO: 1046313 - RNA, 24 nt, Human
cacucaaaucucugcacugucugu

SEQ ID NO: 1046314 - RNA, 21 nt, Human
cauguccaacaacugcaagcu

SEQ ID NO: 1046315 - RNA, 25 nt, Human
ccacaaaaugagacagugccccaag

SEQ ID NO: 1046316 - RNA, 22 nt, Human
ccaccacaauuucauguccaac

SEQ ID NO: 1046317 - RNA, 22 nt, Human
ccagccccaacacagucagaca

SEQ ID NO: 1046318 - RNA, 22 nt, Human
cccagccccaacacagucagac

SEQ ID NO: 1046319 - RNA, 19 nt, Human
ccguugcuagagaaacaag

SEQ ID NO: 1046320 - RNA, 26 nt, Human
cuagagaaacaagacaacauccaagu

SEQ ID NO: 1046321 - RNA, 18 nt, Human
guugcuagagaaacaaga

SEQ ID NO: 1046322 - RNA, 23 nt, Human
uaacccaccacaauuucaugucc

SEQ ID NO: 1046323 - RNA, 18 nt, Human
uaacuaugaccccaagca

SEQ ID NO: 1046324 - RNA, 20 nt, Human
uaacuaugaccccaagcaaa

SEQ ID NO: 1046325 - RNA, 24 nt, Human
uauauaacccaccacaauuucaug

SEQ ID NO: 1046326 - RNA, 21 nt, Human
ucaauuauccuuuaucuucau

SEQ ID NO: 1046327 - RNA, 18 nt, Human
ucagacaaaucgcugggc

SEQ ID NO: 1046328 - RNA, 21 nt, Human
ucagacaaaucgcugggcggc

SEQ ID NO: 1046329 - RNA, 20 nt, Human
uccacacucagugugaaaag

SEQ ID NO: 1046330 - RNA, 26 nt, Human
uccacacuuauucuucuccucuuucc

SEQ ID NO: 1046331 - RNA, 20 nt, Human
ucccaguuauccagcuucaa

SEQ ID NO: 1046332 - RNA, 18 nt, Human
ucgcugggcggccaucug

SEQ ID NO: 1046333 - RNA, 22 nt, Human
ucgcugggcggccaucugcucu

SEQ ID NO: 1046334 - RNA, 22 nt, Human
ugaaauucuaaagaugcgacau

SEQ ID NO: 1046335 - RNA, 24 nt, Human
ugaauuggagacaaguggcccaau

SEQ ID NO: 1046336 - RNA, 22 nt, Human
ugaccaaacuuaucuuuucacc

SEQ ID NO: 1046337 - RNA, 21 nt, Human
ugaccccaagcaaauacuccu

SEQ ID NO: 1046338 - RNA, 21 nt, Human
ugaccccaagcaaauacuccu

SEQ ID NO: 1046339 - RNA, 28 nt, Human
ugaccccaagcaaauacuccugaauuua

SEQ ID NO: 1046340 - RNA, 18 nt, Human
ugucccaguuauccagcu

SEQ ID NO: 1046341 - RNA, 22 nt, Human
uguccuuaguuuucagccuuua

SEQ ID NO: 1046342 - RNA, 20 nt, Human
uuuuuuuuuuuuuuuucucu

SEQ ID NO: 1046343 - RNA, 23 nt, Human
uuuuuuuuuuuuuuuuucucuuu

SEQ ID NO: 1046344 - RNA, 24 nt, Human
aaaaugcugggauuacaggcauga

SEQ ID NO: 1046345 - RNA, 18 nt, Human
aaagcuuucugggucugg

SEQ ID NO: 1046346 - RNA, 20 nt, Human
aaaguccucugucuacacca

SEQ ID NO: 1046347 - RNA, 26 nt, Human
aaaugcugggauuacaggcaugagcc

SEQ ID NO: 1046348 - RNA, 20 nt, Human
aacacagaggcuagaguccc

SEQ ID NO: 1046349 - RNA, 24 nt, Human
aacauccauccacuucuuaauguc

SEQ ID NO: 1046350 - RNA, 20 nt, Human
aaccuccgccuccugggcuc

SEQ ID NO: 1046351 - RNA, 20 nt, Human
aacugcaggcacucgagaua

SEQ ID NO: 1046352 - RNA, 21 nt, Human
aaggggugugcuauggguccc

SEQ ID NO: 1046353 - RNA, 21 nt, Human
aaguagcugggaccacagaug

SEQ ID NO: 1046354 - RNA, 23 nt, Human
aaguccuagagcugaagaacugg

SEQ ID NO: 1046355 - RNA, 21 nt, Human
aagugucacuucaggucaccc

SEQ ID NO: 1046356 - RNA, 19 nt, Human
acaaaguccucugucuaca

SEQ ID NO: 1046357 - RNA, 25 nt, Human
accauguugcccaggcugcucugca

SEQ ID NO: 1046358 - RNA, 20 nt, Human
accgaccccgacccugacgc

SEQ ID NO: 1046359 - RNA, 24 nt, Human
accgaccccgacccugacgccgac

SEQ ID NO: 1046360 - RNA, 23 nt, Human
acggguuucaccauguugcccag

SEQ ID NO: 1046361 - RNA, 23 nt, Human
acuuuacgauucuaauugugcug

SEQ ID NO: 1046362 - RNA, 21 nt, Human
agaagccaaguagauacucaa

SEQ ID NO: 1046363 - RNA, 18 nt, Human
agagcugaagaacuggca

SEQ ID NO: 1046364 - RNA, 20 nt, Human
agcagcagggcagcaugaag

SEQ ID NO: 1046365 - RNA, 21 nt, Human
agccaaguagauacucaagga

SEQ ID NO: 1046366 - RNA, 21 nt, Human
agcccccacaucccuuggccu

SEQ ID NO: 1046367 - RNA, 18 nt, Human
aggaucugguagauggag

SEQ ID NO: 1046368 - RNA, 19 nt, Human
aggccucccagucccccag

SEQ ID NO: 1046369 - RNA, 23 nt, Human
agggacagcgagagucuuuuggc

SEQ ID NO: 1046370 - RNA, 25 nt, Human
agggacagcgagagucuuuuggcuu

SEQ ID NO: 1046371 - RNA, 19 nt, Human
agggaggugcguggguccc

SEQ ID NO: 1046372 - RNA, 23 nt, Human
aguagcugggaccacagaugugc

SEQ ID NO: 1046373 - RNA, 18 nt, Human
auccagagagguguaaaa

SEQ ID NO: 1046374 - RNA, 24 nt, Human
caaaaugcugggauuacaggcaug

SEQ ID NO: 1046375 - RNA, 23 nt, Human
caaccuccgccuccugggcucaa

SEQ ID NO: 1046376 - RNA, 21 nt, Human
caacuucaaaaaaggaacaac

SEQ ID NO: 1046377 - RNA, 28 nt, Human
caagcaaaguacccgauuccccugaaag

SEQ ID NO: 1046378 - RNA, 20 nt, Human
cacagaugugccaccacgcc

SEQ ID NO: 1046379 - RNA, 18 nt, Human
caccaaggggcccacagc

SEQ ID NO: 1046380 - RNA, 20 nt, Human
caccagagugguaggaacca

SEQ ID NO: 1046381 - RNA, 22 nt, Human
caccauguugcccaggcugcuc

SEQ ID NO: 1046382 - RNA, 21 nt, Human
cacugcaaccuccgccuccug

SEQ ID NO: 1046383 - RNA, 23 nt, Human
cacugcaaccuccgccuccuggg

SEQ ID NO: 1046384 - RNA, 23 nt, Human
cagcagcagcagggcagcaugaa

SEQ ID NO: 1046385 - RNA, 19 nt, Human
cagcagggcagcaugaaga

SEQ ID NO: 1046386 - RNA, 18 nt, Human
cagccaccgccaccaccc

SEQ ID NO: 1046387 - RNA, 18 nt, Human
cagcccccacaucccuug

SEQ ID NO: 1046388 - RNA, 24 nt, Human
cagcccccacaucccuuggccuuc

SEQ ID NO: 1046389 - RNA, 19 nt, Human
cagcuucugaggcagcccu

SEQ ID NO: 1046390 - RNA, 20 nt, Human
cagggaggugcguggguccc

SEQ ID NO: 1046391 - RNA, 20 nt, Human
cauccacuucuuaaugucuu

SEQ ID NO: 1046392 - RNA, 21 nt, Human
caugagccaccaugcuggccu

SEQ ID NO: 1046393 - RNA, 22 nt, Human
cauguugcccaggcugcucugc

SEQ ID NO: 1046394 - RNA, 24 nt, Human
cauguugcccaggcugcucugcaa

SEQ ID NO: 1046395 - RNA, 21 nt, Human
cauguuuagugugagacuugg

SEQ ID NO: 1046396 - RNA, 23 nt, Human
ccaaaaugcugggauuacaggca

SEQ ID NO: 1046397 - RNA, 24 nt, Human
ccaaaaugcugggauuacaggcau

SEQ ID NO: 1046398 - RNA, 22 nt, Human
ccacacucaacccaugccacaa

SEQ ID NO: 1046399 - RNA, 24 nt, Human
cccaaaaugcugggauuacaggca

SEQ ID NO: 1046400 - RNA, 19 nt, Human
cccagccagcuucugaggc

SEQ ID NO: 1046401 - RNA, 19 nt, Human
cccagcccccacaucccuu

SEQ ID NO: 1046402 - RNA, 22 nt, Human
cccagcccccacaucccuuggc

SEQ ID NO: 1046403 - RNA, 23 nt, Human
cccgacccugacgccgacgcgac

SEQ ID NO: 1046404 - RNA, 19 nt, Human
ccgacccugacgccgacgc

SEQ ID NO: 1046405 - RNA, 28 nt, Human
ccgacgcgaccgccgucgccgcagccag

SEQ ID NO: 1046406 - RNA, 24 nt, Human
ccgccuccugggcucaagcgaucc

SEQ ID NO: 1046407 - RNA, 22 nt, Human
ccggucugcuggcugcuuuugg

SEQ ID NO: 1046408 - RNA, 19 nt, Human
ccuccgccuccugggcuca

SEQ ID NO: 1046409 - RNA, 26 nt, Human
ccuccuggcucagccucucaaguagc

SEQ ID NO: 1046410 - RNA, 20 nt, Human
ccugaaguauuaacacaacu

SEQ ID NO: 1046411 - RNA, 24 nt, Human
ccugcagguggccacacucaaccc

SEQ ID NO: 1046412 - RNA, 23 nt, Human
ccuggcucagccucucaaguagc

SEQ ID NO: 1046413 - RNA, 20 nt, Human
ccugggcucaagcgauccuc

SEQ ID NO: 1046414 - RNA, 23 nt, Human
ccugggcucaagcgauccuccug

SEQ ID NO: 1046415 - RNA, 18 nt, Human
cgacccugacgccgacgc

SEQ ID NO: 1046416 - RNA, 24 nt, Human
cgacgcgaccgccgucgccgcagc

SEQ ID NO: 1046417 - RNA, 24 nt, Human
cgccuccugggcucaagcgauccu

SEQ ID NO: 1046418 - RNA, 24 nt, Human
cgcucugucgcccgggcuggagug

SEQ ID NO: 1046419 - RNA, 23 nt, Human
cggguuucaccauguugcccagg

SEQ ID NO: 1046420 - RNA, 24 nt, Human
cucacugcaaccuccgccuccugg

SEQ ID NO: 1046421 - RNA, 24 nt, Human
cucagccucucaaguagcugggac

SEQ ID NO: 1046422 - RNA, 20 nt, Human
cuccaggcacaucgaagccc

SEQ ID NO: 1046423 - RNA, 25 nt, Human
cuccugggcucaagcgauccuccug

SEQ ID NO: 1046424 - RNA, 19 nt, Human
cucgcucugucgcccgggc

SEQ ID NO: 1046425 - RNA, 21 nt, Human
cucgcucugucgcccgggcug

SEQ ID NO: 1046426 - RNA, 24 nt, Human
cucgcucugucgcccgggcuggag

SEQ ID NO: 1046427 - RNA, 21 nt, Human
cugagccucccaaaaugcugg

SEQ ID NO: 1046428 - RNA, 23 nt, Human
cugcaaccuccgccuccugggcu

SEQ ID NO: 1046429 - RNA, 24 nt, Human
cugccugagccucccaaaaugcug

SEQ ID NO: 1046430 - RNA, 21 nt, Human
cuuuuugucuguuugguagag

SEQ ID NO: 1046431 - RNA, 19 nt, Human
gaagggggaggagcuccca

SEQ ID NO: 1046432 - RNA, 18 nt, Human
gaccgccgucgccgcagc

SEQ ID NO: 1046433 - RNA, 22 nt, Human
gagaagccaaguagauacucaa

SEQ ID NO: 1046434 - RNA, 23 nt, Human
gagacggguuucaccauguugcc

SEQ ID NO: 1046435 - RNA, 18 nt, Human
gauuacaggcaugagcca

SEQ ID NO: 1046436 - RNA, 21 nt, Human
gauuacaggcaugagccacca

SEQ ID NO: 1046437 - RNA, 22 nt, Human
gauuacaggcaugagccaccau

SEQ ID NO: 1046438 - RNA, 18 nt, Human
gauucccuuuaacuauga

SEQ ID NO: 1046439 - RNA, 22 nt, Human
gcaaccuccgccuccugggcuc

SEQ ID NO: 1046440 - RNA, 21 nt, Human
gcagcagcagggcagcaugaa

SEQ ID NO: 1046441 - RNA, 18 nt, Human
gcaggcacucgagauacc

SEQ ID NO: 1046442 - RNA, 19 nt, Human
gcccgggcuggagugcaau

SEQ ID NO: 1046443 - RNA, 18 nt, Human
gccgcagccaccgccacc

SEQ ID NO: 1046444 - RNA, 24 nt, Human
gcgauuugucugccugagccuccc

SEQ ID NO: 1046445 - RNA, 27 nt, Human
gcuggagugcaauaaguggugccaguc

SEQ ID NO: 1046446 - RNA, 18 nt, Human
ggaggagcucccagaagg

SEQ ID NO: 1046447 - RNA, 24 nt, Human
ggaggagcucccagaagggggagg

SEQ ID NO: 1046448 - RNA, 24 nt, Human
ggauuacaggcaugagccaccaug

SEQ ID NO: 1046449 - RNA, 25 nt, Human
gggcagcaugaagacugccaggccu

SEQ ID NO: 1046450 - RNA, 25 nt, Human
ggggaggagcucccagaacgcagcg

SEQ ID NO: 1046451 - RNA, 20 nt, Human
gggucccuguggggaaaucc

SEQ ID NO: 1046452 - RNA, 21 nt, Human
ggguuucaccauguugcccag

SEQ ID NO: 1046453 - RNA, 22 nt, Human
ggguuucaccauguugcccagg

SEQ ID NO: 1046454 - RNA, 20 nt, Human
gguagagacggguuucacca

SEQ ID NO: 1046455 - RNA, 20 nt, Human
guagagacggguuucaccau

SEQ ID NO: 1046456 - RNA, 21 nt, Human
guagagacggguuucaccaug

SEQ ID NO: 1046457 - RNA, 22 nt, Human
guagauacucaaggaaaacacc

SEQ ID NO: 1046458 - RNA, 19 nt, Human
gugccucccuguuuucagc

SEQ ID NO: 1046459 - RNA, 19 nt, Human
gugcgugggucccuguggg

SEQ ID NO: 1046460 - RNA, 18 nt, Human
uacaggcaugagccacca

SEQ ID NO: 1046461 - RNA, 19 nt, Human
uagagacggguuucaccau

SEQ ID NO: 1046462 - RNA, 21 nt, Human
uagagacggguuucaccaugu

SEQ ID NO: 1046463 - RNA, 20 nt, Human
uagaguccccagccagcuuc

SEQ ID NO: 1046464 - RNA, 22 nt, Human
uagauacucaaggaaaacacca

SEQ ID NO: 1046465 - RNA, 21 nt, Human
uagauggagucucgcucuguc

SEQ ID NO: 1046466 - RNA, 21 nt, Human
uaggaaccaaggcaggcauca

SEQ ID NO: 1046467 - RNA, 23 nt, Human
ucacugcaaccuccgccuccugg

SEQ ID NO: 1046468 - RNA, 24 nt, Human
ucacugcaaccuccgccuccuggg

SEQ ID NO: 1046469 - RNA, 25 nt, Human
ucacugcaaccuccgccuccugggc

SEQ ID NO: 1046470 - RNA, 26 nt, Human
ucacugcaaccuccgccuccugggcu

SEQ ID NO: 1046471 - RNA, 23 nt, Human
ucacuuuacgauucuaauugugc

SEQ ID NO: 1046472 - RNA, 22 nt, Human
uccaaaagagcagcgggucacc

SEQ ID NO: 1046473 - RNA, 18 nt, Human
uccaggcacaucgaagcc

SEQ ID NO: 1046474 - RNA, 24 nt, Human
ucccaaaaugcugggauuacaggc

SEQ ID NO: 1046475 - RNA, 19 nt, Human
ucccccagcccccacaucc

SEQ ID NO: 1046476 - RNA, 23 nt, Human
ucccuaaaggugaaagaucccca

SEQ ID NO: 1046477 - RNA, 21 nt, Human
ucccuuggccuucuggggagg

SEQ ID NO: 1046478 - RNA, 21 nt, Human
uccugggcucaagcgauccuc

SEQ ID NO: 1046479 - RNA, 22 nt, Human
uccugggcucaagcgauccucc

SEQ ID NO: 1046480 - RNA, 24 nt, Human
uccugggcucaagcgauccuccug

SEQ ID NO: 1046481 - RNA, 18 nt, Human
ucgcccgggcuggagugc

SEQ ID NO: 1046482 - RNA, 24 nt, Human
ucgcucugucgcccgggcuggagu

SEQ ID NO: 1046483 - RNA, 18 nt, Human
ucucaaguagcugggacc

SEQ ID NO: 1046484 - RNA, 18 nt, Human
ucucgcucugucgcccgg

SEQ ID NO: 1046485 - RNA, 19 nt, Human
ucucgcucugucgcccggg

SEQ ID NO: 1046486 - RNA, 23 nt, Human
ucucgcucugucgcccgggcugg

SEQ ID NO: 1046487 - RNA, 24 nt, Human
ucucgcucugucgcccgggcugga

SEQ ID NO: 1046488 - RNA, 22 nt, Human
ucugcaacuucugagcuagagc

SEQ ID NO: 1046489 - RNA, 24 nt, Human
ucugucgcccgggcuggagugcaa

SEQ ID NO: 1046490 - RNA, 20 nt, Human
ucuuuaugaacacagaggcu

SEQ ID NO: 1046491 - RNA, 20 nt, Human
ugaagcuuaucgacagcgcu

SEQ ID NO: 1046492 - RNA, 22 nt, Human
ugaauacaauacaaacuucgaa

SEQ ID NO: 1046493 - RNA, 24 nt, Human
ugacaacuucaaaaaaggaacaac

SEQ ID NO: 1046494 - RNA, 18 nt, Human
ugagcuagagcgauuugu

SEQ ID NO: 1046495 - RNA, 20 nt, Human
ugcaaagaacugucaaggug

SEQ ID NO: 1046496 - RNA, 18 nt, Human
ugccaggccucccagucc

SEQ ID NO: 1046497 - RNA, 24 nt, Human
ugccugagccucccaaaaugcugg

SEQ ID NO: 1046498 - RNA, 24 nt, Human
ugcuaugggucccgcgugcugggg

SEQ ID NO: 1046499 - RNA, 22 nt, Human
ugcuuaaagcuacaaguccuag

SEQ ID NO: 1046500 - RNA, 24 nt, Human
uggagucucgcucugucgcccggg

SEQ ID NO: 1046501 - RNA, 21 nt, Human
uggaugagcugaaguaaaaau

SEQ ID NO: 1046502 - RNA, 21 nt, Human
uggccacacucaacccaugcc

SEQ ID NO: 1046503 - RNA, 18 nt, Human
uggccuucuggggagggg

SEQ ID NO: 1046504 - RNA, 23 nt, Human
uggcucagccucucaaguagcug

SEQ ID NO: 1046505 - RNA, 23 nt, Human
ugggaaaaaccacgagaagccaa

SEQ ID NO: 1046506 - RNA, 19 nt, Human
ugggaccacagaugugcca

SEQ ID NO: 1046507 - RNA, 22 nt, Human
ugggaccacagaugugccacca

SEQ ID NO: 1046508 - RNA, 18 nt, Human
ugggauuacaggcaugag

SEQ ID NO: 1046509 - RNA, 22 nt, Human
ugggauuacaggcaugagccac

SEQ ID NO: 1046510 - RNA, 23 nt, Human
ugggauuacaggcaugagccacc

SEQ ID NO: 1046511 - RNA, 24 nt, Human
ugggauuacaggcaugagccacca

SEQ ID NO: 1046512 - RNA, 25 nt, Human
ugggauuacaggcaugagccaccau

SEQ ID NO: 1046513 - RNA, 26 nt, Human
ugggauuacaggcaugagccaccaug

SEQ ID NO: 1046514 - RNA, 23 nt, Human
ugguagagacggguuucaccaug

SEQ ID NO: 1046515 - RNA, 24 nt, Human
uggugccaucucagcucacugcaa

SEQ ID NO: 1046516 - RNA, 22 nt, Human
ugucugccugagccucccaaaa

SEQ ID NO: 1046517 - RNA, 18 nt, Human
ugugcaaagaacugucaa

SEQ ID NO: 1046518 - RNA, 22 nt, Human
uguugcccaggcugcucugcaa

SEQ ID NO: 1046519 - RNA, 23 nt, Human
uguuugguagagacggguuucac

SEQ ID NO: 1046520 - RNA, 22 nt, Human
uuaaugacaacuucaaaaaagg

SEQ ID NO: 1046521 - RNA, 23 nt, Human
uucaggucacccauuuccaaaag

SEQ ID NO: 1046522 - RNA, 23 nt, Human
uuggacaaaguccucugucuaca

SEQ ID NO: 1046523 - RNA, 24 nt, Human
uugguagagacggguuucaccaug

SEQ ID NO: 1046524 - RNA, 22 nt, Human
uugucuguuugguagagacggg

SEQ ID NO: 1046525 - RNA, 24 nt, Human
uugugugcaaagaacugucaaggu

SEQ ID NO: 1046526 - RNA, 21 nt, Human
uuucaccauguugcccaggcu

SEQ ID NO: 1046527 - RNA, 24 nt, Human
uuugguagagacggguuucaccau

SEQ ID NO: 1046528 - RNA, 23 nt, Human
uuuuugucuguuugguagagacg

SEQ ID NO: 1046529 - RNA, 23 nt, Human
aaccaugccaagccugccugcca

SEQ ID NO: 1046530 - RNA, 23 nt, Human
aaggcgggggcuguggaggaugc

SEQ ID NO: 1046531 - RNA, 19 nt, Human
aaggggcucugcucugggc

SEQ ID NO: 1046532 - RNA, 21 nt, Human
aaggggcucugcucugggccu

SEQ ID NO: 1046533 - RNA, 23 nt, Human
aagugcccacccccagggaccac

SEQ ID NO: 1046534 - RNA, 22 nt, Human
aaguggacuuccagcacaccua

SEQ ID NO: 1046535 - RNA, 18 nt, Human
acccaguguacgucccgc

SEQ ID NO: 1046536 - RNA, 25 nt, Human
acccugcccgcccugagggcccaac

SEQ ID NO: 1046537 - RNA, 24 nt, Human
agacacaggcacugaccccgaccc

SEQ ID NO: 1046538 - RNA, 21 nt, Human
agaggccuugcuugucuggga

SEQ ID NO: 1046539 - RNA, 20 nt, Human
agaugcggggagccccacug

SEQ ID NO: 1046540 - RNA, 22 nt, Human
agauggggguuuaucucauggu

SEQ ID NO: 1046541 - RNA, 18 nt, Human
agccaaggcccugccgcg

SEQ ID NO: 1046542 - RNA, 19 nt, Human
aggcacugaccccgacccu

SEQ ID NO: 1046543 - RNA, 24 nt, Human
agggagccaguuccagucaggucu

SEQ ID NO: 1046544 - RNA, 19 nt, Human
agggccagcagugaccagg

SEQ ID NO: 1046545 - RNA, 18 nt, Human
aggguccacccaccccac

SEQ ID NO: 1046546 - RNA, 24 nt, Human
augcccccaagugcccacccccag

SEQ ID NO: 1046547 - RNA, 22 nt, Human
auuagacuaagacccucccggg

SEQ ID NO: 1046548 - RNA, 23 nt, Human
auucucaggauuggcauguuucu

SEQ ID NO: 1046549 - RNA, 24 nt, Human
caaaacagcugcccggggguggga

SEQ ID NO: 1046550 - RNA, 24 nt, Human
caaaggccauacccagcaggugca

SEQ ID NO: 1046551 - RNA, 19 nt, Human
caaccaugccaagccugcc

SEQ ID NO: 1046552 - RNA, 20 nt, Human
caagaagcuggacacaccua

SEQ ID NO: 1046553 - RNA, 22 nt, Human
cacccaccccaccagguggaau

SEQ ID NO: 1046554 - RNA, 25 nt, Human
cacccccaugcaccccaaggagcga

SEQ ID NO: 1046555 - RNA, 21 nt, Human
cacccugcccgcccugagggc

SEQ ID NO: 1046556 - RNA, 23 nt, Human
caccgggggacccagagagcugc

SEQ ID NO: 1046557 - RNA, 19 nt, Human
cacugugcccggggcaccc

SEQ ID NO: 1046558 - RNA, 20 nt, Human
cagccacccugcccgcccug

SEQ ID NO: 1046559 - RNA, 19 nt, Human
cagcugcccggggguggga

SEQ ID NO: 1046560 - RNA, 23 nt, Human
cagugaccaggaugcccccaagu

SEQ ID NO: 1046561 - RNA, 22 nt, Human
cauacccagcaggugcaaacaa

SEQ ID NO: 1046562 - RNA, 21 nt, Human
caucaccugagagucuccagg

SEQ ID NO: 1046563 - RNA, 19 nt, Human
ccacccagauccucggagg

SEQ ID NO: 1046564 - RNA, 18 nt, Human
ccaccugccugacaccca

SEQ ID NO: 1046565 - RNA, 18 nt, Human
ccacgcccacccgcugcu

SEQ ID NO: 1046566 - RNA, 21 nt, Human
ccagaggaggggcugaacgca

SEQ ID NO: 1046567 - RNA, 20 nt, Human
ccagggaugagcagugucca

SEQ ID NO: 1046568 - RNA, 19 nt, Human
ccagugccccacaggccaa

SEQ ID NO: 1046569 - RNA, 18 nt, Human
cccaacagugagcaaggc

SEQ ID NO: 1046570 - RNA, 19 nt, Human
cccaacucuccugaguggc

SEQ ID NO: 1046571 - RNA, 18 nt, Human
cccaagugcccaccccca

SEQ ID NO: 1046572 - RNA, 19 nt, Human
cccacagugguccccaggu

SEQ ID NO: 1046573 - RNA, 22 nt, Human
ccccacaggccaaaggcccaag

SEQ ID NO: 1046574 - RNA, 18 nt, Human
ccccagggaaagguggcc

SEQ ID NO: 1046575 - RNA, 18 nt, Human
ccccaggucuggacuagg

SEQ ID NO: 1046576 - RNA, 22 nt, Human
ccccaugcaccccaaggagcga

SEQ ID NO: 1046577 - RNA, 25 nt, Human
ccccggccaaccaugccaagccugc

SEQ ID NO: 1046578 - RNA, 23 nt, Human
cccugcccgcccugagggcccaa

SEQ ID NO: 1046579 - RNA, 19 nt, Human
ccugcuggagcugacccca

SEQ ID NO: 1046580 - RNA, 20 nt, Human
ccuguuaggguccccaggga

SEQ ID NO: 1046581 - RNA, 18 nt, Human
ccuuggggcaggcuggcc

SEQ ID NO: 1046582 - RNA, 20 nt, Human
cggagaacuuaaaauggcca

SEQ ID NO: 1046583 - RNA, 18 nt, Human
cggccgcugccagcccug

SEQ ID NO: 1046584 - RNA, 19 nt, Human
cgugugguagccaaggccc

SEQ ID NO: 1046585 - RNA, 21 nt, Human
cuccaaggugcauugucuucc

SEQ ID NO: 1046586 - RNA, 20 nt, Human
cuccaggguccacccacccc

SEQ ID NO: 1046587 - RNA, 19 nt, Human
cucccgggccggccgcccc

SEQ ID NO: 1046588 - RNA, 25 nt, Human
cucccgggccggccgccccaaaggc

SEQ ID NO: 1046589 - RNA, 22 nt, Human
cucugcgccuggccuagggugc

SEQ ID NO: 1046590 - RNA, 20 nt, Human
cucugcucugggccuguuag

SEQ ID NO: 1046591 - RNA, 21 nt, Human
cugcuggagcugaccccacgc

SEQ ID NO: 1046592 - RNA, 18 nt, Human
cugucgccuuugaaggga

SEQ ID NO: 1046593 - RNA, 20 nt, Human
cuguguccugcccacccucc

SEQ ID NO: 1046594 - RNA, 25 nt, Human
cuugggcaaaacagcugcccggggg

SEQ ID NO: 1046595 - RNA, 18 nt, Human
cuugggucugucgccuuu

SEQ ID NO: 1046596 - RNA, 21 nt, Human
gaacuuaaaauggccauguuu

SEQ ID NO: 1046597 - RNA, 18 nt, Human
gaagggagccgggagacc

SEQ ID NO: 1046598 - RNA, 19 nt, Human
gaccugggagguaaggggc

SEQ ID NO: 1046599 - RNA, 18 nt, Human
gacgccacccagauccuc

SEQ ID NO: 1046600 - RNA, 23 nt, Human
gagccaguuccagucaggucucc

SEQ ID NO: 1046601 - RNA, 21 nt, Human
gagcugcagcugggaaccuga

SEQ ID NO: 1046602 - RNA, 23 nt, Human
gcagugggucaccugcuaugcau

SEQ ID NO: 1046603 - RNA, 23 nt, Human
gcauguuucuggucagauggggg

SEQ ID NO: 1046604 - RNA, 20 nt, Human
gccagcagugaccaggaugc

SEQ ID NO: 1046605 - RNA, 22 nt, Human
gccccaaaggccauacccagca

SEQ ID NO: 1046606 - RNA, 20 nt, Human
gccgcgugugguagccaagg

SEQ ID NO: 1046607 - RNA, 26 nt, Human
ggaccggagcccccuccaaccggagg

SEQ ID NO: 1046608 - RNA, 21 nt, Human
ggaccggagcccccuccacag

SEQ ID NO: 1046609 - RNA, 25 nt, Human
ggagcccccuccacagacacccuuc

SEQ ID NO: 1046610 - RNA, 19 nt, Human
ggcaggaagggagccggga

SEQ ID NO: 1046611 - RNA, 20 nt, Human
ggcauugggggcaggaaggg

SEQ ID NO: 1046612 - RNA, 20 nt, Human
ggccgccccaaaggccauac

SEQ ID NO: 1046613 - RNA, 22 nt, Human
ggcuccccgacucccuguuccc

SEQ ID NO: 1046614 - RNA, 24 nt, Human
gggagcugauggggagggagccag

SEQ ID NO: 1046615 - RNA, 22 nt, Human
gggcucggagccugcgaagcag

SEQ ID NO: 1046616 - RNA, 20 nt, Human
gguggaaucaagcccaucuc

SEQ ID NO: 1046617 - RNA, 21 nt, Human
gguggcauugggggcaggaag

SEQ ID NO: 1046618 - RNA, 20 nt, Human
gucacacccacccacccacg

SEQ ID NO: 1046619 - RNA, 22 nt, Human
gucuggacuagggagugcagag

SEQ ID NO: 1046620 - RNA, 20 nt, Human
uaaaauggccauguuugucc

SEQ ID NO: 1046621 - RNA, 24 nt, Human
uaagggcauuuaaggguuuaggaa

SEQ ID NO: 1046622 - RNA, 28 nt, Human
uaccuggaccggagcccccuccacagac

SEQ ID NO: 1046623 - RNA, 22 nt, Human
uagcuugguguaacugaaagcc

SEQ ID NO: 1046624 - RNA, 23 nt, Human
uagggagugcagagagggcugca

SEQ ID NO: 1046625 - RNA, 20 nt, Human
uagggugcagccaccugccu

SEQ ID NO: 1046626 - RNA, 18 nt, Human
ucacagccacccugcccg

SEQ ID NO: 1046627 - RNA, 19 nt, Human
ucagggacauucucuuaca

SEQ ID NO: 1046628 - RNA, 23 nt, Human
uccccagugccccacaggccaaa

SEQ ID NO: 1046629 - RNA, 21 nt, Human
ucccgggccggccgccccaaa

SEQ ID NO: 1046630 - RNA, 20 nt, Human
ucuccaggguccacccaccc

SEQ ID NO: 1046631 - RNA, 22 nt, Human
ucugaccugggagguaaggggc

SEQ ID NO: 1046632 - RNA, 24 nt, Human
ucuggccgauuucggucagggaca

SEQ ID NO: 1046633 - RNA, 21 nt, Human
ucuuccaguaucuacagcuuc

SEQ ID NO: 1046634 - RNA, 22 nt, Human
ugaaggagaguuuuauugcaga

SEQ ID NO: 1046635 - RNA, 19 nt, Human
ugaguggcccccaccagac

SEQ ID NO: 1046636 - RNA, 18 nt, Human
ugcaaggguggcauuggg

SEQ ID NO: 1046637 - RNA, 23 nt, Human
ugcccacccccagggaccacaca

SEQ ID NO: 1046638 - RNA, 21 nt, Human
ugcccccaagugcccaccccc

SEQ ID NO: 1046639 - RNA, 20 nt, Human
ugcggcccacgcccacccgc

SEQ ID NO: 1046640 - RNA, 19 nt, Human
uggaauaucucuggcugga

SEQ ID NO: 1046641 - RNA, 22 nt, Human
uggaaucaagcccaucucugcc

SEQ ID NO: 1046642 - RNA, 21 nt, Human
uggaccggagcccccuccaca

SEQ ID NO: 1046643 - RNA, 18 nt, Human
ugggagggaccagggugg

SEQ ID NO: 1046644 - RNA, 26 nt, Human
ugggagguaaggggcucugcucuggg

SEQ ID NO: 1046645 - RNA, 18 nt, Human
uggggagggagccaguuc

SEQ ID NO: 1046646 - RNA, 19 nt, Human
uggggagggagccaguucc

SEQ ID NO: 1046647 - RNA, 23 nt, Human
ugggggcaggaagggagccggga

SEQ ID NO: 1046648 - RNA, 19 nt, Human
uguggaggaugcagggcuc

SEQ ID NO: 1046649 - RNA, 19 nt, Human
uuaaaauggccauguuugu

SEQ ID NO: 1046650 - RNA, 22 nt, Human
uuccagcacaccuagggcagca

SEQ ID NO: 1046651 - RNA, 26 nt, Human
uuccaguaucuacagcuucagacuug

SEQ ID NO: 1046652 - RNA, 18 nt, Human
uuccccgcucccggcucc

SEQ ID NO: 1046653 - RNA, 19 nt, Human
uucccggcuccccgacucc

SEQ ID NO: 1046654 - RNA, 18 nt, Human
uucgcagacacguuccac

SEQ ID NO: 1046655 - RNA, 23 nt, Human
uucugugugaaggagaguuuuau

SEQ ID NO: 1046656 - RNA, 24 nt, Human
aaacuacugggauuacaggcguga

SEQ ID NO: 1046657 - RNA, 22 nt, Human
aaagaucuuugcuucuccacuu

SEQ ID NO: 1046658 - RNA, 23 nt, Human
aagccacucaggaccccagaaag

SEQ ID NO: 1046659 - RNA, 28 nt, Human
aagcccuggagguuaccagcuccaagcc

SEQ ID NO: 1046660 - RNA, 21 nt, Human
acaggcaccugccaccaugcc

SEQ ID NO: 1046661 - RNA, 24 nt, Human
accggguuucgucauguuggccag

SEQ ID NO: 1046662 - RNA, 20 nt, Human
accucggccuucugaauagc

SEQ ID NO: 1046663 - RNA, 24 nt, Human
acggauucucccaccucggccuuc

SEQ ID NO: 1046664 - RNA, 25 nt, Human
acuaauuuuucagggcccaacacca

SEQ ID NO: 1046665 - RNA, 19 nt, Human
agcccuggagguuaccagc

SEQ ID NO: 1046666 - RNA, 24 nt, Human
aggugaucugcccgccuuggccuc

SEQ ID NO: 1046667 - RNA, 20 nt, Human
aguuggggggcagagaaaug

SEQ ID NO: 1046668 - RNA, 23 nt, Human
aucagcugccuuuguguucccag

SEQ ID NO: 1046669 - RNA, 21 nt, Human
aucuuguccccuuuccuucug

SEQ ID NO: 1046670 - RNA, 25 nt, Human
augaauugaaacuaugggauccuaa

SEQ ID NO: 1046671 - RNA, 24 nt, Human
caaacuacugggauuacaggcgug

SEQ ID NO: 1046672 - RNA, 23 nt, Human
cacaaccuccgccucccagguuc

SEQ ID NO: 1046673 - RNA, 18 nt, Human
caccagacccugcuccug

SEQ ID NO: 1046674 - RNA, 24 nt, Human
caccaugccuggcuaauuuuugua

SEQ ID NO: 1046675 - RNA, 24 nt, Human
caccucggccuucugaauagccgg

SEQ ID NO: 1046676 - RNA, 21 nt, Human
caccuugcacgucagcugcac

SEQ ID NO: 1046677 - RNA, 20 nt, Human
caggguucaucccgcucucc

SEQ ID NO: 1046678 - RNA, 19 nt, Human
cagguucaacggauucucc

SEQ ID NO: 1046679 - RNA, 21 nt, Human
caucacaaccuccgccuccca

SEQ ID NO: 1046680 - RNA, 22 nt, Human
caucacaaccuccgccucccag

SEQ ID NO: 1046681 - RNA, 24 nt, Human
cauccucagccucccacaugcuag

SEQ ID NO: 1046682 - RNA, 21 nt, Human
cauguagacuagacucagacu

SEQ ID NO: 1046683 - RNA, 21 nt, Human
cauguccugccuuguccugga

SEQ ID NO: 1046684 - RNA, 18 nt, Human
cauguuggccaggcuggu

SEQ ID NO: 1046685 - RNA, 19 nt, Human
cauguuggccaggcugguc

SEQ ID NO: 1046686 - RNA, 22 nt, Human
ccaaacuacugggauuacaggc

SEQ ID NO: 1046687 - RNA, 24 nt, Human
ccaaacuacugggauuacaggcgu

SEQ ID NO: 1046688 - RNA, 21 nt, Human
cccacaugcuagacuucaggu

SEQ ID NO: 1046689 - RNA, 21 nt, Human
cccacccucacauccuggguu

SEQ ID NO: 1046690 - RNA, 23 nt, Human
ccccuguagccugugccaggcug

SEQ ID NO: 1046691 - RNA, 19 nt, Human
ccccuuuccuucugcccca

SEQ ID NO: 1046692 - RNA, 21 nt, Human
cccucacauccuggguucuau

SEQ ID NO: 1046693 - RNA, 22 nt, Human
cccuguuuucucuuccaguccc

SEQ ID NO: 1046694 - RNA, 18 nt, Human
ccgccucccagguucaac

SEQ ID NO: 1046695 - RNA, 24 nt, Human
ccggguuucgucauguuggccagg

SEQ ID NO: 1046696 - RNA, 21 nt, Human
ccucccaccagacccugcucc

SEQ ID NO: 1046697 - RNA, 24 nt, Human
ccucccagguucaacggauucucc

SEQ ID NO: 1046698 - RNA, 23 nt, Human
ccuccuccuucccuuuccuccca

SEQ ID NO: 1046699 - RNA, 19 nt, Human
ccuccuucccuuuccuccc

SEQ ID NO: 1046700 - RNA, 19 nt, Human
ccucgcccagccuggauga

SEQ ID NO: 1046701 - RNA, 26 nt, Human
ccucuggaagaaccacugaaagcgag

SEQ ID NO: 1046702 - RNA, 22 nt, Human
ccugaccucaggugaucugccc

SEQ ID NO: 1046703 - RNA, 19 nt, Human
ccugggauguccuucuccc

SEQ ID NO: 1046704 - RNA, 19 nt, Human
ccuucugccccaccccugu

SEQ ID NO: 1046705 - RNA, 23 nt, Human
ccuucugccccaccccuguagcc

SEQ ID NO: 1046706 - RNA, 21 nt, Human
cgggauuacaggcaccugcca

SEQ ID NO: 1046707 - RNA, 22 nt, Human
cgggauuacaggcaccugccac

SEQ ID NO: 1046708 - RNA, 24 nt, Human
cgggauuacaggcaccugccacca

SEQ ID NO: 1046709 - RNA, 22 nt, Human
cggguuucgucauguuggccag

SEQ ID NO: 1046710 - RNA, 23 nt, Human
cggguuucgucauguuggccagg

SEQ ID NO: 1046711 - RNA, 27 nt, Human
cgucauguuggccaggcuggucuaaaa

SEQ ID NO: 1046712 - RNA, 21 nt, Human
cucccaaacuacugggauuac

SEQ ID NO: 1046713 - RNA, 21 nt, Human
cucccacaugcuagacuucag

SEQ ID NO: 1046714 - RNA, 21 nt, Human
cucccaccucggccuucugaa

SEQ ID NO: 1046715 - RNA, 23 nt, Human
cucccagguucaacggauucucc

SEQ ID NO: 1046716 - RNA, 26 nt, Human
cuccugaccucaggugaucugcccgc

SEQ ID NO: 1046717 - RNA, 23 nt, Human
cuccugggcagccuuagccuccu

SEQ ID NO: 1046718 - RNA, 18 nt, Human
cuccuuggaccacuggcg

SEQ ID NO: 1046719 - RNA, 24 nt, Human
cuggacugaggccucuuugcaagc

SEQ ID NO: 1046720 - RNA, 27 nt, Human
cuuccagucccuucucuuaggggccgc

SEQ ID NO: 1046721 - RNA, 24 nt, Human
cuucugaauagccgggauuacagg

SEQ ID NO: 1046722 - RNA, 24 nt, Human
gaagcccuggagguuaccagcucc

SEQ ID NO: 1046723 - RNA, 25 nt, Human
gaauagccgggauuacaggcaccug

SEQ ID NO: 1046724 - RNA, 24 nt, Human
gacccuguuuucucuuccaguccc

SEQ ID NO: 1046725 - RNA, 23 nt, Human
gaccucaggugaucugcccgccu

SEQ ID NO: 1046726 - RNA, 24 nt, Human
gauuacaggcaccugccaccaugc

SEQ ID NO: 1046727 - RNA, 18 nt, Human
gauuacaggcgugagcca

SEQ ID NO: 1046728 - RNA, 20 nt, Human
gauuacaggcgugagccacc

SEQ ID NO: 1046729 - RNA, 20 nt, Human
gauuacaggcgugagccacc

SEQ ID NO: 1046730 - RNA, 21 nt, Human
gcacuuuugacaucugggguc

SEQ ID NO: 1046731 - RNA, 18 nt, Human
gccuccuccuucccuuuc

SEQ ID NO: 1046732 - RNA, 24 nt, Human
gccugguauccaaggccuccuggg

SEQ ID NO: 1046733 - RNA, 23 nt, Human
gcuggucuaaaacuccugaccuc

SEQ ID NO: 1046734 - RNA, 21 nt, Human
ggauucucccaccucggccuu

SEQ ID NO: 1046735 - RNA, 24 nt, Human
ggcuggucuaaaacuccugaccuc

SEQ ID NO: 1046736 - RNA, 23 nt, Human
gggauuacaggcaccugccacca

SEQ ID NO: 1046737 - RNA, 24 nt, Human
gggauuacaggcaccugccaccau

SEQ ID NO: 1046738 - RNA, 22 nt, Human
ggggcagagaaaugcccagcuc

SEQ ID NO: 1046739 - RNA, 23 nt, Human
guauccaaggccuccugggcagc

SEQ ID NO: 1046740 - RNA, 20 nt, Human
gugcauccgcuccaccccca

SEQ ID NO: 1046741 - RNA, 23 nt, Human
uaaaaagaaaaaaguuggggggc

SEQ ID NO: 1046742 - RNA, 24 nt, Human
uaaaaagaaaaaaguuggggggca

SEQ ID NO: 1046743 - RNA, 24 nt, Human
uaauuuuuguauuuuuaguagaga

SEQ ID NO: 1046744 - RNA, 22 nt, Human
uacaggcaccugccaccaugcc

SEQ ID NO: 1046745 - RNA, 18 nt, Human
uacaggcgugagccaccu

SEQ ID NO: 1046746 - RNA, 25 nt, Human
uaccucccccuguugggacgacccu

SEQ ID NO: 1046747 - RNA, 24 nt, Human
uacugggauuacaggcgugagcca

SEQ ID NO: 1046748 - RNA, 24 nt, Human
uaguagagaccggguuucgucaug

SEQ ID NO: 1046749 - RNA, 19 nt, Human
uaucuuguccccuuuccuu

SEQ ID NO: 1046750 - RNA, 27 nt, Human
uaucuuguccccuuuccuucugcccca

SEQ ID NO: 1046751 - RNA, 23 nt, Human
ucacaaccuccgccucccagguu

SEQ ID NO: 1046752 - RNA, 24 nt, Human
ucacaaccuccgccucccagguuc

SEQ ID NO: 1046753 - RNA, 26 nt, Human
ucagccucccacaugcuagacuucag

SEQ ID NO: 1046754 - RNA, 19 nt, Human
ucaggugucuguugaacuu

SEQ ID NO: 1046755 - RNA, 22 nt, Human
ucaguacugagauccaucaagu

SEQ ID NO: 1046756 - RNA, 24 nt, Human
ucaucacaaccuccgccucccagg

SEQ ID NO: 1046757 - RNA, 25 nt, Human
ucaucacaaccuccgccucccaggu

SEQ ID NO: 1046758 - RNA, 27 nt, Human
ucaucccgcucuccuggaagccacuca

SEQ ID NO: 1046759 - RNA, 22 nt, Human
uccacccccacccucacauccu

SEQ ID NO: 1046760 - RNA, 19 nt, Human
uccagucccuucucuuagc

SEQ ID NO: 1046761 - RNA, 24 nt, Human
ucccaaacuacugggauuacaggc

SEQ ID NO: 1046762 - RNA, 21 nt, Human
ucccagguucaacggauucuc

SEQ ID NO: 1046763 - RNA, 22 nt, Human
ucccauuaccaccacaaaaucg

SEQ ID NO: 1046764 - RNA, 21 nt, Human
uccgcuccacccccacccuca

SEQ ID NO: 1046765 - RNA, 19 nt, Human
uccgggucuccuacuccag

SEQ ID NO: 1046766 - RNA, 20 nt, Human
uccuccuucccuuuccuccc

SEQ ID NO: 1046767 - RNA, 19 nt, Human
uccugggcagccuuagccu

SEQ ID NO: 1046768 - RNA, 21 nt, Human
uccuuggaccacuggcggcac

SEQ ID NO: 1046769 - RNA, 23 nt, Human
ucgcccagccuggaugaaggugu

SEQ ID NO: 1046770 - RNA, 22 nt, Human
ucgucauguuggccaggcuggu

SEQ ID NO: 1046771 - RNA, 25 nt, Human
ucuaaaacuccugaccucaggugau

SEQ ID NO: 1046772 - RNA, 23 nt, Human
ucucccauuaccaccacaaaauc

SEQ ID NO: 1046773 - RNA, 24 nt, Human
ucugaauagccgggauuacaggca

SEQ ID NO: 1046774 - RNA, 23 nt, Human
ucugucacaccaggcagaggcug

SEQ ID NO: 1046775 - RNA, 18 nt, Human
ugaccucaggugaucugc

SEQ ID NO: 1046776 - RNA, 20 nt, Human
ugaccucaggugaucugccc

SEQ ID NO: 1046777 - RNA, 24 nt, Human
ugaccucaggugaucugcccgccu

SEQ ID NO: 1046778 - RNA, 18 nt, Human
ugcaacggccgcucaaaa

SEQ ID NO: 1046779 - RNA, 24 nt, Human
ugcaguguuuagcagcguaccuga

SEQ ID NO: 1046780 - RNA, 18 nt, Human
ugcauccgcuccaccccc

SEQ ID NO: 1046781 - RNA, 20 nt, Human
ugccaggcugugacccuggu

SEQ ID NO: 1046782 - RNA, 22 nt, Human
ugccccaccccuguagccugug

SEQ ID NO: 1046783 - RNA, 20 nt, Human
uggaagaaccacugaaagcg

SEQ ID NO: 1046784 - RNA, 23 nt, Human
uggaagaaccacugaaagcgagu

SEQ ID NO: 1046785 - RNA, 21 nt, Human
uggaagccacucaggacccca

SEQ ID NO: 1046786 - RNA, 22 nt, Human
uggacugaggccucuuugcaag

SEQ ID NO: 1046787 - RNA, 22 nt, Human
uggaugaagguguuuucaaagc

SEQ ID NO: 1046788 - RNA, 18 nt, Human
uggcagggcucauggccc

SEQ ID NO: 1046789 - RNA, 24 nt, Human
uggccaggcuggucuaaaacuccu

SEQ ID NO: 1046790 - RNA, 22 nt, Human
uggcggcacuuuccuuggaccu

SEQ ID NO: 1046791 - RNA, 19 nt, Human
ugggagcugcaguguuuag

SEQ ID NO: 1046792 - RNA, 18 nt, Human
ugggauuacaggcgugag

SEQ ID NO: 1046793 - RNA, 19 nt, Human
ugggauuacaggcgugagc

SEQ ID NO: 1046794 - RNA, 21 nt, Human
ugggauuacaggcgugagcca

SEQ ID NO: 1046795 - RNA, 22 nt, Human
ugggauuacaggcgugagccac

SEQ ID NO: 1046796 - RNA, 23 nt, Human
ugggauuacaggcgugagccacc

SEQ ID NO: 1046797 - RNA, 23 nt, Human
ugggauuacaggcgugagccacc

SEQ ID NO: 1046798 - RNA, 26 nt, Human
ugggauuacaggcgugagccaccucg

SEQ ID NO: 1046799 - RNA, 27 nt, Human
ugggauuacaggcgugagccaccucgc

SEQ ID NO: 1046800 - RNA, 23 nt, Human
uggucuaaaacuccugaccucag

SEQ ID NO: 1046801 - RNA, 23 nt, Human
uguccugccuuguccuggaguug

SEQ ID NO: 1046802 - RNA, 25 nt, Human
uguuuucucuuccagucccuucucu

SEQ ID NO: 1046803 - RNA, 21 nt, Human
uuaguagagaccggguuucgu

SEQ ID NO: 1046804 - RNA, 24 nt, Human
uuaguagagaccggguuucgucau

SEQ ID NO: 1046805 - RNA, 23 nt, Human
uucccagcuccauccucagccuc

SEQ ID NO: 1046806 - RNA, 19 nt, Human
uuccuuggaccugcuuuau

SEQ ID NO: 1046807 - RNA, 20 nt, Human
uuggaccugcuuuauaaucu

SEQ ID NO: 1046808 - RNA, 23 nt, Human
uuggcaguccuccgugaccuucc

SEQ ID NO: 1046809 - RNA, 24 nt, Human
uuucgucauguuggccaggcuggu

SEQ ID NO: 1046810 - RNA, 22 nt, Human
uuuuccaaaauuuuacaacaaa

SEQ ID NO: 1046811 - RNA, 24 nt, Human
uuuuuaguagagaccggguuucgu

SEQ ID NO: 1046812 - RNA, 20 nt, Human
uuuuuguauuuuuaguagag

SEQ ID NO: 1046813 - RNA, 20 nt, Human
agcuuugguaccuggccgau

SEQ ID NO: 1046814 - RNA, 19 nt, Human
cacccaucugcccagccag

SEQ ID NO: 1046815 - RNA, 24 nt, Human
ccagccaaucagagucuccagaau

SEQ ID NO: 1046816 - RNA, 21 nt, Human
gaacucacccacccaucugcc

SEQ ID NO: 1046817 - RNA, 21 nt, Human
gauggcucuggggagagggaa

SEQ ID NO: 1046818 - RNA, 23 nt, Human
gggaacucacccacccaucugcc

SEQ ID NO: 1046819 - RNA, 20 nt, Human
ucauagcaugacauccaggu

SEQ ID NO: 1046820 - RNA, 19 nt, Human
ugucaauaccaccuuccuu

SEQ ID NO: 1046821 - RNA, 20 nt, Human
cuguggguuucaccagaucc

SEQ ID NO: 1046822 - RNA, 26 nt, Human
uaacugagaauaaagcuaucaugcag

SEQ ID NO: 1046823 - RNA, 19 nt, Human
uauuauauuuauccuucca

SEQ ID NO: 1046824 - RNA, 22 nt, Human
ucagguguuucuguggguuuca

SEQ ID NO: 1046825 - RNA, 22 nt, Human
ugacuggagccuugaucaaacu

SEQ ID NO: 1046826 - RNA, 22 nt, Human
uuaaaaccagucagaaguaucc

SEQ ID NO: 1046827 - RNA, 22 nt, Human
uugaaagccacucuaccacuag

SEQ ID NO: 1046828 - RNA, 22 nt, Human
agggaaacagugcuuuccugga

SEQ ID NO: 1046829 - RNA, 20 nt, Human
uaagcagcagcucuaggaac

SEQ ID NO: 1046830 - RNA, 19 nt, Human
ugagggaaacagugcuuuc

SEQ ID NO: 1046831 - RNA, 18 nt, Human
ugauacaccacugcacac

SEQ ID NO: 1046832 - RNA, 23 nt, Human
ugauacaccacugcacacauggu

SEQ ID NO: 1046833 - RNA, 23 nt, Human
aaugaaaugaaacuucuuuuuga

SEQ ID NO: 1046834 - RNA, 21 nt, Human
aauguauaagcauauauuuua

SEQ ID NO: 1046835 - RNA, 21 nt, Human
acagucauugcauucaaaagg

SEQ ID NO: 1046836 - RNA, 20 nt, Human
agaaacacugucaugcccau

SEQ ID NO: 1046837 - RNA, 26 nt, Human
caaaagguuuuuuccuuguaugauuu

SEQ ID NO: 1046838 - RNA, 27 nt, Human
caaagggucucucuccauuaugaauuu

SEQ ID NO: 1046839 - RNA, 19 nt, Human
cagaaacacugucaugccc

SEQ ID NO: 1046840 - RNA, 18 nt, Human
cagaacaugauuggcauu

SEQ ID NO: 1046841 - RNA, 19 nt, Human
cagaauacaagugccuuuc

SEQ ID NO: 1046842 - RNA, 21 nt, Human
cauuaugaauuuucugaugag

SEQ ID NO: 1046843 - RNA, 23 nt, Human
cccacaaucauugcacacaaagg

SEQ ID NO: 1046844 - RNA, 20 nt, Human
ccucaacugaauacuuacug

SEQ ID NO: 1046845 - RNA, 24 nt, Human
cuucccacaaucauugcacacaaa

SEQ ID NO: 1046846 - RNA, 24 nt, Human
cuucucauauucauaaagugaaua

SEQ ID NO: 1046847 - RNA, 23 nt, Human
guaauacagaauacaagugccuu

SEQ ID NO: 1046848 - RNA, 23 nt, Human
gugccagcaaauggaugaaaaua

SEQ ID NO: 1046849 - RNA, 22 nt, Human
gugccuuucucuccucaauuag

SEQ ID NO: 1046850 - RNA, 20 nt, Human
uaaauuagguggcaaacacu

SEQ ID NO: 1046851 - RNA, 19 nt, Human
uaauaaggccuucucauau

SEQ ID NO: 1046852 - RNA, 20 nt, Human
uagcaaauauuuaauaaggc

SEQ ID NO: 1046853 - RNA, 21 nt, Human
uauuauaaaaauuaaaaguca

SEQ ID NO: 1046854 - RNA, 22 nt, Human
ucaugcccauuaaaagugccag

SEQ ID NO: 1046855 - RNA, 24 nt, Human
ugcaaggugugccuuccugcuaua

SEQ ID NO: 1046856 - RNA, 24 nt, Human
uguaaaaaguuuauuaucacuucc

SEQ ID NO: 1046857 - RNA, 21 nt, Human
ugucuaaugaaaugaaacuuc

SEQ ID NO: 1046858 - RNA, 23 nt, Human
ugucuuguuuuuuguucugguau

SEQ ID NO: 1046859 - RNA, 24 nt, Human
uuacuguaauacagaauacaagug

SEQ ID NO: 1046860 - RNA, 24 nt, Human
uuccugcuauaggcuuuuccacag

SEQ ID NO: 1046861 - RNA, 24 nt, Human
uuucccgcauucacugcauucaua

SEQ ID NO: 1046862 - RNA, 22 nt, Human
aaaaaaugaaaacaacaauacc

SEQ ID NO: 1046863 - RNA, 18 nt, Human
aaacagccacaaauaaca

SEQ ID NO: 1046864 - RNA, 21 nt, Human
aaacagccacaaauaacacag

SEQ ID NO: 1046865 - RNA, 21 nt, Human
aaaccacaauuacuuuugcac

SEQ ID NO: 1046866 - RNA, 25 nt, Human
aaacuaaacagacgcuuccucccag

SEQ ID NO: 1046867 - RNA, 22 nt, Human
aaagccuuuuugauaagggaaa

SEQ ID NO: 1046868 - RNA, 19 nt, Human
aaagcgcugggauuauagg

SEQ ID NO: 1046869 - RNA, 24 nt, Human
aaagcgcugggauuauaggcauga

SEQ ID NO: 1046870 - RNA, 20 nt, Human
aaauuucaccaacuguaccc

SEQ ID NO: 1046871 - RNA, 24 nt, Human
aacacagccugcuuuccaaaucuc

SEQ ID NO: 1046872 - RNA, 19 nt, Human
aaccuaaucaaaccaccag

SEQ ID NO: 1046873 - RNA, 21 nt, Human
aacgugcuccagucuccccua

SEQ ID NO: 1046874 - RNA, 23 nt, Human
aagccuuuuugauaagggaaaga

SEQ ID NO: 1046875 - RNA, 19 nt, Human
aagcgcugggauuauaggc

SEQ ID NO: 1046876 - RNA, 20 nt, Human
aaggagaaaacagccacaaa

SEQ ID NO: 1046877 - RNA, 22 nt, Human
aaggagaaaacagccacaaaua

SEQ ID NO: 1046878 - RNA, 23 nt, Human
aagguaggcaauaauguuagucc

SEQ ID NO: 1046879 - RNA, 20 nt, Human
aaguagcugggauuacaggc

SEQ ID NO: 1046880 - RNA, 26 nt, Human
aaguagcugggauuacaggcgccugc

SEQ ID NO: 1046881 - RNA, 19 nt, Human
aaucuccaaagcacaucuc

SEQ ID NO: 1046882 - RNA, 19 nt, Human
aaugaagcacauuccugca

SEQ ID NO: 1046883 - RNA, 20 nt, Human
acagacaggguuucgccaug

SEQ ID NO: 1046884 - RNA, 18 nt, Human
acaggguuucgccauguu

SEQ ID NO: 1046885 - RNA, 21 nt, Human
acaggguuucgccauguuggc

SEQ ID NO: 1046886 - RNA, 24 nt, Human
acaggguuucgccauguuggccag

SEQ ID NO: 1046887 - RNA, 19 nt, Human
acaugaagcuugcuacuuc

SEQ ID NO: 1046888 - RNA, 18 nt, Human
accccuucucaacucaaa

SEQ ID NO: 1046889 - RNA, 18 nt, Human
acccugaggugugggagg

SEQ ID NO: 1046890 - RNA, 20 nt, Human
accucagccuuccaaguagc

SEQ ID NO: 1046891 - RNA, 23 nt, Human
acuccaccuuuuguuuuagaaaa

SEQ ID NO: 1046892 - RNA, 24 nt, Human
acucuguugcccaggcuggagugc

SEQ ID NO: 1046893 - RNA, 22 nt, Human
acugcagccuccaucucccagg

SEQ ID NO: 1046894 - RNA, 22 nt, Human
acugcagcuaaugaagcacauu

SEQ ID NO: 1046895 - RNA, 22 nt, Human
agaaaacagccacaaauaacac

SEQ ID NO: 1046896 - RNA, 18 nt, Human
agacaggguuucgccaug

SEQ ID NO: 1046897 - RNA, 25 nt, Human
agagaaguaagcaauauuuuuacaa

SEQ ID NO: 1046898 - RNA, 23 nt, Human
agaugucuauggggcaucuagga

SEQ ID NO: 1046899 - RNA, 19 nt, Human
agauuacaaacgugcucca

SEQ ID NO: 1046900 - RNA, 18 nt, Human
agcaaagagaacagacag

SEQ ID NO: 1046901 - RNA, 19 nt, Human
agcaaaugcaaagaaguaa

SEQ ID NO: 1046902 - RNA, 18 nt, Human
agccacaaauaacacagc

SEQ ID NO: 1046903 - RNA, 19 nt, Human
agccacaaauaacacagcc

SEQ ID NO: 1046904 - RNA, 18 nt, Human
agccucacuuuucucaug

SEQ ID NO: 1046905 - RNA, 19 nt, Human
agccucaggcucccauuug

SEQ ID NO: 1046906 - RNA, 18 nt, Human
agcgcugggauuauaggc

SEQ ID NO: 1046907 - RNA, 22 nt, Human
aggcagcaccagcgcacugcag

SEQ ID NO: 1046908 - RNA, 25 nt, Human
aggcuggagugcagugguacaaucu

SEQ ID NO: 1046909 - RNA, 20 nt, Human
aggcuuucagccagagagcc

SEQ ID NO: 1046910 - RNA, 22 nt, Human
agguaucagcuccuccaggaag

SEQ ID NO: 1046911 - RNA, 20 nt, Human
aguaauggcaaaaaccacaa

SEQ ID NO: 1046912 - RNA, 20 nt, Human
agugcagugguacaaucuug

SEQ ID NO: 1046913 - RNA, 24 nt, Human
agugcagugguacaaucuuggcuu

SEQ ID NO: 1046914 - RNA, 19 nt, Human
auacuguacauccacaacc

SEQ ID NO: 1046915 - RNA, 25 nt, Human
auagagcaaagagaacagacagggg

SEQ ID NO: 1046916 - RNA, 18 nt, Human
aucacccuuucaccaugu

SEQ ID NO: 1046917 - RNA, 26 nt, Human
aucacccuuucaccauguugggugaa

SEQ ID NO: 1046918 - RNA, 18 nt, Human
aucucuccccuucuacca

SEQ ID NO: 1046919 - RNA, 24 nt, Human
caaagcgcugggauuauaggcaug

SEQ ID NO: 1046920 - RNA, 24 nt, Human
caaaugcaaagaaguaauauauua

SEQ ID NO: 1046921 - RNA, 23 nt, Human
caaccagucacucaacuauccaa

SEQ ID NO: 1046922 - RNA, 23 nt, Human
caaccucguaggcucccaagccc

SEQ ID NO: 1046923 - RNA, 19 nt, Human
caacgcagaaggucuucca

SEQ ID NO: 1046924 - RNA, 24 nt, Human
caacuaucaccacugaaggcuuuc

SEQ ID NO: 1046925 - RNA, 25 nt, Human
caacuguaccccuucucaacucaaa

SEQ ID NO: 1046926 - RNA, 27 nt, Human
caagcgauucucauaccucagccuucc

SEQ ID NO: 1046927 - RNA, 21 nt, Human
caagcuuccuucccuucagca

SEQ ID NO: 1046928 - RNA, 21 nt, Human
cacaugcaucaaggagaaaac

SEQ ID NO: 1046929 - RNA, 24 nt, Human
cacauuccugcaggccugucuccu

SEQ ID NO: 1046930 - RNA, 21 nt, Human
caccaaccuaaucaaaccacc

SEQ ID NO: 1046931 - RNA, 22 nt, Human
cacucuguugcccaggcuggag

SEQ ID NO: 1046932 - RNA, 24 nt, Human
cagagucucacucuguugcccagg

SEQ ID NO: 1046933 - RNA, 24 nt, Human
cagauaucuccacuucuggguuuu

SEQ ID NO: 1046934 - RNA, 24 nt, Human
cagccagcaucagccaucacccaa

SEQ ID NO: 1046935 - RNA, 22 nt, Human
cagccaucacccaaacucaaaa

SEQ ID NO: 1046936 - RNA, 23 nt, Human
cagccuccaucucccagguucaa

SEQ ID NO: 1046937 - RNA, 22 nt, Human
cagcgaaccacauuccccagaa

SEQ ID NO: 1046938 - RNA, 25 nt, Human
caggcgccugccaucauaucugggg

SEQ ID NO: 1046939 - RNA, 24 nt, Human
caggguuucgccauguuggccagg

SEQ ID NO: 1046940 - RNA, 20 nt, Human
cagugaacgaacuccaccuu

SEQ ID NO: 1046941 - RNA, 21 nt, Human
cauaucuggcuaauuuuugua

SEQ ID NO: 1046942 - RNA, 18 nt, Human
caucaaggagaaaacagc

SEQ ID NO: 1046943 - RNA, 24 nt, Human
caucaaggagaaaacagccacaaa

SEQ ID NO: 1046944 - RNA, 20 nt, Human
caugcaucaaggagaaaaca

SEQ ID NO: 1046945 - RNA, 23 nt, Human
cauguuggccaggcugguuucaa

SEQ ID NO: 1046946 - RNA, 21 nt, Human
ccaaagcacaucucugcaauc

SEQ ID NO: 1046947 - RNA, 24 nt, Human
ccaaagcgcugggauuauaggcau

SEQ ID NO: 1046948 - RNA, 22 nt, Human
ccaaguagcugggauuacaggc

SEQ ID NO: 1046949 - RNA, 23 nt, Human
ccacagcgaaccacauuccccag

SEQ ID NO: 1046950 - RNA, 24 nt, Human
ccaccaggacuugguuggcugagg

SEQ ID NO: 1046951 - RNA, 25 nt, Human
ccagcaucagccaucacccaaacuc

SEQ ID NO: 1046952 - RNA, 19 nt, Human
ccagggcgguaguuccucu

SEQ ID NO: 1046953 - RNA, 24 nt, Human
ccagggcgguaguuccucugaaga

SEQ ID NO: 1046954 - RNA, 23 nt, Human
ccaugggaaaaucuagcacagcc

SEQ ID NO: 1046955 - RNA, 19 nt, Human
ccauguuggccaggcuggu

SEQ ID NO: 1046956 - RNA, 18 nt, Human
ccccacuuccuugagucu

SEQ ID NO: 1046957 - RNA, 19 nt, Human
cccugguagcugcuguugg

SEQ ID NO: 1046958 - RNA, 18 nt, Human
cccuucuccccuugcuuu

SEQ ID NO: 1046959 - RNA, 19 nt, Human
ccggccucaaccuuuucau

SEQ ID NO: 1046960 - RNA, 20 nt, Human
ccuaaacugagagcgccagc

SEQ ID NO: 1046961 - RNA, 21 nt, Human
ccucaucuccagcuacucucc

SEQ ID NO: 1046962 - RNA, 21 nt, Human
ccucgcgccucugggccacag

SEQ ID NO: 1046963 - RNA, 21 nt, Human
ccugaccucaggugaucugcc

SEQ ID NO: 1046964 - RNA, 23 nt, Human
ccugaccucaggugaucugccug

SEQ ID NO: 1046965 - RNA, 20 nt, Human
ccugccaguguccucuacuc

SEQ ID NO: 1046966 - RNA, 21 nt, Human
ccugccucgaccucccaaagc

SEQ ID NO: 1046967 - RNA, 22 nt, Human
ccuugaguaaguuacuauaccu

SEQ ID NO: 1046968 - RNA, 22 nt, Human
ccuugagucuucuacauuccuc

SEQ ID NO: 1046969 - RNA, 18 nt, Human
ccuugaguuccuagcugg

SEQ ID NO: 1046970 - RNA, 24 nt, Human
cgccauguuggccaggcugguuuc

SEQ ID NO: 1046971 - RNA, 31 nt, Human
cgccauguuggccaggcugguuucaaacucc

SEQ ID NO: 1046972 - RNA, 20 nt, Human
cuaauuuuuguauuuuuaga

SEQ ID NO: 1046973 - RNA, 19 nt, Human
cucaagacccuucaaaccu

SEQ ID NO: 1046974 - RNA, 24 nt, Human
cucacucuguugcccaggcuggag

SEQ ID NO: 1046975 - RNA, 23 nt, Human
cucagccuuccaaguagcuggga

SEQ ID NO: 1046976 - RNA, 18 nt, Human
cucagugugugggcaaga

SEQ ID NO: 1046977 - RNA, 26 nt, Human
cuccugaccucaggugaucugccugc

SEQ ID NO: 1046978 - RNA, 23 nt, Human
cuccugccucaucuccagcuacu

SEQ ID NO: 1046979 - RNA, 23 nt, Human
cugcagccuccaucucccagguu

SEQ ID NO: 1046980 - RNA, 22 nt, Human
cuguacauccacaaccagucac

SEQ ID NO: 1046981 - RNA, 21 nt, Human
cuuacugcagccuccaucucc

SEQ ID NO: 1046982 - RNA, 24 nt, Human
cuucaaaucagucuaacgccuuca

SEQ ID NO: 1046983 - RNA, 20 nt, Human
cuuccugucucccuacccca

SEQ ID NO: 1046984 - RNA, 19 nt, Human
cuugguuggcugagggugg

SEQ ID NO: 1046985 - RNA, 22 nt, Human
cuuucagauuacaaacgugcuc

SEQ ID NO: 1046986 - RNA, 24 nt, Human
cuuucagccagagagcaauuuguu

SEQ ID NO: 1046987 - RNA, 18 nt, Human
cuuuucaacucaucuucc

SEQ ID NO: 1046988 - RNA, 18 nt, Human
gaacggcagagacaggcc

SEQ ID NO: 1046989 - RNA, 24 nt, Human
gaccucaggugaucugccugccuc

SEQ ID NO: 1046990 - RNA, 20 nt, Human
gacuugguuggcugagggug

SEQ ID NO: 1046991 - RNA, 20 nt, Human
gagaaaacagccacaaauaa

SEQ ID NO: 1046992 - RNA, 21 nt, Human
gagauagacaauaaagaaaua

SEQ ID NO: 1046993 - RNA, 20 nt, Human
gagccucacuuuucucaugg

SEQ ID NO: 1046994 - RNA, 20 nt, Human
gagccucacuuuucucaugu

SEQ ID NO: 1046995 - RNA, 21 nt, Human
gagugucuggcuugcugguac

SEQ ID NO: 1046996 - RNA, 18 nt, Human
gauuacaggcgccugcca

SEQ ID NO: 1046997 - RNA, 24 nt, Human
gauuacaggcgccugccaucauau

SEQ ID NO: 1046998 - RNA, 18 nt, Human
gauuauaggcaugaacca

SEQ ID NO: 1046999 - RNA, 23 nt, Human
gauuauaggcaugaaccaaugca

SEQ ID NO: 1047000 - RNA, 19 nt, Human
gauucucauaccucagccu

SEQ ID NO: 1047001 - RNA, 22 nt, Human
gcagccuccaucucccagguuc

SEQ ID NO: 1047002 - RNA, 20 nt, Human
gcccaggcuggagugcagug

SEQ ID NO: 1047003 - RNA, 21 nt, Human
gccucugggccacagcgaacc

SEQ ID NO: 1047004 - RNA, 22 nt, Human
gcuccgaguuacuucucagugu

SEQ ID NO: 1047005 - RNA, 28 nt, Human
gcucugggaagaagggguaguuggcugg

SEQ ID NO: 1047006 - RNA, 23 nt, Human
gcugguuucaaacuccugaccuc

SEQ ID NO: 1047007 - RNA, 21 nt, Human
gcuuacugcagccuccaucuc

SEQ ID NO: 1047008 - RNA, 21 nt, Human
ggcccagggcuggaaccgucc

SEQ ID NO: 1047009 - RNA, 24 nt, Human
ggcugguuucaaacuccugaccuc

SEQ ID NO: 1047010 - RNA, 18 nt, Human
gggaagaagggguaguug

SEQ ID NO: 1047011 - RNA, 23 nt, Human
gggaagaagggguaguuggcugg

SEQ ID NO: 1047012 - RNA, 21 nt, Human
ggggucuaggcugacuccuug

SEQ ID NO: 1047013 - RNA, 22 nt, Human
ggguuucgccauguuggccagg

SEQ ID NO: 1047014 - RNA, 18 nt, Human
gugaucugccugccucga

SEQ ID NO: 1047015 - RNA, 23 nt, Human
uaaucuaauccccacuuccuuga

SEQ ID NO: 1047016 - RNA, 24 nt, Human
uaauuuuuguauuuuuaguacaga

SEQ ID NO: 1047017 - RNA, 22 nt, Human
uacagacaggguuucgccaugu

SEQ ID NO: 1047018 - RNA, 22 nt, Human
uaccacagugcugggcccaggg

SEQ ID NO: 1047019 - RNA, 19 nt, Human
uaccccuucucaacucaaa

SEQ ID NO: 1047020 - RNA, 24 nt, Human
uaccucagccuuccaaguagcugg

SEQ ID NO: 1047021 - RNA, 18 nt, Human
uacuuuuuucuacugcag

SEQ ID NO: 1047022 - RNA, 19 nt, Human
uacuuuuuucuacugcagu

SEQ ID NO: 1047023 - RNA, 22 nt, Human
uagcaaccguauggcgcuuccu

SEQ ID NO: 1047024 - RNA, 20 nt, Human
uaggcaugaaccaaugcacc

SEQ ID NO: 1047025 - RNA, 18 nt, Human
uagggcucuccgaauccu

SEQ ID NO: 1047026 - RNA, 19 nt, Human
uagggcucuccgaauccuc

SEQ ID NO: 1047027 - RNA, 24 nt, Human
uaguacagacaggguuucgccaug

SEQ ID NO: 1047028 - RNA, 18 nt, Human
uauaacagggaacagaac

SEQ ID NO: 1047029 - RNA, 21 nt, Human
uauacaccuaccccacagaau

SEQ ID NO: 1047030 - RNA, 21 nt, Human
uauauaaagauccagguaaag

SEQ ID NO: 1047031 - RNA, 22 nt, Human
ucaaauagacccggauuuugaa

SEQ ID NO: 1047032 - RNA, 23 nt, Human
ucaaaucagucuaacgccuucac

SEQ ID NO: 1047033 - RNA, 21 nt, Human
ucaacucaucuuccuuuuuuu

SEQ ID NO: 1047034 - RNA, 23 nt, Human
ucaccaacuguaccccuucucaa

SEQ ID NO: 1047035 - RNA, 24 nt, Human
ucacucuguugcccaggcuggagu

SEQ ID NO: 1047036 - RNA, 25 nt, Human
ucaguauacaccuaccccacagaau

SEQ ID NO: 1047037 - RNA, 20 nt, Human
uccaaaucuccaaagcacau

SEQ ID NO: 1047038 - RNA, 23 nt, Human
uccaaguagcugggauuacaggc

SEQ ID NO: 1047039 - RNA, 23 nt, Human
uccaaguagcugggauuacaggc

SEQ ID NO: 1047040 - RNA, 24 nt, Human
uccaaguagcugggauuacaggcg

SEQ ID NO: 1047041 - RNA, 24 nt, Human
ucccaaagcgcugggauuauaggc

SEQ ID NO: 1047042 - RNA, 19 nt, Human
ucccagguucaagcgauuc

SEQ ID NO: 1047043 - RNA, 21 nt, Human
ucccagguucaagcgauucuc

SEQ ID NO: 1047044 - RNA, 21 nt, Human
uccccuauccaaacuccugcc

SEQ ID NO: 1047045 - RNA, 19 nt, Human
uccuaaguuagcagaacuc

SEQ ID NO: 1047046 - RNA, 22 nt, Human
ucgccauguuggccaggcuggu

SEQ ID NO: 1047047 - RNA, 24 nt, Human
ucgccauguuggccaggcugguuu

SEQ ID NO: 1047048 - RNA, 25 nt, Human
ucuaaaaaaugaaaacaacaauacc

SEQ ID NO: 1047049 - RNA, 19 nt, Human
ucuacagagcccuaaacug

SEQ ID NO: 1047050 - RNA, 23 nt, Human
ucuaccagcucuuuccuuucaga

SEQ ID NO: 1047051 - RNA, 22 nt, Human
ucuauuaacuaacauuccccua

SEQ ID NO: 1047052 - RNA, 23 nt, Human
ucucacucuguugcccaggcugg

SEQ ID NO: 1047053 - RNA, 24 nt, Human
ucucacucuguugcccaggcugga

SEQ ID NO: 1047054 - RNA, 26 nt, Human
ucucacucuguugcccaggcuggagu

SEQ ID NO: 1047055 - RNA, 27 nt, Human
ucucacucuguugcccaggcuggagug

SEQ ID NO: 1047056 - RNA, 22 nt, Human
ucucccagguucaagcgauucu

SEQ ID NO: 1047057 - RNA, 18 nt, Human
ucugcacaugcaucaagg

SEQ ID NO: 1047058 - RNA, 18 nt, Human
ucuguugcccaggcugga

SEQ ID NO: 1047059 - RNA, 24 nt, Human
ucuguugcccaggcuggagugcag

SEQ ID NO: 1047060 - RNA, 28 nt, Human
ucuuccacauagccuauuaacacaaaag

SEQ ID NO: 1047061 - RNA, 26 nt, Human
ucuucuacagagcccuaaacugagag

SEQ ID NO: 1047062 - RNA, 23 nt, Human
ucuuuaaacaugaagcuugcuac

SEQ ID NO: 1047063 - RNA, 21 nt, Human
ugaaauauaguaguaacuuca

SEQ ID NO: 1047064 - RNA, 21 nt, Human
ugaaaucauccaaggcaacca

SEQ ID NO: 1047065 - RNA, 21 nt, Human
ugaaggcuuucagccagagag

SEQ ID NO: 1047066 - RNA, 18 nt, Human
ugaccucaggugaucugc

SEQ ID NO: 1047067 - RNA, 20 nt, Human
ugaccucaggugaucugccu

SEQ ID NO: 1047068 - RNA, 24 nt, Human
ugaccucaggugaucugccugccu

SEQ ID NO: 1047069 - RNA, 21 nt, Human
ugacuccuugaguuccuagcu

SEQ ID NO: 1047070 - RNA, 23 nt, Human
ugagaguagaugaaaucauccaa

SEQ ID NO: 1047071 - RNA, 21 nt, Human
ugcaacuggaacagcaaaugc

SEQ ID NO: 1047072 - RNA, 18 nt, Human
ugcccaggcuggagugca

SEQ ID NO: 1047073 - RNA, 21 nt, Human
ugcccaggcuggagugcagug

SEQ ID NO: 1047074 - RNA, 21 nt, Human
ugcccaggcuggagugcagug

SEQ ID NO: 1047075 - RNA, 22 nt, Human
ugcccaggcuggagugcagugg

SEQ ID NO: 1047076 - RNA, 24 nt, Human
ugccucgaccucccaaagcgcugg

SEQ ID NO: 1047077 - RNA, 21 nt, Human
ugccugccucgaccucccaaa

SEQ ID NO: 1047078 - RNA, 24 nt, Human
ugcucaagacccuucaaaccugau

SEQ ID NO: 1047079 - RNA, 21 nt, Human
uggaacagcaaaugcaaagaa

SEQ ID NO: 1047080 - RNA, 24 nt, Human
uggaacagcaaaugcaaagaagua

SEQ ID NO: 1047081 - RNA, 21 nt, Human
uggaaugucaucagcauguaa

SEQ ID NO: 1047082 - RNA, 23 nt, Human
uggagugcagugguacaaucuug

SEQ ID NO: 1047083 - RNA, 24 nt, Human
uggagugcagugguacaaucuugg

SEQ ID NO: 1047084 - RNA, 21 nt, Human
uggcauauucacagugaaauc

SEQ ID NO: 1047085 - RNA, 24 nt, Human
uggccaggcugguuucaaacuccu

SEQ ID NO: 1047086 - RNA, 24 nt, Human
uggcugagggugggagaugugggg

SEQ ID NO: 1047087 - RNA, 18 nt, Human
ugggagauguggggucua

SEQ ID NO: 1047088 - RNA, 21 nt, Human
ugggaggcuucgggccaguuc

SEQ ID NO: 1047089 - RNA, 19 nt, Human
ugggauuacaggcgccugc

SEQ ID NO: 1047090 - RNA, 21 nt, Human
ugggauuacaggcgccugcca

SEQ ID NO: 1047091 - RNA, 21 nt, Human
ugggauuacaggcgccugcca

SEQ ID NO: 1047092 - RNA, 22 nt, Human
ugggauuacaggcgccugccau

SEQ ID NO: 1047093 - RNA, 24 nt, Human
ugggauuacaggcgccugccauca

SEQ ID NO: 1047094 - RNA, 19 nt, Human
ugggauuauaggcaugaac

SEQ ID NO: 1047095 - RNA, 21 nt, Human
ugggauuauaggcaugaacca

SEQ ID NO: 1047096 - RNA, 21 nt, Human
ugggauuauaggcaugaacca

SEQ ID NO: 1047097 - RNA, 21 nt, Human
ugggauuauaggcaugaacca

SEQ ID NO: 1047098 - RNA, 24 nt, Human
ugggauuauaggcaugaaccaaug

SEQ ID NO: 1047099 - RNA, 31 nt, Human
ugggauuauaggcaugaaccaaugcacccgg

SEQ ID NO: 1047100 - RNA, 21 nt, Human
uggggaaagagcauugcaacu

SEQ ID NO: 1047101 - RNA, 25 nt, Human
uggggaaagagcauugcaacuggaa

SEQ ID NO: 1047102 - RNA, 25 nt, Human
ugggggcucuggagaccaacgcaga

SEQ ID NO: 1047103 - RNA, 21 nt, Human
ugggugagagaaguaagcaau

SEQ ID NO: 1047104 - RNA, 23 nt, Human
ugggugagagaaguaagcaauau

SEQ ID NO: 1047105 - RNA, 26 nt, Human
ugguagcugcuguuggcgcccuccag

SEQ ID NO: 1047106 - RNA, 22 nt, Human
ugguuggcugagggugggagau

SEQ ID NO: 1047107 - RNA, 23 nt, Human
ugucccaggcucuguuccagaug

SEQ ID NO: 1047108 - RNA, 27 nt, Human
ugucucccuaccccagcuucucuucca

SEQ ID NO: 1047109 - RNA, 21 nt, Human
ugugcguucuguuaggcagca

SEQ ID NO: 1047110 - RNA, 22 nt, Human
uguuagucccgucccuucuccc

SEQ ID NO: 1047111 - RNA, 24 nt, Human
uuacugcagccuccaucucccagg

SEQ ID NO: 1047112 - RNA, 20 nt, Human
uuagaaguaauggcaaaaac

SEQ ID NO: 1047113 - RNA, 22 nt, Human
uuagaugcuuauacuguacauc

SEQ ID NO: 1047114 - RNA, 24 nt, Human
uuagcagaacucuuugguucuuua

SEQ ID NO: 1047115 - RNA, 24 nt, Human
uuaguacagacaggguuucgccau

SEQ ID NO: 1047116 - RNA, 23 nt, Human
uucaagcgauucucauaccucag

SEQ ID NO: 1047117 - RNA, 24 nt, Human
uucaagcgauucucauaccucagc

SEQ ID NO: 1047118 - RNA, 19 nt, Human
uucauuuuaacauauauau

SEQ ID NO: 1047119 - RNA, 21 nt, Human
uucauuuuuaacagacuguag

SEQ ID NO: 1047120 - RNA, 24 nt, Human
uuccaaaucuccaaagcacaucuc

SEQ ID NO: 1047121 - RNA, 24 nt, Human
uuccaaguagcugggauuacaggc

SEQ ID NO: 1047122 - RNA, 18 nt, Human
uuccccuauccaaacucc

SEQ ID NO: 1047123 - RNA, 18 nt, Human
uuccucugaagaaacucc

SEQ ID NO: 1047124 - RNA, 18 nt, Human
uugaaggugauguuucug

SEQ ID NO: 1047125 - RNA, 19 nt, Human
uugaaggugauguuucugu

SEQ ID NO: 1047126 - RNA, 27 nt, Human
uuuaagacugaacacagguaucagcuc

SEQ ID NO: 1047127 - RNA, 25 nt, Human
uuucauuuuaacauauauauguaug

SEQ ID NO: 1047128 - RNA, 24 nt, Human
uuucgccauguuggccaggcuggu

SEQ ID NO: 1047129 - RNA, 25 nt, Human
uuuuaaauuucaccaacuguacccc

SEQ ID NO: 1047130 - RNA, 23 nt, Human
uuuuuaguacagacaggguuucg

SEQ ID NO: 1047131 - RNA, 24 nt, Human
uuuuuaguacagacaggguuucgc

SEQ ID NO: 1047132 - RNA, 20 nt, Human
uuuuuguauuuuuaguacag

SEQ ID NO: 1047133 - RNA, 23 nt, Human
uuuuuguauuuuuaguacagaca

SEQ ID NO: 1047134 - RNA, 24 nt, Human
aaagaauaaaaaauaaaggcaccc

SEQ ID NO: 1047135 - RNA, 24 nt, Human
aaaggcacccggaacuucccccac

SEQ ID NO: 1047136 - RNA, 20 nt, Human
aaagugccuguguccugcca

SEQ ID NO: 1047137 - RNA, 20 nt, Human
aaugcuuuuauauuaguuuu

SEQ ID NO: 1047138 - RNA, 18 nt, Human
acccggaacuucccccac

SEQ ID NO: 1047139 - RNA, 21 nt, Human
acccggaacuucccccacagg

SEQ ID NO: 1047140 - RNA, 19 nt, Human
acgcggcgaggcaggccac

SEQ ID NO: 1047141 - RNA, 19 nt, Human
acuccugccccaaggcccc

SEQ ID NO: 1047142 - RNA, 22 nt, Human
acuccugccccaaggccccagc

SEQ ID NO: 1047143 - RNA, 20 nt, Human
aggcacccggaacuuccccc

SEQ ID NO: 1047144 - RNA, 23 nt, Human
aggccccagcagcacccaggggg

SEQ ID NO: 1047145 - RNA, 22 nt, Human
agugggggugugacagagacug

SEQ ID NO: 1047146 - RNA, 21 nt, Human
auguguguguguguggugugu

SEQ ID NO: 1047147 - RNA, 21 nt, Human
caaggccccagcagcacccag

SEQ ID NO: 1047148 - RNA, 22 nt, Human
caccaaacucuaaguugccuuc

SEQ ID NO: 1047149 - RNA, 25 nt, Human
cacccggaacuucccccacaggccu

SEQ ID NO: 1047150 - RNA, 22 nt, Human
cacuccugccccaaggccccag

SEQ ID NO: 1047151 - RNA, 18 nt, Human
cagcagggggagggaaug

SEQ ID NO: 1047152 - RNA, 25 nt, Human
cagcuggguccuuccucccuggcuc

SEQ ID NO: 1047153 - RNA, 19 nt, Human
cagcuuugagauuuuuauc

SEQ ID NO: 1047154 - RNA, 19 nt, Human
cagggggcucucccauccu

SEQ ID NO: 1047155 - RNA, 23 nt, Human
cauguguguguguguggugugua

SEQ ID NO: 1047156 - RNA, 18 nt, Human
ccacugggcuugcccauu

SEQ ID NO: 1047157 - RNA, 24 nt, Human
ccagcagcacccagggggcucucc

SEQ ID NO: 1047158 - RNA, 22 nt, Human
ccaggccaggccagcaguccug

SEQ ID NO: 1047159 - RNA, 21 nt, Human
ccauuggaaaagugccugugu

SEQ ID NO: 1047160 - RNA, 21 nt, Human
cccaaggccccagcagcaccc

SEQ ID NO: 1047161 - RNA, 24 nt, Human
ccccaaggccccagcagcacccag

SEQ ID NO: 1047162 - RNA, 28 nt, Human
ccccaucaccucugcuucacuccugccc

SEQ ID NO: 1047163 - RNA, 24 nt, Human
cccccacaggccugaagaacaaag

SEQ ID NO: 1047164 - RNA, 20 nt, Human
ccuccuccucuuccuccucc

SEQ ID NO: 1047165 - RNA, 18 nt, Human
ccuccuccuuuuccuucc

SEQ ID NO: 1047166 - RNA, 24 nt, Human
ccuccuccuuuuccuuccccaagc

SEQ ID NO: 1047167 - RNA, 18 nt, Human
ccuccucuuccuccuccu

SEQ ID NO: 1047168 - RNA, 20 nt, Human
ccuccucuuccuccuccucc

SEQ ID NO: 1047169 - RNA, 21 nt, Human
ccuccucuuccuccuccuccu

SEQ ID NO: 1047170 - RNA, 22 nt, Human
cgcacaugacuugugcaugugu

SEQ ID NO: 1047171 - RNA, 26 nt, Human
cucagcccagccccaucaccgguucc

SEQ ID NO: 1047172 - RNA, 23 nt, Human
cucagcccagccccaucaccucu

SEQ ID NO: 1047173 - RNA, 19 nt, Human
cuccuccuccuccucuucc

SEQ ID NO: 1047174 - RNA, 22 nt, Human
cuccuccucuuccuccuccucc

SEQ ID NO: 1047175 - RNA, 22 nt, Human
cugauucuggcuggggcaagag

SEQ ID NO: 1047176 - RNA, 18 nt, Human
cugcaugauucagagggc

SEQ ID NO: 1047177 - RNA, 21 nt, Human
cugccccaaggccccagcagc

SEQ ID NO: 1047178 - RNA, 18 nt, Human
cuuccuccuccuccuuuu

SEQ ID NO: 1047179 - RNA, 21 nt, Human
cuuggaaaugucaccaaacuc

SEQ ID NO: 1047180 - RNA, 19 nt, Human
cuugugcaugugugugugu

SEQ ID NO: 1047181 - RNA, 18 nt, Human
gacagauggacagggcag

SEQ ID NO: 1047182 - RNA, 20 nt, Human
gacuguggugguuuggaggg

SEQ ID NO: 1047183 - RNA, 19 nt, Human
gccccaaggccccagcagc

SEQ ID NO: 1047184 - RNA, 18 nt, Human
gcugagcuggguguuuga

SEQ ID NO: 1047185 - RNA, 18 nt, Human
gggcaagagcugucugug

SEQ ID NO: 1047186 - RNA, 18 nt, Human
gggccaggccaggccagc

SEQ ID NO: 1047187 - RNA, 20 nt, Human
gggccaggccaggccagcag

SEQ ID NO: 1047188 - RNA, 22 nt, Human
gugggccaggccaggccagcag

SEQ ID NO: 1047189 - RNA, 31 nt, Human
gugugugguguguaugcauacgcauacacag

SEQ ID NO: 1047190 - RNA, 24 nt, Human
uaaaggcacccggaacuuccccca

SEQ ID NO: 1047191 - RNA, 21 nt, Human
uagaaaagaauaaaaaauaaa

SEQ ID NO: 1047192 - RNA, 24 nt, Human
uaugcauacgcauacacaugucag

SEQ ID NO: 1047193 - RNA, 19 nt, Human
ucaauguccaagaccugca

SEQ ID NO: 1047194 - RNA, 18 nt, Human
ucaccucugcuucacucc

SEQ ID NO: 1047195 - RNA, 19 nt, Human
ucagcagggggagggaaug

SEQ ID NO: 1047196 - RNA, 18 nt, Human
uccacugggcuugcccau

SEQ ID NO: 1047197 - RNA, 27 nt, Human
ucccccacaggccugaagaacaaaggu

SEQ ID NO: 1047198 - RNA, 18 nt, Human
ucccuggcucagcccagc

SEQ ID NO: 1047199 - RNA, 19 nt, Human
ucccuggcucagcccagcc

SEQ ID NO: 1047200 - RNA, 20 nt, Human
ucccuggcucagcccagccc

SEQ ID NO: 1047201 - RNA, 24 nt, Human
ucuuccuccuccuccuccucuucc

SEQ ID NO: 1047202 - RNA, 22 nt, Human
ucuuccuccuccuccuuuuccu

SEQ ID NO: 1047203 - RNA, 18 nt, Human
ugaaggcuccugucccca

SEQ ID NO: 1047204 - RNA, 21 nt, Human
ugacuugugcaugugugugug

SEQ ID NO: 1047205 - RNA, 19 nt, Human
ugagcuggguguuugaggg

SEQ ID NO: 1047206 - RNA, 19 nt, Human
ugccccaaggccccagcag

SEQ ID NO: 1047207 - RNA, 22 nt, Human
ugccccaaggccccagcagcac

SEQ ID NO: 1047208 - RNA, 21 nt, Human
uggaaaagugccuguguccug

SEQ ID NO: 1047209 - RNA, 24 nt, Human
uggacagggcagacggcgagcugc

SEQ ID NO: 1047210 - RNA, 18 nt, Human
uggaggguaguugugugu

SEQ ID NO: 1047211 - RNA, 24 nt, Human
uggcaggcaccuggccacagagca

SEQ ID NO: 1047212 - RNA, 23 nt, Human
uggcagggagggacucuuagcag

SEQ ID NO: 1047213 - RNA, 21 nt, Human
ugggaaaggaauaaaagccag

SEQ ID NO: 1047214 - RNA, 22 nt, Human
uguaugcauacgcauacacaug

SEQ ID NO: 1047215 - RNA, 23 nt, Human
ugugaugugugugcaugugucug

SEQ ID NO: 1047216 - RNA, 20 nt, Human
ugugcaugugugugugugug

SEQ ID NO: 1047217 - RNA, 22 nt, Human
uguggugguuuggaggguaguu

SEQ ID NO: 1047218 - RNA, 18 nt, Human
ugugguguguaugcauac

SEQ ID NO: 1047219 - RNA, 19 nt, Human
ugugugccagggcaggggc

SEQ ID NO: 1047220 - RNA, 18 nt, Human
uguguggcugagcugggu

SEQ ID NO: 1047221 - RNA, 20 nt, Human
uguguggcugagcugggugu

SEQ ID NO: 1047222 - RNA, 23 nt, Human
uguguggcugagcuggguguuug

SEQ ID NO: 1047223 - RNA, 22 nt, Human
ugugugguguguaugcauacgc

SEQ ID NO: 1047224 - RNA, 18 nt, Human
uguguguguguggugugu

SEQ ID NO: 1047225 - RNA, 19 nt, Human
uguguguguguguggugug

SEQ ID NO: 1047226 - RNA, 19 nt, Human
uguguguguguguggugug

SEQ ID NO: 1047227 - RNA, 25 nt, Human
uguucgcacaugacuugugcaugug

SEQ ID NO: 1047228 - RNA, 21 nt, Human
uuccagaggguggcaggcacc

SEQ ID NO: 1047229 - RNA, 20 nt, Human
uuccuccuccuccuccucuu

SEQ ID NO: 1047230 - RNA, 27 nt, Human
uucgcacaugacuugugcaugugugug

SEQ ID NO: 1047231 - RNA, 19 nt, Human
ggaucucuccuuaccacau

SEQ ID NO: 1047232 - RNA, 21 nt, Human
uaagugacaaacccaaagccc

SEQ ID NO: 1047233 - RNA, 21 nt, Human
uccaccuccuccacaguggca

SEQ ID NO: 1047234 - RNA, 22 nt, Human
uccaccuccuccacaguggcau

SEQ ID NO: 1047235 - RNA, 20 nt, Human
ugacaaacccaaagccccuc

SEQ ID NO: 1047236 - RNA, 22 nt, Human
ugacaaacccaaagccccugga

SEQ ID NO: 1047237 - RNA, 18 nt, Human
ugcauccaccuccuccac

SEQ ID NO: 1047238 - RNA, 18 nt, Human
aaacuacccccaaccucc

SEQ ID NO: 1047239 - RNA, 19 nt, Human
aaccucccuccccugaggc

SEQ ID NO: 1047240 - RNA, 21 nt, Human
aaccucccuccccugaggcuc

SEQ ID NO: 1047241 - RNA, 22 nt, Human
aagcugggaugagguggggagg

SEQ ID NO: 1047242 - RNA, 24 nt, Human
acaagggaccuuucagcucagaca

SEQ ID NO: 1047243 - RNA, 21 nt, Human
acaccacaugacgugucugcc

SEQ ID NO: 1047244 - RNA, 19 nt, Human
acccuccucaccacccugc

SEQ ID NO: 1047245 - RNA, 19 nt, Human
acugggaaaaucauauuua

SEQ ID NO: 1047246 - RNA, 21 nt, Human
agaggccccuggaguagccuc

SEQ ID NO: 1047247 - RNA, 20 nt, Human
agcugggugaauagcugugu

SEQ ID NO: 1047248 - RNA, 23 nt, Human
aggaagagcagauucagguggca

SEQ ID NO: 1047249 - RNA, 19 nt, Human
aggcauguuaggguggagg

SEQ ID NO: 1047250 - RNA, 22 nt, Human
agggcagaugggggagguccag

SEQ ID NO: 1047251 - RNA, 19 nt, Human
agggggcaggucuggguga

SEQ ID NO: 1047252 - RNA, 22 nt, Human
agguggggaggucagcgggggc

SEQ ID NO: 1047253 - RNA, 22 nt, Human
aguagcugcuuccuuguccuug

SEQ ID NO: 1047254 - RNA, 20 nt, Human
aguggcagagggacaagcga

SEQ ID NO: 1047255 - RNA, 18 nt, Human
augacaccacaugacgug

SEQ ID NO: 1047256 - RNA, 21 nt, Human
caaagaguaagugaaggccca

SEQ ID NO: 1047257 - RNA, 21 nt, Human
cacagacugauagggagacac

SEQ ID NO: 1047258 - RNA, 20 nt, Human
cacuguguguguuggggggu

SEQ ID NO: 1047259 - RNA, 25 nt, Human
cagccgugacccucccaccgucaga

SEQ ID NO: 1047260 - RNA, 21 nt, Human
cagcugggugaauagcugugu

SEQ ID NO: 1047261 - RNA, 18 nt, Human
caggacccagggaccaaa

SEQ ID NO: 1047262 - RNA, 18 nt, Human
caggugguugcacaaccc

SEQ ID NO: 1047263 - RNA, 19 nt, Human
cagugggcccuggccugua

SEQ ID NO: 1047264 - RNA, 20 nt, Human
caugacaaaggcacgaggaa

SEQ ID NO: 1047265 - RNA, 21 nt, Human
cauguucugggggcacacacu

SEQ ID NO: 1047266 - RNA, 24 nt, Human
ccacugccccugccuuuuuuccug

SEQ ID NO: 1047267 - RNA, 18 nt, Human
ccccaaccucccacauug

SEQ ID NO: 1047268 - RNA, 21 nt, Human
ccccaaccucccacauuggcc

SEQ ID NO: 1047269 - RNA, 19 nt, Human
ccccacagccacccuccuc

SEQ ID NO: 1047270 - RNA, 19 nt, Human
ccccacagccacccuccuc

SEQ ID NO: 1047271 - RNA, 20 nt, Human
ccccacagccacccuccuca

SEQ ID NO: 1047272 - RNA, 22 nt, Human
ccccacagccacccuccucacc

SEQ ID NO: 1047273 - RNA, 23 nt, Human
ccccaguagcuaucaaccucccu

SEQ ID NO: 1047274 - RNA, 24 nt, Human
cccccacagccacccuccucacca

SEQ ID NO: 1047275 - RNA, 25 nt, Human
cccccacagccacccuccucaccac

SEQ ID NO: 1047276 - RNA, 19 nt, Human
ccccccugccccccguuuu

SEQ ID NO: 1047277 - RNA, 19 nt, Human
ccccugccccccguuuucc

SEQ ID NO: 1047278 - RNA, 18 nt, Human
cccuccucaccacccugc

SEQ ID NO: 1047279 - RNA, 20 nt, Human
ccuaauccccccugcccccc

SEQ ID NO: 1047280 - RNA, 20 nt, Human
ccucccacauuggccccugg

SEQ ID NO: 1047281 - RNA, 22 nt, Human
ccucccacauuggccccugggc

SEQ ID NO: 1047282 - RNA, 23 nt, Human
ccugcccacucaggccuugggag

SEQ ID NO: 1047283 - RNA, 21 nt, Human
ccuggaguagccucugccuuu

SEQ ID NO: 1047284 - RNA, 23 nt, Human
ccugugcugggcagggcuaggga

SEQ ID NO: 1047285 - RNA, 20 nt, Human
ccuuuuuuccuggguggccu

SEQ ID NO: 1047286 - RNA, 23 nt, Human
cgggaccugugcugggcagggcu

SEQ ID NO: 1047287 - RNA, 18 nt, Human
cucagugaccugcccauu

SEQ ID NO: 1047288 - RNA, 21 nt, Human
cucagugggcccuggccugua

SEQ ID NO: 1047289 - RNA, 23 nt, Human
cucucagccgugacccucccacc

SEQ ID NO: 1047290 - RNA, 22 nt, Human
cugaguagucuuggcauccucu

SEQ ID NO: 1047291 - RNA, 20 nt, Human
cuugggcagcugggugaaua

SEQ ID NO: 1047292 - RNA, 21 nt, Human
gagcccccacagccacccucc

SEQ ID NO: 1047293 - RNA, 21 nt, Human
gagcuuccugagcccccacag

SEQ ID NO: 1047294 - RNA, 22 nt, Human
gaucacugagaacugacuccug

SEQ ID NO: 1047295 - RNA, 19 nt, Human
gaucuuaucugcugaucuc

SEQ ID NO: 1047296 - RNA, 24 nt, Human
gauucccaucccuggcuugcucuc

SEQ ID NO: 1047297 - RNA, 18 nt, Human
gauuuggugccagugggg

SEQ ID NO: 1047298 - RNA, 22 nt, Human
gcacaacccagaggccccugga

SEQ ID NO: 1047299 - RNA, 18 nt, Human
gccccccguuuuccuauc

SEQ ID NO: 1047300 - RNA, 29 nt, Human
gccccugggcgagcuuccugagcccccag

SEQ ID NO: 1047301 - RNA, 18 nt, Human
gcuagggaggcccaaccc

SEQ ID NO: 1047302 - RNA, 22 nt, Human
gcuggugaugguggaagaaauu

SEQ ID NO: 1047303 - RNA, 21 nt, Human
ggaauuccucuccuccugcuu

SEQ ID NO: 1047304 - RNA, 19 nt, Human
ggaccuggaugacucagug

SEQ ID NO: 1047305 - RNA, 24 nt, Human
ggagaggaagagcagauucaggug

SEQ ID NO: 1047306 - RNA, 19 nt, Human
ggaggaagcugggaugagg

SEQ ID NO: 1047307 - RNA, 20 nt, Human
ggauuuggugccaguggggg

SEQ ID NO: 1047308 - RNA, 19 nt, Human
ggcagcugggugaauagcu

SEQ ID NO: 1047309 - RNA, 23 nt, Human
ggcauccucucugagguccaccu

SEQ ID NO: 1047310 - RNA, 24 nt, Human
gggaauugucuagugggcauuugg

SEQ ID NO: 1047311 - RNA, 18 nt, Human
gggacaagcgaggcuggc

SEQ ID NO: 1047312 - RNA, 18 nt, Human
gggaggucagcgggggcc

SEQ ID NO: 1047313 - RNA, 23 nt, Human
gggcauucuagccagaggaaaua

SEQ ID NO: 1047314 - RNA, 18 nt, Human
ggggaaccuggagauggg

SEQ ID NO: 1047315 - RNA, 19 nt, Human
gggggaaccuggagauggg

SEQ ID NO: 1047316 - RNA, 22 nt, Human
gggggccucccagggaauuguc

SEQ ID NO: 1047317 - RNA, 21 nt, Human
ggggugggaagggcauucuag

SEQ ID NO: 1047318 - RNA, 19 nt, Human
gggugugagggacaaggau

SEQ ID NO: 1047319 - RNA, 19 nt, Human
gguagggauugccccuguc

SEQ ID NO: 1047320 - RNA, 22 nt, Human
gguggaggugugguucugggag

SEQ ID NO: 1047321 - RNA, 21 nt, Human
guagucuuggcauccucucug

SEQ ID NO: 1047322 - RNA, 24 nt, Human
guggugguggggugggggaguaac

SEQ ID NO: 1047323 - RNA, 23 nt, Human
gugucugccuggggaaccaggag

SEQ ID NO: 1047324 - RNA, 22 nt, Human
guguguguuggggggugauggg

SEQ ID NO: 1047325 - RNA, 25 nt, Human
uaaagcagguggaaugacaugguca

SEQ ID NO: 1047326 - RNA, 24 nt, Human
uagccucugccuuugggcacagcc

SEQ ID NO: 1047327 - RNA, 25 nt, Human
uauacaaaauccccaguagcuauca

SEQ ID NO: 1047328 - RNA, 24 nt, Human
uaucggccacuccccaccuggucu

SEQ ID NO: 1047329 - RNA, 26 nt, Human
ucacaaagaguaagugaaggcccaga

SEQ ID NO: 1047330 - RNA, 21 nt, Human
ucacaaucaccgugucaucau

SEQ ID NO: 1047331 - RNA, 20 nt, Human
uccacagauggaaguagcag

SEQ ID NO: 1047332 - RNA, 22 nt, Human
uccacagauggaaguagcagag

SEQ ID NO: 1047333 - RNA, 22 nt, Human
ucccuggcuugcucucagccgu

SEQ ID NO: 1047334 - RNA, 20 nt, Human
uccugagcccccacagccac

SEQ ID NO: 1047335 - RNA, 21 nt, Human
ucucugagguccaccuaaucc

SEQ ID NO: 1047336 - RNA, 21 nt, Human
ugacauggucaguugcauaga

SEQ ID NO: 1047337 - RNA, 21 nt, Human
ugagaacugacuccugcuggg

SEQ ID NO: 1047338 - RNA, 22 nt, Human
ugagaugggguggggcaucuuc

SEQ ID NO: 1047339 - RNA, 24 nt, Human
ugagaugggguggggcaucuucaa

SEQ ID NO: 1047340 - RNA, 22 nt, Human
ugagcccccacagccacccucc

SEQ ID NO: 1047341 - RNA, 22 nt, Human
ugagcugaugaggucagcuugg

SEQ ID NO: 1047342 - RNA, 23 nt, Human
ugagcugaugaggucagcuugga

SEQ ID NO: 1047343 - RNA, 18 nt, Human
ugagguggggaggucagc

SEQ ID NO: 1047344 - RNA, 24 nt, Human
ugagguggggaggucagcgggggc

SEQ ID NO: 1047345 - RNA, 25 nt, Human
ugagguggggaggucagcgggggcc

SEQ ID NO: 1047346 - RNA, 22 nt, Human
ugaugaggucagcuugggagug

SEQ ID NO: 1047347 - RNA, 21 nt, Human
ugcacaacccagaggccccug

SEQ ID NO: 1047348 - RNA, 22 nt, Human
ugcccacucaggccuugggagc

SEQ ID NO: 1047349 - RNA, 20 nt, Human
ugcuuuggccaggugguugc

SEQ ID NO: 1047350 - RNA, 21 nt, Human
uggaaggucuauaccugggug

SEQ ID NO: 1047351 - RNA, 23 nt, Human
uggaaggucuauaccugggugcu

SEQ ID NO: 1047352 - RNA, 18 nt, Human
uggcagagggacaagcga

SEQ ID NO: 1047353 - RNA, 21 nt, Human
uggcagagggacaagcgaggc

SEQ ID NO: 1047354 - RNA, 23 nt, Human
uggcagagggacaagcgaggcug

SEQ ID NO: 1047355 - RNA, 20 nt, Human
uggccccugggcgagcuucc

SEQ ID NO: 1047356 - RNA, 21 nt, Human
uggccccugggcgagcuuccu

SEQ ID NO: 1047357 - RNA, 22 nt, Human
uggccccugggcgagcuuccug

SEQ ID NO: 1047358 - RNA, 22 nt, Human
uggccuguaggaugugccucuu

SEQ ID NO: 1047359 - RNA, 21 nt, Human
uggcggguaugagaugccugg

SEQ ID NO: 1047360 - RNA, 24 nt, Human
ugggaagggcauucuagccagagg

SEQ ID NO: 1047361 - RNA, 21 nt, Human
ugggaguugccaaagucugag

SEQ ID NO: 1047362 - RNA, 18 nt, Human
ugggaugagguggggagg

SEQ ID NO: 1047363 - RNA, 21 nt, Human
ugggcacagcccaucauguuc

SEQ ID NO: 1047364 - RNA, 23 nt, Human
ugggggagguccaggagguaguu

SEQ ID NO: 1047365 - RNA, 24 nt, Human
ugggggcacacacuguguguguug

SEQ ID NO: 1047366 - RNA, 21 nt, Human
uggugguggggugggggagua

SEQ ID NO: 1047367 - RNA, 23 nt, Human
uuccuucuuggguccaguagcug

SEQ ID NO: 1047368 - RNA, 21 nt, Human
uuguuguaaggagaggaagag

SEQ ID NO: 1047369 - RNA, 18 nt, Human
acuguuguucccacacuc

SEQ ID NO: 1047370 - RNA, 19 nt, Human
agagaacucuuuaaagcca

SEQ ID NO: 1047371 - RNA, 22 nt, Human
agagaacucuuuaaagccaaca

SEQ ID NO: 1047372 - RNA, 22 nt, Human
ccgaacacuuucuagagaacuc

SEQ ID NO: 1047373 - RNA, 21 nt, Human
cgggcuuugucgaguuuggcc

SEQ ID NO: 1047374 - RNA, 21 nt, Human
cugcuccuugaauuuguuucu

SEQ ID NO: 1047375 - RNA, 19 nt, Human
gaauuuguuucuuuuuucu

SEQ ID NO: 1047376 - RNA, 19 nt, Human
gacuguuguucccacacuc

SEQ ID NO: 1047377 - RNA, 21 nt, Human
uagagaacucuuuaaagccaa

SEQ ID NO: 1047378 - RNA, 25 nt, Human
ugaauuuguuucuuuuuucuggauu

SEQ ID NO: 1047379 - RNA, 24 nt, Human
uggauucaguaacguggacaggag

SEQ ID NO: 1047380 - RNA, 25 nt, Human
uuuucuggauucaguaacguggaca

SEQ ID NO: 1047381 - RNA, 26 nt, Human
aaaaaaaaaaaaaaaaauuccaaaag

SEQ ID NO: 1047382 - RNA, 21 nt, Human
aaagagggaggggaggggagg

SEQ ID NO: 1047383 - RNA, 21 nt, Human
aagagggaggggaggggaggg

SEQ ID NO: 1047384 - RNA, 19 nt, Human
agagggaggggaggggagg

SEQ ID NO: 1047385 - RNA, 18 nt, Human
agggaggggaggggaggg

SEQ ID NO: 1047386 - RNA, 23 nt, Human
agggaggggaggggaggggaacu

SEQ ID NO: 1047387 - RNA, 19 nt, Human
aggggaggggaggggaacu

SEQ ID NO: 1047388 - RNA, 21 nt, Human
auauacacacauacauauggu

SEQ ID NO: 1047389 - RNA, 19 nt, Human
caagugugcuucucagaac

SEQ ID NO: 1047390 - RNA, 19 nt, Human
ccaaaagaugcaguuacaa

SEQ ID NO: 1047391 - RNA, 23 nt, Human
cucagaauuucccugggcaaaaa

SEQ ID NO: 1047392 - RNA, 18 nt, Human
gaggggaggggaggggaa

SEQ ID NO: 1047393 - RNA, 30 nt, Human
gcauucaauauacacacauacauauguaca

SEQ ID NO: 1047394 - RNA, 19 nt, Human
ggaaaaaaaaaaaaaaaaa

SEQ ID NO: 1047395 - RNA, 23 nt, Human
uacacacauacauauguacacuc

SEQ ID NO: 1047396 - RNA, 24 nt, Human
uauguacacucuuugacacaccuu

SEQ ID NO: 1047397 - RNA, 21 nt, Human
ucagaauuucccugggcaaaa

SEQ ID NO: 1047398 - RNA, 23 nt, Human
ucccugggcaaaaaccugugacc

SEQ ID NO: 1047399 - RNA, 27 nt, Human
ucucuaccccuuggaaaaaaaaaaaaa

SEQ ID NO: 1047400 - RNA, 26 nt, Human
ugaaauaaaauacauaaaucucuacc

SEQ ID NO: 1047401 - RNA, 19 nt, Human
uggaaaaaaaaaaaaaaaa

SEQ ID NO: 1047402 - RNA, 19 nt, Human
uucaauauacacacauaca

SEQ ID NO: 1047403 - RNA, 18 nt, Human
uuccaaaagaugcaguua

SEQ ID NO: 1047404 - RNA, 21 nt, Human
aacagguuuuuauuuuugcuu

SEQ ID NO: 1047405 - RNA, 24 nt, Human
auuuucucuucaaauuuggaugug

SEQ ID NO: 1047406 - RNA, 22 nt, Human
ccaggggcccuuaguccuccuu

SEQ ID NO: 1047407 - RNA, 21 nt, Human
cucaaugccauguuuucuucg

SEQ ID NO: 1047408 - RNA, 23 nt, Human
cuucuacaccaaaguagugcuca

SEQ ID NO: 1047409 - RNA, 19 nt, Human
cuucugguagaucuccugg

SEQ ID NO: 1047410 - RNA, 18 nt, Human
gucuacccaggggcccuu

SEQ ID NO: 1047411 - RNA, 20 nt, Human
uagaacuuugcaacagguuu

SEQ ID NO: 1047412 - RNA, 20 nt, Human
aaagaagaaagcugggagcc

SEQ ID NO: 1047413 - RNA, 24 nt, Human
agcaagaaaggcuuguggaaagaa

SEQ ID NO: 1047414 - RNA, 18 nt, Human
agggacauugcacaguca

SEQ ID NO: 1047415 - RNA, 18 nt, Human
auggaauagacugcuucc

SEQ ID NO: 1047416 - RNA, 19 nt, Human
auuguucucugaauccuca

SEQ ID NO: 1047417 - RNA, 22 nt, Human
ccaaccacagggacauugcacu

SEQ ID NO: 1047418 - RNA, 28 nt, Human
cuagagcccaaccacagggacauugcac

SEQ ID NO: 1047419 - RNA, 21 nt, Human
gaaggaaacccuucaaagaaa

SEQ ID NO: 1047420 - RNA, 23 nt, Human
gauuagagucaaaaauuaaaaug

SEQ ID NO: 1047421 - RNA, 19 nt, Human
guggaaagaagaaagcugg

SEQ ID NO: 1047422 - RNA, 23 nt, Human
guugaaguuuucauguacaaaug

SEQ ID NO: 1047423 - RNA, 22 nt, Human
uaagucugauuagagucaaaaa

SEQ ID NO: 1047424 - RNA, 18 nt, Human
uagacugcaccugcccag

SEQ ID NO: 1047425 - RNA, 21 nt, Human
uagucuugaagcacagcagca

SEQ ID NO: 1047426 - RNA, 21 nt, Human
ugaaauagacugcaccugccc

SEQ ID NO: 1047427 - RNA, 22 nt, Human
ugauggaauagacugcuuccaa

SEQ ID NO: 1047428 - RNA, 22 nt, Human
ugcccagucuggcugaacacac

SEQ ID NO: 1047429 - RNA, 18 nt, Human
ugguguuggaaaucacau

SEQ ID NO: 1047430 - RNA, 24 nt, Human
uguacaaaugaaauagacugcacc

SEQ ID NO: 1047431 - RNA, 21 nt, Human
uguacuagagcccaaccacag

SEQ ID NO: 1047432 - RNA, 19 nt, Human
uguggaaagaagaaagcug

SEQ ID NO: 1047433 - RNA, 19 nt, Human
uugaagcacagcagcaaga

SEQ ID NO: 1047434 - RNA, 21 nt, Human
uuggcuaguugauggaauaga

SEQ ID NO: 1047435 - RNA, 18 nt, Human
uccuguggccaaagcugu

SEQ ID NO: 1047436 - RNA, 24 nt, Human
agcacugcuuucagccaggaugaa

SEQ ID NO: 1047437 - RNA, 23 nt, Human
caccgccccccuuucggccgccc

SEQ ID NO: 1047438 - RNA, 24 nt, Human
caucuccgcuugcgcggcccgacc

SEQ ID NO: 1047439 - RNA, 19 nt, Human
ccaaguaccagccacugcc

SEQ ID NO: 1047440 - RNA, 23 nt, Human
ccaccggucuccuucaauccucc

SEQ ID NO: 1047441 - RNA, 21 nt, Human
ccagugaagacuggccccuuu

SEQ ID NO: 1047442 - RNA, 24 nt, Human
cccccauagcaggccagaccacuc

SEQ ID NO: 1047443 - RNA, 22 nt, Human
ccccccuuucggccgccccccu

SEQ ID NO: 1047444 - RNA, 22 nt, Human
ccccgccccguccccaccgguc

SEQ ID NO: 1047445 - RNA, 19 nt, Human
ccgaccaccgccccccuuu

SEQ ID NO: 1047446 - RNA, 19 nt, Human
ccgccccccuuucggccgc

SEQ ID NO: 1047447 - RNA, 26 nt, Human
cgccccguccccaccggucuccuuca

SEQ ID NO: 1047448 - RNA, 22 nt, Human
cgcggcccgaccaccgcccccc

SEQ ID NO: 1047449 - RNA, 22 nt, Human
cggccgccccccuccccagcgc

SEQ ID NO: 1047450 - RNA, 21 nt, Human
cugcgccccgccccgucccca

SEQ ID NO: 1047451 - RNA, 19 nt, Human
gaaauggacauguaacacc

SEQ ID NO: 1047452 - RNA, 25 nt, Human
gcagguuuccuuuuaaucaaggcuc

SEQ ID NO: 1047453 - RNA, 21 nt, Human
gcccccaaaacaugaaaugga

SEQ ID NO: 1047454 - RNA, 23 nt, Human
gccccccuuucggccgccccccu

SEQ ID NO: 1047455 - RNA, 25 nt, Human
gccccguccccaccggucuccuuca

SEQ ID NO: 1047456 - RNA, 19 nt, Human
gcgagcacugcuggucugc

SEQ ID NO: 1047457 - RNA, 20 nt, Human
uaaaagcccccaaaacauga

SEQ ID NO: 1047458 - RNA, 21 nt, Human
uaaaagcccccaaaacaugaa

SEQ ID NO: 1047459 - RNA, 21 nt, Human
uccccagcgcugcguuagggc

SEQ ID NO: 1047460 - RNA, 19 nt, Human
ucccccauagcaggccaga

SEQ ID NO: 1047461 - RNA, 23 nt, Human
ucccccauagcaggccagaccac

SEQ ID NO: 1047462 - RNA, 21 nt, Human
ugaaauggacauguaacacca

SEQ ID NO: 1047463 - RNA, 21 nt, Human
ugaaauggacauguaacaccc

SEQ ID NO: 1047464 - RNA, 23 nt, Human
ugaagacuggccccuuuacugaa

SEQ ID NO: 1047465 - RNA, 19 nt, Human
ugaagguguuuuguggggc

SEQ ID NO: 1047466 - RNA, 21 nt, Human
uucagccaggaugaaguggga

SEQ ID NO: 1047467 - RNA, 18 nt, Human
uucauuggcugcauuuca

SEQ ID NO: 1047468 - RNA, 20 nt, Human
uucggccgccccccucccca

SEQ ID NO: 1047469 - RNA, 20 nt, Human
agccagcgcccgccgcgugg

SEQ ID NO: 1047470 - RNA, 18 nt, Human
cagcgcccgccgcguggg

SEQ ID NO: 1047471 - RNA, 19 nt, Human
ccaggccuggcucuccugg

SEQ ID NO: 1047472 - RNA, 19 nt, Human
cccacagugcccacgucug

SEQ ID NO: 1047473 - RNA, 20 nt, Human
cccgccgcgugggagccgcg

SEQ ID NO: 1047474 - RNA, 18 nt, Human
cccgggcuccgugcccuc

SEQ ID NO: 1047475 - RNA, 18 nt, Human
cggcgggcgcgucuccuc

SEQ ID NO: 1047476 - RNA, 22 nt, Human
cgugggagccgcgaggccaggc

SEQ ID NO: 1047477 - RNA, 22 nt, Human
cucaaaagcgaggacacagagc

SEQ ID NO: 1047478 - RNA, 22 nt, Human
cuccacgccuggcucccgggcu

SEQ ID NO: 1047479 - RNA, 21 nt, Human
cugguccggccgcugggcugc

SEQ ID NO: 1047480 - RNA, 20 nt, Human
gggcggguggggacgucugg

SEQ ID NO: 1047481 - RNA, 21 nt, Human
ggguggggacgucugggaagc

SEQ ID NO: 1047482 - RNA, 20 nt, Human
gucccaauacguggaaugcu

SEQ ID NO: 1047483 - RNA, 25 nt, Human
gucuccuccagcugguccggccgcu

SEQ ID NO: 1047484 - RNA, 18 nt, Human
guggaaugcuccguuucc

SEQ ID NO: 1047485 - RNA, 21 nt, Human
uagaagggacuggggccggcg

SEQ ID NO: 1047486 - RNA, 21 nt, Human
ucccaauacguggaaugcucc

SEQ ID NO: 1047487 - RNA, 19 nt, Human
ucccggucucgcugcuccc

SEQ ID NO: 1047488 - RNA, 21 nt, Human
uccgcagacggcgggcucccg

SEQ ID NO: 1047489 - RNA, 22 nt, Human
uccuccagcugguccggccgcu

SEQ ID NO: 1047490 - RNA, 22 nt, Human
ucucgcgcuccacgccuggcuc

SEQ ID NO: 1047491 - RNA, 22 nt, Human
uggcucccgggcuccgugcccu

SEQ ID NO: 1047492 - RNA, 21 nt, Human
uggggccggcggggcgggugg

SEQ ID NO: 1047493 - RNA, 29 nt, Human
ugucccgcgagcuccucaaaagcgaggac

SEQ ID NO: 1047494 - RNA, 26 nt, Human
aaaaauaggaaucaauauaaaaaugc

SEQ ID NO: 1047495 - RNA, 18 nt, Human
aaacagccagagcuggcg

SEQ ID NO: 1047496 - RNA, 20 nt, Human
aacagguuuuauugaggaug

SEQ ID NO: 1047497 - RNA, 19 nt, Human
aagggcugugagggaggcc

SEQ ID NO: 1047498 - RNA, 18 nt, Human
aauguccaccacucccag

SEQ ID NO: 1047499 - RNA, 23 nt, Human
acagacauuugggggaaagaaac

SEQ ID NO: 1047500 - RNA, 21 nt, Human
acagggcagaaacguccagag

SEQ ID NO: 1047501 - RNA, 21 nt, Human
acuuggagcagugcaacgaga

SEQ ID NO: 1047502 - RNA, 24 nt, Human
agaaauccaccaggaaccccagcc

SEQ ID NO: 1047503 - RNA, 22 nt, Human
agagccaacucauucccaaggg

SEQ ID NO: 1047504 - RNA, 21 nt, Human
agaggccaggacucacaaggg

SEQ ID NO: 1047505 - RNA, 24 nt, Human
agaguccuuaguugguuuucuugg

SEQ ID NO: 1047506 - RNA, 20 nt, Human
agccaaaaccuucucaagug

SEQ ID NO: 1047507 - RNA, 20 nt, Human
agccagagcuggcgggggca

SEQ ID NO: 1047508 - RNA, 21 nt, Human
agcgcgaggcccugcagcugc

SEQ ID NO: 1047509 - RNA, 22 nt, Human
agcuggaggagccccagccaag

SEQ ID NO: 1047510 - RNA, 19 nt, Human
agcuggcgggggcagcccg

SEQ ID NO: 1047511 - RNA, 27 nt, Human
aggaaauuggaaccagaggguggaagg

SEQ ID NO: 1047512 - RNA, 19 nt, Human
aggaguggggcuggccugg

SEQ ID NO: 1047513 - RNA, 18 nt, Human
agguaguaagaaauccac

SEQ ID NO: 1047514 - RNA, 18 nt, Human
aguaagaaauccaccagg

SEQ ID NO: 1047515 - RNA, 22 nt, Human
aguggacaccugcaacucaaau

SEQ ID NO: 1047516 - RNA, 24 nt, Human
augccacagcaucaccaugggggc

SEQ ID NO: 1047517 - RNA, 21 nt, Human
caacagguuuuauugaggaug

SEQ ID NO: 1047518 - RNA, 22 nt, Human
caagcuaaacagccagagcugg

SEQ ID NO: 1047519 - RNA, 22 nt, Human
caccacucccagcacucaucuc

SEQ ID NO: 1047520 - RNA, 20 nt, Human
cacuaaaggggaggaggcca

SEQ ID NO: 1047521 - RNA, 24 nt, Human
cagaagucagcagccauccuccau

SEQ ID NO: 1047522 - RNA, 23 nt, Human
cagccaaaaccuucucaaguguc

SEQ ID NO: 1047523 - RNA, 18 nt, Human
cagcccagcccgcagcag

SEQ ID NO: 1047524 - RNA, 20 nt, Human
cagcccgggagagacaggga

SEQ ID NO: 1047525 - RNA, 19 nt, Human
cagccugcaugcagggaga

SEQ ID NO: 1047526 - RNA, 25 nt, Human
caggccagccccuuccagaaacaaa

SEQ ID NO: 1047527 - RNA, 23 nt, Human
cagggccuauggggugcagcccu

SEQ ID NO: 1047528 - RNA, 21 nt, Human
caggggccucugugcugcccu

SEQ ID NO: 1047529 - RNA, 19 nt, Human
ccaagcccucacaaacugc

SEQ ID NO: 1047530 - RNA, 21 nt, Human
ccaaggccacggccgccucug

SEQ ID NO: 1047531 - RNA, 25 nt, Human
ccaccaggaaccccagccaaaaccu

SEQ ID NO: 1047532 - RNA, 30 nt, Human
ccaggaaccccagccaaaaccuucucaagg

SEQ ID NO: 1047533 - RNA, 21 nt, Human
cccagccuuagccuccugggc

SEQ ID NO: 1047534 - RNA, 21 nt, Human
cccauaaacauuuuagaaacg

SEQ ID NO: 1047535 - RNA, 22 nt, Human
cccaucccuaacacaucagaug

SEQ ID NO: 1047536 - RNA, 19 nt, Human
cccauggcugccacuggag

SEQ ID NO: 1047537 - RNA, 24 nt, Human
ccccaggucugugccccaagcccu

SEQ ID NO: 1047538 - RNA, 25 nt, Human
ccccucuuguacacacauacaccca

SEQ ID NO: 1047539 - RNA, 22 nt, Human
cccguuuuuuuucuugggaccc

SEQ ID NO: 1047540 - RNA, 20 nt, Human
ccucacaaacugccuucccc

SEQ ID NO: 1047541 - RNA, 28 nt, Human
ccuccugccccaggucugugccccaagc

SEQ ID NO: 1047542 - RNA, 21 nt, Human
ccuccugggcccuaguccugc

SEQ ID NO: 1047543 - RNA, 22 nt, Human
ccuuagccuccugggcccuagu

SEQ ID NO: 1047544 - RNA, 20 nt, Human
cgaaugaccccaguucacac

SEQ ID NO: 1047545 - RNA, 21 nt, Human
cucacaaacugccuuccccau

SEQ ID NO: 1047546 - RNA, 24 nt, Human
cucccagccuuagccuccugggcc

SEQ ID NO: 1047547 - RNA, 24 nt, Human
cugccccaggucugugccccaagc

SEQ ID NO: 1047548 - RNA, 24 nt, Human
cugcccucaagcuaaacagccaga

SEQ ID NO: 1047549 - RNA, 20 nt, Human
cuggagcagugaaagggagg

SEQ ID NO: 1047550 - RNA, 28 nt, Human
cuuguacacacauacacccaccauaugg

SEQ ID NO: 1047551 - RNA, 18 nt, Human
gaacaggaaauuggaacc

SEQ ID NO: 1047552 - RNA, 21 nt, Human
gaagaagagguugagcgaaga

SEQ ID NO: 1047553 - RNA, 21 nt, Human
gacacugcacagacauuuggg

SEQ ID NO: 1047554 - RNA, 24 nt, Human
gaccgaaugaccccaguucacacu

SEQ ID NO: 1047555 - RNA, 19 nt, Human
gaccuagggaagaagaggu

SEQ ID NO: 1047556 - RNA, 25 nt, Human
gagaguccuuaguugguuuucuugg

SEQ ID NO: 1047557 - RNA, 24 nt, Human
gagaucacagaccgaaugacccca

SEQ ID NO: 1047558 - RNA, 19 nt, Human
gagcaaacagccugcuuug

SEQ ID NO: 1047559 - RNA, 21 nt, Human
gagcugccuccugccccaggu

SEQ ID NO: 1047560 - RNA, 18 nt, Human
gaggagccccagccaagg

SEQ ID NO: 1047561 - RNA, 22 nt, Human
gaggucccagggggagcuggag

SEQ ID NO: 1047562 - RNA, 18 nt, Human
gagguugaucuuucuggc

SEQ ID NO: 1047563 - RNA, 18 nt, Human
gcacccuuucucucccag

SEQ ID NO: 1047564 - RNA, 22 nt, Human
gcacccuuucucucccagccuu

SEQ ID NO: 1047565 - RNA, 20 nt, Human
gcagaaacguccagagccaa

SEQ ID NO: 1047566 - RNA, 20 nt, Human
gcauccugccuguuuccugc

SEQ ID NO: 1047567 - RNA, 19 nt, Human
gccagagcuggcgggggca

SEQ ID NO: 1047568 - RNA, 23 nt, Human
gcccaccacggacaugucugaug

SEQ ID NO: 1047569 - RNA, 21 nt, Human
gcccccacagaugaaccccuc

SEQ ID NO: 1047570 - RNA, 24 nt, Human
gcccucacaaacugccuuccccau

SEQ ID NO: 1047571 - RNA, 23 nt, Human
gccuuggggauaccuggcugggg

SEQ ID NO: 1047572 - RNA, 24 nt, Human
ggaaaaccccacaguccuuagucc

SEQ ID NO: 1047573 - RNA, 24 nt, Human
ggaaggagaggaagcccccacaga

SEQ ID NO: 1047574 - RNA, 23 nt, Human
ggacugagggguugggaggggca

SEQ ID NO: 1047575 - RNA, 19 nt, Human
ggagaaagggaagagugcu

SEQ ID NO: 1047576 - RNA, 22 nt, Human
ggagaggaagcccccacagaug

SEQ ID NO: 1047577 - RNA, 24 nt, Human
ggauaccuggcuggggugacaagg

SEQ ID NO: 1047578 - RNA, 22 nt, Human
ggcagaaacguccagagccaac

SEQ ID NO: 1047579 - RNA, 20 nt, Human
ggccaggacucacaaggggc

SEQ ID NO: 1047580 - RNA, 18 nt, Human
ggcugcaguccuggcagg

SEQ ID NO: 1047581 - RNA, 18 nt, Human
ggcugggcugugugccuc

SEQ ID NO: 1047582 - RNA, 22 nt, Human
gggaacagggcagaaacgucca

SEQ ID NO: 1047583 - RNA, 19 nt, Human
gggcaggggaggaggguug

SEQ ID NO: 1047584 - RNA, 18 nt, Human
ggggccucugugcugccc

SEQ ID NO: 1047585 - RNA, 18 nt, Human
gggguugggaggggcauc

SEQ ID NO: 1047586 - RNA, 21 nt, Human
ggucccagggggagcuggagg

SEQ ID NO: 1047587 - RNA, 19 nt, Human
gguuugagaguccuuaguu

SEQ ID NO: 1047588 - RNA, 22 nt, Human
guggaaggagaggaagccccca

SEQ ID NO: 1047589 - RNA, 24 nt, Human
guggggcuggccuggcgagggccg

SEQ ID NO: 1047590 - RNA, 23 nt, Human
guugcccuuucccagggcaacag

SEQ ID NO: 1047591 - RNA, 18 nt, Human
uaagaaauccaccaggaa

SEQ ID NO: 1047592 - RNA, 23 nt, Human
uaagaaauccaccaggaacccca

SEQ ID NO: 1047593 - RNA, 18 nt, Human
uaaguggacaccugcaac

SEQ ID NO: 1047594 - RNA, 25 nt, Human
uacacccaccauaugguucuuauua

SEQ ID NO: 1047595 - RNA, 26 nt, Human
uagaacaggaaauuggaaccagaggg

SEQ ID NO: 1047596 - RNA, 21 nt, Human
uagccuccugggcccuagucc

SEQ ID NO: 1047597 - RNA, 22 nt, Human
uagccuccugggcccuaguccu

SEQ ID NO: 1047598 - RNA, 23 nt, Human
uagcucccguuuuuuuucuuggg

SEQ ID NO: 1047599 - RNA, 23 nt, Human
uagggacugagggguugggaggg

SEQ ID NO: 1047600 - RNA, 23 nt, Human
uauaccaaguuagaagugaaaug

SEQ ID NO: 1047601 - RNA, 21 nt, Human
ucaauauaaaaaugcacaagg

SEQ ID NO: 1047602 - RNA, 24 nt, Human
ucacuugggcagauuuggguuauc

SEQ ID NO: 1047603 - RNA, 21 nt, Human
ucagagggccaaacgagaggu

SEQ ID NO: 1047604 - RNA, 22 nt, Human
uccaccacucccagcacucauc

SEQ ID NO: 1047605 - RNA, 23 nt, Human
uccaccacucccagcacucaucc

SEQ ID NO: 1047606 - RNA, 22 nt, Human
uccuuaguugguuuucuugggc

SEQ ID NO: 1047607 - RNA, 20 nt, Human
ucgauucugccuccgccacu

SEQ ID NO: 1047608 - RNA, 20 nt, Human
ucucccagccuuagccuccu

SEQ ID NO: 1047609 - RNA, 21 nt, Human
ucugcacuagauacuucuaga

SEQ ID NO: 1047610 - RNA, 20 nt, Human
ucugccuuggggauaccugg

SEQ ID NO: 1047611 - RNA, 24 nt, Human
ucuguucagcuuuuguuuuuuuuu

SEQ ID NO: 1047612 - RNA, 21 nt, Human
ucuugggacccuacuuaguuc

SEQ ID NO: 1047613 - RNA, 22 nt, Human
ugaacgugaagagcugccuccu

SEQ ID NO: 1047614 - RNA, 18 nt, Human
ugaaggaacccacugcuc

SEQ ID NO: 1047615 - RNA, 23 nt, Human
ugaccccaguucacacuugguac

SEQ ID NO: 1047616 - RNA, 20 nt, Human
ugacguagggacugaggggu

SEQ ID NO: 1047617 - RNA, 21 nt, Human
ugagaaaaccagcccagcccg

SEQ ID NO: 1047618 - RNA, 22 nt, Human
ugagcgaagaacccccaccagg

SEQ ID NO: 1047619 - RNA, 25 nt, Human
ugagcgaagaacccccaccagguau

SEQ ID NO: 1047620 - RNA, 19 nt, Human
ugagcucccucucagcucc

SEQ ID NO: 1047621 - RNA, 26 nt, Human
ugagcucccucucagcuccuucaggg

SEQ ID NO: 1047622 - RNA, 18 nt, Human
ugauaguggcuuugaccu

SEQ ID NO: 1047623 - RNA, 18 nt, Human
ugcaacgagaucacagac

SEQ ID NO: 1047624 - RNA, 23 nt, Human
ugcacuagauacuucuagacacu

SEQ ID NO: 1047625 - RNA, 21 nt, Human
ugcagaggagcucugaucggg

SEQ ID NO: 1047626 - RNA, 21 nt, Human
ugccacagcaucaccaugggg

SEQ ID NO: 1047627 - RNA, 20 nt, Human
ugccccaagcccucacaaac

SEQ ID NO: 1047628 - RNA, 22 nt, Human
ugcccucaagcuaaacagccag

SEQ ID NO: 1047629 - RNA, 21 nt, Human
uggaaggagaggaagccccca

SEQ ID NO: 1047630 - RNA, 22 nt, Human
uggaaggagaggaagcccccac

SEQ ID NO: 1047631 - RNA, 20 nt, Human
uggagcagugcaacgagauc

SEQ ID NO: 1047632 - RNA, 24 nt, Human
uggaggucccagggggagcuggag

SEQ ID NO: 1047633 - RNA, 22 nt, Human
uggcgggggcagcccggggucc

SEQ ID NO: 1047634 - RNA, 18 nt, Human
uggcuggggugacaagga

SEQ ID NO: 1047635 - RNA, 18 nt, Human
ugggcaggggaggagggu

SEQ ID NO: 1047636 - RNA, 23 nt, Human
ugggcaggggaggaggguuggca

SEQ ID NO: 1047637 - RNA, 23 nt, Human
ugucguuuucauaguuaaaaucu

SEQ ID NO: 1047638 - RNA, 18 nt, Human
uuaaaaaaaaaauaggaa

SEQ ID NO: 1047639 - RNA, 20 nt, Human
uuaaucuuaaaaaaaaaaua

SEQ ID NO: 1047640 - RNA, 21 nt, Human
uuagguaguaagaaauccacc

SEQ ID NO: 1047641 - RNA, 20 nt, Human
uuaguuccgugggcucccau

SEQ ID NO: 1047642 - RNA, 19 nt, Human
uuaguugguuuucuugggc

SEQ ID NO: 1047643 - RNA, 21 nt, Human
uucugccuccgccaccaucug

SEQ ID NO: 1047644 - RNA, 22 nt, Human
uuggaaccagaggguggaagga

SEQ ID NO: 1047645 - RNA, 21 nt, Human
uuugaccuagggaagaagagg

SEQ ID NO: 1047646 - RNA, 22 nt, Human
uuugaccuagggaagaagaggu

SEQ ID NO: 1047647 - RNA, 21 nt, Human
uuuggagaaguugugggcagg

SEQ ID NO: 1047648 - RNA, 19 nt, Human
aaaagucuucagggcccac

SEQ ID NO: 1047649 - RNA, 19 nt, Human
aaacaugugcaccccugca

SEQ ID NO: 1047650 - RNA, 24 nt, Human
aaagggaaaggagagguggccugg

SEQ ID NO: 1047651 - RNA, 18 nt, Human
aacauacaccucccaugc

SEQ ID NO: 1047652 - RNA, 21 nt, Human
aagagccccccacuuugccga

SEQ ID NO: 1047653 - RNA, 22 nt, Human
aauacaagccugcacacucaaa

SEQ ID NO: 1047654 - RNA, 19 nt, Human
acaaagcagagagcuaagc

SEQ ID NO: 1047655 - RNA, 23 nt, Human
acagggaagcgauauuuuccuca

SEQ ID NO: 1047656 - RNA, 22 nt, Human
accaauucaacauccaaugcug

SEQ ID NO: 1047657 - RNA, 26 nt, Human
acccucccacacgccccuuuccgcca

SEQ ID NO: 1047658 - RNA, 18 nt, Human
accugcaaucaugccagc

SEQ ID NO: 1047659 - RNA, 23 nt, Human
acuacuccugguucccuuuccug

SEQ ID NO: 1047660 - RNA, 25 nt, Human
acucuguaacucgcggagccugcca

SEQ ID NO: 1047661 - RNA, 19 nt, Human
agcagccacuaaaccuccu

SEQ ID NO: 1047662 - RNA, 22 nt, Human
agcagccacuaaaccuccuaca

SEQ ID NO: 1047663 - RNA, 22 nt, Human
agccaaccucuggcuccuccug

SEQ ID NO: 1047664 - RNA, 23 nt, Human
agccccgcgccaggccccugcgc

SEQ ID NO: 1047665 - RNA, 22 nt, Human
agcgauauuuuccucaucggcc

SEQ ID NO: 1047666 - RNA, 18 nt, Human
agcuacagacaaaaaguc

SEQ ID NO: 1047667 - RNA, 21 nt, Human
aggcugggguaggccaugagg

SEQ ID NO: 1047668 - RNA, 23 nt, Human
agucaccaccuuccggcguuaaa

SEQ ID NO: 1047669 - RNA, 18 nt, Human
aguggagaagaaaggcug

SEQ ID NO: 1047670 - RNA, 25 nt, Human
augcuuauucacacaugccuacaca

SEQ ID NO: 1047671 - RNA, 18 nt, Human
augugcccaaaggcagag

SEQ ID NO: 1047672 - RNA, 25 nt, Human
caaauauauacauauacccuugcac

SEQ ID NO: 1047673 - RNA, 26 nt, Human
caaccucuggcuccuccugacagucc

SEQ ID NO: 1047674 - RNA, 24 nt, Human
caagacucacccacucuguaacuc

SEQ ID NO: 1047675 - RNA, 20 nt, Human
cacacaugccuacacacacc

SEQ ID NO: 1047676 - RNA, 23 nt, Human
cacacugccaaaauugcagccaa

SEQ ID NO: 1047677 - RNA, 27 nt, Human
cacauacaccuaauacaagccugcaca

SEQ ID NO: 1047678 - RNA, 29 nt, Human
cacaugccuacacacaccagccuacaugg

SEQ ID NO: 1047679 - RNA, 21 nt, Human
caccagccuacauguuagcac

SEQ ID NO: 1047680 - RNA, 18 nt, Human
cacgccccuuuccgccac

SEQ ID NO: 1047681 - RNA, 25 nt, Human
cacgccccuuuccgccacgcggcuu

SEQ ID NO: 1047682 - RNA, 27 nt, Human
cacucaugcgcauauacacacacugcu

SEQ ID NO: 1047683 - RNA, 21 nt, Human
cacucuguaacucgcggagcc

SEQ ID NO: 1047684 - RNA, 22 nt, Human
cacugccaaaauugcagccaaa

SEQ ID NO: 1047685 - RNA, 18 nt, Human
cacuguuaucaucuuucc

SEQ ID NO: 1047686 - RNA, 18 nt, Human
cagaagcuuaaaugaaca

SEQ ID NO: 1047687 - RNA, 23 nt, Human
cagagcagccacuaaaccuccua

SEQ ID NO: 1047688 - RNA, 21 nt, Human
cagcgcgcccagccccagucc

SEQ ID NO: 1047689 - RNA, 18 nt, Human
cagugacuuccaugccac

SEQ ID NO: 1047690 - RNA, 24 nt, Human
cauacacacucaugccuaccugca

SEQ ID NO: 1047691 - RNA, 22 nt, Human
caucagggacaauagccucagc

SEQ ID NO: 1047692 - RNA, 19 nt, Human
caucuucaucacuacuccu

SEQ ID NO: 1047693 - RNA, 28 nt, Human
caugcgcauauacacacacugcugggua

SEQ ID NO: 1047694 - RNA, 21 nt, Human
caugugcacacagcacacuua

SEQ ID NO: 1047695 - RNA, 19 nt, Human
caugugcccaaaggcagag

SEQ ID NO: 1047696 - RNA, 20 nt, Human
caugugcccaaaggcagagu

SEQ ID NO: 1047697 - RNA, 19 nt, Human
ccaccaguguccccucuuc

SEQ ID NO: 1047698 - RNA, 21 nt, Human
cccacacgccccuuuccgcca

SEQ ID NO: 1047699 - RNA, 26 nt, Human
cccaccgccgggacaaccccuaaggc

SEQ ID NO: 1047700 - RNA, 23 nt, Human
cccaucucccaugugcccaaagg

SEQ ID NO: 1047701 - RNA, 19 nt, Human
ccccgcgccaggccccugc

SEQ ID NO: 1047702 - RNA, 22 nt, Human
ccccgcgccaggccccugcgcc

SEQ ID NO: 1047703 - RNA, 19 nt, Human
ccccucacccccacucucu

SEQ ID NO: 1047704 - RNA, 20 nt, Human
cccgcgccaggccccugcgc

SEQ ID NO: 1047705 - RNA, 24 nt, Human
cccugcgccggaaccgcuucgccc

SEQ ID NO: 1047706 - RNA, 19 nt, Human
ccggaaccgcuucgccccc

SEQ ID NO: 1047707 - RNA, 23 nt, Human
ccggcuucguccucuacccuccc

SEQ ID NO: 1047708 - RNA, 18 nt, Human
ccuaacauacaccuccca

SEQ ID NO: 1047709 - RNA, 22 nt, Human
ccucuccgcaguuacccuccca

SEQ ID NO: 1047710 - RNA, 22 nt, Human
ccugcaaucaugccagcaaauu

SEQ ID NO: 1047711 - RNA, 21 nt, Human
ccugggcgucuccgcggucca

SEQ ID NO: 1047712 - RNA, 22 nt, Human
cgcccagccccagucccggacu

SEQ ID NO: 1047713 - RNA, 19 nt, Human
cggagccccgcgccaggcc

SEQ ID NO: 1047714 - RNA, 18 nt, Human
cuaaagccagagaggcac

SEQ ID NO: 1047715 - RNA, 21 nt, Human
cuaaagccagagaggcacagc

SEQ ID NO: 1047716 - RNA, 18 nt, Human
cuagucccugggcugggg

SEQ ID NO: 1047717 - RNA, 25 nt, Human
cucacacaugccugcaaauauauac

SEQ ID NO: 1047718 - RNA, 22 nt, Human
cuccacacacugccaaaauugc

SEQ ID NO: 1047719 - RNA, 24 nt, Human
cucucagaucugucuucagcccag

SEQ ID NO: 1047720 - RNA, 19 nt, Human
cucuccgcaguuacccucc

SEQ ID NO: 1047721 - RNA, 20 nt, Human
cucugugcguccugcccuuc

SEQ ID NO: 1047722 - RNA, 21 nt, Human
cugcagauaaauuagcugugu

SEQ ID NO: 1047723 - RNA, 18 nt, Human
cuggcucuggcuccgccc

SEQ ID NO: 1047724 - RNA, 28 nt, Human
cuguucccucggucuagcauucucuucc

SEQ ID NO: 1047725 - RNA, 30 nt, Human
cuuacauacuacacacacacacauauggug

SEQ ID NO: 1047726 - RNA, 24 nt, Human
cuucagagaaaugaaccaaaccaa

SEQ ID NO: 1047727 - RNA, 24 nt, Human
cuucagggcccaccccucaccccc

SEQ ID NO: 1047728 - RNA, 19 nt, Human
cuuccagguccggugcucu

SEQ ID NO: 1047729 - RNA, 27 nt, Human
cuugcaagcuuauaaacauacauugcc

SEQ ID NO: 1047730 - RNA, 22 nt, Human
gaacacgguuugcaacagcucc

SEQ ID NO: 1047731 - RNA, 25 nt, Human
gaccucauucucugcuguagcuuca

SEQ ID NO: 1047732 - RNA, 19 nt, Human
gacuucagagaaaugaacc

SEQ ID NO: 1047733 - RNA, 25 nt, Human
gaggcgcccgcuccggcgcgucugg

SEQ ID NO: 1047734 - RNA, 21 nt, Human
gcccugguggugucuaguccc

SEQ ID NO: 1047735 - RNA, 22 nt, Human
gcgucuggcucuggcuccgccc

SEQ ID NO: 1047736 - RNA, 18 nt, Human
gcuuccucacauacaccu

SEQ ID NO: 1047737 - RNA, 20 nt, Human
gggguuccucggccugggcg

SEQ ID NO: 1047738 - RNA, 20 nt, Human
guccaggcgugggugcgggg

SEQ ID NO: 1047739 - RNA, 23 nt, Human
uaaacuccucaauggcuucccca

SEQ ID NO: 1047740 - RNA, 21 nt, Human
uaacucgcggagccugccaau

SEQ ID NO: 1047741 - RNA, 22 nt, Human
uacacacacacacauauguuca

SEQ ID NO: 1047742 - RNA, 23 nt, Human
uacacacaccagccuacauguua

SEQ ID NO: 1047743 - RNA, 23 nt, Human
uacacaugugcacacagcacacu

SEQ ID NO: 1047744 - RNA, 21 nt, Human
uagacacacacaucuucugcc

SEQ ID NO: 1047745 - RNA, 22 nt, Human
uauacaugcuuauucacacaug

SEQ ID NO: 1047746 - RNA, 18 nt, Human
uauccaaccggcguagag

SEQ ID NO: 1047747 - RNA, 30 nt, Human
ucacccaccaguguccccucuucauaccag

SEQ ID NO: 1047748 - RNA, 19 nt, Human
ucagagaaaugaaccaaac

SEQ ID NO: 1047749 - RNA, 19 nt, Human
ucagcugagcaagucuggg

SEQ ID NO: 1047750 - RNA, 22 nt, Human
ucaugcgcauauacacacagug

SEQ ID NO: 1047751 - RNA, 21 nt, Human
uccaacugcuauccaaccggc

SEQ ID NO: 1047752 - RNA, 26 nt, Human
uccaagacucacccacucuguaacuc

SEQ ID NO: 1047753 - RNA, 20 nt, Human
uccaauggagagaugguuug

SEQ ID NO: 1047754 - RNA, 21 nt, Human
uccacacacugccaaaauugc

SEQ ID NO: 1047755 - RNA, 26 nt, Human
uccacacacugccaaaauugcagcca

SEQ ID NO: 1047756 - RNA, 20 nt, Human
uccacuguuaucaucuuucc

SEQ ID NO: 1047757 - RNA, 25 nt, Human
ucccaugugcccaaaggcagaguuc

SEQ ID NO: 1047758 - RNA, 22 nt, Human
uccccauccccaccaucaucuu

SEQ ID NO: 1047759 - RNA, 21 nt, Human
uccccuauguccucugucccc

SEQ ID NO: 1047760 - RNA, 22 nt, Human
ucccgggcagcgcgcccagccc

SEQ ID NO: 1047761 - RNA, 23 nt, Human
ucccucuccgcaguuacccuccc

SEQ ID NO: 1047762 - RNA, 19 nt, Human
uccucaauggcuuccccac

SEQ ID NO: 1047763 - RNA, 21 nt, Human
ucgcugcagacaccgugccau

SEQ ID NO: 1047764 - RNA, 19 nt, Human
ucuagucccugggcugggg

SEQ ID NO: 1047765 - RNA, 19 nt, Human
ucucagucuccugcaaagg

SEQ ID NO: 1047766 - RNA, 20 nt, Human
ucuccaagacucacccacuc

SEQ ID NO: 1047767 - RNA, 21 nt, Human
ucuccagggaacagugggacc

SEQ ID NO: 1047768 - RNA, 19 nt, Human
ucugccuacaaacacacau

SEQ ID NO: 1047769 - RNA, 25 nt, Human
ucuugcauucucuuggcucccaaga

SEQ ID NO: 1047770 - RNA, 19 nt, Human
ugaaagaagggguuaaaau

SEQ ID NO: 1047771 - RNA, 23 nt, Human
ugacacuguccccuucacauccc

SEQ ID NO: 1047772 - RNA, 19 nt, Human
ugaggaacacaaggugugg

SEQ ID NO: 1047773 - RNA, 20 nt, Human
ugaggaacacaagguguggg

SEQ ID NO: 1047774 - RNA, 24 nt, Human
ugcacacacaagggcuuccucaca

SEQ ID NO: 1047775 - RNA, 24 nt, Human
ugccuacacacaccagccuacaug

SEQ ID NO: 1047776 - RNA, 19 nt, Human
ugcucacccaccaggaucu

SEQ ID NO: 1047777 - RNA, 22 nt, Human
uggcauucgcugggcccuuccc

SEQ ID NO: 1047778 - RNA, 22 nt, Human
uggcucuggcuccgcccggccc

SEQ ID NO: 1047779 - RNA, 22 nt, Human
ugggaacugguauuuuagaauu

SEQ ID NO: 1047780 - RNA, 18 nt, Human
ugucagagcacauuccuu

SEQ ID NO: 1047781 - RNA, 19 nt, Human
uguccucuguccccauccc

SEQ ID NO: 1047782 - RNA, 19 nt, Human
uguggccaaacaugugcac

SEQ ID NO: 1047783 - RNA, 18 nt, Human
uguggguggacacccaca

SEQ ID NO: 1047784 - RNA, 19 nt, Human
uguguguacacaugugcac

SEQ ID NO: 1047785 - RNA, 20 nt, Human
uguguguacacaugugcaca

SEQ ID NO: 1047786 - RNA, 22 nt, Human
uguguguacacaugugcacaca

SEQ ID NO: 1047787 - RNA, 24 nt, Human
uguucacucuuacaugcucacaua

SEQ ID NO: 1047788 - RNA, 23 nt, Human
uuccucacauacaccuaauacaa

SEQ ID NO: 1047789 - RNA, 20 nt, Human
uucgcccccgcgcggggccg

SEQ ID NO: 1047790 - RNA, 21 nt, Human
uucgcugggcccuucccauca

SEQ ID NO: 1047791 - RNA, 18 nt, Human
uugacccaggccuuccag

SEQ ID NO: 1047792 - RNA, 22 nt, Human
aagaggccacaacgcccaagca

SEQ ID NO: 1047793 - RNA, 24 nt, Human
aaggacccaaaacucuggaaagga

SEQ ID NO: 1047794 - RNA, 24 nt, Human
acagacaggaaagcauuggcuucg

SEQ ID NO: 1047795 - RNA, 26 nt, Human
accuugguaacuugccaguuacgcug

SEQ ID NO: 1047796 - RNA, 18 nt, Human
aggcacagacuucacugc

SEQ ID NO: 1047797 - RNA, 19 nt, Human
auggaacagcuggaaggga

SEQ ID NO: 1047798 - RNA, 22 nt, Human
cacaguucacuguaaaggcaag

SEQ ID NO: 1047799 - RNA, 22 nt, Human
cagagacccaggaccucagcuc

SEQ ID NO: 1047800 - RNA, 19 nt, Human
caguuacgcugguggugga

SEQ ID NO: 1047801 - RNA, 23 nt, Human
ccguuccgcuccauccgccgccu

SEQ ID NO: 1047802 - RNA, 20 nt, Human
cuccauccgccgccugcgcc

SEQ ID NO: 1047803 - RNA, 21 nt, Human
cuccauccgccgccugcgccc

SEQ ID NO: 1047804 - RNA, 23 nt, Human
cuguccugcugguaaacaacccu

SEQ ID NO: 1047805 - RNA, 22 nt, Human
cuucccagcugcaccagguccc

SEQ ID NO: 1047806 - RNA, 23 nt, Human
gagaauggaacagcuggaaggga

SEQ ID NO: 1047807 - RNA, 21 nt, Human
gagagaauggaacagcuggaa

SEQ ID NO: 1047808 - RNA, 18 nt, Human
gcuccauccgccgccugc

SEQ ID NO: 1047809 - RNA, 18 nt, Human
gugguggagagaauggaa

SEQ ID NO: 1047810 - RNA, 18 nt, Human
ucacaguucacuguaaag

SEQ ID NO: 1047811 - RNA, 19 nt, Human
ucagaggacacgcagugca

SEQ ID NO: 1047812 - RNA, 19 nt, Human
ucccaagcuucccagcugc

SEQ ID NO: 1047813 - RNA, 21 nt, Human
ucccaagcuucccagcugcac

SEQ ID NO: 1047814 - RNA, 19 nt, Human
uccugcaucaaauacagac

SEQ ID NO: 1047815 - RNA, 23 nt, Human
ucucaagaccccuagccguuccg

SEQ ID NO: 1047816 - RNA, 20 nt, Human
ugaucacugcuguuucagga

SEQ ID NO: 1047817 - RNA, 30 nt, Human
uggagagaauggaacagcuggaagggagaa

SEQ ID NO: 1047818 - RNA, 20 nt, Human
ugggaaguguuuaauccugc

SEQ ID NO: 1047819 - RNA, 25 nt, Human
ugggaaguguuuaauccugcaucaa

SEQ ID NO: 1047820 - RNA, 19 nt, Human
uggugguggagagaaugga

SEQ ID NO: 1047821 - RNA, 24 nt, Human
uuggcuucgagagaaucacaguuc

SEQ ID NO: 1047822 - RNA, 21 nt, Human
aaaaucccuucagaucccgcu

SEQ ID NO: 1047823 - RNA, 18 nt, Human
aaacagaaggagauucua

SEQ ID NO: 1047824 - RNA, 21 nt, Human
aguuuuauuaaaacagaagga

SEQ ID NO: 1047825 - RNA, 19 nt, Human
aucccuucagaucccgcua

SEQ ID NO: 1047826 - RNA, 22 nt, Human
caaaucaaaagcaucuacaaua

SEQ ID NO: 1047827 - RNA, 18 nt, Human
cagcucagaggugcgcgg

SEQ ID NO: 1047828 - RNA, 22 nt, Human
cauagccagaaacuaaguccaa

SEQ ID NO: 1047829 - RNA, 24 nt, Human
caucauagccagaaacuaagucca

SEQ ID NO: 1047830 - RNA, 21 nt, Human
ccagaaacuaaguccaaauca

SEQ ID NO: 1047831 - RNA, 21 nt, Human
ccgccacuacacuuaggcugg

SEQ ID NO: 1047832 - RNA, 19 nt, Human
uccgugcuucuccccagga

SEQ ID NO: 1047833 - RNA, 21 nt, Human
uggguaaaaagggagauaagg

SEQ ID NO: 1047834 - RNA, 20 nt, Human
uucaaaaucccuucagaucc

SEQ ID NO: 1047835 - RNA, 21 nt, Human
uuucaaaaucccuucagaucc

SEQ ID NO: 1047836 - RNA, 21 nt, Human
aagagaaagcagacgcgugca

SEQ ID NO: 1047837 - RNA, 25 nt, Human
aggcagaagagaugaucucucugca

SEQ ID NO: 1047838 - RNA, 19 nt, Human
gcuugaggcagaagagaug

SEQ ID NO: 1047839 - RNA, 20 nt, Human
gcuugaggcagaagagauga

SEQ ID NO: 1047840 - RNA, 18 nt, Human
ggcagaagagaugaucuc

SEQ ID NO: 1047841 - RNA, 21 nt, Human
ggcuugaggcagaagagauga

SEQ ID NO: 1047842 - RNA, 21 nt, Human
uggcuugaggcagaagagaug

SEQ ID NO: 1047843 - RNA, 22 nt, Human
aaacaggaguucaaaccucagc

SEQ ID NO: 1047844 - RNA, 23 nt, Human
aaaccucagcagaacaggacucu

SEQ ID NO: 1047845 - RNA, 18 nt, Human
agguccccgccgccccuc

SEQ ID NO: 1047846 - RNA, 26 nt, Human
caauaaaaacaggaguucaaaccuca

SEQ ID NO: 1047847 - RNA, 22 nt, Human
cagaacaggacucugggguccc

SEQ ID NO: 1047848 - RNA, 18 nt, Human
ccccagagggcccuccuc

SEQ ID NO: 1047849 - RNA, 18 nt, Human
ccccagagggcccuccuc

SEQ ID NO: 1047850 - RNA, 19 nt, Human
ccccgccgccccucgcugc

SEQ ID NO: 1047851 - RNA, 28 nt, Human
cccggugccagguccccgccgccccucc

SEQ ID NO: 1047852 - RNA, 27 nt, Human
cccucgcugcccucgcgcugcggcccg

SEQ ID NO: 1047853 - RNA, 21 nt, Human
ccgcccggugccagguccccg

SEQ ID NO: 1047854 - RNA, 18 nt, Human
ccgccgccccucgcugcc

SEQ ID NO: 1047855 - RNA, 19 nt, Human
ccgccgccccucgcugccc

SEQ ID NO: 1047856 - RNA, 20 nt, Human
ccgccgccccucgcugcccu

SEQ ID NO: 1047857 - RNA, 31 nt, Human
ccucgcgcugcggcccggagcggccccuccu

SEQ ID NO: 1047858 - RNA, 20 nt, Human
ccucgcugcccucgcgcugc

SEQ ID NO: 1047859 - RNA, 18 nt, Human
cgcugccgccggccccgc

SEQ ID NO: 1047860 - RNA, 24 nt, Human
cugcggcccggagcggccccuccc

SEQ ID NO: 1047861 - RNA, 22 nt, Human
gacucugggguccccagagggc

SEQ ID NO: 1047862 - RNA, 23 nt, Human
gacucugggguccccagagggcc

SEQ ID NO: 1047863 - RNA, 21 nt, Human
gccccuccccgguacggcccg

SEQ ID NO: 1047864 - RNA, 18 nt, Human
gcugcggcccggagcggc

SEQ ID NO: 1047865 - RNA, 19 nt, Human
ggacucugggguccccaga

SEQ ID NO: 1047866 - RNA, 21 nt, Human
gggcaauuuauuuuacaauaa

SEQ ID NO: 1047867 - RNA, 19 nt, Human
gggcggggagcucggcuuc

SEQ ID NO: 1047868 - RNA, 22 nt, Human
ggguccccagagggcccuccuc

SEQ ID NO: 1047869 - RNA, 22 nt, Human
uagggggacgacaggggugggc

SEQ ID NO: 1047870 - RNA, 18 nt, Human
uauuuuacaauaaaaaca

SEQ ID NO: 1047871 - RNA, 19 nt, Human
ucacacugggugaggaggg

SEQ ID NO: 1047872 - RNA, 22 nt, Human
uccccgccgccccucgcugccc

SEQ ID NO: 1047873 - RNA, 23 nt, Human
uccccgccgccccucgcugcccc

SEQ ID NO: 1047874 - RNA, 21 nt, Human
uccccgguacggcccgggucc

SEQ ID NO: 1047875 - RNA, 22 nt, Human
uuaggggaccagaauggggggc

SEQ ID NO: 1047876 - RNA, 20 nt, Human
uuuuuuuuuuuaggggacca

SEQ ID NO: 1047877 - RNA, 20 nt, Human
uuuuuuuuuuuuaggggacc

SEQ ID NO: 1047878 - RNA, 22 nt, Human
aaaaaaaaaauuauccauggaa

SEQ ID NO: 1047879 - RNA, 23 nt, Human
aaacagaggcccagacagguuca

SEQ ID NO: 1047880 - RNA, 23 nt, Human
aaacagggcagccagcaagccca

SEQ ID NO: 1047881 - RNA, 20 nt, Human
aacauuuucgccgauaacaa

SEQ ID NO: 1047882 - RNA, 19 nt, Human
aagcuaugcacuuugccuc

SEQ ID NO: 1047883 - RNA, 25 nt, Human
agaaucauaaauaauucugccacug

SEQ ID NO: 1047884 - RNA, 22 nt, Human
agcugcccucgcggcaagcucc

SEQ ID NO: 1047885 - RNA, 21 nt, Human
aggaagugucugggccgggau

SEQ ID NO: 1047886 - RNA, 24 nt, Human
aggcagcugcccucgcggcaagcu

SEQ ID NO: 1047887 - RNA, 23 nt, Human
agugucugggccgggaugugagu

SEQ ID NO: 1047888 - RNA, 22 nt, Human
caaaacagggcagccagcaagc

SEQ ID NO: 1047889 - RNA, 24 nt, Human
caaaacagggcagccagcaagccc

SEQ ID NO: 1047890 - RNA, 24 nt, Human
caccuaucacaccagcuaccacuu

SEQ ID NO: 1047891 - RNA, 24 nt, Human
cacucuuuccucugugccgcucca

SEQ ID NO: 1047892 - RNA, 22 nt, Human
cagcaagcccagcuccugccag

SEQ ID NO: 1047893 - RNA, 21 nt, Human
cagccagcaagcccagcuccu

SEQ ID NO: 1047894 - RNA, 20 nt, Human
caggagggcguggguuggca

SEQ ID NO: 1047895 - RNA, 18 nt, Human
cagggcagccagcaagcc

SEQ ID NO: 1047896 - RNA, 19 nt, Human
caguauggauuaugucccc

SEQ ID NO: 1047897 - RNA, 21 nt, Human
cauagcaacauuauacaauag

SEQ ID NO: 1047898 - RNA, 27 nt, Human
ccaaagcccacacucuuuccucugugc

SEQ ID NO: 1047899 - RNA, 21 nt, Human
ccacacugcccucucugccug

SEQ ID NO: 1047900 - RNA, 24 nt, Human
ccacacugcccucucugccugggc

SEQ ID NO: 1047901 - RNA, 21 nt, Human
ccagacagguucaucaacugg

SEQ ID NO: 1047902 - RNA, 21 nt, Human
cccaccuaucacaccagcuac

SEQ ID NO: 1047903 - RNA, 24 nt, Human
cccagccuuagacaaccaguuggc

SEQ ID NO: 1047904 - RNA, 19 nt, Human
ccccucugucucuguggga

SEQ ID NO: 1047905 - RNA, 19 nt, Human
ccuccacacugcccucucu

SEQ ID NO: 1047906 - RNA, 28 nt, Human
cuagcaacuucccuccacacugcccucu

SEQ ID NO: 1047907 - RNA, 21 nt, Human
cucuaagcuaugcacuuugcc

SEQ ID NO: 1047908 - RNA, 19 nt, Human
cugcccucucugccugggc

SEQ ID NO: 1047909 - RNA, 23 nt, Human
cugcuggucugacugucuccugc

SEQ ID NO: 1047910 - RNA, 29 nt, Human
cuuaaccccuucccagccuuagacaacca

SEQ ID NO: 1047911 - RNA, 21 nt, Human
cuuggcccaccuaucacacca

SEQ ID NO: 1047912 - RNA, 23 nt, Human
cuuggcccaccuaucacaccagc

SEQ ID NO: 1047913 - RNA, 24 nt, Human
gagugcccgcugaggcagcugccc

SEQ ID NO: 1047914 - RNA, 25 nt, Human
ggcaucuuaaccccuucccagccuu

SEQ ID NO: 1047915 - RNA, 24 nt, Human
ggggagcagugccuggguucugca

SEQ ID NO: 1047916 - RNA, 18 nt, Human
uagcgaguacuuccuucc

SEQ ID NO: 1047917 - RNA, 18 nt, Human
ucacaccagcuaccacuu

SEQ ID NO: 1047918 - RNA, 19 nt, Human
uccccaaguagagggaucc

SEQ ID NO: 1047919 - RNA, 19 nt, Human
ucccuccacacugcccucu

SEQ ID NO: 1047920 - RNA, 23 nt, Human
ucugacugucuccugccauguua

SEQ ID NO: 1047921 - RNA, 19 nt, Human
ucugccacugugaugugcc

SEQ ID NO: 1047922 - RNA, 20 nt, Human
ugaggaaacagaggcccaga

SEQ ID NO: 1047923 - RNA, 24 nt, Human
ugaugugccugggaaagaggccag

SEQ ID NO: 1047924 - RNA, 21 nt, Human
ugcugugcugucuccaaagcc

SEQ ID NO: 1047925 - RNA, 18 nt, Human
uggcucaaggucacacag

SEQ ID NO: 1047926 - RNA, 19 nt, Human
ugucuccaaagcccacacu

SEQ ID NO: 1047927 - RNA, 24 nt, Human
ugugaugugccugggaaagaggcc

SEQ ID NO: 1047928 - RNA, 21 nt, Human
ugugccugggaaagaggccag

SEQ ID NO: 1047929 - RNA, 22 nt, Human
uugccauucaggagggcguggg

SEQ ID NO: 1047930 - RNA, 21 nt, Human
uuguuccccucugucucugug

SEQ ID NO: 1047931 - RNA, 25 nt, Human
uuuauucaccuguauuuaucaaggg

SEQ ID NO: 1047932 - RNA, 20 nt, Human
aacucucccuccagcccccg

SEQ ID NO: 1047933 - RNA, 22 nt, Human
accagccccagcccagucuccu

SEQ ID NO: 1047934 - RNA, 25 nt, Human
acucucccuccagcccccgcuccac

SEQ ID NO: 1047935 - RNA, 20 nt, Human
auagagugagggugugauac

SEQ ID NO: 1047936 - RNA, 21 nt, Human
caaccaaugauccaaguucaa

SEQ ID NO: 1047937 - RNA, 25 nt, Human
cagcccccgcuccacccccgcacac

SEQ ID NO: 1047938 - RNA, 24 nt, Human
caugccgcacucagccuggggggc

SEQ ID NO: 1047939 - RNA, 24 nt, Human
cccauucucccucuagcccccuca

SEQ ID NO: 1047940 - RNA, 18 nt, Human
cccccgcuccacccccgc

SEQ ID NO: 1047941 - RNA, 21 nt, Human
ccuccagcccccgcuccaccc

SEQ ID NO: 1047942 - RNA, 25 nt, Human
ccucccauaaauauagagugagggu

SEQ ID NO: 1047943 - RNA, 19 nt, Human
cucccucuagcccccucaa

SEQ ID NO: 1047944 - RNA, 19 nt, Human
gauuugacgucaguugcuc

SEQ ID NO: 1047945 - RNA, 20 nt, Human
gcccccucaaccaaugauca

SEQ ID NO: 1047946 - RNA, 18 nt, Human
ggagaucaugccgcacuc

SEQ ID NO: 1047947 - RNA, 20 nt, Human
gucaguugcucagcuccauu

SEQ ID NO: 1047948 - RNA, 21 nt, Human
ucccauucucccucuagcccc

SEQ ID NO: 1047949 - RNA, 23 nt, Human
ugcucagcuccauuccuuccuuc

SEQ ID NO: 1047950 - RNA, 21 nt, Human
uggcagccucuugagucgacu

SEQ ID NO: 1047951 - RNA, 24 nt, Human
cucucuaggcucgggcagaccagc

SEQ ID NO: 1047952 - RNA, 23 nt, Human
cugaugaugggaaugcuguuucc

SEQ ID NO: 1047953 - RNA, 18 nt, Human
cuguguggccuugaguaa

SEQ ID NO: 1047954 - RNA, 23 nt, Human
uacuugcuguguggccuugagua

SEQ ID NO: 1047955 - RNA, 19 nt, Human
uagguaccaagucugauga

SEQ ID NO: 1047956 - RNA, 22 nt, Human
ucaccuacuugcuguguggccu

SEQ ID NO: 1047957 - RNA, 18 nt, Human
ucucuaggcucgggcaga

SEQ ID NO: 1047958 - RNA, 20 nt, Human
ccacugcggggguacagaga

SEQ ID NO: 1047959 - RNA, 18 nt, Human
ugacuaacuuuauuggca

SEQ ID NO: 1047960 - RNA, 22 nt, Human
ugcucuggagaggcuggcuggu

SEQ ID NO: 1047961 - RNA, 20 nt, Human
aaacucaucaguaauaggac

SEQ ID NO: 1047962 - RNA, 18 nt, Human
aaccacagcaaaacacaa

SEQ ID NO: 1047963 - RNA, 18 nt, Human
aaggaugcaaacagaugg

SEQ ID NO: 1047964 - RNA, 21 nt, Human
acaggaguggucucugggguu

SEQ ID NO: 1047965 - RNA, 25 nt, Human
acaggaguggucucugggguucccg

SEQ ID NO: 1047966 - RNA, 20 nt, Human
accacagcaaaacacaagga

SEQ ID NO: 1047967 - RNA, 22 nt, Human
agaguaaauucauuaugaauaa

SEQ ID NO: 1047968 - RNA, 18 nt, Human
agcacugguagcgcccgc

SEQ ID NO: 1047969 - RNA, 20 nt, Human
caaaacacaaggaugcaaac

SEQ ID NO: 1047970 - RNA, 22 nt, Human
caaaacacaaggaugcaaacag

SEQ ID NO: 1047971 - RNA, 19 nt, Human
caaacagauggcuuugaaa

SEQ ID NO: 1047972 - RNA, 19 nt, Human
cauggugcccgagcacugg

SEQ ID NO: 1047973 - RNA, 22 nt, Human
ccacagcaaaacacaaggaugc

SEQ ID NO: 1047974 - RNA, 20 nt, Human
ccagccgauuguuccaaggg

SEQ ID NO: 1047975 - RNA, 24 nt, Human
ccccucagcucuccacaggaguug

SEQ ID NO: 1047976 - RNA, 24 nt, Human
ccccugagcucccggagggccugu

SEQ ID NO: 1047977 - RNA, 19 nt, Human
cccgcagucggggcgccgc

SEQ ID NO: 1047978 - RNA, 20 nt, Human
cccugagcucccggagggcc

SEQ ID NO: 1047979 - RNA, 21 nt, Human
ccuguaacacaguguaguugg

SEQ ID NO: 1047980 - RNA, 22 nt, Human
ccugugcugaaauauguacugg

SEQ ID NO: 1047981 - RNA, 22 nt, Human
cgcagucggggcgccgcucgcc

SEQ ID NO: 1047982 - RNA, 18 nt, Human
cgccgggaacugcagccc

SEQ ID NO: 1047983 - RNA, 20 nt, Human
cggggccccuggucucuccc

SEQ ID NO: 1047984 - RNA, 24 nt, Human
cucaauguacuuaaauaccaaaaa

SEQ ID NO: 1047985 - RNA, 19 nt, Human
gaccaacgggaccgaucug

SEQ ID NO: 1047986 - RNA, 23 nt, Human
gaggggaagcaggagaccaagga

SEQ ID NO: 1047987 - RNA, 25 nt, Human
gcccgcugucgcuggcacgcgccug

SEQ ID NO: 1047988 - RNA, 18 nt, Human
gcgucggcggagcgcagg

SEQ ID NO: 1047989 - RNA, 23 nt, Human
gcuccuuuaaaaaccacagcaaa

SEQ ID NO: 1047990 - RNA, 23 nt, Human
gcucgccgggaacugcagcccgg

SEQ ID NO: 1047991 - RNA, 19 nt, Human
ggacgguagccgcccccuc

SEQ ID NO: 1047992 - RNA, 20 nt, Human
ggaggaaugagccugcagag

SEQ ID NO: 1047993 - RNA, 21 nt, Human
ggaugcaaacagauggcuuug

SEQ ID NO: 1047994 - RNA, 18 nt, Human
gggaagcaggagaccaag

SEQ ID NO: 1047995 - RNA, 21 nt, Human
gggaagcaggagaccaaggag

SEQ ID NO: 1047996 - RNA, 21 nt, Human
guaguuggcgcuggaguggaa

SEQ ID NO: 1047997 - RNA, 20 nt, Human
uaaaauauucucaagugcuc

SEQ ID NO: 1047998 - RNA, 27 nt, Human
uaacagguuucuacuucuugcugaauu

SEQ ID NO: 1047999 - RNA, 20 nt, Human
uaccaaaaaaacugccugug

SEQ ID NO: 1048000 - RNA, 22 nt, Human
uaccaaaaaaacugccugugcu

SEQ ID NO: 1048001 - RNA, 23 nt, Human
uccaggaccacccggcucagaag

SEQ ID NO: 1048002 - RNA, 23 nt, Human
ucugggguucccgggcucacagc

SEQ ID NO: 1048003 - RNA, 19 nt, Human
ugaaaucgucagccacuac

SEQ ID NO: 1048004 - RNA, 18 nt, Human
ugacuaaauucacaucca

SEQ ID NO: 1048005 - RNA, 21 nt, Human
ugagaggugggggucucgggc

SEQ ID NO: 1048006 - RNA, 24 nt, Human
ugagaggugggggucucgggccga

SEQ ID NO: 1048007 - RNA, 24 nt, Human
ugagaggugggggucucgggcguu

SEQ ID NO: 1048008 - RNA, 23 nt, Human
ugaggggaagcaggagaccaagg

SEQ ID NO: 1048009 - RNA, 24 nt, Human
ugaggggaagcaggagaccaagga

SEQ ID NO: 1048010 - RNA, 25 nt, Human
ugaggggaagcaggagaccaaggag

SEQ ID NO: 1048011 - RNA, 19 nt, Human
uggaggugguguuccggac

SEQ ID NO: 1048012 - RNA, 23 nt, Human
uggcacgcgccuguaacacagug

SEQ ID NO: 1048013 - RNA, 28 nt, Human
uuaaauaccaaaaaaacugccugugcuu

SEQ ID NO: 1048014 - RNA, 23 nt, Human
uuugacccuaaaauauucucaag

SEQ ID NO: 1048015 - RNA, 22 nt, Human
cccucgcaggcuggacaugguc

SEQ ID NO: 1048016 - RNA, 24 nt, Human
ccgguagugaugucaucauccucc

SEQ ID NO: 1048017 - RNA, 22 nt, Human
cguagcaggucaucuccaggga

SEQ ID NO: 1048018 - RNA, 21 nt, Human
gucaccugggacccucgcagg

SEQ ID NO: 1048019 - RNA, 23 nt, Human
aaccugccucuccacagcugaca

SEQ ID NO: 1048020 - RNA, 21 nt, Human
accugccucuccacagcugac

SEQ ID NO: 1048021 - RNA, 19 nt, Human
aggaugucugucagaagcc

SEQ ID NO: 1048022 - RNA, 23 nt, Human
caaaccugccucuccacagcuga

SEQ ID NO: 1048023 - RNA, 22 nt, Human
ccugcaguugcaaaccugccuc

SEQ ID NO: 1048024 - RNA, 21 nt, Human
cugacaguguucaguuucuuc

SEQ ID NO: 1048025 - RNA, 23 nt, Human
cugcaguugcaaaccugccucuc

SEQ ID NO: 1048026 - RNA, 21 nt, Human
gcaguugcaaaccugccucuc

SEQ ID NO: 1048027 - RNA, 22 nt, Human
ggguccugcaguugcaaaccug

SEQ ID NO: 1048028 - RNA, 24 nt, Human
ugacaguguucaguuucuucagga

SEQ ID NO: 1048029 - RNA, 25 nt, Human
ugcaguugcaaaccugccucuccac

SEQ ID NO: 1048030 - RNA, 18 nt, Human
aaacuguauuacaagcaa

SEQ ID NO: 1048031 - RNA, 22 nt, Human
aaucacuuuucaguggguucac

SEQ ID NO: 1048032 - RNA, 19 nt, Human
accaugaagcagacacuuc

SEQ ID NO: 1048033 - RNA, 23 nt, Human
agacacuucggcaacuagaaaug

SEQ ID NO: 1048034 - RNA, 21 nt, Human
caagcaaaugcaccaaauacc

SEQ ID NO: 1048035 - RNA, 19 nt, Human
caccaugaagcagacacuu

SEQ ID NO: 1048036 - RNA, 24 nt, Human
cguucagcaccaugaagcagacac

SEQ ID NO: 1048037 - RNA, 21 nt, Human
cuagcauuuacaaaacaguaa

SEQ ID NO: 1048038 - RNA, 18 nt, Human
gaaaaagcagucugugaa

SEQ ID NO: 1048039 - RNA, 20 nt, Human
gcaaaugcaccaaauaccag

SEQ ID NO: 1048040 - RNA, 24 nt, Human
guucacuucacauucaugcugcac

SEQ ID NO: 1048041 - RNA, 20 nt, Human
uaaaaaacuguauuacaagc

SEQ ID NO: 1048042 - RNA, 24 nt, Human
uaaacuacuagcauuuacaaaaca

SEQ ID NO: 1048043 - RNA, 21 nt, Human
uacaagcaaaugcaccaaaua

SEQ ID NO: 1048044 - RNA, 21 nt, Human
uagauuuuguacacaugguag

SEQ ID NO: 1048045 - RNA, 19 nt, Human
uccagggccgcugcaguug

SEQ ID NO: 1048046 - RNA, 24 nt, Human
ugaaaaagcagucugugaaaugcg

SEQ ID NO: 1048047 - RNA, 19 nt, Human
ugaaguuugcuggagaaca

SEQ ID NO: 1048048 - RNA, 23 nt, Human
uuaaaaaucacuuuucagugggu

SEQ ID NO: 1048049 - RNA, 20 nt, Human
uucacauucaugcugcacug

SEQ ID NO: 1048050 - RNA, 22 nt, Human
uuugcuggagaacauuaaaaau

SEQ ID NO: 1048051 - RNA, 21 nt, Human
aaaaaaaaaaaaaaccacaca

SEQ ID NO: 1048052 - RNA, 24 nt, Human
aaaaaaaaaagaaaaacacacaaa

SEQ ID NO: 1048053 - RNA, 22 nt, Human
aaaaaaaaagaaaaacacacaa

SEQ ID NO: 1048054 - RNA, 21 nt, Human
aaaaaaagaaaaacacacaaa

SEQ ID NO: 1048055 - RNA, 18 nt, Human
aaaaaaccacacacacac

SEQ ID NO: 1048056 - RNA, 25 nt, Human
aaaaaaccacacacacacacaaaua

SEQ ID NO: 1048057 - RNA, 20 nt, Human
aaaaaagaaaaacacacaaa

SEQ ID NO: 1048058 - RNA, 30 nt, Human
aaaaaagaaaaacacacaaauaguuugggg

SEQ ID NO: 1048059 - RNA, 24 nt, Human
aaaaaaggcuguggaaagccuggg

SEQ ID NO: 1048060 - RNA, 26 nt, Human
aaaaacaaaaacaaaaccaaaaaaaa

SEQ ID NO: 1048061 - RNA, 25 nt, Human
aaaacaaaaacaaaaacaaaaccaa

SEQ ID NO: 1048062 - RNA, 26 nt, Human
aaaacaaaaacaaaaacaaaaccaaa

SEQ ID NO: 1048063 - RNA, 22 nt, Human
aaaacaaaaccaaaaaaaaacc

SEQ ID NO: 1048064 - RNA, 24 nt, Human
aaaaccaaaaaaaaaccacaaaua

SEQ ID NO: 1048065 - RNA, 19 nt, Human
aaaaggcuguggaaagccu

SEQ ID NO: 1048066 - RNA, 22 nt, Human
aaacaaaaacaaaaacaaaacc

SEQ ID NO: 1048067 - RNA, 23 nt, Human
aaacaaaaacaaaaacaaaacca

SEQ ID NO: 1048068 - RNA, 25 nt, Human
aaacaaaaacaaaaacaaaaccaaa

SEQ ID NO: 1048069 - RNA, 26 nt, Human
aaacaaaaacaaaaacaaaaccaaaa

SEQ ID NO: 1048070 - RNA, 23 nt, Human
aaacaaaaacaaaaccaaaaaaa

SEQ ID NO: 1048071 - RNA, 20 nt, Human
aaagagaaaacaaaugagaa

SEQ ID NO: 1048072 - RNA, 24 nt, Human
aaauaguuugggaggccgaggcag

SEQ ID NO: 1048073 - RNA, 22 nt, Human
aacaaaaccaaaaaaaaaccac

SEQ ID NO: 1048074 - RNA, 21 nt, Human
aacaaagcugcaaagacaagc

SEQ ID NO: 1048075 - RNA, 26 nt, Human
aacaaaguggcaauuuggaggcagag

SEQ ID NO: 1048076 - RNA, 27 nt, Human
aacaaaguggcaauuuggaggcagaga

SEQ ID NO: 1048077 - RNA, 19 nt, Human
aacauggugaaaccccguc

SEQ ID NO: 1048078 - RNA, 20 nt, Human
aacauggugaaaccccgucu

SEQ ID NO: 1048079 - RNA, 21 nt, Human
aacauggugaaaccccgucuc

SEQ ID NO: 1048080 - RNA, 20 nt, Human
aacauggugaaacccugucu

SEQ ID NO: 1048081 - RNA, 21 nt, Human
aacauggugaaacccugucuc

SEQ ID NO: 1048082 - RNA, 20 nt, Human
aagaaaagggaucucuuagc

SEQ ID NO: 1048083 - RNA, 24 nt, Human
aagcaggaaugagaguaagggugg

SEQ ID NO: 1048084 - RNA, 20 nt, Human
aaggugucaauuaggaagug

SEQ ID NO: 1048085 - RNA, 22 nt, Human
aagugccaaaauacuaaagucu

SEQ ID NO: 1048086 - RNA, 18 nt, Human
aaucgcuugaacccugga

SEQ ID NO: 1048087 - RNA, 24 nt, Human
aaucgcuugaacccuggaggcaga

SEQ ID NO: 1048088 - RNA, 24 nt, Human
acaaaaacaaaaacaaaaccaaaa

SEQ ID NO: 1048089 - RNA, 21 nt, Human
acaaaaccaaaaaaaaaccac

SEQ ID NO: 1048090 - RNA, 24 nt, Human
acaaaaccaaaaaaaaaccacaaa

SEQ ID NO: 1048091 - RNA, 19 nt, Human
acaaagcugcaaagacaag

SEQ ID NO: 1048092 - RNA, 26 nt, Human
acaaaguggcaauuuggaggcagaga

SEQ ID NO: 1048093 - RNA, 20 nt, Human
acagagcaagacuccgucuc

SEQ ID NO: 1048094 - RNA, 24 nt, Human
acagagcaagacuccgucucaaaa

SEQ ID NO: 1048095 - RNA, 19 nt, Human
accacaaauaggccaggcu

SEQ ID NO: 1048096 - RNA, 24 nt, Human
accccgucucuacuaaaaauacaa

SEQ ID NO: 1048097 - RNA, 24 nt, Human
acccugucucuacuaaaaauauaa

SEQ ID NO: 1048098 - RNA, 20 nt, Human
accuuaugucaggaguucaa

SEQ ID NO: 1048099 - RNA, 22 nt, Human
acgccacugcacuccagccugg

SEQ ID NO: 1048100 - RNA, 24 nt, Human
acgccacugcacuccagccugggc

SEQ ID NO: 1048101 - RNA, 18 nt, Human
acugcacuccagccuggg

SEQ ID NO: 1048102 - RNA, 24 nt, Human
acugcacuccagccugggcaaaag

SEQ ID NO: 1048103 - RNA, 24 nt, Human
acugcacucuagccugggcgacag

SEQ ID NO: 1048104 - RNA, 26 nt, Human
acugcacucuagccugggcgacagag

SEQ ID NO: 1048105 - RNA, 22 nt, Human
acuuagcgggaauaaggggaac

SEQ ID NO: 1048106 - RNA, 20 nt, Human
agaaaggagacauaaaaaaa

SEQ ID NO: 1048107 - RNA, 25 nt, Human
agaaaggagacauaaaaaaaggcug

SEQ ID NO: 1048108 - RNA, 26 nt, Human
agaaaggagacauaaaaaaaggcugu

SEQ ID NO: 1048109 - RNA, 21 nt, Human
agacauaaaaaaaggcugugg

SEQ ID NO: 1048110 - RNA, 25 nt, Human
agagcuaacaaagcugcaaagacaa

SEQ ID NO: 1048111 - RNA, 19 nt, Human
agaggaagcaggaaugaga

SEQ ID NO: 1048112 - RNA, 18 nt, Human
agagguugcagugagccg

SEQ ID NO: 1048113 - RNA, 23 nt, Human
agagguugcagugagccgagauc

SEQ ID NO: 1048114 - RNA, 24 nt, Human
agagguugcagugagccgagauca

SEQ ID NO: 1048115 - RNA, 24 nt, Human
agcacuuugggaggcugaggcggg

SEQ ID NO: 1048116 - RNA, 22 nt, Human
agcaggaaugagaguaagggug

SEQ ID NO: 1048117 - RNA, 22 nt, Human
agccuggccaacauggugaaac

SEQ ID NO: 1048118 - RNA, 24 nt, Human
agccuggccaacauggugaaaccc

SEQ ID NO: 1048119 - RNA, 24 nt, Human
agccugggcaaaagugugagacuc

SEQ ID NO: 1048120 - RNA, 24 nt, Human
agccugggcgacagagcaagacuc

SEQ ID NO: 1048121 - RNA, 23 nt, Human
agccuggggaguuaugugggugg

SEQ ID NO: 1048122 - RNA, 20 nt, Human
agcugggcgugguggugggc

SEQ ID NO: 1048123 - RNA, 19 nt, Human
aggaaagaaagagaaaaca

SEQ ID NO: 1048124 - RNA, 19 nt, Human
aggagaggaaagaaagaga

SEQ ID NO: 1048125 - RNA, 18 nt, Human
aggcaagagaaucgcuug

SEQ ID NO: 1048126 - RNA, 20 nt, Human
aggcagagaaggaauaaggu

SEQ ID NO: 1048127 - RNA, 25 nt, Human
aggcagagaaggaauaagguagggu

SEQ ID NO: 1048128 - RNA, 21 nt, Human
aggcagagguugcagugagcc

SEQ ID NO: 1048129 - RNA, 24 nt, Human
aggcagagguugcagugagccgag

SEQ ID NO: 1048130 - RNA, 18 nt, Human
aggcaggagaauggugug

SEQ ID NO: 1048131 - RNA, 20 nt, Human
aggcaggagaauggugugaa

SEQ ID NO: 1048132 - RNA, 20 nt, Human
aggcaggagaauggugugaa

SEQ ID NO: 1048133 - RNA, 24 nt, Human
aggcaggagaauggugugaaucug

SEQ ID NO: 1048134 - RNA, 24 nt, Human
aggcagguggaucacgaggucagg

SEQ ID NO: 1048135 - RNA, 26 nt, Human
aggcagguggaucacgaggucaggag

SEQ ID NO: 1048136 - RNA, 21 nt, Human
aggccgaggcagguggaucac

SEQ ID NO: 1048137 - RNA, 21 nt, Human
aggcggagguugcagugagcc

SEQ ID NO: 1048138 - RNA, 24 nt, Human
aggcggagguugcagugagccgag

SEQ ID NO: 1048139 - RNA, 24 nt, Human
aggcguuguggcgugugccuguaa

SEQ ID NO: 1048140 - RNA, 24 nt, Human
aggcucagugccucacgccuguaa

SEQ ID NO: 1048141 - RNA, 19 nt, Human
aggcugaggcaggagaaug

SEQ ID NO: 1048142 - RNA, 19 nt, Human
aggcugaggcggguggauu

SEQ ID NO: 1048143 - RNA, 21 nt, Human
aggcugaggcggguggauuac

SEQ ID NO: 1048144 - RNA, 19 nt, Human
agguaguaaacagcagcaa

SEQ ID NO: 1048145 - RNA, 18 nt, Human
agguaguaaacucccauc

SEQ ID NO: 1048146 - RNA, 24 nt, Human
agguggaucacgaggucaggagau

SEQ ID NO: 1048147 - RNA, 19 nt, Human
aguaagaaaagggaucucu

SEQ ID NO: 1048148 - RNA, 24 nt, Human
agugccucacgccuguaaucccag

SEQ ID NO: 1048149 - RNA, 19 nt, Human
agugguggggaggaaaggg

SEQ ID NO: 1048150 - RNA, 25 nt, Human
aguuucaaccauaacccccaucuac

SEQ ID NO: 1048151 - RNA, 24 nt, Human
aucacgccacugcacuccagccug

SEQ ID NO: 1048152 - RNA, 20 nt, Human
aucauccuaaaucuuagaaa

SEQ ID NO: 1048153 - RNA, 24 nt, Human
aucgcgccacugcacucuagccug

SEQ ID NO: 1048154 - RNA, 24 nt, Human
auuaccuuaugucaggaguucaag

SEQ ID NO: 1048155 - RNA, 23 nt, Human
caaaaaaaaaccacaaauaggcc

SEQ ID NO: 1048156 - RNA, 24 nt, Human
caaaaaaaaaccacaaauaggcca

SEQ ID NO: 1048157 - RNA, 26 nt, Human
caaaaacaaaaacaaaaacaaaacca

SEQ ID NO: 1048158 - RNA, 24 nt, Human
caacauggugaaacccugucucua

SEQ ID NO: 1048159 - RNA, 18 nt, Human
caagaacagccuggccaa

SEQ ID NO: 1048160 - RNA, 24 nt, Human
caagaacagccuggccaacauggu

SEQ ID NO: 1048161 - RNA, 21 nt, Human
caccuguaaucccagcuacuc

SEQ ID NO: 1048162 - RNA, 24 nt, Human
caccuguaaucccagcuacucggg

SEQ ID NO: 1048163 - RNA, 24 nt, Human
cacgccuguaaucccagcacuuug

SEQ ID NO: 1048164 - RNA, 20 nt, Human
cacuccagccugggcaaaag

SEQ ID NO: 1048165 - RNA, 20 nt, Human
cacuccagccugggcaaaag

SEQ ID NO: 1048166 - RNA, 22 nt, Human
cacuccagccugggcaaaagug

SEQ ID NO: 1048167 - RNA, 19 nt, Human
cacugcacuccagccuggg

SEQ ID NO: 1048168 - RNA, 21 nt, Human
cacugcacuccagccugggca

SEQ ID NO: 1048169 - RNA, 22 nt, Human
cacugcacuccagccugggcaa

SEQ ID NO: 1048170 - RNA, 23 nt, Human
cacugcacuccagccugggcaaa

SEQ ID NO: 1048171 - RNA, 19 nt, Human
cacugcacucuagccuggg

SEQ ID NO: 1048172 - RNA, 20 nt, Human
cacugcacucuagccugggc

SEQ ID NO: 1048173 - RNA, 22 nt, Human
cacugcacucuagccugggcga

SEQ ID NO: 1048174 - RNA, 23 nt, Human
cacugcacucuagccugggcgac

SEQ ID NO: 1048175 - RNA, 24 nt, Human
cacugcacucuagccugggcgaca

SEQ ID NO: 1048176 - RNA, 24 nt, Human
cagcacuuugggaggcugaggcgg

SEQ ID NO: 1048177 - RNA, 24 nt, Human
cagcuacucgggaggcugaggcag

SEQ ID NO: 1048178 - RNA, 25 nt, Human
caggaagguccaaacgcaggguuua

SEQ ID NO: 1048179 - RNA, 20 nt, Human
caggguuuaacuaagcuggg

SEQ ID NO: 1048180 - RNA, 19 nt, Human
ccaaccaccccagucagcu

SEQ ID NO: 1048181 - RNA, 20 nt, Human
ccacugcacuccagccuggg

SEQ ID NO: 1048182 - RNA, 21 nt, Human
ccacugcacuccagccugggc

SEQ ID NO: 1048183 - RNA, 24 nt, Human
ccacugcacuccagccugggcaaa

SEQ ID NO: 1048184 - RNA, 20 nt, Human
ccacugcacucuagccuggg

SEQ ID NO: 1048185 - RNA, 20 nt, Human
ccacugcacucuagccuggg

SEQ ID NO: 1048186 - RNA, 21 nt, Human
ccacugcacucuagccugggc

SEQ ID NO: 1048187 - RNA, 21 nt, Human
ccacugcacucuagccugggc

SEQ ID NO: 1048188 - RNA, 21 nt, Human
ccacugcacucuagccugggc

SEQ ID NO: 1048189 - RNA, 23 nt, Human
ccacugcacucuagccugggcga

SEQ ID NO: 1048190 - RNA, 24 nt, Human
ccacugcacucuagccugggcgac

SEQ ID NO: 1048191 - RNA, 22 nt, Human
ccccggagccugccagccugcc

SEQ ID NO: 1048192 - RNA, 20 nt, Human
ccgucucaaaaacaaaaaca

SEQ ID NO: 1048193 - RNA, 23 nt, Human
ccgucucaaaaacaaaaacaaaa

SEQ ID NO: 1048194 - RNA, 27 nt, Human
ccgucucaaaaacaaaaacaaaaacaa

SEQ ID NO: 1048195 - RNA, 22 nt, Human
ccuggccaacauggugaaaccc

SEQ ID NO: 1048196 - RNA, 24 nt, Human
ccuggccaacauggugaaacccug

SEQ ID NO: 1048197 - RNA, 22 nt, Human
ccuggcuaacauggugaaaccc

SEQ ID NO: 1048198 - RNA, 23 nt, Human
ccuggcuaacauggugaaacccc

SEQ ID NO: 1048199 - RNA, 24 nt, Human
ccuggcuaacauggugaaaccccg

SEQ ID NO: 1048200 - RNA, 22 nt, Human
ccugggcgacagagcaagacuc

SEQ ID NO: 1048201 - RNA, 22 nt, Human
ccuguaaucccagcacuuuggg

SEQ ID NO: 1048202 - RNA, 21 nt, Human
ccuguaaucccagcuacucgg

SEQ ID NO: 1048203 - RNA, 21 nt, Human
ccuguaaucccagcuacucgg

SEQ ID NO: 1048204 - RNA, 24 nt, Human
cgagaucacgccacugcacuccag

SEQ ID NO: 1048205 - RNA, 24 nt, Human
cgaggcagguggaucacgagguca

SEQ ID NO: 1048206 - RNA, 24 nt, Human
cgccacugcacuccagccugggca

SEQ ID NO: 1048207 - RNA, 25 nt, Human
cgcuuccaaaaaauaaaauguuagg

SEQ ID NO: 1048208 - RNA, 21 nt, Human
cggccgccaauggaguagcgc

SEQ ID NO: 1048209 - RNA, 19 nt, Human
cuaaaggcaaaaucuucau

SEQ ID NO: 1048210 - RNA, 21 nt, Human
cuaaaucuuagaaaggagaca

SEQ ID NO: 1048211 - RNA, 24 nt, Human
cuaguaugguauacauaugcccua

SEQ ID NO: 1048212 - RNA, 27 nt, Human
cucaaaaacaaaaacaaaaacaaaacc

SEQ ID NO: 1048213 - RNA, 22 nt, Human
cucacgccuguaaucccagcac

SEQ ID NO: 1048214 - RNA, 24 nt, Human
cucacgccuguaaucccagcacuu

SEQ ID NO: 1048215 - RNA, 22 nt, Human
cucagugccucacgccuguaau

SEQ ID NO: 1048216 - RNA, 25 nt, Human
cugcaggcaggaagguccaaacgca

SEQ ID NO: 1048217 - RNA, 24 nt, Human
cuggaaguuuaagagcuaacaaag

SEQ ID NO: 1048218 - RNA, 24 nt, Human
cuggccaacauggugaaacccugu

SEQ ID NO: 1048219 - RNA, 21 nt, Human
cuguaaucccagcuacucggg

SEQ ID NO: 1048220 - RNA, 26 nt, Human
cugucuuccaaaaaaaaaaaaaaacc

SEQ ID NO: 1048221 - RNA, 19 nt, Human
gaaacccugucucuacuaa

SEQ ID NO: 1048222 - RNA, 24 nt, Human
gaagugccaaaauacuaaagucuc

SEQ ID NO: 1048223 - RNA, 21 nt, Human
gaauaauaagguagggaagga

SEQ ID NO: 1048224 - RNA, 24 nt, Human
gacagagcaagacuccgucucaaa

SEQ ID NO: 1048225 - RNA, 20 nt, Human
gagaucgcgccacugcacuc

SEQ ID NO: 1048226 - RNA, 23 nt, Human
gagcaagacuccgucucaaaaac

SEQ ID NO: 1048227 - RNA, 20 nt, Human
gaggcagguggaucacgagg

SEQ ID NO: 1048228 - RNA, 23 nt, Human
gagguugcagugagccgagaucg

SEQ ID NO: 1048229 - RNA, 18 nt, Human
gaucauugauucucuuuc

SEQ ID NO: 1048230 - RNA, 24 nt, Human
gcacucuagccugggcgacagagc

SEQ ID NO: 1048231 - RNA, 24 nt, Human
gccaacauggugaaacccugucuc

SEQ ID NO: 1048232 - RNA, 22 nt, Human
gccacugcacuccagccugggc

SEQ ID NO: 1048233 - RNA, 24 nt, Human
gccacugcacuccagccugggcaa

SEQ ID NO: 1048234 - RNA, 24 nt, Human
gccacugcacucuagccugggcga

SEQ ID NO: 1048235 - RNA, 18 nt, Human
gccccggagccugccagc

SEQ ID NO: 1048236 - RNA, 20 nt, Human
gccccggagccugccagccu

SEQ ID NO: 1048237 - RNA, 20 nt, Human
gccgagaucacgccacugca

SEQ ID NO: 1048238 - RNA, 20 nt, Human
gccgagaucgcgccacugca

SEQ ID NO: 1048239 - RNA, 24 nt, Human
gcuaacauggugaaaccccgucuc

SEQ ID NO: 1048240 - RNA, 19 nt, Human
ggagacauaaaaaaaggcu

SEQ ID NO: 1048241 - RNA, 18 nt, Human
ggaggcagagaaggaaua

SEQ ID NO: 1048242 - RNA, 20 nt, Human
ggagguugcagugagccgag

SEQ ID NO: 1048243 - RNA, 22 nt, Human
ggagguugcagugagccgagau

SEQ ID NO: 1048244 - RNA, 23 nt, Human
ggagguugcagugagccgagauc

SEQ ID NO: 1048245 - RNA, 24 nt, Human
ggagguugcagugagccgagaucg

SEQ ID NO: 1048246 - RNA, 19 nt, Human
gggaagcugaggcaagaga

SEQ ID NO: 1048247 - RNA, 18 nt, Human
gggaggcggagguugcag

SEQ ID NO: 1048248 - RNA, 24 nt, Human
gggcgugguggugggcaccuguaa

SEQ ID NO: 1048249 - RNA, 24 nt, Human
gguggugggcaccuguaaucccag

SEQ ID NO: 1048250 - RNA, 24 nt, Human
gugaaucugggaggcggagguugc

SEQ ID NO: 1048251 - RNA, 22 nt, Human
guggcgugugccuguaauccca

SEQ ID NO: 1048252 - RNA, 23 nt, Human
guggugggcaccuguaaucccag

SEQ ID NO: 1048253 - RNA, 19 nt, Human
guugcagugagccgagauc

SEQ ID NO: 1048254 - RNA, 19 nt, Human
guugcagugagccgagauc

SEQ ID NO: 1048255 - RNA, 21 nt, Human
guugcagugagccgagaucgc

SEQ ID NO: 1048256 - RNA, 20 nt, Human
guuugggaggccgaggcagg

SEQ ID NO: 1048257 - RNA, 22 nt, Human
uaacauggugaaaccccgucuc

SEQ ID NO: 1048258 - RNA, 24 nt, Human
uaacauggugaaaccccgucucua

SEQ ID NO: 1048259 - RNA, 22 nt, Human
uaaggguggggcacauaauccu

SEQ ID NO: 1048260 - RNA, 21 nt, Human
uagaaaggagacauaaaaaaa

SEQ ID NO: 1048261 - RNA, 19 nt, Human
uaguaagaaaagggaucuc

SEQ ID NO: 1048262 - RNA, 21 nt, Human
uaguaugguauacauaugccc

SEQ ID NO: 1048263 - RNA, 21 nt, Human
uaugucaggaguucaagaaca

SEQ ID NO: 1048264 - RNA, 19 nt, Human
ucaaaaaaaaaaaaaaaga

SEQ ID NO: 1048265 - RNA, 23 nt, Human
ucaaaaaaaaaaaaaaagaaaaa

SEQ ID NO: 1048266 - RNA, 21 nt, Human
ucaaaaacaaaaacaaaaaca

SEQ ID NO: 1048267 - RNA, 24 nt, Human
ucaaauaaaacuacauccaaaaac

SEQ ID NO: 1048268 - RNA, 24 nt, Human
ucacgaggucaggagauggagacc

SEQ ID NO: 1048269 - RNA, 23 nt, Human
ucacgccacugcacuccagccug

SEQ ID NO: 1048270 - RNA, 18 nt, Human
uccugcagucucccaagg

SEQ ID NO: 1048271 - RNA, 18 nt, Human
ucgcuugaacccuggagg

SEQ ID NO: 1048272 - RNA, 24 nt, Human
ucuacuguagaguauauccagaaa

SEQ ID NO: 1048273 - RNA, 24 nt, Human
ucuagccugggcgacagagcaaga

SEQ ID NO: 1048274 - RNA, 22 nt, Human
ucucuacuaaaaauacaaaaaa

SEQ ID NO: 1048275 - RNA, 23 nt, Human
ucucuacuaaaaauauaaaaauu

SEQ ID NO: 1048276 - RNA, 23 nt, Human
ucucuuagcaaauaggaaucuag

SEQ ID NO: 1048277 - RNA, 25 nt, Human
ucugucuuccaaaaaaaaaaaaaaa

SEQ ID NO: 1048278 - RNA, 21 nt, Human
ugaaaagaaggacacaugaac

SEQ ID NO: 1048279 - RNA, 19 nt, Human
ugaagggaaauauggaaau

SEQ ID NO: 1048280 - RNA, 22 nt, Human
ugaagggaaauauggaaauaug

SEQ ID NO: 1048281 - RNA, 19 nt, Human
ugaaucugggaggcggagg

SEQ ID NO: 1048282 - RNA, 22 nt, Human
ugagccgagaucacgccacugc

SEQ ID NO: 1048283 - RNA, 22 nt, Human
ugagccgagaucgcgccacugc

SEQ ID NO: 1048284 - RNA, 20 nt, Human
ugaggcaagagaaucgcuug

SEQ ID NO: 1048285 - RNA, 24 nt, Human
ugaggcaagagaaucgcuugaacc

SEQ ID NO: 1048286 - RNA, 25 nt, Human
ugaggcaagagaaucgcuugaaccc

SEQ ID NO: 1048287 - RNA, 22 nt, Human
ugaggcaggagaauggugugaa

SEQ ID NO: 1048288 - RNA, 22 nt, Human
ugaggcaggagaauggugugaa

SEQ ID NO: 1048289 - RNA, 19 nt, Human
ugaggcggguggauuaccu

SEQ ID NO: 1048290 - RNA, 26 nt, Human
ugaggcggguggauuaccuuauguca

SEQ ID NO: 1048291 - RNA, 21 nt, Human
ugccucacgccuguaauccca

SEQ ID NO: 1048292 - RNA, 22 nt, Human
ugccucacgccuguaaucccag

SEQ ID NO: 1048293 - RNA, 24 nt, Human
ugccucacgccuguaaucccagca

SEQ ID NO: 1048294 - RNA, 23 nt, Human
ugccuguaaucccagcuacucgg

SEQ ID NO: 1048295 - RNA, 24 nt, Human
ugccuguaaucccagcuacucggg

SEQ ID NO: 1048296 - RNA, 22 nt, Human
uggaaagccuggggaguuaugu

SEQ ID NO: 1048297 - RNA, 19 nt, Human
uggaaggagaggaaagaaa

SEQ ID NO: 1048298 - RNA, 20 nt, Human
uggaaggagaggaaagaaag

SEQ ID NO: 1048299 - RNA, 23 nt, Human
uggaaggagaggaaagaaagaga

SEQ ID NO: 1048300 - RNA, 25 nt, Human
uggaggcagagaaggaauaagguag

SEQ ID NO: 1048301 - RNA, 23 nt, Human
uggaggcagagguugcagugagc

SEQ ID NO: 1048302 - RNA, 24 nt, Human
uggauuaccuuaugucaggaguuc

SEQ ID NO: 1048303 - RNA, 24 nt, Human
uggccaacauggugaaacccuguc

SEQ ID NO: 1048304 - RNA, 21 nt, Human
uggcgugugccuguaauccca

SEQ ID NO: 1048305 - RNA, 24 nt, Human
uggcgugugccuguaaucccagcu

SEQ ID NO: 1048306 - RNA, 24 nt, Human
ugggaggccgaggcagguggauca

SEQ ID NO: 1048307 - RNA, 29 nt, Human
ugggaggcggagguugcagugacaacggu

SEQ ID NO: 1048308 - RNA, 24 nt, Human
ugggaggcggagguugcagugagc

SEQ ID NO: 1048309 - RNA, 20 nt, Human
ugggaggcugaggcgggugg

SEQ ID NO: 1048310 - RNA, 22 nt, Human
ugggaggcugaggcggguggau

SEQ ID NO: 1048311 - RNA, 23 nt, Human
ugggaggcugaggcggguggauu

SEQ ID NO: 1048312 - RNA, 24 nt, Human
ugguggugggcaccuguaauccca

SEQ ID NO: 1048313 - RNA, 24 nt, Human
uggugugaaucugggaggcggagg

SEQ ID NO: 1048314 - RNA, 24 nt, Human
uguggcgugugccuguaaucccag

SEQ ID NO: 1048315 - RNA, 18 nt, Human
uguuuagagggaauacug

SEQ ID NO: 1048316 - RNA, 18 nt, Human
uuagcugggcgugguggu

SEQ ID NO: 1048317 - RNA, 24 nt, Human
uuagcugggcgugguggugggcac

SEQ ID NO: 1048318 - RNA, 22 nt, Human
uucucuuucccuuccugcaguc

SEQ ID NO: 1048319 - RNA, 18 nt, Human
uugcagugagccgagauc

SEQ ID NO: 1048320 - RNA, 18 nt, Human
uugcagugagccgagauc

SEQ ID NO: 1048321 - RNA, 19 nt, Human
uugcagugagccgagauca

SEQ ID NO: 1048322 - RNA, 20 nt, Human
uugcagugagccgagaucac

SEQ ID NO: 1048323 - RNA, 19 nt, Human
uugcagugagccgagaucg

SEQ ID NO: 1048324 - RNA, 22 nt, Human
uugcagugagccgagaucgcgc

SEQ ID NO: 1048325 - RNA, 25 nt, Human
uugggaggccgaggcagguggauca

SEQ ID NO: 1048326 - RNA, 18 nt, Human
agagucagcccauuagcc

SEQ ID NO: 1048327 - RNA, 18 nt, Human
agcacagccuucucagca

SEQ ID NO: 1048328 - RNA, 22 nt, Human
agcacagccuucucagcaagcu

SEQ ID NO: 1048329 - RNA, 18 nt, Human
agcguaccauguguuuuc

SEQ ID NO: 1048330 - RNA, 25 nt, Human
cagaggcucuucuucaugaccguuc

SEQ ID NO: 1048331 - RNA, 22 nt, Human
caugaccguucugaaugauuuc

SEQ ID NO: 1048332 - RNA, 24 nt, Human
ccacaugcacaucucugucauccu

SEQ ID NO: 1048333 - RNA, 23 nt, Human
ggccuggcuaccucuaggguacu

SEQ ID NO: 1048334 - RNA, 26 nt, Human
uaacaauacccacaugcacaucucug

SEQ ID NO: 1048335 - RNA, 22 nt, Human
ucagagucagcccauuagccgc

SEQ ID NO: 1048336 - RNA, 18 nt, Human
ucuccuaacaauacccac

SEQ ID NO: 1048337 - RNA, 20 nt, Human
aaucauagcaaguauauuuc

SEQ ID NO: 1048338 - RNA, 24 nt, Human
cuuucagaacuguuaaguuuuaaa

SEQ ID NO: 1048339 - RNA, 19 nt, Human
gauggcuucaguuucuucu

SEQ ID NO: 1048340 - RNA, 21 nt, Human
uggccuuggguuuacaacucc

SEQ ID NO: 1048341 - RNA, 25 nt, Human
caaaaggucucucuucagugcgaau

SEQ ID NO: 1048342 - RNA, 20 nt, Human
cagugcgaauuuucugacug

SEQ ID NO: 1048343 - RNA, 21 nt, Human
ccacagucuuuacucucaaaa

SEQ ID NO: 1048344 - RNA, 20 nt, Human
cccacagucuuuacucucaa

SEQ ID NO: 1048345 - RNA, 24 nt, Human
cugacugguagggagacuuuccuu

SEQ ID NO: 1048346 - RNA, 19 nt, Human
uuccuucuggcaaaaggau

SEQ ID NO: 1048347 - RNA, 25 nt, Human
agaaagaccaugaacaacuuuccca

SEQ ID NO: 1048348 - RNA, 22 nt, Human
ccaguugcaagaauauggccuc

SEQ ID NO: 1048349 - RNA, 20 nt, Human
ggaagaaagaccaugaacac

SEQ ID NO: 1048350 - RNA, 19 nt, Human
uauaagcuuuuccgcaguu

SEQ ID NO: 1048351 - RNA, 24 nt, Human
uauggucgauaucugguguguacc

SEQ ID NO: 1048352 - RNA, 22 nt, Human
ucagaacggaagaaagaccaug

SEQ ID NO: 1048353 - RNA, 24 nt, Human
ugaacucccggcugcacugaucac

SEQ ID NO: 1048354 - RNA, 18 nt, Human
ugagauggucagaccuca

SEQ ID NO: 1048355 - RNA, 18 nt, Human
ugcuugagauggucagac

SEQ ID NO: 1048356 - RNA, 23 nt, Human
ugugugcuugcgcugguggcuca

SEQ ID NO: 1048357 - RNA, 20 nt, Human
uucccaguugcaagaauaug

SEQ ID NO: 1048358 - RNA, 18 nt, Human
agagucccauuuucuccu

SEQ ID NO: 1048359 - RNA, 18 nt, Human
cacagacuugcacgccgu

SEQ ID NO: 1048360 - RNA, 23 nt, Human
cauccuaccaggccacacacaga

SEQ ID NO: 1048361 - RNA, 18 nt, Human
ccacacacagacuugcac

SEQ ID NO: 1048362 - RNA, 23 nt, Human
ccaggccacacacagacuugcac

SEQ ID NO: 1048363 - RNA, 20 nt, Human
cccuggcuccaucucccucc

SEQ ID NO: 1048364 - RNA, 19 nt, Human
cucugguuccacugacauc

SEQ ID NO: 1048365 - RNA, 23 nt, Human
cuggcuccaucucccucccugcc

SEQ ID NO: 1048366 - RNA, 20 nt, Human
gaacccagaaagcugugucu

SEQ ID NO: 1048367 - RNA, 26 nt, Human
uccccacaucucuucaggaaccccuc

SEQ ID NO: 1048368 - RNA, 20 nt, Human
ucccugccuuccucccugca

SEQ ID NO: 1048369 - RNA, 22 nt, Human
uuagggucccuccucugguucc

SEQ ID NO: 1048370 - RNA, 23 nt, Human
uuuuagggucccuccucugguuc

SEQ ID NO: 1048371 - RNA, 23 nt, Human
acccgcugguugguccacaccac

SEQ ID NO: 1048372 - RNA, 19 nt, Human
cacagcaccauggacgccg

SEQ ID NO: 1048373 - RNA, 21 nt, Human
cagcacagcaccauggacgcc

SEQ ID NO: 1048374 - RNA, 20 nt, Human
cagcaccauggacgccgcug

SEQ ID NO: 1048375 - RNA, 18 nt, Human
cuggagggccucccugcu

SEQ ID NO: 1048376 - RNA, 22 nt, Human
cuggggccaucuggcuucucuu

SEQ ID NO: 1048377 - RNA, 19 nt, Human
ggcccggcgcuccuggagg

SEQ ID NO: 1048378 - RNA, 21 nt, Human
uacagcagcucgauccccagc

SEQ ID NO: 1048379 - RNA, 20 nt, Human
uccuggagggccucccugcu

SEQ ID NO: 1048380 - RNA, 19 nt, Human
uuccugggucucucacguu

SEQ ID NO: 1048381 - RNA, 22 nt, Human
uugguacagcagcucgaucccc

SEQ ID NO: 1048382 - RNA, 19 nt, Human
aaggaggaacaaggcggcg

SEQ ID NO: 1048383 - RNA, 19 nt, Human
aaggaggaacaaggcggcg

SEQ ID NO: 1048384 - RNA, 23 nt, Human
ccagugcccagaauauguccucc

SEQ ID NO: 1048385 - RNA, 18 nt, Human
ucccugcaguagucuacc

SEQ ID NO: 1048386 - RNA, 18 nt, Human
uggcucaggucccugcag

SEQ ID NO: 1048387 - RNA, 22 nt, Human
uggcucaggucccugcaguagu

SEQ ID NO: 1048388 - RNA, 20 nt, Human
aaggaccaagagucaggcag

SEQ ID NO: 1048389 - RNA, 26 nt, Human
aaggaccaagagucaggcagugggca

SEQ ID NO: 1048390 - RNA, 22 nt, Human
acccugggggcucugggguugc

SEQ ID NO: 1048391 - RNA, 21 nt, Human
accuggcccucagccagggag

SEQ ID NO: 1048392 - RNA, 18 nt, Human
acugaggagcaugaggac

SEQ ID NO: 1048393 - RNA, 18 nt, Human
aggaccauccaggagcca

SEQ ID NO: 1048394 - RNA, 18 nt, Human
agucaggcaggauugagg

SEQ ID NO: 1048395 - RNA, 20 nt, Human
auggagacacugcaggcccc

SEQ ID NO: 1048396 - RNA, 24 nt, Human
caagaccccagauauauauaaaua

SEQ ID NO: 1048397 - RNA, 19 nt, Human
cacccugggggcucugggg

SEQ ID NO: 1048398 - RNA, 18 nt, Human
caggagccaggcauggag

SEQ ID NO: 1048399 - RNA, 19 nt, Human
caggagccaggcauggagg

SEQ ID NO: 1048400 - RNA, 22 nt, Human
caggagccaggcauggaggugg

SEQ ID NO: 1048401 - RNA, 27 nt, Human
cauggccccagagccgagcaaggcaag

SEQ ID NO: 1048402 - RNA, 23 nt, Human
ccagaaggaccaagagucaggca

SEQ ID NO: 1048403 - RNA, 24 nt, Human
ccagcugccagcacgguccaggac

SEQ ID NO: 1048404 - RNA, 18 nt, Human
cccccauuccugugucca

SEQ ID NO: 1048405 - RNA, 24 nt, Human
cccucaaugccaaggccacagaag

SEQ ID NO: 1048406 - RNA, 24 nt, Human
ccuccaggaccauccaggagccag

SEQ ID NO: 1048407 - RNA, 20 nt, Human
gacauagaaaggagagggcc

SEQ ID NO: 1048408 - RNA, 21 nt, Human
gagccgagcaaggcaagcucc

SEQ ID NO: 1048409 - RNA, 25 nt, Human
gagccgagcaaggcaagcuccuggg

SEQ ID NO: 1048410 - RNA, 22 nt, Human
gaucaccuguuaugguccccau

SEQ ID NO: 1048411 - RNA, 22 nt, Human
gcaccagaacguuccccagcca

SEQ ID NO: 1048412 - RNA, 18 nt, Human
gcccucagccagggagcu

SEQ ID NO: 1048413 - RNA, 20 nt, Human
ggccacagaagcgaagugcc

SEQ ID NO: 1048414 - RNA, 20 nt, Human
guuaugguccccaugucaga

SEQ ID NO: 1048415 - RNA, 18 nt, Human
uagacaagaccccagaua

SEQ ID NO: 1048416 - RNA, 21 nt, Human
uccaggagccaggcauggagg

SEQ ID NO: 1048417 - RNA, 21 nt, Human
ucccagcaccaucagcaccag

SEQ ID NO: 1048418 - RNA, 21 nt, Human
ugccaaggccacagaagcgaa

SEQ ID NO: 1048419 - RNA, 21 nt, Human
ugccagaaggaccaagaguca

SEQ ID NO: 1048420 - RNA, 19 nt, Human
ugcccucaaugccaaggcc

SEQ ID NO: 1048421 - RNA, 24 nt, Human
uggggaauggagacacugcaggcc

SEQ ID NO: 1048422 - RNA, 23 nt, Human
uguccagccugugcccucaaugc

SEQ ID NO: 1048423 - RNA, 20 nt, Human
uugcucugccacccaccugg

SEQ ID NO: 1048424 - RNA, 23 nt, Human
uuugccagguaucagugaucacc

SEQ ID NO: 1048425 - RNA, 22 nt, Human
uuuugcucugccacccaccugg

SEQ ID NO: 1048426 - RNA, 18 nt, Human
aaagcucccucuccuuuc

SEQ ID NO: 1048427 - RNA, 22 nt, Human
agcucccucuccuuuccugcua

SEQ ID NO: 1048428 - RNA, 23 nt, Human
agguggucaguacaggcccuggc

SEQ ID NO: 1048429 - RNA, 19 nt, Human
ggaaagcucccucuccuuu

SEQ ID NO: 1048430 - RNA, 19 nt, Human
ggcacguggagguggucag

SEQ ID NO: 1048431 - RNA, 20 nt, Human
uacaggcccuggcgugcaac

SEQ ID NO: 1048432 - RNA, 22 nt, Human
uacaggcccuggcgugcaacca

SEQ ID NO: 1048433 - RNA, 21 nt, Human
ucggggaaagcucccucuccu

SEQ ID NO: 1048434 - RNA, 27 nt, Human
uggggcugguccaggagggucgagagc

SEQ ID NO: 1048435 - RNA, 20 nt, Human
gcucagaggaugcccagcaa

SEQ ID NO: 1048436 - RNA, 22 nt, Human
aaaaggagacagggcugggcca

SEQ ID NO: 1048437 - RNA, 21 nt, Human
aaacaugaucuacaauaauuu

SEQ ID NO: 1048438 - RNA, 25 nt, Human
aacccaguucuaaaggauuuacuga

SEQ ID NO: 1048439 - RNA, 21 nt, Human
aacucccauuucaaaacccag

SEQ ID NO: 1048440 - RNA, 19 nt, Human
accgacuagcgcuggccgc

SEQ ID NO: 1048441 - RNA, 19 nt, Human
acggcaccgaggagcgcgc

SEQ ID NO: 1048442 - RNA, 20 nt, Human
acggcaccgaggagcgcgcc

SEQ ID NO: 1048443 - RNA, 19 nt, Human
acuaaugcugauuauuuag

SEQ ID NO: 1048444 - RNA, 22 nt, Human
auccaaggagaaacaauccaau

SEQ ID NO: 1048445 - RNA, 22 nt, Human
auccaaucauuugcauacccag

SEQ ID NO: 1048446 - RNA, 25 nt, Human
auguaucacacuuauuuugcaugua

SEQ ID NO: 1048447 - RNA, 18 nt, Human
caaaacccaguucuaaag

SEQ ID NO: 1048448 - RNA, 20 nt, Human
caaaaucucuugggcaacac

SEQ ID NO: 1048449 - RNA, 24 nt, Human
caauccaaucauuugcauacccag

SEQ ID NO: 1048450 - RNA, 18 nt, Human
ccgcuggcgccgaagccc

SEQ ID NO: 1048451 - RNA, 21 nt, Human
ccggccccggggcgcgcucac

SEQ ID NO: 1048452 - RNA, 21 nt, Human
ccuaacaaaacaugaucuaca

SEQ ID NO: 1048453 - RNA, 23 nt, Human
ccuaugcuaaaaggagacagggc

SEQ ID NO: 1048454 - RNA, 23 nt, Human
ccuauuaaaaaggcucaauauuu

SEQ ID NO: 1048455 - RNA, 24 nt, Human
ccuguacauacagagauccaagga

SEQ ID NO: 1048456 - RNA, 21 nt, Human
ccuuuuguaaauccuuaccag

SEQ ID NO: 1048457 - RNA, 18 nt, Human
cuucaugaaacuacugca

SEQ ID NO: 1048458 - RNA, 25 nt, Human
cuucugugaaccuuuccccaauccc

SEQ ID NO: 1048459 - RNA, 26 nt, Human
gcauuguggccagaaaaaaaaaaauc

SEQ ID NO: 1048460 - RNA, 22 nt, Human
gccauggaagagcccacaugaa

SEQ ID NO: 1048461 - RNA, 21 nt, Human
ggccggccccggggcgcgcuc

SEQ ID NO: 1048462 - RNA, 20 nt, Human
ggcugggccacggggcgcgc

SEQ ID NO: 1048463 - RNA, 22 nt, Human
ggcugggccacggggcgcgcuc

SEQ ID NO: 1048464 - RNA, 20 nt, Human
gggcaacacuuaagccaugg

SEQ ID NO: 1048465 - RNA, 19 nt, Human
uaagacuacaagaaaugau

SEQ ID NO: 1048466 - RNA, 22 nt, Human
uaagccauggaagagcccacaa

SEQ ID NO: 1048467 - RNA, 20 nt, Human
uacaugaauacuaacccuug

SEQ ID NO: 1048468 - RNA, 23 nt, Human
uacccagaaaaaaugagaacacu

SEQ ID NO: 1048469 - RNA, 22 nt, Human
uaccuguacauacagagaucca

SEQ ID NO: 1048470 - RNA, 18 nt, Human
uacugcaagcauguguau

SEQ ID NO: 1048471 - RNA, 21 nt, Human
uagaauuugggcucuacaaag

SEQ ID NO: 1048472 - RNA, 21 nt, Human
uaguaucuggcauuguggcca

SEQ ID NO: 1048473 - RNA, 21 nt, Human
uagucauggaaaaugucucuc

SEQ ID NO: 1048474 - RNA, 21 nt, Human
ucacacuuauuuugcauguag

SEQ ID NO: 1048475 - RNA, 21 nt, Human
ucacggcaccgaggagcgcgc

SEQ ID NO: 1048476 - RNA, 25 nt, Human
ucauagucuuuugacuuuauuuucu

SEQ ID NO: 1048477 - RNA, 24 nt, Human
uccuauuaaaaaggcucaauauuu

SEQ ID NO: 1048478 - RNA, 21 nt, Human
ucucuccuucauuggugauua

SEQ ID NO: 1048479 - RNA, 24 nt, Human
uguaauuauaacuugccauaaaug

SEQ ID NO: 1048480 - RNA, 20 nt, Human
uguggccagaaaaaaaaaaa

SEQ ID NO: 1048481 - RNA, 21 nt, Human
uuaaaauuucacgccagagac

SEQ ID NO: 1048482 - RNA, 25 nt, Human
uuaauagucuucuugaugauauccu

SEQ ID NO: 1048483 - RNA, 22 nt, Human
uuccugauuaucagcauucauc

SEQ ID NO: 1048484 - RNA, 24 nt, Human
uucugugaaccuuuccccaauccc

SEQ ID NO: 1048485 - RNA, 23 nt, Human
uuguggccagaaaaaaaaaaauc

SEQ ID NO: 1048486 - RNA, 18 nt, Human
caucagagaauccagcug

SEQ ID NO: 1048487 - RNA, 21 nt, Human
caucagagaauccagcugcag

SEQ ID NO: 1048488 - RNA, 23 nt, Human
aaaaaaaaacauuaaaugcuaaa

SEQ ID NO: 1048489 - RNA, 19 nt, Human
aaacccacagacccagaca

SEQ ID NO: 1048490 - RNA, 22 nt, Human
aaagucaaccaaaucaagaccu

SEQ ID NO: 1048491 - RNA, 22 nt, Human
aacccacagacccagacaugca

SEQ ID NO: 1048492 - RNA, 20 nt, Human
aacuagagagcaggggccca

SEQ ID NO: 1048493 - RNA, 24 nt, Human
aacucagcacccaacagaaaccca

SEQ ID NO: 1048494 - RNA, 26 nt, Human
aacucagcacccaacagaaacccaca

SEQ ID NO: 1048495 - RNA, 20 nt, Human
aagaacuugaagcagaaaaa

SEQ ID NO: 1048496 - RNA, 21 nt, Human
aagaccuucccacuccacacu

SEQ ID NO: 1048497 - RNA, 24 nt, Human
aagauguucuauccccaccuccag

SEQ ID NO: 1048498 - RNA, 18 nt, Human
aaggagggagguguacag

SEQ ID NO: 1048499 - RNA, 22 nt, Human
aaucacccaacucagcacccaa

SEQ ID NO: 1048500 - RNA, 21 nt, Human
acagaaacccacagacccaga

SEQ ID NO: 1048501 - RNA, 24 nt, Human
accucuugcuagcccuuuccccag

SEQ ID NO: 1048502 - RNA, 22 nt, Human
accuucccacuccacacugagc

SEQ ID NO: 1048503 - RNA, 19 nt, Human
acuaaaaugaaaucaccca

SEQ ID NO: 1048504 - RNA, 19 nt, Human
acuagagagcaggggccca

SEQ ID NO: 1048505 - RNA, 22 nt, Human
acucagcacccaacagaaaccc

SEQ ID NO: 1048506 - RNA, 19 nt, Human
agacaugcacguguacacc

SEQ ID NO: 1048507 - RNA, 21 nt, Human
agcacccaacagaaacccaca

SEQ ID NO: 1048508 - RNA, 19 nt, Human
agcuauaagccccuguccc

SEQ ID NO: 1048509 - RNA, 19 nt, Human
aucaggggguggccaugag

SEQ ID NO: 1048510 - RNA, 21 nt, Human
aucccauccaaacccuugaca

SEQ ID NO: 1048511 - RNA, 22 nt, Human
auccccaccuccacccccauca

SEQ ID NO: 1048512 - RNA, 21 nt, Human
auccccagugcuuacugcucu

SEQ ID NO: 1048513 - RNA, 23 nt, Human
caaacccuugacauguauaggcu

SEQ ID NO: 1048514 - RNA, 18 nt, Human
caacucagcacccaacag

SEQ ID NO: 1048515 - RNA, 22 nt, Human
cacauuuagugccaauccugaa

SEQ ID NO: 1048516 - RNA, 18 nt, Human
cacuccacacugagcaac

SEQ ID NO: 1048517 - RNA, 24 nt, Human
cagacaagagggccacaguaacgu

SEQ ID NO: 1048518 - RNA, 25 nt, Human
cagacaugcacguguacaccacaau

SEQ ID NO: 1048519 - RNA, 22 nt, Human
cagcuauaagccccugucccuc

SEQ ID NO: 1048520 - RNA, 24 nt, Human
cagcucuguccucaguccuggaga

SEQ ID NO: 1048521 - RNA, 19 nt, Human
ccaacagaaacccacagac

SEQ ID NO: 1048522 - RNA, 22 nt, Human
ccaauccugaacaaacuauaua

SEQ ID NO: 1048523 - RNA, 20 nt, Human
cccaacagaaacccacagac

SEQ ID NO: 1048524 - RNA, 19 nt, Human
cccacagacccagacaugc

SEQ ID NO: 1048525 - RNA, 22 nt, Human
cccacuccacacugagcaacac

SEQ ID NO: 1048526 - RNA, 21 nt, Human
cccccaucaauauccuccaaa

SEQ ID NO: 1048527 - RNA, 19 nt, Human
cccugggcuccaggcugcc

SEQ ID NO: 1048528 - RNA, 21 nt, Human
cccuggggaguccuccucuga

SEQ ID NO: 1048529 - RNA, 22 nt, Human
ccucugacuucaggccaggccc

SEQ ID NO: 1048530 - RNA, 22 nt, Human
ccuucccacuccacacugagca

SEQ ID NO: 1048531 - RNA, 23 nt, Human
cuaagaacuugaagcagaaaaaa

SEQ ID NO: 1048532 - RNA, 23 nt, Human
cuagcugcccuggggaguccucc

SEQ ID NO: 1048533 - RNA, 21 nt, Human
cuagggggucauucagauugg

SEQ ID NO: 1048534 - RNA, 20 nt, Human
cuagucuuuauguucucaua

SEQ ID NO: 1048535 - RNA, 21 nt, Human
cugcccuggggaguccuccuc

SEQ ID NO: 1048536 - RNA, 18 nt, Human
cugcucugcucaacacau

SEQ ID NO: 1048537 - RNA, 22 nt, Human
cuggaaagaaaggggucuaucu

SEQ ID NO: 1048538 - RNA, 21 nt, Human
cuugacauguauaggcuaaca

SEQ ID NO: 1048539 - RNA, 22 nt, Human
gaaaucacccaacucagcaccc

SEQ ID NO: 1048540 - RNA, 24 nt, Human
gacuaaauggaugaugucauagga

SEQ ID NO: 1048541 - RNA, 20 nt, Human
gagagcuccaauacauguuu

SEQ ID NO: 1048542 - RNA, 21 nt, Human
gagcagcucuguccucagucc

SEQ ID NO: 1048543 - RNA, 23 nt, Human
gaggcuucaccucuugcuagccc

SEQ ID NO: 1048544 - RNA, 22 nt, Human
gaggugauaacaguuaauccug

SEQ ID NO: 1048545 - RNA, 21 nt, Human
gcccaaaucccauccaaaccc

SEQ ID NO: 1048546 - RNA, 24 nt, Human
gggcuccaggcugccagacaagag

SEQ ID NO: 1048547 - RNA, 19 nt, Human
gguguccagacacaugcag

SEQ ID NO: 1048548 - RNA, 27 nt, Human
guggguacaaaggagaaaaaggaggga

SEQ ID NO: 1048549 - RNA, 24 nt, Human
uaacagccuccuaugaccagggcu

SEQ ID NO: 1048550 - RNA, 18 nt, Human
uaagaggagcacgugaag

SEQ ID NO: 1048551 - RNA, 20 nt, Human
uacaaaggagaaaaaggagg

SEQ ID NO: 1048552 - RNA, 21 nt, Human
uacaggagaggugauaacagu

SEQ ID NO: 1048553 - RNA, 25 nt, Human
uaccaaacagugugaaagauguucu

SEQ ID NO: 1048554 - RNA, 23 nt, Human
uagaagaagaagagcagcucugu

SEQ ID NO: 1048555 - RNA, 19 nt, Human
uagagagcaggggcccaca

SEQ ID NO: 1048556 - RNA, 21 nt, Human
uagugccaauccugaacaagg

SEQ ID NO: 1048557 - RNA, 19 nt, Human
uauacuugauuauuucagc

SEQ ID NO: 1048558 - RNA, 23 nt, Human
uauuagguauguucuugcugagg

SEQ ID NO: 1048559 - RNA, 25 nt, Human
uauuucagcuagugcuggaaagaaa

SEQ ID NO: 1048560 - RNA, 18 nt, Human
ucacccaacucagcaccc

SEQ ID NO: 1048561 - RNA, 22 nt, Human
ucagcacccaacagaaacccac

SEQ ID NO: 1048562 - RNA, 18 nt, Human
ucaggccaggcccaagga

SEQ ID NO: 1048563 - RNA, 26 nt, Human
ucauucagauuggagggcagacccaa

SEQ ID NO: 1048564 - RNA, 22 nt, Human
ucauuuguacuuuauuacuuuu

SEQ ID NO: 1048565 - RNA, 23 nt, Human
uccacccccaucaauauccucca

SEQ ID NO: 1048566 - RNA, 18 nt, Human
ucccacuccacacugagc

SEQ ID NO: 1048567 - RNA, 27 nt, Human
uccccaccuccacccccaucaauaucc

SEQ ID NO: 1048568 - RNA, 23 nt, Human
uccccuagcugcccuggggaguc

SEQ ID NO: 1048569 - RNA, 18 nt, Human
ucccugggcuccaggcug

SEQ ID NO: 1048570 - RNA, 22 nt, Human
ucccugggcuccaggcugccag

SEQ ID NO: 1048571 - RNA, 20 nt, Human
uccuaugaccagggcuagug

SEQ ID NO: 1048572 - RNA, 20 nt, Human
uccugccauauccccagugc

SEQ ID NO: 1048573 - RNA, 20 nt, Human
ucucucaggccugagugucu

SEQ ID NO: 1048574 - RNA, 23 nt, Human
ucuguaccaaacagugugaaaga

SEQ ID NO: 1048575 - RNA, 18 nt, Human
ugaaaaaaucugcacaug

SEQ ID NO: 1048576 - RNA, 24 nt, Human
ugaccaggaggcuucaccucuugc

SEQ ID NO: 1048577 - RNA, 19 nt, Human
ugacuuguaagguucuagg

SEQ ID NO: 1048578 - RNA, 18 nt, Human
ugauuccugccauauccc

SEQ ID NO: 1048579 - RNA, 19 nt, Human
ugcagccacuggcagcuuc

SEQ ID NO: 1048580 - RNA, 18 nt, Human
ugccaaggaaacgaaggc

SEQ ID NO: 1048581 - RNA, 20 nt, Human
ugcccuggggaguccuccuc

SEQ ID NO: 1048582 - RNA, 21 nt, Human
uggagagucuguguauaagag

SEQ ID NO: 1048583 - RNA, 21 nt, Human
uggagauagcacugugcacua

SEQ ID NO: 1048584 - RNA, 21 nt, Human
uguguacugcguugccaagga

SEQ ID NO: 1048585 - RNA, 22 nt, Human
uguuaugaucuuuauaacccca

SEQ ID NO: 1048586 - RNA, 18 nt, Human
uguucuauccccaccucc

SEQ ID NO: 1048587 - RNA, 22 nt, Human
caagccucauuggaaaagcuga

SEQ ID NO: 1048588 - RNA, 22 nt, Human
cacaggcugucaguucaagugg

SEQ ID NO: 1048589 - RNA, 20 nt, Human
caggaaaagacugaccauug

SEQ ID NO: 1048590 - RNA, 21 nt, Human
caucuaaacaacuccgacugc

SEQ ID NO: 1048591 - RNA, 24 nt, Human
cauugccagaucacaucuaaacaa

SEQ ID NO: 1048592 - RNA, 21 nt, Human
ccacugccagcaucacauugu

SEQ ID NO: 1048593 - RNA, 18 nt, Human
cccaaggggcucacaggc

SEQ ID NO: 1048594 - RNA, 27 nt, Human
ccucuggccaggaaaagaccggggucc

SEQ ID NO: 1048595 - RNA, 22 nt, Human
cucccaaguugauucaugaugc

SEQ ID NO: 1048596 - RNA, 23 nt, Human
cugcaguuucacacagguggugg

SEQ ID NO: 1048597 - RNA, 27 nt, Human
cugcaguuucacacaggugguggucca

SEQ ID NO: 1048598 - RNA, 25 nt, Human
gcaguuucacacaggugguggucca

SEQ ID NO: 1048599 - RNA, 19 nt, Human
gggagggccaucaaucuuu

SEQ ID NO: 1048600 - RNA, 20 nt, Human
ggggguuugacuuuauuuga

SEQ ID NO: 1048601 - RNA, 18 nt, Human
gucauagcacgacgcagu

SEQ ID NO: 1048602 - RNA, 21 nt, Human
guccaaaauuuguaaaaaagu

SEQ ID NO: 1048603 - RNA, 19 nt, Human
uaaaaaagugaaagugaug

SEQ ID NO: 1048604 - RNA, 23 nt, Human
uaugcccccaaggggcucacagg

SEQ ID NO: 1048605 - RNA, 18 nt, Human
ucaaucuuuccucuggcc

SEQ ID NO: 1048606 - RNA, 19 nt, Human
ucacaucuaaacaacuccg

SEQ ID NO: 1048607 - RNA, 22 nt, Human
ucacaucuaaacaacuccgacu

SEQ ID NO: 1048608 - RNA, 21 nt, Human
ucaguucaagugggagggcca

SEQ ID NO: 1048609 - RNA, 24 nt, Human
ucuguaccacacacuuuggaaggg

SEQ ID NO: 1048610 - RNA, 22 nt, Human
ugaagauagggcugagaugaga

SEQ ID NO: 1048611 - RNA, 22 nt, Human
ugagaggaaauggauucaagcc

SEQ ID NO: 1048612 - RNA, 18 nt, Human
ugagaugagaggaaaugg

SEQ ID NO: 1048613 - RNA, 23 nt, Human
uggugguccaaaauuuguaaaaa

SEQ ID NO: 1048614 - RNA, 21 nt, Human
uuguaaaaaagugaaagugau

SEQ ID NO: 1048615 - RNA, 23 nt, Human
cucuuguuccuuggugucagggg

SEQ ID NO: 1048616 - RNA, 24 nt, Human
ugaguuucugcauauagcucacaa

SEQ ID NO: 1048617 - RNA, 21 nt, Human
uuaguagucgcucuuguuccu

SEQ ID NO: 1048618 - RNA, 21 nt, Human
uucaaaucucucuuuuaguag

SEQ ID NO: 1048619 - RNA, 19 nt, Human
aaacuccaucaaaaaaaaa

SEQ ID NO: 1048620 - RNA, 24 nt, Human
aacuccaucaaaaaaaaaaaaaag

SEQ ID NO: 1048621 - RNA, 23 nt, Human
aagaucgugccauugcacuccag

SEQ ID NO: 1048622 - RNA, 24 nt, Human
aaguggagguugcagugagccaag

SEQ ID NO: 1048623 - RNA, 19 nt, Human
acaacagcgaaacuccauc

SEQ ID NO: 1048624 - RNA, 24 nt, Human
aucgugccauugcacuccagccug

SEQ ID NO: 1048625 - RNA, 24 nt, Human
auugcacuccagccugggcaacaa

SEQ ID NO: 1048626 - RNA, 18 nt, Human
caacaacagcgaaacucc

SEQ ID NO: 1048627 - RNA, 21 nt, Human
caacaacagcgaaacuccauc

SEQ ID NO: 1048628 - RNA, 25 nt, Human
caacaacagcgaaacuccaucaaaa

SEQ ID NO: 1048629 - RNA, 22 nt, Human
cagcagagccggagccggaacg

SEQ ID NO: 1048630 - RNA, 24 nt, Human
caugccuguaaucccagcuacuug

SEQ ID NO: 1048631 - RNA, 20 nt, Human
cauucugugucgucacuucu

SEQ ID NO: 1048632 - RNA, 18 nt, Human
cauugcacuccagccugg

SEQ ID NO: 1048633 - RNA, 19 nt, Human
cauugcacuccagccuggg

SEQ ID NO: 1048634 - RNA, 21 nt, Human
cauugcacuccagccugggca

SEQ ID NO: 1048635 - RNA, 24 nt, Human
cauugcacuccagccugggcaaca

SEQ ID NO: 1048636 - RNA, 26 nt, Human
cauugcacuccagccugggcaacaac

SEQ ID NO: 1048637 - RNA, 20 nt, Human
ccauugcacuccagccuggg

SEQ ID NO: 1048638 - RNA, 21 nt, Human
ccauugcacuccagccugggc

SEQ ID NO: 1048639 - RNA, 23 nt, Human
ccauugcacuccagccugggcaa

SEQ ID NO: 1048640 - RNA, 24 nt, Human
ccauugcacuccagccugggcaac

SEQ ID NO: 1048641 - RNA, 21 nt, Human
ccugggaaguggagguugcag

SEQ ID NO: 1048642 - RNA, 18 nt, Human
ccuguaaucccagcuacu

SEQ ID NO: 1048643 - RNA, 21 nt, Human
ccuguaaucccagcuacuugg

SEQ ID NO: 1048644 - RNA, 21 nt, Human
cggcuaauugaaaagcagcac

SEQ ID NO: 1048645 - RNA, 21 nt, Human
cuagaaccugggaaguggagg

SEQ ID NO: 1048646 - RNA, 21 nt, Human
cuccaucaaaaaaaaaaaaaa

SEQ ID NO: 1048647 - RNA, 24 nt, Human
cuuauacucuuccugugggagcca

SEQ ID NO: 1048648 - RNA, 18 nt, Human
gaaguggagguugcagug

SEQ ID NO: 1048649 - RNA, 23 nt, Human
gagguugcagugagccaagaucg

SEQ ID NO: 1048650 - RNA, 20 nt, Human
gccagcagagccggagccgg

SEQ ID NO: 1048651 - RNA, 22 nt, Human
gccauugcacuccagccugggc

SEQ ID NO: 1048652 - RNA, 24 nt, Human
gccauugcacuccagccugggcaa

SEQ ID NO: 1048653 - RNA, 21 nt, Human
ggagacucgcuagaaccuggg

SEQ ID NO: 1048654 - RNA, 22 nt, Human
ggagcaagugucggagcuuagg

SEQ ID NO: 1048655 - RNA, 20 nt, Human
ggagguugcagugagccaag

SEQ ID NO: 1048656 - RNA, 23 nt, Human
ggagguugcagugagccaagauc

SEQ ID NO: 1048657 - RNA, 24 nt, Human
ggagguugcagugagccaagaucg

SEQ ID NO: 1048658 - RNA, 22 nt, Human
uaaaagggcaauguaagaagua

SEQ ID NO: 1048659 - RNA, 25 nt, Human
uacaaucuucuauaacccuauaaaa

SEQ ID NO: 1048660 - RNA, 22 nt, Human
uacuuuagcuuacuccauccuc

SEQ ID NO: 1048661 - RNA, 18 nt, Human
ucaaaaaaaaaaaaaagu

SEQ ID NO: 1048662 - RNA, 25 nt, Human
ucacaguagugcuuauacucuuccu

SEQ ID NO: 1048663 - RNA, 26 nt, Human
ucagguggugguucuauauaaaaggg

SEQ ID NO: 1048664 - RNA, 19 nt, Human
uccacugagaucccuuuca

SEQ ID NO: 1048665 - RNA, 23 nt, Human
uccaucaaaaaaaaaaaaaagua

SEQ ID NO: 1048666 - RNA, 23 nt, Human
ucgugccauugcacuccagccug

SEQ ID NO: 1048667 - RNA, 23 nt, Human
ugaaaagcagcacaaggcuagaa

SEQ ID NO: 1048668 - RNA, 22 nt, Human
ugagccaagaucgugccauugc

SEQ ID NO: 1048669 - RNA, 24 nt, Human
ugagggaggagacucgcuagaacc

SEQ ID NO: 1048670 - RNA, 22 nt, Human
ugcacuccagccugggcaacaa

SEQ ID NO: 1048671 - RNA, 24 nt, Human
ugccauugcacuccagccugggca

SEQ ID NO: 1048672 - RNA, 19 nt, Human
ugcccccugcaguugauuc

SEQ ID NO: 1048673 - RNA, 24 nt, Human
ugccuguaaucccagcuacuuggg

SEQ ID NO: 1048674 - RNA, 24 nt, Human
ugggaaguggagguugcagugagc

SEQ ID NO: 1048675 - RNA, 18 nt, Human
uuagcuuacuccauccuc

SEQ ID NO: 1048676 - RNA, 22 nt, Human
uugcagugagccaagaucgugc

SEQ ID NO: 1048677 - RNA, 22 nt, Human
cgagaaggugggcugggcagug

SEQ ID NO: 1048678 - RNA, 23 nt, Human
cgccagggcagcccuugagaaga

SEQ ID NO: 1048679 - RNA, 19 nt, Human
gaccguaggcagaggccag

SEQ ID NO: 1048680 - RNA, 20 nt, Human
gagaaggugggcugggcagu

SEQ ID NO: 1048681 - RNA, 19 nt, Human
gcagcccuugagaagagug

SEQ ID NO: 1048682 - RNA, 19 nt, Human
gcccuuggcaggauuccag

SEQ ID NO: 1048683 - RNA, 18 nt, Human
guggcgagaaggugggcu

SEQ ID NO: 1048684 - RNA, 22 nt, Human
ucccugcaguggcccuuggcag

SEQ ID NO: 1048685 - RNA, 18 nt, Human
ucuggccucuguggcagg

SEQ ID NO: 1048686 - RNA, 19 nt, Human
ucuguggcagggccaggag

SEQ ID NO: 1048687 - RNA, 22 nt, Human
ugagaagaguggcgagaaggug

SEQ ID NO: 1048688 - RNA, 25 nt, Human
ugagaagaguggcgagaaggugggc

SEQ ID NO: 1048689 - RNA, 23 nt, Human
ugcgggguucccgccagggcagc

SEQ ID NO: 1048690 - RNA, 20 nt, Human
uggcgagaaggugggcuggg

SEQ ID NO: 1048691 - RNA, 18 nt, Human
aaagccaucagacaggug

SEQ ID NO: 1048692 - RNA, 19 nt, Human
aagggcaaguagggggucc

SEQ ID NO: 1048693 - RNA, 21 nt, Human
acccugccucagggccucagc

SEQ ID NO: 1048694 - RNA, 18 nt, Human
accuuggggucccugcgc

SEQ ID NO: 1048695 - RNA, 21 nt, Human
agauaggcuggggcaaagcca

SEQ ID NO: 1048696 - RNA, 22 nt, Human
aggcuggggggucaccccaggg

SEQ ID NO: 1048697 - RNA, 22 nt, Human
agggacccugccucagggccuc

SEQ ID NO: 1048698 - RNA, 19 nt, Human
aggggcuuggcggcuggug

SEQ ID NO: 1048699 - RNA, 23 nt, Human
agggugguagacaguuggggugc

SEQ ID NO: 1048700 - RNA, 19 nt, Human
agugucugggacagaagug

SEQ ID NO: 1048701 - RNA, 24 nt, Human
augacugaggggcagggugggcgg

SEQ ID NO: 1048702 - RNA, 19 nt, Human
auguccccuccuggucagc

SEQ ID NO: 1048703 - RNA, 19 nt, Human
cagaguccagcgccugcug

SEQ ID NO: 1048704 - RNA, 20 nt, Human
cagggccucagcaaagccug

SEQ ID NO: 1048705 - RNA, 22 nt, Human
caguuggggugcaggcuggggg

SEQ ID NO: 1048706 - RNA, 18 nt, Human
caugacucuugaugugcc

SEQ ID NO: 1048707 - RNA, 20 nt, Human
ccaggguggaaaagggugga

SEQ ID NO: 1048708 - RNA, 22 nt, Human
ccaucuugcuccccuucccgug

SEQ ID NO: 1048709 - RNA, 22 nt, Human
cccagacacaugcugacugaaa

SEQ ID NO: 1048710 - RNA, 20 nt, Human
ccccagaguccagcgccugc

SEQ ID NO: 1048711 - RNA, 20 nt, Human
ccccagggacccugccucag

SEQ ID NO: 1048712 - RNA, 21 nt, Human
cccccagaguccagcgccugc

SEQ ID NO: 1048713 - RNA, 25 nt, Human
cccccagcacuagacuuggacaauu

SEQ ID NO: 1048714 - RNA, 24 nt, Human
cccguggcccccugggaguuuucu

SEQ ID NO: 1048715 - RNA, 19 nt, Human
cccugccucagggccucag

SEQ ID NO: 1048716 - RNA, 25 nt, Human
ccgccugccuccgacucccggccgc

SEQ ID NO: 1048717 - RNA, 22 nt, Human
ccggcccugccggccuugaccg

SEQ ID NO: 1048718 - RNA, 25 nt, Human
ccucagggccucagcaaagccugga

SEQ ID NO: 1048719 - RNA, 23 nt, Human
ccuccuggucagcagcuugauuu

SEQ ID NO: 1048720 - RNA, 23 nt, Human
ccucugggacucacggcugcgcu

SEQ ID NO: 1048721 - RNA, 21 nt, Human
ccugguggcagacgcugccuc

SEQ ID NO: 1048722 - RNA, 19 nt, Human
cgggacgggggccaggauc

SEQ ID NO: 1048723 - RNA, 20 nt, Human
cuccacccgucccugccagg

SEQ ID NO: 1048724 - RNA, 20 nt, Human
cuccugccugggaagggcca

SEQ ID NO: 1048725 - RNA, 18 nt, Human
cugccucagggccucagc

SEQ ID NO: 1048726 - RNA, 23 nt, Human
cugggaguuuucugcaggcaugg

SEQ ID NO: 1048727 - RNA, 21 nt, Human
cuguccuuucuccugccuggg

SEQ ID NO: 1048728 - RNA, 23 nt, Human
cuuguucccuggacaccuugggg

SEQ ID NO: 1048729 - RNA, 23 nt, Human
gacucccggccgccgcgcagccc

SEQ ID NO: 1048730 - RNA, 21 nt, Human
gaugggacugcucccucugcc

SEQ ID NO: 1048731 - RNA, 20 nt, Human
ggaggggcuuggcggcuggu

SEQ ID NO: 1048732 - RNA, 20 nt, Human
gggacagaaguggaauucca

SEQ ID NO: 1048733 - RNA, 23 nt, Human
gggcagcgcccaugaugccccca

SEQ ID NO: 1048734 - RNA, 19 nt, Human
gggcagggugggcggugcu

SEQ ID NO: 1048735 - RNA, 18 nt, Human
gggcuuggcggcuggugg

SEQ ID NO: 1048736 - RNA, 20 nt, Human
gggguccggcccugccggcc

SEQ ID NO: 1048737 - RNA, 18 nt, Human
gguccggcccugccggcc

SEQ ID NO: 1048738 - RNA, 20 nt, Human
gucgcagggaggccuccugg

SEQ ID NO: 1048739 - RNA, 19 nt, Human
gucuggagcgccuccuccc

SEQ ID NO: 1048740 - RNA, 18 nt, Human
uaccugagaccccagaca

SEQ ID NO: 1048741 - RNA, 19 nt, Human
ucaccccagggacccugcc

SEQ ID NO: 1048742 - RNA, 20 nt, Human
ucagcaaagccuggaggggc

SEQ ID NO: 1048743 - RNA, 22 nt, Human
ucagcaaagccuggaggggcuu

SEQ ID NO: 1048744 - RNA, 21 nt, Human
uccacagcgucaccucugccc

SEQ ID NO: 1048745 - RNA, 24 nt, Human
uccccugugcccuugcguguccac

SEQ ID NO: 1048746 - RNA, 21 nt, Human
ucccucugccacucauaccug

SEQ ID NO: 1048747 - RNA, 21 nt, Human
ucccuggacaccuuggggucc

SEQ ID NO: 1048748 - RNA, 24 nt, Human
ucccuggacaccuuggggucccug

SEQ ID NO: 1048749 - RNA, 25 nt, Human
uccuggcuggggcuggggagcucau

SEQ ID NO: 1048750 - RNA, 21 nt, Human
ucugccacucauaccugagac

SEQ ID NO: 1048751 - RNA, 23 nt, Human
ucugggacagaaguggaauucca

SEQ ID NO: 1048752 - RNA, 22 nt, Human
ugaaaggcgggcugguuguggc

SEQ ID NO: 1048753 - RNA, 19 nt, Human
ugccucagggccucagcaa

SEQ ID NO: 1048754 - RNA, 22 nt, Human
ugccucagggccucagcaaagc

SEQ ID NO: 1048755 - RNA, 19 nt, Human
uggcucuggggcagcgccc

SEQ ID NO: 1048756 - RNA, 21 nt, Human
uggggcaaagccaucagacag

SEQ ID NO: 1048757 - RNA, 21 nt, Human
uggggcagcgcccaugaugcc

SEQ ID NO: 1048758 - RNA, 21 nt, Human
uggggcccacccagguccaca

SEQ ID NO: 1048759 - RNA, 19 nt, Human
uggggugcaggcugggggg

SEQ ID NO: 1048760 - RNA, 23 nt, Human
ugguggggccgucgcagggaggc

SEQ ID NO: 1048761 - RNA, 19 nt, Human
ugguggguuugaggggcag

SEQ ID NO: 1048762 - RNA, 18 nt, Human
uguccuggcuggggcugg

SEQ ID NO: 1048763 - RNA, 20 nt, Human
uuccucugggacucacggcu

SEQ ID NO: 1048764 - RNA, 18 nt, Human
aaaagcagcuuugggggc

SEQ ID NO: 1048765 - RNA, 24 nt, Human
aaagucgcgaggucucuagccccc

SEQ ID NO: 1048766 - RNA, 23 nt, Human
acagggguaaccgcgcggaggag

SEQ ID NO: 1048767 - RNA, 22 nt, Human
acaugacaacucccaugccucu

SEQ ID NO: 1048768 - RNA, 22 nt, Human
acucauccggagcgccaggacg

SEQ ID NO: 1048769 - RNA, 21 nt, Human
agacccaaggcagcaucccuc

SEQ ID NO: 1048770 - RNA, 23 nt, Human
agcaaagccauccaagggagagc

SEQ ID NO: 1048771 - RNA, 25 nt, Human
agcccgcgugcaaggccccgggcac

SEQ ID NO: 1048772 - RNA, 21 nt, Human
agcguagggaaggggcuuagu

SEQ ID NO: 1048773 - RNA, 24 nt, Human
agcugaagggucuucaacucugga

SEQ ID NO: 1048774 - RNA, 21 nt, Human
aggaaaaaugggggcgcuggc

SEQ ID NO: 1048775 - RNA, 20 nt, Human
aggaggcugaggggcaggcc

SEQ ID NO: 1048776 - RNA, 19 nt, Human
agggaaaagucgaauaaug

SEQ ID NO: 1048777 - RNA, 20 nt, Human
agguccuggcaaaggagucu

SEQ ID NO: 1048778 - RNA, 18 nt, Human
caacaggaacaaauucuu

SEQ ID NO: 1048779 - RNA, 23 nt, Human
caacaugacaacucccaugccuc

SEQ ID NO: 1048780 - RNA, 24 nt, Human
caaccgaaaagcagcuuugggggc

SEQ ID NO: 1048781 - RNA, 21 nt, Human
caacucuggaucccaaguccc

SEQ ID NO: 1048782 - RNA, 22 nt, Human
caagggagagcugucaucuguc

SEQ ID NO: 1048783 - RNA, 24 nt, Human
cacagcccacgaggccuaggcagg

SEQ ID NO: 1048784 - RNA, 21 nt, Human
cagaaaaagucaacaggaaca

SEQ ID NO: 1048785 - RNA, 27 nt, Human
cagacccaaggcagcaucccucaagga

SEQ ID NO: 1048786 - RNA, 19 nt, Human
cagagccacagggcuuuuc

SEQ ID NO: 1048787 - RNA, 18 nt, Human
caggaacaaauucuuggu

SEQ ID NO: 1048788 - RNA, 26 nt, Human
caugacaacucccaugccucugcaca

SEQ ID NO: 1048789 - RNA, 21 nt, Human
cccaaggcagcaucccucaag

SEQ ID NO: 1048790 - RNA, 22 nt, Human
cccaaggcagcaucccucaagg

SEQ ID NO: 1048791 - RNA, 18 nt, Human
ccccagagccacagggcu

SEQ ID NO: 1048792 - RNA, 22 nt, Human
cccccaaacaaucaugaggagg

SEQ ID NO: 1048793 - RNA, 25 nt, Human
cccccaaacaaucaugaggaggccc

SEQ ID NO: 1048794 - RNA, 30 nt, Human
cccccaaacaaucaugaggaggccccucca

SEQ ID NO: 1048795 - RNA, 21 nt, Human
ccuagggggguuugacgucug

SEQ ID NO: 1048796 - RNA, 20 nt, Human
ccucaaggauacugaggucu

SEQ ID NO: 1048797 - RNA, 19 nt, Human
ccuccauuuaaaccucagc

SEQ ID NO: 1048798 - RNA, 23 nt, Human
ccugcaccucuugggguuuccuc

SEQ ID NO: 1048799 - RNA, 21 nt, Human
cgccaggacggauggcggcga

SEQ ID NO: 1048800 - RNA, 23 nt, Human
cgcuggcuggugcggaaccagca

SEQ ID NO: 1048801 - RNA, 19 nt, Human
cggaggaggcugaggggca

SEQ ID NO: 1048802 - RNA, 21 nt, Human
cuagauggaagaaaaccuguc

SEQ ID NO: 1048803 - RNA, 20 nt, Human
cucuguggcacuggcagggc

SEQ ID NO: 1048804 - RNA, 21 nt, Human
gaccccaggucauuguccuga

SEQ ID NO: 1048805 - RNA, 18 nt, Human
gaggacaaugguccauag

SEQ ID NO: 1048806 - RNA, 20 nt, Human
gaggucuagcauguucccaa

SEQ ID NO: 1048807 - RNA, 19 nt, Human
gcagcaucccucaaggaua

SEQ ID NO: 1048808 - RNA, 22 nt, Human
gccacagggcuuuuccucugcc

SEQ ID NO: 1048809 - RNA, 21 nt, Human
gcgcggaggaggcugaggggc

SEQ ID NO: 1048810 - RNA, 21 nt, Human
gcggaggaggcugaggggcag

SEQ ID NO: 1048811 - RNA, 19 nt, Human
ggaaaagucgaauaauguu

SEQ ID NO: 1048812 - RNA, 18 nt, Human
ggacguggcacaaugacc

SEQ ID NO: 1048813 - RNA, 23 nt, Human
ggagcguccuccauuuaaaccuc

SEQ ID NO: 1048814 - RNA, 20 nt, Human
ggaggaggcugaggggcagg

SEQ ID NO: 1048815 - RNA, 23 nt, Human
ggaggaggcugaggggcaggccg

SEQ ID NO: 1048816 - RNA, 22 nt, Human
ggcggguacagggguaaccgcc

SEQ ID NO: 1048817 - RNA, 20 nt, Human
gggcagagccagcugaaggg

SEQ ID NO: 1048818 - RNA, 23 nt, Human
gggccauggcacucuguggcacu

SEQ ID NO: 1048819 - RNA, 19 nt, Human
ggguuuccucuaacaguuu

SEQ ID NO: 1048820 - RNA, 21 nt, Human
ggugcugcaggaaaaaugggg

SEQ ID NO: 1048821 - RNA, 21 nt, Human
ucaggagucggagaucggggu

SEQ ID NO: 1048822 - RNA, 20 nt, Human
ucagggugcugcaggaaaaa

SEQ ID NO: 1048823 - RNA, 18 nt, Human
uccaagggagagcuguca

SEQ ID NO: 1048824 - RNA, 24 nt, Human
ucuaacaguuuccagacccaaggc

SEQ ID NO: 1048825 - RNA, 23 nt, Human
ucuccaggauagccgcacagccc

SEQ ID NO: 1048826 - RNA, 26 nt, Human
ucugcacacaguggacuauccaggga

SEQ ID NO: 1048827 - RNA, 22 nt, Human
ugacaacucccaugccucugca

SEQ ID NO: 1048828 - RNA, 25 nt, Human
ugagggaaaagucgaauaauguugu

SEQ ID NO: 1048829 - RNA, 27 nt, Human
ugagggaaaagucgaauaauguugugc

SEQ ID NO: 1048830 - RNA, 21 nt, Human
ugagugggugagaggacaaug

SEQ ID NO: 1048831 - RNA, 24 nt, Human
ugcacacaguggacuauccaggga

SEQ ID NO: 1048832 - RNA, 24 nt, Human
ugcggaaccagcaaagccauccaa

SEQ ID NO: 1048833 - RNA, 18 nt, Human
ugcugcaggaaaaauggg

SEQ ID NO: 1048834 - RNA, 19 nt, Human
uggcacaaugaccgacacu

SEQ ID NO: 1048835 - RNA, 20 nt, Human
uggcacaaugaccgacacuu

SEQ ID NO: 1048836 - RNA, 19 nt, Human
uggcuggugcggaaccagc

SEQ ID NO: 1048837 - RNA, 26 nt, Human
ugggggcuuccaaagucaggagucgg

SEQ ID NO: 1048838 - RNA, 23 nt, Human
uguugugcugagacaauaggggc

SEQ ID NO: 1048839 - RNA, 24 nt, Human
uuuuuuuuuuuuuuuuucauguuu

SEQ ID NO: 1048840 - RNA, 23 nt, Human
cucuggggcagguuuuggcuccu

SEQ ID NO: 1048841 - RNA, 24 nt, Human
cuggggcagguuuuggcuccuuuc

SEQ ID NO: 1048842 - RNA, 22 nt, Human
gggcagguuuuggcuccuuucu

SEQ ID NO: 1048843 - RNA, 22 nt, Human
guuuuggcuccuuucuccauuu

SEQ ID NO: 1048844 - RNA, 26 nt, Human
ucagucucuggggcagguuuuggcuc

SEQ ID NO: 1048845 - RNA, 22 nt, Human
ucucuggggcagguuuuggcuc

SEQ ID NO: 1048846 - RNA, 18 nt, Human
ugacucuuucagaaaagc

SEQ ID NO: 1048847 - RNA, 23 nt, Human
uuuaaagcuuucuuuucauugac

SEQ ID NO: 1048848 - RNA, 21 nt, Human
uuuggcuccuuucuccauuug

SEQ ID NO: 1048849 - RNA, 27 nt, Human
aggcagggaggccaguggagaggaugu

SEQ ID NO: 1048850 - RNA, 22 nt, Human
agggcgaugaugacagaggggg

SEQ ID NO: 1048851 - RNA, 22 nt, Human
ccuuuauuuugcaagugauggg

SEQ ID NO: 1048852 - RNA, 19 nt, Human
ggaaaggagccaggcggcc

SEQ ID NO: 1048853 - RNA, 19 nt, Human
ggacuggaggcagggaggc

SEQ ID NO: 1048854 - RNA, 18 nt, Human
ggaggccaguggagagga

SEQ ID NO: 1048855 - RNA, 22 nt, Human
ggccaguggagaggaugugguc

SEQ ID NO: 1048856 - RNA, 21 nt, Human
ggcuagggaaggacuggaggc

SEQ ID NO: 1048857 - RNA, 24 nt, Human
ggggggcuucuguggaggagggcu

SEQ ID NO: 1048858 - RNA, 21 nt, Human
uggaggagggcuagggaagga

SEQ ID NO: 1048859 - RNA, 22 nt, Human
uggaggcagggaggccagugga

SEQ ID NO: 1048860 - RNA, 26 nt, Human
uuaaggcuuuggccuuuauuuugcaa

SEQ ID NO: 1048861 - RNA, 25 nt, Human
cacagucaggccugaucgacugccc

SEQ ID NO: 1048862 - RNA, 23 nt, Human
cucccuggcacagucaggccuga

SEQ ID NO: 1048863 - RNA, 19 nt, Human
ucaggccugaucgacugcc

SEQ ID NO: 1048864 - RNA, 24 nt, Human
ucgacugcccuuggaguuccuggu

SEQ ID NO: 1048865 - RNA, 24 nt, Human
ugggcucccuggcacagucaggcc

SEQ ID NO: 1048866 - RNA, 19 nt, Human
ugggguugggcucccuggc

SEQ ID NO: 1048867 - RNA, 22 nt, Human
accgcccauaagcagagaagug

SEQ ID NO: 1048868 - RNA, 18 nt, Human
aggcucgaggcaaacugg

SEQ ID NO: 1048869 - RNA, 23 nt, Human
augaaaaucuaauaccgcccaua

SEQ ID NO: 1048870 - RNA, 21 nt, Human
auggcuggggugauuuuuuuu

SEQ ID NO: 1048871 - RNA, 25 nt, Human
auuuuuuuuuuuuuuuuuuuuuggc

SEQ ID NO: 1048872 - RNA, 26 nt, Human
auuuuuuuuuuuuuuuuuuuuugggg

SEQ ID NO: 1048873 - RNA, 24 nt, Human
ccaguuggacugccggccuuuucu

SEQ ID NO: 1048874 - RNA, 20 nt, Human
cccauaagcagagaagugga

SEQ ID NO: 1048875 - RNA, 26 nt, Human
ccgcccauaagcagagaaguggaaau

SEQ ID NO: 1048876 - RNA, 20 nt, Human
cuucucagagccaggguguc

SEQ ID NO: 1048877 - RNA, 24 nt, Human
gaagcaggauggugcaacgaagaa

SEQ ID NO: 1048878 - RNA, 18 nt, Human
gacgagacagccccauug

SEQ ID NO: 1048879 - RNA, 21 nt, Human
ggcucgaggcaaacugggcuu

SEQ ID NO: 1048880 - RNA, 19 nt, Human
gugaaaaggguacugugga

SEQ ID NO: 1048881 - RNA, 23 nt, Human
ucagagccagggugucaggagga

SEQ ID NO: 1048882 - RNA, 19 nt, Human
uccaggcuggaaaguggaa

SEQ ID NO: 1048883 - RNA, 21 nt, Human
ucgguggcacuuuguuuucuu

SEQ ID NO: 1048884 - RNA, 18 nt, Human
ugaggaugaagagaaaug

SEQ ID NO: 1048885 - RNA, 22 nt, Human
uggaaaguggaaacuaaggcau

SEQ ID NO: 1048886 - RNA, 18 nt, Human
uggaagaggcucgaggca

SEQ ID NO: 1048887 - RNA, 25 nt, Human
uggaagaggcucgaggcaaacuggg

SEQ ID NO: 1048888 - RNA, 30 nt, Human
uggcuggggugauuuuuuuuuuuuuuuuuu

SEQ ID NO: 1048889 - RNA, 32 nt, Human
uggcuggggugauuuuuuuuuuuuuuuuuuuu

SEQ ID NO: 1048890 - RNA, 19 nt, Human
ugggccagaucagacagca

SEQ ID NO: 1048891 - RNA, 25 nt, Human
uggggugauuuuuuuuuuuuuuuuu

SEQ ID NO: 1048892 - RNA, 21 nt, Human
uguagaaucagaagaugcuga

SEQ ID NO: 1048893 - RNA, 20 nt, Human
ugucuggaagaggcucgagg

SEQ ID NO: 1048894 - RNA, 19 nt, Human
ugugacagugaaaagggua

SEQ ID NO: 1048895 - RNA, 19 nt, Human
ugugacagugaaaagggua

SEQ ID NO: 1048896 - RNA, 20 nt, Human
ugugaggggauccaggcugg

SEQ ID NO: 1048897 - RNA, 20 nt, Human
uucaaugucagaagcaggau

SEQ ID NO: 1048898 - RNA, 25 nt, Human
uuuuuuuuuuuuggcagucuucuca

SEQ ID NO: 1048899 - RNA, 18 nt, Human
uuuuuuuuuuuuuuuuug

SEQ ID NO: 1048900 - RNA, 22 nt, Human
uuuuuuuuuuuuuuuuuggcag

SEQ ID NO: 1048901 - RNA, 21 nt, Human
agccugaugccacuaccaucc

SEQ ID NO: 1048902 - RNA, 24 nt, Human
aggaagacugaaggcaaagguggu

SEQ ID NO: 1048903 - RNA, 22 nt, Human
caucccacagcugccccccacc

SEQ ID NO: 1048904 - RNA, 23 nt, Human
ccacagcugccccccaccaggaa

SEQ ID NO: 1048905 - RNA, 21 nt, Human
ccacuaccaucccacagcugc

SEQ ID NO: 1048906 - RNA, 21 nt, Human
cccagaaccucugcacucaga

SEQ ID NO: 1048907 - RNA, 20 nt, Human
cucagaagccugaugccacu

SEQ ID NO: 1048908 - RNA, 22 nt, Human
ucccagaaccucugcacucaga

SEQ ID NO: 1048909 - RNA, 21 nt, Human
ugcacucagaagccugaugcc

SEQ ID NO: 1048910 - RNA, 24 nt, Human
accuggcaauaagagcccacacua

SEQ ID NO: 1048911 - RNA, 22 nt, Human
caauaagagcccacacuaaaag

SEQ ID NO: 1048912 - RNA, 25 nt, Human
cagggcacaccacguucacauucuc

SEQ ID NO: 1048913 - RNA, 20 nt, Human
ccacguucacauucucguag

SEQ ID NO: 1048914 - RNA, 22 nt, Human
gggugaagccuugucacagggc

SEQ ID NO: 1048915 - RNA, 26 nt, Human
aagacgcccacgccccuuggcccuca

SEQ ID NO: 1048916 - RNA, 22 nt, Human
cacgccccuuggcccucagcgg

SEQ ID NO: 1048917 - RNA, 23 nt, Human
cccgcccucucccccgagucucu

SEQ ID NO: 1048918 - RNA, 20 nt, Human
ccucccgcccucucccccga

SEQ ID NO: 1048919 - RNA, 22 nt, Human
cucccgcccucucccccgaguc

SEQ ID NO: 1048920 - RNA, 19 nt, Human
cucggucacucgcuggugc

SEQ ID NO: 1048921 - RNA, 26 nt, Human
gaagacgcccacgccccuuggcccuc

SEQ ID NO: 1048922 - RNA, 21 nt, Human
ucccccgagucucucggucac

SEQ ID NO: 1048923 - RNA, 18 nt, Human
ucggucacucgcuggugc

SEQ ID NO: 1048924 - RNA, 24 nt, Human
aacuccgcuagcucuccaacaaga

SEQ ID NO: 1048925 - RNA, 22 nt, Human
aagaagugacuugacgcagccc

SEQ ID NO: 1048926 - RNA, 20 nt, Human
acagagaagcaagagauaag

SEQ ID NO: 1048927 - RNA, 23 nt, Human
auguggccaagaggaugugaggu

SEQ ID NO: 1048928 - RNA, 19 nt, Human
cagagaagcaagagauaag

SEQ ID NO: 1048929 - RNA, 22 nt, Human
gugacauuccacacagcacugg

SEQ ID NO: 1048930 - RNA, 22 nt, Human
uagcucuccaacaagaagugac

SEQ ID NO: 1048931 - RNA, 20 nt, Human
ugaggugacauuccacacag

SEQ ID NO: 1048932 - RNA, 20 nt, Human
ugaugcaaggugcuggcagu

SEQ ID NO: 1048933 - RNA, 19 nt, Human
uggcagugacacuaucaca

SEQ ID NO: 1048934 - RNA, 22 nt, Human
agcuggguuuccacaagguggg

SEQ ID NO: 1048935 - RNA, 18 nt, Human
caugacaucucccugccc

SEQ ID NO: 1048936 - RNA, 19 nt, Human
ccaugacaucucccugccc

SEQ ID NO: 1048937 - RNA, 22 nt, Human
cccggacagcgaagaguugagg

SEQ ID NO: 1048938 - RNA, 22 nt, Human
ccuaugaugguggcgggguuuu

SEQ ID NO: 1048939 - RNA, 24 nt, Human
cuacacagguagccggaacugcag

SEQ ID NO: 1048940 - RNA, 21 nt, Human
cuagcguagcuccgcuuucuc

SEQ ID NO: 1048941 - RNA, 18 nt, Human
gaacugcagccaaccuuc

SEQ ID NO: 1048942 - RNA, 19 nt, Human
uagauccuacuagccagga

SEQ ID NO: 1048943 - RNA, 24 nt, Human
ucuagauccuacuagccaggagac

SEQ ID NO: 1048944 - RNA, 24 nt, Human
uggggucaaagggagggagaaauc

SEQ ID NO: 1048945 - RNA, 24 nt, Human
uuuauauguuuuguuacuguccag

SEQ ID NO: 1048946 - RNA, 23 nt, Human
cagcgugugagggucugugucuc

SEQ ID NO: 1048947 - RNA, 22 nt, Human
gcgugugagggucugugucucc

SEQ ID NO: 1048948 - RNA, 24 nt, Human
ccuccagugaccuugcagggacug

SEQ ID NO: 1048949 - RNA, 19 nt, Human
cuggauuccugaugauguu

SEQ ID NO: 1048950 - RNA, 22 nt, Human
cuggauuccugaugauguucgu

SEQ ID NO: 1048951 - RNA, 22 nt, Human
cuucaggaaccuccagugaccu

SEQ ID NO: 1048952 - RNA, 21 nt, Human
gagcggcucaaaguccucguc

SEQ ID NO: 1048953 - RNA, 21 nt, Human
ugucugaacuucaggaaccuc

SEQ ID NO: 1048954 - RNA, 24 nt, Human
aaauguccucccgcgcugggcucc

SEQ ID NO: 1048955 - RNA, 18 nt, Human
aacagcggggacacagau

SEQ ID NO: 1048956 - RNA, 22 nt, Human
accagagccccggcaacagcgg

SEQ ID NO: 1048957 - RNA, 24 nt, Human
aggaggcuaugaaaauguccuccc

SEQ ID NO: 1048958 - RNA, 21 nt, Human
auagggcgcgcaaguggauac

SEQ ID NO: 1048959 - RNA, 22 nt, Human
cagcucaggauuccauccuccc

SEQ ID NO: 1048960 - RNA, 22 nt, Human
cagugcaccugcuuuugucugg

SEQ ID NO: 1048961 - RNA, 23 nt, Human
cccaggcucgggcuccggucccu

SEQ ID NO: 1048962 - RNA, 21 nt, Human
ccucagggagugggacugagg

SEQ ID NO: 1048963 - RNA, 18 nt, Human
ccucggacuguaggaccc

SEQ ID NO: 1048964 - RNA, 18 nt, Human
cgugcgcgcaggcagccg

SEQ ID NO: 1048965 - RNA, 20 nt, Human
cgugcgcgcaggcagccgcg

SEQ ID NO: 1048966 - RNA, 22 nt, Human
cuccucccucgcugcgggaccu

SEQ ID NO: 1048967 - RNA, 22 nt, Human
cugcuuuugucuggauuccuac

SEQ ID NO: 1048968 - RNA, 21 nt, Human
gaaaguuugaugucaaguuca

SEQ ID NO: 1048969 - RNA, 21 nt, Human
gaggugagaguagugacugug

SEQ ID NO: 1048970 - RNA, 22 nt, Human
uaucagaaaguuugaugucaag

SEQ ID NO: 1048971 - RNA, 21 nt, Human
ucagaaaguuugaugucaagu

SEQ ID NO: 1048972 - RNA, 24 nt, Human
uccccaauguucccagcugagguu

SEQ ID NO: 1048973 - RNA, 23 nt, Human
ugcagcucaggauuccauccucc

SEQ ID NO: 1048974 - RNA, 22 nt, Human
ugcgugcgcgcaggcagccgcg

SEQ ID NO: 1048975 - RNA, 18 nt, Human
uggauccccaccacauag

SEQ ID NO: 1048976 - RNA, 24 nt, Human
ugggcuccugccaccgccacguuu

SEQ ID NO: 1048977 - RNA, 19 nt, Human
uucccagcugaggugagag

SEQ ID NO: 1048978 - RNA, 18 nt, Human
uuccuauugucucaggag

SEQ ID NO: 1048979 - RNA, 18 nt, Human
cagcagacccagucucug

SEQ ID NO: 1048980 - RNA, 23 nt, Human
cagggccuggagauguccuugag

SEQ ID NO: 1048981 - RNA, 21 nt, Human
ccagccuucuugcucuggggc

SEQ ID NO: 1048982 - RNA, 23 nt, Human
cccgacugccgucuguccagaag

SEQ ID NO: 1048983 - RNA, 24 nt, Human
gccuccccaccacuguguggagac

SEQ ID NO: 1048984 - RNA, 23 nt, Human
ggccuggagauguccuugagggc

SEQ ID NO: 1048985 - RNA, 21 nt, Human
ucuguccagaaggccucccca

SEQ ID NO: 1048986 - RNA, 21 nt, Human
aggcugcaccggggaccccag

SEQ ID NO: 1048987 - RNA, 23 nt, Human
cacacagcugacgaggcugcacc

SEQ ID NO: 1048988 - RNA, 21 nt, Human
caccggggaccccagcugcag

SEQ ID NO: 1048989 - RNA, 23 nt, Human
caggagccccugcacaaggccca

SEQ ID NO: 1048990 - RNA, 23 nt, Human
ccccagcugcaggcuaaauccaa

SEQ ID NO: 1048991 - RNA, 21 nt, Human
gagccccugcacaaggcccag

SEQ ID NO: 1048992 - RNA, 22 nt, Human
gccacaccgcacacagcugacg

SEQ ID NO: 1048993 - RNA, 22 nt, Human
ggagccccugcacaaggcccuu

SEQ ID NO: 1048994 - RNA, 22 nt, Human
ggcccacaccgccacaccgcac

SEQ ID NO: 1048995 - RNA, 22 nt, Human
gggugggagggauuugcagggc

SEQ ID NO: 1048996 - RNA, 20 nt, Human
ugggacggcccacaccgcca

SEQ ID NO: 1048997 - RNA, 18 nt, Human
caugcuuguccuccaggg

SEQ ID NO: 1048998 - RNA, 18 nt, Human
ccucggugaucuccggcc

SEQ ID NO: 1048999 - RNA, 20 nt, Human
cucggauuccucggugaucu

SEQ ID NO: 1049000 - RNA, 19 nt, Human
gagaagaagcugcaaggug

SEQ ID NO: 1049001 - RNA, 18 nt, Human
gcucggauuccucgguga

SEQ ID NO: 1049002 - RNA, 20 nt, Human
ggagaagaagcugcaaggug

SEQ ID NO: 1049003 - RNA, 22 nt, Human
ggagaagaagcugcaaggugcc

SEQ ID NO: 1049004 - RNA, 23 nt, Human
uccucggugaucuccggccucac

SEQ ID NO: 1049005 - RNA, 18 nt, Human
uucaugcuuguccuccag

SEQ ID NO: 1049006 - RNA, 18 nt, Human
aaaccagcguuuccucca

SEQ ID NO: 1049007 - RNA, 20 nt, Human
aaaccagcguuuccuccagg

SEQ ID NO: 1049008 - RNA, 19 nt, Human
aacacagcuaucaccagca

SEQ ID NO: 1049009 - RNA, 22 nt, Human
aaccccauggauggggccccuc

SEQ ID NO: 1049010 - RNA, 22 nt, Human
acacagcuaucaccagcaagaa

SEQ ID NO: 1049011 - RNA, 23 nt, Human
acacagugagacaccgggggcuc

SEQ ID NO: 1049012 - RNA, 21 nt, Human
acagugaaagaaacacagcua

SEQ ID NO: 1049013 - RNA, 24 nt, Human
acucauucauguccucccuggucu

SEQ ID NO: 1049014 - RNA, 21 nt, Human
acuguccuggccccacucugg

SEQ ID NO: 1049015 - RNA, 19 nt, Human
agaaaguggcgagcccagu

SEQ ID NO: 1049016 - RNA, 24 nt, Human
agaacagacucccucaugcaugga

SEQ ID NO: 1049017 - RNA, 26 nt, Human
agaaggcagcacagaccaugcaccau

SEQ ID NO: 1049018 - RNA, 26 nt, Human
agaaggcagcacaggccaugcaccau

SEQ ID NO: 1049019 - RNA, 26 nt, Human
agaaggcagcacaggccgugcaccau

SEQ ID NO: 1049020 - RNA, 20 nt, Human
agaagugccccagccaggaa

SEQ ID NO: 1049021 - RNA, 22 nt, Human
agacucccucaugcauggacuc

SEQ ID NO: 1049022 - RNA, 21 nt, Human
agaguggaaaucuguugggag

SEQ ID NO: 1049023 - RNA, 21 nt, Human
agcaagaaaguggcgagccca

SEQ ID NO: 1049024 - RNA, 24 nt, Human
agcaagaacaagauaggaaugaga

SEQ ID NO: 1049025 - RNA, 24 nt, Human
agccaggaaccccauggauggggc

SEQ ID NO: 1049026 - RNA, 24 nt, Human
agcucucaggaccccuuggggucc

SEQ ID NO: 1049027 - RNA, 21 nt, Human
agcugcccucagaagcaaugc

SEQ ID NO: 1049028 - RNA, 22 nt, Human
aggacagugaaagaaacacagc

SEQ ID NO: 1049029 - RNA, 26 nt, Human
aggcaagaaaaaaaugagaugucugg

SEQ ID NO: 1049030 - RNA, 22 nt, Human
aggcacaggugggccccaagca

SEQ ID NO: 1049031 - RNA, 20 nt, Human
aggcacuguccuggccccac

SEQ ID NO: 1049032 - RNA, 19 nt, Human
aggcagaaggcagcacaga

SEQ ID NO: 1049033 - RNA, 21 nt, Human
aggcagaaggcagcacagacc

SEQ ID NO: 1049034 - RNA, 19 nt, Human
aggcagaaggcagcacagg

SEQ ID NO: 1049035 - RNA, 19 nt, Human
aggcagaaggcagcacagg

SEQ ID NO: 1049036 - RNA, 19 nt, Human
aggcagcacagaccaugca

SEQ ID NO: 1049037 - RNA, 24 nt, Human
agggagcagcaagaaaguggcgag

SEQ ID NO: 1049038 - RNA, 22 nt, Human
agggaguaagaggagagagggu

SEQ ID NO: 1049039 - RNA, 21 nt, Human
aggggucagacuuuggagcag

SEQ ID NO: 1049040 - RNA, 18 nt, Human
aggugcagggaugggcca

SEQ ID NO: 1049041 - RNA, 22 nt, Human
aggugcagggaugggccaggug

SEQ ID NO: 1049042 - RNA, 20 nt, Human
agguguggcucagcacccaa

SEQ ID NO: 1049043 - RNA, 18 nt, Human
agucuggccccuccgcag

SEQ ID NO: 1049044 - RNA, 20 nt, Human
aguggcuggguccacucagg

SEQ ID NO: 1049045 - RNA, 22 nt, Human
aucucuggccacugacugaagc

SEQ ID NO: 1049046 - RNA, 21 nt, Human
augcagauguggccucgagac

SEQ ID NO: 1049047 - RNA, 18 nt, Human
augguccauuuaaaggga

SEQ ID NO: 1049048 - RNA, 19 nt, Human
caagggggugaaggugggg

SEQ ID NO: 1049049 - RNA, 22 nt, Human
caaguccugacucggcacuggc

SEQ ID NO: 1049050 - RNA, 20 nt, Human
caauguccacguggguuucc

SEQ ID NO: 1049051 - RNA, 21 nt, Human
cacacagugagacaccggggg

SEQ ID NO: 1049052 - RNA, 20 nt, Human
cacagcugcccucagaagca

SEQ ID NO: 1049053 - RNA, 21 nt, Human
cacagcugcccucagaagcaa

SEQ ID NO: 1049054 - RNA, 19 nt, Human
cacaucagaugucuuggcc

SEQ ID NO: 1049055 - RNA, 23 nt, Human
caccagguaaaagguacgcucac

SEQ ID NO: 1049056 - RNA, 18 nt, Human
caccaugcagauguggcc

SEQ ID NO: 1049057 - RNA, 19 nt, Human
cagaucugacagaugcucu

SEQ ID NO: 1049058 - RNA, 20 nt, Human
cagcaagaaaguggcgagcc

SEQ ID NO: 1049059 - RNA, 21 nt, Human
cagcacccaauguccacucag

SEQ ID NO: 1049060 - RNA, 19 nt, Human
caggaagagacugaggaug

SEQ ID NO: 1049061 - RNA, 18 nt, Human
caggaccccuuggggucc

SEQ ID NO: 1049062 - RNA, 19 nt, Human
caggcccugaucaaggcaa

SEQ ID NO: 1049063 - RNA, 22 nt, Human
caggggcuucuuggagccauca

SEQ ID NO: 1049064 - RNA, 18 nt, Human
caugacacagucaacaug

SEQ ID NO: 1049065 - RNA, 19 nt, Human
cccagccaggaaccccaug

SEQ ID NO: 1049066 - RNA, 19 nt, Human
cccaggaaagaacagacuc

SEQ ID NO: 1049067 - RNA, 21 nt, Human
ccccauggauggggccccucu

SEQ ID NO: 1049068 - RNA, 22 nt, Human
cccugauauuacagagcuuuag

SEQ ID NO: 1049069 - RNA, 19 nt, Human
ccggcuggcauucccucca

SEQ ID NO: 1049070 - RNA, 22 nt, Human
ccgggucugaggggcaggaaga

SEQ ID NO: 1049071 - RNA, 26 nt, Human
ccuccaggcaaagagccucagcuuuu

SEQ ID NO: 1049072 - RNA, 21 nt, Human
ccucgagacccaucauccacc

SEQ ID NO: 1049073 - RNA, 22 nt, Human
ccucugggcagccucagggguc

SEQ ID NO: 1049074 - RNA, 22 nt, Human
ccuggccccacucugguuuugg

SEQ ID NO: 1049075 - RNA, 21 nt, Human
cuaucaccagcaagaacaaga

SEQ ID NO: 1049076 - RNA, 21 nt, Human
cucagguuucuggaugcuggg

SEQ ID NO: 1049077 - RNA, 19 nt, Human
cucauucauguccucccug

SEQ ID NO: 1049078 - RNA, 22 nt, Human
cucccuggucucagccaccagg

SEQ ID NO: 1049079 - RNA, 18 nt, Human
cuucacagccggcagggu

SEQ ID NO: 1049080 - RNA, 20 nt, Human
cuugcuucacagccggcagg

SEQ ID NO: 1049081 - RNA, 19 nt, Human
gaccuuggaaagacucuga

SEQ ID NO: 1049082 - RNA, 19 nt, Human
gacuaaguccucugccucu

SEQ ID NO: 1049083 - RNA, 21 nt, Human
gagacaccccggaggugcagg

SEQ ID NO: 1049084 - RNA, 21 nt, Human
gagagaggguggcaacuggaa

SEQ ID NO: 1049085 - RNA, 23 nt, Human
gagcccagucugcugcauggggg

SEQ ID NO: 1049086 - RNA, 19 nt, Human
gagccucagcuucuucucg

SEQ ID NO: 1049087 - RNA, 21 nt, Human
gaggggcaggaagagacugag

SEQ ID NO: 1049088 - RNA, 20 nt, Human
gaugccggagccaggcagaa

SEQ ID NO: 1049089 - RNA, 19 nt, Human
gcauguucugcucucuggc

SEQ ID NO: 1049090 - RNA, 18 nt, Human
gcugcugucuucagcagc

SEQ ID NO: 1049091 - RNA, 20 nt, Human
ggaaagaacagacucccuca

SEQ ID NO: 1049092 - RNA, 18 nt, Human
ggagcagcucugaggcac

SEQ ID NO: 1049093 - RNA, 21 nt, Human
ggagcagcucugaggcacugu

SEQ ID NO: 1049094 - RNA, 22 nt, Human
ggagcagcugggcucagcugug

SEQ ID NO: 1049095 - RNA, 19 nt, Human
ggcaggaagagacugagga

SEQ ID NO: 1049096 - RNA, 20 nt, Human
ggcugggggcugcugucuuc

SEQ ID NO: 1049097 - RNA, 18 nt, Human
gggaugggccaggugggc

SEQ ID NO: 1049098 - RNA, 19 nt, Human
gggucagacuuuggagcag

SEQ ID NO: 1049099 - RNA, 27 nt, Human
gucagcaucucaggcccugaucaaggc

SEQ ID NO: 1049100 - RNA, 20 nt, Human
uaagaggagagaggguggca

SEQ ID NO: 1049101 - RNA, 21 nt, Human
uaccagacccaggcagaaggc

SEQ ID NO: 1049102 - RNA, 24 nt, Human
uaccagacccaggcagaaggcagc

SEQ ID NO: 1049103 - RNA, 19 nt, Human
uaggaagaggacagugaaa

SEQ ID NO: 1049104 - RNA, 21 nt, Human
ucacaucaacauccagcugcu

SEQ ID NO: 1049105 - RNA, 19 nt, Human
uccaccucaaguccugacu

SEQ ID NO: 1049106 - RNA, 19 nt, Human
ucccuggucucagccaccu

SEQ ID NO: 1049107 - RNA, 24 nt, Human
ucuggacccacucauucauguccu

SEQ ID NO: 1049108 - RNA, 18 nt, Human
ugaccuuggaaagacucu

SEQ ID NO: 1049109 - RNA, 20 nt, Human
ugagaguggaaaucuguugg

SEQ ID NO: 1049110 - RNA, 21 nt, Human
ugaggggcaggaagagacuga

SEQ ID NO: 1049111 - RNA, 18 nt, Human
ugaugggagcagcugggc

SEQ ID NO: 1049112 - RNA, 19 nt, Human
ugaugggagcagcugggcu

SEQ ID NO: 1049113 - RNA, 23 nt, Human
ugcauggacucagcaggccggcu

SEQ ID NO: 1049114 - RNA, 19 nt, Human
ugccugaagccacagaucu

SEQ ID NO: 1049115 - RNA, 22 nt, Human
ugccugaagccacagaucugac

SEQ ID NO: 1049116 - RNA, 22 nt, Human
ugccuggaugguccauuuaaag

SEQ ID NO: 1049117 - RNA, 24 nt, Human
ugccuggaugguccauuuaaaggg

SEQ ID NO: 1049118 - RNA, 20 nt, Human
ugcuagucuggccccuccgc

SEQ ID NO: 1049119 - RNA, 24 nt, Human
ugcugggcccaggcagaaggcagc

SEQ ID NO: 1049120 - RNA, 20 nt, Human
ugcuucacagccggcagggu

SEQ ID NO: 1049121 - RNA, 22 nt, Human
uggaaaucuguugggagcccgg

SEQ ID NO: 1049122 - RNA, 20 nt, Human
uggcgugcuggugcgagcgg

SEQ ID NO: 1049123 - RNA, 23 nt, Human
uggcucagcacccaauguccacg

SEQ ID NO: 1049124 - RNA, 19 nt, Human
uggggugugggaucacuua

SEQ ID NO: 1049125 - RNA, 20 nt, Human
uuagaguguggcggagcagg

SEQ ID NO: 1049126 - RNA, 23 nt, Human
uuccuccaggcaaagagccucag

SEQ ID NO: 1049127 - RNA, 22 nt, Human
uuccuccugccugaagccacag

SEQ ID NO: 1049128 - RNA, 19 nt, Human
uugaucaccuuggcugggg

SEQ ID NO: 1049129 - RNA, 23 nt, Human
uugcauguucugcucucuggcug

SEQ ID NO: 1049130 - RNA, 21 nt, Human
uuggaaagacucugaaaucaa

SEQ ID NO: 1049131 - RNA, 18 nt, Human
uuggagcagcuuccauga

SEQ ID NO: 1049132 - RNA, 20 nt, Human
uuuugaucaccuuggcuggg

SEQ ID NO: 1049133 - RNA, 22 nt, Human
cuggugccccuuaggugcuggg

SEQ ID NO: 1049134 - RNA, 24 nt, Human
ugcugggcccuuggaaaucggcgc

SEQ ID NO: 1049135 - RNA, 18 nt, Human
uggugccccuuaggugcu

SEQ ID NO: 1049136 - RNA, 23 nt, Human
uuggaaaucggcgcguggggggc

SEQ ID NO: 1049137 - RNA, 18 nt, Human
acaugacacucuguccuc

SEQ ID NO: 1049138 - RNA, 18 nt, Human
acugaucugacacagccu

SEQ ID NO: 1049139 - RNA, 18 nt, Human
cacagccucacaugacac

SEQ ID NO: 1049140 - RNA, 18 nt, Human
caggacacagacugaucu

SEQ ID NO: 1049141 - RNA, 22 nt, Human
caggacacagacugaucugaca

SEQ ID NO: 1049142 - RNA, 23 nt, Human
cccaggacacagacugaucugac

SEQ ID NO: 1049143 - RNA, 24 nt, Human
aaaaccagagucuccaggggccga

SEQ ID NO: 1049144 - RNA, 23 nt, Human
aaacagacugaggaagcugcaca

SEQ ID NO: 1049145 - RNA, 21 nt, Human
aacaggacgagcaaccaauag

SEQ ID NO: 1049146 - RNA, 20 nt, Human
aagcgccgacaaacaggacg

SEQ ID NO: 1049147 - RNA, 22 nt, Human
aagcugcacaggccaauggcag

SEQ ID NO: 1049148 - RNA, 22 nt, Human
acaaauuucuaauacuguccag

SEQ ID NO: 1049149 - RNA, 21 nt, Human
acaacccccacccccaccccc

SEQ ID NO: 1049150 - RNA, 24 nt, Human
acacaaaaucuaacaagugugaac

SEQ ID NO: 1049151 - RNA, 18 nt, Human
acagacccagccuagccc

SEQ ID NO: 1049152 - RNA, 23 nt, Human
acaggacgagcaaccaauagcaa

SEQ ID NO: 1049153 - RNA, 23 nt, Human
acaggagaaaacacacucaagca

SEQ ID NO: 1049154 - RNA, 20 nt, Human
accaugcccagccugaccug

SEQ ID NO: 1049155 - RNA, 21 nt, Human
accaugcccagccugaccugg

SEQ ID NO: 1049156 - RNA, 20 nt, Human
acccccacccccacccccac

SEQ ID NO: 1049157 - RNA, 22 nt, Human
acccccacccccacccccacug

SEQ ID NO: 1049158 - RNA, 26 nt, Human
acccccacccccacccccacuguuca

SEQ ID NO: 1049159 - RNA, 22 nt, Human
agacuguguaggcuggucacag

SEQ ID NO: 1049160 - RNA, 22 nt, Human
agaucugcagcuccagcagucu

SEQ ID NO: 1049161 - RNA, 23 nt, Human
agcaaccgagggcggcugcggcc

SEQ ID NO: 1049162 - RNA, 21 nt, Human
agcacaacccccacccccacc

SEQ ID NO: 1049163 - RNA, 19 nt, Human
agcagagugugagcacuca

SEQ ID NO: 1049164 - RNA, 24 nt, Human
aggagaaaacacacucaagcaggg

SEQ ID NO: 1049165 - RNA, 22 nt, Human
aggguauccugcaugcagguga

SEQ ID NO: 1049166 - RNA, 22 nt, Human
caacagcaacuugaaacagacu

SEQ ID NO: 1049167 - RNA, 18 nt, Human
caagagaauaagcauaca

SEQ ID NO: 1049168 - RNA, 23 nt, Human
caauagcaaccgagggcggcugc

SEQ ID NO: 1049169 - RNA, 26 nt, Human
cacaacagggccaccauaggaugaga

SEQ ID NO: 1049170 - RNA, 21 nt, Human
cacaggucagggcuacccuuc

SEQ ID NO: 1049171 - RNA, 25 nt, Human
cacccccacccccacuguucacaga

SEQ ID NO: 1049172 - RNA, 19 nt, Human
caccugccugcaugugcag

SEQ ID NO: 1049173 - RNA, 21 nt, Human
cacuguucacagacacagggg

SEQ ID NO: 1049174 - RNA, 19 nt, Human
cagcaucacacaacagggc

SEQ ID NO: 1049175 - RNA, 21 nt, Human
cagcaucacacaacagggcca

SEQ ID NO: 1049176 - RNA, 18 nt, Human
cagcgaaccucccagauc

SEQ ID NO: 1049177 - RNA, 18 nt, Human
caggcgggcauccugggc

SEQ ID NO: 1049178 - RNA, 26 nt, Human
caguucuuuucagcagcuuuaugaga

SEQ ID NO: 1049179 - RNA, 25 nt, Human
cauuaugacccaccuguguguccag

SEQ ID NO: 1049180 - RNA, 21 nt, Human
ccagagucuccaggggccgac

SEQ ID NO: 1049181 - RNA, 21 nt, Human
ccaggaagagagcagggaggg

SEQ ID NO: 1049182 - RNA, 20 nt, Human
ccauaugucuuggacuugga

SEQ ID NO: 1049183 - RNA, 18 nt, Human
cccagccuagcccucagc

SEQ ID NO: 1049184 - RNA, 18 nt, Human
ccccacccccacccccac

SEQ ID NO: 1049185 - RNA, 21 nt, Human
ccccacccccacuguucacag

SEQ ID NO: 1049186 - RNA, 24 nt, Human
cccccacccccacccccacuguuc

SEQ ID NO: 1049187 - RNA, 23 nt, Human
ccucucaaaucacacggcucugg

SEQ ID NO: 1049188 - RNA, 25 nt, Human
cgccgacaaacaggacgagcaacca

SEQ ID NO: 1049189 - RNA, 19 nt, Human
cggcgcgcgcggagggccg

SEQ ID NO: 1049190 - RNA, 20 nt, Human
cuaccuuacgucagccgccu

SEQ ID NO: 1049191 - RNA, 19 nt, Human
cucacaaugcucaccaaac

SEQ ID NO: 1049192 - RNA, 24 nt, Human
cuccuaugcuaccaugcccagccu

SEQ ID NO: 1049193 - RNA, 18 nt, Human
cuggccaguucuuuucag

SEQ ID NO: 1049194 - RNA, 23 nt, Human
cugggacguggcaggcaguuucc

SEQ ID NO: 1049195 - RNA, 22 nt, Human
cuuacgucagccgccucucaaa

SEQ ID NO: 1049196 - RNA, 19 nt, Human
cuuagggagcacaggagaa

SEQ ID NO: 1049197 - RNA, 24 nt, Human
cuucgagaagcgccgacaaacagg

SEQ ID NO: 1049198 - RNA, 19 nt, Human
cuucgcccccuucuucgag

SEQ ID NO: 1049199 - RNA, 19 nt, Human
gaaaacacacucaagcagg

SEQ ID NO: 1049200 - RNA, 21 nt, Human
gaaagacauucacaguggcac

SEQ ID NO: 1049201 - RNA, 22 nt, Human
gaaaucagaugaaauagcuuuu

SEQ ID NO: 1049202 - RNA, 18 nt, Human
gagagcagggagggugcu

SEQ ID NO: 1049203 - RNA, 19 nt, Human
gagcagggagggugcuggg

SEQ ID NO: 1049204 - RNA, 21 nt, Human
gaguggagcagagugugagca

SEQ ID NO: 1049205 - RNA, 20 nt, Human
gaugggggaacgcuggcucc

SEQ ID NO: 1049206 - RNA, 20 nt, Human
gcacaacuguuuagcuaccu

SEQ ID NO: 1049207 - RNA, 18 nt, Human
gggcggcugcggcgcgcg

SEQ ID NO: 1049208 - RNA, 18 nt, Human
ggguauccugcaugcagg

SEQ ID NO: 1049209 - RNA, 19 nt, Human
gugaacuuaauuuucagcu

SEQ ID NO: 1049210 - RNA, 22 nt, Human
gugagcacaacccccaccccca

SEQ ID NO: 1049211 - RNA, 19 nt, Human
guucuuuucagcagcuuua

SEQ ID NO: 1049212 - RNA, 26 nt, Human
uaaacagaccucuucaagaaauagug

SEQ ID NO: 1049213 - RNA, 22 nt, Human
uacaacacuguuacacacaaaa

SEQ ID NO: 1049214 - RNA, 28 nt, Human
uacacacaaaaucuaacaagugugaacc

SEQ ID NO: 1049215 - RNA, 20 nt, Human
uacugagcaucaagguggug

SEQ ID NO: 1049216 - RNA, 19 nt, Human
uauucaacuugcugccugu

SEQ ID NO: 1049217 - RNA, 20 nt, Human
ucaaaucucaacaauccggu

SEQ ID NO: 1049218 - RNA, 19 nt, Human
ucacgucuucgcccccuuc

SEQ ID NO: 1049219 - RNA, 23 nt, Human
ucagcagcuuuaugagauuuucu

SEQ ID NO: 1049220 - RNA, 22 nt, Human
uccugggccgcgcagcuaccuu

SEQ ID NO: 1049221 - RNA, 26 nt, Human
uccugugagcaagagcucacagggac

SEQ ID NO: 1049222 - RNA, 19 nt, Human
ucuccaggggccgaccugg

SEQ ID NO: 1049223 - RNA, 20 nt, Human
ucuccaggggccgaccuggg

SEQ ID NO: 1049224 - RNA, 24 nt, Human
ucuucagcugaguccacaaacccu

SEQ ID NO: 1049225 - RNA, 19 nt, Human
ugcaacagcaacuugaaac

SEQ ID NO: 1049226 - RNA, 21 nt, Human
ugcaacagcaacuugaaacag

SEQ ID NO: 1049227 - RNA, 19 nt, Human
ugcccagccugaccuggcu

SEQ ID NO: 1049228 - RNA, 18 nt, Human
ugcuaccaugcccagccu

SEQ ID NO: 1049229 - RNA, 19 nt, Human
uggcgcgaagccuacgcga

SEQ ID NO: 1049230 - RNA, 23 nt, Human
ugggcaaguagggcuagcaaugu

SEQ ID NO: 1049231 - RNA, 18 nt, Human
uguccagguacaacacug

SEQ ID NO: 1049232 - RNA, 20 nt, Human
ugucuuggacuuggauuucu

SEQ ID NO: 1049233 - RNA, 21 nt, Human
uucauacauuuuaaaacacuu

SEQ ID NO: 1049234 - RNA, 23 nt, Human
aaagaccuacuggccagaagcac

SEQ ID NO: 1049235 - RNA, 19 nt, Human
aacauggugaaaccccguc

SEQ ID NO: 1049236 - RNA, 20 nt, Human
aacauggugaaaccccgucu

SEQ ID NO: 1049237 - RNA, 21 nt, Human
aacauggugaaaccccgucuc

SEQ ID NO: 1049238 - RNA, 20 nt, Human
aaccacagggcccugauccg

SEQ ID NO: 1049239 - RNA, 21 nt, Human
aagaagaugaugcacauggug

SEQ ID NO: 1049240 - RNA, 18 nt, Human
aaucccagcuaaucagga

SEQ ID NO: 1049241 - RNA, 20 nt, Human
aaucuagcaaugagucugca

SEQ ID NO: 1049242 - RNA, 21 nt, Human
aaugcaguauggcaaaggaag

SEQ ID NO: 1049243 - RNA, 24 nt, Human
aauugcuugaacuugggaggcgga

SEQ ID NO: 1049244 - RNA, 20 nt, Human
acagagcaagacuccgucuc

SEQ ID NO: 1049245 - RNA, 24 nt, Human
acagagcaagacuccgucucaaaa

SEQ ID NO: 1049246 - RNA, 24 nt, Human
acagggcgaggaucaaacuuaaag

SEQ ID NO: 1049247 - RNA, 24 nt, Human
accaacauggugaaaccccgucuc

SEQ ID NO: 1049248 - RNA, 24 nt, Human
accccgucucuacuaaaaacacaa

SEQ ID NO: 1049249 - RNA, 19 nt, Human
acccugaacugggcauggg

SEQ ID NO: 1049250 - RNA, 24 nt, Human
acuccugucguuggaccagaacaa

SEQ ID NO: 1049251 - RNA, 24 nt, Human
acugcacuccagccugggugacag

SEQ ID NO: 1049252 - RNA, 26 nt, Human
acugcacuccagccugggugacagag

SEQ ID NO: 1049253 - RNA, 21 nt, Human
agaggcauggucuccagcugg

SEQ ID NO: 1049254 - RNA, 18 nt, Human
agagggagagagcagggc

SEQ ID NO: 1049255 - RNA, 18 nt, Human
agagucgcccuucugccu

SEQ ID NO: 1049256 - RNA, 24 nt, Human
agcacuuugggaggccgaggcagg

SEQ ID NO: 1049257 - RNA, 24 nt, Human
agccugaccaacauggugaaaccc

SEQ ID NO: 1049258 - RNA, 24 nt, Human
agccugggugacagagcaagacuc

SEQ ID NO: 1049259 - RNA, 23 nt, Human
agcugggcaugguggcacacgcc

SEQ ID NO: 1049260 - RNA, 24 nt, Human
aggcagguggaucaccacgucagg

SEQ ID NO: 1049261 - RNA, 21 nt, Human
aggccgaggcagguggaucac

SEQ ID NO: 1049262 - RNA, 24 nt, Human
aggcggagguugcagugagccgag

SEQ ID NO: 1049263 - RNA, 24 nt, Human
aggcgugguggcucacgccuguaa

SEQ ID NO: 1049264 - RNA, 24 nt, Human
aggcuggggcaggagaauugcuug

SEQ ID NO: 1049265 - RNA, 24 nt, Human
agguggaucaccacgucaggaguu

SEQ ID NO: 1049266 - RNA, 20 nt, Human
agguguauccacauguucau

SEQ ID NO: 1049267 - RNA, 24 nt, Human
agguuuccuguccacagugccccu

SEQ ID NO: 1049268 - RNA, 22 nt, Human
aucaccacgucaggaguucaag

SEQ ID NO: 1049269 - RNA, 24 nt, Human
aucgugccacugcacuccagccug

SEQ ID NO: 1049270 - RNA, 23 nt, Human
augguggugcagggcggcucugc

SEQ ID NO: 1049271 - RNA, 20 nt, Human
auuagcugggcaugguggcc

SEQ ID NO: 1049272 - RNA, 23 nt, Human
caaacacagaggaccucuggcac

SEQ ID NO: 1049273 - RNA, 24 nt, Human
caacauggugaaaccccgucucua

SEQ ID NO: 1049274 - RNA, 21 nt, Human
caagacuccgucucaaaaaaa

SEQ ID NO: 1049275 - RNA, 20 nt, Human
caagaguccaagcacgccug

SEQ ID NO: 1049276 - RNA, 28 nt, Human
cacacggagccuccuggcacacacagga

SEQ ID NO: 1049277 - RNA, 24 nt, Human
cacagauggguaacacgcaaacca

SEQ ID NO: 1049278 - RNA, 23 nt, Human
cacaggauugucucaaacacaga

SEQ ID NO: 1049279 - RNA, 18 nt, Human
cacgccuguaaucccagc

SEQ ID NO: 1049280 - RNA, 24 nt, Human
cacgccuguaaucccagcacuuug

SEQ ID NO: 1049281 - RNA, 19 nt, Human
cacgccuguaaucccagcu

SEQ ID NO: 1049282 - RNA, 22 nt, Human
cacuccagccugggugacagag

SEQ ID NO: 1049283 - RNA, 19 nt, Human
cacugcacuccagccuggg

SEQ ID NO: 1049284 - RNA, 21 nt, Human
cacugcacuccagccugggug

SEQ ID NO: 1049285 - RNA, 22 nt, Human
cacugcacuccagccuggguga

SEQ ID NO: 1049286 - RNA, 23 nt, Human
cacugcacuccagccugggugac

SEQ ID NO: 1049287 - RNA, 24 nt, Human
cacugcacuccagccugggugaca

SEQ ID NO: 1049288 - RNA, 24 nt, Human
cacugcacuccagccugggugaca

SEQ ID NO: 1049289 - RNA, 18 nt, Human
cagaacaaagaccuacug

SEQ ID NO: 1049290 - RNA, 26 nt, Human
cagaacaaagaccuacuggccagaag

SEQ ID NO: 1049291 - RNA, 24 nt, Human
cagcacuuugggaggccgaggcag

SEQ ID NO: 1049292 - RNA, 26 nt, Human
cagcacuuugggaggccgaggcaggu

SEQ ID NO: 1049293 - RNA, 24 nt, Human
cagcuaaucaggaggcuggggcag

SEQ ID NO: 1049294 - RNA, 21 nt, Human
caggagcucacauucagguac

SEQ ID NO: 1049295 - RNA, 21 nt, Human
caggaguguaugugugugcca

SEQ ID NO: 1049296 - RNA, 23 nt, Human
cagggcgaggaucaaacuuaaag

SEQ ID NO: 1049297 - RNA, 23 nt, Human
cagggcgcagcagaugcagagcg

SEQ ID NO: 1049298 - RNA, 22 nt, Human
cagguggaucaccacgucagga

SEQ ID NO: 1049299 - RNA, 20 nt, Human
ccaaauguggcugucuccuc

SEQ ID NO: 1049300 - RNA, 20 nt, Human
ccacugcacuccagccuggg

SEQ ID NO: 1049301 - RNA, 20 nt, Human
ccacugcacuccagccuggg

SEQ ID NO: 1049302 - RNA, 21 nt, Human
ccacugcacuccagccugggu

SEQ ID NO: 1049303 - RNA, 21 nt, Human
ccacugcacuccagccugggu

SEQ ID NO: 1049304 - RNA, 24 nt, Human
ccacugcacuccagccugggugac

SEQ ID NO: 1049305 - RNA, 21 nt, Human
ccccucaaggcagggcccccc

SEQ ID NO: 1049306 - RNA, 27 nt, Human
ccccucaaggcagggccccccaggagc

SEQ ID NO: 1049307 - RNA, 23 nt, Human
ccucugcaggagcaggucugcuu

SEQ ID NO: 1049308 - RNA, 18 nt, Human
ccugaacugggcaugggg

SEQ ID NO: 1049309 - RNA, 23 nt, Human
ccugaccaacauggugaaacccc

SEQ ID NO: 1049310 - RNA, 24 nt, Human
ccugaccaacauggugaaaccccg

SEQ ID NO: 1049311 - RNA, 22 nt, Human
ccugggugacagagcaagacuc

SEQ ID NO: 1049312 - RNA, 21 nt, Human
ccuguaaucccagcuaaucag

SEQ ID NO: 1049313 - RNA, 18 nt, Human
ccuguguacaugugcaag

SEQ ID NO: 1049314 - RNA, 24 nt, Human
cgagaucgugccacugcacuccag

SEQ ID NO: 1049315 - RNA, 24 nt, Human
cgaggcagguggaucaccacguca

SEQ ID NO: 1049316 - RNA, 23 nt, Human
cgccuguaaucccagcacuuugg

SEQ ID NO: 1049317 - RNA, 24 nt, Human
cgccuguaaucccagcacuuuggg

SEQ ID NO: 1049318 - RNA, 24 nt, Human
cgccuguaaucccagcuaaucagg

SEQ ID NO: 1049319 - RNA, 24 nt, Human
cggccaggcgugguggcucacgcc

SEQ ID NO: 1049320 - RNA, 25 nt, Human
cgugugugugcaccugugugugugu

SEQ ID NO: 1049321 - RNA, 22 nt, Human
cucaaaaaaaaaaaaaagagag

SEQ ID NO: 1049322 - RNA, 22 nt, Human
cucacgccuguaaucccagcac

SEQ ID NO: 1049323 - RNA, 24 nt, Human
cucacgccuguaaucccagcacuu

SEQ ID NO: 1049324 - RNA, 19 nt, Human
cuccgucucaaaaaaaaaa

SEQ ID NO: 1049325 - RNA, 19 nt, Human
cugccuuguucggcaucgu

SEQ ID NO: 1049326 - RNA, 24 nt, Human
cugcugcuccucacuggcauaaag

SEQ ID NO: 1049327 - RNA, 24 nt, Human
cugugugugugugucugugcaacu

SEQ ID NO: 1049328 - RNA, 19 nt, Human
cuucuguuaugagaguggg

SEQ ID NO: 1049329 - RNA, 19 nt, Human
cuugaacuugggaggcgga

SEQ ID NO: 1049330 - RNA, 24 nt, Human
gacagagcaagacuccgucucaaa

SEQ ID NO: 1049331 - RNA, 23 nt, Human
gagaauugcuugaacuugggagg

SEQ ID NO: 1049332 - RNA, 18 nt, Human
gaggcuggggcaggagaa

SEQ ID NO: 1049333 - RNA, 23 nt, Human
gagguugcagugagccgagaucg

SEQ ID NO: 1049334 - RNA, 22 nt, Human
gaucaccacgucaggaguucaa

SEQ ID NO: 1049335 - RNA, 24 nt, Human
gaucaccacgucaggaguucaaga

SEQ ID NO: 1049336 - RNA, 20 nt, Human
gcacacggagccuccuggca

SEQ ID NO: 1049337 - RNA, 20 nt, Human
gcacauguguagcacaccug

SEQ ID NO: 1049338 - RNA, 24 nt, Human
gcacuccagccugggugacagagc

SEQ ID NO: 1049339 - RNA, 19 nt, Human
gccacugcacuccagccug

SEQ ID NO: 1049340 - RNA, 24 nt, Human
gccacugcacuccagccuggguga

SEQ ID NO: 1049341 - RNA, 20 nt, Human
gccgagaucgugccacugca

SEQ ID NO: 1049342 - RNA, 21 nt, Human
gcugucuccucugcaggagca

SEQ ID NO: 1049343 - RNA, 21 nt, Human
ggaagagggagagagcagggc

SEQ ID NO: 1049344 - RNA, 24 nt, Human
ggaagagggagagagcagggcugg

SEQ ID NO: 1049345 - RNA, 19 nt, Human
ggaagguuuccuguccaca

SEQ ID NO: 1049346 - RNA, 20 nt, Human
ggagguugcagugagccgag

SEQ ID NO: 1049347 - RNA, 22 nt, Human
ggagguugcagugagccgagau

SEQ ID NO: 1049348 - RNA, 24 nt, Human
ggagguugcagugagccgagaucg

SEQ ID NO: 1049349 - RNA, 20 nt, Human
ggcaggagaauugcuugaac

SEQ ID NO: 1049350 - RNA, 20 nt, Human
ggcaugguggcacacgccug

SEQ ID NO: 1049351 - RNA, 23 nt, Human
ggcaugguggcacacgccuguaa

SEQ ID NO: 1049352 - RNA, 21 nt, Human
ggccaggcgugguggcucacg

SEQ ID NO: 1049353 - RNA, 21 nt, Human
ggcucacgccuguaaucccag

SEQ ID NO: 1049354 - RNA, 24 nt, Human
gggcaggagaauugcuugaacuug

SEQ ID NO: 1049355 - RNA, 19 nt, Human
gggcggcucugcugacaca

SEQ ID NO: 1049356 - RNA, 24 nt, Human
ggggcaggagaauugcuugaacuu

SEQ ID NO: 1049357 - RNA, 24 nt, Human
gguggcacacgccuguaaucccag

SEQ ID NO: 1049358 - RNA, 24 nt, Human
gguggcucacgccuguaaucccag

SEQ ID NO: 1049359 - RNA, 20 nt, Human
gucucaaaaaaaaaaaaaag

SEQ ID NO: 1049360 - RNA, 23 nt, Human
guggaucaccacgucaggaguuc

SEQ ID NO: 1049361 - RNA, 23 nt, Human
guggcacacgccuguaaucccag

SEQ ID NO: 1049362 - RNA, 21 nt, Human
gugugugcaccugugugugug

SEQ ID NO: 1049363 - RNA, 19 nt, Human
gugugugccaugugagugc

SEQ ID NO: 1049364 - RNA, 24 nt, Human
guugcagugagccgagaucgugcc

SEQ ID NO: 1049365 - RNA, 18 nt, Human
uaaaggcagacccugaac

SEQ ID NO: 1049366 - RNA, 24 nt, Human
uaagcgggauucugagagccccug

SEQ ID NO: 1049367 - RNA, 22 nt, Human
uagcugggcaugguggcacacg

SEQ ID NO: 1049368 - RNA, 24 nt, Human
ucaaaaaaaaaaaaaagagagagu

SEQ ID NO: 1049369 - RNA, 24 nt, Human
ucaccacgucaggaguucaagacc

SEQ ID NO: 1049370 - RNA, 19 nt, Human
ucagaguuuuauuaucagg

SEQ ID NO: 1049371 - RNA, 19 nt, Human
uccaagcacgccuguguuc

SEQ ID NO: 1049372 - RNA, 24 nt, Human
uccagccugggugacagagcaaga

SEQ ID NO: 1049373 - RNA, 22 nt, Human
uccgucucaaaaaaaaaaaaaa

SEQ ID NO: 1049374 - RNA, 23 nt, Human
uccgucucaaaaaaaaaaaaaag

SEQ ID NO: 1049375 - RNA, 23 nt, Human
ucgugccacugcacuccagccug

SEQ ID NO: 1049376 - RNA, 22 nt, Human
ucgugugugugcaccugugugu

SEQ ID NO: 1049377 - RNA, 19 nt, Human
ucucaaacacagaggaccu

SEQ ID NO: 1049378 - RNA, 23 nt, Human
ucucuacuaaaaacacaaaaauu

SEQ ID NO: 1049379 - RNA, 24 nt, Human
ucugugcaacugugcaugugugca

SEQ ID NO: 1049380 - RNA, 24 nt, Human
ugaccaacauggugaaaccccguc

SEQ ID NO: 1049381 - RNA, 22 nt, Human
ugagauggggcugccagaggca

SEQ ID NO: 1049382 - RNA, 22 nt, Human
ugagccgagaucgugccacugc

SEQ ID NO: 1049383 - RNA, 22 nt, Human
ugagugccuguguacaugugca

SEQ ID NO: 1049384 - RNA, 21 nt, Human
ugaugcacaugguggugcagg

SEQ ID NO: 1049385 - RNA, 21 nt, Human
ugcacacgcaggaguguaugu

SEQ ID NO: 1049386 - RNA, 18 nt, Human
ugcagagcgaggggguua

SEQ ID NO: 1049387 - RNA, 18 nt, Human
ugccuguguacaugugca

SEQ ID NO: 1049388 - RNA, 19 nt, Human
ugccugugucgguguccau

SEQ ID NO: 1049389 - RNA, 22 nt, Human
uggaucaccacgucaggaguuc

SEQ ID NO: 1049390 - RNA, 21 nt, Human
uggcacacgccuguaauccca

SEQ ID NO: 1049391 - RNA, 24 nt, Human
uggcucacgccuguaaucccagca

SEQ ID NO: 1049392 - RNA, 24 nt, Human
ugggaggccgaggcagguggauca

SEQ ID NO: 1049393 - RNA, 29 nt, Human
ugggaggcggagguugcagugacaacggu

SEQ ID NO: 1049394 - RNA, 24 nt, Human
ugggaggcggagguugcagugagc

SEQ ID NO: 1049395 - RNA, 24 nt, Human
uggggcaggagaauugcuugaacu

SEQ ID NO: 1049396 - RNA, 20 nt, Human
uggguaacacgcaaaccaca

SEQ ID NO: 1049397 - RNA, 23 nt, Human
uggugcagggcggcucugggagg

SEQ ID NO: 1049398 - RNA, 24 nt, Human
ugguggcacacgccuguaauccca

SEQ ID NO: 1049399 - RNA, 24 nt, Human
ugguggcucacgccuguaauccca

SEQ ID NO: 1049400 - RNA, 23 nt, Human
uguauauggcuugcaugugugug

SEQ ID NO: 1049401 - RNA, 22 nt, Human
uguaugugugugccaugugagu

SEQ ID NO: 1049402 - RNA, 19 nt, Human
ugugcaacugugcaugugu

SEQ ID NO: 1049403 - RNA, 20 nt, Human
ugugcaagagugggcucagg

SEQ ID NO: 1049404 - RNA, 22 nt, Human
ugugcacacgcaggaguguaug

SEQ ID NO: 1049405 - RNA, 27 nt, Human
ugugcacauguguagcacaccugugca

SEQ ID NO: 1049406 - RNA, 19 nt, Human
ugugcaccugugugugugu

SEQ ID NO: 1049407 - RNA, 20 nt, Human
ugugcacguacaugugccug

SEQ ID NO: 1049408 - RNA, 22 nt, Human
ugugcaugugugcacaugugua

SEQ ID NO: 1049409 - RNA, 23 nt, Human
ugugccaugugagugccugugua

SEQ ID NO: 1049410 - RNA, 23 nt, Human
uguguagcacaccugugcacgua

SEQ ID NO: 1049411 - RNA, 20 nt, Human
ugugugcaccugugugugug

SEQ ID NO: 1049412 - RNA, 20 nt, Human
ugugugcuugugcacacgca

SEQ ID NO: 1049413 - RNA, 20 nt, Human
ugugugugcaccugugugug

SEQ ID NO: 1049414 - RNA, 21 nt, Human
ugugugugcaccugugugugu

SEQ ID NO: 1049415 - RNA, 23 nt, Human
ugugugugugucugugcaacugu

SEQ ID NO: 1049416 - RNA, 18 nt, Human
ugugugugugugucugug

SEQ ID NO: 1049417 - RNA, 24 nt, Human
uuagcugggcaugguggcacacgc

SEQ ID NO: 1049418 - RNA, 24 nt, Human
uugaacuugggaggcggagguugc

SEQ ID NO: 1049419 - RNA, 21 nt, Human
uugcagugagccgagaucgug

SEQ ID NO: 1049420 - RNA, 22 nt, Human
uugcagugagccgagaucgugc

SEQ ID NO: 1049421 - RNA, 24 nt, Human
uugcuugaacuugggaggcggagg

SEQ ID NO: 1049422 - RNA, 25 nt, Human
uugggaggccgaggcagguggauca

SEQ ID NO: 1049423 - RNA, 25 nt, Human
uugugcacacgcaggaguguaugug

SEQ ID NO: 1049424 - RNA, 23 nt, Human
aaaaaaaaaaaaaaauacaaaag

SEQ ID NO: 1049425 - RNA, 25 nt, Human
aaaaaaaaaaaaaauacaaaaguca

SEQ ID NO: 1049426 - RNA, 19 nt, Human
aaaaaccaaagugcccaaa

SEQ ID NO: 1049427 - RNA, 19 nt, Human
aaaccaaacuuaucuggga

SEQ ID NO: 1049428 - RNA, 24 nt, Human
aaauguugaaaaccaaacuuaucu

SEQ ID NO: 1049429 - RNA, 21 nt, Human
aacuguuuccccuaguccccg

SEQ ID NO: 1049430 - RNA, 23 nt, Human
aagcccaacaaaaaaaaagugau

SEQ ID NO: 1049431 - RNA, 22 nt, Human
aagggcuggcgguguggccaga

SEQ ID NO: 1049432 - RNA, 21 nt, Human
aauagcacuuccccugaagcc

SEQ ID NO: 1049433 - RNA, 24 nt, Human
acaaaaaaaaaaaaaaauacaaaa

SEQ ID NO: 1049434 - RNA, 22 nt, Human
acaaaagacaguacaaaaacca

SEQ ID NO: 1049435 - RNA, 26 nt, Human
acaguacaaaaaccaaagugcccaaa

SEQ ID NO: 1049436 - RNA, 25 nt, Human
accuccaacuguuuccccuaguccc

SEQ ID NO: 1049437 - RNA, 22 nt, Human
agacuagccuugucugaaggca

SEQ ID NO: 1049438 - RNA, 20 nt, Human
agagggugguggauaugguc

SEQ ID NO: 1049439 - RNA, 19 nt, Human
agccuugucugaaggcagc

SEQ ID NO: 1049440 - RNA, 19 nt, Human
aggcaugcugugugugggc

SEQ ID NO: 1049441 - RNA, 24 nt, Human
aggcaugcugugugugggcaguga

SEQ ID NO: 1049442 - RNA, 22 nt, Human
agggcugaagucgggggaggug

SEQ ID NO: 1049443 - RNA, 22 nt, Human
caaagagauggcacccaaaggc

SEQ ID NO: 1049444 - RNA, 18 nt, Human
caagggcuggcggugugg

SEQ ID NO: 1049445 - RNA, 24 nt, Human
cacagcccagugccugccuggacc

SEQ ID NO: 1049446 - RNA, 20 nt, Human
cacucuugccccuagacuag

SEQ ID NO: 1049447 - RNA, 21 nt, Human
cacugugccauuuauaacccu

SEQ ID NO: 1049448 - RNA, 21 nt, Human
cagagccacuugccaggcuga

SEQ ID NO: 1049449 - RNA, 23 nt, Human
cagcgaacuugcccaaaacagag

SEQ ID NO: 1049450 - RNA, 18 nt, Human
caggccaccaaggaccuu

SEQ ID NO: 1049451 - RNA, 18 nt, Human
cagggcaggggacaggcc

SEQ ID NO: 1049452 - RNA, 18 nt, Human
caggggaagcugaaggcc

SEQ ID NO: 1049453 - RNA, 19 nt, Human
cagugagcucgagugggca

SEQ ID NO: 1049454 - RNA, 18 nt, Human
cauuccuacagcaaaugc

SEQ ID NO: 1049455 - RNA, 21 nt, Human
ccaaaacagaaaagcucuaaa

SEQ ID NO: 1049456 - RNA, 20 nt, Human
ccaaauagaaggagcagcga

SEQ ID NO: 1049457 - RNA, 21 nt, Human
ccaaauagaaggagcagcgaa

SEQ ID NO: 1049458 - RNA, 27 nt, Human
ccagggcaggggacaggccaccaagga

SEQ ID NO: 1049459 - RNA, 21 nt, Human
cccaaaacagaaaagcucuaa

SEQ ID NO: 1049460 - RNA, 18 nt, Human
cccacaugggagaggaau

SEQ ID NO: 1049461 - RNA, 21 nt, Human
ccccucggucccccugccugc

SEQ ID NO: 1049462 - RNA, 20 nt, Human
ccccugccugcccucugccc

SEQ ID NO: 1049463 - RNA, 25 nt, Human
cccgugcuugagcucggagggguac

SEQ ID NO: 1049464 - RNA, 23 nt, Human
ccuccaacuguuuccccuagucc

SEQ ID NO: 1049465 - RNA, 18 nt, Human
ccugcccucugcccugag

SEQ ID NO: 1049466 - RNA, 18 nt, Human
cucacacagauaaggacc

SEQ ID NO: 1049467 - RNA, 19 nt, Human
cuccuaucugcugccccuc

SEQ ID NO: 1049468 - RNA, 22 nt, Human
cugccuggaccgcaggucuggg

SEQ ID NO: 1049469 - RNA, 20 nt, Human
cugcugccccucgguccccc

SEQ ID NO: 1049470 - RNA, 19 nt, Human
cuugcagugaagccaccau

SEQ ID NO: 1049471 - RNA, 19 nt, Human
gacggcacgaaccuccaac

SEQ ID NO: 1049472 - RNA, 23 nt, Human
gagggugguggauaugguccugu

SEQ ID NO: 1049473 - RNA, 20 nt, Human
gcaaagagauggcacccaaa

SEQ ID NO: 1049474 - RNA, 23 nt, Human
gcaaaugaagguuuacauuucug

SEQ ID NO: 1049475 - RNA, 18 nt, Human
gcacccaaaggcaugcug

SEQ ID NO: 1049476 - RNA, 21 nt, Human
gcgaacuugcccaaaacagaa

SEQ ID NO: 1049477 - RNA, 21 nt, Human
ggcaaagagauggcacccaaa

SEQ ID NO: 1049478 - RNA, 23 nt, Human
ggcagcuucagagccacuugcca

SEQ ID NO: 1049479 - RNA, 18 nt, Human
ggcagguggccacguucu

SEQ ID NO: 1049480 - RNA, 19 nt, Human
gggcagguggccacguucu

SEQ ID NO: 1049481 - RNA, 21 nt, Human
gggcagugagcucgagugggc

SEQ ID NO: 1049482 - RNA, 18 nt, Human
guggccagaggacagggg

SEQ ID NO: 1049483 - RNA, 18 nt, Human
uaaaaaauguucaaucaa

SEQ ID NO: 1049484 - RNA, 22 nt, Human
uaaauaacuuaaauagaagucc

SEQ ID NO: 1049485 - RNA, 19 nt, Human
uaaauguugaaaaccaaac

SEQ ID NO: 1049486 - RNA, 23 nt, Human
uaacccugacaucaccucccaag

SEQ ID NO: 1049487 - RNA, 24 nt, Human
uagccuugucugaaggcagcuuca

SEQ ID NO: 1049488 - RNA, 18 nt, Human
uaggaagggcugaagucg

SEQ ID NO: 1049489 - RNA, 26 nt, Human
uaggaagggcugaagucgggggaggu

SEQ ID NO: 1049490 - RNA, 18 nt, Human
uaguuuguuuguuuuaga

SEQ ID NO: 1049491 - RNA, 19 nt, Human
uauccgggcucagugcucu

SEQ ID NO: 1049492 - RNA, 23 nt, Human
uccauguaagugaagcaucuuga

SEQ ID NO: 1049493 - RNA, 19 nt, Human
ucccagggcaggggacagg

SEQ ID NO: 1049494 - RNA, 23 nt, Human
ucggcaguccugcuccuugcagu

SEQ ID NO: 1049495 - RNA, 21 nt, Human
ugacaucaccucccaaggcuc

SEQ ID NO: 1049496 - RNA, 22 nt, Human
ugacaucaccucccaaggcucu

SEQ ID NO: 1049497 - RNA, 24 nt, Human
ugaccuccauccucugcaaagugg

SEQ ID NO: 1049498 - RNA, 20 nt, Human
ugagggaagggcuucagggc

SEQ ID NO: 1049499 - RNA, 22 nt, Human
ugagggaagggcuucagggcca

SEQ ID NO: 1049500 - RNA, 24 nt, Human
ugagggcaucagguaaauuaaagg

SEQ ID NO: 1049501 - RNA, 22 nt, Human
ugcagaagcccaacaaaaaaaa

SEQ ID NO: 1049502 - RNA, 18 nt, Human
ugcccaaaacagaaaagc

SEQ ID NO: 1049503 - RNA, 25 nt, Human
ugcccugagacaaguuacuaaaugu

SEQ ID NO: 1049504 - RNA, 26 nt, Human
uggcaaaugaagguuuacauuucugu

SEQ ID NO: 1049505 - RNA, 24 nt, Human
ugggcagugagcucgagugggcac

SEQ ID NO: 1049506 - RNA, 22 nt, Human
uggguuuaggaagggcugaagu

SEQ ID NO: 1049507 - RNA, 23 nt, Human
ugguuuuugaccuccauccucug

SEQ ID NO: 1049508 - RNA, 21 nt, Human
ugucugaaggcagcuucagag

SEQ ID NO: 1049509 - RNA, 23 nt, Human
uuagaaguuucuuccauguaagu

SEQ ID NO: 1049510 - RNA, 21 nt, Human
uugagucacucaggacuuggc

SEQ ID NO: 1049511 - RNA, 21 nt, Human
uuuaggaagggcugaagucgg

SEQ ID NO: 1049512 - RNA, 23 nt, Human
uuuggcaaaugaagguuuacauu

SEQ ID NO: 1049513 - RNA, 22 nt, Human
aaaccuccucacuuccaauccc

SEQ ID NO: 1049514 - RNA, 20 nt, Human
auugcacauuugugucuugg

SEQ ID NO: 1049515 - RNA, 19 nt, Human
cccccgagucugcaccgac

SEQ ID NO: 1049516 - RNA, 22 nt, Human
cccccgagucugcaccgaccuc

SEQ ID NO: 1049517 - RNA, 19 nt, Human
cgagucugcaccgaccucu

SEQ ID NO: 1049518 - RNA, 18 nt, Human
cggcggugggacccgggc

SEQ ID NO: 1049519 - RNA, 22 nt, Human
cucacuuccaaucccagcuauc

SEQ ID NO: 1049520 - RNA, 19 nt, Human
cuuccaaucccagcuaucu

SEQ ID NO: 1049521 - RNA, 19 nt, Human
gaaaccuccucacuuccaa

SEQ ID NO: 1049522 - RNA, 21 nt, Human
gacccgggcgaccuuagagac

SEQ ID NO: 1049523 - RNA, 22 nt, Human
gcggcagcggugcugucgcggg

SEQ ID NO: 1049524 - RNA, 24 nt, Human
gcggcagcggugcugucgcgggga

SEQ ID NO: 1049525 - RNA, 18 nt, Human
gucgcggggacaaaugcc

SEQ ID NO: 1049526 - RNA, 23 nt, Human
guggcggcggugggacccgggcg

SEQ ID NO: 1049527 - RNA, 20 nt, Human
uacaaucugguguugugguc

SEQ ID NO: 1049528 - RNA, 22 nt, Human
ucuaaaauaaacuuuuaauugc

SEQ ID NO: 1049529 - RNA, 23 nt, Human
ucuaaaauaaacuuuuaauugca

SEQ ID NO: 1049530 - RNA, 25 nt, Human
ucuaaaauaaacuuuuaauugcaca

SEQ ID NO: 1049531 - RNA, 24 nt, Human
ucuuggguuaucuguggggugaga

SEQ ID NO: 1049532 - RNA, 19 nt, Human
uggcccccgagucugcacc

SEQ ID NO: 1049533 - RNA, 25 nt, Human
uggucuaaaauaaacuuuuaauugc

SEQ ID NO: 1049534 - RNA, 24 nt, Human
ugucgcggggacaaaugccgcagc

SEQ ID NO: 1049535 - RNA, 23 nt, Human
uuaucuguggggugagaaaccuc

SEQ ID NO: 1049536 - RNA, 18 nt, Human
aggagccccgaggaugac

SEQ ID NO: 1049537 - RNA, 19 nt, Human
auuugauuuuuuuuucucc

SEQ ID NO: 1049538 - RNA, 20 nt, Human
auuuuuuuuucucccccucc

SEQ ID NO: 1049539 - RNA, 19 nt, Human
cugguggcugcaggggaag

SEQ ID NO: 1049540 - RNA, 23 nt, Human
ggccgcccggccaggagccccga

SEQ ID NO: 1049541 - RNA, 22 nt, Human
guugguggauuugauuuuuuuu

SEQ ID NO: 1049542 - RNA, 23 nt, Human
uaaggcaaagaaugguuggugga

SEQ ID NO: 1049543 - RNA, 23 nt, Human
ugagaaagcgcuucggaaucuug

SEQ ID NO: 1049544 - RNA, 21 nt, Human
uggaauaaccuuccuaaggca

SEQ ID NO: 1049545 - RNA, 18 nt, Human
uuuuuuuucucccccucc

SEQ ID NO: 1049546 - RNA, 20 nt, Human
accccugauguccuggaggg

SEQ ID NO: 1049547 - RNA, 19 nt, Human
cagcagguucugggaggcc

SEQ ID NO: 1049548 - RNA, 21 nt, Human
cccucccucugauccuccaaa

SEQ ID NO: 1049549 - RNA, 22 nt, Human
cccucccucugauccuccaaaa

SEQ ID NO: 1049550 - RNA, 19 nt, Human
ccuccccucccucugaucc

SEQ ID NO: 1049551 - RNA, 21 nt, Human
cgacagcagccagcuguggcg

SEQ ID NO: 1049552 - RNA, 22 nt, Human
cugccuccccucccucugaucc

SEQ ID NO: 1049553 - RNA, 22 nt, Human
cuuggcugccuccccucccucu

SEQ ID NO: 1049554 - RNA, 19 nt, Human
uacgaccccugauguccug

SEQ ID NO: 1049555 - RNA, 20 nt, Human
uggaggguggaacaaggcuc

SEQ ID NO: 1049556 - RNA, 18 nt, Human
ugggaggccccaaaggug

SEQ ID NO: 1049557 - RNA, 23 nt, Human
ugggguugaggcuacgacccccu

SEQ ID NO: 1049558 - RNA, 24 nt, Human
uguccugcagaccagcagguucug

SEQ ID NO: 1049559 - RNA, 18 nt, Human
aagcccccggugauccag

SEQ ID NO: 1049560 - RNA, 18 nt, Human
aaggagggaggggcacag

SEQ ID NO: 1049561 - RNA, 24 nt, Human
aaggagggaggggcacaggagggc

SEQ ID NO: 1049562 - RNA, 20 nt, Human
acccugaggacauuaauaaa

SEQ ID NO: 1049563 - RNA, 21 nt, Human
agcacacaucuaccuccuggc

SEQ ID NO: 1049564 - RNA, 22 nt, Human
aggcggccccuuccucuccaug

SEQ ID NO: 1049565 - RNA, 20 nt, Human
augcgggagggccugggggc

SEQ ID NO: 1049566 - RNA, 22 nt, Human
cagagggaaacugaggcccaag

SEQ ID NO: 1049567 - RNA, 21 nt, Human
caggagggcuccccgagguuu

SEQ ID NO: 1049568 - RNA, 23 nt, Human
cccccugcccugucaucucugca

SEQ ID NO: 1049569 - RNA, 22 nt, Human
cccucagugccuuugggccugg

SEQ ID NO: 1049570 - RNA, 18 nt, Human
cccuuccucuccaugucc

SEQ ID NO: 1049571 - RNA, 19 nt, Human
ccgagccccagcuccugac

SEQ ID NO: 1049572 - RNA, 20 nt, Human
ccgagccccagcuccugacc

SEQ ID NO: 1049573 - RNA, 21 nt, Human
ccucaggggccgccaccaccc

SEQ ID NO: 1049574 - RNA, 25 nt, Human
ccuccccccacuucacagagggaaa

SEQ ID NO: 1049575 - RNA, 22 nt, Human
ccucucagcccuugcucagccu

SEQ ID NO: 1049576 - RNA, 18 nt, Human
ccugaccucggggugggg

SEQ ID NO: 1049577 - RNA, 23 nt, Human
ccuuguaccucuaucccuccuug

SEQ ID NO: 1049578 - RNA, 21 nt, Human
cucagagggaagaacugaggc

SEQ ID NO: 1049579 - RNA, 23 nt, Human
cucuccauguccccauccccaac

SEQ ID NO: 1049580 - RNA, 20 nt, Human
cugucaucucugcaugugcc

SEQ ID NO: 1049581 - RNA, 21 nt, Human
cuuaccccuaaggccuagaug

SEQ ID NO: 1049582 - RNA, 25 nt, Human
cuugaaggccugccuccccccacuu

SEQ ID NO: 1049583 - RNA, 18 nt, Human
cuuguaccucuaucccuc

SEQ ID NO: 1049584 - RNA, 21 nt, Human
gagaugcgggagggccugggg

SEQ ID NO: 1049585 - RNA, 22 nt, Human
gccccuuccucuccaugucccc

SEQ ID NO: 1049586 - RNA, 21 nt, Human
gccuagauggcagaagggacc

SEQ ID NO: 1049587 - RNA, 20 nt, Human
gccuggucugccucaggggc

SEQ ID NO: 1049588 - RNA, 21 nt, Human
ggaagaacugaggcaagaagc

SEQ ID NO: 1049589 - RNA, 23 nt, Human
ggagggccugggggcucagaggg

SEQ ID NO: 1049590 - RNA, 21 nt, Human
ggucccuggaggcagcuggcc

SEQ ID NO: 1049591 - RNA, 20 nt, Human
uaccccuaaggccuagaugg

SEQ ID NO: 1049592 - RNA, 25 nt, Human
uagauggcagaagggacccugagga

SEQ ID NO: 1049593 - RNA, 18 nt, Human
uccccgagguuuggucgg

SEQ ID NO: 1049594 - RNA, 22 nt, Human
uccuugaaggccugccuccccc

SEQ ID NO: 1049595 - RNA, 24 nt, Human
ucugucacaagcauuugcaggagu

SEQ ID NO: 1049596 - RNA, 21 nt, Human
ugagaccugcuuaccccuaag

SEQ ID NO: 1049597 - RNA, 19 nt, Human
ugagaugcgggagggccug

SEQ ID NO: 1049598 - RNA, 21 nt, Human
ugcccccugcccugucaucuc

SEQ ID NO: 1049599 - RNA, 23 nt, Human
ugccgagccccagcuccugacuc

SEQ ID NO: 1049600 - RNA, 24 nt, Human
uggacaacaaggagggaggggcac

SEQ ID NO: 1049601 - RNA, 23 nt, Human
uggccuggucugccucaggggcc

SEQ ID NO: 1049602 - RNA, 22 nt, Human
uucacagagggaaacugaggcc

SEQ ID NO: 1049603 - RNA, 24 nt, Human
uugcaggaguaggcggccccuucc

SEQ ID NO: 1049604 - RNA, 18 nt, Human
acaccuuccucauggggu

SEQ ID NO: 1049605 - RNA, 21 nt, Human
cagaagugaacugaugcagcg

SEQ ID NO: 1049606 - RNA, 18 nt, Human
cagcggaugcagcagaca

SEQ ID NO: 1049607 - RNA, 23 nt, Human
cggaugcagcagacacauccacg

SEQ ID NO: 1049608 - RNA, 23 nt, Human
uacaccuuccucaugggguuccu

SEQ ID NO: 1049609 - RNA, 19 nt, Human
uccuucagaagugaacuga

SEQ ID NO: 1049610 - RNA, 23 nt, Human
caagacagcacagauggcugggg

SEQ ID NO: 1049611 - RNA, 23 nt, Human
ucugccccuaucaagacagcacc

SEQ ID NO: 1049612 - RNA, 24 nt, Human
uggcuggggcuggaguggggcugu

SEQ ID NO: 1049613 - RNA, 21 nt, Human
aguaguggcuguagccuugac

SEQ ID NO: 1049614 - RNA, 27 nt, Human
gaguggaacaauucaagacuucagagg

SEQ ID NO: 1049615 - RNA, 24 nt, Human
ucaguaguggcuguagccuugacc

SEQ ID NO: 1049616 - RNA, 21 nt, Human
aaauuagccucacugagccag

SEQ ID NO: 1049617 - RNA, 23 nt, Human
aacaacacaaauuuauucccuua

SEQ ID NO: 1049618 - RNA, 19 nt, Human
aagaagcugggagcugugg

SEQ ID NO: 1049619 - RNA, 22 nt, Human
acaccuccaaccuccucucccg

SEQ ID NO: 1049620 - RNA, 22 nt, Human
acaugggcaucuugggaggcca

SEQ ID NO: 1049621 - RNA, 23 nt, Human
accacaacugggcagcaaaacua

SEQ ID NO: 1049622 - RNA, 22 nt, Human
agagaagggucugaggccugga

SEQ ID NO: 1049623 - RNA, 20 nt, Human
agagcaucucugccccacgg

SEQ ID NO: 1049624 - RNA, 20 nt, Human
agaggcacaggaccaacuga

SEQ ID NO: 1049625 - RNA, 20 nt, Human
agcccuccugaacaagcugg

SEQ ID NO: 1049626 - RNA, 19 nt, Human
aggacggaacacagagaag

SEQ ID NO: 1049627 - RNA, 19 nt, Human
aggccauggggcaagugag

SEQ ID NO: 1049628 - RNA, 22 nt, Human
aggccauggggcaagugagguc

SEQ ID NO: 1049629 - RNA, 19 nt, Human
agggcuggggccuuccagg

SEQ ID NO: 1049630 - RNA, 21 nt, Human
agguggccuggacucuguggc

SEQ ID NO: 1049631 - RNA, 19 nt, Human
caacaagcccauggccagg

SEQ ID NO: 1049632 - RNA, 21 nt, Human
cacaacugggcagcaaaacua

SEQ ID NO: 1049633 - RNA, 20 nt, Human
caccuccaaccuccucuccc

SEQ ID NO: 1049634 - RNA, 20 nt, Human
caucgcuacaccuccaaccu

SEQ ID NO: 1049635 - RNA, 20 nt, Human
cauuacaucugcaaagcccc

SEQ ID NO: 1049636 - RNA, 26 nt, Human
ccacagggugcccgccuaagcccaca

SEQ ID NO: 1049637 - RNA, 18 nt, Human
ccagacaagugcagcucc

SEQ ID NO: 1049638 - RNA, 21 nt, Human
cccgccuaagcccacaccugc

SEQ ID NO: 1049639 - RNA, 18 nt, Human
ccucguucccgaccgacc

SEQ ID NO: 1049640 - RNA, 22 nt, Human
ccucucccgucaccugcucuuc

SEQ ID NO: 1049641 - RNA, 21 nt, Human
ccuggacucuguggcuugagc

SEQ ID NO: 1049642 - RNA, 19 nt, Human
ccugggauuaggacauggg

SEQ ID NO: 1049643 - RNA, 22 nt, Human
ccuuaacuucauuacaucugca

SEQ ID NO: 1049644 - RNA, 19 nt, Human
cgagaacuggaagaagcug

SEQ ID NO: 1049645 - RNA, 18 nt, Human
cgccaugaaggccauggg

SEQ ID NO: 1049646 - RNA, 18 nt, Human
cuaagcccacaccugcug

SEQ ID NO: 1049647 - RNA, 21 nt, Human
cuaagcccacaccugcugacu

SEQ ID NO: 1049648 - RNA, 21 nt, Human
cucaccaacccuccccuucca

SEQ ID NO: 1049649 - RNA, 24 nt, Human
cucaccaacccuccccuuccaacc

SEQ ID NO: 1049650 - RNA, 20 nt, Human
cucacugcaguaucuccuug

SEQ ID NO: 1049651 - RNA, 21 nt, Human
cucacugcaguaucuccuuga

SEQ ID NO: 1049652 - RNA, 18 nt, Human
cuccgcgcgggccuggcc

SEQ ID NO: 1049653 - RNA, 22 nt, Human
cuggagcgcgccaugaaggcca

SEQ ID NO: 1049654 - RNA, 22 nt, Human
cugggacucaccaacccucccc

SEQ ID NO: 1049655 - RNA, 25 nt, Human
cuguggcugggaguggcucugaggc

SEQ ID NO: 1049656 - RNA, 22 nt, Human
gacggaacacagagaagggucu

SEQ ID NO: 1049657 - RNA, 19 nt, Human
gagaugcuggaaacugugg

SEQ ID NO: 1049658 - RNA, 19 nt, Human
gaggaugcauuuccuggcu

SEQ ID NO: 1049659 - RNA, 20 nt, Human
gaggaugcauuuccuggcuc

SEQ ID NO: 1049660 - RNA, 19 nt, Human
gcaguggggcagggugggg

SEQ ID NO: 1049661 - RNA, 19 nt, Human
gccaugaaggccauggggc

SEQ ID NO: 1049662 - RNA, 21 nt, Human
gcccauggccaggacggaaca

SEQ ID NO: 1049663 - RNA, 18 nt, Human
gcuggugagaggcacagg

SEQ ID NO: 1049664 - RNA, 25 nt, Human
ggauaaucuuccuggcgaaagaucc

SEQ ID NO: 1049665 - RNA, 24 nt, Human
ggccuggagcgcgccaugaaggcc

SEQ ID NO: 1049666 - RNA, 19 nt, Human
gggcaguggcaggaaggca

SEQ ID NO: 1049667 - RNA, 20 nt, Human
guggcuugagcugcccuccu

SEQ ID NO: 1049668 - RNA, 21 nt, Human
ucacgcaguaccccuggccac

SEQ ID NO: 1049669 - RNA, 22 nt, Human
ucacgcaguaccccuggccaca

SEQ ID NO: 1049670 - RNA, 20 nt, Human
ucacugagccaguccaggug

SEQ ID NO: 1049671 - RNA, 21 nt, Human
ucacugagccaguccaggugg

SEQ ID NO: 1049672 - RNA, 23 nt, Human
ucacugagccaguccagguggga

SEQ ID NO: 1049673 - RNA, 19 nt, Human
uccaaccagagaaacucac

SEQ ID NO: 1049674 - RNA, 23 nt, Human
uccaaccagagaaacucacugca

SEQ ID NO: 1049675 - RNA, 19 nt, Human
uccagggcucugugggagg

SEQ ID NO: 1049676 - RNA, 22 nt, Human
uccaucgcuacaccuccaaccu

SEQ ID NO: 1049677 - RNA, 23 nt, Human
uccgcgcgggccuggccgccuga

SEQ ID NO: 1049678 - RNA, 26 nt, Human
uccuugaaagucuggugacgugucug

SEQ ID NO: 1049679 - RNA, 25 nt, Human
ucugccccacggcaugugcggguga

SEQ ID NO: 1049680 - RNA, 23 nt, Human
ucuguggcuugagcugcccuccu

SEQ ID NO: 1049681 - RNA, 20 nt, Human
ugaggccuggagcgcgccau

SEQ ID NO: 1049682 - RNA, 19 nt, Human
ugagguggccuggacucug

SEQ ID NO: 1049683 - RNA, 18 nt, Human
ugcuggaaacuguggcug

SEQ ID NO: 1049684 - RNA, 19 nt, Human
ugcuggugagaggcacagg

SEQ ID NO: 1049685 - RNA, 19 nt, Human
uggaagaagcugggagcug

SEQ ID NO: 1049686 - RNA, 24 nt, Human
uggcucugagguggccuggacucu

SEQ ID NO: 1049687 - RNA, 20 nt, Human
uggcuugagcugcccuccuc

SEQ ID NO: 1049688 - RNA, 22 nt, Human
uggcuugagcugcccuccucaa

SEQ ID NO: 1049689 - RNA, 19 nt, Human
ugggaggaaaaggguugga

SEQ ID NO: 1049690 - RNA, 24 nt, Human
ugggaggaugcauuuccuggcucu

SEQ ID NO: 1049691 - RNA, 20 nt, Human
ugggaguggcucugaggccc

SEQ ID NO: 1049692 - RNA, 19 nt, Human
ugggcaucuugggaggcca

SEQ ID NO: 1049693 - RNA, 20 nt, Human
uggggcaguggcaggaaggc

SEQ ID NO: 1049694 - RNA, 21 nt, Human
uguggucccuguccacagaga

SEQ ID NO: 1049695 - RNA, 18 nt, Human
uuccuggcgaaagauccu

SEQ ID NO: 1049696 - RNA, 21 nt, Human
uuccuggcucugagguggccu

SEQ ID NO: 1049697 - RNA, 24 nt, Human
uuuccugcuccaucgcuacaccuc

SEQ ID NO: 1049698 - RNA, 18 nt, Human
uuuuuuuuuuuuuuuuug

SEQ ID NO: 1049699 - RNA, 18 nt, Human
acccccccuccccccucc

SEQ ID NO: 1049700 - RNA, 21 nt, Human
cccccccuccccccucccgga

SEQ ID NO: 1049701 - RNA, 22 nt, Human
cccccccuccccccucccggac

SEQ ID NO: 1049702 - RNA, 25 nt, Human
aaaaauccauagauccacacuccca

SEQ ID NO: 1049703 - RNA, 23 nt, Human
agauccacacucccaacaaggcg

SEQ ID NO: 1049704 - RNA, 26 nt, Human
caacacgaaaaauccauagauccaca

SEQ ID NO: 1049705 - RNA, 30 nt, Human
caacacgaaaaauccauagauccacacucc

SEQ ID NO: 1049706 - RNA, 18 nt, Human
cauagauccacacucccu

SEQ ID NO: 1049707 - RNA, 18 nt, Human
ccauggcagcagccacgg

SEQ ID NO: 1049708 - RNA, 19 nt, Human
ugccucccugcugcagccc

SEQ ID NO: 1049709 - RNA, 20 nt, Human
ugccucccugcugcagcccc

SEQ ID NO: 1049710 - RNA, 20 nt, Human
uugccucccugcugcagccc

SEQ ID NO: 1049711 - RNA, 19 nt, Human
agccgugcuccugggguug

SEQ ID NO: 1049712 - RNA, 18 nt, Human
aguugugauaacaugacc

SEQ ID NO: 1049713 - RNA, 19 nt, Human
cagcccagggcggcaggug

SEQ ID NO: 1049714 - RNA, 19 nt, Human
cagcccagggcggcaggug

SEQ ID NO: 1049715 - RNA, 19 nt, Human
cagcccagggcggcaggug

SEQ ID NO: 1049716 - RNA, 19 nt, Human
cagcccagggcggcaggug

SEQ ID NO: 1049717 - RNA, 19 nt, Human
cuccugggguugggcguuu

SEQ ID NO: 1049718 - RNA, 22 nt, Human
gcauugggguggucccagccag

SEQ ID NO: 1049719 - RNA, 22 nt, Human
gcauugggguggucccagccag

SEQ ID NO: 1049720 - RNA, 20 nt, Human
ucccagccagcccagggcgg

SEQ ID NO: 1049721 - RNA, 20 nt, Human
ucccagccagcccagggcgg

SEQ ID NO: 1049722 - RNA, 20 nt, Human
ucccagccagcccagggcgg

SEQ ID NO: 1049723 - RNA, 23 nt, Human
ugaggaguugugauaacaugacc

SEQ ID NO: 1049724 - RNA, 20 nt, Human
uggucccagcccagggcggc

SEQ ID NO: 1049725 - RNA, 23 nt, Human
aaagaucucgagguccacgagga

SEQ ID NO: 1049726 - RNA, 21 nt, Human
aagaaaagcaggaacuaccaa

SEQ ID NO: 1049727 - RNA, 24 nt, Human
aagaagaaaagcaggaacuaccaa

SEQ ID NO: 1049728 - RNA, 22 nt, Human
aagauaagcuuaaaaaucaaga

SEQ ID NO: 1049729 - RNA, 23 nt, Human
aagcaggaacuaccaacaggaga

SEQ ID NO: 1049730 - RNA, 18 nt, Human
aaggacaugccagugaca

SEQ ID NO: 1049731 - RNA, 19 nt, Human
aaguagcggcuuccuggag

SEQ ID NO: 1049732 - RNA, 24 nt, Human
aaucacuuguaugaaagcauucga

SEQ ID NO: 1049733 - RNA, 22 nt, Human
agacaggagggaggucacaggg

SEQ ID NO: 1049734 - RNA, 23 nt, Human
agacaggagggaggucacagggc

SEQ ID NO: 1049735 - RNA, 20 nt, Human
agcagcuucuucucaagggg

SEQ ID NO: 1049736 - RNA, 20 nt, Human
aggagcugcaagacaggagg

SEQ ID NO: 1049737 - RNA, 21 nt, Human
aggaggguggcggcgggaagc

SEQ ID NO: 1049738 - RNA, 18 nt, Human
agggccuggggagucacu

SEQ ID NO: 1049739 - RNA, 20 nt, Human
agggguccuccccgaggccu

SEQ ID NO: 1049740 - RNA, 21 nt, Human
agguccacgaggaauuuccaa

SEQ ID NO: 1049741 - RNA, 19 nt, Human
auggcagcgaggagggugg

SEQ ID NO: 1049742 - RNA, 22 nt, Human
caaaguagcggcuuccuggagc

SEQ ID NO: 1049743 - RNA, 21 nt, Human
caagacaggagggaggucaca

SEQ ID NO: 1049744 - RNA, 21 nt, Human
caagagaaauggacacaaagu

SEQ ID NO: 1049745 - RNA, 27 nt, Human
caauuuacauugccagggugaaauuca

SEQ ID NO: 1049746 - RNA, 21 nt, Human
cagcccagagaauggcagcga

SEQ ID NO: 1049747 - RNA, 20 nt, Human
cagcgaggaggguggcggcg

SEQ ID NO: 1049748 - RNA, 20 nt, Human
caggaugauguccugaggaa

SEQ ID NO: 1049749 - RNA, 25 nt, Human
cagggugaaauucaacagaacuauu

SEQ ID NO: 1049750 - RNA, 23 nt, Human
cauacaaaacauucaaaagaaaa

SEQ ID NO: 1049751 - RNA, 18 nt, Human
cauggagcggggcuucuc

SEQ ID NO: 1049752 - RNA, 23 nt, Human
ccacugagcuugucgggccccug

SEQ ID NO: 1049753 - RNA, 19 nt, Human
ccccagaccuagaaacuag

SEQ ID NO: 1049754 - RNA, 18 nt, Human
ccucgcccauccucuuuc

SEQ ID NO: 1049755 - RNA, 23 nt, Human
ccucgcccauccucuuuccacuc

SEQ ID NO: 1049756 - RNA, 21 nt, Human
ccugggccugcacugacauca

SEQ ID NO: 1049757 - RNA, 24 nt, Human
ccuugggugguccguguggccgcc

SEQ ID NO: 1049758 - RNA, 21 nt, Human
cucaggaugauguccugagga

SEQ ID NO: 1049759 - RNA, 28 nt, Human
cugggguugggugggggaugcugagggg

SEQ ID NO: 1049760 - RNA, 23 nt, Human
gaaaauucuucauuuagagugac

SEQ ID NO: 1049761 - RNA, 21 nt, Human
gagcaaagcugagggguccuc

SEQ ID NO: 1049762 - RNA, 21 nt, Human
gagcagaggacugauggugag

SEQ ID NO: 1049763 - RNA, 19 nt, Human
gagcagcuucuucucaagg

SEQ ID NO: 1049764 - RNA, 20 nt, Human
gagcagcuucuucucaaggg

SEQ ID NO: 1049765 - RNA, 20 nt, Human
gaggaauuuccaagaagaaa

SEQ ID NO: 1049766 - RNA, 24 nt, Human
gaggauaugugcccaagguggucg

SEQ ID NO: 1049767 - RNA, 18 nt, Human
gaugcugaggggggugcc

SEQ ID NO: 1049768 - RNA, 18 nt, Human
ggaggguggcggcgggaa

SEQ ID NO: 1049769 - RNA, 23 nt, Human
ggggguggugggcagcucgcagg

SEQ ID NO: 1049770 - RNA, 22 nt, Human
ggguccuccccgaggccugccc

SEQ ID NO: 1049771 - RNA, 23 nt, Human
ggguggugggcagcucgcagguc

SEQ ID NO: 1049772 - RNA, 21 nt, Human
gguaaagaucucgagguccac

SEQ ID NO: 1049773 - RNA, 22 nt, Human
ggucacagggccuggggaguca

SEQ ID NO: 1049774 - RNA, 22 nt, Human
ggugguaaguuuccucaagaga

SEQ ID NO: 1049775 - RNA, 18 nt, Human
gguugggugggggaugcu

SEQ ID NO: 1049776 - RNA, 22 nt, Human
uagccuuacugauuagagugau

SEQ ID NO: 1049777 - RNA, 18 nt, Human
uagcggcuuccuggagcu

SEQ ID NO: 1049778 - RNA, 19 nt, Human
uaguguccagguaagcccg

SEQ ID NO: 1049779 - RNA, 22 nt, Human
uauuuuacauacaaaacauuca

SEQ ID NO: 1049780 - RNA, 20 nt, Human
ucaaaagaaaauucuucauu

SEQ ID NO: 1049781 - RNA, 20 nt, Human
ucacagggccuggggaguca

SEQ ID NO: 1049782 - RNA, 18 nt, Human
uccaagaagaaaagcagg

SEQ ID NO: 1049783 - RNA, 25 nt, Human
uccaagaagaaaagcaggaacuacc

SEQ ID NO: 1049784 - RNA, 19 nt, Human
uccaucaccuuagugucca

SEQ ID NO: 1049785 - RNA, 23 nt, Human
uccccgaggccugcccagcagac

SEQ ID NO: 1049786 - RNA, 23 nt, Human
uccguguggccgccaccuuccgg

SEQ ID NO: 1049787 - RNA, 24 nt, Human
ucgcccauccucuuuccacucaua

SEQ ID NO: 1049788 - RNA, 18 nt, Human
ucuggcucagugaaucug

SEQ ID NO: 1049789 - RNA, 18 nt, Human
ugagaggcagguagagga

SEQ ID NO: 1049790 - RNA, 18 nt, Human
ugaggauaugugcccaag

SEQ ID NO: 1049791 - RNA, 19 nt, Human
ugccuaguaacaauuacua

SEQ ID NO: 1049792 - RNA, 19 nt, Human
ugccuuagucuggcucagu

SEQ ID NO: 1049793 - RNA, 18 nt, Human
uggcagcgaggagggugg

SEQ ID NO: 1049794 - RNA, 20 nt, Human
uggcggcgggaagcagaggc

SEQ ID NO: 1049795 - RNA, 19 nt, Human
ugggggaugcugagggggg

SEQ ID NO: 1049796 - RNA, 24 nt, Human
uggggguggugggcagcucgcagg

SEQ ID NO: 1049797 - RNA, 25 nt, Human
ugggguugggugggggaugcugagg

SEQ ID NO: 1049798 - RNA, 24 nt, Human
ugggugggggaugcugaggggggu

SEQ ID NO: 1049799 - RNA, 24 nt, Human
ugguaaguuuccucaagagaaaug

SEQ ID NO: 1049800 - RNA, 22 nt, Human
uguaucugggggcgggccuggg

SEQ ID NO: 1049801 - RNA, 20 nt, Human
ugucucaggugagcagagga

SEQ ID NO: 1049802 - RNA, 18 nt, Human
uuacuaggcuggccccag

SEQ ID NO: 1049803 - RNA, 19 nt, Human
uucacauaaacaauagggc

SEQ ID NO: 1049804 - RNA, 21 nt, Human
uuccagcccagagaauggcag

SEQ ID NO: 1049805 - RNA, 24 nt, Human
uuccggagucugggguuggguggg

SEQ ID NO: 1049806 - RNA, 20 nt, Human
uuuaaaaauagccacuugcu

SEQ ID NO: 1049807 - RNA, 22 nt, Human
uuuugccaagguuaaggacaug

SEQ ID NO: 1049808 - RNA, 21 nt, Human
aaguccugucucccuguccgg

SEQ ID NO: 1049809 - RNA, 19 nt, Human
accacccuggguugagccc

SEQ ID NO: 1049810 - RNA, 18 nt, Human
caggagccccaggggagg

SEQ ID NO: 1049811 - RNA, 19 nt, Human
ccacaccuccccuugaagc

SEQ ID NO: 1049812 - RNA, 18 nt, Human
ccggaagcgguggccuuc

SEQ ID NO: 1049813 - RNA, 19 nt, Human
ccuugcugagacggccuuu

SEQ ID NO: 1049814 - RNA, 20 nt, Human
cucccuguccuugcugagac

SEQ ID NO: 1049815 - RNA, 25 nt, Human
gacacacgugugucgguguugugga

SEQ ID NO: 1049816 - RNA, 20 nt, Human
gacuccugaaguccugucuc

SEQ ID NO: 1049817 - RNA, 20 nt, Human
gcagggccacaccuccccuu

SEQ ID NO: 1049818 - RNA, 22 nt, Human
ggcaucaggagccccaggggag

SEQ ID NO: 1049819 - RNA, 18 nt, Human
ggccuuuuggccccuugg

SEQ ID NO: 1049820 - RNA, 20 nt, Human
gugugucgguguuguggaag

SEQ ID NO: 1049821 - RNA, 19 nt, Human
uacuggggguugggggcag

SEQ ID NO: 1049822 - RNA, 22 nt, Human
ucucccuguccggaagcggugg

SEQ ID NO: 1049823 - RNA, 18 nt, Human
ugagacggccuuuuggcc

SEQ ID NO: 1049824 - RNA, 18 nt, Human
ugagggcacagguaccuu

SEQ ID NO: 1049825 - RNA, 21 nt, Human
uggaaggucaggacuugggca

SEQ ID NO: 1049826 - RNA, 23 nt, Human
uggccccuuggcaucaggagccc

SEQ ID NO: 1049827 - RNA, 19 nt, Human
ugggaugaggaugggguca

SEQ ID NO: 1049828 - RNA, 23 nt, Human
ugggaugaggauggggucagcug

SEQ ID NO: 1049829 - RNA, 19 nt, Human
uugaagcagacacacgugu

SEQ ID NO: 1049830 - RNA, 21 nt, Human
uugaagcagacacacgugugu

SEQ ID NO: 1049831 - RNA, 19 nt, Human
cuucaaaggacaccaaccc

SEQ ID NO: 1049832 - RNA, 27 nt, Human
aaaaacagcauaaggaaaccgguaccc

SEQ ID NO: 1049833 - RNA, 27 nt, Human
aagagcugaagauaaugauacuaaacc

SEQ ID NO: 1049834 - RNA, 20 nt, Human
agagagagagaaauaugaac

SEQ ID NO: 1049835 - RNA, 19 nt, Human
agccagcauggacgugguc

SEQ ID NO: 1049836 - RNA, 22 nt, Human
aggagcaggucuggaaagaaca

SEQ ID NO: 1049837 - RNA, 22 nt, Human
auauaucuauuccauagauacc

SEQ ID NO: 1049838 - RNA, 23 nt, Human
auuuacugccgacaucaacuucu

SEQ ID NO: 1049839 - RNA, 22 nt, Human
caacaauacuuuagcuuccuga

SEQ ID NO: 1049840 - RNA, 23 nt, Human
gacguggucucagcccugcggcu

SEQ ID NO: 1049841 - RNA, 21 nt, Human
gugcagcaggagcaggucugg

SEQ ID NO: 1049842 - RNA, 21 nt, Human
uggagggcucccucucccuca

SEQ ID NO: 1049843 - RNA, 24 nt, Human
uuuggagggcucccucucccucag

SEQ ID NO: 1049844 - RNA, 19 nt, Human
aaaacuguacaccugcccc

SEQ ID NO: 1049845 - RNA, 21 nt, Human
aaaacuguacaccugccccca

SEQ ID NO: 1049846 - RNA, 22 nt, Human
aauggccauucuucaaguccga

SEQ ID NO: 1049847 - RNA, 23 nt, Human
acuauguuacaaaacuguacacc

SEQ ID NO: 1049848 - RNA, 22 nt, Human
aggcggcuccgaggcccggaac

SEQ ID NO: 1049849 - RNA, 18 nt, Human
agguucuuagccuggugc

SEQ ID NO: 1049850 - RNA, 21 nt, Human
auguggaguacaggaauggcc

SEQ ID NO: 1049851 - RNA, 24 nt, Human
cagguucuuagccuggugcuucca

SEQ ID NO: 1049852 - RNA, 27 nt, Human
cauacaacucauuuauaauuuauuuuc

SEQ ID NO: 1049853 - RNA, 18 nt, Human
ccaacaaggcuagaccag

SEQ ID NO: 1049854 - RNA, 18 nt, Human
ccccaaaguuggauaacc

SEQ ID NO: 1049855 - RNA, 22 nt, Human
ccucaaggcggcuccgaggccc

SEQ ID NO: 1049856 - RNA, 22 nt, Human
gaaagagaagaaucaacacugg

SEQ ID NO: 1049857 - RNA, 24 nt, Human
gggcccaacaaggcuagaccagaa

SEQ ID NO: 1049858 - RNA, 21 nt, Human
guggaguacaggaauggccag

SEQ ID NO: 1049859 - RNA, 21 nt, Human
uuucacacaacucacuauguu

SEQ ID NO: 1049860 - RNA, 18 nt, Human
uuuucacacaacucacua

SEQ ID NO: 1049861 - RNA, 20 nt, Human
aaaaguacuaaaauacccac

SEQ ID NO: 1049862 - RNA, 20 nt, Human
aaaggaagugaggggcagag

SEQ ID NO: 1049863 - RNA, 22 nt, Human
aaaguacuaaaauacccacgug

SEQ ID NO: 1049864 - RNA, 25 nt, Human
aaccccaguggucuggcuuuggcac

SEQ ID NO: 1049865 - RNA, 31 nt, Human
accuccaccagacuucuauccccucugcugg

SEQ ID NO: 1049866 - RNA, 28 nt, Human
accugaagggcuggcugggugagugagg

SEQ ID NO: 1049867 - RNA, 21 nt, Human
acgaaauaaauggaaagaaga

SEQ ID NO: 1049868 - RNA, 18 nt, Human
agauggggaagugggggc

SEQ ID NO: 1049869 - RNA, 19 nt, Human
agauggggaagugggggcg

SEQ ID NO: 1049870 - RNA, 20 nt, Human
agccaggguggugguggugu

SEQ ID NO: 1049871 - RNA, 19 nt, Human
auggcacaggugggcaugg

SEQ ID NO: 1049872 - RNA, 20 nt, Human
cccacuccaccuccaccaga

SEQ ID NO: 1049873 - RNA, 25 nt, Human
cccccaacucuccagaacaggcuac

SEQ ID NO: 1049874 - RNA, 21 nt, Human
ccccgccgccgccgcacccug

SEQ ID NO: 1049875 - RNA, 25 nt, Human
cccucugcuguucccagcccccaau

SEQ ID NO: 1049876 - RNA, 18 nt, Human
ccgcacccugcucggccc

SEQ ID NO: 1049877 - RNA, 18 nt, Human
ccgcacccugcucggccc

SEQ ID NO: 1049878 - RNA, 20 nt, Human
ccucugcuguucccagcccc

SEQ ID NO: 1049879 - RNA, 19 nt, Human
cgccccgccgccgccgcac

SEQ ID NO: 1049880 - RNA, 19 nt, Human
cuauccccucugcuguucc

SEQ ID NO: 1049881 - RNA, 23 nt, Human
cuccaccagacuucuauccccuc

SEQ ID NO: 1049882 - RNA, 21 nt, Human
cugcuguucccagcccccaau

SEQ ID NO: 1049883 - RNA, 23 nt, Human
cuguggcagcuggcagggcccac

SEQ ID NO: 1049884 - RNA, 20 nt, Human
gaaagaagauaugggguggg

SEQ ID NO: 1049885 - RNA, 18 nt, Human
gaacaggcuacaaacaug

SEQ ID NO: 1049886 - RNA, 22 nt, Human
gaacaggcuacaaacaugcaaa

SEQ ID NO: 1049887 - RNA, 23 nt, Human
gaacaggcuacaaacaugcaaau

SEQ ID NO: 1049888 - RNA, 21 nt, Human
gcaggaaaccccaguggucug

SEQ ID NO: 1049889 - RNA, 22 nt, Human
gccacaaccaucagcuguccug

SEQ ID NO: 1049890 - RNA, 24 nt, Human
gccacuucuccagaagugaggaag

SEQ ID NO: 1049891 - RNA, 20 nt, Human
gcuggcagggcccacuccuc

SEQ ID NO: 1049892 - RNA, 18 nt, Human
ggaagcaggucaugcagc

SEQ ID NO: 1049893 - RNA, 19 nt, Human
ggacaagagguagaugggg

SEQ ID NO: 1049894 - RNA, 20 nt, Human
ggacaagagguagaugggga

SEQ ID NO: 1049895 - RNA, 19 nt, Human
ggcggaccagcuaccuuga

SEQ ID NO: 1049896 - RNA, 18 nt, Human
gggugcuguggaggccgg

SEQ ID NO: 1049897 - RNA, 18 nt, Human
ggguggggugcuguggag

SEQ ID NO: 1049898 - RNA, 21 nt, Human
gggugguggugguguuggggg

SEQ ID NO: 1049899 - RNA, 24 nt, Human
gguguuggggggaggacaagaggu

SEQ ID NO: 1049900 - RNA, 20 nt, Human
guggggugcuguggaggccg

SEQ ID NO: 1049901 - RNA, 18 nt, Human
uaaaggaagugaggggca

SEQ ID NO: 1049902 - RNA, 24 nt, Human
uaugggguggggugcuguggaggc

SEQ ID NO: 1049903 - RNA, 22 nt, Human
ucaugcagcuguggcagcuggc

SEQ ID NO: 1049904 - RNA, 22 nt, Human
uccagaagugaggaagcccaga

SEQ ID NO: 1049905 - RNA, 23 nt, Human
uggaaagaagauauggggugggg

SEQ ID NO: 1049906 - RNA, 19 nt, Human
uggcagggcccacuccucc

SEQ ID NO: 1049907 - RNA, 19 nt, Human
uggccacuucuccagaagu

SEQ ID NO: 1049908 - RNA, 22 nt, Human
uggcugggugagugaggacagg

SEQ ID NO: 1049909 - RNA, 21 nt, Human
ugggauggccacuucuccaga

SEQ ID NO: 1049910 - RNA, 18 nt, Human
uggggaagugggggcgga

SEQ ID NO: 1049911 - RNA, 20 nt, Human
ugggguggggugcuguggag

SEQ ID NO: 1049912 - RNA, 23 nt, Human
uucccagcccccaauuccugcag

SEQ ID NO: 1049913 - RNA, 22 nt, Human
uuccugcagcaggaaaccccag

SEQ ID NO: 1049914 - RNA, 18 nt, Human
uuucugccacaaccauca

SEQ ID NO: 1049915 - RNA, 22 nt, Human
acagcggagacgggcaaccaga

SEQ ID NO: 1049916 - RNA, 19 nt, Human
aggcagggucugcaggcgc

SEQ ID NO: 1049917 - RNA, 23 nt, Human
ccuccaugguccccacuugaccc

SEQ ID NO: 1049918 - RNA, 22 nt, Human
cuccuccaugguccccacuuga

SEQ ID NO: 1049919 - RNA, 23 nt, Human
ugaggaaacacauuuugaaacca

SEQ ID NO: 1049920 - RNA, 22 nt, Human
uggguuggggagcggucagggu

SEQ ID NO: 1049921 - RNA, 20 nt, Human
uugcugggcuuguacagcag

SEQ ID NO: 1049922 - RNA, 25 nt, Human
uuggggagcggucaggguugcuggg

SEQ ID NO: 1049923 - RNA, 18 nt, Human
aaaaagcacaaaauccua

SEQ ID NO: 1049924 - RNA, 20 nt, Human
aagcaucuuuuaaagugcga

SEQ ID NO: 1049925 - RNA, 21 nt, Human
accacaauuucaguuauuuaa

SEQ ID NO: 1049926 - RNA, 22 nt, Human
cacuguuacaaaaagcacaaaa

SEQ ID NO: 1049927 - RNA, 26 nt, Human
cagcagcacucuugcuaacuucuggu

SEQ ID NO: 1049928 - RNA, 25 nt, Human
cgaaggaaccagcagcacuggagac

SEQ ID NO: 1049929 - RNA, 22 nt, Human
cuaaaagaaguaugagauagcu

SEQ ID NO: 1049930 - RNA, 19 nt, Human
gcuacaaauagguuguauc

SEQ ID NO: 1049931 - RNA, 19 nt, Human
gguuuuagguguagcaacu

SEQ ID NO: 1049932 - RNA, 18 nt, Human
uaaaaccaguaccuuccc

SEQ ID NO: 1049933 - RNA, 20 nt, Human
uagcaaccuccuucuuuggu

SEQ ID NO: 1049934 - RNA, 24 nt, Human
uagcaaccuccuucuuugguguuu

SEQ ID NO: 1049935 - RNA, 24 nt, Human
ucccacggguaacggcgugcuacc

SEQ ID NO: 1049936 - RNA, 18 nt, Human
ucuaaaagaaguaugaga

SEQ ID NO: 1049937 - RNA, 21 nt, Human
ugaagcaugcacuguuacaaa

SEQ ID NO: 1049938 - RNA, 19 nt, Human
ugagauagcuauccauacu

SEQ ID NO: 1049939 - RNA, 21 nt, Human
uuaaugaaaaaggcuucuuuc

SEQ ID NO: 1049940 - RNA, 18 nt, Human
uuuacaauaaucaaugcu

SEQ ID NO: 1049941 - RNA, 24 nt, Human
ccgcuccucgcucgccggggccga

SEQ ID NO: 1049942 - RNA, 21 nt, Human
cagcaguaguuuaaugaccga

SEQ ID NO: 1049943 - RNA, 20 nt, Human
ggaaagaggaaccagcagua

SEQ ID NO: 1049944 - RNA, 24 nt, Human
uucugguuuggccuaguagaaggc

SEQ ID NO: 1049945 - RNA, 19 nt, Human
aagagggugagcggauguu

SEQ ID NO: 1049946 - RNA, 22 nt, Human
acgcggguccagagggccuggc

SEQ ID NO: 1049947 - RNA, 24 nt, Human
agagggugagcggauguuggccag

SEQ ID NO: 1049948 - RNA, 21 nt, Human
aggcagccacccucugcgaag

SEQ ID NO: 1049949 - RNA, 23 nt, Human
agggugagcggauguuggccagg

SEQ ID NO: 1049950 - RNA, 23 nt, Human
aucucagccucuuccugcuucag

SEQ ID NO: 1049951 - RNA, 21 nt, Human
augaaccaggccaaggaaugg

SEQ ID NO: 1049952 - RNA, 23 nt, Human
cagccagccacacagucuuccca

SEQ ID NO: 1049953 - RNA, 21 nt, Human
caggaagcuggggaugaacca

SEQ ID NO: 1049954 - RNA, 23 nt, Human
caggagcucuugggggagcccca

SEQ ID NO: 1049955 - RNA, 23 nt, Human
caggauggcauccaggagcagcu

SEQ ID NO: 1049956 - RNA, 18 nt, Human
ccacacagucuucccagg

SEQ ID NO: 1049957 - RNA, 18 nt, Human
cccccagggaugcccagg

SEQ ID NO: 1049958 - RNA, 20 nt, Human
gaagcuggggaugaaccagg

SEQ ID NO: 1049959 - RNA, 19 nt, Human
gcucccaggagcucuuggg

SEQ ID NO: 1049960 - RNA, 20 nt, Human
ggcccagggccaggcagcca

SEQ ID NO: 1049961 - RNA, 19 nt, Human
ucagggagcagaacuuugc

SEQ ID NO: 1049962 - RNA, 19 nt, Human
ugaugggugggcuguggau

SEQ ID NO: 1049963 - RNA, 19 nt, Human
ugcccaggaucccacucac

SEQ ID NO: 1049964 - RNA, 20 nt, Human
uggcauagguacugcuguuu

SEQ ID NO: 1049965 - RNA, 19 nt, Human
uggccaggauggcauccag

SEQ ID NO: 1049966 - RNA, 18 nt, Human
uggcccagggccaggcag

SEQ ID NO: 1049967 - RNA, 21 nt, Human
ugggggagccccaauuccccc

SEQ ID NO: 1049968 - RNA, 23 nt, Human
uggugcucccaggagcucuuggg

SEQ ID NO: 1049969 - RNA, 24 nt, Human
uuggcauuaaucucagccucuucc

SEQ ID NO: 1049970 - RNA, 22 nt, Human
uaccuuugucagagcuguccuc

SEQ ID NO: 1049971 - RNA, 19 nt, Human
ugcauaccuuugucagagc

SEQ ID NO: 1049972 - RNA, 18 nt, Human
aaagugccauuugaaugg

SEQ ID NO: 1049973 - RNA, 18 nt, Human
aaauacuucccaagucac

SEQ ID NO: 1049974 - RNA, 18 nt, Human
aagaaauaucccauugag

SEQ ID NO: 1049975 - RNA, 19 nt, Human
aagauccauagcacuuuuc

SEQ ID NO: 1049976 - RNA, 24 nt, Human
aauaaauugugaaaaaaaugacaa

SEQ ID NO: 1049977 - RNA, 22 nt, Human
aauacaagaaauaucccauuga

SEQ ID NO: 1049978 - RNA, 22 nt, Human
accauaaggccucugcugaggc

SEQ ID NO: 1049979 - RNA, 23 nt, Human
acucauuuugagcucuuccucaa

SEQ ID NO: 1049980 - RNA, 20 nt, Human
agaaaagaaaaaguguaaag

SEQ ID NO: 1049981 - RNA, 23 nt, Human
aggaaaagaaagauuuguucugu

SEQ ID NO: 1049982 - RNA, 21 nt, Human
aggaaauuacagagaaguuau

SEQ ID NO: 1049983 - RNA, 24 nt, Human
aggaauaaaguccacugaucugcu

SEQ ID NO: 1049984 - RNA, 20 nt, Human
aguauuuuauuuuuuccagc

SEQ ID NO: 1049985 - RNA, 24 nt, Human
aguuuacuguugcaaugguggcau

SEQ ID NO: 1049986 - RNA, 20 nt, Human
auaauacugugccuucaguu

SEQ ID NO: 1049987 - RNA, 18 nt, Human
aucaucccgcugggauuc

SEQ ID NO: 1049988 - RNA, 19 nt, Human
auuuuauuuuuuccagcau

SEQ ID NO: 1049989 - RNA, 18 nt, Human
caaggguaauagaucaag

SEQ ID NO: 1049990 - RNA, 21 nt, Human
caagguuuaacauccuuucca

SEQ ID NO: 1049991 - RNA, 22 nt, Human
caaguaacucugagauucuaga

SEQ ID NO: 1049992 - RNA, 23 nt, Human
cacacccaugauguuuuacagga

SEQ ID NO: 1049993 - RNA, 24 nt, Human
cagcagcaguauaaaaaucacacc

SEQ ID NO: 1049994 - RNA, 19 nt, Human
caucaaguuccucaaaagg

SEQ ID NO: 1049995 - RNA, 22 nt, Human
cauccugggauaguauuuaaua

SEQ ID NO: 1049996 - RNA, 23 nt, Human
ccaccgugaguuguucugacugc

SEQ ID NO: 1049997 - RNA, 25 nt, Human
ccaccgugaguuguucugacugcac

SEQ ID NO: 1049998 - RNA, 19 nt, Human
ccccuaauuuucucaaauc

SEQ ID NO: 1049999 - RNA, 23 nt, Human
ccucaagacaaauacuucccaag

SEQ ID NO: 1050000 - RNA, 23 nt, Human
ccuuccuucuuuucaucuuuucu

SEQ ID NO: 1050001 - RNA, 26 nt, Human
cucaaaaggguauccaaauucauaaa

SEQ ID NO: 1050002 - RNA, 22 nt, Human
cucaagacaaauacuucccaag

SEQ ID NO: 1050003 - RNA, 21 nt, Human
cugaggcuugguuuuggagca

SEQ ID NO: 1050004 - RNA, 18 nt, Human
cuucagcuucacucggcc

SEQ ID NO: 1050005 - RNA, 24 nt, Human
cuuccuuccuucuuuucaucuuuu

SEQ ID NO: 1050006 - RNA, 24 nt, Human
gaaaaugaaaauguuacacuuucu

SEQ ID NO: 1050007 - RNA, 19 nt, Human
gagcaggcugcacaggacu

SEQ ID NO: 1050008 - RNA, 20 nt, Human
gaucugcuuugguuuuugca

SEQ ID NO: 1050009 - RNA, 24 nt, Human
gccaagguuuaacauccuuuccaa

SEQ ID NO: 1050010 - RNA, 19 nt, Human
ggacugccagcagcugcuc

SEQ ID NO: 1050011 - RNA, 19 nt, Human
gucuucagcuucacucggc

SEQ ID NO: 1050012 - RNA, 18 nt, Human
uaaaagagaaaaugaaaa

SEQ ID NO: 1050013 - RNA, 22 nt, Human
uaaguguggacugucaguggcc

SEQ ID NO: 1050014 - RNA, 24 nt, Human
uacaagaaauaucccauugagaua

SEQ ID NO: 1050015 - RNA, 22 nt, Human
uaccaaguaacucugagauucu

SEQ ID NO: 1050016 - RNA, 23 nt, Human
uaccauaaggccucugcugaggc

SEQ ID NO: 1050017 - RNA, 26 nt, Human
uaccauaaggccucugcugaggcuug

SEQ ID NO: 1050018 - RNA, 22 nt, Human
uagcagagauucacuuuuaaau

SEQ ID NO: 1050019 - RNA, 24 nt, Human
uaguauuuaauagugucugaaaug

SEQ ID NO: 1050020 - RNA, 20 nt, Human
uauaaaaaucacacccauga

SEQ ID NO: 1050021 - RNA, 24 nt, Human
uaucaggagagaugauugaacuuc

SEQ ID NO: 1050022 - RNA, 18 nt, Human
uaucuuuaaaauguagag

SEQ ID NO: 1050023 - RNA, 20 nt, Human
uaugauaauuuaauauaggu

SEQ ID NO: 1050024 - RNA, 21 nt, Human
uauuuugguuugcaccucagg

SEQ ID NO: 1050025 - RNA, 21 nt, Human
ucacaaggaguauauguacuu

SEQ ID NO: 1050026 - RNA, 21 nt, Human
ucacacccaugauguuuuaca

SEQ ID NO: 1050027 - RNA, 24 nt, Human
ucagauaugagacugcuacauaau

SEQ ID NO: 1050028 - RNA, 21 nt, Human
ucuaacaucuucuagcagaga

SEQ ID NO: 1050029 - RNA, 24 nt, Human
ucuaacaucuucuagcagagauuc

SEQ ID NO: 1050030 - RNA, 23 nt, Human
ucuccagguacaaggguguuuuc

SEQ ID NO: 1050031 - RNA, 22 nt, Human
ucucucagugccuaagugugga

SEQ ID NO: 1050032 - RNA, 24 nt, Human
ucugcuucaaacuguuucacucuc

SEQ ID NO: 1050033 - RNA, 20 nt, Human
ucugucagucuguuucuuca

SEQ ID NO: 1050034 - RNA, 24 nt, Human
ugccaagguuuaacauccuuucca

SEQ ID NO: 1050035 - RNA, 22 nt, Human
ugcccuugacuucgagacauuu

SEQ ID NO: 1050036 - RNA, 20 nt, Human
ugcugaggcuugguuuugga

SEQ ID NO: 1050037 - RNA, 20 nt, Human
uggagcaggcugcacaggac

SEQ ID NO: 1050038 - RNA, 19 nt, Human
uggaguucuaacaucuucu

SEQ ID NO: 1050039 - RNA, 20 nt, Human
uguucuguguaaucucuugc

SEQ ID NO: 1050040 - RNA, 21 nt, Human
uguuucaucucuucauuccag

SEQ ID NO: 1050041 - RNA, 23 nt, Human
uuagagaagacuuguuucucuug

SEQ ID NO: 1050042 - RNA, 22 nt, Human
uucaggggauagcaggguuguc

SEQ ID NO: 1050043 - RNA, 20 nt, Human
uuccccccuuuaccauaagg

SEQ ID NO: 1050044 - RNA, 21 nt, Human
uucugcaauauuuuuacacau

SEQ ID NO: 1050045 - RNA, 23 nt, Human
uuggagcaggcugcacaggacug

SEQ ID NO: 1050046 - RNA, 23 nt, Human
uuggcucugcuucaaacuguuuc

SEQ ID NO: 1050047 - RNA, 23 nt, Human
uugugaaaaaaaugacaaggugu

SEQ ID NO: 1050048 - RNA, 18 nt, Human
uuguucuguguaaucucu

SEQ ID NO: 1050049 - RNA, 20 nt, Human
uuuacaggaaaacagaacaa

SEQ ID NO: 1050050 - RNA, 21 nt, Human
uuuacaucaaguuccucaaaa

SEQ ID NO: 1050051 - RNA, 23 nt, Human
uuuauagacacauucuaugauaa

SEQ ID NO: 1050052 - RNA, 21 nt, Human
uuucucuuguaugcccuugac

SEQ ID NO: 1050053 - RNA, 20 nt, Human
uuuuccaucaucccgcuggg

SEQ ID NO: 1050054 - RNA, 21 nt, Human
uuuugcucuuugaauggcuuc

SEQ ID NO: 1050055 - RNA, 24 nt, Human
uuuugcucuuugaauggcuuccuu

SEQ ID NO: 1050056 - RNA, 27 nt, Human
aaaaacacuggaaaagaaccgguaccc

SEQ ID NO: 1050057 - RNA, 18 nt, Human
aaacacugcagcacauuc

SEQ ID NO: 1050058 - RNA, 22 nt, Human
aagaugcacaaggcuccaacug

SEQ ID NO: 1050059 - RNA, 20 nt, Human
aauccuggugaacuaauucg

SEQ ID NO: 1050060 - RNA, 18 nt, Human
accgggaggugcugcccg

SEQ ID NO: 1050061 - RNA, 21 nt, Human
accgggaggugcugcccggcc

SEQ ID NO: 1050062 - RNA, 19 nt, Human
agaauucuuuauguuucuc

SEQ ID NO: 1050063 - RNA, 18 nt, Human
agcaacaugaaucuuuac

SEQ ID NO: 1050064 - RNA, 23 nt, Human
agccuuaggaugaugccaauguu

SEQ ID NO: 1050065 - RNA, 22 nt, Human
agcugcccucuggaccaacugg

SEQ ID NO: 1050066 - RNA, 18 nt, Human
agggggugggguguggag

SEQ ID NO: 1050067 - RNA, 20 nt, Human
caaaaucuuuaauuuauauc

SEQ ID NO: 1050068 - RNA, 23 nt, Human
caacaugaaucuuuacuucuuuc

SEQ ID NO: 1050069 - RNA, 20 nt, Human
caauagauuucauguauugu

SEQ ID NO: 1050070 - RNA, 21 nt, Human
cacacaaacaccccuucguac

SEQ ID NO: 1050071 - RNA, 25 nt, Human
caccccuucguacuuacauaaucug

SEQ ID NO: 1050072 - RNA, 19 nt, Human
cagccgggguaccgggagg

SEQ ID NO: 1050073 - RNA, 19 nt, Human
ccucuuugaagaauucugg

SEQ ID NO: 1050074 - RNA, 18 nt, Human
cuccaacugcuacuggca

SEQ ID NO: 1050075 - RNA, 19 nt, Human
cucuucagcugcccucugg

SEQ ID NO: 1050076 - RNA, 20 nt, Human
cugcucccgagaaacgcccu

SEQ ID NO: 1050077 - RNA, 18 nt, Human
gaaaagaacuguuccucu

SEQ ID NO: 1050078 - RNA, 21 nt, Human
gaaucauuggaucagaaacac

SEQ ID NO: 1050079 - RNA, 20 nt, Human
gggggugggguguggaggcg

SEQ ID NO: 1050080 - RNA, 23 nt, Human
uaauucgaaaaacacuggaaaag

SEQ ID NO: 1050081 - RNA, 21 nt, Human
uagccagccuuaggaugaugc

SEQ ID NO: 1050082 - RNA, 20 nt, Human
ucagaaacacugcagcacau

SEQ ID NO: 1050083 - RNA, 18 nt, Human
ucagcugcccucuggacc

SEQ ID NO: 1050084 - RNA, 21 nt, Human
ucaucccaugaccacgagggu

SEQ ID NO: 1050085 - RNA, 27 nt, Human
ucccgagaaacgcccuccagccggggu

SEQ ID NO: 1050086 - RNA, 20 nt, Human
ucuccaagugaccguaagua

SEQ ID NO: 1050087 - RNA, 25 nt, Human
ucuccaagugaccguaaguaguauu

SEQ ID NO: 1050088 - RNA, 25 nt, Human
ucuguggguagaggugcugcaugaa

SEQ ID NO: 1050089 - RNA, 21 nt, Human
ugcacaaggcuccaacugcua

SEQ ID NO: 1050090 - RNA, 23 nt, Human
ugcaugaacugcucccgagaaac

SEQ ID NO: 1050091 - RNA, 22 nt, Human
ugcugcccggccaugguugcuc

SEQ ID NO: 1050092 - RNA, 21 nt, Human
uggguagaggugcugcaugaa

SEQ ID NO: 1050093 - RNA, 21 nt, Human
uuacuucuuucuucccuccaa

SEQ ID NO: 1050094 - RNA, 23 nt, Human
uucgaaaaacacuggaaaagaag

SEQ ID NO: 1050095 - RNA, 18 nt, Human
uucucuguggguagaggu

SEQ ID NO: 1050096 - RNA, 21 nt, Human
uucuggaaacuuaauaucucc

SEQ ID NO: 1050097 - RNA, 25 nt, Human
uuguacauggccccaaaucaauccc

SEQ ID NO: 1050098 - RNA, 22 nt, Human
uugugguugaaaaggggguggg

SEQ ID NO: 1050099 - RNA, 21 nt, Human
uuuacuucuuucuucccucca

SEQ ID NO: 1050100 - RNA, 18 nt, Human
aacauucuuuuacaaaug

SEQ ID NO: 1050101 - RNA, 19 nt, Human
agaauuuaguaauucuggg

SEQ ID NO: 1050102 - RNA, 19 nt, Human
augguacuguguguugguu

SEQ ID NO: 1050103 - RNA, 20 nt, Human
auugcucugcccuccucugg

SEQ ID NO: 1050104 - RNA, 28 nt, Human
ccucgcaacagcacuugccuuuaggcuu

SEQ ID NO: 1050105 - RNA, 24 nt, Human
cuccaugagucaccccagauccau

SEQ ID NO: 1050106 - RNA, 20 nt, Human
guggauugcucugcccuccu

SEQ ID NO: 1050107 - RNA, 20 nt, Human
uaaaugcaauauacccucua

SEQ ID NO: 1050108 - RNA, 23 nt, Human
uacaaauguaaaugcaauauacc

SEQ ID NO: 1050109 - RNA, 23 nt, Human
ugccuuuaggcuugguugcgcuu

SEQ ID NO: 1050110 - RNA, 20 nt, Human
ugguuccuggaugucgaccu

SEQ ID NO: 1050111 - RNA, 21 nt, Human
uguccauucuggccaccacuc

SEQ ID NO: 1050112 - RNA, 21 nt, Human
uuccuccaugagucaccccag

SEQ ID NO: 1050113 - RNA, 24 nt, Human
uucuguggauugcucugcccuccu

SEQ ID NO: 1050114 - RNA, 23 nt, Human
uuuaaaagauacauggggaaaca

SEQ ID NO: 1050115 - RNA, 22 nt, Human
aaacaaaaaauuuaacauaguc

SEQ ID NO: 1050116 - RNA, 22 nt, Human
aaacaaaagaaaaaccaugaaa

SEQ ID NO: 1050117 - RNA, 23 nt, Human
aaacaaaugugcaaaagguaacc

SEQ ID NO: 1050118 - RNA, 19 nt, Human
aaaccacaaaacaaaagaa

SEQ ID NO: 1050119 - RNA, 21 nt, Human
aaaccacaaaacaaaagaaaa

SEQ ID NO: 1050120 - RNA, 22 nt, Human
aaauauaauacacauaagcaua

SEQ ID NO: 1050121 - RNA, 23 nt, Human
aagcgaaaaucaagauuaugguc

SEQ ID NO: 1050122 - RNA, 19 nt, Human
acaaaacaaaagaaaaacc

SEQ ID NO: 1050123 - RNA, 19 nt, Human
acaaaagaaaaaccaugaa

SEQ ID NO: 1050124 - RNA, 24 nt, Human
acaaugacagaaauaaguggacgc

SEQ ID NO: 1050125 - RNA, 21 nt, Human
accacaaaacaaaagaaaaac

SEQ ID NO: 1050126 - RNA, 25 nt, Human
acuuuaagagguguuucaccaagag

SEQ ID NO: 1050127 - RNA, 21 nt, Human
acuuuugcaccaacuucauaa

SEQ ID NO: 1050128 - RNA, 25 nt, Human
caaaacaaaagaaaaaccaugaaaa

SEQ ID NO: 1050129 - RNA, 18 nt, Human
caagacagaacagucaac

SEQ ID NO: 1050130 - RNA, 26 nt, Human
cacaaaacaaaagaaaaaccaugaaa

SEQ ID NO: 1050131 - RNA, 20 nt, Human
cccccccuuccauucaucac

SEQ ID NO: 1050132 - RNA, 23 nt, Human
cccccccuuccauucaucacucc

SEQ ID NO: 1050133 - RNA, 22 nt, Human
ccccccuuccauucaucacucc

SEQ ID NO: 1050134 - RNA, 18 nt, Human
cccccuaacaacaaaagc

SEQ ID NO: 1050135 - RNA, 27 nt, Human
cuucucuuugcugucacugagagagau

SEQ ID NO: 1050136 - RNA, 24 nt, Human
gcaaaagguaacccagacuuaaag

SEQ ID NO: 1050137 - RNA, 26 nt, Human
gcgaaaaucaagauuauggucaaaug

SEQ ID NO: 1050138 - RNA, 19 nt, Human
gcuccaugauggagacaga

SEQ ID NO: 1050139 - RNA, 28 nt, Human
uaaaaaagcccccuaacaacaaaagccc

SEQ ID NO: 1050140 - RNA, 19 nt, Human
uaaaauaaacacguacagc

SEQ ID NO: 1050141 - RNA, 18 nt, Human
uaaaggccucuuccuagu

SEQ ID NO: 1050142 - RNA, 24 nt, Human
uaagagguguuucaccaagaguac

SEQ ID NO: 1050143 - RNA, 19 nt, Human
uaggaauauauaugcggca

SEQ ID NO: 1050144 - RNA, 23 nt, Human
uaugcagaacagccauauguaac

SEQ ID NO: 1050145 - RNA, 24 nt, Human
ucaagaaaguaagaagcugaggau

SEQ ID NO: 1050146 - RNA, 22 nt, Human
uccaaaaagucauguugaauac

SEQ ID NO: 1050147 - RNA, 22 nt, Human
uccaugauggagacagagaggc

SEQ ID NO: 1050148 - RNA, 18 nt, Human
uccgcgccgccaccagca

SEQ ID NO: 1050149 - RNA, 24 nt, Human
ucuaaaccacaaaacaaaagaaaa

SEQ ID NO: 1050150 - RNA, 21 nt, Human
ucuggcaagggacuaagaggg

SEQ ID NO: 1050151 - RNA, 24 nt, Human
ugaaaauauuaccuuuucuccaug

SEQ ID NO: 1050152 - RNA, 25 nt, Human
ugacagaaauaaguggacgcucaaa

SEQ ID NO: 1050153 - RNA, 18 nt, Human
ugagagagauaaauggcu

SEQ ID NO: 1050154 - RNA, 19 nt, Human
ugcaccaacuucauaaaaa

SEQ ID NO: 1050155 - RNA, 23 nt, Human
uggagacagagaggcccccccuu

SEQ ID NO: 1050156 - RNA, 18 nt, Human
ugggaagccacuggcucu

SEQ ID NO: 1050157 - RNA, 18 nt, Human
uguagaggacgacggccg

SEQ ID NO: 1050158 - RNA, 23 nt, Human
uuacuuuugcaccaacuucauaa

SEQ ID NO: 1050159 - RNA, 21 nt, Human
cacuguguaaguuuguaaggc

SEQ ID NO: 1050160 - RNA, 21 nt, Human
ccugaaacaccucucuccacu

SEQ ID NO: 1050161 - RNA, 23 nt, Human
ccugaaacaccucucuccacuga

SEQ ID NO: 1050162 - RNA, 21 nt, Human
cuccugaaacaccucucucca

SEQ ID NO: 1050163 - RNA, 21 nt, Human
gcaggucaaaauucuuccuuu

SEQ ID NO: 1050164 - RNA, 21 nt, Human
ucuucaguucaucaauuuuuc

SEQ ID NO: 1050165 - RNA, 22 nt, Human
ugaaacaccucucuccacugag

SEQ ID NO: 1050166 - RNA, 20 nt, Human
uggaauucccaaagcacugu

SEQ ID NO: 1050167 - RNA, 19 nt, Human
uuacaggugcccuuggcua

SEQ ID NO: 1050168 - RNA, 22 nt, Human
aacccaggaugaaguugagcgg

SEQ ID NO: 1050169 - RNA, 19 nt, Human
auucuggaaguucuccucc

SEQ ID NO: 1050170 - RNA, 21 nt, Human
cuccgccucaacccaggauga

SEQ ID NO: 1050171 - RNA, 23 nt, Human
cuggaaguucuccuccgccucaa

SEQ ID NO: 1050172 - RNA, 23 nt, Human
uuaaaguagacauaauacaaauu

SEQ ID NO: 1050173 - RNA, 21 nt, Human
accaaauuaaaaaccccccuc

SEQ ID NO: 1050174 - RNA, 23 nt, Human
acugaguugcugaaaccccccca

SEQ ID NO: 1050175 - RNA, 18 nt, Human
agccccacccucuccccu

SEQ ID NO: 1050176 - RNA, 21 nt, Human
aggcaggcggggcaggcgggg

SEQ ID NO: 1050177 - RNA, 22 nt, Human
aggcaggcggggcaggcggggc

SEQ ID NO: 1050178 - RNA, 18 nt, Human
agggcccagaaaaaaggg

SEQ ID NO: 1050179 - RNA, 23 nt, Human
agggcccagaaaaaaggggggcc

SEQ ID NO: 1050180 - RNA, 24 nt, Human
agggcccagaaaaaaggggggcca

SEQ ID NO: 1050181 - RNA, 23 nt, Human
auucugcugcccaggcuucccag

SEQ ID NO: 1050182 - RNA, 21 nt, Human
caacagguccuaaagccagug

SEQ ID NO: 1050183 - RNA, 21 nt, Human
cacccucuccccugcaguuug

SEQ ID NO: 1050184 - RNA, 20 nt, Human
cagaaugagacuccaguauc

SEQ ID NO: 1050185 - RNA, 22 nt, Human
cagcucugaaucguguuggaac

SEQ ID NO: 1050186 - RNA, 18 nt, Human
caggcaggcggggcaggc

SEQ ID NO: 1050187 - RNA, 19 nt, Human
caguaucaaucaucugcca

SEQ ID NO: 1050188 - RNA, 24 nt, Human
cauucugcugcccaggcuucccag

SEQ ID NO: 1050189 - RNA, 24 nt, Human
ccaggccucagccuuccuuccagc

SEQ ID NO: 1050190 - RNA, 19 nt, Human
ccaguaucaaucaucugcc

SEQ ID NO: 1050191 - RNA, 23 nt, Human
cccagaggcgcccuacacaccag

SEQ ID NO: 1050192 - RNA, 21 nt, Human
cccaggaggacuggggccugc

SEQ ID NO: 1050193 - RNA, 19 nt, Human
ccccacccucuccccugca

SEQ ID NO: 1050194 - RNA, 22 nt, Human
ccucccaggaggacuggggccu

SEQ ID NO: 1050195 - RNA, 22 nt, Human
cugaaacccccccauuuccugg

SEQ ID NO: 1050196 - RNA, 18 nt, Human
cugaccaggccucagccu

SEQ ID NO: 1050197 - RNA, 21 nt, Human
cugcccaggcuucccagaggc

SEQ ID NO: 1050198 - RNA, 22 nt, Human
gaaacccccccauuuccugggc

SEQ ID NO: 1050199 - RNA, 23 nt, Human
gccucagccuuccuuccagcccc

SEQ ID NO: 1050200 - RNA, 23 nt, Human
gccugcucugcuggggucacugc

SEQ ID NO: 1050201 - RNA, 21 nt, Human
ggaacugacaggaaaguucca

SEQ ID NO: 1050202 - RNA, 20 nt, Human
ggagggcaguagggcccaga

SEQ ID NO: 1050203 - RNA, 21 nt, Human
ggcaguagggcccagaaaaaa

SEQ ID NO: 1050204 - RNA, 20 nt, Human
gggcaggcggggcaggcggc

SEQ ID NO: 1050205 - RNA, 21 nt, Human
gggcaggcggggcaggcggcu

SEQ ID NO: 1050206 - RNA, 19 nt, Human
ggggcaggcggcuggugga

SEQ ID NO: 1050207 - RNA, 20 nt, Human
ggggccagccucccaggagg

SEQ ID NO: 1050208 - RNA, 23 nt, Human
uaaaaauaaaaacaaaccccuga

SEQ ID NO: 1050209 - RNA, 19 nt, Human
uaaaaauaaaaacaaaccu

SEQ ID NO: 1050210 - RNA, 21 nt, Human
uagcucagaguucccgccuug

SEQ ID NO: 1050211 - RNA, 22 nt, Human
uagcucagaguucccgccuuga

SEQ ID NO: 1050212 - RNA, 20 nt, Human
ucagcagcgaggggugaagc

SEQ ID NO: 1050213 - RNA, 22 nt, Human
ucccagaggcgcccuacacacc

SEQ ID NO: 1050214 - RNA, 23 nt, Human
uccgugucaacagguccuaaagc

SEQ ID NO: 1050215 - RNA, 19 nt, Human
uccugggcagaggagggca

SEQ ID NO: 1050216 - RNA, 19 nt, Human
ucugugacacugaguugcu

SEQ ID NO: 1050217 - RNA, 21 nt, Human
ugacaggaaaguuccaggugu

SEQ ID NO: 1050218 - RNA, 19 nt, Human
ugacaucggcucagcagcg

SEQ ID NO: 1050219 - RNA, 20 nt, Human
ugacaucggcucagcagcga

SEQ ID NO: 1050220 - RNA, 19 nt, Human
ugccaggcagccagcucug

SEQ ID NO: 1050221 - RNA, 19 nt, Human
ugcccugggugcaaggggc

SEQ ID NO: 1050222 - RNA, 21 nt, Human
uggaacugacaggaaaguucc

SEQ ID NO: 1050223 - RNA, 23 nt, Human
ugggcagaggagggcaguagggc

SEQ ID NO: 1050224 - RNA, 24 nt, Human
ugggcagaggagggcaguagggcc

SEQ ID NO: 1050225 - RNA, 18 nt, Human
uuccagccccacccucuc

SEQ ID NO: 1050226 - RNA, 21 nt, Human
uuccagccccacccucucccc

SEQ ID NO: 1050227 - RNA, 21 nt, Human
uuccugggcagaggagggcag

SEQ ID NO: 1050228 - RNA, 23 nt, Human
uuggaacugacaggaaaguucca

SEQ ID NO: 1050229 - RNA, 18 nt, Human
aagccugcccgcacccag

SEQ ID NO: 1050230 - RNA, 20 nt, Human
aagccugcccgcacccaggc

SEQ ID NO: 1050231 - RNA, 23 nt, Human
accuccuccgcuugcuccccccg

SEQ ID NO: 1050232 - RNA, 20 nt, Human
acuggcaccuccuccgcuug

SEQ ID NO: 1050233 - RNA, 24 nt, Human
agcccggucagugucuuggagccc

SEQ ID NO: 1050234 - RNA, 22 nt, Human
aggccccucggagacccugccc

SEQ ID NO: 1050235 - RNA, 18 nt, Human
aggcucagaacaggucag

SEQ ID NO: 1050236 - RNA, 18 nt, Human
aggggcacaccccgcagg

SEQ ID NO: 1050237 - RNA, 18 nt, Human
agguacccggcgcagagc

SEQ ID NO: 1050238 - RNA, 18 nt, Human
agugcucggacgccucuc

SEQ ID NO: 1050239 - RNA, 21 nt, Human
caccggcguccacagcugcac

SEQ ID NO: 1050240 - RNA, 18 nt, Human
cacgaugcggccgugggc

SEQ ID NO: 1050241 - RNA, 23 nt, Human
cagagcauggugcuggggcgcag

SEQ ID NO: 1050242 - RNA, 19 nt, Human
cagcugcaccagggccagg

SEQ ID NO: 1050243 - RNA, 22 nt, Human
cagcugggcucgcggcuggagg

SEQ ID NO: 1050244 - RNA, 30 nt, Human
caggaaggacaggggcacaccccgcaggcu

SEQ ID NO: 1050245 - RNA, 18 nt, Human
caggcgguuccggcaggg

SEQ ID NO: 1050246 - RNA, 20 nt, Human
cagggucccucgggcucccc

SEQ ID NO: 1050247 - RNA, 21 nt, Human
cauccagggucccucgggcuc

SEQ ID NO: 1050248 - RNA, 20 nt, Human
ccaagccugcccgcacccag

SEQ ID NO: 1050249 - RNA, 21 nt, Human
ccagaagcucccugcagcugg

SEQ ID NO: 1050250 - RNA, 21 nt, Human
ccagaagcucccugcagcugg

SEQ ID NO: 1050251 - RNA, 18 nt, Human
ccagcccgggccccugcc

SEQ ID NO: 1050252 - RNA, 21 nt, Human
ccaggcccaccaggccgcuga

SEQ ID NO: 1050253 - RNA, 19 nt, Human
cccaagccugcccgcaccc

SEQ ID NO: 1050254 - RNA, 19 nt, Human
ccccaagccugcccgcacc

SEQ ID NO: 1050255 - RNA, 21 nt, Human
ccccagggcucuucggcaggu

SEQ ID NO: 1050256 - RNA, 19 nt, Human
cccccaagccugcccgcac

SEQ ID NO: 1050257 - RNA, 20 nt, Human
cccccaagccugcccgcacc

SEQ ID NO: 1050258 - RNA, 21 nt, Human
ccccccgggaccccucugcca

SEQ ID NO: 1050259 - RNA, 19 nt, Human
cccccgggaccccucugcc

SEQ ID NO: 1050260 - RNA, 21 nt, Human
cccccgggaccccucugccag

SEQ ID NO: 1050261 - RNA, 24 nt, Human
cccccgggcucaccggcguccaca

SEQ ID NO: 1050262 - RNA, 23 nt, Human
ccccucugccagcgucacagucc

SEQ ID NO: 1050263 - RNA, 18 nt, Human
ccccuuccucuccagccc

SEQ ID NO: 1050264 - RNA, 18 nt, Human
cccgcagccgucccccca

SEQ ID NO: 1050265 - RNA, 21 nt, Human
ccgcaggccccucggagaccc

SEQ ID NO: 1050266 - RNA, 22 nt, Human
ccuccuccgcuugcuccccccg

SEQ ID NO: 1050267 - RNA, 20 nt, Human
ccucggagacccugccccuc

SEQ ID NO: 1050268 - RNA, 21 nt, Human
ccucggagacccugccccucc

SEQ ID NO: 1050269 - RNA, 19 nt, Human
ccucgggcuccccuucugc

SEQ ID NO: 1050270 - RNA, 18 nt, Human
ccugcagcuccugggggg

SEQ ID NO: 1050271 - RNA, 18 nt, Human
ccugcagggccugcacca

SEQ ID NO: 1050272 - RNA, 25 nt, Human
ccugcccgcacccaggcucugaaaa

SEQ ID NO: 1050273 - RNA, 18 nt, Human
ccuggggggggucccagg

SEQ ID NO: 1050274 - RNA, 20 nt, Human
cgcagagccgggcggcgucu

SEQ ID NO: 1050275 - RNA, 20 nt, Human
cgcagcccgggccccagggc

SEQ ID NO: 1050276 - RNA, 19 nt, Human
cggcgcagagcauggugcu

SEQ ID NO: 1050277 - RNA, 20 nt, Human
cggcuggaggaggcugcgcu

SEQ ID NO: 1050278 - RNA, 20 nt, Human
cgggcuccccuucugccagg

SEQ ID NO: 1050279 - RNA, 22 nt, Human
cgggggccaggcucagaacagg

SEQ ID NO: 1050280 - RNA, 20 nt, Human
cucaucugcuccuggagcca

SEQ ID NO: 1050281 - RNA, 22 nt, Human
cuccccccgggaccccucugcc

SEQ ID NO: 1050282 - RNA, 22 nt, Human
cuccccuucugccagggcagcc

SEQ ID NO: 1050283 - RNA, 24 nt, Human
cuccuggggcuccuggggcaggca

SEQ ID NO: 1050284 - RNA, 23 nt, Human
cucucucacugcuucagccucag

SEQ ID NO: 1050285 - RNA, 20 nt, Human
cugccugcagcuccuggggg

SEQ ID NO: 1050286 - RNA, 18 nt, Human
cuggggcuccuggggcag

SEQ ID NO: 1050287 - RNA, 18 nt, Human
gagcggcagcugagacgc

SEQ ID NO: 1050288 - RNA, 20 nt, Human
gagcggcagcugagacgcag

SEQ ID NO: 1050289 - RNA, 19 nt, Human
gaggaggcugcgcucaucu

SEQ ID NO: 1050290 - RNA, 18 nt, Human
gagggguagcagcagcag

SEQ ID NO: 1050291 - RNA, 19 nt, Human
gcacaccccgcaggccccu

SEQ ID NO: 1050292 - RNA, 19 nt, Human
gcccaacacagucucugcc

SEQ ID NO: 1050293 - RNA, 20 nt, Human
gcccccaagaggagagugaa

SEQ ID NO: 1050294 - RNA, 23 nt, Human
gcccccaagaggagagugaagac

SEQ ID NO: 1050295 - RNA, 18 nt, Human
gcccgugggcaaaccaug

SEQ ID NO: 1050296 - RNA, 18 nt, Human
gcgcagcccgggccccag

SEQ ID NO: 1050297 - RNA, 21 nt, Human
gcgucugccugcagcuccugg

SEQ ID NO: 1050298 - RNA, 19 nt, Human
gcuccuggggcuccugggg

SEQ ID NO: 1050299 - RNA, 20 nt, Human
gcucugaaaagcccggucag

SEQ ID NO: 1050300 - RNA, 26 nt, Human
ggaaggacaggggcacaccccgcagg

SEQ ID NO: 1050301 - RNA, 20 nt, Human
ggaccccucugccagcguca

SEQ ID NO: 1050302 - RNA, 21 nt, Human
ggagacccugccccuccgccc

SEQ ID NO: 1050303 - RNA, 22 nt, Human
ggccagaagcucccugcagcug

SEQ ID NO: 1050304 - RNA, 20 nt, Human
ggcggcgucugccugcagcu

SEQ ID NO: 1050305 - RNA, 18 nt, Human
ggcuccaggcccaccagg

SEQ ID NO: 1050306 - RNA, 23 nt, Human
gggccccugcccuacauccaucc

SEQ ID NO: 1050307 - RNA, 25 nt, Human
gggccucucucacugcuucagccuc

SEQ ID NO: 1050308 - RNA, 21 nt, Human
gggcgggggccaggcucagaa

SEQ ID NO: 1050309 - RNA, 22 nt, Human
ggggcacaccccgcaggccccu

SEQ ID NO: 1050310 - RNA, 21 nt, Human
ggggggggucccaggccagaa

SEQ ID NO: 1050311 - RNA, 20 nt, Human
gguucacuggcaccuccucc

SEQ ID NO: 1050312 - RNA, 19 nt, Human
guucacuggcaccuccucc

SEQ ID NO: 1050313 - RNA, 18 nt, Human
uagcagcagcagcacagc

SEQ ID NO: 1050314 - RNA, 18 nt, Human
uagggcgggggccaggcu

SEQ ID NO: 1050315 - RNA, 22 nt, Human
ucaccggcguccacagcugcac

SEQ ID NO: 1050316 - RNA, 18 nt, Human
uccagcccgggccccugc

SEQ ID NO: 1050317 - RNA, 18 nt, Human
uccccgcagccguccccc

SEQ ID NO: 1050318 - RNA, 23 nt, Human
ucccucgggcuccccuucugcca

SEQ ID NO: 1050319 - RNA, 18 nt, Human
ucccugcagcugggcucg

SEQ ID NO: 1050320 - RNA, 24 nt, Human
uccggcagggggcuccuggggcuc

SEQ ID NO: 1050321 - RNA, 20 nt, Human
uccuggggcuccuggggcag

SEQ ID NO: 1050322 - RNA, 19 nt, Human
uccuggggggggucccagg

SEQ ID NO: 1050323 - RNA, 19 nt, Human
ucgaagagggcgccccagc

SEQ ID NO: 1050324 - RNA, 22 nt, Human
ucuccagcccgggccccugccc

SEQ ID NO: 1050325 - RNA, 23 nt, Human
ucucgccgcacggcccuucacaa

SEQ ID NO: 1050326 - RNA, 21 nt, Human
ucugccaggaccucaugaaag

SEQ ID NO: 1050327 - RNA, 20 nt, Human
ugagcaggggaacacgggcc

SEQ ID NO: 1050328 - RNA, 19 nt, Human
ugagcuugggagggguagg

SEQ ID NO: 1050329 - RNA, 23 nt, Human
ugcagggccugcaccagcagccg

SEQ ID NO: 1050330 - RNA, 19 nt, Human
ugcagggcgcuggggggca

SEQ ID NO: 1050331 - RNA, 20 nt, Human
ugcagggcgcuggggggcag

SEQ ID NO: 1050332 - RNA, 20 nt, Human
ugccaggaccucaugaaagu

SEQ ID NO: 1050333 - RNA, 23 nt, Human
ugcgguucacuggcaccuccucc

SEQ ID NO: 1050334 - RNA, 18 nt, Human
ugcuggggcgcagcccgg

SEQ ID NO: 1050335 - RNA, 19 nt, Human
ugcuggggcgcagcccggg

SEQ ID NO: 1050336 - RNA, 22 nt, Human
uggcaccuccuccgcuugcucc

SEQ ID NO: 1050337 - RNA, 20 nt, Human
uggcacgagucaacgccccc

SEQ ID NO: 1050338 - RNA, 18 nt, Human
uggccggcuccaggccca

SEQ ID NO: 1050339 - RNA, 21 nt, Human
ugggagggguagcagcagcag

SEQ ID NO: 1050340 - RNA, 21 nt, Human
ugggguggggcaggaugcggu

SEQ ID NO: 1050341 - RNA, 18 nt, Human
uguguacagugggugccc

SEQ ID NO: 1050342 - RNA, 21 nt, Human
uucacaaacguagucuagguu

SEQ ID NO: 1050343 - RNA, 19 nt, Human
uucacuggcaccuccuccg

SEQ ID NO: 1050344 - RNA, 23 nt, Human
aaaagggcucugagccucagaca

SEQ ID NO: 1050345 - RNA, 20 nt, Human
aaauaagcaaaauauaauuc

SEQ ID NO: 1050346 - RNA, 22 nt, Human
aaaugguagauaggauaaaaua

SEQ ID NO: 1050347 - RNA, 20 nt, Human
aacaugcuuguagaacagaa

SEQ ID NO: 1050348 - RNA, 19 nt, Human
aagaacccuaaugcuauuu

SEQ ID NO: 1050349 - RNA, 18 nt, Human
aagaagccaaugugggca

SEQ ID NO: 1050350 - RNA, 20 nt, Human
accaagaaaucccacuccaa

SEQ ID NO: 1050351 - RNA, 20 nt, Human
accacagcaaaguuuauuca

SEQ ID NO: 1050352 - RNA, 24 nt, Human
agaaaagaaauauaaauaagcaaa

SEQ ID NO: 1050353 - RNA, 25 nt, Human
agaaaagaaauauaaauaagcaaaa

SEQ ID NO: 1050354 - RNA, 18 nt, Human
aggguacgauggcugaag

SEQ ID NO: 1050355 - RNA, 21 nt, Human
agguugguauauuugcaguug

SEQ ID NO: 1050356 - RNA, 19 nt, Human
aguucaauggaaaaugugc

SEQ ID NO: 1050357 - RNA, 21 nt, Human
auuuaucugccuuugaacugg

SEQ ID NO: 1050358 - RNA, 18 nt, Human
caaacaacaucuaaucua

SEQ ID NO: 1050359 - RNA, 22 nt, Human
caauaauacagcuagauaccac

SEQ ID NO: 1050360 - RNA, 19 nt, Human
cacaacaugcuuguagaac

SEQ ID NO: 1050361 - RNA, 22 nt, Human
cacugcauaacaaaugguggau

SEQ ID NO: 1050362 - RNA, 18 nt, Human
cagaagaggguacgaugg

SEQ ID NO: 1050363 - RNA, 20 nt, Human
cagccaggacacauagacag

SEQ ID NO: 1050364 - RNA, 22 nt, Human
cagcgagcccaucaugacgagu

SEQ ID NO: 1050365 - RNA, 18 nt, Human
ccagauauuugguaguga

SEQ ID NO: 1050366 - RNA, 22 nt, Human
ccucugcaggaacacuuggcuc

SEQ ID NO: 1050367 - RNA, 21 nt, Human
ccuggucuccaguuuucugcc

SEQ ID NO: 1050368 - RNA, 24 nt, Human
ccuuacccaaaaauggcucugcag

SEQ ID NO: 1050369 - RNA, 21 nt, Human
cucuauaauuucccccucacu

SEQ ID NO: 1050370 - RNA, 23 nt, Human
cugcugcuucuguacaccuggug

SEQ ID NO: 1050371 - RNA, 18 nt, Human
cuggaagaucuugucugc

SEQ ID NO: 1050372 - RNA, 19 nt, Human
cuuggcucuagaauuuggg

SEQ ID NO: 1050373 - RNA, 26 nt, Human
gaaaaugugcauucuauucagagccc

SEQ ID NO: 1050374 - RNA, 24 nt, Human
gaacagaaauuugggaacacugca

SEQ ID NO: 1050375 - RNA, 19 nt, Human
gaagaagccaaugugggca

SEQ ID NO: 1050376 - RNA, 21 nt, Human
gacauaaagauacauuaauug

SEQ ID NO: 1050377 - RNA, 19 nt, Human
gagccauacuuuagaaaaa

SEQ ID NO: 1050378 - RNA, 21 nt, Human
gcgagcccaucaugacgagug

SEQ ID NO: 1050379 - RNA, 20 nt, Human
gcucuauaauuucccccuca

SEQ ID NO: 1050380 - RNA, 20 nt, Human
ggaaaaugugcauucuauuc

SEQ ID NO: 1050381 - RNA, 20 nt, Human
ggagaagcagaggcuccggg

SEQ ID NO: 1050382 - RNA, 23 nt, Human
ggagaagcagaggcuccgggguc

SEQ ID NO: 1050383 - RNA, 21 nt, Human
ggugcugucugaguaagacag

SEQ ID NO: 1050384 - RNA, 18 nt, Human
uaagaaaugguagauagg

SEQ ID NO: 1050385 - RNA, 23 nt, Human
uaagugaaacauauguuccaaga

SEQ ID NO: 1050386 - RNA, 22 nt, Human
uagacagccucugcaggaacac

SEQ ID NO: 1050387 - RNA, 22 nt, Human
uaucaaaagggcucugagccuc

SEQ ID NO: 1050388 - RNA, 19 nt, Human
uauguuccaagaaaauguu

SEQ ID NO: 1050389 - RNA, 21 nt, Human
ucaaaagggcucugagccuca

SEQ ID NO: 1050390 - RNA, 24 nt, Human
ucagacacaagaucaaugccuucu

SEQ ID NO: 1050391 - RNA, 22 nt, Human
ucagucagaagaggguacgaug

SEQ ID NO: 1050392 - RNA, 23 nt, Human
uccaagaaaauguuuacuaugcc

SEQ ID NO: 1050393 - RNA, 19 nt, Human
uccagauauuugguaguga

SEQ ID NO: 1050394 - RNA, 19 nt, Human
ucucccugcugaucuggaa

SEQ ID NO: 1050395 - RNA, 24 nt, Human
ucugcaggaacacuuggcucuaga

SEQ ID NO: 1050396 - RNA, 18 nt, Human
ucugcaggaguguccuug

SEQ ID NO: 1050397 - RNA, 28 nt, Human
ucugcaggaguguccuuggggcggcggc

SEQ ID NO: 1050398 - RNA, 19 nt, Human
ucuugucugcugcuucugu

SEQ ID NO: 1050399 - RNA, 18 nt, Human
ugaaaauacacaacaaac

SEQ ID NO: 1050400 - RNA, 24 nt, Human
ugaaacauauguuccaagaaaaug

SEQ ID NO: 1050401 - RNA, 20 nt, Human
ugagagggaccuuugugaug

SEQ ID NO: 1050402 - RNA, 20 nt, Human
uggaagaagccaaugugggc

SEQ ID NO: 1050403 - RNA, 20 nt, Human
uggaagaagccaaugugggc

SEQ ID NO: 1050404 - RNA, 21 nt, Human
uguaaguguuccuuacccaaa

SEQ ID NO: 1050405 - RNA, 18 nt, Human
uguccuugggcagccagg

SEQ ID NO: 1050406 - RNA, 21 nt, Human
ugugaugacggguccaucagu

SEQ ID NO: 1050407 - RNA, 24 nt, Human
uguggaagaagccaaugugggcag

SEQ ID NO: 1050408 - RNA, 20 nt, Human
uuccaagaaaauguuuacua

SEQ ID NO: 1050409 - RNA, 21 nt, Human
uuccuuacccaaaaauggcuc

SEQ ID NO: 1050410 - RNA, 26 nt, Human
uuuaagauucuauaugcagaccuuuu

SEQ ID NO: 1050411 - RNA, 24 nt, Human
aaaaaaaaaaaacagcccucagag

SEQ ID NO: 1050412 - RNA, 22 nt, Human
aaaaaaaaaacagcccucagag

SEQ ID NO: 1050413 - RNA, 21 nt, Human
aaaacagcccucagagccuuc

SEQ ID NO: 1050414 - RNA, 23 nt, Human
aaacagcccucagagccuucccg

SEQ ID NO: 1050415 - RNA, 25 nt, Human
aacugcuuuuccaacaaacucaaac

SEQ ID NO: 1050416 - RNA, 22 nt, Human
aagugcugagguugggagugcc

SEQ ID NO: 1050417 - RNA, 25 nt, Human
acaucaaaaaaaaaaaacagcccuc

SEQ ID NO: 1050418 - RNA, 20 nt, Human
acgcgugugacccuacggaa

SEQ ID NO: 1050419 - RNA, 19 nt, Human
agcaggguggagcccgugg

SEQ ID NO: 1050420 - RNA, 20 nt, Human
aggaaauagaggguuuaagg

SEQ ID NO: 1050421 - RNA, 21 nt, Human
auccacacucuuaaauauccu

SEQ ID NO: 1050422 - RNA, 18 nt, Human
auggcaugggagggcuug

SEQ ID NO: 1050423 - RNA, 22 nt, Human
auggcaugggagggcuuguuuc

SEQ ID NO: 1050424 - RNA, 22 nt, Human
caaaaaaaaaaaacagcccuca

SEQ ID NO: 1050425 - RNA, 23 nt, Human
caacaaacucaaaccccuugaaa

SEQ ID NO: 1050426 - RNA, 23 nt, Human
cacacaacaucaacuacugcagg

SEQ ID NO: 1050427 - RNA, 23 nt, Human
cagcggcgcgcccgccccugggc

SEQ ID NO: 1050428 - RNA, 26 nt, Human
cagcuaaaucccucugugaggaaguc

SEQ ID NO: 1050429 - RNA, 21 nt, Human
ccacggggacauggcauggga

SEQ ID NO: 1050430 - RNA, 21 nt, Human
cccccaguuaacugcuuuucc

SEQ ID NO: 1050431 - RNA, 20 nt, Human
ccccuugaaaaggugcuaag

SEQ ID NO: 1050432 - RNA, 19 nt, Human
ccuuaucuauaacugucca

SEQ ID NO: 1050433 - RNA, 22 nt, Human
cgauuauuuuuccaccucuuca

SEQ ID NO: 1050434 - RNA, 20 nt, Human
cgcccgcgccgcucgcccgc

SEQ ID NO: 1050435 - RNA, 21 nt, Human
cuaaaauccuuuacagcacac

SEQ ID NO: 1050436 - RNA, 18 nt, Human
cuccggccgcccgcgccg

SEQ ID NO: 1050437 - RNA, 22 nt, Human
cucugcgcggggaaggcccccc

SEQ ID NO: 1050438 - RNA, 24 nt, Human
cuggugguggccauggccgggccu

SEQ ID NO: 1050439 - RNA, 22 nt, Human
cuguuaacaucaaaaaaaaaaa

SEQ ID NO: 1050440 - RNA, 23 nt, Human
cuucauccuuccgaaacauccca

SEQ ID NO: 1050441 - RNA, 18 nt, Human
gacaagugcugagguugg

SEQ ID NO: 1050442 - RNA, 18 nt, Human
gcaacauacauucagcaa

SEQ ID NO: 1050443 - RNA, 19 nt, Human
gcggcgcgcccgccccugg

SEQ ID NO: 1050444 - RNA, 19 nt, Human
gcugaggggcugcagcagg

SEQ ID NO: 1050445 - RNA, 22 nt, Human
gcugaggggcugcagcagggug

SEQ ID NO: 1050446 - RNA, 20 nt, Human
gcuggugguggccauggccg

SEQ ID NO: 1050447 - RNA, 24 nt, Human
ggaaauuccuuaucuauaacuguc

SEQ ID NO: 1050448 - RNA, 20 nt, Human
ggaugcagcggcgcgcccgc

SEQ ID NO: 1050449 - RNA, 21 nt, Human
ggcugcagcaggguggagccc

SEQ ID NO: 1050450 - RNA, 23 nt, Human
gggcugcagcaggguggagcccg

SEQ ID NO: 1050451 - RNA, 19 nt, Human
gguggagcccguggugcug

SEQ ID NO: 1050452 - RNA, 23 nt, Human
ucggagcucugcgcggggaaggc

SEQ ID NO: 1050453 - RNA, 21 nt, Human
ugaaaaggugcuaagauuggu

SEQ ID NO: 1050454 - RNA, 22 nt, Human
ugcugaggggcugcagcagggu

SEQ ID NO: 1050455 - RNA, 23 nt, Human
ugcugaggggcugcagcagggug

SEQ ID NO: 1050456 - RNA, 24 nt, Human
ugcugaggggcugcagcagggugg

SEQ ID NO: 1050457 - RNA, 21 nt, Human
uggagcccguggugcuggugg

SEQ ID NO: 1050458 - RNA, 22 nt, Human
uggcaugggagggcuuguuuca

SEQ ID NO: 1050459 - RNA, 21 nt, Human
uguuaacaucaaaaaaaaaaa

SEQ ID NO: 1050460 - RNA, 23 nt, Human
uguuaacaucaaaaaaaaaaaac

SEQ ID NO: 1050461 - RNA, 21 nt, Human
uuauugcauuuuaaaaauauc

SEQ ID NO: 1050462 - RNA, 23 nt, Human
uucagcaacagggcacgcgugug

SEQ ID NO: 1050463 - RNA, 22 nt, Human
uugaaaaggugcuaagauuggu

SEQ ID NO: 1050464 - RNA, 21 nt, Human
uugcugaggggcugcagcagg

SEQ ID NO: 1050465 - RNA, 23 nt, Human
uuuaggaaauagaggguuuaagg

SEQ ID NO: 1050466 - RNA, 19 nt, Human
uagauaacaagcagauuug

SEQ ID NO: 1050467 - RNA, 24 nt, Human
aaaacccgcccagaaucucuacuu

SEQ ID NO: 1050468 - RNA, 19 nt, Human
aaacaaaugcuguccucca

SEQ ID NO: 1050469 - RNA, 19 nt, Human
aaccuuuucagaggagcug

SEQ ID NO: 1050470 - RNA, 20 nt, Human
aagcacugagauugagucug

SEQ ID NO: 1050471 - RNA, 19 nt, Human
aaguuuucccgcccagccu

SEQ ID NO: 1050472 - RNA, 19 nt, Human
acaaagagcugcugccucu

SEQ ID NO: 1050473 - RNA, 23 nt, Human
acacagaaagcuccugacucagc

SEQ ID NO: 1050474 - RNA, 22 nt, Human
accccaugcucuggcaaaacca

SEQ ID NO: 1050475 - RNA, 20 nt, Human
accuggcccgcucuuccugg

SEQ ID NO: 1050476 - RNA, 22 nt, Human
acgcugagcuccugggccggag

SEQ ID NO: 1050477 - RNA, 18 nt, Human
acucccguccaagcacuc

SEQ ID NO: 1050478 - RNA, 20 nt, Human
agaaacugggucuuaucuuu

SEQ ID NO: 1050479 - RNA, 23 nt, Human
agaggauuugcauuugcagcagg

SEQ ID NO: 1050480 - RNA, 22 nt, Human
agcagacacuaauggccagcca

SEQ ID NO: 1050481 - RNA, 19 nt, Human
agccaccaccugcaccuug

SEQ ID NO: 1050482 - RNA, 22 nt, Human
agcuguuucucgucgaugcugg

SEQ ID NO: 1050483 - RNA, 19 nt, Human
aggaauccuagacauaacc

SEQ ID NO: 1050484 - RNA, 21 nt, Human
aggauuugcauuugcagcagg

SEQ ID NO: 1050485 - RNA, 28 nt, Human
aggccguggccaggccagccacggagga

SEQ ID NO: 1050486 - RNA, 21 nt, Human
aggggcacgaaggacugaguc

SEQ ID NO: 1050487 - RNA, 22 nt, Human
auagaacccuccucugaucuua

SEQ ID NO: 1050488 - RNA, 18 nt, Human
auagaaccuuguucucuc

SEQ ID NO: 1050489 - RNA, 27 nt, Human
auagaaccuuguucucucucuacugag

SEQ ID NO: 1050490 - RNA, 23 nt, Human
auggggcuggcuuuacgggaagc

SEQ ID NO: 1050491 - RNA, 21 nt, Human
caaaucgcaagucgcagcuga

SEQ ID NO: 1050492 - RNA, 22 nt, Human
caccgccugccucucagaagaa

SEQ ID NO: 1050493 - RNA, 22 nt, Human
caccugcaccuugugcucuucc

SEQ ID NO: 1050494 - RNA, 18 nt, Human
cacugggcagccuugucu

SEQ ID NO: 1050495 - RNA, 19 nt, Human
cagaaagcuccugacucag

SEQ ID NO: 1050496 - RNA, 23 nt, Human
cagaagaaucuccucuucugcga

SEQ ID NO: 1050497 - RNA, 19 nt, Human
cagccuucacaaggaguug

SEQ ID NO: 1050498 - RNA, 19 nt, Human
caggagcccacgucacacc

SEQ ID NO: 1050499 - RNA, 20 nt, Human
cagguggaaaaggaucaacg

SEQ ID NO: 1050500 - RNA, 18 nt, Human
ccacacccucugcugccu

SEQ ID NO: 1050501 - RNA, 23 nt, Human
ccacuucgagcucucugggggag

SEQ ID NO: 1050502 - RNA, 18 nt, Human
ccaugguuagagccgagc

SEQ ID NO: 1050503 - RNA, 21 nt, Human
ccauuugccacccgucacucc

SEQ ID NO: 1050504 - RNA, 18 nt, Human
cccaggccggggauggag

SEQ ID NO: 1050505 - RNA, 23 nt, Human
cccagugaugaccacaagguacc

SEQ ID NO: 1050506 - RNA, 21 nt, Human
ccccagcuauguggauauucc

SEQ ID NO: 1050507 - RNA, 21 nt, Human
ccccaggcugcugggaacccc

SEQ ID NO: 1050508 - RNA, 24 nt, Human
cccccauucuggguaccacacuca

SEQ ID NO: 1050509 - RNA, 23 nt, Human
cccgcccagaaucucuacuucca

SEQ ID NO: 1050510 - RNA, 21 nt, Human
cccuuuuccucuuucucucuc

SEQ ID NO: 1050511 - RNA, 25 nt, Human
ccggaguccgagacucagccgaguc

SEQ ID NO: 1050512 - RNA, 19 nt, Human
ccucucagaagaaucuccu

SEQ ID NO: 1050513 - RNA, 21 nt, Human
ccugcaggaguucugugggag

SEQ ID NO: 1050514 - RNA, 19 nt, Human
ccugggccggaguccgaga

SEQ ID NO: 1050515 - RNA, 23 nt, Human
ccuuaguuugguuuccucuuugg

SEQ ID NO: 1050516 - RNA, 19 nt, Human
ccuucccuuuuccucuuuc

SEQ ID NO: 1050517 - RNA, 19 nt, Human
ccuuucuucccacucuccu

SEQ ID NO: 1050518 - RNA, 24 nt, Human
cgagccaccaccugcaccuugugc

SEQ ID NO: 1050519 - RNA, 19 nt, Human
cgauguaacagccuucaca

SEQ ID NO: 1050520 - RNA, 18 nt, Human
cgggaagcaggcaggugg

SEQ ID NO: 1050521 - RNA, 21 nt, Human
cgggaugaagugccagcccag

SEQ ID NO: 1050522 - RNA, 18 nt, Human
cgggggugggcacugggc

SEQ ID NO: 1050523 - RNA, 19 nt, Human
cucaggagaugaacauacc

SEQ ID NO: 1050524 - RNA, 22 nt, Human
cuccacacccucugcugccugu

SEQ ID NO: 1050525 - RNA, 18 nt, Human
cuccaggucugcggucug

SEQ ID NO: 1050526 - RNA, 19 nt, Human
cucguagcucccaggggcu

SEQ ID NO: 1050527 - RNA, 23 nt, Human
cucugcgcugcaccgccugccuc

SEQ ID NO: 1050528 - RNA, 25 nt, Human
cucugcuccuuucuucccacucucc

SEQ ID NO: 1050529 - RNA, 19 nt, Human
cugaccugucugccaaaac

SEQ ID NO: 1050530 - RNA, 19 nt, Human
cugccaaaacccgcccaga

SEQ ID NO: 1050531 - RNA, 21 nt, Human
cugccgagccaccaccugcac

SEQ ID NO: 1050532 - RNA, 18 nt, Human
cugcugccucuccccuug

SEQ ID NO: 1050533 - RNA, 19 nt, Human
cugcugcuguggcugcugc

SEQ ID NO: 1050534 - RNA, 19 nt, Human
cuggaaagcucccuguguc

SEQ ID NO: 1050535 - RNA, 18 nt, Human
cugggugaccuguggggc

SEQ ID NO: 1050536 - RNA, 22 nt, Human
cuggugaggacaauggggcugg

SEQ ID NO: 1050537 - RNA, 20 nt, Human
cugugugcaugcuccuugcc

SEQ ID NO: 1050538 - RNA, 23 nt, Human
cuuuuccucuuucucucucucug

SEQ ID NO: 1050539 - RNA, 18 nt, Human
gaaccugagagcugagcg

SEQ ID NO: 1050540 - RNA, 24 nt, Human
gaagcagacacuaauggccagcca

SEQ ID NO: 1050541 - RNA, 19 nt, Human
gcaagcacugagauugagu

SEQ ID NO: 1050542 - RNA, 18 nt, Human
gcagcaggcucuggccuc

SEQ ID NO: 1050543 - RNA, 23 nt, Human
gcccagaaucucuacuuccacac

SEQ ID NO: 1050544 - RNA, 21 nt, Human
gcccugcggcucugccagggg

SEQ ID NO: 1050545 - RNA, 18 nt, Human
gcuccugggccggagucc

SEQ ID NO: 1050546 - RNA, 20 nt, Human
gcugaggaggagcuggaccc

SEQ ID NO: 1050547 - RNA, 22 nt, Human
gcugggaaccccaugcucuggc

SEQ ID NO: 1050548 - RNA, 19 nt, Human
ggacaaagagcugcugccu

SEQ ID NO: 1050549 - RNA, 22 nt, Human
ggagauggcugaauucugggcc

SEQ ID NO: 1050550 - RNA, 18 nt, Human
ggagcuggggaagagggc

SEQ ID NO: 1050551 - RNA, 20 nt, Human
ggaggaaccugagagcugag

SEQ ID NO: 1050552 - RNA, 23 nt, Human
ggaugguggguguuaagcuuguu

SEQ ID NO: 1050553 - RNA, 19 nt, Human
ggcugcucgcacugacauu

SEQ ID NO: 1050554 - RNA, 24 nt, Human
gggauggagcccugcggcucugcc

SEQ ID NO: 1050555 - RNA, 20 nt, Human
gggcagccuugucugacucu

SEQ ID NO: 1050556 - RNA, 18 nt, Human
gggccucaucaccaccug

SEQ ID NO: 1050557 - RNA, 22 nt, Human
guagaagacagauuuauucuga

SEQ ID NO: 1050558 - RNA, 21 nt, Human
gucagcagagcccguguuacu

SEQ ID NO: 1050559 - RNA, 23 nt, Human
gugaggacaauggggcuggcuuu

SEQ ID NO: 1050560 - RNA, 20 nt, Human
guggcugcugcauagccugc

SEQ ID NO: 1050561 - RNA, 20 nt, Human
guggcugggccacuucgagc

SEQ ID NO: 1050562 - RNA, 20 nt, Human
gugggagcgaggaggcuggg

SEQ ID NO: 1050563 - RNA, 19 nt, Human
uaccagaacuaaagaccaa

SEQ ID NO: 1050564 - RNA, 21 nt, Human
uaccugagcuggugcaaggac

SEQ ID NO: 1050565 - RNA, 18 nt, Human
uaguuugguuuccucuuu

SEQ ID NO: 1050566 - RNA, 19 nt, Human
ucacaaggaguuggcacuu

SEQ ID NO: 1050567 - RNA, 22 nt, Human
ucagcagagcccguguuacuga

SEQ ID NO: 1050568 - RNA, 18 nt, Human
ucaggcacugcugcagcu

SEQ ID NO: 1050569 - RNA, 25 nt, Human
ucauauucuucauccucgggcagaa

SEQ ID NO: 1050570 - RNA, 21 nt, Human
uccaggguggcaagcacugag

SEQ ID NO: 1050571 - RNA, 21 nt, Human
ucccaggggcucugaacaccc

SEQ ID NO: 1050572 - RNA, 23 nt, Human
ucccaggggcucugaacacccag

SEQ ID NO: 1050573 - RNA, 22 nt, Human
uccccuugucuggaaagcuccc

SEQ ID NO: 1050574 - RNA, 21 nt, Human
ucccugugucugcaggcugag

SEQ ID NO: 1050575 - RNA, 21 nt, Human
ucuccacacccucugcugccu

SEQ ID NO: 1050576 - RNA, 25 nt, Human
ucuccacacccucugcugccuguca

SEQ ID NO: 1050577 - RNA, 21 nt, Human
ucucuccagccuuaguuuggu

SEQ ID NO: 1050578 - RNA, 22 nt, Human
ucucugggggagaggauuugca

SEQ ID NO: 1050579 - RNA, 24 nt, Human
ucugaccugucugccaaaacccgc

SEQ ID NO: 1050580 - RNA, 19 nt, Human
ucugccaaaacccgcccag

SEQ ID NO: 1050581 - RNA, 24 nt, Human
ucuggaaaacgucaccaaggcugg

SEQ ID NO: 1050582 - RNA, 22 nt, Human
ucugucaaagggcauggccacu

SEQ ID NO: 1050583 - RNA, 21 nt, Human
ucugugggaggaacucaggag

SEQ ID NO: 1050584 - RNA, 21 nt, Human
ucuuccaagauggaauuccgg

SEQ ID NO: 1050585 - RNA, 18 nt, Human
ucuugcugacuaggguug

SEQ ID NO: 1050586 - RNA, 23 nt, Human
ucuuucucucucucugcuccuuu

SEQ ID NO: 1050587 - RNA, 26 nt, Human
ugaacagucacccccagcuaugugga

SEQ ID NO: 1050588 - RNA, 18 nt, Human
ugagauauuucagacacc

SEQ ID NO: 1050589 - RNA, 21 nt, Human
ugagcuccugggccggagucc

SEQ ID NO: 1050590 - RNA, 23 nt, Human
ugaggacaauggggcuggcuuua

SEQ ID NO: 1050591 - RNA, 23 nt, Human
ugagggggcugcacgcgcagcau

SEQ ID NO: 1050592 - RNA, 21 nt, Human
ugaggugcuuguaauaucuug

SEQ ID NO: 1050593 - RNA, 21 nt, Human
ugccagggggaugcucccucc

SEQ ID NO: 1050594 - RNA, 26 nt, Human
ugccccagacacucccguccaagcac

SEQ ID NO: 1050595 - RNA, 20 nt, Human
ugcccgugaacgcugagcuc

SEQ ID NO: 1050596 - RNA, 23 nt, Human
ugccgagccaccaccugcaccuu

SEQ ID NO: 1050597 - RNA, 20 nt, Human
ugccucaacaagguacuugc

SEQ ID NO: 1050598 - RNA, 18 nt, Human
ugccucaagcagaaaaca

SEQ ID NO: 1050599 - RNA, 22 nt, Human
ugcggucugccgagccaccacc

SEQ ID NO: 1050600 - RNA, 27 nt, Human
uggaaagcucccugugucgugagacca

SEQ ID NO: 1050601 - RNA, 19 nt, Human
uggaauagaaccuuguucu

SEQ ID NO: 1050602 - RNA, 21 nt, Human
uggaauuccgggggugggcac

SEQ ID NO: 1050603 - RNA, 26 nt, Human
uggacacuugagauccuuuguagccc

SEQ ID NO: 1050604 - RNA, 23 nt, Human
uggaggggaggaacaucuccuga

SEQ ID NO: 1050605 - RNA, 21 nt, Human
uggcacugggacuuuucuauc

SEQ ID NO: 1050606 - RNA, 22 nt, Human
uggcaggcacacucucugcuca

SEQ ID NO: 1050607 - RNA, 23 nt, Human
uggccuccuggguguggcccggg

SEQ ID NO: 1050608 - RNA, 23 nt, Human
uggccuccuggguguggcccucc

SEQ ID NO: 1050609 - RNA, 18 nt, Human
ugggagcgaggaggcugg

SEQ ID NO: 1050610 - RNA, 21 nt, Human
ugggaggaacucaggagccca

SEQ ID NO: 1050611 - RNA, 18 nt, Human
ugggcuaagucauacacu

SEQ ID NO: 1050612 - RNA, 20 nt, Human
uggggccucaucaccaccug

SEQ ID NO: 1050613 - RNA, 24 nt, Human
uguaauaucuugcccugcugcaga

SEQ ID NO: 1050614 - RNA, 19 nt, Human
ugugcggaugagcauaaag

SEQ ID NO: 1050615 - RNA, 23 nt, Human
ugugugcagggcugaggaggagc

SEQ ID NO: 1050616 - RNA, 22 nt, Human
uuagagccgagccaucugcugc

SEQ ID NO: 1050617 - RNA, 19 nt, Human
uucauuggcaauucgcugg

SEQ ID NO: 1050618 - RNA, 19 nt, Human
uucccccuucccuuuuccu

SEQ ID NO: 1050619 - RNA, 24 nt, Human
uucugggcccacaagcgaaggcuc

SEQ ID NO: 1050620 - RNA, 23 nt, Human
uugcaauccaugggaaggaggcu

SEQ ID NO: 1050621 - RNA, 21 nt, Human
uugcagcaggcucuggccucc

SEQ ID NO: 1050622 - RNA, 18 nt, Human
aaaacaaaacaaccccaa

SEQ ID NO: 1050623 - RNA, 19 nt, Human
aaaacaaaacaaccccaaa

SEQ ID NO: 1050624 - RNA, 24 nt, Human
aaaacaaaacaaccccaaaacaaa

SEQ ID NO: 1050625 - RNA, 24 nt, Human
aaaacaaccccaaaacaaaacuaa

SEQ ID NO: 1050626 - RNA, 20 nt, Human
aaacaaaacaaccccaaaac

SEQ ID NO: 1050627 - RNA, 26 nt, Human
aaacaaaacuaaauaaaacuccccaa

SEQ ID NO: 1050628 - RNA, 18 nt, Human
aaacaaccccaaaacaaa

SEQ ID NO: 1050629 - RNA, 23 nt, Human
aaacaaccccaaaacaaaacuaa

SEQ ID NO: 1050630 - RNA, 25 nt, Human
aaacaaccccaaaacaaaacuaaau

SEQ ID NO: 1050631 - RNA, 28 nt, Human
aaacaaccccaaaacaaaagggaacgcc

SEQ ID NO: 1050632 - RNA, 20 nt, Human
aaagaacauuccgcaccccc

SEQ ID NO: 1050633 - RNA, 20 nt, Human
aaagaagcugaaaagaacau

SEQ ID NO: 1050634 - RNA, 22 nt, Human
aacaaaacaaccccaaaacaag

SEQ ID NO: 1050635 - RNA, 22 nt, Human
aacuucgaucagguuaccaaaa

SEQ ID NO: 1050636 - RNA, 19 nt, Human
aagaacauuccgcaccccc

SEQ ID NO: 1050637 - RNA, 18 nt, Human
aaguggaauugcugaguc

SEQ ID NO: 1050638 - RNA, 19 nt, Human
acaaaaaacccugcccucu

SEQ ID NO: 1050639 - RNA, 18 nt, Human
acaaaacaaccccaaaac

SEQ ID NO: 1050640 - RNA, 23 nt, Human
acaaaacaaccccaaaacaaaac

SEQ ID NO: 1050641 - RNA, 22 nt, Human
accccaaccgcuaucuacauaa

SEQ ID NO: 1050642 - RNA, 23 nt, Human
acccgaaugcaggagccucacug

SEQ ID NO: 1050643 - RNA, 18 nt, Human
acucauuucauuucccca

SEQ ID NO: 1050644 - RNA, 18 nt, Human
agccucacugcucuuugc

SEQ ID NO: 1050645 - RNA, 21 nt, Human
aggagguccaucagaucuagg

SEQ ID NO: 1050646 - RNA, 18 nt, Human
agucucaccccauucaga

SEQ ID NO: 1050647 - RNA, 28 nt, Human
caaaacaaaacaaccccaaaacaaaacu

SEQ ID NO: 1050648 - RNA, 21 nt, Human
caaaacaaaacuaaauaaaac

SEQ ID NO: 1050649 - RNA, 23 nt, Human
caaaacaaccccaaaacaaaacu

SEQ ID NO: 1050650 - RNA, 25 nt, Human
caaaacaaccccaaaacaaaacuaa

SEQ ID NO: 1050651 - RNA, 26 nt, Human
caaaacaaccccaaaacaaaacuaaa

SEQ ID NO: 1050652 - RNA, 22 nt, Human
caaagcucggcuuuagacacuc

SEQ ID NO: 1050653 - RNA, 23 nt, Human
caaauugcauaaauuguugcuga

SEQ ID NO: 1050654 - RNA, 24 nt, Human
caacugugauccagagcuuccucc

SEQ ID NO: 1050655 - RNA, 25 nt, Human
cacccccccgaccccaaccgcuauc

SEQ ID NO: 1050656 - RNA, 19 nt, Human
cacuacuccuguccccugc

SEQ ID NO: 1050657 - RNA, 19 nt, Human
cacugcucuuugcuucugc

SEQ ID NO: 1050658 - RNA, 25 nt, Human
cagagcuuccuccaaauugcauaaa

SEQ ID NO: 1050659 - RNA, 26 nt, Human
caguagcuuguuuugugugacuuucu

SEQ ID NO: 1050660 - RNA, 19 nt, Human
cauagugcagcuucagggc

SEQ ID NO: 1050661 - RNA, 22 nt, Human
ccaaaacaaaacuaaauaaaac

SEQ ID NO: 1050662 - RNA, 18 nt, Human
ccaaacaaaaaacccugc

SEQ ID NO: 1050663 - RNA, 19 nt, Human
ccaaacaaaaaacccugcc

SEQ ID NO: 1050664 - RNA, 21 nt, Human
ccaagcgguugagccaauuug

SEQ ID NO: 1050665 - RNA, 22 nt, Human
ccacccgaaugcaggagccuca

SEQ ID NO: 1050666 - RNA, 26 nt, Human
ccagagcuuccuccaaauugcauaaa

SEQ ID NO: 1050667 - RNA, 24 nt, Human
cccaaaacaaaacuaaauaaaacu

SEQ ID NO: 1050668 - RNA, 20 nt, Human
cccccccgaccccaaccgcu

SEQ ID NO: 1050669 - RNA, 24 nt, Human
cccccccgaccccaaccgcuaucu

SEQ ID NO: 1050670 - RNA, 18 nt, Human
ccccugccaaaacaaaac

SEQ ID NO: 1050671 - RNA, 22 nt, Human
cccugccaaaacaaaacaaccc

SEQ ID NO: 1050672 - RNA, 22 nt, Human
ccuguccccugccaaaacaaaa

SEQ ID NO: 1050673 - RNA, 22 nt, Human
cgcacccccccgaccccaaccg

SEQ ID NO: 1050674 - RNA, 20 nt, Human
cuaagacaucuuucugugcu

SEQ ID NO: 1050675 - RNA, 21 nt, Human
cuacugagcugaaugccgcau

SEQ ID NO: 1050676 - RNA, 24 nt, Human
cuccaaauugcauaaauuguugcu

SEQ ID NO: 1050677 - RNA, 23 nt, Human
cuccuguccccugccaaaacaaa

SEQ ID NO: 1050678 - RNA, 25 nt, Human
gaacauucugaguuuuaaaagauuc

SEQ ID NO: 1050679 - RNA, 19 nt, Human
gagccucacugcucuuugc

SEQ ID NO: 1050680 - RNA, 22 nt, Human
gcagcuucagggccacucaaga

SEQ ID NO: 1050681 - RNA, 20 nt, Human
gccaaaacaaaacaacccca

SEQ ID NO: 1050682 - RNA, 19 nt, Human
gccaauuugcaucagcagu

SEQ ID NO: 1050683 - RNA, 18 nt, Human
gccaccgcugcugucuca

SEQ ID NO: 1050684 - RNA, 23 nt, Human
gcugaugugcagaggcuaagaca

SEQ ID NO: 1050685 - RNA, 24 nt, Human
gcugguugcuuuuguucaacauua

SEQ ID NO: 1050686 - RNA, 19 nt, Human
ggaguuucagcaggagcuu

SEQ ID NO: 1050687 - RNA, 24 nt, Human
gguaaacuucgaucagguuaccaa

SEQ ID NO: 1050688 - RNA, 22 nt, Human
gucaccuuugucauucauacuc

SEQ ID NO: 1050689 - RNA, 22 nt, Human
gucugccaccgcugcugucuca

SEQ ID NO: 1050690 - RNA, 18 nt, Human
gugauccagagcuuccuc

SEQ ID NO: 1050691 - RNA, 18 nt, Human
guggucaaagguguuaga

SEQ ID NO: 1050692 - RNA, 22 nt, Human
gugucugccaccgcugcugucu

SEQ ID NO: 1050693 - RNA, 22 nt, Human
guugcugacuuggguuauucca

SEQ ID NO: 1050694 - RNA, 21 nt, Human
uaaaacuccccaaacaaaaaa

SEQ ID NO: 1050695 - RNA, 28 nt, Human
uaacaguagcuuguuuugugugacuggu

SEQ ID NO: 1050696 - RNA, 20 nt, Human
uaacugggaauccuacagca

SEQ ID NO: 1050697 - RNA, 19 nt, Human
uaagggacuuccuugcaau

SEQ ID NO: 1050698 - RNA, 22 nt, Human
uaaguaagugcugauauaauau

SEQ ID NO: 1050699 - RNA, 21 nt, Human
uacuccuguccccugccaaaa

SEQ ID NO: 1050700 - RNA, 21 nt, Human
uaugucaccuuugucauucau

SEQ ID NO: 1050701 - RNA, 22 nt, Human
uaugucaccuuugucauucaua

SEQ ID NO: 1050702 - RNA, 18 nt, Human
ucaaacauuuucccaagc

SEQ ID NO: 1050703 - RNA, 21 nt, Human
ucaaagcucggcuuuagacac

SEQ ID NO: 1050704 - RNA, 23 nt, Human
ucaaagcucggcuuuagacacuc

SEQ ID NO: 1050705 - RNA, 23 nt, Human
ucacacccaagccuuugccggcu

SEQ ID NO: 1050706 - RNA, 24 nt, Human
ucacacugucaccaguacuuggua

SEQ ID NO: 1050707 - RNA, 21 nt, Human
uccacccgaaugcaggagccu

SEQ ID NO: 1050708 - RNA, 21 nt, Human
uccagagcuuccuccaaauug

SEQ ID NO: 1050709 - RNA, 25 nt, Human
uccccaaacaaaaaacccugcccuc

SEQ ID NO: 1050710 - RNA, 21 nt, Human
uccccugccaaaacaaaacaa

SEQ ID NO: 1050711 - RNA, 19 nt, Human
uccgcacccccccgacccc

SEQ ID NO: 1050712 - RNA, 18 nt, Human
ucgaggguauacauaugu

SEQ ID NO: 1050713 - RNA, 21 nt, Human
ucugccaccgcugcugucuca

SEQ ID NO: 1050714 - RNA, 21 nt, Human
ucuuuuaugacuccccuacug

SEQ ID NO: 1050715 - RNA, 18 nt, Human
ucuuuugugaagugcuug

SEQ ID NO: 1050716 - RNA, 18 nt, Human
ugaaucuauccacuacuc

SEQ ID NO: 1050717 - RNA, 18 nt, Human
ugccaaaacaaaacaacc

SEQ ID NO: 1050718 - RNA, 27 nt, Human
ugccaaaacaaaacaaccccaaaacaa

SEQ ID NO: 1050719 - RNA, 22 nt, Human
ugccagcauaacuuuaagucuc

SEQ ID NO: 1050720 - RNA, 23 nt, Human
ugcuuucagcucuuccacagcuu

SEQ ID NO: 1050721 - RNA, 20 nt, Human
uggaaaaaauaacugauaau

SEQ ID NO: 1050722 - RNA, 21 nt, Human
uggaaguacaacaucugucug

SEQ ID NO: 1050723 - RNA, 20 nt, Human
ugguacauauauguacacaa

SEQ ID NO: 1050724 - RNA, 20 nt, Human
uguaguuuuaaugagcaguu

SEQ ID NO: 1050725 - RNA, 22 nt, Human
ugucuggauuugaggcaacugu

SEQ ID NO: 1050726 - RNA, 20 nt, Human
ugugcagaggcuaagacauc

SEQ ID NO: 1050727 - RNA, 19 nt, Human
ugugcugguuaugucaccu

SEQ ID NO: 1050728 - RNA, 20 nt, Human
uuccgcacccccccgacccc

SEQ ID NO: 1050729 - RNA, 24 nt, Human
uuuguuggauauaugcuuagaagu

SEQ ID NO: 1050730 - RNA, 22 nt, Human
aaguaaaugugagggccaagau

SEQ ID NO: 1050731 - RNA, 24 nt, Human
aauuuccacuaccagagccaaaag

SEQ ID NO: 1050732 - RNA, 20 nt, Human
acugauaacagaaaaguaaa

SEQ ID NO: 1050733 - RNA, 24 nt, Human
agaaaaguaaaugugagggccaag

SEQ ID NO: 1050734 - RNA, 28 nt, Human
agggccaagaugaugauugugaaauuuu

SEQ ID NO: 1050735 - RNA, 21 nt, Human
cccuggauaacggaaaaagaa

SEQ ID NO: 1050736 - RNA, 18 nt, Human
gagggccaagaugaugau

SEQ ID NO: 1050737 - RNA, 27 nt, Human
gauaacggaaaaagaaaagggagggcc

SEQ ID NO: 1050738 - RNA, 22 nt, Human
gauaacggaaaaagaaaagucc

SEQ ID NO: 1050739 - RNA, 24 nt, Human
ggcaucugucauaguaacucacgc

SEQ ID NO: 1050740 - RNA, 21 nt, Human
gugagggccaagaugaugauu

SEQ ID NO: 1050741 - RNA, 24 nt, Human
uaaauuguauguucugaaguuacu

SEQ ID NO: 1050742 - RNA, 18 nt, Human
uaacucacgcauuucccu

SEQ ID NO: 1050743 - RNA, 22 nt, Human
uccacuaccagagccaaaaguc

SEQ ID NO: 1050744 - RNA, 24 nt, Human
ucccuggauaacggaaaaagaaaa

SEQ ID NO: 1050745 - RNA, 19 nt, Human
ugucauaguaacucacgca

SEQ ID NO: 1050746 - RNA, 25 nt, Human
uuaauugucuuuuuucucuuuuucc

SEQ ID NO: 1050747 - RNA, 22 nt, Human
acuaaaguacaaaaaagccugg

SEQ ID NO: 1050748 - RNA, 21 nt, Human
caaaaaagccugaacaguaug

SEQ ID NO: 1050749 - RNA, 19 nt, Human
caguaaguuuucuuaaucc

SEQ ID NO: 1050750 - RNA, 20 nt, Human
gaguucccaaacaguaaguu

SEQ ID NO: 1050751 - RNA, 24 nt, Human
gcuuucggaaguccccaaagccag

SEQ ID NO: 1050752 - RNA, 19 nt, Human
uacaaaaaagccugaacag

SEQ ID NO: 1050753 - RNA, 21 nt, Human
uauaucuauguucucaccaaa

SEQ ID NO: 1050754 - RNA, 24 nt, Human
uauauggaguucccaaacaguaag

SEQ ID NO: 1050755 - RNA, 21 nt, Human
ucaacagugaagggcucccuu

SEQ ID NO: 1050756 - RNA, 18 nt, Human
ugacacuaaaguacaaaa

SEQ ID NO: 1050757 - RNA, 27 nt, Human
uuuuuuuuugccuuuuacaaauuuuuu

SEQ ID NO: 1050758 - RNA, 24 nt, Human
uuuuuuuuuuuuuuuuuugccuuu

SEQ ID NO: 1050759 - RNA, 25 nt, Human
uuuuuuuuuuuuuuuuuuugccuuu

SEQ ID NO: 1050760 - RNA, 21 nt, Human
uuuuuuuuuuuuuuuuuuugg

SEQ ID NO: 1050761 - RNA, 20 nt, Human
aacucccgccaaagcagcag

SEQ ID NO: 1050762 - RNA, 23 nt, Human
caaagcagcagcuccgcaaagcc

SEQ ID NO: 1050763 - RNA, 22 nt, Human
ccucacaccagcuuccaacucc

SEQ ID NO: 1050764 - RNA, 21 nt, Human
cucccgccaaagcagcagcuc

SEQ ID NO: 1050765 - RNA, 21 nt, Human
ucccgccaaagcagcagcucc

SEQ ID NO: 1050766 - RNA, 19 nt, Human
uccgcaaagccgccacaag

SEQ ID NO: 1050767 - RNA, 22 nt, Human
uccgcaaagccgccacaaggcg

SEQ ID NO: 1050768 - RNA, 22 nt, Human
aaaccccgucuccaccaaaaaa

SEQ ID NO: 1050769 - RNA, 19 nt, Human
aacacagcgaaaccccguc

SEQ ID NO: 1050770 - RNA, 20 nt, Human
aacacagcgaaaccccgucu

SEQ ID NO: 1050771 - RNA, 21 nt, Human
aacacagcgaaaccccgucuc

SEQ ID NO: 1050772 - RNA, 23 nt, Human
aacucauuacuucccaaaguccc

SEQ ID NO: 1050773 - RNA, 22 nt, Human
aagcacuuuaaagggggggguu

SEQ ID NO: 1050774 - RNA, 21 nt, Human
acacagcgaaaccccgucucc

SEQ ID NO: 1050775 - RNA, 21 nt, Human
acacguagaucaccaguccuc

SEQ ID NO: 1050776 - RNA, 21 nt, Human
agccagcgccgcggccggacg

SEQ ID NO: 1050777 - RNA, 21 nt, Human
aggaauccagcuacccucgcc

SEQ ID NO: 1050778 - RNA, 21 nt, Human
aggccgaggcuggcggaucac

SEQ ID NO: 1050779 - RNA, 21 nt, Human
aggcugaggcaggagaaucag

SEQ ID NO: 1050780 - RNA, 24 nt, Human
agguguggcggcgcgcgccuguaa

SEQ ID NO: 1050781 - RNA, 18 nt, Human
aguaagugaaccagacuc

SEQ ID NO: 1050782 - RNA, 23 nt, Human
agucagguguggcggcgcgcgcc

SEQ ID NO: 1050783 - RNA, 20 nt, Human
aguuuuuacaaaaaugacag

SEQ ID NO: 1050784 - RNA, 21 nt, Human
auuuugggaagaaguucuuua

SEQ ID NO: 1050785 - RNA, 18 nt, Human
caaaauagcauccaaagc

SEQ ID NO: 1050786 - RNA, 23 nt, Human
caaucaacucauuacuucccaaa

SEQ ID NO: 1050787 - RNA, 18 nt, Human
cacucggcaggcugaggc

SEQ ID NO: 1050788 - RNA, 20 nt, Human
cacucggcaggcugaggcag

SEQ ID NO: 1050789 - RNA, 24 nt, Human
cacugcuguaggagcgcccgggcc

SEQ ID NO: 1050790 - RNA, 21 nt, Human
cagcaguacaguccagcuucg

SEQ ID NO: 1050791 - RNA, 21 nt, Human
caggaucucuccacagccgug

SEQ ID NO: 1050792 - RNA, 23 nt, Human
cccggccaacacagcgaaacccc

SEQ ID NO: 1050793 - RNA, 24 nt, Human
cccggccaacacagcgaaaccccg

SEQ ID NO: 1050794 - RNA, 22 nt, Human
cccuugaaaaagcacacguaga

SEQ ID NO: 1050795 - RNA, 21 nt, Human
ccucaaucauuaaaaaaacuc

SEQ ID NO: 1050796 - RNA, 18 nt, Human
ccucgggaggccgaggcu

SEQ ID NO: 1050797 - RNA, 19 nt, Human
ccucgggaggccgaggcug

SEQ ID NO: 1050798 - RNA, 26 nt, Human
ccuguaaucgcaggcacucggcaggc

SEQ ID NO: 1050799 - RNA, 23 nt, Human
cgccuguaaucgcaggcacucgg

SEQ ID NO: 1050800 - RNA, 23 nt, Human
cgcggccggacgguuacuaggcc

SEQ ID NO: 1050801 - RNA, 18 nt, Human
cgcgguuaggagcuggag

SEQ ID NO: 1050802 - RNA, 24 nt, Human
cggcaggcugaggcaggagaauca

SEQ ID NO: 1050803 - RNA, 23 nt, Human
cgucugcaaucccggcaccucgg

SEQ ID NO: 1050804 - RNA, 24 nt, Human
cgucugcaaucccggcaccucggg

SEQ ID NO: 1050805 - RNA, 21 nt, Human
cucaaggucaaucaacucauu

SEQ ID NO: 1050806 - RNA, 24 nt, Human
cuccacagccgugcaggccuagcu

SEQ ID NO: 1050807 - RNA, 23 nt, Human
cucuguugcccaagcuggagugc

SEQ ID NO: 1050808 - RNA, 23 nt, Human
cugcuguaggagcgcccgggccu

SEQ ID NO: 1050809 - RNA, 18 nt, Human
cuguaggagcgcccgggc

SEQ ID NO: 1050810 - RNA, 21 nt, Human
gcagcaguacaguccagcuuc

SEQ ID NO: 1050811 - RNA, 22 nt, Human
gcggccggacgguuacuaggcc

SEQ ID NO: 1050812 - RNA, 31 nt, Human
gcuaugugauuauuuauuuauuuauuuauuu

SEQ ID NO: 1050813 - RNA, 26 nt, Human
gcuggagugcaguaagugaaccaguc

SEQ ID NO: 1050814 - RNA, 18 nt, Human
ggagguugcagugagcca

SEQ ID NO: 1050815 - RNA, 18 nt, Human
ggagguugcagugagcca

SEQ ID NO: 1050816 - RNA, 19 nt, Human
ggagguugcagugagccag

SEQ ID NO: 1050817 - RNA, 25 nt, Human
ggagguugcagugagccagagaugg

SEQ ID NO: 1050818 - RNA, 23 nt, Human
gggaggccgaggcuggcggauca

SEQ ID NO: 1050819 - RNA, 24 nt, Human
gggagguugcagugagccagagau

SEQ ID NO: 1050820 - RNA, 22 nt, Human
uacaaaauagcauccaaagcac

SEQ ID NO: 1050821 - RNA, 19 nt, Human
uagaaauccaucucaacuc

SEQ ID NO: 1050822 - RNA, 21 nt, Human
ucaaucaacucauuacuuccc

SEQ ID NO: 1050823 - RNA, 22 nt, Human
ucagcucccuugaaaaagcaca

SEQ ID NO: 1050824 - RNA, 19 nt, Human
ucaggcagggagguugcag

SEQ ID NO: 1050825 - RNA, 24 nt, Human
ucaggcagggagguugcagugagc

SEQ ID NO: 1050826 - RNA, 21 nt, Human
uccaccaaaaaaauacgaaaa

SEQ ID NO: 1050827 - RNA, 21 nt, Human
ucccaaagucccuguagggug

SEQ ID NO: 1050828 - RNA, 22 nt, Human
ucccuguagggugaauccaucc

SEQ ID NO: 1050829 - RNA, 18 nt, Human
ucgcgguuaggagcugga

SEQ ID NO: 1050830 - RNA, 21 nt, Human
ucuccacagccgugcaggccu

SEQ ID NO: 1050831 - RNA, 24 nt, Human
ucuguugcccaagcuggagugcag

SEQ ID NO: 1050832 - RNA, 23 nt, Human
ucuugcucuguugcccaagcugg

SEQ ID NO: 1050833 - RNA, 24 nt, Human
ucuugcucuguugcccaagcugga

SEQ ID NO: 1050834 - RNA, 22 nt, Human
ugagauggagucuugcucuguu

SEQ ID NO: 1050835 - RNA, 19 nt, Human
ugaggcaggagaaucaggc

SEQ ID NO: 1050836 - RNA, 24 nt, Human
ugcucuguugcccaagcuggagug

SEQ ID NO: 1050837 - RNA, 23 nt, Human
uggcaggugacuaguaucuuuaa

SEQ ID NO: 1050838 - RNA, 22 nt, Human
uuaggagcuggagaccagcccg

SEQ ID NO: 1050839 - RNA, 22 nt, Human
uuauuuauuuauuuauuuauug

SEQ ID NO: 1050840 - RNA, 20 nt, Human
uuccaugacuuauggcaggu

SEQ ID NO: 1050841 - RNA, 19 nt, Human
uugcagugagccagagauc

SEQ ID NO: 1050842 - RNA, 18 nt, Human
uugcccaagcuggagugc

SEQ ID NO: 1050843 - RNA, 22 nt, Human
uuuauuuauugagauggagucu

SEQ ID NO: 1050844 - RNA, 22 nt, Human
augaagaacagcuuuauuaacu

SEQ ID NO: 1050845 - RNA, 22 nt, Human
cuuagucuucucaauguuaaaa

SEQ ID NO: 1050846 - RNA, 18 nt, Human
gaacagcuuuauuaacug

SEQ ID NO: 1050847 - RNA, 24 nt, Human
uagaugaagaacagcuuuauuaac

SEQ ID NO: 1050848 - RNA, 19 nt, Human
ugaaauccauuuauauuug

SEQ ID NO: 1050849 - RNA, 19 nt, Human
uggaaaagugacuguggcg

SEQ ID NO: 1050850 - RNA, 23 nt, Human
uggaaaagugacuguggcgccaa

SEQ ID NO: 1050851 - RNA, 22 nt, Human
uaccuuugucagagcuguccuc

SEQ ID NO: 1050852 - RNA, 19 nt, Human
ucagaaaguaacuggcaaa

SEQ ID NO: 1050853 - RNA, 19 nt, Human
ugcauaccuuugucagagc

SEQ ID NO: 1050854 - RNA, 22 nt, Human
aaaauacaaauugagucauaaa

SEQ ID NO: 1050855 - RNA, 22 nt, Human
aaaggccaccucccaucuuuac

SEQ ID NO: 1050856 - RNA, 22 nt, Human
aagcggcaaaggccaccuccca

SEQ ID NO: 1050857 - RNA, 23 nt, Human
aagcggcaaaggccaccucccau

SEQ ID NO: 1050858 - RNA, 24 nt, Human
aaucuguagacaaauuggagcugg

SEQ ID NO: 1050859 - RNA, 21 nt, Human
acagcacauucuuauaaacag

SEQ ID NO: 1050860 - RNA, 21 nt, Human
agaagauggaaagcggcaaag

SEQ ID NO: 1050861 - RNA, 18 nt, Human
agaguguguacaaaacug

SEQ ID NO: 1050862 - RNA, 18 nt, Human
aucuauucuauggaagag

SEQ ID NO: 1050863 - RNA, 19 nt, Human
caucuuuaccagcagucuc

SEQ ID NO: 1050864 - RNA, 20 nt, Human
cgugaagaaacugcagugag

SEQ ID NO: 1050865 - RNA, 20 nt, Human
uaaaacuauaaaacaaauuu

SEQ ID NO: 1050866 - RNA, 25 nt, Human
uacaaauugagucauaaaacuauaa

SEQ ID NO: 1050867 - RNA, 19 nt, Human
ucuccugauaugaugaagg

SEQ ID NO: 1050868 - RNA, 23 nt, Human
ugagucauaaaacuauaaaacaa

SEQ ID NO: 1050869 - RNA, 18 nt, Human
uggaaagcggcaaaggcc

SEQ ID NO: 1050870 - RNA, 22 nt, Human
uggggaaguaaaaagaauaaau

SEQ ID NO: 1050871 - RNA, 20 nt, Human
aaacuucccacauccaugca

SEQ ID NO: 1050872 - RNA, 21 nt, Human
aauucagugagagaggauuca

SEQ ID NO: 1050873 - RNA, 23 nt, Human
acagcaauguaagcaauggcauc

SEQ ID NO: 1050874 - RNA, 18 nt, Human
acuccuauaaccaagaag

SEQ ID NO: 1050875 - RNA, 22 nt, Human
acuucccacauccaugcacucc

SEQ ID NO: 1050876 - RNA, 26 nt, Human
agaagaaacaucuuggcucugaaaag

SEQ ID NO: 1050877 - RNA, 25 nt, Human
ccuauaaccaagaagcagaagaaac

SEQ ID NO: 1050878 - RNA, 24 nt, Human
cgugacuaaugucaaaaggguaaa

SEQ ID NO: 1050879 - RNA, 19 nt, Human
ggcucugaaaagacuggca

SEQ ID NO: 1050880 - RNA, 23 nt, Human
uacaacaaauagaacagcaaugu

SEQ ID NO: 1050881 - RNA, 20 nt, Human
ucaaagugguaucaaguaga

SEQ ID NO: 1050882 - RNA, 20 nt, Human
uccaugcacuccuauaacca

SEQ ID NO: 1050883 - RNA, 23 nt, Human
aaaaacauuacauuuuagccucc

SEQ ID NO: 1050884 - RNA, 21 nt, Human
aaacaaacacacacuugggaa

SEQ ID NO: 1050885 - RNA, 18 nt, Human
aaacugaccccaaaccac

SEQ ID NO: 1050886 - RNA, 22 nt, Human
aaacugaccccaaaccacaacc

SEQ ID NO: 1050887 - RNA, 22 nt, Human
aaagaggucagcagggaagcac

SEQ ID NO: 1050888 - RNA, 18 nt, Human
aaagauguguacuuauuc

SEQ ID NO: 1050889 - RNA, 18 nt, Human
aaagugcugggauuacaa

SEQ ID NO: 1050890 - RNA, 24 nt, Human
aaagugcugggauuacaagcguga

SEQ ID NO: 1050891 - RNA, 18 nt, Human
aacaaacacacacuuggg

SEQ ID NO: 1050892 - RNA, 19 nt, Human
aagugcugggauuacaagc

SEQ ID NO: 1050893 - RNA, 19 nt, Human
aagugcugggauuacaagc

SEQ ID NO: 1050894 - RNA, 26 nt, Human
aagugcugggauuacaagcgugagcc

SEQ ID NO: 1050895 - RNA, 18 nt, Human
acgggguuucaccauguu

SEQ ID NO: 1050896 - RNA, 19 nt, Human
acgggguuucaccauguua

SEQ ID NO: 1050897 - RNA, 20 nt, Human
acgggguuucaccauguuag

SEQ ID NO: 1050898 - RNA, 24 nt, Human
acgggguuucaccauguuagccag

SEQ ID NO: 1050899 - RNA, 18 nt, Human
acugcaagcuccgccucc

SEQ ID NO: 1050900 - RNA, 22 nt, Human
acuggaugacaaauauaaaaca

SEQ ID NO: 1050901 - RNA, 23 nt, Human
agaaaaaugagacacucccuuau

SEQ ID NO: 1050902 - RNA, 18 nt, Human
agaaagagggaaguagaa

SEQ ID NO: 1050903 - RNA, 22 nt, Human
agaaagagggaaguagaaaaau

SEQ ID NO: 1050904 - RNA, 23 nt, Human
agaaauaagcucaacuccauauu

SEQ ID NO: 1050905 - RNA, 25 nt, Human
aggcuggagugcaguggcgccaucu

SEQ ID NO: 1050906 - RNA, 22 nt, Human
aguagagacgggguuucaccau

SEQ ID NO: 1050907 - RNA, 19 nt, Human
aguagcugggacuacaggc

SEQ ID NO: 1050908 - RNA, 23 nt, Human
aguagcugggacuacaggcacgu

SEQ ID NO: 1050909 - RNA, 23 nt, Human
aguagcugggacuacaggcacgu

SEQ ID NO: 1050910 - RNA, 21 nt, Human
agugcaguggcgccaucucag

SEQ ID NO: 1050911 - RNA, 21 nt, Human
augacaaauauaaaacaaaca

SEQ ID NO: 1050912 - RNA, 22 nt, Human
augacaaauauaaaacaaacac

SEQ ID NO: 1050913 - RNA, 19 nt, Human
augguguuuuccaaaacag

SEQ ID NO: 1050914 - RNA, 20 nt, Human
auucucacagccagcaaggc

SEQ ID NO: 1050915 - RNA, 22 nt, Human
caaaacagaaaauccuccucgc

SEQ ID NO: 1050916 - RNA, 22 nt, Human
caaaauugaugucucaaggcca

SEQ ID NO: 1050917 - RNA, 24 nt, Human
caaagugcugggauuacaagcgug

SEQ ID NO: 1050918 - RNA, 22 nt, Human
cacaacccaauuuacaugcuau

SEQ ID NO: 1050919 - RNA, 24 nt, Human
cacaacccaauuuacaugcuaucu

SEQ ID NO: 1050920 - RNA, 18 nt, Human
caccauguuagccaggau

SEQ ID NO: 1050921 - RNA, 22 nt, Human
caccauguuagccaggaugguc

SEQ ID NO: 1050922 - RNA, 24 nt, Human
caccauguuagccaggauggucuc

SEQ ID NO: 1050923 - RNA, 22 nt, Human
caccgcacccagccagucaaaa

SEQ ID NO: 1050924 - RNA, 22 nt, Human
cacgccauucuccugccucagc

SEQ ID NO: 1050925 - RNA, 18 nt, Human
cagcucacugcaagcucc

SEQ ID NO: 1050926 - RNA, 23 nt, Human
caggaauacuauugccaguugcu

SEQ ID NO: 1050927 - RNA, 22 nt, Human
caggauggucuccaucuccuga

SEQ ID NO: 1050928 - RNA, 23 nt, Human
cauagaaguuucuaauauuuucc

SEQ ID NO: 1050929 - RNA, 22 nt, Human
ccaaagugcugggauuacaagc

SEQ ID NO: 1050930 - RNA, 24 nt, Human
ccaaagugcugggauuacaagcgu

SEQ ID NO: 1050931 - RNA, 20 nt, Human
ccaccacgccuggcuaauuu

SEQ ID NO: 1050932 - RNA, 22 nt, Human
ccagccagucaaaaugucuucu

SEQ ID NO: 1050933 - RNA, 21 nt, Human
ccccaaaccacaacccaauuu

SEQ ID NO: 1050934 - RNA, 24 nt, Human
ccgagggaaaucacccaaacgaac

SEQ ID NO: 1050935 - RNA, 22 nt, Human
ccgcacccagccagucaaaaug

SEQ ID NO: 1050936 - RNA, 26 nt, Human
ccgccugccucagccucccaaagugc

SEQ ID NO: 1050937 - RNA, 24 nt, Human
ccggaguagcugggacuacaggca

SEQ ID NO: 1050938 - RNA, 20 nt, Human
ccuccucgcuacuauuucau

SEQ ID NO: 1050939 - RNA, 21 nt, Human
ccugaccucgugauccgccug

SEQ ID NO: 1050940 - RNA, 24 nt, Human
ccugccucagccucccaaagugcu

SEQ ID NO: 1050941 - RNA, 23 nt, Human
ccugccucagccuccggaguagc

SEQ ID NO: 1050942 - RNA, 19 nt, Human
cgccucccggguucacgcc

SEQ ID NO: 1050943 - RNA, 24 nt, Human
cgugauccgccugccucagccucc

SEQ ID NO: 1050944 - RNA, 18 nt, Human
cucacagccagcaaggca

SEQ ID NO: 1050945 - RNA, 24 nt, Human
cucagccuccggaguagcugggac

SEQ ID NO: 1050946 - RNA, 24 nt, Human
cuccccucauuuuauuuucaggaa

SEQ ID NO: 1050947 - RNA, 21 nt, Human
cucccggguucacgccauucu

SEQ ID NO: 1050948 - RNA, 24 nt, Human
cuccugaccucgugauccgccugc

SEQ ID NO: 1050949 - RNA, 19 nt, Human
cugaaggcuguucggguga

SEQ ID NO: 1050950 - RNA, 24 nt, Human
cugccucagccucccaaagugcug

SEQ ID NO: 1050951 - RNA, 23 nt, Human
cugccucagccuccggaguagcu

SEQ ID NO: 1050952 - RNA, 24 nt, Human
cuugcucuguugccuaggcuggag

SEQ ID NO: 1050953 - RNA, 21 nt, Human
gaagcaccugaaggcuguucg

SEQ ID NO: 1050954 - RNA, 18 nt, Human
gaaggaaauacguugcaa

SEQ ID NO: 1050955 - RNA, 22 nt, Human
gaccucgugauccgccugccuc

SEQ ID NO: 1050956 - RNA, 24 nt, Human
gaccucgugauccgccugccucag

SEQ ID NO: 1050957 - RNA, 21 nt, Human
gagacggagucuugcucuguu

SEQ ID NO: 1050958 - RNA, 24 nt, Human
gagacgggguuucaccauguuagc

SEQ ID NO: 1050959 - RNA, 18 nt, Human
gaguguccauuauuuugu

SEQ ID NO: 1050960 - RNA, 22 nt, Human
gaugacaaauauaaaacaaaca

SEQ ID NO: 1050961 - RNA, 18 nt, Human
gauuacaagcgugagcca

SEQ ID NO: 1050962 - RNA, 25 nt, Human
gccucccggguucacgccauucucc

SEQ ID NO: 1050963 - RNA, 23 nt, Human
gccuggcuaauuuuuuguauuuu

SEQ ID NO: 1050964 - RNA, 20 nt, Human
gcuggagugcaguggcgcca

SEQ ID NO: 1050965 - RNA, 21 nt, Human
gcugggauuacaagcgugagc

SEQ ID NO: 1050966 - RNA, 18 nt, Human
ggacaggaaauugaguga

SEQ ID NO: 1050967 - RNA, 23 nt, Human
gggguuucaccauguuagccagg

SEQ ID NO: 1050968 - RNA, 22 nt, Human
ggguuucaccauguuagccagg

SEQ ID NO: 1050969 - RNA, 20 nt, Human
ggucuccaucuccugaccuc

SEQ ID NO: 1050970 - RNA, 24 nt, Human
gguuucaccauguuagccaggaug

SEQ ID NO: 1050971 - RNA, 23 nt, Human
guagagacgggguuucaccaugu

SEQ ID NO: 1050972 - RNA, 19 nt, Human
guaguuucuaauauuuucc

SEQ ID NO: 1050973 - RNA, 24 nt, Human
gugauccgccugccucagccuccc

SEQ ID NO: 1050974 - RNA, 24 nt, Human
uaaaacaaacacacacuugggaaa

SEQ ID NO: 1050975 - RNA, 19 nt, Human
uaaagggugggcaauuuaa

SEQ ID NO: 1050976 - RNA, 19 nt, Human
uaacccaaaacaaagcugg

SEQ ID NO: 1050977 - RNA, 20 nt, Human
uaagugucucccucauucuu

SEQ ID NO: 1050978 - RNA, 24 nt, Human
uaauuuuuuguauuuuuaguagag

SEQ ID NO: 1050979 - RNA, 25 nt, Human
uaauuuuuuguauuuuuaguagaga

SEQ ID NO: 1050980 - RNA, 25 nt, Human
uacaagccuuaaguauuacugugca

SEQ ID NO: 1050981 - RNA, 24 nt, Human
uacaagcgugagccaccgcaccca

SEQ ID NO: 1050982 - RNA, 22 nt, Human
uacaggcacgugccaccacgcc

SEQ ID NO: 1050983 - RNA, 22 nt, Human
uagagacgggguuucaccaugu

SEQ ID NO: 1050984 - RNA, 24 nt, Human
uagccaggauggucuccaucuccu

SEQ ID NO: 1050985 - RNA, 19 nt, Human
uaggagcgaccuccaccgc

SEQ ID NO: 1050986 - RNA, 24 nt, Human
uaguagagacgggguuucaccaug

SEQ ID NO: 1050987 - RNA, 26 nt, Human
uaguagagacgggguuucaccauguu

SEQ ID NO: 1050988 - RNA, 21 nt, Human
uauagcaaguguaugaaaaag

SEQ ID NO: 1050989 - RNA, 21 nt, Human
uauccugcuacuuccccuuca

SEQ ID NO: 1050990 - RNA, 27 nt, Human
uaucuaucuaucuuuguuauccacaua

SEQ ID NO: 1050991 - RNA, 20 nt, Human
uauggaaaugcaauggacug

SEQ ID NO: 1050992 - RNA, 24 nt, Human
ucaccauguuagccaggauggucu

SEQ ID NO: 1050993 - RNA, 18 nt, Human
ucacugcaagcuccgccu

SEQ ID NO: 1050994 - RNA, 19 nt, Human
ucacugcaagcuccgccuc

SEQ ID NO: 1050995 - RNA, 24 nt, Human
ucacugcaagcuccgccucccggg

SEQ ID NO: 1050996 - RNA, 23 nt, Human
ucaggaauaauauaaauacugca

SEQ ID NO: 1050997 - RNA, 19 nt, Human
uccaaaugaagaaaaacaa

SEQ ID NO: 1050998 - RNA, 21 nt, Human
uccacauauaaaauucucaca

SEQ ID NO: 1050999 - RNA, 23 nt, Human
uccacauauaaaauucucacagc

SEQ ID NO: 1051000 - RNA, 18 nt, Human
ucccaaagugcugggauu

SEQ ID NO: 1051001 - RNA, 24 nt, Human
ucccaaagugcugggauuacaagc

SEQ ID NO: 1051002 - RNA, 21 nt, Human
ucccggguucacgccauucuc

SEQ ID NO: 1051003 - RNA, 24 nt, Human
ucccggguucacgccauucuccug

SEQ ID NO: 1051004 - RNA, 24 nt, Human
uccggaguagcugggacuacaggc

SEQ ID NO: 1051005 - RNA, 22 nt, Human
ucuaaugguguuuuccaaaaca

SEQ ID NO: 1051006 - RNA, 21 nt, Human
ucucaaaucuuacucucucua

SEQ ID NO: 1051007 - RNA, 24 nt, Human
ucucaaaucuuacucucucuaacc

SEQ ID NO: 1051008 - RNA, 24 nt, Human
ucuccugccucagccuccggagua

SEQ ID NO: 1051009 - RNA, 28 nt, Human
ucugccagaaaguauucuggucccguga

SEQ ID NO: 1051010 - RNA, 24 nt, Human
ucuguugccuaggcuggagugcag

SEQ ID NO: 1051011 - RNA, 20 nt, Human
ucuugcucuguugccuaggc

SEQ ID NO: 1051012 - RNA, 23 nt, Human
ucuugcucuguugccuaggcugg

SEQ ID NO: 1051013 - RNA, 24 nt, Human
ucuugcucuguugccuaggcugga

SEQ ID NO: 1051014 - RNA, 19 nt, Human
ugaccccaaaccacaaccc

SEQ ID NO: 1051015 - RNA, 22 nt, Human
ugcaguggcgccaucucagcuc

SEQ ID NO: 1051016 - RNA, 24 nt, Human
ugccaguugcuuagggaauauucu

SEQ ID NO: 1051017 - RNA, 19 nt, Human
ugccuaggcuggagugcag

SEQ ID NO: 1051018 - RNA, 20 nt, Human
ugccuaggcuggagugcagu

SEQ ID NO: 1051019 - RNA, 22 nt, Human
ugccuaggcuggagugcagugg

SEQ ID NO: 1051020 - RNA, 24 nt, Human
ugccuaggcuggagugcaguggcg

SEQ ID NO: 1051021 - RNA, 24 nt, Human
ugccucagccucccaaagugcugg

SEQ ID NO: 1051022 - RNA, 24 nt, Human
ugccucagccuccggaguagcugg

SEQ ID NO: 1051023 - RNA, 27 nt, Human
ugcugggauuacaagcgugagccaccg

SEQ ID NO: 1051024 - RNA, 18 nt, Human
uggagugcaguggcgcca

SEQ ID NO: 1051025 - RNA, 28 nt, Human
uggagugcaguggcgccauccuagcacg

SEQ ID NO: 1051026 - RNA, 23 nt, Human
uggagugcaguggcgccaucuca

SEQ ID NO: 1051027 - RNA, 28 nt, Human
uggagugcaguggcgccauggcucuagc

SEQ ID NO: 1051028 - RNA, 24 nt, Human
uggcgccaucucagcucacugcaa

SEQ ID NO: 1051029 - RNA, 21 nt, Human
ugggacuacaggcacgugcca

SEQ ID NO: 1051030 - RNA, 22 nt, Human
ugggacuacaggcacgugccac

SEQ ID NO: 1051031 - RNA, 24 nt, Human
ugggacuacaggcacgugccacca

SEQ ID NO: 1051032 - RNA, 19 nt, Human
ugggauuacaagcgugagc

SEQ ID NO: 1051033 - RNA, 21 nt, Human
ugggauuacaagcgugagcca

SEQ ID NO: 1051034 - RNA, 22 nt, Human
ugggauuacaagcgugagccac

SEQ ID NO: 1051035 - RNA, 23 nt, Human
ugggauuacaagcgugagccacc

SEQ ID NO: 1051036 - RNA, 24 nt, Human
ugggauuacaagcgugagccaccg

SEQ ID NO: 1051037 - RNA, 18 nt, Human
ugucucccucauucagau

SEQ ID NO: 1051038 - RNA, 20 nt, Human
uguggucuuuaccaucuguc

SEQ ID NO: 1051039 - RNA, 20 nt, Human
uguugccuaggcuggagugc

SEQ ID NO: 1051040 - RNA, 22 nt, Human
uguuucugcagaggaugggcuu

SEQ ID NO: 1051041 - RNA, 18 nt, Human
uuaguagagacgggguuu

SEQ ID NO: 1051042 - RNA, 22 nt, Human
uuaguagagacgggguuucacc

SEQ ID NO: 1051043 - RNA, 24 nt, Human
uuaguagagacgggguuucaccau

SEQ ID NO: 1051044 - RNA, 20 nt, Human
uuccacauaguaccaacagc

SEQ ID NO: 1051045 - RNA, 24 nt, Human
uucuaaugguguuuuccaaaacag

SEQ ID NO: 1051046 - RNA, 21 nt, Human
uucuggguuaaauaauuaugu

SEQ ID NO: 1051047 - RNA, 24 nt, Human
uugccuaggcuggagugcaguggc

SEQ ID NO: 1051048 - RNA, 24 nt, Human
uugcucuguugccuaggcuggagu

SEQ ID NO: 1051049 - RNA, 23 nt, Human
uuguauuuuuaguagagacgggg

SEQ ID NO: 1051050 - RNA, 19 nt, Human
uuucaccauguuagccagg

SEQ ID NO: 1051051 - RNA, 20 nt, Human
uuucaccauguuagccagga

SEQ ID NO: 1051052 - RNA, 24 nt, Human
uuuuuaguagagacgggguuucac

SEQ ID NO: 1051053 - RNA, 21 nt, Human
uuuuuguauuuuuaguagaga

SEQ ID NO: 1051054 - RNA, 24 nt, Human
uuuuuuguauuuuuaguagagacg

SEQ ID NO: 1051055 - RNA, 25 nt, Human
aaaguuucucuuuuucucccuuguc

SEQ ID NO: 1051056 - RNA, 19 nt, Human
agauaggaaaaggaacuga

SEQ ID NO: 1051057 - RNA, 21 nt, Human
cggcaaaagauaggaaaagga

SEQ ID NO: 1051058 - RNA, 27 nt, Human
cugucaccaaaaggaggauggaaaauc

SEQ ID NO: 1051059 - RNA, 20 nt, Human
ggcaaaagauaggaaaagga

SEQ ID NO: 1051060 - RNA, 21 nt, Human
uacggcaaaagauaggaaaag

SEQ ID NO: 1051061 - RNA, 19 nt, Human
ugcugucaccaaaaggagg

SEQ ID NO: 1051062 - RNA, 22 nt, Human
uggaaugaguuugggauuccuc

SEQ ID NO: 1051063 - RNA, 19 nt, Human
cuucaauaaaguguaguau

SEQ ID NO: 1051064 - RNA, 23 nt, Human
uaccagaugaauuaacgcaggaa

SEQ ID NO: 1051065 - RNA, 18 nt, Human
uaguauagugaauggaug

SEQ ID NO: 1051066 - RNA, 19 nt, Human
uaguauagugaauggaugg

SEQ ID NO: 1051067 - RNA, 24 nt, Human
ugugaaacaaacagauuuauuuga

SEQ ID NO: 1051068 - RNA, 26 nt, Human
agaaaagaaaauaguaauggagagga

SEQ ID NO: 1051069 - RNA, 25 nt, Human
auaguaauggagaggaugaaguuua

SEQ ID NO: 1051070 - RNA, 19 nt, Human
caccacagaaucaaagaug

SEQ ID NO: 1051071 - RNA, 24 nt, Human
gucaccaccaccugagcuucugga

SEQ ID NO: 1051072 - RNA, 23 nt, Human
uacugaaaauacauugaaagaca

SEQ ID NO: 1051073 - RNA, 21 nt, Human
aaaaauaagguuaccaaaggc

SEQ ID NO: 1051074 - RNA, 23 nt, Human
aaaacuaaaauguccacaucccu

SEQ ID NO: 1051075 - RNA, 20 nt, Human
aaacaagaccuccaugagca

SEQ ID NO: 1051076 - RNA, 20 nt, Human
aaacagauggaauuaccaac

SEQ ID NO: 1051077 - RNA, 18 nt, Human
aaacugcagcggcugaac

SEQ ID NO: 1051078 - RNA, 19 nt, Human
aaaggcucaguggucaggu

SEQ ID NO: 1051079 - RNA, 20 nt, Human
aaaugaagaggagcagagcc

SEQ ID NO: 1051080 - RNA, 21 nt, Human
aaauuccauuccuuggcaugg

SEQ ID NO: 1051081 - RNA, 22 nt, Human
aacacucacaaaugcagaggua

SEQ ID NO: 1051082 - RNA, 18 nt, Human
aacacuguucucaaaugu

SEQ ID NO: 1051083 - RNA, 19 nt, Human
aaccaccccccucgcccca

SEQ ID NO: 1051084 - RNA, 24 nt, Human
aaccguuagaaccuacuaauccug

SEQ ID NO: 1051085 - RNA, 26 nt, Human
aaccuacuaauccugccaaccaucca

SEQ ID NO: 1051086 - RNA, 22 nt, Human
aaccuccuccugaaccccaaga

SEQ ID NO: 1051087 - RNA, 18 nt, Human
aacuagauaugauucaga

SEQ ID NO: 1051088 - RNA, 18 nt, Human
aagaccaacccacagagc

SEQ ID NO: 1051089 - RNA, 18 nt, Human
aagacuccagcccucaca

SEQ ID NO: 1051090 - RNA, 21 nt, Human
aagagucugcugcccuucagg

SEQ ID NO: 1051091 - RNA, 20 nt, Human
aagccacaccccugccaccu

SEQ ID NO: 1051092 - RNA, 23 nt, Human
aaugcucagccgccagcacagau

SEQ ID NO: 1051093 - RNA, 24 nt, Human
acacaaaaagcaaauuucucagaa

SEQ ID NO: 1051094 - RNA, 19 nt, Human
acaccccugccaccugcug

SEQ ID NO: 1051095 - RNA, 27 nt, Human
acacuaccauaaucuuucaugaugagc

SEQ ID NO: 1051096 - RNA, 19 nt, Human
acagggacucaugggcaca

SEQ ID NO: 1051097 - RNA, 19 nt, Human
acagucagugccaaagaaa

SEQ ID NO: 1051098 - RNA, 22 nt, Human
acaucccuaacuggcaacccac

SEQ ID NO: 1051099 - RNA, 22 nt, Human
acccaaauaggccacauacccc

SEQ ID NO: 1051100 - RNA, 18 nt, Human
acccaccucaagccacac

SEQ ID NO: 1051101 - RNA, 19 nt, Human
acccaggccuuacaucccc

SEQ ID NO: 1051102 - RNA, 20 nt, Human
acucuggcccucacagagcg

SEQ ID NO: 1051103 - RNA, 21 nt, Human
agaauuugcuuuaagaccaac

SEQ ID NO: 1051104 - RNA, 23 nt, Human
agagacccucucagaaagcacca

SEQ ID NO: 1051105 - RNA, 19 nt, Human
agaggagcagagcccccuc

SEQ ID NO: 1051106 - RNA, 21 nt, Human
agaggaggaccagacgcugcc

SEQ ID NO: 1051107 - RNA, 19 nt, Human
agagggaacacucacaaau

SEQ ID NO: 1051108 - RNA, 25 nt, Human
agccaaacuggcgacaauggacaca

SEQ ID NO: 1051109 - RNA, 23 nt, Human
aggaccuacugauaaagcauguc

SEQ ID NO: 1051110 - RNA, 24 nt, Human
aggacuuuuccaauaaagacauau

SEQ ID NO: 1051111 - RNA, 19 nt, Human
aggccugcagcaccagcug

SEQ ID NO: 1051112 - RNA, 30 nt, Human
agggacccaggccuuacaucccccaccccu

SEQ ID NO: 1051113 - RNA, 23 nt, Human
auaaaccaccccccucgccccaa

SEQ ID NO: 1051114 - RNA, 23 nt, Human
auaaagcagaggacaauaccucc

SEQ ID NO: 1051115 - RNA, 19 nt, Human
auccugccaaccauccacu

SEQ ID NO: 1051116 - RNA, 19 nt, Human
augccuaccuguuuucagc

SEQ ID NO: 1051117 - RNA, 23 nt, Human
caaacaagaccuccaugagcaga

SEQ ID NO: 1051118 - RNA, 18 nt, Human
caaaccacaccaagaaga

SEQ ID NO: 1051119 - RNA, 23 nt, Human
caaaccucgcaacucccucccag

SEQ ID NO: 1051120 - RNA, 24 nt, Human
caaaccucgcaacucccucccagg

SEQ ID NO: 1051121 - RNA, 21 nt, Human
caacagacacuggccuccccc

SEQ ID NO: 1051122 - RNA, 18 nt, Human
caacccacagagucagcu

SEQ ID NO: 1051123 - RNA, 28 nt, Human
caacccacaucaaccccaaaagguugaa

SEQ ID NO: 1051124 - RNA, 19 nt, Human
caagacuccagcccucaca

SEQ ID NO: 1051125 - RNA, 18 nt, Human
caagauaaggcuaucccc

SEQ ID NO: 1051126 - RNA, 21 nt, Human
cacagcaacccugcuaggagc

SEQ ID NO: 1051127 - RNA, 23 nt, Human
cacagcaacccugcuaggagcac

SEQ ID NO: 1051128 - RNA, 23 nt, Human
cacauaaaccaccccccucgccc

SEQ ID NO: 1051129 - RNA, 20 nt, Human
caccagaaagagcaagguac

SEQ ID NO: 1051130 - RNA, 18 nt, Human
caccagagcccacagcac

SEQ ID NO: 1051131 - RNA, 23 nt, Human
cacugaccaggugcccaccccaa

SEQ ID NO: 1051132 - RNA, 22 nt, Human
cagaaugcuagugggcauccuc

SEQ ID NO: 1051133 - RNA, 23 nt, Human
cagagggaacacucacaaaugca

SEQ ID NO: 1051134 - RNA, 21 nt, Human
cagagucagcuggagacuaac

SEQ ID NO: 1051135 - RNA, 30 nt, Human
cagcacagauccaaacaagaccuccaugag

SEQ ID NO: 1051136 - RNA, 21 nt, Human
cagcaccagcuguggaauccc

SEQ ID NO: 1051137 - RNA, 21 nt, Human
cagcacucaaaccaccacugc

SEQ ID NO: 1051138 - RNA, 24 nt, Human
cagcugccuugcccacuggucugc

SEQ ID NO: 1051139 - RNA, 23 nt, Human
caggagaggcucgcagacaacag

SEQ ID NO: 1051140 - RNA, 23 nt, Human
cauaacaauucuuguuacaauaa

SEQ ID NO: 1051141 - RNA, 18 nt, Human
caugagcagagaaacugc

SEQ ID NO: 1051142 - RNA, 19 nt, Human
caugggcacagccuguggu

SEQ ID NO: 1051143 - RNA, 21 nt, Human
ccaaacaagaccuccaugagc

SEQ ID NO: 1051144 - RNA, 26 nt, Human
ccaagcaagccugaagagaugccugu

SEQ ID NO: 1051145 - RNA, 20 nt, Human
ccacaauaaacccugccagc

SEQ ID NO: 1051146 - RNA, 19 nt, Human
ccaccccccucgccccaaa

SEQ ID NO: 1051147 - RNA, 19 nt, Human
ccaccccccucgccccaaa

SEQ ID NO: 1051148 - RNA, 18 nt, Human
ccaccucaagccacaccc

SEQ ID NO: 1051149 - RNA, 18 nt, Human
ccacugacuccaccaagc

SEQ ID NO: 1051150 - RNA, 19 nt, Human
ccagcgcacgccggcccgc

SEQ ID NO: 1051151 - RNA, 21 nt, Human
ccagcgcacgccggcccgcgg

SEQ ID NO: 1051152 - RNA, 19 nt, Human
ccaggacagucagugccaa

SEQ ID NO: 1051153 - RNA, 19 nt, Human
cccaaauaggccacauacc

SEQ ID NO: 1051154 - RNA, 26 nt, Human
cccacaauaaacccugccagggcccc

SEQ ID NO: 1051155 - RNA, 22 nt, Human
cccacagcacucaaaccaccac

SEQ ID NO: 1051156 - RNA, 24 nt, Human
cccaccagagcccacagcacucaa

SEQ ID NO: 1051157 - RNA, 24 nt, Human
cccaccucaagccacaccccugcc

SEQ ID NO: 1051158 - RNA, 24 nt, Human
cccaggccuuacaucccccacccc

SEQ ID NO: 1051159 - RNA, 23 nt, Human
ccccaagacuccagcccucacag

SEQ ID NO: 1051160 - RNA, 24 nt, Human
ccccacccccacucugacccucac

SEQ ID NO: 1051161 - RNA, 22 nt, Human
ccccaggccaaccacacucugc

SEQ ID NO: 1051162 - RNA, 21 nt, Human
cccccacccccacucugaccc

SEQ ID NO: 1051163 - RNA, 18 nt, Human
ccccgcgucuccgccgcc

SEQ ID NO: 1051164 - RNA, 19 nt, Human
ccccgcgucuccgccgccu

SEQ ID NO: 1051165 - RNA, 21 nt, Human
ccccgcgucuccgccgccucc

SEQ ID NO: 1051166 - RNA, 18 nt, Human
ccccuccccaccagagcc

SEQ ID NO: 1051167 - RNA, 19 nt, Human
cccugccaccugcugcugc

SEQ ID NO: 1051168 - RNA, 24 nt, Human
cccugccaccugcugcugcgccca

SEQ ID NO: 1051169 - RNA, 22 nt, Human
ccgcggcggcgaccugggccuc

SEQ ID NO: 1051170 - RNA, 24 nt, Human
ccuacucucucccaaaccucgcaa

SEQ ID NO: 1051171 - RNA, 19 nt, Human
ccucagcagacaagucacc

SEQ ID NO: 1051172 - RNA, 22 nt, Human
ccucagugaccagcgcacgccg

SEQ ID NO: 1051173 - RNA, 23 nt, Human
ccuccgagccccgcgucuccgcc

SEQ ID NO: 1051174 - RNA, 22 nt, Human
ccugacccagcuaccagcaaau

SEQ ID NO: 1051175 - RNA, 18 nt, Human
ccuggcccucucugcugu

SEQ ID NO: 1051176 - RNA, 24 nt, Human
cgacccaaauaggccacauacccc

SEQ ID NO: 1051177 - RNA, 18 nt, Human
cgccgcgcucccgcucgc

SEQ ID NO: 1051178 - RNA, 26 nt, Human
cucaagccacaccccugccaccugcu

SEQ ID NO: 1051179 - RNA, 21 nt, Human
cucacagagcggcaaguucau

SEQ ID NO: 1051180 - RNA, 21 nt, Human
cucaugggcacagccuguggu

SEQ ID NO: 1051181 - RNA, 22 nt, Human
cucccacaauaaacccugccag

SEQ ID NO: 1051182 - RNA, 21 nt, Human
cucccggacgccgcgcucccg

SEQ ID NO: 1051183 - RNA, 18 nt, Human
cuccgcagcccgcgcucc

SEQ ID NO: 1051184 - RNA, 23 nt, Human
cuccugaaccccaagacuccagc

SEQ ID NO: 1051185 - RNA, 25 nt, Human
cucgcaacucccucccaggacaguc

SEQ ID NO: 1051186 - RNA, 21 nt, Human
cucugcuuuagagacccucuc

SEQ ID NO: 1051187 - RNA, 19 nt, Human
cugcugcccuucagaaagc

SEQ ID NO: 1051188 - RNA, 21 nt, Human
cugcugcgcccaauggagguc

SEQ ID NO: 1051189 - RNA, 21 nt, Human
cuucccuacucucucccaaac

SEQ ID NO: 1051190 - RNA, 22 nt, Human
cuugcuuugugccaagugcccu

SEQ ID NO: 1051191 - RNA, 19 nt, Human
cuuucaccagcacucacug

SEQ ID NO: 1051192 - RNA, 23 nt, Human
cuuugugccaagugcccucagcu

SEQ ID NO: 1051193 - RNA, 18 nt, Human
gacaccaauacuuacaua

SEQ ID NO: 1051194 - RNA, 20 nt, Human
gacaccuaacugaacuggcu

SEQ ID NO: 1051195 - RNA, 21 nt, Human
gacauauccacggcccugccu

SEQ ID NO: 1051196 - RNA, 19 nt, Human
gaggaauuuuaaauaaagu

SEQ ID NO: 1051197 - RNA, 24 nt, Human
gcacagauccaaacaagaccucca

SEQ ID NO: 1051198 - RNA, 20 nt, Human
gcccccuccccaccagagcc

SEQ ID NO: 1051199 - RNA, 19 nt, Human
gcccgccucuccgcagccc

SEQ ID NO: 1051200 - RNA, 22 nt, Human
gccgcgcucccgcucgcucggc

SEQ ID NO: 1051201 - RNA, 22 nt, Human
gccuuacaucccccacccccac

SEQ ID NO: 1051202 - RNA, 20 nt, Human
gcgggcuuggccguggggcg

SEQ ID NO: 1051203 - RNA, 18 nt, Human
gcugaaccccuggaaccg

SEQ ID NO: 1051204 - RNA, 20 nt, Human
gcuuugugccaagugcccuc

SEQ ID NO: 1051205 - RNA, 18 nt, Human
ggacuuuuccaauaaaga

SEQ ID NO: 1051206 - RNA, 19 nt, Human
ggagcagagcccccucccc

SEQ ID NO: 1051207 - RNA, 18 nt, Human
ggcucaguggucaggugu

SEQ ID NO: 1051208 - RNA, 21 nt, Human
gggcacaaacugugugccugc

SEQ ID NO: 1051209 - RNA, 20 nt, Human
gggcacagccuguggugagg

SEQ ID NO: 1051210 - RNA, 18 nt, Human
guccuuugcuuaccugcu

SEQ ID NO: 1051211 - RNA, 25 nt, Human
uaaaauacguuuccauuccuuugga

SEQ ID NO: 1051212 - RNA, 18 nt, Human
uaaagcagacaccaauac

SEQ ID NO: 1051213 - RNA, 19 nt, Human
uaaccuccuccugaacccc

SEQ ID NO: 1051214 - RNA, 18 nt, Human
uaacuguaagacuuugca

SEQ ID NO: 1051215 - RNA, 20 nt, Human
uaagagaacuguaaugaaaa

SEQ ID NO: 1051216 - RNA, 21 nt, Human
uagaaccuacuaauccugcca

SEQ ID NO: 1051217 - RNA, 20 nt, Human
uagauagcagagaaacugcu

SEQ ID NO: 1051218 - RNA, 20 nt, Human
uaggccuacaaaccacacca

SEQ ID NO: 1051219 - RNA, 20 nt, Human
uauaaaauaagaugugaaaa

SEQ ID NO: 1051220 - RNA, 18 nt, Human
uaugacaguuuugugacu

SEQ ID NO: 1051221 - RNA, 24 nt, Human
ucaaacacacaaaaagcaaauuuc

SEQ ID NO: 1051222 - RNA, 26 nt, Human
ucacagccagaugaugccaccagaaa

SEQ ID NO: 1051223 - RNA, 19 nt, Human
ucacugagaaccgacaugc

SEQ ID NO: 1051224 - RNA, 21 nt, Human
ucaggaauaaagaaucugcug

SEQ ID NO: 1051225 - RNA, 18 nt, Human
uccacggcccugccuuuc

SEQ ID NO: 1051226 - RNA, 23 nt, Human
uccaggaaaaaaaaaaaaaaagg

SEQ ID NO: 1051227 - RNA, 18 nt, Human
ucccgcucgcucggcucc

SEQ ID NO: 1051228 - RNA, 24 nt, Human
uccugaaccccaagacuccagccc

SEQ ID NO: 1051229 - RNA, 23 nt, Human
uccugcaagcauggcuguuucuc

SEQ ID NO: 1051230 - RNA, 22 nt, Human
ucgcaacucccucccaggacag

SEQ ID NO: 1051231 - RNA, 23 nt, Human
ucuaaccuccuccugaaccccaa

SEQ ID NO: 1051232 - RNA, 20 nt, Human
ucuccaggaaaaaaaaaaaa

SEQ ID NO: 1051233 - RNA, 21 nt, Human
ucugcccccacacauagacac

SEQ ID NO: 1051234 - RNA, 18 nt, Human
ugaaccccaagacuccag

SEQ ID NO: 1051235 - RNA, 18 nt, Human
ugaagguggcccaacugc

SEQ ID NO: 1051236 - RNA, 18 nt, Human
ugacccagcuaccagcaa

SEQ ID NO: 1051237 - RNA, 21 nt, Human
ugaugccaccagaaagagcaa

SEQ ID NO: 1051238 - RNA, 18 nt, Human
ugcacagggacucauggg

SEQ ID NO: 1051239 - RNA, 20 nt, Human
ugccaaguaccaagcaagcc

SEQ ID NO: 1051240 - RNA, 19 nt, Human
ugccuggcccucucugcug

SEQ ID NO: 1051241 - RNA, 19 nt, Human
ugcuuaccugcugucucaa

SEQ ID NO: 1051242 - RNA, 18 nt, Human
uggaagugccuucaggcc

SEQ ID NO: 1051243 - RNA, 18 nt, Human
uggcaggagaggcucgca

SEQ ID NO: 1051244 - RNA, 18 nt, Human
uggccagcacagcaaccc

SEQ ID NO: 1051245 - RNA, 24 nt, Human
uggcccaacugcucagaguaacac

SEQ ID NO: 1051246 - RNA, 20 nt, Human
uggcccucacagagcggcaa

SEQ ID NO: 1051247 - RNA, 20 nt, Human
uggccugagaucuggcccag

SEQ ID NO: 1051248 - RNA, 19 nt, Human
uggcguguggggggugcag

SEQ ID NO: 1051249 - RNA, 19 nt, Human
uggcguguggggggugcag

SEQ ID NO: 1051250 - RNA, 20 nt, Human
ugggaaaaaagacuucucug

SEQ ID NO: 1051251 - RNA, 19 nt, Human
uggggcagaaugcuagugg

SEQ ID NO: 1051252 - RNA, 22 nt, Human
ugggggcgggguggagggaagc

SEQ ID NO: 1051253 - RNA, 18 nt, Human
uggggggugcagcccacu

SEQ ID NO: 1051254 - RNA, 22 nt, Human
ugguuggaggcgcaaggccugc

SEQ ID NO: 1051255 - RNA, 19 nt, Human
uguacauguauguuuccau

SEQ ID NO: 1051256 - RNA, 21 nt, Human
ugugcuugcuuugugccaagu

SEQ ID NO: 1051257 - RNA, 19 nt, Human
uuaaaaaaacaaaaaggaa

SEQ ID NO: 1051258 - RNA, 22 nt, Human
uucacuggccacacuaccauaa

SEQ ID NO: 1051259 - RNA, 20 nt, Human
uucacuuuaacacuuauaac

SEQ ID NO: 1051260 - RNA, 18 nt, Human
uuccuuggcauggauacg

SEQ ID NO: 1051261 - RNA, 19 nt, Human
uucuaaccuccuccugaac

SEQ ID NO: 1051262 - RNA, 19 nt, Human
uugaaaacugcaguauuaa

SEQ ID NO: 1051263 - RNA, 24 nt, Human
uuuccagacauauccacggcccug

SEQ ID NO: 1051264 - RNA, 18 nt, Human
gacccaggaucucaggca

SEQ ID NO: 1051265 - RNA, 26 nt, Human
ggcucuguugcgguggucgcagcacg

SEQ ID NO: 1051266 - RNA, 18 nt, Human
uauuccaagcaagccagg

SEQ ID NO: 1051267 - RNA, 19 nt, Human
ucaggcaucaggcucugcu

SEQ ID NO: 1051268 - RNA, 19 nt, Human
uccaagcaagccaggcugg

SEQ ID NO: 1051269 - RNA, 25 nt, Human
uggaaguacuugagggugguggugc

SEQ ID NO: 1051270 - RNA, 18 nt, Human
uggcuaaagauuuuauuc

SEQ ID NO: 1051271 - RNA, 22 nt, Human
ugguccuggaaguacuugaggg

SEQ ID NO: 1051272 - RNA, 18 nt, Human
accagcucccuccagugc

SEQ ID NO: 1051273 - RNA, 19 nt, Human
caugucagguguuugccgc

SEQ ID NO: 1051274 - RNA, 18 nt, Human
cuggaggggguucgauuc

SEQ ID NO: 1051275 - RNA, 19 nt, Human
gauuccuguggucucccuc

SEQ ID NO: 1051276 - RNA, 18 nt, Human
ucccuccagugcuggagg

SEQ ID NO: 1051277 - RNA, 25 nt, Human
ugagugugggcccaguacaaaguca

SEQ ID NO: 1051278 - RNA, 20 nt, Human
ugccaugucagguguuugcc

SEQ ID NO: 1051279 - RNA, 22 nt, Human
aaaugaaggugaagaaaaagga

SEQ ID NO: 1051280 - RNA, 22 nt, Human
acagagaaaagccugaaaugaa

SEQ ID NO: 1051281 - RNA, 30 nt, Human
acuggucucauguccaugaugagcugcacc

SEQ ID NO: 1051282 - RNA, 27 nt, Human
auuauucucugagaucucaagacaugg

SEQ ID NO: 1051283 - RNA, 21 nt, Human
cagcaaagacuggguuuuuua

SEQ ID NO: 1051284 - RNA, 23 nt, Human
cucaagacauggaagacagagaa

SEQ ID NO: 1051285 - RNA, 25 nt, Human
cuuccagggugagucuucacacugg

SEQ ID NO: 1051286 - RNA, 23 nt, Human
cuuugucuggucagcaaagacug

SEQ ID NO: 1051287 - RNA, 18 nt, Human
gaaaaaggaaaaagaagg

SEQ ID NO: 1051288 - RNA, 21 nt, Human
gacauggaagacagagaaaag

SEQ ID NO: 1051289 - RNA, 18 nt, Human
ggugaagaaaaaggaaaa

SEQ ID NO: 1051290 - RNA, 24 nt, Human
ugaagaaaaaggaaaaagaaggag

SEQ ID NO: 1051291 - RNA, 18 nt, Human
uggaagacagagaaaagc

SEQ ID NO: 1051292 - RNA, 19 nt, Human
aaagugcugggauuacaga

SEQ ID NO: 1051293 - RNA, 24 nt, Human
aaagugcugggauuacagacauga

SEQ ID NO: 1051294 - RNA, 23 nt, Human
aaaugaccauauggggaaaagga

SEQ ID NO: 1051295 - RNA, 27 nt, Human
aaccacuucuuaugacauauuuuccau

SEQ ID NO: 1051296 - RNA, 21 nt, Human
aagugcugggauuacagacau

SEQ ID NO: 1051297 - RNA, 26 nt, Human
aagugcugggauuacagacaugagcu

SEQ ID NO: 1051298 - RNA, 18 nt, Human
acaagcucccucagcugg

SEQ ID NO: 1051299 - RNA, 21 nt, Human
acaugagcuaccuugcccagc

SEQ ID NO: 1051300 - RNA, 22 nt, Human
acguuaaaaucaguuuuuccca

SEQ ID NO: 1051301 - RNA, 24 nt, Human
agcuggucucaaacuccugggcuc

SEQ ID NO: 1051302 - RNA, 24 nt, Human
agugcugggauuacagacaugagc

SEQ ID NO: 1051303 - RNA, 25 nt, Human
caaacuccugggcucaagcgauccu

SEQ ID NO: 1051304 - RNA, 24 nt, Human
caaagugcugggauuacagacaug

SEQ ID NO: 1051305 - RNA, 19 nt, Human
caacaaagccaaaacuuug

SEQ ID NO: 1051306 - RNA, 23 nt, Human
caagcgauccuccugccucgacc

SEQ ID NO: 1051307 - RNA, 28 nt, Human
caagcgauccuccugccucgaccuccca

SEQ ID NO: 1051308 - RNA, 23 nt, Human
cacuguguuaccuagcuggucuc

SEQ ID NO: 1051309 - RNA, 22 nt, Human
cagagacgggaucucacugugu

SEQ ID NO: 1051310 - RNA, 19 nt, Human
cagcaguacaaaauuacua

SEQ ID NO: 1051311 - RNA, 19 nt, Human
cagcuuuuauacuagaagc

SEQ ID NO: 1051312 - RNA, 23 nt, Human
cauggcacagaacuuucagaguu

SEQ ID NO: 1051313 - RNA, 19 nt, Human
ccaaagugcugggauuaca

SEQ ID NO: 1051314 - RNA, 24 nt, Human
ccaaagugcugggauuacagacau

SEQ ID NO: 1051315 - RNA, 18 nt, Human
ccucaguucuugcuauca

SEQ ID NO: 1051316 - RNA, 22 nt, Human
ccuccugccucgaccucccaaa

SEQ ID NO: 1051317 - RNA, 26 nt, Human
ccuccugccucgaccucccaaagugc

SEQ ID NO: 1051318 - RNA, 20 nt, Human
ccugggcucaagcgauccuc

SEQ ID NO: 1051319 - RNA, 23 nt, Human
ccugggcucaagcgauccuccug

SEQ ID NO: 1051320 - RNA, 23 nt, Human
cuaacacacaggauacuacccac

SEQ ID NO: 1051321 - RNA, 24 nt, Human
cucaagcgauccuccugccucgac

SEQ ID NO: 1051322 - RNA, 23 nt, Human
cuccugggcucaagcgauccucc

SEQ ID NO: 1051323 - RNA, 25 nt, Human
cuccugggcucaagcgauccuccug

SEQ ID NO: 1051324 - RNA, 24 nt, Human
cugccucgaccucccaaagugcug

SEQ ID NO: 1051325 - RNA, 18 nt, Human
gauuacagacaugagcua

SEQ ID NO: 1051326 - RNA, 19 nt, Human
gauuacagacaugagcuac

SEQ ID NO: 1051327 - RNA, 20 nt, Human
gauuacagacaugagcuacc

SEQ ID NO: 1051328 - RNA, 25 nt, Human
gcgcaucuuuaaaucagcaguacaa

SEQ ID NO: 1051329 - RNA, 24 nt, Human
ggauuacagacaugagcuaccuug

SEQ ID NO: 1051330 - RNA, 22 nt, Human
gggcucaagcgauccuccugcc

SEQ ID NO: 1051331 - RNA, 18 nt, Human
ggggaaaaggaagcaaua

SEQ ID NO: 1051332 - RNA, 24 nt, Human
uaacagagacgggaucucacugug

SEQ ID NO: 1051333 - RNA, 19 nt, Human
uaccuugcccagccagcag

SEQ ID NO: 1051334 - RNA, 21 nt, Human
uagguuuuugccagcaagucc

SEQ ID NO: 1051335 - RNA, 20 nt, Human
uaugacauauuuuccauacc

SEQ ID NO: 1051336 - RNA, 18 nt, Human
ucaaagacaaaucuaaau

SEQ ID NO: 1051337 - RNA, 25 nt, Human
ucagacacuugaaauaauccaaaac

SEQ ID NO: 1051338 - RNA, 24 nt, Human
uccauggucaaggaugaccggggc

SEQ ID NO: 1051339 - RNA, 18 nt, Human
ucccaaagugcugggauu

SEQ ID NO: 1051340 - RNA, 24 nt, Human
ucccaaagugcugggauuacagac

SEQ ID NO: 1051341 - RNA, 20 nt, Human
uccucaguucuugcuaucau

SEQ ID NO: 1051342 - RNA, 21 nt, Human
uccugggcucaagcgauccuc

SEQ ID NO: 1051343 - RNA, 24 nt, Human
uccugggcucaagcgauccuccug

SEQ ID NO: 1051344 - RNA, 23 nt, Human
ucucaaacuccugggcucaagcg

SEQ ID NO: 1051345 - RNA, 25 nt, Human
ucugagaucuucuuacucuagauuu

SEQ ID NO: 1051346 - RNA, 18 nt, Human
ugagaucuucuuacucua

SEQ ID NO: 1051347 - RNA, 24 nt, Human
ugccucgaccucccaaagugcugg

SEQ ID NO: 1051348 - RNA, 20 nt, Human
ugcugggauuacagacauga

SEQ ID NO: 1051349 - RNA, 18 nt, Human
ugggauuacagacaugag

SEQ ID NO: 1051350 - RNA, 19 nt, Human
ugggauuacagacaugagc

SEQ ID NO: 1051351 - RNA, 21 nt, Human
ugggauuacagacaugagcua

SEQ ID NO: 1051352 - RNA, 22 nt, Human
ugggauuacagacaugagcuac

SEQ ID NO: 1051353 - RNA, 26 nt, Human
ugggauuacagacaugagcuaccuug

SEQ ID NO: 1051354 - RNA, 24 nt, Human
ugggcucaagcgauccuccugccu

SEQ ID NO: 1051355 - RNA, 23 nt, Human
uguguuaccuagcuggucucaaa

SEQ ID NO: 1051356 - RNA, 19 nt, Human
uuccugcuuuucuggucaa

SEQ ID NO: 1051357 - RNA, 22 nt, Human
uuguacaagcucccucagcugg

SEQ ID NO: 1051358 - RNA, 18 nt, Human
uagaaugacgauuucccu

SEQ ID NO: 1051359 - RNA, 22 nt, Human
uagaaugacgauuucccuuaau

SEQ ID NO: 1051360 - RNA, 22 nt, Human
ucaggguggcggugugcucuuc

SEQ ID NO: 1051361 - RNA, 19 nt, Human
agcuggucaacucaggacc

SEQ ID NO: 1051362 - RNA, 20 nt, Human
auauuuguagcuccugucac

SEQ ID NO: 1051363 - RNA, 20 nt, Human
caccauccccaaggucacca

SEQ ID NO: 1051364 - RNA, 22 nt, Human
cauauuaggguccagggugaag

SEQ ID NO: 1051365 - RNA, 21 nt, Human
cauauuuguagcuccugucac

SEQ ID NO: 1051366 - RNA, 22 nt, Human
ccagggugaagaugcuuuccuc

SEQ ID NO: 1051367 - RNA, 19 nt, Human
ccugaccuacgucuugaaa

SEQ ID NO: 1051368 - RNA, 18 nt, Human
ccugcaguuaaggagggg

SEQ ID NO: 1051369 - RNA, 26 nt, Human
gaaagaagcuggucaacucaggaccu

SEQ ID NO: 1051370 - RNA, 19 nt, Human
gagggccccggccaucauc

SEQ ID NO: 1051371 - RNA, 26 nt, Human
gcuacaugaauuagucaccuuugacu

SEQ ID NO: 1051372 - RNA, 20 nt, Human
guguugggcuuuugaagacc

SEQ ID NO: 1051373 - RNA, 19 nt, Human
uaucuuucuugcuagcuag

SEQ ID NO: 1051374 - RNA, 23 nt, Human
uccagggugaagaugcuuuccuc

SEQ ID NO: 1051375 - RNA, 18 nt, Human
ugaagaugcuuuccucuc

SEQ ID NO: 1051376 - RNA, 21 nt, Human
ugcuuuccucucuugcacugu

SEQ ID NO: 1051377 - RNA, 21 nt, Human
uucuugcuagcuagucaaagg

SEQ ID NO: 1051378 - RNA, 20 nt, Human
uugcacugucucucucaacg

SEQ ID NO: 1051379 - RNA, 18 nt, Human
uuuguagcuccugucaca

SEQ ID NO: 1051380 - RNA, 28 nt, Human
aacugcucuucagaacagccaucucuau

SEQ ID NO: 1051381 - RNA, 22 nt, Human
caugcccugcuggaguugagaa

SEQ ID NO: 1051382 - RNA, 20 nt, Human
gaaagucgcuggcaaagcug

SEQ ID NO: 1051383 - RNA, 18 nt, Human
ugaauguucaggcucccc

SEQ ID NO: 1051384 - RNA, 19 nt, Human
ugcccugcuggaguugaga

SEQ ID NO: 1051385 - RNA, 19 nt, Human
uggaauaccgguguguggc

SEQ ID NO: 1051386 - RNA, 23 nt, Human
uucaaaaucuccaaucucuaccu

SEQ ID NO: 1051387 - RNA, 23 nt, Human
uuugauucacuuugcacugauug

SEQ ID NO: 1051388 - RNA, 21 nt, Human
aaacaucugggccaagaaaca

SEQ ID NO: 1051389 - RNA, 20 nt, Human
cacccagcuuuucccucuga

SEQ ID NO: 1051390 - RNA, 22 nt, Human
cagcuuuucccucugggagccc

SEQ ID NO: 1051391 - RNA, 18 nt, Human
ccuccuucuuccuuugcc

SEQ ID NO: 1051392 - RNA, 21 nt, Human
cgccagaccccaggaggucag

SEQ ID NO: 1051393 - RNA, 21 nt, Human
cucccagggcacacccagcuu

SEQ ID NO: 1051394 - RNA, 21 nt, Human
gccagaccccaggaggucagc

SEQ ID NO: 1051395 - RNA, 23 nt, Human
gcccugagacucccagggcacac

SEQ ID NO: 1051396 - RNA, 21 nt, Human
ggaugcuggggcuuggagagg

SEQ ID NO: 1051397 - RNA, 18 nt, Human
ggccaagaaacagggugg

SEQ ID NO: 1051398 - RNA, 23 nt, Human
guuccaggcccugagacucccag

SEQ ID NO: 1051399 - RNA, 20 nt, Human
ucagucagggaauaggugug

SEQ ID NO: 1051400 - RNA, 23 nt, Human
ucccuggggaugcuggggcuugg

SEQ ID NO: 1051401 - RNA, 21 nt, Human
ucugcacgccagaccccagga

SEQ ID NO: 1051402 - RNA, 19 nt, Human
ugagacucccagggcacac

SEQ ID NO: 1051403 - RNA, 20 nt, Human
ugccuccuucuuccuuugcc

SEQ ID NO: 1051404 - RNA, 19 nt, Human
ugcuggggcuuggagaggu

SEQ ID NO: 1051405 - RNA, 20 nt, Human
ugcuggggcuuggagagguc

SEQ ID NO: 1051406 - RNA, 22 nt, Human
uuacugccuccuucuuccuuug

SEQ ID NO: 1051407 - RNA, 20 nt, Human
uucccuggggaugcuggggc

SEQ ID NO: 1051408 - RNA, 23 nt, Human
uuuacugccuccuucuuccuuug

SEQ ID NO: 1051409 - RNA, 19 nt, Human
uuucccaguaccuuuacug

SEQ ID NO: 1051410 - RNA, 22 nt, Human
aaagaaagagagaaggaaagac

SEQ ID NO: 1051411 - RNA, 20 nt, Human
aacaacaaagaaaaagaaag

SEQ ID NO: 1051412 - RNA, 21 nt, Human
aacuuccggccucuucaggcc

SEQ ID NO: 1051413 - RNA, 18 nt, Human
aagggaggagcggguccc

SEQ ID NO: 1051414 - RNA, 21 nt, Human
aauacagguaugcaaaaagga

SEQ ID NO: 1051415 - RNA, 20 nt, Human
acaaagaaaaagaaagagag

SEQ ID NO: 1051416 - RNA, 21 nt, Human
acaaagaaaaagaaagagaga

SEQ ID NO: 1051417 - RNA, 21 nt, Human
acaacaaagaaaaagaaagag

SEQ ID NO: 1051418 - RNA, 21 nt, Human
acaacgggccaggacugaacc

SEQ ID NO: 1051419 - RNA, 21 nt, Human
accaguccagcuuuccaccau

SEQ ID NO: 1051420 - RNA, 20 nt, Human
agaaaaagaaagagagaagg

SEQ ID NO: 1051421 - RNA, 21 nt, Human
agaaaaagaaagagagaagga

SEQ ID NO: 1051422 - RNA, 23 nt, Human
agaaauuccuauccacugcaauc

SEQ ID NO: 1051423 - RNA, 22 nt, Human
agaaggaaagaccugaagagaa

SEQ ID NO: 1051424 - RNA, 19 nt, Human
agagaagcaggacggccga

SEQ ID NO: 1051425 - RNA, 19 nt, Human
agagaagcaggacggccga

SEQ ID NO: 1051426 - RNA, 24 nt, Human
agagaaggaaagaccugaagagaa

SEQ ID NO: 1051427 - RNA, 21 nt, Human
aggaaagaaaagaaacauaag

SEQ ID NO: 1051428 - RNA, 21 nt, Human
caaaaguucagaggaagaagc

SEQ ID NO: 1051429 - RNA, 21 nt, Human
caaacacacagcagacacacg

SEQ ID NO: 1051430 - RNA, 24 nt, Human
caacaacaaagaaaaagaaagaga

SEQ ID NO: 1051431 - RNA, 25 nt, Human
caagauuuaaggaaagaaaagaaac

SEQ ID NO: 1051432 - RNA, 22 nt, Human
cagaguacagaagaugaaccaa

SEQ ID NO: 1051433 - RNA, 19 nt, Human
cagcagacacacgccuauu

SEQ ID NO: 1051434 - RNA, 21 nt, Human
caucagggaccaucuccgggg

SEQ ID NO: 1051435 - RNA, 23 nt, Human
ccacaacgggccaggacugaacc

SEQ ID NO: 1051436 - RNA, 24 nt, Human
ccacaacgggccaggacugaaccc

SEQ ID NO: 1051437 - RNA, 18 nt, Human
ccaguccagcuuuccacc

SEQ ID NO: 1051438 - RNA, 20 nt, Human
cccuauguccgugggccccu

SEQ ID NO: 1051439 - RNA, 21 nt, Human
cccuauguccgugggccccuc

SEQ ID NO: 1051440 - RNA, 19 nt, Human
ccgaacacaaacacacagc

SEQ ID NO: 1051441 - RNA, 22 nt, Human
ccucuagaccccaagggaggag

SEQ ID NO: 1051442 - RNA, 22 nt, Human
ccuggacagcucugucacaguc

SEQ ID NO: 1051443 - RNA, 27 nt, Human
cgggcaagauuuaaggaaagaaaagaa

SEQ ID NO: 1051444 - RNA, 18 nt, Human
cuauguccgugggccccu

SEQ ID NO: 1051445 - RNA, 19 nt, Human
cugaccagcagaaaacuga

SEQ ID NO: 1051446 - RNA, 24 nt, Human
cugaccagcagaaaacugacagag

SEQ ID NO: 1051447 - RNA, 24 nt, Human
gaaauaaccagauuuuagcucaaa

SEQ ID NO: 1051448 - RNA, 22 nt, Human
gaagcaggacggccgaacacag

SEQ ID NO: 1051449 - RNA, 19 nt, Human
gaccagcagaaaacugaca

SEQ ID NO: 1051450 - RNA, 21 nt, Human
gcagaaaacugacagaguaca

SEQ ID NO: 1051451 - RNA, 22 nt, Human
gcucaucagggaccaucuccgg

SEQ ID NO: 1051452 - RNA, 22 nt, Human
ggaaacagagaagcaggacggc

SEQ ID NO: 1051453 - RNA, 22 nt, Human
ggacagcucugucacagucaca

SEQ ID NO: 1051454 - RNA, 22 nt, Human
ggcuucgccuuucgggagacca

SEQ ID NO: 1051455 - RNA, 23 nt, Human
gggcaagauuuaaggaaagaaaa

SEQ ID NO: 1051456 - RNA, 20 nt, Human
gucacagucacagauguucu

SEQ ID NO: 1051457 - RNA, 20 nt, Human
guccagcuuuccaccaucac

SEQ ID NO: 1051458 - RNA, 21 nt, Human
uaacacaggggcauguguacg

SEQ ID NO: 1051459 - RNA, 24 nt, Human
uauauuauuuuacaacaacaaaga

SEQ ID NO: 1051460 - RNA, 24 nt, Human
uauccacugcaauccuggacagcc

SEQ ID NO: 1051461 - RNA, 21 nt, Human
ucacagauguucugaccagca

SEQ ID NO: 1051462 - RNA, 22 nt, Human
ucccgcccgccauucccagguc

SEQ ID NO: 1051463 - RNA, 20 nt, Human
ucuccgggggucuccucuag

SEQ ID NO: 1051464 - RNA, 23 nt, Human
ugaaccaaaguaacacaggggca

SEQ ID NO: 1051465 - RNA, 19 nt, Human
ugcaaaaaggaagcccucg

SEQ ID NO: 1051466 - RNA, 23 nt, Human
ugcaaaaaggaagcccucgagau

SEQ ID NO: 1051467 - RNA, 21 nt, Human
ugggccccucagcuggcccaa

SEQ ID NO: 1051468 - RNA, 19 nt, Human
ugucacagucacagauguu

SEQ ID NO: 1051469 - RNA, 23 nt, Human
uuaauacagguaugcaaaaagga

SEQ ID NO: 1051470 - RNA, 23 nt, Human
uucccaggucucagaguuuacuu

SEQ ID NO: 1051471 - RNA, 18 nt, Human
accgccacucccgccucg

SEQ ID NO: 1051472 - RNA, 26 nt, Human
acuuuuuguuguuguuaaagaaaaau

SEQ ID NO: 1051473 - RNA, 23 nt, Human
agcaucauuuaucugguaguagc

SEQ ID NO: 1051474 - RNA, 21 nt, Human
cagcagcaucauuuaucuggu

SEQ ID NO: 1051475 - RNA, 20 nt, Human
ccgccgccgcugccacgccg

SEQ ID NO: 1051476 - RNA, 20 nt, Human
cgcuccgccgccgcugccac

SEQ ID NO: 1051477 - RNA, 21 nt, Human
cgggccggugcccuccgcugg

SEQ ID NO: 1051478 - RNA, 25 nt, Human
cgggccggugcccuccgcuggcacc

SEQ ID NO: 1051479 - RNA, 20 nt, Human
cuccgccgccgcugccacgc

SEQ ID NO: 1051480 - RNA, 18 nt, Human
cuggcaccgccacucccg

SEQ ID NO: 1051481 - RNA, 21 nt, Human
cugguaguagcaagacagccu

SEQ ID NO: 1051482 - RNA, 18 nt, Human
cuuggcuuucauguccag

SEQ ID NO: 1051483 - RNA, 18 nt, Human
guuguuaaagaaaaauaa

SEQ ID NO: 1051484 - RNA, 22 nt, Human
ugucaagauuugccuaccaaua

SEQ ID NO: 1051485 - RNA, 24 nt, Human
ugucuuggcuuucauguccagugg

SEQ ID NO: 1051486 - RNA, 19 nt, Human
agguaguagagcucccggc

SEQ ID NO: 1051487 - RNA, 23 nt, Human
augcccccaggcauaguuauggg

SEQ ID NO: 1051488 - RNA, 25 nt, Human
caaugaucuugccaaugucgugaug

SEQ ID NO: 1051489 - RNA, 18 nt, Human
cagaaccaguuucuccac

SEQ ID NO: 1051490 - RNA, 20 nt, Human
cagaaccaguuucuccacca

SEQ ID NO: 1051491 - RNA, 23 nt, Human
ccaaagcuguggaaaaccgagaa

SEQ ID NO: 1051492 - RNA, 20 nt, Human
ccaguggucuugucacuugg

SEQ ID NO: 1051493 - RNA, 23 nt, Human
cuccaccaaagcuguggaaaacc

SEQ ID NO: 1051494 - RNA, 19 nt, Human
cucccggcagcauugccaa

SEQ ID NO: 1051495 - RNA, 18 nt, Human
gcacuggugaaccagcuu

SEQ ID NO: 1051496 - RNA, 21 nt, Human
gccaauccagacaucagccuc

SEQ ID NO: 1051497 - RNA, 21 nt, Human
guagagcucccggcagcauug

SEQ ID NO: 1051498 - RNA, 20 nt, Human
guggucuugucacuuggcau

SEQ ID NO: 1051499 - RNA, 20 nt, Human
ucuccaccaaagcuguggaa

SEQ ID NO: 1051500 - RNA, 19 nt, Human
ucuuccuugucugugauga

SEQ ID NO: 1051501 - RNA, 19 nt, Human
uggucuugucacuuggcau

SEQ ID NO: 1051502 - RNA, 18 nt, Human
ugucugugaugagcugcu

SEQ ID NO: 1051503 - RNA, 19 nt, Human
ugucugugaugagcugcuc

SEQ ID NO: 1051504 - RNA, 20 nt, Human
ugugaugagcugcucagggu

SEQ ID NO: 1051505 - RNA, 22 nt, Human
uguggaaaaccgagaagcccug

SEQ ID NO: 1051506 - RNA, 22 nt, Human
uuccagguuuauaaacacugcc

SEQ ID NO: 1051507 - RNA, 20 nt, Human
uugucugugaugagcugcuc

SEQ ID NO: 1051508 - RNA, 21 nt, Human
aaaacaguacuauaaagcuca

SEQ ID NO: 1051509 - RNA, 19 nt, Human
aaacaguacuauaaagcuc

SEQ ID NO: 1051510 - RNA, 23 nt, Human
aacaggaucaacucugaaaagaa

SEQ ID NO: 1051511 - RNA, 20 nt, Human
acuauaaagcucaacaggau

SEQ ID NO: 1051512 - RNA, 19 nt, Human
caacaggaucaacucugaa

SEQ ID NO: 1051513 - RNA, 20 nt, Human
ucccugaucugucaagaaaa

SEQ ID NO: 1051514 - RNA, 21 nt, Human
ucugucaagaaaaacaguacu

SEQ ID NO: 1051515 - RNA, 18 nt, Human
acaggaagaaacuucugg

SEQ ID NO: 1051516 - RNA, 23 nt, Human
aggaagaaacuucuggaucacuc

SEQ ID NO: 1051517 - RNA, 22 nt, Human
gacccagggcgccccuagagac

SEQ ID NO: 1051518 - RNA, 18 nt, Human
ucuggaucacuccuggaa

SEQ ID NO: 1051519 - RNA, 18 nt, Human
aaaaaacccaacaacuga

SEQ ID NO: 1051520 - RNA, 22 nt, Human
aaaagaaaauauaaaagcaaaa

SEQ ID NO: 1051521 - RNA, 24 nt, Human
aaaagaaaauauaaaagcaaaaaa

SEQ ID NO: 1051522 - RNA, 23 nt, Human
aaacacauaaauuaucuucauca

SEQ ID NO: 1051523 - RNA, 19 nt, Human
aagcaaaaaacccaacaac

SEQ ID NO: 1051524 - RNA, 20 nt, Human
acuacuucccucaaacauua

SEQ ID NO: 1051525 - RNA, 26 nt, Human
agaaaagaaaauauaaaagcaaaaaa

SEQ ID NO: 1051526 - RNA, 21 nt, Human
auuugaggugucugacuauuc

SEQ ID NO: 1051527 - RNA, 21 nt, Human
caaaacaaaaccaugcuucaa

SEQ ID NO: 1051528 - RNA, 23 nt, Human
cacaaaacaaaaccaugcuucaa

SEQ ID NO: 1051529 - RNA, 23 nt, Human
cacaaaacaaaaccaugcuucaa

SEQ ID NO: 1051530 - RNA, 25 nt, Human
caccacaaaacaaaaccaugcuuca

SEQ ID NO: 1051531 - RNA, 19 nt, Human
ccacaaaacaaaaccaugc

SEQ ID NO: 1051532 - RNA, 21 nt, Human
ccacaccacaaaacaaaacca

SEQ ID NO: 1051533 - RNA, 23 nt, Human
ccaugcuucaacuacuucccuca

SEQ ID NO: 1051534 - RNA, 27 nt, Human
cugguaacaauaauacaucccacaauu

SEQ ID NO: 1051535 - RNA, 22 nt, Human
cuucaucauuccuuaaguccaa

SEQ ID NO: 1051536 - RNA, 22 nt, Human
gguaacaauaauacaucccaca

SEQ ID NO: 1051537 - RNA, 22 nt, Human
uaaaagcaaaaaacccaacaac

SEQ ID NO: 1051538 - RNA, 20 nt, Human
uacuacauggauuccacacc

SEQ ID NO: 1051539 - RNA, 24 nt, Human
ucuccaaaggaucuugcuguccau

SEQ ID NO: 1051540 - RNA, 27 nt, Human
ucucuaaaguuccaugauacuuaauuu

SEQ ID NO: 1051541 - RNA, 22 nt, Human
ucuucuccaaaggaucuugcug

SEQ ID NO: 1051542 - RNA, 22 nt, Human
ugaggugucugacuauucaaga

SEQ ID NO: 1051543 - RNA, 21 nt, Human
ugauggaucuguguguucccu

SEQ ID NO: 1051544 - RNA, 22 nt, Human
uggaucuguguguucccucuua

SEQ ID NO: 1051545 - RNA, 20 nt, Human
uucaucauuccuuaagucca

SEQ ID NO: 1051546 - RNA, 23 nt, Human
uuccacaccacaaaacaaaacca

SEQ ID NO: 1051547 - RNA, 24 nt, Human
gaggcugcgucuuucaggaggcca

SEQ ID NO: 1051548 - RNA, 24 nt, Human
uacauuuuuuuuucuuucucauga

SEQ ID NO: 1051549 - RNA, 23 nt, Human
uguuuuguucuuucagcucguua

SEQ ID NO: 1051550 - RNA, 19 nt, Human
aaguaauaaaaauugcucc

SEQ ID NO: 1051551 - RNA, 22 nt, Human
acaguaagcaagcuugcucucu

SEQ ID NO: 1051552 - RNA, 27 nt, Human
acccugagaaaugucuuggauaaagag

SEQ ID NO: 1051553 - RNA, 28 nt, Human
acccugagaaaugucuuggauaaagagu

SEQ ID NO: 1051554 - RNA, 18 nt, Human
agcaagguguguaggagu

SEQ ID NO: 1051555 - RNA, 22 nt, Human
agcaagguguguaggaguacaa

SEQ ID NO: 1051556 - RNA, 21 nt, Human
agccuuggaccccccucauca

SEQ ID NO: 1051557 - RNA, 20 nt, Human
aggcggggcaggggguggug

SEQ ID NO: 1051558 - RNA, 20 nt, Human
agggagcggacgccaccccg

SEQ ID NO: 1051559 - RNA, 20 nt, Human
aggggguggugagcggugaa

SEQ ID NO: 1051560 - RNA, 24 nt, Human
aguacaagagccucacagaaagga

SEQ ID NO: 1051561 - RNA, 25 nt, Human
caacacuuauuaaaaaacaguugau

SEQ ID NO: 1051562 - RNA, 20 nt, Human
caaggacccggcgaccaagg

SEQ ID NO: 1051563 - RNA, 23 nt, Human
caggacccaaggcggggcagggg

SEQ ID NO: 1051564 - RNA, 20 nt, Human
caucaggaccuccggcacag

SEQ ID NO: 1051565 - RNA, 19 nt, Human
cccaaggcggggcaggggg

SEQ ID NO: 1051566 - RNA, 23 nt, Human
ccccaagccuuggaccccccuca

SEQ ID NO: 1051567 - RNA, 23 nt, Human
cccgcaaggacccggcgaccaag

SEQ ID NO: 1051568 - RNA, 22 nt, Human
cucacagaaaggagccucccaa

SEQ ID NO: 1051569 - RNA, 26 nt, Human
cuggaaguaauaaaaauugcucccuu

SEQ ID NO: 1051570 - RNA, 19 nt, Human
cuuggauaaagagugguga

SEQ ID NO: 1051571 - RNA, 21 nt, Human
gauaaagaguggugagagccu

SEQ ID NO: 1051572 - RNA, 20 nt, Human
gcacaggcgcccguuucccg

SEQ ID NO: 1051573 - RNA, 24 nt, Human
gcggggcaggggguggugagcggu

SEQ ID NO: 1051574 - RNA, 18 nt, Human
ggacccaaggcggggcag

SEQ ID NO: 1051575 - RNA, 18 nt, Human
ggaccccccucaucagga

SEQ ID NO: 1051576 - RNA, 20 nt, Human
ggaccccccucaucaggacc

SEQ ID NO: 1051577 - RNA, 21 nt, Human
ggcaggggguggugagcggug

SEQ ID NO: 1051578 - RNA, 23 nt, Human
ggggcaggggguggugagcggug

SEQ ID NO: 1051579 - RNA, 23 nt, Human
guaauuccagugaaagaagagga

SEQ ID NO: 1051580 - RNA, 23 nt, Human
uaaagaguggugagagccuugca

SEQ ID NO: 1051581 - RNA, 22 nt, Human
uauuacaggagggguaacacug

SEQ ID NO: 1051582 - RNA, 19 nt, Human
ucccuggcaccgaggacuc

SEQ ID NO: 1051583 - RNA, 18 nt, Human
ugcauucuuggcauacuu

SEQ ID NO: 1051584 - RNA, 22 nt, Human
uggaaguaauaaaaauugcucc

SEQ ID NO: 1051585 - RNA, 20 nt, Human
uggcauacuuagcaaggugu

SEQ ID NO: 1051586 - RNA, 19 nt, Human
ugucuuggauaaagagugg

SEQ ID NO: 1051587 - RNA, 18 nt, Human
uuaauucauucuucuuuu

SEQ ID NO: 1051588 - RNA, 20 nt, Human
uucccgcacaaguccccaag

SEQ ID NO: 1051589 - RNA, 22 nt, Human
uucccuggcaccgaggacucga

SEQ ID NO: 1051590 - RNA, 20 nt, Human
uuucccgccacugccuucca

SEQ ID NO: 1051591 - RNA, 24 nt, Human
acacccuucuucuugggccaugcc

SEQ ID NO: 1051592 - RNA, 21 nt, Human
accgccauuucucccuccucc

SEQ ID NO: 1051593 - RNA, 23 nt, Human
agaaaucucagggggaaaagccc

SEQ ID NO: 1051594 - RNA, 22 nt, Human
agaaucccucaggccagcuccg

SEQ ID NO: 1051595 - RNA, 21 nt, Human
agccugaggccaccgccauuu

SEQ ID NO: 1051596 - RNA, 23 nt, Human
aguggcagaagggcaaaggcccg

SEQ ID NO: 1051597 - RNA, 27 nt, Human
augccuccuccgcccuugggugcccca

SEQ ID NO: 1051598 - RNA, 19 nt, Human
caaaggcccgggcgaaggc

SEQ ID NO: 1051599 - RNA, 20 nt, Human
caaaggcccgggcgaaggcg

SEQ ID NO: 1051600 - RNA, 19 nt, Human
caccucggaaggacaggau

SEQ ID NO: 1051601 - RNA, 24 nt, Human
ccugucugacagggagggcugugg

SEQ ID NO: 1051602 - RNA, 18 nt, Human
cuccucuucacacccuuc

SEQ ID NO: 1051603 - RNA, 21 nt, Human
cugcagugcugagccugaggc

SEQ ID NO: 1051604 - RNA, 23 nt, Human
gaaagugggguccaggucccaca

SEQ ID NO: 1051605 - RNA, 18 nt, Human
gagcggcgacggagaaag

SEQ ID NO: 1051606 - RNA, 20 nt, Human
gcucccccgaggccgcgucc

SEQ ID NO: 1051607 - RNA, 23 nt, Human
gggccaugccuccuccgcccuug

SEQ ID NO: 1051608 - RNA, 18 nt, Human
gggcgaaggcgcugaaga

SEQ ID NO: 1051609 - RNA, 19 nt, Human
uaaggagaacaccaucuuu

SEQ ID NO: 1051610 - RNA, 22 nt, Human
uaggaaaguggcagaagggcaa

SEQ ID NO: 1051611 - RNA, 24 nt, Human
ucacacccuucuucuugggccaug

SEQ ID NO: 1051612 - RNA, 23 nt, Human
ucagagcugcagugcugagccug

SEQ ID NO: 1051613 - RNA, 18 nt, Human
ucgcaggccccgcggcuc

SEQ ID NO: 1051614 - RNA, 24 nt, Human
ucucagggggaaaagccccugugg

SEQ ID NO: 1051615 - RNA, 23 nt, Human
ucucccuccuccucuucacaccc

SEQ ID NO: 1051616 - RNA, 22 nt, Human
ucuccggaaagugggguccagg

SEQ ID NO: 1051617 - RNA, 21 nt, Human
ucuucacacccuucuucuugg

SEQ ID NO: 1051618 - RNA, 19 nt, Human
ugacagggagggcuguggc

SEQ ID NO: 1051619 - RNA, 23 nt, Human
ugcugagccugaggccaccgcca

SEQ ID NO: 1051620 - RNA, 24 nt, Human
uuaccacuugucugaguuucuuca

SEQ ID NO: 1051621 - RNA, 21 nt, Human
uucaaaaacuucccaccaguu

SEQ ID NO: 1051622 - RNA, 19 nt, Human
uucacacccuucuucuugg

SEQ ID NO: 1051623 - RNA, 18 nt, Human
cccacacucagugugggg

SEQ ID NO: 1051624 - RNA, 20 nt, Human
aacgcccggcucuuggcugg

SEQ ID NO: 1051625 - RNA, 18 nt, Human
aagacaaaaauaaaaaag

SEQ ID NO: 1051626 - RNA, 18 nt, Human
aagagcugggagggggcu

SEQ ID NO: 1051627 - RNA, 19 nt, Human
aagagcugggagggggcug

SEQ ID NO: 1051628 - RNA, 21 nt, Human
accccaggcccgagguccccg

SEQ ID NO: 1051629 - RNA, 21 nt, Human
agacaaaaauaaaaaagaaaa

SEQ ID NO: 1051630 - RNA, 19 nt, Human
agcgcucagcagccccgga

SEQ ID NO: 1051631 - RNA, 23 nt, Human
agcugaaggggacuggggaagcc

SEQ ID NO: 1051632 - RNA, 20 nt, Human
aggaggaggugggagcugcc

SEQ ID NO: 1051633 - RNA, 21 nt, Human
aggcuccgggggugggggcag

SEQ ID NO: 1051634 - RNA, 21 nt, Human
aguuaaaaaaaaaaaaaacuc

SEQ ID NO: 1051635 - RNA, 22 nt, Human
auaacaauagaaaaaguaauac

SEQ ID NO: 1051636 - RNA, 19 nt, Human
cagagguccuggggcugag

SEQ ID NO: 1051637 - RNA, 18 nt, Human
ccccaggcccgagguccc

SEQ ID NO: 1051638 - RNA, 23 nt, Human
ccccgucccgcucuccuaguccc

SEQ ID NO: 1051639 - RNA, 21 nt, Human
cccgccagagucaggcuucug

SEQ ID NO: 1051640 - RNA, 19 nt, Human
ccgggggugggggcagggg

SEQ ID NO: 1051641 - RNA, 23 nt, Human
ccgggggugggggcaggggcggg

SEQ ID NO: 1051642 - RNA, 19 nt, Human
ccucgcucgcggcucccuc

SEQ ID NO: 1051643 - RNA, 19 nt, Human
ccucuccucucuccacuca

SEQ ID NO: 1051644 - RNA, 21 nt, Human
ccugcagaccccaggcccgag

SEQ ID NO: 1051645 - RNA, 20 nt, Human
ccuggagcccacaggcgccc

SEQ ID NO: 1051646 - RNA, 20 nt, Human
ccuugugacccacagguucu

SEQ ID NO: 1051647 - RNA, 26 nt, Human
cgucccgcucuccuagucccggagcc

SEQ ID NO: 1051648 - RNA, 21 nt, Human
cgugcgccagggacccagggg

SEQ ID NO: 1051649 - RNA, 19 nt, Human
cuagggcaggaggcugaag

SEQ ID NO: 1051650 - RNA, 22 nt, Human
cuccucucuccacucacucucc

SEQ ID NO: 1051651 - RNA, 20 nt, Human
cucgcagugucgcggcagcg

SEQ ID NO: 1051652 - RNA, 18 nt, Human
cucgcugggucugaacca

SEQ ID NO: 1051653 - RNA, 19 nt, Human
cucucuccacucacucucc

SEQ ID NO: 1051654 - RNA, 24 nt, Human
cugcagaccccaggcccgaggucc

SEQ ID NO: 1051655 - RNA, 22 nt, Human
cuggagcccacaggcgccccug

SEQ ID NO: 1051656 - RNA, 26 nt, Human
cuucguugccucuccucucuccacuc

SEQ ID NO: 1051657 - RNA, 19 nt, Human
gaaccaggagcagcugaga

SEQ ID NO: 1051658 - RNA, 18 nt, Human
gaagugccgcgugcgcca

SEQ ID NO: 1051659 - RNA, 20 nt, Human
gagcagcagggacggucggg

SEQ ID NO: 1051660 - RNA, 21 nt, Human
gagcagcagggacggucgggg

SEQ ID NO: 1051661 - RNA, 19 nt, Human
gagcccacaggcgccccug

SEQ ID NO: 1051662 - RNA, 21 nt, Human
gagcccacggccgccagcuga

SEQ ID NO: 1051663 - RNA, 20 nt, Human
gagcugggagggggcugccc

SEQ ID NO: 1051664 - RNA, 19 nt, Human
gaggaggugggagcugcca

SEQ ID NO: 1051665 - RNA, 24 nt, Human
gcagggacggucggggucgcggcc

SEQ ID NO: 1051666 - RNA, 22 nt, Human
gcccgagguccccgucccgcuc

SEQ ID NO: 1051667 - RNA, 23 nt, Human
gcccuggagcccacaggcgcccc

SEQ ID NO: 1051668 - RNA, 19 nt, Human
gccgcugggccuagggucc

SEQ ID NO: 1051669 - RNA, 19 nt, Human
gcggccccgggcggggcuc

SEQ ID NO: 1051670 - RNA, 21 nt, Human
ggaggagagggccgcugggcc

SEQ ID NO: 1051671 - RNA, 19 nt, Human
ggaggaggaggugggagcu

SEQ ID NO: 1051672 - RNA, 21 nt, Human
ggccaagaguuuagccgcguc

SEQ ID NO: 1051673 - RNA, 23 nt, Human
ggcuggcugcucccucgcagugu

SEQ ID NO: 1051674 - RNA, 18 nt, Human
gggagcgagcgcucagca

SEQ ID NO: 1051675 - RNA, 20 nt, Human
gggcccccugcagaccccag

SEQ ID NO: 1051676 - RNA, 21 nt, Human
gggcggggcucugaagugccg

SEQ ID NO: 1051677 - RNA, 22 nt, Human
gggcggggcucugaagugccgc

SEQ ID NO: 1051678 - RNA, 24 nt, Human
guuaaaaaaaaaaaaaacuccagu

SEQ ID NO: 1051679 - RNA, 19 nt, Human
guugccucuccucucucca

SEQ ID NO: 1051680 - RNA, 19 nt, Human
uaaugcaguuucccuuccg

SEQ ID NO: 1051681 - RNA, 26 nt, Human
uacacuuuugcaggcuccgggggugg

SEQ ID NO: 1051682 - RNA, 26 nt, Human
uauggucaaagacaaaaauaaaaaag

SEQ ID NO: 1051683 - RNA, 22 nt, Human
ucaaagacaaaaauaaaaaaga

SEQ ID NO: 1051684 - RNA, 21 nt, Human
ucccgagcgagcgccucuccc

SEQ ID NO: 1051685 - RNA, 21 nt, Human
ucccgcucuccuagucccgga

SEQ ID NO: 1051686 - RNA, 22 nt, Human
ucccuauggaggagagggccgc

SEQ ID NO: 1051687 - RNA, 18 nt, Human
uccucucuccacucacuc

SEQ ID NO: 1051688 - RNA, 26 nt, Human
ucgguaguugcaguggcuucucaauc

SEQ ID NO: 1051689 - RNA, 19 nt, Human
ucuccacucacucuccgca

SEQ ID NO: 1051690 - RNA, 21 nt, Human
ugaaccaggagcagcugagaa

SEQ ID NO: 1051691 - RNA, 24 nt, Human
ugaaccaggagcagcugagaacgu

SEQ ID NO: 1051692 - RNA, 18 nt, Human
ugaaggggacuggggaag

SEQ ID NO: 1051693 - RNA, 24 nt, Human
ugagaacgugccggggagaggccg

SEQ ID NO: 1051694 - RNA, 18 nt, Human
ugagcugcaagagcuggg

SEQ ID NO: 1051695 - RNA, 24 nt, Human
ugagcugcaagagcugggaggggg

SEQ ID NO: 1051696 - RNA, 23 nt, Human
ugcaagagcugggagggggcugc

SEQ ID NO: 1051697 - RNA, 20 nt, Human
ugccccgcggucccuagggc

SEQ ID NO: 1051698 - RNA, 19 nt, Human
ugggagggggcugccccgc

SEQ ID NO: 1051699 - RNA, 20 nt, Human
ugggagggggcugccccgcg

SEQ ID NO: 1051700 - RNA, 21 nt, Human
ugggagggggcugccccgcgg

SEQ ID NO: 1051701 - RNA, 24 nt, Human
uuaauaguuaaaaaaaaaaaaaaa

SEQ ID NO: 1051702 - RNA, 22 nt, Human
uucguugccucuccucucucca

SEQ ID NO: 1051703 - RNA, 21 nt, Human
uucugggagaggcgccgcugc

SEQ ID NO: 1051704 - RNA, 22 nt, Human
aaaaaaacccauucaaccugaa

SEQ ID NO: 1051705 - RNA, 22 nt, Human
acuuuuuuuuuuuuuuuuuuua

SEQ ID NO: 1051706 - RNA, 22 nt, Human
cacaaagccacuuccacacccu

SEQ ID NO: 1051707 - RNA, 22 nt, Human
caccacaaagccacuuccacac

SEQ ID NO: 1051708 - RNA, 22 nt, Human
cauuaaaaaaaacccauucaac

SEQ ID NO: 1051709 - RNA, 18 nt, Human
cuagaugcagauguaagg

SEQ ID NO: 1051710 - RNA, 24 nt, Human
cuuaaauauaaaucaaaauagcuc

SEQ ID NO: 1051711 - RNA, 20 nt, Human
cuugacagccaaccuuggcg

SEQ ID NO: 1051712 - RNA, 24 nt, Human
uaaacacacuauuuaacuuucagu

SEQ ID NO: 1051713 - RNA, 21 nt, Human
uacacuuauacauugguauua

SEQ ID NO: 1051714 - RNA, 22 nt, Human
uagagguggcaccacaaagcca

SEQ ID NO: 1051715 - RNA, 23 nt, Human
ucauuaaaaaaaacccauucaac

SEQ ID NO: 1051716 - RNA, 23 nt, Human
uguagaauggggguugaccuccg

SEQ ID NO: 1051717 - RNA, 24 nt, Human
uguagaauggggguugaccuccga

SEQ ID NO: 1051718 - RNA, 24 nt, Human
uuuuuuuuuuuuuuuuuacuauaa

SEQ ID NO: 1051719 - RNA, 24 nt, Human
aaaaaaaaaaauuauaccauuaac

SEQ ID NO: 1051720 - RNA, 23 nt, Human
aaaaguaugacaggcugaacuua

SEQ ID NO: 1051721 - RNA, 21 nt, Human
aaacacacagacagaaagaag

SEQ ID NO: 1051722 - RNA, 21 nt, Human
aaauaaguaguaaucaaaguc

SEQ ID NO: 1051723 - RNA, 21 nt, Human
aaauaguucacuuaucacaaa

SEQ ID NO: 1051724 - RNA, 24 nt, Human
aacacacagacagaaagaggaaag

SEQ ID NO: 1051725 - RNA, 24 nt, Human
aauaguagugauuacacugcacaa

SEQ ID NO: 1051726 - RNA, 22 nt, Human
aauccuguaacaguauuuacua

SEQ ID NO: 1051727 - RNA, 19 nt, Human
acacacagacagaaagaag

SEQ ID NO: 1051728 - RNA, 18 nt, Human
acacagacagaaagaagc

SEQ ID NO: 1051729 - RNA, 23 nt, Human
acagcaguuucuaagaagaaugc

SEQ ID NO: 1051730 - RNA, 21 nt, Human
acauaugccccccaaaaugua

SEQ ID NO: 1051731 - RNA, 24 nt, Human
accacacuuacaaauggucuggua

SEQ ID NO: 1051732 - RNA, 22 nt, Human
acugcgccuuuuuuuuccuuuu

SEQ ID NO: 1051733 - RNA, 18 nt, Human
agacagaaagaagcagua

SEQ ID NO: 1051734 - RNA, 19 nt, Human
agaugcaaauuaaaacaca

SEQ ID NO: 1051735 - RNA, 24 nt, Human
aucauucauacaagauaucacacc

SEQ ID NO: 1051736 - RNA, 24 nt, Human
augcauguauguauucaaguacaa

SEQ ID NO: 1051737 - RNA, 24 nt, Human
caaaauaaacacuaucaaacaccc

SEQ ID NO: 1051738 - RNA, 24 nt, Human
caaaguaccagggauugcuugaua

SEQ ID NO: 1051739 - RNA, 24 nt, Human
cacacagacagaaagaagcaguaa

SEQ ID NO: 1051740 - RNA, 24 nt, Human
cacacaucacucuaacuuggaccu

SEQ ID NO: 1051741 - RNA, 19 nt, Human
cacauaugccccccaaaau

SEQ ID NO: 1051742 - RNA, 22 nt, Human
cagcaaagcuuuaaacuuuuaa

SEQ ID NO: 1051743 - RNA, 23 nt, Human
cauguuuuacauuuuuuucuaau

SEQ ID NO: 1051744 - RNA, 22 nt, Human
ccaaaauuuaugguucauuucu

SEQ ID NO: 1051745 - RNA, 19 nt, Human
ccauaugcacaaccauaaa

SEQ ID NO: 1051746 - RNA, 25 nt, Human
ccccccaaccacacauaugcccccc

SEQ ID NO: 1051747 - RNA, 20 nt, Human
ccugaguuccuucuucaugg

SEQ ID NO: 1051748 - RNA, 18 nt, Human
cugcucugcuuuccauau

SEQ ID NO: 1051749 - RNA, 19 nt, Human
cugcuuaauuauaaagauc

SEQ ID NO: 1051750 - RNA, 21 nt, Human
cuuuuaacagauuccucacaa

SEQ ID NO: 1051751 - RNA, 23 nt, Human
gauagguaaucuuuugacuuucu

SEQ ID NO: 1051752 - RNA, 23 nt, Human
gcaaagcuuuaaacuuuuaacag

SEQ ID NO: 1051753 - RNA, 19 nt, Human
ggcagaugcaaauuaaaaa

SEQ ID NO: 1051754 - RNA, 23 nt, Human
guuuagcagcaugcauguaugua

SEQ ID NO: 1051755 - RNA, 20 nt, Human
guuuucuuuuucucccucag

SEQ ID NO: 1051756 - RNA, 20 nt, Human
uaaaaaaugaccacuaaaga

SEQ ID NO: 1051757 - RNA, 24 nt, Human
uaaacuuuuaacagauuccucaca

SEQ ID NO: 1051758 - RNA, 20 nt, Human
uaacagcagcuaucuacuua

SEQ ID NO: 1051759 - RNA, 25 nt, Human
uaacaguauuuacuagagaugucaa

SEQ ID NO: 1051760 - RNA, 22 nt, Human
uaacauaucuuacaauguugau

SEQ ID NO: 1051761 - RNA, 21 nt, Human
uaaguaguaaucaaagucuga

SEQ ID NO: 1051762 - RNA, 23 nt, Human
uacacacaucacucuaacuugga

SEQ ID NO: 1051763 - RNA, 20 nt, Human
uaccuggggagaagauuuau

SEQ ID NO: 1051764 - RNA, 22 nt, Human
uagcugaaccucuugagcugaa

SEQ ID NO: 1051765 - RNA, 23 nt, Human
uaguaauucauccaacugaaaug

SEQ ID NO: 1051766 - RNA, 18 nt, Human
uaguagugauuacacugc

SEQ ID NO: 1051767 - RNA, 21 nt, Human
uauaacaagccauggaagucc

SEQ ID NO: 1051768 - RNA, 22 nt, Human
uaucaaacacccaaauuuuaaa

SEQ ID NO: 1051769 - RNA, 18 nt, Human
uaucacaaagcucaguaa

SEQ ID NO: 1051770 - RNA, 19 nt, Human
uaucuacuuauuuuacagc

SEQ ID NO: 1051771 - RNA, 23 nt, Human
uaugcacaaccauaaaacauucc

SEQ ID NO: 1051772 - RNA, 22 nt, Human
uauuuuauuguagaacgauagg

SEQ ID NO: 1051773 - RNA, 23 nt, Human
uauuuuauuguagaacgauaggu

SEQ ID NO: 1051774 - RNA, 21 nt, Human
ucaaauaaaucacacccacuc

SEQ ID NO: 1051775 - RNA, 24 nt, Human
ucaaauaaaucacacccacucuaa

SEQ ID NO: 1051776 - RNA, 18 nt, Human
ucagaguuucaaacugua

SEQ ID NO: 1051777 - RNA, 26 nt, Human
uccagauauuaaaaaaaaaaaauuau

SEQ ID NO: 1051778 - RNA, 23 nt, Human
uccugaguuccuucuucauggag

SEQ ID NO: 1051779 - RNA, 22 nt, Human
ucguaagacuuuucugcaucac

SEQ ID NO: 1051780 - RNA, 20 nt, Human
ucuacuuauuuuacagcuau

SEQ ID NO: 1051781 - RNA, 24 nt, Human
ugaauacauuauaccauguauaua

SEQ ID NO: 1051782 - RNA, 22 nt, Human
ugacaggcugaacuuaugauac

SEQ ID NO: 1051783 - RNA, 18 nt, Human
ugagcugaaaggaaguuc

SEQ ID NO: 1051784 - RNA, 24 nt, Human
ugagggucaucaccacugcgccuu

SEQ ID NO: 1051785 - RNA, 21 nt, Human
ugcucugcuuuccauauuuua

SEQ ID NO: 1051786 - RNA, 21 nt, Human
uggaaguccaaaguaccaggg

SEQ ID NO: 1051787 - RNA, 25 nt, Human
uggaaguccaaaguaccagggauug

SEQ ID NO: 1051788 - RNA, 25 nt, Human
uguagaacgauagguaaucuuuuga

SEQ ID NO: 1051789 - RNA, 20 nt, Human
ugugaacaaguugugcuucu

SEQ ID NO: 1051790 - RNA, 21 nt, Human
ugugcacuuaaaaaaugacca

SEQ ID NO: 1051791 - RNA, 22 nt, Human
uguuuaguuuauuuuuacaugu

SEQ ID NO: 1051792 - RNA, 19 nt, Human
uguuuucuuuuucucccuc

SEQ ID NO: 1051793 - RNA, 24 nt, Human
uuaaaaaaguagcaauguguugga

SEQ ID NO: 1051794 - RNA, 22 nt, Human
uuaugauacaguauuuaaaaaa

SEQ ID NO: 1051795 - RNA, 23 nt, Human
uucacauaaaucauguuuuacau

SEQ ID NO: 1051796 - RNA, 22 nt, Human
uucacauccauaugcacaacca

SEQ ID NO: 1051797 - RNA, 20 nt, Human
uuccuuuaaauaguucacuu

SEQ ID NO: 1051798 - RNA, 21 nt, Human
uuguuauuaauguucuccaga

SEQ ID NO: 1051799 - RNA, 18 nt, Human
uuuaugaaauuccugaga

SEQ ID NO: 1051800 - RNA, 19 nt, Human
uuuccauguauuuuauugu

SEQ ID NO: 1051801 - RNA, 18 nt, Human
aaagugcugggauuacaa

SEQ ID NO: 1051802 - RNA, 24 nt, Human
aaagugcugggauuacaaguguga

SEQ ID NO: 1051803 - RNA, 18 nt, Human
aacagacacucaauacau

SEQ ID NO: 1051804 - RNA, 18 nt, Human
aacagcauuauuauuacc

SEQ ID NO: 1051805 - RNA, 21 nt, Human
aagaaaaaaaaugcuuaggca

SEQ ID NO: 1051806 - RNA, 19 nt, Human
aaggaaggaaagugagggg

SEQ ID NO: 1051807 - RNA, 20 nt, Human
aaggugcugggauuacaggc

SEQ ID NO: 1051808 - RNA, 24 nt, Human
aaggugcugggauuacaggcauga

SEQ ID NO: 1051809 - RNA, 19 nt, Human
aaguaaacugccucagugu

SEQ ID NO: 1051810 - RNA, 22 nt, Human
aaguagcugggaucacaggcau

SEQ ID NO: 1051811 - RNA, 24 nt, Human
aaguagcugggaucacaggcaugc

SEQ ID NO: 1051812 - RNA, 18 nt, Human
aagugcugggauuacaag

SEQ ID NO: 1051813 - RNA, 19 nt, Human
aagugcugggauuacaagu

SEQ ID NO: 1051814 - RNA, 24 nt, Human
aauuuuuuguauuuaguagagaug

SEQ ID NO: 1051815 - RNA, 26 nt, Human
acaaagagagacacagagaacaccau

SEQ ID NO: 1051816 - RNA, 24 nt, Human
acaauaggugcaugacaccaggcc

SEQ ID NO: 1051817 - RNA, 21 nt, Human
acagcaaccucugccucccgg

SEQ ID NO: 1051818 - RNA, 21 nt, Human
acagcaaccucugccucccgg

SEQ ID NO: 1051819 - RNA, 22 nt, Human
acagcaaccucugccucccggg

SEQ ID NO: 1051820 - RNA, 19 nt, Human
acaggguuucaccaugcug

SEQ ID NO: 1051821 - RNA, 20 nt, Human
acaggguuucaccaugcugg

SEQ ID NO: 1051822 - RNA, 24 nt, Human
acaggguuucaccaugcuggccag

SEQ ID NO: 1051823 - RNA, 23 nt, Human
acccaggcuggagugcaguggug

SEQ ID NO: 1051824 - RNA, 24 nt, Human
acccaggcuggagugcaguggugu

SEQ ID NO: 1051825 - RNA, 23 nt, Human
accucagccucucaaguagcugg

SEQ ID NO: 1051826 - RNA, 24 nt, Human
accugaauuuuugccgcccaacac

SEQ ID NO: 1051827 - RNA, 19 nt, Human
acuacaggcgugugccacc

SEQ ID NO: 1051828 - RNA, 20 nt, Human
acugcacccagccaaugcag

SEQ ID NO: 1051829 - RNA, 18 nt, Human
aggaaagugaggggggcc

SEQ ID NO: 1051830 - RNA, 18 nt, Human
aggaaggaaagugagggg

SEQ ID NO: 1051831 - RNA, 18 nt, Human
aggaaggaaagugagggg

SEQ ID NO: 1051832 - RNA, 18 nt, Human
aggcaauccuccugccuc

SEQ ID NO: 1051833 - RNA, 25 nt, Human
aggcaauccuccugccucagccucc

SEQ ID NO: 1051834 - RNA, 19 nt, Human
aggcagugggcuccuggac

SEQ ID NO: 1051835 - RNA, 24 nt, Human
aggcgugugccaccacacccagcu

SEQ ID NO: 1051836 - RNA, 19 nt, Human
agggguaugacuggaaagg

SEQ ID NO: 1051837 - RNA, 24 nt, Human
aggugauccaccugccucggccuu

SEQ ID NO: 1051838 - RNA, 26 nt, Human
aggugcugggauuacaggcaugagcc

SEQ ID NO: 1051839 - RNA, 22 nt, Human
aguaaagacaggguuucaccau

SEQ ID NO: 1051840 - RNA, 22 nt, Human
aguagagaugggguuucgccau

SEQ ID NO: 1051841 - RNA, 23 nt, Human
aguagcugggacuacaggcgugu

SEQ ID NO: 1051842 - RNA, 28 nt, Human
agugaggggggcaaaguugaggaaagga

SEQ ID NO: 1051843 - RNA, 23 nt, Human
agugcaguggugugauaacagcu

SEQ ID NO: 1051844 - RNA, 24 nt, Human
agugcaguggugugauaacagcuc

SEQ ID NO: 1051845 - RNA, 24 nt, Human
agugcugggauuacaagugugagu

SEQ ID NO: 1051846 - RNA, 23 nt, Human
aguugaggaaaggaagaaggacu

SEQ ID NO: 1051847 - RNA, 21 nt, Human
auccuccugccucagccuccc

SEQ ID NO: 1051848 - RNA, 24 nt, Human
augauccaccugccucggccuccc

SEQ ID NO: 1051849 - RNA, 20 nt, Human
augggguuucgccauguugg

SEQ ID NO: 1051850 - RNA, 23 nt, Human
augggguuucgccauguugguca

SEQ ID NO: 1051851 - RNA, 24 nt, Human
augggguuucgccauguuggucau

SEQ ID NO: 1051852 - RNA, 23 nt, Human
auucuuguugcccaggcuggagu

SEQ ID NO: 1051853 - RNA, 24 nt, Human
auucuuguugcccaggcuggagug

SEQ ID NO: 1051854 - RNA, 22 nt, Human
auuuucccaccucagccucuca

SEQ ID NO: 1051855 - RNA, 25 nt, Human
caaacuccugggcucaggcaauccu

SEQ ID NO: 1051856 - RNA, 24 nt, Human
caaagugcugggauuacaagugug

SEQ ID NO: 1051857 - RNA, 21 nt, Human
caacacuuucagaaacuucaa

SEQ ID NO: 1051858 - RNA, 21 nt, Human
caaggugcugggauuacaggc

SEQ ID NO: 1051859 - RNA, 23 nt, Human
caaggugcugggauuacaggcau

SEQ ID NO: 1051860 - RNA, 24 nt, Human
caaggugcugggauuacaggcaug

SEQ ID NO: 1051861 - RNA, 26 nt, Human
caaugcacaguagguacuaaaugaac

SEQ ID NO: 1051862 - RNA, 23 nt, Human
cacaggcaugcgccaccaugccc

SEQ ID NO: 1051863 - RNA, 24 nt, Human
caccacacccagcuaauuuuugua

SEQ ID NO: 1051864 - RNA, 22 nt, Human
caccaugcuggccaggaugguc

SEQ ID NO: 1051865 - RNA, 24 nt, Human
caccaugcuggccaggauggucuc

SEQ ID NO: 1051866 - RNA, 24 nt, Human
cacccaggcuggagugcaguggug

SEQ ID NO: 1051867 - RNA, 21 nt, Human
cacccucaaacuccugggcuc

SEQ ID NO: 1051868 - RNA, 18 nt, Human
caccgugcccagcccucc

SEQ ID NO: 1051869 - RNA, 23 nt, Human
caccugccucggccucccaaagu

SEQ ID NO: 1051870 - RNA, 24 nt, Human
cacuccacccucaaacuccugggc

SEQ ID NO: 1051871 - RNA, 21 nt, Human
cacugcaacuucugccuccug

SEQ ID NO: 1051872 - RNA, 23 nt, Human
cacugcaacuucugccuccuggg

SEQ ID NO: 1051873 - RNA, 21 nt, Human
cagcccuccuucagcuuucua

SEQ ID NO: 1051874 - RNA, 20 nt, Human
cagccuccugaguagcuggg

SEQ ID NO: 1051875 - RNA, 22 nt, Human
caggcaauccuccugccucagc

SEQ ID NO: 1051876 - RNA, 24 nt, Human
caggguuucaccaugcuggccagg

SEQ ID NO: 1051877 - RNA, 22 nt, Human
caggugauccaccugccucggc

SEQ ID NO: 1051878 - RNA, 23 nt, Human
cagugggcuccuggacaucuugc

SEQ ID NO: 1051879 - RNA, 22 nt, Human
caugcuggucucaaacuccuga

SEQ ID NO: 1051880 - RNA, 23 nt, Human
cauucuuguugcccaggcuggag

SEQ ID NO: 1051881 - RNA, 18 nt, Human
cauugugugacuggcagu

SEQ ID NO: 1051882 - RNA, 21 nt, Human
ccaaagugcugggauuacaag

SEQ ID NO: 1051883 - RNA, 24 nt, Human
ccaaagugcugggauuacaagugu

SEQ ID NO: 1051884 - RNA, 20 nt, Human
ccaccacacccagcuaauuu

SEQ ID NO: 1051885 - RNA, 21 nt, Human
ccacugcacccagccaaugca

SEQ ID NO: 1051886 - RNA, 24 nt, Human
ccagaggcacaaagagagacacag

SEQ ID NO: 1051887 - RNA, 18 nt, Human
ccagcccuccuucagcuu

SEQ ID NO: 1051888 - RNA, 22 nt, Human
ccauguuggucaugcuggucuc

SEQ ID NO: 1051889 - RNA, 23 nt, Human
ccuaccucagccuccugaguagc

SEQ ID NO: 1051890 - RNA, 24 nt, Human
ccuccuggguucaagcgauucucc

SEQ ID NO: 1051891 - RNA, 21 nt, Human
ccugaccucaggugauccacc

SEQ ID NO: 1051892 - RNA, 23 nt, Human
ccugaccucaggugauccaccug

SEQ ID NO: 1051893 - RNA, 23 nt, Human
ccugaccucaggugauccaccug

SEQ ID NO: 1051894 - RNA, 23 nt, Human
ccugaguagcugggacuacaggc

SEQ ID NO: 1051895 - RNA, 24 nt, Human
ccugaguagcugggacuacaggcg

SEQ ID NO: 1051896 - RNA, 24 nt, Human
ccugccucggccucccaaagugcu

SEQ ID NO: 1051897 - RNA, 18 nt, Human
ccuucagcuuucuaaggc

SEQ ID NO: 1051898 - RNA, 24 nt, Human
cgccauguuggucaugcuggucuc

SEQ ID NO: 1051899 - RNA, 20 nt, Human
cgugugccaccacacccagc

SEQ ID NO: 1051900 - RNA, 21 nt, Human
cuaacagacacucaauacaug

SEQ ID NO: 1051901 - RNA, 20 nt, Human
cuaauuuuuguauuuuuaga

SEQ ID NO: 1051902 - RNA, 23 nt, Human
cuaccucagccuccugaguagcu

SEQ ID NO: 1051903 - RNA, 18 nt, Human
cucacuccacccucaaac

SEQ ID NO: 1051904 - RNA, 24 nt, Human
cucacugcaacuucugccuccugg

SEQ ID NO: 1051905 - RNA, 24 nt, Human
cucagccuccugaguagcugggac

SEQ ID NO: 1051906 - RNA, 24 nt, Human
cucagccucucaaguagcugggau

SEQ ID NO: 1051907 - RNA, 23 nt, Human
cuccacccucaaacuccugggcu

SEQ ID NO: 1051908 - RNA, 22 nt, Human
cuccuaccucagccuccugagu

SEQ ID NO: 1051909 - RNA, 23 nt, Human
cuccugggcucaggcaauccucc

SEQ ID NO: 1051910 - RNA, 21 nt, Human
cuccuggguucaagcgauucu

SEQ ID NO: 1051911 - RNA, 20 nt, Human
cucugucacccaggcuggag

SEQ ID NO: 1051912 - RNA, 23 nt, Human
cugcaacuucugccuccuggguu

SEQ ID NO: 1051913 - RNA, 24 nt, Human
cugcaacuucugccuccuggguuc

SEQ ID NO: 1051914 - RNA, 20 nt, Human
cuggaaaggaaaaaggaagg

SEQ ID NO: 1051915 - RNA, 24 nt, Human
cuuacagcaaccucugccucccgg

SEQ ID NO: 1051916 - RNA, 19 nt, Human
cuuccucuccuuuuauguc

SEQ ID NO: 1051917 - RNA, 24 nt, Human
cuugcucugucacccaggcuggag

SEQ ID NO: 1051918 - RNA, 24 nt, Human
gaccucaggugauccaccugccuc

SEQ ID NO: 1051919 - RNA, 22 nt, Human
gaccucaugauccaccugccuc

SEQ ID NO: 1051920 - RNA, 22 nt, Human
gaccucaugauccaccugccuc

SEQ ID NO: 1051921 - RNA, 20 nt, Human
gacgccgcggggcggacgcc

SEQ ID NO: 1051922 - RNA, 18 nt, Human
gagacaauaggugcauga

SEQ ID NO: 1051923 - RNA, 19 nt, Human
gagacucaguuuccucauc

SEQ ID NO: 1051924 - RNA, 24 nt, Human
gagaugggguuucgccauguuggu

SEQ ID NO: 1051925 - RNA, 20 nt, Human
gaguagcugggacuacaggc

SEQ ID NO: 1051926 - RNA, 25 nt, Human
gaguagcugggacuacaggcgugug

SEQ ID NO: 1051927 - RNA, 22 nt, Human
gaucacaggcaugcgccaccau

SEQ ID NO: 1051928 - RNA, 18 nt, Human
gauuacaagugugaguca

SEQ ID NO: 1051929 - RNA, 24 nt, Human
gauuacaagugugagucaccgugc

SEQ ID NO: 1051930 - RNA, 18 nt, Human
gauuacaggcaugagcca

SEQ ID NO: 1051931 - RNA, 22 nt, Human
gauuacaggcaugagccacugc

SEQ ID NO: 1051932 - RNA, 23 nt, Human
gauuacaggcaugagccacugca

SEQ ID NO: 1051933 - RNA, 21 nt, Human
gauucuccuaccucagccucc

SEQ ID NO: 1051934 - RNA, 22 nt, Human
gcaaccucugccucccggguuc

SEQ ID NO: 1051935 - RNA, 19 nt, Human
gcacgacaccugaaggaag

SEQ ID NO: 1051936 - RNA, 23 nt, Human
gccauguuggucaugcuggucuc

SEQ ID NO: 1051937 - RNA, 19 nt, Human
gcccaggcuggagugcaau

SEQ ID NO: 1051938 - RNA, 25 nt, Human
gcucugucacccaggcuggagugca

SEQ ID NO: 1051939 - RNA, 23 nt, Human
gcuggucucaaacuccugaccuc

SEQ ID NO: 1051940 - RNA, 19 nt, Human
ggacuacaggcgugugcca

SEQ ID NO: 1051941 - RNA, 22 nt, Human
ggauuacaggcaugagccacug

SEQ ID NO: 1051942 - RNA, 22 nt, Human
ggcuggagugcaguggugugau

SEQ ID NO: 1051943 - RNA, 22 nt, Human
gggcucaggcaauccuccugcc

SEQ ID NO: 1051944 - RNA, 21 nt, Human
gggguuucgccauguugguca

SEQ ID NO: 1051945 - RNA, 18 nt, Human
ggugcugggauuacaggc

SEQ ID NO: 1051946 - RNA, 23 nt, Human
guagagaugggguuucgccaugu

SEQ ID NO: 1051947 - RNA, 23 nt, Human
gucaugcuggucucaaacuccug

SEQ ID NO: 1051948 - RNA, 22 nt, Human
gucuuauuuaucuuuggaucca

SEQ ID NO: 1051949 - RNA, 22 nt, Human
gugauccaccugccucggccuu

SEQ ID NO: 1051950 - RNA, 21 nt, Human
gugcugggauuacaggcauga

SEQ ID NO: 1051951 - RNA, 19 nt, Human
gugugccaccacacccagc

SEQ ID NO: 1051952 - RNA, 22 nt, Human
uaacagaaacauaccuaguuac

SEQ ID NO: 1051953 - RNA, 22 nt, Human
uaacagacacucaauacauggu

SEQ ID NO: 1051954 - RNA, 24 nt, Human
uaacagcucacuccacccucaaac

SEQ ID NO: 1051955 - RNA, 21 nt, Human
uaagagauacugaauguaaac

SEQ ID NO: 1051956 - RNA, 24 nt, Human
uaauuuuuguauuuuuaguaaaga

SEQ ID NO: 1051957 - RNA, 22 nt, Human
uaauuuuuuguauuuaguagag

SEQ ID NO: 1051958 - RNA, 23 nt, Human
uacagcaaccucugccucccggg

SEQ ID NO: 1051959 - RNA, 24 nt, Human
uacaggcaugagccacugcaccca

SEQ ID NO: 1051960 - RNA, 24 nt, Human
uacaggcgugugccaccacaccca

SEQ ID NO: 1051961 - RNA, 24 nt, Human
uaccucagccuccugaguagcugg

SEQ ID NO: 1051962 - RNA, 22 nt, Human
uagagaugggguuucgccaugu

SEQ ID NO: 1051963 - RNA, 21 nt, Human
uaggugcaugacaccaggccc

SEQ ID NO: 1051964 - RNA, 24 nt, Human
uaguaaagacaggguuucaccaug

SEQ ID NO: 1051965 - RNA, 25 nt, Human
uaguaaagacaggguuucaccaugc

SEQ ID NO: 1051966 - RNA, 24 nt, Human
uaguagagaugggguuucgccaug

SEQ ID NO: 1051967 - RNA, 24 nt, Human
uauuuaguagagaugggguuucgc

SEQ ID NO: 1051968 - RNA, 28 nt, Human
ucaaaacaaugaugucuuggucucccuc

SEQ ID NO: 1051969 - RNA, 22 nt, Human
ucaaggugcugggauuacaggc

SEQ ID NO: 1051970 - RNA, 23 nt, Human
ucaaggugcugggauuacaggca

SEQ ID NO: 1051971 - RNA, 24 nt, Human
ucaaggugcugggauuacaggcau

SEQ ID NO: 1051972 - RNA, 24 nt, Human
ucaccaugcuggccaggauggucu

SEQ ID NO: 1051973 - RNA, 22 nt, Human
ucacccaggcuggagugcagug

SEQ ID NO: 1051974 - RNA, 24 nt, Human
ucacugcaacuucugccuccuggg

SEQ ID NO: 1051975 - RNA, 25 nt, Human
ucacugcaacuucugccuccugggu

SEQ ID NO: 1051976 - RNA, 23 nt, Human
ucagccuccugaguagcugggac

SEQ ID NO: 1051977 - RNA, 22 nt, Human
ucagcuuucuaaggcagugggc

SEQ ID NO: 1051978 - RNA, 21 nt, Human
ucaggugauccaccugccucg

SEQ ID NO: 1051979 - RNA, 24 nt, Human
ucauacuuugcaccuaacagacac

SEQ ID NO: 1051980 - RNA, 21 nt, Human
ucauucuuguugcccaggcug

SEQ ID NO: 1051981 - RNA, 23 nt, Human
ucauucuuguugcccaggcugga

SEQ ID NO: 1051982 - RNA, 20 nt, Human
uccauuauuggaacacuaag

SEQ ID NO: 1051983 - RNA, 18 nt, Human
ucccaaagugcugggauu

SEQ ID NO: 1051984 - RNA, 23 nt, Human
ucccaaagugcugggauuacaag

SEQ ID NO: 1051985 - RNA, 25 nt, Human
ucccccaggcaccugaauuuuugcc

SEQ ID NO: 1051986 - RNA, 18 nt, Human
ucccggguucaagccauu

SEQ ID NO: 1051987 - RNA, 18 nt, Human
ucccggguucaagccauu

SEQ ID NO: 1051988 - RNA, 21 nt, Human
ucccggguucaagccauuuuc

SEQ ID NO: 1051989 - RNA, 20 nt, Human
ucccucugcggcccgccaga

SEQ ID NO: 1051990 - RNA, 27 nt, Human
uccuccugccucagccucccaaguaac

SEQ ID NO: 1051991 - RNA, 24 nt, Human
uccugaguagcugggacuacaggc

SEQ ID NO: 1051992 - RNA, 18 nt, Human
uccugggcucaggcaauc

SEQ ID NO: 1051993 - RNA, 24 nt, Human
uccugggcucaggcaauccuccug

SEQ ID NO: 1051994 - RNA, 21 nt, Human
uccuggguucaagcgauucuc

SEQ ID NO: 1051995 - RNA, 23 nt, Human
uccuggguucaagcgauucuccu

SEQ ID NO: 1051996 - RNA, 22 nt, Human
ucgccauguuggucaugcuggu

SEQ ID NO: 1051997 - RNA, 24 nt, Human
ucucaaguagcugggaucacaggc

SEQ ID NO: 1051998 - RNA, 18 nt, Human
ucucacucuguaguuuga

SEQ ID NO: 1051999 - RNA, 24 nt, Human
ucugucacccaggcuggagugcag

SEQ ID NO: 1052000 - RNA, 23 nt, Human
ucuugcucugucacccaggcugg

SEQ ID NO: 1052001 - RNA, 24 nt, Human
ucuugcucugucacccaggcugga

SEQ ID NO: 1052002 - RNA, 22 nt, Human
ucuuguugcccaggcuggagug

SEQ ID NO: 1052003 - RNA, 24 nt, Human
ugaccucaggugauccaccugccu

SEQ ID NO: 1052004 - RNA, 25 nt, Human
ugaccucaugauccaccugccucgg

SEQ ID NO: 1052005 - RNA, 21 nt, Human
ugaggggggcaaaguugagga

SEQ ID NO: 1052006 - RNA, 25 nt, Human
ugcaccuaacagacacucaauacau

SEQ ID NO: 1052007 - RNA, 18 nt, Human
ugcccaggcuggagugca

SEQ ID NO: 1052008 - RNA, 21 nt, Human
ugcccaggcuggagugcaaug

SEQ ID NO: 1052009 - RNA, 21 nt, Human
ugcccaggcuggagugcaaug

SEQ ID NO: 1052010 - RNA, 23 nt, Human
ugcccggcuaauuuuuuguauuu

SEQ ID NO: 1052011 - RNA, 24 nt, Human
ugccucagccucccaaguaacuga

SEQ ID NO: 1052012 - RNA, 19 nt, Human
ugccucccggguucaagcc

SEQ ID NO: 1052013 - RNA, 21 nt, Human
ugccucggccucccaaagugc

SEQ ID NO: 1052014 - RNA, 24 nt, Human
ugccucggccucccaaagugcugg

SEQ ID NO: 1052015 - RNA, 24 nt, Human
ugcugggauuacaagugugaguca

SEQ ID NO: 1052016 - RNA, 22 nt, Human
ugcuuaggcauagaacagaaca

SEQ ID NO: 1052017 - RNA, 23 nt, Human
uggagugcaaugguacaaucuca

SEQ ID NO: 1052018 - RNA, 24 nt, Human
uggagugcaaugguacaaucucag

SEQ ID NO: 1052019 - RNA, 19 nt, Human
uggagugcaguggugugau

SEQ ID NO: 1052020 - RNA, 23 nt, Human
uggagugcaguggugugauaaca

SEQ ID NO: 1052021 - RNA, 28 nt, Human
uggagugcaguggugugauggcucuagc

SEQ ID NO: 1052022 - RNA, 21 nt, Human
uggccaggauggucucaaucu

SEQ ID NO: 1052023 - RNA, 18 nt, Human
ugggacuacaggcgugug

SEQ ID NO: 1052024 - RNA, 21 nt, Human
ugggacuacaggcgugugcca

SEQ ID NO: 1052025 - RNA, 22 nt, Human
ugggacuacaggcgugugccac

SEQ ID NO: 1052026 - RNA, 24 nt, Human
ugggacuacaggcgugugccacca

SEQ ID NO: 1052027 - RNA, 21 nt, Human
ugggaucacaggcaugcgcca

SEQ ID NO: 1052028 - RNA, 22 nt, Human
ugggaucacaggcaugcgccac

SEQ ID NO: 1052029 - RNA, 24 nt, Human
ugggaucacaggcaugcgccacca

SEQ ID NO: 1052030 - RNA, 21 nt, Human
ugggauuacaagugugaguca

SEQ ID NO: 1052031 - RNA, 22 nt, Human
ugggauuacaagugugagucac

SEQ ID NO: 1052032 - RNA, 23 nt, Human
ugggauuacaagugugagucacc

SEQ ID NO: 1052033 - RNA, 23 nt, Human
ugggauuacaagugugagucacc

SEQ ID NO: 1052034 - RNA, 24 nt, Human
ugggauuacaagugugagucaccg

SEQ ID NO: 1052035 - RNA, 19 nt, Human
ugggauuacaggcaugagc

SEQ ID NO: 1052036 - RNA, 21 nt, Human
ugggauuacaggcaugagcca

SEQ ID NO: 1052037 - RNA, 22 nt, Human
ugggauuacaggcaugagccac

SEQ ID NO: 1052038 - RNA, 22 nt, Human
ugggauuacaggcaugagccac

SEQ ID NO: 1052039 - RNA, 24 nt, Human
ugggauuacaggcaugagccacug

SEQ ID NO: 1052040 - RNA, 26 nt, Human
ugggauuacaggcaugagccacugca

SEQ ID NO: 1052041 - RNA, 24 nt, Human
ugggcucaggcaauccuccugccu

SEQ ID NO: 1052042 - RNA, 21 nt, Human
ugggcuccuggacaucuugcc

SEQ ID NO: 1052043 - RNA, 22 nt, Human
ugggguuucgccauguugguca

SEQ ID NO: 1052044 - RNA, 24 nt, Human
ugggguuucgccauguuggucaug

SEQ ID NO: 1052045 - RNA, 23 nt, Human
uggguucaagcgauucuccuacc

SEQ ID NO: 1052046 - RNA, 24 nt, Human
ugguacaaucucagcuuacagcaa

SEQ ID NO: 1052047 - RNA, 24 nt, Human
uggucaugcuggucucaaacuccu

SEQ ID NO: 1052048 - RNA, 20 nt, Human
uguugcccaggcuggagugc

SEQ ID NO: 1052049 - RNA, 22 nt, Human
uguugcccaggcuggagugcaa

SEQ ID NO: 1052050 - RNA, 25 nt, Human
uguuuuguuuuguuuuguuuugauu

SEQ ID NO: 1052051 - RNA, 24 nt, Human
uuacagcaaccucugccucccggg

SEQ ID NO: 1052052 - RNA, 25 nt, Human
uuacauauuuuaugcuuaauuugaa

SEQ ID NO: 1052053 - RNA, 24 nt, Human
uuaguaaagacaggguuucaccau

SEQ ID NO: 1052054 - RNA, 18 nt, Human
uuaguagagaugggguuu

SEQ ID NO: 1052055 - RNA, 22 nt, Human
uuaguagagaugggguuucgcc

SEQ ID NO: 1052056 - RNA, 24 nt, Human
uuaguagagaugggguuucgccau

SEQ ID NO: 1052057 - RNA, 20 nt, Human
uucaagccauuuucccaccu

SEQ ID NO: 1052058 - RNA, 24 nt, Human
uucaagccauuuucccaccucagc

SEQ ID NO: 1052059 - RNA, 23 nt, Human
uucaagcgauucuccuaccucag

SEQ ID NO: 1052060 - RNA, 24 nt, Human
uucaagcgauucuccuaccucagc

SEQ ID NO: 1052061 - RNA, 24 nt, Human
uucaaggugcugggauuacaggca

SEQ ID NO: 1052062 - RNA, 24 nt, Human
uucauucuuguugcccaggcugga

SEQ ID NO: 1052063 - RNA, 23 nt, Human
uucccaccucagccucucaagua

SEQ ID NO: 1052064 - RNA, 24 nt, Human
uuccuugauuacauauuuuaugcu

SEQ ID NO: 1052065 - RNA, 18 nt, Human
uucuuguugcccaggcug

SEQ ID NO: 1052066 - RNA, 18 nt, Human
uugcccaggcuggagugc

SEQ ID NO: 1052067 - RNA, 24 nt, Human
uugcucugucacccaggcuggagu

SEQ ID NO: 1052068 - RNA, 18 nt, Human
uuggaacacuaagcaugu

SEQ ID NO: 1052069 - RNA, 21 nt, Human
uuuaguagagaugggguuucg

SEQ ID NO: 1052070 - RNA, 19 nt, Human
uuucaccaugcuggccagg

SEQ ID NO: 1052071 - RNA, 24 nt, Human
uuucauucuuguugcccaggcugg

SEQ ID NO: 1052072 - RNA, 20 nt, Human
uuugaaguauuuuuccaaug

SEQ ID NO: 1052073 - RNA, 19 nt, Human
uuuguuuuguuuuguuuug

SEQ ID NO: 1052074 - RNA, 22 nt, Human
uuuuguauuuuuaguaaagaca

SEQ ID NO: 1052075 - RNA, 24 nt, Human
uuuuuaguaaagacaggguuucac

SEQ ID NO: 1052076 - RNA, 19 nt, Human
uuuuuguauuuaguagaga

SEQ ID NO: 1052077 - RNA, 20 nt, Human
uuuuuguauuuuuaguaaag

SEQ ID NO: 1052078 - RNA, 19 nt, Human
acccaggggugauggcagc

SEQ ID NO: 1052079 - RNA, 18 nt, Human
accugcaggccaggaucu

SEQ ID NO: 1052080 - RNA, 21 nt, Human
agccucggcaaugccacagcc

SEQ ID NO: 1052081 - RNA, 18 nt, Human
agcgccuggacuuuggcc

SEQ ID NO: 1052082 - RNA, 26 nt, Human
cagcuggccuucuccagcagggagac

SEQ ID NO: 1052083 - RNA, 20 nt, Human
cagcugggccagugcuggca

SEQ ID NO: 1052084 - RNA, 19 nt, Human
ccagcaugggucacccagg

SEQ ID NO: 1052085 - RNA, 20 nt, Human
ccaggggugauggcagcaag

SEQ ID NO: 1052086 - RNA, 25 nt, Human
ccagugcuggcagcuggccuucucc

SEQ ID NO: 1052087 - RNA, 19 nt, Human
ccucuguagccagcagccc

SEQ ID NO: 1052088 - RNA, 21 nt, Human
ccugcaggccaggaucuugcc

SEQ ID NO: 1052089 - RNA, 19 nt, Human
cgccuggacuuuggccuug

SEQ ID NO: 1052090 - RNA, 20 nt, Human
cucuguagccagcagccccc

SEQ ID NO: 1052091 - RNA, 22 nt, Human
cuuggagcucgccagccucggc

SEQ ID NO: 1052092 - RNA, 19 nt, Human
gccugcugcgcagugcccu

SEQ ID NO: 1052093 - RNA, 18 nt, Human
gcgccuggacuuuggccu

SEQ ID NO: 1052094 - RNA, 25 nt, Human
ggcaauguugcucacuuucagcaac

SEQ ID NO: 1052095 - RNA, 20 nt, Human
ggccuucuccagcagggaga

SEQ ID NO: 1052096 - RNA, 19 nt, Human
gugauggcagcaaggggcu

SEQ ID NO: 1052097 - RNA, 18 nt, Human
uaccugcaggccaggauc

SEQ ID NO: 1052098 - RNA, 23 nt, Human
uccgugauguugcagucccucuc

SEQ ID NO: 1052099 - RNA, 22 nt, Human
uccugcugugugcuuggccugc

SEQ ID NO: 1052100 - RNA, 24 nt, Human
ugauggcagcaaggggcuacauga

SEQ ID NO: 1052101 - RNA, 19 nt, Human
ugauguugcagucccucuc

SEQ ID NO: 1052102 - RNA, 19 nt, Human
ugccucuguagccagcagc

SEQ ID NO: 1052103 - RNA, 19 nt, Human
ugcugggucucgcgggccu

SEQ ID NO: 1052104 - RNA, 23 nt, Human
uguugcagucccucucguugucc

SEQ ID NO: 1052105 - RNA, 19 nt, Human
aaagaagcacuugcuggug

SEQ ID NO: 1052106 - RNA, 24 nt, Human
aaggccuuccaaagaagcacuugc

SEQ ID NO: 1052107 - RNA, 22 nt, Human
acgcagguggcccuccuccagc

SEQ ID NO: 1052108 - RNA, 18 nt, Human
agcccccgagucaguccu

SEQ ID NO: 1052109 - RNA, 21 nt, Human
agccgagcccccgagucaguc

SEQ ID NO: 1052110 - RNA, 18 nt, Human
cauuuuuaccuuggcaca

SEQ ID NO: 1052111 - RNA, 22 nt, Human
ccuccagccgagcccccgaguc

SEQ ID NO: 1052112 - RNA, 18 nt, Human
cuccuccagccgagcccc

SEQ ID NO: 1052113 - RNA, 18 nt, Human
cuuuuucuuaggacgacu

SEQ ID NO: 1052114 - RNA, 21 nt, Human
gagcccccgagucaggacccu

SEQ ID NO: 1052115 - RNA, 20 nt, Human
ucaagagguagccuugucuu

SEQ ID NO: 1052116 - RNA, 21 nt, Human
ucagagggccuucgaccagca

SEQ ID NO: 1052117 - RNA, 19 nt, Human
ucauuuuuaccuuggcaca

SEQ ID NO: 1052118 - RNA, 18 nt, Human
ugguguguuuuuuguucu

SEQ ID NO: 1052119 - RNA, 19 nt, Human
uucaagagguagccuuguc

SEQ ID NO: 1052120 - RNA, 23 nt, Human
uuccugcccuucuacuccuauaa

SEQ ID NO: 1052121 - RNA, 19 nt, Human
uuaguuccuugcccuucac

SEQ ID NO: 1052122 - RNA, 26 nt, Human
uugaauaguuuguugcaguccuuccc

SEQ ID NO: 1052123 - RNA, 18 nt, Human
ccauuuuauuuucuaaaa

SEQ ID NO: 1052124 - RNA, 19 nt, Human
aacacugcggcgcccccag

SEQ ID NO: 1052125 - RNA, 19 nt, Human
acucauacagagggccugg

SEQ ID NO: 1052126 - RNA, 23 nt, Human
agagugugcaaugcggcgccccc

SEQ ID NO: 1052127 - RNA, 23 nt, Human
augagucucgguuagacucaaaa

SEQ ID NO: 1052128 - RNA, 19 nt, Human
cacgaacacugcggcgccc

SEQ ID NO: 1052129 - RNA, 21 nt, Human
cacgaacacugcggcgccccc

SEQ ID NO: 1052130 - RNA, 22 nt, Human
cagagggccugggagugggcac

SEQ ID NO: 1052131 - RNA, 20 nt, Human
cagcccgcugccccauccca

SEQ ID NO: 1052132 - RNA, 26 nt, Human
cccacgaacacugcggcgcccccaga

SEQ ID NO: 1052133 - RNA, 20 nt, Human
ccccaucccacgaacacugc

SEQ ID NO: 1052134 - RNA, 20 nt, Human
ccccgccagcccgcugccgg

SEQ ID NO: 1052135 - RNA, 25 nt, Human
cccgccagcccgcugccggagcccg

SEQ ID NO: 1052136 - RNA, 22 nt, Human
cccgcugccggagcccgggagc

SEQ ID NO: 1052137 - RNA, 20 nt, Human
cucagggcaacaggagagaa

SEQ ID NO: 1052138 - RNA, 20 nt, Human
gaaggagcgagggagcgcag

SEQ ID NO: 1052139 - RNA, 19 nt, Human
gagcucagggaaggagcga

SEQ ID NO: 1052140 - RNA, 21 nt, Human
gagucucgguuagacucaaaa

SEQ ID NO: 1052141 - RNA, 25 nt, Human
ggagcccgggagcucaggaccaaag

SEQ ID NO: 1052142 - RNA, 22 nt, Human
gggcacucagggcaacaggaga

SEQ ID NO: 1052143 - RNA, 22 nt, Human
gggcacucagggcaacaggaga

SEQ ID NO: 1052144 - RNA, 19 nt, Human
uaagaaccccagaucucga

SEQ ID NO: 1052145 - RNA, 20 nt, Human
uacugcaucucaugcaugua

SEQ ID NO: 1052146 - RNA, 22 nt, Human
ucaugcauguauucuuccaaau

SEQ ID NO: 1052147 - RNA, 18 nt, Human
uggaccaucgagaucccc

SEQ ID NO: 1052148 - RNA, 20 nt, Human
aacaagaggguuugaccugg

SEQ ID NO: 1052149 - RNA, 18 nt, Human
aagccuggaagucagacc

SEQ ID NO: 1052150 - RNA, 18 nt, Human
aaucaugguacccagccu

SEQ ID NO: 1052151 - RNA, 22 nt, Human
agagacugcacccccugguagu

SEQ ID NO: 1052152 - RNA, 18 nt, Human
agcaggcagaaguguggc

SEQ ID NO: 1052153 - RNA, 20 nt, Human
agcucucuuugaccaggaag

SEQ ID NO: 1052154 - RNA, 21 nt, Human
aggcagaaguguggcauaucu

SEQ ID NO: 1052155 - RNA, 19 nt, Human
aggcagucaaggaggucaa

SEQ ID NO: 1052156 - RNA, 19 nt, Human
aucuucucaggcccugcca

SEQ ID NO: 1052157 - RNA, 26 nt, Human
auuaacaagagcagccuaguccagga

SEQ ID NO: 1052158 - RNA, 22 nt, Human
cacuccaaaguucaccguucac

SEQ ID NO: 1052159 - RNA, 19 nt, Human
cagcaggcagaaguguggc

SEQ ID NO: 1052160 - RNA, 19 nt, Human
cccaaacguagcucucuuu

SEQ ID NO: 1052161 - RNA, 19 nt, Human
ccccagagacugcaccccc

SEQ ID NO: 1052162 - RNA, 23 nt, Human
cccccauaauuugcaaauagauu

SEQ ID NO: 1052163 - RNA, 19 nt, Human
cucgguagugguggucccc

SEQ ID NO: 1052164 - RNA, 20 nt, Human
cuggaaguuuucuucguaca

SEQ ID NO: 1052165 - RNA, 22 nt, Human
cuucguacaguugccuuucuca

SEQ ID NO: 1052166 - RNA, 23 nt, Human
gaaauccuuucagcuaaaggccu

SEQ ID NO: 1052167 - RNA, 18 nt, Human
gagcagccuaguccagga

SEQ ID NO: 1052168 - RNA, 21 nt, Human
gcagaaguguggcauaucugg

SEQ ID NO: 1052169 - RNA, 21 nt, Human
gccuugagguccaaugugcac

SEQ ID NO: 1052170 - RNA, 23 nt, Human
ggaaaacugcuuucucaugaggg

SEQ ID NO: 1052171 - RNA, 21 nt, Human
ggaggucaagaaauccuuuca

SEQ ID NO: 1052172 - RNA, 21 nt, Human
guugccaacagcaggcagaag

SEQ ID NO: 1052173 - RNA, 21 nt, Human
guugccaggauccucucugca

SEQ ID NO: 1052174 - RNA, 21 nt, Human
uaaaagcuuuauuucccccca

SEQ ID NO: 1052175 - RNA, 23 nt, Human
uaaucacauaaacaagaggguuu

SEQ ID NO: 1052176 - RNA, 21 nt, Human
uaauuugcaaauagauuucau

SEQ ID NO: 1052177 - RNA, 20 nt, Human
uccaagcaaaccacuggcuu

SEQ ID NO: 1052178 - RNA, 22 nt, Human
ucccauccucaguccuguggcc

SEQ ID NO: 1052179 - RNA, 21 nt, Human
uccccagagacugcacccccu

SEQ ID NO: 1052180 - RNA, 21 nt, Human
ugaccaggaagccuggaaguc

SEQ ID NO: 1052181 - RNA, 23 nt, Human
ugccaaauucccauccucagucc

SEQ ID NO: 1052182 - RNA, 19 nt, Human
uggcuugugcuuuagaggc

SEQ ID NO: 1052183 - RNA, 21 nt, Human
uucauauuaguuccacuggaa

SEQ ID NO: 1052184 - RNA, 23 nt, Human
uucccauccucaguccuguggcc

SEQ ID NO: 1052185 - RNA, 25 nt, Human
uuuuuggcuugugcuuuagaggcug

SEQ ID NO: 1052186 - RNA, 24 nt, Human
aaagugcugggauuacaggcguga

SEQ ID NO: 1052187 - RNA, 25 nt, Human
aaaucaauacccagacugauucuca

SEQ ID NO: 1052188 - RNA, 22 nt, Human
aaguagcuggaacuacgggugc

SEQ ID NO: 1052189 - RNA, 19 nt, Human
aagugcugggauuacaggc

SEQ ID NO: 1052190 - RNA, 19 nt, Human
aagugcugggauuacaggc

SEQ ID NO: 1052191 - RNA, 26 nt, Human
aagugcugggauuacaggcgugagcc

SEQ ID NO: 1052192 - RNA, 18 nt, Human
accacacccagcuaauuu

SEQ ID NO: 1052193 - RNA, 18 nt, Human
acgggguuucaccguguu

SEQ ID NO: 1052194 - RNA, 19 nt, Human
acgggguuucaccguguua

SEQ ID NO: 1052195 - RNA, 20 nt, Human
acgggguuucaccguguuag

SEQ ID NO: 1052196 - RNA, 24 nt, Human
acgggguuucaccguguuagccag

SEQ ID NO: 1052197 - RNA, 18 nt, Human
agacagguggcugagccu

SEQ ID NO: 1052198 - RNA, 19 nt, Human
agagacgggguuucaccgu

SEQ ID NO: 1052199 - RNA, 24 nt, Human
agcgauucuccugcuucagccucc

SEQ ID NO: 1052200 - RNA, 23 nt, Human
aggcgugagccaccgugcccggc

SEQ ID NO: 1052201 - RNA, 20 nt, Human
agugcaguggcaugaucucg

SEQ ID NO: 1052202 - RNA, 21 nt, Human
agugcaguggcaugaucucgg

SEQ ID NO: 1052203 - RNA, 23 nt, Human
agugcaguggcaugaucucggcu

SEQ ID NO: 1052204 - RNA, 24 nt, Human
agugcaguggcaugaucucggcuc

SEQ ID NO: 1052205 - RNA, 18 nt, Human
agugcugggauuacaggc

SEQ ID NO: 1052206 - RNA, 24 nt, Human
aguggcaugaucucggcucacugc

SEQ ID NO: 1052207 - RNA, 21 nt, Human
auagagacagguccaucuccu

SEQ ID NO: 1052208 - RNA, 24 nt, Human
auguagagacgggguuucaccgug

SEQ ID NO: 1052209 - RNA, 24 nt, Human
caaagugcugggauuacaggcgug

SEQ ID NO: 1052210 - RNA, 23 nt, Human
caaccuccaccucccagguucaa

SEQ ID NO: 1052211 - RNA, 22 nt, Human
caagcgauucuccugcuucagc

SEQ ID NO: 1052212 - RNA, 18 nt, Human
caccguguuagccaggau

SEQ ID NO: 1052213 - RNA, 24 nt, Human
caccguguuagccaggauggucuc

SEQ ID NO: 1052214 - RNA, 19 nt, Human
caccuuuuuucuggacagg

SEQ ID NO: 1052215 - RNA, 21 nt, Human
cacugcaaccuccaccuccca

SEQ ID NO: 1052216 - RNA, 23 nt, Human
cagcagcaugggagucccuggcu

SEQ ID NO: 1052217 - RNA, 18 nt, Human
cagcaugggagucccugg

SEQ ID NO: 1052218 - RNA, 18 nt, Human
caggagacagguggcuga

SEQ ID NO: 1052219 - RNA, 22 nt, Human
ccaaagugcugggauuacaggc

SEQ ID NO: 1052220 - RNA, 22 nt, Human
ccaaagugcugggauuacaggc

SEQ ID NO: 1052221 - RNA, 24 nt, Human
ccaaagugcugggauuacaggcgu

SEQ ID NO: 1052222 - RNA, 24 nt, Human
ccaccucccagguucaagcgauuc

SEQ ID NO: 1052223 - RNA, 20 nt, Human
cccagguucaagcgauucuc

SEQ ID NO: 1052224 - RNA, 23 nt, Human
cccagguucaagcgauucuccug

SEQ ID NO: 1052225 - RNA, 24 nt, Human
cccagugcaguggcaugaucucgg

SEQ ID NO: 1052226 - RNA, 24 nt, Human
ccucccagguucaagcgauucucc

SEQ ID NO: 1052227 - RNA, 21 nt, Human
ccugaccucgugauccgccug

SEQ ID NO: 1052228 - RNA, 24 nt, Human
cucacugcaaccuccaccucccag

SEQ ID NO: 1052229 - RNA, 24 nt, Human
cuccugaccucgugauccgccugc

SEQ ID NO: 1052230 - RNA, 21 nt, Human
cugacagugguuggaggugaa

SEQ ID NO: 1052231 - RNA, 23 nt, Human
cugcaaccuccaccucccagguu

SEQ ID NO: 1052232 - RNA, 24 nt, Human
cugcaaccuccaccucccagguuc

SEQ ID NO: 1052233 - RNA, 23 nt, Human
cugcuucagccucccaaguagcu

SEQ ID NO: 1052234 - RNA, 22 nt, Human
gaccucgugauccgccugccuc

SEQ ID NO: 1052235 - RNA, 22 nt, Human
gaccucgugauccgccugccuc

SEQ ID NO: 1052236 - RNA, 24 nt, Human
gaccucgugauccgccugccucgg

SEQ ID NO: 1052237 - RNA, 24 nt, Human
gagacgggguuucaccguguuagc

SEQ ID NO: 1052238 - RNA, 22 nt, Human
gagugcugcugacagugguugg

SEQ ID NO: 1052239 - RNA, 18 nt, Human
gauuacaggcgugagcca

SEQ ID NO: 1052240 - RNA, 20 nt, Human
gauuacaggcgugagccacc

SEQ ID NO: 1052241 - RNA, 21 nt, Human
gauuacaggcgugagccaccg

SEQ ID NO: 1052242 - RNA, 22 nt, Human
gcaaccuccaccucccagguuc

SEQ ID NO: 1052243 - RNA, 21 nt, Human
gccagucacuggaaaaggaaa

SEQ ID NO: 1052244 - RNA, 24 nt, Human
gcgauucuccugcuucagccuccc

SEQ ID NO: 1052245 - RNA, 21 nt, Human
gcucuguugcccagugcagug

SEQ ID NO: 1052246 - RNA, 21 nt, Human
ggaaauaaaagcaaugugaga

SEQ ID NO: 1052247 - RNA, 23 nt, Human
gggguuucaccguguuagccagg

SEQ ID NO: 1052248 - RNA, 22 nt, Human
ggguuucaccguguuagccagg

SEQ ID NO: 1052249 - RNA, 20 nt, Human
ggucucgaucuccugaccuc

SEQ ID NO: 1052250 - RNA, 19 nt, Human
guagagacgggguuucacc

SEQ ID NO: 1052251 - RNA, 21 nt, Human
gugaggcuaaugugacauuug

SEQ ID NO: 1052252 - RNA, 23 nt, Human
uacaggcgugagccaccgugccc

SEQ ID NO: 1052253 - RNA, 24 nt, Human
uacgggugcgugcuaccacaccca

SEQ ID NO: 1052254 - RNA, 18 nt, Human
uagagacgggguuucacc

SEQ ID NO: 1052255 - RNA, 21 nt, Human
uagcuuuaaagaaaggaaggg

SEQ ID NO: 1052256 - RNA, 24 nt, Human
uauguagagacgggguuucaccgu

SEQ ID NO: 1052257 - RNA, 24 nt, Human
ucaccguguuagccaggauggucu

SEQ ID NO: 1052258 - RNA, 24 nt, Human
ucacugcaaccuccaccucccagg

SEQ ID NO: 1052259 - RNA, 25 nt, Human
ucacugcaaccuccaccucccaggu

SEQ ID NO: 1052260 - RNA, 27 nt, Human
ucacugcaaccuccaccucccagguuc

SEQ ID NO: 1052261 - RNA, 20 nt, Human
ucagccucccaaguagcugg

SEQ ID NO: 1052262 - RNA, 23 nt, Human
uccaaagugcugggauuacaggc

SEQ ID NO: 1052263 - RNA, 24 nt, Human
uccaaagugcugggauuacaggcg

SEQ ID NO: 1052264 - RNA, 24 nt, Human
ucccaaguagcuggaacuacgggu

SEQ ID NO: 1052265 - RNA, 21 nt, Human
ucccagguucaagcgauucuc

SEQ ID NO: 1052266 - RNA, 24 nt, Human
ucccagguucaagcgauucuccug

SEQ ID NO: 1052267 - RNA, 19 nt, Human
ucccuggcuagggucaggg

SEQ ID NO: 1052268 - RNA, 21 nt, Human
ucugaaagcuucuuaaucuuc

SEQ ID NO: 1052269 - RNA, 19 nt, Human
ugagccuagcccuggacug

SEQ ID NO: 1052270 - RNA, 22 nt, Human
ugagccuagcccuggacuggau

SEQ ID NO: 1052271 - RNA, 22 nt, Human
ugcaguggcaugaucucggcuc

SEQ ID NO: 1052272 - RNA, 22 nt, Human
ugcccgcucuucaaacuccagc

SEQ ID NO: 1052273 - RNA, 24 nt, Human
ugcugggauuacaggcgugagcca

SEQ ID NO: 1052274 - RNA, 24 nt, Human
ugcuucagccucccaaguagcugg

SEQ ID NO: 1052275 - RNA, 24 nt, Human
uggaacuacgggugcgugcuacca

SEQ ID NO: 1052276 - RNA, 18 nt, Human
uggacaggagacaggugg

SEQ ID NO: 1052277 - RNA, 19 nt, Human
uggaggugaaggaggagga

SEQ ID NO: 1052278 - RNA, 19 nt, Human
uggcgugugcagccacugc

SEQ ID NO: 1052279 - RNA, 18 nt, Human
ugggauuacaggcgugag

SEQ ID NO: 1052280 - RNA, 21 nt, Human
ugggauuacaggcgugagcca

SEQ ID NO: 1052281 - RNA, 22 nt, Human
ugggauuacaggcgugagccac

SEQ ID NO: 1052282 - RNA, 23 nt, Human
ugggauuacaggcgugagccacc

SEQ ID NO: 1052283 - RNA, 23 nt, Human
ugggauuacaggcgugagccacc

SEQ ID NO: 1052284 - RNA, 24 nt, Human
ugggauuacaggcgugagccaccg

SEQ ID NO: 1052285 - RNA, 23 nt, Human
uguagagacgggguuucaccgug

SEQ ID NO: 1052286 - RNA, 24 nt, Human
uguagagacgggguuucaccgugu

SEQ ID NO: 1052287 - RNA, 30 nt, Human
uucaaccucuguaagccucaguuuccucaa

SEQ ID NO: 1052288 - RNA, 23 nt, Human
uucaagcgauucuccugcuucag

SEQ ID NO: 1052289 - RNA, 24 nt, Human
uucaagcgauucuccugcuucagc

SEQ ID NO: 1052290 - RNA, 19 nt, Human
uuucaccguguuagccagg

SEQ ID NO: 1052291 - RNA, 21 nt, Human
uuuuauguagagacgggguuu

SEQ ID NO: 1052292 - RNA, 18 nt, Human
uuuugcucuguugcccag

SEQ ID NO: 1052293 - RNA, 21 nt, Human
uuuugcucuguugcccagugc

SEQ ID NO: 1052294 - RNA, 18 nt, Human
uuuuuuuuuuuuuuuuug

SEQ ID NO: 1052295 - RNA, 20 nt, Human
aagagcugucuggcugcggu

SEQ ID NO: 1052296 - RNA, 21 nt, Human
acucagggcucuggcagcagc

SEQ ID NO: 1052297 - RNA, 25 nt, Human
agccuguuuggaaggcuccagcccc

SEQ ID NO: 1052298 - RNA, 19 nt, Human
aggcaaucaaucaaaagag

SEQ ID NO: 1052299 - RNA, 20 nt, Human
caaaagagaccuucccacgc

SEQ ID NO: 1052300 - RNA, 21 nt, Human
caccccacacagauccugugc

SEQ ID NO: 1052301 - RNA, 21 nt, Human
cacucagggcucuggcagcag

SEQ ID NO: 1052302 - RNA, 22 nt, Human
cacuccccucucucucuccuca

SEQ ID NO: 1052303 - RNA, 24 nt, Human
cacuccccucucucucuccucacc

SEQ ID NO: 1052304 - RNA, 20 nt, Human
cacugagcuuucuuccagcu

SEQ ID NO: 1052305 - RNA, 22 nt, Human
cagcugccgcucugucuccccu

SEQ ID NO: 1052306 - RNA, 25 nt, Human
ccacgcggaacagccgccgccccuc

SEQ ID NO: 1052307 - RNA, 23 nt, Human
ccacuccccucucucucuccuca

SEQ ID NO: 1052308 - RNA, 18 nt, Human
ccacuuuccuccucuccu

SEQ ID NO: 1052309 - RNA, 22 nt, Human
ccacuuuccuccucuccuccca

SEQ ID NO: 1052310 - RNA, 20 nt, Human
cccccuccuaucagucuggg

SEQ ID NO: 1052311 - RNA, 23 nt, Human
ccccucucucucuccucacccca

SEQ ID NO: 1052312 - RNA, 22 nt, Human
cccuccaccagacugcugccuc

SEQ ID NO: 1052313 - RNA, 26 nt, Human
cccuccaccagacugcugccucugac

SEQ ID NO: 1052314 - RNA, 19 nt, Human
ccgccgccccuccaccaga

SEQ ID NO: 1052315 - RNA, 27 nt, Human
ccgccgccccuccaccagacugcugcc

SEQ ID NO: 1052316 - RNA, 28 nt, Human
ccgccgccccuccaccagacugcugccu

SEQ ID NO: 1052317 - RNA, 18 nt, Human
ccucaccccacacagauc

SEQ ID NO: 1052318 - RNA, 19 nt, Human
ccuccucuccucccacucc

SEQ ID NO: 1052319 - RNA, 21 nt, Human
ccucucucucuccucacccca

SEQ ID NO: 1052320 - RNA, 21 nt, Human
ccuuccugcucugcagggugg

SEQ ID NO: 1052321 - RNA, 18 nt, Human
cucucucuccucacccca

SEQ ID NO: 1052322 - RNA, 21 nt, Human
gaacagccgccgccccuccac

SEQ ID NO: 1052323 - RNA, 23 nt, Human
gccgccccuccaccagacugcug

SEQ ID NO: 1052324 - RNA, 19 nt, Human
gcggaacagccgccgcccc

SEQ ID NO: 1052325 - RNA, 21 nt, Human
gcggaacagccgccgccccuc

SEQ ID NO: 1052326 - RNA, 19 nt, Human
uaggaccccaggcagucgc

SEQ ID NO: 1052327 - RNA, 19 nt, Human
ucaaaagagaccuucccac

SEQ ID NO: 1052328 - RNA, 18 nt, Human
ucagcaggggucuucagc

SEQ ID NO: 1052329 - RNA, 21 nt, Human
ucagggcucuggcagcagcug

SEQ ID NO: 1052330 - RNA, 23 nt, Human
uccaccagacugcugccucugac

SEQ ID NO: 1052331 - RNA, 21 nt, Human
uccuaucagucugggcacuca

SEQ ID NO: 1052332 - RNA, 23 nt, Human
uccucccacuccccucucucucu

SEQ ID NO: 1052333 - RNA, 18 nt, Human
uccugcucugcagggugg

SEQ ID NO: 1052334 - RNA, 23 nt, Human
ucgcucccuuggagauggguccc

SEQ ID NO: 1052335 - RNA, 21 nt, Human
ucucucucuccucaccccaca

SEQ ID NO: 1052336 - RNA, 25 nt, Human
ucuguaccaggcaaucaaucaaaag

SEQ ID NO: 1052337 - RNA, 21 nt, Human
ucuuccagcugauggcucugg

SEQ ID NO: 1052338 - RNA, 25 nt, Human
ugccaagugacaacuuggcaccaua

SEQ ID NO: 1052339 - RNA, 27 nt, Human
ugccuggacugagccuguuuggaaggc

SEQ ID NO: 1052340 - RNA, 23 nt, Human
uggaagcugggugccaagugaca

SEQ ID NO: 1052341 - RNA, 23 nt, Human
uggaaggcuccagcccccuccua

SEQ ID NO: 1052342 - RNA, 22 nt, Human
ugggcauaagagcugucuggcu

SEQ ID NO: 1052343 - RNA, 18 nt, Human
ugguaccuggccagugcc

SEQ ID NO: 1052344 - RNA, 20 nt, Human
uuccacuuuccuccucuccu

SEQ ID NO: 1052345 - RNA, 26 nt, Human
uuccuccucuccucccacuccccucu

SEQ ID NO: 1052346 - RNA, 19 nt, Human
uuccuuguauugcuuuggc

SEQ ID NO: 1052347 - RNA, 27 nt, Human
uuguauugcuuuggcauaugcaucgua

SEQ ID NO: 1052348 - RNA, 23 nt, Human
uuuggaaggcuccagcccccucc

SEQ ID NO: 1052349 - RNA, 25 nt, Human
aacccagcccagagcagcacccccc

SEQ ID NO: 1052350 - RNA, 20 nt, Human
aagccugcccacccccacac

SEQ ID NO: 1052351 - RNA, 22 nt, Human
acaaggacaagaacccuuagau

SEQ ID NO: 1052352 - RNA, 22 nt, Human
acacacucacaacccugagcac

SEQ ID NO: 1052353 - RNA, 31 nt, Human
acaguuugccccauagacaaggacaagaacu

SEQ ID NO: 1052354 - RNA, 21 nt, Human
agagcagcacccccccacccc

SEQ ID NO: 1052355 - RNA, 24 nt, Human
agaggcccgaggggccgggguugc

SEQ ID NO: 1052356 - RNA, 21 nt, Human
agcccagagcagcaccccccc

SEQ ID NO: 1052357 - RNA, 22 nt, Human
agcguccccuccaagccugccc

SEQ ID NO: 1052358 - RNA, 22 nt, Human
agggacagccaaagccaggagg

SEQ ID NO: 1052359 - RNA, 23 nt, Human
caacacacucacaacccugagca

SEQ ID NO: 1052360 - RNA, 18 nt, Human
caacccugagcacacccc

SEQ ID NO: 1052361 - RNA, 23 nt, Human
cacagacacacgggcaacacacu

SEQ ID NO: 1052362 - RNA, 27 nt, Human
cacauacacacagacacacgggcaaca

SEQ ID NO: 1052363 - RNA, 19 nt, Human
cacccccaucuccugccac

SEQ ID NO: 1052364 - RNA, 19 nt, Human
cacccccccacccccaucu

SEQ ID NO: 1052365 - RNA, 23 nt, Human
cacccccccacccccaucuccug

SEQ ID NO: 1052366 - RNA, 21 nt, Human
caccccgaguuccucaggagc

SEQ ID NO: 1052367 - RNA, 21 nt, Human
cagaaccgcggccccaugccc

SEQ ID NO: 1052368 - RNA, 22 nt, Human
cagagcagcacccccccacccc

SEQ ID NO: 1052369 - RNA, 18 nt, Human
cagcacccccccaccccc

SEQ ID NO: 1052370 - RNA, 21 nt, Human
cagcuccggccucugcuccug

SEQ ID NO: 1052371 - RNA, 23 nt, Human
caugcaccgugcauuuaaacccc

SEQ ID NO: 1052372 - RNA, 22 nt, Human
ccaaugggguucacaccccgag

SEQ ID NO: 1052373 - RNA, 25 nt, Human
ccacacacauacacacagacacacg

SEQ ID NO: 1052374 - RNA, 25 nt, Human
ccacccccacacacauacacacaga

SEQ ID NO: 1052375 - RNA, 24 nt, Human
ccagaaccgcggccccaugcccug

SEQ ID NO: 1052376 - RNA, 18 nt, Human
ccagaggcuccaacugac

SEQ ID NO: 1052377 - RNA, 20 nt, Human
ccagcccagagcagcacccc

SEQ ID NO: 1052378 - RNA, 22 nt, Human
ccagucccgcggcguccgggaa

SEQ ID NO: 1052379 - RNA, 21 nt, Human
cccaacccagcccagagcagc

SEQ ID NO: 1052380 - RNA, 18 nt, Human
cccacacacauacacaca

SEQ ID NO: 1052381 - RNA, 19 nt, Human
cccacccccacacacauac

SEQ ID NO: 1052382 - RNA, 20 nt, Human
cccacccccacacacauaca

SEQ ID NO: 1052383 - RNA, 18 nt, Human
cccagagcagcacccccc

SEQ ID NO: 1052384 - RNA, 21 nt, Human
cccagagcagcacccccccac

SEQ ID NO: 1052385 - RNA, 22 nt, Human
cccagagcagcacccccccacc

SEQ ID NO: 1052386 - RNA, 23 nt, Human
cccagcguccccuccaagccugc

SEQ ID NO: 1052387 - RNA, 22 nt, Human
cccauagacaaggacaagaacc

SEQ ID NO: 1052388 - RNA, 21 nt, Human
cccccccacccccaucuccug

SEQ ID NO: 1052389 - RNA, 23 nt, Human
ccccuccccaacucccuucccaa

SEQ ID NO: 1052390 - RNA, 18 nt, Human
cccuccaagccugcccac

SEQ ID NO: 1052391 - RNA, 22 nt, Human
cccugagcccgcccgcggccuu

SEQ ID NO: 1052392 - RNA, 21 nt, Human
ccggcuggcacuccagucccg

SEQ ID NO: 1052393 - RNA, 21 nt, Human
cgaggaagggggcugcugggc

SEQ ID NO: 1052394 - RNA, 20 nt, Human
cgccccagaaccgcggcccc

SEQ ID NO: 1052395 - RNA, 20 nt, Human
cguccccuccaagccugccc

SEQ ID NO: 1052396 - RNA, 25 nt, Human
cguccccuccaagccugcccacccc

SEQ ID NO: 1052397 - RNA, 21 nt, Human
cuccaagccugcccacccccc

SEQ ID NO: 1052398 - RNA, 19 nt, Human
cucugcuccugacgucacu

SEQ ID NO: 1052399 - RNA, 23 nt, Human
cucuugggagcuugggagggggc

SEQ ID NO: 1052400 - RNA, 20 nt, Human
cugcccacccccacacacau

SEQ ID NO: 1052401 - RNA, 18 nt, Human
cuggaggcgaccugagcu

SEQ ID NO: 1052402 - RNA, 23 nt, Human
gaaacccuaccagucagaaaucu

SEQ ID NO: 1052403 - RNA, 20 nt, Human
gaaccgcggccccaugcccu

SEQ ID NO: 1052404 - RNA, 19 nt, Human
gaacucgggcugggccuga

SEQ ID NO: 1052405 - RNA, 26 nt, Human
gagcacaccccaaugggguucacacc

SEQ ID NO: 1052406 - RNA, 18 nt, Human
gagcagcacccccccacc

SEQ ID NO: 1052407 - RNA, 24 nt, Human
gaggccaggggaccagggugaggg

SEQ ID NO: 1052408 - RNA, 24 nt, Human
gcacauuuauaaaagauguaaaac

SEQ ID NO: 1052409 - RNA, 23 nt, Human
gcccagagcagcacccccccacc

SEQ ID NO: 1052410 - RNA, 20 nt, Human
gccccauagacaaggacaag

SEQ ID NO: 1052411 - RNA, 23 nt, Human
gcccugagcccgcccgcggccuu

SEQ ID NO: 1052412 - RNA, 22 nt, Human
gcuacaguuugccccauagaca

SEQ ID NO: 1052413 - RNA, 21 nt, Human
ggaaaguccgucgugcgagga

SEQ ID NO: 1052414 - RNA, 18 nt, Human
ggacaagaacccuuagau

SEQ ID NO: 1052415 - RNA, 23 nt, Human
ggcccgaggggccgggguugcgg

SEQ ID NO: 1052416 - RNA, 19 nt, Human
ggcugggccugaggaaggg

SEQ ID NO: 1052417 - RNA, 22 nt, Human
ggcugguggcuuuacagaggcc

SEQ ID NO: 1052418 - RNA, 21 nt, Human
gggcugggccugaggaagggg

SEQ ID NO: 1052419 - RNA, 22 nt, Human
ggggagacagaagcaugaggug

SEQ ID NO: 1052420 - RNA, 22 nt, Human
gugcagaggcccgaggggccgg

SEQ ID NO: 1052421 - RNA, 20 nt, Human
gugcugggcuggaggcgacc

SEQ ID NO: 1052422 - RNA, 20 nt, Human
uccaagccugcccacccccc

SEQ ID NO: 1052423 - RNA, 19 nt, Human
uccaggcuggggagaggga

SEQ ID NO: 1052424 - RNA, 24 nt, Human
ucccaacccagcccagagcagcac

SEQ ID NO: 1052425 - RNA, 23 nt, Human
uccgcggagacaugcaggaggug

SEQ ID NO: 1052426 - RNA, 22 nt, Human
ucuccugccacugcccucaggc

SEQ ID NO: 1052427 - RNA, 24 nt, Human
ucugcuccugacgucacucagggc

SEQ ID NO: 1052428 - RNA, 23 nt, Human
ugacugcagagucuagacagaca

SEQ ID NO: 1052429 - RNA, 22 nt, Human
ugacugggguccagggaaaguc

SEQ ID NO: 1052430 - RNA, 23 nt, Human
ugagccuggagaaacccuaccag

SEQ ID NO: 1052431 - RNA, 21 nt, Human
ugaggaaggggaaggcgcagg

SEQ ID NO: 1052432 - RNA, 22 nt, Human
ugagugaaagaggcugugcaga

SEQ ID NO: 1052433 - RNA, 18 nt, Human
ugcccacccccacacaca

SEQ ID NO: 1052434 - RNA, 26 nt, Human
ugcccacccccacacacauacacaca

SEQ ID NO: 1052435 - RNA, 18 nt, Human
ugcccugagcccgcccgc

SEQ ID NO: 1052436 - RNA, 23 nt, Human
ugcccugagcccgcccgcggccu

SEQ ID NO: 1052437 - RNA, 19 nt, Human
ugcgaggaagggggcugcu

SEQ ID NO: 1052438 - RNA, 18 nt, Human
uggcacauuuauaaaaga

SEQ ID NO: 1052439 - RNA, 18 nt, Human
uggcagaggccacacagu

SEQ ID NO: 1052440 - RNA, 22 nt, Human
ugggagcuugggagggggcuuu

SEQ ID NO: 1052441 - RNA, 23 nt, Human
ugggcuggaggcgaccugagcuu

SEQ ID NO: 1052442 - RNA, 20 nt, Human
uggggugggggagacagaag

SEQ ID NO: 1052443 - RNA, 22 nt, Human
ugucggcgcgguggcggcgccg

SEQ ID NO: 1052444 - RNA, 21 nt, Human
ugugcagaggcccgaggggcc

SEQ ID NO: 1052445 - RNA, 20 nt, Human
uuccucaggagccucuuggg

SEQ ID NO: 1052446 - RNA, 27 nt, Human
uuccucaggagccucuugggagcuuuc

SEQ ID NO: 1052447 - RNA, 19 nt, Human
uugcggggcgccagaggcu

SEQ ID NO: 1052448 - RNA, 24 nt, Human
uugggagggggcuuuccucucagg

SEQ ID NO: 1052449 - RNA, 24 nt, Human
aaccagggaacaguugcuagccgc

SEQ ID NO: 1052450 - RNA, 19 nt, Human
aaccucccuccccaagccc

SEQ ID NO: 1052451 - RNA, 19 nt, Human
accucccuccccaagccca

SEQ ID NO: 1052452 - RNA, 20 nt, Human
aggccccuuccugcccacuc

SEQ ID NO: 1052453 - RNA, 25 nt, Human
caaccagggaacaguugcuagccgc

SEQ ID NO: 1052454 - RNA, 22 nt, Human
caccgcgaccccgcacucuggc

SEQ ID NO: 1052455 - RNA, 24 nt, Human
cagcuccagcauaagggagaugac

SEQ ID NO: 1052456 - RNA, 20 nt, Human
caggugaaccucccucccca

SEQ ID NO: 1052457 - RNA, 25 nt, Human
caggugaaccucccuccccaagccc

SEQ ID NO: 1052458 - RNA, 23 nt, Human
caguugcuagccgcucucuucca

SEQ ID NO: 1052459 - RNA, 22 nt, Human
caucacucccgcuugucucugc

SEQ ID NO: 1052460 - RNA, 19 nt, Human
ccaagccgggcagggucug

SEQ ID NO: 1052461 - RNA, 19 nt, Human
ccacaucggggcagcucca

SEQ ID NO: 1052462 - RNA, 20 nt, Human
ccacugagggcccaaccagg

SEQ ID NO: 1052463 - RNA, 23 nt, Human
ccagggugcuccgggccuccucu

SEQ ID NO: 1052464 - RNA, 21 nt, Human
cccaaccagggaacaguugcu

SEQ ID NO: 1052465 - RNA, 23 nt, Human
ccccgcccagcccggguuaccgg

SEQ ID NO: 1052466 - RNA, 24 nt, Human
ccccgcccagcccggguuaccgga

SEQ ID NO: 1052467 - RNA, 18 nt, Human
ccccgccccuuccucucc

SEQ ID NO: 1052468 - RNA, 20 nt, Human
ccccgccccuuccucucccc

SEQ ID NO: 1052469 - RNA, 20 nt, Human
ccccgcgccagccggccccc

SEQ ID NO: 1052470 - RNA, 20 nt, Human
cccugccccgccccuuccuc

SEQ ID NO: 1052471 - RNA, 22 nt, Human
cccugccccgccccuuccucuc

SEQ ID NO: 1052472 - RNA, 19 nt, Human
ccgccccuuccucuccccc

SEQ ID NO: 1052473 - RNA, 19 nt, Human
ccgcucucuuccaugcagc

SEQ ID NO: 1052474 - RNA, 22 nt, Human
ccgcucucuuccaugcagcugg

SEQ ID NO: 1052475 - RNA, 21 nt, Human
ccuuuauuuuuuccaggcccc

SEQ ID NO: 1052476 - RNA, 20 nt, Human
cgcccagcccggguuaccgg

SEQ ID NO: 1052477 - RNA, 24 nt, Human
cgggccuccucucccuguguaccc

SEQ ID NO: 1052478 - RNA, 22 nt, Human
cuccacaucggggcagcuccag

SEQ ID NO: 1052479 - RNA, 20 nt, Human
cuccucaggugaaccucccu

SEQ ID NO: 1052480 - RNA, 24 nt, Human
cugcccacuccacaucggggcagc

SEQ ID NO: 1052481 - RNA, 24 nt, Human
gaccuccacaucacucccgcuugu

SEQ ID NO: 1052482 - RNA, 20 nt, Human
gcgaccuccacaucacuccc

SEQ ID NO: 1052483 - RNA, 18 nt, Human
ggagaagcgacgagugcu

SEQ ID NO: 1052484 - RNA, 23 nt, Human
ggcgggcucccugccccgccccu

SEQ ID NO: 1052485 - RNA, 21 nt, Human
gggcagcuccagcauaaggga

SEQ ID NO: 1052486 - RNA, 18 nt, Human
ggugugagggccacaguc

SEQ ID NO: 1052487 - RNA, 21 nt, Human
uaccggagcccccgcgccagc

SEQ ID NO: 1052488 - RNA, 23 nt, Human
uaccggagcccccgcgccagccg

SEQ ID NO: 1052489 - RNA, 22 nt, Human
uagcaaggccuuccagaggcuc

SEQ ID NO: 1052490 - RNA, 18 nt, Human
uaggagaagcgacgagug

SEQ ID NO: 1052491 - RNA, 22 nt, Human
uccacaucggggcagcuccagc

SEQ ID NO: 1052492 - RNA, 22 nt, Human
uccaggccccuuccugcccacu

SEQ ID NO: 1052493 - RNA, 21 nt, Human
ucccgcuugucucugcccucc

SEQ ID NO: 1052494 - RNA, 24 nt, Human
ucccugccccgccccuuccucucc

SEQ ID NO: 1052495 - RNA, 23 nt, Human
ugcagcuggagcacuagcaaggc

SEQ ID NO: 1052496 - RNA, 20 nt, Human
ugcucgaaguccgcaccgcg

SEQ ID NO: 1052497 - RNA, 19 nt, Human
uuaccggagcccccgcgcc

SEQ ID NO: 1052498 - RNA, 23 nt, Human
uuaccggagcccccgcgccagcc

SEQ ID NO: 1052499 - RNA, 28 nt, Human
uuuauuuuuuccaggccccuuccugccc

SEQ ID NO: 1052500 - RNA, 19 nt, Human
uuuccaggccccuuccugc

SEQ ID NO: 1052501 - RNA, 21 nt, Human
uuuuuuccuuuuuuuuuuuuu

SEQ ID NO: 1052502 - RNA, 23 nt, Human
uuuuuuuuuuuuuuuuuuccuuu

SEQ ID NO: 1052503 - RNA, 25 nt, Human
uuuuuuuuuuuuuuuuuuccuuuuu

SEQ ID NO: 1052504 - RNA, 21 nt, Human
aaaaauaauggauuauagccg

SEQ ID NO: 1052505 - RNA, 25 nt, Human
augguacaggcacacauugggacac

SEQ ID NO: 1052506 - RNA, 19 nt, Human
ccacaaugaaaaauaaugg

SEQ ID NO: 1052507 - RNA, 18 nt, Human
uaccacaaugaaaaauaa

SEQ ID NO: 1052508 - RNA, 22 nt, Human
acuaaaguacaaaaaagccugg

SEQ ID NO: 1052509 - RNA, 22 nt, Human
auagcaauaaaaaugaagugac

SEQ ID NO: 1052510 - RNA, 21 nt, Human
caaaaaagccugaacaguaug

SEQ ID NO: 1052511 - RNA, 19 nt, Human
caauaaaaaugaagugaca

SEQ ID NO: 1052512 - RNA, 19 nt, Human
caguaaguuuucuuaaucc

SEQ ID NO: 1052513 - RNA, 20 nt, Human
gaguucccaaacaguaaguu

SEQ ID NO: 1052514 - RNA, 24 nt, Human
gcuuucggaaguccccaaagccag

SEQ ID NO: 1052515 - RNA, 19 nt, Human
uacaaaaaagccugaacag

SEQ ID NO: 1052516 - RNA, 21 nt, Human
uauaucuauguucucaccaaa

SEQ ID NO: 1052517 - RNA, 24 nt, Human
uauauggaguucccaaacaguaag

SEQ ID NO: 1052518 - RNA, 21 nt, Human
ucaacagugaagggcucccuu

SEQ ID NO: 1052519 - RNA, 18 nt, Human
ugacacuaaaguacaaaa

SEQ ID NO: 1052520 - RNA, 20 nt, Human
accuuggaaaacacuuggag

SEQ ID NO: 1052521 - RNA, 20 nt, Human
acggaaccuuggaaaacacu

SEQ ID NO: 1052522 - RNA, 24 nt, Human
acuugaggucaggaguucgaggcc

SEQ ID NO: 1052523 - RNA, 24 nt, Human
agcacucggggaggcugagguggg

SEQ ID NO: 1052524 - RNA, 21 nt, Human
aggaaaauucaggccaggugc

SEQ ID NO: 1052525 - RNA, 23 nt, Human
aggaucacuugaggucaggaguu

SEQ ID NO: 1052526 - RNA, 24 nt, Human
aggaucacuugaggucaggaguuc

SEQ ID NO: 1052527 - RNA, 20 nt, Human
aggcaggacugaagggcugu

SEQ ID NO: 1052528 - RNA, 24 nt, Human
aggcaggacugaagggcugugggg

SEQ ID NO: 1052529 - RNA, 24 nt, Human
aggcugaggugggaggaucacuug

SEQ ID NO: 1052530 - RNA, 24 nt, Human
aggugccguggcucacgucuuuaa

SEQ ID NO: 1052531 - RNA, 18 nt, Human
aggugggaggaucacuug

SEQ ID NO: 1052532 - RNA, 23 nt, Human
aggugggaggaucacuugagguc

SEQ ID NO: 1052533 - RNA, 24 nt, Human
agugcagugucaggcaggacuucc

SEQ ID NO: 1052534 - RNA, 24 nt, Human
aucacuugaggucaggaguucgag

SEQ ID NO: 1052535 - RNA, 20 nt, Human
caacaccaggggcuaagcuc

SEQ ID NO: 1052536 - RNA, 21 nt, Human
caacaccaggggcuaagcuca

SEQ ID NO: 1052537 - RNA, 23 nt, Human
cacaacaccaggggcuaagcuca

SEQ ID NO: 1052538 - RNA, 23 nt, Human
cacgucuuuaaucccagcacucg

SEQ ID NO: 1052539 - RNA, 23 nt, Human
cacuugaggucaggaguucgagg

SEQ ID NO: 1052540 - RNA, 21 nt, Human
cagcacucggggaggcugagg

SEQ ID NO: 1052541 - RNA, 24 nt, Human
cagcacucggggaggcugaggugg

SEQ ID NO: 1052542 - RNA, 18 nt, Human
cagcagagaacaaagaag

SEQ ID NO: 1052543 - RNA, 23 nt, Human
caggcaggacugaagggcugugg

SEQ ID NO: 1052544 - RNA, 21 nt, Human
ccccauugcucuaggggcaag

SEQ ID NO: 1052545 - RNA, 22 nt, Human
cgucuuuaaucccagcacucgg

SEQ ID NO: 1052546 - RNA, 23 nt, Human
cgucuuuaaucccagcacucggg

SEQ ID NO: 1052547 - RNA, 24 nt, Human
cguggcucacgucuuuaaucccag

SEQ ID NO: 1052548 - RNA, 23 nt, Human
cucacgucuuuaaucccagcacu

SEQ ID NO: 1052549 - RNA, 22 nt, Human
cuugaggucaggaguucgaggc

SEQ ID NO: 1052550 - RNA, 20 nt, Human
gacccccgacucuuggaucc

SEQ ID NO: 1052551 - RNA, 23 nt, Human
gaggugggaggaucacuugaggu

SEQ ID NO: 1052552 - RNA, 24 nt, Human
gaucacuugaggucaggaguucga

SEQ ID NO: 1052553 - RNA, 19 nt, Human
gaucuccaccccauugcuc

SEQ ID NO: 1052554 - RNA, 25 nt, Human
gaucuccaccccauugcucuagggg

SEQ ID NO: 1052555 - RNA, 24 nt, Human
gaugggucauacggaaacuuugga

SEQ ID NO: 1052556 - RNA, 18 nt, Human
gcucugcucaucuuugcc

SEQ ID NO: 1052557 - RNA, 23 nt, Human
ggaaacauagggagacccccgac

SEQ ID NO: 1052558 - RNA, 23 nt, Human
ggaucacuugaggucaggaguuc

SEQ ID NO: 1052559 - RNA, 23 nt, Human
gggaggcugaggugggaggauca

SEQ ID NO: 1052560 - RNA, 22 nt, Human
gggcuguggggagcugcucuuc

SEQ ID NO: 1052561 - RNA, 20 nt, Human
guuuuuuugugugucucucu

SEQ ID NO: 1052562 - RNA, 19 nt, Human
uacggaaccuuggaaaaca

SEQ ID NO: 1052563 - RNA, 22 nt, Human
uagccaaaccuucaucaggauu

SEQ ID NO: 1052564 - RNA, 24 nt, Human
ucaggccaggugccguggcucacg

SEQ ID NO: 1052565 - RNA, 20 nt, Human
ucugcaagcaucugaaguuc

SEQ ID NO: 1052566 - RNA, 23 nt, Human
ugaggaaaauucaggccaggugc

SEQ ID NO: 1052567 - RNA, 19 nt, Human
ugaggugggaggaucacuu

SEQ ID NO: 1052568 - RNA, 23 nt, Human
ugaggugggaggaucacuugagg

SEQ ID NO: 1052569 - RNA, 24 nt, Human
ugaggugggaggaucacuugaggu

SEQ ID NO: 1052570 - RNA, 26 nt, Human
ugaggugggaggaucacuugagguca

SEQ ID NO: 1052571 - RNA, 22 nt, Human
ugcagugucaggcaggacugaa

SEQ ID NO: 1052572 - RNA, 21 nt, Human
uggcucacgucuuuaauccca

SEQ ID NO: 1052573 - RNA, 24 nt, Human
uggcucacgucuuuaaucccagca

SEQ ID NO: 1052574 - RNA, 22 nt, Human
uggcucugcucaucuuugccuu

SEQ ID NO: 1052575 - RNA, 21 nt, Human
ugucacagagcauucaugaag

SEQ ID NO: 1052576 - RNA, 19 nt, Human
uucagaauugugccaccau

SEQ ID NO: 1052577 - RNA, 18 nt, Human
uucaugaagugucugcaa

SEQ ID NO: 1052578 - RNA, 24 nt, Human
uugugugucucucuuuguaaugga

SEQ ID NO: 1052579 - RNA, 24 nt, Human
uuugaaccugaugcaaaugcagca

SEQ ID NO: 1052580 - RNA, 22 nt, Human
uuugccagaggagaucuccaac

SEQ ID NO: 1052581 - RNA, 19 nt, Human
agacagaagugagaacuaa

SEQ ID NO: 1052582 - RNA, 27 nt, Human
agacagaagugagaacuaaaggagcug

SEQ ID NO: 1052583 - RNA, 23 nt, Human
ccaguaaugucuuuauugcuucu

SEQ ID NO: 1052584 - RNA, 27 nt, Human
cuaaaggagcugaaucuauuguaaugg

SEQ ID NO: 1052585 - RNA, 20 nt, Human
ggagcugaaucuauuguaaa

SEQ ID NO: 1052586 - RNA, 24 nt, Human
ggggaguuuuuccuggcuuuucuc

SEQ ID NO: 1052587 - RNA, 22 nt, Human
ucaaugucaguauuuuaucuug

SEQ ID NO: 1052588 - RNA, 28 nt, Human
ucuugacguggagacagaagugagaacu

SEQ ID NO: 1052589 - RNA, 21 nt, Human
ugacguggagacagaagugag

SEQ ID NO: 1052590 - RNA, 23 nt, Human
uggcggcuuacucuguaaucugc

SEQ ID NO: 1052591 - RNA, 19 nt, Human
uuuccuggcuuuucucugg

SEQ ID NO: 1052592 - RNA, 18 nt, Human
uuucucuggaacuguugu

SEQ ID NO: 1052593 - RNA, 21 nt, Human
aaaagagagaguggaaaaaga

SEQ ID NO: 1052594 - RNA, 22 nt, Human
aaacaagaaggaaacagcagag

SEQ ID NO: 1052595 - RNA, 22 nt, Human
aaacacuaggugaacauggacc

SEQ ID NO: 1052596 - RNA, 21 nt, Human
aaagccucagggcuccccagg

SEQ ID NO: 1052597 - RNA, 24 nt, Human
aacaaaagagagaguggaaaaaga

SEQ ID NO: 1052598 - RNA, 21 nt, Human
aacaggaaaccuagaaaagaa

SEQ ID NO: 1052599 - RNA, 24 nt, Human
aaccaacaggaaaccuagaaaaga

SEQ ID NO: 1052600 - RNA, 24 nt, Human
aagaaaaccaacaggaaaccuaga

SEQ ID NO: 1052601 - RNA, 18 nt, Human
aagaaggaaacagcagag

SEQ ID NO: 1052602 - RNA, 18 nt, Human
aagagaccuggccuugac

SEQ ID NO: 1052603 - RNA, 19 nt, Human
aaggaaagaaaaggggagg

SEQ ID NO: 1052604 - RNA, 27 nt, Human
aaggggaggaggggagauagggaagag

SEQ ID NO: 1052605 - RNA, 22 nt, Human
aaguacacacugacuaaggcac

SEQ ID NO: 1052606 - RNA, 22 nt, Human
acaaaacaagaaggaaacagca

SEQ ID NO: 1052607 - RNA, 19 nt, Human
acacaaguacacacugacu

SEQ ID NO: 1052608 - RNA, 25 nt, Human
acaggaacauagcaccgagcaggga

SEQ ID NO: 1052609 - RNA, 21 nt, Human
acccgccaccccguggaacag

SEQ ID NO: 1052610 - RNA, 23 nt, Human
accuagaaaagaauugagaggaa

SEQ ID NO: 1052611 - RNA, 22 nt, Human
acggagaaaaggucuggcugug

SEQ ID NO: 1052612 - RNA, 21 nt, Human
acuggaaauuauugacuucca

SEQ ID NO: 1052613 - RNA, 20 nt, Human
agaacaaaacaagaaggaaa

SEQ ID NO: 1052614 - RNA, 21 nt, Human
agaaggaaacagcagaggaaa

SEQ ID NO: 1052615 - RNA, 19 nt, Human
agagguuggagaggcaaac

SEQ ID NO: 1052616 - RNA, 21 nt, Human
aggaaacagcagaggaaaggg

SEQ ID NO: 1052617 - RNA, 19 nt, Human
aggagaagaaaagccucag

SEQ ID NO: 1052618 - RNA, 20 nt, Human
aggagaagaaaagccucagg

SEQ ID NO: 1052619 - RNA, 23 nt, Human
aggaggggagauagggaagagga

SEQ ID NO: 1052620 - RNA, 21 nt, Human
aggcggaggaggcccaggggc

SEQ ID NO: 1052621 - RNA, 26 nt, Human
agugacaaggccacgcagguggacac

SEQ ID NO: 1052622 - RNA, 18 nt, Human
agugcgaugaauugggaa

SEQ ID NO: 1052623 - RNA, 18 nt, Human
caacagaacaaaacaaga

SEQ ID NO: 1052624 - RNA, 23 nt, Human
caagaaggaaacagcagaggaaa

SEQ ID NO: 1052625 - RNA, 23 nt, Human
cacacacaaguacacacugacua

SEQ ID NO: 1052626 - RNA, 19 nt, Human
caccggcauggcagcaguc

SEQ ID NO: 1052627 - RNA, 22 nt, Human
cagcugcaaugggugugggggu

SEQ ID NO: 1052628 - RNA, 22 nt, Human
caggcggaggaggcccaggggc

SEQ ID NO: 1052629 - RNA, 21 nt, Human
caguggguuuucuguaagucu

SEQ ID NO: 1052630 - RNA, 20 nt, Human
ccaaacacacacaaguacac

SEQ ID NO: 1052631 - RNA, 27 nt, Human
ccaauucccacucccccaaacacacac

SEQ ID NO: 1052632 - RNA, 20 nt, Human
ccaccccguggaacaggaac

SEQ ID NO: 1052633 - RNA, 21 nt, Human
ccauaggccccuuccaggcgc

SEQ ID NO: 1052634 - RNA, 22 nt, Human
cccacucccccaaacacacaca

SEQ ID NO: 1052635 - RNA, 19 nt, Human
cccccaaacacacacaagu

SEQ ID NO: 1052636 - RNA, 27 nt, Human
cccccaaacacacacaaguacacacug

SEQ ID NO: 1052637 - RNA, 20 nt, Human
cguggaacaggaacauagca

SEQ ID NO: 1052638 - RNA, 22 nt, Human
cuagggacccagggucugcgcu

SEQ ID NO: 1052639 - RNA, 23 nt, Human
cuguaagucuggcacaaauucug

SEQ ID NO: 1052640 - RNA, 18 nt, Human
gaaagaaaaggggaggag

SEQ ID NO: 1052641 - RNA, 24 nt, Human
gaagaacaguugggaugaaaggga

SEQ ID NO: 1052642 - RNA, 22 nt, Human
gaagagaccuggccuugacccg

SEQ ID NO: 1052643 - RNA, 23 nt, Human
gaggaggggagauagggaagagg

SEQ ID NO: 1052644 - RNA, 19 nt, Human
gaggggagauagggaagag

SEQ ID NO: 1052645 - RNA, 25 nt, Human
gcaacagaacaaaacaagaaggaaa

SEQ ID NO: 1052646 - RNA, 18 nt, Human
gcacagcacaccuuccuc

SEQ ID NO: 1052647 - RNA, 18 nt, Human
gcagaggaaagggaagaa

SEQ ID NO: 1052648 - RNA, 18 nt, Human
gcagcaguccuggcugag

SEQ ID NO: 1052649 - RNA, 18 nt, Human
gccuggaaaaggcuggga

SEQ ID NO: 1052650 - RNA, 20 nt, Human
ggaaagaaaaggggaggagg

SEQ ID NO: 1052651 - RNA, 18 nt, Human
ggaaagaaacaaaagaga

SEQ ID NO: 1052652 - RNA, 24 nt, Human
ggaaauaggcagauaagaaaacca

SEQ ID NO: 1052653 - RNA, 22 nt, Human
ggaggggagauagggaagagga

SEQ ID NO: 1052654 - RNA, 24 nt, Human
ggcaacagaacaaaacaagaagga

SEQ ID NO: 1052655 - RNA, 24 nt, Human
ggcaggagaagaaaagccucaggg

SEQ ID NO: 1052656 - RNA, 21 nt, Human
gggaagaacauacaucagaga

SEQ ID NO: 1052657 - RNA, 25 nt, Human
gggcaggagaagaaaagccucaggg

SEQ ID NO: 1052658 - RNA, 19 nt, Human
gggcccaauucccacuccc

SEQ ID NO: 1052659 - RNA, 25 nt, Human
gggcgggcagaaggccccuugggag

SEQ ID NO: 1052660 - RNA, 21 nt, Human
ggggaggaggggagauagggg

SEQ ID NO: 1052661 - RNA, 18 nt, Human
gguggucgugacgguugg

SEQ ID NO: 1052662 - RNA, 18 nt, Human
gucuggcacaaauucugg

SEQ ID NO: 1052663 - RNA, 23 nt, Human
guggaacaggaacauagcaccga

SEQ ID NO: 1052664 - RNA, 20 nt, Human
guggacaccagcugcagcag

SEQ ID NO: 1052665 - RNA, 23 nt, Human
uaagucacacgccuggaaaaggc

SEQ ID NO: 1052666 - RNA, 21 nt, Human
uaccgcgaagaacaguuggga

SEQ ID NO: 1052667 - RNA, 22 nt, Human
ucagagaacugggaaagugcga

SEQ ID NO: 1052668 - RNA, 22 nt, Human
ucccucccaggacccgccaccc

SEQ ID NO: 1052669 - RNA, 23 nt, Human
ucuaggcaguggguuuucuguaa

SEQ ID NO: 1052670 - RNA, 23 nt, Human
ucuggcaaggcagagugcuaggc

SEQ ID NO: 1052671 - RNA, 21 nt, Human
uggaaaaggcugggaacagcg

SEQ ID NO: 1052672 - RNA, 22 nt, Human
uggaccaguuacccauaggccc

SEQ ID NO: 1052673 - RNA, 21 nt, Human
uggagaggcaaacggggcccu

SEQ ID NO: 1052674 - RNA, 19 nt, Human
uggccaccagugacaaggc

SEQ ID NO: 1052675 - RNA, 25 nt, Human
uggccucuaggcaguggguuuucug

SEQ ID NO: 1052676 - RNA, 27 nt, Human
ugggaaggaaagaaaaggggaggaggg

SEQ ID NO: 1052677 - RNA, 30 nt, Human
ugggaaggaaagaaaaggggaggaggggag

SEQ ID NO: 1052678 - RNA, 22 nt, Human
ugggaggacguggcgccacagc

SEQ ID NO: 1052679 - RNA, 24 nt, Human
ugggggcaggagaagaaaagccuc

SEQ ID NO: 1052680 - RNA, 22 nt, Human
ugugggcaacagaacaaaacaa

SEQ ID NO: 1052681 - RNA, 20 nt, Human
uucccacucccccaaacaca

SEQ ID NO: 1052682 - RNA, 25 nt, Human
uugggaaggaaagaaaaggggaggg

SEQ ID NO: 1052683 - RNA, 22 nt, Human
uuuucuguaagucuggcacaaa

SEQ ID NO: 1052684 - RNA, 21 nt, Human
gagcauccucacccacccaaa

SEQ ID NO: 1052685 - RNA, 18 nt, Human
uagaauggcuggccuuac

SEQ ID NO: 1052686 - RNA, 18 nt, Human
ugcuccuggaccgcuccc

SEQ ID NO: 1052687 - RNA, 19 nt, Human
uggugcugagaaaauggug

SEQ ID NO: 1052688 - RNA, 22 nt, Human
ugguuguuuuccccacaggucu

SEQ ID NO: 1052689 - RNA, 19 nt, Human
ugugguuguuuuccccaca

SEQ ID NO: 1052690 - RNA, 28 nt, Human
aaaaaaaaaaaacaauaaggcaacagaa

SEQ ID NO: 1052691 - RNA, 32 nt, Human
aaaaaaaaaaaacaauaaggcaacagaagagg

SEQ ID NO: 1052692 - RNA, 18 nt, Human
aaaaacaauaaggcaacc

SEQ ID NO: 1052693 - RNA, 22 nt, Human
aacaauaaggcaacagaagaag

SEQ ID NO: 1052694 - RNA, 24 nt, Human
aagaugcugcauuaaaauuuaaca

SEQ ID NO: 1052695 - RNA, 20 nt, Human
aauaaauggaaaucauacaa

SEQ ID NO: 1052696 - RNA, 21 nt, Human
aauaaggcaacagaagaagaa

SEQ ID NO: 1052697 - RNA, 19 nt, Human
acaaauaaugcacaaauau

SEQ ID NO: 1052698 - RNA, 28 nt, Human
acuuaaaaaaaaaaaaacaauaaggcaa

SEQ ID NO: 1052699 - RNA, 23 nt, Human
agaaagguugggagguuuugcau

SEQ ID NO: 1052700 - RNA, 21 nt, Human
caaagacagagaagagacuua

SEQ ID NO: 1052701 - RNA, 18 nt, Human
caauaagacaccaucagg

SEQ ID NO: 1052702 - RNA, 19 nt, Human
cuagaaaugucccauggca

SEQ ID NO: 1052703 - RNA, 18 nt, Human
cuccgcgcuguuccccuc

SEQ ID NO: 1052704 - RNA, 27 nt, Human
cuuaaaaaaaaaaaaacaauaaggcaa

SEQ ID NO: 1052705 - RNA, 22 nt, Human
gaaagguugggagguuuugcau

SEQ ID NO: 1052706 - RNA, 24 nt, Human
gaccgcuuugugcuuggacuccug

SEQ ID NO: 1052707 - RNA, 22 nt, Human
gcacugcucccuauucucacag

SEQ ID NO: 1052708 - RNA, 23 nt, Human
gucccauggcacugcucccuauu

SEQ ID NO: 1052709 - RNA, 22 nt, Human
uacaaugacaagaaaauuauac

SEQ ID NO: 1052710 - RNA, 18 nt, Human
uccacaguagucuugucc

SEQ ID NO: 1052711 - RNA, 21 nt, Human
uccauugcaguuucuucuuuc

SEQ ID NO: 1052712 - RNA, 24 nt, Human
uccuuuugcaaguagaaaugacuc

SEQ ID NO: 1052713 - RNA, 22 nt, Human
ugaauccacaguagucuugucc

SEQ ID NO: 1052714 - RNA, 19 nt, Human
ugacaaggaacguccacaa

SEQ ID NO: 1052715 - RNA, 22 nt, Human
uuaaugcagaaauccaguuaac

SEQ ID NO: 1052716 - RNA, 22 nt, Human
uuagaaagguugggagguuuug

SEQ ID NO: 1052717 - RNA, 22 nt, Human
aaaaaauagcauuugacaccaa

SEQ ID NO: 1052718 - RNA, 22 nt, Human
aaaaugcaauuauuaugaaaca

SEQ ID NO: 1052719 - RNA, 21 nt, Human
aaacaaacaugaguggauaca

SEQ ID NO: 1052720 - RNA, 24 nt, Human
aagaaaaugcaauuauuaugaaac

SEQ ID NO: 1052721 - RNA, 20 nt, Human
accaccauuaaccugaccca

SEQ ID NO: 1052722 - RNA, 22 nt, Human
agagaaaauaugauugguucuc

SEQ ID NO: 1052723 - RNA, 19 nt, Human
agagagaaaauaugauugg

SEQ ID NO: 1052724 - RNA, 20 nt, Human
auugguucuccuugagugaa

SEQ ID NO: 1052725 - RNA, 21 nt, Human
auuugagcaaacauggccacu

SEQ ID NO: 1052726 - RNA, 18 nt, Human
caaggagcagaaaccuau

SEQ ID NO: 1052727 - RNA, 18 nt, Human
cacauaguucaccaccau

SEQ ID NO: 1052728 - RNA, 19 nt, Human
caccaccauuaaccugacc

SEQ ID NO: 1052729 - RNA, 22 nt, Human
cauuaaccugacccagacacca

SEQ ID NO: 1052730 - RNA, 21 nt, Human
ccagacaccaacuuacucacu

SEQ ID NO: 1052731 - RNA, 22 nt, Human
ccucugugcugucacagugauu

SEQ ID NO: 1052732 - RNA, 19 nt, Human
cuuuauacaaagcacacuc

SEQ ID NO: 1052733 - RNA, 23 nt, Human
gaaggaagcagguucucucagaa

SEQ ID NO: 1052734 - RNA, 24 nt, Human
gaggcaggucuuaugaagguggug

SEQ ID NO: 1052735 - RNA, 18 nt, Human
ggucuuaugaagguggug

SEQ ID NO: 1052736 - RNA, 21 nt, Human
gugaaguacaucuguuuggcc

SEQ ID NO: 1052737 - RNA, 25 nt, Human
uaaaaaauagcauuugacaccaaaa

SEQ ID NO: 1052738 - RNA, 24 nt, Human
uaaauauagacauucauauaaauu

SEQ ID NO: 1052739 - RNA, 18 nt, Human
uaaccugacccagacacc

SEQ ID NO: 1052740 - RNA, 24 nt, Human
uaugaaacaaacaugaguggauac

SEQ ID NO: 1052741 - RNA, 24 nt, Human
ucaccaccauuaaccugacccaga

SEQ ID NO: 1052742 - RNA, 22 nt, Human
ucucuugucaaggagcagaaac

SEQ ID NO: 1052743 - RNA, 19 nt, Human
ugaacccaaccagcucuga

SEQ ID NO: 1052744 - RNA, 25 nt, Human
ugacugacaacucuauuuuaaugua

SEQ ID NO: 1052745 - RNA, 18 nt, Human
ugaggacauuugagcaaa

SEQ ID NO: 1052746 - RNA, 19 nt, Human
ugaguggauacaaguaaug

SEQ ID NO: 1052747 - RNA, 21 nt, Human
uggucucaguucaauuuuuuu

SEQ ID NO: 1052748 - RNA, 18 nt, Human
uuaguugaggccaaggug

SEQ ID NO: 1052749 - RNA, 22 nt, Human
uuauucaggccauaucucuugu

SEQ ID NO: 1052750 - RNA, 22 nt, Human
uuauugugcuaucaaguaauua

SEQ ID NO: 1052751 - RNA, 19 nt, Human
uugguucuccuugagugaa

SEQ ID NO: 1052752 - RNA, 20 nt, Human
uuuauacaaagcacacucaa

SEQ ID NO: 1052753 - RNA, 19 nt, Human
uuucaaauuauucuuccuu

SEQ ID NO: 1052754 - RNA, 21 nt, Human
aaaaaagagagagagagagaa

SEQ ID NO: 1052755 - RNA, 22 nt, Human
aaaaguucaagaccagccuggu

SEQ ID NO: 1052756 - RNA, 22 nt, Human
aacacucugucccuccuaaccc

SEQ ID NO: 1052757 - RNA, 20 nt, Human
aacauagugagacccuaucu

SEQ ID NO: 1052758 - RNA, 19 nt, Human
aacauggagaaaccccauc

SEQ ID NO: 1052759 - RNA, 20 nt, Human
aacauggagaaaccccaucu

SEQ ID NO: 1052760 - RNA, 21 nt, Human
aacauggagaaaccccaucuc

SEQ ID NO: 1052761 - RNA, 19 nt, Human
aaccaagggaaaccacagc

SEQ ID NO: 1052762 - RNA, 18 nt, Human
aagcaggagaauugccug

SEQ ID NO: 1052763 - RNA, 24 nt, Human
aagcaggagaauugccuggaccua

SEQ ID NO: 1052764 - RNA, 21 nt, Human
aaguccucucccuucuucagc

SEQ ID NO: 1052765 - RNA, 20 nt, Human
acacuguugcacuccagccu

SEQ ID NO: 1052766 - RNA, 23 nt, Human
acagugcgagacucugucuggaa

SEQ ID NO: 1052767 - RNA, 21 nt, Human
accagaugccuguaaucccag

SEQ ID NO: 1052768 - RNA, 24 nt, Human
accccaucucuacuaaaaauacaa

SEQ ID NO: 1052769 - RNA, 19 nt, Human
acccuagaagugugggcua

SEQ ID NO: 1052770 - RNA, 20 nt, Human
acccuagaagugugggcuau

SEQ ID NO: 1052771 - RNA, 24 nt, Human
acugcccucuagccuaggugacag

SEQ ID NO: 1052772 - RNA, 21 nt, Human
agaaacuggaaaaaaugugga

SEQ ID NO: 1052773 - RNA, 19 nt, Human
agaaagaaaagaugaagga

SEQ ID NO: 1052774 - RNA, 22 nt, Human
agaccagccugaccaacaugga

SEQ ID NO: 1052775 - RNA, 22 nt, Human
agacggaggcacagaguguugc

SEQ ID NO: 1052776 - RNA, 21 nt, Human
agacggaguaaggagcugcca

SEQ ID NO: 1052777 - RNA, 23 nt, Human
agaggagaaugcggauguuugaa

SEQ ID NO: 1052778 - RNA, 24 nt, Human
agcaagcgauagagacugauuuga

SEQ ID NO: 1052779 - RNA, 25 nt, Human
agcacagcucugcaacaugucaccc

SEQ ID NO: 1052780 - RNA, 24 nt, Human
agcacuuugggaggcugaggcagg

SEQ ID NO: 1052781 - RNA, 23 nt, Human
agccaggcauggcggcacaugcc

SEQ ID NO: 1052782 - RNA, 24 nt, Human
agccuaggcgacagugcgagacuc

SEQ ID NO: 1052783 - RNA, 22 nt, Human
agccuggucaacauagugagac

SEQ ID NO: 1052784 - RNA, 24 nt, Human
agccuggucaacauagugagaccc

SEQ ID NO: 1052785 - RNA, 23 nt, Human
agcgauagagacugauuugaaga

SEQ ID NO: 1052786 - RNA, 24 nt, Human
agcuacuugggaggcugagguggg

SEQ ID NO: 1052787 - RNA, 22 nt, Human
aggaagaagaggagaaugcgga

SEQ ID NO: 1052788 - RNA, 18 nt, Human
aggagagagcaagcgaua

SEQ ID NO: 1052789 - RNA, 22 nt, Human
aggcacagaguguugcagcagc

SEQ ID NO: 1052790 - RNA, 18 nt, Human
aggcaggcggaucaccug

SEQ ID NO: 1052791 - RNA, 22 nt, Human
aggcaggcggaucaccugaagg

SEQ ID NO: 1052792 - RNA, 22 nt, Human
aggcaggcggaucaccugaagu

SEQ ID NO: 1052793 - RNA, 26 nt, Human
aggcaggcggaucaccugaaguuggg

SEQ ID NO: 1052794 - RNA, 22 nt, Human
aggcauggccgggcgcaguggc

SEQ ID NO: 1052795 - RNA, 24 nt, Human
aggcauggcggcacaugccuguaa

SEQ ID NO: 1052796 - RNA, 20 nt, Human
aggccaaggugggaggauca

SEQ ID NO: 1052797 - RNA, 24 nt, Human
aggcggagguugcggugagccaag

SEQ ID NO: 1052798 - RNA, 21 nt, Human
aggcugaggcaggcggaucac

SEQ ID NO: 1052799 - RNA, 24 nt, Human
aggcugaggcaggcggaucaccug

SEQ ID NO: 1052800 - RNA, 24 nt, Human
aggcugaggugggaggauugcuug

SEQ ID NO: 1052801 - RNA, 23 nt, Human
agggcucuccgggcuggggagag

SEQ ID NO: 1052802 - RNA, 19 nt, Human
agugcagacccaagcugcc

SEQ ID NO: 1052803 - RNA, 24 nt, Human
agugcuuugggaggccaagguggg

SEQ ID NO: 1052804 - RNA, 24 nt, Human
aguggcucacaccuguaaucccag

SEQ ID NO: 1052805 - RNA, 28 nt, Human
auagauucuuccccagauacuccuaaaa

SEQ ID NO: 1052806 - RNA, 20 nt, Human
aucacacuguugcacuccag

SEQ ID NO: 1052807 - RNA, 22 nt, Human
aucccagugcuuugggaggcca

SEQ ID NO: 1052808 - RNA, 24 nt, Human
auggcucugucacaugcuccaccc

SEQ ID NO: 1052809 - RNA, 21 nt, Human
auuuauaauugcaucacugcc

SEQ ID NO: 1052810 - RNA, 22 nt, Human
caacauagugagacccuaucuc

SEQ ID NO: 1052811 - RNA, 24 nt, Human
caagaccagccuggucaacauagu

SEQ ID NO: 1052812 - RNA, 19 nt, Human
caaguccucucccuucuuc

SEQ ID NO: 1052813 - RNA, 24 nt, Human
cacaccuguaaucccagcacuuug

SEQ ID NO: 1052814 - RNA, 21 nt, Human
cacacuguugcacuccagccu

SEQ ID NO: 1052815 - RNA, 22 nt, Human
cacagaguguugcagcagccag

SEQ ID NO: 1052816 - RNA, 20 nt, Human
cacagcagcugcaaggagug

SEQ ID NO: 1052817 - RNA, 26 nt, Human
cacccaaaccaagggaaaccacagcc

SEQ ID NO: 1052818 - RNA, 18 nt, Human
caccucucugaaucucag

SEQ ID NO: 1052819 - RNA, 23 nt, Human
caccuguaaucccagcacuuugg

SEQ ID NO: 1052820 - RNA, 24 nt, Human
caccuguaaucccagcacuuuggg

SEQ ID NO: 1052821 - RNA, 21 nt, Human
cacucugucccuccuaacccc

SEQ ID NO: 1052822 - RNA, 18 nt, Human
cacugcccucuagccuag

SEQ ID NO: 1052823 - RNA, 19 nt, Human
cacugcccucuagccuagg

SEQ ID NO: 1052824 - RNA, 19 nt, Human
cacugcccucuagccuagg

SEQ ID NO: 1052825 - RNA, 20 nt, Human
cacugcccucuagccuaggu

SEQ ID NO: 1052826 - RNA, 23 nt, Human
cacugcccucuagccuaggugac

SEQ ID NO: 1052827 - RNA, 21 nt, Human
cagagcacccaggaagaagag

SEQ ID NO: 1052828 - RNA, 18 nt, Human
cagaugccuguaauccca

SEQ ID NO: 1052829 - RNA, 24 nt, Human
cagcacuuugggaggcugaggcag

SEQ ID NO: 1052830 - RNA, 26 nt, Human
cagcacuuugggaggcugaggcaggc

SEQ ID NO: 1052831 - RNA, 27 nt, Human
cagcagcugcaaggagugaacacaccg

SEQ ID NO: 1052832 - RNA, 24 nt, Human
cagccugaccaacauggagaaacc

SEQ ID NO: 1052833 - RNA, 21 nt, Human
cagggucccuuucauggggca

SEQ ID NO: 1052834 - RNA, 24 nt, Human
cagugcgagacucugucuggaaua

SEQ ID NO: 1052835 - RNA, 24 nt, Human
cagugcuuugggaggccaaggugg

SEQ ID NO: 1052836 - RNA, 19 nt, Human
caucagggucacaagcugg

SEQ ID NO: 1052837 - RNA, 22 nt, Human
cauggcucugucacaugcucca

SEQ ID NO: 1052838 - RNA, 18 nt, Human
ccaugugucuguaucccu

SEQ ID NO: 1052839 - RNA, 23 nt, Human
cccaaaccaagggaaaccacagc

SEQ ID NO: 1052840 - RNA, 24 nt, Human
cccagugcuuugggaggccaaggu

SEQ ID NO: 1052841 - RNA, 20 nt, Human
ccccucucuucccugcaucc

SEQ ID NO: 1052842 - RNA, 21 nt, Human
ccgauggggacagggcucucc

SEQ ID NO: 1052843 - RNA, 22 nt, Human
ccuaggguuuuugcucccauuc

SEQ ID NO: 1052844 - RNA, 23 nt, Human
ccuccuaaccccgggagagccug

SEQ ID NO: 1052845 - RNA, 18 nt, Human
ccugacaugcucccucca

SEQ ID NO: 1052846 - RNA, 24 nt, Human
ccugaccaacauggagaaacccca

SEQ ID NO: 1052847 - RNA, 19 nt, Human
ccuggaagggagaccuagg

SEQ ID NO: 1052848 - RNA, 19 nt, Human
ccuggcagagcacccagga

SEQ ID NO: 1052849 - RNA, 22 nt, Human
ccuggucaacauagugagaccc

SEQ ID NO: 1052850 - RNA, 23 nt, Human
ccuggucaacauagugagacccu

SEQ ID NO: 1052851 - RNA, 21 nt, Human
ccuguaauuccagcuacucag

SEQ ID NO: 1052852 - RNA, 20 nt, Human
ccuuaaaagguggaggaagu

SEQ ID NO: 1052853 - RNA, 22 nt, Human
cgagcucacucagggcuccagg

SEQ ID NO: 1052854 - RNA, 24 nt, Human
cggaucaccugaaguugggaguuu

SEQ ID NO: 1052855 - RNA, 21 nt, Human
cucaaaccuccuccuggaaca

SEQ ID NO: 1052856 - RNA, 22 nt, Human
cucacaccuguaaucccagcac

SEQ ID NO: 1052857 - RNA, 24 nt, Human
cucacaccuguaaucccagcacuu

SEQ ID NO: 1052858 - RNA, 23 nt, Human
cucagcucaaaccuccuccugga

SEQ ID NO: 1052859 - RNA, 21 nt, Human
cuccgggcuggggagagcauu

SEQ ID NO: 1052860 - RNA, 20 nt, Human
cucuagccuaggugacagag

SEQ ID NO: 1052861 - RNA, 20 nt, Human
cuggaccuaggaggcggagg

SEQ ID NO: 1052862 - RNA, 24 nt, Human
cuggaccuaggaggcggagguugc

SEQ ID NO: 1052863 - RNA, 19 nt, Human
cuguugcacuccagccuag

SEQ ID NO: 1052864 - RNA, 21 nt, Human
cuguugcacuccagccuaggc

SEQ ID NO: 1052865 - RNA, 24 nt, Human
cuguugcacuccagccuaggcgac

SEQ ID NO: 1052866 - RNA, 20 nt, Human
cuugagcccgggaguucaag

SEQ ID NO: 1052867 - RNA, 24 nt, Human
gaaaccagaugccuguaaucccag

SEQ ID NO: 1052868 - RNA, 18 nt, Human
gagagagagagagagacc

SEQ ID NO: 1052869 - RNA, 21 nt, Human
gagcacccaggaagaagagga

SEQ ID NO: 1052870 - RNA, 24 nt, Human
gaggugggaggauugcuugagccc

SEQ ID NO: 1052871 - RNA, 22 nt, Human
gagguugcggugagccaagauc

SEQ ID NO: 1052872 - RNA, 18 nt, Human
gaucaccugaaguuggga

SEQ ID NO: 1052873 - RNA, 24 nt, Human
gaucauuugagcccaaaaguucaa

SEQ ID NO: 1052874 - RNA, 24 nt, Human
gaugaaggagugaggcaggagaga

SEQ ID NO: 1052875 - RNA, 24 nt, Human
gaugccuguaaucccagugcuuug

SEQ ID NO: 1052876 - RNA, 18 nt, Human
gauugcuugagcccggga

SEQ ID NO: 1052877 - RNA, 24 nt, Human
gauugcuugagcccgggaguucaa

SEQ ID NO: 1052878 - RNA, 20 nt, Human
gcaagugugugugugugugu

SEQ ID NO: 1052879 - RNA, 31 nt, Human
gccaggcauggccgggcgcaguggcucacag

SEQ ID NO: 1052880 - RNA, 19 nt, Human
gccuguaaucccagugcuu

SEQ ID NO: 1052881 - RNA, 18 nt, Human
gcgcaguggcucacaccu

SEQ ID NO: 1052882 - RNA, 21 nt, Human
gcggaucaccugaaguuggga

SEQ ID NO: 1052883 - RNA, 21 nt, Human
ggaaauagauucuuccccaga

SEQ ID NO: 1052884 - RNA, 24 nt, Human
ggaacggacagcuccuaggaaagg

SEQ ID NO: 1052885 - RNA, 20 nt, Human
ggagagcauuugagcccagu

SEQ ID NO: 1052886 - RNA, 27 nt, Human
ggaggcagaagcaggagaauugccugg

SEQ ID NO: 1052887 - RNA, 20 nt, Human
ggagguugcggugagccaag

SEQ ID NO: 1052888 - RNA, 24 nt, Human
ggagguugcggugagccaagauca

SEQ ID NO: 1052889 - RNA, 18 nt, Human
ggaguucaaggcuacaau

SEQ ID NO: 1052890 - RNA, 22 nt, Human
ggaucaccugaaguugggaguu

SEQ ID NO: 1052891 - RNA, 23 nt, Human
ggaucaccugaaguugggaguuu

SEQ ID NO: 1052892 - RNA, 22 nt, Human
ggcaggguccuccucacugucc

SEQ ID NO: 1052893 - RNA, 19 nt, Human
ggccauggcucugucacau

SEQ ID NO: 1052894 - RNA, 23 nt, Human
ggcgcaguggcucacaccuguaa

SEQ ID NO: 1052895 - RNA, 24 nt, Human
ggcggcacaugccuguaauuccag

SEQ ID NO: 1052896 - RNA, 19 nt, Human
ggcuacaaugauuuauaau

SEQ ID NO: 1052897 - RNA, 21 nt, Human
gggagagcauuugagcccagu

SEQ ID NO: 1052898 - RNA, 25 nt, Human
gggcacccaugaguucccaagcugg

SEQ ID NO: 1052899 - RNA, 21 nt, Human
ggugcaagugugugugugugu

SEQ ID NO: 1052900 - RNA, 25 nt, Human
ggugcaagugugugugugugugugg

SEQ ID NO: 1052901 - RNA, 19 nt, Human
guccccacccacacccacc

SEQ ID NO: 1052902 - RNA, 19 nt, Human
gugauauaaucacaagggu

SEQ ID NO: 1052903 - RNA, 22 nt, Human
gugcaagugugugugugugugu

SEQ ID NO: 1052904 - RNA, 20 nt, Human
gugcucacuugucacagcag

SEQ ID NO: 1052905 - RNA, 20 nt, Human
gugugugugugugugugcgc

SEQ ID NO: 1052906 - RNA, 22 nt, Human
guguuuuaaccaacaaagagga

SEQ ID NO: 1052907 - RNA, 24 nt, Human
guugcacuccagccuaggcgacag

SEQ ID NO: 1052908 - RNA, 19 nt, Human
guuuuuguuuuggccaguu

SEQ ID NO: 1052909 - RNA, 19 nt, Human
uaaaagagcacagcucugc

SEQ ID NO: 1052910 - RNA, 26 nt, Human
uaaaagagcacagcucugcaacaugg

SEQ ID NO: 1052911 - RNA, 24 nt, Human
uaaucacaaggguccuuaaaaggu

SEQ ID NO: 1052912 - RNA, 24 nt, Human
uagcuacuugggaggcugaggugg

SEQ ID NO: 1052913 - RNA, 21 nt, Human
uaggaggcggagguugcggug

SEQ ID NO: 1052914 - RNA, 24 nt, Human
uaggaggcggagguugcggugagc

SEQ ID NO: 1052915 - RNA, 24 nt, Human
ucacaaggguccuuaaaaggugga

SEQ ID NO: 1052916 - RNA, 31 nt, Human
ucacacuguugcacuccagccuaggcgacaa

SEQ ID NO: 1052917 - RNA, 21 nt, Human
ucacugcccucuagccuaggu

SEQ ID NO: 1052918 - RNA, 24 nt, Human
ucacugcccucuagccuaggugac

SEQ ID NO: 1052919 - RNA, 19 nt, Human
uccuaaccccgggagagcc

SEQ ID NO: 1052920 - RNA, 19 nt, Human
ucucuaaaaaaaaaagaga

SEQ ID NO: 1052921 - RNA, 24 nt, Human
ucucuacuaaaaauacaaaaaauu

SEQ ID NO: 1052922 - RNA, 28 nt, Human
ugaauccauuuguguuuuaaccaacaaa

SEQ ID NO: 1052923 - RNA, 20 nt, Human
ugaaucgcaggaggggagac

SEQ ID NO: 1052924 - RNA, 18 nt, Human
ugaccccuuggguccccu

SEQ ID NO: 1052925 - RNA, 23 nt, Human
ugacuggugcuguugugggcugg

SEQ ID NO: 1052926 - RNA, 19 nt, Human
ugagaaaauaaauuuaaaa

SEQ ID NO: 1052927 - RNA, 23 nt, Human
ugagcccaaaaguucaagaccag

SEQ ID NO: 1052928 - RNA, 20 nt, Human
ugaggcaggcggaucaccug

SEQ ID NO: 1052929 - RNA, 20 nt, Human
ugaggugggaggauugcuug

SEQ ID NO: 1052930 - RNA, 22 nt, Human
ugaggugggaggauugcuugag

SEQ ID NO: 1052931 - RNA, 23 nt, Human
ugaggugggaggauugcuugagc

SEQ ID NO: 1052932 - RNA, 24 nt, Human
ugaggugggaggauugcuugagcc

SEQ ID NO: 1052933 - RNA, 22 nt, Human
ugcacuccagccuaggcgacag

SEQ ID NO: 1052934 - RNA, 23 nt, Human
ugccuguaaucccagugcuuugg

SEQ ID NO: 1052935 - RNA, 24 nt, Human
ugccuguaaucccagugcuuuggg

SEQ ID NO: 1052936 - RNA, 24 nt, Human
ugccuguaauuccagcuacucagg

SEQ ID NO: 1052937 - RNA, 18 nt, Human
ugcuguguugacuguugu

SEQ ID NO: 1052938 - RNA, 24 nt, Human
uggaaauagauucuuccccagaua

SEQ ID NO: 1052939 - RNA, 18 nt, Human
uggcagagcacccaggaa

SEQ ID NO: 1052940 - RNA, 24 nt, Human
uggcagagcacccaggaagaagag

SEQ ID NO: 1052941 - RNA, 26 nt, Human
uggcagagcacccaggaagaagagga

SEQ ID NO: 1052942 - RNA, 24 nt, Human
uggcggcacaugccuguaauucca

SEQ ID NO: 1052943 - RNA, 21 nt, Human
uggcucacaccuguaauccca

SEQ ID NO: 1052944 - RNA, 24 nt, Human
uggcucacaccuguaaucccagca

SEQ ID NO: 1052945 - RNA, 19 nt, Human
uggcucugucacaugcucc

SEQ ID NO: 1052946 - RNA, 19 nt, Human
ugggaggccaaggugggag

SEQ ID NO: 1052947 - RNA, 24 nt, Human
ugggaggccaaggugggaggauca

SEQ ID NO: 1052948 - RNA, 18 nt, Human
ugggaggcugaggcaggc

SEQ ID NO: 1052949 - RNA, 20 nt, Human
ugggaggcugaggcaggcgg

SEQ ID NO: 1052950 - RNA, 24 nt, Human
ugggaggcugaggcaggcggauca

SEQ ID NO: 1052951 - RNA, 22 nt, Human
ugggaggcugaggugggaggau

SEQ ID NO: 1052952 - RNA, 24 nt, Human
ugggaggcugaggugggaggauug

SEQ ID NO: 1052953 - RNA, 23 nt, Human
ugggcaggguccuccucacuguc

SEQ ID NO: 1052954 - RNA, 19 nt, Human
uggggagagcauuugagcc

SEQ ID NO: 1052955 - RNA, 31 nt, Human
ugucacagcagcugcaaggagugaacacacc

SEQ ID NO: 1052956 - RNA, 19 nt, Human
ugucagaguugugaucuuc

SEQ ID NO: 1052957 - RNA, 18 nt, Human
uguccccacccacaccca

SEQ ID NO: 1052958 - RNA, 18 nt, Human
uguccugggaacggacag

SEQ ID NO: 1052959 - RNA, 24 nt, Human
ugucuguaucccuagcuacuuggg

SEQ ID NO: 1052960 - RNA, 22 nt, Human
uguguaagagugaccccuuggg

SEQ ID NO: 1052961 - RNA, 21 nt, Human
ugugugugugugugcgcuugu

SEQ ID NO: 1052962 - RNA, 19 nt, Human
ugugugugugugugugcgc

SEQ ID NO: 1052963 - RNA, 19 nt, Human
uguugauucucuuggguug

SEQ ID NO: 1052964 - RNA, 24 nt, Human
uguugcacuccagccuaggcgaca

SEQ ID NO: 1052965 - RNA, 19 nt, Human
uguuuuggccaguuuuugu

SEQ ID NO: 1052966 - RNA, 19 nt, Human
uucaccucucugaaucuca

SEQ ID NO: 1052967 - RNA, 22 nt, Human
uucuuccccagauacuccuaaa

SEQ ID NO: 1052968 - RNA, 20 nt, Human
uugagaaacuggaaaaaaug

SEQ ID NO: 1052969 - RNA, 20 nt, Human
uugcacuccagccuaggcga

SEQ ID NO: 1052970 - RNA, 27 nt, Human
uugcaucacugcccucuagccuaggug

SEQ ID NO: 1052971 - RNA, 24 nt, Human
uugccuggaccuaggaggcggagg

SEQ ID NO: 1052972 - RNA, 20 nt, Human
uugcggugagccaagaucac

SEQ ID NO: 1052973 - RNA, 24 nt, Human
uugcuugagcccgggaguucaagg

SEQ ID NO: 1052974 - RNA, 25 nt, Human
uugggaggcugaggcaggcggauca

SEQ ID NO: 1052975 - RNA, 20 nt, Human
uugggaggcugaggugggag

SEQ ID NO: 1052976 - RNA, 24 nt, Human
uuguacggccguggaccaguuacu

SEQ ID NO: 1052977 - RNA, 21 nt, Human
uuguuuuuguuuuggccaguu

SEQ ID NO: 1052978 - RNA, 19 nt, Human
uuuguuuuggccaguuuuu

SEQ ID NO: 1052979 - RNA, 23 nt, Human
uuuuaagcuaugcaguuugugcu

SEQ ID NO: 1052980 - RNA, 20 nt, Human
aaagauucugaaagccaaca

SEQ ID NO: 1052981 - RNA, 18 nt, Human
aaauggccucaaaauggg

SEQ ID NO: 1052982 - RNA, 22 nt, Human
aaaugggcuucuuggaugacuu

SEQ ID NO: 1052983 - RNA, 26 nt, Human
aaccuuuggcuuuaaagauuauaaac

SEQ ID NO: 1052984 - RNA, 22 nt, Human
aacuggacagaaccuaccuaac

SEQ ID NO: 1052985 - RNA, 23 nt, Human
acaaaacauauuuuguaccaaau

SEQ ID NO: 1052986 - RNA, 24 nt, Human
agaagaaaauacaguauauaauaa

SEQ ID NO: 1052987 - RNA, 18 nt, Human
agccagcuacauguaugc

SEQ ID NO: 1052988 - RNA, 19 nt, Human
aggaggaggcaaauuggua

SEQ ID NO: 1052989 - RNA, 20 nt, Human
aguaauuacuuaaggcacag

SEQ ID NO: 1052990 - RNA, 21 nt, Human
agugcaaaguugaaggacugu

SEQ ID NO: 1052991 - RNA, 25 nt, Human
agugcaaaguugaaggacuguuuug

SEQ ID NO: 1052992 - RNA, 22 nt, Human
aucagucccagaaagugaaccc

SEQ ID NO: 1052993 - RNA, 19 nt, Human
caaaaugggcuucuuggau

SEQ ID NO: 1052994 - RNA, 21 nt, Human
caacaucauguuuaggguaaa

SEQ ID NO: 1052995 - RNA, 23 nt, Human
cacaacaaggccacccuguugua

SEQ ID NO: 1052996 - RNA, 18 nt, Human
cagcuacauguaugcuuc

SEQ ID NO: 1052997 - RNA, 21 nt, Human
cccggccagggcccgccccuc

SEQ ID NO: 1052998 - RNA, 21 nt, Human
ccggccagggcccgccccucc

SEQ ID NO: 1052999 - RNA, 21 nt, Human
ccucggcggcgcagcucugcc

SEQ ID NO: 1053000 - RNA, 23 nt, Human
cgagaagggaccgcucagccucg

SEQ ID NO: 1053001 - RNA, 23 nt, Human
cggcggcgcagcucugccgaagc

SEQ ID NO: 1053002 - RNA, 27 nt, Human
cuacauguaugcuugccuugguauccu

SEQ ID NO: 1053003 - RNA, 24 nt, Human
cugguaaacaucauuacugcaucu

SEQ ID NO: 1053004 - RNA, 18 nt, Human
cuuacugggauuuccuca

SEQ ID NO: 1053005 - RNA, 19 nt, Human
gaaccuaccuaacaacacc

SEQ ID NO: 1053006 - RNA, 20 nt, Human
gaagccuuccgccuucccgg

SEQ ID NO: 1053007 - RNA, 20 nt, Human
gagauugcagcuaauccuag

SEQ ID NO: 1053008 - RNA, 26 nt, Human
gcaaaguugaaggacuguuuugguac

SEQ ID NO: 1053009 - RNA, 20 nt, Human
gcauaggaaacaauaaucuc

SEQ ID NO: 1053010 - RNA, 19 nt, Human
ggcccuuuaaaaaauggca

SEQ ID NO: 1053011 - RNA, 19 nt, Human
ggccgcagcgagaagggac

SEQ ID NO: 1053012 - RNA, 21 nt, Human
gggcgcgggcaccugggcggc

SEQ ID NO: 1053013 - RNA, 22 nt, Human
guggcccuuuaaaaaauggcag

SEQ ID NO: 1053014 - RNA, 27 nt, Human
guuacaauuaaacaucagucccagaaa

SEQ ID NO: 1053015 - RNA, 24 nt, Human
uaaaagaccuuaauuuagcaaaga

SEQ ID NO: 1053016 - RNA, 22 nt, Human
uaaaagauucugaaagccaaca

SEQ ID NO: 1053017 - RNA, 22 nt, Human
uagaagaaaauacaguauauaa

SEQ ID NO: 1053018 - RNA, 20 nt, Human
uauaaugugaaaaaaguccc

SEQ ID NO: 1053019 - RNA, 23 nt, Human
ucgaaaguagagauugcagcuaa

SEQ ID NO: 1053020 - RNA, 22 nt, Human
ucggcggcgcagcucugccgaa

SEQ ID NO: 1053021 - RNA, 24 nt, Human
ucugccgaagccuuccgccuuccc

SEQ ID NO: 1053022 - RNA, 24 nt, Human
ugaggaaggaggaggcaaauuggu

SEQ ID NO: 1053023 - RNA, 22 nt, Human
uggaacaaaaugccacuccauu

SEQ ID NO: 1053024 - RNA, 18 nt, Human
uggaugacuuccaacagu

SEQ ID NO: 1053025 - RNA, 21 nt, Human
uggcccuuuaaaaaauggcag

SEQ ID NO: 1053026 - RNA, 20 nt, Human
ugggauuuccucaucgaaag

SEQ ID NO: 1053027 - RNA, 22 nt, Human
ugguaauucuauaguuguggcc

SEQ ID NO: 1053028 - RNA, 26 nt, Human
uuaaaaaauggcagcauuguacuuga

SEQ ID NO: 1053029 - RNA, 20 nt, Human
uucaagucuaaaaaaaccuu

SEQ ID NO: 1053030 - RNA, 23 nt, Human
uucauguucauuuuuguccugga

SEQ ID NO: 1053031 - RNA, 24 nt, Human
uucauguucauuuuuguccuggag

SEQ ID NO: 1053032 - RNA, 20 nt, Human
uucauuuuuguccuggagag

SEQ ID NO: 1053033 - RNA, 21 nt, Human
uuccucaucgaaaguagagau

SEQ ID NO: 1053034 - RNA, 27 nt, Human
uuuugcauaggaaacaauaaucucugg

SEQ ID NO: 1053035 - RNA, 18 nt, Human
ucucugcucaucucccca

SEQ ID NO: 1053036 - RNA, 20 nt, Human
ucucugcucaucuccccaca

SEQ ID NO: 1053037 - RNA, 25 nt, Human
ugacugcuuucugucuggugcuuug

SEQ ID NO: 1053038 - RNA, 18 nt, Human
ugagaaagaauaaucagg

SEQ ID NO: 1053039 - RNA, 20 nt, Human
ugagaaagaauaaucaggug

SEQ ID NO: 1053040 - RNA, 22 nt, Human
ugagaaguggugucucugcuca

SEQ ID NO: 1053041 - RNA, 21 nt, Human
uguagccuguguugcguuugc

SEQ ID NO: 1053042 - RNA, 19 nt, Human
ugucauggugccuccagaa

SEQ ID NO: 1053043 - RNA, 24 nt, Human
uugagaaguggugucucugcucau

SEQ ID NO: 1053044 - RNA, 25 nt, Human
ccacagugggaauccuuacaccccc

SEQ ID NO: 1053045 - RNA, 22 nt, Human
gggaauccuuacacccagugcc

SEQ ID NO: 1053046 - RNA, 18 nt, Human
agaaaaggagacagaaga

SEQ ID NO: 1053047 - RNA, 23 nt, Human
agagaaacacagccaugccugag

SEQ ID NO: 1053048 - RNA, 18 nt, Human
cacuggggagccagacuc

SEQ ID NO: 1053049 - RNA, 24 nt, Human
cagaagagauuuggacacugaaga

SEQ ID NO: 1053050 - RNA, 22 nt, Human
cagccaugccugagcucccuga

SEQ ID NO: 1053051 - RNA, 20 nt, Human
ggagacagaagagauuugga

SEQ ID NO: 1053052 - RNA, 23 nt, Human
ggagccagacucugcugcauuug

SEQ ID NO: 1053053 - RNA, 18 nt, Human
uacaauagaaaccucuuu

SEQ ID NO: 1053054 - RNA, 21 nt, Human
uccacgcaucaacaaaaccuc

SEQ ID NO: 1053055 - RNA, 19 nt, Human
ugggauaaggaugaugaug

SEQ ID NO: 1053056 - RNA, 25 nt, Human
uuaguucuuaagaaaaggagacaga

SEQ ID NO: 1053057 - RNA, 22 nt, Human
aagguaacccuacccucccuca

SEQ ID NO: 1053058 - RNA, 22 nt, Human
accccauauugaggaaaggcug

SEQ ID NO: 1053059 - RNA, 19 nt, Human
agacaagggucuucugaac

SEQ ID NO: 1053060 - RNA, 22 nt, Human
agacaagggucuucugaaccca

SEQ ID NO: 1053061 - RNA, 24 nt, Human
agacuuggcaacggaagcuagcag

SEQ ID NO: 1053062 - RNA, 22 nt, Human
agccauugguggccacgggggg

SEQ ID NO: 1053063 - RNA, 27 nt, Human
agcgggaggcagacuuggaggucgacc

SEQ ID NO: 1053064 - RNA, 21 nt, Human
agcuuccagcguguggccaau

SEQ ID NO: 1053065 - RNA, 24 nt, Human
aggcuugggccccucaaguucugu

SEQ ID NO: 1053066 - RNA, 19 nt, Human
aguaauagaaguaacugga

SEQ ID NO: 1053067 - RNA, 21 nt, Human
aguaauagaaguaacuggacc

SEQ ID NO: 1053068 - RNA, 23 nt, Human
caagguaacccuacccucccuca

SEQ ID NO: 1053069 - RNA, 23 nt, Human
caauccaacggaaccccauauug

SEQ ID NO: 1053070 - RNA, 22 nt, Human
cagacugccaggggaauacacc

SEQ ID NO: 1053071 - RNA, 21 nt, Human
cauugguggccacgggggggu

SEQ ID NO: 1053072 - RNA, 20 nt, Human
cguugcccagacugccaggg

SEQ ID NO: 1053073 - RNA, 23 nt, Human
cuguuucguucaagguaacccua

SEQ ID NO: 1053074 - RNA, 18 nt, Human
gccccaauccaacggaac

SEQ ID NO: 1053075 - RNA, 24 nt, Human
ggaaaggcugagauaaggcuuggg

SEQ ID NO: 1053076 - RNA, 19 nt, Human
ggccaauaccccauguggc

SEQ ID NO: 1053077 - RNA, 24 nt, Human
gggaauacaccuacuucaucuggg

SEQ ID NO: 1053078 - RNA, 21 nt, Human
uaacuggaccaggaagaggag

SEQ ID NO: 1053079 - RNA, 22 nt, Human
ucuccguugcccagacugccag

SEQ ID NO: 1053080 - RNA, 23 nt, Human
uggaccaggaagaggaggcaucu

SEQ ID NO: 1053081 - RNA, 19 nt, Human
uggcaacggaagcuagcau

SEQ ID NO: 1053082 - RNA, 18 nt, Human
ugucauagccauuggugg

SEQ ID NO: 1053083 - RNA, 20 nt, Human
ugucauagccauugguggcc

SEQ ID NO: 1053084 - RNA, 18 nt, Human
ugucccgcccugucuucc

SEQ ID NO: 1053085 - RNA, 18 nt, Human
uucaucuggggaggcugc

SEQ ID NO: 1053086 - RNA, 19 nt, Human
uucccacuagucauggagg

SEQ ID NO: 1053087 - RNA, 23 nt, Human
uucuuggucuccguugcccagac

SEQ ID NO: 1053088 - RNA, 23 nt, Human
uggcagcaguuacggcgccggaa

SEQ ID NO: 1053089 - RNA, 20 nt, Human
aaacaaaaauaaaaaguuag

SEQ ID NO: 1053090 - RNA, 24 nt, Human
aaacaaaaauaaaaaguuaguguc

SEQ ID NO: 1053091 - RNA, 22 nt, Human
aaaguuagugucaaaagucuac

SEQ ID NO: 1053092 - RNA, 26 nt, Human
aagccugccccagauuucagagccag

SEQ ID NO: 1053093 - RNA, 20 nt, Human
acaaaaauaaaaaguuagug

SEQ ID NO: 1053094 - RNA, 20 nt, Human
acgccagggacaaacccuac

SEQ ID NO: 1053095 - RNA, 18 nt, Human
aggaaaagugaaacgccc

SEQ ID NO: 1053096 - RNA, 21 nt, Human
aucucccuguccucuccgcca

SEQ ID NO: 1053097 - RNA, 20 nt, Human
caaagggcauagccucaggg

SEQ ID NO: 1053098 - RNA, 21 nt, Human
cagggguacaucuaagggcuc

SEQ ID NO: 1053099 - RNA, 20 nt, Human
ccaaacgcaggaaaagugaa

SEQ ID NO: 1053100 - RNA, 23 nt, Human
ccacccccucccgcgcccgagac

SEQ ID NO: 1053101 - RNA, 26 nt, Human
ccacccccucccgcgcccgagacccu

SEQ ID NO: 1053102 - RNA, 21 nt, Human
cccgcgcccgagaccugagac

SEQ ID NO: 1053103 - RNA, 22 nt, Human
ccgccacccccucccgcgcccg

SEQ ID NO: 1053104 - RNA, 21 nt, Human
ccgcgcccgagaccugagaca

SEQ ID NO: 1053105 - RNA, 23 nt, Human
ccgcgcccgagaccugagacacc

SEQ ID NO: 1053106 - RNA, 24 nt, Human
gcauagccucagggacuccccaaa

SEQ ID NO: 1053107 - RNA, 18 nt, Human
gccagggacaaacccuac

SEQ ID NO: 1053108 - RNA, 18 nt, Human
gcgcccgagaccugagac

SEQ ID NO: 1053109 - RNA, 22 nt, Human
gugaucccaaacaaaaauaaaa

SEQ ID NO: 1053110 - RNA, 19 nt, Human
uacacaggacucaguuuua

SEQ ID NO: 1053111 - RNA, 25 nt, Human
uaccuuugacgccagggacaaaccc

SEQ ID NO: 1053112 - RNA, 18 nt, Human
ugaaacgcccacuccugg

SEQ ID NO: 1053113 - RNA, 22 nt, Human
ugauuguauuccaguuacauag

SEQ ID NO: 1053114 - RNA, 22 nt, Human
ugggcucucgccgucaggggua

SEQ ID NO: 1053115 - RNA, 19 nt, Human
uguccucuccgccaccccc

SEQ ID NO: 1053116 - RNA, 24 nt, Human
uuauugauuguauuccaguuacau

SEQ ID NO: 1053117 - RNA, 23 nt, Human
uucagagccagcgcuggggaauc

SEQ ID NO: 1053118 - RNA, 20 nt, Human
uuuuuuuuuuuuuuugucag

SEQ ID NO: 1053119 - RNA, 20 nt, Human
uuuuuuuuuuuuuuugucag

SEQ ID NO: 1053120 - RNA, 21 nt, Human
aaaggugaucugaccucaucc

SEQ ID NO: 1053121 - RNA, 24 nt, Human
aaaguguugggauuacagguguga

SEQ ID NO: 1053122 - RNA, 21 nt, Human
aaguguugggauuacaggugu

SEQ ID NO: 1053123 - RNA, 26 nt, Human
aaguguugggauuacaggugugagcc

SEQ ID NO: 1053124 - RNA, 18 nt, Human
acagcacugaaacaggac

SEQ ID NO: 1053125 - RNA, 23 nt, Human
acaggaagguugguacauguggg

SEQ ID NO: 1053126 - RNA, 21 nt, Human
acaggcucugaaaugaggcuu

SEQ ID NO: 1053127 - RNA, 24 nt, Human
acaguguugcucaggcuggucucg

SEQ ID NO: 1053128 - RNA, 23 nt, Human
accucagccucucaaaguguugg

SEQ ID NO: 1053129 - RNA, 26 nt, Human
accucauccuuguuccugagguccag

SEQ ID NO: 1053130 - RNA, 18 nt, Human
agaaaggacaggcucggg

SEQ ID NO: 1053131 - RNA, 18 nt, Human
agaagcuuacuggguguu

SEQ ID NO: 1053132 - RNA, 19 nt, Human
agcuuucaaaaccucaucc

SEQ ID NO: 1053133 - RNA, 22 nt, Human
aggcuggucucgaacuccuggc

SEQ ID NO: 1053134 - RNA, 24 nt, Human
aguguugcucaggcuggucucgaa

SEQ ID NO: 1053135 - RNA, 22 nt, Human
auagagagcaagucugaccaca

SEQ ID NO: 1053136 - RNA, 19 nt, Human
caaaguguugggauuacag

SEQ ID NO: 1053137 - RNA, 20 nt, Human
caaaguguugggauuacagg

SEQ ID NO: 1053138 - RNA, 24 nt, Human
caaaguguugggauuacaggugug

SEQ ID NO: 1053139 - RNA, 19 nt, Human
cacaggcucugaaaugagg

SEQ ID NO: 1053140 - RNA, 24 nt, Human
cacaguguugcucaggcuggucuc

SEQ ID NO: 1053141 - RNA, 19 nt, Human
caccccccagcacacacac

SEQ ID NO: 1053142 - RNA, 24 nt, Human
cagagcuacaagaagaaauucuga

SEQ ID NO: 1053143 - RNA, 22 nt, Human
cagcacacacacuuugcaugua

SEQ ID NO: 1053144 - RNA, 20 nt, Human
cagcagcccggcccucgggc

SEQ ID NO: 1053145 - RNA, 22 nt, Human
cagcccucccaccccccagcac

SEQ ID NO: 1053146 - RNA, 23 nt, Human
caucccaccucagccucucaaag

SEQ ID NO: 1053147 - RNA, 21 nt, Human
ccaaaggugaucugaccucau

SEQ ID NO: 1053148 - RNA, 23 nt, Human
ccacagauagccauuaugugaac

SEQ ID NO: 1053149 - RNA, 19 nt, Human
ccacugcucccagcccaga

SEQ ID NO: 1053150 - RNA, 19 nt, Human
cccggcccucgggccuggg

SEQ ID NO: 1053151 - RNA, 21 nt, Human
cccuguucugggcagcccucc

SEQ ID NO: 1053152 - RNA, 19 nt, Human
ccgcggaggaagcuccagg

SEQ ID NO: 1053153 - RNA, 22 nt, Human
ccuggccucaagugaucauccc

SEQ ID NO: 1053154 - RNA, 24 nt, Human
ccuggccucaagugaucaucccac

SEQ ID NO: 1053155 - RNA, 18 nt, Human
ccuugcuggagaaaggac

SEQ ID NO: 1053156 - RNA, 18 nt, Human
cuaaagaaaaugaaaguc

SEQ ID NO: 1053157 - RNA, 24 nt, Human
cucaagugaucaucccaccucagc

SEQ ID NO: 1053158 - RNA, 20 nt, Human
cucauccaccugcuuacaca

SEQ ID NO: 1053159 - RNA, 22 nt, Human
cuccuggccucaagugaucauc

SEQ ID NO: 1053160 - RNA, 19 nt, Human
cugcuuacacagagcuaca

SEQ ID NO: 1053161 - RNA, 18 nt, Human
gacuugaggagugggaca

SEQ ID NO: 1053162 - RNA, 19 nt, Human
gacuugaggagugggacag

SEQ ID NO: 1053163 - RNA, 24 nt, Human
gauggcgggggggucucacagugu

SEQ ID NO: 1053164 - RNA, 18 nt, Human
gauuacaggugugagcca

SEQ ID NO: 1053165 - RNA, 21 nt, Human
gauuacaggugugagccacug

SEQ ID NO: 1053166 - RNA, 22 nt, Human
gauuacaggugugagccacugc

SEQ ID NO: 1053167 - RNA, 23 nt, Human
gcuggucucgaacuccuggccuc

SEQ ID NO: 1053168 - RNA, 21 nt, Human
ggagaggguaacaggaaagga

SEQ ID NO: 1053169 - RNA, 24 nt, Human
ggccucaagugaucaucccaccuc

SEQ ID NO: 1053170 - RNA, 24 nt, Human
ggcuggucucgaacuccuggccuc

SEQ ID NO: 1053171 - RNA, 20 nt, Human
gggaagggcacaggcucuga

SEQ ID NO: 1053172 - RNA, 21 nt, Human
gggagcaacaggaagguuggu

SEQ ID NO: 1053173 - RNA, 23 nt, Human
gguagcuauuauucuguggaugg

SEQ ID NO: 1053174 - RNA, 21 nt, Human
gguuaagcugggcagcugggc

SEQ ID NO: 1053175 - RNA, 24 nt, Human
gugaucaucccaccucagccucuc

SEQ ID NO: 1053176 - RNA, 20 nt, Human
uacaggugugagccacugcu

SEQ ID NO: 1053177 - RNA, 24 nt, Human
uacaggugugagccacugcuccca

SEQ ID NO: 1053178 - RNA, 21 nt, Human
uacauguggggagaggguaac

SEQ ID NO: 1053179 - RNA, 24 nt, Human
uacauguggggagaggguaacagg

SEQ ID NO: 1053180 - RNA, 23 nt, Human
uauguagagauggcggggggguc

SEQ ID NO: 1053181 - RNA, 21 nt, Human
uaugugaaccugagcauggau

SEQ ID NO: 1053182 - RNA, 21 nt, Human
ucaaaguguugggauuacagg

SEQ ID NO: 1053183 - RNA, 24 nt, Human
ucaaaguguugggauuacaggugu

SEQ ID NO: 1053184 - RNA, 18 nt, Human
ucacagaggcucaggcgg

SEQ ID NO: 1053185 - RNA, 23 nt, Human
ucucaaaguguugggauuacagg

SEQ ID NO: 1053186 - RNA, 24 nt, Human
ucucaaaguguugggauuacaggu

SEQ ID NO: 1053187 - RNA, 21 nt, Human
ucucacaguguugcucaggcu

SEQ ID NO: 1053188 - RNA, 23 nt, Human
ucucacaguguugcucaggcugg

SEQ ID NO: 1053189 - RNA, 21 nt, Human
ucucgaacuccuggccucaag

SEQ ID NO: 1053190 - RNA, 23 nt, Human
ucugaaaugaggcuuggauuuca

SEQ ID NO: 1053191 - RNA, 19 nt, Human
ucuuuuuuuacaccauccu

SEQ ID NO: 1053192 - RNA, 21 nt, Human
ugagccacugcucccagccca

SEQ ID NO: 1053193 - RNA, 19 nt, Human
ugccuggcggaucagcagc

SEQ ID NO: 1053194 - RNA, 24 nt, Human
ugcucaggcuggucucgaacuccu

SEQ ID NO: 1053195 - RNA, 22 nt, Human
ugcuggagaaaggacaggcucg

SEQ ID NO: 1053196 - RNA, 18 nt, Human
ugggauuacaggugugag

SEQ ID NO: 1053197 - RNA, 19 nt, Human
ugggauuacaggugugagc

SEQ ID NO: 1053198 - RNA, 21 nt, Human
ugggauuacaggugugagcca

SEQ ID NO: 1053199 - RNA, 22 nt, Human
ugggauuacaggugugagccac

SEQ ID NO: 1053200 - RNA, 22 nt, Human
ugggauuacaggugugagccac

SEQ ID NO: 1053201 - RNA, 24 nt, Human
ugggauuacaggugugagccacug

SEQ ID NO: 1053202 - RNA, 20 nt, Human
ugggcagcccucccaccccc

SEQ ID NO: 1053203 - RNA, 21 nt, Human
uguguaaacaguagcaaauga

SEQ ID NO: 1053204 - RNA, 22 nt, Human
uucccagucagcccucacucac

SEQ ID NO: 1053205 - RNA, 21 nt, Human
uuggaggcugaagccuggugg

SEQ ID NO: 1053206 - RNA, 21 nt, Human
uugggauuacaggugugagcc

SEQ ID NO: 1053207 - RNA, 23 nt, Human
uuucaaaaccucauccuuguucc

SEQ ID NO: 1053208 - RNA, 22 nt, Human
uuuuuuuuuuuuuuuuguuuuu

SEQ ID NO: 1053209 - RNA, 27 nt, Human
aagcccugcaggcccagugugugggga

SEQ ID NO: 1053210 - RNA, 18 nt, Human
caccugaggggacagagc

SEQ ID NO: 1053211 - RNA, 19 nt, Human
cccccgaggagcugugccu

SEQ ID NO: 1053212 - RNA, 22 nt, Human
cggcaacgggggcaggaggggg

SEQ ID NO: 1053213 - RNA, 22 nt, Human
cggccugggccccccgaggagc

SEQ ID NO: 1053214 - RNA, 22 nt, Human
gauaaagggguuaauggaagga

SEQ ID NO: 1053215 - RNA, 20 nt, Human
gcaggaggggguuccugaug

SEQ ID NO: 1053216 - RNA, 25 nt, Human
ggcccaguguguggggacagagagg

SEQ ID NO: 1053217 - RNA, 19 nt, Human
gggacagagaggccaacac

SEQ ID NO: 1053218 - RNA, 23 nt, Human
gggcaggaggggguuccugaugc

SEQ ID NO: 1053219 - RNA, 20 nt, Human
gugcugccucggcaacgggg

SEQ ID NO: 1053220 - RNA, 18 nt, Human
uccugaagcugcccucug

SEQ ID NO: 1053221 - RNA, 22 nt, Human
ugcagccuuggagcuccccagg

SEQ ID NO: 1053222 - RNA, 19 nt, Human
uguggggacagagaggcca

SEQ ID NO: 1053223 - RNA, 19 nt, Human
aaaagaagaaacugccuuu

SEQ ID NO: 1053224 - RNA, 25 nt, Human
aaacaagacaacuguuaaaaaaaaa

SEQ ID NO: 1053225 - RNA, 22 nt, Human
aacagcucuuuuuuguucuucu

SEQ ID NO: 1053226 - RNA, 25 nt, Human
aagaaucugcuauuaauuucuucag

SEQ ID NO: 1053227 - RNA, 22 nt, Human
aagauuguuacauuagaaguga

SEQ ID NO: 1053228 - RNA, 18 nt, Human
aauacaaaaguauaaaga

SEQ ID NO: 1053229 - RNA, 21 nt, Human
aauuucuucuugaaagauugu

SEQ ID NO: 1053230 - RNA, 18 nt, Human
acacuguuuggucacucu

SEQ ID NO: 1053231 - RNA, 23 nt, Human
agaaaacaguagagaaaaugaga

SEQ ID NO: 1053232 - RNA, 20 nt, Human
agaaauuucuucuugaaaga

SEQ ID NO: 1053233 - RNA, 21 nt, Human
agaacccugucuucccugccg

SEQ ID NO: 1053234 - RNA, 24 nt, Human
aggcuuccaaagguucagcaauuu

SEQ ID NO: 1053235 - RNA, 23 nt, Human
auguacuuguacuccuagaugac

SEQ ID NO: 1053236 - RNA, 24 nt, Human
augucuuguucuuccauuguuuca

SEQ ID NO: 1053237 - RNA, 18 nt, Human
auucuucucacuugguca

SEQ ID NO: 1053238 - RNA, 25 nt, Human
cagaagaaaaaacaagacaacuguu

SEQ ID NO: 1053239 - RNA, 25 nt, Human
cauaauaguacaguaaaucuuuaga

SEQ ID NO: 1053240 - RNA, 22 nt, Human
ccauuuuccagguggaaaaacc

SEQ ID NO: 1053241 - RNA, 24 nt, Human
ccgaagcccuuucuuuuaacuagg

SEQ ID NO: 1053242 - RNA, 25 nt, Human
ccuugcccccuuucuccuaagaucc

SEQ ID NO: 1053243 - RNA, 18 nt, Human
ccuuuuuuuuuaaaacuc

SEQ ID NO: 1053244 - RNA, 18 nt, Human
cuaaacugugggaaagga

SEQ ID NO: 1053245 - RNA, 22 nt, Human
cuagaagggcugccuacuagug

SEQ ID NO: 1053246 - RNA, 21 nt, Human
cucuauuccaagaguacaaag

SEQ ID NO: 1053247 - RNA, 22 nt, Human
cuucugcuccuccguuucuuua

SEQ ID NO: 1053248 - RNA, 21 nt, Human
cuuuaauugaagacugagaag

SEQ ID NO: 1053249 - RNA, 18 nt, Human
gaaaaugagaacguuccu

SEQ ID NO: 1053250 - RNA, 24 nt, Human
gcuucuugucaccauuauuuucac

SEQ ID NO: 1053251 - RNA, 23 nt, Human
ggcagucuaccuccaacuguaaa

SEQ ID NO: 1053252 - RNA, 19 nt, Human
ggggugggguggguagggg

SEQ ID NO: 1053253 - RNA, 20 nt, Human
guauuuuucaucaacagcuc

SEQ ID NO: 1053254 - RNA, 28 nt, Human
guuucucuuaccgguuuuuuuuuggggg

SEQ ID NO: 1053255 - RNA, 22 nt, Human
uacacuuaccacuaaguuuuua

SEQ ID NO: 1053256 - RNA, 21 nt, Human
uaccuccaacuguaaaugaaa

SEQ ID NO: 1053257 - RNA, 22 nt, Human
uaccuccaacuguaaaugaaau

SEQ ID NO: 1053258 - RNA, 18 nt, Human
uacuacauuuggcagucu

SEQ ID NO: 1053259 - RNA, 23 nt, Human
uacuuuaauugaagacugagaag

SEQ ID NO: 1053260 - RNA, 25 nt, Human
uauacaguguuucucuuaccgguuc

SEQ ID NO: 1053261 - RNA, 21 nt, Human
ucacucuuucuaauuuuggcu

SEQ ID NO: 1053262 - RNA, 22 nt, Human
ucagaauuacagugaaauacag

SEQ ID NO: 1053263 - RNA, 18 nt, Human
ucaggaaaggaggaaaaa

SEQ ID NO: 1053264 - RNA, 23 nt, Human
ucuaacacuacgaacaucagaau

SEQ ID NO: 1053265 - RNA, 19 nt, Human
ucugcuauuaauuucuuca

SEQ ID NO: 1053266 - RNA, 22 nt, Human
ucuucccugcagcaugccuugc

SEQ ID NO: 1053267 - RNA, 21 nt, Human
ugaguuuugcacacuguuugg

SEQ ID NO: 1053268 - RNA, 23 nt, Human
ugcagaagaaaaaacaagacaac

SEQ ID NO: 1053269 - RNA, 22 nt, Human
ugccaaauguucuauaacaucu

SEQ ID NO: 1053270 - RNA, 21 nt, Human
ugcuucacugugggacuccuu

SEQ ID NO: 1053271 - RNA, 21 nt, Human
uggaugucuucuugaaguucu

SEQ ID NO: 1053272 - RNA, 24 nt, Human
uguaaaugaaauuucuauugcaaa

SEQ ID NO: 1053273 - RNA, 23 nt, Human
uguagccuugucaagaaucugcu

SEQ ID NO: 1053274 - RNA, 23 nt, Human
ugucuuguucuuccauuguuuca

SEQ ID NO: 1053275 - RNA, 22 nt, Human
uguugaaaguauguuugaagga

SEQ ID NO: 1053276 - RNA, 23 nt, Human
uguuucaucuuuugugucuuuca

SEQ ID NO: 1053277 - RNA, 18 nt, Human
uucaaaagacggauuucc

SEQ ID NO: 1053278 - RNA, 18 nt, Human
uucaggaaaggaggaaaa

SEQ ID NO: 1053279 - RNA, 20 nt, Human
uucaucuuuugugucuuuca

SEQ ID NO: 1053280 - RNA, 23 nt, Human
uucccugcagcaugccuugcuua

SEQ ID NO: 1053281 - RNA, 19 nt, Human
uugcugcucuuuuugcucu

SEQ ID NO: 1053282 - RNA, 22 nt, Human
uugggcacauguuauaaugaag

SEQ ID NO: 1053283 - RNA, 25 nt, Human
uuggucagaacuacacauuauuuca

SEQ ID NO: 1053284 - RNA, 22 nt, Human
uuugcacacuguuuggucacuc

SEQ ID NO: 1053285 - RNA, 19 nt, Human
uuugugaguuuugcacacu

SEQ ID NO: 1053286 - RNA, 19 nt, Human
uuuucacauugcaauacgc

SEQ ID NO: 1053287 - RNA, 23 nt, Human
uuuuccaugcucuggaugucuuc

SEQ ID NO: 1053288 - RNA, 23 nt, Human
uuuuuuggggggguggggugggu

SEQ ID NO: 1053289 - RNA, 24 nt, Human
aaaauacaguccaugcaucugcca

SEQ ID NO: 1053290 - RNA, 18 nt, Human
aagagaaggggacgagcg

SEQ ID NO: 1053291 - RNA, 18 nt, Human
aagagggagggaguggag

SEQ ID NO: 1053292 - RNA, 27 nt, Human
aagagggagggaguggaguggagcgag

SEQ ID NO: 1053293 - RNA, 19 nt, Human
acaauacaagggcuuaaca

SEQ ID NO: 1053294 - RNA, 22 nt, Human
agaaaagagggagggaguggag

SEQ ID NO: 1053295 - RNA, 21 nt, Human
agagggagggaguggagugga

SEQ ID NO: 1053296 - RNA, 21 nt, Human
agcgagggaggaaggaaagga

SEQ ID NO: 1053297 - RNA, 18 nt, Human
aggaggguacugagaaaa

SEQ ID NO: 1053298 - RNA, 18 nt, Human
agggcuuaacagauccag

SEQ ID NO: 1053299 - RNA, 24 nt, Human
auaaaaaauggauacagauaccau

SEQ ID NO: 1053300 - RNA, 20 nt, Human
augggggugggggaagaggg

SEQ ID NO: 1053301 - RNA, 19 nt, Human
caggaguaguagaaguauu

SEQ ID NO: 1053302 - RNA, 21 nt, Human
cccaggaugcaaaauccggcu

SEQ ID NO: 1053303 - RNA, 20 nt, Human
ccucagggcuacacaugcaa

SEQ ID NO: 1053304 - RNA, 22 nt, Human
gagaaggggacgagcggguggc

SEQ ID NO: 1053305 - RNA, 22 nt, Human
gaggaggguacugagaaaagag

SEQ ID NO: 1053306 - RNA, 23 nt, Human
gaggaggguacugagaaaagagg

SEQ ID NO: 1053307 - RNA, 25 nt, Human
gcggggagauggcagcuucucacag

SEQ ID NO: 1053308 - RNA, 24 nt, Human
ggaaaggaggguggcagaaagaga

SEQ ID NO: 1053309 - RNA, 21 nt, Human
ggagcgagggaggaaggaaag

SEQ ID NO: 1053310 - RNA, 20 nt, Human
gggacgaggucugucccgcc

SEQ ID NO: 1053311 - RNA, 21 nt, Human
guaaauguuucaaaaugcuuu

SEQ ID NO: 1053312 - RNA, 22 nt, Human
uaaaaaguuaacaauacaaggg

SEQ ID NO: 1053313 - RNA, 21 nt, Human
uaacucggagaguaaagagga

SEQ ID NO: 1053314 - RNA, 21 nt, Human
uacugagaaaagagggaggga

SEQ ID NO: 1053315 - RNA, 19 nt, Human
uagaaguauuaaauaugaa

SEQ ID NO: 1053316 - RNA, 19 nt, Human
uagcaacagcggcugggaa

SEQ ID NO: 1053317 - RNA, 21 nt, Human
uagcaggaauaguauuucaga

SEQ ID NO: 1053318 - RNA, 23 nt, Human
uaguaaguuauuguuaucugugu

SEQ ID NO: 1053319 - RNA, 24 nt, Human
ucaguaaauguuucaaaaugcuuu

SEQ ID NO: 1053320 - RNA, 18 nt, Human
ucaguuaacucggagagu

SEQ ID NO: 1053321 - RNA, 21 nt, Human
ucaguuaacucggagaguaaa

SEQ ID NO: 1053322 - RNA, 18 nt, Human
uccggcuuugaaguggag

SEQ ID NO: 1053323 - RNA, 23 nt, Human
ucuaucaacauucaguaaauguu

SEQ ID NO: 1053324 - RNA, 19 nt, Human
ucuccggaaacccugacuc

SEQ ID NO: 1053325 - RNA, 18 nt, Human
ugacuccauucucgguga

SEQ ID NO: 1053326 - RNA, 20 nt, Human
ugagaaaagagggagggagu

SEQ ID NO: 1053327 - RNA, 23 nt, Human
ugagaaaagagggagggagugga

SEQ ID NO: 1053328 - RNA, 25 nt, Human
uggagcgagggaggaaggaaaggag

SEQ ID NO: 1053329 - RNA, 18 nt, Human
uggcagaaagagaagggg

SEQ ID NO: 1053330 - RNA, 19 nt, Human
uggcagaaagagaagggga

SEQ ID NO: 1053331 - RNA, 20 nt, Human
ugggaaaggugcugagagca

SEQ ID NO: 1053332 - RNA, 22 nt, Human
ugggaaaggugcugagagcaga

SEQ ID NO: 1053333 - RNA, 23 nt, Human
uuuuuuuuuuuuuuuuuuauuuu

SEQ ID NO: 1053334 - RNA, 19 nt, Human
aaaaaaaaaaaaaaaaaga

SEQ ID NO: 1053335 - RNA, 24 nt, Human
aucauccuagaaagcccgcccugu

SEQ ID NO: 1053336 - RNA, 23 nt, Human
auuuuuuuuuuuuuuuuuuacag

SEQ ID NO: 1053337 - RNA, 20 nt, Human
cagaaucaguauaaaauagc

SEQ ID NO: 1053338 - RNA, 28 nt, Human
ccaguccuuaaaaaaaaaaaaaaaaaaa

SEQ ID NO: 1053339 - RNA, 22 nt, Human
ccauaauuaucagaauuauuua

SEQ ID NO: 1053340 - RNA, 19 nt, Human
ccgcccuguugauaucugu

SEQ ID NO: 1053341 - RNA, 24 nt, Human
cuccauaauuaucagaauuauuua

SEQ ID NO: 1053342 - RNA, 18 nt, Human
cuuaaaaaaaaaaaaaaa

SEQ ID NO: 1053343 - RNA, 18 nt, Human
cuuaaaaaaaaaaaaaaa

SEQ ID NO: 1053344 - RNA, 30 nt, Human
uaguuacaaaaauuuuuuuuuuuuuuuuuu

SEQ ID NO: 1053345 - RNA, 21 nt, Human
ucaguauaaaauagcaguuga

SEQ ID NO: 1053346 - RNA, 20 nt, Human
uccuuaaaaaaaaaaaaaaa

SEQ ID NO: 1053347 - RNA, 20 nt, Human
uuaaaaaaaaaaaaaaaaaa

SEQ ID NO: 1053348 - RNA, 22 nt, Human
uugauaucugucaugcuuagcu

SEQ ID NO: 1053349 - RNA, 24 nt, Human
aaacuaauacgaacuuaaaauuca

SEQ ID NO: 1053350 - RNA, 21 nt, Human
agcgacgcaacccccaaccuc

SEQ ID NO: 1053351 - RNA, 20 nt, Human
cagcucagaggccgcggcca

SEQ ID NO: 1053352 - RNA, 25 nt, Human
ccaacaccugcacgccuuuaccaga

SEQ ID NO: 1053353 - RNA, 21 nt, Human
cgcggccaacaccugcacgcc

SEQ ID NO: 1053354 - RNA, 21 nt, Human
cucccuugcuuccaccgggag

SEQ ID NO: 1053355 - RNA, 20 nt, Human
gaggccgcggccaacaccug

SEQ ID NO: 1053356 - RNA, 21 nt, Human
gcaacccccaaccucaagcac

SEQ ID NO: 1053357 - RNA, 23 nt, Human
aaaauacaaguagaauauacguc

SEQ ID NO: 1053358 - RNA, 23 nt, Human
aaaugaaaauuauaaagcaaccc

SEQ ID NO: 1053359 - RNA, 20 nt, Human
aacaagucauuaauacacuu

SEQ ID NO: 1053360 - RNA, 24 nt, Human
aacauuuucccacagggagugcua

SEQ ID NO: 1053361 - RNA, 19 nt, Human
aaccuggccaacgugacaa

SEQ ID NO: 1053362 - RNA, 23 nt, Human
aagauugugccacugcacuccag

SEQ ID NO: 1053363 - RNA, 24 nt, Human
aagcagagguugcagugagcuaag

SEQ ID NO: 1053364 - RNA, 18 nt, Human
aagcucaagugaaaggug

SEQ ID NO: 1053365 - RNA, 19 nt, Human
aagcucaagugaaaggugc

SEQ ID NO: 1053366 - RNA, 19 nt, Human
aauacacuguauuguagua

SEQ ID NO: 1053367 - RNA, 19 nt, Human
aaugguuuguggauguuag

SEQ ID NO: 1053368 - RNA, 24 nt, Human
aauuguuugaacccaggaagcaga

SEQ ID NO: 1053369 - RNA, 24 nt, Human
acccaggaagcagagguugcagug

SEQ ID NO: 1053370 - RNA, 18 nt, Human
acugcacuccagccugag

SEQ ID NO: 1053371 - RNA, 20 nt, Human
agagguugcagugagcuaag

SEQ ID NO: 1053372 - RNA, 22 nt, Human
agagguugcagugagcuaagau

SEQ ID NO: 1053373 - RNA, 24 nt, Human
agagguugcagugagcuaagauug

SEQ ID NO: 1053374 - RNA, 24 nt, Human
agcaaccaaacaagucauuaauac

SEQ ID NO: 1053375 - RNA, 23 nt, Human
agccaggcauggcgguacaugcc

SEQ ID NO: 1053376 - RNA, 19 nt, Human
agcggcucaugccuguaac

SEQ ID NO: 1053377 - RNA, 21 nt, Human
aggaagcagagguugcaguga

SEQ ID NO: 1053378 - RNA, 18 nt, Human
aggcugaggcaugagaau

SEQ ID NO: 1053379 - RNA, 24 nt, Human
aggcugguggaucacuugaguccg

SEQ ID NO: 1053380 - RNA, 29 nt, Human
agguggaggcugguggaucacuugaggaa

SEQ ID NO: 1053381 - RNA, 24 nt, Human
auacaagaaaaaaacauuagccag

SEQ ID NO: 1053382 - RNA, 20 nt, Human
auucagggcucaccauucug

SEQ ID NO: 1053383 - RNA, 19 nt, Human
auucccagagcugcaucuc

SEQ ID NO: 1053384 - RNA, 20 nt, Human
auucccagagcugcaucucu

SEQ ID NO: 1053385 - RNA, 25 nt, Human
auugcaaccuaauauuuuucugauu

SEQ ID NO: 1053386 - RNA, 18 nt, Human
auuucuugguaaagcggc

SEQ ID NO: 1053387 - RNA, 20 nt, Human
caaguagaauauacgucaaa

SEQ ID NO: 1053388 - RNA, 19 nt, Human
cacauguccaaaggcagag

SEQ ID NO: 1053389 - RNA, 20 nt, Human
cacauguccaaaggcagagu

SEQ ID NO: 1053390 - RNA, 19 nt, Human
cacuccagccugagugaca

SEQ ID NO: 1053391 - RNA, 23 nt, Human
cacuccagccugagugacauagc

SEQ ID NO: 1053392 - RNA, 19 nt, Human
cacugcacuccagccugag

SEQ ID NO: 1053393 - RNA, 19 nt, Human
cacugcacuccagccugag

SEQ ID NO: 1053394 - RNA, 22 nt, Human
cacugcacuccagccugaguga

SEQ ID NO: 1053395 - RNA, 24 nt, Human
cacugcacuccagccugagugaca

SEQ ID NO: 1053396 - RNA, 24 nt, Human
cauagcaagacugucucaaaaaaa

SEQ ID NO: 1053397 - RNA, 20 nt, Human
ccacugcacuccagccugag

SEQ ID NO: 1053398 - RNA, 20 nt, Human
ccacugcacuccagccugag

SEQ ID NO: 1053399 - RNA, 21 nt, Human
ccacugcacuccagccugagu

SEQ ID NO: 1053400 - RNA, 24 nt, Human
ccacugcacuccagccugagugac

SEQ ID NO: 1053401 - RNA, 20 nt, Human
ccauggguucaggcuggaag

SEQ ID NO: 1053402 - RNA, 24 nt, Human
cccaccacgucgggagguggaggc

SEQ ID NO: 1053403 - RNA, 21 nt, Human
ccugcaauacaguacaaucaa

SEQ ID NO: 1053404 - RNA, 20 nt, Human
ccuggccaacgugacaaaac

SEQ ID NO: 1053405 - RNA, 23 nt, Human
ccuguaaccccaccacgucggga

SEQ ID NO: 1053406 - RNA, 18 nt, Human
ccuguagucccagcuacu

SEQ ID NO: 1053407 - RNA, 21 nt, Human
ccuguagucccagcuacuugg

SEQ ID NO: 1053408 - RNA, 22 nt, Human
ccuguagucccagcuacuuggg

SEQ ID NO: 1053409 - RNA, 21 nt, Human
cgaggccaaccuggccaacgu

SEQ ID NO: 1053410 - RNA, 18 nt, Human
cuacuaacaauacaagaa

SEQ ID NO: 1053411 - RNA, 22 nt, Human
cucaaguuucuuuccuaugacu

SEQ ID NO: 1053412 - RNA, 19 nt, Human
cucaugccuguaaccccac

SEQ ID NO: 1053413 - RNA, 25 nt, Human
cugucucaaaaaaaaaaagagcaua

SEQ ID NO: 1053414 - RNA, 24 nt, Human
gaggcaugagaauuguuugaaccc

SEQ ID NO: 1053415 - RNA, 20 nt, Human
gaguccgaggccaaccuggc

SEQ ID NO: 1053416 - RNA, 19 nt, Human
gccacugcacuccagccug

SEQ ID NO: 1053417 - RNA, 21 nt, Human
gccacugcacuccagccugag

SEQ ID NO: 1053418 - RNA, 20 nt, Human
ggcucaugccuguaacccca

SEQ ID NO: 1053419 - RNA, 23 nt, Human
gguaaagcggcucaugccuguaa

SEQ ID NO: 1053420 - RNA, 19 nt, Human
guccuuguucucauuccca

SEQ ID NO: 1053421 - RNA, 28 nt, Human
uagcaagacugucucaaaaaaaaaaaga

SEQ ID NO: 1053422 - RNA, 21 nt, Human
uaugugaugaaaucuccauau

SEQ ID NO: 1053423 - RNA, 24 nt, Human
uccagccugagugacauagcaaga

SEQ ID NO: 1053424 - RNA, 21 nt, Human
ucccagagcugcaucucugcu

SEQ ID NO: 1053425 - RNA, 18 nt, Human
ucgggagguggaggcugg

SEQ ID NO: 1053426 - RNA, 24 nt, Human
ucuacuaacaauacaagaaaaaaa

SEQ ID NO: 1053427 - RNA, 21 nt, Human
ucucucacauguccaaaggcu

SEQ ID NO: 1053428 - RNA, 21 nt, Human
ugaaauaaaacaugaggcaga

SEQ ID NO: 1053429 - RNA, 20 nt, Human
ugagaagaagcagguccuug

SEQ ID NO: 1053430 - RNA, 22 nt, Human
ugagcuaagauugugccacugc

SEQ ID NO: 1053431 - RNA, 24 nt, Human
ugccuguagucccagcuacuuggg

SEQ ID NO: 1053432 - RNA, 27 nt, Human
uggaucacuugaguccgaggccaaccu

SEQ ID NO: 1053433 - RNA, 24 nt, Human
uggcgguacaugccuguaguccca

SEQ ID NO: 1053434 - RNA, 22 nt, Human
ugggaggcugaggcaugagaau

SEQ ID NO: 1053435 - RNA, 24 nt, Human
uucucauucccagagcugcaucuc

SEQ ID NO: 1053436 - RNA, 19 nt, Human
uugcagugagcuaagauug

SEQ ID NO: 1053437 - RNA, 22 nt, Human
uugcagugagcuaagauugugc

SEQ ID NO: 1053438 - RNA, 23 nt, Human
uugggaggcugaggcaugagaau

SEQ ID NO: 1053439 - RNA, 23 nt, Human
uugugccacugcacuccagccug

SEQ ID NO: 1053440 - RNA, 24 nt, Human
uuguuugaacccaggaagcagagg

SEQ ID NO: 1053441 - RNA, 20 nt, Human
agagcuacugaaagccacug

SEQ ID NO: 1053442 - RNA, 23 nt, Human
agcuacugaaagccacuguagcc

SEQ ID NO: 1053443 - RNA, 20 nt, Human
agcuucuggcaaucaccccu

SEQ ID NO: 1053444 - RNA, 22 nt, Human
cacuguagccagcagcuucugg

SEQ ID NO: 1053445 - RNA, 19 nt, Human
cagaaccuccaaaggcuuc

SEQ ID NO: 1053446 - RNA, 22 nt, Human
cagaaccuccaaaggcuucuga

SEQ ID NO: 1053447 - RNA, 20 nt, Human
cagacuuucgaaugccuccc

SEQ ID NO: 1053448 - RNA, 19 nt, Human
caucagaaccuccaaaggc

SEQ ID NO: 1053449 - RNA, 18 nt, Human
ccagccuucagagcuacu

SEQ ID NO: 1053450 - RNA, 24 nt, Human
cccugcuggaaacugccagcauca

SEQ ID NO: 1053451 - RNA, 21 nt, Human
cuccaaaggcuucugaggccu

SEQ ID NO: 1053452 - RNA, 18 nt, Human
gacaaauuguaaaggcag

SEQ ID NO: 1053453 - RNA, 20 nt, Human
ucccugcuggaaacugccag

SEQ ID NO: 1053454 - RNA, 20 nt, Human
ucugaggccugcaacugcuc

SEQ ID NO: 1053455 - RNA, 25 nt, Human
uucugaggccugcaacugcucucuu

SEQ ID NO: 1053456 - RNA, 19 nt, Human
aaagaaauuauccagagac

SEQ ID NO: 1053457 - RNA, 19 nt, Human
aaaguuauuuuaaaguaac

SEQ ID NO: 1053458 - RNA, 19 nt, Human
aaaugccauuaaugcuuaa

SEQ ID NO: 1053459 - RNA, 21 nt, Human
aaauuguuaaaaacccuucua

SEQ ID NO: 1053460 - RNA, 19 nt, Human
aagaaaacugaucgcagcc

SEQ ID NO: 1053461 - RNA, 23 nt, Human
aagaacaaaguuguaaaaaacag

SEQ ID NO: 1053462 - RNA, 21 nt, Human
aagaagauaccuuaaaaagaa

SEQ ID NO: 1053463 - RNA, 22 nt, Human
acaaaaagcaacauuuauucua

SEQ ID NO: 1053464 - RNA, 24 nt, Human
acaaauauugaauguggacugaca

SEQ ID NO: 1053465 - RNA, 21 nt, Human
acagcaauugcuuauaguuaa

SEQ ID NO: 1053466 - RNA, 19 nt, Human
agaauugaaaaggccaaca

SEQ ID NO: 1053467 - RNA, 21 nt, Human
agaguuaacaugugcuggugu

SEQ ID NO: 1053468 - RNA, 19 nt, Human
agcacagucccuaaauacu

SEQ ID NO: 1053469 - RNA, 26 nt, Human
aggaaaaagggaaucuaaauuguuaa

SEQ ID NO: 1053470 - RNA, 25 nt, Human
caaauugacaaaacagcuuaaauga

SEQ ID NO: 1053471 - RNA, 21 nt, Human
cacagcugcaacagcagcuga

SEQ ID NO: 1053472 - RNA, 21 nt, Human
cacagucccuaaauacuuuuc

SEQ ID NO: 1053473 - RNA, 23 nt, Human
caccugaaccagaagaagaaaac

SEQ ID NO: 1053474 - RNA, 21 nt, Human
cacugcuggaagcacagcugc

SEQ ID NO: 1053475 - RNA, 23 nt, Human
cacuuagcaguagccuuggaagc

SEQ ID NO: 1053476 - RNA, 18 nt, Human
cagagagcaggaaucugu

SEQ ID NO: 1053477 - RNA, 23 nt, Human
cagcagcugaacuguuuaccugg

SEQ ID NO: 1053478 - RNA, 24 nt, Human
cagcuuguuuucacaugugaugau

SEQ ID NO: 1053479 - RNA, 21 nt, Human
cagguuaagagauauguccca

SEQ ID NO: 1053480 - RNA, 22 nt, Human
ccaacaaucaaaagaaaacuga

SEQ ID NO: 1053481 - RNA, 20 nt, Human
ccaacaauguucugcaaacu

SEQ ID NO: 1053482 - RNA, 20 nt, Human
ccugaagugcaaaaaacagu

SEQ ID NO: 1053483 - RNA, 24 nt, Human
ccuggcaucgaaaauaugggggaa

SEQ ID NO: 1053484 - RNA, 25 nt, Human
ccugggaggagaguuaacaugugcu

SEQ ID NO: 1053485 - RNA, 22 nt, Human
ccuguaagcccuaaguccugaa

SEQ ID NO: 1053486 - RNA, 18 nt, Human
cuaaauacuccauauaac

SEQ ID NO: 1053487 - RNA, 21 nt, Human
cuauaauaacuguaaaauuca

SEQ ID NO: 1053488 - RNA, 20 nt, Human
cucuuuucacaacuacagcu

SEQ ID NO: 1053489 - RNA, 19 nt, Human
cugaaacagcagccguucc

SEQ ID NO: 1053490 - RNA, 24 nt, Human
gaaacccucuccugauuauugccu

SEQ ID NO: 1053491 - RNA, 20 nt, Human
gaagugcaaaaaacaguuug

SEQ ID NO: 1053492 - RNA, 20 nt, Human
gagaauguugauuuuuuuug

SEQ ID NO: 1053493 - RNA, 23 nt, Human
gagaugcuauuuuagcacagucc

SEQ ID NO: 1053494 - RNA, 21 nt, Human
gaucccacuuuacuuggcaac

SEQ ID NO: 1053495 - RNA, 18 nt, Human
gcaguagccuuggaagcu

SEQ ID NO: 1053496 - RNA, 18 nt, Human
ggaaaaagggaaucuaaa

SEQ ID NO: 1053497 - RNA, 18 nt, Human
ggaauauccggauuaaaa

SEQ ID NO: 1053498 - RNA, 24 nt, Human
ggcaucgaaaauaugggggaagga

SEQ ID NO: 1053499 - RNA, 21 nt, Human
ggggaaggaauaucuuuuuau

SEQ ID NO: 1053500 - RNA, 21 nt, Human
guaaaaaacagaccugguuua

SEQ ID NO: 1053501 - RNA, 22 nt, Human
guacauaagugacaauagcaau

SEQ ID NO: 1053502 - RNA, 19 nt, Human
guauagaauugaaaaggcc

SEQ ID NO: 1053503 - RNA, 20 nt, Human
gugaagccuucuccagagag

SEQ ID NO: 1053504 - RNA, 19 nt, Human
uaaaaaacagaccugguuu

SEQ ID NO: 1053505 - RNA, 21 nt, Human
uaaaaaguugaugcaauuaua

SEQ ID NO: 1053506 - RNA, 20 nt, Human
uaaacaaagagaauguugau

SEQ ID NO: 1053507 - RNA, 24 nt, Human
uaaccaacaaucaaaagaaaacug

SEQ ID NO: 1053508 - RNA, 23 nt, Human
uaagaacaaaguuguaaaaaaca

SEQ ID NO: 1053509 - RNA, 23 nt, Human
uacacuuaaccuaaguuuccuuu

SEQ ID NO: 1053510 - RNA, 23 nt, Human
uacauaagugacaauagcaauau

SEQ ID NO: 1053511 - RNA, 23 nt, Human
uagcaguagccuuggaagcuaac

SEQ ID NO: 1053512 - RNA, 23 nt, Human
uauaaaauggaguauagaauuga

SEQ ID NO: 1053513 - RNA, 23 nt, Human
uauaaacacuuccuccugaaaua

SEQ ID NO: 1053514 - RNA, 28 nt, Human
uauaacuaaauacuccauauaacugcag

SEQ ID NO: 1053515 - RNA, 21 nt, Human
uauaauauaaacacuuccucc

SEQ ID NO: 1053516 - RNA, 18 nt, Human
uccaaaagcauaaaaauc

SEQ ID NO: 1053517 - RNA, 20 nt, Human
uccuauuaaaacacauccug

SEQ ID NO: 1053518 - RNA, 24 nt, Human
ucggccaaaaacacaggaggucau

SEQ ID NO: 1053519 - RNA, 23 nt, Human
ucuaguaacuucacaugcugggu

SEQ ID NO: 1053520 - RNA, 22 nt, Human
ucuccagagagcaggaaucugu

SEQ ID NO: 1053521 - RNA, 24 nt, Human
ucugcaaacuacacuuaaccuaag

SEQ ID NO: 1053522 - RNA, 23 nt, Human
ugaaaaggccaacagcugaaaca

SEQ ID NO: 1053523 - RNA, 20 nt, Human
ugaaaaucggccaaaaacac

SEQ ID NO: 1053524 - RNA, 21 nt, Human
ugaaauucagacggaacacug

SEQ ID NO: 1053525 - RNA, 22 nt, Human
ugaaccagaagaagaaaacuga

SEQ ID NO: 1053526 - RNA, 19 nt, Human
ugaauauuuuucacuuauu

SEQ ID NO: 1053527 - RNA, 19 nt, Human
ugaauguggacugacauga

SEQ ID NO: 1053528 - RNA, 22 nt, Human
ugaauuaaaaauaaucuuugca

SEQ ID NO: 1053529 - RNA, 19 nt, Human
ugacugcagucacacauag

SEQ ID NO: 1053530 - RNA, 23 nt, Human
ugauacuuacguugcuucccaag

SEQ ID NO: 1053531 - RNA, 18 nt, Human
ugccauagcaagcuugga

SEQ ID NO: 1053532 - RNA, 21 nt, Human
ugggcugcuuaaagcuugcuu

SEQ ID NO: 1053533 - RNA, 22 nt, Human
ugugcaaaucuaaaugccauua

SEQ ID NO: 1053534 - RNA, 21 nt, Human
uguuuuguuuguucagugcau

SEQ ID NO: 1053535 - RNA, 22 nt, Human
uuaaaacugaagaaacauuugc

SEQ ID NO: 1053536 - RNA, 21 nt, Human
uuaagggggaaaugcaacaca

SEQ ID NO: 1053537 - RNA, 24 nt, Human
uucacuuauugucaauauauucac

SEQ ID NO: 1053538 - RNA, 21 nt, Human
uucuacacaaaagggugcccc

SEQ ID NO: 1053539 - RNA, 19 nt, Human
uugcaguuuacuguuagag

SEQ ID NO: 1053540 - RNA, 20 nt, Human
uuguaagguuuuucacacua

SEQ ID NO: 1053541 - RNA, 25 nt, Human
uuuaaaaugaauauggucagacaug

SEQ ID NO: 1053542 - RNA, 21 nt, Human
acucuggccucuccuagccuc

SEQ ID NO: 1053543 - RNA, 19 nt, Human
agaaggagacauaucugca

SEQ ID NO: 1053544 - RNA, 21 nt, Human
cacccucccauuucuucuccu

SEQ ID NO: 1053545 - RNA, 23 nt, Human
cacccuugcccaaaaguccagga

SEQ ID NO: 1053546 - RNA, 19 nt, Human
cacuuuauucuuccuaaag

SEQ ID NO: 1053547 - RNA, 21 nt, Human
cagcacacggccugggauacc

SEQ ID NO: 1053548 - RNA, 22 nt, Human
cccaaaaguccaggacuaagca

SEQ ID NO: 1053549 - RNA, 18 nt, Human
ccccacaaggccaggcca

SEQ ID NO: 1053550 - RNA, 26 nt, Human
cggaaagacgagaaggcugaguccug

SEQ ID NO: 1053551 - RNA, 18 nt, Human
cggugccaagggggcucc

SEQ ID NO: 1053552 - RNA, 19 nt, Human
cuucccuuuccuuggcuga

SEQ ID NO: 1053553 - RNA, 21 nt, Human
gaaggcacuuuauucuuccua

SEQ ID NO: 1053554 - RNA, 18 nt, Human
gacgcagccccugaggca

SEQ ID NO: 1053555 - RNA, 24 nt, Human
gcaacacuggagaagccucuaguu

SEQ ID NO: 1053556 - RNA, 21 nt, Human
gcacugguaggaagguggcac

SEQ ID NO: 1053557 - RNA, 19 nt, Human
gccagcacacggccuggga

SEQ ID NO: 1053558 - RNA, 21 nt, Human
ggaaccagcucuccagacucc

SEQ ID NO: 1053559 - RNA, 21 nt, Human
gggauaccgcccugugguucu

SEQ ID NO: 1053560 - RNA, 23 nt, Human
gggccagcacacggccugggaua

SEQ ID NO: 1053561 - RNA, 24 nt, Human
gggcuccucucuguaccccugcuu

SEQ ID NO: 1053562 - RNA, 22 nt, Human
uagggggauauggcaacacugg

SEQ ID NO: 1053563 - RNA, 18 nt, Human
uauggcaacacuggagaa

SEQ ID NO: 1053564 - RNA, 19 nt, Human
uccuaaagaaggagacaua

SEQ ID NO: 1053565 - RNA, 20 nt, Human
ucuccuagccucuuuucugg

SEQ ID NO: 1053566 - RNA, 23 nt, Human
ucugugggaaccagcucuccaga

SEQ ID NO: 1053567 - RNA, 18 nt, Human
ugaggcaccauaacugga

SEQ ID NO: 1053568 - RNA, 21 nt, Human
ugcccaaaaguccaggacuaa

SEQ ID NO: 1053569 - RNA, 22 nt, Human
ugcccaaaaguccaggacuaag

SEQ ID NO: 1053570 - RNA, 19 nt, Human
ugcgguggcggugccaagg

SEQ ID NO: 1053571 - RNA, 21 nt, Human
uggagaagccucuaguuucuc

SEQ ID NO: 1053572 - RNA, 23 nt, Human
uggggcagggccagcacacggcc

SEQ ID NO: 1053573 - RNA, 21 nt, Human
uuggcugacgcagccccugag

SEQ ID NO: 1053574 - RNA, 20 nt, Human
ccaccgucugggccugcucg

SEQ ID NO: 1053575 - RNA, 19 nt, Human
cgucugggccugcucgaug

SEQ ID NO: 1053576 - RNA, 24 nt, Human
accccccggugccccuucccacug

SEQ ID NO: 1053577 - RNA, 26 nt, Human
acuggccuuguccacacagggccacg

SEQ ID NO: 1053578 - RNA, 27 nt, Human
acuggccuuguccacacagggccacgc

SEQ ID NO: 1053579 - RNA, 22 nt, Human
agaguccuggggcuugaguccu

SEQ ID NO: 1053580 - RNA, 18 nt, Human
cagcccuuguccuggguc

SEQ ID NO: 1053581 - RNA, 18 nt, Human
ccagcccagggcucuggg

SEQ ID NO: 1053582 - RNA, 24 nt, Human
ccagcccagggcucuggggggcaa

SEQ ID NO: 1053583 - RNA, 25 nt, Human
cccccgcuguugccaagagugugac

SEQ ID NO: 1053584 - RNA, 22 nt, Human
ccugugggccccagcccagggc

SEQ ID NO: 1053585 - RNA, 21 nt, Human
ccugugucuggggucuggggu

SEQ ID NO: 1053586 - RNA, 20 nt, Human
ccuugggccugccaguuugc

SEQ ID NO: 1053587 - RNA, 23 nt, Human
cguuccuccugugggccccagcc

SEQ ID NO: 1053588 - RNA, 18 nt, Human
cugaacgcuaccagggag

SEQ ID NO: 1053589 - RNA, 21 nt, Human
cugguuccugugucugggguc

SEQ ID NO: 1053590 - RNA, 20 nt, Human
cuucugaacgcuaccaggga

SEQ ID NO: 1053591 - RNA, 21 nt, Human
gagccuugggccugccaguuu

SEQ ID NO: 1053592 - RNA, 21 nt, Human
gcccagggcucuggggggcaa

SEQ ID NO: 1053593 - RNA, 21 nt, Human
gggccccagcccagggcucug

SEQ ID NO: 1053594 - RNA, 24 nt, Human
gggcuugaguccuggaucuggggu

SEQ ID NO: 1053595 - RNA, 23 nt, Human
guuccuccugugggccccagccc

SEQ ID NO: 1053596 - RNA, 20 nt, Human
uccuggguccugggucuggg

SEQ ID NO: 1053597 - RNA, 23 nt, Human
uccugggucugggguuuggguuu

SEQ ID NO: 1053598 - RNA, 24 nt, Human
uccugggucugggguuuggguuug

SEQ ID NO: 1053599 - RNA, 22 nt, Human
uccugugggccccagcccaggg

SEQ ID NO: 1053600 - RNA, 18 nt, Human
ugaccccccggugccccu

SEQ ID NO: 1053601 - RNA, 19 nt, Human
ugccaagcagcuacccccg

SEQ ID NO: 1053602 - RNA, 22 nt, Human
ugggagucugaaaaccugaagg

SEQ ID NO: 1053603 - RNA, 22 nt, Human
uggguccugggucugggguuug

SEQ ID NO: 1053604 - RNA, 23 nt, Human
uuggguuugcaguccuggaaguc

SEQ ID NO: 1053605 - RNA, 24 nt, Human
uuucucuccucgagccuugggccc

SEQ ID NO: 1053606 - RNA, 22 nt, Human
aaucccuucuccacugacccac

SEQ ID NO: 1053607 - RNA, 23 nt, Human
cacugacccacuuuccaucccuc

SEQ ID NO: 1053608 - RNA, 21 nt, Human
cagcagccgcagcugggucug

SEQ ID NO: 1053609 - RNA, 20 nt, Human
cugcagcagccgcagcuggg

SEQ ID NO: 1053610 - RNA, 18 nt, Human
gaauguggguaaaacuca

SEQ ID NO: 1053611 - RNA, 21 nt, Human
uacugguccaggccccuugac

SEQ ID NO: 1053612 - RNA, 20 nt, Human
uggggaagaaugugucauuu

SEQ ID NO: 1053613 - RNA, 20 nt, Human
uggguaaaacucacgcagca

SEQ ID NO: 1053614 - RNA, 18 nt, Human
ugggucuggcuggagucu

SEQ ID NO: 1053615 - RNA, 23 nt, Human
acaaugacagauguguuuccuuc

SEQ ID NO: 1053616 - RNA, 26 nt, Human
agaaccuuuccaagauaucauaauau

SEQ ID NO: 1053617 - RNA, 22 nt, Human
agagaaaauaaacacuucagga

SEQ ID NO: 1053618 - RNA, 22 nt, Human
agucaaaucagaaguuucuucu

SEQ ID NO: 1053619 - RNA, 26 nt, Human
caagacaaugacagauguguuuccuu

SEQ ID NO: 1053620 - RNA, 22 nt, Human
caguagcuuccuuuccacgucc

SEQ ID NO: 1053621 - RNA, 30 nt, Human
ccaggagugugaggacaguagcuuccuuuu

SEQ ID NO: 1053622 - RNA, 18 nt, Human
cugcucagugauccagga

SEQ ID NO: 1053623 - RNA, 21 nt, Human
cuucuuugcucuuucuaggga

SEQ ID NO: 1053624 - RNA, 24 nt, Human
cuucuuugcucuuucuagggaucu

SEQ ID NO: 1053625 - RNA, 25 nt, Human
gaaaauaaacacuucaggaaacuug

SEQ ID NO: 1053626 - RNA, 18 nt, Human
gaaacuugcucaccacag

SEQ ID NO: 1053627 - RNA, 18 nt, Human
uaauggcaagaauauuuu

SEQ ID NO: 1053628 - RNA, 24 nt, Human
uaucauaauauuuucuuuauagga

SEQ ID NO: 1053629 - RNA, 21 nt, Human
uaugagagaaaauaaacacuu

SEQ ID NO: 1053630 - RNA, 24 nt, Human
ucaggaacaggauucacguuuggu

SEQ ID NO: 1053631 - RNA, 26 nt, Human
ugguggauaugagagaaaauaaacac

SEQ ID NO: 1053632 - RNA, 21 nt, Human
ugguuaagagcgauagucuca

SEQ ID NO: 1053633 - RNA, 19 nt, Human
uguuuccuucuuugcucuu

SEQ ID NO: 1053634 - RNA, 21 nt, Human
aaaaauacuucacaacagugc

SEQ ID NO: 1053635 - RNA, 18 nt, Human
aaacaggaaacuggccag

SEQ ID NO: 1053636 - RNA, 19 nt, Human
aaacauucagcucugagaa

SEQ ID NO: 1053637 - RNA, 23 nt, Human
aaagugcuggggcgggagcgggg

SEQ ID NO: 1053638 - RNA, 22 nt, Human
aaccccuccuccucaggcccca

SEQ ID NO: 1053639 - RNA, 24 nt, Human
aagcaacaaaaugcaagggagaaa

SEQ ID NO: 1053640 - RNA, 25 nt, Human
aagugaaccccuccuccucaggccc

SEQ ID NO: 1053641 - RNA, 21 nt, Human
aaugucaggaaaaaagcuaga

SEQ ID NO: 1053642 - RNA, 27 nt, Human
aauucuugcaccaaaaagaaccaaggg

SEQ ID NO: 1053643 - RNA, 18 nt, Human
acacgcgcgcacacagaa

SEQ ID NO: 1053644 - RNA, 22 nt, Human
accccuccuccucaggccccag

SEQ ID NO: 1053645 - RNA, 21 nt, Human
acggauggguagccacggugg

SEQ ID NO: 1053646 - RNA, 20 nt, Human
acucucuuucaucucccccc

SEQ ID NO: 1053647 - RNA, 19 nt, Human
agaacaggggacgggcaug

SEQ ID NO: 1053648 - RNA, 18 nt, Human
agaaccagaacagugcua

SEQ ID NO: 1053649 - RNA, 24 nt, Human
agagccaaaagugcuggggcggga

SEQ ID NO: 1053650 - RNA, 21 nt, Human
agauauuggaugucuuuaacu

SEQ ID NO: 1053651 - RNA, 18 nt, Human
agccaaccuucccucacc

SEQ ID NO: 1053652 - RNA, 26 nt, Human
aggaggaagugaaccccuccuccuca

SEQ ID NO: 1053653 - RNA, 22 nt, Human
agggaguuggggggaggggagc

SEQ ID NO: 1053654 - RNA, 23 nt, Human
aggguguguguguuucuaaagga

SEQ ID NO: 1053655 - RNA, 18 nt, Human
agugugccuaggggccgg

SEQ ID NO: 1053656 - RNA, 21 nt, Human
auaaagagagccccagcaaca

SEQ ID NO: 1053657 - RNA, 18 nt, Human
aucuccccccacccccca

SEQ ID NO: 1053658 - RNA, 19 nt, Human
caaaaagaaccaagggcua

SEQ ID NO: 1053659 - RNA, 22 nt, Human
caaaaagaaccaagggcuaaag

SEQ ID NO: 1053660 - RNA, 21 nt, Human
caaaucuccccgcauccccac

SEQ ID NO: 1053661 - RNA, 18 nt, Human
caacagcacccgggaugg

SEQ ID NO: 1053662 - RNA, 21 nt, Human
caacagugcaaaaauauuuua

SEQ ID NO: 1053663 - RNA, 25 nt, Human
caagaucgaagaauaaaacuacugg

SEQ ID NO: 1053664 - RNA, 24 nt, Human
cacagaauuaccccagccugggca

SEQ ID NO: 1053665 - RNA, 27 nt, Human
cacaguaucauggagugagaucuuuug

SEQ ID NO: 1053666 - RNA, 20 nt, Human
cacuggcgugcaaacagaac

SEQ ID NO: 1053667 - RNA, 20 nt, Human
cagaaccagaacagugcuag

SEQ ID NO: 1053668 - RNA, 18 nt, Human
caguaucauggagugaga

SEQ ID NO: 1053669 - RNA, 27 nt, Human
cauccccacgcgcaacagagccaaaag

SEQ ID NO: 1053670 - RNA, 20 nt, Human
caucuccccccaccccccaa

SEQ ID NO: 1053671 - RNA, 21 nt, Human
caucuccccccaccccccaaa

SEQ ID NO: 1053672 - RNA, 22 nt, Human
caucuccccccaccccccaaac

SEQ ID NO: 1053673 - RNA, 19 nt, Human
cauuucccccuuccugggg

SEQ ID NO: 1053674 - RNA, 18 nt, Human
ccaaaaagaaccaagggc

SEQ ID NO: 1053675 - RNA, 24 nt, Human
ccaaaaagaaccaagggcuaaagg

SEQ ID NO: 1053676 - RNA, 29 nt, Human
ccaccccccaaacaguuauuugaagaauu

SEQ ID NO: 1053677 - RNA, 21 nt, Human
ccagaacagugcuacuuuuaa

SEQ ID NO: 1053678 - RNA, 27 nt, Human
ccagcaacagcacccgggauggugcaa

SEQ ID NO: 1053679 - RNA, 18 nt, Human
cccaaacaguuauuugaa

SEQ ID NO: 1053680 - RNA, 21 nt, Human
cccacaaacaggaaacuggcc

SEQ ID NO: 1053681 - RNA, 19 nt, Human
cccacgcgcaacagagcca

SEQ ID NO: 1053682 - RNA, 19 nt, Human
cccagggggugggaggagg

SEQ ID NO: 1053683 - RNA, 25 nt, Human
ccccagccugggcaagggcgagagc

SEQ ID NO: 1053684 - RNA, 18 nt, Human
ccccauuucccccuuccu

SEQ ID NO: 1053685 - RNA, 21 nt, Human
cccccaccccccaaacaguua

SEQ ID NO: 1053686 - RNA, 19 nt, Human
ccccccaccccccaaacag

SEQ ID NO: 1053687 - RNA, 19 nt, Human
cccccguuugggcuggucu

SEQ ID NO: 1053688 - RNA, 25 nt, Human
ccccgcauccccacgcgcaacagag

SEQ ID NO: 1053689 - RNA, 22 nt, Human
cccgcugagccaccggccccug

SEQ ID NO: 1053690 - RNA, 19 nt, Human
ccggcgacgcgcggaggag

SEQ ID NO: 1053691 - RNA, 22 nt, Human
ccuacggccugagacuaggaac

SEQ ID NO: 1053692 - RNA, 22 nt, Human
ccucaaacaccuugagagcaaa

SEQ ID NO: 1053693 - RNA, 19 nt, Human
ccucaggccccagcugccc

SEQ ID NO: 1053694 - RNA, 22 nt, Human
ccuccgaggcgguguccagcuc

SEQ ID NO: 1053695 - RNA, 24 nt, Human
ccuccgaggggugcuggagaugga

SEQ ID NO: 1053696 - RNA, 23 nt, Human
ccucucaaaucuccccgcauccc

SEQ ID NO: 1053697 - RNA, 23 nt, Human
ccugggggcgggcaagggacagg

SEQ ID NO: 1053698 - RNA, 21 nt, Human
cgcagggccgcucccaggggg

SEQ ID NO: 1053699 - RNA, 23 nt, Human
cgccuuugcagugcgcccucucc

SEQ ID NO: 1053700 - RNA, 18 nt, Human
cggcccgggcaagaucga

SEQ ID NO: 1053701 - RNA, 19 nt, Human
cucacccgcaucccagagg

SEQ ID NO: 1053702 - RNA, 20 nt, Human
cuccccccaccccccaaaca

SEQ ID NO: 1053703 - RNA, 24 nt, Human
cuccgaggggugcuggagauggaa

SEQ ID NO: 1053704 - RNA, 19 nt, Human
cuccgcucccgggcucucc

SEQ ID NO: 1053705 - RNA, 22 nt, Human
cucucaaaucuccccgcauccc

SEQ ID NO: 1053706 - RNA, 19 nt, Human
cucucuuucaucucccccc

SEQ ID NO: 1053707 - RNA, 19 nt, Human
cugagguaaacagccagaa

SEQ ID NO: 1053708 - RNA, 19 nt, Human
cugcugcccgccuuugcag

SEQ ID NO: 1053709 - RNA, 20 nt, Human
cuggccaggcaccuacggcc

SEQ ID NO: 1053710 - RNA, 26 nt, Human
cugggcuccaaguguaggucugggcc

SEQ ID NO: 1053711 - RNA, 18 nt, Human
cuggucucaagucagcaa

SEQ ID NO: 1053712 - RNA, 23 nt, Human
gaaagaacgagcguagaguggaa

SEQ ID NO: 1053713 - RNA, 20 nt, Human
gacucucuuucaucuccccc

SEQ ID NO: 1053714 - RNA, 20 nt, Human
gagaacaggggacgggcaug

SEQ ID NO: 1053715 - RNA, 22 nt, Human
gagaacaggggacgggcauggc

SEQ ID NO: 1053716 - RNA, 24 nt, Human
gagagcaaauuuuuuuuuuuuuuu

SEQ ID NO: 1053717 - RNA, 19 nt, Human
gagauggaaagccccccgu

SEQ ID NO: 1053718 - RNA, 21 nt, Human
gagcaaagagucucaggcaag

SEQ ID NO: 1053719 - RNA, 20 nt, Human
gagcaaauuuuuuuuuuuuu

SEQ ID NO: 1053720 - RNA, 24 nt, Human
gagcgggggccgggagguagggga

SEQ ID NO: 1053721 - RNA, 21 nt, Human
gaggcgguguccagcuccgcu

SEQ ID NO: 1053722 - RNA, 20 nt, Human
gagugugccuaggggccggu

SEQ ID NO: 1053723 - RNA, 22 nt, Human
gcagcugggcggcggcggcggc

SEQ ID NO: 1053724 - RNA, 19 nt, Human
gccccauuucccccuuccu

SEQ ID NO: 1053725 - RNA, 20 nt, Human
gccccgcgcagcagucccgc

SEQ ID NO: 1053726 - RNA, 20 nt, Human
gcgccccggcgcagcugggc

SEQ ID NO: 1053727 - RNA, 19 nt, Human
gcgccggcgacgcgcggag

SEQ ID NO: 1053728 - RNA, 18 nt, Human
gcggcggcggcggcggag

SEQ ID NO: 1053729 - RNA, 18 nt, Human
gcgggagcgggggccggg

SEQ ID NO: 1053730 - RNA, 22 nt, Human
gcucaguguccgggcuggccug

SEQ ID NO: 1053731 - RNA, 20 nt, Human
gcuccaaguguaggucuggg

SEQ ID NO: 1053732 - RNA, 21 nt, Human
gcuccgagaacaggggacggg

SEQ ID NO: 1053733 - RNA, 25 nt, Human
ggacuggggccaaaacccgcggaaa

SEQ ID NO: 1053734 - RNA, 20 nt, Human
ggagauggaaagccccccgu

SEQ ID NO: 1053735 - RNA, 20 nt, Human
ggcggcggcggcggcggagc

SEQ ID NO: 1053736 - RNA, 19 nt, Human
gggaguuggggggagggga

SEQ ID NO: 1053737 - RNA, 22 nt, Human
gggcaagggacagggagguugu

SEQ ID NO: 1053738 - RNA, 23 nt, Human
gggcaagggacagggagguuguc

SEQ ID NO: 1053739 - RNA, 18 nt, Human
gggcggcggcggcggcgg

SEQ ID NO: 1053740 - RNA, 21 nt, Human
gggcggcggcggcggcggagc

SEQ ID NO: 1053741 - RNA, 22 nt, Human
ggggaaagcggucgggggaacg

SEQ ID NO: 1053742 - RNA, 19 nt, Human
ggggcgggagcgggggccg

SEQ ID NO: 1053743 - RNA, 20 nt, Human
ggugcuggagauggaaagcc

SEQ ID NO: 1053744 - RNA, 21 nt, Human
gugcgggggagacacgcgcgc

SEQ ID NO: 1053745 - RNA, 18 nt, Human
guggagcgccggcgacgg

SEQ ID NO: 1053746 - RNA, 24 nt, Human
gugguagggaguuggggggagggg

SEQ ID NO: 1053747 - RNA, 20 nt, Human
uaaaaaagaaaauauucagc

SEQ ID NO: 1053748 - RNA, 21 nt, Human
uaacacacacaacccucagga

SEQ ID NO: 1053749 - RNA, 20 nt, Human
uaacuguaaacaaaacgcga

SEQ ID NO: 1053750 - RNA, 22 nt, Human
uaccccagccugggcaagggcg

SEQ ID NO: 1053751 - RNA, 22 nt, Human
uaccucauuucuucccuccgag

SEQ ID NO: 1053752 - RNA, 24 nt, Human
uacuucacaacagugcaaaaauau

SEQ ID NO: 1053753 - RNA, 23 nt, Human
uagaguggaaaaugucaggaaaa

SEQ ID NO: 1053754 - RNA, 19 nt, Human
ucaaaucuccccgcauccc

SEQ ID NO: 1053755 - RNA, 18 nt, Human
ucacugcaucuucgcucc

SEQ ID NO: 1053756 - RNA, 19 nt, Human
ucacugcaucuucgcuccg

SEQ ID NO: 1053757 - RNA, 28 nt, Human
ucacugcaucuucgcuccgggguccucc

SEQ ID NO: 1053758 - RNA, 23 nt, Human
ucagcagcucgcccaaagugcgg

SEQ ID NO: 1053759 - RNA, 21 nt, Human
ucagccaaccuucccucaccc

SEQ ID NO: 1053760 - RNA, 19 nt, Human
ucaggccccagcugcccca

SEQ ID NO: 1053761 - RNA, 22 nt, Human
ucaucuccccccaccccccaaa

SEQ ID NO: 1053762 - RNA, 25 nt, Human
ucauuucuucccuccgaggcgguga

SEQ ID NO: 1053763 - RNA, 19 nt, Human
uccccacgcgcaacagagc

SEQ ID NO: 1053764 - RNA, 19 nt, Human
uccccccaccccccaaaca

SEQ ID NO: 1053765 - RNA, 19 nt, Human
uccccuaacacacacaacc

SEQ ID NO: 1053766 - RNA, 20 nt, Human
uccccuaacacacacaaccc

SEQ ID NO: 1053767 - RNA, 18 nt, Human
uccggugcugcgagcggc

SEQ ID NO: 1053768 - RNA, 20 nt, Human
uccucaggccccagcugccc

SEQ ID NO: 1053769 - RNA, 20 nt, Human
uccuccucaggccccagcug

SEQ ID NO: 1053770 - RNA, 23 nt, Human
uccucuuuauucucuccccacug

SEQ ID NO: 1053771 - RNA, 18 nt, Human
ucuccacggucugcugcc

SEQ ID NO: 1053772 - RNA, 21 nt, Human
ucucuuucaucuccccccacc

SEQ ID NO: 1053773 - RNA, 18 nt, Human
ucugggccccaaaugccc

SEQ ID NO: 1053774 - RNA, 23 nt, Human
ugagacuaggaacuucagccaac

SEQ ID NO: 1053775 - RNA, 21 nt, Human
ugagccaccggccccugccag

SEQ ID NO: 1053776 - RNA, 19 nt, Human
ugcaaacagaaccagaaca

SEQ ID NO: 1053777 - RNA, 21 nt, Human
ugccccacaaacaggaaacug

SEQ ID NO: 1053778 - RNA, 19 nt, Human
ugcggucggaugcuggguc

SEQ ID NO: 1053779 - RNA, 22 nt, Human
ugcuggggcgggagcgggggcc

SEQ ID NO: 1053780 - RNA, 22 nt, Human
uggaaaaugucaggaaaaaagc

SEQ ID NO: 1053781 - RNA, 24 nt, Human
uggaaagccccccguuugggcugg

SEQ ID NO: 1053782 - RNA, 21 nt, Human
uggccggguccgggaaccgcc

SEQ ID NO: 1053783 - RNA, 18 nt, Human
ugggccccaaaugcccca

SEQ ID NO: 1053784 - RNA, 19 nt, Human
ugggcggcggcggcggcgg

SEQ ID NO: 1053785 - RNA, 24 nt, Human
uggguccccuaacacacacaaccc

SEQ ID NO: 1053786 - RNA, 21 nt, Human
ugguagggaguuggggggagg

SEQ ID NO: 1053787 - RNA, 28 nt, Human
uggugcgggggagacacgcgcgcacaca

SEQ ID NO: 1053788 - RNA, 18 nt, Human
uguccagcuccgcucccg

SEQ ID NO: 1053789 - RNA, 23 nt, Human
uucaucuccccccaccccccaaa

SEQ ID NO: 1053790 - RNA, 25 nt, Human
uucaucuccccccaccccccaaaca

SEQ ID NO: 1053791 - RNA, 23 nt, Human
uuccccucucaaaucuccccgca

SEQ ID NO: 1053792 - RNA, 20 nt, Human
uuuugagcaagaggaagggu

SEQ ID NO: 1053793 - RNA, 20 nt, Human
uuuuuuuuuuuuaaugagau

SEQ ID NO: 1053794 - RNA, 22 nt, Human
uaggcagccggagggcacacag

SEQ ID NO: 1053795 - RNA, 23 nt, Human
aaaaaauagaaacgccauauuuc

SEQ ID NO: 1053796 - RNA, 23 nt, Human
aaaaagcuggugucuagagcuaa

SEQ ID NO: 1053797 - RNA, 19 nt, Human
aaagguuuuuuuuuuuuuu

SEQ ID NO: 1053798 - RNA, 18 nt, Human
aaagugcuuuuccuauca

SEQ ID NO: 1053799 - RNA, 18 nt, Human
aaccucugccuccccagu

SEQ ID NO: 1053800 - RNA, 22 nt, Human
acagugcugggauuacaggcau

SEQ ID NO: 1053801 - RNA, 24 nt, Human
acagugcugggauuacaggcauga

SEQ ID NO: 1053802 - RNA, 22 nt, Human
accauguuggucaggcuggucu

SEQ ID NO: 1053803 - RNA, 19 nt, Human
acccaggcuggaguacagu

SEQ ID NO: 1053804 - RNA, 25 nt, Human
acucugucacccaggcuggaguaca

SEQ ID NO: 1053805 - RNA, 23 nt, Human
agaaagaaggcaggugccaauua

SEQ ID NO: 1053806 - RNA, 19 nt, Human
agaaggcaggugccaauua

SEQ ID NO: 1053807 - RNA, 24 nt, Human
agauguaguaugugcuagacacuu

SEQ ID NO: 1053808 - RNA, 19 nt, Human
agccuguuugguuugauac

SEQ ID NO: 1053809 - RNA, 21 nt, Human
agggugagaaaacaaaacuau

SEQ ID NO: 1053810 - RNA, 23 nt, Human
aguagaaaugggguuucaccaug

SEQ ID NO: 1053811 - RNA, 19 nt, Human
agugcugggauuacaggca

SEQ ID NO: 1053812 - RNA, 20 nt, Human
agugcugggauuacaggcau

SEQ ID NO: 1053813 - RNA, 22 nt, Human
agugcugggauuacaggcauga

SEQ ID NO: 1053814 - RNA, 20 nt, Human
aucauuuuuccuaacucucc

SEQ ID NO: 1053815 - RNA, 22 nt, Human
auggaguaucacucugucaccc

SEQ ID NO: 1053816 - RNA, 21 nt, Human
augggguuucaccauguuggu

SEQ ID NO: 1053817 - RNA, 23 nt, Human
augggguuucaccauguugguca

SEQ ID NO: 1053818 - RNA, 24 nt, Human
augggguuucaccauguuggucag

SEQ ID NO: 1053819 - RNA, 20 nt, Human
auucacccaccucggccgcc

SEQ ID NO: 1053820 - RNA, 24 nt, Human
caaaaagcuggugucuagagcuaa

SEQ ID NO: 1053821 - RNA, 21 nt, Human
caccauguuggucaggcuggu

SEQ ID NO: 1053822 - RNA, 23 nt, Human
caccauguuggucaggcuggucu

SEQ ID NO: 1053823 - RNA, 22 nt, Human
cacucugucacccaggcuggag

SEQ ID NO: 1053824 - RNA, 23 nt, Human
cacucugucacccaggcuggagu

SEQ ID NO: 1053825 - RNA, 23 nt, Human
cacugcaaccucugccuccccag

SEQ ID NO: 1053826 - RNA, 20 nt, Human
cagugcugggauuacaggca

SEQ ID NO: 1053827 - RNA, 25 nt, Human
cagugcugggauuacaggcaugagc

SEQ ID NO: 1053828 - RNA, 24 nt, Human
cauguuggucaggcuggucuugaa

SEQ ID NO: 1053829 - RNA, 23 nt, Human
ccuacagugcugggauuacaggc

SEQ ID NO: 1053830 - RNA, 20 nt, Human
cgccuggaugccuuuuccca

SEQ ID NO: 1053831 - RNA, 24 nt, Human
cuacagugcugggauuacaggcau

SEQ ID NO: 1053832 - RNA, 22 nt, Human
cuagaauuucaacuacuaauuu

SEQ ID NO: 1053833 - RNA, 21 nt, Human
cucacugcaaccucugccucc

SEQ ID NO: 1053834 - RNA, 22 nt, Human
cucacugcaaccucugccuccc

SEQ ID NO: 1053835 - RNA, 25 nt, Human
cucacugcaaccucugccuccccag

SEQ ID NO: 1053836 - RNA, 21 nt, Human
cuccccuagccuguuugguuu

SEQ ID NO: 1053837 - RNA, 20 nt, Human
cucuuagauguaguaugugc

SEQ ID NO: 1053838 - RNA, 19 nt, Human
cuugucucacugcaaccuc

SEQ ID NO: 1053839 - RNA, 21 nt, Human
cuugucucacugcaaccucug

SEQ ID NO: 1053840 - RNA, 24 nt, Human
gaaaugggguuucaccauguuggu

SEQ ID NO: 1053841 - RNA, 24 nt, Human
gaccucaugugauucacccaccuc

SEQ ID NO: 1053842 - RNA, 26 nt, Human
gagaaaacaaaacuaucagccauuga

SEQ ID NO: 1053843 - RNA, 18 nt, Human
gauuacaggcaugagcca

SEQ ID NO: 1053844 - RNA, 20 nt, Human
gauuacaggcaugagccacc

SEQ ID NO: 1053845 - RNA, 23 nt, Human
gauuacaggcaugagccaccgca

SEQ ID NO: 1053846 - RNA, 18 nt, Human
gcaaccucugccucccca

SEQ ID NO: 1053847 - RNA, 23 nt, Human
gcuggucuugaacuccugaccuc

SEQ ID NO: 1053848 - RNA, 23 nt, Human
gcuuuguaugcaaggauguuuuc

SEQ ID NO: 1053849 - RNA, 22 nt, Human
ggauuacaggcaugagccaccg

SEQ ID NO: 1053850 - RNA, 27 nt, Human
ggcaccaaagguuuuuuuuuuuuuuuu

SEQ ID NO: 1053851 - RNA, 24 nt, Human
ggcuggucuugaacuccugaccuc

SEQ ID NO: 1053852 - RNA, 18 nt, Human
gggccucuggucugucuc

SEQ ID NO: 1053853 - RNA, 22 nt, Human
gggguuucaccauguuggucag

SEQ ID NO: 1053854 - RNA, 19 nt, Human
ggucuugaacuccugaccu

SEQ ID NO: 1053855 - RNA, 21 nt, Human
guagaaaugggguuucaccau

SEQ ID NO: 1053856 - RNA, 24 nt, Human
gucacaauuagaccuauucucccc

SEQ ID NO: 1053857 - RNA, 22 nt, Human
gucaucaucaucaucuucuucu

SEQ ID NO: 1053858 - RNA, 23 nt, Human
gugauucacccaccucggccgcc

SEQ ID NO: 1053859 - RNA, 25 nt, Human
guucuugggccucuggucugucucu

SEQ ID NO: 1053860 - RNA, 19 nt, Human
guuuaaagugcuuuuccua

SEQ ID NO: 1053861 - RNA, 22 nt, Human
uacaggcaugagccaccgcacc

SEQ ID NO: 1053862 - RNA, 18 nt, Human
uacagugcugggauuaca

SEQ ID NO: 1053863 - RNA, 21 nt, Human
uagaaaugggguuucaccaug

SEQ ID NO: 1053864 - RNA, 22 nt, Human
uagaaaugggguuucaccaugu

SEQ ID NO: 1053865 - RNA, 24 nt, Human
uaucacucugucacccaggcugga

SEQ ID NO: 1053866 - RNA, 24 nt, Human
uauugagcuuuucuucucggauuu

SEQ ID NO: 1053867 - RNA, 19 nt, Human
ucacaaaggugacaggaac

SEQ ID NO: 1053868 - RNA, 18 nt, Human
ucacucucuucaccauca

SEQ ID NO: 1053869 - RNA, 22 nt, Human
ucacucugucacccaggcugga

SEQ ID NO: 1053870 - RNA, 24 nt, Human
ucacucugucacccaggcuggagu

SEQ ID NO: 1053871 - RNA, 19 nt, Human
ucacugcaaccucugccuc

SEQ ID NO: 1053872 - RNA, 24 nt, Human
ucacugcaaccucugccuccccag

SEQ ID NO: 1053873 - RNA, 19 nt, Human
ucagguaaagaagagagaa

SEQ ID NO: 1053874 - RNA, 22 nt, Human
ucccauggcuugucuuuccaaa

SEQ ID NO: 1053875 - RNA, 18 nt, Human
ucugucacccaggcugga

SEQ ID NO: 1053876 - RNA, 24 nt, Human
ucugucacccaggcuggaguacag

SEQ ID NO: 1053877 - RNA, 19 nt, Human
ucuuaaaaaaauagaaacg

SEQ ID NO: 1053878 - RNA, 19 nt, Human
ucuuccagcaugcgccugg

SEQ ID NO: 1053879 - RNA, 21 nt, Human
ucuugaacuccugaccucaug

SEQ ID NO: 1053880 - RNA, 18 nt, Human
ucuuucccauggcuuguc

SEQ ID NO: 1053881 - RNA, 20 nt, Human
ugaagggugagaaaacaaaa

SEQ ID NO: 1053882 - RNA, 22 nt, Human
ugagaaaacaaaacuaucagcc

SEQ ID NO: 1053883 - RNA, 19 nt, Human
uggaguacagugacgugau

SEQ ID NO: 1053884 - RNA, 23 nt, Human
uggaguacagugacgugaucuug

SEQ ID NO: 1053885 - RNA, 18 nt, Human
ugggauuacaggcaugag

SEQ ID NO: 1053886 - RNA, 19 nt, Human
ugggauuacaggcaugagc

SEQ ID NO: 1053887 - RNA, 21 nt, Human
ugggauuacaggcaugagcca

SEQ ID NO: 1053888 - RNA, 22 nt, Human
ugggauuacaggcaugagccac

SEQ ID NO: 1053889 - RNA, 23 nt, Human
ugggauuacaggcaugagccacc

SEQ ID NO: 1053890 - RNA, 24 nt, Human
ugggauuacaggcaugagccaccg

SEQ ID NO: 1053891 - RNA, 24 nt, Human
ugggauuacaggcaugagccaccg

SEQ ID NO: 1053892 - RNA, 26 nt, Human
ugggauuacaggcaugagccaccgca

SEQ ID NO: 1053893 - RNA, 24 nt, Human
ugggguuucaccauguuggucagg

SEQ ID NO: 1053894 - RNA, 24 nt, Human
uggucaggcuggucuugaacuccu

SEQ ID NO: 1053895 - RNA, 20 nt, Human
uggucugucucucuguucuu

SEQ ID NO: 1053896 - RNA, 21 nt, Human
uucaaaaagcuggugucuaga

SEQ ID NO: 1053897 - RNA, 21 nt, Human
uucuaauuuguuccuuugcuu

SEQ ID NO: 1053898 - RNA, 21 nt, Human
uucucacuuuguucuugggcc

SEQ ID NO: 1053899 - RNA, 22 nt, Human
uucucacuuuguucuugggccu

SEQ ID NO: 1053900 - RNA, 19 nt, Human
uucuucaucuguuucuugg

SEQ ID NO: 1053901 - RNA, 23 nt, Human
uugcuuugccuuccucuucucug

SEQ ID NO: 1053902 - RNA, 22 nt, Human
uuguuccuuugcuuugccuucc

SEQ ID NO: 1053903 - RNA, 24 nt, Human
uuucaccauguuggucaggcuggu

SEQ ID NO: 1053904 - RNA, 21 nt, Human
uuucuagaaauauugaagggu

SEQ ID NO: 1053905 - RNA, 19 nt, Human
uuucucacuuuguucuugg

SEQ ID NO: 1053906 - RNA, 22 nt, Human
uuuuuuuuuuuuuugagaugga

SEQ ID NO: 1053907 - RNA, 18 nt, Human
uuuuuuuuuuuuuuuuug

SEQ ID NO: 1053908 - RNA, 20 nt, Human
aaccuggcuuccgguuguag

SEQ ID NO: 1053909 - RNA, 21 nt, Human
aagcgaagcuccucuucuugu

SEQ ID NO: 1053910 - RNA, 18 nt, Human
accugggcagugauggcu

SEQ ID NO: 1053911 - RNA, 18 nt, Human
agcagucauagaacggag

SEQ ID NO: 1053912 - RNA, 19 nt, Human
cacagcacugaaagggugc

SEQ ID NO: 1053913 - RNA, 19 nt, Human
cagcuccugagugucagga

SEQ ID NO: 1053914 - RNA, 19 nt, Human
caggagagacacagaagua

SEQ ID NO: 1053915 - RNA, 22 nt, Human
caucugucauguuccucacccu

SEQ ID NO: 1053916 - RNA, 21 nt, Human
cccaucagcuuggaccaccau

SEQ ID NO: 1053917 - RNA, 21 nt, Human
ccgccgccgcucagcaagcgc

SEQ ID NO: 1053918 - RNA, 23 nt, Human
ccucugaagguucaaccuggcuu

SEQ ID NO: 1053919 - RNA, 23 nt, Human
cuaagcgaagcuccucuucuugu

SEQ ID NO: 1053920 - RNA, 22 nt, Human
cuccucuucuuguucuuccuuc

SEQ ID NO: 1053921 - RNA, 18 nt, Human
cucuccacagaacgcuca

SEQ ID NO: 1053922 - RNA, 21 nt, Human
cuuccuucuuucuuugcucuu

SEQ ID NO: 1053923 - RNA, 19 nt, Human
gagcagucauagaacggag

SEQ ID NO: 1053924 - RNA, 26 nt, Human
gauaacucuuuaaugaaucaaagugc

SEQ ID NO: 1053925 - RNA, 22 nt, Human
gucaucuucuauuugcuuauuc

SEQ ID NO: 1053926 - RNA, 20 nt, Human
guucuuccuucuuucuuugc

SEQ ID NO: 1053927 - RNA, 18 nt, Human
uacuguuuccucuaaagu

SEQ ID NO: 1053928 - RNA, 19 nt, Human
uccacagaacgcucaagcc

SEQ ID NO: 1053929 - RNA, 23 nt, Human
uccugugcuaagcgaagcuccuc

SEQ ID NO: 1053930 - RNA, 20 nt, Human
ucuaccugggcagugauggc

SEQ ID NO: 1053931 - RNA, 22 nt, Human
ucuccacagaacgcucaagccc

SEQ ID NO: 1053932 - RNA, 22 nt, Human
ucuuccuucuuucuuugcucuu

SEQ ID NO: 1053933 - RNA, 24 nt, Human
ucuuccuucuuucuuugcucuucc

SEQ ID NO: 1053934 - RNA, 19 nt, Human
ucuuucuuugcucuuccuc

SEQ ID NO: 1053935 - RNA, 22 nt, Human
ugacugagagaacagcugagau

SEQ ID NO: 1053936 - RNA, 18 nt, Human
ugagagaacagcugagau

SEQ ID NO: 1053937 - RNA, 19 nt, Human
ugagagaacagcugagauu

SEQ ID NO: 1053938 - RNA, 20 nt, Human
ugagagaacagcugagauug

SEQ ID NO: 1053939 - RNA, 24 nt, Human
ugcuaagcgaagcuccucuucuug

SEQ ID NO: 1053940 - RNA, 23 nt, Human
ugcuauaugcuccuccucugaag

SEQ ID NO: 1053941 - RNA, 18 nt, Human
ugucaggagagacacaga

SEQ ID NO: 1053942 - RNA, 19 nt, Human
ugucaggagagacacagaa

SEQ ID NO: 1053943 - RNA, 27 nt, Human
ugucauguuccucacccuuugaauaua

SEQ ID NO: 1053944 - RNA, 20 nt, Human
uugcuauaugcuccuccucu

SEQ ID NO: 1053945 - RNA, 22 nt, Human
uugcucuuccuccaguuguuuc

SEQ ID NO: 1053946 - RNA, 20 nt, Human
uuugcaguucuuguuucaca

SEQ ID NO: 1053947 - RNA, 27 nt, Human
uuugcucuuccuccaguuguuucuucc

SEQ ID NO: 1053948 - RNA, 23 nt, Human
aacuccuccucugacuccuucug

SEQ ID NO: 1053949 - RNA, 18 nt, Human
accucuuccuccuccucc

SEQ ID NO: 1053950 - RNA, 19 nt, Human
aggcgagcgcaagugggcc

SEQ ID NO: 1053951 - RNA, 18 nt, Human
ccccgggucuccgaagcc

SEQ ID NO: 1053952 - RNA, 22 nt, Human
ccgcuaggcgagcgcaaguggg

SEQ ID NO: 1053953 - RNA, 23 nt, Human
ccuccuccucuaacuccuccucu

SEQ ID NO: 1053954 - RNA, 19 nt, Human
ccuccucuaacuccuccuc

SEQ ID NO: 1053955 - RNA, 20 nt, Human
ccucugacuccuucuggucc

SEQ ID NO: 1053956 - RNA, 23 nt, Human
cuccuccuccuccuccucuaacu

SEQ ID NO: 1053957 - RNA, 24 nt, Human
cuccucuaacuccuccucugacuc

SEQ ID NO: 1053958 - RNA, 20 nt, Human
cucuuuggccgcggccccgg

SEQ ID NO: 1053959 - RNA, 27 nt, Human
cuuccuccuccuccuccuccucuaacu

SEQ ID NO: 1053960 - RNA, 18 nt, Human
uccucugacuccuucugg

SEQ ID NO: 1053961 - RNA, 25 nt, Human
ucugacuccuucugguccuucuucc

SEQ ID NO: 1053962 - RNA, 23 nt, Human
uuccccgggucuccgaagccgcu

SEQ ID NO: 1053963 - RNA, 21 nt, Human
aaaaagcaaauuuaauacgaa

SEQ ID NO: 1053964 - RNA, 20 nt, Human
aaaaggcucucaccugggag

SEQ ID NO: 1053965 - RNA, 24 nt, Human
aaacagggaggaggcaggcucuga

SEQ ID NO: 1053966 - RNA, 20 nt, Human
aaagggucaguggcucugau

SEQ ID NO: 1053967 - RNA, 21 nt, Human
aaauaggcugggcuagacccu

SEQ ID NO: 1053968 - RNA, 21 nt, Human
aacacacuccacccacaacua

SEQ ID NO: 1053969 - RNA, 20 nt, Human
aagcuuccagaccacugccc

SEQ ID NO: 1053970 - RNA, 19 nt, Human
aauguccauuuccugcagc

SEQ ID NO: 1053971 - RNA, 18 nt, Human
acaaagcacagaugaagc

SEQ ID NO: 1053972 - RNA, 22 nt, Human
acacacacaccugagugcccag

SEQ ID NO: 1053973 - RNA, 22 nt, Human
acauuucaucacuacaauuucu

SEQ ID NO: 1053974 - RNA, 23 nt, Human
acccaucccagcuccugaauccu

SEQ ID NO: 1053975 - RNA, 23 nt, Human
accuguuuuccaacaccuaggaa

SEQ ID NO: 1053976 - RNA, 19 nt, Human
agaaaacauucccacgucc

SEQ ID NO: 1053977 - RNA, 21 nt, Human
agacagagcggaaccuuccaa

SEQ ID NO: 1053978 - RNA, 21 nt, Human
agagacaccaguccucacagg

SEQ ID NO: 1053979 - RNA, 18 nt, Human
aggagaccuagccacuuc

SEQ ID NO: 1053980 - RNA, 21 nt, Human
aggcaggguggugcuagacug

SEQ ID NO: 1053981 - RNA, 21 nt, Human
aggcugggcuagacccuggag

SEQ ID NO: 1053982 - RNA, 22 nt, Human
aucaauauuggcaugcucuacc

SEQ ID NO: 1053983 - RNA, 22 nt, Human
augaggggaagacaggugugug

SEQ ID NO: 1053984 - RNA, 24 nt, Human
caacacacacacaccugagugccc

SEQ ID NO: 1053985 - RNA, 21 nt, Human
caacaucugucgguuucuugc

SEQ ID NO: 1053986 - RNA, 19 nt, Human
caagcacucugcauagucc

SEQ ID NO: 1053987 - RNA, 18 nt, Human
cacacuccacccacaacu

SEQ ID NO: 1053988 - RNA, 19 nt, Human
cacccucccuuccucaaag

SEQ ID NO: 1053989 - RNA, 19 nt, Human
cacccugcccuccagccuc

SEQ ID NO: 1053990 - RNA, 22 nt, Human
cacucaacacacacacaccuga

SEQ ID NO: 1053991 - RNA, 21 nt, Human
cagaccacugcccacccuccc

SEQ ID NO: 1053992 - RNA, 27 nt, Human
cagaugagcugcccaguaggcaggcac

SEQ ID NO: 1053993 - RNA, 18 nt, Human
cagccugccuuccauacc

SEQ ID NO: 1053994 - RNA, 23 nt, Human
caggacugugucucuuccuacaa

SEQ ID NO: 1053995 - RNA, 21 nt, Human
caggcuguguguuguuacaga

SEQ ID NO: 1053996 - RNA, 21 nt, Human
cagggccuuguccugagcccu

SEQ ID NO: 1053997 - RNA, 20 nt, Human
caguuuucauggguccaugg

SEQ ID NO: 1053998 - RNA, 23 nt, Human
caugccugcuuuccccucuggca

SEQ ID NO: 1053999 - RNA, 24 nt, Human
caugccugcuuuccccucuggcag

SEQ ID NO: 1054000 - RNA, 25 nt, Human
ccagcaaccccaggucauacccucu

SEQ ID NO: 1054001 - RNA, 19 nt, Human
ccaugcucaguccaaggag

SEQ ID NO: 1054002 - RNA, 20 nt, Human
ccauuuccugcagccugccu

SEQ ID NO: 1054003 - RNA, 22 nt, Human
cccacccucccuuccucaaaag

SEQ ID NO: 1054004 - RNA, 19 nt, Human
cccacucaacacacacaca

SEQ ID NO: 1054005 - RNA, 21 nt, Human
cccaucccuccuucuuucuca

SEQ ID NO: 1054006 - RNA, 24 nt, Human
ccccaacacugcaguaaguguacc

SEQ ID NO: 1054007 - RNA, 20 nt, Human
ccccaacuuuccauucacuc

SEQ ID NO: 1054008 - RNA, 24 nt, Human
ccccaggggccacuggaaugucca

SEQ ID NO: 1054009 - RNA, 24 nt, Human
ccccaggggccacuggaauguccu

SEQ ID NO: 1054010 - RNA, 25 nt, Human
ccccaggucauacccucuauuuugc

SEQ ID NO: 1054011 - RNA, 23 nt, Human
cccuccagccucgccaacccuag

SEQ ID NO: 1054012 - RNA, 21 nt, Human
cccucuucuuuuucucucucc

SEQ ID NO: 1054013 - RNA, 21 nt, Human
cccugcccaaccccucaccau

SEQ ID NO: 1054014 - RNA, 21 nt, Human
cccuuccucaaaaggcucuca

SEQ ID NO: 1054015 - RNA, 23 nt, Human
cccuuccugcucaguuucagaag

SEQ ID NO: 1054016 - RNA, 25 nt, Human
ccuagccacuuccuuacccuuccug

SEQ ID NO: 1054017 - RNA, 18 nt, Human
ccucccuaacaaauaggc

SEQ ID NO: 1054018 - RNA, 23 nt, Human
ccugagcccucuucuuuuucucu

SEQ ID NO: 1054019 - RNA, 22 nt, Human
ccugcccaaccccucaccaugc

SEQ ID NO: 1054020 - RNA, 25 nt, Human
ccugccuuccauaccgcccuuccug

SEQ ID NO: 1054021 - RNA, 19 nt, Human
ccuuguggccacuccucuu

SEQ ID NO: 1054022 - RNA, 25 nt, Human
cucacaagcacucugcauaguccgc

SEQ ID NO: 1054023 - RNA, 18 nt, Human
cucacacguucuacuccc

SEQ ID NO: 1054024 - RNA, 23 nt, Human
cucaucacaccaucuugacuguu

SEQ ID NO: 1054025 - RNA, 24 nt, Human
cuccagccucgccaacccuagauu

SEQ ID NO: 1054026 - RNA, 22 nt, Human
cuccagucuauguuuuuauacc

SEQ ID NO: 1054027 - RNA, 24 nt, Human
cuccucccuggcucuggccagcaa

SEQ ID NO: 1054028 - RNA, 22 nt, Human
cucucaauuuccaaagcacucc

SEQ ID NO: 1054029 - RNA, 24 nt, Human
cugcccacccucccuuccucaaaa

SEQ ID NO: 1054030 - RNA, 19 nt, Human
cugggagaugcuauccugu

SEQ ID NO: 1054031 - RNA, 21 nt, Human
cuuccuuacccuuccugcuca

SEQ ID NO: 1054032 - RNA, 22 nt, Human
cuucucacacguucuacucccc

SEQ ID NO: 1054033 - RNA, 23 nt, Human
gaaaacaucuacuucauaccuuc

SEQ ID NO: 1054034 - RNA, 22 nt, Human
gacccaucuuucucucaacucc

SEQ ID NO: 1054035 - RNA, 26 nt, Human
gacugugucucuuccuacaaaggucc

SEQ ID NO: 1054036 - RNA, 20 nt, Human
gagaacacacuccacccaca

SEQ ID NO: 1054037 - RNA, 18 nt, Human
gcaaaaccccaacacugc

SEQ ID NO: 1054038 - RNA, 19 nt, Human
gcccacccucccuuccuca

SEQ ID NO: 1054039 - RNA, 18 nt, Human
gcccugcccuucugcugu

SEQ ID NO: 1054040 - RNA, 18 nt, Human
gccugccuuccauaccgc

SEQ ID NO: 1054041 - RNA, 21 nt, Human
gcucacccugcccuccagccu

SEQ ID NO: 1054042 - RNA, 20 nt, Human
gcucagccuugcccugcccu

SEQ ID NO: 1054043 - RNA, 20 nt, Human
ggaaaacaucuacuucauac

SEQ ID NO: 1054044 - RNA, 21 nt, Human
ggaggaggcaggcucugagaa

SEQ ID NO: 1054045 - RNA, 20 nt, Human
ggaggcaggcucugagaacc

SEQ ID NO: 1054046 - RNA, 24 nt, Human
ggaggcaggcucugagaaccugcc

SEQ ID NO: 1054047 - RNA, 19 nt, Human
gggguccuccucuuugugc

SEQ ID NO: 1054048 - RNA, 18 nt, Human
guccucugcucaaaacau

SEQ ID NO: 1054049 - RNA, 23 nt, Human
guuucuugcuucagcacccaugu

SEQ ID NO: 1054050 - RNA, 21 nt, Human
uaagaaaacauucccacgucc

SEQ ID NO: 1054051 - RNA, 18 nt, Human
uaagaccaagggcugcca

SEQ ID NO: 1054052 - RNA, 28 nt, Human
uacagccugccuuccauaccgcccuucu

SEQ ID NO: 1054053 - RNA, 19 nt, Human
uacgcauauaaacagggag

SEQ ID NO: 1054054 - RNA, 22 nt, Human
uacuucccuggcaaaaccccaa

SEQ ID NO: 1054055 - RNA, 25 nt, Human
uagacccuggagggcaaccauggag

SEQ ID NO: 1054056 - RNA, 21 nt, Human
uagaugaagugaaggcagggu

SEQ ID NO: 1054057 - RNA, 20 nt, Human
uaggucacaccauucuccuc

SEQ ID NO: 1054058 - RNA, 23 nt, Human
uauuuugccuuuaccugagauug

SEQ ID NO: 1054059 - RNA, 26 nt, Human
uauuuugccuuuaccugagauugcuc

SEQ ID NO: 1054060 - RNA, 23 nt, Human
ucaccacucaagacaagagcaag

SEQ ID NO: 1054061 - RNA, 26 nt, Human
ucaccuccuguuuucaauuccaauuu

SEQ ID NO: 1054062 - RNA, 25 nt, Human
ucaccugggagaugcuauccuguca

SEQ ID NO: 1054063 - RNA, 18 nt, Human
ucacuacaauuucuccug

SEQ ID NO: 1054064 - RNA, 25 nt, Human
ucagaaagcacagggggugcucugu

SEQ ID NO: 1054065 - RNA, 22 nt, Human
ucagagcucagccuugcccugc

SEQ ID NO: 1054066 - RNA, 18 nt, Human
ucagcacccauguggagg

SEQ ID NO: 1054067 - RNA, 18 nt, Human
ucaguggcucugaucucc

SEQ ID NO: 1054068 - RNA, 22 nt, Human
ucauguaucaucucucagaucc

SEQ ID NO: 1054069 - RNA, 18 nt, Human
ucccucccuagucaccuc

SEQ ID NO: 1054070 - RNA, 24 nt, Human
uccugagcccucuucuuuuucucu

SEQ ID NO: 1054071 - RNA, 19 nt, Human
ucucauggacucugcuccu

SEQ ID NO: 1054072 - RNA, 19 nt, Human
ucuccauggauuaccuccu

SEQ ID NO: 1054073 - RNA, 20 nt, Human
ucucccaccuuuuaagagcc

SEQ ID NO: 1054074 - RNA, 22 nt, Human
ucucggagucucaggcauccca

SEQ ID NO: 1054075 - RNA, 23 nt, Human
ucugagaacacacuccacccaca

SEQ ID NO: 1054076 - RNA, 18 nt, Human
ucuguuucucuauccucc

SEQ ID NO: 1054077 - RNA, 20 nt, Human
ucuucuuuuucucucucccc

SEQ ID NO: 1054078 - RNA, 27 nt, Human
ugacuccuaggucacaccauucuccuu

SEQ ID NO: 1054079 - RNA, 19 nt, Human
ugacugagaaccaagugca

SEQ ID NO: 1054080 - RNA, 22 nt, Human
ugacugagaaccaagugcacaa

SEQ ID NO: 1054081 - RNA, 22 nt, Human
ugagaacacacuccacccacaa

SEQ ID NO: 1054082 - RNA, 23 nt, Human
ugagaacacacuccacccacaac

SEQ ID NO: 1054083 - RNA, 22 nt, Human
ugagcccucuucuuuuucucuc

SEQ ID NO: 1054084 - RNA, 23 nt, Human
ugaggggaagacaggugugugca

SEQ ID NO: 1054085 - RNA, 21 nt, Human
ugauaauuaaccucuaggagu

SEQ ID NO: 1054086 - RNA, 18 nt, Human
ugccacuggccuuguggc

SEQ ID NO: 1054087 - RNA, 25 nt, Human
ugccagggugccugggauaagcugu

SEQ ID NO: 1054088 - RNA, 18 nt, Human
ugccauaaagggucagug

SEQ ID NO: 1054089 - RNA, 21 nt, Human
ugcccagcauccuacucuaaa

SEQ ID NO: 1054090 - RNA, 23 nt, Human
ugccccucccaucucucucauca

SEQ ID NO: 1054091 - RNA, 21 nt, Human
ugccugggauaagcugugacu

SEQ ID NO: 1054092 - RNA, 19 nt, Human
ugccuggggguuaccaggc

SEQ ID NO: 1054093 - RNA, 21 nt, Human
ugccuggggguuaccaggcug

SEQ ID NO: 1054094 - RNA, 23 nt, Human
ugcuccaccucucaauuuccaaa

SEQ ID NO: 1054095 - RNA, 19 nt, Human
ugcuucagaagcuccuugc

SEQ ID NO: 1054096 - RNA, 20 nt, Human
ugcuuuggucaccacucaag

SEQ ID NO: 1054097 - RNA, 19 nt, Human
uggaaccccaggggccacu

SEQ ID NO: 1054098 - RNA, 24 nt, Human
uggccagcaaccccaggucauacc

SEQ ID NO: 1054099 - RNA, 19 nt, Human
uggccuuguggccacuccu

SEQ ID NO: 1054100 - RNA, 18 nt, Human
ugggaaggauucacccuu

SEQ ID NO: 1054101 - RNA, 21 nt, Human
ugggauacucaagcagaguga

SEQ ID NO: 1054102 - RNA, 19 nt, Human
ugguauuaguguugaccug

SEQ ID NO: 1054103 - RNA, 19 nt, Human
uggucaccacucaagacaa

SEQ ID NO: 1054104 - RNA, 20 nt, Human
ugguucccucugcccaaacu

SEQ ID NO: 1054105 - RNA, 22 nt, Human
uguuucucuauccucccuaaca

SEQ ID NO: 1054106 - RNA, 21 nt, Human
uuaccuccuccagucuauguu

SEQ ID NO: 1054107 - RNA, 19 nt, Human
uucccuggcaaaaccccaa

SEQ ID NO: 1054108 - RNA, 21 nt, Human
uucuuggucagauuaaaccuu

SEQ ID NO: 1054109 - RNA, 21 nt, Human
uugggcugcucucccaccuuu

SEQ ID NO: 1054110 - RNA, 22 nt, Human
uuuaggauugggccuccucagg

SEQ ID NO: 1054111 - RNA, 21 nt, Human
uuugccuuuaccugagauugc

SEQ ID NO: 1054112 - RNA, 20 nt, Human
aaaaacaaaaaugcagauga

SEQ ID NO: 1054113 - RNA, 23 nt, Human
aaaagaaaggaguucgugcuuaa

SEQ ID NO: 1054114 - RNA, 23 nt, Human
aacauuggguguuucguuguuga

SEQ ID NO: 1054115 - RNA, 20 nt, Human
aagcuccaucaaaauggcag

SEQ ID NO: 1054116 - RNA, 23 nt, Human
aaucagcagguccauccagagca

SEQ ID NO: 1054117 - RNA, 22 nt, Human
acaaaaaugcagaugaggacac

SEQ ID NO: 1054118 - RNA, 19 nt, Human
acacccuuacguccaggag

SEQ ID NO: 1054119 - RNA, 18 nt, Human
acacuaccauaaccugga

SEQ ID NO: 1054120 - RNA, 26 nt, Human
accuccuuuuucuccuuucacaccag

SEQ ID NO: 1054121 - RNA, 20 nt, Human
accugauaaccuacaaacug

SEQ ID NO: 1054122 - RNA, 23 nt, Human
accuggacugccaucauugcccu

SEQ ID NO: 1054123 - RNA, 18 nt, Human
acugguccaggggcuccu

SEQ ID NO: 1054124 - RNA, 20 nt, Human
acuugcagaacaaacagcag

SEQ ID NO: 1054125 - RNA, 19 nt, Human
agaaaacuuccagcucaaa

SEQ ID NO: 1054126 - RNA, 22 nt, Human
agaaaauuacccucuucucauc

SEQ ID NO: 1054127 - RNA, 23 nt, Human
agaaaauuacccucuucucauca

SEQ ID NO: 1054128 - RNA, 23 nt, Human
agaacaaacagcagcauguccuu

SEQ ID NO: 1054129 - RNA, 20 nt, Human
agagagcuguguccuguacu

SEQ ID NO: 1054130 - RNA, 20 nt, Human
agagugcuggaauugucagg

SEQ ID NO: 1054131 - RNA, 20 nt, Human
agauaucauuuugccucuag

SEQ ID NO: 1054132 - RNA, 24 nt, Human
agccuggugucccgggggggccug

SEQ ID NO: 1054133 - RNA, 24 nt, Human
agggagccuucaaguccaucuggu

SEQ ID NO: 1054134 - RNA, 23 nt, Human
aguaagcuuccuaaugaagagaa

SEQ ID NO: 1054135 - RNA, 20 nt, Human
aguauccaucugcuccaugc

SEQ ID NO: 1054136 - RNA, 18 nt, Human
agugcuggaauugucagg

SEQ ID NO: 1054137 - RNA, 19 nt, Human
agugcuggaauugucagga

SEQ ID NO: 1054138 - RNA, 22 nt, Human
auaugcauacaucauauaaauu

SEQ ID NO: 1054139 - RNA, 24 nt, Human
aucaaaaugggggcuucaagcucc

SEQ ID NO: 1054140 - RNA, 22 nt, Human
auccagagcaacaguuaugagg

SEQ ID NO: 1054141 - RNA, 24 nt, Human
aucccaucucuccuggaagcccag

SEQ ID NO: 1054142 - RNA, 24 nt, Human
auccccucgcaggcccuuugcucc

SEQ ID NO: 1054143 - RNA, 26 nt, Human
aucucccuuuucuccuuuucuuccag

SEQ ID NO: 1054144 - RNA, 23 nt, Human
augaagccaagccuuuggcuccu

SEQ ID NO: 1054145 - RNA, 21 nt, Human
augccaauagagagcuguguc

SEQ ID NO: 1054146 - RNA, 22 nt, Human
auggguuugcagaaaaugaacu

SEQ ID NO: 1054147 - RNA, 24 nt, Human
auguacacauaugcauacaucaua

SEQ ID NO: 1054148 - RNA, 22 nt, Human
auuuugccucuagcucccuuca

SEQ ID NO: 1054149 - RNA, 19 nt, Human
caaaaaugcagaugaggac

SEQ ID NO: 1054150 - RNA, 22 nt, Human
caaaaaugcagaugaggacaca

SEQ ID NO: 1054151 - RNA, 29 nt, Human
caaaaaugcagaugaggacacagccauca

SEQ ID NO: 1054152 - RNA, 19 nt, Human
caaaaugggggcuucaagc

SEQ ID NO: 1054153 - RNA, 19 nt, Human
caagccacgaggaccagga

SEQ ID NO: 1054154 - RNA, 22 nt, Human
caagccuuuggcuccuuucaca

SEQ ID NO: 1054155 - RNA, 22 nt, Human
caccugauaaccuacaaacugu

SEQ ID NO: 1054156 - RNA, 26 nt, Human
cacguucuccuuucaagccugugggu

SEQ ID NO: 1054157 - RNA, 21 nt, Human
cacuugcagaacaaacagcag

SEQ ID NO: 1054158 - RNA, 23 nt, Human
cagaagucguuuuaaaaaaauac

SEQ ID NO: 1054159 - RNA, 23 nt, Human
cagacuagaaguccaucaaaaug

SEQ ID NO: 1054160 - RNA, 21 nt, Human
cagaguuaacuagaaaaaucc

SEQ ID NO: 1054161 - RNA, 20 nt, Human
cagcagcauguccuuucagc

SEQ ID NO: 1054162 - RNA, 25 nt, Human
cagcucaaaagcaauaauuuauguu

SEQ ID NO: 1054163 - RNA, 21 nt, Human
cagcucuuagacugagguaag

SEQ ID NO: 1054164 - RNA, 19 nt, Human
caggaaagacagacuagaa

SEQ ID NO: 1054165 - RNA, 24 nt, Human
caggaucucccauugugccaucuc

SEQ ID NO: 1054166 - RNA, 23 nt, Human
cauguagaaaaugaagccaagcc

SEQ ID NO: 1054167 - RNA, 22 nt, Human
ccagagucuuaccaugcuuccu

SEQ ID NO: 1054168 - RNA, 20 nt, Human
ccaggagucccucucuuccc

SEQ ID NO: 1054169 - RNA, 19 nt, Human
ccauugcuaccaacugugg

SEQ ID NO: 1054170 - RNA, 20 nt, Human
cccacaccuccuuuuucucc

SEQ ID NO: 1054171 - RNA, 22 nt, Human
cccagggagccuucaaguccau

SEQ ID NO: 1054172 - RNA, 21 nt, Human
cccauguacacauaugcauag

SEQ ID NO: 1054173 - RNA, 24 nt, Human
ccccaaucucacccuuagguccac

SEQ ID NO: 1054174 - RNA, 25 nt, Human
cccuuugcuccacggucaccaggag

SEQ ID NO: 1054175 - RNA, 20 nt, Human
cccuuugcucccuugcgucc

SEQ ID NO: 1054176 - RNA, 20 nt, Human
ccucaucucccuuuucuccu

SEQ ID NO: 1054177 - RNA, 20 nt, Human
ccugguuccccaggggaucc

SEQ ID NO: 1054178 - RNA, 19 nt, Human
ccuuaagucccagggagcc

SEQ ID NO: 1054179 - RNA, 19 nt, Human
ccuuaguaccuugcucucc

SEQ ID NO: 1054180 - RNA, 21 nt, Human
ccuucuugucccuuugcuccc

SEQ ID NO: 1054181 - RNA, 20 nt, Human
ccuugaacuucuugcuccuc

SEQ ID NO: 1054182 - RNA, 19 nt, Human
cgaggaccaggaaagccaa

SEQ ID NO: 1054183 - RNA, 20 nt, Human
cguuuuaaaaaaauacugca

SEQ ID NO: 1054184 - RNA, 21 nt, Human
cucacauguagaaaaugaagc

SEQ ID NO: 1054185 - RNA, 22 nt, Human
cucagaguuaacuagaaaaauc

SEQ ID NO: 1054186 - RNA, 23 nt, Human
cucaucaguccaagcaaacaacu

SEQ ID NO: 1054187 - RNA, 19 nt, Human
cucccuugaaaucgagacu

SEQ ID NO: 1054188 - RNA, 23 nt, Human
cuccuggaccaccagggucccca

SEQ ID NO: 1054189 - RNA, 18 nt, Human
cugcugucuuucuucugg

SEQ ID NO: 1054190 - RNA, 22 nt, Human
cuggagguccccuuuucccugg

SEQ ID NO: 1054191 - RNA, 19 nt, Human
cuuacgggauccccucgca

SEQ ID NO: 1054192 - RNA, 24 nt, Human
cuucagcccagucucuccuggacc

SEQ ID NO: 1054193 - RNA, 25 nt, Human
cuuccaggaagaccauuaucacccu

SEQ ID NO: 1054194 - RNA, 19 nt, Human
cuugcagaacaaacagcag

SEQ ID NO: 1054195 - RNA, 20 nt, Human
cuugcucucccacuggucca

SEQ ID NO: 1054196 - RNA, 23 nt, Human
gaaaaacagacaaauacaucuua

SEQ ID NO: 1054197 - RNA, 20 nt, Human
gaacaaacagcagcaugucc

SEQ ID NO: 1054198 - RNA, 22 nt, Human
gaacaaacagcagcauguccuu

SEQ ID NO: 1054199 - RNA, 23 nt, Human
gagaaaacuuccagcucaaaagc

SEQ ID NO: 1054200 - RNA, 23 nt, Human
gagcauuagacauuacuaaauua

SEQ ID NO: 1054201 - RNA, 24 nt, Human
gagccagcucuuagacugagguaa

SEQ ID NO: 1054202 - RNA, 18 nt, Human
gaucagccaagucacuug

SEQ ID NO: 1054203 - RNA, 19 nt, Human
gcagcagauuuaguuacua

SEQ ID NO: 1054204 - RNA, 23 nt, Human
gccuggugucccgggggggccug

SEQ ID NO: 1054205 - RNA, 22 nt, Human
gcugucuuucuucuggagccug

SEQ ID NO: 1054206 - RNA, 22 nt, Human
ggacagagauaaaagaauuaac

SEQ ID NO: 1054207 - RNA, 18 nt, Human
ggaccaggaaagccaaca

SEQ ID NO: 1054208 - RNA, 23 nt, Human
ggagguccugguuccccagggga

SEQ ID NO: 1054209 - RNA, 19 nt, Human
gggauccccucgcaggccc

SEQ ID NO: 1054210 - RNA, 21 nt, Human
gggccuggccagccucuucug

SEQ ID NO: 1054211 - RNA, 23 nt, Human
guaaaaguaacucagagcuucau

SEQ ID NO: 1054212 - RNA, 25 nt, Human
guaccuugcucucccacugguccaa

SEQ ID NO: 1054213 - RNA, 28 nt, Human
guacucaaauccuuucccaaccggaggg

SEQ ID NO: 1054214 - RNA, 19 nt, Human
guccuggaggccccugggg

SEQ ID NO: 1054215 - RNA, 28 nt, Human
uaaaaaaauacgacauauaaacagcauc

SEQ ID NO: 1054216 - RNA, 24 nt, Human
uaacaaaagaaaggaguucgugcu

SEQ ID NO: 1054217 - RNA, 24 nt, Human
uaacuagaaaaaucccuuuuauua

SEQ ID NO: 1054218 - RNA, 24 nt, Human
uaacuagaaaaaucccuuuuauua

SEQ ID NO: 1054219 - RNA, 24 nt, Human
uaacuccuugaacuucuugcuccu

SEQ ID NO: 1054220 - RNA, 20 nt, Human
uaagagcucugcuaauccug

SEQ ID NO: 1054221 - RNA, 24 nt, Human
uaauccgucaauuccauuuucccc

SEQ ID NO: 1054222 - RNA, 18 nt, Human
uaccauaaccuggacugc

SEQ ID NO: 1054223 - RNA, 20 nt, Human
uacuaaauuaggaaaggagg

SEQ ID NO: 1054224 - RNA, 18 nt, Human
uacucaaauccuuuccca

SEQ ID NO: 1054225 - RNA, 24 nt, Human
uagacauuacuaaauuaggaaagg

SEQ ID NO: 1054226 - RNA, 21 nt, Human
uagagauggagaaaauuaccc

SEQ ID NO: 1054227 - RNA, 24 nt, Human
ucaagucaccugauaaccuacaaa

SEQ ID NO: 1054228 - RNA, 19 nt, Human
ucagagcuucaucuaugac

SEQ ID NO: 1054229 - RNA, 18 nt, Human
uccaagcaaacaacuccc

SEQ ID NO: 1054230 - RNA, 20 nt, Human
uccagagcaacaguuaugag

SEQ ID NO: 1054231 - RNA, 18 nt, Human
uccaggagcucccuugaa

SEQ ID NO: 1054232 - RNA, 18 nt, Human
uccaggggcuccucuuuc

SEQ ID NO: 1054233 - RNA, 25 nt, Human
uccagguucuccuuuauuuccuugg

SEQ ID NO: 1054234 - RNA, 19 nt, Human
uccaucugguccugggaug

SEQ ID NO: 1054235 - RNA, 20 nt, Human
ucccagaucuccagguucuc

SEQ ID NO: 1054236 - RNA, 18 nt, Human
ucccagguagccuucacc

SEQ ID NO: 1054237 - RNA, 19 nt, Human
ucccauugugccaucuccu

SEQ ID NO: 1054238 - RNA, 25 nt, Human
uccccaacuucucccuccuguccau

SEQ ID NO: 1054239 - RNA, 23 nt, Human
ucccugccucuccuccggguccc

SEQ ID NO: 1054240 - RNA, 23 nt, Human
ucccugugggccuguaugucccc

SEQ ID NO: 1054241 - RNA, 21 nt, Human
ucccuuaggaccuuuggugcc

SEQ ID NO: 1054242 - RNA, 20 nt, Human
ucccuucagcccagucucuc

SEQ ID NO: 1054243 - RNA, 21 nt, Human
ucccuuugcucccuugcgucc

SEQ ID NO: 1054244 - RNA, 24 nt, Human
uccucugaagacaugaggugcuau

SEQ ID NO: 1054245 - RNA, 18 nt, Human
uccucuguuucccuuagg

SEQ ID NO: 1054246 - RNA, 20 nt, Human
uccuggaccaccaggguccc

SEQ ID NO: 1054247 - RNA, 21 nt, Human
uccuggaccaccagggucccc

SEQ ID NO: 1054248 - RNA, 19 nt, Human
uccuggaggccccugggga

SEQ ID NO: 1054249 - RNA, 26 nt, Human
uccuucuaugcuacugucaacuccag

SEQ ID NO: 1054250 - RNA, 22 nt, Human
uccuucuugucccuuugcuccc

SEQ ID NO: 1054251 - RNA, 21 nt, Human
ucuaaagaauauauggauuag

SEQ ID NO: 1054252 - RNA, 25 nt, Human
ucuaugcuacugucaacuccaggag

SEQ ID NO: 1054253 - RNA, 20 nt, Human
ucucccacugguccaggggc

SEQ ID NO: 1054254 - RNA, 23 nt, Human
ucuccuggaccaccagggucccc

SEQ ID NO: 1054255 - RNA, 19 nt, Human
ucuugggcccugagggccc

SEQ ID NO: 1054256 - RNA, 21 nt, Human
ugaaaauuaauaaaugaccau

SEQ ID NO: 1054257 - RNA, 18 nt, Human
ugaagagaaaacuuccag

SEQ ID NO: 1054258 - RNA, 19 nt, Human
ugagaucccucaucucccu

SEQ ID NO: 1054259 - RNA, 18 nt, Human
ugauaaccuacaaacugu

SEQ ID NO: 1054260 - RNA, 18 nt, Human
ugaucucuuuugcaucuc

SEQ ID NO: 1054261 - RNA, 18 nt, Human
ugcagaacaaacagcagc

SEQ ID NO: 1054262 - RNA, 20 nt, Human
ugcuaccaacuguggagcca

SEQ ID NO: 1054263 - RNA, 19 nt, Human
uggacugccaucauugccc

SEQ ID NO: 1054264 - RNA, 18 nt, Human
uggaggccccuggggacc

SEQ ID NO: 1054265 - RNA, 22 nt, Human
ugggcuucccugagaucccuca

SEQ ID NO: 1054266 - RNA, 18 nt, Human
uggugucccgggggggcc

SEQ ID NO: 1054267 - RNA, 25 nt, Human
uguacacauaugcauacaucauaau

SEQ ID NO: 1054268 - RNA, 25 nt, Human
uguacacauaugcauacaucauaua

SEQ ID NO: 1054269 - RNA, 21 nt, Human
uguacucaaauccuuucccaa

SEQ ID NO: 1054270 - RNA, 18 nt, Human
uguauuuaaggcuguuuu

SEQ ID NO: 1054271 - RNA, 19 nt, Human
ugucuuucuucuggagccu

SEQ ID NO: 1054272 - RNA, 20 nt, Human
uuaaugguauuuccaacaau

SEQ ID NO: 1054273 - RNA, 22 nt, Human
uuccauuuuccccaacuucucc

SEQ ID NO: 1054274 - RNA, 26 nt, Human
uuccccaacuucucccuccuguccau

SEQ ID NO: 1054275 - RNA, 22 nt, Human
uucuccuuuauuuccuuggcuu

SEQ ID NO: 1054276 - RNA, 23 nt, Human
uugaaacauuuuuucugaacccc

SEQ ID NO: 1054277 - RNA, 19 nt, Human
uuuucuaaguucaucagau

SEQ ID NO: 1054278 - RNA, 19 nt, Human
uuuucugaaccccuaagca

SEQ ID NO: 1054279 - RNA, 22 nt, Human
auccauucguucucagagaagu

SEQ ID NO: 1054280 - RNA, 21 nt, Human
cagggcucucugagcagggcc

SEQ ID NO: 1054281 - RNA, 24 nt, Human
gagcagggcccaggccgauccauu

SEQ ID NO: 1054282 - RNA, 20 nt, Human
ucucugagcagggcccaggc

SEQ ID NO: 1054283 - RNA, 19 nt, Human
agagcggggcacuggccag

SEQ ID NO: 1054284 - RNA, 19 nt, Human
cacuggccaggucccucug

SEQ ID NO: 1054285 - RNA, 25 nt, Human
cccucugauaaugaauugcugcucu

SEQ ID NO: 1054286 - RNA, 23 nt, Human
ccucugauaaugaauugcugcuc

SEQ ID NO: 1054287 - RNA, 18 nt, Human
aaacaucuccaugaccaa

SEQ ID NO: 1054288 - RNA, 20 nt, Human
acagcagugacacaucaaaa

SEQ ID NO: 1054289 - RNA, 18 nt, Human
cgaauuguccuuccucag

SEQ ID NO: 1054290 - RNA, 24 nt, Human
uacagcagugacacaucaaaaaga

SEQ ID NO: 1054291 - RNA, 24 nt, Human
uccucagacuauaugaauagaucu

SEQ ID NO: 1054292 - RNA, 24 nt, Human
ucgaauuguccuuccucagacuau

SEQ ID NO: 1054293 - RNA, 20 nt, Human
ugaccaaaauuuuuuccaac

SEQ ID NO: 1054294 - RNA, 18 nt, Human
uggaauuacagaugucgu

SEQ ID NO: 1054295 - RNA, 22 nt, Human
uuaaauugauaauccacaccua

SEQ ID NO: 1054296 - RNA, 21 nt, Human
uuuaaaggacagucaacuuag

SEQ ID NO: 1054297 - RNA, 27 nt, Human
aaacaacccuaaaccaauucugaggac

SEQ ID NO: 1054298 - RNA, 23 nt, Human
aaacagcacagggggcccacagc

SEQ ID NO: 1054299 - RNA, 19 nt, Human
aaagugcugggguuauagg

SEQ ID NO: 1054300 - RNA, 24 nt, Human
aaagugcugggguuauaggcauga

SEQ ID NO: 1054301 - RNA, 19 nt, Human
aagugcugggauuacaggc

SEQ ID NO: 1054302 - RNA, 21 nt, Human
aagugcugggauuacaggcau

SEQ ID NO: 1054303 - RNA, 22 nt, Human
aagugcugggauuacaggcaug

SEQ ID NO: 1054304 - RNA, 23 nt, Human
aagugcugggauuacaggcauga

SEQ ID NO: 1054305 - RNA, 26 nt, Human
aagugcugggauuacaggcaugagcc

SEQ ID NO: 1054306 - RNA, 18 nt, Human
acaccacugcacuccagc

SEQ ID NO: 1054307 - RNA, 20 nt, Human
acaccacugcacuccagccu

SEQ ID NO: 1054308 - RNA, 21 nt, Human
acacuggucuugaacuccugg

SEQ ID NO: 1054309 - RNA, 19 nt, Human
acagaguuucaccauguug

SEQ ID NO: 1054310 - RNA, 21 nt, Human
acaggcacucgccacuaugcc

SEQ ID NO: 1054311 - RNA, 18 nt, Human
accauguuggccaggcug

SEQ ID NO: 1054312 - RNA, 22 nt, Human
accgcacccagacgaaagagug

SEQ ID NO: 1054313 - RNA, 27 nt, Human
acucugucgcccaggcuggagugcaau

SEQ ID NO: 1054314 - RNA, 23 nt, Human
agcuacucaggaggcugaggcag

SEQ ID NO: 1054315 - RNA, 24 nt, Human
aggcaggaagacugcuugagccca

SEQ ID NO: 1054316 - RNA, 24 nt, Human
aggcaugguggcuuacaccuguag

SEQ ID NO: 1054317 - RNA, 24 nt, Human
aggcugaggcaggaagacugcuug

SEQ ID NO: 1054318 - RNA, 23 nt, Human
agggaucugcuggccuuggccuc

SEQ ID NO: 1054319 - RNA, 21 nt, Human
aguagcugggauuacaggcac

SEQ ID NO: 1054320 - RNA, 24 nt, Human
agugcaauggcaugaucuuggcuc

SEQ ID NO: 1054321 - RNA, 18 nt, Human
agugcugggauuacaggc

SEQ ID NO: 1054322 - RNA, 24 nt, Human
aucacacaccacugcacuccagcc

SEQ ID NO: 1054323 - RNA, 18 nt, Human
auggggucucaccauguu

SEQ ID NO: 1054324 - RNA, 20 nt, Human
auggggucucaccauguugg

SEQ ID NO: 1054325 - RNA, 23 nt, Human
caaagugcugggguuauaggcau

SEQ ID NO: 1054326 - RNA, 24 nt, Human
caaagugcugggguuauaggcaug

SEQ ID NO: 1054327 - RNA, 21 nt, Human
caaauaauaugaauccacgcu

SEQ ID NO: 1054328 - RNA, 23 nt, Human
caacccuaaaccaauucugagga

SEQ ID NO: 1054329 - RNA, 18 nt, Human
caaccucggccucccgaa

SEQ ID NO: 1054330 - RNA, 22 nt, Human
caagcgauucucuugccucagc

SEQ ID NO: 1054331 - RNA, 24 nt, Human
cacacaccacugcacuccagccug

SEQ ID NO: 1054332 - RNA, 21 nt, Human
cacaccacugcacuccagccu

SEQ ID NO: 1054333 - RNA, 23 nt, Human
cacagccagccccacugggccuc

SEQ ID NO: 1054334 - RNA, 24 nt, Human
caccacauuuggcuaauuuuugua

SEQ ID NO: 1054335 - RNA, 24 nt, Human
caccauguugcccacacuggucuu

SEQ ID NO: 1054336 - RNA, 27 nt, Human
caccauguugcccacacuggucuugaa

SEQ ID NO: 1054337 - RNA, 21 nt, Human
caccauguuggccaggcuggu

SEQ ID NO: 1054338 - RNA, 24 nt, Human
caccauguuggccaggcuggucuc

SEQ ID NO: 1054339 - RNA, 27 nt, Human
caccauguuggccaggcuggucucaaa

SEQ ID NO: 1054340 - RNA, 21 nt, Human
cacccagacgaaagagugauu

SEQ ID NO: 1054341 - RNA, 24 nt, Human
caccuguaguccuagcuacucagg

SEQ ID NO: 1054342 - RNA, 18 nt, Human
cacgccucaaacagcaca

SEQ ID NO: 1054343 - RNA, 22 nt, Human
cacucugucgcccaggcuggag

SEQ ID NO: 1054344 - RNA, 18 nt, Human
cacugcacuccagccugc

SEQ ID NO: 1054345 - RNA, 19 nt, Human
cacugcacuccagccugcg

SEQ ID NO: 1054346 - RNA, 26 nt, Human
cacugcacuccagccugcguaccaca

SEQ ID NO: 1054347 - RNA, 23 nt, Human
cacugcagucuccgccucuuggg

SEQ ID NO: 1054348 - RNA, 21 nt, Human
cacuggucuugaacuccuggg

SEQ ID NO: 1054349 - RNA, 18 nt, Human
cagaguuucaccauguug

SEQ ID NO: 1054350 - RNA, 20 nt, Human
cagccuccugaguagcuggg

SEQ ID NO: 1054351 - RNA, 24 nt, Human
cagggucucacucugucgcccagg

SEQ ID NO: 1054352 - RNA, 24 nt, Human
caugccaccacauuuggcuaauuu

SEQ ID NO: 1054353 - RNA, 25 nt, Human
caugcucauuaaaaaaaauuaaggg

SEQ ID NO: 1054354 - RNA, 20 nt, Human
cauguugcccacacuggucu

SEQ ID NO: 1054355 - RNA, 24 nt, Human
cauguugcccacacuggucuugaa

SEQ ID NO: 1054356 - RNA, 24 nt, Human
cauguuggccaggcuggucucaaa

SEQ ID NO: 1054357 - RNA, 18 nt, Human
ccacugcacuccagccug

SEQ ID NO: 1054358 - RNA, 18 nt, Human
ccacugcacuccagccug

SEQ ID NO: 1054359 - RNA, 19 nt, Human
ccacugcacuccagccugc

SEQ ID NO: 1054360 - RNA, 24 nt, Human
ccacugcacuccagccugcguacc

SEQ ID NO: 1054361 - RNA, 18 nt, Human
cccacagccagccccacu

SEQ ID NO: 1054362 - RNA, 19 nt, Human
cccaggggaggucgaggcu

SEQ ID NO: 1054363 - RNA, 24 nt, Human
cccgaagugcugggauuacaggca

SEQ ID NO: 1054364 - RNA, 21 nt, Human
cccuaaaccaauucugaggac

SEQ ID NO: 1054365 - RNA, 24 nt, Human
ccgaagugcugggauuacaggcau

SEQ ID NO: 1054366 - RNA, 18 nt, Human
ccgcgaaacaacccuaaa

SEQ ID NO: 1054367 - RNA, 22 nt, Human
ccucagaugaucccccaaccuu

SEQ ID NO: 1054368 - RNA, 24 nt, Human
ccucuuggguucaagcgauucucu

SEQ ID NO: 1054369 - RNA, 22 nt, Human
ccugaccucagaugauccccca

SEQ ID NO: 1054370 - RNA, 32 nt, Human
ccugaccucagaugaucccccaaccucggccg

SEQ ID NO: 1054371 - RNA, 23 nt, Human
ccugaguagcugggauuacaggc

SEQ ID NO: 1054372 - RNA, 24 nt, Human
ccugaguagcugggauuacaggca

SEQ ID NO: 1054373 - RNA, 18 nt, Human
ccugggcucaagggaucu

SEQ ID NO: 1054374 - RNA, 21 nt, Human
cgggaagaaccgcgaaacaac

SEQ ID NO: 1054375 - RNA, 22 nt, Human
cgggaagaaccgcgaaacaacc

SEQ ID NO: 1054376 - RNA, 23 nt, Human
cucaaacagcacagggggcccac

SEQ ID NO: 1054377 - RNA, 24 nt, Human
cucacucugucgcccaggcuggag

SEQ ID NO: 1054378 - RNA, 20 nt, Human
cucacugcagucuccgccuc

SEQ ID NO: 1054379 - RNA, 24 nt, Human
cucacugcagucuccgccucuugg

SEQ ID NO: 1054380 - RNA, 23 nt, Human
cucagccuccugaguagcuggga

SEQ ID NO: 1054381 - RNA, 25 nt, Human
cugaagauucuccaucaccaaauaa

SEQ ID NO: 1054382 - RNA, 23 nt, Human
cugaguagcugggauuacaggca

SEQ ID NO: 1054383 - RNA, 20 nt, Human
cugcuugagcccaggggagg

SEQ ID NO: 1054384 - RNA, 24 nt, Human
cuggagugcaauggcaugaucuug

SEQ ID NO: 1054385 - RNA, 24 nt, Human
cuguagagacagaguuucaccaug

SEQ ID NO: 1054386 - RNA, 24 nt, Human
cuugccucagccuccugaguagcu

SEQ ID NO: 1054387 - RNA, 24 nt, Human
cuuggccucucaaagugcuggggu

SEQ ID NO: 1054388 - RNA, 24 nt, Human
gaaacaacccuaaaccaauucuga

SEQ ID NO: 1054389 - RNA, 24 nt, Human
gaagugcugggauuacaggcauga

SEQ ID NO: 1054390 - RNA, 24 nt, Human
gaccucagaugaucccccaaccuc

SEQ ID NO: 1054391 - RNA, 21 nt, Human
gagacagaguuucaccauguu

SEQ ID NO: 1054392 - RNA, 19 nt, Human
gaggucgaggcuacaauga

SEQ ID NO: 1054393 - RNA, 25 nt, Human
gaguagcugggauuacaggcacucg

SEQ ID NO: 1054394 - RNA, 21 nt, Human
gaucugcuggccuuggccucu

SEQ ID NO: 1054395 - RNA, 24 nt, Human
gauuacaggcacucgccacuaugc

SEQ ID NO: 1054396 - RNA, 18 nt, Human
gauuacaggcaugagcca

SEQ ID NO: 1054397 - RNA, 22 nt, Human
gauuacaggcaugagccaccgc

SEQ ID NO: 1054398 - RNA, 23 nt, Human
gauuacaggcaugagccaccgca

SEQ ID NO: 1054399 - RNA, 21 nt, Human
gauucucuugccucagccucc

SEQ ID NO: 1054400 - RNA, 18 nt, Human
gcaugguggcuuacaccu

SEQ ID NO: 1054401 - RNA, 24 nt, Human
gcccagcuaauuuuuuuguauuuu

SEQ ID NO: 1054402 - RNA, 23 nt, Human
gcccaggcuggagugcaauggca

SEQ ID NO: 1054403 - RNA, 24 nt, Human
gcccaggcuggagugcaauggcau

SEQ ID NO: 1054404 - RNA, 20 nt, Human
gccucagccuccugaguagc

SEQ ID NO: 1054405 - RNA, 22 nt, Human
gccuuggccucucaaagugcug

SEQ ID NO: 1054406 - RNA, 24 nt, Human
gcgauucucuugccucagccuccu

SEQ ID NO: 1054407 - RNA, 21 nt, Human
gcucacugcagucuccgccuc

SEQ ID NO: 1054408 - RNA, 19 nt, Human
gcuggagugcaauggcaug

SEQ ID NO: 1054409 - RNA, 23 nt, Human
gcuggucucaaacuccugaccuc

SEQ ID NO: 1054410 - RNA, 22 nt, Human
ggaucugcuggccuuggccucu

SEQ ID NO: 1054411 - RNA, 22 nt, Human
ggauuacaggcaugagccaccg

SEQ ID NO: 1054412 - RNA, 24 nt, Human
ggcuggucucaaacuccugaccuc

SEQ ID NO: 1054413 - RNA, 22 nt, Human
ggggucucaccauguuggccag

SEQ ID NO: 1054414 - RNA, 22 nt, Human
gggucucaccauguuggccagg

SEQ ID NO: 1054415 - RNA, 18 nt, Human
ggguucaagcgauucucu

SEQ ID NO: 1054416 - RNA, 18 nt, Human
ggucucaccauguuggcc

SEQ ID NO: 1054417 - RNA, 24 nt, Human
gguggcuuacaccuguaguccuag

SEQ ID NO: 1054418 - RNA, 22 nt, Human
guagagacagaguuucaccaug

SEQ ID NO: 1054419 - RNA, 23 nt, Human
guagagauggggucucaccaugu

SEQ ID NO: 1054420 - RNA, 18 nt, Human
guagcugggauuacaggc

SEQ ID NO: 1054421 - RNA, 22 nt, Human
uaauuuuuguauuuucuguaga

SEQ ID NO: 1054422 - RNA, 24 nt, Human
uaauuuuuguauuuucuguagaga

SEQ ID NO: 1054423 - RNA, 26 nt, Human
uaauuuuuuuguauuuuuaguagaga

SEQ ID NO: 1054424 - RNA, 19 nt, Human
uacaccuguaguccuagcu

SEQ ID NO: 1054425 - RNA, 20 nt, Human
uacaggcacaugccaccaca

SEQ ID NO: 1054426 - RNA, 24 nt, Human
uacaggcacucgccacuaugccca

SEQ ID NO: 1054427 - RNA, 24 nt, Human
uacaggcaugagccaccgcaccca

SEQ ID NO: 1054428 - RNA, 22 nt, Human
uagagacagaguuucaccaugu

SEQ ID NO: 1054429 - RNA, 22 nt, Human
uagagauggggucucaccaugu

SEQ ID NO: 1054430 - RNA, 24 nt, Human
uaguagagauggggucucaccaug

SEQ ID NO: 1054431 - RNA, 26 nt, Human
uaguagagauggggucucaccauguu

SEQ ID NO: 1054432 - RNA, 19 nt, Human
uauaaaguaaaaagaguga

SEQ ID NO: 1054433 - RNA, 22 nt, Human
uauuuaugaaacagggucucac

SEQ ID NO: 1054434 - RNA, 24 nt, Human
ucaaagugcugggguuauaggcau

SEQ ID NO: 1054435 - RNA, 19 nt, Human
ucaagcgauucucuugccu

SEQ ID NO: 1054436 - RNA, 24 nt, Human
ucacucugucgcccaggcuggagu

SEQ ID NO: 1054437 - RNA, 23 nt, Human
ucacugcagucuccgccucuugg

SEQ ID NO: 1054438 - RNA, 23 nt, Human
ucacugcagucuccgccucuugg

SEQ ID NO: 1054439 - RNA, 24 nt, Human
ucacugcagucuccgccucuuggg

SEQ ID NO: 1054440 - RNA, 20 nt, Human
ucagccuccugaguagcugg

SEQ ID NO: 1054441 - RNA, 19 nt, Human
ucccccaaccucggccucc

SEQ ID NO: 1054442 - RNA, 19 nt, Human
ucccgaagugcugggauua

SEQ ID NO: 1054443 - RNA, 24 nt, Human
ucccgaagugcugggauuacaggc

SEQ ID NO: 1054444 - RNA, 19 nt, Human
uccgccucuuggguucaag

SEQ ID NO: 1054445 - RNA, 24 nt, Human
uccugaguagcugggauuacaggc

SEQ ID NO: 1054446 - RNA, 18 nt, Human
uccugggcucaagggauc

SEQ ID NO: 1054447 - RNA, 18 nt, Human
ucgcccaggcuggagugc

SEQ ID NO: 1054448 - RNA, 18 nt, Human
ucggccucccgaagugcu

SEQ ID NO: 1054449 - RNA, 24 nt, Human
ucucaaagugcugggguuauaggc

SEQ ID NO: 1054450 - RNA, 24 nt, Human
ucucaccauguuggccaggcuggu

SEQ ID NO: 1054451 - RNA, 22 nt, Human
ucucacucugucgcccaggcug

SEQ ID NO: 1054452 - RNA, 23 nt, Human
ucucacucugucgcccaggcugg

SEQ ID NO: 1054453 - RNA, 24 nt, Human
ucucacucugucgcccaggcugga

SEQ ID NO: 1054454 - RNA, 26 nt, Human
ucucacucugucgcccaggcuggagu

SEQ ID NO: 1054455 - RNA, 27 nt, Human
ucucacucugucgcccaggcuggagug

SEQ ID NO: 1054456 - RNA, 24 nt, Human
ucugucgcccaggcuggagugcaa

SEQ ID NO: 1054457 - RNA, 22 nt, Human
ucuugaacuccugggcucaagg

SEQ ID NO: 1054458 - RNA, 22 nt, Human
ugaaacagggucucacucuguc

SEQ ID NO: 1054459 - RNA, 20 nt, Human
ugaccucagaugauccccca

SEQ ID NO: 1054460 - RNA, 18 nt, Human
ugacgguaacacuuaaca

SEQ ID NO: 1054461 - RNA, 24 nt, Human
ugaggcaggaagacugcuugagcc

SEQ ID NO: 1054462 - RNA, 25 nt, Human
ugaggcaggaagacugcuugagccc

SEQ ID NO: 1054463 - RNA, 24 nt, Human
ugcccacacuggucuugaacuccu

SEQ ID NO: 1054464 - RNA, 24 nt, Human
ugccucagccuccugaguagcugg

SEQ ID NO: 1054465 - RNA, 19 nt, Human
uggagugcaauggcaugau

SEQ ID NO: 1054466 - RNA, 24 nt, Human
uggagugcaauggcaugaucuugg

SEQ ID NO: 1054467 - RNA, 19 nt, Human
uggcaugaucuuggcucac

SEQ ID NO: 1054468 - RNA, 21 nt, Human
uggcaugaucuuggcucacug

SEQ ID NO: 1054469 - RNA, 24 nt, Human
uggccaggcuggucucaaacuccu

SEQ ID NO: 1054470 - RNA, 19 nt, Human
uggcuuacaccuguagucc

SEQ ID NO: 1054471 - RNA, 21 nt, Human
uggcuuacaccuguaguccua

SEQ ID NO: 1054472 - RNA, 21 nt, Human
ugggacuacaggcacaugcca

SEQ ID NO: 1054473 - RNA, 22 nt, Human
ugggacuacaggcacaugccac

SEQ ID NO: 1054474 - RNA, 24 nt, Human
ugggacuacaggcacaugccacca

SEQ ID NO: 1054475 - RNA, 21 nt, Human
ugggauuacaggcacucgcca

SEQ ID NO: 1054476 - RNA, 22 nt, Human
ugggauuacaggcacucgccac

SEQ ID NO: 1054477 - RNA, 22 nt, Human
ugggauuacaggcacucgccac

SEQ ID NO: 1054478 - RNA, 22 nt, Human
ugggauuacaggcacucgccac

SEQ ID NO: 1054479 - RNA, 24 nt, Human
ugggauuacaggcacucgccacua

SEQ ID NO: 1054480 - RNA, 18 nt, Human
ugggauuacaggcaugag

SEQ ID NO: 1054481 - RNA, 19 nt, Human
ugggauuacaggcaugagc

SEQ ID NO: 1054482 - RNA, 21 nt, Human
ugggauuacaggcaugagcca

SEQ ID NO: 1054483 - RNA, 22 nt, Human
ugggauuacaggcaugagccac

SEQ ID NO: 1054484 - RNA, 23 nt, Human
ugggauuacaggcaugagccacc

SEQ ID NO: 1054485 - RNA, 24 nt, Human
ugggauuacaggcaugagccaccg

SEQ ID NO: 1054486 - RNA, 24 nt, Human
ugggauuacaggcaugagccaccg

SEQ ID NO: 1054487 - RNA, 26 nt, Human
ugggauuacaggcaugagccaccgca

SEQ ID NO: 1054488 - RNA, 19 nt, Human
ugggcucaagggaucugcu

SEQ ID NO: 1054489 - RNA, 24 nt, Human
uggggucucaccauguuggccagg

SEQ ID NO: 1054490 - RNA, 18 nt, Human
ugggguuauaggcaugag

SEQ ID NO: 1054491 - RNA, 22 nt, Human
ugggguuauaggcaugagccua

SEQ ID NO: 1054492 - RNA, 23 nt, Human
ugggguuauaggcaugagccuau

SEQ ID NO: 1054493 - RNA, 20 nt, Human
uggguucaagcgauucucuu

SEQ ID NO: 1054494 - RNA, 23 nt, Human
uggguucaagcgauucucuugcc

SEQ ID NO: 1054495 - RNA, 24 nt, Human
uggguucaagcgauucucuugccu

SEQ ID NO: 1054496 - RNA, 22 nt, Human
ugguggcuuacaccuguagucc

SEQ ID NO: 1054497 - RNA, 23 nt, Human
uguagagacagaguuucaccaug

SEQ ID NO: 1054498 - RNA, 20 nt, Human
ugucgcccaggcuggagugc

SEQ ID NO: 1054499 - RNA, 18 nt, Human
uuaguagagauggggucu

SEQ ID NO: 1054500 - RNA, 24 nt, Human
uuaguagagauggggucucaccau

SEQ ID NO: 1054501 - RNA, 23 nt, Human
uucaagcgauucucuugccucag

SEQ ID NO: 1054502 - RNA, 22 nt, Human
uucaagggaagguauaaaugcc

SEQ ID NO: 1054503 - RNA, 23 nt, Human
uuguauuuuuaguagagaugggg

SEQ ID NO: 1054504 - RNA, 21 nt, Human
uuucaccauguugcccacacu

SEQ ID NO: 1054505 - RNA, 23 nt, Human
uuuuaaauuuuccucuucaaggg

SEQ ID NO: 1054506 - RNA, 25 nt, Human
uuuuauuuauuuaugaaacaggguc

SEQ ID NO: 1054507 - RNA, 20 nt, Human
uuuuguauuuuuaguagaga

SEQ ID NO: 1054508 - RNA, 24 nt, Human
uuuuuaguagagauggggucucac

SEQ ID NO: 1054509 - RNA, 20 nt, Human
uuuuuguauuuucuguagag

SEQ ID NO: 1054510 - RNA, 23 nt, Human
uuuuuguauuuucuguagagaca

SEQ ID NO: 1054511 - RNA, 21 nt, Human
uuuuuguauuuuuaguagaga

SEQ ID NO: 1054512 - RNA, 21 nt, Human
uuuuuuguauuuuuaguagag

SEQ ID NO: 1054513 - RNA, 19 nt, Human
gacguggcaccugcccuca

SEQ ID NO: 1054514 - RNA, 22 nt, Human
gcucaaucccgggcgccgcgac

SEQ ID NO: 1054515 - RNA, 19 nt, Human
aaaaaggaucaaacacuuu

SEQ ID NO: 1054516 - RNA, 19 nt, Human
aacaggggacacucagcgc

SEQ ID NO: 1054517 - RNA, 18 nt, Human
cacucagcgcagcagggc

SEQ ID NO: 1054518 - RNA, 21 nt, Human
cgaagagcagcggcgagaaga

SEQ ID NO: 1054519 - RNA, 19 nt, Human
gggucgaggcuaacagggg

SEQ ID NO: 1054520 - RNA, 24 nt, Human
uaacauauauaaaagcaagcaaaa

SEQ ID NO: 1054521 - RNA, 23 nt, Human
uacacauaacauauauaaaagca

SEQ ID NO: 1054522 - RNA, 20 nt, Human
uaggcucgggugggcggcgg

SEQ ID NO: 1054523 - RNA, 18 nt, Human
ucgcacaggcagagccuc

SEQ ID NO: 1054524 - RNA, 19 nt, Human
ugaguguggggugggacug

SEQ ID NO: 1054525 - RNA, 20 nt, Human
ugggacugcaagcacacgca

SEQ ID NO: 1054526 - RNA, 20 nt, Human
ugggccacgaagagcagcgg

SEQ ID NO: 1054527 - RNA, 22 nt, Human
uguggggugggacugcaagcac

SEQ ID NO: 1054528 - RNA, 19 nt, Human
uuuuuuuuuuuuuuuuugu

SEQ ID NO: 1054529 - RNA, 20 nt, Human
uuuuuuuuuuuuuuuuuugg

SEQ ID NO: 1054530 - RNA, 18 nt, Human
aacccacgucucuccucu

SEQ ID NO: 1054531 - RNA, 23 nt, Human
aacccacgucucuccucuacccu

SEQ ID NO: 1054532 - RNA, 23 nt, Human
aacuggcacccucgacaggcucu

SEQ ID NO: 1054533 - RNA, 29 nt, Human
aagcaagaggaggagguaggagggacccc

SEQ ID NO: 1054534 - RNA, 18 nt, Human
agaucaggaguuggagac

SEQ ID NO: 1054535 - RNA, 20 nt, Human
aggaggaagcaggacccagc

SEQ ID NO: 1054536 - RNA, 20 nt, Human
aggaggagguaggaguugga

SEQ ID NO: 1054537 - RNA, 29 nt, Human
agguaggaguuggaggauggggggacccc

SEQ ID NO: 1054538 - RNA, 20 nt, Human
auaaaccaaugaucuugccc

SEQ ID NO: 1054539 - RNA, 21 nt, Human
aucuugcccaaacccugaguu

SEQ ID NO: 1054540 - RNA, 22 nt, Human
caaaagucccugaggcaccuac

SEQ ID NO: 1054541 - RNA, 18 nt, Human
caggcucugggcccaacc

SEQ ID NO: 1054542 - RNA, 19 nt, Human
cccacuagcuuagccuacu

SEQ ID NO: 1054543 - RNA, 23 nt, Human
ccucgcaucagcuaacuggcacc

SEQ ID NO: 1054544 - RNA, 19 nt, Human
ccugaggcaccuacgcaga

SEQ ID NO: 1054545 - RNA, 20 nt, Human
gagucagugacaucaccagc

SEQ ID NO: 1054546 - RNA, 22 nt, Human
uaaauggaacccuaucuaaagu

SEQ ID NO: 1054547 - RNA, 21 nt, Human
uaauuuguccaagauccccac

SEQ ID NO: 1054548 - RNA, 20 nt, Human
uaggaguuggaggaugggug

SEQ ID NO: 1054549 - RNA, 21 nt, Human
ucucaacccacgucucuccuc

SEQ ID NO: 1054550 - RNA, 19 nt, Human
ugacaucaccagcgcuaga

SEQ ID NO: 1054551 - RNA, 22 nt, Human
ugggguccuggguuucacuaug

SEQ ID NO: 1054552 - RNA, 19 nt, Human
ugguacaaaaaucuuaaau

SEQ ID NO: 1054553 - RNA, 20 nt, Human
uuaaauggaacccuaucuaa

SEQ ID NO: 1054554 - RNA, 22 nt, Human
caaauccccucacaucuguguu

SEQ ID NO: 1054555 - RNA, 22 nt, Human
ucaaauccccucacaucugugu

SEQ ID NO: 1054556 - RNA, 19 nt, Human
uucaaauccccucacaucu

SEQ ID NO: 1054557 - RNA, 25 nt, Human
aaagaaacagggugaggggcucaag

SEQ ID NO: 1054558 - RNA, 21 nt, Human
aaccaaacagccaaggccaag

SEQ ID NO: 1054559 - RNA, 25 nt, Human
agggugaggggcucaagagagaggc

SEQ ID NO: 1054560 - RNA, 22 nt, Human
augguccuauuuauuuucagac

SEQ ID NO: 1054561 - RNA, 21 nt, Human
caaggagaggaggggcccuaa

SEQ ID NO: 1054562 - RNA, 18 nt, Human
cauucucgcuucacagaa

SEQ ID NO: 1054563 - RNA, 23 nt, Human
cauucucgcuucacagaaagaaa

SEQ ID NO: 1054564 - RNA, 24 nt, Human
ccacugcucucagcacugccuggc

SEQ ID NO: 1054565 - RNA, 24 nt, Human
ccccacugcucucagcacugccug

SEQ ID NO: 1054566 - RNA, 19 nt, Human
cccuaaggcuuagagaggc

SEQ ID NO: 1054567 - RNA, 19 nt, Human
ccucauccucagggguagg

SEQ ID NO: 1054568 - RNA, 22 nt, Human
ccucugaacucccaaaauguga

SEQ ID NO: 1054569 - RNA, 22 nt, Human
gaccaaccuugcucugccaucu

SEQ ID NO: 1054570 - RNA, 23 nt, Human
gagaagcacgggaacgcugaacu

SEQ ID NO: 1054571 - RNA, 22 nt, Human
gaggaccaaccuugcucugcca

SEQ ID NO: 1054572 - RNA, 25 nt, Human
gaggggcuuguccucauccucaggg

SEQ ID NO: 1054573 - RNA, 20 nt, Human
ggccaaggagaggaggggcc

SEQ ID NO: 1054574 - RNA, 19 nt, Human
ggugaggggcucaagagag

SEQ ID NO: 1054575 - RNA, 19 nt, Human
guaggccuccucugaacuc

SEQ ID NO: 1054576 - RNA, 23 nt, Human
guaggccuccucugaacucccaa

SEQ ID NO: 1054577 - RNA, 24 nt, Human
guaggccuccucugaacucccaaa

SEQ ID NO: 1054578 - RNA, 19 nt, Human
uaaccaaacagccaaggcc

SEQ ID NO: 1054579 - RNA, 22 nt, Human
uagggggaagcccccaucugcc

SEQ ID NO: 1054580 - RNA, 22 nt, Human
ucauccucagggguagggggaa

SEQ ID NO: 1054581 - RNA, 18 nt, Human
ucugaacucccaaaaugu

SEQ ID NO: 1054582 - RNA, 21 nt, Human
ugacaguuaaccaaacagcca

SEQ ID NO: 1054583 - RNA, 20 nt, Human
ugccagcccacagcuccggc

SEQ ID NO: 1054584 - RNA, 19 nt, Human
ugcccaagggagaagcacg

SEQ ID NO: 1054585 - RNA, 23 nt, Human
uguaggccuccucugaacuccca

SEQ ID NO: 1054586 - RNA, 23 nt, Human
aaacacauacccccaaccuggua

SEQ ID NO: 1054587 - RNA, 23 nt, Human
aaauauaaaagucaaacagcaua

SEQ ID NO: 1054588 - RNA, 23 nt, Human
aagaaagcauuccgguuccaacu

SEQ ID NO: 1054589 - RNA, 23 nt, Human
acucgguggucggacacggggca

SEQ ID NO: 1054590 - RNA, 24 nt, Human
acugucacaacucauaaaaccagc

SEQ ID NO: 1054591 - RNA, 22 nt, Human
agagacagcaagaggagcagag

SEQ ID NO: 1054592 - RNA, 25 nt, Human
agagacagcaagaggagccgguacc

SEQ ID NO: 1054593 - RNA, 26 nt, Human
agcaagaggagcagagguagaaagga

SEQ ID NO: 1054594 - RNA, 24 nt, Human
agcccacaccccaugaaaggcaaa

SEQ ID NO: 1054595 - RNA, 18 nt, Human
aggaaauaaacacauacc

SEQ ID NO: 1054596 - RNA, 19 nt, Human
aggaagggcagagagaggg

SEQ ID NO: 1054597 - RNA, 21 nt, Human
caaacaaacacagcuccuucc

SEQ ID NO: 1054598 - RNA, 21 nt, Human
cacccacggucugugugccug

SEQ ID NO: 1054599 - RNA, 21 nt, Human
caccccaugaaaggcaaauaa

SEQ ID NO: 1054600 - RNA, 23 nt, Human
cagagacagcaagaggagcagag

SEQ ID NO: 1054601 - RNA, 22 nt, Human
cccacaccccaugaaaggcaaa

SEQ ID NO: 1054602 - RNA, 25 nt, Human
cccacagccacggugaggagaccca

SEQ ID NO: 1054603 - RNA, 18 nt, Human
cccccaaccugguaacac

SEQ ID NO: 1054604 - RNA, 23 nt, Human
cccucgggcgcuggcuccucuuc

SEQ ID NO: 1054605 - RNA, 21 nt, Human
ccuccagccgccaguggcccc

SEQ ID NO: 1054606 - RNA, 22 nt, Human
ccucccgucacccccagcaugg

SEQ ID NO: 1054607 - RNA, 28 nt, Human
ccuccugccagcccacaccccaugaaag

SEQ ID NO: 1054608 - RNA, 22 nt, Human
cgagucacuuuuagcccgaggg

SEQ ID NO: 1054609 - RNA, 19 nt, Human
cgcacugcccacagccacg

SEQ ID NO: 1054610 - RNA, 19 nt, Human
cggccucgcugccugccgg

SEQ ID NO: 1054611 - RNA, 28 nt, Human
cgggcgcuggcuccucuucccucuuuuu

SEQ ID NO: 1054612 - RNA, 19 nt, Human
cucaucuuaucauagggca

SEQ ID NO: 1054613 - RNA, 21 nt, Human
cugugcuuccuuccaccuugc

SEQ ID NO: 1054614 - RNA, 22 nt, Human
cuuaaaaaucucuguuuugccc

SEQ ID NO: 1054615 - RNA, 19 nt, Human
cuugcauauuuggucagug

SEQ ID NO: 1054616 - RNA, 19 nt, Human
cuuuggggacuaaaaagag

SEQ ID NO: 1054617 - RNA, 19 nt, Human
gaaauaaacacauaccccc

SEQ ID NO: 1054618 - RNA, 19 nt, Human
gaccuccagccgccagugg

SEQ ID NO: 1054619 - RNA, 19 nt, Human
gcccagggcccgcccggcc

SEQ ID NO: 1054620 - RNA, 18 nt, Human
gcuccucuucccucuuuu

SEQ ID NO: 1054621 - RNA, 19 nt, Human
ggaaauaaacacauacccc

SEQ ID NO: 1054622 - RNA, 22 nt, Human
ggaaauaaacacauacccccaa

SEQ ID NO: 1054623 - RNA, 24 nt, Human
ggacuaaaaagaguuuuuaaauac

SEQ ID NO: 1054624 - RNA, 18 nt, Human
ggcaaauaaacccauuuc

SEQ ID NO: 1054625 - RNA, 18 nt, Human
ggcagagacagcaagagg

SEQ ID NO: 1054626 - RNA, 23 nt, Human
gggaggggcgcgagggcccaggg

SEQ ID NO: 1054627 - RNA, 24 nt, Human
uagggcaucaucuaauaauauucc

SEQ ID NO: 1054628 - RNA, 21 nt, Human
uaguuacaaaagccauuuuga

SEQ ID NO: 1054629 - RNA, 21 nt, Human
ucaggucccucacaacacugu

SEQ ID NO: 1054630 - RNA, 24 nt, Human
ucaguguuuguagugcaacugaau

SEQ ID NO: 1054631 - RNA, 21 nt, Human
ucaucuaauaauauuccaaau

SEQ ID NO: 1054632 - RNA, 20 nt, Human
ucgcacugcccacagccacg

SEQ ID NO: 1054633 - RNA, 19 nt, Human
ucuuuggggacuaaaaaga

SEQ ID NO: 1054634 - RNA, 22 nt, Human
ucuuuggggacuaaaaagaguu

SEQ ID NO: 1054635 - RNA, 24 nt, Human
ugaguaagaaagcauuccgguucc

SEQ ID NO: 1054636 - RNA, 25 nt, Human
ugccagcccacaccccaugaaaggc

SEQ ID NO: 1054637 - RNA, 21 nt, Human
ugccugugcuuccuuccaccu

SEQ ID NO: 1054638 - RNA, 20 nt, Human
ugggacgacaacaaacaaac

SEQ ID NO: 1054639 - RNA, 22 nt, Human
uucagaaaucaauaguuacaaa

SEQ ID NO: 1054640 - RNA, 21 nt, Human
uucgcacugcccacagccacg

SEQ ID NO: 1054641 - RNA, 21 nt, Human
uucuuuggggacuaaaaagag

SEQ ID NO: 1054642 - RNA, 19 nt, Human
aagcaggacagcuugaagg

SEQ ID NO: 1054643 - RNA, 20 nt, Human
aagguggggggugggaagga

SEQ ID NO: 1054644 - RNA, 21 nt, Human
agaaaagcaggacagcuugaa

SEQ ID NO: 1054645 - RNA, 22 nt, Human
cacagcaucaggagguccugag

SEQ ID NO: 1054646 - RNA, 23 nt, Human
caggcagacaucaaugaauacac

SEQ ID NO: 1054647 - RNA, 21 nt, Human
cuugaagguggggggugggaa

SEQ ID NO: 1054648 - RNA, 18 nt, Human
gugguugaauuacagcug

SEQ ID NO: 1054649 - RNA, 18 nt, Human
uacagaaaagcaggacag

SEQ ID NO: 1054650 - RNA, 19 nt, Human
ucugaagaccuuuuccugu

SEQ ID NO: 1054651 - RNA, 20 nt, Human
ugaagguggggggugggaag

SEQ ID NO: 1054652 - RNA, 23 nt, Human
ugccaagguuaaagacaugccac

SEQ ID NO: 1054653 - RNA, 22 nt, Human
uucaccuguaguagccguuuug

SEQ ID NO: 1054654 - RNA, 18 nt, Human
uugaauuacagcugauuu

SEQ ID NO: 1054655 - RNA, 23 nt, Human
aaugucuaucucuucugcuagac

SEQ ID NO: 1054656 - RNA, 20 nt, Human
caaugucuaucucuucugcu

SEQ ID NO: 1054657 - RNA, 24 nt, Human
cagcaaucagaaccauccuaggcc

SEQ ID NO: 1054658 - RNA, 23 nt, Human
ccgaucaggugauaaucucuuuu

SEQ ID NO: 1054659 - RNA, 18 nt, Human
ccuaggcaauuucagaug

SEQ ID NO: 1054660 - RNA, 22 nt, Human
cugaauaccagcaaucagaacc

SEQ ID NO: 1054661 - RNA, 20 nt, Human
gaaggaaggaauugccuggc

SEQ ID NO: 1054662 - RNA, 22 nt, Human
ggcugcagaaggauugggaucu

SEQ ID NO: 1054663 - RNA, 19 nt, Human
uaccagcaaucagaaccau

SEQ ID NO: 1054664 - RNA, 23 nt, Human
uaccagcaaucagaaccauccua

SEQ ID NO: 1054665 - RNA, 23 nt, Human
uaugcaauuauuuaaaaauuguu

SEQ ID NO: 1054666 - RNA, 20 nt, Human
ucuauccuauuguaaagcac

SEQ ID NO: 1054667 - RNA, 21 nt, Human
ugaaggaaggaauugccuggc

SEQ ID NO: 1054668 - RNA, 19 nt, Human
uggauguuggggcugcaga

SEQ ID NO: 1054669 - RNA, 23 nt, Human
uuacuguauccucagcaguucca

SEQ ID NO: 1054670 - RNA, 20 nt, Human
uucuugaaguguauggguaa

SEQ ID NO: 1054671 - RNA, 23 nt, Human
uucuugaaguguauggguaaaua

SEQ ID NO: 1054672 - RNA, 25 nt, Human
uugccuggccaauucauuacuguau

SEQ ID NO: 1054673 - RNA, 22 nt, Human
uuuucugaccuuugaacuccga

SEQ ID NO: 1054674 - RNA, 19 nt, Human
aaacagaacggucagccuu

SEQ ID NO: 1054675 - RNA, 20 nt, Human
aacacacacccccaggcccc

SEQ ID NO: 1054676 - RNA, 21 nt, Human
aauggauuugugugcugauuu

SEQ ID NO: 1054677 - RNA, 21 nt, Human
acacacacccccaggccccag

SEQ ID NO: 1054678 - RNA, 18 nt, Human
acacccccaggccccaga

SEQ ID NO: 1054679 - RNA, 24 nt, Human
acacccccaggccccagauccaaa

SEQ ID NO: 1054680 - RNA, 25 nt, Human
accaguauuugucacuuuauuuuuu

SEQ ID NO: 1054681 - RNA, 21 nt, Human
acccucacugggagcccuggc

SEQ ID NO: 1054682 - RNA, 18 nt, Human
aggagccaggaggcuggu

SEQ ID NO: 1054683 - RNA, 23 nt, Human
aggcuggacccucacugggagcc

SEQ ID NO: 1054684 - RNA, 21 nt, Human
aguguugacaggccacaggag

SEQ ID NO: 1054685 - RNA, 24 nt, Human
aguuaacaacagguucuuguacaa

SEQ ID NO: 1054686 - RNA, 25 nt, Human
caacacacacccccaggccccagau

SEQ ID NO: 1054687 - RNA, 20 nt, Human
cacccccaggccccagaucc

SEQ ID NO: 1054688 - RNA, 21 nt, Human
cacccccaggccccagaucca

SEQ ID NO: 1054689 - RNA, 22 nt, Human
cacccccaggccccagauccaa

SEQ ID NO: 1054690 - RNA, 19 nt, Human
cagcccuguggccccuucc

SEQ ID NO: 1054691 - RNA, 21 nt, Human
cagcccuguggccccuuccug

SEQ ID NO: 1054692 - RNA, 21 nt, Human
cagccuucuguggucuuaacc

SEQ ID NO: 1054693 - RNA, 23 nt, Human
caggaggagccaggaggcuggug

SEQ ID NO: 1054694 - RNA, 23 nt, Human
caggccacaggaggagccaggag

SEQ ID NO: 1054695 - RNA, 23 nt, Human
ccaacuggucuuccacgauguca

SEQ ID NO: 1054696 - RNA, 18 nt, Human
ccaggcuaaauaugugcc

SEQ ID NO: 1054697 - RNA, 21 nt, Human
ccagguggugccucucccccu

SEQ ID NO: 1054698 - RNA, 24 nt, Human
cccaccaacacacacccccaggcc

SEQ ID NO: 1054699 - RNA, 25 nt, Human
cccaccaacacacacccccaggccc

SEQ ID NO: 1054700 - RNA, 19 nt, Human
cccccaccaacacacaccc

SEQ ID NO: 1054701 - RNA, 19 nt, Human
cccccaggccccagaucca

SEQ ID NO: 1054702 - RNA, 18 nt, Human
cccccuacucagagccca

SEQ ID NO: 1054703 - RNA, 19 nt, Human
cccccuacucagagcccag

SEQ ID NO: 1054704 - RNA, 27 nt, Human
cccugcacucagcccuguggccccuuc

SEQ ID NO: 1054705 - RNA, 18 nt, Human
cccuuccuuuccuuucuc

SEQ ID NO: 1054706 - RNA, 19 nt, Human
ccucacugggagcccuggc

SEQ ID NO: 1054707 - RNA, 23 nt, Human
ccuccccaucuacuaucccaggc

SEQ ID NO: 1054708 - RNA, 24 nt, Human
ccuuucccuuccuuuccuuucuca

SEQ ID NO: 1054709 - RNA, 23 nt, Human
cggacacuugggacccugacccc

SEQ ID NO: 1054710 - RNA, 22 nt, Human
cucccuccccaucuacuauccc

SEQ ID NO: 1054711 - RNA, 20 nt, Human
cuguggucuuaaccccuggg

SEQ ID NO: 1054712 - RNA, 18 nt, Human
cuugggacccugaccccu

SEQ ID NO: 1054713 - RNA, 21 nt, Human
gaccccuuugucccugcacuc

SEQ ID NO: 1054714 - RNA, 22 nt, Human
gaggcuuuggcaccagaggcuu

SEQ ID NO: 1054715 - RNA, 18 nt, Human
gccaucugggguggccag

SEQ ID NO: 1054716 - RNA, 20 nt, Human
gccuucuguggucuuaaccc

SEQ ID NO: 1054717 - RNA, 19 nt, Human
ggaaauaguguagaugugg

SEQ ID NO: 1054718 - RNA, 20 nt, Human
ggaaggagagaccugcccau

SEQ ID NO: 1054719 - RNA, 24 nt, Human
ggacccugaccccuuugucccugc

SEQ ID NO: 1054720 - RNA, 19 nt, Human
ggcaccagaggcuuggcua

SEQ ID NO: 1054721 - RNA, 18 nt, Human
gggcagcuauuucuagac

SEQ ID NO: 1054722 - RNA, 23 nt, Human
ggggggugguggcaucuggacaa

SEQ ID NO: 1054723 - RNA, 22 nt, Human
ggguggguagcugggggcccgg

SEQ ID NO: 1054724 - RNA, 18 nt, Human
guggccccuuccuguccu

SEQ ID NO: 1054725 - RNA, 21 nt, Human
uaaccccuggguauuuuucug

SEQ ID NO: 1054726 - RNA, 23 nt, Human
uaccuggaauggauuugugugcu

SEQ ID NO: 1054727 - RNA, 19 nt, Human
uccaaggcagucuucccca

SEQ ID NO: 1054728 - RNA, 22 nt, Human
ucccccaccaacacacaccccc

SEQ ID NO: 1054729 - RNA, 22 nt, Human
ucccccaccaacacacaccccc

SEQ ID NO: 1054730 - RNA, 18 nt, Human
ucccccuacucagagccc

SEQ ID NO: 1054731 - RNA, 22 nt, Human
ucccuuccuuuccuuucucagg

SEQ ID NO: 1054732 - RNA, 23 nt, Human
uccucagggcuguggggcaggca

SEQ ID NO: 1054733 - RNA, 23 nt, Human
ucuuaggggggugguggcaucug

SEQ ID NO: 1054734 - RNA, 19 nt, Human
ugacaaaaccaaaaacaga

SEQ ID NO: 1054735 - RNA, 19 nt, Human
uggauuugugugcugauuu

SEQ ID NO: 1054736 - RNA, 22 nt, Human
uggccagagaguguugacaggc

SEQ ID NO: 1054737 - RNA, 21 nt, Human
uggggcaggcacuagggggcc

SEQ ID NO: 1054738 - RNA, 19 nt, Human
ugggguggguagcuggggg

SEQ ID NO: 1054739 - RNA, 20 nt, Human
uguacaaaaaucucaccaag

SEQ ID NO: 1054740 - RNA, 20 nt, Human
uuccccagguggugccucuc

SEQ ID NO: 1054741 - RNA, 18 nt, Human
uuccccugaccuugggcc

SEQ ID NO: 1054742 - RNA, 18 nt, Human
uuccucagggcugugggg

SEQ ID NO: 1054743 - RNA, 19 nt, Human
uuccucagggcuguggggc

SEQ ID NO: 1054744 - RNA, 20 nt, Human
uuccucagggcuguggggca

SEQ ID NO: 1054745 - RNA, 20 nt, Human
uuccuuuccuuucucaggcc

SEQ ID NO: 1054746 - RNA, 22 nt, Human
uucuguggucuuaaccccuggg

SEQ ID NO: 1054747 - RNA, 22 nt, Human
uuuaagagcugaggcuggaccc

SEQ ID NO: 1054748 - RNA, 23 nt, Human
aaacagaggcaggcuccccagga

SEQ ID NO: 1054749 - RNA, 24 nt, Human
aaaccccaacauuauuaaaaccau

SEQ ID NO: 1054750 - RNA, 20 nt, Human
aaauaaaaugugacauuucu

SEQ ID NO: 1054751 - RNA, 23 nt, Human
aacauuauuaaaaccauacugaa

SEQ ID NO: 1054752 - RNA, 19 nt, Human
aagcaagaauaggguccag

SEQ ID NO: 1054753 - RNA, 20 nt, Human
aagcugcuccagauggguga

SEQ ID NO: 1054754 - RNA, 21 nt, Human
acacaguuucccugcugggcc

SEQ ID NO: 1054755 - RNA, 21 nt, Human
acuucagagauuccaaagaag

SEQ ID NO: 1054756 - RNA, 21 nt, Human
agagaaugaagggcuggcaca

SEQ ID NO: 1054757 - RNA, 19 nt, Human
agaggcaggcuccccagga

SEQ ID NO: 1054758 - RNA, 22 nt, Human
agcucguuggcaguuggugcug

SEQ ID NO: 1054759 - RNA, 20 nt, Human
aggaugugcagcaaaucugg

SEQ ID NO: 1054760 - RNA, 22 nt, Human
aggcacucagaaaaacaguuuu

SEQ ID NO: 1054761 - RNA, 30 nt, Human
aggccaaagugugugugugugugugugugg

SEQ ID NO: 1054762 - RNA, 19 nt, Human
aggcgauagcacagagcuu

SEQ ID NO: 1054763 - RNA, 19 nt, Human
agggcuggcacacucugcc

SEQ ID NO: 1054764 - RNA, 21 nt, Human
aucagcccuaccccaaaccaa

SEQ ID NO: 1054765 - RNA, 24 nt, Human
caaaccaacuaugugacccagggc

SEQ ID NO: 1054766 - RNA, 23 nt, Human
caacuaugugacccagggcaagu

SEQ ID NO: 1054767 - RNA, 25 nt, Human
caagaauaggguccagaguaggauu

SEQ ID NO: 1054768 - RNA, 23 nt, Human
cagaaaaacaguuucuuuaccau

SEQ ID NO: 1054769 - RNA, 22 nt, Human
cagagauuccaaagaagcagag

SEQ ID NO: 1054770 - RNA, 24 nt, Human
cagcaagggaugucaugaccaaua

SEQ ID NO: 1054771 - RNA, 21 nt, Human
cagcaggccucaaagaaccga

SEQ ID NO: 1054772 - RNA, 22 nt, Human
caggaaaaggugaauuacagca

SEQ ID NO: 1054773 - RNA, 24 nt, Human
caucuucaucccuaggcuugggag

SEQ ID NO: 1054774 - RNA, 23 nt, Human
ccaaagaagcagaggguccucca

SEQ ID NO: 1054775 - RNA, 18 nt, Human
ccagaucagauaccucac

SEQ ID NO: 1054776 - RNA, 24 nt, Human
ccccauaccagauuggccuccuaa

SEQ ID NO: 1054777 - RNA, 21 nt, Human
ccuaucagcugggacaggaau

SEQ ID NO: 1054778 - RNA, 18 nt, Human
cucaaagaaccgaaacau

SEQ ID NO: 1054779 - RNA, 21 nt, Human
cucaguuuccccacaagugau

SEQ ID NO: 1054780 - RNA, 19 nt, Human
cuccuguauguaaacuaca

SEQ ID NO: 1054781 - RNA, 22 nt, Human
cugaaugcuuaacacugauugc

SEQ ID NO: 1054782 - RNA, 18 nt, Human
gaauggucaggccaaagu

SEQ ID NO: 1054783 - RNA, 23 nt, Human
gacaggaauggguuagcagcagc

SEQ ID NO: 1054784 - RNA, 18 nt, Human
gacucugggcagcugcuc

SEQ ID NO: 1054785 - RNA, 24 nt, Human
gagaaugugaggagaaccgguacc

SEQ ID NO: 1054786 - RNA, 18 nt, Human
gcucugucccguucuuga

SEQ ID NO: 1054787 - RNA, 19 nt, Human
gcuggaauuggaaauccca

SEQ ID NO: 1054788 - RNA, 21 nt, Human
gugugugcgugcgugcgugcg

SEQ ID NO: 1054789 - RNA, 21 nt, Human
gugugugugugugugugcgug

SEQ ID NO: 1054790 - RNA, 20 nt, Human
gugugugugugugugugugu

SEQ ID NO: 1054791 - RNA, 21 nt, Human
gugugugugugugugugugug

SEQ ID NO: 1054792 - RNA, 21 nt, Human
gugugugugugugugugugug

SEQ ID NO: 1054793 - RNA, 21 nt, Human
gugugugugugugugugugug

SEQ ID NO: 1054794 - RNA, 21 nt, Human
gugugugugugugugugugug

SEQ ID NO: 1054795 - RNA, 22 nt, Human
uaacauguauuauauuacuguu

SEQ ID NO: 1054796 - RNA, 20 nt, Human
uaaggcacucagaaaaacag

SEQ ID NO: 1054797 - RNA, 26 nt, Human
uacaagugaccacuccagggaaacag

SEQ ID NO: 1054798 - RNA, 22 nt, Human
uacucagggcagugaaggcuga

SEQ ID NO: 1054799 - RNA, 18 nt, Human
uacuucagagauuccaaa

SEQ ID NO: 1054800 - RNA, 22 nt, Human
uagaaggagggaacaccagagg

SEQ ID NO: 1054801 - RNA, 20 nt, Human
uagaaugcacacaguuuccc

SEQ ID NO: 1054802 - RNA, 21 nt, Human
uagaaugcacacaguuucccu

SEQ ID NO: 1054803 - RNA, 25 nt, Human
uagaaugcacacaguuucccugcug

SEQ ID NO: 1054804 - RNA, 23 nt, Human
uaggaaaacacuauugccaaaag

SEQ ID NO: 1054805 - RNA, 23 nt, Human
uagggcccucucccuuuccccag

SEQ ID NO: 1054806 - RNA, 23 nt, Human
uauugccaaaagaugagugagag

SEQ ID NO: 1054807 - RNA, 20 nt, Human
ucaagaaaguagcuaggacu

SEQ ID NO: 1054808 - RNA, 23 nt, Human
ucagagauuccaaagaagcagag

SEQ ID NO: 1054809 - RNA, 24 nt, Human
ucagagauuccaaagaagcagagg

SEQ ID NO: 1054810 - RNA, 18 nt, Human
ucagggcagugaaggcug

SEQ ID NO: 1054811 - RNA, 20 nt, Human
uccaaagaagcagagggucc

SEQ ID NO: 1054812 - RNA, 19 nt, Human
ucccugcugggccuuccac

SEQ ID NO: 1054813 - RNA, 22 nt, Human
ucucagauacccuaucagcugg

SEQ ID NO: 1054814 - RNA, 19 nt, Human
ucucccuuuccccagcagg

SEQ ID NO: 1054815 - RNA, 25 nt, Human
ugaaagacuggauuuuuguugcaga

SEQ ID NO: 1054816 - RNA, 24 nt, Human
ugaagagaaugaagggcuggcaca

SEQ ID NO: 1054817 - RNA, 21 nt, Human
ugaagagacuaaaacuggcca

SEQ ID NO: 1054818 - RNA, 22 nt, Human
ugagaaaacuucaggguguggc

SEQ ID NO: 1054819 - RNA, 23 nt, Human
ugaggagaacaagaguuuuuggc

SEQ ID NO: 1054820 - RNA, 23 nt, Human
ugagugagagauugaagagaaug

SEQ ID NO: 1054821 - RNA, 24 nt, Human
ugcgugcgugcgugcgugcgugug

SEQ ID NO: 1054822 - RNA, 24 nt, Human
ugcgugcgugcgugcgugugugug

SEQ ID NO: 1054823 - RNA, 25 nt, Human
ugcgugcgugcgugugugugugugu

SEQ ID NO: 1054824 - RNA, 21 nt, Human
ugcgugcgugugugugugugu

SEQ ID NO: 1054825 - RNA, 19 nt, Human
ugcgugugugugugugugu

SEQ ID NO: 1054826 - RNA, 21 nt, Human
uggaaagggugcuagcuggaa

SEQ ID NO: 1054827 - RNA, 20 nt, Human
uggcauuugcuguugaccuu

SEQ ID NO: 1054828 - RNA, 23 nt, Human
ugggagcagugcacacugugcug

SEQ ID NO: 1054829 - RNA, 23 nt, Human
ugugauaggcucggagaaagaau

SEQ ID NO: 1054830 - RNA, 24 nt, Human
ugugugcgugcgugcgugcgugcg

SEQ ID NO: 1054831 - RNA, 19 nt, Human
ugugugugugugcgugcgu

SEQ ID NO: 1054832 - RNA, 20 nt, Human
ugugugugugugcgugcgug

SEQ ID NO: 1054833 - RNA, 22 nt, Human
ugugugugugugcgugcgugcg

SEQ ID NO: 1054834 - RNA, 18 nt, Human
ugugugugugugugugug

SEQ ID NO: 1054835 - RNA, 18 nt, Human
ugugugugugugugugug

SEQ ID NO: 1054836 - RNA, 18 nt, Human
ugugugugugugugugug

SEQ ID NO: 1054837 - RNA, 18 nt, Human
ugugugugugugugugug

SEQ ID NO: 1054838 - RNA, 18 nt, Human
ugugugugugugugugug

SEQ ID NO: 1054839 - RNA, 18 nt, Human
ugugugugugugugugug

SEQ ID NO: 1054840 - RNA, 18 nt, Human
ugugugugugugugugug

SEQ ID NO: 1054841 - RNA, 19 nt, Human
ugugugugugugugugugc

SEQ ID NO: 1054842 - RNA, 21 nt, Human
ugugugugugugugugugugc

SEQ ID NO: 1054843 - RNA, 21 nt, Human
ugugugugugugugugugugu

SEQ ID NO: 1054844 - RNA, 21 nt, Human
ugugugugugugugugugugu

SEQ ID NO: 1054845 - RNA, 21 nt, Human
ugugugugugugugugugugu

SEQ ID NO: 1054846 - RNA, 21 nt, Human
ugugugugugugugugugugu

SEQ ID NO: 1054847 - RNA, 21 nt, Human
ugugugugugugugugugugu

SEQ ID NO: 1054848 - RNA, 21 nt, Human
ugugugugugugugugugugu

SEQ ID NO: 1054849 - RNA, 21 nt, Human
ugugugugugugugugugugu

SEQ ID NO: 1054850 - RNA, 21 nt, Human
ugugugugugugugugugugu

SEQ ID NO: 1054851 - RNA, 21 nt, Human
ugugugugugugugugugugu

SEQ ID NO: 1054852 - RNA, 21 nt, Human
ugugugugugugugugugugu

SEQ ID NO: 1054853 - RNA, 21 nt, Human
ugugugugugugugugugugu

SEQ ID NO: 1054854 - RNA, 21 nt, Human
ugugugugugugugugugugu

SEQ ID NO: 1054855 - RNA, 22 nt, Human
ugugugugugugugugugugug

SEQ ID NO: 1054856 - RNA, 22 nt, Human
ugugugugugugugugugugug

SEQ ID NO: 1054857 - RNA, 18 nt, Human
uguguuaguagaaggagg

SEQ ID NO: 1054858 - RNA, 26 nt, Human
uuauagggcccucucccuuuccccag

SEQ ID NO: 1054859 - RNA, 19 nt, Human
aaaaauucaaaaauuagcc

SEQ ID NO: 1054860 - RNA, 21 nt, Human
aaaacaaacaaacaaacaaac

SEQ ID NO: 1054861 - RNA, 22 nt, Human
aaacaaacaaacaaacaaacuc

SEQ ID NO: 1054862 - RNA, 23 nt, Human
aaacaaacaaacaaacaaacuca

SEQ ID NO: 1054863 - RNA, 23 nt, Human
aaacaaacaaacaaacucaccga

SEQ ID NO: 1054864 - RNA, 22 nt, Human
aaacaaacaaacucaccgagca

SEQ ID NO: 1054865 - RNA, 24 nt, Human
aaacaaacaaacucaccgagcagg

SEQ ID NO: 1054866 - RNA, 22 nt, Human
aaacccugacucuacuaaaaaa

SEQ ID NO: 1054867 - RNA, 18 nt, Human
aacauagugaaacccacu

SEQ ID NO: 1054868 - RNA, 20 nt, Human
aacauagugaaacccacucu

SEQ ID NO: 1054869 - RNA, 21 nt, Human
aacauagugaaacccacucuc

SEQ ID NO: 1054870 - RNA, 22 nt, Human
aagcagagaaguaggcucagag

SEQ ID NO: 1054871 - RNA, 18 nt, Human
aauugcuugaaccaggga

SEQ ID NO: 1054872 - RNA, 18 nt, Human
acaaacaaacaaacaaac

SEQ ID NO: 1054873 - RNA, 19 nt, Human
acagcuacugcuaccccuc

SEQ ID NO: 1054874 - RNA, 18 nt, Human
acccugacucuacuaaaa

SEQ ID NO: 1054875 - RNA, 20 nt, Human
accgagcaggaaaaagaagc

SEQ ID NO: 1054876 - RNA, 19 nt, Human
accuagagcuggaaagacc

SEQ ID NO: 1054877 - RNA, 20 nt, Human
accuagagcuggaaagaccc

SEQ ID NO: 1054878 - RNA, 19 nt, Human
acuccagcacagccgaccu

SEQ ID NO: 1054879 - RNA, 24 nt, Human
acuccagccugggaagcaaaguga

SEQ ID NO: 1054880 - RNA, 28 nt, Human
acucugucucaaaaacaaacaaacaaac

SEQ ID NO: 1054881 - RNA, 18 nt, Human
acugcacuccagccuggg

SEQ ID NO: 1054882 - RNA, 26 nt, Human
agacaggcagaucaguugaggccagg

SEQ ID NO: 1054883 - RNA, 19 nt, Human
agagaaguaggcucagagc

SEQ ID NO: 1054884 - RNA, 24 nt, Human
agcaaagugagacucugucucaaa

SEQ ID NO: 1054885 - RNA, 22 nt, Human
agcagcccccuuuccacaaaga

SEQ ID NO: 1054886 - RNA, 23 nt, Human
agcagcccccuuuccacaaagau

SEQ ID NO: 1054887 - RNA, 18 nt, Human
agcaggaaaaagaagcac

SEQ ID NO: 1054888 - RNA, 23 nt, Human
agccaggcgugguggugggcgcc

SEQ ID NO: 1054889 - RNA, 22 nt, Human
agccuggccaacauagugaaac

SEQ ID NO: 1054890 - RNA, 24 nt, Human
agccuggccaacauagugaaaccc

SEQ ID NO: 1054891 - RNA, 24 nt, Human
agccugggaagcaaagugagacuc

SEQ ID NO: 1054892 - RNA, 19 nt, Human
agccugguccucuuccuuu

SEQ ID NO: 1054893 - RNA, 23 nt, Human
agcugggugugguggcgcaugcc

SEQ ID NO: 1054894 - RNA, 23 nt, Human
aggaauucucacgccuuggccuc

SEQ ID NO: 1054895 - RNA, 24 nt, Human
aggaauucucacgccuuggccucc

SEQ ID NO: 1054896 - RNA, 24 nt, Human
aggcacggugccucaugccuguaa

SEQ ID NO: 1054897 - RNA, 23 nt, Human
aggcaggagaaucgcuugaaccc

SEQ ID NO: 1054898 - RNA, 23 nt, Human
aggcaggagaaucgcuugaaccc

SEQ ID NO: 1054899 - RNA, 25 nt, Human
aggcaggagaaucgcuugaaccccg

SEQ ID NO: 1054900 - RNA, 21 nt, Human
aggccgaggcggacggaucac

SEQ ID NO: 1054901 - RNA, 26 nt, Human
aggcggacggaucacuugaggucagg

SEQ ID NO: 1054902 - RNA, 20 nt, Human
aggcugaggcaggagaaucg

SEQ ID NO: 1054903 - RNA, 24 nt, Human
aggcugaggcaggagaaucgcuug

SEQ ID NO: 1054904 - RNA, 24 nt, Human
aucgcaccacugcacuccagccug

SEQ ID NO: 1054905 - RNA, 22 nt, Human
caaacaaacaaacucaccgagc

SEQ ID NO: 1054906 - RNA, 23 nt, Human
caaagugagacucugucucaaaa

SEQ ID NO: 1054907 - RNA, 26 nt, Human
caccacugcacuccagccugggaagc

SEQ ID NO: 1054908 - RNA, 23 nt, Human
caccuucaccccagacauuauuc

SEQ ID NO: 1054909 - RNA, 20 nt, Human
cacgccuguaaucccagaac

SEQ ID NO: 1054910 - RNA, 24 nt, Human
cacgccuguaaucccagaacuuug

SEQ ID NO: 1054911 - RNA, 23 nt, Human
cacucucuacuaaaaauucaaaa

SEQ ID NO: 1054912 - RNA, 18 nt, Human
cacugcacuccagccugg

SEQ ID NO: 1054913 - RNA, 19 nt, Human
cacugcacuccagccuggg

SEQ ID NO: 1054914 - RNA, 19 nt, Human
cacugcacuccagccuggg

SEQ ID NO: 1054915 - RNA, 24 nt, Human
cacugcacuccagccugggaagca

SEQ ID NO: 1054916 - RNA, 23 nt, Human
cacugugccgugcuuugcagggu

SEQ ID NO: 1054917 - RNA, 24 nt, Human
cagaacuuuggaaggccgaggcgg

SEQ ID NO: 1054918 - RNA, 24 nt, Human
cagaucaguugaggccaggaguuu

SEQ ID NO: 1054919 - RNA, 18 nt, Human
cagcacagccgaccuaga

SEQ ID NO: 1054920 - RNA, 19 nt, Human
cagccgaccuagagcugga

SEQ ID NO: 1054921 - RNA, 24 nt, Human
cagcuacuugggaggcuggggcag

SEQ ID NO: 1054922 - RNA, 21 nt, Human
caggaagccugguccucuucc

SEQ ID NO: 1054923 - RNA, 24 nt, Human
caggcagaucaguugaggccagga

SEQ ID NO: 1054924 - RNA, 18 nt, Human
caguucuuugggaggccg

SEQ ID NO: 1054925 - RNA, 20 nt, Human
caguucuuugggaggccgag

SEQ ID NO: 1054926 - RNA, 18 nt, Human
caucaggggaccauaggg

SEQ ID NO: 1054927 - RNA, 24 nt, Human
caugccuguaaucccaguucuuug

SEQ ID NO: 1054928 - RNA, 24 nt, Human
ccacaaagauggcuggagcccaga

SEQ ID NO: 1054929 - RNA, 22 nt, Human
ccaccccugcucaugcucagac

SEQ ID NO: 1054930 - RNA, 19 nt, Human
ccacugcacuccagccugg

SEQ ID NO: 1054931 - RNA, 20 nt, Human
ccacugcacuccagccuggg

SEQ ID NO: 1054932 - RNA, 21 nt, Human
ccacugcacuccagccuggga

SEQ ID NO: 1054933 - RNA, 22 nt, Human
ccacugcacuccagccugggaa

SEQ ID NO: 1054934 - RNA, 23 nt, Human
ccacugcacuccagccugggaag

SEQ ID NO: 1054935 - RNA, 24 nt, Human
ccacugcacuccagccugggaagc

SEQ ID NO: 1054936 - RNA, 25 nt, Human
ccacugcacuccagccugggaagca

SEQ ID NO: 1054937 - RNA, 24 nt, Human
ccagaccagccuggccaacauagu

SEQ ID NO: 1054938 - RNA, 25 nt, Human
ccgaggcggacggaucacuugaggu

SEQ ID NO: 1054939 - RNA, 21 nt, Human
ccgguagucccagcuacuugg

SEQ ID NO: 1054940 - RNA, 24 nt, Human
ccgguagucccagcuacuuggcag

SEQ ID NO: 1054941 - RNA, 21 nt, Human
ccucugaauuguggaggggga

SEQ ID NO: 1054942 - RNA, 19 nt, Human
ccuggccaaaguaaaaccc

SEQ ID NO: 1054943 - RNA, 22 nt, Human
ccuggccaacauagugaaaccc

SEQ ID NO: 1054944 - RNA, 23 nt, Human
ccuggccaacauagugaaaccca

SEQ ID NO: 1054945 - RNA, 22 nt, Human
ccuguaaucccaguucuuuggg

SEQ ID NO: 1054946 - RNA, 21 nt, Human
ccuguagucccagcuacuugg

SEQ ID NO: 1054947 - RNA, 18 nt, Human
ccuuucccucucggccac

SEQ ID NO: 1054948 - RNA, 26 nt, Human
cgaggcggacggaucacuugagguca

SEQ ID NO: 1054949 - RNA, 21 nt, Human
cgcaccacugcacuccagccu

SEQ ID NO: 1054950 - RNA, 23 nt, Human
cgccgguagucccagcuacuugg

SEQ ID NO: 1054951 - RNA, 18 nt, Human
cgccuguaaucccagaac

SEQ ID NO: 1054952 - RNA, 23 nt, Human
cgccuguaaucccagaacuuugg

SEQ ID NO: 1054953 - RNA, 23 nt, Human
cgcugccucccaccccugcucau

SEQ ID NO: 1054954 - RNA, 24 nt, Human
cggaucacuugaggucaggcguuc

SEQ ID NO: 1054955 - RNA, 21 nt, Human
cguuccagaccagccuggcca

SEQ ID NO: 1054956 - RNA, 18 nt, Human
cucaaaaacaaacaaaca

SEQ ID NO: 1054957 - RNA, 22 nt, Human
cucacgccuguaaucccagaac

SEQ ID NO: 1054958 - RNA, 24 nt, Human
cucacgccuguaaucccagaacuu

SEQ ID NO: 1054959 - RNA, 19 nt, Human
cucacgccuuggccuccac

SEQ ID NO: 1054960 - RNA, 19 nt, Human
cucagucucugacaggaag

SEQ ID NO: 1054961 - RNA, 24 nt, Human
cucaugccuguaaucccaguucuu

SEQ ID NO: 1054962 - RNA, 22 nt, Human
cucccaccccugcucaugcuca

SEQ ID NO: 1054963 - RNA, 19 nt, Human
cuggagcccagaagcagag

SEQ ID NO: 1054964 - RNA, 19 nt, Human
cuguuccuuagcccaugug

SEQ ID NO: 1054965 - RNA, 24 nt, Human
cuuaacgcugccucccaccccugc

SEQ ID NO: 1054966 - RNA, 20 nt, Human
cuuggccuccacuuuucugu

SEQ ID NO: 1054967 - RNA, 22 nt, Human
gaaggaacuuggaaacagauuu

SEQ ID NO: 1054968 - RNA, 25 nt, Human
gagacaggcagaucaguugaggcca

SEQ ID NO: 1054969 - RNA, 22 nt, Human
gagucuugggcugggugcuuca

SEQ ID NO: 1054970 - RNA, 19 nt, Human
gaucacuugaggucaggcg

SEQ ID NO: 1054971 - RNA, 25 nt, Human
gaucacuugaggucaggcguuccag

SEQ ID NO: 1054972 - RNA, 24 nt, Human
gaucaguugaggccaggaguuuaa

SEQ ID NO: 1054973 - RNA, 21 nt, Human
gcaaagugagacucugucuca

SEQ ID NO: 1054974 - RNA, 20 nt, Human
gcaccacugcacuccagccu

SEQ ID NO: 1054975 - RNA, 22 nt, Human
gccaacauagugaaacccacuc

SEQ ID NO: 1054976 - RNA, 21 nt, Human
gccucaugccuguaaucccag

SEQ ID NO: 1054977 - RNA, 20 nt, Human
gcugagaucgcaccacugca

SEQ ID NO: 1054978 - RNA, 20 nt, Human
gcuggagcccagaagcagag

SEQ ID NO: 1054979 - RNA, 21 nt, Human
gcuggagcccagaagcagaga

SEQ ID NO: 1054980 - RNA, 24 nt, Human
ggacaggggccgagacauguuucu

SEQ ID NO: 1054981 - RNA, 23 nt, Human
ggaggcugcaguaagcugagauc

SEQ ID NO: 1054982 - RNA, 24 nt, Human
ggaggcugcaguaagcugagaucg

SEQ ID NO: 1054983 - RNA, 23 nt, Human
ggaucacuugaggucaggcguuc

SEQ ID NO: 1054984 - RNA, 18 nt, Human
ggccgaggcggacggauc

SEQ ID NO: 1054985 - RNA, 21 nt, Human
ggcucacgccuguaaucccag

SEQ ID NO: 1054986 - RNA, 24 nt, Human
gggcgcgguggcucacgccuguaa

SEQ ID NO: 1054987 - RNA, 23 nt, Human
ggugccucaugccuguaauccca

SEQ ID NO: 1054988 - RNA, 24 nt, Human
ggugccucaugccuguaaucccag

SEQ ID NO: 1054989 - RNA, 23 nt, Human
gguggcucacgccuguaauccca

SEQ ID NO: 1054990 - RNA, 24 nt, Human
gguggcucacgccuguaaucccag

SEQ ID NO: 1054991 - RNA, 19 nt, Human
ggugugguggcgcaugccu

SEQ ID NO: 1054992 - RNA, 18 nt, Human
gugggcgccgguaguccc

SEQ ID NO: 1054993 - RNA, 20 nt, Human
uaacgcugccucccaccccu

SEQ ID NO: 1054994 - RNA, 19 nt, Human
uagacuccagcacagccga

SEQ ID NO: 1054995 - RNA, 23 nt, Human
uauaacaccugcagcuuggcaca

SEQ ID NO: 1054996 - RNA, 26 nt, Human
ucaggccgggcgcgguggcucacgcc

SEQ ID NO: 1054997 - RNA, 20 nt, Human
ucaugccuguaaucccaguu

SEQ ID NO: 1054998 - RNA, 20 nt, Human
uccagccugggaagcaaagu

SEQ ID NO: 1054999 - RNA, 21 nt, Human
uccguguucuccaggcaucug

SEQ ID NO: 1055000 - RNA, 23 nt, Human
ucgcaccacugcacuccagccug

SEQ ID NO: 1055001 - RNA, 22 nt, Human
ucgcuugaaccccggaagcgga

SEQ ID NO: 1055002 - RNA, 18 nt, Human
ucucacgccuuggccucc

SEQ ID NO: 1055003 - RNA, 19 nt, Human
ucuccaggcaucugguuca

SEQ ID NO: 1055004 - RNA, 21 nt, Human
ucucuacuaaaaauucaaaaa

SEQ ID NO: 1055005 - RNA, 22 nt, Human
ucucugacaggaagccuggucc

SEQ ID NO: 1055006 - RNA, 20 nt, Human
ucugacaggaagccuggucc

SEQ ID NO: 1055007 - RNA, 21 nt, Human
ucugugugaauuccugcaccc

SEQ ID NO: 1055008 - RNA, 20 nt, Human
ucuuugggaggccgagacag

SEQ ID NO: 1055009 - RNA, 19 nt, Human
ugacucugaugccucccuu

SEQ ID NO: 1055010 - RNA, 24 nt, Human
ugagaucgcaccacugcacuccag

SEQ ID NO: 1055011 - RNA, 27 nt, Human
ugaggaauucucacgccuuggccucca

SEQ ID NO: 1055012 - RNA, 20 nt, Human
ugaggcaggagaaucgcuug

SEQ ID NO: 1055013 - RNA, 24 nt, Human
ugaggcaggagaaucgcuugaacc

SEQ ID NO: 1055014 - RNA, 25 nt, Human
ugaggcaggagaaucgcuugaaccc

SEQ ID NO: 1055015 - RNA, 21 nt, Human
ugaggucaggcguuccagacc

SEQ ID NO: 1055016 - RNA, 18 nt, Human
ugccucaugccuguaauc

SEQ ID NO: 1055017 - RNA, 21 nt, Human
ugccucaugccuguaauccca

SEQ ID NO: 1055018 - RNA, 22 nt, Human
ugccucaugccuguaaucccag

SEQ ID NO: 1055019 - RNA, 22 nt, Human
ugccucccaccccugcucaugc

SEQ ID NO: 1055020 - RNA, 23 nt, Human
ugccuguaaucccaguucuuugg

SEQ ID NO: 1055021 - RNA, 23 nt, Human
ugccuguagucccagcuacuugg

SEQ ID NO: 1055022 - RNA, 24 nt, Human
ugccuguagucccagcuacuuggg

SEQ ID NO: 1055023 - RNA, 24 nt, Human
uggaaggccgaggcggacggauca

SEQ ID NO: 1055024 - RNA, 18 nt, Human
uggagggggacaggggcc

SEQ ID NO: 1055025 - RNA, 24 nt, Human
uggcacaacagcuacugcuacccc

SEQ ID NO: 1055026 - RNA, 21 nt, Human
uggcucacgccuguaauccca

SEQ ID NO: 1055027 - RNA, 22 nt, Human
uggcucacgccuguaaucccag

SEQ ID NO: 1055028 - RNA, 24 nt, Human
ugggaggccgagacaggcagauca

SEQ ID NO: 1055029 - RNA, 20 nt, Human
ugggcaaauccuagacucca

SEQ ID NO: 1055030 - RNA, 21 nt, Human
uggggcagaauugcuugaacc

SEQ ID NO: 1055031 - RNA, 18 nt, Human
ugggugugguggcgcaug

SEQ ID NO: 1055032 - RNA, 19 nt, Human
ugguauaaagagcgcuggg

SEQ ID NO: 1055033 - RNA, 24 nt, Human
ugguggcgcaugccuguaguccca

SEQ ID NO: 1055034 - RNA, 21 nt, Human
uggugggcgccgguaguccca

SEQ ID NO: 1055035 - RNA, 24 nt, Human
uuagccaggcgugguggugggcgc

SEQ ID NO: 1055036 - RNA, 18 nt, Human
uuagcugggugugguggc

SEQ ID NO: 1055037 - RNA, 20 nt, Human
uuagcugggugugguggcgc

SEQ ID NO: 1055038 - RNA, 24 nt, Human
uuagcugggugugguggcgcaugc

SEQ ID NO: 1055039 - RNA, 19 nt, Human
uucaccuucaccccagaca

SEQ ID NO: 1055040 - RNA, 18 nt, Human
uucauagucggagagcuc

SEQ ID NO: 1055041 - RNA, 26 nt, Human
uuccacaaagauggcuggagcccaga

SEQ ID NO: 1055042 - RNA, 19 nt, Human
uuccuggguccucagucuc

SEQ ID NO: 1055043 - RNA, 22 nt, Human
uucuucacaaacacuuguuugc

SEQ ID NO: 1055044 - RNA, 22 nt, Human
uugaggccaggaguuuaagacc

SEQ ID NO: 1055045 - RNA, 24 nt, Human
uugcuugaaccagggagacagagg

SEQ ID NO: 1055046 - RNA, 25 nt, Human
uuggaaggccgaggcggacggauca

SEQ ID NO: 1055047 - RNA, 24 nt, Human
uuggcaggcugaggcaggagaauc

SEQ ID NO: 1055048 - RNA, 25 nt, Human
uuuucugugugaauuccugcacccg

SEQ ID NO: 1055049 - RNA, 21 nt, Human
acccagugucuguguggucug

SEQ ID NO: 1055050 - RNA, 18 nt, Human
accccaccugucuccccg

SEQ ID NO: 1055051 - RNA, 24 nt, Human
accugucuccccggcuuccuuccg

SEQ ID NO: 1055052 - RNA, 20 nt, Human
aggccucgcucccccgugac

SEQ ID NO: 1055053 - RNA, 25 nt, Human
cagcaggccucgcucccccgugacu

SEQ ID NO: 1055054 - RNA, 18 nt, Human
cagcuucccgaguacccc

SEQ ID NO: 1055055 - RNA, 22 nt, Human
ccagugucuguguggucugggu

SEQ ID NO: 1055056 - RNA, 18 nt, Human
cccccgugacugcaccgc

SEQ ID NO: 1055057 - RNA, 28 nt, Human
cccccgugacugcaccgccggcccgcuc

SEQ ID NO: 1055058 - RNA, 24 nt, Human
cccggcuuccuuccggcccuuugu

SEQ ID NO: 1055059 - RNA, 19 nt, Human
cuccccggcuuccuuccgg

SEQ ID NO: 1055060 - RNA, 18 nt, Human
cuugacccagugucugug

SEQ ID NO: 1055061 - RNA, 20 nt, Human
cuugacccagugucugugug

SEQ ID NO: 1055062 - RNA, 21 nt, Human
cuugacccagugucugugugg

SEQ ID NO: 1055063 - RNA, 18 nt, Human
cuuugugcuugcucuccu

SEQ ID NO: 1055064 - RNA, 20 nt, Human
gacuuugugcuugcucuccu

SEQ ID NO: 1055065 - RNA, 20 nt, Human
guguggucugggucgccucc

SEQ ID NO: 1055066 - RNA, 22 nt, Human
ucagagguuuaaaaaacuucga

SEQ ID NO: 1055067 - RNA, 23 nt, Human
uccauuagaaguauuuuauuuua

SEQ ID NO: 1055068 - RNA, 24 nt, Human
uccauuagaaguauuuuauuuuaa

SEQ ID NO: 1055069 - RNA, 23 nt, Human
uggucugggucgccuccgaggcc

SEQ ID NO: 1055070 - RNA, 21 nt, Human
ugucuccccggcuuccuuccg

SEQ ID NO: 1055071 - RNA, 18 nt, Human
uguguuuucuucucuugc

SEQ ID NO: 1055072 - RNA, 20 nt, Human
uuguguuuucuucucuugcu

SEQ ID NO: 1055073 - RNA, 21 nt, Human
aaacauacagcaugaggaaug

SEQ ID NO: 1055074 - RNA, 18 nt, Human
aagaugccuaacacugcc

SEQ ID NO: 1055075 - RNA, 21 nt, Human
aaguggcuuuaauauaaaagu

SEQ ID NO: 1055076 - RNA, 24 nt, Human
aaugaaaugguugaaucacaaggu

SEQ ID NO: 1055077 - RNA, 18 nt, Human
acaagguagugcaagaca

SEQ ID NO: 1055078 - RNA, 20 nt, Human
acaagguagugcaagacagu

SEQ ID NO: 1055079 - RNA, 21 nt, Human
agauuugagaaagcucacaag

SEQ ID NO: 1055080 - RNA, 19 nt, Human
agguggccuuggacaaccu

SEQ ID NO: 1055081 - RNA, 21 nt, Human
aucuaaacauacagcaugagg

SEQ ID NO: 1055082 - RNA, 24 nt, Human
auuuccucaggccccuuuuccauu

SEQ ID NO: 1055083 - RNA, 19 nt, Human
auuugaauucccugcccuc

SEQ ID NO: 1055084 - RNA, 18 nt, Human
cacaagguagugcaagac

SEQ ID NO: 1055085 - RNA, 22 nt, Human
cacaguguucgauucgcuucua

SEQ ID NO: 1055086 - RNA, 19 nt, Human
ccacagauacuauauuuuc

SEQ ID NO: 1055087 - RNA, 19 nt, Human
ccauucguaucuaaaacag

SEQ ID NO: 1055088 - RNA, 24 nt, Human
ccauucguaucuaaaacaggcaga

SEQ ID NO: 1055089 - RNA, 21 nt, Human
ccggaaaauuuccucaggccc

SEQ ID NO: 1055090 - RNA, 19 nt, Human
ccucuagguggccuuggac

SEQ ID NO: 1055091 - RNA, 18 nt, Human
cgauaagccacauuuaac

SEQ ID NO: 1055092 - RNA, 21 nt, Human
cggcuuuaggcuccacccagc

SEQ ID NO: 1055093 - RNA, 22 nt, Human
cucaacuuaauguuuuugagau

SEQ ID NO: 1055094 - RNA, 19 nt, Human
gaaagcucacaagcuacaa

SEQ ID NO: 1055095 - RNA, 18 nt, Human
ggauggaaauuucacugu

SEQ ID NO: 1055096 - RNA, 24 nt, Human
guaaacuugaaguuaauuccauuu

SEQ ID NO: 1055097 - RNA, 24 nt, Human
gugauuguaucuaucauauuugug

SEQ ID NO: 1055098 - RNA, 20 nt, Human
uaaaacaggcagaucguuuc

SEQ ID NO: 1055099 - RNA, 19 nt, Human
uaaaaucacaaaucuaaac

SEQ ID NO: 1055100 - RNA, 18 nt, Human
uaagaugccuaacacugc

SEQ ID NO: 1055101 - RNA, 20 nt, Human
uaagaugccuaacacugcca

SEQ ID NO: 1055102 - RNA, 22 nt, Human
uaagaugccuaacacugccacc

SEQ ID NO: 1055103 - RNA, 25 nt, Human
uacauauaguaaaaucacaaaucua

SEQ ID NO: 1055104 - RNA, 21 nt, Human
uagauaguauguuauguuugg

SEQ ID NO: 1055105 - RNA, 23 nt, Human
uaguaaaaucacaaaucuaaaca

SEQ ID NO: 1055106 - RNA, 21 nt, Human
uaguauguuauguuugguuug

SEQ ID NO: 1055107 - RNA, 24 nt, Human
uauacaauuugccacagauacuau

SEQ ID NO: 1055108 - RNA, 22 nt, Human
uaucauauuugugcuucauuuu

SEQ ID NO: 1055109 - RNA, 19 nt, Human
uaucuuaaaagguauagag

SEQ ID NO: 1055110 - RNA, 27 nt, Human
uaucuuguuuuuauuuugauaguuuua

SEQ ID NO: 1055111 - RNA, 18 nt, Human
uauggauggaaauuucac

SEQ ID NO: 1055112 - RNA, 19 nt, Human
ucagcaguccuuuuuuaaa

SEQ ID NO: 1055113 - RNA, 22 nt, Human
ucaguauuuuauauuguuguga

SEQ ID NO: 1055114 - RNA, 19 nt, Human
uccucuagguggccuugga

SEQ ID NO: 1055115 - RNA, 22 nt, Human
ucuaagcagccacuguucuggu

SEQ ID NO: 1055116 - RNA, 18 nt, Human
ugaaaucaucuacaaaga

SEQ ID NO: 1055117 - RNA, 26 nt, Human
ugaaaugguugaaucacaagguagug

SEQ ID NO: 1055118 - RNA, 22 nt, Human
ugacaaauauaugcagcuacau

SEQ ID NO: 1055119 - RNA, 21 nt, Human
ugagaaagcucacaagcuaca

SEQ ID NO: 1055120 - RNA, 21 nt, Human
uggaagaaaaggaaaugccuu

SEQ ID NO: 1055121 - RNA, 21 nt, Human
uggcuucuucuuuucagccga

SEQ ID NO: 1055122 - RNA, 21 nt, Human
ugguauuggaagaaaaggaaa

SEQ ID NO: 1055123 - RNA, 25 nt, Human
uguagucaggauacuuaauaauacc

SEQ ID NO: 1055124 - RNA, 18 nt, Human
ugugcugggaaugcaaca

SEQ ID NO: 1055125 - RNA, 18 nt, Human
ugugcuucauuuuuaucc

SEQ ID NO: 1055126 - RNA, 25 nt, Human
uuaaaaaacaucuaaacaaauuuua

SEQ ID NO: 1055127 - RNA, 18 nt, Human
uuaaaugaacaguauucc

SEQ ID NO: 1055128 - RNA, 24 nt, Human
uuuuugagauucauacagguuguu

SEQ ID NO: 1055129 - RNA, 23 nt, Human
aaauuuaaauuuuccuuccucag

SEQ ID NO: 1055130 - RNA, 19 nt, Human
acaccaacccuccacaaag

SEQ ID NO: 1055131 - RNA, 25 nt, Human
accaagcccaugacugacccacacc

SEQ ID NO: 1055132 - RNA, 23 nt, Human
acccuccacaaagagguuacggc

SEQ ID NO: 1055133 - RNA, 25 nt, Human
agaggucagcccugucaagaguuuu

SEQ ID NO: 1055134 - RNA, 19 nt, Human
agcagcucggcuccugcac

SEQ ID NO: 1055135 - RNA, 19 nt, Human
agcuagaauagugaagacc

SEQ ID NO: 1055136 - RNA, 19 nt, Human
aggaagaaugaugggcagg

SEQ ID NO: 1055137 - RNA, 21 nt, Human
aguaaggaucaccgggaggaa

SEQ ID NO: 1055138 - RNA, 20 nt, Human
auaaaguauaccgugcuauc

SEQ ID NO: 1055139 - RNA, 24 nt, Human
auuacaaaaauaaaaugacacaga

SEQ ID NO: 1055140 - RNA, 21 nt, Human
caaauacacaaacccagacuc

SEQ ID NO: 1055141 - RNA, 23 nt, Human
caagaaagagaauaaaguauacc

SEQ ID NO: 1055142 - RNA, 23 nt, Human
caagcuagaauagugaagaccag

SEQ ID NO: 1055143 - RNA, 20 nt, Human
cacagaaaguucuuuuagac

SEQ ID NO: 1055144 - RNA, 22 nt, Human
cacccugacuuuucaauagucu

SEQ ID NO: 1055145 - RNA, 26 nt, Human
cacugcagauauagaacauuucuguc

SEQ ID NO: 1055146 - RNA, 21 nt, Human
cagccuucuuuuugcaggccc

SEQ ID NO: 1055147 - RNA, 24 nt, Human
caggauauuccuagacugguggug

SEQ ID NO: 1055148 - RNA, 23 nt, Human
cagggcccucuagaaaauccuga

SEQ ID NO: 1055149 - RNA, 20 nt, Human
caugacugacccacaccucu

SEQ ID NO: 1055150 - RNA, 23 nt, Human
ccaaaauauaacugacaggaaaa

SEQ ID NO: 1055151 - RNA, 22 nt, Human
ccaagcccaugacugacccaca

SEQ ID NO: 1055152 - RNA, 19 nt, Human
cccguuguuccagccuucu

SEQ ID NO: 1055153 - RNA, 18 nt, Human
cugcugagucacucugac

SEQ ID NO: 1055154 - RNA, 24 nt, Human
gaaaauccugaugugggacaagga

SEQ ID NO: 1055155 - RNA, 21 nt, Human
gaaggaacuagaguuuugauc

SEQ ID NO: 1055156 - RNA, 21 nt, Human
gaccaggggauaccaagccca

SEQ ID NO: 1055157 - RNA, 22 nt, Human
gagucacucugacuaggaacac

SEQ ID NO: 1055158 - RNA, 24 nt, Human
gaucaccgggaggaagggauuccu

SEQ ID NO: 1055159 - RNA, 20 nt, Human
gcagcagcucggcuccugca

SEQ ID NO: 1055160 - RNA, 21 nt, Human
gcagcagcucggcuccugcac

SEQ ID NO: 1055161 - RNA, 21 nt, Human
ggacacugcagauauagaaca

SEQ ID NO: 1055162 - RNA, 21 nt, Human
ggcagguuaaauucauggaua

SEQ ID NO: 1055163 - RNA, 20 nt, Human
gggagcagugcugcuuggag

SEQ ID NO: 1055164 - RNA, 22 nt, Human
ggugguggagucacagaaagga

SEQ ID NO: 1055165 - RNA, 19 nt, Human
uaaaauguuaguuguccuc

SEQ ID NO: 1055166 - RNA, 20 nt, Human
uaaauugcacaagagaacaa

SEQ ID NO: 1055167 - RNA, 22 nt, Human
uaacacaauagcuaguagcccc

SEQ ID NO: 1055168 - RNA, 19 nt, Human
uaaggaucaccgggaggaa

SEQ ID NO: 1055169 - RNA, 19 nt, Human
uaauuccaaauaccauucu

SEQ ID NO: 1055170 - RNA, 18 nt, Human
uacaacacaagaaagaga

SEQ ID NO: 1055171 - RNA, 19 nt, Human
uacaccaacccuccacaaa

SEQ ID NO: 1055172 - RNA, 21 nt, Human
uaccauucuuucuuuuccucu

SEQ ID NO: 1055173 - RNA, 19 nt, Human
uaggaacacauaauaguca

SEQ ID NO: 1055174 - RNA, 23 nt, Human
uaggcugcuuauagaagcagcuu

SEQ ID NO: 1055175 - RNA, 24 nt, Human
ucagcccugucaagaguuuuguga

SEQ ID NO: 1055176 - RNA, 25 nt, Human
uccucagucacacuagccacauuuc

SEQ ID NO: 1055177 - RNA, 23 nt, Human
ucuaacacaauagcuaguagccc

SEQ ID NO: 1055178 - RNA, 21 nt, Human
ucuacaacacaagaaagagaa

SEQ ID NO: 1055179 - RNA, 22 nt, Human
ugacacagaauaaauugcacaa

SEQ ID NO: 1055180 - RNA, 21 nt, Human
ugacaugccuucacucugcuc

SEQ ID NO: 1055181 - RNA, 22 nt, Human
ugacugacccacaccucuccca

SEQ ID NO: 1055182 - RNA, 23 nt, Human
ugacugacccacaccucucccag

SEQ ID NO: 1055183 - RNA, 19 nt, Human
ugagagaggucagcccugu

SEQ ID NO: 1055184 - RNA, 27 nt, Human
ugaucaauuaucacuaaaaucagucac

SEQ ID NO: 1055185 - RNA, 19 nt, Human
ugcacaagagaacaaaaua

SEQ ID NO: 1055186 - RNA, 20 nt, Human
ugcuuagcuaggauguaggc

SEQ ID NO: 1055187 - RNA, 21 nt, Human
ugggaaguguuucuucuuugc

SEQ ID NO: 1055188 - RNA, 21 nt, Human
ugggcagguuaaauucaugga

SEQ ID NO: 1055189 - RNA, 24 nt, Human
uggugguggagucacagaaaggag

SEQ ID NO: 1055190 - RNA, 18 nt, Human
ugucagaggggagcagug

SEQ ID NO: 1055191 - RNA, 21 nt, Human
uuaguuguccucccaagaucc

SEQ ID NO: 1055192 - RNA, 21 nt, Human
uugcacaagagaacaaaauaa

SEQ ID NO: 1055193 - RNA, 20 nt, Human
uuuaaaaaauauaagccacc

SEQ ID NO: 1055194 - RNA, 21 nt, Human
uuuauuuuuauuucauagccu

SEQ ID NO: 1055195 - RNA, 23 nt, Human
uuugcagaaagcuuccaucuccc

SEQ ID NO: 1055196 - RNA, 24 nt, Human
agcugguccugcaguuaccauugg

SEQ ID NO: 1055197 - RNA, 21 nt, Human
ccaucugggcacugggagagg

SEQ ID NO: 1055198 - RNA, 18 nt, Human
cccaugacacugccugca

SEQ ID NO: 1055199 - RNA, 20 nt, Human
cucuucccugcagcuggucc

SEQ ID NO: 1055200 - RNA, 18 nt, Human
gcacagugcuggcacagg

SEQ ID NO: 1055201 - RNA, 21 nt, Human
ggcacugggagaggcacugcc

SEQ ID NO: 1055202 - RNA, 24 nt, Human
uaagaucagcacaguaucccacga

SEQ ID NO: 1055203 - RNA, 25 nt, Human
uaugugggcuuuucccugcacaucu

SEQ ID NO: 1055204 - RNA, 20 nt, Human
ucagacuccaacggcccaug

SEQ ID NO: 1055205 - RNA, 18 nt, Human
ugaaaguagccaucuggg

SEQ ID NO: 1055206 - RNA, 23 nt, Human
uggcacaggugauggcagucuca

SEQ ID NO: 1055207 - RNA, 19 nt, Human
agccauguaaaagcacaac

SEQ ID NO: 1055208 - RNA, 21 nt, Human
caacuaucuccggacuuccaa

SEQ ID NO: 1055209 - RNA, 23 nt, Human
cauguaaaagcacaacuaucucc

SEQ ID NO: 1055210 - RNA, 20 nt, Human
ccggacuuccaaccacaccc

SEQ ID NO: 1055211 - RNA, 22 nt, Human
cuuccaaccacacccacaaugu

SEQ ID NO: 1055212 - RNA, 23 nt, Human
cuuccaaccacacccacaauguc

SEQ ID NO: 1055213 - RNA, 20 nt, Human
gaagauacgcagucccuugu

SEQ ID NO: 1055214 - RNA, 18 nt, Human
gccugcucaaauauggaa

SEQ ID NO: 1055215 - RNA, 22 nt, Human
guagcuggauguuggaaagcca

SEQ ID NO: 1055216 - RNA, 21 nt, Human
ucuggagccccagaugcccca

SEQ ID NO: 1055217 - RNA, 20 nt, Human
ugauguggucucuguuuguc

SEQ ID NO: 1055218 - RNA, 22 nt, Human
uggagccccagaugccccaaag

SEQ ID NO: 1055219 - RNA, 25 nt, Human
accccggccgaccucaaagcgaccg

SEQ ID NO: 1055220 - RNA, 21 nt, Human
acucccgugaaccugcuccuc

SEQ ID NO: 1055221 - RNA, 19 nt, Human
agaccccggccgaccucaa

SEQ ID NO: 1055222 - RNA, 22 nt, Human
agggacccgccccccagacccc

SEQ ID NO: 1055223 - RNA, 20 nt, Human
agggcgcuggggaugcgcga

SEQ ID NO: 1055224 - RNA, 21 nt, Human
aggguguccucagcaacggug

SEQ ID NO: 1055225 - RNA, 22 nt, Human
caccggggucaccgccacagcc

SEQ ID NO: 1055226 - RNA, 23 nt, Human
cagcggucagggacccgcccccc

SEQ ID NO: 1055227 - RNA, 23 nt, Human
cagggacccgccccccagacccc

SEQ ID NO: 1055228 - RNA, 20 nt, Human
ccagacccccaggaccgcgc

SEQ ID NO: 1055229 - RNA, 20 nt, Human
ccccaggagcuccugggaac

SEQ ID NO: 1055230 - RNA, 21 nt, Human
ccccaggagcuccugggaacc

SEQ ID NO: 1055231 - RNA, 21 nt, Human
cccccagacccccaggaccgc

SEQ ID NO: 1055232 - RNA, 20 nt, Human
cccccaggaccgcgcuuccg

SEQ ID NO: 1055233 - RNA, 22 nt, Human
cccgccccccagacccccagga

SEQ ID NO: 1055234 - RNA, 18 nt, Human
cccggccgaccucaaagc

SEQ ID NO: 1055235 - RNA, 22 nt, Human
cccuccucaccggggucaccgc

SEQ ID NO: 1055236 - RNA, 20 nt, Human
ccgcaccaaagcccuccuca

SEQ ID NO: 1055237 - RNA, 20 nt, Human
ccgccccccagacccccagg

SEQ ID NO: 1055238 - RNA, 20 nt, Human
ccgggggaggaggguguccu

SEQ ID NO: 1055239 - RNA, 19 nt, Human
cgaggcccgcagggcgcug

SEQ ID NO: 1055240 - RNA, 20 nt, Human
cgcagggcgcuggggaugcg

SEQ ID NO: 1055241 - RNA, 23 nt, Human
cgccacagccggugcgaggcccg

SEQ ID NO: 1055242 - RNA, 22 nt, Human
cggccgaccucaaagcgaccgc

SEQ ID NO: 1055243 - RNA, 25 nt, Human
cggcggggcccccaggagcuccugg

SEQ ID NO: 1055244 - RNA, 20 nt, Human
gaaccgaggguccuggggcg

SEQ ID NO: 1055245 - RNA, 21 nt, Human
gacccgccccccagaccccca

SEQ ID NO: 1055246 - RNA, 18 nt, Human
gccacagccggugcgagg

SEQ ID NO: 1055247 - RNA, 24 nt, Human
gcggggcccccaggagcuccuggg

SEQ ID NO: 1055248 - RNA, 22 nt, Human
ggaccgcgcuuccgggggagga

SEQ ID NO: 1055249 - RNA, 18 nt, Human
ggcagaccccggccgacc

SEQ ID NO: 1055250 - RNA, 18 nt, Human
ggccuggggugggggcgg

SEQ ID NO: 1055251 - RNA, 18 nt, Human
gggacuggggcugcgcag

SEQ ID NO: 1055252 - RNA, 19 nt, Human
gggcagaccccggccgacc

SEQ ID NO: 1055253 - RNA, 22 nt, Human
gggugggggcggcggggccccc

SEQ ID NO: 1055254 - RNA, 19 nt, Human
ucaccgccacagccggugc

SEQ ID NO: 1055255 - RNA, 23 nt, Human
ugacccgcaccaaagcccuccuc

SEQ ID NO: 1055256 - RNA, 19 nt, Human
ugcgaggcccgcagggcgc

SEQ ID NO: 1055257 - RNA, 20 nt, Human
uggggaugcgcgaccgacuc

SEQ ID NO: 1055258 - RNA, 19 nt, Human
uggggccggcggggacugg

SEQ ID NO: 1055259 - RNA, 22 nt, Human
ugggggcggcggggcccccagg

SEQ ID NO: 1055260 - RNA, 20 nt, Human
uggggugggggcggcggggc

SEQ ID NO: 1055261 - RNA, 21 nt, Human
uggggugggggcggcggggcc

SEQ ID NO: 1055262 - RNA, 20 nt, Human
agccccgcaccccccggaac

SEQ ID NO: 1055263 - RNA, 18 nt, Human
aggauguugaaaagggga

SEQ ID NO: 1055264 - RNA, 24 nt, Human
cagccccgcaccccccggaaccag

SEQ ID NO: 1055265 - RNA, 23 nt, Human
cccccggaaccagccagacaacc

SEQ ID NO: 1055266 - RNA, 27 nt, Human
cccccggaaccagccagacaaccgcag

SEQ ID NO: 1055267 - RNA, 18 nt, Human
ccccgcaccccccggaac

SEQ ID NO: 1055268 - RNA, 19 nt, Human
ccccgcaccccccggaacc

SEQ ID NO: 1055269 - RNA, 21 nt, Human
ccccgcaccccccggaaccag

SEQ ID NO: 1055270 - RNA, 23 nt, Human
cccgcaccccccggaaccagcca

SEQ ID NO: 1055271 - RNA, 21 nt, Human
ccgcaggauguugaaaagggg

SEQ ID NO: 1055272 - RNA, 19 nt, Human
ccggcaccaggcacgucag

SEQ ID NO: 1055273 - RNA, 19 nt, Human
gccgggggggcgggcgggc

SEQ ID NO: 1055274 - RNA, 24 nt, Human
gcggcgggcaggcgggcaaaggcc

SEQ ID NO: 1055275 - RNA, 23 nt, Human
ggaaacccaacacaaacgccagu

SEQ ID NO: 1055276 - RNA, 18 nt, Human
ggaaccagccagacaacc

SEQ ID NO: 1055277 - RNA, 19 nt, Human
gggcggcgggcaggcgggc

SEQ ID NO: 1055278 - RNA, 26 nt, Human
gggggcgggcgggcgagcggcggcgg

SEQ ID NO: 1055279 - RNA, 19 nt, Human
gugcagcgcgcacuccagg

SEQ ID NO: 1055280 - RNA, 20 nt, Human
gugcagcgcgcacuccaggu

SEQ ID NO: 1055281 - RNA, 18 nt, Human
uaguaguagcgcaggccc

SEQ ID NO: 1055282 - RNA, 24 nt, Human
uccgugugcagcgcgcacuccagg

SEQ ID NO: 1055283 - RNA, 21 nt, Human
uugcggcuguaguaguagcgc

SEQ ID NO: 1055284 - RNA, 20 nt, Human
ccacaggaaauaucucuaau

SEQ ID NO: 1055285 - RNA, 21 nt, Human
aaaaauugaauauuucaugcu

SEQ ID NO: 1055286 - RNA, 23 nt, Human
aaagaaacaagucuccgguugag

SEQ ID NO: 1055287 - RNA, 23 nt, Human
aacccugguaacaaacuccccug

SEQ ID NO: 1055288 - RNA, 19 nt, Human
aagagccagagcagggagc

SEQ ID NO: 1055289 - RNA, 23 nt, Human
aagcacaagaaccacuguuccca

SEQ ID NO: 1055290 - RNA, 24 nt, Human
aagcacucaucaguauuuccauca

SEQ ID NO: 1055291 - RNA, 24 nt, Human
aagcggugacgguaguggccccgg

SEQ ID NO: 1055292 - RNA, 20 nt, Human
aauucaaaugaagcaccugg

SEQ ID NO: 1055293 - RNA, 23 nt, Human
acacagugacuagugugccaaau

SEQ ID NO: 1055294 - RNA, 20 nt, Human
acacugaugccugguaaaug

SEQ ID NO: 1055295 - RNA, 22 nt, Human
acacugaugccugguaaaugcu

SEQ ID NO: 1055296 - RNA, 25 nt, Human
acagaacagagacuugagaacaaag

SEQ ID NO: 1055297 - RNA, 24 nt, Human
acagggcucucuucgacuuucaaa

SEQ ID NO: 1055298 - RNA, 22 nt, Human
accacgccgcucagcuccucca

SEQ ID NO: 1055299 - RNA, 21 nt, Human
accguggcaaccucaggcucg

SEQ ID NO: 1055300 - RNA, 18 nt, Human
acgcugggggccaagugg

SEQ ID NO: 1055301 - RNA, 20 nt, Human
acgcuguagcgcacgaagcc

SEQ ID NO: 1055302 - RNA, 21 nt, Human
acggucgaggguguugcuggu

SEQ ID NO: 1055303 - RNA, 24 nt, Human
acucccucacuuuuggcugugauc

SEQ ID NO: 1055304 - RNA, 21 nt, Human
acuggaaacaauaaacucugg

SEQ ID NO: 1055305 - RNA, 19 nt, Human
acuggaagaacgggccugc

SEQ ID NO: 1055306 - RNA, 19 nt, Human
agaacauugaugaucucgg

SEQ ID NO: 1055307 - RNA, 19 nt, Human
agaaggacuguggucauug

SEQ ID NO: 1055308 - RNA, 21 nt, Human
agacaaaaggaaauauaauag

SEQ ID NO: 1055309 - RNA, 19 nt, Human
agacauacaccaggguucc

SEQ ID NO: 1055310 - RNA, 22 nt, Human
agagagugggggcucuccgagg

SEQ ID NO: 1055311 - RNA, 18 nt, Human
agaggaggcacucccugg

SEQ ID NO: 1055312 - RNA, 20 nt, Human
agccaggcgugaucacugcc

SEQ ID NO: 1055313 - RNA, 22 nt, Human
agcuccuagguggaucucccag

SEQ ID NO: 1055314 - RNA, 22 nt, Human
aggcagguggcagagagugggg

SEQ ID NO: 1055315 - RNA, 23 nt, Human
aggcagguggcagagaguggggg

SEQ ID NO: 1055316 - RNA, 18 nt, Human
aggcugcacgcugggggc

SEQ ID NO: 1055317 - RNA, 24 nt, Human
aggucagagcacagaaugacaagg

SEQ ID NO: 1055318 - RNA, 18 nt, Human
aggugcuucauagcucag

SEQ ID NO: 1055319 - RNA, 22 nt, Human
aguacucgaagggugaagacuu

SEQ ID NO: 1055320 - RNA, 20 nt, Human
aguccuggucaguggcaaga

SEQ ID NO: 1055321 - RNA, 18 nt, Human
agucgguagcaaaaaccu

SEQ ID NO: 1055322 - RNA, 18 nt, Human
agugcugaucgcaccgcu

SEQ ID NO: 1055323 - RNA, 21 nt, Human
auaacuggaaacaauaaacuc

SEQ ID NO: 1055324 - RNA, 20 nt, Human
aucaagcuguaggagcuggu

SEQ ID NO: 1055325 - RNA, 18 nt, Human
aucacugaugcucgucac

SEQ ID NO: 1055326 - RNA, 21 nt, Human
aucauugucauuaacaucagu

SEQ ID NO: 1055327 - RNA, 21 nt, Human
aucauuuacaucaagaacagu

SEQ ID NO: 1055328 - RNA, 19 nt, Human
auccuggaaagauggggaa

SEQ ID NO: 1055329 - RNA, 19 nt, Human
auccuguaucaagacugcu

SEQ ID NO: 1055330 - RNA, 26 nt, Human
aucuucauuuccacuaaaaauugaau

SEQ ID NO: 1055331 - RNA, 18 nt, Human
auuccugugguggaguca

SEQ ID NO: 1055332 - RNA, 21 nt, Human
auugcagggagccgagauugc

SEQ ID NO: 1055333 - RNA, 24 nt, Human
auugugguuguucuuauuucacca

SEQ ID NO: 1055334 - RNA, 21 nt, Human
caaccggggcaugcucugcaa

SEQ ID NO: 1055335 - RNA, 24 nt, Human
cacagccacacgugcaccaagagc

SEQ ID NO: 1055336 - RNA, 23 nt, Human
cacagcugaaagcacaagaacca

SEQ ID NO: 1055337 - RNA, 25 nt, Human
cacaucaucuacggugaugcucacc

SEQ ID NO: 1055338 - RNA, 19 nt, Human
caccacagcgcccagcagc

SEQ ID NO: 1055339 - RNA, 20 nt, Human
caccagaucuagaggcuccg

SEQ ID NO: 1055340 - RNA, 22 nt, Human
caccugaauauuaacaacugcc

SEQ ID NO: 1055341 - RNA, 23 nt, Human
cacguguaacuccuuuccaggga

SEQ ID NO: 1055342 - RNA, 19 nt, Human
cacucugaaaagauaauga

SEQ ID NO: 1055343 - RNA, 18 nt, Human
cacugucccauauauccc

SEQ ID NO: 1055344 - RNA, 23 nt, Human
cagaaaauacucaguuugcccau

SEQ ID NO: 1055345 - RNA, 24 nt, Human
cagaaagaagccgcuccccuccug

SEQ ID NO: 1055346 - RNA, 23 nt, Human
cagcagcacuuaucacuuucuaa

SEQ ID NO: 1055347 - RNA, 19 nt, Human
cagcgcccagcagcguggc

SEQ ID NO: 1055348 - RNA, 21 nt, Human
cagcgcccagcagcguggcgg

SEQ ID NO: 1055349 - RNA, 19 nt, Human
cagcgugagcucccgcugc

SEQ ID NO: 1055350 - RNA, 19 nt, Human
cagcuccuugggaaggcuc

SEQ ID NO: 1055351 - RNA, 28 nt, Human
cagcuccuugggaaggcucucggguaac

SEQ ID NO: 1055352 - RNA, 22 nt, Human
cagggcucucuucgacuuucaa

SEQ ID NO: 1055353 - RNA, 19 nt, Human
cagggcugccugaggaugc

SEQ ID NO: 1055354 - RNA, 22 nt, Human
caguaacugagacguaaaccgc

SEQ ID NO: 1055355 - RNA, 20 nt, Human
caguguccaaccggggcaug

SEQ ID NO: 1055356 - RNA, 22 nt, Human
caguuucuuccaacaaaucuug

SEQ ID NO: 1055357 - RNA, 22 nt, Human
cauagaguccugaaucugcauc

SEQ ID NO: 1055358 - RNA, 18 nt, Human
caucaguauuuccaucaa

SEQ ID NO: 1055359 - RNA, 20 nt, Human
caugcaagaaggugggggaa

SEQ ID NO: 1055360 - RNA, 25 nt, Human
cauucacguccuccagguccacacg

SEQ ID NO: 1055361 - RNA, 25 nt, Human
cauuucuccuccagcuccuugggaa

SEQ ID NO: 1055362 - RNA, 20 nt, Human
ccacagccacacgugcacca

SEQ ID NO: 1055363 - RNA, 22 nt, Human
ccacagcugaaagcacaagaac

SEQ ID NO: 1055364 - RNA, 22 nt, Human
ccagagcuucaacccugguaac

SEQ ID NO: 1055365 - RNA, 24 nt, Human
ccaugguggcguuucguggugggg

SEQ ID NO: 1055366 - RNA, 26 nt, Human
cccacagccacacgugcaccaagagc

SEQ ID NO: 1055367 - RNA, 19 nt, Human
cccacccgacgaggaauac

SEQ ID NO: 1055368 - RNA, 22 nt, Human
cccaugccucgaucugcagccg

SEQ ID NO: 1055369 - RNA, 24 nt, Human
cccauucaggccuucauccuuguc

SEQ ID NO: 1055370 - RNA, 23 nt, Human
ccccaaguccaggucaucagcuc

SEQ ID NO: 1055371 - RNA, 18 nt, Human
cccgaggccgcccacagc

SEQ ID NO: 1055372 - RNA, 20 nt, Human
cccguguaagggcggauucc

SEQ ID NO: 1055373 - RNA, 19 nt, Human
ccgccgcuacccgccccag

SEQ ID NO: 1055374 - RNA, 22 nt, Human
ccgccgucccaugccucgaucu

SEQ ID NO: 1055375 - RNA, 24 nt, Human
ccgcggucugucacuagcacaguc

SEQ ID NO: 1055376 - RNA, 20 nt, Human
ccgcgucgcccagugccccg

SEQ ID NO: 1055377 - RNA, 20 nt, Human
ccuccagaagaugggcucau

SEQ ID NO: 1055378 - RNA, 18 nt, Human
ccucggacacugaggccu

SEQ ID NO: 1055379 - RNA, 18 nt, Human
ccucggcgcccggcuggg

SEQ ID NO: 1055380 - RNA, 24 nt, Human
ccucggugcugcugcaggcugggg

SEQ ID NO: 1055381 - RNA, 19 nt, Human
ccugaucagaugcuguuac

SEQ ID NO: 1055382 - RNA, 19 nt, Human
ccugcaccacagcgcccag

SEQ ID NO: 1055383 - RNA, 21 nt, Human
ccugcaccacagcgcccagca

SEQ ID NO: 1055384 - RNA, 22 nt, Human
ccugcuccugucugugucucga

SEQ ID NO: 1055385 - RNA, 18 nt, Human
ccuggcuggaaugcccug

SEQ ID NO: 1055386 - RNA, 19 nt, Human
ccuggcuggaaugcccugg

SEQ ID NO: 1055387 - RNA, 22 nt, Human
ccugugccucgcgguccagagg

SEQ ID NO: 1055388 - RNA, 19 nt, Human
ccuuccuuucuucuuuugc

SEQ ID NO: 1055389 - RNA, 18 nt, Human
cgaagcuguagugguccc

SEQ ID NO: 1055390 - RNA, 20 nt, Human
cgacagaaagaagccgcucc

SEQ ID NO: 1055391 - RNA, 18 nt, Human
cgacagaccucggcgccc

SEQ ID NO: 1055392 - RNA, 19 nt, Human
cgagauugcagggagccga

SEQ ID NO: 1055393 - RNA, 23 nt, Human
cgcagcuccacgcucaggaggcc

SEQ ID NO: 1055394 - RNA, 20 nt, Human
cgcccacagccacacgugca

SEQ ID NO: 1055395 - RNA, 18 nt, Human
cgcccgcgcccaggcugc

SEQ ID NO: 1055396 - RNA, 24 nt, Human
cgccgagaucaccagaagaaaucc

SEQ ID NO: 1055397 - RNA, 21 nt, Human
cgccggggucggccgccgucc

SEQ ID NO: 1055398 - RNA, 21 nt, Human
cgccuccaucgcgggccucca

SEQ ID NO: 1055399 - RNA, 18 nt, Human
cgccuguguuugcagcau

SEQ ID NO: 1055400 - RNA, 18 nt, Human
cgcgacagaccucggcgc

SEQ ID NO: 1055401 - RNA, 20 nt, Human
cggaaugccugaggugcuuc

SEQ ID NO: 1055402 - RNA, 22 nt, Human
cggcaucggaggcgcugaccca

SEQ ID NO: 1055403 - RNA, 20 nt, Human
cggcgcccggcugggcgucc

SEQ ID NO: 1055404 - RNA, 19 nt, Human
cgggggaaagaaacacauc

SEQ ID NO: 1055405 - RNA, 20 nt, Human
cgucguccccuuccacagcc

SEQ ID NO: 1055406 - RNA, 20 nt, Human
cuaccucuccagugucagaa

SEQ ID NO: 1055407 - RNA, 23 nt, Human
cucaaagaccggcggguugucgu

SEQ ID NO: 1055408 - RNA, 25 nt, Human
cuccaaacaccuugucauggguucc

SEQ ID NO: 1055409 - RNA, 20 nt, Human
cuccacacucgcaccacgcc

SEQ ID NO: 1055410 - RNA, 23 nt, Human
cuccacacucgcaccacgccgcu

SEQ ID NO: 1055411 - RNA, 21 nt, Human
cucccgcugcucgcccgcgcc

SEQ ID NO: 1055412 - RNA, 19 nt, Human
cuccugcugcugcgcggcc

SEQ ID NO: 1055413 - RNA, 23 nt, Human
cuccugcugcugcgcggccggca

SEQ ID NO: 1055414 - RNA, 22 nt, Human
cucuccucccggggagcagaag

SEQ ID NO: 1055415 - RNA, 19 nt, Human
cugaauauuaacaacugcc

SEQ ID NO: 1055416 - RNA, 18 nt, Human
cugaaugcaaagucuguc

SEQ ID NO: 1055417 - RNA, 18 nt, Human
cugacccacaugacuaca

SEQ ID NO: 1055418 - RNA, 18 nt, Human
cugcaccgugagcacaac

SEQ ID NO: 1055419 - RNA, 18 nt, Human
cugcagaaagcagugucc

SEQ ID NO: 1055420 - RNA, 23 nt, Human
cugcagcagcacuuaucacuuuc

SEQ ID NO: 1055421 - RNA, 23 nt, Human
cugcagccggugcgccgccgccu

SEQ ID NO: 1055422 - RNA, 18 nt, Human
cugccgagcugcgccugc

SEQ ID NO: 1055423 - RNA, 19 nt, Human
cugccucacaauuuucagu

SEQ ID NO: 1055424 - RNA, 18 nt, Human
cugcucaaagaccggcgg

SEQ ID NO: 1055425 - RNA, 18 nt, Human
cugcucaaagaccggcgg

SEQ ID NO: 1055426 - RNA, 22 nt, Human
cugcugcaggcuggggcgcugc

SEQ ID NO: 1055427 - RNA, 21 nt, Human
cugguaacaaacuccccugga

SEQ ID NO: 1055428 - RNA, 23 nt, Human
cuggugccaggccugugccucgc

SEQ ID NO: 1055429 - RNA, 20 nt, Human
cuguccauucuuuccagagu

SEQ ID NO: 1055430 - RNA, 21 nt, Human
cuucaucauuuacaucaagaa

SEQ ID NO: 1055431 - RNA, 19 nt, Human
cuucgcccaucuuccgccc

SEQ ID NO: 1055432 - RNA, 20 nt, Human
cuugaaguucaucagaacug

SEQ ID NO: 1055433 - RNA, 26 nt, Human
cuugguccucggcccugagagucagc

SEQ ID NO: 1055434 - RNA, 18 nt, Human
gaaagaaauaaaaguggg

SEQ ID NO: 1055435 - RNA, 21 nt, Human
gaacagcacccccagggcucu

SEQ ID NO: 1055436 - RNA, 18 nt, Human
gaaguaggccgcgucgcc

SEQ ID NO: 1055437 - RNA, 19 nt, Human
gacaaugaagggaaucccc

SEQ ID NO: 1055438 - RNA, 19 nt, Human
gacauccucuuugacaugg

SEQ ID NO: 1055439 - RNA, 24 nt, Human
gacugucagcaccagcagggcugc

SEQ ID NO: 1055440 - RNA, 19 nt, Human
gagcagaaggagcuucccg

SEQ ID NO: 1055441 - RNA, 18 nt, Human
gagcagagaccaucaacg

SEQ ID NO: 1055442 - RNA, 20 nt, Human
gagcccgaggccgcccacag

SEQ ID NO: 1055443 - RNA, 21 nt, Human
gagcuccuagguggaucuccc

SEQ ID NO: 1055444 - RNA, 18 nt, Human
gagguuggucuucagggc

SEQ ID NO: 1055445 - RNA, 21 nt, Human
gagucaaugguaaaaagggac

SEQ ID NO: 1055446 - RNA, 22 nt, Human
gauagugcugaucgcaccgcuu

SEQ ID NO: 1055447 - RNA, 25 nt, Human
gcagaggagcccgaggccgcccaca

SEQ ID NO: 1055448 - RNA, 20 nt, Human
gcagccggugcgccgccgcc

SEQ ID NO: 1055449 - RNA, 21 nt, Human
gccaccacuuucagcuccacc

SEQ ID NO: 1055450 - RNA, 25 nt, Human
gccaugguggcguuucguggugggg

SEQ ID NO: 1055451 - RNA, 20 nt, Human
gcccgcgcccaggcugccgu

SEQ ID NO: 1055452 - RNA, 18 nt, Human
gccgcaaauaaauccagc

SEQ ID NO: 1055453 - RNA, 21 nt, Human
gccgcaaauaaauccagcccg

SEQ ID NO: 1055454 - RNA, 24 nt, Human
gccgcuacccgccccaggcacuug

SEQ ID NO: 1055455 - RNA, 19 nt, Human
gccgguguccgggugcacg

SEQ ID NO: 1055456 - RNA, 21 nt, Human
gccuccaucgcgggccuccac

SEQ ID NO: 1055457 - RNA, 21 nt, Human
gcgaaguaggccgcgucgccc

SEQ ID NO: 1055458 - RNA, 22 nt, Human
gcgcggccggcagcccggcgcg

SEQ ID NO: 1055459 - RNA, 21 nt, Human
gcggucccuggcgggcugagc

SEQ ID NO: 1055460 - RNA, 22 nt, Human
gcugacccacaugacuacagug

SEQ ID NO: 1055461 - RNA, 18 nt, Human
gcugcguccuggcgccgc

SEQ ID NO: 1055462 - RNA, 19 nt, Human
ggaaagaaacacaucaaaa

SEQ ID NO: 1055463 - RNA, 22 nt, Human
ggaauugacuccugaaucucug

SEQ ID NO: 1055464 - RNA, 28 nt, Human
ggacagguugugguuaguaacgaccucg

SEQ ID NO: 1055465 - RNA, 19 nt, Human
ggagcgcugcguccuggcg

SEQ ID NO: 1055466 - RNA, 24 nt, Human
ggagucgaggggaaagcggggcga

SEQ ID NO: 1055467 - RNA, 21 nt, Human
ggcgauggacacgcgcaccgu

SEQ ID NO: 1055468 - RNA, 23 nt, Human
ggcugugaucccuaaaggcuguu

SEQ ID NO: 1055469 - RNA, 19 nt, Human
gggaaagaaacacaucaaa

SEQ ID NO: 1055470 - RNA, 19 nt, Human
gggaaucccccaucucgua

SEQ ID NO: 1055471 - RNA, 18 nt, Human
gggcguccucgcgcaccg

SEQ ID NO: 1055472 - RNA, 23 nt, Human
gggcguggucugggauauucuaa

SEQ ID NO: 1055473 - RNA, 21 nt, Human
ggggaaagaaauaaaaguggg

SEQ ID NO: 1055474 - RNA, 18 nt, Human
ggggaaagcccugcugga

SEQ ID NO: 1055475 - RNA, 21 nt, Human
gggguggaugagaaauggauu

SEQ ID NO: 1055476 - RNA, 18 nt, Human
ggucauugaggucagcga

SEQ ID NO: 1055477 - RNA, 20 nt, Human
ggucuucagggccuacaaag

SEQ ID NO: 1055478 - RNA, 18 nt, Human
ggugacgaggagccuggc

SEQ ID NO: 1055479 - RNA, 18 nt, Human
guauuagaaagccugggc

SEQ ID NO: 1055480 - RNA, 21 nt, Human
gucccaugccucgaucugcag

SEQ ID NO: 1055481 - RNA, 20 nt, Human
gugcgccgccgccuccucuc

SEQ ID NO: 1055482 - RNA, 26 nt, Human
gugcugcugcaggcuggggcgcugcc

SEQ ID NO: 1055483 - RNA, 19 nt, Human
gugguugucauugacaucc

SEQ ID NO: 1055484 - RNA, 23 nt, Human
gugguuguccuggcuggaaugcc

SEQ ID NO: 1055485 - RNA, 18 nt, Human
guguagcccugagugcug

SEQ ID NO: 1055486 - RNA, 20 nt, Human
guucaaaaaacugccgucau

SEQ ID NO: 1055487 - RNA, 18 nt, Human
uaaaacgaugaguugaac

SEQ ID NO: 1055488 - RNA, 21 nt, Human
uaaauccagcccguguaaggg

SEQ ID NO: 1055489 - RNA, 23 nt, Human
uaacuccuuuccagggagacacu

SEQ ID NO: 1055490 - RNA, 18 nt, Human
uaacugccagcuuaauau

SEQ ID NO: 1055491 - RNA, 20 nt, Human
uaacuggaaacaauaaacuc

SEQ ID NO: 1055492 - RNA, 20 nt, Human
uaacuucugcauuauuuccu

SEQ ID NO: 1055493 - RNA, 20 nt, Human
uaacuugcagguguauuaca

SEQ ID NO: 1055494 - RNA, 18 nt, Human
uaagaaaguguacuuagg

SEQ ID NO: 1055495 - RNA, 20 nt, Human
uaagccacugucccauauau

SEQ ID NO: 1055496 - RNA, 20 nt, Human
uaaguaaauaauuccugugg

SEQ ID NO: 1055497 - RNA, 23 nt, Human
uacaggugcugcuuaaauacugg

SEQ ID NO: 1055498 - RNA, 19 nt, Human
uacagugccaggggccgcg

SEQ ID NO: 1055499 - RNA, 19 nt, Human
uacgcuggguuccagcgag

SEQ ID NO: 1055500 - RNA, 21 nt, Human
uacuuaggccuuucaaacuca

SEQ ID NO: 1055501 - RNA, 20 nt, Human
uagcucaggaauccaucaua

SEQ ID NO: 1055502 - RNA, 18 nt, Human
uaguggccccggaguccg

SEQ ID NO: 1055503 - RNA, 23 nt, Human
uauaucccagaguccuggucagu

SEQ ID NO: 1055504 - RNA, 24 nt, Human
uaucaucugcaacaauacuaaaau

SEQ ID NO: 1055505 - RNA, 19 nt, Human
uaucccagaguccugguca

SEQ ID NO: 1055506 - RNA, 18 nt, Human
uaugggaacauucuccuc

SEQ ID NO: 1055507 - RNA, 18 nt, Human
uauuacagagcuccuagg

SEQ ID NO: 1055508 - RNA, 21 nt, Human
ucaaucuuaaagugaucagaa

SEQ ID NO: 1055509 - RNA, 23 nt, Human
ucacaaugacaguugucugguuu

SEQ ID NO: 1055510 - RNA, 28 nt, Human
ucaguaacugagacguaaaccggggucc

SEQ ID NO: 1055511 - RNA, 21 nt, Human
ucagucagaaaauacucaguu

SEQ ID NO: 1055512 - RNA, 25 nt, Human
uccaaaaucacuauuugugcuguca

SEQ ID NO: 1055513 - RNA, 24 nt, Human
uccaaacaccuugucauggguucc

SEQ ID NO: 1055514 - RNA, 22 nt, Human
uccaccugcaccacagcgccca

SEQ ID NO: 1055515 - RNA, 26 nt, Human
uccagaaccuucacguguaacucccu

SEQ ID NO: 1055516 - RNA, 20 nt, Human
uccagaguccaugucaauag

SEQ ID NO: 1055517 - RNA, 21 nt, Human
uccagggagacacugggggaa

SEQ ID NO: 1055518 - RNA, 19 nt, Human
ucccaggaucauuagcagc

SEQ ID NO: 1055519 - RNA, 20 nt, Human
ucccaugccucgaucugcag

SEQ ID NO: 1055520 - RNA, 21 nt, Human
ucccuggcgggcugagcucgg

SEQ ID NO: 1055521 - RNA, 20 nt, Human
ucccuggucaguggcaauga

SEQ ID NO: 1055522 - RNA, 20 nt, Human
uccucgcgcaccgcggcgcg

SEQ ID NO: 1055523 - RNA, 23 nt, Human
uccugcagcagcacuuaucacuu

SEQ ID NO: 1055524 - RNA, 23 nt, Human
uccugggccaccacuuucagcuc

SEQ ID NO: 1055525 - RNA, 20 nt, Human
uccuucaggccucugguguc

SEQ ID NO: 1055526 - RNA, 23 nt, Human
ucgauacuaaggaagacugugcu

SEQ ID NO: 1055527 - RNA, 19 nt, Human
ucgcccgcgcccaggcugc

SEQ ID NO: 1055528 - RNA, 24 nt, Human
ucggaguccuccgacagaaagaag

SEQ ID NO: 1055529 - RNA, 19 nt, Human
ucggugagagagacucacu

SEQ ID NO: 1055530 - RNA, 23 nt, Human
ucuccagugucagaauuuaucuc

SEQ ID NO: 1055531 - RNA, 19 nt, Human
ucuccgagguccugggcca

SEQ ID NO: 1055532 - RNA, 20 nt, Human
ucucggguaacugccagcuu

SEQ ID NO: 1055533 - RNA, 24 nt, Human
ucucuugcuuucacuguuccaaug

SEQ ID NO: 1055534 - RNA, 18 nt, Human
ucugaggaguucaagggc

SEQ ID NO: 1055535 - RNA, 22 nt, Human
ucugcauuauuuccuucaucag

SEQ ID NO: 1055536 - RNA, 24 nt, Human
ucuuuacaucuucuccuuccaugu

SEQ ID NO: 1055537 - RNA, 24 nt, Human
ucuuugauugcagggagccgacca

SEQ ID NO: 1055538 - RNA, 19 nt, Human
ugaaagcacaagaaccacu

SEQ ID NO: 1055539 - RNA, 18 nt, Human
ugaaauugaauuucuccu

SEQ ID NO: 1055540 - RNA, 18 nt, Human
ugaagaaagugcuggugu

SEQ ID NO: 1055541 - RNA, 23 nt, Human
ugaagacuucuugaauuucucug

SEQ ID NO: 1055542 - RNA, 22 nt, Human
ugaagaggaggcacucccuggu

SEQ ID NO: 1055543 - RNA, 22 nt, Human
ugaagcaccuggcaugauuuca

SEQ ID NO: 1055544 - RNA, 24 nt, Human
ugaagcgcccccaccucgcauccc

SEQ ID NO: 1055545 - RNA, 19 nt, Human
ugacauccaugacuguuau

SEQ ID NO: 1055546 - RNA, 20 nt, Human
ugacuccugaaucucugucc

SEQ ID NO: 1055547 - RNA, 28 nt, Human
ugacugggucucugcaaaacuaaaaacc

SEQ ID NO: 1055548 - RNA, 22 nt, Human
ugacuguuauguugaccucggu

SEQ ID NO: 1055549 - RNA, 23 nt, Human
ugagaugcuaccugcuccugucu

SEQ ID NO: 1055550 - RNA, 22 nt, Human
ugagcauuguagaguuggcuuu

SEQ ID NO: 1055551 - RNA, 21 nt, Human
ugaggaacgcugggugguugu

SEQ ID NO: 1055552 - RNA, 21 nt, Human
ugagggguggaugagaaaugg

SEQ ID NO: 1055553 - RNA, 22 nt, Human
ugagguugaacaacugggcaga

SEQ ID NO: 1055554 - RNA, 18 nt, Human
ugauggguuaaacacagg

SEQ ID NO: 1055555 - RNA, 18 nt, Human
ugcaaaacuaaaaaccac

SEQ ID NO: 1055556 - RNA, 20 nt, Human
ugcaaaacuaaaaaccacag

SEQ ID NO: 1055557 - RNA, 23 nt, Human
ugcaccaggguguagcccugagu

SEQ ID NO: 1055558 - RNA, 24 nt, Human
ugcacgccuugguccucggcccug

SEQ ID NO: 1055559 - RNA, 21 nt, Human
ugcagccggugcgccgccgcc

SEQ ID NO: 1055560 - RNA, 19 nt, Human
ugccaggggccgcggccuc

SEQ ID NO: 1055561 - RNA, 21 nt, Human
ugccaucauccagugccagaa

SEQ ID NO: 1055562 - RNA, 23 nt, Human
ugcccagccgcgggugaauggag

SEQ ID NO: 1055563 - RNA, 24 nt, Human
ugcccaggccacagagguuggucu

SEQ ID NO: 1055564 - RNA, 24 nt, Human
ugcccagguuaugacauagauggu

SEQ ID NO: 1055565 - RNA, 23 nt, Human
ugccugaggugcuucauagcuca

SEQ ID NO: 1055566 - RNA, 21 nt, Human
ugcuccugucugugucucgcc

SEQ ID NO: 1055567 - RNA, 21 nt, Human
ugcugcaggcuggggcgcugc

SEQ ID NO: 1055568 - RNA, 25 nt, Human
ugcugcugcaggcuggggcgcugcc

SEQ ID NO: 1055569 - RNA, 19 nt, Human
ugcuguuuguuuccugcag

SEQ ID NO: 1055570 - RNA, 23 nt, Human
ugcuucagaggggagaaaagcug

SEQ ID NO: 1055571 - RNA, 18 nt, Human
ugcuucgugaacccugga

SEQ ID NO: 1055572 - RNA, 23 nt, Human
uggaauaagcucauaagccacug

SEQ ID NO: 1055573 - RNA, 21 nt, Human
uggaaugcuucuucuugguug

SEQ ID NO: 1055574 - RNA, 18 nt, Human
uggaugagaaauggauuc

SEQ ID NO: 1055575 - RNA, 21 nt, Human
uggcaaaagaugguccacacu

SEQ ID NO: 1055576 - RNA, 22 nt, Human
uggcagagagugggggcucucc

SEQ ID NO: 1055577 - RNA, 21 nt, Human
uggcauugaagacauacacca

SEQ ID NO: 1055578 - RNA, 24 nt, Human
uggcgauggaguaccggaugaguc

SEQ ID NO: 1055579 - RNA, 19 nt, Human
uggcugcgggcuggcgaug

SEQ ID NO: 1055580 - RNA, 18 nt, Human
uggcugggucucaucacu

SEQ ID NO: 1055581 - RNA, 21 nt, Human
uggcuuggacaaucaagcugu

SEQ ID NO: 1055582 - RNA, 22 nt, Human
uggcuuucagacacugaugccu

SEQ ID NO: 1055583 - RNA, 25 nt, Human
uggcuuucagacacugaugccuggu

SEQ ID NO: 1055584 - RNA, 18 nt, Human
ugggaaggcucucgggua

SEQ ID NO: 1055585 - RNA, 22 nt, Human
ugggcagaggagcccgaggccg

SEQ ID NO: 1055586 - RNA, 19 nt, Human
ugggcauuggggaaagaaa

SEQ ID NO: 1055587 - RNA, 25 nt, Human
uggggaaagaaauaaaaguggggaa

SEQ ID NO: 1055588 - RNA, 22 nt, Human
uggggaacagggcucucuucga

SEQ ID NO: 1055589 - RNA, 23 nt, Human
ugggugguugucauugacaucca

SEQ ID NO: 1055590 - RNA, 27 nt, Human
uguaaccaacauauuuacugguugacc

SEQ ID NO: 1055591 - RNA, 18 nt, Human
ugucaaagucugggauga

SEQ ID NO: 1055592 - RNA, 18 nt, Human
ugucaccuuccuuucuuc

SEQ ID NO: 1055593 - RNA, 20 nt, Human
ugucauggguuccagcaggg

SEQ ID NO: 1055594 - RNA, 22 nt, Human
uguccgggugcacguggaaguc

SEQ ID NO: 1055595 - RNA, 18 nt, Human
uguuauuaaaucuucagg

SEQ ID NO: 1055596 - RNA, 21 nt, Human
uguuggacaacauugucaauu

SEQ ID NO: 1055597 - RNA, 22 nt, Human
uuacugucaggaugacaguugg

SEQ ID NO: 1055598 - RNA, 20 nt, Human
uuagcccacccccauccuuc

SEQ ID NO: 1055599 - RNA, 23 nt, Human
uucacuguuccaaugggacuauc

SEQ ID NO: 1055600 - RNA, 23 nt, Human
uuccuuagaaagaaacaagucuc

SEQ ID NO: 1055601 - RNA, 22 nt, Human
uucuuuuucuuuuccuucaggc

SEQ ID NO: 1055602 - RNA, 18 nt, Human
uugagaguucuccugaca

SEQ ID NO: 1055603 - RNA, 19 nt, Human
uugauggguuaaacacagg

SEQ ID NO: 1055604 - RNA, 18 nt, Human
uugcagggagccgagagu

SEQ ID NO: 1055605 - RNA, 25 nt, Human
uugcagggagccgagaguuggacua

SEQ ID NO: 1055606 - RNA, 20 nt, Human
uugcagggagccgagauugc

SEQ ID NO: 1055607 - RNA, 25 nt, Human
uugccagacagaauagaauacucaa

SEQ ID NO: 1055608 - RNA, 21 nt, Human
uuguagaguuggcuuucagac

SEQ ID NO: 1055609 - RNA, 22 nt, Human
uuuacaucaagaacaguaacug

SEQ ID NO: 1055610 - RNA, 19 nt, Human
uuucccaauggcaucugac

SEQ ID NO: 1055611 - RNA, 20 nt, Human
uuuuccauuccuuccuucgu

SEQ ID NO: 1055612 - RNA, 30 nt, Human
aaaacaaauaaaagaaaaaaaaaugcaccc

SEQ ID NO: 1055613 - RNA, 21 nt, Human
aaaagaaaaaaaaaugcacca

SEQ ID NO: 1055614 - RNA, 22 nt, Human
aaaguguugggauuacaggcau

SEQ ID NO: 1055615 - RNA, 24 nt, Human
aaaguguugggauuacaggcauca

SEQ ID NO: 1055616 - RNA, 19 nt, Human
aacauggugaaaccccauc

SEQ ID NO: 1055617 - RNA, 20 nt, Human
aacauggugaaaccccaucu

SEQ ID NO: 1055618 - RNA, 21 nt, Human
aacauggugaaaccccaucuc

SEQ ID NO: 1055619 - RNA, 21 nt, Human
aacauggugaaaccccaucuc

SEQ ID NO: 1055620 - RNA, 18 nt, Human
aacguaaaacaaaggaga

SEQ ID NO: 1055621 - RNA, 25 nt, Human
aagcuaagaaauggaaacuacacaa

SEQ ID NO: 1055622 - RNA, 19 nt, Human
aaguguugggauuacaggc

SEQ ID NO: 1055623 - RNA, 21 nt, Human
aaguguugggauuacaggcau

SEQ ID NO: 1055624 - RNA, 24 nt, Human
aaucacuugaacccgggaggugga

SEQ ID NO: 1055625 - RNA, 19 nt, Human
acaaaguguugggauuaca

SEQ ID NO: 1055626 - RNA, 23 nt, Human
acaaaguguugggauuacaggca

SEQ ID NO: 1055627 - RNA, 24 nt, Human
acaaaguguugggauuacaggcau

SEQ ID NO: 1055628 - RNA, 29 nt, Human
acacaaaguucuaaauaaaacaaauaaag

SEQ ID NO: 1055629 - RNA, 20 nt, Human
acaccaggauauaucaacca

SEQ ID NO: 1055630 - RNA, 24 nt, Human
acacuagacuccagccugggugac

SEQ ID NO: 1055631 - RNA, 18 nt, Human
acagcucacuguagccuc

SEQ ID NO: 1055632 - RNA, 21 nt, Human
acaggcaucagucacuaugcc

SEQ ID NO: 1055633 - RNA, 22 nt, Human
acaggcguaugcaaccaggccu

SEQ ID NO: 1055634 - RNA, 24 nt, Human
accccaucucuacuaaaaauacaa

SEQ ID NO: 1055635 - RNA, 21 nt, Human
acuagacuccagccuggguga

SEQ ID NO: 1055636 - RNA, 24 nt, Human
acuagacuccagccugggugacag

SEQ ID NO: 1055637 - RNA, 24 nt, Human
acuauguugcccaggcuggucugg

SEQ ID NO: 1055638 - RNA, 22 nt, Human
acuccagccugggugacagagc

SEQ ID NO: 1055639 - RNA, 23 nt, Human
acuccagccugggugacagagcg

SEQ ID NO: 1055640 - RNA, 24 nt, Human
acuggaggucaggaguuugagacu

SEQ ID NO: 1055641 - RNA, 20 nt, Human
agaaauuccuuccuagaaac

SEQ ID NO: 1055642 - RNA, 22 nt, Human
agaaucacuugaacccgggagg

SEQ ID NO: 1055643 - RNA, 24 nt, Human
agcacuuugggaggccgagguggg

SEQ ID NO: 1055644 - RNA, 22 nt, Human
agccuggccaacauggugaaac

SEQ ID NO: 1055645 - RNA, 24 nt, Human
agccuggccaacauggugaaaccc

SEQ ID NO: 1055646 - RNA, 23 nt, Human
agcuauccuccugcuuuggccuc

SEQ ID NO: 1055647 - RNA, 19 nt, Human
aggaauauuuaacuacuga

SEQ ID NO: 1055648 - RNA, 19 nt, Human
aggcaaaagcuaagaaaug

SEQ ID NO: 1055649 - RNA, 24 nt, Human
aggcacaguggcucacaccuguaa

SEQ ID NO: 1055650 - RNA, 24 nt, Human
aggccagagaaucacuugaacccg

SEQ ID NO: 1055651 - RNA, 21 nt, Human
aggccgaggugggcagaucac

SEQ ID NO: 1055652 - RNA, 24 nt, Human
agguggagguugcagugagccaag

SEQ ID NO: 1055653 - RNA, 22 nt, Human
aggugggcagaucacuggaggu

SEQ ID NO: 1055654 - RNA, 26 nt, Human
aggugggcagaucacuggaggucagg

SEQ ID NO: 1055655 - RNA, 21 nt, Human
aguacaguggugcaaucacag

SEQ ID NO: 1055656 - RNA, 23 nt, Human
aguacaguggugcaaucacagcu

SEQ ID NO: 1055657 - RNA, 24 nt, Human
aguggcucacaccuguaaucccag

SEQ ID NO: 1055658 - RNA, 24 nt, Human
aucacgacacuagacuccagccug

SEQ ID NO: 1055659 - RNA, 20 nt, Human
aucacuggaggucaggaguu

SEQ ID NO: 1055660 - RNA, 24 nt, Human
aucacuggaggucaggaguuugag

SEQ ID NO: 1055661 - RNA, 20 nt, Human
auccuccugcuucagccucc

SEQ ID NO: 1055662 - RNA, 22 nt, Human
auguugcccaggcuggucugga

SEQ ID NO: 1055663 - RNA, 19 nt, Human
auuuaucacugaccuuccu

SEQ ID NO: 1055664 - RNA, 25 nt, Human
caaacuccugggcucaagcuauccu

SEQ ID NO: 1055665 - RNA, 21 nt, Human
caaaguguugggauuacaggc

SEQ ID NO: 1055666 - RNA, 22 nt, Human
caaaguguugggauuacaggca

SEQ ID NO: 1055667 - RNA, 23 nt, Human
caaaguguugggauuacaggcau

SEQ ID NO: 1055668 - RNA, 24 nt, Human
caacauggugaaaccccaucucua

SEQ ID NO: 1055669 - RNA, 22 nt, Human
caagcuauccuccugcuucagc

SEQ ID NO: 1055670 - RNA, 22 nt, Human
caagcuauccuccugcuuuggc

SEQ ID NO: 1055671 - RNA, 24 nt, Human
cacaccuguaaucccagcacuuug

SEQ ID NO: 1055672 - RNA, 24 nt, Human
cacaccuguagucccagcuacuug

SEQ ID NO: 1055673 - RNA, 23 nt, Human
caccuguaaucccagcacuuugg

SEQ ID NO: 1055674 - RNA, 24 nt, Human
caccuguaaucccagcacuuuggg

SEQ ID NO: 1055675 - RNA, 23 nt, Human
caccuguagucccagcuacuugg

SEQ ID NO: 1055676 - RNA, 24 nt, Human
caccuguagucccagcuacuuggg

SEQ ID NO: 1055677 - RNA, 23 nt, Human
cacuagacuccagccugggugac

SEQ ID NO: 1055678 - RNA, 24 nt, Human
cacuagacuccagccugggugaca

SEQ ID NO: 1055679 - RNA, 19 nt, Human
cacuauguugcccaggcug

SEQ ID NO: 1055680 - RNA, 22 nt, Human
cacuauguugcccaggcugguc

SEQ ID NO: 1055681 - RNA, 26 nt, Human
cacucugcuauuuccaaugccaccuc

SEQ ID NO: 1055682 - RNA, 23 nt, Human
cacuggaggucaggaguuugaga

SEQ ID NO: 1055683 - RNA, 24 nt, Human
cagaucacuggaggucaggaguuu

SEQ ID NO: 1055684 - RNA, 24 nt, Human
cagcacuuugggaggccgaggugg

SEQ ID NO: 1055685 - RNA, 20 nt, Human
cagccuccugaguagcuggg

SEQ ID NO: 1055686 - RNA, 24 nt, Human
caggaucucacuauguugcccagg

SEQ ID NO: 1055687 - RNA, 24 nt, Human
ccaccuccucccaaacguaaaaca

SEQ ID NO: 1055688 - RNA, 21 nt, Human
cccgggagguggagguugcag

SEQ ID NO: 1055689 - RNA, 18 nt, Human
ccgcgaagcacucugcua

SEQ ID NO: 1055690 - RNA, 24 nt, Human
ccuccugcuucagccuccugagua

SEQ ID NO: 1055691 - RNA, 25 nt, Human
ccuccugcuuuggccucccaacaaa

SEQ ID NO: 1055692 - RNA, 18 nt, Human
ccugccugugcccuucuu

SEQ ID NO: 1055693 - RNA, 18 nt, Human
ccugccugugcccuucuu

SEQ ID NO: 1055694 - RNA, 23 nt, Human
ccuggccaacauggugaaacccc

SEQ ID NO: 1055695 - RNA, 24 nt, Human
ccuggccaacauggugaaacccca

SEQ ID NO: 1055696 - RNA, 20 nt, Human
ccuggccucaagcuauccuc

SEQ ID NO: 1055697 - RNA, 20 nt, Human
ccugggcucaagcuauccuc

SEQ ID NO: 1055698 - RNA, 23 nt, Human
ccugggcucaagcuauccuccug

SEQ ID NO: 1055699 - RNA, 20 nt, Human
ccugggugacagagcgagac

SEQ ID NO: 1055700 - RNA, 21 nt, Human
ccuguagucccagcuacuugg

SEQ ID NO: 1055701 - RNA, 18 nt, Human
ccugugcccuucuugaag

SEQ ID NO: 1055702 - RNA, 24 nt, Human
cgaggugggcagaucacuggaggu

SEQ ID NO: 1055703 - RNA, 26 nt, Human
cgaggugggcagaucacuggagguca

SEQ ID NO: 1055704 - RNA, 29 nt, Human
cgggagguggagguugcagugacaacggu

SEQ ID NO: 1055705 - RNA, 24 nt, Human
cgggagguggagguugcagugagc

SEQ ID NO: 1055706 - RNA, 19 nt, Human
cuagagugaaggccucuuc

SEQ ID NO: 1055707 - RNA, 18 nt, Human
cucaagcuauccuccugc

SEQ ID NO: 1055708 - RNA, 21 nt, Human
cucaagcuauccuccugcuuc

SEQ ID NO: 1055709 - RNA, 22 nt, Human
cucacaccuguaaucccagcac

SEQ ID NO: 1055710 - RNA, 24 nt, Human
cucacaccuguaaucccagcacuu

SEQ ID NO: 1055711 - RNA, 24 nt, Human
cucacuguagccucaaacuccugg

SEQ ID NO: 1055712 - RNA, 23 nt, Human
cugcuucagccuccugaguagcu

SEQ ID NO: 1055713 - RNA, 23 nt, Human
cuggccaacauggugaaacccca

SEQ ID NO: 1055714 - RNA, 22 nt, Human
cuucagcaaacaccugcuggac

SEQ ID NO: 1055715 - RNA, 21 nt, Human
cuugaacccgggagguggagg

SEQ ID NO: 1055716 - RNA, 23 nt, Human
cuuugggaggccgaggugggcag

SEQ ID NO: 1055717 - RNA, 21 nt, Human
gaaaauuuaucacugaccuuc

SEQ ID NO: 1055718 - RNA, 19 nt, Human
gaagcacacuuuaagaaca

SEQ ID NO: 1055719 - RNA, 22 nt, Human
gacuccagccugggugacagag

SEQ ID NO: 1055720 - RNA, 23 nt, Human
gacuccagccugggugacagagc

SEQ ID NO: 1055721 - RNA, 23 nt, Human
gagacuagccuggccaacauggu

SEQ ID NO: 1055722 - RNA, 19 nt, Human
gaggucaggaguuugagac

SEQ ID NO: 1055723 - RNA, 18 nt, Human
gagguugcagugagccaa

SEQ ID NO: 1055724 - RNA, 22 nt, Human
gagguugcagugagccaagauc

SEQ ID NO: 1055725 - RNA, 24 nt, Human
gaucacuggaggucaggaguuuga

SEQ ID NO: 1055726 - RNA, 19 nt, Human
gauuacaggcaucagucac

SEQ ID NO: 1055727 - RNA, 21 nt, Human
gauuacaggcaucagucacua

SEQ ID NO: 1055728 - RNA, 24 nt, Human
gccaacauggugaaaccccaucuc

SEQ ID NO: 1055729 - RNA, 24 nt, Human
gccaccuccucccaaacguaaaac

SEQ ID NO: 1055730 - RNA, 20 nt, Human
gccuaccaacaaaaacaaaa

SEQ ID NO: 1055731 - RNA, 21 nt, Human
gcgaagcacucugcuauuucc

SEQ ID NO: 1055732 - RNA, 21 nt, Human
gcgagacgccuaccaacaaaa

SEQ ID NO: 1055733 - RNA, 23 nt, Human
gcuggucuggaacuccuggccuc

SEQ ID NO: 1055734 - RNA, 20 nt, Human
ggagguugcagugagccaag

SEQ ID NO: 1055735 - RNA, 24 nt, Human
ggagguugcagugagccaagauca

SEQ ID NO: 1055736 - RNA, 24 nt, Human
ggauuacaggcaucagucacuaug

SEQ ID NO: 1055737 - RNA, 25 nt, Human
ggcagaucacuggaggucaggaguu

SEQ ID NO: 1055738 - RNA, 21 nt, Human
ggccaggcacaguggcucaca

SEQ ID NO: 1055739 - RNA, 22 nt, Human
ggcguggugacacacaccugua

SEQ ID NO: 1055740 - RNA, 24 nt, Human
ggcuggucuggaacuccuggccuc

SEQ ID NO: 1055741 - RNA, 19 nt, Human
gggcucaagcuauccuccu

SEQ ID NO: 1055742 - RNA, 24 nt, Human
ggugacacacaccuguagucccag

SEQ ID NO: 1055743 - RNA, 20 nt, Human
guuaaucugcuucauccugu

SEQ ID NO: 1055744 - RNA, 21 nt, Human
uaaaaagaaaacaaaaaucac

SEQ ID NO: 1055745 - RNA, 23 nt, Human
uaaaaagaaaacaaaaaucacaa

SEQ ID NO: 1055746 - RNA, 18 nt, Human
uaaaacaaaggagaaacu

SEQ ID NO: 1055747 - RNA, 22 nt, Human
uaaaacaaauaaaagaaaaaaa

SEQ ID NO: 1055748 - RNA, 22 nt, Human
uaagcugucuucagcaaacacc

SEQ ID NO: 1055749 - RNA, 21 nt, Human
uacaccaggauauaucaacca

SEQ ID NO: 1055750 - RNA, 22 nt, Human
uacaggcaucagucacuaugcc

SEQ ID NO: 1055751 - RNA, 22 nt, Human
uagagacaggaucucacuaugu

SEQ ID NO: 1055752 - RNA, 22 nt, Human
uagagugaaggccucuucuguu

SEQ ID NO: 1055753 - RNA, 24 nt, Human
uagccuggccaacauggugaaacc

SEQ ID NO: 1055754 - RNA, 19 nt, Human
uaggagcaucuuaguaacu

SEQ ID NO: 1055755 - RNA, 19 nt, Human
uauguugcccaggcugguc

SEQ ID NO: 1055756 - RNA, 20 nt, Human
uauguugcccaggcuggucu

SEQ ID NO: 1055757 - RNA, 22 nt, Human
uauguugcccaggcuggucugg

SEQ ID NO: 1055758 - RNA, 23 nt, Human
uauguugcccaggcuggucugga

SEQ ID NO: 1055759 - RNA, 24 nt, Human
uauguugcccaggcuggucuggaa

SEQ ID NO: 1055760 - RNA, 24 nt, Human
ucacuguagccucaaacuccuggg

SEQ ID NO: 1055761 - RNA, 24 nt, Human
ucacuugaacccgggagguggagg

SEQ ID NO: 1055762 - RNA, 21 nt, Human
ucagcaaacaccugcuggacu

SEQ ID NO: 1055763 - RNA, 20 nt, Human
ucagccuccugaguagcugg

SEQ ID NO: 1055764 - RNA, 22 nt, Human
uccaacagauaauauauugaag

SEQ ID NO: 1055765 - RNA, 23 nt, Human
uccagccugggugacagagcgag

SEQ ID NO: 1055766 - RNA, 24 nt, Human
uccagccugggugacagagcgaga

SEQ ID NO: 1055767 - RNA, 20 nt, Human
uccucccaaacguaaaacaa

SEQ ID NO: 1055768 - RNA, 23 nt, Human
uccuccugcuuuggccucccaac

SEQ ID NO: 1055769 - RNA, 24 nt, Human
uccuccugcuuuggccucccaaca

SEQ ID NO: 1055770 - RNA, 24 nt, Human
uccugaguagcugggaacacaggc

SEQ ID NO: 1055771 - RNA, 22 nt, Human
uccugggcucaagcuauccucc

SEQ ID NO: 1055772 - RNA, 22 nt, Human
uccugggcucaagcuauccucc

SEQ ID NO: 1055773 - RNA, 24 nt, Human
uccugggcucaagcuauccuccug

SEQ ID NO: 1055774 - RNA, 19 nt, Human
ucucacuauguugcccagg

SEQ ID NO: 1055775 - RNA, 23 nt, Human
ucucacuauguugcccaggcugg

SEQ ID NO: 1055776 - RNA, 24 nt, Human
ucucacuauguugcccaggcuggu

SEQ ID NO: 1055777 - RNA, 26 nt, Human
ucucacuauguugcccaggcuggucu

SEQ ID NO: 1055778 - RNA, 27 nt, Human
ucucacuauguugcccaggcuggucug

SEQ ID NO: 1055779 - RNA, 21 nt, Human
ucucuacuaaaaauacaaaaa

SEQ ID NO: 1055780 - RNA, 20 nt, Human
ugaaaauaagucuuauaucc

SEQ ID NO: 1055781 - RNA, 19 nt, Human
ugaaaccccaucucuacua

SEQ ID NO: 1055782 - RNA, 23 nt, Human
ugagacuagccuggccaacaugg

SEQ ID NO: 1055783 - RNA, 20 nt, Human
ugaggccagagaaucacuug

SEQ ID NO: 1055784 - RNA, 24 nt, Human
ugaggccagagaaucacuugaacc

SEQ ID NO: 1055785 - RNA, 23 nt, Human
ugaucugaguaagcugucuucag

SEQ ID NO: 1055786 - RNA, 24 nt, Human
ugcccaggcuggucuggaacuccu

SEQ ID NO: 1055787 - RNA, 24 nt, Human
ugcuucagccuccugaguagcugg

SEQ ID NO: 1055788 - RNA, 20 nt, Human
ugcuuuggccucccaacaaa

SEQ ID NO: 1055789 - RNA, 21 nt, Human
uggaagcacacuuuaagaaca

SEQ ID NO: 1055790 - RNA, 26 nt, Human
uggaagcacacuuuaagaacacacaa

SEQ ID NO: 1055791 - RNA, 19 nt, Human
uggaguacaguggugcaau

SEQ ID NO: 1055792 - RNA, 24 nt, Human
uggccaacauggugaaaccccauc

SEQ ID NO: 1055793 - RNA, 20 nt, Human
uggccucaagcuauccuccu

SEQ ID NO: 1055794 - RNA, 21 nt, Human
uggccucaagcuauccuccug

SEQ ID NO: 1055795 - RNA, 24 nt, Human
uggccucaagcuauccuccugcuu

SEQ ID NO: 1055796 - RNA, 21 nt, Human
uggcucacaccuguaauccca

SEQ ID NO: 1055797 - RNA, 24 nt, Human
uggcucacaccuguaaucccagca

SEQ ID NO: 1055798 - RNA, 24 nt, Human
ugggaacacaggcguaugcaacca

SEQ ID NO: 1055799 - RNA, 19 nt, Human
ugggaggccgaggugggca

SEQ ID NO: 1055800 - RNA, 20 nt, Human
ugggaggccgaggugggcag

SEQ ID NO: 1055801 - RNA, 24 nt, Human
ugggaggccgaggugggcagauca

SEQ ID NO: 1055802 - RNA, 24 nt, Human
ugggaggcugaggccagagaauca

SEQ ID NO: 1055803 - RNA, 18 nt, Human
ugggauuacaggcaucag

SEQ ID NO: 1055804 - RNA, 21 nt, Human
ugggauuacaggcaucaguca

SEQ ID NO: 1055805 - RNA, 22 nt, Human
ugggauuacaggcaucagucac

SEQ ID NO: 1055806 - RNA, 22 nt, Human
ugggauuacaggcaucagucac

SEQ ID NO: 1055807 - RNA, 24 nt, Human
ugggauuacaggcaucagucacua

SEQ ID NO: 1055808 - RNA, 24 nt, Human
ugggcagaucacuggaggucagga

SEQ ID NO: 1055809 - RNA, 24 nt, Human
ugggcucaagcuauccuccugcuu

SEQ ID NO: 1055810 - RNA, 23 nt, Human
uggugacacacaccuguaguccc

SEQ ID NO: 1055811 - RNA, 24 nt, Human
uggugacacacaccuguaguccca

SEQ ID NO: 1055812 - RNA, 24 nt, Human
uggugcaaucacagcucacuguag

SEQ ID NO: 1055813 - RNA, 23 nt, Human
ugucacugaucacucuucuguua

SEQ ID NO: 1055814 - RNA, 21 nt, Human
uguucuguucacacaggcucc

SEQ ID NO: 1055815 - RNA, 19 nt, Human
uguugcccaggcuggucug

SEQ ID NO: 1055816 - RNA, 20 nt, Human
uuagccgggcguggugacac

SEQ ID NO: 1055817 - RNA, 21 nt, Human
uucagcaaacaccugcuggac

SEQ ID NO: 1055818 - RNA, 20 nt, Human
uuccaaugccaccuccuccc

SEQ ID NO: 1055819 - RNA, 24 nt, Human
uugaacccgggagguggagguugc

SEQ ID NO: 1055820 - RNA, 20 nt, Human
uugcagugagccaagaucac

SEQ ID NO: 1055821 - RNA, 25 nt, Human
uugggaggccgaggugggcagauca

SEQ ID NO: 1055822 - RNA, 25 nt, Human
uugggaggcugaggccagagaauca

SEQ ID NO: 1055823 - RNA, 24 nt, Human
uuguagagacaggaucucacuaug

SEQ ID NO: 1055824 - RNA, 20 nt, Human
uuuccaaugccaccuccucc

SEQ ID NO: 1055825 - RNA, 21 nt, Human
uuuggccucccaacaaagugu

SEQ ID NO: 1055826 - RNA, 18 nt, Human
uuuuuuuguagagacagg

SEQ ID NO: 1055827 - RNA, 21 nt, Human
aacauacugagcuggaagcac

SEQ ID NO: 1055828 - RNA, 18 nt, Human
aagcagauuuaacuaaga

SEQ ID NO: 1055829 - RNA, 21 nt, Human
auacugagcuggaagcacugc

SEQ ID NO: 1055830 - RNA, 25 nt, Human
caagugucccugcaccuuaaauuuu

SEQ ID NO: 1055831 - RNA, 19 nt, Human
cacccuuugcuaugacguc

SEQ ID NO: 1055832 - RNA, 20 nt, Human
ccaguaaagguagaguugcu

SEQ ID NO: 1055833 - RNA, 23 nt, Human
cuaauuuccucauuuaaaauuuc

SEQ ID NO: 1055834 - RNA, 21 nt, Human
cucauagcauucacaguaguu

SEQ ID NO: 1055835 - RNA, 19 nt, Human
cucccuccuuuccuuuccc

SEQ ID NO: 1055836 - RNA, 19 nt, Human
cuuccagaaaaucaagugu

SEQ ID NO: 1055837 - RNA, 20 nt, Human
gcuuucggggccgacuggcc

SEQ ID NO: 1055838 - RNA, 21 nt, Human
uaaaggcuucuggauuucugu

SEQ ID NO: 1055839 - RNA, 22 nt, Human
uaagcagauuuaacuaagauuu

SEQ ID NO: 1055840 - RNA, 25 nt, Human
uacaauuacagggcuuucggggccc

SEQ ID NO: 1055841 - RNA, 23 nt, Human
uacaauugcaguuguugcaaaau

SEQ ID NO: 1055842 - RNA, 20 nt, Human
uacagggcuuucggggccga

SEQ ID NO: 1055843 - RNA, 21 nt, Human
uaccagauguuccaguaaagg

SEQ ID NO: 1055844 - RNA, 23 nt, Human
uaggcuuaaaggcuucuggauuu

SEQ ID NO: 1055845 - RNA, 21 nt, Human
uaucagucuuuugugcaagag

SEQ ID NO: 1055846 - RNA, 19 nt, Human
uauugcuuuuugccuuuca

SEQ ID NO: 1055847 - RNA, 23 nt, Human
uccuuuccuuucccuaucuuagg

SEQ ID NO: 1055848 - RNA, 20 nt, Human
ucucccuccuuuccuuuccc

SEQ ID NO: 1055849 - RNA, 25 nt, Human
ucucuuguuuuucuuccagaaaauc

SEQ ID NO: 1055850 - RNA, 23 nt, Human
ugagcuggaagcacugcauaacc

SEQ ID NO: 1055851 - RNA, 19 nt, Human
ugauacauaugaagacugc

SEQ ID NO: 1055852 - RNA, 19 nt, Human
uggaagccgugccuggguc

SEQ ID NO: 1055853 - RNA, 23 nt, Human
uuaaaauguacuaauuuccucau

SEQ ID NO: 1055854 - RNA, 21 nt, Human
uucacaguaguuuuuaagaca

SEQ ID NO: 1055855 - RNA, 22 nt, Human
uuccaguaaagguagaguugcu

SEQ ID NO: 1055856 - RNA, 22 nt, Human
aaaauucaacucauacuucaga

SEQ ID NO: 1055857 - RNA, 23 nt, Human
aaacagcaaguggccaggcaggg

SEQ ID NO: 1055858 - RNA, 24 nt, Human
aaacuaacauuuacccagguuaca

SEQ ID NO: 1055859 - RNA, 19 nt, Human
aaagcaagccaaccaauaa

SEQ ID NO: 1055860 - RNA, 20 nt, Human
aaagggaacauugagucuuc

SEQ ID NO: 1055861 - RNA, 25 nt, Human
aacacuugaauuuuccaggaaugug

SEQ ID NO: 1055862 - RNA, 23 nt, Human
aaccaaacugggcacucucaaaa

SEQ ID NO: 1055863 - RNA, 19 nt, Human
aagcaagcugaugaccagg

SEQ ID NO: 1055864 - RNA, 21 nt, Human
aagcagcuguuuccacgcacu

SEQ ID NO: 1055865 - RNA, 20 nt, Human
aaugcaauauaucuaaaguu

SEQ ID NO: 1055866 - RNA, 20 nt, Human
acagugaagaagucaaggga

SEQ ID NO: 1055867 - RNA, 18 nt, Human
acccuaugauaaaaccaa

SEQ ID NO: 1055868 - RNA, 23 nt, Human
accuccucacccuaugauaaaac

SEQ ID NO: 1055869 - RNA, 23 nt, Human
accuggccggguucgggaagcca

SEQ ID NO: 1055870 - RNA, 23 nt, Human
acuaacaugagcuccccaaccug

SEQ ID NO: 1055871 - RNA, 24 nt, Human
acugggucaaaggagcaggucugg

SEQ ID NO: 1055872 - RNA, 23 nt, Human
agaaacuuuuauauauaacacau

SEQ ID NO: 1055873 - RNA, 25 nt, Human
agaaagaacauuacuuauugcaaga

SEQ ID NO: 1055874 - RNA, 18 nt, Human
agaaggaaagcauuuuau

SEQ ID NO: 1055875 - RNA, 22 nt, Human
agaagugaaguaacuugcucag

SEQ ID NO: 1055876 - RNA, 21 nt, Human
agacacagaagacagauggcg

SEQ ID NO: 1055877 - RNA, 23 nt, Human
agauauuagugaagaccuuucaa

SEQ ID NO: 1055878 - RNA, 23 nt, Human
aggggcaggcacugaagaggucc

SEQ ID NO: 1055879 - RNA, 20 nt, Human
aggguagaaagcaaauaaac

SEQ ID NO: 1055880 - RNA, 24 nt, Human
aggugcugguucuggcacuaagcu

SEQ ID NO: 1055881 - RNA, 20 nt, Human
agugaagaccuuucaacgua

SEQ ID NO: 1055882 - RNA, 18 nt, Human
auggugccccuaguuuuu

SEQ ID NO: 1055883 - RNA, 22 nt, Human
auuaucuucuacacuuagccuu

SEQ ID NO: 1055884 - RNA, 23 nt, Human
caaacugggcacucucaaaauca

SEQ ID NO: 1055885 - RNA, 24 nt, Human
caaagcaagcugaugaccagguca

SEQ ID NO: 1055886 - RNA, 21 nt, Human
caaaugcgccaagccaaaaca

SEQ ID NO: 1055887 - RNA, 25 nt, Human
caacuaaaccaaacugggcacucuc

SEQ ID NO: 1055888 - RNA, 27 nt, Human
caacuaaaccaaacugggcacucucaa

SEQ ID NO: 1055889 - RNA, 18 nt, Human
cacacaguucccauaaaa

SEQ ID NO: 1055890 - RNA, 19 nt, Human
caccugaaaagcaucaggu

SEQ ID NO: 1055891 - RNA, 22 nt, Human
cacuauuccucucggccccacg

SEQ ID NO: 1055892 - RNA, 19 nt, Human
cacugcauugcuucaaagu

SEQ ID NO: 1055893 - RNA, 20 nt, Human
cagaacggaaaagcaagcca

SEQ ID NO: 1055894 - RNA, 25 nt, Human
cagaacggaaaagcaagccaaccaa

SEQ ID NO: 1055895 - RNA, 25 nt, Human
cagaacggaaaagcaagccaaccaa

SEQ ID NO: 1055896 - RNA, 21 nt, Human
cagcaugguagaugcuuucca

SEQ ID NO: 1055897 - RNA, 19 nt, Human
cagccgccugagcccggcc

SEQ ID NO: 1055898 - RNA, 22 nt, Human
cagcucaaauuagaaacugaag

SEQ ID NO: 1055899 - RNA, 23 nt, Human
ccaaccuccucacccuaugauaa

SEQ ID NO: 1055900 - RNA, 29 nt, Human
ccaaccuccucacccuaugauaaaaccaa

SEQ ID NO: 1055901 - RNA, 20 nt, Human
ccaucugcaaacuaaaauga

SEQ ID NO: 1055902 - RNA, 19 nt, Human
ccccagcagccgccugagc

SEQ ID NO: 1055903 - RNA, 23 nt, Human
ccgccgcgccucauccgccgucc

SEQ ID NO: 1055904 - RNA, 23 nt, Human
cgccgucccgcgcggucuccugg

SEQ ID NO: 1055905 - RNA, 18 nt, Human
cggaaaagcaagccaacc

SEQ ID NO: 1055906 - RNA, 19 nt, Human
gaaaguagauguuugugag

SEQ ID NO: 1055907 - RNA, 24 nt, Human
gaaauucucucaacuaaguagcuu

SEQ ID NO: 1055908 - RNA, 18 nt, Human
gaacaaggaaauucucuc

SEQ ID NO: 1055909 - RNA, 21 nt, Human
gaagaggucccucaaaccucc

SEQ ID NO: 1055910 - RNA, 22 nt, Human
gauccaucugcaaacuaaaaug

SEQ ID NO: 1055911 - RNA, 24 nt, Human
gccgccgcgccucauccgccgucc

SEQ ID NO: 1055912 - RNA, 24 nt, Human
gggcucagagcgcggcagguguuu

SEQ ID NO: 1055913 - RNA, 18 nt, Human
ggggaggugcccugggcc

SEQ ID NO: 1055914 - RNA, 18 nt, Human
guauaugugcuuggcucc

SEQ ID NO: 1055915 - RNA, 19 nt, Human
gucugaggcagacacagaa

SEQ ID NO: 1055916 - RNA, 19 nt, Human
uaacacaugcauuaaaaca

SEQ ID NO: 1055917 - RNA, 20 nt, Human
uaagccgaaaaucuagaaac

SEQ ID NO: 1055918 - RNA, 20 nt, Human
uaagccgaaaaucuagaaac

SEQ ID NO: 1055919 - RNA, 23 nt, Human
uaagccgaaaaucuagaaacuaa

SEQ ID NO: 1055920 - RNA, 22 nt, Human
uacaaaugcgccaagccaaaac

SEQ ID NO: 1055921 - RNA, 27 nt, Human
uagaaagcaaauaaacugagcuaccug

SEQ ID NO: 1055922 - RNA, 20 nt, Human
uagaacaggugaagagcaug

SEQ ID NO: 1055923 - RNA, 21 nt, Human
uagaaugcaauauaucuaaag

SEQ ID NO: 1055924 - RNA, 22 nt, Human
uagaugcuuuccacuucaguuc

SEQ ID NO: 1055925 - RNA, 19 nt, Human
uagauguuugugaggcaug

SEQ ID NO: 1055926 - RNA, 19 nt, Human
uauaaaagggaacauugag

SEQ ID NO: 1055927 - RNA, 23 nt, Human
uauauaacacaugcauuaaaaca

SEQ ID NO: 1055928 - RNA, 23 nt, Human
uaugcaaagagggcaaaaaauuc

SEQ ID NO: 1055929 - RNA, 22 nt, Human
ucaaagugaugacuaauguaaa

SEQ ID NO: 1055930 - RNA, 22 nt, Human
ucacccuaugauaaaaccaagg

SEQ ID NO: 1055931 - RNA, 22 nt, Human
ucaccugaaaagcaucaggugc

SEQ ID NO: 1055932 - RNA, 21 nt, Human
ucagaacggaaaagcaagcca

SEQ ID NO: 1055933 - RNA, 19 nt, Human
ucagagaagugaaguaacu

SEQ ID NO: 1055934 - RNA, 24 nt, Human
uccaaccuccucacccuaugauaa

SEQ ID NO: 1055935 - RNA, 24 nt, Human
uccacgcacugggucaaaggagca

SEQ ID NO: 1055936 - RNA, 21 nt, Human
uccaucugcaaacuaaaauga

SEQ ID NO: 1055937 - RNA, 27 nt, Human
uccuuccagcacacugcauugcuucaa

SEQ ID NO: 1055938 - RNA, 23 nt, Human
ucgaaugaauaugauccuaaaug

SEQ ID NO: 1055939 - RNA, 20 nt, Human
ucuucuacacuuagccuuaa

SEQ ID NO: 1055940 - RNA, 21 nt, Human
ugaaaaaaaggcagaaagaac

SEQ ID NO: 1055941 - RNA, 23 nt, Human
ugaaaaaaaggcagaaagaacau

SEQ ID NO: 1055942 - RNA, 20 nt, Human
ugacuuaaaagugaaaaaaa

SEQ ID NO: 1055943 - RNA, 21 nt, Human
ugacuuaaaagugaaaaaaag

SEQ ID NO: 1055944 - RNA, 20 nt, Human
ugagauggaaaucuugaacc

SEQ ID NO: 1055945 - RNA, 18 nt, Human
ugaggcagacacagaaga

SEQ ID NO: 1055946 - RNA, 24 nt, Human
ugaggcagacacagaagacagaug

SEQ ID NO: 1055947 - RNA, 24 nt, Human
ugauaaaaccaaggcucagagaag

SEQ ID NO: 1055948 - RNA, 18 nt, Human
ugcccaccacuucagaaa

SEQ ID NO: 1055949 - RNA, 20 nt, Human
ugcuccuuccagcacacugg

SEQ ID NO: 1055950 - RNA, 23 nt, Human
ugcuuuccacuucaguucacaca

SEQ ID NO: 1055951 - RNA, 21 nt, Human
uggauucuuuccaaaaauuuu

SEQ ID NO: 1055952 - RNA, 24 nt, Human
uggccaggcaggguagaaagcaaa

SEQ ID NO: 1055953 - RNA, 18 nt, Human
uggccggguucgggaagc

SEQ ID NO: 1055954 - RNA, 21 nt, Human
uggccggguucgggaagccag

SEQ ID NO: 1055955 - RNA, 24 nt, Human
uggggggcucagagcgcggcaggu

SEQ ID NO: 1055956 - RNA, 19 nt, Human
uggggugauauggcgggaa

SEQ ID NO: 1055957 - RNA, 18 nt, Human
uggucagacagaguucaa

SEQ ID NO: 1055958 - RNA, 19 nt, Human
ugguuauacccaagcuuuu

SEQ ID NO: 1055959 - RNA, 23 nt, Human
ugugccuuuuuccaaaucaguau

SEQ ID NO: 1055960 - RNA, 20 nt, Human
uuauauauaacacaugcauu

SEQ ID NO: 1055961 - RNA, 18 nt, Human
uucaccugaaaagcauca

SEQ ID NO: 1055962 - RNA, 23 nt, Human
uugcucagugccacaaagcaagc

SEQ ID NO: 1055963 - RNA, 21 nt, Human
uuugacagugaagaagucaaa

SEQ ID NO: 1055964 - RNA, 23 nt, Human
uuuuauuuucaccugaaaagcau

SEQ ID NO: 1055965 - RNA, 20 nt, Human
aaaaaaaaauacacugaaaa

SEQ ID NO: 1055966 - RNA, 30 nt, Human
aaaagcaauaaaaacacaauaucguacaaa

SEQ ID NO: 1055967 - RNA, 23 nt, Human
aaacaccuuuucaaacaacuugc

SEQ ID NO: 1055968 - RNA, 25 nt, Human
aaacagccagcacaugauuugaaac

SEQ ID NO: 1055969 - RNA, 22 nt, Human
aaguuauauuuaaccugggagc

SEQ ID NO: 1055970 - RNA, 19 nt, Human
aaugagaagacacuaagaa

SEQ ID NO: 1055971 - RNA, 20 nt, Human
acaauaucguacaaagucuu

SEQ ID NO: 1055972 - RNA, 23 nt, Human
accagcccggccccuccugucac

SEQ ID NO: 1055973 - RNA, 19 nt, Human
acugccccaauuucugaaa

SEQ ID NO: 1055974 - RNA, 21 nt, Human
agcuuguuucauacuuuuucu

SEQ ID NO: 1055975 - RNA, 24 nt, Human
aucugauuuuuuuccugaaaacaa

SEQ ID NO: 1055976 - RNA, 22 nt, Human
aucuuuacugauuuucaucaca

SEQ ID NO: 1055977 - RNA, 24 nt, Human
augaaagaacuauaaaauuauaaa

SEQ ID NO: 1055978 - RNA, 21 nt, Human
cacaauaucguacaaagucuu

SEQ ID NO: 1055979 - RNA, 18 nt, Human
cacaguagugaaacaaga

SEQ ID NO: 1055980 - RNA, 19 nt, Human
cagagguuuagaaauaaga

SEQ ID NO: 1055981 - RNA, 21 nt, Human
cagccaacuccuaccgccccg

SEQ ID NO: 1055982 - RNA, 23 nt, Human
cauauauggcuaccaaaugucaa

SEQ ID NO: 1055983 - RNA, 21 nt, Human
ccaaagauacaaaugccugac

SEQ ID NO: 1055984 - RNA, 20 nt, Human
ccacgccgcgacgcaccagg

SEQ ID NO: 1055985 - RNA, 20 nt, Human
ccccccuuuccuuuauaauc

SEQ ID NO: 1055986 - RNA, 21 nt, Human
ccccccuuuccuuuauaaucu

SEQ ID NO: 1055987 - RNA, 21 nt, Human
ccccgccggccugggcgccug

SEQ ID NO: 1055988 - RNA, 18 nt, Human
ccccggacagccgccgga

SEQ ID NO: 1055989 - RNA, 23 nt, Human
ccccggacagccgccggaggacc

SEQ ID NO: 1055990 - RNA, 20 nt, Human
ccgcacccgccgcugacagg

SEQ ID NO: 1055991 - RNA, 20 nt, Human
ccgccgcccgaaggcugccc

SEQ ID NO: 1055992 - RNA, 21 nt, Human
ccgccgcccgaaggcugcccu

SEQ ID NO: 1055993 - RNA, 18 nt, Human
ccuaccgccccggacagc

SEQ ID NO: 1055994 - RNA, 22 nt, Human
ccucacaauucuauugugcacu

SEQ ID NO: 1055995 - RNA, 21 nt, Human
ccugaaaacaacaguaaaaua

SEQ ID NO: 1055996 - RNA, 22 nt, Human
cgcagccaacuccuaccgcccc

SEQ ID NO: 1055997 - RNA, 23 nt, Human
cuaauaaaaacaccuuuucaaac

SEQ ID NO: 1055998 - RNA, 19 nt, Human
cucgcccaacccccggccg

SEQ ID NO: 1055999 - RNA, 23 nt, Human
cugaaaacaacaguaaaauacaa

SEQ ID NO: 1056000 - RNA, 21 nt, Human
gacaccuuaauaacauggcua

SEQ ID NO: 1056001 - RNA, 20 nt, Human
gcauuagaaaaaaauguacu

SEQ ID NO: 1056002 - RNA, 21 nt, Human
gccaacuccuaccgccccgga

SEQ ID NO: 1056003 - RNA, 20 nt, Human
gcccgaaggcugcccuggga

SEQ ID NO: 1056004 - RNA, 21 nt, Human
gccggaggaccacgccgcgac

SEQ ID NO: 1056005 - RNA, 19 nt, Human
gggagaaguuuucuaagug

SEQ ID NO: 1056006 - RNA, 18 nt, Human
guggggagugugaguggg

SEQ ID NO: 1056007 - RNA, 20 nt, Human
guucacuuucuggugguguu

SEQ ID NO: 1056008 - RNA, 21 nt, Human
uaaaaaaaaauacacugaaaa

SEQ ID NO: 1056009 - RNA, 23 nt, Human
uaaaaacacaauaucguacaaag

SEQ ID NO: 1056010 - RNA, 20 nt, Human
uaaaaauauugcaaaagcag

SEQ ID NO: 1056011 - RNA, 18 nt, Human
uaaaaccugaaaaugcug

SEQ ID NO: 1056012 - RNA, 23 nt, Human
uaaaaccugaaaaugcugaauua

SEQ ID NO: 1056013 - RNA, 20 nt, Human
uaaaauuuccaguagcauuu

SEQ ID NO: 1056014 - RNA, 19 nt, Human
uaacaaaacccaaaauauc

SEQ ID NO: 1056015 - RNA, 21 nt, Human
uaagacaccuuaauaacaugg

SEQ ID NO: 1056016 - RNA, 24 nt, Human
uaauuagcaccaaaauugucugaa

SEQ ID NO: 1056017 - RNA, 19 nt, Human
uacaaaugccugacugccc

SEQ ID NO: 1056018 - RNA, 18 nt, Human
uaccaaagauacaaaugg

SEQ ID NO: 1056019 - RNA, 24 nt, Human
uaguguaugcuaauuaucauuuac

SEQ ID NO: 1056020 - RNA, 22 nt, Human
uauauauucaacccuguuauga

SEQ ID NO: 1056021 - RNA, 23 nt, Human
uaugagauuauuugguggggagu

SEQ ID NO: 1056022 - RNA, 21 nt, Human
uaugaucaagaguuuaguuuu

SEQ ID NO: 1056023 - RNA, 19 nt, Human
uauguagauauacaaaauc

SEQ ID NO: 1056024 - RNA, 21 nt, Human
ucaacccuguuaugaucaaga

SEQ ID NO: 1056025 - RNA, 23 nt, Human
uccuaccgccccggacagccgcc

SEQ ID NO: 1056026 - RNA, 23 nt, Human
ucuacauguuuuacuuguugccc

SEQ ID NO: 1056027 - RNA, 19 nt, Human
ucuaggaaaaaauaugcaa

SEQ ID NO: 1056028 - RNA, 25 nt, Human
ugaauucuaaaucuuaacuaccccc

SEQ ID NO: 1056029 - RNA, 20 nt, Human
ugacaggagccgccggagcg

SEQ ID NO: 1056030 - RNA, 23 nt, Human
ugacaggagccgccggagcgcgc

SEQ ID NO: 1056031 - RNA, 23 nt, Human
ugacaguauacuaaauaguuagu

SEQ ID NO: 1056032 - RNA, 24 nt, Human
ugacuuuagccuuagaaaaagauu

SEQ ID NO: 1056033 - RNA, 19 nt, Human
ugagaagacacuaagaaug

SEQ ID NO: 1056034 - RNA, 19 nt, Human
uggcauggggauagaggug

SEQ ID NO: 1056035 - RNA, 20 nt, Human
uggggagugugaguggggag

SEQ ID NO: 1056036 - RNA, 19 nt, Human
uggguaaaagcuuuaugaa

SEQ ID NO: 1056037 - RNA, 22 nt, Human
uguacaucauaucauuuaugug

SEQ ID NO: 1056038 - RNA, 26 nt, Human
ugucaaaaagugaaauauauaacuuc

SEQ ID NO: 1056039 - RNA, 19 nt, Human
ugucaaacaauucaauucg

SEQ ID NO: 1056040 - RNA, 26 nt, Human
ugucaagauaggaaauacauuguuuc

SEQ ID NO: 1056041 - RNA, 21 nt, Human
ugugaaaaaauccaugucaag

SEQ ID NO: 1056042 - RNA, 21 nt, Human
uuacuuaagauuuggcauggg

SEQ ID NO: 1056043 - RNA, 22 nt, Human
uucccuguucacuuucuggugg

SEQ ID NO: 1056044 - RNA, 21 nt, Human
uuccugaaaacaacaguaaaa

SEQ ID NO: 1056045 - RNA, 25 nt, Human
uucuucaauuacauauauggcuacc

SEQ ID NO: 1056046 - RNA, 21 nt, Human
uuggcauggggauagaggugu

SEQ ID NO: 1056047 - RNA, 19 nt, Human
uuuccaguagcauuagaaa

SEQ ID NO: 1056048 - RNA, 25 nt, Human
uuucuggugguguuacuuaagauuu

SEQ ID NO: 1056049 - RNA, 22 nt, Human
aaacaaaacuauaaaccacuga

SEQ ID NO: 1056050 - RNA, 19 nt, Human
caaaacuauaaaccacuga

SEQ ID NO: 1056051 - RNA, 18 nt, Human
cacucaguugcuggguca

SEQ ID NO: 1056052 - RNA, 21 nt, Human
ccacugaaauucuauuuugaa

SEQ ID NO: 1056053 - RNA, 23 nt, Human
ucccaaacaaaacuauaaaccac

SEQ ID NO: 1056054 - RNA, 22 nt, Human
acucguacuccccgcaucgcgg

SEQ ID NO: 1056055 - RNA, 21 nt, Human
agccagggggggaagaggggc

SEQ ID NO: 1056056 - RNA, 21 nt, Human
agccagggggggaagaggggc

SEQ ID NO: 1056057 - RNA, 24 nt, Human
agccagggggggaagaggggcugg

SEQ ID NO: 1056058 - RNA, 19 nt, Human
ccagggggggaagaggggc

SEQ ID NO: 1056059 - RNA, 20 nt, Human
ccagggggggaagaggggcu

SEQ ID NO: 1056060 - RNA, 23 nt, Human
ccugcgauggggguccuaagagc

SEQ ID NO: 1056061 - RNA, 24 nt, Human
cugacucguacuccccgcaucgcg

SEQ ID NO: 1056062 - RNA, 18 nt, Human
cugagggaauaguuuaga

SEQ ID NO: 1056063 - RNA, 22 nt, Human
gagccaggggaggagaagggcu

SEQ ID NO: 1056064 - RNA, 24 nt, Human
gauaggugcccuaagagccagggg

SEQ ID NO: 1056065 - RNA, 24 nt, Human
gauggggguccuaagagccagggg

SEQ ID NO: 1056066 - RNA, 20 nt, Human
gccagggggggaagaggggc

SEQ ID NO: 1056067 - RNA, 21 nt, Human
ggaagaggggcuggcucuuac

SEQ ID NO: 1056068 - RNA, 19 nt, Human
ggagaagggcugacucgua

SEQ ID NO: 1056069 - RNA, 19 nt, Human
ggggggaagaggggcuggc

SEQ ID NO: 1056070 - RNA, 21 nt, Human
gucaccagcagcaucgccagg

SEQ ID NO: 1056071 - RNA, 22 nt, Human
uaggagaccgcggccgccacca

SEQ ID NO: 1056072 - RNA, 22 nt, Human
uaggugcccuaagagccagggg

SEQ ID NO: 1056073 - RNA, 21 nt, Human
uccgcagguaggagaccgcgg

SEQ ID NO: 1056074 - RNA, 29 nt, Human
ugccucaccccccugcgauaggugcccua

SEQ ID NO: 1056075 - RNA, 30 nt, Human
ugccucaccccccugcgauggggguccuaa

SEQ ID NO: 1056076 - RNA, 22 nt, Human
ugcgauaggugcccuaagagcc

SEQ ID NO: 1056077 - RNA, 23 nt, Human
ugcgauaggugcccuaagagcca

SEQ ID NO: 1056078 - RNA, 18 nt, Human
ugcgauggggguccuaag

SEQ ID NO: 1056079 - RNA, 18 nt, Human
uggggguccuaagagcca

SEQ ID NO: 1056080 - RNA, 22 nt, Human
uggggguccuaagagccagggg

SEQ ID NO: 1056081 - RNA, 20 nt, Human
gcagagaucuugcccuuugg

SEQ ID NO: 1056082 - RNA, 19 nt, Human
ucugcacgucugcccaaag

SEQ ID NO: 1056083 - RNA, 18 nt, Human
ugacagggacuucugggu

SEQ ID NO: 1056084 - RNA, 21 nt, Human
ugcccaaagaaggcauaagca

SEQ ID NO: 1056085 - RNA, 23 nt, Human
ugcccaaagaaggcauaagcaga

SEQ ID NO: 1056086 - RNA, 21 nt, Human
uucuucucugcacgucugccc

SEQ ID NO: 1056087 - RNA, 20 nt, Human
uucuucuuauguucuucucu

SEQ ID NO: 1056088 - RNA, 20 nt, Human
aaaugucaaccccacaagag

SEQ ID NO: 1056089 - RNA, 26 nt, Human
aaauuguugaagguuaucugcacuuc

SEQ ID NO: 1056090 - RNA, 20 nt, Human
ucaaguacugcaaaugucaa

SEQ ID NO: 1056091 - RNA, 19 nt, Human
ucugcacugaggcaaaggg

SEQ ID NO: 1056092 - RNA, 21 nt, Human
uuguucgugucucuuuccugu

SEQ ID NO: 1056093 - RNA, 21 nt, Human
aaaucaacccuaauuuuuagu

SEQ ID NO: 1056094 - RNA, 19 nt, Human
aagcagaagaaugcacuua

SEQ ID NO: 1056095 - RNA, 23 nt, Human
agaaaauacaaaaaaacauuuua

SEQ ID NO: 1056096 - RNA, 25 nt, Human
agacacaguaagccacaugcacccu

SEQ ID NO: 1056097 - RNA, 18 nt, Human
cacuauauagcagcagac

SEQ ID NO: 1056098 - RNA, 19 nt, Human
cacuauauagcagcagacu

SEQ ID NO: 1056099 - RNA, 18 nt, Human
cacuauuauuuugcuacc

SEQ ID NO: 1056100 - RNA, 24 nt, Human
gcagcagacuguguugccccuacg

SEQ ID NO: 1056101 - RNA, 18 nt, Human
ggagaaaauacaaaaaaa

SEQ ID NO: 1056102 - RNA, 20 nt, Human
uagcuggggugaaaagcaga

SEQ ID NO: 1056103 - RNA, 26 nt, Human
uauagcagcagacuguguugccccua

SEQ ID NO: 1056104 - RNA, 24 nt, Human
uauuuugcuaccuuugguaaauua

SEQ ID NO: 1056105 - RNA, 18 nt, Human
uccuuguuaaacagaggc

SEQ ID NO: 1056106 - RNA, 23 nt, Human
ugaaaagcagaagaaugcacuua

SEQ ID NO: 1056107 - RNA, 19 nt, Human
ugaaaauaucacaaaaauu

SEQ ID NO: 1056108 - RNA, 20 nt, Human
ugaaaauaucacaaaaauua

SEQ ID NO: 1056109 - RNA, 23 nt, Human
ugauagcuggggugaaaagcaga

SEQ ID NO: 1056110 - RNA, 22 nt, Human
cagcuuccaacuuccagacccu

SEQ ID NO: 1056111 - RNA, 19 nt, Human
ccagacccugcauacccca

SEQ ID NO: 1056112 - RNA, 24 nt, Human
cuuccagacccugcauaccccauu

SEQ ID NO: 1056113 - RNA, 24 nt, Human
uccagacccugcauaccccauuuc

SEQ ID NO: 1056114 - RNA, 20 nt, Human
uccuugaggagagguuccca

SEQ ID NO: 1056115 - RNA, 18 nt, Human
ugccauggaaugcugggu

SEQ ID NO: 1056116 - RNA, 19 nt, Human
uggaaugcugggucaggau

SEQ ID NO: 1056117 - RNA, 24 nt, Human
aaacccuccuuuggacccuugagg

SEQ ID NO: 1056118 - RNA, 22 nt, Human
aagcacugaaugaggaaggccg

SEQ ID NO: 1056119 - RNA, 21 nt, Human
aagggucuuuccagcuggugc

SEQ ID NO: 1056120 - RNA, 24 nt, Human
augaggaaggccggggugcucuuc

SEQ ID NO: 1056121 - RNA, 21 nt, Human
caaaagaagggucuuuccagc

SEQ ID NO: 1056122 - RNA, 24 nt, Human
caagcacugaaugaggaaggccgg

SEQ ID NO: 1056123 - RNA, 22 nt, Human
caggccuuugucaagugguggc

SEQ ID NO: 1056124 - RNA, 19 nt, Human
caggucgucugccaggugu

SEQ ID NO: 1056125 - RNA, 21 nt, Human
ccaaagcucaacuuucauguu

SEQ ID NO: 1056126 - RNA, 24 nt, Human
ccaguuaagagauguuaaagggag

SEQ ID NO: 1056127 - RNA, 21 nt, Human
cccucacacagacagugaagu

SEQ ID NO: 1056128 - RNA, 19 nt, Human
ccucacacagacagugaag

SEQ ID NO: 1056129 - RNA, 22 nt, Human
ccuccuuuggacccuugaggau

SEQ ID NO: 1056130 - RNA, 22 nt, Human
cgucugccagguguccugguag

SEQ ID NO: 1056131 - RNA, 21 nt, Human
gaagugccuuagccucugccc

SEQ ID NO: 1056132 - RNA, 18 nt, Human
gcaaaauaaacccuccuu

SEQ ID NO: 1056133 - RNA, 24 nt, Human
ggagggaguggaggcucugaagga

SEQ ID NO: 1056134 - RNA, 22 nt, Human
uaaagggagcuaacuacgaaug

SEQ ID NO: 1056135 - RNA, 22 nt, Human
uauuggguugggcaggcagccc

SEQ ID NO: 1056136 - RNA, 18 nt, Human
ugaagugccuuagccucu

SEQ ID NO: 1056137 - RNA, 24 nt, Human
ugccagguguccugguagcacucc

SEQ ID NO: 1056138 - RNA, 18 nt, Human
uggcuggaguccaguuaa

SEQ ID NO: 1056139 - RNA, 25 nt, Human
ugugugcagugucugugcccaaaag

SEQ ID NO: 1056140 - RNA, 27 nt, Human
uguuccaacacgcugcaggucgucugc

SEQ ID NO: 1056141 - RNA, 21 nt, Human
uguuucuucaucuacaagcac

SEQ ID NO: 1056142 - RNA, 21 nt, Human
aaggagacagagaaauagcca

SEQ ID NO: 1056143 - RNA, 24 nt, Human
cacgugccacaaaaauaugagaag

SEQ ID NO: 1056144 - RNA, 20 nt, Human
cuagcuucgcggccaccguc

SEQ ID NO: 1056145 - RNA, 21 nt, Human
cuuuaaaaggagacagagaaa

SEQ ID NO: 1056146 - RNA, 23 nt, Human
cuuuauuuauuuuuaccaauagu

SEQ ID NO: 1056147 - RNA, 22 nt, Human
ggagacagagaaauagccaagu

SEQ ID NO: 1056148 - RNA, 24 nt, Human
uaaacucuguuuaaucuuuaaaag

SEQ ID NO: 1056149 - RNA, 20 nt, Human
uaaaguauacaaaauguuga

SEQ ID NO: 1056150 - RNA, 20 nt, Human
ugagaaaugcuuauaaccau

SEQ ID NO: 1056151 - RNA, 20 nt, Human
uuuaaaaggagacagagaaa

SEQ ID NO: 1056152 - RNA, 23 nt, Human
aaacagcucccgccuuccccccc

SEQ ID NO: 1056153 - RNA, 22 nt, Human
cagcucccgccuuccccccccu

SEQ ID NO: 1056154 - RNA, 24 nt, Human
ccagcgccaaacagcucccgccuu

SEQ ID NO: 1056155 - RNA, 23 nt, Human
ccccccagcagaacccgacacuc

SEQ ID NO: 1056156 - RNA, 22 nt, Human
ccgacacucgaagaagggcuuu

SEQ ID NO: 1056157 - RNA, 21 nt, Human
ccuucccccccagcagaaccc

SEQ ID NO: 1056158 - RNA, 24 nt, Human
cgccaaacagcucccgccuucccc

SEQ ID NO: 1056159 - RNA, 19 nt, Human
cuuugcuuuuucuuggcau

SEQ ID NO: 1056160 - RNA, 18 nt, Human
ggcaaaaauuccgggccu

SEQ ID NO: 1056161 - RNA, 21 nt, Human
uccccagcgccaaacagcucc

SEQ ID NO: 1056162 - RNA, 22 nt, Human
uccgaaaacucaagcucgaacg

SEQ ID NO: 1056163 - RNA, 18 nt, Human
agguuccgggaggauucu

SEQ ID NO: 1056164 - RNA, 23 nt, Human
aucccgagaccggccagccugug

SEQ ID NO: 1056165 - RNA, 21 nt, Human
caggacacugguuuuuccugc

SEQ ID NO: 1056166 - RNA, 19 nt, Human
caggcccagcacuaggauu

SEQ ID NO: 1056167 - RNA, 22 nt, Human
cccuggggcgucagaauccaga

SEQ ID NO: 1056168 - RNA, 21 nt, Human
cgucuccggcuucaaucccga

SEQ ID NO: 1056169 - RNA, 24 nt, Human
gagccgcacagugggcugaguccu

SEQ ID NO: 1056170 - RNA, 21 nt, Human
gauuugcuuguuuuucuccuc

SEQ ID NO: 1056171 - RNA, 21 nt, Human
ggauuugcuuguuuuucuccu

SEQ ID NO: 1056172 - RNA, 21 nt, Human
gugccacacugugcuggacuc

SEQ ID NO: 1056173 - RNA, 21 nt, Human
gugcuggacucuguuugaagc

SEQ ID NO: 1056174 - RNA, 22 nt, Human
ucaacacugaugacaucucagu

SEQ ID NO: 1056175 - RNA, 21 nt, Human
ucaaucccgagaccggccagc

SEQ ID NO: 1056176 - RNA, 19 nt, Human
uggcuaagagccuuccacg

SEQ ID NO: 1056177 - RNA, 19 nt, Human
uguuugaagcuagagagug

SEQ ID NO: 1056178 - RNA, 20 nt, Human
uugaugcaaacugcauggaa

SEQ ID NO: 1056179 - RNA, 25 nt, Human
uugggugggugccacacugugcugg

SEQ ID NO: 1056180 - RNA, 21 nt, Human
uuuccugcuccauccaggccc

SEQ ID NO: 1056181 - RNA, 18 nt, Human
uuugcuuguuuuucuccu

SEQ ID NO: 1056182 - RNA, 23 nt, Human
aacacuccucacaacaauuacuc

SEQ ID NO: 1056183 - RNA, 21 nt, Human
aagcagcagcucccagaagcc

SEQ ID NO: 1056184 - RNA, 19 nt, Human
aauucuucaguguugcuga

SEQ ID NO: 1056185 - RNA, 20 nt, Human
aauuuguagcacagaaccuu

SEQ ID NO: 1056186 - RNA, 25 nt, Human
acagaguuucuugguuauaucuuug

SEQ ID NO: 1056187 - RNA, 23 nt, Human
acagcgaagcagcagcucccaga

SEQ ID NO: 1056188 - RNA, 22 nt, Human
acauuuagcagacuuaggaauc

SEQ ID NO: 1056189 - RNA, 25 nt, Human
accaauucuugccccaaaaacagag

SEQ ID NO: 1056190 - RNA, 21 nt, Human
acugaaguuuaucuaaacauc

SEQ ID NO: 1056191 - RNA, 19 nt, Human
agcagcucccagaagccga

SEQ ID NO: 1056192 - RNA, 18 nt, Human
agccccucugggggacaa

SEQ ID NO: 1056193 - RNA, 21 nt, Human
auucuugccccaaaaacagag

SEQ ID NO: 1056194 - RNA, 28 nt, Human
caauaaauuuacuuuucuggaaagaucu

SEQ ID NO: 1056195 - RNA, 18 nt, Human
cacaacaauuacucaacc

SEQ ID NO: 1056196 - RNA, 21 nt, Human
cacagaaccuuagcaagucuc

SEQ ID NO: 1056197 - RNA, 23 nt, Human
cacauuuagcagacuuaggaauc

SEQ ID NO: 1056198 - RNA, 21 nt, Human
cacuccucacaacaauuacuc

SEQ ID NO: 1056199 - RNA, 18 nt, Human
cagaauaguggcucacaa

SEQ ID NO: 1056200 - RNA, 21 nt, Human
cagcagcucccagaagccgua

SEQ ID NO: 1056201 - RNA, 23 nt, Human
cagcgaagcagcagcucccagaa

SEQ ID NO: 1056202 - RNA, 21 nt, Human
ccaaaaacagaguuucuuggu

SEQ ID NO: 1056203 - RNA, 25 nt, Human
cucacaacaauuacucaacccuaaa

SEQ ID NO: 1056204 - RNA, 24 nt, Human
cuguucauacuacagaauaguggc

SEQ ID NO: 1056205 - RNA, 26 nt, Human
gcauucggcccuuucccggauagcuc

SEQ ID NO: 1056206 - RNA, 21 nt, Human
gcgaagcagcagcucccagaa

SEQ ID NO: 1056207 - RNA, 20 nt, Human
ggaaagaucuccucuaagua

SEQ ID NO: 1056208 - RNA, 24 nt, Human
uagcaagucucgcggauuagguuu

SEQ ID NO: 1056209 - RNA, 22 nt, Human
uauaucuuugguuggcaaucau

SEQ ID NO: 1056210 - RNA, 25 nt, Human
uauuauaaaauuuugcaguauagga

SEQ ID NO: 1056211 - RNA, 21 nt, Human
uccagaugggagaaggaagga

SEQ ID NO: 1056212 - RNA, 21 nt, Human
ucccagaagccguaaagcuuc

SEQ ID NO: 1056213 - RNA, 26 nt, Human
ucuguucauacuacagaauaguggcu

SEQ ID NO: 1056214 - RNA, 21 nt, Human
ugagggguggagagccccucu

SEQ ID NO: 1056215 - RNA, 23 nt, Human
uggaaagagaaauucaaaacaau

SEQ ID NO: 1056216 - RNA, 23 nt, Human
uguucuuccccuuuaguaaaaca

SEQ ID NO: 1056217 - RNA, 22 nt, Human
uugaucgcauucggcccuuucc

SEQ ID NO: 1056218 - RNA, 24 nt, Human
uuguuaugacugggaggugcuacu

SEQ ID NO: 1056219 - RNA, 22 nt, Human
uuuauaauguucuuccccuuua

SEQ ID NO: 1056220 - RNA, 21 nt, Human
aagaacuggagaauuuaagcc

SEQ ID NO: 1056221 - RNA, 22 nt, Human
acuucccaauaagaacuggaga

SEQ ID NO: 1056222 - RNA, 18 nt, Human
agaaggacaggcugaaga

SEQ ID NO: 1056223 - RNA, 27 nt, Human
aucacaccuaauuaaacaaaagugcua

SEQ ID NO: 1056224 - RNA, 25 nt, Human
caacacaggauggaucuuuugacuu

SEQ ID NO: 1056225 - RNA, 24 nt, Human
caagcugacauauaaauaaaguua

SEQ ID NO: 1056226 - RNA, 22 nt, Human
cagaaggacaggcugaagagca

SEQ ID NO: 1056227 - RNA, 19 nt, Human
cccagaaauaauguuuuac

SEQ ID NO: 1056228 - RNA, 25 nt, Human
ggaauucagagacaaaauuugacuc

SEQ ID NO: 1056229 - RNA, 18 nt, Human
ucccaauaagaacugggg

SEQ ID NO: 1056230 - RNA, 27 nt, Human
ucgcagguuuccccucuucagaaacuu

SEQ ID NO: 1056231 - RNA, 23 nt, Human
ugacauauaaauaaaguuaacca

SEQ ID NO: 1056232 - RNA, 23 nt, Human
uguuuuguucucuaacuccuugu

SEQ ID NO: 1056233 - RNA, 23 nt, Human
ugcucugccccucaagagcccgc

SEQ ID NO: 1056234 - RNA, 24 nt, Human
aaaaaaaauaaaucaaaggcgagg

SEQ ID NO: 1056235 - RNA, 24 nt, Human
aaaauaaauucuaacaauuacaga

SEQ ID NO: 1056236 - RNA, 18 nt, Human
acaguucaauaacaaaaa

SEQ ID NO: 1056237 - RNA, 23 nt, Human
accccaaagcaagcauuaaacaa

SEQ ID NO: 1056238 - RNA, 23 nt, Human
agcacgaacuauuuucaaaaaca

SEQ ID NO: 1056239 - RNA, 27 nt, Human
augaaacacuggugggaguaagaacca

SEQ ID NO: 1056240 - RNA, 23 nt, Human
auucauaauaauccuccuccccu

SEQ ID NO: 1056241 - RNA, 21 nt, Human
caaaaaccgaagagcacgaac

SEQ ID NO: 1056242 - RNA, 23 nt, Human
caaagagcagauuccuuugcaga

SEQ ID NO: 1056243 - RNA, 25 nt, Human
caaagcaagcauuaaacacauaauc

SEQ ID NO: 1056244 - RNA, 21 nt, Human
caaccaaaaucuuuuuuuccc

SEQ ID NO: 1056245 - RNA, 23 nt, Human
cagcugccucccccuggcugcuc

SEQ ID NO: 1056246 - RNA, 23 nt, Human
caguucaauaacaaaaaccgaag

SEQ ID NO: 1056247 - RNA, 25 nt, Human
caguucaauaacaaaaaccgaagag

SEQ ID NO: 1056248 - RNA, 21 nt, Human
cauaauaauccuccuccccuc

SEQ ID NO: 1056249 - RNA, 22 nt, Human
cauaauaauccuccuccccuca

SEQ ID NO: 1056250 - RNA, 22 nt, Human
cccgaagucagucccgggucgc

SEQ ID NO: 1056251 - RNA, 24 nt, Human
ccgccgccacgguagcagcuccgg

SEQ ID NO: 1056252 - RNA, 22 nt, Human
ccuccccucaaaugucuuuaaa

SEQ ID NO: 1056253 - RNA, 19 nt, Human
ccuccuccccucaaauguc

SEQ ID NO: 1056254 - RNA, 23 nt, Human
cgcccagaaaaaaaauaaaucaa

SEQ ID NO: 1056255 - RNA, 18 nt, Human
cuucccggauacucaccg

SEQ ID NO: 1056256 - RNA, 20 nt, Human
gagccgcagcugccuccccc

SEQ ID NO: 1056257 - RNA, 23 nt, Human
gagccgcagcugccucccccugg

SEQ ID NO: 1056258 - RNA, 21 nt, Human
gcagacauuaaucaaugcgcu

SEQ ID NO: 1056259 - RNA, 22 nt, Human
guagcagcuccgggggcuccac

SEQ ID NO: 1056260 - RNA, 19 nt, Human
guuaaaaaucaaaacaaaa

SEQ ID NO: 1056261 - RNA, 22 nt, Human
guuguaaguucuuaaaaaauaa

SEQ ID NO: 1056262 - RNA, 27 nt, Human
uaaaaaauaaauucuaacaauuacaga

SEQ ID NO: 1056263 - RNA, 24 nt, Human
uaaaaaauacaugaaacaguucaa

SEQ ID NO: 1056264 - RNA, 22 nt, Human
uaaaguaauauuuaauuucaug

SEQ ID NO: 1056265 - RNA, 22 nt, Human
uaacaaaaaccgaagagcacga

SEQ ID NO: 1056266 - RNA, 19 nt, Human
uaauuuagucucaaccaaa

SEQ ID NO: 1056267 - RNA, 20 nt, Human
uaccccaaagcaagcauuaa

SEQ ID NO: 1056268 - RNA, 19 nt, Human
uagcaaucuuuucugaguu

SEQ ID NO: 1056269 - RNA, 18 nt, Human
uagcagcuccgggggcuc

SEQ ID NO: 1056270 - RNA, 18 nt, Human
uaggaaaauguugaaagg

SEQ ID NO: 1056271 - RNA, 21 nt, Human
uaggaaaauguugaaagguua

SEQ ID NO: 1056272 - RNA, 23 nt, Human
uaggagagaccaucuuguuagua

SEQ ID NO: 1056273 - RNA, 20 nt, Human
uauaguggugauccccaaaa

SEQ ID NO: 1056274 - RNA, 18 nt, Human
uaugcaaaauugugcagu

SEQ ID NO: 1056275 - RNA, 19 nt, Human
ucccauuuacaaguggaau

SEQ ID NO: 1056276 - RNA, 22 nt, Human
ucccgggucgcagcggccgccc

SEQ ID NO: 1056277 - RNA, 21 nt, Human
uccuccuccccucaaaugucu

SEQ ID NO: 1056278 - RNA, 24 nt, Human
ugauccccaaaacuauuuugacau

SEQ ID NO: 1056279 - RNA, 19 nt, Human
uuaccccaaagcaagcauu

SEQ ID NO: 1056280 - RNA, 21 nt, Human
uucaauaacaaaaaccgaaga

SEQ ID NO: 1056281 - RNA, 20 nt, Human
uuuaaaaaauacaugaaaca

SEQ ID NO: 1056282 - RNA, 23 nt, Human
aaauaucucaaucgaaaucucac

SEQ ID NO: 1056283 - RNA, 23 nt, Human
aucucacagcacccagugacagc

SEQ ID NO: 1056284 - RNA, 18 nt, Human
cucaaucgaaaucucaca

SEQ ID NO: 1056285 - RNA, 27 nt, Human
gaaaauaucucaaucgaaaucucacag

SEQ ID NO: 1056286 - RNA, 20 nt, Human
gaaaucucacagcacccagu

SEQ ID NO: 1056287 - RNA, 22 nt, Human
aaaaaaaccaagcccccacuag

SEQ ID NO: 1056288 - RNA, 23 nt, Human
aaaaaaaccaagcccccacuaga

SEQ ID NO: 1056289 - RNA, 18 nt, Human
aaaaccaagcccccacua

SEQ ID NO: 1056290 - RNA, 24 nt, Human
aagugaccacuuauugauaagaau

SEQ ID NO: 1056291 - RNA, 19 nt, Human
aaucauuacuuuggccucc

SEQ ID NO: 1056292 - RNA, 20 nt, Human
acaaagagcaagccugugua

SEQ ID NO: 1056293 - RNA, 19 nt, Human
acagccucucacauagcuu

SEQ ID NO: 1056294 - RNA, 19 nt, Human
aggaaaaaaaccaagcccc

SEQ ID NO: 1056295 - RNA, 23 nt, Human
aggaaaaaaaccaagcccccacu

SEQ ID NO: 1056296 - RNA, 20 nt, Human
aggacccuuccaaacucagc

SEQ ID NO: 1056297 - RNA, 19 nt, Human
auucucauuucuuugucca

SEQ ID NO: 1056298 - RNA, 23 nt, Human
caaggaaaaaaaccaagccccca

SEQ ID NO: 1056299 - RNA, 25 nt, Human
cagaggucucuucaugaauaagcuu

SEQ ID NO: 1056300 - RNA, 23 nt, Human
cagugcuuuucaacaaaggaaag

SEQ ID NO: 1056301 - RNA, 18 nt, Human
caucauggaaaaacaaac

SEQ ID NO: 1056302 - RNA, 21 nt, Human
caucauggaaaaacaaaccca

SEQ ID NO: 1056303 - RNA, 19 nt, Human
ccaagcccccacuagaaug

SEQ ID NO: 1056304 - RNA, 24 nt, Human
ccaagcccccacuagaaugucagc

SEQ ID NO: 1056305 - RNA, 22 nt, Human
ccaaggaaaaaaaccaagcccc

SEQ ID NO: 1056306 - RNA, 24 nt, Human
ccaguacccaaggaaaaaaaccaa

SEQ ID NO: 1056307 - RNA, 25 nt, Human
ccaguacccaaggaaaaaaaccaag

SEQ ID NO: 1056308 - RNA, 21 nt, Human
cccacuagaaugucagcucca

SEQ ID NO: 1056309 - RNA, 25 nt, Human
cucaaaggcuucaaacuagacaacu

SEQ ID NO: 1056310 - RNA, 18 nt, Human
cucaucauggaaaaacaa

SEQ ID NO: 1056311 - RNA, 19 nt, Human
cuccauaagggcagggauu

SEQ ID NO: 1056312 - RNA, 22 nt, Human
cuccuucagacuaucugcacaa

SEQ ID NO: 1056313 - RNA, 25 nt, Human
cugauauaauaauggcuucaugucc

SEQ ID NO: 1056314 - RNA, 21 nt, Human
cugcucuccacucucuccuac

SEQ ID NO: 1056315 - RNA, 23 nt, Human
gcagaggucucuucaugaauaag

SEQ ID NO: 1056316 - RNA, 24 nt, Human
ggaaaaacaaacccaguacccaag

SEQ ID NO: 1056317 - RNA, 23 nt, Human
ggacaggaguaggaaagcaucug

SEQ ID NO: 1056318 - RNA, 19 nt, Human
guacccaaggaaaaaaacc

SEQ ID NO: 1056319 - RNA, 24 nt, Human
uaagcuucacacugaggucccaca

SEQ ID NO: 1056320 - RNA, 22 nt, Human
uacccaaggaaaaaaaccaagc

SEQ ID NO: 1056321 - RNA, 22 nt, Human
uagaaugucagcuccauaaggg

SEQ ID NO: 1056322 - RNA, 19 nt, Human
uagugaugucucccaaguu

SEQ ID NO: 1056323 - RNA, 24 nt, Human
uauuuuguuuagugaugucuccca

SEQ ID NO: 1056324 - RNA, 23 nt, Human
ucagcuacuggacaaagagcaag

SEQ ID NO: 1056325 - RNA, 19 nt, Human
ucaggacaggaguaggaaa

SEQ ID NO: 1056326 - RNA, 23 nt, Human
uccugauauaauaauggcuucau

SEQ ID NO: 1056327 - RNA, 24 nt, Human
ucucugcacggucaggacaggagu

SEQ ID NO: 1056328 - RNA, 20 nt, Human
ucucuucaugaauaagcuuc

SEQ ID NO: 1056329 - RNA, 19 nt, Human
ucugcacggucaggacagg

SEQ ID NO: 1056330 - RNA, 18 nt, Human
ugaaauggugaacuguag

SEQ ID NO: 1056331 - RNA, 24 nt, Human
ugaauaagcuucacacugaggucc

SEQ ID NO: 1056332 - RNA, 23 nt, Human
ugaccacuuauugauaagaaucu

SEQ ID NO: 1056333 - RNA, 20 nt, Human
ugauaagaaucucugcacgg

SEQ ID NO: 1056334 - RNA, 19 nt, Human
ugcacggucaggacaggag

SEQ ID NO: 1056335 - RNA, 19 nt, Human
ugcuauagugcaucauagg

SEQ ID NO: 1056336 - RNA, 19 nt, Human
ugcugcaccagccuccuuc

SEQ ID NO: 1056337 - RNA, 24 nt, Human
ugucagcuccauaagggcagggau

SEQ ID NO: 1056338 - RNA, 22 nt, Human
uguccucuaggacccuuccaaa

SEQ ID NO: 1056339 - RNA, 19 nt, Human
uuacagggcugaaauggug

SEQ ID NO: 1056340 - RNA, 22 nt, Human
uuagugaugucucccaaguucu

SEQ ID NO: 1056341 - RNA, 20 nt, Human
uuccugauauaauaauggcu

SEQ ID NO: 1056342 - RNA, 19 nt, Human
uuugcuguauguucaggca

SEQ ID NO: 1056343 - RNA, 23 nt, Human
aacgugaaaagaaaggagaaaau

SEQ ID NO: 1056344 - RNA, 25 nt, Human
aacgugaaaagaaaggagaaaauga

SEQ ID NO: 1056345 - RNA, 24 nt, Human
acaguacaggauuguggccacaga

SEQ ID NO: 1056346 - RNA, 21 nt, Human
acuccaaguuugguugcugca

SEQ ID NO: 1056347 - RNA, 18 nt, Human
acugaggauggcuccugg

SEQ ID NO: 1056348 - RNA, 24 nt, Human
agaaaaugacauauaacugcacaa

SEQ ID NO: 1056349 - RNA, 20 nt, Human
agaauuauccaagaauaaug

SEQ ID NO: 1056350 - RNA, 22 nt, Human
agcccggcuggcacagcugucg

SEQ ID NO: 1056351 - RNA, 22 nt, Human
aggaacaguacaggauuguggc

SEQ ID NO: 1056352 - RNA, 18 nt, Human
agggauggaaggaacagu

SEQ ID NO: 1056353 - RNA, 19 nt, Human
aguaacgugaaaagaaagg

SEQ ID NO: 1056354 - RNA, 19 nt, Human
caaauggaaagcuaggauu

SEQ ID NO: 1056355 - RNA, 22 nt, Human
cacgucugucugcaauaaccac

SEQ ID NO: 1056356 - RNA, 21 nt, Human
cagagaggggcccagagccac

SEQ ID NO: 1056357 - RNA, 28 nt, Human
cagagaggggcccagagccacgucuguc

SEQ ID NO: 1056358 - RNA, 23 nt, Human
cagagcccggcuggcacagcugu

SEQ ID NO: 1056359 - RNA, 21 nt, Human
cuaccuucuggaaaaacaagg

SEQ ID NO: 1056360 - RNA, 21 nt, Human
gaccuccuuuuaucagggaug

SEQ ID NO: 1056361 - RNA, 23 nt, Human
gaggggcccagagccacgucugu

SEQ ID NO: 1056362 - RNA, 23 nt, Human
ggacagggcacagacaagggccu

SEQ ID NO: 1056363 - RNA, 21 nt, Human
uaagaugaaaaaauuccauga

SEQ ID NO: 1056364 - RNA, 18 nt, Human
uauaacugcacaaaugga

SEQ ID NO: 1056365 - RNA, 18 nt, Human
ugaaaagaaaggagaaaa

SEQ ID NO: 1056366 - RNA, 20 nt, Human
ugcaaggugggacagagagg

SEQ ID NO: 1056367 - RNA, 20 nt, Human
ugcucagagaguucauccug

SEQ ID NO: 1056368 - RNA, 18 nt, Human
ugggucagaaauagacag

SEQ ID NO: 1056369 - RNA, 22 nt, Human
ugugcaaggugggacagagagg

SEQ ID NO: 1056370 - RNA, 23 nt, Human
ugugcaaggugggacagagaggg

SEQ ID NO: 1056371 - RNA, 20 nt, Human
uuccuaccuucuggaaaaac

SEQ ID NO: 1056372 - RNA, 20 nt, Human
uugguugcugcaggagcagg

SEQ ID NO: 1056373 - RNA, 26 nt, Human
acaaaaugaguaacaauaccaauugc

SEQ ID NO: 1056374 - RNA, 23 nt, Human
acuccuuucuauaaacucucuug

SEQ ID NO: 1056375 - RNA, 18 nt, Human
acuuuaaaagaggcaagg

SEQ ID NO: 1056376 - RNA, 21 nt, Human
cuuucuauaaacucucuugaa

SEQ ID NO: 1056377 - RNA, 19 nt, Human
uaaaagaggcaagguaaua

SEQ ID NO: 1056378 - RNA, 23 nt, Human
uaaaagaggcaagguaauagaaa

SEQ ID NO: 1056379 - RNA, 25 nt, Human
ucugaugacuccuuucuauaaacuc

SEQ ID NO: 1056380 - RNA, 28 nt, Human
ugaaaagagcuagccguacugaguccca

SEQ ID NO: 1056381 - RNA, 23 nt, Human
uuccuaugauugcuacaauugcu

SEQ ID NO: 1056382 - RNA, 23 nt, Human
gaaccuucucccagauaucacaa

SEQ ID NO: 1056383 - RNA, 19 nt, Human
uacauuggaagacucaagu

SEQ ID NO: 1056384 - RNA, 23 nt, Human
uaucuuacuuccuuuggcaguga

SEQ ID NO: 1056385 - RNA, 24 nt, Human
ucacaaggaucaucuacauuggaa

SEQ ID NO: 1056386 - RNA, 21 nt, Human
ucucccagauaucacaaggau

SEQ ID NO: 1056387 - RNA, 18 nt, Human
ugaagaugaggcuaaugu

SEQ ID NO: 1056388 - RNA, 24 nt, Human
uggaagacucaaguucauugcaga

SEQ ID NO: 1056389 - RNA, 19 nt, Human
aggaagagcuucacccaaa

SEQ ID NO: 1056390 - RNA, 20 nt, Human
aggaagagcuucacccaaag

SEQ ID NO: 1056391 - RNA, 24 nt, Human
aggaagagcuucacccaaagcuuc

SEQ ID NO: 1056392 - RNA, 18 nt, Human
ccccaggaagagcuucac

SEQ ID NO: 1056393 - RNA, 19 nt, Human
ccccaggaagagcuucacc

SEQ ID NO: 1056394 - RNA, 19 nt, Human
uucauggugcauuucgaca

SEQ ID NO: 1056395 - RNA, 20 nt, Human
aaagucagcuuaaagugcaa

SEQ ID NO: 1056396 - RNA, 24 nt, Human
aagaagaugacacagggaagagga

SEQ ID NO: 1056397 - RNA, 18 nt, Human
acaccgcgagaggagcac

SEQ ID NO: 1056398 - RNA, 19 nt, Human
acagcgcaggcuccucggg

SEQ ID NO: 1056399 - RNA, 25 nt, Human
accuuugugaguuuuuuuuuuuuuu

SEQ ID NO: 1056400 - RNA, 20 nt, Human
agcacggucucuccccaaga

SEQ ID NO: 1056401 - RNA, 23 nt, Human
agcgcaggcuccucgggacuccg

SEQ ID NO: 1056402 - RNA, 18 nt, Human
agugcucgggacugcaug

SEQ ID NO: 1056403 - RNA, 24 nt, Human
aguuuuuuuuuuuuuuccgcauga

SEQ ID NO: 1056404 - RNA, 22 nt, Human
auuaagaagaugacacagggaa

SEQ ID NO: 1056405 - RNA, 19 nt, Human
caaugguagaagagcacgg

SEQ ID NO: 1056406 - RNA, 19 nt, Human
caccgcguguagucggccc

SEQ ID NO: 1056407 - RNA, 21 nt, Human
cagcgagcucccgggaaagcu

SEQ ID NO: 1056408 - RNA, 22 nt, Human
cagcgagcucccgggaaagcuu

SEQ ID NO: 1056409 - RNA, 21 nt, Human
caggaccagcgagcucccggg

SEQ ID NO: 1056410 - RNA, 24 nt, Human
caucuucccaggcugagccgggag

SEQ ID NO: 1056411 - RNA, 22 nt, Human
ccaggccgaccaugggcccacg

SEQ ID NO: 1056412 - RNA, 19 nt, Human
cccacgucccggggccucg

SEQ ID NO: 1056413 - RNA, 19 nt, Human
cccacgucccggggccucg

SEQ ID NO: 1056414 - RNA, 20 nt, Human
cccaggcugagccgggaggc

SEQ ID NO: 1056415 - RNA, 22 nt, Human
cccccggaaagguggcgccagg

SEQ ID NO: 1056416 - RNA, 20 nt, Human
ccccgugugcccuccgccgg

SEQ ID NO: 1056417 - RNA, 19 nt, Human
ccccuaaagucagcuuaaa

SEQ ID NO: 1056418 - RNA, 19 nt, Human
ccgcgcggucuuucagcug

SEQ ID NO: 1056419 - RNA, 23 nt, Human
ccgcgcucugggguucccgauuc

SEQ ID NO: 1056420 - RNA, 18 nt, Human
ccgcugggcgacaccgcg

SEQ ID NO: 1056421 - RNA, 21 nt, Human
cgagaggagcacagcgcaggc

SEQ ID NO: 1056422 - RNA, 24 nt, Human
cgcgugcgaugccuggugcgcgug

SEQ ID NO: 1056423 - RNA, 22 nt, Human
cgcucugggguucccgauucgc

SEQ ID NO: 1056424 - RNA, 19 nt, Human
cggcgcaggccgggcagcc

SEQ ID NO: 1056425 - RNA, 24 nt, Human
gaaguaaacuugucaaaacucaga

SEQ ID NO: 1056426 - RNA, 18 nt, Human
gagguugucuucucaucu

SEQ ID NO: 1056427 - RNA, 19 nt, Human
gaugacacagggaagagga

SEQ ID NO: 1056428 - RNA, 20 nt, Human
gcaccgcguguagucggccc

SEQ ID NO: 1056429 - RNA, 19 nt, Human
gcaggcuccucgggacucc

SEQ ID NO: 1056430 - RNA, 22 nt, Human
gcgcgggugcagagccgcgugc

SEQ ID NO: 1056431 - RNA, 18 nt, Human
gcgcugucacuugcuagc

SEQ ID NO: 1056432 - RNA, 23 nt, Human
gcggguccgcaggcuucuggggc

SEQ ID NO: 1056433 - RNA, 18 nt, Human
ggaaagcuuacccagaga

SEQ ID NO: 1056434 - RNA, 22 nt, Human
ggacugcaugugccagaaguaa

SEQ ID NO: 1056435 - RNA, 19 nt, Human
ggccaggaccagcgagcuc

SEQ ID NO: 1056436 - RNA, 18 nt, Human
ggcugugggggaggcggc

SEQ ID NO: 1056437 - RNA, 28 nt, Human
gggccaggaccagcgagcucccgggaaa

SEQ ID NO: 1056438 - RNA, 23 nt, Human
guaaacacuuaauauacuguuau

SEQ ID NO: 1056439 - RNA, 20 nt, Human
guaaaggacgcugugguggu

SEQ ID NO: 1056440 - RNA, 18 nt, Human
guccggggcccgcagcgg

SEQ ID NO: 1056441 - RNA, 18 nt, Human
guggcuucccccggaaag

SEQ ID NO: 1056442 - RNA, 21 nt, Human
uaaaagacuuguucugccccc

SEQ ID NO: 1056443 - RNA, 22 nt, Human
uagccaaaaagcagugcucggg

SEQ ID NO: 1056444 - RNA, 18 nt, Human
ucaguauaaaaccuuugu

SEQ ID NO: 1056445 - RNA, 22 nt, Human
uccccaagacggccugagcuuu

SEQ ID NO: 1056446 - RNA, 18 nt, Human
ucccgaaaccaaccucua

SEQ ID NO: 1056447 - RNA, 18 nt, Human
ucccugagguugucuucu

SEQ ID NO: 1056448 - RNA, 26 nt, Human
ucccugggcggguccgcaggcuucug

SEQ ID NO: 1056449 - RNA, 22 nt, Human
ucuggggccaggaccagcgagc

SEQ ID NO: 1056450 - RNA, 23 nt, Human
ugagaauaaaugagacauggcaa

SEQ ID NO: 1056451 - RNA, 18 nt, Human
ugagacauggcaaguguc

SEQ ID NO: 1056452 - RNA, 19 nt, Human
ugagacauggcaagugucu

SEQ ID NO: 1056453 - RNA, 18 nt, Human
ugcaaugguagaagagca

SEQ ID NO: 1056454 - RNA, 18 nt, Human
uggugugagaauaaauga

SEQ ID NO: 1056455 - RNA, 22 nt, Human
ugugaguuuuuuuuuuuuuucc

SEQ ID NO: 1056456 - RNA, 25 nt, Human
uuguucugccccccuuuaucgcuua

SEQ ID NO: 1056457 - RNA, 20 nt, Human
agccagaagccagaggccug

SEQ ID NO: 1056458 - RNA, 19 nt, Human
agccagccagaagccagag

SEQ ID NO: 1056459 - RNA, 24 nt, Human
cagccagccagaagccagaggccu

SEQ ID NO: 1056460 - RNA, 20 nt, Human
ccagccagaagccagaggcc

SEQ ID NO: 1056461 - RNA, 23 nt, Human
ccagccagccagaagccagaggc

SEQ ID NO: 1056462 - RNA, 21 nt, Human
gaggugcuccuggacccagag

SEQ ID NO: 1056463 - RNA, 18 nt, Human
aacucagggcaucagcag

SEQ ID NO: 1056464 - RNA, 18 nt, Human
aagcaauaggcccaauga

SEQ ID NO: 1056465 - RNA, 22 nt, Human
accaaagucagaaucagccccg

SEQ ID NO: 1056466 - RNA, 22 nt, Human
aggaggaaacugguuccgccug

SEQ ID NO: 1056467 - RNA, 21 nt, Human
aggcagcucuugcuccugugu

SEQ ID NO: 1056468 - RNA, 23 nt, Human
aggcagcucuugcuccugugugg

SEQ ID NO: 1056469 - RNA, 22 nt, Human
caauaggcccaaugacaucacc

SEQ ID NO: 1056470 - RNA, 20 nt, Human
caccuugaaacaggcagcuc

SEQ ID NO: 1056471 - RNA, 19 nt, Human
cagggcaucagcagugaag

SEQ ID NO: 1056472 - RNA, 23 nt, Human
cccaggaggaaacugguuccgcc

SEQ ID NO: 1056473 - RNA, 19 nt, Human
ccugcuguggaacucaggg

SEQ ID NO: 1056474 - RNA, 24 nt, Human
gcagcucuugcuccuguguggggg

SEQ ID NO: 1056475 - RNA, 21 nt, Human
gcccaaugacaucaccuugaa

SEQ ID NO: 1056476 - RNA, 18 nt, Human
gggggccugaccccugcu

SEQ ID NO: 1056477 - RNA, 18 nt, Human
uacccaggaggaaacugg

SEQ ID NO: 1056478 - RNA, 24 nt, Human
ugugugggggccugaccccugcug

SEQ ID NO: 1056479 - RNA, 24 nt, Human
aaauauaauaucaacaaaaacaua

SEQ ID NO: 1056480 - RNA, 23 nt, Human
agcaaguagcuuuuaucaugaaa

SEQ ID NO: 1056481 - RNA, 19 nt, Human
agggggccgcgcucggccg

SEQ ID NO: 1056482 - RNA, 19 nt, Human
cccccgagaccgcguccca

SEQ ID NO: 1056483 - RNA, 24 nt, Human
cccccgagaccgcgucccaggagc

SEQ ID NO: 1056484 - RNA, 18 nt, Human
cccgagaccgcgucccag

SEQ ID NO: 1056485 - RNA, 20 nt, Human
cccgccccggcccgggagga

SEQ ID NO: 1056486 - RNA, 18 nt, Human
ccgcccucaguguuccug

SEQ ID NO: 1056487 - RNA, 18 nt, Human
ccucaguguuccuggcac

SEQ ID NO: 1056488 - RNA, 25 nt, Human
cgcucggccgccuuccccuggcuuc

SEQ ID NO: 1056489 - RNA, 28 nt, Human
cucuggggcuucguccuuccccuuuccu

SEQ ID NO: 1056490 - RNA, 29 nt, Human
gcccccgagaccgcgucccaggagcggag

SEQ ID NO: 1056491 - RNA, 18 nt, Human
gcccgggaggagaggggg

SEQ ID NO: 1056492 - RNA, 21 nt, Human
gggccgugaccaggacggcgc

SEQ ID NO: 1056493 - RNA, 27 nt, Human
gggccgugaccaggacggcgcggggaa

SEQ ID NO: 1056494 - RNA, 22 nt, Human
gugcuuccgugggcgcacacaa

SEQ ID NO: 1056495 - RNA, 18 nt, Human
guuccuggcaccgccuga

SEQ ID NO: 1056496 - RNA, 23 nt, Human
uaagaaauuccuauuccaauuaa

SEQ ID NO: 1056497 - RNA, 22 nt, Human
uagaaaaccuaauaauuucuga

SEQ ID NO: 1056498 - RNA, 19 nt, Human
ugaccaggacggcgcgggg

SEQ ID NO: 1056499 - RNA, 19 nt, Human
uuggaacauaaauauaaua

SEQ ID NO: 1056500 - RNA, 21 nt, Human
aaaaacccuauuuaagacuaa

SEQ ID NO: 1056501 - RNA, 27 nt, Human
aaaaagccaaaagucaaccguuaugaa

SEQ ID NO: 1056502 - RNA, 20 nt, Human
aaaagacugcaaaaggagaa

SEQ ID NO: 1056503 - RNA, 24 nt, Human
aaaccaugagccacaaaagcauca

SEQ ID NO: 1056504 - RNA, 23 nt, Human
aaacccuauuuaagacuaagaag

SEQ ID NO: 1056505 - RNA, 21 nt, Human
aaacucagaggcucuuaacag

SEQ ID NO: 1056506 - RNA, 18 nt, Human
aaauaacuuucuaagaca

SEQ ID NO: 1056507 - RNA, 18 nt, Human
aacacaaauaaaugugga

SEQ ID NO: 1056508 - RNA, 22 nt, Human
aagaaaaggcggaaugggaggg

SEQ ID NO: 1056509 - RNA, 18 nt, Human
aagacaaauggcaaaggc

SEQ ID NO: 1056510 - RNA, 22 nt, Human
aagagagagaccaacaaaugua

SEQ ID NO: 1056511 - RNA, 22 nt, Human
aagaugaccuuuacauaaaaau

SEQ ID NO: 1056512 - RNA, 24 nt, Human
aaggagacugagguaggaaaauca

SEQ ID NO: 1056513 - RNA, 22 nt, Human
aauaauccaagagagagaccaa

SEQ ID NO: 1056514 - RNA, 21 nt, Human
aaugcauacugcagauggguu

SEQ ID NO: 1056515 - RNA, 19 nt, Human
aauuaauacagaagaagaa

SEQ ID NO: 1056516 - RNA, 19 nt, Human
acagagauuccaaaguugc

SEQ ID NO: 1056517 - RNA, 18 nt, Human
accacucuuugcuucugu

SEQ ID NO: 1056518 - RNA, 24 nt, Human
acccaaguaauguugucaaaauaa

SEQ ID NO: 1056519 - RNA, 22 nt, Human
acccuauuuaagacuaagaagc

SEQ ID NO: 1056520 - RNA, 21 nt, Human
acuaaaauaaauguauggccc

SEQ ID NO: 1056521 - RNA, 19 nt, Human
agaagaagaaaauaucaga

SEQ ID NO: 1056522 - RNA, 18 nt, Human
agaauuccccaaggugcc

SEQ ID NO: 1056523 - RNA, 22 nt, Human
agacuaagagaauuccccaagg

SEQ ID NO: 1056524 - RNA, 24 nt, Human
agaucagauuaaagucuugaaaga

SEQ ID NO: 1056525 - RNA, 22 nt, Human
agcaaaggcagaaaguauucau

SEQ ID NO: 1056526 - RNA, 26 nt, Human
agcuauuaaaaaggucaaaggagcag

SEQ ID NO: 1056527 - RNA, 23 nt, Human
aggcuuucuuuuucaugaauucc

SEQ ID NO: 1056528 - RNA, 20 nt, Human
aguaauaaacacaaauaaau

SEQ ID NO: 1056529 - RNA, 21 nt, Human
aguuguugcccuuugagcagu

SEQ ID NO: 1056530 - RNA, 18 nt, Human
augaaguuugccauuacc

SEQ ID NO: 1056531 - RNA, 21 nt, Human
augcaauagaaacgaaguauc

SEQ ID NO: 1056532 - RNA, 21 nt, Human
augcucuaccagguauggggg

SEQ ID NO: 1056533 - RNA, 23 nt, Human
auggcccugagaccagaauaaaa

SEQ ID NO: 1056534 - RNA, 23 nt, Human
auggguuacacauuuguuugugu

SEQ ID NO: 1056535 - RNA, 23 nt, Human
auuaaaaacuccauuuacuauag

SEQ ID NO: 1056536 - RNA, 23 nt, Human
caagucacaaauacacugcuuug

SEQ ID NO: 1056537 - RNA, 22 nt, Human
caagucuaguucaagagacugg

SEQ ID NO: 1056538 - RNA, 19 nt, Human
cacucgcagguggcccggc

SEQ ID NO: 1056539 - RNA, 23 nt, Human
cacuuuagccugguggggaaagc

SEQ ID NO: 1056540 - RNA, 20 nt, Human
cagaguuggggaggcaaugg

SEQ ID NO: 1056541 - RNA, 20 nt, Human
cagcuuccaagucacuaccu

SEQ ID NO: 1056542 - RNA, 21 nt, Human
cagcuuccaagucacuaccuu

SEQ ID NO: 1056543 - RNA, 22 nt, Human
caggaagccagguguuaaauca

SEQ ID NO: 1056544 - RNA, 18 nt, Human
ccaacagugguaauuuuc

SEQ ID NO: 1056545 - RNA, 23 nt, Human
ccagagagacuacaaaaagccaa

SEQ ID NO: 1056546 - RNA, 19 nt, Human
ccuuuaaauucccuagucg

SEQ ID NO: 1056547 - RNA, 21 nt, Human
cggccgccuugccccacuccc

SEQ ID NO: 1056548 - RNA, 19 nt, Human
cuaaaauaaauguauggcc

SEQ ID NO: 1056549 - RNA, 27 nt, Human
cuaaaauaaauguauggcccugagacc

SEQ ID NO: 1056550 - RNA, 21 nt, Human
cuauauggaccugcacccuaa

SEQ ID NO: 1056551 - RNA, 19 nt, Human
cuaucauuagcaaaggcag

SEQ ID NO: 1056552 - RNA, 22 nt, Human
gaaccaggaaaccaugagccac

SEQ ID NO: 1056553 - RNA, 21 nt, Human
gaagccagguguuaaaucaaa

SEQ ID NO: 1056554 - RNA, 19 nt, Human
gaccugcacccuaaaacau

SEQ ID NO: 1056555 - RNA, 19 nt, Human
gagcagcuagauguuggga

SEQ ID NO: 1056556 - RNA, 20 nt, Human
gaggggcccggccgccuugc

SEQ ID NO: 1056557 - RNA, 19 nt, Human
gcaaacuuauauguguagu

SEQ ID NO: 1056558 - RNA, 23 nt, Human
gcagcaggugugggcagaguugg

SEQ ID NO: 1056559 - RNA, 18 nt, Human
gcugaaauacgaacucug

SEQ ID NO: 1056560 - RNA, 20 nt, Human
ggaaugggaggggcccggcc

SEQ ID NO: 1056561 - RNA, 20 nt, Human
ggcccggccgccuugcccca

SEQ ID NO: 1056562 - RNA, 24 nt, Human
gggcagaguuggggaggcaauggg

SEQ ID NO: 1056563 - RNA, 18 nt, Human
ggugugggcagaguuggg

SEQ ID NO: 1056564 - RNA, 19 nt, Human
guaaagcacuaauaaugca

SEQ ID NO: 1056565 - RNA, 18 nt, Human
gugggcagaguuggggag

SEQ ID NO: 1056566 - RNA, 23 nt, Human
guuaucuaguaucuugugguaug

SEQ ID NO: 1056567 - RNA, 22 nt, Human
uaaaaacccuauuuaagacuaa

SEQ ID NO: 1056568 - RNA, 20 nt, Human
uaaaaaggucaaaggagcag

SEQ ID NO: 1056569 - RNA, 24 nt, Human
uaaaaugaaaaccaagaauaaaau

SEQ ID NO: 1056570 - RNA, 26 nt, Human
uaaaauggaagaaugcauacugcaga

SEQ ID NO: 1056571 - RNA, 26 nt, Human
uaaaucaaagaaccaggaaaccauga

SEQ ID NO: 1056572 - RNA, 25 nt, Human
uaaauguauggcccugagaccagaa

SEQ ID NO: 1056573 - RNA, 24 nt, Human
uaaauucccuagucgccaagaauc

SEQ ID NO: 1056574 - RNA, 22 nt, Human
uaagaagcacuuuagccuggug

SEQ ID NO: 1056575 - RNA, 22 nt, Human
uaagaugcuuuacaacaaaaua

SEQ ID NO: 1056576 - RNA, 19 nt, Human
uaagcagaaauuuacaaaa

SEQ ID NO: 1056577 - RNA, 23 nt, Human
uacacauuucaagaaagcuguau

SEQ ID NO: 1056578 - RNA, 25 nt, Human
uacagaaugaaaauauaccuuuaga

SEQ ID NO: 1056579 - RNA, 19 nt, Human
uaccagguaugggggcuuc

SEQ ID NO: 1056580 - RNA, 19 nt, Human
uaccuuugggaagcaaugc

SEQ ID NO: 1056581 - RNA, 22 nt, Human
uagaaaaggagacugagguagg

SEQ ID NO: 1056582 - RNA, 25 nt, Human
uagaauaacuaucauuagcaaaggc

SEQ ID NO: 1056583 - RNA, 26 nt, Human
uagaauaacuaucauuagcaaaggca

SEQ ID NO: 1056584 - RNA, 19 nt, Human
uaguggugguaaaauggaa

SEQ ID NO: 1056585 - RNA, 20 nt, Human
uauaucguugaugaagcucc

SEQ ID NO: 1056586 - RNA, 23 nt, Human
uaucauuagcaaaggcagaaagu

SEQ ID NO: 1056587 - RNA, 23 nt, Human
uaugcaauagaaacgaaguaucc

SEQ ID NO: 1056588 - RNA, 18 nt, Human
uauggcccugagaccaga

SEQ ID NO: 1056589 - RNA, 23 nt, Human
uauggcccugagaccagaauaaa

SEQ ID NO: 1056590 - RNA, 23 nt, Human
uauguaacauaauuacagaauga

SEQ ID NO: 1056591 - RNA, 25 nt, Human
uauuauauuuuucuuagccaauaca

SEQ ID NO: 1056592 - RNA, 22 nt, Human
uauugcacccuuucagugguag

SEQ ID NO: 1056593 - RNA, 22 nt, Human
ucaaagaaccaggaaaccauga

SEQ ID NO: 1056594 - RNA, 21 nt, Human
ucacuaccaaaauuuuauuau

SEQ ID NO: 1056595 - RNA, 20 nt, Human
uccaaaguugcauagugagg

SEQ ID NO: 1056596 - RNA, 26 nt, Human
uccaagucacaaauacacugcuuuga

SEQ ID NO: 1056597 - RNA, 18 nt, Human
ucuaaauuagggccugag

SEQ ID NO: 1056598 - RNA, 18 nt, Human
ugaaaauccuuguuagcu

SEQ ID NO: 1056599 - RNA, 18 nt, Human
ugaagagcacuuucugag

SEQ ID NO: 1056600 - RNA, 20 nt, Human
ugaagagcacuuucugagcg

SEQ ID NO: 1056601 - RNA, 24 nt, Human
ugaaguauuaagugauucugcuga

SEQ ID NO: 1056602 - RNA, 24 nt, Human
ugagaaaguggacucaggcagcca

SEQ ID NO: 1056603 - RNA, 18 nt, Human
ugagguaggaaaaucaag

SEQ ID NO: 1056604 - RNA, 20 nt, Human
ugagguaggaaaaucaaggc

SEQ ID NO: 1056605 - RNA, 22 nt, Human
ugauucagauuuuauaagauuu

SEQ ID NO: 1056606 - RNA, 20 nt, Human
ugauucucgacaugauguuu

SEQ ID NO: 1056607 - RNA, 19 nt, Human
ugccccacucccccgagac

SEQ ID NO: 1056608 - RNA, 24 nt, Human
ugccuaauauauaaacuuggagua

SEQ ID NO: 1056609 - RNA, 21 nt, Human
ugcuuuaguauuucuggacuu

SEQ ID NO: 1056610 - RNA, 18 nt, Human
uggaagauaagucuaagg

SEQ ID NO: 1056611 - RNA, 22 nt, Human
uggaauaaagacuggaaaauuu

SEQ ID NO: 1056612 - RNA, 18 nt, Human
ugggaggggcccggccgc

SEQ ID NO: 1056613 - RNA, 24 nt, Human
ugggauaauaacaaaaagacugca

SEQ ID NO: 1056614 - RNA, 25 nt, Human
uguuugagaaaguggacucaggcag

SEQ ID NO: 1056615 - RNA, 21 nt, Human
uuaauuaauacagaagaagaa

SEQ ID NO: 1056616 - RNA, 26 nt, Human
uuaguaaagacauauuuuuucacuau

SEQ ID NO: 1056617 - RNA, 27 nt, Human
uuaguauucauucaagcauugacaacu

SEQ ID NO: 1056618 - RNA, 28 nt, Human
uuaguauucauucaagcauugacaacuu

SEQ ID NO: 1056619 - RNA, 24 nt, Human
uucaaaguaaaagaagcaaauacu

SEQ ID NO: 1056620 - RNA, 21 nt, Human
uugcagucaauuuauauuugg

SEQ ID NO: 1056621 - RNA, 27 nt, Human
uugccccacucccccgagacgcucuua

SEQ ID NO: 1056622 - RNA, 22 nt, Human
uuucuggaaguccuccagagag

SEQ ID NO: 1056623 - RNA, 19 nt, Human
uuuucaugaauucuuuggu

SEQ ID NO: 1056624 - RNA, 22 nt, Human
aaaacaccagccgccguccccc

SEQ ID NO: 1056625 - RNA, 24 nt, Human
aagcggacuuuccaaaggaagggg

SEQ ID NO: 1056626 - RNA, 22 nt, Human
aagggggugggagauagggaaa

SEQ ID NO: 1056627 - RNA, 24 nt, Human
acaaaacaccagccgccguccccc

SEQ ID NO: 1056628 - RNA, 18 nt, Human
accagccgccguccccca

SEQ ID NO: 1056629 - RNA, 19 nt, Human
agaggcgccggcggaggcu

SEQ ID NO: 1056630 - RNA, 19 nt, Human
cccccaaaacaaaaaguga

SEQ ID NO: 1056631 - RNA, 23 nt, Human
cgaauuagacagagcuagaggcg

SEQ ID NO: 1056632 - RNA, 20 nt, Human
uagggccauacaaaacacca

SEQ ID NO: 1056633 - RNA, 20 nt, Human
ucccccaaaacaaaaaguga

SEQ ID NO: 1056634 - RNA, 21 nt, Human
ucccccaaaacaaaaagugac

SEQ ID NO: 1056635 - RNA, 23 nt, Human
uuagacagagcuagaggcgccgg

SEQ ID NO: 1056636 - RNA, 18 nt, Human
uuccaaaggaagggggug

SEQ ID NO: 1056637 - RNA, 19 nt, Human
uuccaaaggaagggggugg

SEQ ID NO: 1056638 - RNA, 19 nt, Human
uucggcagccuucaaaucg

SEQ ID NO: 1056639 - RNA, 19 nt, Human
acagugcaaaauuuuugaa

SEQ ID NO: 1056640 - RNA, 20 nt, Human
agcuaggcauaugagcacug

SEQ ID NO: 1056641 - RNA, 20 nt, Human
aggcaaaaauucagaagcuc

SEQ ID NO: 1056642 - RNA, 19 nt, Human
aguguaguugccacagugg

SEQ ID NO: 1056643 - RNA, 25 nt, Human
ccacagggcugcuccaaacugucau

SEQ ID NO: 1056644 - RNA, 18 nt, Human
cccuuggcccuccugucc

SEQ ID NO: 1056645 - RNA, 24 nt, Human
ccuccuguccuuagcaggcugggc

SEQ ID NO: 1056646 - RNA, 22 nt, Human
cggaaaccgccgaaccuuauca

SEQ ID NO: 1056647 - RNA, 23 nt, Human
cggccuccagcggcucuacuccc

SEQ ID NO: 1056648 - RNA, 22 nt, Human
cuccaauaauaacuaaauauuc

SEQ ID NO: 1056649 - RNA, 20 nt, Human
cuccagcggcucuacucccc

SEQ ID NO: 1056650 - RNA, 19 nt, Human
cugaggacuuggcuuuuuu

SEQ ID NO: 1056651 - RNA, 21 nt, Human
cuuggcccuccuguccuuagc

SEQ ID NO: 1056652 - RNA, 20 nt, Human
gaaacugaggacuuggcuuu

SEQ ID NO: 1056653 - RNA, 18 nt, Human
gacuuggcuuuuuuccuu

SEQ ID NO: 1056654 - RNA, 18 nt, Human
gaggacuucgggguuccc

SEQ ID NO: 1056655 - RNA, 22 nt, Human
gcuucgaggacuucgggguucc

SEQ ID NO: 1056656 - RNA, 19 nt, Human
ggaaacugaggacuuggcu

SEQ ID NO: 1056657 - RNA, 18 nt, Human
ggguucccuuggcccucc

SEQ ID NO: 1056658 - RNA, 19 nt, Human
uaagcagcccaaaccacag

SEQ ID NO: 1056659 - RNA, 18 nt, Human
uaaguacauacaauaaga

SEQ ID NO: 1056660 - RNA, 19 nt, Human
uccuguccuuagcaggcug

SEQ ID NO: 1056661 - RNA, 23 nt, Human
ugcaaguguaguugccacagugg

SEQ ID NO: 1056662 - RNA, 20 nt, Human
ugcuccaaacugucauccac

SEQ ID NO: 1056663 - RNA, 20 nt, Human
uuggaaacugaggacuuggc

SEQ ID NO: 1056664 - RNA, 19 nt, Human
aacaaauaauuaugauuca

SEQ ID NO: 1056665 - RNA, 24 nt, Human
aagaagagaugaacaaaggggacc

SEQ ID NO: 1056666 - RNA, 18 nt, Human
acgccacaggcgccagac

SEQ ID NO: 1056667 - RNA, 27 nt, Human
auaaaacacaucaaaauuaacaaauaa

SEQ ID NO: 1056668 - RNA, 19 nt, Human
caaagcagcaguuguagac

SEQ ID NO: 1056669 - RNA, 19 nt, Human
cagccucagucaacggcag

SEQ ID NO: 1056670 - RNA, 20 nt, Human
caucuaaaagaagagaugaa

SEQ ID NO: 1056671 - RNA, 22 nt, Human
cgacuacuaaagucccaauucu

SEQ ID NO: 1056672 - RNA, 23 nt, Human
uaaaacacaucaaaauuaacaaa

SEQ ID NO: 1056673 - RNA, 19 nt, Human
uaacacuugcaugcauaug

SEQ ID NO: 1056674 - RNA, 24 nt, Human
uaacacuugcaugcauaugguuaa

SEQ ID NO: 1056675 - RNA, 24 nt, Human
uagaauaagcauuaauucugaaaa

SEQ ID NO: 1056676 - RNA, 19 nt, Human
uagauucuucauacucuuc

SEQ ID NO: 1056677 - RNA, 24 nt, Human
ucagucaacggcagccgggcccuc

SEQ ID NO: 1056678 - RNA, 24 nt, Human
ugcaugcauaugguuaacaauauu

SEQ ID NO: 1056679 - RNA, 23 nt, Human
uguagaauaagcauuaauucuga

SEQ ID NO: 1056680 - RNA, 24 nt, Human
uuaacaauauuuaacuaaagguau

SEQ ID NO: 1056681 - RNA, 18 nt, Human
uuaauguuucaucuuuag

SEQ ID NO: 1056682 - RNA, 18 nt, Human
agcacaaccaguccuccc

SEQ ID NO: 1056683 - RNA, 22 nt, Human
aggcccggcggccccggcggaa

SEQ ID NO: 1056684 - RNA, 25 nt, Human
aggccugggccaggaccuuagggga

SEQ ID NO: 1056685 - RNA, 22 nt, Human
augccaucgccuucuccagccc

SEQ ID NO: 1056686 - RNA, 23 nt, Human
caaagcggcagcaugccaucgcc

SEQ ID NO: 1056687 - RNA, 21 nt, Human
ccgaccauccugggcuucucu

SEQ ID NO: 1056688 - RNA, 22 nt, Human
ccugcaccgcgacugcuaggga

SEQ ID NO: 1056689 - RNA, 22 nt, Human
cggcagcaugccaucgccuucu

SEQ ID NO: 1056690 - RNA, 25 nt, Human
cggcuucucagccuuaaccucggcc

SEQ ID NO: 1056691 - RNA, 18 nt, Human
cuagggacugucaaagcg

SEQ ID NO: 1056692 - RNA, 22 nt, Human
cucagccuuaaccucggcgggc

SEQ ID NO: 1056693 - RNA, 22 nt, Human
cucccaucaccugcaccgcgac

SEQ ID NO: 1056694 - RNA, 18 nt, Human
gacaggccugggccagga

SEQ ID NO: 1056695 - RNA, 19 nt, Human
gccuucuccagcccuucuc

SEQ ID NO: 1056696 - RNA, 26 nt, Human
ggcagcaugccaucgccuucuccagc

SEQ ID NO: 1056697 - RNA, 18 nt, Human
ucaaagcggcagcaugcc

SEQ ID NO: 1056698 - RNA, 18 nt, Human
ucccaucaccugcaccgc

SEQ ID NO: 1056699 - RNA, 22 nt, Human
ucgccuucuccagcccuucucc

SEQ ID NO: 1056700 - RNA, 18 nt, Human
ucuccagcccuucuccag

SEQ ID NO: 1056701 - RNA, 21 nt, Human
ucucuuuggacaggccugggc

SEQ ID NO: 1056702 - RNA, 19 nt, Human
aaacaaaaaugacagugac

SEQ ID NO: 1056703 - RNA, 22 nt, Human
aaacaaaaaugacagugaccua

SEQ ID NO: 1056704 - RNA, 25 nt, Human
aaacaagucucucuugggagaaauu

SEQ ID NO: 1056705 - RNA, 23 nt, Human
aaagagaauggucagcuccccaa

SEQ ID NO: 1056706 - RNA, 23 nt, Human
aacauuuaccaaaagagaauggu

SEQ ID NO: 1056707 - RNA, 24 nt, Human
aagcucugcccgagaguccagaac

SEQ ID NO: 1056708 - RNA, 19 nt, Human
acaccacaaaaggcccaaa

SEQ ID NO: 1056709 - RNA, 20 nt, Human
accacaaaaggcccaaacaa

SEQ ID NO: 1056710 - RNA, 24 nt, Human
acugacaccacaaaaggcccaaac

SEQ ID NO: 1056711 - RNA, 22 nt, Human
agccagugaggaguggaagggg

SEQ ID NO: 1056712 - RNA, 20 nt, Human
aggaaacacaccuggucccu

SEQ ID NO: 1056713 - RNA, 18 nt, Human
aggcagggucugagggcc

SEQ ID NO: 1056714 - RNA, 24 nt, Human
aggcagggucugagggccccuggg

SEQ ID NO: 1056715 - RNA, 21 nt, Human
aguggaagggguuaauccgaa

SEQ ID NO: 1056716 - RNA, 21 nt, Human
aguucccacacucugcccggu

SEQ ID NO: 1056717 - RNA, 24 nt, Human
aguuuacuauagauacucccccca

SEQ ID NO: 1056718 - RNA, 25 nt, Human
auagauacuccccccaacucuuaaa

SEQ ID NO: 1056719 - RNA, 21 nt, Human
aucccaauuacucugguugca

SEQ ID NO: 1056720 - RNA, 24 nt, Human
auucugcugggucagcucguggag

SEQ ID NO: 1056721 - RNA, 23 nt, Human
caacucuuaaaacaaaaaugaca

SEQ ID NO: 1056722 - RNA, 23 nt, Human
cacaaaaggcccaaacaagucuc

SEQ ID NO: 1056723 - RNA, 22 nt, Human
cacacagucauucugcugucag

SEQ ID NO: 1056724 - RNA, 18 nt, Human
cacauacaaaaguacagc

SEQ ID NO: 1056725 - RNA, 19 nt, Human
cacccaaacuuccaaaagu

SEQ ID NO: 1056726 - RNA, 21 nt, Human
caccuggucccugggccucug

SEQ ID NO: 1056727 - RNA, 21 nt, Human
cacugacaccacaaaaggccc

SEQ ID NO: 1056728 - RNA, 25 nt, Human
cagaucacuugaagccagccuuguu

SEQ ID NO: 1056729 - RNA, 19 nt, Human
cagcaggaaaggccaccca

SEQ ID NO: 1056730 - RNA, 25 nt, Human
cagggucugagggccccugggauuc

SEQ ID NO: 1056731 - RNA, 22 nt, Human
cauacaaaaguacagcuacaaa

SEQ ID NO: 1056732 - RNA, 21 nt, Human
cauccacccaaacuuccaaaa

SEQ ID NO: 1056733 - RNA, 22 nt, Human
cccccaacucuuaaaacaaaaa

SEQ ID NO: 1056734 - RNA, 22 nt, Human
ccccugggauucucagaauaga

SEQ ID NO: 1056735 - RNA, 24 nt, Human
cccgagaguccagaacggcggacc

SEQ ID NO: 1056736 - RNA, 24 nt, Human
cugcugggucagcucguggagugu

SEQ ID NO: 1056737 - RNA, 22 nt, Human
cuugauccugacacccucuuca

SEQ ID NO: 1056738 - RNA, 20 nt, Human
gaggaaacacaccugguccc

SEQ ID NO: 1056739 - RNA, 24 nt, Human
gcccaaacaagucucucuugggag

SEQ ID NO: 1056740 - RNA, 20 nt, Human
gcuccccaaguugcccaccc

SEQ ID NO: 1056741 - RNA, 19 nt, Human
uaccaaaagagaaugguca

SEQ ID NO: 1056742 - RNA, 21 nt, Human
uaccaaaagagaauggucagc

SEQ ID NO: 1056743 - RNA, 20 nt, Human
uaccuauccauuccacugac

SEQ ID NO: 1056744 - RNA, 22 nt, Human
uacuaugaaucacaacacaguc

SEQ ID NO: 1056745 - RNA, 18 nt, Human
uacucugguugcagauca

SEQ ID NO: 1056746 - RNA, 19 nt, Human
uacuguguggacaaucugc

SEQ ID NO: 1056747 - RNA, 22 nt, Human
uauucauccucuugagccguca

SEQ ID NO: 1056748 - RNA, 22 nt, Human
ucagaacacagugaaccagcca

SEQ ID NO: 1056749 - RNA, 18 nt, Human
uccacugacaccacaaaa

SEQ ID NO: 1056750 - RNA, 25 nt, Human
uccacugacaccacaaaaggcccaa

SEQ ID NO: 1056751 - RNA, 18 nt, Human
ucccaauuacucugguug

SEQ ID NO: 1056752 - RNA, 27 nt, Human
ucuaugaucguauugaggccggggucc

SEQ ID NO: 1056753 - RNA, 26 nt, Human
ucucucacaaagcucugcccgagagu

SEQ ID NO: 1056754 - RNA, 19 nt, Human
ucucucuuuuuaauguacu

SEQ ID NO: 1056755 - RNA, 23 nt, Human
ucugcuuaucuuggaaagcuuca

SEQ ID NO: 1056756 - RNA, 19 nt, Human
ucuugguucucaguuucuc

SEQ ID NO: 1056757 - RNA, 20 nt, Human
ugaaagagaacagggagagu

SEQ ID NO: 1056758 - RNA, 23 nt, Human
ugaggcaguaguucccacacucu

SEQ ID NO: 1056759 - RNA, 19 nt, Human
uggaagggguuaauccgaa

SEQ ID NO: 1056760 - RNA, 23 nt, Human
uggacaaucugcagcuauaaaaa

SEQ ID NO: 1056761 - RNA, 18 nt, Human
uggagugucagcaggaaa

SEQ ID NO: 1056762 - RNA, 19 nt, Human
ugggccucugcauauagca

SEQ ID NO: 1056763 - RNA, 25 nt, Human
ugugaaguucaaggucacacaguca

SEQ ID NO: 1056764 - RNA, 18 nt, Human
uuccaaaaguauacugug

SEQ ID NO: 1056765 - RNA, 20 nt, Human
uucuaugaucguauugaggc

SEQ ID NO: 1056766 - RNA, 20 nt, Human
uucucucacaaagcucugcc

SEQ ID NO: 1056767 - RNA, 23 nt, Human
uucuuucucucucucucucuuuu

SEQ ID NO: 1056768 - RNA, 22 nt, Human
uugaagccagccuuguuucucu

SEQ ID NO: 1056769 - RNA, 23 nt, Human
uugaagccagccuuguuucucuc

SEQ ID NO: 1056770 - RNA, 25 nt, Human
uugaagccagccuuguuucucucac

SEQ ID NO: 1056771 - RNA, 19 nt, Human
aaugauaaaaacuacugga

SEQ ID NO: 1056772 - RNA, 23 nt, Human
aauuaugguauacuggggaccgg

SEQ ID NO: 1056773 - RNA, 21 nt, Human
acaacgaaggcgcacccugga

SEQ ID NO: 1056774 - RNA, 22 nt, Human
agagugugguaugauagggagg

SEQ ID NO: 1056775 - RNA, 23 nt, Human
agagugugguaugauagggaggu

SEQ ID NO: 1056776 - RNA, 21 nt, Human
cacccuggaaguuaccuccgc

SEQ ID NO: 1056777 - RNA, 24 nt, Human
ccacuucuuuaacaucaagcuaaa

SEQ ID NO: 1056778 - RNA, 20 nt, Human
cugcacaugaauuuccaccu

SEQ ID NO: 1056779 - RNA, 23 nt, Human
cuggaaugacaugaugccuuucu

SEQ ID NO: 1056780 - RNA, 19 nt, Human
gaaggcgcacccuggaagu

SEQ ID NO: 1056781 - RNA, 23 nt, Human
gacaacgaaggcgcacccuggaa

SEQ ID NO: 1056782 - RNA, 20 nt, Human
gagugugguaugauagggag

SEQ ID NO: 1056783 - RNA, 19 nt, Human
ggaaaaugauaaaaacuac

SEQ ID NO: 1056784 - RNA, 22 nt, Human
ggaaaaugauaaaaacuacugg

SEQ ID NO: 1056785 - RNA, 22 nt, Human
uaaaaaggauuuguuucuuuuu

SEQ ID NO: 1056786 - RNA, 24 nt, Human
uaaaugucucugcacaugaauuuc

SEQ ID NO: 1056787 - RNA, 18 nt, Human
uagauuuguauauuuucu

SEQ ID NO: 1056788 - RNA, 23 nt, Human
uaggugaaaugguaugacuauaa

SEQ ID NO: 1056789 - RNA, 18 nt, Human
uaugacuauaaaaaggau

SEQ ID NO: 1056790 - RNA, 20 nt, Human
ucucugcacaugaauuucca

SEQ ID NO: 1056791 - RNA, 22 nt, Human
uggagaagacaacgaaggcgca

SEQ ID NO: 1056792 - RNA, 21 nt, Human
uuuuuuuuuuuuuugcuuuua

SEQ ID NO: 1056793 - RNA, 24 nt, Human
uuuuuuuuuuuuuuuuuugcuuuu

SEQ ID NO: 1056794 - RNA, 27 nt, Human
uuuuuuuuuuuuuuuuuuuuuuugggg

SEQ ID NO: 1056795 - RNA, 21 nt, Human
aaaaauaaacaggucaaagaa

SEQ ID NO: 1056796 - RNA, 18 nt, Human
aaaagcagguggccugac

SEQ ID NO: 1056797 - RNA, 24 nt, Human
aaacacagccagcgacaguugaaa

SEQ ID NO: 1056798 - RNA, 21 nt, Human
aaagcagguggccugaccuac

SEQ ID NO: 1056799 - RNA, 27 nt, Human
aaguacaaaggccacaacaagugagcu

SEQ ID NO: 1056800 - RNA, 23 nt, Human
acagaggaagagguuucuccaaa

SEQ ID NO: 1056801 - RNA, 21 nt, Human
acagccagcgacaguugaaac

SEQ ID NO: 1056802 - RNA, 24 nt, Human
accagugcacuggagaugaagaaa

SEQ ID NO: 1056803 - RNA, 22 nt, Human
accggaugucgucuuugccauc

SEQ ID NO: 1056804 - RNA, 22 nt, Human
agccagcgacaguugaaacaca

SEQ ID NO: 1056805 - RNA, 22 nt, Human
aggggcccgggaaauccacugg

SEQ ID NO: 1056806 - RNA, 23 nt, Human
auucagagccuugacugagcggc

SEQ ID NO: 1056807 - RNA, 22 nt, Human
caaagugcugaaucccucugca

SEQ ID NO: 1056808 - RNA, 21 nt, Human
caacaagugagcucaggcucu

SEQ ID NO: 1056809 - RNA, 19 nt, Human
caagcugcugaguggcuga

SEQ ID NO: 1056810 - RNA, 21 nt, Human
caaggacacuguguaagucac

SEQ ID NO: 1056811 - RNA, 22 nt, Human
caagugagcucaggcucuucag

SEQ ID NO: 1056812 - RNA, 24 nt, Human
cacagcggcaguugaaacacagcc

SEQ ID NO: 1056813 - RNA, 19 nt, Human
cacaggaccucagcgacag

SEQ ID NO: 1056814 - RNA, 20 nt, Human
cacaggaccucagcgacagg

SEQ ID NO: 1056815 - RNA, 20 nt, Human
cacucuaaauucuccuuacc

SEQ ID NO: 1056816 - RNA, 22 nt, Human
cagagaauguucaaaugaacac

SEQ ID NO: 1056817 - RNA, 19 nt, Human
caggaccucagcgacaggu

SEQ ID NO: 1056818 - RNA, 18 nt, Human
cauagccauucuuaucuc

SEQ ID NO: 1056819 - RNA, 23 nt, Human
ccagcauaaguacaaaggccaca

SEQ ID NO: 1056820 - RNA, 24 nt, Human
ccaggaaagucaaaagcauauaca

SEQ ID NO: 1056821 - RNA, 18 nt, Human
ccccaaggagagaaucaa

SEQ ID NO: 1056822 - RNA, 18 nt, Human
ccuacgaugguccugggg

SEQ ID NO: 1056823 - RNA, 23 nt, Human
ccuacgaugguccuggggcauuc

SEQ ID NO: 1056824 - RNA, 20 nt, Human
ccucugugcaaccacuugcc

SEQ ID NO: 1056825 - RNA, 21 nt, Human
ccucugugcaaccacuugccc

SEQ ID NO: 1056826 - RNA, 22 nt, Human
cgacucaucaaucaacacccag

SEQ ID NO: 1056827 - RNA, 19 nt, Human
cgcaccggaugucgucuuu

SEQ ID NO: 1056828 - RNA, 20 nt, Human
cggcuggggcugaauccaca

SEQ ID NO: 1056829 - RNA, 20 nt, Human
cgggagagggcuuguuggua

SEQ ID NO: 1056830 - RNA, 22 nt, Human
cguacacuccagagggcugagg

SEQ ID NO: 1056831 - RNA, 23 nt, Human
cucccgggccugccggggucauc

SEQ ID NO: 1056832 - RNA, 21 nt, Human
cugccgcucucuagaccagug

SEQ ID NO: 1056833 - RNA, 24 nt, Human
cuggggcugaauccacagcaaggg

SEQ ID NO: 1056834 - RNA, 23 nt, Human
gaaacucucugguguccggggcu

SEQ ID NO: 1056835 - RNA, 19 nt, Human
gaaucaugcuaaaaaccua

SEQ ID NO: 1056836 - RNA, 21 nt, Human
gagcggccaagggcgccacag

SEQ ID NO: 1056837 - RNA, 20 nt, Human
gagcucaggcucuucagcag

SEQ ID NO: 1056838 - RNA, 22 nt, Human
gagguuucuccaaaacucguac

SEQ ID NO: 1056839 - RNA, 23 nt, Human
gcucaggcucuucagcagccuca

SEQ ID NO: 1056840 - RNA, 20 nt, Human
ggagaugaagaaaaaagaag

SEQ ID NO: 1056841 - RNA, 27 nt, Human
gggauuuuccccacuuuuucugcaggu

SEQ ID NO: 1056842 - RNA, 21 nt, Human
guugggguggaagacaggaua

SEQ ID NO: 1056843 - RNA, 24 nt, Human
uaaauucuccuuaccaaggacacu

SEQ ID NO: 1056844 - RNA, 19 nt, Human
uaagcugacacaaucacau

SEQ ID NO: 1056845 - RNA, 18 nt, Human
ucaacacccagucauagc

SEQ ID NO: 1056846 - RNA, 20 nt, Human
ucacaggaccucagcgacag

SEQ ID NO: 1056847 - RNA, 19 nt, Human
ucacucccgggccugccgg

SEQ ID NO: 1056848 - RNA, 23 nt, Human
ucagagccuugacugagcggcca

SEQ ID NO: 1056849 - RNA, 21 nt, Human
ucaggcucuucagcagccuca

SEQ ID NO: 1056850 - RNA, 23 nt, Human
ucaguccaggaaagucaaaagca

SEQ ID NO: 1056851 - RNA, 19 nt, Human
uccaaaacucguacacucc

SEQ ID NO: 1056852 - RNA, 22 nt, Human
uccaacugccgcucucuagacc

SEQ ID NO: 1056853 - RNA, 24 nt, Human
uccacgggauccucugugcaacca

SEQ ID NO: 1056854 - RNA, 21 nt, Human
uccagagggcugaggggcccg

SEQ ID NO: 1056855 - RNA, 19 nt, Human
uccccaaaagacacaacaa

SEQ ID NO: 1056856 - RNA, 26 nt, Human
uccccaaaagacacaacaacggcugg

SEQ ID NO: 1056857 - RNA, 18 nt, Human
uccuucagcucacuaggu

SEQ ID NO: 1056858 - RNA, 22 nt, Human
ucggcuggaggaccuacaggaa

SEQ ID NO: 1056859 - RNA, 23 nt, Human
ucucugguguccggggcuuccaa

SEQ ID NO: 1056860 - RNA, 23 nt, Human
ucugcaggugccgggagagggcu

SEQ ID NO: 1056861 - RNA, 23 nt, Human
ucugccucuucggggauuuuccc

SEQ ID NO: 1056862 - RNA, 24 nt, Human
ucugccucuucggggauuuucccc

SEQ ID NO: 1056863 - RNA, 21 nt, Human
ucugggguccaacugccgcuc

SEQ ID NO: 1056864 - RNA, 18 nt, Human
ugacaaaagcagguggcc

SEQ ID NO: 1056865 - RNA, 23 nt, Human
ugagcucaggcucuucagcagcc

SEQ ID NO: 1056866 - RNA, 21 nt, Human
ugaguggcugaugaugucauu

SEQ ID NO: 1056867 - RNA, 23 nt, Human
ugccgggagagggcuuguuggua

SEQ ID NO: 1056868 - RNA, 18 nt, Human
ugcuuggcaauuaaguga

SEQ ID NO: 1056869 - RNA, 21 nt, Human
uggggaguucugauaaccuca

SEQ ID NO: 1056870 - RNA, 18 nt, Human
ugggguccaacugccgcc

SEQ ID NO: 1056871 - RNA, 24 nt, Human
uguauacaggucuuuucuucaguu

SEQ ID NO: 1056872 - RNA, 21 nt, Human
uguccuguguauacaggucuu

SEQ ID NO: 1056873 - RNA, 20 nt, Human
uguuucugccucuucgggga

SEQ ID NO: 1056874 - RNA, 18 nt, Human
uuccccacuuuuucugca

SEQ ID NO: 1056875 - RNA, 19 nt, Human
uuugccauccccagugggc

SEQ ID NO: 1056876 - RNA, 19 nt, Human
acagcgggguccuccagga

SEQ ID NO: 1056877 - RNA, 22 nt, Human
auggugcuugccgcugccgcug

SEQ ID NO: 1056878 - RNA, 18 nt, Human
cagcaggcgacagcgggg

SEQ ID NO: 1056879 - RNA, 24 nt, Human
cagcaggcgacagcgggguccucc

SEQ ID NO: 1056880 - RNA, 24 nt, Human
caggaaggguagcgggcagcaggc

SEQ ID NO: 1056881 - RNA, 21 nt, Human
caggcgacagcgggguccucc

SEQ ID NO: 1056882 - RNA, 18 nt, Human
ccgcugccgcugcagcgc

SEQ ID NO: 1056883 - RNA, 19 nt, Human
cgcugcugcucagcugugg

SEQ ID NO: 1056884 - RNA, 18 nt, Human
cuccaggagcgcugcugc

SEQ ID NO: 1056885 - RNA, 24 nt, Human
gagcgcugcugcucagcugugggc

SEQ ID NO: 1056886 - RNA, 19 nt, Human
gugcuugccgcugccgcug

SEQ ID NO: 1056887 - RNA, 22 nt, Human
ucagcagcaggaaggguagcgg

SEQ ID NO: 1056888 - RNA, 20 nt, Human
ugcucagguagcucagcagc

SEQ ID NO: 1056889 - RNA, 21 nt, Human
ugcugcucagcugugggcgca

SEQ ID NO: 1056890 - RNA, 19 nt, Human
aaaaaaaaaaaaaaaaaga

SEQ ID NO: 1056891 - RNA, 18 nt, Human
aaauguuagaaauuauau

SEQ ID NO: 1056892 - RNA, 20 nt, Human
aacauggugaauccccauau

SEQ ID NO: 1056893 - RNA, 23 nt, Human
aacgacaggaucuuuuggcaaaa

SEQ ID NO: 1056894 - RNA, 22 nt, Human
aagcagucucaacaauaaccaa

SEQ ID NO: 1056895 - RNA, 21 nt, Human
aauaugaugucguucaagaag

SEQ ID NO: 1056896 - RNA, 18 nt, Human
aaucgcuugaaccuggga

SEQ ID NO: 1056897 - RNA, 25 nt, Human
acaaagcaagacuccguucucaaaa

SEQ ID NO: 1056898 - RNA, 18 nt, Human
acuagagccuuucaaugc

SEQ ID NO: 1056899 - RNA, 18 nt, Human
acugcaguccagccuggg

SEQ ID NO: 1056900 - RNA, 23 nt, Human
acugcaguccagccugggugaca

SEQ ID NO: 1056901 - RNA, 24 nt, Human
acuuauuggauaacuaauacauuu

SEQ ID NO: 1056902 - RNA, 22 nt, Human
agaaucgcuugaaccugggaga

SEQ ID NO: 1056903 - RNA, 23 nt, Human
agaucaaucucugggaaaacacu

SEQ ID NO: 1056904 - RNA, 19 nt, Human
agauggagguugcagagcc

SEQ ID NO: 1056905 - RNA, 21 nt, Human
agauggagguugcagagccga

SEQ ID NO: 1056906 - RNA, 24 nt, Human
agcacauauacaaacauauuuacc

SEQ ID NO: 1056907 - RNA, 18 nt, Human
agccaggcauaguggugc

SEQ ID NO: 1056908 - RNA, 24 nt, Human
agccugggugacaaagcaagacuc

SEQ ID NO: 1056909 - RNA, 24 nt, Human
aggcagaucacaaggucaggaguu

SEQ ID NO: 1056910 - RNA, 22 nt, Human
aggcaggagaaucgcuugaacc

SEQ ID NO: 1056911 - RNA, 24 nt, Human
aggcaggagaaucgcuugaaccug

SEQ ID NO: 1056912 - RNA, 24 nt, Human
aggcaggcagaucacaaggucagg

SEQ ID NO: 1056913 - RNA, 24 nt, Human
aggcauaguggugccugccuguaa

SEQ ID NO: 1056914 - RNA, 23 nt, Human
aggccgaggcaggcagaucacaa

SEQ ID NO: 1056915 - RNA, 20 nt, Human
aggcugaggcaggagaaucg

SEQ ID NO: 1056916 - RNA, 24 nt, Human
aggcugaggcaggagaaucgcuug

SEQ ID NO: 1056917 - RNA, 24 nt, Human
aguggugccugccuguaaucccag

SEQ ID NO: 1056918 - RNA, 21 nt, Human
auaaguagaucaauaauuaga

SEQ ID NO: 1056919 - RNA, 29 nt, Human
auaucaaaaaaaaaaagccagaucaaucu

SEQ ID NO: 1056920 - RNA, 25 nt, Human
aucaaaauucucugucuugaaaauu

SEQ ID NO: 1056921 - RNA, 21 nt, Human
aucacaaggucaggaguucga

SEQ ID NO: 1056922 - RNA, 24 nt, Human
aucaugccacugcaguccagccug

SEQ ID NO: 1056923 - RNA, 19 nt, Human
augccuguaaucccaauac

SEQ ID NO: 1056924 - RNA, 20 nt, Human
caaaaaaaaaaagccagauc

SEQ ID NO: 1056925 - RNA, 25 nt, Human
caaaugaaagaaacacaugacuuug

SEQ ID NO: 1056926 - RNA, 18 nt, Human
caacggcacgagaauacc

SEQ ID NO: 1056927 - RNA, 22 nt, Human
caacggcacgagaauaccaacu

SEQ ID NO: 1056928 - RNA, 22 nt, Human
caagacuccguucucaaaaaaa

SEQ ID NO: 1056929 - RNA, 19 nt, Human
caaucucugggaaaacacu

SEQ ID NO: 1056930 - RNA, 19 nt, Human
cacugcaguccagccuggg

SEQ ID NO: 1056931 - RNA, 24 nt, Human
cacugcaguccagccugggugaca

SEQ ID NO: 1056932 - RNA, 23 nt, Human
cagaagaauaaugcaaaucucac

SEQ ID NO: 1056933 - RNA, 22 nt, Human
cagcaccaaaugaaagaaacac

SEQ ID NO: 1056934 - RNA, 24 nt, Human
cagcuacuugggaggcugaggcag

SEQ ID NO: 1056935 - RNA, 20 nt, Human
caugccuguaaucccaauac

SEQ ID NO: 1056936 - RNA, 22 nt, Human
caugccuguaaucccaauacug

SEQ ID NO: 1056937 - RNA, 22 nt, Human
cauucaaacacauuuuugcuau

SEQ ID NO: 1056938 - RNA, 23 nt, Human
ccaauacugggaggccgaggcag

SEQ ID NO: 1056939 - RNA, 24 nt, Human
ccaauacugggaggccgaggcagg

SEQ ID NO: 1056940 - RNA, 20 nt, Human
ccacugcaguccagccuggg

SEQ ID NO: 1056941 - RNA, 20 nt, Human
ccacugcaguccagccuggg

SEQ ID NO: 1056942 - RNA, 21 nt, Human
ccacugcaguccagccugggu

SEQ ID NO: 1056943 - RNA, 24 nt, Human
ccacugcaguccagccugggugac

SEQ ID NO: 1056944 - RNA, 19 nt, Human
ccagcaccugacauaguuu

SEQ ID NO: 1056945 - RNA, 21 nt, Human
ccccgcaccacacgcuucccc

SEQ ID NO: 1056946 - RNA, 21 nt, Human
cccgcccccaggcuaacucua

SEQ ID NO: 1056947 - RNA, 24 nt, Human
ccugaccaacauggugaaucccca

SEQ ID NO: 1056948 - RNA, 23 nt, Human
ccugcagcuaugacagcaucugc

SEQ ID NO: 1056949 - RNA, 22 nt, Human
ccugccccucuaaauuuaaaaa

SEQ ID NO: 1056950 - RNA, 21 nt, Human
ccugggagauggagguugcag

SEQ ID NO: 1056951 - RNA, 22 nt, Human
ccugggugacaaagcaagacuc

SEQ ID NO: 1056952 - RNA, 19 nt, Human
ccuguaaucccagcuacuu

SEQ ID NO: 1056953 - RNA, 21 nt, Human
ccuguaaucccagcuacuugg

SEQ ID NO: 1056954 - RNA, 22 nt, Human
ccuuuauuuaagccugccccuc

SEQ ID NO: 1056955 - RNA, 26 nt, Human
cgaacagucucuucaucauauucucu

SEQ ID NO: 1056956 - RNA, 19 nt, Human
cgacuauccguccagcuuu

SEQ ID NO: 1056957 - RNA, 24 nt, Human
cgagaccagccugaccaacauggu

SEQ ID NO: 1056958 - RNA, 26 nt, Human
cgaggcaggcagaucacaaggucagg

SEQ ID NO: 1056959 - RNA, 25 nt, Human
cuauaaaaaauaugcacuaaucaaa

SEQ ID NO: 1056960 - RNA, 23 nt, Human
cucaaaaaaaaaaaaaaaaaaaa

SEQ ID NO: 1056961 - RNA, 20 nt, Human
cucaugccuguaaucccaau

SEQ ID NO: 1056962 - RNA, 25 nt, Human
cuccguucucaaaaaaaaaaaaaaa

SEQ ID NO: 1056963 - RNA, 28 nt, Human
cuccguucucaaaaaaaaaaaaaaaaaa

SEQ ID NO: 1056964 - RNA, 20 nt, Human
cucuuuacuagacgaaccuc

SEQ ID NO: 1056965 - RNA, 23 nt, Human
gagaucaugccacugcaguccag

SEQ ID NO: 1056966 - RNA, 24 nt, Human
gagcccacgggcaagcagucucaa

SEQ ID NO: 1056967 - RNA, 21 nt, Human
gaucacaaggucaggaguucg

SEQ ID NO: 1056968 - RNA, 22 nt, Human
gaucacaaggucaggaguucga

SEQ ID NO: 1056969 - RNA, 24 nt, Human
gaucacaaggucaggaguucgaga

SEQ ID NO: 1056970 - RNA, 19 nt, Human
gcagaucacaaggucagga

SEQ ID NO: 1056971 - RNA, 19 nt, Human
gccacugcaguccagccug

SEQ ID NO: 1056972 - RNA, 24 nt, Human
gccacugcaguccagccuggguga

SEQ ID NO: 1056973 - RNA, 22 nt, Human
gcccacgggcaagcagucucaa

SEQ ID NO: 1056974 - RNA, 20 nt, Human
gccgagaucaugccacugca

SEQ ID NO: 1056975 - RNA, 22 nt, Human
gccgggcaugguggcucaugcc

SEQ ID NO: 1056976 - RNA, 18 nt, Human
gccugccuguaaucccag

SEQ ID NO: 1056977 - RNA, 23 nt, Human
ggcaugguggcucaugccuguaa

SEQ ID NO: 1056978 - RNA, 23 nt, Human
ggccgggcaugguggcucaugcc

SEQ ID NO: 1056979 - RNA, 23 nt, Human
gguggcucaugccuguaauccca

SEQ ID NO: 1056980 - RNA, 18 nt, Human
guauaucaaaaaaaaaaa

SEQ ID NO: 1056981 - RNA, 20 nt, Human
uaaaaaauugauaagaacaa

SEQ ID NO: 1056982 - RNA, 26 nt, Human
uaaaagcuauucuguaaaucuuggaa

SEQ ID NO: 1056983 - RNA, 19 nt, Human
uaaagauggaagaaaccug

SEQ ID NO: 1056984 - RNA, 24 nt, Human
uaacagaucuauuuggacaaucag

SEQ ID NO: 1056985 - RNA, 21 nt, Human
uaagagcacucaauucgacua

SEQ ID NO: 1056986 - RNA, 19 nt, Human
uaaggauagagucuguuuc

SEQ ID NO: 1056987 - RNA, 24 nt, Human
uaaggccgggcaugguggcucaug

SEQ ID NO: 1056988 - RNA, 23 nt, Human
uaauuuccuccaaaaauaaagga

SEQ ID NO: 1056989 - RNA, 23 nt, Human
uacuauaaaaaauaugcacuaau

SEQ ID NO: 1056990 - RNA, 18 nt, Human
uagcacauauacaaacau

SEQ ID NO: 1056991 - RNA, 23 nt, Human
uaguauggagcuucuuuauaaag

SEQ ID NO: 1056992 - RNA, 24 nt, Human
uaguggugccugccuguaauccca

SEQ ID NO: 1056993 - RNA, 24 nt, Human
uaguuuuacauggcacagaguggg

SEQ ID NO: 1056994 - RNA, 19 nt, Human
uaucaaaaaaaaaaagcca

SEQ ID NO: 1056995 - RNA, 23 nt, Human
uaucaaaaaaaaaaagccagauc

SEQ ID NO: 1056996 - RNA, 21 nt, Human
uaucacaaauggagcacaaua

SEQ ID NO: 1056997 - RNA, 22 nt, Human
uauuucacccagaacugcugaa

SEQ ID NO: 1056998 - RNA, 23 nt, Human
ucaaaaaaaaaaaaaaaaaaaaa

SEQ ID NO: 1056999 - RNA, 24 nt, Human
ucacaaggucaggaguucgagacc

SEQ ID NO: 1057000 - RNA, 23 nt, Human
ucagcaccaaaugaaagaaacac

SEQ ID NO: 1057001 - RNA, 22 nt, Human
ucagcacucuugguuaccaauu

SEQ ID NO: 1057002 - RNA, 21 nt, Human
ucaguucauccuuuuaguccc

SEQ ID NO: 1057003 - RNA, 21 nt, Human
ucaugccacugcaguccagcc

SEQ ID NO: 1057004 - RNA, 23 nt, Human
ucaugccacugcaguccagccug

SEQ ID NO: 1057005 - RNA, 22 nt, Human
ucaugccuguaaucccaauacu

SEQ ID NO: 1057006 - RNA, 24 nt, Human
uccagccugggugacaaagcaaga

SEQ ID NO: 1057007 - RNA, 24 nt, Human
ucgcuugaaccugggagauggagg

SEQ ID NO: 1057008 - RNA, 25 nt, Human
ucgcuugaaccugggagauggaggu

SEQ ID NO: 1057009 - RNA, 20 nt, Human
ucuacuaaaaauacaaaaaa

SEQ ID NO: 1057010 - RNA, 20 nt, Human
ucuauaguauggagcuucuu

SEQ ID NO: 1057011 - RNA, 21 nt, Human
ucucgccaguaaucaaaauuu

SEQ ID NO: 1057012 - RNA, 18 nt, Human
ucuggauauacaucaaaa

SEQ ID NO: 1057013 - RNA, 18 nt, Human
ugaaaaccacaauacuaa

SEQ ID NO: 1057014 - RNA, 18 nt, Human
ugaaagaaacacaugacu

SEQ ID NO: 1057015 - RNA, 23 nt, Human
ugaaagcauucaucuauaauuuc

SEQ ID NO: 1057016 - RNA, 21 nt, Human
ugaacagaaauuuucagcacc

SEQ ID NO: 1057017 - RNA, 24 nt, Human
ugaaccugggagauggagguugca

SEQ ID NO: 1057018 - RNA, 20 nt, Human
ugaggcaggagaaucgcuug

SEQ ID NO: 1057019 - RNA, 24 nt, Human
ugaggcaggagaaucgcuugaacc

SEQ ID NO: 1057020 - RNA, 25 nt, Human
ugaggcaggagaaucgcuugaaccu

SEQ ID NO: 1057021 - RNA, 21 nt, Human
ugccuguaaucccaauacugg

SEQ ID NO: 1057022 - RNA, 22 nt, Human
ugccuguaaucccaauacuggg

SEQ ID NO: 1057023 - RNA, 23 nt, Human
ugccuguaaucccagcuacuugg

SEQ ID NO: 1057024 - RNA, 24 nt, Human
ugccuguaaucccagcuacuuggg

SEQ ID NO: 1057025 - RNA, 23 nt, Human
ugcuaugcuaacauuccuuugcc

SEQ ID NO: 1057026 - RNA, 19 nt, Human
uggaagaaaccuguaagac

SEQ ID NO: 1057027 - RNA, 21 nt, Human
uggcucaugccuguaauccca

SEQ ID NO: 1057028 - RNA, 22 nt, Human
uggcucaugccuguaaucccaa

SEQ ID NO: 1057029 - RNA, 24 nt, Human
uggcucaugccuguaaucccaaua

SEQ ID NO: 1057030 - RNA, 24 nt, Human
ugggaaaacacuacauuuuaaugu

SEQ ID NO: 1057031 - RNA, 23 nt, Human
ugggagauggagguugcagagcc

SEQ ID NO: 1057032 - RNA, 20 nt, Human
ugggaggccgaggcaggcag

SEQ ID NO: 1057033 - RNA, 24 nt, Human
ugggaggccgaggcaggcagauca

SEQ ID NO: 1057034 - RNA, 19 nt, Human
ugggaggcugaggcaggag

SEQ ID NO: 1057035 - RNA, 23 nt, Human
ugggaggcugaggcaggagaauc

SEQ ID NO: 1057036 - RNA, 21 nt, Human
ugggugacaaagcaagacucc

SEQ ID NO: 1057037 - RNA, 24 nt, Human
ugguggcucaugccuguaauccca

SEQ ID NO: 1057038 - RNA, 19 nt, Human
uguauaucaaaaaaaaaaa

SEQ ID NO: 1057039 - RNA, 19 nt, Human
ugugccaucaccuccugca

SEQ ID NO: 1057040 - RNA, 19 nt, Human
uuaaauauuggcaaaacua

SEQ ID NO: 1057041 - RNA, 21 nt, Human
uuacagaaugaaacucaaaug

SEQ ID NO: 1057042 - RNA, 21 nt, Human
uuagccaggcauaguggugcc

SEQ ID NO: 1057043 - RNA, 24 nt, Human
uuaggucaaugucaggauuuauca

SEQ ID NO: 1057044 - RNA, 23 nt, Human
uucaagaaguccacuguaacuag

SEQ ID NO: 1057045 - RNA, 24 nt, Human
uucaucaacauauccagcaccuga

SEQ ID NO: 1057046 - RNA, 18 nt, Human
uuccuugagauuaaggau

SEQ ID NO: 1057047 - RNA, 19 nt, Human
uucugagcccacaagacuc

SEQ ID NO: 1057048 - RNA, 24 nt, Human
uugaaccugggagauggagguugc

SEQ ID NO: 1057049 - RNA, 24 nt, Human
uugggaggcugaggcaggagaauc

SEQ ID NO: 1057050 - RNA, 20 nt, Human
aacagagggguggcgugugc

SEQ ID NO: 1057051 - RNA, 22 nt, Human
aaccuucaaaggaccagggaug

SEQ ID NO: 1057052 - RNA, 20 nt, Human
aagaaagaugaaacaaauga

SEQ ID NO: 1057053 - RNA, 21 nt, Human
aagaagcaaguugcaggauca

SEQ ID NO: 1057054 - RNA, 21 nt, Human
aagaaggcaacuguaaaaacu

SEQ ID NO: 1057055 - RNA, 21 nt, Human
aagaugaaacaaaugaacaaa

SEQ ID NO: 1057056 - RNA, 24 nt, Human
aagcaaauaaaaagguacaaucau

SEQ ID NO: 1057057 - RNA, 18 nt, Human
aagguaaaauauuucaug

SEQ ID NO: 1057058 - RNA, 23 nt, Human
acuccaaaggcacuggcuguggg

SEQ ID NO: 1057059 - RNA, 21 nt, Human
acugggaagucaucuaaacaa

SEQ ID NO: 1057060 - RNA, 22 nt, Human
agaaagaagcaaguugcaggaa

SEQ ID NO: 1057061 - RNA, 19 nt, Human
agaaaggaggaggcagggc

SEQ ID NO: 1057062 - RNA, 22 nt, Human
agaaaggaggaggcagggcugg

SEQ ID NO: 1057063 - RNA, 21 nt, Human
agccugggcugcgcgcccugc

SEQ ID NO: 1057064 - RNA, 24 nt, Human
aggaggaggcagggcuggcaggug

SEQ ID NO: 1057065 - RNA, 25 nt, Human
aggcagagaauagaaagaagggacc

SEQ ID NO: 1057066 - RNA, 23 nt, Human
aggcagagaauagaagggacccc

SEQ ID NO: 1057067 - RNA, 23 nt, Human
aggcagugagcaaaggucuuggc

SEQ ID NO: 1057068 - RNA, 22 nt, Human
agggcuggcaggugaaaauuug

SEQ ID NO: 1057069 - RNA, 23 nt, Human
agguaggagacggauccugccaa

SEQ ID NO: 1057070 - RNA, 22 nt, Human
augaaacaaaugaacaaaaacu

SEQ ID NO: 1057071 - RNA, 25 nt, Human
caacuguaaaaacugaaauaaagca

SEQ ID NO: 1057072 - RNA, 19 nt, Human
cagaacucuaaagcaaaua

SEQ ID NO: 1057073 - RNA, 25 nt, Human
cagaacucuaaagcaaauaaaaagg

SEQ ID NO: 1057074 - RNA, 26 nt, Human
caggcagugagcaaaggucuuggcag

SEQ ID NO: 1057075 - RNA, 18 nt, Human
cagggguucuccuucccu

SEQ ID NO: 1057076 - RNA, 20 nt, Human
caguacuccaaaggcacugg

SEQ ID NO: 1057077 - RNA, 21 nt, Human
caucuaaacaaggaggaugaa

SEQ ID NO: 1057078 - RNA, 23 nt, Human
ccccucacccaaggcuacaccua

SEQ ID NO: 1057079 - RNA, 22 nt, Human
cccugcgccgggcuaaggacuc

SEQ ID NO: 1057080 - RNA, 24 nt, Human
ccuaggaagagguaggagacggau

SEQ ID NO: 1057081 - RNA, 23 nt, Human
ccuuagccacugguaccugaagc

SEQ ID NO: 1057082 - RNA, 25 nt, Human
cuaaagcaaauaaaaagguacaauc

SEQ ID NO: 1057083 - RNA, 21 nt, Human
cuccaaaggcacuggcugugg

SEQ ID NO: 1057084 - RNA, 22 nt, Human
cuccaaaggcacuggcuguggg

SEQ ID NO: 1057085 - RNA, 20 nt, Human
cugaagccacaaagccuuac

SEQ ID NO: 1057086 - RNA, 21 nt, Human
cugccaauucucucgcccuuc

SEQ ID NO: 1057087 - RNA, 23 nt, Human
gagaacagagggguggccgguac

SEQ ID NO: 1057088 - RNA, 19 nt, Human
gagagaacagagggguggc

SEQ ID NO: 1057089 - RNA, 19 nt, Human
gagcagaccagguuuccug

SEQ ID NO: 1057090 - RNA, 19 nt, Human
gcagagaauagaaagaagc

SEQ ID NO: 1057091 - RNA, 22 nt, Human
gcagguggagcugaagagagaa

SEQ ID NO: 1057092 - RNA, 23 nt, Human
gcgccgggcuaaggacucugugc

SEQ ID NO: 1057093 - RNA, 21 nt, Human
gggaagucaucuaaacaagga

SEQ ID NO: 1057094 - RNA, 19 nt, Human
ggggacuggaaacugggaa

SEQ ID NO: 1057095 - RNA, 24 nt, Human
ggggguguuuacgccaugguuuuu

SEQ ID NO: 1057096 - RNA, 24 nt, Human
gucaaauauuuccugaguuuuuuu

SEQ ID NO: 1057097 - RNA, 26 nt, Human
uaaaaagguacaaucauuugaaggua

SEQ ID NO: 1057098 - RNA, 20 nt, Human
uaagacgggaaucuuaagaa

SEQ ID NO: 1057099 - RNA, 19 nt, Human
uaagguaaucucuaagguu

SEQ ID NO: 1057100 - RNA, 24 nt, Human
uaccugaagccacaaagccuuaca

SEQ ID NO: 1057101 - RNA, 18 nt, Human
uagaaggguauuaacugc

SEQ ID NO: 1057102 - RNA, 28 nt, Human
uaggaaaagggagaaaggaggaggcagg

SEQ ID NO: 1057103 - RNA, 20 nt, Human
uaggaagagguaggagacgg

SEQ ID NO: 1057104 - RNA, 25 nt, Human
uaucaagaaagaugaaacaaaugaa

SEQ ID NO: 1057105 - RNA, 20 nt, Human
uauuucagaacucuaaagca

SEQ ID NO: 1057106 - RNA, 24 nt, Human
uccaugucugaccagcaaaggagg

SEQ ID NO: 1057107 - RNA, 23 nt, Human
ucuaggaaaagggagaaaggagg

SEQ ID NO: 1057108 - RNA, 21 nt, Human
ucuguuccuagcagauuaagg

SEQ ID NO: 1057109 - RNA, 18 nt, Human
ugaaaagugauagaagga

SEQ ID NO: 1057110 - RNA, 18 nt, Human
ugaaauggaagauauguc

SEQ ID NO: 1057111 - RNA, 21 nt, Human
ugaaauggaagauaugucaaa

SEQ ID NO: 1057112 - RNA, 23 nt, Human
ugaaauggaagauaugucaaaua

SEQ ID NO: 1057113 - RNA, 26 nt, Human
ugaacaaaaacucuggggguguuuac

SEQ ID NO: 1057114 - RNA, 19 nt, Human
ugacaugauggagcaacca

SEQ ID NO: 1057115 - RNA, 23 nt, Human
ugcaggaucaguggcagguggag

SEQ ID NO: 1057116 - RNA, 19 nt, Human
uggcagggguucuccuucc

SEQ ID NO: 1057117 - RNA, 23 nt, Human
uggcagggguucuccuucccuaa

SEQ ID NO: 1057118 - RNA, 21 nt, Human
ugucaaauauuuccugaguuu

SEQ ID NO: 1057119 - RNA, 19 nt, Human
ugugaccaacugcaggcuc

SEQ ID NO: 1057120 - RNA, 23 nt, Human
ugugaccaacugcaggcuccaug

SEQ ID NO: 1057121 - RNA, 19 nt, Human
uucagaacucuaaagcaaa

SEQ ID NO: 1057122 - RNA, 22 nt, Human
uuccugaguuuuuuuaugaaaa

SEQ ID NO: 1057123 - RNA, 24 nt, Human
agcggcggcagccugaagccugga

SEQ ID NO: 1057124 - RNA, 20 nt, Human
aggugguggcggcggcccug

SEQ ID NO: 1057125 - RNA, 22 nt, Human
caggugguggcggcggcccugc

SEQ ID NO: 1057126 - RNA, 18 nt, Human
ccgcuccaaaccucgacc

SEQ ID NO: 1057127 - RNA, 19 nt, Human
ccucccagcggcggcagcc

SEQ ID NO: 1057128 - RNA, 20 nt, Human
ccugaagccuggaugcuagg

SEQ ID NO: 1057129 - RNA, 23 nt, Human
cgccucccagcggcggcagccug

SEQ ID NO: 1057130 - RNA, 23 nt, Human
cuccuugcacuuccgguggcacu

SEQ ID NO: 1057131 - RNA, 19 nt, Human
cuggaugcuagggcggagg

SEQ ID NO: 1057132 - RNA, 21 nt, Human
gacccacacugguccuggcgc

SEQ ID NO: 1057133 - RNA, 19 nt, Human
gcagggguugggcaggcag

SEQ ID NO: 1057134 - RNA, 21 nt, Human
gcggcccugcaggcagggagc

SEQ ID NO: 1057135 - RNA, 21 nt, Human
guccgcuccaaaccucgaccc

SEQ ID NO: 1057136 - RNA, 20 nt, Human
gugguggcggcggcccugca

SEQ ID NO: 1057137 - RNA, 24 nt, Human
gugguggcggcggcccugcaggca

SEQ ID NO: 1057138 - RNA, 21 nt, Human
uccuugcacuuccgguggcac

SEQ ID NO: 1057139 - RNA, 19 nt, Human
ucuacagcuccuugcacuu

SEQ ID NO: 1057140 - RNA, 20 nt, Human
ugacugccaacacuuucccc

SEQ ID NO: 1057141 - RNA, 21 nt, Human
ugcacuuccgguggcacuccu

SEQ ID NO: 1057142 - RNA, 20 nt, Human
uggcgcccaggccgccuccc

SEQ ID NO: 1057143 - RNA, 24 nt, Human
uggcggcagucccacgagggccgg

SEQ ID NO: 1057144 - RNA, 23 nt, Human
uggcgguugcagcuccggggguc

SEQ ID NO: 1057145 - RNA, 24 nt, Human
uugacaccuuccaucuacagcucc

SEQ ID NO: 1057146 - RNA, 21 nt, Human
cggcgggaggauccccgggcc

SEQ ID NO: 1057147 - RNA, 23 nt, Human
uccccgggccgcuuucgccuccg

SEQ ID NO: 1057148 - RNA, 23 nt, Human
aaggugcuuguucuugccaaccg

SEQ ID NO: 1057149 - RNA, 22 nt, Human
acccuugagaccaucagaugca

SEQ ID NO: 1057150 - RNA, 21 nt, Human
caaaucagcaagacucacuuc

SEQ ID NO: 1057151 - RNA, 22 nt, Human
cagcaagacucacuucaaacac

SEQ ID NO: 1057152 - RNA, 20 nt, Human
cuggugaugagcaucuuucc

SEQ ID NO: 1057153 - RNA, 23 nt, Human
gaugagcaucuuuccaauauuuc

SEQ ID NO: 1057154 - RNA, 18 nt, Human
gccauggaaguuaggcag

SEQ ID NO: 1057155 - RNA, 20 nt, Human
gccauggaaguuaggcaguu

SEQ ID NO: 1057156 - RNA, 19 nt, Human
uagaaaauggaucaaccac

SEQ ID NO: 1057157 - RNA, 24 nt, Human
uagaaaauggaucaaccacuuucu

SEQ ID NO: 1057158 - RNA, 21 nt, Human
ucuucuuggcccccuuuuugc

SEQ ID NO: 1057159 - RNA, 23 nt, Human
ucuucuuggcccccuuuuugcug

SEQ ID NO: 1057160 - RNA, 23 nt, Human
uucguaaggugcuuguucuugcc

SEQ ID NO: 1057161 - RNA, 19 nt, Human
uugguuccuuggguccugg

SEQ ID NO: 1057162 - RNA, 21 nt, Human
uuugguuccuuggguccuggu

SEQ ID NO: 1057163 - RNA, 25 nt, Human
agagaagcaaaugaaguauauucaa

SEQ ID NO: 1057164 - RNA, 24 nt, Human
cauugacaagauuauacagagaag

SEQ ID NO: 1057165 - RNA, 23 nt, Human
ccucacugucaucuucaucauua

SEQ ID NO: 1057166 - RNA, 21 nt, Human
cuucaucauuaucuggcuucu

SEQ ID NO: 1057167 - RNA, 20 nt, Human
uauacagagaagcaaaugaa

SEQ ID NO: 1057168 - RNA, 19 nt, Human
uauucaacagcuccuguca

SEQ ID NO: 1057169 - RNA, 22 nt, Human
ucaacagcuccugucaguccca

SEQ ID NO: 1057170 - RNA, 25 nt, Human
uccacauuauuuucuguuucuuuag

SEQ ID NO: 1057171 - RNA, 21 nt, Human
uucuucuugagauuccccuuu

SEQ ID NO: 1057172 - RNA, 20 nt, Human
uugagauuccccuuuguuuu

SEQ ID NO: 1057173 - RNA, 19 nt, Human
caaccgucaccgagguucu

SEQ ID NO: 1057174 - RNA, 22 nt, Human
cacuguaaaaaaacuggccaac

SEQ ID NO: 1057175 - RNA, 20 nt, Human
cagggagccgacggugaagg

SEQ ID NO: 1057176 - RNA, 19 nt, Human
uaaaacagaaacucauaac

SEQ ID NO: 1057177 - RNA, 27 nt, Human
uaaaacagaaacucauaacaaauaaga

SEQ ID NO: 1057178 - RNA, 20 nt, Human
uacaaauuaguaaacucaac

SEQ ID NO: 1057179 - RNA, 25 nt, Human
uacaaauuaguaaacucaacucucc

SEQ ID NO: 1057180 - RNA, 20 nt, Human
ugacaggagcagggagccga

SEQ ID NO: 1057181 - RNA, 21 nt, Human
uguaaaaaaacuggccaaccg

SEQ ID NO: 1057182 - RNA, 24 nt, Human
aaaaauacuaggggcugagguggc

SEQ ID NO: 1057183 - RNA, 21 nt, Human
aaacaggaacagaauagcugg

SEQ ID NO: 1057184 - RNA, 23 nt, Human
acaggcugcuuugaggcugauaa

SEQ ID NO: 1057185 - RNA, 22 nt, Human
accucugaguuuucagggaagg

SEQ ID NO: 1057186 - RNA, 18 nt, Human
aggcccuggaguucaaca

SEQ ID NO: 1057187 - RNA, 21 nt, Human
agugagguuaguuguccuggg

SEQ ID NO: 1057188 - RNA, 18 nt, Human
caaggcauugauagaaaa

SEQ ID NO: 1057189 - RNA, 19 nt, Human
cacagaccgugacucagag

SEQ ID NO: 1057190 - RNA, 21 nt, Human
ccucacagaccgugacucaga

SEQ ID NO: 1057191 - RNA, 19 nt, Human
cuaggggcugagguggcug

SEQ ID NO: 1057192 - RNA, 19 nt, Human
cucugauuucaggccagac

SEQ ID NO: 1057193 - RNA, 19 nt, Human
uagacagcagaauugaaga

SEQ ID NO: 1057194 - RNA, 19 nt, Human
uagagugaagguuagugag

SEQ ID NO: 1057195 - RNA, 18 nt, Human
uagccucacagaccguga

SEQ ID NO: 1057196 - RNA, 20 nt, Human
uagcugggagcuccaagauu

SEQ ID NO: 1057197 - RNA, 21 nt, Human
uagcugggagcuccaagauuc

SEQ ID NO: 1057198 - RNA, 21 nt, Human
uauaggcccuggaguucaaca

SEQ ID NO: 1057199 - RNA, 22 nt, Human
uauuuugccuuuuagcauggca

SEQ ID NO: 1057200 - RNA, 20 nt, Human
ucagagcuucauugcaggac

SEQ ID NO: 1057201 - RNA, 20 nt, Human
ucucuguaauguagacacag

SEQ ID NO: 1057202 - RNA, 22 nt, Human
ugaagaggaauaugaacccauc

SEQ ID NO: 1057203 - RNA, 19 nt, Human
ugacagaaacaggaacaga

SEQ ID NO: 1057204 - RNA, 21 nt, Human
ugacucagagcuucauugcag

SEQ ID NO: 1057205 - RNA, 19 nt, Human
ugaguaacaggaaccgcaa

SEQ ID NO: 1057206 - RNA, 21 nt, Human
ugaguaacaggaaccgcaguc

SEQ ID NO: 1057207 - RNA, 24 nt, Human
ugauagaaaaaauacuaggggcug

SEQ ID NO: 1057208 - RNA, 22 nt, Human
ugggagcuccaagauucacauu

SEQ ID NO: 1057209 - RNA, 19 nt, Human
uuacugucucucccaggga

SEQ ID NO: 1057210 - RNA, 20 nt, Human
uuagagugaagguuagugag

SEQ ID NO: 1057211 - RNA, 21 nt, Human
uuaguuguccugggguucaca

SEQ ID NO: 1057212 - RNA, 22 nt, Human
uucuguagugcuugcucugauu

SEQ ID NO: 1057213 - RNA, 23 nt, Human
uugcaggagcuggugugaguuuu

SEQ ID NO: 1057214 - RNA, 23 nt, Human
uuggaaaguccucauuaaagcug

SEQ ID NO: 1057215 - RNA, 22 nt, Human
uuucaaauuacugucucuccca

SEQ ID NO: 1057216 - RNA, 24 nt, Human
aaaccaggcuggggaacgcaccuc

SEQ ID NO: 1057217 - RNA, 25 nt, Human
aaagcauaauucuacuugauuauag

SEQ ID NO: 1057218 - RNA, 19 nt, Human
aaagcgcugggauuacagg

SEQ ID NO: 1057219 - RNA, 24 nt, Human
aaagcgcugggauuacaggcauga

SEQ ID NO: 1057220 - RNA, 19 nt, Human
aagcgcugggauuacaggc

SEQ ID NO: 1057221 - RNA, 26 nt, Human
aagcgcugggauuacaggcaugagcc

SEQ ID NO: 1057222 - RNA, 22 nt, Human
aauuagaauucaaaucaaagca

SEQ ID NO: 1057223 - RNA, 22 nt, Human
aauucaaaucaaagcauaauuc

SEQ ID NO: 1057224 - RNA, 18 nt, Human
acagaggaaauccucccu

SEQ ID NO: 1057225 - RNA, 23 nt, Human
acagaggaaauccucccuccucc

SEQ ID NO: 1057226 - RNA, 19 nt, Human
acaggcgccugccaccacg

SEQ ID NO: 1057227 - RNA, 23 nt, Human
accucagccucccaaagcgcugg

SEQ ID NO: 1057228 - RNA, 20 nt, Human
agaggaaauccucccuccuc

SEQ ID NO: 1057229 - RNA, 18 nt, Human
agcgcugggauuacaggc

SEQ ID NO: 1057230 - RNA, 22 nt, Human
agcggagauucgcggcggcggg

SEQ ID NO: 1057231 - RNA, 20 nt, Human
aggcccggaguuacgagcgg

SEQ ID NO: 1057232 - RNA, 25 nt, Human
aggcuggagugcaguagcaugaucu

SEQ ID NO: 1057233 - RNA, 18 nt, Human
aguagcugggacuacagg

SEQ ID NO: 1057234 - RNA, 19 nt, Human
aguagcugggacuacaggc

SEQ ID NO: 1057235 - RNA, 24 nt, Human
agugcaguagcaugaucucggcuc

SEQ ID NO: 1057236 - RNA, 18 nt, Human
aucacaacuggaacugau

SEQ ID NO: 1057237 - RNA, 21 nt, Human
auucuccugccucagccuccc

SEQ ID NO: 1057238 - RNA, 24 nt, Human
caaagcgcugggauuacaggcaug

SEQ ID NO: 1057239 - RNA, 20 nt, Human
caaccucugccuccuggguu

SEQ ID NO: 1057240 - RNA, 22 nt, Human
caccgcguccggcccucauuuu

SEQ ID NO: 1057241 - RNA, 18 nt, Human
caccguguuagccaggau

SEQ ID NO: 1057242 - RNA, 24 nt, Human
caccguguuagccaggauggucuc

SEQ ID NO: 1057243 - RNA, 22 nt, Human
cacgccauucuccugccucagc

SEQ ID NO: 1057244 - RNA, 21 nt, Human
cacugcaaccucugccuccug

SEQ ID NO: 1057245 - RNA, 23 nt, Human
cacugcaaccucugccuccuggg

SEQ ID NO: 1057246 - RNA, 19 nt, Human
cacugcaucacaacuggaa

SEQ ID NO: 1057247 - RNA, 21 nt, Human
cacugcaucacaacuggaacc

SEQ ID NO: 1057248 - RNA, 21 nt, Human
caggcgccugccaccacgccc

SEQ ID NO: 1057249 - RNA, 23 nt, Human
caggcgccugccaccacgcccgg

SEQ ID NO: 1057250 - RNA, 19 nt, Human
ccaaagcgcugggauuaca

SEQ ID NO: 1057251 - RNA, 23 nt, Human
ccaaagcgcugggauuacaggca

SEQ ID NO: 1057252 - RNA, 24 nt, Human
ccaaagcgcugggauuacaggcau

SEQ ID NO: 1057253 - RNA, 20 nt, Human
ccaccacgcccggcuaauuu

SEQ ID NO: 1057254 - RNA, 19 nt, Human
ccaccgcguccggcccuca

SEQ ID NO: 1057255 - RNA, 24 nt, Human
cccaaagcgcugggauuacaggca

SEQ ID NO: 1057256 - RNA, 18 nt, Human
cccccagcaucgcccgaa

SEQ ID NO: 1057257 - RNA, 26 nt, Human
cccccagcaucgcccgaaggaaucgc

SEQ ID NO: 1057258 - RNA, 23 nt, Human
cccgaguagcugggacuacaggc

SEQ ID NO: 1057259 - RNA, 24 nt, Human
cccgaguagcugggacuacaggcg

SEQ ID NO: 1057260 - RNA, 27 nt, Human
ccucgcccgcggcuccggaagcggcug

SEQ ID NO: 1057261 - RNA, 19 nt, Human
ccucugccuccuggguuca

SEQ ID NO: 1057262 - RNA, 23 nt, Human
ccugccucagccucccgaguagc

SEQ ID NO: 1057263 - RNA, 18 nt, Human
cgcucgaaagcugcacag

SEQ ID NO: 1057264 - RNA, 24 nt, Human
cgcucugucgcccaggcuggagug

SEQ ID NO: 1057265 - RNA, 24 nt, Human
cgggucagagcccagagcaaaccu

SEQ ID NO: 1057266 - RNA, 22 nt, Human
cggguuucaccguguuagccag

SEQ ID NO: 1057267 - RNA, 23 nt, Human
cggguuucaccguguuagccagg

SEQ ID NO: 1057268 - RNA, 21 nt, Human
cgugauccguccaccucagcc

SEQ ID NO: 1057269 - RNA, 24 nt, Human
cgugauccguccaccucagccucc

SEQ ID NO: 1057270 - RNA, 24 nt, Human
cucacugcaaccucugccuccugg

SEQ ID NO: 1057271 - RNA, 24 nt, Human
cucagccucccgaguagcugggac

SEQ ID NO: 1057272 - RNA, 22 nt, Human
cuccugaccucgugauccgucc

SEQ ID NO: 1057273 - RNA, 21 nt, Human
cuccuggguucacgccauucu

SEQ ID NO: 1057274 - RNA, 24 nt, Human
cucgcucugucgcccaggcuggag

SEQ ID NO: 1057275 - RNA, 23 nt, Human
cucucacuggauccagauuuuau

SEQ ID NO: 1057276 - RNA, 23 nt, Human
cucugucgcccaggcuggagugc

SEQ ID NO: 1057277 - RNA, 19 nt, Human
cugcaaccucugccuccug

SEQ ID NO: 1057278 - RNA, 24 nt, Human
cugcaaccucugccuccuggguuc

SEQ ID NO: 1057279 - RNA, 23 nt, Human
cugccucagccucccgaguagcu

SEQ ID NO: 1057280 - RNA, 24 nt, Human
cuggagugcaguagcaugaucucg

SEQ ID NO: 1057281 - RNA, 22 nt, Human
gaccucgugauccguccaccuc

SEQ ID NO: 1057282 - RNA, 24 nt, Human
gaccucgugauccguccaccucag

SEQ ID NO: 1057283 - RNA, 26 nt, Human
gaguagcugggacuacaggcgccugc

SEQ ID NO: 1057284 - RNA, 18 nt, Human
gauuacaggcaugagcca

SEQ ID NO: 1057285 - RNA, 22 nt, Human
gauuacaggcaugagccaccgc

SEQ ID NO: 1057286 - RNA, 22 nt, Human
gauuacaggcaugagccaccgc

SEQ ID NO: 1057287 - RNA, 19 nt, Human
gcccaggcuggagugcagu

SEQ ID NO: 1057288 - RNA, 22 nt, Human
gcccgcggcuccggaagcggcu

SEQ ID NO: 1057289 - RNA, 23 nt, Human
gcccggcuaauuuuuuguauuuu

SEQ ID NO: 1057290 - RNA, 23 nt, Human
gcucagacuuuccuuuucuuguu

SEQ ID NO: 1057291 - RNA, 22 nt, Human
ggauuacaggcaugagccaccg

SEQ ID NO: 1057292 - RNA, 20 nt, Human
ggcgggucagagcccagagc

SEQ ID NO: 1057293 - RNA, 21 nt, Human
ggguuucaccguguuagccag

SEQ ID NO: 1057294 - RNA, 22 nt, Human
ggucucccaccuguagucccag

SEQ ID NO: 1057295 - RNA, 20 nt, Human
ggucucgaucuccugaccuc

SEQ ID NO: 1057296 - RNA, 24 nt, Human
gucucgcucugucgcccaggcugg

SEQ ID NO: 1057297 - RNA, 24 nt, Human
gugauccguccaccucagccuccc

SEQ ID NO: 1057298 - RNA, 22 nt, Human
uaauuuuuuguauuuuuaguag

SEQ ID NO: 1057299 - RNA, 25 nt, Human
uaauuuuuuguauuuuuaguaggga

SEQ ID NO: 1057300 - RNA, 23 nt, Human
uacaggcaugagccaccgcgucc

SEQ ID NO: 1057301 - RNA, 23 nt, Human
uacaggcgccugccaccacgccc

SEQ ID NO: 1057302 - RNA, 21 nt, Human
uaguagggaucggguuucacc

SEQ ID NO: 1057303 - RNA, 24 nt, Human
uaguagggaucggguuucaccgug

SEQ ID NO: 1057304 - RNA, 24 nt, Human
ucaccguguuagccaggauggucu

SEQ ID NO: 1057305 - RNA, 24 nt, Human
ucacugcaaccucugccuccuggg

SEQ ID NO: 1057306 - RNA, 25 nt, Human
ucacugcaaccucugccuccugggu

SEQ ID NO: 1057307 - RNA, 23 nt, Human
ucagccucccgaguagcugggac

SEQ ID NO: 1057308 - RNA, 24 nt, Human
ucccaaagcgcugggauuacaggc

SEQ ID NO: 1057309 - RNA, 24 nt, Human
ucccgaguagcugggacuacaggc

SEQ ID NO: 1057310 - RNA, 18 nt, Human
ucccuccuccagguucag

SEQ ID NO: 1057311 - RNA, 18 nt, Human
uccggaagcggcugcggc

SEQ ID NO: 1057312 - RNA, 21 nt, Human
uccguccaccucagccuccca

SEQ ID NO: 1057313 - RNA, 21 nt, Human
uccuggguucacgccauucuc

SEQ ID NO: 1057314 - RNA, 24 nt, Human
uccuggguucacgccauucuccug

SEQ ID NO: 1057315 - RNA, 24 nt, Human
ucgcccaggcuggagugcaguagc

SEQ ID NO: 1057316 - RNA, 24 nt, Human
ucgcucugucgcccaggcuggagu

SEQ ID NO: 1057317 - RNA, 24 nt, Human
ucggguuucaccguguuagccagg

SEQ ID NO: 1057318 - RNA, 24 nt, Human
ucuccugccucagccucccgagua

SEQ ID NO: 1057319 - RNA, 19 nt, Human
ucucgcucugucgcccagg

SEQ ID NO: 1057320 - RNA, 22 nt, Human
ucucgcucugucgcccaggcug

SEQ ID NO: 1057321 - RNA, 23 nt, Human
ucucgcucugucgcccaggcugg

SEQ ID NO: 1057322 - RNA, 24 nt, Human
ucucgcucugucgcccaggcugga

SEQ ID NO: 1057323 - RNA, 26 nt, Human
ucucgcucugucgcccaggcuggagu

SEQ ID NO: 1057324 - RNA, 24 nt, Human
ucugucgcccaggcuggagugcag

SEQ ID NO: 1057325 - RNA, 19 nt, Human
ucuguggaggucucccacc

SEQ ID NO: 1057326 - RNA, 19 nt, Human
ugaauuagaauucaaauca

SEQ ID NO: 1057327 - RNA, 24 nt, Human
ugauccguccaccucagccuccca

SEQ ID NO: 1057328 - RNA, 22 nt, Human
ugcaguagcaugaucucggcuc

SEQ ID NO: 1057329 - RNA, 24 nt, Human
ugccucagccucccgaguagcugg

SEQ ID NO: 1057330 - RNA, 19 nt, Human
ugccuccuggguucacgcc

SEQ ID NO: 1057331 - RNA, 24 nt, Human
ugcucagacuuuccuuuucuuguu

SEQ ID NO: 1057332 - RNA, 24 nt, Human
uggaggucucccaccuguaguccc

SEQ ID NO: 1057333 - RNA, 28 nt, Human
uggaggucucccaccuguagucccaggg

SEQ ID NO: 1057334 - RNA, 19 nt, Human
uggagugcaguagcaugau

SEQ ID NO: 1057335 - RNA, 24 nt, Human
uggagugcaguagcaugaucucgg

SEQ ID NO: 1057336 - RNA, 20 nt, Human
uggcaagggcugaugcugua

SEQ ID NO: 1057337 - RNA, 21 nt, Human
ugggacuacaggcgccugcca

SEQ ID NO: 1057338 - RNA, 22 nt, Human
ugggacuacaggcgccugccac

SEQ ID NO: 1057339 - RNA, 24 nt, Human
ugggacuacaggcgccugccacca

SEQ ID NO: 1057340 - RNA, 18 nt, Human
ugggauuacaggcaugag

SEQ ID NO: 1057341 - RNA, 19 nt, Human
ugggauuacaggcaugagc

SEQ ID NO: 1057342 - RNA, 21 nt, Human
ugggauuacaggcaugagcca

SEQ ID NO: 1057343 - RNA, 22 nt, Human
ugggauuacaggcaugagccac

SEQ ID NO: 1057344 - RNA, 23 nt, Human
ugggauuacaggcaugagccacc

SEQ ID NO: 1057345 - RNA, 24 nt, Human
ugggauuacaggcaugagccaccg

SEQ ID NO: 1057346 - RNA, 24 nt, Human
ugggauuacaggcaugagccaccg

SEQ ID NO: 1057347 - RNA, 20 nt, Human
uggguucacgccauucuccu

SEQ ID NO: 1057348 - RNA, 25 nt, Human
uguguagacacccacugcaucacaa

SEQ ID NO: 1057349 - RNA, 21 nt, Human
uuagaagacagcuugcuggaa

SEQ ID NO: 1057350 - RNA, 18 nt, Human
uuaguagggaucggguuu

SEQ ID NO: 1057351 - RNA, 22 nt, Human
uuaguagggaucggguuucacc

SEQ ID NO: 1057352 - RNA, 24 nt, Human
uuaguagggaucggguuucaccgu

SEQ ID NO: 1057353 - RNA, 18 nt, Human
uuauuuauuuauuuauuu

SEQ ID NO: 1057354 - RNA, 19 nt, Human
uuauuuauuuauuuauuua

SEQ ID NO: 1057355 - RNA, 19 nt, Human
uuauuuauuuauuuauuua

SEQ ID NO: 1057356 - RNA, 25 nt, Human
uuauuuauuuauuuauuuauuuauu

SEQ ID NO: 1057357 - RNA, 19 nt, Human
uuucaccguguuagccagg

SEQ ID NO: 1057358 - RNA, 21 nt, Human
uuucaugaauuauucccaugg

SEQ ID NO: 1057359 - RNA, 21 nt, Human
uuuguauuuuuaguagggauc

SEQ ID NO: 1057360 - RNA, 23 nt, Human
uuuguuuguagauuggauuuuca

SEQ ID NO: 1057361 - RNA, 23 nt, Human
uuuguuuuguuucuuuuuucaug

SEQ ID NO: 1057362 - RNA, 19 nt, Human
uuuuaagaacgugagaaau

SEQ ID NO: 1057363 - RNA, 21 nt, Human
uuuuaagaacgugagaaauga

SEQ ID NO: 1057364 - RNA, 20 nt, Human
uuuucaugaauuauucccau

SEQ ID NO: 1057365 - RNA, 24 nt, Human
uuuuuaguagggaucggguuucac

SEQ ID NO: 1057366 - RNA, 21 nt, Human
uuuuuguauuuuuaguaggga

SEQ ID NO: 1057367 - RNA, 18 nt, Human
uuuuuuguauuuuuagua

SEQ ID NO: 1057368 - RNA, 25 nt, Human
caaguaacucuuuaacagcuauaau

SEQ ID NO: 1057369 - RNA, 18 nt, Human
cagggcaaagugaccuuc

SEQ ID NO: 1057370 - RNA, 22 nt, Human
gaccuucagcuuuaugggguuc

SEQ ID NO: 1057371 - RNA, 22 nt, Human
ggcaaagugaccuucagcuuua

SEQ ID NO: 1057372 - RNA, 18 nt, Human
aaacagacagaaaauuac

SEQ ID NO: 1057373 - RNA, 24 nt, Human
aaaccauuuuuacccuggagcuaa

SEQ ID NO: 1057374 - RNA, 24 nt, Human
acaauacuggcagccuaaaaaugc

SEQ ID NO: 1057375 - RNA, 21 nt, Human
accaguauuguauuugacuuu

SEQ ID NO: 1057376 - RNA, 21 nt, Human
acgggcagcacgggaacggaa

SEQ ID NO: 1057377 - RNA, 18 nt, Human
agacccucugucucugag

SEQ ID NO: 1057378 - RNA, 20 nt, Human
agugaugaaacagacagaaa

SEQ ID NO: 1057379 - RNA, 24 nt, Human
caagaaaccauauccccaacagcg

SEQ ID NO: 1057380 - RNA, 20 nt, Human
cagcggcagagcaucgggag

SEQ ID NO: 1057381 - RNA, 19 nt, Human
cccccacucaguacccgga

SEQ ID NO: 1057382 - RNA, 22 nt, Human
ccucgagucacuaaaagcaguu

SEQ ID NO: 1057383 - RNA, 22 nt, Human
ccucggucggggagcgcgggac

SEQ ID NO: 1057384 - RNA, 21 nt, Human
cggcagagcaucgggaggaga

SEQ ID NO: 1057385 - RNA, 18 nt, Human
cgggaggagacccucugu

SEQ ID NO: 1057386 - RNA, 22 nt, Human
cgggaggagacccucugucucu

SEQ ID NO: 1057387 - RNA, 22 nt, Human
cuaaaaaugcuucaagaaacca

SEQ ID NO: 1057388 - RNA, 22 nt, Human
cugaggcuucggugcacuucug

SEQ ID NO: 1057389 - RNA, 23 nt, Human
cuuugcgcaggcgcggcgccccc

SEQ ID NO: 1057390 - RNA, 18 nt, Human
gaagacgccggagacccg

SEQ ID NO: 1057391 - RNA, 24 nt, Human
gaccaguauuguauuugacuuuuu

SEQ ID NO: 1057392 - RNA, 28 nt, Human
uaaaaaaccauuuuuacccuggagcuaa

SEQ ID NO: 1057393 - RNA, 22 nt, Human
uaaaaaugcuucaagaaaccau

SEQ ID NO: 1057394 - RNA, 23 nt, Human
ucucugaggcuucggugcacuuc

SEQ ID NO: 1057395 - RNA, 26 nt, Human
ugaggagaaaguauuuagggagugau

SEQ ID NO: 1057396 - RNA, 22 nt, Human
ugaugaaacagacagaaaauua

SEQ ID NO: 1057397 - RNA, 19 nt, Human
ugccuggccucgagucacu

SEQ ID NO: 1057398 - RNA, 20 nt, Human
uggccaugacacgggcagca

SEQ ID NO: 1057399 - RNA, 23 nt, Human
ugguaaggaccaguauuguauuu

SEQ ID NO: 1057400 - RNA, 23 nt, Human
uucugcucagacgguggcgggag

SEQ ID NO: 1057401 - RNA, 23 nt, Human
agagcccgcggaccccucugccc

SEQ ID NO: 1057402 - RNA, 24 nt, Human
aggggccgggagaggcucgcgagg

SEQ ID NO: 1057403 - RNA, 23 nt, Human
aucucggcgccgacucuccucca

SEQ ID NO: 1057404 - RNA, 19 nt, Human
cagagcccgcggaccccuc

SEQ ID NO: 1057405 - RNA, 23 nt, Human
cagagcccgcggaccccucugcc

SEQ ID NO: 1057406 - RNA, 21 nt, Human
cagcagccuggagaccuuagc

SEQ ID NO: 1057407 - RNA, 24 nt, Human
ccagagcccgcggaccccucugcc

SEQ ID NO: 1057408 - RNA, 22 nt, Human
ccccuuguccacauggugucug

SEQ ID NO: 1057409 - RNA, 22 nt, Human
cccgcggaccccucugcccgga

SEQ ID NO: 1057410 - RNA, 22 nt, Human
cccucacuucaucagcagccug

SEQ ID NO: 1057411 - RNA, 23 nt, Human
ccuccagagcccgcggaccccuc

SEQ ID NO: 1057412 - RNA, 22 nt, Human
ccucugauuucucuccuccccc

SEQ ID NO: 1057413 - RNA, 21 nt, Human
ccuuacucucgccucucccuc

SEQ ID NO: 1057414 - RNA, 21 nt, Human
cgacucuccuccacuuucccu

SEQ ID NO: 1057415 - RNA, 19 nt, Human
cguccagcaccuccagagc

SEQ ID NO: 1057416 - RNA, 20 nt, Human
cguccagcaccuccagagcc

SEQ ID NO: 1057417 - RNA, 23 nt, Human
cuccagagcccgcggaccccucu

SEQ ID NO: 1057418 - RNA, 22 nt, Human
gccuucgcgcgccaccucugau

SEQ ID NO: 1057419 - RNA, 21 nt, Human
gggcgcucagccuucgcgcgc

SEQ ID NO: 1057420 - RNA, 23 nt, Human
uccaguaagcauuuaaaacacag

SEQ ID NO: 1057421 - RNA, 20 nt, Human
uccccuuguccacauggugu

SEQ ID NO: 1057422 - RNA, 18 nt, Human
ucgcgcgccaccucugau

SEQ ID NO: 1057423 - RNA, 20 nt, Human
uuucucuccuccccuugucc

SEQ ID NO: 1057424 - RNA, 21 nt, Human
ccccugcgcucccaaucuccg

SEQ ID NO: 1057425 - RNA, 18 nt, Human
cucaguggguuuccagga

SEQ ID NO: 1057426 - RNA, 22 nt, Human
cugccccugcgcucccaaucuc

SEQ ID NO: 1057427 - RNA, 19 nt, Human
gccccugcgcucccaaucu

SEQ ID NO: 1057428 - RNA, 20 nt, Human
ugccccugcgcucccaaucu

SEQ ID NO: 1057429 - RNA, 18 nt, Human
uggguuuccaggaggagc

SEQ ID NO: 1057430 - RNA, 20 nt, Human
uguucucaguggguuuccag

SEQ ID NO: 1057431 - RNA, 20 nt, Human
uuuuucagauguucucagug

SEQ ID NO: 1057432 - RNA, 18 nt, Human
aaaacagagauacagagc

SEQ ID NO: 1057433 - RNA, 19 nt, Human
aaacagagauacagagcac

SEQ ID NO: 1057434 - RNA, 21 nt, Human
aagaaaaacagagauacagag

SEQ ID NO: 1057435 - RNA, 22 nt, Human
aaggcgcggccguaggaccauu

SEQ ID NO: 1057436 - RNA, 23 nt, Human
agaagacaggaacacaaaggcgc

SEQ ID NO: 1057437 - RNA, 22 nt, Human
agagcacagcaaacacgugccg

SEQ ID NO: 1057438 - RNA, 19 nt, Human
agagcacguuuucaccaag

SEQ ID NO: 1057439 - RNA, 19 nt, Human
agagggcgcaccugguguc

SEQ ID NO: 1057440 - RNA, 21 nt, Human
agcagcacaccacaaaucagc

SEQ ID NO: 1057441 - RNA, 21 nt, Human
agcucagggcaaugugaccgg

SEQ ID NO: 1057442 - RNA, 18 nt, Human
aggaacacaaaggcgcgg

SEQ ID NO: 1057443 - RNA, 19 nt, Human
augggccacagaaagacac

SEQ ID NO: 1057444 - RNA, 20 nt, Human
cagagcacagcaaacacgug

SEQ ID NO: 1057445 - RNA, 19 nt, Human
caugcaaaucaucguauga

SEQ ID NO: 1057446 - RNA, 24 nt, Human
caugggccacagaaagacacauuu

SEQ ID NO: 1057447 - RNA, 19 nt, Human
cauucaggaugcaguucug

SEQ ID NO: 1057448 - RNA, 20 nt, Human
cauuuacauggaaauggagc

SEQ ID NO: 1057449 - RNA, 19 nt, Human
ccaaaggucauagcacaaa

SEQ ID NO: 1057450 - RNA, 20 nt, Human
ccagggguggucgcaguauc

SEQ ID NO: 1057451 - RNA, 21 nt, Human
ccccagagggcgcaccuggug

SEQ ID NO: 1057452 - RNA, 19 nt, Human
cggggacgcacggcggaga

SEQ ID NO: 1057453 - RNA, 20 nt, Human
cuacgccaccgucugccagg

SEQ ID NO: 1057454 - RNA, 21 nt, Human
cucacccaucccaauuucggg

SEQ ID NO: 1057455 - RNA, 18 nt, Human
cuggcuggaguaaaaacg

SEQ ID NO: 1057456 - RNA, 19 nt, Human
cuguacacacaucuuuuca

SEQ ID NO: 1057457 - RNA, 24 nt, Human
cuuccaucuaauggcacugguuua

SEQ ID NO: 1057458 - RNA, 18 nt, Human
gaggaugcacagcauuga

SEQ ID NO: 1057459 - RNA, 18 nt, Human
gcauugaggagaugucag

SEQ ID NO: 1057460 - RNA, 21 nt, Human
ggaccaugggccacagaaaga

SEQ ID NO: 1057461 - RNA, 23 nt, Human
ggcagaggggcaggcaggcuggg

SEQ ID NO: 1057462 - RNA, 22 nt, Human
ggcaggcaggcugggaaauguc

SEQ ID NO: 1057463 - RNA, 22 nt, Human
gggcaaugugaccggggugggc

SEQ ID NO: 1057464 - RNA, 21 nt, Human
ggggugggcagaggggcaggc

SEQ ID NO: 1057465 - RNA, 21 nt, Human
uaaaugucaucacagcggacc

SEQ ID NO: 1057466 - RNA, 20 nt, Human
uaagacuugccacuuggaau

SEQ ID NO: 1057467 - RNA, 23 nt, Human
uagaaccuggcaauguuaaauuu

SEQ ID NO: 1057468 - RNA, 24 nt, Human
uagaaccuggcaauguuaaauuug

SEQ ID NO: 1057469 - RNA, 22 nt, Human
uagcacaaaugaggucuaaaug

SEQ ID NO: 1057470 - RNA, 23 nt, Human
ucuacgccaccgucugccagggg

SEQ ID NO: 1057471 - RNA, 24 nt, Human
ucuguggacagcagcacaccacaa

SEQ ID NO: 1057472 - RNA, 23 nt, Human
ugaaauagacccgaucaugcaaa

SEQ ID NO: 1057473 - RNA, 20 nt, Human
ugaccggggugggcagaggg

SEQ ID NO: 1057474 - RNA, 23 nt, Human
ugagccccagagggcgcaccugg

SEQ ID NO: 1057475 - RNA, 22 nt, Human
ugcagugaaugggaaaucaacu

SEQ ID NO: 1057476 - RNA, 22 nt, Human
uggaaagaagcucagggcaaug

SEQ ID NO: 1057477 - RNA, 20 nt, Human
uggcuggaguaaaaacgggu

SEQ ID NO: 1057478 - RNA, 21 nt, Human
ugggcagaggggcaggcaggc

SEQ ID NO: 1057479 - RNA, 21 nt, Human
ugggggagauuaaauaacagg

SEQ ID NO: 1057480 - RNA, 20 nt, Human
uggucgcaguauccucugcc

SEQ ID NO: 1057481 - RNA, 18 nt, Human
ugguggagagaagacagg

SEQ ID NO: 1057482 - RNA, 24 nt, Human
ugucacuagcacagauauuaaaau

SEQ ID NO: 1057483 - RNA, 21 nt, Human
uuagaaacaguauuuccucau

SEQ ID NO: 1057484 - RNA, 23 nt, Human
uucaaguuauguugaccuuccag

SEQ ID NO: 1057485 - RNA, 23 nt, Human
aaaacaaaaauggaguuucuaga

SEQ ID NO: 1057486 - RNA, 21 nt, Human
aaacaaaaauggaguuucuag

SEQ ID NO: 1057487 - RNA, 18 nt, Human
aaccagugauggagcgau

SEQ ID NO: 1057488 - RNA, 25 nt, Human
aacggagcaggccuuguccacagga

SEQ ID NO: 1057489 - RNA, 25 nt, Human
aaggaggcuccagaugccaccuucu

SEQ ID NO: 1057490 - RNA, 25 nt, Human
acccggagcugcccugcagcauucc

SEQ ID NO: 1057491 - RNA, 26 nt, Human
accucacuccugugacugccucccca

SEQ ID NO: 1057492 - RNA, 27 nt, Human
acuggguggggcacacacuggguaccu

SEQ ID NO: 1057493 - RNA, 25 nt, Human
agaaaccaacccaacaguuaccaag

SEQ ID NO: 1057494 - RNA, 21 nt, Human
agagagccagugaacagaaac

SEQ ID NO: 1057495 - RNA, 22 nt, Human
agagccagugaacagaaaccaa

SEQ ID NO: 1057496 - RNA, 19 nt, Human
agccagugaacagaaacca

SEQ ID NO: 1057497 - RNA, 21 nt, Human
agcgacugcuuccaaaaagaa

SEQ ID NO: 1057498 - RNA, 26 nt, Human
agcucauugccucccgcaugaacucc

SEQ ID NO: 1057499 - RNA, 18 nt, Human
aggccucagguugcucag

SEQ ID NO: 1057500 - RNA, 21 nt, Human
aggcuccuaacccagcaaccu

SEQ ID NO: 1057501 - RNA, 19 nt, Human
agggcuccuggucccuacu

SEQ ID NO: 1057502 - RNA, 21 nt, Human
agggcuccuggucccuacugc

SEQ ID NO: 1057503 - RNA, 22 nt, Human
augaacuccucuagguuuggaa

SEQ ID NO: 1057504 - RNA, 26 nt, Human
auggaguuucuagaguucaauugugc

SEQ ID NO: 1057505 - RNA, 19 nt, Human
caaccagaauuuuacccaa

SEQ ID NO: 1057506 - RNA, 21 nt, Human
cacuggguggggcacacacug

SEQ ID NO: 1057507 - RNA, 22 nt, Human
cacuggguggggcacacacugg

SEQ ID NO: 1057508 - RNA, 24 nt, Human
cagcaaccagaauuuuacccaagu

SEQ ID NO: 1057509 - RNA, 19 nt, Human
cagcagcucauugccuccc

SEQ ID NO: 1057510 - RNA, 20 nt, Human
cagcccgcucaccuuuccca

SEQ ID NO: 1057511 - RNA, 23 nt, Human
cagugaacagaaaccaacccaac

SEQ ID NO: 1057512 - RNA, 21 nt, Human
cauucccgcuccaggguggag

SEQ ID NO: 1057513 - RNA, 18 nt, Human
ccagaauuuuacccaagu

SEQ ID NO: 1057514 - RNA, 19 nt, Human
ccagcgucuagcccgcguc

SEQ ID NO: 1057515 - RNA, 22 nt, Human
ccaggguggagcgacccucccc

SEQ ID NO: 1057516 - RNA, 20 nt, Human
cccaugcagcagccccugcu

SEQ ID NO: 1057517 - RNA, 25 nt, Human
cccuagaacacaaaucuagaaaaug

SEQ ID NO: 1057518 - RNA, 24 nt, Human
ccucacuccugugacugccucccc

SEQ ID NO: 1057519 - RNA, 19 nt, Human
ccuccucccucccggcccc

SEQ ID NO: 1057520 - RNA, 24 nt, Human
ccucgacuacaccuggggucucuc

SEQ ID NO: 1057521 - RNA, 22 nt, Human
ccucuggaaaaacaaaaaugga

SEQ ID NO: 1057522 - RNA, 20 nt, Human
ccuggucccuacugcacaaa

SEQ ID NO: 1057523 - RNA, 19 nt, Human
ccugugacugccuccccaa

SEQ ID NO: 1057524 - RNA, 22 nt, Human
ccugugacugccuccccaaaga

SEQ ID NO: 1057525 - RNA, 19 nt, Human
ccuugaacggagcaggccu

SEQ ID NO: 1057526 - RNA, 21 nt, Human
cgacccggagcugcccugcag

SEQ ID NO: 1057527 - RNA, 23 nt, Human
cgccuggcgacccggagcugccc

SEQ ID NO: 1057528 - RNA, 23 nt, Human
cgucccgcccgcccaggggccca

SEQ ID NO: 1057529 - RNA, 24 nt, Human
cguugccuggaaaccgccgccugg

SEQ ID NO: 1057530 - RNA, 19 nt, Human
cuacaccuggggucucucc

SEQ ID NO: 1057531 - RNA, 22 nt, Human
cuagaaaaugcagcaaccagaa

SEQ ID NO: 1057532 - RNA, 21 nt, Human
cuccagcagcucauugccucc

SEQ ID NO: 1057533 - RNA, 23 nt, Human
cuccaggguggagcgacccuccc

SEQ ID NO: 1057534 - RNA, 18 nt, Human
cuccucccucccggcccc

SEQ ID NO: 1057535 - RNA, 18 nt, Human
cugcagcauucccgcucc

SEQ ID NO: 1057536 - RNA, 20 nt, Human
gacccuccccuccucccucc

SEQ ID NO: 1057537 - RNA, 21 nt, Human
gagaaggggaaaggaggcucc

SEQ ID NO: 1057538 - RNA, 20 nt, Human
gccagcgucuagcccgcguc

SEQ ID NO: 1057539 - RNA, 22 nt, Human
gcccccgccuuggccgcggucc

SEQ ID NO: 1057540 - RNA, 18 nt, Human
ggaaaaacaaaaauggag

SEQ ID NO: 1057541 - RNA, 20 nt, Human
ggaaaagcaacugcaccuca

SEQ ID NO: 1057542 - RNA, 19 nt, Human
ggagcaggccuuguccaca

SEQ ID NO: 1057543 - RNA, 19 nt, Human
ggggaaaggaggcuccaga

SEQ ID NO: 1057544 - RNA, 20 nt, Human
gucaggguuguuuguguuca

SEQ ID NO: 1057545 - RNA, 18 nt, Human
uaccaaggggaaacaaag

SEQ ID NO: 1057546 - RNA, 18 nt, Human
uagaaaaugcagcaacca

SEQ ID NO: 1057547 - RNA, 23 nt, Human
uagagaauccuuuuuccauauuc

SEQ ID NO: 1057548 - RNA, 26 nt, Human
uagaugauaugacuugcccccugaag

SEQ ID NO: 1057549 - RNA, 21 nt, Human
uaggcgucaugagaaggggaa

SEQ ID NO: 1057550 - RNA, 20 nt, Human
ucccaugcagcagccccugc

SEQ ID NO: 1057551 - RNA, 19 nt, Human
ucccggccccucgacuaca

SEQ ID NO: 1057552 - RNA, 21 nt, Human
uccgucccgcccgcccagggg

SEQ ID NO: 1057553 - RNA, 20 nt, Human
ucuggaaaaacaaaaaugga

SEQ ID NO: 1057554 - RNA, 21 nt, Human
ugacugccuccccaaagaauc

SEQ ID NO: 1057555 - RNA, 19 nt, Human
ugagaaggggaaaggaggc

SEQ ID NO: 1057556 - RNA, 20 nt, Human
ugaggaaaugucugcucaug

SEQ ID NO: 1057557 - RNA, 21 nt, Human
ugaggaaaugucugcucaugu

SEQ ID NO: 1057558 - RNA, 21 nt, Human
ugcccugugggccacggggau

SEQ ID NO: 1057559 - RNA, 19 nt, Human
uuacuagggcuccuggucc

SEQ ID NO: 1057560 - RNA, 26 nt, Human
uucaaaacaauaaaaccagugaugga

SEQ ID NO: 1057561 - RNA, 18 nt, Human
uuccaagggauccauuca

SEQ ID NO: 1057562 - RNA, 21 nt, Human
aaaacauugcugaaaauccac

SEQ ID NO: 1057563 - RNA, 20 nt, Human
aaacgccucucugaauccuu

SEQ ID NO: 1057564 - RNA, 20 nt, Human
aaagccaaggcucagaggca

SEQ ID NO: 1057565 - RNA, 18 nt, Human
aacaaugcguccgucccc

SEQ ID NO: 1057566 - RNA, 23 nt, Human
aacagacuuuucgaagggcuggc

SEQ ID NO: 1057567 - RNA, 21 nt, Human
aagaacccccaguugcuuuuc

SEQ ID NO: 1057568 - RNA, 22 nt, Human
aagaugugaccaucuuacuuca

SEQ ID NO: 1057569 - RNA, 19 nt, Human
aagggcuggcguuacaaac

SEQ ID NO: 1057570 - RNA, 19 nt, Human
acagaaagccaaggcucag

SEQ ID NO: 1057571 - RNA, 21 nt, Human
aggcaguaagucauggguccg

SEQ ID NO: 1057572 - RNA, 21 nt, Human
agggcuggcguuacaaacggc

SEQ ID NO: 1057573 - RNA, 21 nt, Human
auacaacuuaaguaugaacaa

SEQ ID NO: 1057574 - RNA, 26 nt, Human
auaugcaauaaaaauaacaaugcguc

SEQ ID NO: 1057575 - RNA, 23 nt, Human
caaauguacacauauacagcuua

SEQ ID NO: 1057576 - RNA, 23 nt, Human
caagcccaguaaguaagaacccc

SEQ ID NO: 1057577 - RNA, 24 nt, Human
cacaagcccaguaaguaagaaccc

SEQ ID NO: 1057578 - RNA, 21 nt, Human
cacagaaagccaaggcucaga

SEQ ID NO: 1057579 - RNA, 19 nt, Human
cacagcagcagugaaauga

SEQ ID NO: 1057580 - RNA, 21 nt, Human
cacagcagcagugaaaugaaa

SEQ ID NO: 1057581 - RNA, 25 nt, Human
cacauacauguauacaaauguacac

SEQ ID NO: 1057582 - RNA, 21 nt, Human
cacuaccgauguccacaaggg

SEQ ID NO: 1057583 - RNA, 18 nt, Human
cagaggcaguaagucaug

SEQ ID NO: 1057584 - RNA, 19 nt, Human
cagccaccagggugccacc

SEQ ID NO: 1057585 - RNA, 19 nt, Human
caggugcauggaaaggcag

SEQ ID NO: 1057586 - RNA, 24 nt, Human
caguaagucauggguccgaggccu

SEQ ID NO: 1057587 - RNA, 19 nt, Human
caucucuccaucagugggc

SEQ ID NO: 1057588 - RNA, 20 nt, Human
cauuaucccaguggcagaga

SEQ ID NO: 1057589 - RNA, 18 nt, Human
ccacaagggauccucuuc

SEQ ID NO: 1057590 - RNA, 24 nt, Human
ccaccagggugccacccacaagcc

SEQ ID NO: 1057591 - RNA, 25 nt, Human
ccacccacaagcccaguaaguaaga

SEQ ID NO: 1057592 - RNA, 26 nt, Human
ccacccacaagcccaguaaguaagaa

SEQ ID NO: 1057593 - RNA, 27 nt, Human
ccacccacaagcccaguaaguaagaac

SEQ ID NO: 1057594 - RNA, 23 nt, Human
ccaguugcuuuucugcaaacugu

SEQ ID NO: 1057595 - RNA, 24 nt, Human
cccacaagcccaguaaguaagaac

SEQ ID NO: 1057596 - RNA, 22 nt, Human
cccauaaccaugaccaucacuu

SEQ ID NO: 1057597 - RNA, 25 nt, Human
cccauaaccaugaccaucacuuauu

SEQ ID NO: 1057598 - RNA, 21 nt, Human
cucaagaaauaaaaaagugac

SEQ ID NO: 1057599 - RNA, 24 nt, Human
cuuucuucuuuaaguguuucuagg

SEQ ID NO: 1057600 - RNA, 20 nt, Human
guagaacaugucuugacuga

SEQ ID NO: 1057601 - RNA, 27 nt, Human
uaagaaaauagcaucaaaagcagauuu

SEQ ID NO: 1057602 - RNA, 22 nt, Human
uaaggaaaguaauaguaauuuc

SEQ ID NO: 1057603 - RNA, 19 nt, Human
uaaguacgaaugacucaag

SEQ ID NO: 1057604 - RNA, 22 nt, Human
uacaaaaaggaaagagauacaa

SEQ ID NO: 1057605 - RNA, 22 nt, Human
uacacagccaccagggugccac

SEQ ID NO: 1057606 - RNA, 21 nt, Human
uacaguaaucuagugguggaa

SEQ ID NO: 1057607 - RNA, 24 nt, Human
uacauuuacacauacauguauaca

SEQ ID NO: 1057608 - RNA, 19 nt, Human
uaggugccaugaguuuuag

SEQ ID NO: 1057609 - RNA, 21 nt, Human
uauaaaauauaaacgccucuc

SEQ ID NO: 1057610 - RNA, 24 nt, Human
uauaaaauauaaacgccucucuga

SEQ ID NO: 1057611 - RNA, 24 nt, Human
uauuaaaugaguggcagcucucaa

SEQ ID NO: 1057612 - RNA, 20 nt, Human
ucagguucacuuggaacacc

SEQ ID NO: 1057613 - RNA, 22 nt, Human
uccccacuaccgauguccacaa

SEQ ID NO: 1057614 - RNA, 20 nt, Human
ugacuucaaaacuugcaggu

SEQ ID NO: 1057615 - RNA, 23 nt, Human
ugauucuaggucagccaaccccc

SEQ ID NO: 1057616 - RNA, 22 nt, Human
ugccaugaguuuuagaaauugg

SEQ ID NO: 1057617 - RNA, 18 nt, Human
ugcuaaggacacagcugu

SEQ ID NO: 1057618 - RNA, 24 nt, Human
uggcagagauacacagaaagccaa

SEQ ID NO: 1057619 - RNA, 18 nt, Human
uguauacaaauguacaca

SEQ ID NO: 1057620 - RNA, 22 nt, Human
uguguaccauuaucccaguggc

SEQ ID NO: 1057621 - RNA, 23 nt, Human
uguguaccauuaucccaguggcu

SEQ ID NO: 1057622 - RNA, 19 nt, Human
uuucacaacauuuucaauc

SEQ ID NO: 1057623 - RNA, 21 nt, Human
uuuuaagaaaauagcaucaaa

SEQ ID NO: 1057624 - RNA, 19 nt, Human
aaagugcuggaauuacagg

SEQ ID NO: 1057625 - RNA, 24 nt, Human
aaagugcuggaauuacaggcauga

SEQ ID NO: 1057626 - RNA, 24 nt, Human
aaagugcugggauuacaggcguga

SEQ ID NO: 1057627 - RNA, 19 nt, Human
aaccucgacucacugcaac

SEQ ID NO: 1057628 - RNA, 20 nt, Human
aaguagcugggacuacaggc

SEQ ID NO: 1057629 - RNA, 20 nt, Human
aaguagcugggacuacaggc

SEQ ID NO: 1057630 - RNA, 24 nt, Human
aaguagcugggacuacaggcgugc

SEQ ID NO: 1057631 - RNA, 19 nt, Human
aagugcuggaauuacaggc

SEQ ID NO: 1057632 - RNA, 19 nt, Human
aagugcugggauuacaggc

SEQ ID NO: 1057633 - RNA, 19 nt, Human
aagugcugggauuacaggc

SEQ ID NO: 1057634 - RNA, 26 nt, Human
aagugcugggauuacaggcgugagcc

SEQ ID NO: 1057635 - RNA, 18 nt, Human
aauuacaggcaugaggca

SEQ ID NO: 1057636 - RNA, 22 nt, Human
aauuacaggcaugaggcacuac

SEQ ID NO: 1057637 - RNA, 21 nt, Human
acaccaggcuaauuuuuguau

SEQ ID NO: 1057638 - RNA, 24 nt, Human
acaguaguggcacaaucuuggcuc

SEQ ID NO: 1057639 - RNA, 18 nt, Human
accauguuggccaggcug

SEQ ID NO: 1057640 - RNA, 22 nt, Human
accauguuggccaggcuggucu

SEQ ID NO: 1057641 - RNA, 25 nt, Human
acccacuuuggccucccaaagugcu

SEQ ID NO: 1057642 - RNA, 25 nt, Human
acucugcugcccaggcuagaguaca

SEQ ID NO: 1057643 - RNA, 19 nt, Human
agacagagucucccucugu

SEQ ID NO: 1057644 - RNA, 19 nt, Human
agccaccgcacccggccug

SEQ ID NO: 1057645 - RNA, 24 nt, Human
aggaggcggcguggcgccgggcgg

SEQ ID NO: 1057646 - RNA, 24 nt, Human
aggugauccacccacuuuggccuc

SEQ ID NO: 1057647 - RNA, 23 nt, Human
aguagcugggauuacaggcacau

SEQ ID NO: 1057648 - RNA, 19 nt, Human
agugauccacccaccucgg

SEQ ID NO: 1057649 - RNA, 18 nt, Human
agugcugggauuacaggc

SEQ ID NO: 1057650 - RNA, 18 nt, Human
auggggucucaccauguu

SEQ ID NO: 1057651 - RNA, 24 nt, Human
auggggucucaccauguuggccag

SEQ ID NO: 1057652 - RNA, 22 nt, Human
augggguuucaccauguuggcc

SEQ ID NO: 1057653 - RNA, 23 nt, Human
augggguuucaccauguuggcca

SEQ ID NO: 1057654 - RNA, 24 nt, Human
augggguuucaccauguuggccag

SEQ ID NO: 1057655 - RNA, 24 nt, Human
auugauucuugugccucagccucc

SEQ ID NO: 1057656 - RNA, 22 nt, Human
auuuuuauauuuuuaguagaga

SEQ ID NO: 1057657 - RNA, 24 nt, Human
caaagugcuggaauuacaggcaug

SEQ ID NO: 1057658 - RNA, 24 nt, Human
caaagugcugggauuacaggcgug

SEQ ID NO: 1057659 - RNA, 24 nt, Human
caccacaccaggcuaauuuuugua

SEQ ID NO: 1057660 - RNA, 21 nt, Human
caccauguuggccaggcuggu

SEQ ID NO: 1057661 - RNA, 21 nt, Human
caccauguuggccaggcuggu

SEQ ID NO: 1057662 - RNA, 23 nt, Human
caccauguuggccaggcuggucu

SEQ ID NO: 1057663 - RNA, 24 nt, Human
caccauguuggccaggcuggucuc

SEQ ID NO: 1057664 - RNA, 27 nt, Human
caccauguuggccaggcuggucucaaa

SEQ ID NO: 1057665 - RNA, 24 nt, Human
caccauguuggccaggcuggucuu

SEQ ID NO: 1057666 - RNA, 27 nt, Human
caccauguuggccaggcuggucuugaa

SEQ ID NO: 1057667 - RNA, 22 nt, Human
cacccaccucggccucccaaag

SEQ ID NO: 1057668 - RNA, 23 nt, Human
cacccaccucggccucccaaagu

SEQ ID NO: 1057669 - RNA, 21 nt, Human
caccgcgcggaggccgaaccc

SEQ ID NO: 1057670 - RNA, 24 nt, Human
caccucggccucccaaagugcugg

SEQ ID NO: 1057671 - RNA, 18 nt, Human
cacuacaccuggucagac

SEQ ID NO: 1057672 - RNA, 22 nt, Human
cacucugcugcccaggcuagag

SEQ ID NO: 1057673 - RNA, 18 nt, Human
cacugcaaccucugccuc

SEQ ID NO: 1057674 - RNA, 23 nt, Human
cacugcagucuccaccuccuggg

SEQ ID NO: 1057675 - RNA, 19 nt, Human
caggcuagaguacaguagu

SEQ ID NO: 1057676 - RNA, 24 nt, Human
cagggucucacucugcugcccagg

SEQ ID NO: 1057677 - RNA, 24 nt, Human
cauguuggccaggcuggucucaaa

SEQ ID NO: 1057678 - RNA, 24 nt, Human
cauguuggccaggcuggucuugaa

SEQ ID NO: 1057679 - RNA, 19 nt, Human
ccaaagugcuggaauuaca

SEQ ID NO: 1057680 - RNA, 24 nt, Human
ccaaagugcuggaauuacaggcau

SEQ ID NO: 1057681 - RNA, 22 nt, Human
ccaaagugcugggauuacaggc

SEQ ID NO: 1057682 - RNA, 22 nt, Human
ccaaagugcugggauuacaggc

SEQ ID NO: 1057683 - RNA, 24 nt, Human
ccaaagugcugggauuacaggcgu

SEQ ID NO: 1057684 - RNA, 22 nt, Human
ccacccacuuuggccucccaaa

SEQ ID NO: 1057685 - RNA, 24 nt, Human
ccaccuccuggguucuauugauuc

SEQ ID NO: 1057686 - RNA, 21 nt, Human
ccaggcuggagugcaguagcg

SEQ ID NO: 1057687 - RNA, 19 nt, Human
ccagguucaagugauucuc

SEQ ID NO: 1057688 - RNA, 23 nt, Human
cccaaguagcugggacuacaggc

SEQ ID NO: 1057689 - RNA, 24 nt, Human
cccaaguagcugggacuacaggcg

SEQ ID NO: 1057690 - RNA, 23 nt, Human
cccggcugauuuuuauauuuuua

SEQ ID NO: 1057691 - RNA, 18 nt, Human
ccgcgcggaggccgaacc

SEQ ID NO: 1057692 - RNA, 22 nt, Human
ccuccagguucaagugauucuc

SEQ ID NO: 1057693 - RNA, 23 nt, Human
ccuccagguucaagugauucucc

SEQ ID NO: 1057694 - RNA, 24 nt, Human
ccugaccucaagugauccacccac

SEQ ID NO: 1057695 - RNA, 24 nt, Human
ccugaccucaggugauccacccac

SEQ ID NO: 1057696 - RNA, 23 nt, Human
ccugaguagcugggauuacaggc

SEQ ID NO: 1057697 - RNA, 24 nt, Human
ccugaguagcugggauuacaggca

SEQ ID NO: 1057698 - RNA, 22 nt, Human
cgagagggacguggacgcggcg

SEQ ID NO: 1057699 - RNA, 24 nt, Human
cucaagugauccacccaccucggc

SEQ ID NO: 1057700 - RNA, 20 nt, Human
cucacugcaaccucugccuc

SEQ ID NO: 1057701 - RNA, 24 nt, Human
cucacugcaaccucugccuccagg

SEQ ID NO: 1057702 - RNA, 21 nt, Human
cucacugcagucuccaccucc

SEQ ID NO: 1057703 - RNA, 24 nt, Human
cucacugcagucuccaccuccugg

SEQ ID NO: 1057704 - RNA, 24 nt, Human
cucagccucccaaguagcugggac

SEQ ID NO: 1057705 - RNA, 24 nt, Human
cucaggugauccacccacuuuggc

SEQ ID NO: 1057706 - RNA, 18 nt, Human
cuccagguucaagugauu

SEQ ID NO: 1057707 - RNA, 19 nt, Human
cucccucuguuguccaggc

SEQ ID NO: 1057708 - RNA, 24 nt, Human
cucccucuguuguccaggcuggag

SEQ ID NO: 1057709 - RNA, 21 nt, Human
cuccuggguucuauugauucu

SEQ ID NO: 1057710 - RNA, 23 nt, Human
cugaguagcugggauuacaggca

SEQ ID NO: 1057711 - RNA, 23 nt, Human
cugcaaccucugccuccagguuc

SEQ ID NO: 1057712 - RNA, 24 nt, Human
cugcagucuccaccuccuggguuc

SEQ ID NO: 1057713 - RNA, 25 nt, Human
cuugugccucagccucccaaguagc

SEQ ID NO: 1057714 - RNA, 24 nt, Human
gaccucaagugauccacccaccuc

SEQ ID NO: 1057715 - RNA, 21 nt, Human
gaccucaggugauccacccac

SEQ ID NO: 1057716 - RNA, 20 nt, Human
gagaugggguuucaccaugu

SEQ ID NO: 1057717 - RNA, 24 nt, Human
gagaugggguuucaccauguuggc

SEQ ID NO: 1057718 - RNA, 19 nt, Human
gaggacgcggggauccugc

SEQ ID NO: 1057719 - RNA, 21 nt, Human
gaggcggcguggcgccgggcg

SEQ ID NO: 1057720 - RNA, 25 nt, Human
gaguagcugggauuacaggcacaug

SEQ ID NO: 1057721 - RNA, 24 nt, Human
gauuacaggcacaugccaccaugc

SEQ ID NO: 1057722 - RNA, 18 nt, Human
gauuacaggcgugagcca

SEQ ID NO: 1057723 - RNA, 22 nt, Human
gauuacaggcgugagccaccgc

SEQ ID NO: 1057724 - RNA, 23 nt, Human
gauuacaggcgugagccaccgca

SEQ ID NO: 1057725 - RNA, 21 nt, Human
gcaaccucugccuccagguuc

SEQ ID NO: 1057726 - RNA, 22 nt, Human
gcccggcugauuuuuauauuuu

SEQ ID NO: 1057727 - RNA, 18 nt, Human
gcgcugcaccgcgcggag

SEQ ID NO: 1057728 - RNA, 21 nt, Human
gcguggcgccgggcggggacg

SEQ ID NO: 1057729 - RNA, 21 nt, Human
gcucacugcagucuccaccuc

SEQ ID NO: 1057730 - RNA, 19 nt, Human
gcuggagugcaguagcgca

SEQ ID NO: 1057731 - RNA, 23 nt, Human
gcuggucucaaacuccugaccuc

SEQ ID NO: 1057732 - RNA, 23 nt, Human
gcuggucuugaacuccugaccuc

SEQ ID NO: 1057733 - RNA, 24 nt, Human
ggcuggucucaaacuccugaccuc

SEQ ID NO: 1057734 - RNA, 24 nt, Human
ggcuggucuugaacuccugaccuc

SEQ ID NO: 1057735 - RNA, 20 nt, Human
gggacguggacgcggcgacc

SEQ ID NO: 1057736 - RNA, 18 nt, Human
ggggucucaccauguugg

SEQ ID NO: 1057737 - RNA, 22 nt, Human
ggggucucaccauguuggccag

SEQ ID NO: 1057738 - RNA, 22 nt, Human
gggguuucaccauguuggccag

SEQ ID NO: 1057739 - RNA, 22 nt, Human
gggucucaccauguuggccagg

SEQ ID NO: 1057740 - RNA, 22 nt, Human
ggguuucaccauguuggccagg

SEQ ID NO: 1057741 - RNA, 18 nt, Human
ggucucaccauguuggcc

SEQ ID NO: 1057742 - RNA, 19 nt, Human
ggucuugaacuccugaccu

SEQ ID NO: 1057743 - RNA, 22 nt, Human
guagagauggggucucaccaug

SEQ ID NO: 1057744 - RNA, 23 nt, Human
guagagaugggguuucaccaugu

SEQ ID NO: 1057745 - RNA, 18 nt, Human
guagcugggauuacaggc

SEQ ID NO: 1057746 - RNA, 19 nt, Human
guauuuuuuguagagaugg

SEQ ID NO: 1057747 - RNA, 24 nt, Human
gugauccacccaccucggccuccc

SEQ ID NO: 1057748 - RNA, 24 nt, Human
gugauccacccacuuuggccuccc

SEQ ID NO: 1057749 - RNA, 22 nt, Human
gugccucagccucccaaguagc

SEQ ID NO: 1057750 - RNA, 18 nt, Human
guuguccaggcuggagug

SEQ ID NO: 1057751 - RNA, 24 nt, Human
uaauuuuuguauuuuuuguagaga

SEQ ID NO: 1057752 - RNA, 23 nt, Human
uacaggcacaugccaccaugccc

SEQ ID NO: 1057753 - RNA, 22 nt, Human
uacaggcaugaggcacuacacc

SEQ ID NO: 1057754 - RNA, 23 nt, Human
uacaggcgugagccaccgcaccc

SEQ ID NO: 1057755 - RNA, 22 nt, Human
uagagauggggucucaccaugu

SEQ ID NO: 1057756 - RNA, 22 nt, Human
uagagaugggguuucaccaugu

SEQ ID NO: 1057757 - RNA, 27 nt, Human
uagaguacaguaguggcacaaucuugg

SEQ ID NO: 1057758 - RNA, 24 nt, Human
uaguagagaugggguuucaccaug

SEQ ID NO: 1057759 - RNA, 26 nt, Human
uaguagagaugggguuucaccauguu

SEQ ID NO: 1057760 - RNA, 20 nt, Human
ucaagugauccacccaccuc

SEQ ID NO: 1057761 - RNA, 19 nt, Human
ucacugcaaccucugccuc

SEQ ID NO: 1057762 - RNA, 23 nt, Human
ucacugcaaccucugccuccagg

SEQ ID NO: 1057763 - RNA, 27 nt, Human
ucacugcaaccucugccuccagguuca

SEQ ID NO: 1057764 - RNA, 23 nt, Human
ucacugcagucuccaccuccugg

SEQ ID NO: 1057765 - RNA, 24 nt, Human
ucacugcagucuccaccuccuggg

SEQ ID NO: 1057766 - RNA, 25 nt, Human
ucacugcagucuccaccuccugggg

SEQ ID NO: 1057767 - RNA, 25 nt, Human
ucacugcagucuccaccuccugggu

SEQ ID NO: 1057768 - RNA, 20 nt, Human
ucagccucccaaguagcugg

SEQ ID NO: 1057769 - RNA, 23 nt, Human
uccagguucaagugauucuccuc

SEQ ID NO: 1057770 - RNA, 24 nt, Human
ucccaaagugcuggaauuacaggc

SEQ ID NO: 1057771 - RNA, 24 nt, Human
ucccaaagugcugggauuacaggc

SEQ ID NO: 1057772 - RNA, 24 nt, Human
ucccaaguagcugggacuacaggc

SEQ ID NO: 1057773 - RNA, 20 nt, Human
ucccucuguuguccaggcug

SEQ ID NO: 1057774 - RNA, 24 nt, Human
ucccucuguuguccaggcuggagu

SEQ ID NO: 1057775 - RNA, 24 nt, Human
uccugaguagcugggauuacaggc

SEQ ID NO: 1057776 - RNA, 21 nt, Human
uccuggguucuauugauucuu

SEQ ID NO: 1057777 - RNA, 23 nt, Human
ucuaggaaggcuugcccuugauu

SEQ ID NO: 1057778 - RNA, 24 nt, Human
ucucaccauguuggccaggcuggu

SEQ ID NO: 1057779 - RNA, 24 nt, Human
ucucacucugcugcccaggcuaga

SEQ ID NO: 1057780 - RNA, 25 nt, Human
ucucacucugcugcccaggcuagag

SEQ ID NO: 1057781 - RNA, 26 nt, Human
ucucacucugcugcccaggcuagagu

SEQ ID NO: 1057782 - RNA, 19 nt, Human
ucuccaccuccuggguucu

SEQ ID NO: 1057783 - RNA, 22 nt, Human
ucuccagguacugaccugguuu

SEQ ID NO: 1057784 - RNA, 22 nt, Human
ucucccucuguuguccaggcug

SEQ ID NO: 1057785 - RNA, 23 nt, Human
ucucccucuguuguccaggcugg

SEQ ID NO: 1057786 - RNA, 24 nt, Human
ucucccucuguuguccaggcugga

SEQ ID NO: 1057787 - RNA, 24 nt, Human
ucugcugcccaggcuagaguacag

SEQ ID NO: 1057788 - RNA, 24 nt, Human
ucuguuguccaggcuggagugcag

SEQ ID NO: 1057789 - RNA, 21 nt, Human
ucuugaacuccugaccucaag

SEQ ID NO: 1057790 - RNA, 21 nt, Human
ugaccucaggugauccaccca

SEQ ID NO: 1057791 - RNA, 22 nt, Human
ugaccucaggugauccacccac

SEQ ID NO: 1057792 - RNA, 24 nt, Human
ugaccucaggugauccacccacuu

SEQ ID NO: 1057793 - RNA, 22 nt, Human
ugagacagagucucccucuguu

SEQ ID NO: 1057794 - RNA, 24 nt, Human
ugagacagagucucccucuguugu

SEQ ID NO: 1057795 - RNA, 20 nt, Human
ugagacagggucucacucug

SEQ ID NO: 1057796 - RNA, 22 nt, Human
ugagacagggucucacucugcu

SEQ ID NO: 1057797 - RNA, 24 nt, Human
ugauccacccaccucggccuccca

SEQ ID NO: 1057798 - RNA, 20 nt, Human
ugauucuugugccucagccu

SEQ ID NO: 1057799 - RNA, 23 nt, Human
ugauucuugugccucagccuccc

SEQ ID NO: 1057800 - RNA, 24 nt, Human
ugauuuuuauauuuuuaguagaga

SEQ ID NO: 1057801 - RNA, 18 nt, Human
ugcaccaccacaccaggc

SEQ ID NO: 1057802 - RNA, 21 nt, Human
ugcccaggcuagaguacagua

SEQ ID NO: 1057803 - RNA, 24 nt, Human
ugcccggcugauuuuuauauuuuu

SEQ ID NO: 1057804 - RNA, 22 nt, Human
ugccucagccucccaaguagcu

SEQ ID NO: 1057805 - RNA, 24 nt, Human
ugccucagccucccaaguagcugg

SEQ ID NO: 1057806 - RNA, 22 nt, Human
ugccuccagguucaagugauuc

SEQ ID NO: 1057807 - RNA, 19 nt, Human
ugcgcugcaccgcgcggag

SEQ ID NO: 1057808 - RNA, 24 nt, Human
ugcuggaauuacaggcaugaggca

SEQ ID NO: 1057809 - RNA, 24 nt, Human
ugcugggauuacaggcgugagcca

SEQ ID NO: 1057810 - RNA, 18 nt, Human
uggaauuacaggcaugag

SEQ ID NO: 1057811 - RNA, 19 nt, Human
uggaauuacaggcaugagg

SEQ ID NO: 1057812 - RNA, 21 nt, Human
uggaauuacaggcaugaggca

SEQ ID NO: 1057813 - RNA, 24 nt, Human
uggaauuacaggcaugaggcacua

SEQ ID NO: 1057814 - RNA, 24 nt, Human
uggaauuacaggcaugaggcacua

SEQ ID NO: 1057815 - RNA, 19 nt, Human
uggagugcaguagcgcaac

SEQ ID NO: 1057816 - RNA, 23 nt, Human
uggcacaaucuuggcucacugca

SEQ ID NO: 1057817 - RNA, 24 nt, Human
uggccaggcuggucucaaacuccu

SEQ ID NO: 1057818 - RNA, 24 nt, Human
uggccaggcuggucuugaacuccu

SEQ ID NO: 1057819 - RNA, 21 nt, Human
ugggacuacaggcgugcacca

SEQ ID NO: 1057820 - RNA, 24 nt, Human
ugggacuacaggcgugcaccacca

SEQ ID NO: 1057821 - RNA, 21 nt, Human
ugggauuacaggcacaugcca

SEQ ID NO: 1057822 - RNA, 22 nt, Human
ugggauuacaggcacaugccac

SEQ ID NO: 1057823 - RNA, 24 nt, Human
ugggauuacaggcacaugccacca

SEQ ID NO: 1057824 - RNA, 25 nt, Human
ugggauuacaggcacaugccaccau

SEQ ID NO: 1057825 - RNA, 18 nt, Human
ugggauuacaggcgugag

SEQ ID NO: 1057826 - RNA, 19 nt, Human
ugggauuacaggcgugagc

SEQ ID NO: 1057827 - RNA, 21 nt, Human
ugggauuacaggcgugagcca

SEQ ID NO: 1057828 - RNA, 22 nt, Human
ugggauuacaggcgugagccac

SEQ ID NO: 1057829 - RNA, 23 nt, Human
ugggauuacaggcgugagccacc

SEQ ID NO: 1057830 - RNA, 24 nt, Human
ugggauuacaggcgugagccaccg

SEQ ID NO: 1057831 - RNA, 24 nt, Human
uggggucucaccauguuggccagg

SEQ ID NO: 1057832 - RNA, 24 nt, Human
ugggguuucaccauguuggccagg

SEQ ID NO: 1057833 - RNA, 24 nt, Human
uguagagauggggucucaccaugu

SEQ ID NO: 1057834 - RNA, 19 nt, Human
uguccaggcuggagugcag

SEQ ID NO: 1057835 - RNA, 20 nt, Human
uguccaggcuggagugcagu

SEQ ID NO: 1057836 - RNA, 21 nt, Human
uguguuucaaaugaaauaauc

SEQ ID NO: 1057837 - RNA, 20 nt, Human
uuacaggcaugaggcacuac

SEQ ID NO: 1057838 - RNA, 18 nt, Human
uuaguagagaugggguuu

SEQ ID NO: 1057839 - RNA, 22 nt, Human
uuaguagagaugggguuucacc

SEQ ID NO: 1057840 - RNA, 24 nt, Human
uuaguagagaugggguuucaccau

SEQ ID NO: 1057841 - RNA, 22 nt, Human
uuauuuacuuauuuauuuuugg

SEQ ID NO: 1057842 - RNA, 25 nt, Human
uuauuuauuuauuuacuuauuuauu

SEQ ID NO: 1057843 - RNA, 19 nt, Human
uuauuuauuuauuuauuua

SEQ ID NO: 1057844 - RNA, 25 nt, Human
uuauuuauuuauuuauuuacuuauu

SEQ ID NO: 1057845 - RNA, 22 nt, Human
uucaagugauucuccuccucag

SEQ ID NO: 1057846 - RNA, 22 nt, Human
uucaagugauucuccuccucag

SEQ ID NO: 1057847 - RNA, 23 nt, Human
uucuauugauucuugugccucag

SEQ ID NO: 1057848 - RNA, 24 nt, Human
uuguagagauggggucucaccaug

SEQ ID NO: 1057849 - RNA, 24 nt, Human
uuguccaggcuggagugcaguagc

SEQ ID NO: 1057850 - RNA, 24 nt, Human
uuucaccauguuggccaggcuggu

SEQ ID NO: 1057851 - RNA, 19 nt, Human
uuuggccucccaaagugcu

SEQ ID NO: 1057852 - RNA, 18 nt, Human
uuuguagagauggggucu

SEQ ID NO: 1057853 - RNA, 24 nt, Human
uuuguagagauggggucucaccau

SEQ ID NO: 1057854 - RNA, 20 nt, Human
uuuuauauuuuuaguagaga

SEQ ID NO: 1057855 - RNA, 24 nt, Human
uuuuuaguagagaugggguuucac

SEQ ID NO: 1057856 - RNA, 20 nt, Human
uuuuuauauuuuuaguagag

SEQ ID NO: 1057857 - RNA, 20 nt, Human
uuuuuguauuuuuuguagag

SEQ ID NO: 1057858 - RNA, 23 nt, Human
uuuuuguauuuuuuguagagaug

SEQ ID NO: 1057859 - RNA, 24 nt, Human
uuuuuuguagagauggggucucac

SEQ ID NO: 1057860 - RNA, 20 nt, Human
uuuuuuuuuuugagacagag

SEQ ID NO: 1057861 - RNA, 24 nt, Human
aaaaacaaagggaaaacacaaaac

SEQ ID NO: 1057862 - RNA, 20 nt, Human
aaacacaaaacugcaauaaa

SEQ ID NO: 1057863 - RNA, 21 nt, Human
aacaaagggaaaacacaaaac

SEQ ID NO: 1057864 - RNA, 21 nt, Human
aaccaaugcuagggaaaaaca

SEQ ID NO: 1057865 - RNA, 22 nt, Human
aaccaaugcuagggaaaaacaa

SEQ ID NO: 1057866 - RNA, 21 nt, Human
aaccgugccgugaagggcaag

SEQ ID NO: 1057867 - RNA, 25 nt, Human
aauacuaaaagcccucaaaugaacc

SEQ ID NO: 1057868 - RNA, 19 nt, Human
aauucccacccccauuccc

SEQ ID NO: 1057869 - RNA, 23 nt, Human
acaauucccacccccauucccua

SEQ ID NO: 1057870 - RNA, 21 nt, Human
acccuagggacauuuccuggg

SEQ ID NO: 1057871 - RNA, 19 nt, Human
agggaaaaacaaagggaaa

SEQ ID NO: 1057872 - RNA, 25 nt, Human
agggaaaacacaaaacugcaauaaa

SEQ ID NO: 1057873 - RNA, 30 nt, Human
caauaaacuucaucuucucucccagguuuu

SEQ ID NO: 1057874 - RNA, 18 nt, Human
ccacugccuggaaggggg

SEQ ID NO: 1057875 - RNA, 18 nt, Human
cccuucuucuccccucuc

SEQ ID NO: 1057876 - RNA, 19 nt, Human
cccuucuucuccccucucc

SEQ ID NO: 1057877 - RNA, 24 nt, Human
cuaaaagcccucaaaugaaccccu

SEQ ID NO: 1057878 - RNA, 21 nt, Human
cuagggaaaaacaaagggaaa

SEQ ID NO: 1057879 - RNA, 20 nt, Human
cuagggacauuuccuggguu

SEQ ID NO: 1057880 - RNA, 24 nt, Human
cuugaacaauucccacccccauuc

SEQ ID NO: 1057881 - RNA, 18 nt, Human
gcagaagugguuugaggg

SEQ ID NO: 1057882 - RNA, 21 nt, Human
ggcagaagugguuugagggcc

SEQ ID NO: 1057883 - RNA, 23 nt, Human
ggcagaagugguuugagggccug

SEQ ID NO: 1057884 - RNA, 26 nt, Human
gggaaaaacaaagggaaaacacaaaa

SEQ ID NO: 1057885 - RNA, 28 nt, Human
gggaaaaacaaagggaaaaccgguaccc

SEQ ID NO: 1057886 - RNA, 20 nt, Human
uagacagugaaugagaaauu

SEQ ID NO: 1057887 - RNA, 23 nt, Human
uagggacauuuccuggguuuucc

SEQ ID NO: 1057888 - RNA, 22 nt, Human
ucccuucuucuccccucuccaa

SEQ ID NO: 1057889 - RNA, 24 nt, Human
ucccuucuucuccccucuccaacc

SEQ ID NO: 1057890 - RNA, 22 nt, Human
ucucccagguuuuucuugaaca

SEQ ID NO: 1057891 - RNA, 22 nt, Human
ugccgugaagggcaagccccuc

SEQ ID NO: 1057892 - RNA, 19 nt, Human
ugccuggaagggggcagaa

SEQ ID NO: 1057893 - RNA, 23 nt, Human
ugccuggaagggggcagaagugg

SEQ ID NO: 1057894 - RNA, 23 nt, Human
ugccuggaagggggcagaagugg

SEQ ID NO: 1057895 - RNA, 18 nt, Human
uggaagggggcagaagug

SEQ ID NO: 1057896 - RNA, 19 nt, Human
uggaagggggcagaagugg

SEQ ID NO: 1057897 - RNA, 19 nt, Human
uggaagggggcagaagugg

SEQ ID NO: 1057898 - RNA, 20 nt, Human
uggaagggggcagaagugga

SEQ ID NO: 1057899 - RNA, 22 nt, Human
uuaauacuaaaagcccucaaau

SEQ ID NO: 1057900 - RNA, 24 nt, Human
uucccacccccauucccuacuaug

SEQ ID NO: 1057901 - RNA, 20 nt, Human
uugaacaauucccaccccca

SEQ ID NO: 1057902 - RNA, 21 nt, Human
uuucccuucuucuccccucuc

SEQ ID NO: 1057903 - RNA, 23 nt, Human
uuucccuucuucuccccucucca

SEQ ID NO: 1057904 - RNA, 23 nt, Human
uuugagggccuguguccggccau

SEQ ID NO: 1057905 - RNA, 24 nt, Human
aaaagcacaggcagaauuggagac

SEQ ID NO: 1057906 - RNA, 19 nt, Human
aaacaaaagcacaggcaga

SEQ ID NO: 1057907 - RNA, 19 nt, Human
aauuaauugcagaucacug

SEQ ID NO: 1057908 - RNA, 23 nt, Human
augcuuuuuaaaagauccgaguu

SEQ ID NO: 1057909 - RNA, 24 nt, Human
auuucaguucaguuuuuugguuuc

SEQ ID NO: 1057910 - RNA, 24 nt, Human
uaaacaucaagaauacacacuuua

SEQ ID NO: 1057911 - RNA, 22 nt, Human
uaacaaaacacaaaagcauuaa

SEQ ID NO: 1057912 - RNA, 28 nt, Human
uauuaugaaguauuaacaaaacacaaaa

SEQ ID NO: 1057913 - RNA, 20 nt, Human
ucagauggcaaaaguagaau

SEQ ID NO: 1057914 - RNA, 25 nt, Human
ucuagagacagucaaacaaaagcac

SEQ ID NO: 1057915 - RNA, 20 nt, Human
uggaaaaaugaucuaugaug

SEQ ID NO: 1057916 - RNA, 24 nt, Human
uguaauucucccuguacauuucug

SEQ ID NO: 1057917 - RNA, 23 nt, Human
aaaauauguaaccccuauagcaa

SEQ ID NO: 1057918 - RNA, 22 nt, Human
acccauagcuccaagagccuca

SEQ ID NO: 1057919 - RNA, 23 nt, Human
acugcaccaccaaugcuucagca

SEQ ID NO: 1057920 - RNA, 23 nt, Human
acuuguucccuccccauaucccc

SEQ ID NO: 1057921 - RNA, 18 nt, Human
agacaauaaaggcuggua

SEQ ID NO: 1057922 - RNA, 21 nt, Human
agccucagugucagaacauag

SEQ ID NO: 1057923 - RNA, 19 nt, Human
agcgguccuccugccucag

SEQ ID NO: 1057924 - RNA, 24 nt, Human
agcgguccuccugccucagccucc

SEQ ID NO: 1057925 - RNA, 18 nt, Human
agcugguauuuccuuugg

SEQ ID NO: 1057926 - RNA, 20 nt, Human
aggcuggagugcaguggcaa

SEQ ID NO: 1057927 - RNA, 19 nt, Human
aguagcugggacuacaggc

SEQ ID NO: 1057928 - RNA, 19 nt, Human
aguagcugggacuacaggc

SEQ ID NO: 1057929 - RNA, 21 nt, Human
aguggccacgguuauucuggg

SEQ ID NO: 1057930 - RNA, 24 nt, Human
auaaaaccuuuacagcugugcaga

SEQ ID NO: 1057931 - RNA, 21 nt, Human
auaaccccuaaguccuacgcu

SEQ ID NO: 1057932 - RNA, 25 nt, Human
auaaccccuaaguccuacgcucugc

SEQ ID NO: 1057933 - RNA, 18 nt, Human
auguguuaaagacagacu

SEQ ID NO: 1057934 - RNA, 25 nt, Human
caaacuccugggcucaagcgguccu

SEQ ID NO: 1057935 - RNA, 20 nt, Human
caagcgguccuccugccuca

SEQ ID NO: 1057936 - RNA, 27 nt, Human
caagcgguccuccugccucagccuccu

SEQ ID NO: 1057937 - RNA, 24 nt, Human
caagugacuuucccaaggucaccc

SEQ ID NO: 1057938 - RNA, 21 nt, Human
caaucaagugacuuucccaag

SEQ ID NO: 1057939 - RNA, 23 nt, Human
caaucuugggagaaaaguaacaa

SEQ ID NO: 1057940 - RNA, 23 nt, Human
cacaagugugaucagaugaucag

SEQ ID NO: 1057941 - RNA, 22 nt, Human
cacccagcuggucauuagaggc

SEQ ID NO: 1057942 - RNA, 22 nt, Human
cacuaaucagugggugauuacu

SEQ ID NO: 1057943 - RNA, 24 nt, Human
cagcacugccucccuuugccuuaa

SEQ ID NO: 1057944 - RNA, 20 nt, Human
cagccuccugaguagcuggg

SEQ ID NO: 1057945 - RNA, 20 nt, Human
caggcgaguaccaccaugcc

SEQ ID NO: 1057946 - RNA, 22 nt, Human
cagugggugauuacuggucagg

SEQ ID NO: 1057947 - RNA, 18 nt, Human
ccagcuggucauuagagg

SEQ ID NO: 1057948 - RNA, 18 nt, Human
ccccggggagcgggccgc

SEQ ID NO: 1057949 - RNA, 22 nt, Human
ccccuaaguccuacgcucugcc

SEQ ID NO: 1057950 - RNA, 23 nt, Human
cccucuucccuucuacuuguucc

SEQ ID NO: 1057951 - RNA, 23 nt, Human
cccuuugccuuaaggacugggag

SEQ ID NO: 1057952 - RNA, 23 nt, Human
ccggcccgguccccggggagcgg

SEQ ID NO: 1057953 - RNA, 24 nt, Human
ccuccugccucagccuccugagua

SEQ ID NO: 1057954 - RNA, 18 nt, Human
ccucuucccuucuacuug

SEQ ID NO: 1057955 - RNA, 23 nt, Human
ccugaguagcugggacuacaggc

SEQ ID NO: 1057956 - RNA, 23 nt, Human
ccugaguagcugggacuacaggc

SEQ ID NO: 1057957 - RNA, 23 nt, Human
ccugccucagccuccugaguagc

SEQ ID NO: 1057958 - RNA, 24 nt, Human
ccugccucagccuccugaguagcu

SEQ ID NO: 1057959 - RNA, 20 nt, Human
ccugggcucaagcgguccuc

SEQ ID NO: 1057960 - RNA, 23 nt, Human
ccugggcucaagcgguccuccug

SEQ ID NO: 1057961 - RNA, 19 nt, Human
ccuguggacauuagagcuc

SEQ ID NO: 1057962 - RNA, 22 nt, Human
ccuucuacuuguucccucccca

SEQ ID NO: 1057963 - RNA, 23 nt, Human
cgaguaccaccaugccuggcuaa

SEQ ID NO: 1057964 - RNA, 23 nt, Human
cgcagggcgcaggggcuccggcg

SEQ ID NO: 1057965 - RNA, 22 nt, Human
cggcccgguccccggggagcgg

SEQ ID NO: 1057966 - RNA, 18 nt, Human
cuaauaauagccacuuuu

SEQ ID NO: 1057967 - RNA, 19 nt, Human
cuacaacauccuguggacu

SEQ ID NO: 1057968 - RNA, 18 nt, Human
cuacuuccuagucuucuc

SEQ ID NO: 1057969 - RNA, 18 nt, Human
cucaagcgguccuccugc

SEQ ID NO: 1057970 - RNA, 24 nt, Human
cucagccuccugaguagcugggac

SEQ ID NO: 1057971 - RNA, 23 nt, Human
cuccauccucauuuccacccuuc

SEQ ID NO: 1057972 - RNA, 23 nt, Human
cuccugggcucaagcgguccucc

SEQ ID NO: 1057973 - RNA, 22 nt, Human
cugguauuuugggugcccugga

SEQ ID NO: 1057974 - RNA, 21 nt, Human
cuuauaaccccuaaguccuac

SEQ ID NO: 1057975 - RNA, 26 nt, Human
cuuuuuuuuuuuaauagauggggucu

SEQ ID NO: 1057976 - RNA, 24 nt, Human
gacaagcugguauuuccuuuggaa

SEQ ID NO: 1057977 - RNA, 24 nt, Human
gacuacaggcgaguaccaccaugc

SEQ ID NO: 1057978 - RNA, 25 nt, Human
gaguagcugggacuacaggcgagua

SEQ ID NO: 1057979 - RNA, 22 nt, Human
gaguaucacugugagcuuaaaa

SEQ ID NO: 1057980 - RNA, 21 nt, Human
gagugcaagaugaggacuuca

SEQ ID NO: 1057981 - RNA, 24 nt, Human
gcgguccuccugccucagccuccu

SEQ ID NO: 1057982 - RNA, 22 nt, Human
gcuggagugcaguggcaauuca

SEQ ID NO: 1057983 - RNA, 21 nt, Human
ggagacugcccaggacuugag

SEQ ID NO: 1057984 - RNA, 22 nt, Human
gggauuuuccuucuuuccucuu

SEQ ID NO: 1057985 - RNA, 22 nt, Human
ggggagcgggccgcagggcgca

SEQ ID NO: 1057986 - RNA, 21 nt, Human
gggucuugcuauuugcuuagg

SEQ ID NO: 1057987 - RNA, 24 nt, Human
gucuugcuauuugcuuaggcugga

SEQ ID NO: 1057988 - RNA, 23 nt, Human
uaaaauauguaaccccuauagca

SEQ ID NO: 1057989 - RNA, 20 nt, Human
uaaaaucaugcagacaauaa

SEQ ID NO: 1057990 - RNA, 22 nt, Human
uaaagucauaaggaugcucucc

SEQ ID NO: 1057991 - RNA, 18 nt, Human
uaaggagacugcccagga

SEQ ID NO: 1057992 - RNA, 19 nt, Human
uaagggacuugauuuacug

SEQ ID NO: 1057993 - RNA, 22 nt, Human
uacccuacaacauccuguggac

SEQ ID NO: 1057994 - RNA, 24 nt, Human
uacuucuucccuuccucagaaggg

SEQ ID NO: 1057995 - RNA, 26 nt, Human
uacuuguucccuccccauauccccua

SEQ ID NO: 1057996 - RNA, 22 nt, Human
uagaauaaagacauugccuccu

SEQ ID NO: 1057997 - RNA, 24 nt, Human
uagcacccaugugacagaaagaag

SEQ ID NO: 1057998 - RNA, 22 nt, Human
uaucaaguguuuguaaaagguu

SEQ ID NO: 1057999 - RNA, 23 nt, Human
uaucuggaucugggcuuauaacc

SEQ ID NO: 1058000 - RNA, 21 nt, Human
ucagaagggaaggcaaagaca

SEQ ID NO: 1058001 - RNA, 21 nt, Human
ucagacacuaugcaagaugcc

SEQ ID NO: 1058002 - RNA, 19 nt, Human
ucagcacugccucccuuug

SEQ ID NO: 1058003 - RNA, 23 nt, Human
ucagccuccugaguagcugggac

SEQ ID NO: 1058004 - RNA, 19 nt, Human
ucagugucagaacauaggu

SEQ ID NO: 1058005 - RNA, 24 nt, Human
ucagugucagaacauagguaaggg

SEQ ID NO: 1058006 - RNA, 20 nt, Human
ucaugcagacaauaaaggcu

SEQ ID NO: 1058007 - RNA, 21 nt, Human
uccaagagccucagugucaga

SEQ ID NO: 1058008 - RNA, 24 nt, Human
uccugaguagcugggacuacaggc

SEQ ID NO: 1058009 - RNA, 22 nt, Human
uccugggcucaagcgguccucc

SEQ ID NO: 1058010 - RNA, 24 nt, Human
uccugggcucaagcgguccuccug

SEQ ID NO: 1058011 - RNA, 19 nt, Human
ucuacuuguucccucccca

SEQ ID NO: 1058012 - RNA, 24 nt, Human
ucucaaacuccugggcucaagcgg

SEQ ID NO: 1058013 - RNA, 19 nt, Human
ucuccagcuaccucagagg

SEQ ID NO: 1058014 - RNA, 21 nt, Human
ucuugcuauuugcuuaggcug

SEQ ID NO: 1058015 - RNA, 22 nt, Human
ucuugcuauuugcuuaggcugg

SEQ ID NO: 1058016 - RNA, 23 nt, Human
ucuugcuauuugcuuaggcugga

SEQ ID NO: 1058017 - RNA, 25 nt, Human
ugagagacccuacccuacaacaucc

SEQ ID NO: 1058018 - RNA, 20 nt, Human
ugagguccuuggucccucua

SEQ ID NO: 1058019 - RNA, 21 nt, Human
ugagugaggcuaaagucugua

SEQ ID NO: 1058020 - RNA, 18 nt, Human
ugcccuggagaacgaggg

SEQ ID NO: 1058021 - RNA, 19 nt, Human
ugcccuggagaacgagggc

SEQ ID NO: 1058022 - RNA, 24 nt, Human
ugccucagccuccugaguagcugg

SEQ ID NO: 1058023 - RNA, 21 nt, Human
ugccuccuggauuucuaaccc

SEQ ID NO: 1058024 - RNA, 18 nt, Human
ugccuuaaggacugggag

SEQ ID NO: 1058025 - RNA, 18 nt, Human
ugcuccauuucucuuucc

SEQ ID NO: 1058026 - RNA, 20 nt, Human
ugcugugaaugggauggaag

SEQ ID NO: 1058027 - RNA, 21 nt, Human
ugcugugaaugggauggaagg

SEQ ID NO: 1058028 - RNA, 20 nt, Human
ugcuuaggcuggagugcagu

SEQ ID NO: 1058029 - RNA, 21 nt, Human
ugcuuaggcuggagugcagug

SEQ ID NO: 1058030 - RNA, 22 nt, Human
ugcuuaggcuggagugcagugg

SEQ ID NO: 1058031 - RNA, 24 nt, Human
ugcuuaggcuggagugcaguggca

SEQ ID NO: 1058032 - RNA, 23 nt, Human
uggagugcaguggcaauucacag

SEQ ID NO: 1058033 - RNA, 24 nt, Human
uggagugcaguggcaauucacagg

SEQ ID NO: 1058034 - RNA, 21 nt, Human
ugggacuacaggcgaguacca

SEQ ID NO: 1058035 - RNA, 24 nt, Human
ugggacuacaggcgaguaccacca

SEQ ID NO: 1058036 - RNA, 25 nt, Human
ugggacuacaggcgaguaccaccau

SEQ ID NO: 1058037 - RNA, 24 nt, Human
ugggcucaagcgguccuccugccu

SEQ ID NO: 1058038 - RNA, 23 nt, Human
uggggucuugcuauuugcuuagg

SEQ ID NO: 1058039 - RNA, 21 nt, Human
ugguagcggccggcgcgcugc

SEQ ID NO: 1058040 - RNA, 19 nt, Human
ugucagaacauagguaagg

SEQ ID NO: 1058041 - RNA, 18 nt, Human
ugucuaaagcauaugagg

SEQ ID NO: 1058042 - RNA, 19 nt, Human
ugugacagaaagaagccau

SEQ ID NO: 1058043 - RNA, 24 nt, Human
uguucccuccccauauccccuaaa

SEQ ID NO: 1058044 - RNA, 20 nt, Human
uuacacugcaccaccaaugc

SEQ ID NO: 1058045 - RNA, 19 nt, Human
uuagagcucugugcuccug

SEQ ID NO: 1058046 - RNA, 23 nt, Human
uuccuagucuucucuuggugucu

SEQ ID NO: 1058047 - RNA, 19 nt, Human
uugagguccuuggucccuc

SEQ ID NO: 1058048 - RNA, 24 nt, Human
uugcuuaggcuggagugcaguggc

SEQ ID NO: 1058049 - RNA, 19 nt, Human
uuguucccuccccauaucc

SEQ ID NO: 1058050 - RNA, 24 nt, Human
aaaaaaaaaaaaaauugccaagag

SEQ ID NO: 1058051 - RNA, 25 nt, Human
aaaaaaaaaccaaaaaccaaaaacc

SEQ ID NO: 1058052 - RNA, 23 nt, Human
aaaaaaaccaaaaaccaaaaacc

SEQ ID NO: 1058053 - RNA, 24 nt, Human
aaaaaaaccaaaaaccaaaaacca

SEQ ID NO: 1058054 - RNA, 22 nt, Human
aaaaaacacacagagaguaauu

SEQ ID NO: 1058055 - RNA, 21 nt, Human
aaaaaaccaaaaaccaaaaac

SEQ ID NO: 1058056 - RNA, 19 nt, Human
aaaaacaaaacaaaaggua

SEQ ID NO: 1058057 - RNA, 23 nt, Human
aaaaacaacaaaaaaacuuugcg

SEQ ID NO: 1058058 - RNA, 21 nt, Human
aaaaaccaaaaaccaaaaacc

SEQ ID NO: 1058059 - RNA, 21 nt, Human
aaaaaccaaaaaccaaaaacc

SEQ ID NO: 1058060 - RNA, 22 nt, Human
aaaaaccaaaaaccaaaaacca

SEQ ID NO: 1058061 - RNA, 19 nt, Human
aacaaaacaaaagguaaag

SEQ ID NO: 1058062 - RNA, 22 nt, Human
aacauuccauaccuaaaauuau

SEQ ID NO: 1058063 - RNA, 20 nt, Human
aaccaaaaaaaaaaaaccaa

SEQ ID NO: 1058064 - RNA, 27 nt, Human
aaccaaaaaccaaaaaacaaaacuagc

SEQ ID NO: 1058065 - RNA, 19 nt, Human
aaccaaaaaccaaaaacca

SEQ ID NO: 1058066 - RNA, 19 nt, Human
aaccaaaaaccaaaaacca

SEQ ID NO: 1058067 - RNA, 20 nt, Human
aaccaaaaaccaaaaaccaa

SEQ ID NO: 1058068 - RNA, 30 nt, Human
aaccaaaaaccaaaaaccaaaaaacaagac

SEQ ID NO: 1058069 - RNA, 18 nt, Human
aacuagccagucauggug

SEQ ID NO: 1058070 - RNA, 25 nt, Human
aagccaauaugacuaaauccaaaac

SEQ ID NO: 1058071 - RNA, 18 nt, Human
aaguaacauaaauagagc

SEQ ID NO: 1058072 - RNA, 24 nt, Human
aaguaacauaaauagagccagagg

SEQ ID NO: 1058073 - RNA, 24 nt, Human
aauagagccagaggaaacuuaaaa

SEQ ID NO: 1058074 - RNA, 20 nt, Human
acaaaauacaagauacuaca

SEQ ID NO: 1058075 - RNA, 20 nt, Human
acaacaaaaaaacuuugcgg

SEQ ID NO: 1058076 - RNA, 23 nt, Human
acacaauuccuguuauagagacc

SEQ ID NO: 1058077 - RNA, 22 nt, Human
accaaccaaccaaaaaaaaaaa

SEQ ID NO: 1058078 - RNA, 19 nt, Human
acgaagcuuuauccucuaa

SEQ ID NO: 1058079 - RNA, 20 nt, Human
agacagccauaaaaaggcag

SEQ ID NO: 1058080 - RNA, 21 nt, Human
agaggaguaaaggcuggugga

SEQ ID NO: 1058081 - RNA, 22 nt, Human
agaugcucccgcuuaaaaacca

SEQ ID NO: 1058082 - RNA, 20 nt, Human
agccagucaugguggugcac

SEQ ID NO: 1058083 - RNA, 22 nt, Human
agccuggacaauauagugagac

SEQ ID NO: 1058084 - RNA, 23 nt, Human
agccuggacaauauagugagacc

SEQ ID NO: 1058085 - RNA, 20 nt, Human
aggauugcuugggcccagga

SEQ ID NO: 1058086 - RNA, 19 nt, Human
aggcaggauugcuugggcc

SEQ ID NO: 1058087 - RNA, 21 nt, Human
aggcugaggcaggauugcuug

SEQ ID NO: 1058088 - RNA, 24 nt, Human
aggcugaggugggaggaucacuug

SEQ ID NO: 1058089 - RNA, 18 nt, Human
aggugggaggaucacuug

SEQ ID NO: 1058090 - RNA, 23 nt, Human
aggugggaggaucacuugagcuc

SEQ ID NO: 1058091 - RNA, 21 nt, Human
aguggugaacgccuguagucc

SEQ ID NO: 1058092 - RNA, 26 nt, Human
auaacauuccauaccuaaaauuauug

SEQ ID NO: 1058093 - RNA, 24 nt, Human
auaagacugaaaaaaaaccacaua

SEQ ID NO: 1058094 - RNA, 19 nt, Human
auaauugacugccuuccua

SEQ ID NO: 1058095 - RNA, 23 nt, Human
auagagccagaggaaacuuaaaa

SEQ ID NO: 1058096 - RNA, 23 nt, Human
auugcuugggcccaggaguugga

SEQ ID NO: 1058097 - RNA, 25 nt, Human
caaaaaaaaaaaaccaaaaaccaaa

SEQ ID NO: 1058098 - RNA, 20 nt, Human
caaaaaccaaaaaacaaaac

SEQ ID NO: 1058099 - RNA, 25 nt, Human
caaaaaccaaaaaacaaaacuagcc

SEQ ID NO: 1058100 - RNA, 24 nt, Human
caacaaaaaaacuuugcgggcgca

SEQ ID NO: 1058101 - RNA, 26 nt, Human
caacuuaaaaaaaaaacaacaaaaaa

SEQ ID NO: 1058102 - RNA, 23 nt, Human
caagucucaucuagaccuuuagc

SEQ ID NO: 1058103 - RNA, 25 nt, Human
caagugagagugagccaaagcuucc

SEQ ID NO: 1058104 - RNA, 24 nt, Human
caccaagauccccucuucaaguga

SEQ ID NO: 1058105 - RNA, 22 nt, Human
cagaacaccagcuauaagacug

SEQ ID NO: 1058106 - RNA, 24 nt, Human
cagaauggaaggcaaaaaaagaca

SEQ ID NO: 1058107 - RNA, 19 nt, Human
cagucuucccuuuucccua

SEQ ID NO: 1058108 - RNA, 22 nt, Human
ccaaaaaccaaaaaacaaaacu

SEQ ID NO: 1058109 - RNA, 23 nt, Human
ccaaauaacauaucaauacccaa

SEQ ID NO: 1058110 - RNA, 24 nt, Human
ccaaaugaucuaaauuuauacgac

SEQ ID NO: 1058111 - RNA, 18 nt, Human
ccaagucucaucuagacc

SEQ ID NO: 1058112 - RNA, 23 nt, Human
ccagcuauaagacugaaaaaaaa

SEQ ID NO: 1058113 - RNA, 23 nt, Human
cccaaugguaagacuucugauga

SEQ ID NO: 1058114 - RNA, 28 nt, Human
cccgccuguaaaaaacaaccaaccaacc

SEQ ID NO: 1058115 - RNA, 24 nt, Human
cccuaccauuuccuuuuuccacaa

SEQ ID NO: 1058116 - RNA, 19 nt, Human
ccgcuuaaaaaccagccuu

SEQ ID NO: 1058117 - RNA, 21 nt, Human
ccuagcuacuuggcaggcuga

SEQ ID NO: 1058118 - RNA, 19 nt, Human
ccugcaggugacugagcug

SEQ ID NO: 1058119 - RNA, 22 nt, Human
ccuggcuacuugguaggcugag

SEQ ID NO: 1058120 - RNA, 27 nt, Human
ccuguaaaaaacaaccaaccaaccaaa

SEQ ID NO: 1058121 - RNA, 21 nt, Human
ccugugguccuggcuacuugg

SEQ ID NO: 1058122 - RNA, 24 nt, Human
ccuucaacuugagauucuuacuac

SEQ ID NO: 1058123 - RNA, 21 nt, Human
cgaugcuccuugccuuccaag

SEQ ID NO: 1058124 - RNA, 23 nt, Human
cgccuguaguccuagcuacuugg

SEQ ID NO: 1058125 - RNA, 24 nt, Human
cuaaaaggaaaaaaacaaaacaaa

SEQ ID NO: 1058126 - RNA, 24 nt, Human
cuccccaaagcccuucaacuugag

SEQ ID NO: 1058127 - RNA, 18 nt, Human
cuuuccaccacuccacug

SEQ ID NO: 1058128 - RNA, 22 nt, Human
cuuugcgggcguuucccucuca

SEQ ID NO: 1058129 - RNA, 22 nt, Human
gagagaauacuuauguuaagug

SEQ ID NO: 1058130 - RNA, 19 nt, Human
gagaugcucccgcuuaaaa

SEQ ID NO: 1058131 - RNA, 21 nt, Human
gaggugggaggaucacuugag

SEQ ID NO: 1058132 - RNA, 24 nt, Human
gauugcuugggcccaggaguugga

SEQ ID NO: 1058133 - RNA, 20 nt, Human
gcaauaaaaaaacacacaga

SEQ ID NO: 1058134 - RNA, 23 nt, Human
gccccugcaaauggggaugagaa

SEQ ID NO: 1058135 - RNA, 23 nt, Human
gcuacuugguaggcugagguggg

SEQ ID NO: 1058136 - RNA, 19 nt, Human
gcuccccaaagcccuucaa

SEQ ID NO: 1058137 - RNA, 22 nt, Human
gcucugggagaacauccaguuc

SEQ ID NO: 1058138 - RNA, 22 nt, Human
ggaguuggaggucagccugggc

SEQ ID NO: 1058139 - RNA, 24 nt, Human
ggcgcaguggugaacgccuguagu

SEQ ID NO: 1058140 - RNA, 20 nt, Human
gggcgcaguggugaacgccc

SEQ ID NO: 1058141 - RNA, 24 nt, Human
gggcgcaguggugaacgccuguag

SEQ ID NO: 1058142 - RNA, 25 nt, Human
gguccuggcuacuugguaggcugag

SEQ ID NO: 1058143 - RNA, 22 nt, Human
gguuuccugugguguggcuaau

SEQ ID NO: 1058144 - RNA, 18 nt, Human
guaaaaaacaaccaacca

SEQ ID NO: 1058145 - RNA, 18 nt, Human
guaaaggcugguggaaua

SEQ ID NO: 1058146 - RNA, 24 nt, Human
guccuggcuacuugguaggcugag

SEQ ID NO: 1058147 - RNA, 20 nt, Human
guggugaacgccuguagucc

SEQ ID NO: 1058148 - RNA, 21 nt, Human
uaaaaaaacacacagagagua

SEQ ID NO: 1058149 - RNA, 19 nt, Human
uaaaaaacaaccaaccaac

SEQ ID NO: 1058150 - RNA, 21 nt, Human
uaaaaaacaaccaaccaacca

SEQ ID NO: 1058151 - RNA, 24 nt, Human
uaaaaaacaaccaaccaaccaaaa

SEQ ID NO: 1058152 - RNA, 23 nt, Human
uaaacauguuuugauaaaggcca

SEQ ID NO: 1058153 - RNA, 23 nt, Human
uaacagauacaaagaauaggaaa

SEQ ID NO: 1058154 - RNA, 23 nt, Human
uaacauaucaauacccaacugcc

SEQ ID NO: 1058155 - RNA, 24 nt, Human
uaacauaucaauacccaacugccu

SEQ ID NO: 1058156 - RNA, 20 nt, Human
uaacuaagagcacugacaca

SEQ ID NO: 1058157 - RNA, 21 nt, Human
uaacuaagagcacugacacaa

SEQ ID NO: 1058158 - RNA, 19 nt, Human
uaacuuuccaccacuccac

SEQ ID NO: 1058159 - RNA, 19 nt, Human
uaagacugaaaaaaaaccc

SEQ ID NO: 1058160 - RNA, 19 nt, Human
uaauugacugccuuccuaa

SEQ ID NO: 1058161 - RNA, 19 nt, Human
uacaauauauacuuagugg

SEQ ID NO: 1058162 - RNA, 23 nt, Human
uacaguccaaguacuacaacacc

SEQ ID NO: 1058163 - RNA, 21 nt, Human
uaccauuaagaugaaaauaac

SEQ ID NO: 1058164 - RNA, 23 nt, Human
uacuacacaauuccuguuauaga

SEQ ID NO: 1058165 - RNA, 18 nt, Human
uacuguaguaggcauuua

SEQ ID NO: 1058166 - RNA, 22 nt, Human
uacuguaguaggcauuuaacac

SEQ ID NO: 1058167 - RNA, 18 nt, Human
uacuucagaagcagaaag

SEQ ID NO: 1058168 - RNA, 23 nt, Human
uacuugguaggcugaggugggag

SEQ ID NO: 1058169 - RNA, 20 nt, Human
uagaauuaucuauaauguaa

SEQ ID NO: 1058170 - RNA, 25 nt, Human
uagcuagcaauaaaaaaacacacag

SEQ ID NO: 1058171 - RNA, 22 nt, Human
uaggugacugcgcucugggaga

SEQ ID NO: 1058172 - RNA, 20 nt, Human
uaguaucaucucaagucaau

SEQ ID NO: 1058173 - RNA, 20 nt, Human
uaucacaguaccaauuuucc

SEQ ID NO: 1058174 - RNA, 24 nt, Human
uauuuuauaacuucaaccuaaacc

SEQ ID NO: 1058175 - RNA, 20 nt, Human
ucauaacauuccauaccuaa

SEQ ID NO: 1058176 - RNA, 22 nt, Human
ucauuuuacgaauaaagaaaca

SEQ ID NO: 1058177 - RNA, 23 nt, Human
uccacaaaauacaagauacuaca

SEQ ID NO: 1058178 - RNA, 21 nt, Human
uccauaauugacugccuuccu

SEQ ID NO: 1058179 - RNA, 24 nt, Human
ucuagccuggacaauauagugaga

SEQ ID NO: 1058180 - RNA, 19 nt, Human
ucuugcuugaaaggguccu

SEQ ID NO: 1058181 - RNA, 24 nt, Human
ugaaaaaaaaccacauaggcccau

SEQ ID NO: 1058182 - RNA, 28 nt, Human
ugacuaaauccaaaacauaucacaugaa

SEQ ID NO: 1058183 - RNA, 22 nt, Human
ugagaaagggguggguauggga

SEQ ID NO: 1058184 - RNA, 25 nt, Human
ugagaccaaacaggucacauuaaau

SEQ ID NO: 1058185 - RNA, 22 nt, Human
ugaggcaggauugcuugggccc

SEQ ID NO: 1058186 - RNA, 19 nt, Human
ugaggugggaggaucacuu

SEQ ID NO: 1058187 - RNA, 21 nt, Human
ugaggugggaggaucacuuga

SEQ ID NO: 1058188 - RNA, 22 nt, Human
ugaggugggaggaucacuugag

SEQ ID NO: 1058189 - RNA, 23 nt, Human
ugaggugggaggaucacuugagc

SEQ ID NO: 1058190 - RNA, 21 nt, Human
ugccaugaaugagagcaccaa

SEQ ID NO: 1058191 - RNA, 26 nt, Human
ugccaugaaugagagcaccaaauaac

SEQ ID NO: 1058192 - RNA, 18 nt, Human
ugccuaaaguccugcagg

SEQ ID NO: 1058193 - RNA, 22 nt, Human
ugcuggagacuucauugcaugc

SEQ ID NO: 1058194 - RNA, 20 nt, Human
uggaaugccaaaagauguuc

SEQ ID NO: 1058195 - RNA, 21 nt, Human
uggcaggcugaggcaggauug

SEQ ID NO: 1058196 - RNA, 19 nt, Human
uggcuaaaaggaaaaaaac

SEQ ID NO: 1058197 - RNA, 18 nt, Human
ugggauuacaagaacaaa

SEQ ID NO: 1058198 - RNA, 23 nt, Human
ugggcccaggaguuggaggucag

SEQ ID NO: 1058199 - RNA, 20 nt, Human
uggggaugagaaaggggugg

SEQ ID NO: 1058200 - RNA, 24 nt, Human
ugguaggcugaggugggaggauca

SEQ ID NO: 1058201 - RNA, 19 nt, Human
uggugaacgccuguagucc

SEQ ID NO: 1058202 - RNA, 24 nt, Human
ugguggugcacuugccuguggucc

SEQ ID NO: 1058203 - RNA, 20 nt, Human
uguccugaucaccaccuccc

SEQ ID NO: 1058204 - RNA, 19 nt, Human
uuaaccagucuucccuuuu

SEQ ID NO: 1058205 - RNA, 19 nt, Human
uuaaguucaagccuaugcu

SEQ ID NO: 1058206 - RNA, 22 nt, Human
uuacaagaacaaaagauggcua

SEQ ID NO: 1058207 - RNA, 24 nt, Human
uuacaagaacaaaagauggcuaaa

SEQ ID NO: 1058208 - RNA, 18 nt, Human
uuacacagaugugacuua

SEQ ID NO: 1058209 - RNA, 21 nt, Human
uuagaaaauucuucuagccug

SEQ ID NO: 1058210 - RNA, 22 nt, Human
uuccaagucucaucuagaccuu

SEQ ID NO: 1058211 - RNA, 23 nt, Human
uucuacucaucauuaaccagucu

SEQ ID NO: 1058212 - RNA, 24 nt, Human
uugcuugggcccaggaguuggagg

SEQ ID NO: 1058213 - RNA, 19 nt, Human
uuggcaggcugaggcagga

SEQ ID NO: 1058214 - RNA, 25 nt, Human
uugguaggcugaggugggaggauca

SEQ ID NO: 1058215 - RNA, 22 nt, Human
uuuauaacuucaaccuaaaccu

SEQ ID NO: 1058216 - RNA, 24 nt, Human
uuuuccacaaaauacaagauacua

SEQ ID NO: 1058217 - RNA, 21 nt, Human
aagcuggguccggcgccuggc

SEQ ID NO: 1058218 - RNA, 25 nt, Human
auguguuuucuucccuccaagauuu

SEQ ID NO: 1058219 - RNA, 22 nt, Human
cagcagcucugaagcugggucc

SEQ ID NO: 1058220 - RNA, 19 nt, Human
ccccuucccggaggcaggg

SEQ ID NO: 1058221 - RNA, 21 nt, Human
ccccuucccggaggcagggug

SEQ ID NO: 1058222 - RNA, 21 nt, Human
ccgcccugcacccuacccacc

SEQ ID NO: 1058223 - RNA, 18 nt, Human
ccgccuccgcacgcggcc

SEQ ID NO: 1058224 - RNA, 18 nt, Human
cgcccugcacccuaccca

SEQ ID NO: 1058225 - RNA, 24 nt, Human
cggcguccgccuccgcacgcggcc

SEQ ID NO: 1058226 - RNA, 18 nt, Human
cggcugcgccggccgccc

SEQ ID NO: 1058227 - RNA, 21 nt, Human
cugaagcuggguccggcgccu

SEQ ID NO: 1058228 - RNA, 19 nt, Human
gccccuucccggaggcagg

SEQ ID NO: 1058229 - RNA, 26 nt, Human
ggcacuggcugggcgcggcguccgcc

SEQ ID NO: 1058230 - RNA, 18 nt, Human
uguguuuucuucccucca

SEQ ID NO: 1058231 - RNA, 22 nt, Human
acccagaguccucagagaggcc

SEQ ID NO: 1058232 - RNA, 20 nt, Human
agaaauugcaccucccacuu

SEQ ID NO: 1058233 - RNA, 24 nt, Human
agaauuuccccagcccagccuaau

SEQ ID NO: 1058234 - RNA, 20 nt, Human
agagaggccagauggcagcu

SEQ ID NO: 1058235 - RNA, 18 nt, Human
caaggacagccaccagga

SEQ ID NO: 1058236 - RNA, 19 nt, Human
cagaguccucagagaggcc

SEQ ID NO: 1058237 - RNA, 21 nt, Human
cagccaccaggaaaucuccag

SEQ ID NO: 1058238 - RNA, 22 nt, Human
cagccaccaggaaaucuccagc

SEQ ID NO: 1058239 - RNA, 21 nt, Human
ccagaguccucagagaggcca

SEQ ID NO: 1058240 - RNA, 25 nt, Human
cccacuuccccuuuccccccuugaa

SEQ ID NO: 1058241 - RNA, 23 nt, Human
ccccagcccagccuaauuuuuac

SEQ ID NO: 1058242 - RNA, 23 nt, Human
ccccuuuccccccuugaaugauc

SEQ ID NO: 1058243 - RNA, 25 nt, Human
cucaccucuguggaaacucccaaaa

SEQ ID NO: 1058244 - RNA, 25 nt, Human
cuccagcugggccugcuuucucuuc

SEQ ID NO: 1058245 - RNA, 24 nt, Human
cucucaccucuguggaaacuccca

SEQ ID NO: 1058246 - RNA, 23 nt, Human
cugcuuucucuucccugcuuccu

SEQ ID NO: 1058247 - RNA, 21 nt, Human
cuguggaaacucccaaagucu

SEQ ID NO: 1058248 - RNA, 19 nt, Human
gagaagggggaggguggug

SEQ ID NO: 1058249 - RNA, 18 nt, Human
gagccaccaaugccuucc

SEQ ID NO: 1058250 - RNA, 24 nt, Human
gcugggccugcuuucucuucccug

SEQ ID NO: 1058251 - RNA, 24 nt, Human
gggccaaggacagccaccaggaaa

SEQ ID NO: 1058252 - RNA, 18 nt, Human
guggaaacucccaaaguc

SEQ ID NO: 1058253 - RNA, 23 nt, Human
guuaaaauugagccaccaaugcc

SEQ ID NO: 1058254 - RNA, 21 nt, Human
uaccaaucugagaaauugcac

SEQ ID NO: 1058255 - RNA, 19 nt, Human
ucagagaggccagauggca

SEQ ID NO: 1058256 - RNA, 20 nt, Human
ucagagaggccagauggcag

SEQ ID NO: 1058257 - RNA, 18 nt, Human
ucccacuuccccuuuccc

SEQ ID NO: 1058258 - RNA, 19 nt, Human
uccccagcccagccuaauu

SEQ ID NO: 1058259 - RNA, 26 nt, Human
uccccuuuccccccuugaaugaucuc

SEQ ID NO: 1058260 - RNA, 21 nt, Human
ucccugagcugagcauugugu

SEQ ID NO: 1058261 - RNA, 21 nt, Human
uccggaggagaauuuccccag

SEQ ID NO: 1058262 - RNA, 20 nt, Human
uccuacagagaagggggagg

SEQ ID NO: 1058263 - RNA, 22 nt, Human
ucugagaaauugcaccucccac

SEQ ID NO: 1058264 - RNA, 18 nt, Human
ucugucaggcugccugga

SEQ ID NO: 1058265 - RNA, 21 nt, Human
ucuguggaaacucccaaaguc

SEQ ID NO: 1058266 - RNA, 22 nt, Human
ugcuccuugugggcucacccug

SEQ ID NO: 1058267 - RNA, 21 nt, Human
uggggccaaggacagccacca

SEQ ID NO: 1058268 - RNA, 22 nt, Human
ugggguuaaaauugagccacca

SEQ ID NO: 1058269 - RNA, 22 nt, Human
ugguggaugaaaaagugaaauu

SEQ ID NO: 1058270 - RNA, 23 nt, Human
uuacaacauagaacaccacgguu

SEQ ID NO: 1058271 - RNA, 20 nt, Human
uucccacccgacucucaccu

SEQ ID NO: 1058272 - RNA, 21 nt, Human
aaacaaaaaccgaucagaaaa

SEQ ID NO: 1058273 - RNA, 22 nt, Human
aagagggaccauaggcgcggug

SEQ ID NO: 1058274 - RNA, 22 nt, Human
aagcagaggugaccaaacgcca

SEQ ID NO: 1058275 - RNA, 20 nt, Human
aagcaggaaacaaaaaccga

SEQ ID NO: 1058276 - RNA, 23 nt, Human
aagcaggaaacaaaaaccgauca

SEQ ID NO: 1058277 - RNA, 26 nt, Human
aagcaggaaacaaaaaccgaucagaa

SEQ ID NO: 1058278 - RNA, 19 nt, Human
acaaaaaccgaucagaaaa

SEQ ID NO: 1058279 - RNA, 24 nt, Human
acaaaaaccgaucagaaaacaccg

SEQ ID NO: 1058280 - RNA, 19 nt, Human
acaaaguaauaaauuuggc

SEQ ID NO: 1058281 - RNA, 18 nt, Human
acgcuggcuccaagaggg

SEQ ID NO: 1058282 - RNA, 21 nt, Human
agaaaacaccguuuuauagua

SEQ ID NO: 1058283 - RNA, 27 nt, Human
agauauaauaaaaggauaccgguaccc

SEQ ID NO: 1058284 - RNA, 19 nt, Human
agguggcagaagcuacagc

SEQ ID NO: 1058285 - RNA, 21 nt, Human
agguggcagaagcuacagcag

SEQ ID NO: 1058286 - RNA, 22 nt, Human
augaagcagaggugaccaaacg

SEQ ID NO: 1058287 - RNA, 22 nt, Human
caaaaauaauuagcauuaacug

SEQ ID NO: 1058288 - RNA, 19 nt, Human
caggaaacaaaaaccgauc

SEQ ID NO: 1058289 - RNA, 22 nt, Human
cccgccacgcuggcuccaagag

SEQ ID NO: 1058290 - RNA, 24 nt, Human
cgcuggcuccaagagggaccauag

SEQ ID NO: 1058291 - RNA, 25 nt, Human
cuacagcaguggcagcugcccggag

SEQ ID NO: 1058292 - RNA, 18 nt, Human
gaaacaaaaaccgaucag

SEQ ID NO: 1058293 - RNA, 24 nt, Human
gcaggaaacaaaaaccgaucagaa

SEQ ID NO: 1058294 - RNA, 18 nt, Human
gcuggcuccaagagggac

SEQ ID NO: 1058295 - RNA, 19 nt, Human
ggagccgccaggcccgcca

SEQ ID NO: 1058296 - RNA, 21 nt, Human
gggagaggcccggucguggca

SEQ ID NO: 1058297 - RNA, 21 nt, Human
guaauaaauuuggcuucuuuu

SEQ ID NO: 1058298 - RNA, 22 nt, Human
uaaaauauauguaacuuaaaua

SEQ ID NO: 1058299 - RNA, 18 nt, Human
uaacagaguacuucuaua

SEQ ID NO: 1058300 - RNA, 21 nt, Human
uaagcaggaaacaaaaaccga

SEQ ID NO: 1058301 - RNA, 21 nt, Human
uagaaagauaaaguucuuuca

SEQ ID NO: 1058302 - RNA, 22 nt, Human
uagcucuuuaacauaugacauc

SEQ ID NO: 1058303 - RNA, 24 nt, Human
uauuuuaaaaaccccaacacaaag

SEQ ID NO: 1058304 - RNA, 21 nt, Human
ucagaaaacaccguuuuauag

SEQ ID NO: 1058305 - RNA, 22 nt, Human
ucauuguagaaagauaaaguuu

SEQ ID NO: 1058306 - RNA, 22 nt, Human
uccccaacaucucugagcccau

SEQ ID NO: 1058307 - RNA, 19 nt, Human
ucucagcggccacugcugc

SEQ ID NO: 1058308 - RNA, 25 nt, Human
ugacaucagcaaaaauaauuagcau

SEQ ID NO: 1058309 - RNA, 23 nt, Human
ugcuaaggacgccuucgguugcu

SEQ ID NO: 1058310 - RNA, 20 nt, Human
uggcagaagcuacagcagug

SEQ ID NO: 1058311 - RNA, 21 nt, Human
uguaacuuaaauaccccccca

SEQ ID NO: 1058312 - RNA, 19 nt, Human
uuaaaaaccccaacacaaa

SEQ ID NO: 1058313 - RNA, 18 nt, Human
aagccgcccuggaagcug

SEQ ID NO: 1058314 - RNA, 24 nt, Human
cagagauccgggaaccagagcccc

SEQ ID NO: 1058315 - RNA, 25 nt, Human
caggcccccggacuccaagccgccc

SEQ ID NO: 1058316 - RNA, 22 nt, Human
cauagacucuggcugugcugcu

SEQ ID NO: 1058317 - RNA, 18 nt, Human
ccccgcggccaggccccc

SEQ ID NO: 1058318 - RNA, 20 nt, Human
ccccggacuccaagccgccc

SEQ ID NO: 1058319 - RNA, 21 nt, Human
ccccggacuccaagccgcccu

SEQ ID NO: 1058320 - RNA, 24 nt, Human
ccccggacuccaagccgcccugga

SEQ ID NO: 1058321 - RNA, 20 nt, Human
cccgcggccaggcccccgga

SEQ ID NO: 1058322 - RNA, 23 nt, Human
ccggcgccugcauagacucuggc

SEQ ID NO: 1058323 - RNA, 22 nt, Human
cgccuggacagagcccagggac

SEQ ID NO: 1058324 - RNA, 22 nt, Human
cgcggccaggcccccggacucc

SEQ ID NO: 1058325 - RNA, 19 nt, Human
cuccaagccgcccuggaag

SEQ ID NO: 1058326 - RNA, 21 nt, Human
gacacagagauccgggaacca

SEQ ID NO: 1058327 - RNA, 23 nt, Human
gccgcccuggaagcugguggagc

SEQ ID NO: 1058328 - RNA, 18 nt, Human
ggacagagcccagggacc

SEQ ID NO: 1058329 - RNA, 18 nt, Human
guagcuggucgccuggac

SEQ ID NO: 1058330 - RNA, 22 nt, Human
ugaccagccgggcgccguagcu

SEQ ID NO: 1058331 - RNA, 20 nt, Human
uggagcgggacacagagauc

SEQ ID NO: 1058332 - RNA, 19 nt, Human
gaggcgcuggaugcgcucg

SEQ ID NO: 1058333 - RNA, 18 nt, Human
gcagcaauucaugcacuu

SEQ ID NO: 1058334 - RNA, 22 nt, Human
gcucgggguccggggcgggcgc

SEQ ID NO: 1058335 - RNA, 18 nt, Human
uucaugcacuuuauuucu

SEQ ID NO: 1058336 - RNA, 21 nt, Human
aacccuugguaagaccagagg

SEQ ID NO: 1058337 - RNA, 19 nt, Human
aaccugacaguuucaaacu

SEQ ID NO: 1058338 - RNA, 21 nt, Human
aguuaaaaccaaaagacuucu

SEQ ID NO: 1058339 - RNA, 20 nt, Human
caaaagacuucuaacccuug

SEQ ID NO: 1058340 - RNA, 22 nt, Human
caaagcaugguagagcuugaaa

SEQ ID NO: 1058341 - RNA, 24 nt, Human
caauauggaaaaguuaaaaccaaa

SEQ ID NO: 1058342 - RNA, 23 nt, Human
cacaaccgcuaccuagacggcaa

SEQ ID NO: 1058343 - RNA, 21 nt, Human
cagccucagcaagcacaaccg

SEQ ID NO: 1058344 - RNA, 20 nt, Human
ccccacuauggacauauuca

SEQ ID NO: 1058345 - RNA, 24 nt, Human
cgaccaaaucccgacuccucgcuc

SEQ ID NO: 1058346 - RNA, 22 nt, Human
cgcgaccaaaucccgacuccuc

SEQ ID NO: 1058347 - RNA, 18 nt, Human
cuuguaauuuugaacaga

SEQ ID NO: 1058348 - RNA, 19 nt, Human
gaggaauuaaggaccgccc

SEQ ID NO: 1058349 - RNA, 26 nt, Human
gagggauuaaaagaccccacuaugga

SEQ ID NO: 1058350 - RNA, 20 nt, Human
uaaaagaccccacuauggac

SEQ ID NO: 1058351 - RNA, 19 nt, Human
ucgcagcugcagugucagc

SEQ ID NO: 1058352 - RNA, 22 nt, Human
ucgcucugcgccucuuagccgc

SEQ ID NO: 1058353 - RNA, 20 nt, Human
ucuacauauaguuacaaagc

SEQ ID NO: 1058354 - RNA, 19 nt, Human
ugaacagaugaacaugaug

SEQ ID NO: 1058355 - RNA, 24 nt, Human
uuaaaaccaaaagacuucuaaccc

SEQ ID NO: 1058356 - RNA, 25 nt, Human
aaacaaguccaaaacaacuuuacca

SEQ ID NO: 1058357 - RNA, 19 nt, Human
aggcauccgcauuuuucuu

SEQ ID NO: 1058358 - RNA, 21 nt, Human
auaaaacuucaugcugagcaa

SEQ ID NO: 1058359 - RNA, 18 nt, Human
caaaacaacuuuaccaua

SEQ ID NO: 1058360 - RNA, 22 nt, Human
caaguccaaaacaacuuuacca

SEQ ID NO: 1058361 - RNA, 22 nt, Human
caugaucuauacucuaauguuc

SEQ ID NO: 1058362 - RNA, 24 nt, Human
cccaaaggcacccuucauuucaca

SEQ ID NO: 1058363 - RNA, 23 nt, Human
gagcaaaaacaaguccaaaacaa

SEQ ID NO: 1058364 - RNA, 18 nt, Human
gcggagccgagcgcacgc

SEQ ID NO: 1058365 - RNA, 23 nt, Human
uauauccauagaauaguucccac

SEQ ID NO: 1058366 - RNA, 23 nt, Human
uaucaaaagaaaaaguuaauuuu

SEQ ID NO: 1058367 - RNA, 20 nt, Human
uauggaauuaguaaaaugca

SEQ ID NO: 1058368 - RNA, 25 nt, Human
uccacagaaugcaggaaaaaaagca

SEQ ID NO: 1058369 - RNA, 20 nt, Human
ugagcaaaaacaaguccaaa

SEQ ID NO: 1058370 - RNA, 22 nt, Human
ugagcaaaaacaaguccaaaac

SEQ ID NO: 1058371 - RNA, 21 nt, Human
uguaggcauccgcauuuuucu

SEQ ID NO: 1058372 - RNA, 20 nt, Human
uuccccaaaggcacccuuca

SEQ ID NO: 1058373 - RNA, 21 nt, Human
uuuuuuuuuuuuuuuuuauuu

SEQ ID NO: 1058374 - RNA, 18 nt, Human
acaaggaaaacauggaac

SEQ ID NO: 1058375 - RNA, 21 nt, Human
aggcaugggagggaacaagga

SEQ ID NO: 1058376 - RNA, 25 nt, Human
cgagcaaaugggguggaaggguguu

SEQ ID NO: 1058377 - RNA, 19 nt, Human
gaacaaggaaaacauggaa

SEQ ID NO: 1058378 - RNA, 22 nt, Human
gagggaacaaggaaaacaugga

SEQ ID NO: 1058379 - RNA, 19 nt, Human
gggaacaaggaaaacaugg

SEQ ID NO: 1058380 - RNA, 21 nt, Human
ggugguuaagauaaaacacaa

SEQ ID NO: 1058381 - RNA, 22 nt, Human
uaacucugcaauccagcuaggc

SEQ ID NO: 1058382 - RNA, 19 nt, Human
uaagauaaaacacaaguca

SEQ ID NO: 1058383 - RNA, 19 nt, Human
ugggagggaacaaggaaaa

SEQ ID NO: 1058384 - RNA, 19 nt, Human
aaacaggaaaacaaauuug

SEQ ID NO: 1058385 - RNA, 18 nt, Human
aaaugccaaagcauacaa

SEQ ID NO: 1058386 - RNA, 18 nt, Human
aagcaggaaaaaaaccaa

SEQ ID NO: 1058387 - RNA, 18 nt, Human
aagcaggaaaaaaaccaa

SEQ ID NO: 1058388 - RNA, 24 nt, Human
aagcaggaaaaaaaccaaacagga

SEQ ID NO: 1058389 - RNA, 22 nt, Human
aagcaucuauuuagaacagccc

SEQ ID NO: 1058390 - RNA, 21 nt, Human
aaucuuccuucuaaaccuggc

SEQ ID NO: 1058391 - RNA, 22 nt, Human
acaagcugcuuaaaccuaaaac

SEQ ID NO: 1058392 - RNA, 19 nt, Human
acaaucuuccuucuaaacc

SEQ ID NO: 1058393 - RNA, 23 nt, Human
acagccccaaaguaguaaugaaa

SEQ ID NO: 1058394 - RNA, 18 nt, Human
acucuaaaggaaaaggaa

SEQ ID NO: 1058395 - RNA, 19 nt, Human
agcaaaagcaggaaaaaaa

SEQ ID NO: 1058396 - RNA, 20 nt, Human
agcaaaagcaggaaaaaaac

SEQ ID NO: 1058397 - RNA, 21 nt, Human
agccgcucguagcccggcccc

SEQ ID NO: 1058398 - RNA, 23 nt, Human
aggaaaaaaaccaaacaggaaaa

SEQ ID NO: 1058399 - RNA, 23 nt, Human
aucacugcucaaaggcaaacacu

SEQ ID NO: 1058400 - RNA, 20 nt, Human
caaaauaaaaccaagaagcu

SEQ ID NO: 1058401 - RNA, 21 nt, Human
caaauacaaugccgcugcuca

SEQ ID NO: 1058402 - RNA, 23 nt, Human
cacugaagaauuauuucagguau

SEQ ID NO: 1058403 - RNA, 22 nt, Human
cagccccaaaguaguaaugaaa

SEQ ID NO: 1058404 - RNA, 23 nt, Human
caggaaaaaaaccaaacaggaaa

SEQ ID NO: 1058405 - RNA, 18 nt, Human
ccagcccgccgccucugg

SEQ ID NO: 1058406 - RNA, 20 nt, Human
ccccagcccgccgccucugc

SEQ ID NO: 1058407 - RNA, 18 nt, Human
ccgccgcgcacgguccug

SEQ ID NO: 1058408 - RNA, 21 nt, Human
ccgccgcgcacgguccugccc

SEQ ID NO: 1058409 - RNA, 18 nt, Human
ccgcucccuccccagccc

SEQ ID NO: 1058410 - RNA, 18 nt, Human
ccgcucccuccccagccc

SEQ ID NO: 1058411 - RNA, 23 nt, Human
ccucgugcuggcgccgcucccuc

SEQ ID NO: 1058412 - RNA, 22 nt, Human
ccuggcccucuuuuccugccuc

SEQ ID NO: 1058413 - RNA, 26 nt, Human
cgaggcaggcgcuggcuccccaaggg

SEQ ID NO: 1058414 - RNA, 21 nt, Human
cgagggcggcggcgaggcagg

SEQ ID NO: 1058415 - RNA, 21 nt, Human
cgccgcggccgccgcgcacgg

SEQ ID NO: 1058416 - RNA, 19 nt, Human
cguagcccggccccucggc

SEQ ID NO: 1058417 - RNA, 21 nt, Human
cucaaaggcaaacacugaaga

SEQ ID NO: 1058418 - RNA, 24 nt, Human
cucccagcacccgccgcggccgcc

SEQ ID NO: 1058419 - RNA, 24 nt, Human
gagcaaaagcaggaaaaaaaccaa

SEQ ID NO: 1058420 - RNA, 22 nt, Human
gcaggaaaaaaaccaaacagga

SEQ ID NO: 1058421 - RNA, 18 nt, Human
gcggcggcgaggcaggcg

SEQ ID NO: 1058422 - RNA, 19 nt, Human
ggccaagacggaguggcag

SEQ ID NO: 1058423 - RNA, 20 nt, Human
ggcggcggcgaggcaggcgc

SEQ ID NO: 1058424 - RNA, 22 nt, Human
gggcggcggcgaggcaggcgcu

SEQ ID NO: 1058425 - RNA, 19 nt, Human
uaaagcaucuauuuagaac

SEQ ID NO: 1058426 - RNA, 23 nt, Human
uaaaucaauuaaugccauguaga

SEQ ID NO: 1058427 - RNA, 23 nt, Human
uaccucaaguaauccugauucau

SEQ ID NO: 1058428 - RNA, 26 nt, Human
uagguguuacacuugaaccccugaag

SEQ ID NO: 1058429 - RNA, 23 nt, Human
uaguuugcuuuuuugcuccauca

SEQ ID NO: 1058430 - RNA, 19 nt, Human
uauaugcucuuaggcaauu

SEQ ID NO: 1058431 - RNA, 18 nt, Human
ucuaaaggaaaaggaaaa

SEQ ID NO: 1058432 - RNA, 18 nt, Human
ugaccauaacucuaaagg

SEQ ID NO: 1058433 - RNA, 18 nt, Human
ugcccugagugcaucugu

SEQ ID NO: 1058434 - RNA, 19 nt, Human
ugccgcugcucaugcccug

SEQ ID NO: 1058435 - RNA, 18 nt, Human
uggcucccagcacccgcc

SEQ ID NO: 1058436 - RNA, 22 nt, Human
ugggaaccucgugcuggcgccg

SEQ ID NO: 1058437 - RNA, 20 nt, Human
uguagaucaauaaauuacaa

SEQ ID NO: 1058438 - RNA, 24 nt, Human
uguauaucaaaauaaaaccaagaa

SEQ ID NO: 1058439 - RNA, 21 nt, Human
uguuacaaaaacucacacagc

SEQ ID NO: 1058440 - RNA, 21 nt, Human
uguuacacuugaaccuaugua

SEQ ID NO: 1058441 - RNA, 22 nt, Human
uucacaaacuaauagguauaau

SEQ ID NO: 1058442 - RNA, 22 nt, Human
uuuagaacagccccaaaguagu

SEQ ID NO: 1058443 - RNA, 20 nt, Human
uuuaucacauaaagcaucua

SEQ ID NO: 1058444 - RNA, 22 nt, Human
uuuuugcuccaucaguuaaaaa

SEQ ID NO: 1058445 - RNA, 23 nt, Human
cauucuuccucuucccacauugu

SEQ ID NO: 1058446 - RNA, 18 nt, Human
uguacugucacuuuacag

SEQ ID NO: 1058447 - RNA, 18 nt, Human
uuguacugucacuuuaca

SEQ ID NO: 1058448 - RNA, 19 nt, Human
uuugugacacucauucuuc

SEQ ID NO: 1058449 - RNA, 20 nt, Human
aaaacaaacaagucagagac

SEQ ID NO: 1058450 - RNA, 23 nt, Human
aaaaguaugcauuuuuucuaaau

SEQ ID NO: 1058451 - RNA, 21 nt, Human
aaaauacuuucaccacaauua

SEQ ID NO: 1058452 - RNA, 20 nt, Human
aaacaaacaagucagagaca

SEQ ID NO: 1058453 - RNA, 21 nt, Human
aagaagucagcacuugccugg

SEQ ID NO: 1058454 - RNA, 31 nt, Human
aaugcaguuaaacacacacacacacacacag

SEQ ID NO: 1058455 - RNA, 18 nt, Human
acaaacaagucagagaca

SEQ ID NO: 1058456 - RNA, 18 nt, Human
acacacaaaaccaagcaa

SEQ ID NO: 1058457 - RNA, 20 nt, Human
acacacacacacacacaaaa

SEQ ID NO: 1058458 - RNA, 23 nt, Human
acacacacacacacacacacaca

SEQ ID NO: 1058459 - RNA, 23 nt, Human
acacacacacacacacacacaca

SEQ ID NO: 1058460 - RNA, 23 nt, Human
acacacacacacacacacacaca

SEQ ID NO: 1058461 - RNA, 23 nt, Human
acacacacacacacacacacaca

SEQ ID NO: 1058462 - RNA, 23 nt, Human
acacacacacacacacacacaca

SEQ ID NO: 1058463 - RNA, 23 nt, Human
acacacacacacacacacacaca

SEQ ID NO: 1058464 - RNA, 23 nt, Human
acacacacacacacacacacaca

SEQ ID NO: 1058465 - RNA, 28 nt, Human
acacacacacacacacacacacaaaacc

SEQ ID NO: 1058466 - RNA, 19 nt, Human
acccuuuccaguguugugu

SEQ ID NO: 1058467 - RNA, 18 nt, Human
acugaagaaaugcaacug

SEQ ID NO: 1058468 - RNA, 18 nt, Human
agaggcacacagugcgcc

SEQ ID NO: 1058469 - RNA, 22 nt, Human
agaggcacacagugcgcccaga

SEQ ID NO: 1058470 - RNA, 24 nt, Human
agcagccccuccagggccuggagc

SEQ ID NO: 1058471 - RNA, 20 nt, Human
aggagcagcagccccuccag

SEQ ID NO: 1058472 - RNA, 20 nt, Human
auaaaaauacuuucaccaca

SEQ ID NO: 1058473 - RNA, 21 nt, Human
caaaaccaagcaauuauaagu

SEQ ID NO: 1058474 - RNA, 20 nt, Human
cacacacacacacacacaca

SEQ ID NO: 1058475 - RNA, 20 nt, Human
cacacacacacacacacaca

SEQ ID NO: 1058476 - RNA, 20 nt, Human
cacacacacacacacacaca

SEQ ID NO: 1058477 - RNA, 20 nt, Human
cacacacacacacacacaca

SEQ ID NO: 1058478 - RNA, 20 nt, Human
cacacacacacacacacaca

SEQ ID NO: 1058479 - RNA, 20 nt, Human
cacacacacacacacacaca

SEQ ID NO: 1058480 - RNA, 20 nt, Human
cacacacacacacacacaca

SEQ ID NO: 1058481 - RNA, 20 nt, Human
cacacacacacacacacaca

SEQ ID NO: 1058482 - RNA, 20 nt, Human
cacacacacacacacacaca

SEQ ID NO: 1058483 - RNA, 20 nt, Human
cacacacacacacacacaca

SEQ ID NO: 1058484 - RNA, 27 nt, Human
cacacacacacacacacacaaaaccaa

SEQ ID NO: 1058485 - RNA, 22 nt, Human
cacacacacacacacacacaca

SEQ ID NO: 1058486 - RNA, 22 nt, Human
cacacacacacacacacacaca

SEQ ID NO: 1058487 - RNA, 22 nt, Human
cacacacacacacacacacaca

SEQ ID NO: 1058488 - RNA, 22 nt, Human
cacacacacacacacacacaca

SEQ ID NO: 1058489 - RNA, 22 nt, Human
cacacacacacacacacacaca

SEQ ID NO: 1058490 - RNA, 22 nt, Human
cacacacacacacacacacaca

SEQ ID NO: 1058491 - RNA, 26 nt, Human
cacacacacacacacacacacacaca

SEQ ID NO: 1058492 - RNA, 22 nt, Human
cacacuccaggucccugggucu

SEQ ID NO: 1058493 - RNA, 23 nt, Human
caccacaauuacauuccagccug

SEQ ID NO: 1058494 - RNA, 21 nt, Human
cagaaccaacaaauacagaug

SEQ ID NO: 1058495 - RNA, 30 nt, Human
cagauuaaaaacaauauauaaacauaugaa

SEQ ID NO: 1058496 - RNA, 18 nt, Human
cagcccccagugcccugg

SEQ ID NO: 1058497 - RNA, 21 nt, Human
ccaccaaauggcaccuauccc

SEQ ID NO: 1058498 - RNA, 24 nt, Human
ccaccaaauggcaccuauccccuu

SEQ ID NO: 1058499 - RNA, 24 nt, Human
ccccaucuuaaaaugggaaucagc

SEQ ID NO: 1058500 - RNA, 23 nt, Human
cccccagugcccuggaagaacau

SEQ ID NO: 1058501 - RNA, 18 nt, Human
ccccuucugggcagaggc

SEQ ID NO: 1058502 - RNA, 24 nt, Human
ccccuucugggcagaggcacacag

SEQ ID NO: 1058503 - RNA, 19 nt, Human
ccuggagaagguguucuca

SEQ ID NO: 1058504 - RNA, 22 nt, Human
ccuugcuagaauauaagcucca

SEQ ID NO: 1058505 - RNA, 22 nt, Human
cgcucaaaugacagaaccaaca

SEQ ID NO: 1058506 - RNA, 23 nt, Human
cggcgaggcccccuucugggcag

SEQ ID NO: 1058507 - RNA, 23 nt, Human
cugaagaaaugcaacugaggagc

SEQ ID NO: 1058508 - RNA, 21 nt, Human
cugugcaaagcugcccuguag

SEQ ID NO: 1058509 - RNA, 23 nt, Human
gaacaucguagcugcaaaaaaug

SEQ ID NO: 1058510 - RNA, 23 nt, Human
gaaucagcuucuggaaaagcuaa

SEQ ID NO: 1058511 - RNA, 19 nt, Human
gagcagcagccccuccagg

SEQ ID NO: 1058512 - RNA, 18 nt, Human
gcaaagucuuuucuaagg

SEQ ID NO: 1058513 - RNA, 19 nt, Human
gcacacagugcgcccagag

SEQ ID NO: 1058514 - RNA, 21 nt, Human
gcagcagccccuccagggccu

SEQ ID NO: 1058515 - RNA, 33 nt, Human
gcaguuaaacacacacacacacacacacacagu

SEQ ID NO: 1058516 - RNA, 21 nt, Human
gcccuguagucauggagguga

SEQ ID NO: 1058517 - RNA, 19 nt, Human
gcuuuauaaaagcaaaguc

SEQ ID NO: 1058518 - RNA, 18 nt, Human
gggacuuccugcugugga

SEQ ID NO: 1058519 - RNA, 26 nt, Human
guuaaacacacacacacacacacaca

SEQ ID NO: 1058520 - RNA, 31 nt, Human; identical to SEQ ID NO: 995755

SEQ ID NO: 1058521 - RNA, 24 nt, Human
guuaaacacacacacacacacagg

SEQ ID NO: 1058522 - RNA, 24 nt, Human
uaaaaucaugcauauucuccauaa

SEQ ID NO: 1058523 - RNA, 22 nt, Human
uaacagagcaaaugaugagaga

SEQ ID NO: 1058524 - RNA, 23 nt, Human
uacccuguguuccuuuugcuuuu

SEQ ID NO: 1058525 - RNA, 25 nt, Human
uacccuguguuccuuuugcuuuuug

SEQ ID NO: 1058526 - RNA, 22 nt, Human
uagaauauaagcuccaugaggg

SEQ ID NO: 1058527 - RNA, 23 nt, Human
uauaagcuccaugagggugggau

SEQ ID NO: 1058528 - RNA, 18 nt, Human
uauauacacaacuuauau

SEQ ID NO: 1058529 - RNA, 19 nt, Human
uaucauauccaucuccccu

SEQ ID NO: 1058530 - RNA, 22 nt, Human
ucaaaacaaacaagucagagac

SEQ ID NO: 1058531 - RNA, 18 nt, Human
ucaaaugacagaaccaac

SEQ ID NO: 1058532 - RNA, 21 nt, Human
ucaaaugacagaaccaacaaa

SEQ ID NO: 1058533 - RNA, 24 nt, Human
ucaaggaaaugaaucuacugaaga

SEQ ID NO: 1058534 - RNA, 22 nt, Human
ucagacuucuaaaaagugcuaa

SEQ ID NO: 1058535 - RNA, 21 nt, Human
ucagcaauauaaaaauacuuu

SEQ ID NO: 1058536 - RNA, 18 nt, Human
ucagcuucuggaaaagcu

SEQ ID NO: 1058537 - RNA, 20 nt, Human
uccaucuccccuugcuagaa

SEQ ID NO: 1058538 - RNA, 21 nt, Human
ucccccaucuuaaaaugggaa

SEQ ID NO: 1058539 - RNA, 22 nt, Human
ucccccaucuuaaaaugggaau

SEQ ID NO: 1058540 - RNA, 20 nt, Human
ucccugggucuggccacaca

SEQ ID NO: 1058541 - RNA, 24 nt, Human
ucuaaaaccucaaaccuuaauuuu

SEQ ID NO: 1058542 - RNA, 24 nt, Human
ugcauauucuccauaaaacuuuuc

SEQ ID NO: 1058543 - RNA, 19 nt, Human
ugcccuguagucauggagg

SEQ ID NO: 1058544 - RNA, 21 nt, Human
uggaagaacaucguagcugca

SEQ ID NO: 1058545 - RNA, 23 nt, Human
uggaggugaacuggggacuuccu

SEQ ID NO: 1058546 - RNA, 19 nt, Human
ugggcagaggcacacagug

SEQ ID NO: 1058547 - RNA, 24 nt, Human
uuuagagagaagucacagccccca

SEQ ID NO: 1058548 - RNA, 25 nt, Human
aacaaccucuccacucuuccugcag

SEQ ID NO: 1058549 - RNA, 19 nt, Human
agccgaacugccggcgccc

SEQ ID NO: 1058550 - RNA, 21 nt, Human
caccagcagccgaacugccgg

SEQ ID NO: 1058551 - RNA, 22 nt, Human
caccagcagccgaacugccggc

SEQ ID NO: 1058552 - RNA, 22 nt, Human
cagcagccgaacugccggcgcc

SEQ ID NO: 1058553 - RNA, 21 nt, Human
ccgccgggaacaaccucucca

SEQ ID NO: 1058554 - RNA, 18 nt, Human
cgccagggccgcuccggg

SEQ ID NO: 1058555 - RNA, 23 nt, Human
cgggaacaaccucuccacucuuc

SEQ ID NO: 1058556 - RNA, 21 nt, Human
cuccccgccgggaacaaccuc

SEQ ID NO: 1058557 - RNA, 24 nt, Human
uccggccgggaugcggccgguacc

SEQ ID NO: 1058558 - RNA, 24 nt, Human
ugcggccgguacccgcuccccgcc

SEQ ID NO: 1058559 - RNA, 24 nt, Human
aaaauaauuaugauacauuuguac

SEQ ID NO: 1058560 - RNA, 19 nt, Human
aaaccccacaagcuuugga

SEQ ID NO: 1058561 - RNA, 24 nt, Human
acgccgcagagcugggcggaaggc

SEQ ID NO: 1058562 - RNA, 25 nt, Human
acgccgcagagcugggcggaaggcc

SEQ ID NO: 1058563 - RNA, 20 nt, Human
acuaaauuuaaaccccacaa

SEQ ID NO: 1058564 - RNA, 18 nt, Human
agcccucgcggccugcug

SEQ ID NO: 1058565 - RNA, 18 nt, Human
caaucuugaccaguucca

SEQ ID NO: 1058566 - RNA, 19 nt, Human
ccaguagguccgagacccg

SEQ ID NO: 1058567 - RNA, 24 nt, Human
ccgagacccgagcuuuauauagcc

SEQ ID NO: 1058568 - RNA, 19 nt, Human
ccucuccgccccucucccu

SEQ ID NO: 1058569 - RNA, 19 nt, Human
cugcugcacauugagaggu

SEQ ID NO: 1058570 - RNA, 21 nt, Human
ucgcugccucuccgccccucu

SEQ ID NO: 1058571 - RNA, 23 nt, Human
ucgcugccucuccgccccucucc

SEQ ID NO: 1058572 - RNA, 18 nt, Human
uggauauaaucaaaagua

SEQ ID NO: 1058573 - RNA, 24 nt, Human
acaggccgcgccgugacugauuug

SEQ ID NO: 1058574 - RNA, 22 nt, Human
acauacagcccaggaccucacg

SEQ ID NO: 1058575 - RNA, 27 nt, Human
auccgcacauacagcccaggaccucac

SEQ ID NO: 1058576 - RNA, 19 nt, Human
caguauccgcacauacagc

SEQ ID NO: 1058577 - RNA, 23 nt, Human
cgggcgcacacaguauccgcaca

SEQ ID NO: 1058578 - RNA, 22 nt, Human
cugcugggcuagucagcugcgu

SEQ ID NO: 1058579 - RNA, 22 nt, Human
gcugggcuagucagcugcgugc

SEQ ID NO: 1058580 - RNA, 21 nt, Human
ggcgcacacaguauccgcaca

SEQ ID NO: 1058581 - RNA, 18 nt, Human
gugacugauuugcgugca

SEQ ID NO: 1058582 - RNA, 21 nt, Human
uccgcacauacagcccaggac

SEQ ID NO: 1058583 - RNA, 22 nt, Human
uccgcacauacagcccaggacc

SEQ ID NO: 1058584 - RNA, 23 nt, Human
ugccgaucuuccacaggccgcgc

SEQ ID NO: 1058585 - RNA, 19 nt, Human
aacccaccucacagcuucu

SEQ ID NO: 1058586 - RNA, 22 nt, Human
caacccaccucacagcuucugc

SEQ ID NO: 1058587 - RNA, 26 nt, Human
caagccaggauccuugccaacccacc

SEQ ID NO: 1058588 - RNA, 18 nt, Human
cacagcuucugcccgggc

SEQ ID NO: 1058589 - RNA, 18 nt, Human
caggauccuugccaaccc

SEQ ID NO: 1058590 - RNA, 20 nt, Human
ccucacagcuucugcccggg

SEQ ID NO: 1058591 - RNA, 21 nt, Human
ccuugccaacccaccucacag

SEQ ID NO: 1058592 - RNA, 22 nt, Human
cuucugcccgggcuguggcucc

SEQ ID NO: 1058593 - RNA, 19 nt, Human
aaacucacaggucgacccc

SEQ ID NO: 1058594 - RNA, 21 nt, Human
cacucucucccgccuuugaga

SEQ ID NO: 1058595 - RNA, 22 nt, Human
cagaaacucacaggucgacccc

SEQ ID NO: 1058596 - RNA, 25 nt, Human
ccggcaucggcggcugcauccuucu

SEQ ID NO: 1058597 - RNA, 24 nt, Human
cgaccccaagacuccacucucucc

SEQ ID NO: 1058598 - RNA, 18 nt, Human
gcugcauccuucuccucc

SEQ ID NO: 1058599 - RNA, 20 nt, Human
ucacaggucgaccccaagac

SEQ ID NO: 1058600 - RNA, 24 nt, Human
ucacaggucgaccccaagacucca

SEQ ID NO: 1058601 - RNA, 18 nt, Human
ucggcggcugcauccuuc

SEQ ID NO: 1058602 - RNA, 21 nt, Human
ugagaagccggaccggcaucg

SEQ ID NO: 1058603 - RNA, 18 nt, Human
aacccugcaacucuuguc

SEQ ID NO: 1058604 - RNA, 18 nt, Human
aacucuugucuccucaaa

SEQ ID NO: 1058605 - RNA, 22 nt, Human
aagcaccugccaccaggaaaua

SEQ ID NO: 1058606 - RNA, 22 nt, Human
acucuugucuccucaaagcuga

SEQ ID NO: 1058607 - RNA, 25 nt, Human
acucuugucuccucaaagcugaaag

SEQ ID NO: 1058608 - RNA, 23 nt, Human
caccugccaccaggaaauaaucc

SEQ ID NO: 1058609 - RNA, 22 nt, Human
ccagugcccauacucucccaag

SEQ ID NO: 1058610 - RNA, 18 nt, Human
cccaaagagguaaucacc

SEQ ID NO: 1058611 - RNA, 24 nt, Human
cuaaacccugcaacucuugucucc

SEQ ID NO: 1058612 - RNA, 18 nt, Human
cugguccuaagaucuaaa

SEQ ID NO: 1058613 - RNA, 19 nt, Human
gaaagcaccugccaccagg

SEQ ID NO: 1058614 - RNA, 23 nt, Human
guccuaagaucuaaacccugcaa

SEQ ID NO: 1058615 - RNA, 21 nt, Human
uaaagucaggauucacacuca

SEQ ID NO: 1058616 - RNA, 18 nt, Human
ucuccucaaagcugaaag

SEQ ID NO: 1058617 - RNA, 26 nt, Human
ugccaccaggaaauaaucccaaagag

SEQ ID NO: 1058618 - RNA, 23 nt, Human
aagcaaaauuuaaaacacagcca

SEQ ID NO: 1058619 - RNA, 22 nt, Human
acacagaccggcuccugaaggc

SEQ ID NO: 1058620 - RNA, 18 nt, Human
acugaugaccagucagug

SEQ ID NO: 1058621 - RNA, 18 nt, Human
aguguuaagagagggaaa

SEQ ID NO: 1058622 - RNA, 24 nt, Human
auuaaugagaacaaggacaaggga

SEQ ID NO: 1058623 - RNA, 21 nt, Human
caagaguagcucauacacaag

SEQ ID NO: 1058624 - RNA, 23 nt, Human
caccacaauggagguuuuucuca

SEQ ID NO: 1058625 - RNA, 25 nt, Human
cagaccggcuccugaaggcugucga

SEQ ID NO: 1058626 - RNA, 19 nt, Human
caggucuccucagcagccc

SEQ ID NO: 1058627 - RNA, 25 nt, Human
cauacacaagucaacuauguguaug

SEQ ID NO: 1058628 - RNA, 20 nt, Human
ccaggauuagucccugcacc

SEQ ID NO: 1058629 - RNA, 19 nt, Human
ccuaaagaauguaauaaaa

SEQ ID NO: 1058630 - RNA, 18 nt, Human
ccucagcagcccccuugg

SEQ ID NO: 1058631 - RNA, 25 nt, Human
cucacuuuccacacugcauagccac

SEQ ID NO: 1058632 - RNA, 22 nt, Human
cucagcagcccccuugguuucu

SEQ ID NO: 1058633 - RNA, 19 nt, Human
cuucuuguuuugcuuuuga

SEQ ID NO: 1058634 - RNA, 19 nt, Human
gaacaacagucccuucacu

SEQ ID NO: 1058635 - RNA, 21 nt, Human
gauccucuggaacaacagucc

SEQ ID NO: 1058636 - RNA, 23 nt, Human
gcugucgagauuuacgaggagau

SEQ ID NO: 1058637 - RNA, 19 nt, Human
ggagaucgggguucucucc

SEQ ID NO: 1058638 - RNA, 19 nt, Human
ggucaaauccaccuuuagc

SEQ ID NO: 1058639 - RNA, 22 nt, Human
guauguuuuuauuauuuaaagc

SEQ ID NO: 1058640 - RNA, 23 nt, Human
uaaaaauggaaaacuuuuuuccu

SEQ ID NO: 1058641 - RNA, 21 nt, Human
uaaaacacagccaauuucaac

SEQ ID NO: 1058642 - RNA, 23 nt, Human
uaaagccacaugacugagguaaa

SEQ ID NO: 1058643 - RNA, 20 nt, Human
uaaagcccaccauucagcuu

SEQ ID NO: 1058644 - RNA, 19 nt, Human
uaauccaguccaaugacac

SEQ ID NO: 1058645 - RNA, 18 nt, Human
uaaugauacugaugacca

SEQ ID NO: 1058646 - RNA, 21 nt, Human
uauaauccaguccaaugacac

SEQ ID NO: 1058647 - RNA, 20 nt, Human
uauugccucugcccuaaaca

SEQ ID NO: 1058648 - RNA, 26 nt, Human
ucaucugucacgugugaccuguuuaa

SEQ ID NO: 1058649 - RNA, 26 nt, Human
uccaaugacacacauauaacuauuuc

SEQ ID NO: 1058650 - RNA, 24 nt, Human
uccucagcagcccccuugguuucu

SEQ ID NO: 1058651 - RNA, 19 nt, Human
ucuacaaauuuaaccagca

SEQ ID NO: 1058652 - RNA, 22 nt, Human
ucuauaauaacaagaauccaag

SEQ ID NO: 1058653 - RNA, 21 nt, Human
ucuccucaccacaauggaggu

SEQ ID NO: 1058654 - RNA, 21 nt, Human
ucuucuuguuuugcuuuugac

SEQ ID NO: 1058655 - RNA, 22 nt, Human
ugcaccaggucuccucagcagc

SEQ ID NO: 1058656 - RNA, 21 nt, Human
uggagguuuuucucacuuucc

SEQ ID NO: 1058657 - RNA, 21 nt, Human
uucaacuucaagacuucugac

SEQ ID NO: 1058658 - RNA, 23 nt, Human
uucaagacuucugacuuauugcc

SEQ ID NO: 1058659 - RNA, 22 nt, Human
uuccuaaagaauguaauaaaaa

SEQ ID NO: 1058660 - RNA, 21 nt, Human
uugguuucuucaucugucacg

SEQ ID NO: 1058661 - RNA, 22 nt, Human
uuguuuugcuuuugacaaaaua

SEQ ID NO: 1058662 - RNA, 19 nt, Human
uuugacaaaauaugaacua

SEQ ID NO: 1058663 - RNA, 24 nt, Human
uuuuuccuucuggcugaaguugga

SEQ ID NO: 1058664 - RNA, 20 nt, Human
aggcagguguuugugucucc

SEQ ID NO: 1058665 - RNA, 19 nt, Human
cucaaacuugaacaagggc

SEQ ID NO: 1058666 - RNA, 21 nt, Human
cuccucgcuuuaauccugagg

SEQ ID NO: 1058667 - RNA, 19 nt, Human
gagacggucugaaauacag

SEQ ID NO: 1058668 - RNA, 20 nt, Human
ggaugaggacacccagcugg

SEQ ID NO: 1058669 - RNA, 23 nt, Human
ucugaaauacagcuccucgcuuu

SEQ ID NO: 1058670 - RNA, 19 nt, Human
ugagacggucugaaauaca

SEQ ID NO: 1058671 - RNA, 19 nt, Human
ugaggcagguguuuguguc

SEQ ID NO: 1058672 - RNA, 24 nt, Human
ugucuuauccuucuuaaugccuca

SEQ ID NO: 1058673 - RNA, 22 nt, Human
aaagcaacagagacagaugauc

SEQ ID NO: 1058674 - RNA, 21 nt, Human
aacaaauaagcacaguacacu

SEQ ID NO: 1058675 - RNA, 20 nt, Human
aagggagcuggacccuaggg

SEQ ID NO: 1058676 - RNA, 21 nt, Human
acgggagguuucaagucccag

SEQ ID NO: 1058677 - RNA, 24 nt, Human
agaaaagaaagcuguggaagucac

SEQ ID NO: 1058678 - RNA, 22 nt, Human
agaugcuaaaagcaacagagac

SEQ ID NO: 1058679 - RNA, 20 nt, Human
agcuggacccuaggggcggg

SEQ ID NO: 1058680 - RNA, 20 nt, Human
caacagagacagaugauccc

SEQ ID NO: 1058681 - RNA, 23 nt, Human
ccuagaaaaugucuuguucucau

SEQ ID NO: 1058682 - RNA, 19 nt, Human
cucuuagaacaaauaagca

SEQ ID NO: 1058683 - RNA, 21 nt, Human
cuguagaaaagaaagcugugg

SEQ ID NO: 1058684 - RNA, 24 nt, Human
cuguauaaagaagcaauucuucuc

SEQ ID NO: 1058685 - RNA, 20 nt, Human
gaugcuaaaagcaacagaga

SEQ ID NO: 1058686 - RNA, 22 nt, Human
gcuccuaggugaagggagcugg

SEQ ID NO: 1058687 - RNA, 19 nt, Human
gcuggacccuaggggcggg

SEQ ID NO: 1058688 - RNA, 20 nt, Human
ggcaggaccuuggcuagagc

SEQ ID NO: 1058689 - RNA, 22 nt, Human
uaaaagcaacagagacagauga

SEQ ID NO: 1058690 - RNA, 22 nt, Human
uacacuauuguaaucuaagaaa

SEQ ID NO: 1058691 - RNA, 18 nt, Human
uccaauggcccauaagcc

SEQ ID NO: 1058692 - RNA, 19 nt, Human
ucccaacaccaacgggagg

SEQ ID NO: 1058693 - RNA, 18 nt, Human
ucucuuagaacaaauaag

SEQ ID NO: 1058694 - RNA, 23 nt, Human
ucugucggagcuguauaaagaag

SEQ ID NO: 1058695 - RNA, 21 nt, Human
uguagaaaagaaagcugugga

SEQ ID NO: 1058696 - RNA, 20 nt, Human
ugucuuguucucauaaaaag

SEQ ID NO: 1058697 - RNA, 22 nt, Human
uuuauugucuauacaacugaag

SEQ ID NO: 1058698 - RNA, 25 nt, Human
aaaaauauuuucccuuuccuaucuu

SEQ ID NO: 1058699 - RNA, 21 nt, Human
aaacacauuauacaaacuaca

SEQ ID NO: 1058700 - RNA, 19 nt, Human
aacauggugaaaccuuguc

SEQ ID NO: 1058701 - RNA, 20 nt, Human
aacauggugaaaccuugucu

SEQ ID NO: 1058702 - RNA, 21 nt, Human
aacauggugaaaccuugucuu

SEQ ID NO: 1058703 - RNA, 24 nt, Human
aacugaggucaggaguucgagacc

SEQ ID NO: 1058704 - RNA, 20 nt, Human
aagaaagaaaauaaucagaa

SEQ ID NO: 1058705 - RNA, 22 nt, Human
aagaaagaaaauaaucagaaau

SEQ ID NO: 1058706 - RNA, 18 nt, Human
aagccauucuccugccuc

SEQ ID NO: 1058707 - RNA, 21 nt, Human
aagccauucuccugccucagc

SEQ ID NO: 1058708 - RNA, 24 nt, Human
aauggugggugucuguaaucccag

SEQ ID NO: 1058709 - RNA, 19 nt, Human
aauugcuugaaccuggcgg

SEQ ID NO: 1058710 - RNA, 25 nt, Human
aauugcuugaaccuggcggggcgga

SEQ ID NO: 1058711 - RNA, 24 nt, Human
aauuuuguauuuuuaguaaaggcg

SEQ ID NO: 1058712 - RNA, 24 nt, Human
accuugucuuuacuaaaaauacaa

SEQ ID NO: 1058713 - RNA, 18 nt, Human
acuccacuccagccuggg

SEQ ID NO: 1058714 - RNA, 24 nt, Human
acuccacuccagccugggugagag

SEQ ID NO: 1058715 - RNA, 24 nt, Human
agagagagagacucugucucaaaa

SEQ ID NO: 1058716 - RNA, 24 nt, Human
agcacuuugggaggcugaggcagg

SEQ ID NO: 1058717 - RNA, 18 nt, Human
agcauauuuucuuccaaa

SEQ ID NO: 1058718 - RNA, 18 nt, Human
agccuccagaguaguugg

SEQ ID NO: 1058719 - RNA, 23 nt, Human
agccuggcuaacauggugaaacc

SEQ ID NO: 1058720 - RNA, 23 nt, Human
agccuggcuaacauggugaaacc

SEQ ID NO: 1058721 - RNA, 24 nt, Human
agccugggugagagagagagacuc

SEQ ID NO: 1058722 - RNA, 22 nt, Human
aggcaggagaauugcuugaacc

SEQ ID NO: 1058723 - RNA, 24 nt, Human
aggcaggagaauugcuugaaccug

SEQ ID NO: 1058724 - RNA, 26 nt, Human
aggcagguggaucaacugaggucagg

SEQ ID NO: 1058725 - RNA, 21 nt, Human
aggcugaggcaggagaauugc

SEQ ID NO: 1058726 - RNA, 24 nt, Human
aggcugaggcaggagaauugcuug

SEQ ID NO: 1058727 - RNA, 18 nt, Human
aggcugaggcagguggau

SEQ ID NO: 1058728 - RNA, 24 nt, Human
aggcugaggcagguggaucaacug

SEQ ID NO: 1058729 - RNA, 18 nt, Human
aguaguugggauuacagg

SEQ ID NO: 1058730 - RNA, 24 nt, Human
auagugccacuccacuccagccug

SEQ ID NO: 1058731 - RNA, 24 nt, Human
auauauauauuuaaacacauuaua

SEQ ID NO: 1058732 - RNA, 19 nt, Human
auuacaggugcaugccacc

SEQ ID NO: 1058733 - RNA, 23 nt, Human
auuauacaaacuacacgacauaa

SEQ ID NO: 1058734 - RNA, 22 nt, Human
caaaaauuagccaggcgcaaug

SEQ ID NO: 1058735 - RNA, 24 nt, Human
caaccuccaccuccuggguuuaag

SEQ ID NO: 1058736 - RNA, 22 nt, Human
caacugauuaauuuaaacugaa

SEQ ID NO: 1058737 - RNA, 24 nt, Human
cacaccugcaaucccagcacuuug

SEQ ID NO: 1058738 - RNA, 21 nt, Human
caccgcaaccuccaccuccug

SEQ ID NO: 1058739 - RNA, 23 nt, Human
caccgcaaccuccaccuccuggg

SEQ ID NO: 1058740 - RNA, 23 nt, Human
caccugcaaucccagcacuuugg

SEQ ID NO: 1058741 - RNA, 24 nt, Human
caccugcaaucccagcacuuuggg

SEQ ID NO: 1058742 - RNA, 24 nt, Human
cacgacauaaaggauauaaagaaa

SEQ ID NO: 1058743 - RNA, 19 nt, Human
cacuccacuccagccuggg

SEQ ID NO: 1058744 - RNA, 22 nt, Human
cacuccacuccagccuggguga

SEQ ID NO: 1058745 - RNA, 24 nt, Human
cacuccacuccagccugggugaga

SEQ ID NO: 1058746 - RNA, 18 nt, Human
cacuccagccugggugag

SEQ ID NO: 1058747 - RNA, 24 nt, Human
cagcacuuugggaggcugaggcag

SEQ ID NO: 1058748 - RNA, 26 nt, Human
cagcacuuugggaggcugaggcaggu

SEQ ID NO: 1058749 - RNA, 24 nt, Human
cagcuacucaggaggcugaggcag

SEQ ID NO: 1058750 - RNA, 24 nt, Human
cauauauauauauauuuaaacaca

SEQ ID NO: 1058751 - RNA, 24 nt, Human
caugccaccacgccuggcuaauuu

SEQ ID NO: 1058752 - RNA, 21 nt, Human
cauuauacaaacuacacgaca

SEQ ID NO: 1058753 - RNA, 18 nt, Human
cauuucuaggcugggcgu

SEQ ID NO: 1058754 - RNA, 20 nt, Human
ccacuccacuccagccuggg

SEQ ID NO: 1058755 - RNA, 21 nt, Human
ccacuccacuccagccugggu

SEQ ID NO: 1058756 - RNA, 21 nt, Human
ccacuccacuccagccugggu

SEQ ID NO: 1058757 - RNA, 23 nt, Human
ccacuccacuccagccuggguga

SEQ ID NO: 1058758 - RNA, 19 nt, Human
ccagaguaguugggauuac

SEQ ID NO: 1058759 - RNA, 22 nt, Human
ccagaguaguugggauuacagg

SEQ ID NO: 1058760 - RNA, 23 nt, Human
ccagaguaguugggauuacaggu

SEQ ID NO: 1058761 - RNA, 24 nt, Human
ccagaguaguugggauuacaggug

SEQ ID NO: 1058762 - RNA, 19 nt, Human
ccauauuggucaggcuggu

SEQ ID NO: 1058763 - RNA, 22 nt, Human
ccauauuggucaggcuggucuc

SEQ ID NO: 1058764 - RNA, 18 nt, Human
ccgcaaccuccaccuccu

SEQ ID NO: 1058765 - RNA, 23 nt, Human
ccgcaaccuccaccuccuggguu

SEQ ID NO: 1058766 - RNA, 24 nt, Human
ccgcaaccuccaccuccuggguuu

SEQ ID NO: 1058767 - RNA, 22 nt, Human
ccuaauuuacagcagcauauuu

SEQ ID NO: 1058768 - RNA, 21 nt, Human
ccuggcuaacauggugaaacc

SEQ ID NO: 1058769 - RNA, 24 nt, Human
ccuggcuaacauggugaaaccuug

SEQ ID NO: 1058770 - RNA, 20 nt, Human
cgacauaaaggauauaaaga

SEQ ID NO: 1058771 - RNA, 24 nt, Human
cgagaccagccuggcuaacauggu

SEQ ID NO: 1058772 - RNA, 23 nt, Human
cgcaauggugggugucuguaauc

SEQ ID NO: 1058773 - RNA, 24 nt, Human
cgcucuuguugcccaggcuggagu

SEQ ID NO: 1058774 - RNA, 24 nt, Human
cuaggcugggcgugguggcucaca

SEQ ID NO: 1058775 - RNA, 22 nt, Human
cucacaccugcaaucccagcac

SEQ ID NO: 1058776 - RNA, 24 nt, Human
cucacaccugcaaucccagcacuu

SEQ ID NO: 1058777 - RNA, 24 nt, Human
cucaccgcaaccuccaccuccugg

SEQ ID NO: 1058778 - RNA, 21 nt, Human
cugccucagccuccagaguag

SEQ ID NO: 1058779 - RNA, 24 nt, Human
cuggcuaacauggugaaaccuugu

SEQ ID NO: 1058780 - RNA, 18 nt, Human
cuguaaucccagcuacuc

SEQ ID NO: 1058781 - RNA, 24 nt, Human
cuuguugcccaggcuggagugcaa

SEQ ID NO: 1058782 - RNA, 19 nt, Human
gaaaccuugucuuuacuaa

SEQ ID NO: 1058783 - RNA, 21 nt, Human
gaaguugcagugaguugggau

SEQ ID NO: 1058784 - RNA, 19 nt, Human
gaccucagcucaccgcaac

SEQ ID NO: 1058785 - RNA, 19 nt, Human
gagagagacucugucucaa

SEQ ID NO: 1058786 - RNA, 26 nt, Human
gaguaguugggauuacaggugcaugc

SEQ ID NO: 1058787 - RNA, 24 nt, Human
gaucaacugaggucaggaguucga

SEQ ID NO: 1058788 - RNA, 18 nt, Human
gauuacaggugcaugcca

SEQ ID NO: 1058789 - RNA, 19 nt, Human
gcaauggcgcgaccucagc

SEQ ID NO: 1058790 - RNA, 19 nt, Human
gccacuccacuccagccug

SEQ ID NO: 1058791 - RNA, 24 nt, Human
gccacuccacuccagccuggguga

SEQ ID NO: 1058792 - RNA, 19 nt, Human
gcccaggcuggagugcaau

SEQ ID NO: 1058793 - RNA, 19 nt, Human
gccgacuccccgagccucc

SEQ ID NO: 1058794 - RNA, 24 nt, Human
gcuaacauggugaaaccuugucuu

SEQ ID NO: 1058795 - RNA, 24 nt, Human
gcucuuguugcccaggcuggagug

SEQ ID NO: 1058796 - RNA, 19 nt, Human
gcuggagugcaauggcgcg

SEQ ID NO: 1058797 - RNA, 18 nt, Human
ggaaguugcagugaguug

SEQ ID NO: 1058798 - RNA, 22 nt, Human
ggaaguugcagugaguugggau

SEQ ID NO: 1058799 - RNA, 23 nt, Human
ggaaguugcagugaguugggaua

SEQ ID NO: 1058800 - RNA, 22 nt, Human
ggaucaacugaggucaggaguu

SEQ ID NO: 1058801 - RNA, 18 nt, Human
ggcggaaguugcagugag

SEQ ID NO: 1058802 - RNA, 23 nt, Human
ggcgugguggcucacaccugcaa

SEQ ID NO: 1058803 - RNA, 24 nt, Human
gggcggaaguugcagugaguuggg

SEQ ID NO: 1058804 - RNA, 21 nt, Human
gugccacuccacuccagccug

SEQ ID NO: 1058805 - RNA, 21 nt, Human
guggaucaacugaggucagga

SEQ ID NO: 1058806 - RNA, 22 nt, Human
guggaucaacugaggucaggag

SEQ ID NO: 1058807 - RNA, 24 nt, Human
guugcagugaguugggauagugcc

SEQ ID NO: 1058808 - RNA, 21 nt, Human
uaaaaauacaaaaauuagcca

SEQ ID NO: 1058809 - RNA, 21 nt, Human
uaacauggugaaaccuugucu

SEQ ID NO: 1058810 - RNA, 21 nt, Human
uaacauggugaaaccuugucu

SEQ ID NO: 1058811 - RNA, 22 nt, Human
uaacauggugaaaccuugucuu

SEQ ID NO: 1058812 - RNA, 18 nt, Human
uaaguuaauucagaugua

SEQ ID NO: 1058813 - RNA, 21 nt, Human
uacagcagcauauuuucuucc

SEQ ID NO: 1058814 - RNA, 22 nt, Human
uacaggugcaugccaccacgcc

SEQ ID NO: 1058815 - RNA, 24 nt, Human
uaguaaaggcgagauuucuccaua

SEQ ID NO: 1058816 - RNA, 19 nt, Human
uauauauauuuaaacacau

SEQ ID NO: 1058817 - RNA, 22 nt, Human
uauuuucccuuuccuaucuuuu

SEQ ID NO: 1058818 - RNA, 24 nt, Human
ucaccgcaaccuccaccuccuggg

SEQ ID NO: 1058819 - RNA, 18 nt, Human
ucaggcuggucucccuuu

SEQ ID NO: 1058820 - RNA, 24 nt, Human
uccagaguaguugggauuacaggu

SEQ ID NO: 1058821 - RNA, 18 nt, Human
uccagccugggugagaga

SEQ ID NO: 1058822 - RNA, 19 nt, Human
uccagccugggugagagag

SEQ ID NO: 1058823 - RNA, 24 nt, Human
uccuggguuuaagccauucuccug

SEQ ID NO: 1058824 - RNA, 22 nt, Human
ucgcucuuguugcccaggcugg

SEQ ID NO: 1058825 - RNA, 23 nt, Human
ucgcucuuguugcccaggcugga

SEQ ID NO: 1058826 - RNA, 21 nt, Human
ucucaaaaaaacaagaaucau

SEQ ID NO: 1058827 - RNA, 18 nt, Human
ucuccugccucagccucc

SEQ ID NO: 1058828 - RNA, 21 nt, Human
ucuguaaucccagcuacucag

SEQ ID NO: 1058829 - RNA, 22 nt, Human
ucuuguugcccaggcuggagug

SEQ ID NO: 1058830 - RNA, 22 nt, Human
ucuuuuuuuuugagacggaguu

SEQ ID NO: 1058831 - RNA, 18 nt, Human
ugaaaaaugaugaaguaa

SEQ ID NO: 1058832 - RNA, 24 nt, Human
ugaggcaggagaauugcuugaacc

SEQ ID NO: 1058833 - RNA, 25 nt, Human
ugaggcaggagaauugcuugaaccu

SEQ ID NO: 1058834 - RNA, 20 nt, Human
ugaggcagguggaucaacug

SEQ ID NO: 1058835 - RNA, 26 nt, Human
ugaggcagguggaucaacugagguca

SEQ ID NO: 1058836 - RNA, 18 nt, Human
ugcccaggcuggagugca

SEQ ID NO: 1058837 - RNA, 21 nt, Human
ugcccaggcuggagugcaaug

SEQ ID NO: 1058838 - RNA, 21 nt, Human
ugcccaggcuggagugcaaug

SEQ ID NO: 1058839 - RNA, 24 nt, Human
ugcccaggcuggagugcaauggcg

SEQ ID NO: 1058840 - RNA, 20 nt, Human
ugccucagccuccagaguag

SEQ ID NO: 1058841 - RNA, 19 nt, Human
uggagugcaauggcgcgac

SEQ ID NO: 1058842 - RNA, 23 nt, Human
uggagugcaauggcgcgaccuca

SEQ ID NO: 1058843 - RNA, 24 nt, Human
uggaucaacugaggucaggaguuc

SEQ ID NO: 1058844 - RNA, 24 nt, Human
uggcgcgaccucagcucaccgcaa

SEQ ID NO: 1058845 - RNA, 22 nt, Human
uggcucacaccugcaaucccag

SEQ ID NO: 1058846 - RNA, 24 nt, Human
uggcucacaccugcaaucccagca

SEQ ID NO: 1058847 - RNA, 18 nt, Human
ugggaggcugaggcaggu

SEQ ID NO: 1058848 - RNA, 24 nt, Human
ugggaggcugaggcagguggauca

SEQ ID NO: 1058849 - RNA, 21 nt, Human
ugggauuacaggugcaugcca

SEQ ID NO: 1058850 - RNA, 22 nt, Human
ugggauuacaggugcaugccac

SEQ ID NO: 1058851 - RNA, 24 nt, Human
ugggauuacaggugcaugccacca

SEQ ID NO: 1058852 - RNA, 24 nt, Human
uggucaggcuggucucccuuuccu

SEQ ID NO: 1058853 - RNA, 21 nt, Human
uggugggugucuguaauccca

SEQ ID NO: 1058854 - RNA, 24 nt, Human
uggugggugucuguaaucccagcu

SEQ ID NO: 1058855 - RNA, 24 nt, Human
ugucuguaaucccagcuacucagg

SEQ ID NO: 1058856 - RNA, 20 nt, Human
uguugcccaggcuggagugc

SEQ ID NO: 1058857 - RNA, 25 nt, Human
uuaagccauucuccugccucagccu

SEQ ID NO: 1058858 - RNA, 23 nt, Human
uuacagcagcauauuuucuuccc

SEQ ID NO: 1058859 - RNA, 24 nt, Human
uuagccaggcgcaauggugggugu

SEQ ID NO: 1058860 - RNA, 19 nt, Human
uuaguaaaggcgagauuuc

SEQ ID NO: 1058861 - RNA, 23 nt, Human
uuauacaaacuacacgacauaaa

SEQ ID NO: 1058862 - RNA, 24 nt, Human
uuccuaauuuacagcagcauauuu

SEQ ID NO: 1058863 - RNA, 24 nt, Human
uucgcucuuguugcccaggcugga

SEQ ID NO: 1058864 - RNA, 24 nt, Human
uucuaggcugggcgugguggcuca

SEQ ID NO: 1058865 - RNA, 22 nt, Human
uugcagugaguugggauagugc

SEQ ID NO: 1058866 - RNA, 25 nt, Human
uugggaggcugaggcagguggauca

SEQ ID NO: 1058867 - RNA, 24 nt, Human
uuucgcucuuguugcccaggcugg

SEQ ID NO: 1058868 - RNA, 19 nt, Human
uuuuguauuuuuaguaaag

SEQ ID NO: 1058869 - RNA, 22 nt, Human
aaaaaaagaaagaauggcauca

SEQ ID NO: 1058870 - RNA, 25 nt, Human
aaaaagacacuggcaggccgggugc

SEQ ID NO: 1058871 - RNA, 20 nt, Human
aaaacaaagauaccucaagc

SEQ ID NO: 1058872 - RNA, 18 nt, Human
aaaaggcauacuaaauau

SEQ ID NO: 1058873 - RNA, 23 nt, Human
aaaagguuucaguacagggugug

SEQ ID NO: 1058874 - RNA, 18 nt, Human
aaaauuagcugggcaugg

SEQ ID NO: 1058875 - RNA, 19 nt, Human
aaacauguuuauuguagau

SEQ ID NO: 1058876 - RNA, 19 nt, Human
aaagauaccucaagcaggg

SEQ ID NO: 1058877 - RNA, 18 nt, Human
aaccuuuuuaaaaaaugg

SEQ ID NO: 1058878 - RNA, 21 nt, Human
aacucugaugauuccaagcaa

SEQ ID NO: 1058879 - RNA, 24 nt, Human
aaucacuugaaccugggaggcaga

SEQ ID NO: 1058880 - RNA, 25 nt, Human
aaucucgugagaacuuaccacccac

SEQ ID NO: 1058881 - RNA, 19 nt, Human
aauuucuuuuguucaaaau

SEQ ID NO: 1058882 - RNA, 24 nt, Human
aauuuuauuuggauaacaaagggu

SEQ ID NO: 1058883 - RNA, 21 nt, Human
acaaaaccaaauaagcaagcc

SEQ ID NO: 1058884 - RNA, 18 nt, Human
acaccacugcacuccagc

SEQ ID NO: 1058885 - RNA, 24 nt, Human
acacuucagccugggcaacagagc

SEQ ID NO: 1058886 - RNA, 24 nt, Human
acagagcgaggcucuaucuuaaaa

SEQ ID NO: 1058887 - RNA, 24 nt, Human
acccagugcuuagaaauaggcacc

SEQ ID NO: 1058888 - RNA, 18 nt, Human
accugaaaucccaacacu

SEQ ID NO: 1058889 - RNA, 21 nt, Human
accugaaaucccaacacuuug

SEQ ID NO: 1058890 - RNA, 24 nt, Human
accugaggucaggaguucgagacc

SEQ ID NO: 1058891 - RNA, 18 nt, Human
acuacacuucagccuggg

SEQ ID NO: 1058892 - RNA, 24 nt, Human
acuacacuucagccugggcaacag

SEQ ID NO: 1058893 - RNA, 22 nt, Human
acuccagccugggagagcaaga

SEQ ID NO: 1058894 - RNA, 18 nt, Human
acugcacuccagccuggg

SEQ ID NO: 1058895 - RNA, 26 nt, Human
agaaauaggcacuccucaaccagugu

SEQ ID NO: 1058896 - RNA, 18 nt, Human
agaaauguauaaaacacc

SEQ ID NO: 1058897 - RNA, 23 nt, Human
agacaggaggauugcuugagccc

SEQ ID NO: 1058898 - RNA, 22 nt, Human
agagguugcagugagccgagau

SEQ ID NO: 1058899 - RNA, 24 nt, Human
agagguugcagugagccgagauug

SEQ ID NO: 1058900 - RNA, 18 nt, Human
agccuggaagcuacagcg

SEQ ID NO: 1058901 - RNA, 19 nt, Human
agccuggccaacaugguga

SEQ ID NO: 1058902 - RNA, 22 nt, Human
agccugggagagcaagaaccug

SEQ ID NO: 1058903 - RNA, 24 nt, Human
agccugggcaacagagcgaggcuc

SEQ ID NO: 1058904 - RNA, 20 nt, Human
aggaggccgaggcaggugca

SEQ ID NO: 1058905 - RNA, 24 nt, Human
aggauugcuugagcccaggaguuu

SEQ ID NO: 1058906 - RNA, 21 nt, Human
aggcagagguugcagugagcc

SEQ ID NO: 1058907 - RNA, 24 nt, Human
aggcagagguugcagugagccgag

SEQ ID NO: 1058908 - RNA, 22 nt, Human
aggcaggagaaucacuugaacc

SEQ ID NO: 1058909 - RNA, 24 nt, Human
aggcaggagaaucacuugaaccug

SEQ ID NO: 1058910 - RNA, 22 nt, Human
aggcaggugcaucaccugaggu

SEQ ID NO: 1058911 - RNA, 26 nt, Human
aggcaggugcaucaccugaggucagg

SEQ ID NO: 1058912 - RNA, 24 nt, Human
aggccaagacaggaggauugcuug

SEQ ID NO: 1058913 - RNA, 21 nt, Human
aggccgaggcaggugcaucac

SEQ ID NO: 1058914 - RNA, 24 nt, Human
aggcugaggcaggagaaucacuug

SEQ ID NO: 1058915 - RNA, 24 nt, Human
aggcugaggugggaggacugcuug

SEQ ID NO: 1058916 - RNA, 18 nt, Human
agggugugaacaaugaaa

SEQ ID NO: 1058917 - RNA, 24 nt, Human
aggugcagugccucaagccuguaa

SEQ ID NO: 1058918 - RNA, 24 nt, Human
agugcuuuaggaggcugagguggg

SEQ ID NO: 1058919 - RNA, 19 nt, Human
auaggcacuccucaaccag

SEQ ID NO: 1058920 - RNA, 23 nt, Human
aucaccugaggucaggaguucga

SEQ ID NO: 1058921 - RNA, 19 nt, Human
augccuguaaucccagcac

SEQ ID NO: 1058922 - RNA, 24 nt, Human
auuacaccacugcacuccagccug

SEQ ID NO: 1058923 - RNA, 24 nt, Human
auugugccacuacacuucagccug

SEQ ID NO: 1058924 - RNA, 23 nt, Human
caaaacacucucaugggugucaa

SEQ ID NO: 1058925 - RNA, 19 nt, Human
caaaaugcuugauaugaag

SEQ ID NO: 1058926 - RNA, 23 nt, Human
caaaaugcuugauaugaaguaug

SEQ ID NO: 1058927 - RNA, 20 nt, Human
caacacuuugggaggccaag

SEQ ID NO: 1058928 - RNA, 24 nt, Human
caacauggugaaaugccgucucua

SEQ ID NO: 1058929 - RNA, 23 nt, Human
caagacaggaggauugcuugagc

SEQ ID NO: 1058930 - RNA, 20 nt, Human
caagagaugacuguaaacac

SEQ ID NO: 1058931 - RNA, 18 nt, Human
caagcaaggaagcaauau

SEQ ID NO: 1058932 - RNA, 23 nt, Human
caagccuguaaucccagugcuuu

SEQ ID NO: 1058933 - RNA, 23 nt, Human
cacaccuguaaucccagcuacuu

SEQ ID NO: 1058934 - RNA, 26 nt, Human
caccacugcacuccagccugggagag

SEQ ID NO: 1058935 - RNA, 23 nt, Human
caccugaggucaggaguucgaga

SEQ ID NO: 1058936 - RNA, 23 nt, Human
caccuguaaucccagcuacuugg

SEQ ID NO: 1058937 - RNA, 24 nt, Human
cacuacacuucagccugggcaaca

SEQ ID NO: 1058938 - RNA, 18 nt, Human
cacuccagccugggagag

SEQ ID NO: 1058939 - RNA, 18 nt, Human
cacugcacuccagccugg

SEQ ID NO: 1058940 - RNA, 19 nt, Human
cacugcacuccagccuggg

SEQ ID NO: 1058941 - RNA, 22 nt, Human
cacugcacuccagccugggaga

SEQ ID NO: 1058942 - RNA, 25 nt, Human
cacugcacuccagccugggagagca

SEQ ID NO: 1058943 - RNA, 24 nt, Human
cacuucagccugggcaacagagcg

SEQ ID NO: 1058944 - RNA, 20 nt, Human
cagaguaagcaauaugcuag

SEQ ID NO: 1058945 - RNA, 18 nt, Human
cagcacuuuaggaggccg

SEQ ID NO: 1058946 - RNA, 24 nt, Human
cagcacuuuaggaggccgaggcag

SEQ ID NO: 1058947 - RNA, 21 nt, Human
cagccugggcaacagagcgag

SEQ ID NO: 1058948 - RNA, 21 nt, Human
cagccugggcaacagagcgag

SEQ ID NO: 1058949 - RNA, 23 nt, Human
caggccgggugcgguggcucaug

SEQ ID NO: 1058950 - RNA, 24 nt, Human
caggugcaucaccugaggucagga

SEQ ID NO: 1058951 - RNA, 24 nt, Human
cagugcuuuaggaggcugaggugg

SEQ ID NO: 1058952 - RNA, 24 nt, Human
cauacauaucaaaauacaccaucc

SEQ ID NO: 1058953 - RNA, 24 nt, Human
caucaccugaggucaggaguucga

SEQ ID NO: 1058954 - RNA, 20 nt, Human
caugccuguaaucccagcac

SEQ ID NO: 1058955 - RNA, 23 nt, Human
caugccuguaaucccagcacuuu

SEQ ID NO: 1058956 - RNA, 22 nt, Human
cauuaacugauugcuuuccuaa

SEQ ID NO: 1058957 - RNA, 20 nt, Human
ccacuacacuucagccuggg

SEQ ID NO: 1058958 - RNA, 23 nt, Human
ccacuacacuucagccugggcaa

SEQ ID NO: 1058959 - RNA, 24 nt, Human
ccacuacacuucagccugggcaac

SEQ ID NO: 1058960 - RNA, 19 nt, Human
ccacugcacuccagccugg

SEQ ID NO: 1058961 - RNA, 20 nt, Human
ccacugcacuccagccuggg

SEQ ID NO: 1058962 - RNA, 22 nt, Human
ccacugcacuccagccugggag

SEQ ID NO: 1058963 - RNA, 25 nt, Human
ccacugcacuccagccugggagagc

SEQ ID NO: 1058964 - RNA, 26 nt, Human
ccacugcacuccagccugggagagca

SEQ ID NO: 1058965 - RNA, 25 nt, Human
ccaggaguucgagacugcagugagc

SEQ ID NO: 1058966 - RNA, 21 nt, Human
cccucagucccaauguugcuc

SEQ ID NO: 1058967 - RNA, 21 nt, Human
ccgucucuacuaaaaauacaa

SEQ ID NO: 1058968 - RNA, 24 nt, Human
ccuaaccuuuuuaaaaaaugguca

SEQ ID NO: 1058969 - RNA, 26 nt, Human
ccuauaccacaaaacacucucauggg

SEQ ID NO: 1058970 - RNA, 26 nt, Human
ccuauuauuacaaaaaagcuuauaau

SEQ ID NO: 1058971 - RNA, 22 nt, Human
ccugaggucaggaguucgagac

SEQ ID NO: 1058972 - RNA, 19 nt, Human
ccuggaagcuacagcgagc

SEQ ID NO: 1058973 - RNA, 23 nt, Human
ccuggccaacauggugaaaugcc

SEQ ID NO: 1058974 - RNA, 24 nt, Human
ccuggccaacauggugaaaugccg

SEQ ID NO: 1058975 - RNA, 25 nt, Human
ccugggaggcagagguugcagugag

SEQ ID NO: 1058976 - RNA, 22 nt, Human
ccugggcaacagagcgaggcuc

SEQ ID NO: 1058977 - RNA, 24 nt, Human
ccuguaaucccagcuacuugguag

SEQ ID NO: 1058978 - RNA, 24 nt, Human
cgagaccagccuggccaacauggu

SEQ ID NO: 1058979 - RNA, 20 nt, Human
cgaggcaggugcaucaccug

SEQ ID NO: 1058980 - RNA, 26 nt, Human
cgaggcaggugcaucaccugagguca

SEQ ID NO: 1058981 - RNA, 19 nt, Human
cuaaagagauaacucaggu

SEQ ID NO: 1058982 - RNA, 22 nt, Human
cucaagcagguccaccuauacc

SEQ ID NO: 1058983 - RNA, 24 nt, Human
cucaagccuguaaucccagugcuu

SEQ ID NO: 1058984 - RNA, 24 nt, Human
cucaugccuguaaucccagcacuu

SEQ ID NO: 1058985 - RNA, 28 nt, Human
cugaaaucccaacacuuugggaggccaa

SEQ ID NO: 1058986 - RNA, 21 nt, Human
cugcuugaguccaggaguucg

SEQ ID NO: 1058987 - RNA, 23 nt, Human
cugcuugaguccaggaguucgag

SEQ ID NO: 1058988 - RNA, 22 nt, Human
cuuugcacuaagccuaaccuuu

SEQ ID NO: 1058989 - RNA, 21 nt, Human
gacacuggcaggccgggugcg

SEQ ID NO: 1058990 - RNA, 22 nt, Human
gacaggaggauugcuugagccc

SEQ ID NO: 1058991 - RNA, 23 nt, Human
gagaaucacuugaaccugggagg

SEQ ID NO: 1058992 - RNA, 23 nt, Human
gagauugugccacuacacuucag

SEQ ID NO: 1058993 - RNA, 18 nt, Human
gagcccaggaguuugagg

SEQ ID NO: 1058994 - RNA, 23 nt, Human
gaggccagccuggaagcuacagc

SEQ ID NO: 1058995 - RNA, 18 nt, Human
gauaacaaagggucucca

SEQ ID NO: 1058996 - RNA, 22 nt, Human
gauugcuugagcccaggaguuu

SEQ ID NO: 1058997 - RNA, 24 nt, Human
gauugcuugagcccaggaguuuga

SEQ ID NO: 1058998 - RNA, 21 nt, Human
gauuuaaugaucaaaaaacua

SEQ ID NO: 1058999 - RNA, 18 nt, Human
gcaauagaaaaaccaaag

SEQ ID NO: 1059000 - RNA, 19 nt, Human
gcacuccagccugggagag

SEQ ID NO: 1059001 - RNA, 23 nt, Human
gcaggagaaucacuugaaccugg

SEQ ID NO: 1059002 - RNA, 19 nt, Human
gccaacauggugaaaugcc

SEQ ID NO: 1059003 - RNA, 24 nt, Human
gccaacauggugaaaugccgucuc

SEQ ID NO: 1059004 - RNA, 21 nt, Human
gccacacaccuguaaucccag

SEQ ID NO: 1059005 - RNA, 21 nt, Human
gccucaagccuguaaucccag

SEQ ID NO: 1059006 - RNA, 20 nt, Human
gcucuuauugggaagaacau

SEQ ID NO: 1059007 - RNA, 22 nt, Human
gcuugaguccaggaguucgaga

SEQ ID NO: 1059008 - RNA, 22 nt, Human
ggauugcuugagcccaggaguu

SEQ ID NO: 1059009 - RNA, 23 nt, Human
ggcaggccgggugcgguggcuca

SEQ ID NO: 1059010 - RNA, 23 nt, Human
ggccgggugcgguggcucaugcc

SEQ ID NO: 1059011 - RNA, 24 nt, Human
gggcauggugccacacaccuguaa

SEQ ID NO: 1059012 - RNA, 24 nt, Human
gggugcgguggcucaugccuguaa

SEQ ID NO: 1059013 - RNA, 24 nt, Human
ggugccacacaccuguaaucccag

SEQ ID NO: 1059014 - RNA, 23 nt, Human
gguggcucaugccuguaauccca

SEQ ID NO: 1059015 - RNA, 24 nt, Human
gguggcucaugccuguaaucccag

SEQ ID NO: 1059016 - RNA, 24 nt, Human
gugcaucaccugaggucaggaguu

SEQ ID NO: 1059017 - RNA, 23 nt, Human
guggcucaugccuguaaucccag

SEQ ID NO: 1059018 - RNA, 24 nt, Human
guugcagugagccgagauugugcc

SEQ ID NO: 1059019 - RNA, 22 nt, Human
uaaaaaacaacauauuacaaaa

SEQ ID NO: 1059020 - RNA, 26 nt, Human
uaaaaaacaagcaugccuucauuaaa

SEQ ID NO: 1059021 - RNA, 23 nt, Human
uaaaaggcauacuaaauauuagc

SEQ ID NO: 1059022 - RNA, 27 nt, Human
uaagcaauaugcuagauacccugaaag

SEQ ID NO: 1059023 - RNA, 24 nt, Human
uaauaaauaaacauuccuuuggga

SEQ ID NO: 1059024 - RNA, 18 nt, Human
uacaaaaagguuuacuaa

SEQ ID NO: 1059025 - RNA, 21 nt, Human
uacaccacugcacuccagccu

SEQ ID NO: 1059026 - RNA, 18 nt, Human
uaccacauauuuuacuuu

SEQ ID NO: 1059027 - RNA, 19 nt, Human
uaccugaaaucccaacacu

SEQ ID NO: 1059028 - RNA, 21 nt, Human
uaccugaaaucccaacacuuu

SEQ ID NO: 1059029 - RNA, 24 nt, Human
uaccugaaaucccaacacuuuggg

SEQ ID NO: 1059030 - RNA, 23 nt, Human
uacuugguaggcugaggcaggag

SEQ ID NO: 1059031 - RNA, 24 nt, Human
uaggaggccgaggcaggugcauca

SEQ ID NO: 1059032 - RNA, 19 nt, Human
uaggaggcugaggugggag

SEQ ID NO: 1059033 - RNA, 23 nt, Human
uaguaaguauaucuuuucuucuc

SEQ ID NO: 1059034 - RNA, 25 nt, Human
uauguaaaaaaauaagcaguuuauu

SEQ ID NO: 1059035 - RNA, 23 nt, Human
uauuacaaaauuagacaaucauc

SEQ ID NO: 1059036 - RNA, 26 nt, Human
uauuacaaaauuagacaaucauccuu

SEQ ID NO: 1059037 - RNA, 22 nt, Human
ucaagccuguaaucccagugcu

SEQ ID NO: 1059038 - RNA, 20 nt, Human
ucaccugaggucaggaguuc

SEQ ID NO: 1059039 - RNA, 25 nt, Human
ucacuugaaccugggaggcagaggu

SEQ ID NO: 1059040 - RNA, 22 nt, Human
ucaugccuguaaucccagcacu

SEQ ID NO: 1059041 - RNA, 21 nt, Human
ucucuacuaaaaauacaaaaa

SEQ ID NO: 1059042 - RNA, 24 nt, Human
ugaaccugggaggcagagguugca

SEQ ID NO: 1059043 - RNA, 18 nt, Human
ugacaaaaccaaauaagc

SEQ ID NO: 1059044 - RNA, 26 nt, Human
ugacugacuuaaguauuuuuaaauau

SEQ ID NO: 1059045 - RNA, 20 nt, Human
ugacuguaaacacaaaauuu

SEQ ID NO: 1059046 - RNA, 22 nt, Human
ugagcacacuuuucacaaacaa

SEQ ID NO: 1059047 - RNA, 23 nt, Human
ugagcccaggaguuugaggccag

SEQ ID NO: 1059048 - RNA, 19 nt, Human
ugagccgagauugugccac

SEQ ID NO: 1059049 - RNA, 20 nt, Human
ugaggcaggagaaucacuug

SEQ ID NO: 1059050 - RNA, 24 nt, Human
ugaggcaggagaaucacuugaacc

SEQ ID NO: 1059051 - RNA, 25 nt, Human
ugaggcaggagaaucacuugaaccu

SEQ ID NO: 1059052 - RNA, 22 nt, Human
ugaggugggaggacugcuugag

SEQ ID NO: 1059053 - RNA, 23 nt, Human
ugaggugggaggacugcuugagu

SEQ ID NO: 1059054 - RNA, 24 nt, Human
ugauuacaccacugcacuccagcc

SEQ ID NO: 1059055 - RNA, 18 nt, Human
ugcaagugucuuuucuuc

SEQ ID NO: 1059056 - RNA, 24 nt, Human
ugcaucaccugaggucaggaguuc

SEQ ID NO: 1059057 - RNA, 21 nt, Human
ugccacacaccuguaauccca

SEQ ID NO: 1059058 - RNA, 22 nt, Human
ugccucaagccuguaaucccag

SEQ ID NO: 1059059 - RNA, 24 nt, Human
ugccucaagccuguaaucccagug

SEQ ID NO: 1059060 - RNA, 22 nt, Human
ugccuguaaucccagcacuuua

SEQ ID NO: 1059061 - RNA, 24 nt, Human
ugccuguaaucccagcacuuuagg

SEQ ID NO: 1059062 - RNA, 24 nt, Human
ugcgggguaaaaaaaaagaaagaa

SEQ ID NO: 1059063 - RNA, 18 nt, Human
ugcuugagcccaggaguu

SEQ ID NO: 1059064 - RNA, 18 nt, Human
uggcaggccgggugcggu

SEQ ID NO: 1059065 - RNA, 18 nt, Human
uggccaacauggugaaau

SEQ ID NO: 1059066 - RNA, 22 nt, Human
uggcucaugccuguaaucccag

SEQ ID NO: 1059067 - RNA, 24 nt, Human
uggcucaugccuguaaucccagca

SEQ ID NO: 1059068 - RNA, 19 nt, Human
ugggaagaacauuguaaua

SEQ ID NO: 1059069 - RNA, 24 nt, Human
ugggaggcagagguugcagugagc

SEQ ID NO: 1059070 - RNA, 22 nt, Human
ugggaggccaagacaggaggau

SEQ ID NO: 1059071 - RNA, 24 nt, Human
ugguaggcugaggcaggagaauca

SEQ ID NO: 1059072 - RNA, 21 nt, Human
ugguauuugagaaaaagguuu

SEQ ID NO: 1059073 - RNA, 24 nt, Human
uggugccacacaccuguaauccca

SEQ ID NO: 1059074 - RNA, 20 nt, Human
uguaaaaaaauaagcaguuu

SEQ ID NO: 1059075 - RNA, 21 nt, Human
uguggagaauuuguuaaaacc

SEQ ID NO: 1059076 - RNA, 21 nt, Human
uuaaaaaacaacauauuacaa

SEQ ID NO: 1059077 - RNA, 23 nt, Human
uuacaccacugcacuccagccug

SEQ ID NO: 1059078 - RNA, 18 nt, Human
uuagcugggcauggugcc

SEQ ID NO: 1059079 - RNA, 19 nt, Human
uuauuuggauaacaaaggg

SEQ ID NO: 1059080 - RNA, 24 nt, Human
uugaaccugggaggcagagguugc

SEQ ID NO: 1059081 - RNA, 22 nt, Human
uugagcccaggaguuugaggcc

SEQ ID NO: 1059082 - RNA, 21 nt, Human
uugaguccaggaguucgagac

SEQ ID NO: 1059083 - RNA, 18 nt, Human
uugcagugagccgagauu

SEQ ID NO: 1059084 - RNA, 19 nt, Human
uugcagugagccgagauug

SEQ ID NO: 1059085 - RNA, 22 nt, Human
uugcagugagccgagauugugc

SEQ ID NO: 1059086 - RNA, 24 nt, Human
uugcuugagcccaggaguuugagg

SEQ ID NO: 1059087 - RNA, 25 nt, Human
uugguaggcugaggcaggagaauca

SEQ ID NO: 1059088 - RNA, 24 nt, Human
uuuaaaccauuaauuuagauaaca

SEQ ID NO: 1059089 - RNA, 23 nt, Human
uuuccaaaagacuaaagagauaa

SEQ ID NO: 1059090 - RNA, 21 nt, Human
uuuucaagaugguagcuuuca

SEQ ID NO: 1059091 - RNA, 21 nt, Human
acugcagccaucagggucauc

SEQ ID NO: 1059092 - RNA, 24 nt, Human
agacugcagccaucagggucauca

SEQ ID NO: 1059093 - RNA, 22 nt, Human
agcuaugguauagacugcagcc

SEQ ID NO: 1059094 - RNA, 20 nt, Human
aggcacuguagacgagacca

SEQ ID NO: 1059095 - RNA, 20 nt, Human
caacaguaggaaccuaggag

SEQ ID NO: 1059096 - RNA, 22 nt, Human
uagcuucauuggaaaggggagc

SEQ ID NO: 1059097 - RNA, 27 nt, Human
uagcuucauuggaaaggggagcuggag

SEQ ID NO: 1059098 - RNA, 23 nt, Human
ucucucaucacaacaguaggaac

SEQ ID NO: 1059099 - RNA, 18 nt, Human
uggaaaggggagcuggag

SEQ ID NO: 1059100 - RNA, 18 nt, Human
agcuugcaaccuccuccg

SEQ ID NO: 1059101 - RNA, 24 nt, Human
agcuugcaaccuccuccgaagccc

SEQ ID NO: 1059102 - RNA, 22 nt, Human
cuugcaaccuccuccgaagccc

SEQ ID NO: 1059103 - RNA, 20 nt, Human
ucgcucucuucuaguuccug

SEQ ID NO: 1059104 - RNA, 18 nt, Human
agagaaggcaauuccugg

SEQ ID NO: 1059105 - RNA, 21 nt, Human
agagaaggcaauuccugguga

SEQ ID NO: 1059106 - RNA, 21 nt, Human
aggagugugugcauguaaaag

SEQ ID NO: 1059107 - RNA, 21 nt, Human
agguuucaccaugagagaagg

SEQ ID NO: 1059108 - RNA, 20 nt, Human
ccaugagagaaggcaauucc

SEQ ID NO: 1059109 - RNA, 19 nt, Human
ggugaugaggggaugugau

SEQ ID NO: 1059110 - RNA, 24 nt, Human
ugagagaaggcaauuccuggugau

SEQ ID NO: 1059111 - RNA, 20 nt, Human
uuuuccagguuucaccauga

SEQ ID NO: 1059112 - RNA, 21 nt, Human
aaaaaaaauuaacaaaaaaga

SEQ ID NO: 1059113 - RNA, 21 nt, Human
aacacaguucuuaaucugccu

SEQ ID NO: 1059114 - RNA, 24 nt, Human
aacacaguucuuaaucugccuccc

SEQ ID NO: 1059115 - RNA, 19 nt, Human
aagcgcgggaccaccaagc

SEQ ID NO: 1059116 - RNA, 21 nt, Human
agcaagcgccugcugagcucc

SEQ ID NO: 1059117 - RNA, 25 nt, Human
agccaaggaguuucaggcugcagug

SEQ ID NO: 1059118 - RNA, 23 nt, Human
agccaggcaugguagcuugugcc

SEQ ID NO: 1059119 - RNA, 24 nt, Human
agcuacuugggaggcugagguggg

SEQ ID NO: 1059120 - RNA, 21 nt, Human
agcuugugccuauaguuccag

SEQ ID NO: 1059121 - RNA, 24 nt, Human
aggaucacuuaagccaaggaguuu

SEQ ID NO: 1059122 - RNA, 19 nt, Human
aggcugaggugggaggauc

SEQ ID NO: 1059123 - RNA, 24 nt, Human
aggcugggugacagagugagacuc

SEQ ID NO: 1059124 - RNA, 20 nt, Human
aggugggaggaucacuuaag

SEQ ID NO: 1059125 - RNA, 24 nt, Human
augccacuacauuccaggcugggu

SEQ ID NO: 1059126 - RNA, 20 nt, Human
caaaaaagaauagccaggca

SEQ ID NO: 1059127 - RNA, 25 nt, Human
caaaaaagaauagccaggcauggua

SEQ ID NO: 1059128 - RNA, 22 nt, Human
cagcaagcgccugcugagcucc

SEQ ID NO: 1059129 - RNA, 24 nt, Human
cagcuacuugggaggcugaggugg

SEQ ID NO: 1059130 - RNA, 23 nt, Human
cauuccaggcugggugacagagu

SEQ ID NO: 1059131 - RNA, 24 nt, Human
cauuccaggcugggugacagagug

SEQ ID NO: 1059132 - RNA, 27 nt, Human
ccaaguuucacuuuggaugcacuccca

SEQ ID NO: 1059133 - RNA, 20 nt, Human
ccacuacauuccaggcuggg

SEQ ID NO: 1059134 - RNA, 21 nt, Human
ccacuacauuccaggcugggu

SEQ ID NO: 1059135 - RNA, 24 nt, Human
ccacuacauuccaggcugggugac

SEQ ID NO: 1059136 - RNA, 21 nt, Human
ccuauaguuccagcuacuugg

SEQ ID NO: 1059137 - RNA, 22 nt, Human
ccuauaguuccagcuacuuggg

SEQ ID NO: 1059138 - RNA, 18 nt, Human
cgggaccaccaagcccug

SEQ ID NO: 1059139 - RNA, 19 nt, Human
cugcaccagccucucaaaa

SEQ ID NO: 1059140 - RNA, 20 nt, Human
cugcugcagcuccggacucc

SEQ ID NO: 1059141 - RNA, 21 nt, Human
cugggugacagagugagacuc

SEQ ID NO: 1059142 - RNA, 18 nt, Human
cuuggaucaggaacacag

SEQ ID NO: 1059143 - RNA, 21 nt, Human
cuuuggaugcacucccaggac

SEQ ID NO: 1059144 - RNA, 20 nt, Human
gagcuccggaaagcgcggga

SEQ ID NO: 1059145 - RNA, 21 nt, Human
gguaagaucaaagagccaaga

SEQ ID NO: 1059146 - RNA, 22 nt, Human
uaaaaaaaauuaacaaaaaaga

SEQ ID NO: 1059147 - RNA, 24 nt, Human
uaacaaaaaagaauagccaggcau

SEQ ID NO: 1059148 - RNA, 24 nt, Human
uagcuugugccuauaguuccagcu

SEQ ID NO: 1059149 - RNA, 24 nt, Human
ucauccaccaucccggaacauuuc

SEQ ID NO: 1059150 - RNA, 19 nt, Human
uccaggcugggugacagag

SEQ ID NO: 1059151 - RNA, 24 nt, Human
uccaggcugggugacagagugaga

SEQ ID NO: 1059152 - RNA, 18 nt, Human
ugaggugggaggaucacu

SEQ ID NO: 1059153 - RNA, 20 nt, Human
ugaggugggaggaucacuua

SEQ ID NO: 1059154 - RNA, 25 nt, Human
ugaggugggaggaucacuuaagcca

SEQ ID NO: 1059155 - RNA, 23 nt, Human
ugccuauaguuccagcuacuugg

SEQ ID NO: 1059156 - RNA, 24 nt, Human
ugccuauaguuccagcuacuuggg

SEQ ID NO: 1059157 - RNA, 19 nt, Human
uggagcucccagaauagca

SEQ ID NO: 1059158 - RNA, 20 nt, Human
ugggaggaucacuuaagcca

SEQ ID NO: 1059159 - RNA, 19 nt, Human
ugggaggcugaggugggag

SEQ ID NO: 1059160 - RNA, 24 nt, Human
ugggaggcugaggugggaggauca

SEQ ID NO: 1059161 - RNA, 23 nt, Human
ugguagcuugugccuauaguucc

SEQ ID NO: 1059162 - RNA, 18 nt, Human
uguggccucugcugcagc

SEQ ID NO: 1059163 - RNA, 23 nt, Human
uucucaggcucuucaaauaacag

SEQ ID NO: 1059164 - RNA, 20 nt, Human
uugaccgguucaagcagcaa

SEQ ID NO: 1059165 - RNA, 25 nt, Human
uugggaggcugaggugggaggauca

SEQ ID NO: 1059166 - RNA, 24 nt, Human
uuuggaugcacucccaggacauuu

SEQ ID NO: 1059167 - RNA, 21 nt, Human
cagagacuuggccgaguccug

SEQ ID NO: 1059168 - RNA, 22 nt, Human
ccuguaggugaccuuggagucc

SEQ ID NO: 1059169 - RNA, 18 nt, Human
gagacuuggccgaguccu

SEQ ID NO: 1059170 - RNA, 19 nt, Human
uccuguaggugaccuugga

SEQ ID NO: 1059171 - RNA, 23 nt, Human
aaagccucuccccauccccaccu

SEQ ID NO: 1059172 - RNA, 25 nt, Human
aagccucuccccauccccaccucag

SEQ ID NO: 1059173 - RNA, 20 nt, Human
agcgggcgggcagcgcgacc

SEQ ID NO: 1059174 - RNA, 21 nt, Human
cauccccaccucaguuuuagg

SEQ ID NO: 1059175 - RNA, 22 nt, Human
ccagaucccuccauggcagauc

SEQ ID NO: 1059176 - RNA, 26 nt, Human
cggccgacgccgagcgggcgggcagc

SEQ ID NO: 1059177 - RNA, 18 nt, Human
cucuccccauccccaccu

SEQ ID NO: 1059178 - RNA, 20 nt, Human
cucuccccauccccaccuca

SEQ ID NO: 1059179 - RNA, 18 nt, Human
gcgacgggcggcguggac

SEQ ID NO: 1059180 - RNA, 22 nt, Human
ggaacaucaggaaaagcuccau

SEQ ID NO: 1059181 - RNA, 21 nt, Human
gggagcuaagggaggaggcca

SEQ ID NO: 1059182 - RNA, 19 nt, Human
gugcacacgucuggaggca

SEQ ID NO: 1059183 - RNA, 21 nt, Human
uggaacaucaggaaaagcucc

SEQ ID NO: 1059184 - RNA, 22 nt, Human
uggagaauaauucaguuggggc

SEQ ID NO: 1059185 - RNA, 27 nt, Human
uggcagauccaagaacagggagcuaag

SEQ ID NO: 1059186 - RNA, 18 nt, Human
ccccggcgucugaugccu

SEQ ID NO: 1059187 - RNA, 22 nt, Human
cgccuccugaauuaacugaccu

SEQ ID NO: 1059188 - RNA, 21 nt, Human
cgucugaugccugcgccuccu

SEQ ID NO: 1059189 - RNA, 30 nt, Human
uaacugaccuccaucaguguaggugacauu

SEQ ID NO: 1059190 - RNA, 21 nt, Human
uccccggcgucugaugccugc

SEQ ID NO: 1059191 - RNA, 19 nt, Human
ugccugcgccuccugaauu

SEQ ID NO: 1059192 - RNA, 24 nt, Human
aaucgcuugaacccaggaggcgga

SEQ ID NO: 1059193 - RNA, 20 nt, Human
acauggugcacucaggcucu

SEQ ID NO: 1059194 - RNA, 20 nt, Human
accuuuguggcugcucuccu

SEQ ID NO: 1059195 - RNA, 22 nt, Human
acugcacuccagccugggugac

SEQ ID NO: 1059196 - RNA, 24 nt, Human
acugcacuccagccugggugacgg

SEQ ID NO: 1059197 - RNA, 26 nt, Human
acugcacuccagccugggugacggag

SEQ ID NO: 1059198 - RNA, 23 nt, Human
agacaagcugaggacacacuccc

SEQ ID NO: 1059199 - RNA, 18 nt, Human
agaguuccagagcguucu

SEQ ID NO: 1059200 - RNA, 22 nt, Human
agaucuugccacugcacuccag

SEQ ID NO: 1059201 - RNA, 24 nt, Human
agccugggugacggagcgagacuc

SEQ ID NO: 1059202 - RNA, 22 nt, Human
agcuuagggcaaagucucacaa

SEQ ID NO: 1059203 - RNA, 19 nt, Human
aggaggcugaggcuggaga

SEQ ID NO: 1059204 - RNA, 24 nt, Human
aggcggagguugcagugagccaag

SEQ ID NO: 1059205 - RNA, 20 nt, Human
aggcucucgagggagggcuc

SEQ ID NO: 1059206 - RNA, 24 nt, Human
aggcugaggcuggagaaucgcuug

SEQ ID NO: 1059207 - RNA, 23 nt, Human
aggcuggagaaucgcuugaaccc

SEQ ID NO: 1059208 - RNA, 24 nt, Human
aucuugccacugcacuccagccug

SEQ ID NO: 1059209 - RNA, 19 nt, Human
caccagcaagggcuggaag

SEQ ID NO: 1059210 - RNA, 22 nt, Human
cacuccagccugggugacggag

SEQ ID NO: 1059211 - RNA, 23 nt, Human
cacuccagccugggugacggagc

SEQ ID NO: 1059212 - RNA, 24 nt, Human
cacuccagccugggugacggagcg

SEQ ID NO: 1059213 - RNA, 19 nt, Human
cacugcacuccagccuggg

SEQ ID NO: 1059214 - RNA, 19 nt, Human
cacugcacuccagccuggg

SEQ ID NO: 1059215 - RNA, 22 nt, Human
cacugcacuccagccuggguga

SEQ ID NO: 1059216 - RNA, 23 nt, Human
cacugcacuccagccugggugac

SEQ ID NO: 1059217 - RNA, 23 nt, Human
cacugcacuccagccugggugac

SEQ ID NO: 1059218 - RNA, 24 nt, Human
cacugcacuccagccugggugacg

SEQ ID NO: 1059219 - RNA, 20 nt, Human
cacugugcagggcuuugggu

SEQ ID NO: 1059220 - RNA, 20 nt, Human
cagaauccuccuguaauucc

SEQ ID NO: 1059221 - RNA, 24 nt, Human
cagacaagcugaggacacacuccc

SEQ ID NO: 1059222 - RNA, 20 nt, Human
cagagccuggguuugcuucc

SEQ ID NO: 1059223 - RNA, 24 nt, Human
cagagcguucugugaagccagagg

SEQ ID NO: 1059224 - RNA, 23 nt, Human
caggcccugugaggagaagcagg

SEQ ID NO: 1059225 - RNA, 22 nt, Human
ccacaagacauggugcacucag

SEQ ID NO: 1059226 - RNA, 20 nt, Human
ccacugcacuccagccuggg

SEQ ID NO: 1059227 - RNA, 20 nt, Human
ccacugcacuccagccuggg

SEQ ID NO: 1059228 - RNA, 21 nt, Human
ccacugcacuccagccugggu

SEQ ID NO: 1059229 - RNA, 21 nt, Human
ccacugcacuccagccugggu

SEQ ID NO: 1059230 - RNA, 23 nt, Human
ccacugcacuccagccuggguga

SEQ ID NO: 1059231 - RNA, 24 nt, Human
ccacugcacuccagccugggugac

SEQ ID NO: 1059232 - RNA, 22 nt, Human
ccaggaggcggagguugcagug

SEQ ID NO: 1059233 - RNA, 27 nt, Human
cccgauggcugcgccuggcccgucacc

SEQ ID NO: 1059234 - RNA, 23 nt, Human
ccuccuccagacaagcugaggac

SEQ ID NO: 1059235 - RNA, 23 nt, Human
ccucuggguuggcugaaugaccu

SEQ ID NO: 1059236 - RNA, 18 nt, Human
ccugcggaucuugggcuu

SEQ ID NO: 1059237 - RNA, 22 nt, Human
ccugggugacggagcgagacuc

SEQ ID NO: 1059238 - RNA, 19 nt, Human
ccuggugaccgaucuccuu

SEQ ID NO: 1059239 - RNA, 21 nt, Human
ccuguaauuccagcuacucag

SEQ ID NO: 1059240 - RNA, 22 nt, Human
ccuguaauuccagcuacucagg

SEQ ID NO: 1059241 - RNA, 21 nt, Human
cgcccugcacuucuugaggac

SEQ ID NO: 1059242 - RNA, 21 nt, Human
cgccuggcccgucaccugggc

SEQ ID NO: 1059243 - RNA, 21 nt, Human
cgugugugucuuucuugaccu

SEQ ID NO: 1059244 - RNA, 20 nt, Human
cuuuguggcugcucuccugg

SEQ ID NO: 1059245 - RNA, 19 nt, Human
gaaggagcacagagccugg

SEQ ID NO: 1059246 - RNA, 21 nt, Human
gaccuuuguggcugcucuccu

SEQ ID NO: 1059247 - RNA, 18 nt, Human
gagcacagagccuggguu

SEQ ID NO: 1059248 - RNA, 18 nt, Human
gaggcugaggcuggagaa

SEQ ID NO: 1059249 - RNA, 18 nt, Human
gagguugcagugagccaa

SEQ ID NO: 1059250 - RNA, 22 nt, Human
gagguugcagugagccaagauc

SEQ ID NO: 1059251 - RNA, 23 nt, Human
gcaaagucucacaauucucuaga

SEQ ID NO: 1059252 - RNA, 27 nt, Human
gcaccuccaagagcucaggauacaaua

SEQ ID NO: 1059253 - RNA, 24 nt, Human
gcacuccagccugggugacggagc

SEQ ID NO: 1059254 - RNA, 23 nt, Human
gcaggacagagguguucuccuuc

SEQ ID NO: 1059255 - RNA, 20 nt, Human
gcaggccuccuccagacaag

SEQ ID NO: 1059256 - RNA, 23 nt, Human
gcagggcuuuggguuggagcugg

SEQ ID NO: 1059257 - RNA, 19 nt, Human
gccacugcacuccagccug

SEQ ID NO: 1059258 - RNA, 24 nt, Human
gccacugcacuccagccuggguga

SEQ ID NO: 1059259 - RNA, 18 nt, Human
gcuuuggguuggagcugg

SEQ ID NO: 1059260 - RNA, 19 nt, Human
ggacagggucuacauccuc

SEQ ID NO: 1059261 - RNA, 22 nt, Human
ggaggcggagguugcagugagc

SEQ ID NO: 1059262 - RNA, 18 nt, Human
ggagguugcagugagcca

SEQ ID NO: 1059263 - RNA, 20 nt, Human
ggagguugcagugagccaag

SEQ ID NO: 1059264 - RNA, 22 nt, Human
gggagcacuuggcagcuuaggg

SEQ ID NO: 1059265 - RNA, 20 nt, Human
gguagcaucugcaccagcaa

SEQ ID NO: 1059266 - RNA, 21 nt, Human
ggugaggcacugugcagggcu

SEQ ID NO: 1059267 - RNA, 26 nt, Human
uaucgaugauguucuccuccccauuc

SEQ ID NO: 1059268 - RNA, 23 nt, Human
uccagccugggugacggagcgag

SEQ ID NO: 1059269 - RNA, 24 nt, Human
uccagccugggugacggagcgaga

SEQ ID NO: 1059270 - RNA, 19 nt, Human
uccgugugugucuuucuug

SEQ ID NO: 1059271 - RNA, 20 nt, Human
uccuccagacaagcugagga

SEQ ID NO: 1059272 - RNA, 22 nt, Human
uccugggcaccuccaagagcuc

SEQ ID NO: 1059273 - RNA, 24 nt, Human
ucgcuugaacccaggaggcggagg

SEQ ID NO: 1059274 - RNA, 20 nt, Human
ucugcugcaggacagagguu

SEQ ID NO: 1059275 - RNA, 22 nt, Human
ugacaagcuugugggguagcau

SEQ ID NO: 1059276 - RNA, 19 nt, Human
ugaggagaagcaggguucc

SEQ ID NO: 1059277 - RNA, 19 nt, Human
ugaggagaagcaggguucc

SEQ ID NO: 1059278 - RNA, 23 nt, Human
ugaggagagaccaggagaaggga

SEQ ID NO: 1059279 - RNA, 24 nt, Human
ugaggcuggagaaucgcuugaacc

SEQ ID NO: 1059280 - RNA, 24 nt, Human
ugggcuucuucaccggccgcagau

SEQ ID NO: 1059281 - RNA, 18 nt, Human
uguuuuauucuuuuguaa

SEQ ID NO: 1059282 - RNA, 19 nt, Human
uucucuagaauguaucugg

SEQ ID NO: 1059283 - RNA, 24 nt, Human
uugaacccaggaggcggagguugc

SEQ ID NO: 1059284 - RNA, 18 nt, Human
uugaggagagaccaggag

SEQ ID NO: 1059285 - RNA, 23 nt, Human
uugaggagagaccaggagaaggg

SEQ ID NO: 1059286 - RNA, 22 nt, Human
uugcagugagccaagaucuugc

SEQ ID NO: 1059287 - RNA, 20 nt, Human
uuugaggagagaccaggaga

SEQ ID NO: 1059288 - RNA, 22 nt, Human
aaaccccaucucuacuaaaaaa

SEQ ID NO: 1059289 - RNA, 19 nt, Human
aacccugucucaaaaaaaa

SEQ ID NO: 1059290 - RNA, 24 nt, Human
aaccgauugaaccugggaggcgga

SEQ ID NO: 1059291 - RNA, 20 nt, Human
aacuacaugcuacuccaucu

SEQ ID NO: 1059292 - RNA, 23 nt, Human
aagagcaaaacccugucucaaaa

SEQ ID NO: 1059293 - RNA, 21 nt, Human
aauaucuacaucauccucuau

SEQ ID NO: 1059294 - RNA, 19 nt, Human
aauaugagaaaccccaucu

SEQ ID NO: 1059295 - RNA, 23 nt, Human
aauuguugggucaaauaggucug

SEQ ID NO: 1059296 - RNA, 18 nt, Human
accccaucucuacuaaaa

SEQ ID NO: 1059297 - RNA, 24 nt, Human
acccuauugcccaggcuggaguag

SEQ ID NO: 1059298 - RNA, 24 nt, Human
accugaggucaggaguucaagacc

SEQ ID NO: 1059299 - RNA, 23 nt, Human
agaucaccugaggucaggaguuc

SEQ ID NO: 1059300 - RNA, 24 nt, Human
agcaguuugggaggccgagguggg

SEQ ID NO: 1059301 - RNA, 23 nt, Human
agccaggcgugguggcgcaugcc

SEQ ID NO: 1059302 - RNA, 21 nt, Human
agccaggugugguggcucacg

SEQ ID NO: 1059303 - RNA, 23 nt, Human
agcuuuugacuccuggguucggg

SEQ ID NO: 1059304 - RNA, 23 nt, Human
aggcacgcaccacgacacccagc

SEQ ID NO: 1059305 - RNA, 22 nt, Human
aggcaggaaaaccgauugaacc

SEQ ID NO: 1059306 - RNA, 24 nt, Human
aggcaggaaaaccgauugaaccug

SEQ ID NO: 1059307 - RNA, 21 nt, Human
aggccgaggugggcagaucac

SEQ ID NO: 1059308 - RNA, 20 nt, Human
aggcggagguuguggugagc

SEQ ID NO: 1059309 - RNA, 24 nt, Human
aggcgugguggcgcaugccuguaa

SEQ ID NO: 1059310 - RNA, 22 nt, Human
aggcugaggcaggaaaaccgau

SEQ ID NO: 1059311 - RNA, 24 nt, Human
aggguagccaggugugguggcuca

SEQ ID NO: 1059312 - RNA, 22 nt, Human
aggugggcagaucaccugaggu

SEQ ID NO: 1059313 - RNA, 26 nt, Human
aggugggcagaucaccugaggucagg

SEQ ID NO: 1059314 - RNA, 24 nt, Human
aggugugguggcucacgccuguaa

SEQ ID NO: 1059315 - RNA, 23 nt, Human
aguaccuaucuccccauucaggc

SEQ ID NO: 1059316 - RNA, 18 nt, Human
aguagcuaggauuauagg

SEQ ID NO: 1059317 - RNA, 19 nt, Human
aucacaguagcucacugca

SEQ ID NO: 1059318 - RNA, 24 nt, Human
aucacgcuauugcacuccaggcug

SEQ ID NO: 1059319 - RNA, 22 nt, Human
aucauccucuaucaguauuuuc

SEQ ID NO: 1059320 - RNA, 19 nt, Human
auccuccauaaagacuguc

SEQ ID NO: 1059321 - RNA, 18 nt, Human
auugcacuccaggcuggg

SEQ ID NO: 1059322 - RNA, 23 nt, Human
auugcacuccaggcugggcaaca

SEQ ID NO: 1059323 - RNA, 20 nt, Human
caagugauccucuugccuca

SEQ ID NO: 1059324 - RNA, 22 nt, Human
caagugauccucuugccucagc

SEQ ID NO: 1059325 - RNA, 27 nt, Human
caagugauccucuugccucagccuccu

SEQ ID NO: 1059326 - RNA, 21 nt, Human
cacaguagcacaccgagggaa

SEQ ID NO: 1059327 - RNA, 24 nt, Human
caccuacuugggaggcugaggcag

SEQ ID NO: 1059328 - RNA, 23 nt, Human
caccugaggucaggaguucaaga

SEQ ID NO: 1059329 - RNA, 24 nt, Human
caccugaguagcuaggauuauagg

SEQ ID NO: 1059330 - RNA, 24 nt, Human
cacgccuguaaucccagcaguuug

SEQ ID NO: 1059331 - RNA, 24 nt, Human
cacuccaggcugggcaacaagagc

SEQ ID NO: 1059332 - RNA, 20 nt, Human
cagagacaggaucuuacccu

SEQ ID NO: 1059333 - RNA, 24 nt, Human
cagaucaccugaggucaggaguuc

SEQ ID NO: 1059334 - RNA, 27 nt, Human
cagaucaccugaggucaggaguucaag

SEQ ID NO: 1059335 - RNA, 21 nt, Human
cagcaguuugggaggccgagg

SEQ ID NO: 1059336 - RNA, 24 nt, Human
cagcaguuugggaggccgaggugg

SEQ ID NO: 1059337 - RNA, 24 nt, Human
caggaucuuacccuauugcccagg

SEQ ID NO: 1059338 - RNA, 21 nt, Human
caucauguacauuuaucucuc

SEQ ID NO: 1059339 - RNA, 24 nt, Human
caugccuguaaucccaccuacuug

SEQ ID NO: 1059340 - RNA, 28 nt, Human
ccacacaaaauucaaguaccuaucuccc

SEQ ID NO: 1059341 - RNA, 18 nt, Human
cccagcccaauuucaugu

SEQ ID NO: 1059342 - RNA, 21 nt, Human
cccaggcuggaguagagaggc

SEQ ID NO: 1059343 - RNA, 23 nt, Human
cccaggcuggaguagagaggcau

SEQ ID NO: 1059344 - RNA, 23 nt, Human
cccaucucuacuaaaaaaauaca

SEQ ID NO: 1059345 - RNA, 25 nt, Human
cccugucucaaaaaaaaaaaaauau

SEQ ID NO: 1059346 - RNA, 24 nt, Human
ccgauugaaccugggaggcggagg

SEQ ID NO: 1059347 - RNA, 19 nt, Human
ccucaaacggcagcaaaac

SEQ ID NO: 1059348 - RNA, 20 nt, Human
ccuccuaaagcacugggauu

SEQ ID NO: 1059349 - RNA, 21 nt, Human
ccucucaccuccgccaccuga

SEQ ID NO: 1059350 - RNA, 24 nt, Human
ccucuugccucagccuccuaaagc

SEQ ID NO: 1059351 - RNA, 23 nt, Human
ccugaccaauaugagaaacccca

SEQ ID NO: 1059352 - RNA, 19 nt, Human
ccugaguagcuaggauuau

SEQ ID NO: 1059353 - RNA, 24 nt, Human
ccugaguagcuaggauuauaggca

SEQ ID NO: 1059354 - RNA, 18 nt, Human
ccuggccucaagugaucc

SEQ ID NO: 1059355 - RNA, 18 nt, Human
ccuggccucaagugaucc

SEQ ID NO: 1059356 - RNA, 20 nt, Human
ccuggccucaagugauccuc

SEQ ID NO: 1059357 - RNA, 22 nt, Human
ccuggccucaagugauccucuu

SEQ ID NO: 1059358 - RNA, 19 nt, Human
ccugggaggcggagguugu

SEQ ID NO: 1059359 - RNA, 22 nt, Human
ccuguaaucccaccuacuuggg

SEQ ID NO: 1059360 - RNA, 20 nt, Human
cgaggugggcagaucaccug

SEQ ID NO: 1059361 - RNA, 24 nt, Human
cgaggugggcagaucaccugaggu

SEQ ID NO: 1059362 - RNA, 26 nt, Human
cgaggugggcagaucaccugagguca

SEQ ID NO: 1059363 - RNA, 23 nt, Human
cgauugaaccugggaggcggagg

SEQ ID NO: 1059364 - RNA, 24 nt, Human
cgccuguaaucccagcaguuuggg

SEQ ID NO: 1059365 - RNA, 27 nt, Human
cgcuacauuacccaggcuggucuggaa

SEQ ID NO: 1059366 - RNA, 24 nt, Human
cuauugcacuccaggcugggcaac

SEQ ID NO: 1059367 - RNA, 21 nt, Human
cucacgccuguaaucccagca

SEQ ID NO: 1059368 - RNA, 21 nt, Human
cucacgccuguaaucccagca

SEQ ID NO: 1059369 - RNA, 21 nt, Human
cucacugcagcuuuugacucc

SEQ ID NO: 1059370 - RNA, 24 nt, Human
cucacugcagcuuuugacuccugg

SEQ ID NO: 1059371 - RNA, 21 nt, Human
cucaucauguacauuuaucuc

SEQ ID NO: 1059372 - RNA, 18 nt, Human
cuccuuucuccucaaacg

SEQ ID NO: 1059373 - RNA, 24 nt, Human
gaguagcuaggauuauaggcacgc

SEQ ID NO: 1059374 - RNA, 24 nt, Human
gagugagccaucgugcccagccca

SEQ ID NO: 1059375 - RNA, 18 nt, Human
gaguuuuacuuuuuuccc

SEQ ID NO: 1059376 - RNA, 18 nt, Human
gauaacaggagugagcca

SEQ ID NO: 1059377 - RNA, 23 nt, Human
gaucaccugaggucaggaguuca

SEQ ID NO: 1059378 - RNA, 24 nt, Human
gaucaccugaggucaggaguucaa

SEQ ID NO: 1059379 - RNA, 19 nt, Human
gcacgcaccacgacaccca

SEQ ID NO: 1059380 - RNA, 21 nt, Human
gcagcuuuugacuccuggguu

SEQ ID NO: 1059381 - RNA, 18 nt, Human
gcaugaucacaguagcuc

SEQ ID NO: 1059382 - RNA, 20 nt, Human
gccuguaaucccaccuacuu

SEQ ID NO: 1059383 - RNA, 24 nt, Human
gcuauugcacuccaggcugggcaa

SEQ ID NO: 1059384 - RNA, 19 nt, Human
gcuggaguagagaggcaug

SEQ ID NO: 1059385 - RNA, 23 nt, Human
gcuggucuggaacuccuggccuc

SEQ ID NO: 1059386 - RNA, 21 nt, Human
ggaaaaccgauugaaccuggg

SEQ ID NO: 1059387 - RNA, 22 nt, Human
ggagguuguggugagcugagau

SEQ ID NO: 1059388 - RNA, 23 nt, Human
ggagguuguggugagcugagauc

SEQ ID NO: 1059389 - RNA, 24 nt, Human
ggagguuguggugagcugagauca

SEQ ID NO: 1059390 - RNA, 25 nt, Human
ggcagaucaccugaggucaggaguu

SEQ ID NO: 1059391 - RNA, 22 nt, Human
ggccucaagugauccucuugcc

SEQ ID NO: 1059392 - RNA, 24 nt, Human
ggccucaagugauccucuugccuc

SEQ ID NO: 1059393 - RNA, 21 nt, Human
ggcucacgccuguaaucccag

SEQ ID NO: 1059394 - RNA, 24 nt, Human
ggcuggucuggaacuccuggccuc

SEQ ID NO: 1059395 - RNA, 22 nt, Human
gguagccaggugugguggcuca

SEQ ID NO: 1059396 - RNA, 19 nt, Human
gugagcaccucaccuucuc

SEQ ID NO: 1059397 - RNA, 23 nt, Human
gugauccucuugccucagccucc

SEQ ID NO: 1059398 - RNA, 21 nt, Human
gugcccagcccaauuucaugu

SEQ ID NO: 1059399 - RNA, 23 nt, Human
guggcucacgccuguaaucccag

SEQ ID NO: 1059400 - RNA, 21 nt, Human
guuugggaggccgaggugggc

SEQ ID NO: 1059401 - RNA, 19 nt, Human
uaaagcacugggauaacag

SEQ ID NO: 1059402 - RNA, 24 nt, Human
uaaagcacugggauaacaggagug

SEQ ID NO: 1059403 - RNA, 21 nt, Human
uaauaucuacaucauccucua

SEQ ID NO: 1059404 - RNA, 18 nt, Human
uacaucuuguggaguuuu

SEQ ID NO: 1059405 - RNA, 24 nt, Human
uacauuacccaggcuggucuggaa

SEQ ID NO: 1059406 - RNA, 22 nt, Human
uacccuauugcccaggcuggag

SEQ ID NO: 1059407 - RNA, 18 nt, Human
uagagacagggucucgcu

SEQ ID NO: 1059408 - RNA, 21 nt, Human
uagagaggcaugaucacagua

SEQ ID NO: 1059409 - RNA, 24 nt, Human
uagccaggugugguggcucacgcc

SEQ ID NO: 1059410 - RNA, 23 nt, Human
uagcucacugcagcuuuugacuc

SEQ ID NO: 1059411 - RNA, 21 nt, Human
uaggauuauaggcacgcacca

SEQ ID NO: 1059412 - RNA, 24 nt, Human
uauugcacuccaggcugggcaaca

SEQ ID NO: 1059413 - RNA, 23 nt, Human
ucaccugaggucaggaguucaag

SEQ ID NO: 1059414 - RNA, 24 nt, Human
ucacugcagcuuuugacuccuggg

SEQ ID NO: 1059415 - RNA, 26 nt, Human
ucacugcagcuuuugacuccuggguc

SEQ ID NO: 1059416 - RNA, 24 nt, Human
uccauccacaaauguuguaugcau

SEQ ID NO: 1059417 - RNA, 25 nt, Human
ucuauaaugaacauuuagcuuguuu

SEQ ID NO: 1059418 - RNA, 27 nt, Human
ucuccuuucuccucaaacggcagcaaa

SEQ ID NO: 1059419 - RNA, 26 nt, Human
ucucgcuacauuacccaggcuggucu

SEQ ID NO: 1059420 - RNA, 27 nt, Human
ucucgcuacauuacccaggcuggucug

SEQ ID NO: 1059421 - RNA, 24 nt, Human
ucucuacuaaaaaaauacaaaauu

SEQ ID NO: 1059422 - RNA, 20 nt, Human
ucucuuauaaaucaagugag

SEQ ID NO: 1059423 - RNA, 21 nt, Human
ucuguauuuucuccuuucucc

SEQ ID NO: 1059424 - RNA, 22 nt, Human
ucuuacccuauugcccaggcug

SEQ ID NO: 1059425 - RNA, 23 nt, Human
ucuuacccuauugcccaggcugg

SEQ ID NO: 1059426 - RNA, 24 nt, Human
ucuuacccuauugcccaggcugga

SEQ ID NO: 1059427 - RNA, 22 nt, Human
ugaaccugggaggcggagguug

SEQ ID NO: 1059428 - RNA, 24 nt, Human
ugacuccuggguucgggcaauccu

SEQ ID NO: 1059429 - RNA, 24 nt, Human
ugagaucacgcuauugcacuccag

SEQ ID NO: 1059430 - RNA, 22 nt, Human
ugagcugagaucacgcuauugc

SEQ ID NO: 1059431 - RNA, 20 nt, Human
ugaggcaggaaaaccgauug

SEQ ID NO: 1059432 - RNA, 24 nt, Human
ugaggcaggaaaaccgauugaacc

SEQ ID NO: 1059433 - RNA, 25 nt, Human
ugaggcaggaaaaccgauugaaccu

SEQ ID NO: 1059434 - RNA, 22 nt, Human
ugcacuccaggcugggcaacaa

SEQ ID NO: 1059435 - RNA, 25 nt, Human
ugcacuccaggcugggcaacaagag

SEQ ID NO: 1059436 - RNA, 20 nt, Human
ugcagcuuuugacuccuggg

SEQ ID NO: 1059437 - RNA, 21 nt, Human
ugcauacauaagcaacauaua

SEQ ID NO: 1059438 - RNA, 26 nt, Human
ugcauacauaagcaacauauaaauau

SEQ ID NO: 1059439 - RNA, 24 nt, Human
ugcauuuauaaaucugauggauuc

SEQ ID NO: 1059440 - RNA, 23 nt, Human
ugcccaggcuggaguagagaggc

SEQ ID NO: 1059441 - RNA, 24 nt, Human
ugcccaggcuggaguagagaggca

SEQ ID NO: 1059442 - RNA, 24 nt, Human
ugccucagccuccuaaagcacugg

SEQ ID NO: 1059443 - RNA, 23 nt, Human
ugccuguaaucccaccuacuugg

SEQ ID NO: 1059444 - RNA, 24 nt, Human
ugccuguaaucccaccuacuuggg

SEQ ID NO: 1059445 - RNA, 18 nt, Human
uggccucaagugauccuc

SEQ ID NO: 1059446 - RNA, 19 nt, Human
uggccucaagugauccucu

SEQ ID NO: 1059447 - RNA, 24 nt, Human
uggccucaagugauccucuugccu

SEQ ID NO: 1059448 - RNA, 21 nt, Human
uggcgcaugccuguaauccca

SEQ ID NO: 1059449 - RNA, 22 nt, Human
uggcucacgccuguaaucccag

SEQ ID NO: 1059450 - RNA, 24 nt, Human
uggcucacgccuguaaucccagca

SEQ ID NO: 1059451 - RNA, 19 nt, Human
ugggaggccgaggugggca

SEQ ID NO: 1059452 - RNA, 20 nt, Human
ugggaggccgaggugggcag

SEQ ID NO: 1059453 - RNA, 24 nt, Human
ugggaggccgaggugggcagauca

SEQ ID NO: 1059454 - RNA, 24 nt, Human
ugggaggcggagguuguggugagc

SEQ ID NO: 1059455 - RNA, 18 nt, Human
ugggaggcugaggcagga

SEQ ID NO: 1059456 - RNA, 24 nt, Human
ugggaggcugaggcaggaaaaccg

SEQ ID NO: 1059457 - RNA, 21 nt, Human
ugggauaacaggagugagcca

SEQ ID NO: 1059458 - RNA, 24 nt, Human
ugggcagaucaccugaggucagga

SEQ ID NO: 1059459 - RNA, 24 nt, Human
ugguggcgcaugccuguaauccca

SEQ ID NO: 1059460 - RNA, 24 nt, Human
ugguggcucacgccuguaauccca

SEQ ID NO: 1059461 - RNA, 18 nt, Human
uguaaucccaccuacuug

SEQ ID NO: 1059462 - RNA, 25 nt, Human
uguaugcauacauaagcaacauaua

SEQ ID NO: 1059463 - RNA, 25 nt, Human
uguccuugucccucaguuugucuca

SEQ ID NO: 1059464 - RNA, 25 nt, Human
uguggaguuuuacuuuuuuccccaa

SEQ ID NO: 1059465 - RNA, 24 nt, Human
uguucuacaucuuguggaguuuua

SEQ ID NO: 1059466 - RNA, 24 nt, Human
uuacccuauugcccaggcuggagu

SEQ ID NO: 1059467 - RNA, 24 nt, Human
uugaaccugggaggcggagguugu

SEQ ID NO: 1059468 - RNA, 18 nt, Human
uugacuccuggguucggg

SEQ ID NO: 1059469 - RNA, 25 nt, Human
uugggaggccgaggugggcagauca

SEQ ID NO: 1059470 - RNA, 24 nt, Human
uuguagagacagggucucgcuaca

SEQ ID NO: 1059471 - RNA, 21 nt, Human
uuguggugagcugagaucacg

SEQ ID NO: 1059472 - RNA, 23 nt, Human
cccccaccuacuccagcugggag

SEQ ID NO: 1059473 - RNA, 18 nt, Human
cucccccaccuacuccag

SEQ ID NO: 1059474 - RNA, 19 nt, Human
aaagggacugggguccugu

SEQ ID NO: 1059475 - RNA, 23 nt, Human
agcaaguggcaggaaccaugggg

SEQ ID NO: 1059476 - RNA, 23 nt, Human
aggcgggacccagcagaagcccg

SEQ ID NO: 1059477 - RNA, 23 nt, Human
aguugaaaguucacaguaauaug

SEQ ID NO: 1059478 - RNA, 18 nt, Human
cagaagcccgcgaguccc

SEQ ID NO: 1059479 - RNA, 23 nt, Human
cccauccugccccgcgagcucca

SEQ ID NO: 1059480 - RNA, 23 nt, Human
cccuuggcugaggggaaagggac

SEQ ID NO: 1059481 - RNA, 22 nt, Human
ccgugccucaucaugacccgca

SEQ ID NO: 1059482 - RNA, 21 nt, Human
ccuaaccccccacguccgugc

SEQ ID NO: 1059483 - RNA, 18 nt, Human
ccuuggcugaggggaaag

SEQ ID NO: 1059484 - RNA, 24 nt, Human
cgccgggaugggccugugggccgg

SEQ ID NO: 1059485 - RNA, 22 nt, Human
cgcuaugguuacaugccccgcc

SEQ ID NO: 1059486 - RNA, 18 nt, Human
cgggaugggccugugggc

SEQ ID NO: 1059487 - RNA, 23 nt, Human
cugaggggaaagggacugggguc

SEQ ID NO: 1059488 - RNA, 22 nt, Human
cugcccgggccagccuccggcc

SEQ ID NO: 1059489 - RNA, 20 nt, Human
gauaguaguugaaaguucac

SEQ ID NO: 1059490 - RNA, 18 nt, Human
ggccugggggccgaaguu

SEQ ID NO: 1059491 - RNA, 20 nt, Human
guaauauggaaaagguauac

SEQ ID NO: 1059492 - RNA, 23 nt, Human
gucccuggcugccaaggccuggg

SEQ ID NO: 1059493 - RNA, 19 nt, Human
gugcucucugucgcuccag

SEQ ID NO: 1059494 - RNA, 19 nt, Human
guggcaggaaccaugggga

SEQ ID NO: 1059495 - RNA, 24 nt, Human
uaauauggaaaagguauacauuuu

SEQ ID NO: 1059496 - RNA, 23 nt, Human
ucacugcccgggccagccuccgg

SEQ ID NO: 1059497 - RNA, 19 nt, Human
ucccuggcugccaaggccu

SEQ ID NO: 1059498 - RNA, 21 nt, Human
uccggccccuguaagugcccc

SEQ ID NO: 1059499 - RNA, 22 nt, Human
ugccaaggccugggggccgaag

SEQ ID NO: 1059500 - RNA, 26 nt, Human
ugccccauccugccccgcgagcucca

SEQ ID NO: 1059501 - RNA, 23 nt, Human
caaagguuuucagggugagguuu

SEQ ID NO: 1059502 - RNA, 22 nt, Human
ccuuucacacaccaaaucucag

SEQ ID NO: 1059503 - RNA, 27 nt, Human
uggaaacaaugaaaaaugugaaacucc

SEQ ID NO: 1059504 - RNA, 25 nt, Human
uggaaccuuucacacaccaaaucuc

SEQ ID NO: 1059505 - RNA, 23 nt, Human
uguaaagaaaacauuuuuuuuuc

SEQ ID NO: 1059506 - RNA, 18 nt, Human
uuuguuguaaagaaaaca

SEQ ID NO: 1059507 - RNA, 24 nt, Human
aaacucaguuugcaaauuuccugc

SEQ ID NO: 1059508 - RNA, 20 nt, Human
acaggcaaaggcccagcaca

SEQ ID NO: 1059509 - RNA, 24 nt, Human
accaaagccacagggacacaacug

SEQ ID NO: 1059510 - RNA, 21 nt, Human
acccgaggcagcccauacccc

SEQ ID NO: 1059511 - RNA, 21 nt, Human
acccucugcugauccuaacuu

SEQ ID NO: 1059512 - RNA, 22 nt, Human
accuacaucacagccgcagcac

SEQ ID NO: 1059513 - RNA, 24 nt, Human
agacagggauugggagacaugcag

SEQ ID NO: 1059514 - RNA, 21 nt, Human
agcacaauggccggaggcccu

SEQ ID NO: 1059515 - RNA, 22 nt, Human
aggcagaagcuguuagagacuc

SEQ ID NO: 1059516 - RNA, 18 nt, Human
aggcgcaccaaagccaca

SEQ ID NO: 1059517 - RNA, 20 nt, Human
agguagcccaguggcuggga

SEQ ID NO: 1059518 - RNA, 22 nt, Human
aguucacauguuucacuccuuc

SEQ ID NO: 1059519 - RNA, 19 nt, Human
aucugccagggcccuccuc

SEQ ID NO: 1059520 - RNA, 24 nt, Human
auucuguuuauaggaagucuucca

SEQ ID NO: 1059521 - RNA, 23 nt, Human
caacccgaggcagcccauacccc

SEQ ID NO: 1059522 - RNA, 19 nt, Human
caagagggagucuccucgc

SEQ ID NO: 1059523 - RNA, 26 nt, Human
caauaauaacucacaaagcugucaag

SEQ ID NO: 1059524 - RNA, 19 nt, Human
cacacaggcgcaccaaagc

SEQ ID NO: 1059525 - RNA, 21 nt, Human
caccuggaacagaagcaauag

SEQ ID NO: 1059526 - RNA, 19 nt, Human
cagaagcaauagccgccac

SEQ ID NO: 1059527 - RNA, 19 nt, Human
cagcaccuggaacagaagc

SEQ ID NO: 1059528 - RNA, 21 nt, Human
cagcccauaccccagaaacag

SEQ ID NO: 1059529 - RNA, 24 nt, Human
cagcccauaccccagaaacagccu

SEQ ID NO: 1059530 - RNA, 21 nt, Human
cagccugucagaaguugccag

SEQ ID NO: 1059531 - RNA, 19 nt, Human
caggaggcuggggacaugc

SEQ ID NO: 1059532 - RNA, 19 nt, Human
caggagguagcccaguggc

SEQ ID NO: 1059533 - RNA, 20 nt, Human
caggcugcgaaggagacuga

SEQ ID NO: 1059534 - RNA, 25 nt, Human
caucacagccgcagcacacaauucc

SEQ ID NO: 1059535 - RNA, 23 nt, Human
cauccucaaucuaacgcuggaaa

SEQ ID NO: 1059536 - RNA, 19 nt, Human
ccaaagccacagggacaca

SEQ ID NO: 1059537 - RNA, 22 nt, Human
ccagggcccuccucuacccucu

SEQ ID NO: 1059538 - RNA, 19 nt, Human
cccauaucucagcugggaa

SEQ ID NO: 1059539 - RNA, 20 nt, Human
ccccacaucugccagggccc

SEQ ID NO: 1059540 - RNA, 23 nt, Human
cccucgcacccacaccugucuca

SEQ ID NO: 1059541 - RNA, 22 nt, Human
ccggcggcuggggugaaagccg

SEQ ID NO: 1059542 - RNA, 22 nt, Human
ccuaacuuguuaaacucaguuu

SEQ ID NO: 1059543 - RNA, 18 nt, Human
ccucccuaccucauccuc

SEQ ID NO: 1059544 - RNA, 24 nt, Human
ccuggacagaugcccgcgcggggg

SEQ ID NO: 1059545 - RNA, 24 nt, Human
cgacaaggcccuggacagaugccc

SEQ ID NO: 1059546 - RNA, 24 nt, Human
cgaggcagcccauaccccagaaac

SEQ ID NO: 1059547 - RNA, 22 nt, Human
cgcaccaaagccacagggacac

SEQ ID NO: 1059548 - RNA, 21 nt, Human
cgcagcacacaauuccaggaa

SEQ ID NO: 1059549 - RNA, 18 nt, Human
cucacaccucggucccaa

SEQ ID NO: 1059550 - RNA, 19 nt, Human
cuccagguggagggagaaa

SEQ ID NO: 1059551 - RNA, 21 nt, Human
cuccucugacucuuggaaucc

SEQ ID NO: 1059552 - RNA, 18 nt, Human
cugccaggagguagccca

SEQ ID NO: 1059553 - RNA, 30 nt, Human
cuggaagucccuccaccuggggucacugag

SEQ ID NO: 1059554 - RNA, 23 nt, Human
cuuccauccugcaccagcagcug

SEQ ID NO: 1059555 - RNA, 25 nt, Human
cuucuggccuucauaccaacccauu

SEQ ID NO: 1059556 - RNA, 24 nt, Human
gaacagcaccuggaacagaagcaa

SEQ ID NO: 1059557 - RNA, 22 nt, Human
gaagagaaaucuugggagaguc

SEQ ID NO: 1059558 - RNA, 19 nt, Human
gaagggcuuaccguggccu

SEQ ID NO: 1059559 - RNA, 19 nt, Human
gagaagagaaaucuuggga

SEQ ID NO: 1059560 - RNA, 25 nt, Human
gcgcaccaaagccacagggacacaa

SEQ ID NO: 1059561 - RNA, 24 nt, Human
ggaaaccuggugcucaauauuggu

SEQ ID NO: 1059562 - RNA, 23 nt, Human
ggaagucuuccauccugcaccag

SEQ ID NO: 1059563 - RNA, 18 nt, Human
ggaccggcggcuggggug

SEQ ID NO: 1059564 - RNA, 23 nt, Human
ggaggcggugggcaggggaacuc

SEQ ID NO: 1059565 - RNA, 21 nt, Human
gggaacucuuuucuuuccuug

SEQ ID NO: 1059566 - RNA, 24 nt, Human
gggcaggagaggcacagacacugc

SEQ ID NO: 1059567 - RNA, 18 nt, Human
gucagagcuuaggaguga

SEQ ID NO: 1059568 - RNA, 23 nt, Human
guugaacgguuggggccaggcug

SEQ ID NO: 1059569 - RNA, 26 nt, Human
uaacagcaacaacccgaggcagccca

SEQ ID NO: 1059570 - RNA, 25 nt, Human
uaacuccuguccucuucuagacccc

SEQ ID NO: 1059571 - RNA, 23 nt, Human
uaccccagaaacagccugucaga

SEQ ID NO: 1059572 - RNA, 22 nt, Human
uagcccaguggcugggaggcgg

SEQ ID NO: 1059573 - RNA, 24 nt, Human
uaggucaccaaauguugccagaag

SEQ ID NO: 1059574 - RNA, 22 nt, Human
ucaccucccuaccucauccuca

SEQ ID NO: 1059575 - RNA, 19 nt, Human
uccagguggagggagaaag

SEQ ID NO: 1059576 - RNA, 26 nt, Human
uccccaggcucccugucugacucugu

SEQ ID NO: 1059577 - RNA, 22 nt, Human
uccucaggguccaaguccccau

SEQ ID NO: 1059578 - RNA, 19 nt, Human
uccucuucuagaccccaca

SEQ ID NO: 1059579 - RNA, 20 nt, Human
ucugccagggcccuccucua

SEQ ID NO: 1059580 - RNA, 23 nt, Human
ucugccagggcccuccucuaccc

SEQ ID NO: 1059581 - RNA, 22 nt, Human
ucuggaucaccucccuaccuca

SEQ ID NO: 1059582 - RNA, 21 nt, Human
ucuucuagaccccacaucugc

SEQ ID NO: 1059583 - RNA, 23 nt, Human
ugaaaacacaauaggcuuuggga

SEQ ID NO: 1059584 - RNA, 25 nt, Human
ugagagcgcgacaaggcccuggaca

SEQ ID NO: 1059585 - RNA, 22 nt, Human
ugaggcagaagcuguuagagac

SEQ ID NO: 1059586 - RNA, 22 nt, Human
ugccagggcccuccucuacccu

SEQ ID NO: 1059587 - RNA, 23 nt, Human
uggaaaauguuagucaaaugaac

SEQ ID NO: 1059588 - RNA, 25 nt, Human
uggagacugcucucuagccccuggg

SEQ ID NO: 1059589 - RNA, 20 nt, Human
uggagagaagagaaaucuug

SEQ ID NO: 1059590 - RNA, 20 nt, Human
uggcuuccuauuaccuugug

SEQ ID NO: 1059591 - RNA, 18 nt, Human
ugggaagggcuuaccgug

SEQ ID NO: 1059592 - RNA, 18 nt, Human
ugggaggcggugggcagg

SEQ ID NO: 1059593 - RNA, 22 nt, Human
uguaacagcaacaacccgaggc

SEQ ID NO: 1059594 - RNA, 18 nt, Human
ugucucagaaguucgucg

SEQ ID NO: 1059595 - RNA, 26 nt, Human
ugucucagaaguucgucgaccgacgg

SEQ ID NO: 1059596 - RNA, 19 nt, Human
uguuagcccaugcuccagg

SEQ ID NO: 1059597 - RNA, 23 nt, Human
uguuucacuccuucuggccuuca

SEQ ID NO: 1059598 - RNA, 19 nt, Human
uuagcccaugcuccaggug

SEQ ID NO: 1059599 - RNA, 21 nt, Human
uucauaccaacccauuguuaa

SEQ ID NO: 1059600 - RNA, 21 nt, Human
uucccuccucacaccucgguc

SEQ ID NO: 1059601 - RNA, 24 nt, Human
uuccuucuccgccuucucuggauc

SEQ ID NO: 1059602 - RNA, 23 nt, Human
uugcaaauuuccugccaggaggu

SEQ ID NO: 1059603 - RNA, 23 nt, Human
uuggggccaggcugcgaaggaga

SEQ ID NO: 1059604 - RNA, 19 nt, Human
uuugcaaauuuccugccag

SEQ ID NO: 1059605 - RNA, 19 nt, Human
aaaagggaggagagcagaa

SEQ ID NO: 1059606 - RNA, 22 nt, Human
aaaccguacggugaaggaacac

SEQ ID NO: 1059607 - RNA, 20 nt, Human
aaagguaaacauuucugcag

SEQ ID NO: 1059608 - RNA, 23 nt, Human
aacaaugacaauccauugccccc

SEQ ID NO: 1059609 - RNA, 22 nt, Human
aacacuuuuuauuacagaaacc

SEQ ID NO: 1059610 - RNA, 21 nt, Human
aagaaacuaugaguaacaagc

SEQ ID NO: 1059611 - RNA, 21 nt, Human
aagcuauaacauaguucacca

SEQ ID NO: 1059612 - RNA, 19 nt, Human
acauucuaaagccaaguaa

SEQ ID NO: 1059613 - RNA, 18 nt, Human
accgaaaaaaugaucaaa

SEQ ID NO: 1059614 - RNA, 21 nt, Human
acggugaaggaacacaacaga

SEQ ID NO: 1059615 - RNA, 21 nt, Human
agcgcugacgggaacaucugc

SEQ ID NO: 1059616 - RNA, 20 nt, Human
auauacaauaugcauaugug

SEQ ID NO: 1059617 - RNA, 23 nt, Human
caagacuaauauaaauucacucc

SEQ ID NO: 1059618 - RNA, 18 nt, Human
caaugggacccccccccc

SEQ ID NO: 1059619 - RNA, 20 nt, Human
cacauaggaaaaagagguac

SEQ ID NO: 1059620 - RNA, 24 nt, Human
cacccuacaguuaguaauauuaca

SEQ ID NO: 1059621 - RNA, 18 nt, Human
cagaaaccguacggugaa

SEQ ID NO: 1059622 - RNA, 20 nt, Human
ccacaaugggaccccccccc

SEQ ID NO: 1059623 - RNA, 19 nt, Human
ccccccccccuuuuucuca

SEQ ID NO: 1059624 - RNA, 19 nt, Human
cccccccccuuuuucucac

SEQ ID NO: 1059625 - RNA, 20 nt, Human
ccugaauucaugagcaguug

SEQ ID NO: 1059626 - RNA, 22 nt, Human
cgaaaaaaugaucaaaaagaaa

SEQ ID NO: 1059627 - RNA, 25 nt, Human
cgagaaaauacuguugcacgcaaua

SEQ ID NO: 1059628 - RNA, 22 nt, Human
cuaaagccaaguaaaauauccc

SEQ ID NO: 1059629 - RNA, 25 nt, Human
gaaaaagagguacacgagaaaauac

SEQ ID NO: 1059630 - RNA, 23 nt, Human
gaccgacugacucagggcagcgc

SEQ ID NO: 1059631 - RNA, 20 nt, Human
gagaugacccuggggaggga

SEQ ID NO: 1059632 - RNA, 19 nt, Human
gagugagucuuucuauccu

SEQ ID NO: 1059633 - RNA, 21 nt, Human
gcacgcaauaauuuucacaca

SEQ ID NO: 1059634 - RNA, 19 nt, Human
gcuugggguggggcggggc

SEQ ID NO: 1059635 - RNA, 20 nt, Human
ggcggggcgggggugugcuc

SEQ ID NO: 1059636 - RNA, 19 nt, Human
gggguggggcggggcgggg

SEQ ID NO: 1059637 - RNA, 19 nt, Human
ggguggggcggggcggggg

SEQ ID NO: 1059638 - RNA, 23 nt, Human
gguuaaaaaaaugcacacacaga

SEQ ID NO: 1059639 - RNA, 21 nt, Human
uaacauaguucaccacaaugg

SEQ ID NO: 1059640 - RNA, 22 nt, Human
uaauuuucacacagauuaacaa

SEQ ID NO: 1059641 - RNA, 23 nt, Human
uagacauuuauaaauaaaaaaga

SEQ ID NO: 1059642 - RNA, 23 nt, Human
uauaacauaguucaccacaaugg

SEQ ID NO: 1059643 - RNA, 18 nt, Human
ucaaaaagaaacuaugag

SEQ ID NO: 1059644 - RNA, 29 nt, Human
ucaacaaugacaauccauugccccuuuuu

SEQ ID NO: 1059645 - RNA, 19 nt, Human
uccaguguccugaauucau

SEQ ID NO: 1059646 - RNA, 21 nt, Human
ucccuguucucauuuugggga

SEQ ID NO: 1059647 - RNA, 23 nt, Human
ucuacacauauacaauaugcaua

SEQ ID NO: 1059648 - RNA, 20 nt, Human
ugaaggaacacaacagacca

SEQ ID NO: 1059649 - RNA, 21 nt, Human
ugaccugggagagaaagaucu

SEQ ID NO: 1059650 - RNA, 22 nt, Human
ugacucagggcagcgcugacgg

SEQ ID NO: 1059651 - RNA, 23 nt, Human
ugacucagggcagcgcugacggg

SEQ ID NO: 1059652 - RNA, 19 nt, Human
ugacugugcccuggaaagu

SEQ ID NO: 1059653 - RNA, 23 nt, Human
ugagaugacccuggggagggagc

SEQ ID NO: 1059654 - RNA, 22 nt, Human
ugagaugaccugggagagaaaa

SEQ ID NO: 1059655 - RNA, 25 nt, Human
ugaguaacaagcuauaacauaguuc

SEQ ID NO: 1059656 - RNA, 19 nt, Human
ugcacgcaauaauuuucac

SEQ ID NO: 1059657 - RNA, 20 nt, Human
ugcuugggguggggcggggc

SEQ ID NO: 1059658 - RNA, 21 nt, Human
uggaagaagcuugaagugagc

SEQ ID NO: 1059659 - RNA, 22 nt, Human
uggaccuggugacuuagugucg

SEQ ID NO: 1059660 - RNA, 19 nt, Human
uggggagggagccacguuc

SEQ ID NO: 1059661 - RNA, 20 nt, Human
uggggagggagccacguucc

SEQ ID NO: 1059662 - RNA, 21 nt, Human
uguaaaacauucuaaagccaa

SEQ ID NO: 1059663 - RNA, 23 nt, Human
uguugcacgcaauaauuuucaca

SEQ ID NO: 1059664 - RNA, 23 nt, Human
uuaacauggauuaacacuuuuua

SEQ ID NO: 1059665 - RNA, 26 nt, Human
uuagaaauucugcugccccaaaguau

SEQ ID NO: 1059666 - RNA, 19 nt, Human
aggcugaggggcagaucgu

SEQ ID NO: 1059667 - RNA, 22 nt, Human
aguggguguggacucgagaggc

SEQ ID NO: 1059668 - RNA, 28 nt, Human
caaaaaacacccaaugcuuaggagccuc

SEQ ID NO: 1059669 - RNA, 18 nt, Human
caaaacagcagcaaggac

SEQ ID NO: 1059670 - RNA, 21 nt, Human
caaaacuucuagaccaaucau

SEQ ID NO: 1059671 - RNA, 22 nt, Human
cacuccacuuccuuuccacgca

SEQ ID NO: 1059672 - RNA, 19 nt, Human
cagcagcaaggacggugag

SEQ ID NO: 1059673 - RNA, 22 nt, Human
ccguguguccacuccacuuccu

SEQ ID NO: 1059674 - RNA, 21 nt, Human
cugggggugaggcugaggggc

SEQ ID NO: 1059675 - RNA, 24 nt, Human
gcaaaacagcagcaaggacgguga

SEQ ID NO: 1059676 - RNA, 24 nt, Human
uaggagccucagucucaaaacuuc

SEQ ID NO: 1059677 - RNA, 22 nt, Human
ucaaaaaacacccaaugcuuag

SEQ ID NO: 1059678 - RNA, 19 nt, Human
ucucaaaacuucuagacca

SEQ ID NO: 1059679 - RNA, 23 nt, Human
ugcaaaacagcagcaaggacggu

SEQ ID NO: 1059680 - RNA, 21 nt, Human
ugcuuaggagccucagucuca

SEQ ID NO: 1059681 - RNA, 20 nt, Human
uugcaaaacagcagcaagga

SEQ ID NO: 1059682 - RNA, 26 nt, Human
uugcaaaacagcagcaaggacgguga

SEQ ID NO: 1059683 - RNA, 22 nt, Human
aaaaggagagggcccaaggcua

SEQ ID NO: 1059684 - RNA, 22 nt, Human
aaaaggagagggcccaaggcua

SEQ ID NO: 1059685 - RNA, 18 nt, Human
aaggagagggcccaaggc

SEQ ID NO: 1059686 - RNA, 18 nt, Human
cagcagccagguugaugg

SEQ ID NO: 1059687 - RNA, 19 nt, Human
cagcagccagguugauggc

SEQ ID NO: 1059688 - RNA, 18 nt, Human
cagccgaaggccacggug

SEQ ID NO: 1059689 - RNA, 19 nt, Human
cagccucucggcccggccc

SEQ ID NO: 1059690 - RNA, 23 nt, Human
ccagccucgggccgggcgcgccc

SEQ ID NO: 1059691 - RNA, 21 nt, Human
cccccagccucgggccgggcg

SEQ ID NO: 1059692 - RNA, 19 nt, Human
ccccgaguccgcccggccc

SEQ ID NO: 1059693 - RNA, 23 nt, Human
ccccgcgccugacccugcgcgcc

SEQ ID NO: 1059694 - RNA, 25 nt, Human
ccccgcgccugacccugcgcgcccg

SEQ ID NO: 1059695 - RNA, 25 nt, Human
cccggcccggccugggguccucggc

SEQ ID NO: 1059696 - RNA, 26 nt, Human
cccugcgcgcccgcgccccgcucccc

SEQ ID NO: 1059697 - RNA, 23 nt, Human
ccgagagaagagcugcagccaca

SEQ ID NO: 1059698 - RNA, 19 nt, Human
ccgcgccccgcucccccag

SEQ ID NO: 1059699 - RNA, 21 nt, Human
ccgcgccccgcucccccagcc

SEQ ID NO: 1059700 - RNA, 21 nt, Human
ccucucggcccggcccggccu

SEQ ID NO: 1059701 - RNA, 20 nt, Human
ccugcgcgcccgcgccccgc

SEQ ID NO: 1059702 - RNA, 23 nt, Human
cgagagaagagcugcagccacac

SEQ ID NO: 1059703 - RNA, 25 nt, Human
cgccaugccgccccgcgccugaccc

SEQ ID NO: 1059704 - RNA, 22 nt, Human
cgcccggccccgguccaggagc

SEQ ID NO: 1059705 - RNA, 20 nt, Human
cggcccggcccggccugggg

SEQ ID NO: 1059706 - RNA, 24 nt, Human
cgguccccgaguccgcccggcccc

SEQ ID NO: 1059707 - RNA, 21 nt, Human
cggugcccacagcagccaggu

SEQ ID NO: 1059708 - RNA, 20 nt, Human
gagagaagagcugcagccac

SEQ ID NO: 1059709 - RNA, 22 nt, Human
gccgaaggccacggugcccaca

SEQ ID NO: 1059710 - RNA, 18 nt, Human
gccucgggccgggcgcgc

SEQ ID NO: 1059711 - RNA, 21 nt, Human
gcgccccgcucccccagccuc

SEQ ID NO: 1059712 - RNA, 22 nt, Human
ggcuaagagguagccugcggug

SEQ ID NO: 1059713 - RNA, 18 nt, Human
gggucagucucuccaccg

SEQ ID NO: 1059714 - RNA, 18 nt, Human
uaagagguagccugcggu

SEQ ID NO: 1059715 - RNA, 19 nt, Human
uaagagguagccugcggug

SEQ ID NO: 1059716 - RNA, 22 nt, Human
ugcagccgaaggccacggugcc

SEQ ID NO: 1059717 - RNA, 23 nt, Human
ugccagcgccaccaagauguagg

SEQ ID NO: 1059718 - RNA, 25 nt, Human
ugccgccccgcgccugacccugcgc

SEQ ID NO: 1059719 - RNA, 18 nt, Human
uguucaggagcacggcug

SEQ ID NO: 1059720 - RNA, 22 nt, Human
aaucaugcccaugaaaaacuaa

SEQ ID NO: 1059721 - RNA, 24 nt, Human
aucaugcccaugaaaaacuaaagu

SEQ ID NO: 1059722 - RNA, 20 nt, Human
augcccaugaaaaacuaaag

SEQ ID NO: 1059723 - RNA, 24 nt, Human
cccacagaugcacccaagaucugg

SEQ ID NO: 1059724 - RNA, 24 nt, Human
cuccacugcccacagaugcaccca

SEQ ID NO: 1059725 - RNA, 18 nt, Human
cugggggcuggcugugga

SEQ ID NO: 1059726 - RNA, 18 nt, Human
cugggggcuggcugugga

SEQ ID NO: 1059727 - RNA, 23 nt, Human
gcauucuuguagguaguuagaag

SEQ ID NO: 1059728 - RNA, 18 nt, Human
ucaugcccaugaaaaacu

SEQ ID NO: 1059729 - RNA, 18 nt, Human
uccacugcccacagaugc

SEQ ID NO: 1059730 - RNA, 23 nt, Human
ugcacccaagaucugggggcugg

SEQ ID NO: 1059731 - RNA, 24 nt, Human
uggaaucaugcccaugaaaaacua

SEQ ID NO: 1059732 - RNA, 23 nt, Human
uggcuguggaagacaaagagcau

SEQ ID NO: 1059733 - RNA, 18 nt, Human
uguggaagacaaagagca

SEQ ID NO: 1059734 - RNA, 19 nt, Human
uuguagguaguuagaagua

SEQ ID NO: 1059735 - RNA, 21 nt, Human
cagagccaguggaaugcagag

SEQ ID NO: 1059736 - RNA, 18 nt, Human
gagccaguggaaugcaga

SEQ ID NO: 1059737 - RNA, 18 nt, Human
guauaguccauggcagag

SEQ ID NO: 1059738 - RNA, 23 nt, Human
guggaaugcagagggagaaguag

SEQ ID NO: 1059739 - RNA, 21 nt, Human
aaaauacauacacucaaggca

SEQ ID NO: 1059740 - RNA, 21 nt, Human
aaaauauauacacucaaggca

SEQ ID NO: 1059741 - RNA, 21 nt, Human
aauugugugagauuuuaccuc

SEQ ID NO: 1059742 - RNA, 22 nt, Human
aauugugugagauuuuaccucu

SEQ ID NO: 1059743 - RNA, 20 nt, Human
acuuuguuguaaaagucucc

SEQ ID NO: 1059744 - RNA, 26 nt, Human
agaauugugugagauuuuaccucuug

SEQ ID NO: 1059745 - RNA, 24 nt, Human
auaauacauuuucaaagagcuuuc

SEQ ID NO: 1059746 - RNA, 22 nt, Human
auagcucuggugauuuuucaug

SEQ ID NO: 1059747 - RNA, 25 nt, Human
caaaauacauacacucaaggcacaa

SEQ ID NO: 1059748 - RNA, 21 nt, Human
caaaauauauacacucaaggc

SEQ ID NO: 1059749 - RNA, 26 nt, Human
cacaaaauauauacacucaaggcaca

SEQ ID NO: 1059750 - RNA, 21 nt, Human
caccuauagcucuggugauuu

SEQ ID NO: 1059751 - RNA, 26 nt, Human
cucuuggguuccaaguauguuuuugu

SEQ ID NO: 1059752 - RNA, 20 nt, Human
uagcucuggugauuuuucau

SEQ ID NO: 1059753 - RNA, 21 nt, Human
ucuuucauuuggcuucaagug

SEQ ID NO: 1059754 - RNA, 18 nt, Human
ugaaggaagaacgugaua

SEQ ID NO: 1059755 - RNA, 22 nt, Human
uguuuuauucaucucuuucauu

SEQ ID NO: 1059756 - RNA, 20 nt, Human
uucaucucuuucauuuggcu

SEQ ID NO: 1059757 - RNA, 21 nt, Human
uuuuuuuuuuuugguuucuca

SEQ ID NO: 1059758 - RNA, 18 nt, Human
aaaaaccaacaccugccc

SEQ ID NO: 1059759 - RNA, 25 nt, Human
aaaaagccucagaaauauagcuaua

SEQ ID NO: 1059760 - RNA, 18 nt, Human
aaaauacaaaaaaagccu

SEQ ID NO: 1059761 - RNA, 18 nt, Human
aaccaaacccaaacuccc

SEQ ID NO: 1059762 - RNA, 20 nt, Human
aagaauccaguagcaaugcc

SEQ ID NO: 1059763 - RNA, 23 nt, Human
aagcaaaugcaugauaaguuuau

SEQ ID NO: 1059764 - RNA, 21 nt, Human
aaugcaagaaacaaaaaccaa

SEQ ID NO: 1059765 - RNA, 25 nt, Human
aaugcaagaaacaaaaaccaacacc

SEQ ID NO: 1059766 - RNA, 24 nt, Human
acaucccagagaaaugcaagaaac

SEQ ID NO: 1059767 - RNA, 20 nt, Human
accaaacccaaacucccagc

SEQ ID NO: 1059768 - RNA, 20 nt, Human
acgcugcgggaaaagacaga

SEQ ID NO: 1059769 - RNA, 19 nt, Human
acgcugcgggaaaagacca

SEQ ID NO: 1059770 - RNA, 21 nt, Human
agacagaugcugccggaccug

SEQ ID NO: 1059771 - RNA, 24 nt, Human
agagaacuaauuugaaacuuaaau

SEQ ID NO: 1059772 - RNA, 27 nt, Human
aguagcaaugccugcuaagagugguuc

SEQ ID NO: 1059773 - RNA, 23 nt, Human
augcaugauaaguuuauucuggg

SEQ ID NO: 1059774 - RNA, 24 nt, Human
caaaacauaaaacuauauuuuuaa

SEQ ID NO: 1059775 - RNA, 21 nt, Human
caaacucccagcgcgccgcgg

SEQ ID NO: 1059776 - RNA, 21 nt, Human
caaccaaacccaaacucccag

SEQ ID NO: 1059777 - RNA, 24 nt, Human
ccaaacccaaacucccagcgcgcc

SEQ ID NO: 1059778 - RNA, 21 nt, Human
ccuucuaugcagcaaugucaa

SEQ ID NO: 1059779 - RNA, 24 nt, Human
cuaaauauuggaaaaggcuuaaca

SEQ ID NO: 1059780 - RNA, 20 nt, Human
cugggaaagaagcuaaaaua

SEQ ID NO: 1059781 - RNA, 18 nt, Human
gaauaucaguuugugaaa

SEQ ID NO: 1059782 - RNA, 23 nt, Human
gcaagaaacaaaaaccaacaccu

SEQ ID NO: 1059783 - RNA, 21 nt, Human
gcagggcagaggguaccagag

SEQ ID NO: 1059784 - RNA, 23 nt, Human
gcugcacgcugcgggaaaagaca

SEQ ID NO: 1059785 - RNA, 20 nt, Human
gcugcgggaaaagacagaug

SEQ ID NO: 1059786 - RNA, 18 nt, Human
ggacaucaccaggccagc

SEQ ID NO: 1059787 - RNA, 22 nt, Human
ggacgcugccugcuugaccagu

SEQ ID NO: 1059788 - RNA, 18 nt, Human
gggaaagaagcuaaaaua

SEQ ID NO: 1059789 - RNA, 19 nt, Human
gggacaucaccaggccagc

SEQ ID NO: 1059790 - RNA, 20 nt, Human
uaaaacagcaaauguuauaa

SEQ ID NO: 1059791 - RNA, 23 nt, Human
uaauuacuuaaauauaaacaauu

SEQ ID NO: 1059792 - RNA, 25 nt, Human
uauaaaacaagguaauucaguuuga

SEQ ID NO: 1059793 - RNA, 21 nt, Human
uauucaaugcauacagccauu

SEQ ID NO: 1059794 - RNA, 21 nt, Human
uauucuggaguuaaauuuuuc

SEQ ID NO: 1059795 - RNA, 22 nt, Human
uauuuggcuuuuugaaaacauu

SEQ ID NO: 1059796 - RNA, 20 nt, Human
uccccgcgggucuccguggg

SEQ ID NO: 1059797 - RNA, 19 nt, Human
ucuguaacuagaaaugauu

SEQ ID NO: 1059798 - RNA, 23 nt, Human
ugcaagaaacaaaaaccaacacc

SEQ ID NO: 1059799 - RNA, 21 nt, Human
ugcauuuuuuacacauugcau

SEQ ID NO: 1059800 - RNA, 18 nt, Human
ugcgcuggacgcugccug

SEQ ID NO: 1059801 - RNA, 20 nt, Human
uggaaaaggcuuaacaccug

SEQ ID NO: 1059802 - RNA, 23 nt, Human
uuaaaaauuauccuaaauacaua

SEQ ID NO: 1059803 - RNA, 28 nt, Human
uuaacaccuguucuguaaguuuucucua

SEQ ID NO: 1059804 - RNA, 21 nt, Human
uucaguuugacuauuaaaaag

SEQ ID NO: 1059805 - RNA, 25 nt, Human
uucucacauaaaauuauuauuuuau

SEQ ID NO: 1059806 - RNA, 24 nt, Human
uugcauacauucuccuguagcaua

SEQ ID NO: 1059807 - RNA, 22 nt, Human
uugcauuuuuuacacauugcau

SEQ ID NO: 1059808 - RNA, 21 nt, Human
uuucuguaacuagaaaugauu

SEQ ID NO: 1059809 - RNA, 23 nt, Human
accuaccccauucccauauaugc

SEQ ID NO: 1059810 - RNA, 23 nt, Human
agaaaagccaucuucccccccac

SEQ ID NO: 1059811 - RNA, 21 nt, Human
aucacuuuacuaauuaccgag

SEQ ID NO: 1059812 - RNA, 18 nt, Human
aucucccucucacacccc

SEQ ID NO: 1059813 - RNA, 23 nt, Human
caaggaagagaucaauauacagu

SEQ ID NO: 1059814 - RNA, 18 nt, Human
caccccuuugaaagcuua

SEQ ID NO: 1059815 - RNA, 21 nt, Human
caccgcaguucugaagauaga

SEQ ID NO: 1059816 - RNA, 19 nt, Human
caucucccucucacacccu

SEQ ID NO: 1059817 - RNA, 23 nt, Human
ccaccaucucccucucacacccc

SEQ ID NO: 1059818 - RNA, 20 nt, Human
cccccaccaucucccucuca

SEQ ID NO: 1059819 - RNA, 21 nt, Human
cccccaccaucucccucucac

SEQ ID NO: 1059820 - RNA, 21 nt, Human
cuugauuucaaugaagaaaag

SEQ ID NO: 1059821 - RNA, 19 nt, Human
gccaucuucccccccacca

SEQ ID NO: 1059822 - RNA, 27 nt, Human
uaaaaaaaugcaccgcaguucugaaga

SEQ ID NO: 1059823 - RNA, 24 nt, Human
uaaaaccaaguuuuaaaaaaaugc

SEQ ID NO: 1059824 - RNA, 18 nt, Human
uaaagguuuacagacuug

SEQ ID NO: 1059825 - RNA, 21 nt, Human
uaugccuuuaaaaaaaaaauc

SEQ ID NO: 1059826 - RNA, 20 nt, Human
uauucauauaaagguuuaca

SEQ ID NO: 1059827 - RNA, 23 nt, Human
ucaucugguagacauagcuuugc

SEQ ID NO: 1059828 - RNA, 18 nt, Human
ucucccucucacaccccu

SEQ ID NO: 1059829 - RNA, 24 nt, Human
ugcaccgcaguucugaagauagaa

SEQ ID NO: 1059830 - RNA, 18 nt, Human
uucccccccaccaucucc

SEQ ID NO: 1059831 - RNA, 19 nt, Human
uucccccccaccaucuccc

SEQ ID NO: 1059832 - RNA, 22 nt, Human
aaacaguaaaucucaccccagu

SEQ ID NO: 1059833 - RNA, 18 nt, Human
aaacccaacugcgucaaa

SEQ ID NO: 1059834 - RNA, 18 nt, Human
aaagcacuagucuuccuc

SEQ ID NO: 1059835 - RNA, 26 nt, Human
aacaauuuuuuuuuucugggggggcc

SEQ ID NO: 1059836 - RNA, 23 nt, Human
aacacugcaauugcuuauuuaug

SEQ ID NO: 1059837 - RNA, 21 nt, Human
aacuaugccaggaaaucccca

SEQ ID NO: 1059838 - RNA, 18 nt, Human
aacuuccucuuccucuuc

SEQ ID NO: 1059839 - RNA, 25 nt, Human
aacuuccucuuccucuucuccuccg

SEQ ID NO: 1059840 - RNA, 23 nt, Human
aagcuuucacauaaagcuuaaag

SEQ ID NO: 1059841 - RNA, 21 nt, Human
acaaagcacuagucuuccucc

SEQ ID NO: 1059842 - RNA, 20 nt, Human
acaguuagggcuaccaaaua

SEQ ID NO: 1059843 - RNA, 19 nt, Human
accauuuuagggcacugua

SEQ ID NO: 1059844 - RNA, 26 nt, Human
acuaagcuuucacauaaagcuuaaag

SEQ ID NO: 1059845 - RNA, 20 nt, Human
agaaggaggguuaggcugcc

SEQ ID NO: 1059846 - RNA, 20 nt, Human
agcagaagccuaucaacaac

SEQ ID NO: 1059847 - RNA, 20 nt, Human
agccggagaggagaagaaga

SEQ ID NO: 1059848 - RNA, 24 nt, Human
auaagaacaccauuuuagggcacu

SEQ ID NO: 1059849 - RNA, 21 nt, Human
auuuucugcaggucauaagaa

SEQ ID NO: 1059850 - RNA, 18 nt, Human
auuuugcaugcaaaacac

SEQ ID NO: 1059851 - RNA, 28 nt, Human
caaaacacugcaauugcuuauuuaugug

SEQ ID NO: 1059852 - RNA, 24 nt, Human
caaaacuuaaaacacaguauuauu

SEQ ID NO: 1059853 - RNA, 19 nt, Human
caacuuccucuuccucuuc

SEQ ID NO: 1059854 - RNA, 23 nt, Human
caagaacagagaauacauuuuga

SEQ ID NO: 1059855 - RNA, 22 nt, Human
caaugcuauauaaauguaugaa

SEQ ID NO: 1059856 - RNA, 25 nt, Human
caccauuuuagggcacuguauucca

SEQ ID NO: 1059857 - RNA, 20 nt, Human
caccccagugauagcuuugg

SEQ ID NO: 1059858 - RNA, 18 nt, Human
cacuuccgguucacuccc

SEQ ID NO: 1059859 - RNA, 19 nt, Human
cagacagacaggcagcagu

SEQ ID NO: 1059860 - RNA, 20 nt, Human
cagcaaauaaagaaaauccc

SEQ ID NO: 1059861 - RNA, 20 nt, Human
cagcagcaagcggaugccgc

SEQ ID NO: 1059862 - RNA, 18 nt, Human
cagccacuacugcucaga

SEQ ID NO: 1059863 - RNA, 22 nt, Human
cagggccgcgcgaagccggaga

SEQ ID NO: 1059864 - RNA, 22 nt, Human
ccaaaguucagucauccagcaa

SEQ ID NO: 1059865 - RNA, 26 nt, Human
ccccuuuuacuaccagcaggaguugg

SEQ ID NO: 1059866 - RNA, 19 nt, Human
ccgcuaggacccuccccca

SEQ ID NO: 1059867 - RNA, 24 nt, Human
ccgguucacuccccgcuaggaccc

SEQ ID NO: 1059868 - RNA, 20 nt, Human
ccucccccaacuuccucuuc

SEQ ID NO: 1059869 - RNA, 24 nt, Human
cgaagccggagaggagaagaagag

SEQ ID NO: 1059870 - RNA, 20 nt, Human
cgccuggccgaggagaggca

SEQ ID NO: 1059871 - RNA, 19 nt, Human
cggagaggagaagaagaga

SEQ ID NO: 1059872 - RNA, 20 nt, Human
cgguggcagcagcaagcgga

SEQ ID NO: 1059873 - RNA, 20 nt, Human
cuccccucaccccucuuaaa

SEQ ID NO: 1059874 - RNA, 23 nt, Human
cucuccccucaccccucuuaaag

SEQ ID NO: 1059875 - RNA, 23 nt, Human
cucucuccccucaccccucuuaa

SEQ ID NO: 1059876 - RNA, 24 nt, Human
cugggaaaccugguuacaagugua

SEQ ID NO: 1059877 - RNA, 22 nt, Human
gaccguucgggcgggagaaaga

SEQ ID NO: 1059878 - RNA, 19 nt, Human
gagagaggcauuucaaaga

SEQ ID NO: 1059879 - RNA, 22 nt, Human
gaggagaggcaggaaccuuuac

SEQ ID NO: 1059880 - RNA, 19 nt, Human
gaggcgguggcagcagcaa

SEQ ID NO: 1059881 - RNA, 21 nt, Human
gcauuucaaagaauguuccuu

SEQ ID NO: 1059882 - RNA, 20 nt, Human
gcgguggcagcagcaagcgg

SEQ ID NO: 1059883 - RNA, 21 nt, Human
ggccgaggagaggcaggaacc

SEQ ID NO: 1059884 - RNA, 20 nt, Human
gggaaaccugguuacaagug

SEQ ID NO: 1059885 - RNA, 21 nt, Human
gggcgagagggaggcagggcc

SEQ ID NO: 1059886 - RNA, 20 nt, Human
guuuacaucacagcagccac

SEQ ID NO: 1059887 - RNA, 23 nt, Human
uaacuaagcuuucacauaaagcu

SEQ ID NO: 1059888 - RNA, 25 nt, Human
uaagaacaccauuuuagggcacugu

SEQ ID NO: 1059889 - RNA, 18 nt, Human
uaagcuuucacauaaagc

SEQ ID NO: 1059890 - RNA, 21 nt, Human
uacaaaauagaaucaggacaa

SEQ ID NO: 1059891 - RNA, 21 nt, Human
uaggacccucccccaacuucc

SEQ ID NO: 1059892 - RNA, 21 nt, Human
uaugaauuucucucuccccuc

SEQ ID NO: 1059893 - RNA, 18 nt, Human
ucaauccauucaaacagc

SEQ ID NO: 1059894 - RNA, 19 nt, Human
uccaagaacagagaauagu

SEQ ID NO: 1059895 - RNA, 23 nt, Human
ucccaguaaaagccugaucaugg

SEQ ID NO: 1059896 - RNA, 24 nt, Human
ucucucuccccucaccccucuuaa

SEQ ID NO: 1059897 - RNA, 19 nt, Human
ugaaaaggucaaauguuac

SEQ ID NO: 1059898 - RNA, 21 nt, Human
ugaaaggggagagaaaaucca

SEQ ID NO: 1059899 - RNA, 24 nt, Human
ugaaaggggagagaaaauccaaag

SEQ ID NO: 1059900 - RNA, 20 nt, Human
ugcaacacaaaacuuaaaac

SEQ ID NO: 1059901 - RNA, 22 nt, Human
ugcaacacaaaacuuaaaacac

SEQ ID NO: 1059902 - RNA, 24 nt, Human
ugcaacacaaaacuuaaaacacag

SEQ ID NO: 1059903 - RNA, 22 nt, Human
ugcaguaaguaaucagccucca

SEQ ID NO: 1059904 - RNA, 18 nt, Human
ugcauucuuaaggcagaa

SEQ ID NO: 1059905 - RNA, 22 nt, Human
ugccaggaaauccccaguagag

SEQ ID NO: 1059906 - RNA, 19 nt, Human
ugcggccaccgggcccagc

SEQ ID NO: 1059907 - RNA, 22 nt, Human
uggcauauguucagcagaagcc

SEQ ID NO: 1059908 - RNA, 18 nt, Human
uggccgaggagaggcagg

SEQ ID NO: 1059909 - RNA, 20 nt, Human
ugucuuugcucucccuuggg

SEQ ID NO: 1059910 - RNA, 22 nt, Human
uuaucuaaagagacaugaaauc

SEQ ID NO: 1059911 - RNA, 26 nt, Human
uuauuuagcauucggauguacaugaa

SEQ ID NO: 1059912 - RNA, 23 nt, Human
uucaaguuuauuccauuuguucu

SEQ ID NO: 1059913 - RNA, 26 nt, Human
uucaaugcuauauaaauguaugaauc

SEQ ID NO: 1059914 - RNA, 18 nt, Human
uuccggaguuaucagucc

SEQ ID NO: 1059915 - RNA, 23 nt, Human
uucggauguacaugaacuaggau

SEQ ID NO: 1059916 - RNA, 24 nt, Human
uuucuccauuuacaaaauagaauc

SEQ ID NO: 1059917 - RNA, 19 nt, Human
uuuuuuucugguagucgga

SEQ ID NO: 1059918 - RNA, 25 nt, Human
caagcuccuggccucggaagaccca

SEQ ID NO: 1059919 - RNA, 23 nt, Human
caggaaaaguacucucgaaccag

SEQ ID NO: 1059920 - RNA, 23 nt, Human
cauagcccaccugccaaucuggg

SEQ ID NO: 1059921 - RNA, 20 nt, Human
ccagacuccagaaauggagc

SEQ ID NO: 1059922 - RNA, 22 nt, Human
ccauguguaugacucauagccc

SEQ ID NO: 1059923 - RNA, 22 nt, Human
cccaggaaaaguacucucgaac

SEQ ID NO: 1059924 - RNA, 24 nt, Human
ccugccaaucuggacucaguggaa

SEQ ID NO: 1059925 - RNA, 19 nt, Human
cuggcgaaggcauucuucc

SEQ ID NO: 1059926 - RNA, 18 nt, Human
gacccagacuccagaaau

SEQ ID NO: 1059927 - RNA, 21 nt, Human
gcgguugguauugggaaaggc

SEQ ID NO: 1059928 - RNA, 22 nt, Human
ucauagcccaccugccaaucug

SEQ ID NO: 1059929 - RNA, 24 nt, Human
ucauagcccaccugccaaucugga

SEQ ID NO: 1059930 - RNA, 19 nt, Human
uccuggccucggaagaccc

SEQ ID NO: 1059931 - RNA, 18 nt, Human
ugaggaaccagcgguugg

SEQ ID NO: 1059932 - RNA, 18 nt, Human
ugccaggauccaguuucu

SEQ ID NO: 1059933 - RNA, 22 nt, Human
uggcgaaggcauucuuccucag

SEQ ID NO: 1059934 - RNA, 18 nt, Human
ugggaaaggccuggcaga

SEQ ID NO: 1059935 - RNA, 18 nt, Human
uguaugacucauagccca

SEQ ID NO: 1059936 - RNA, 21 nt, Human
uucaggcagcuaggugauggc

SEQ ID NO: 1059937 - RNA, 19 nt, Human
uuccucagcuuguccaguc

SEQ ID NO: 1059938 - RNA, 24 nt, Human
uugaaggguuugcccacaugcugg

SEQ ID NO: 1059939 - RNA, 22 nt, Human
uuuuuuuuuuuuuuuuuuccaa

SEQ ID NO: 1059940 - RNA, 21 nt, Human
aaaaucccaaauaaauggccc

SEQ ID NO: 1059941 - RNA, 18 nt, Human
aaacaaaaaccaaacaac

SEQ ID NO: 1059942 - RNA, 25 nt, Human
aaacaaaaaccaaacaacuccaaaa

SEQ ID NO: 1059943 - RNA, 28 nt, Human
aaacaacccacccaccaauuaaagucaa

SEQ ID NO: 1059944 - RNA, 18 nt, Human
aaacagagcggcagaaac

SEQ ID NO: 1059945 - RNA, 25 nt, Human
aaaccagccccaaaccccuccccca

SEQ ID NO: 1059946 - RNA, 23 nt, Human
aaauaaauggcccacaguuuugu

SEQ ID NO: 1059947 - RNA, 21 nt, Human
aaccagccccaaaccccuccc

SEQ ID NO: 1059948 - RNA, 23 nt, Human
aaccagccccaaaccccuccccc

SEQ ID NO: 1059949 - RNA, 22 nt, Human
aacuccugcuucuuccugggaa

SEQ ID NO: 1059950 - RNA, 21 nt, Human
aagaagacagauggaaauuga

SEQ ID NO: 1059951 - RNA, 23 nt, Human
aagaggggaagaggcccuugaug

SEQ ID NO: 1059952 - RNA, 24 nt, Human
aaggagcaggggaaguucccggag

SEQ ID NO: 1059953 - RNA, 22 nt, Human
aauugagcuuuucuuuuuaggu

SEQ ID NO: 1059954 - RNA, 22 nt, Human
acaaacaaaaaccaaacaacuc

SEQ ID NO: 1059955 - RNA, 22 nt, Human
accagccccaaaccccuccccc

SEQ ID NO: 1059956 - RNA, 22 nt, Human
accagccuaccacucuguuucu

SEQ ID NO: 1059957 - RNA, 18 nt, Human
accuucacuuaguggcac

SEQ ID NO: 1059958 - RNA, 21 nt, Human
acugggcucacuguuccugga

SEQ ID NO: 1059959 - RNA, 24 nt, Human
agaaauggggacagccagaaaauu

SEQ ID NO: 1059960 - RNA, 18 nt, Human
agaagccagacaugcaac

SEQ ID NO: 1059961 - RNA, 18 nt, Human
agacacgguggaaugagg

SEQ ID NO: 1059962 - RNA, 21 nt, Human
agagcuggcaggaagagggga

SEQ ID NO: 1059963 - RNA, 21 nt, Human
agcuaccaagaaaugucaggg

SEQ ID NO: 1059964 - RNA, 18 nt, Human
agcuccuggaggugacuc

SEQ ID NO: 1059965 - RNA, 20 nt, Human
agcuggcaggaagaggggaa

SEQ ID NO: 1059966 - RNA, 21 nt, Human
aggaagaggcugaggguucaa

SEQ ID NO: 1059967 - RNA, 19 nt, Human
aggaagaggggaagaggcc

SEQ ID NO: 1059968 - RNA, 18 nt, Human
aggagaaaugaccagccu

SEQ ID NO: 1059969 - RNA, 24 nt, Human
aggagcacaggcagaagccagaca

SEQ ID NO: 1059970 - RNA, 19 nt, Human
aggaggagcacaggcagaa

SEQ ID NO: 1059971 - RNA, 19 nt, Human
aggagggacagggaggaug

SEQ ID NO: 1059972 - RNA, 22 nt, Human
aggcaagaaaauauuuuccuga

SEQ ID NO: 1059973 - RNA, 22 nt, Human
aggcagaagccagacaugcaac

SEQ ID NO: 1059974 - RNA, 28 nt, Human
aggcagaagccagacaugcaacgggaga

SEQ ID NO: 1059975 - RNA, 19 nt, Human
aggcagcuuuggguggggu

SEQ ID NO: 1059976 - RNA, 22 nt, Human
aggcagcuuugggugggguagg

SEQ ID NO: 1059977 - RNA, 19 nt, Human
agggagcuccuacagccag

SEQ ID NO: 1059978 - RNA, 23 nt, Human
agggagcuccuacagccaggaag

SEQ ID NO: 1059979 - RNA, 19 nt, Human
aggggcuggcuuugggugc

SEQ ID NO: 1059980 - RNA, 21 nt, Human
agggguaggcuuuaggggcug

SEQ ID NO: 1059981 - RNA, 18 nt, Human
agucaaaccagccccaaa

SEQ ID NO: 1059982 - RNA, 21 nt, Human
auaaaucgcccugggacagag

SEQ ID NO: 1059983 - RNA, 18 nt, Human
aucgcccugggacagagg

SEQ ID NO: 1059984 - RNA, 22 nt, Human
auggcggggggggauuuggggc

SEQ ID NO: 1059985 - RNA, 21 nt, Human
auuuaggaccccacaaagccc

SEQ ID NO: 1059986 - RNA, 25 nt, Human
caaacaaaaaccaaacaaccccggg

SEQ ID NO: 1059987 - RNA, 24 nt, Human
caaacaacuccaaaaucccaaaua

SEQ ID NO: 1059988 - RNA, 18 nt, Human
cacaaagcccccuucuuc

SEQ ID NO: 1059989 - RNA, 24 nt, Human
cacucuguuucuugucuuccucua

SEQ ID NO: 1059990 - RNA, 24 nt, Human
cagaagccagacaugcaacgggag

SEQ ID NO: 1059991 - RNA, 26 nt, Human
cagcaaacagagcggcagaaacaacc

SEQ ID NO: 1059992 - RNA, 19 nt, Human
cagcagaagauaauuuuua

SEQ ID NO: 1059993 - RNA, 21 nt, Human
cagccagaaaauuugucuguc

SEQ ID NO: 1059994 - RNA, 21 nt, Human
caggcagaagccagacaugca

SEQ ID NO: 1059995 - RNA, 24 nt, Human
caggcagaagccagacaugcaacg

SEQ ID NO: 1059996 - RNA, 20 nt, Human
cagggaggaugcucguggca

SEQ ID NO: 1059997 - RNA, 24 nt, Human
cagggcacggagcugccuggggua

SEQ ID NO: 1059998 - RNA, 20 nt, Human
cauggaaagaccccuugaag

SEQ ID NO: 1059999 - RNA, 22 nt, Human
cauuggaauguaccuuggccug

SEQ ID NO: 1060000 - RNA, 20 nt, Human
ccaaauaaauggcccacagu

SEQ ID NO: 1060001 - RNA, 21 nt, Human
ccaagaauccaaacggaagaa

SEQ ID NO: 1060002 - RNA, 22 nt, Human
ccacccaccaauuaaagucaaa

SEQ ID NO: 1060003 - RNA, 23 nt, Human
ccacucuguuucuugucuuccuc

SEQ ID NO: 1060004 - RNA, 21 nt, Human
cccaaaccccucccccaggag

SEQ ID NO: 1060005 - RNA, 22 nt, Human
cccaggagaaauggggacagcc

SEQ ID NO: 1060006 - RNA, 19 nt, Human
ccccaaaccccucccccag

SEQ ID NO: 1060007 - RNA, 19 nt, Human
ccccacaaagcccccuucu

SEQ ID NO: 1060008 - RNA, 23 nt, Human
ccggagaggggcuucucugggcc

SEQ ID NO: 1060009 - RNA, 19 nt, Human
ccucccagucaccuguccu

SEQ ID NO: 1060010 - RNA, 23 nt, Human
ccucccccaggagaaauggggac

SEQ ID NO: 1060011 - RNA, 21 nt, Human
ccugcagagcaccuuccuacc

SEQ ID NO: 1060012 - RNA, 20 nt, Human
ccuugucuccucuuucuucc

SEQ ID NO: 1060013 - RNA, 24 nt, Human
cgcccugggacagaggcuaugugu

SEQ ID NO: 1060014 - RNA, 26 nt, Human
cggaagaaauggaaaacaaacagcag

SEQ ID NO: 1060015 - RNA, 25 nt, Human
cggcagaaacaacccacccaccaau

SEQ ID NO: 1060016 - RNA, 23 nt, Human
cugcagcaaacagagcggcagaa

SEQ ID NO: 1060017 - RNA, 24 nt, Human
cuggcuggggcugcucacugggcu

SEQ ID NO: 1060018 - RNA, 18 nt, Human
cugggccugaggggacca

SEQ ID NO: 1060019 - RNA, 19 nt, Human
cuugucuccucuuucuucc

SEQ ID NO: 1060020 - RNA, 19 nt, Human
gaaugaggagggacaggga

SEQ ID NO: 1060021 - RNA, 20 nt, Human
gaggaugcucguggcaggag

SEQ ID NO: 1060022 - RNA, 22 nt, Human
gauggggacccauagggccuug

SEQ ID NO: 1060023 - RNA, 23 nt, Human
gcaccaagaauccaaacggaaga

SEQ ID NO: 1060024 - RNA, 20 nt, Human
gccagacaugcaacgggaga

SEQ ID NO: 1060025 - RNA, 18 nt, Human
gccaggaaggcagcuuug

SEQ ID NO: 1060026 - RNA, 26 nt, Human
gccccaaaccccucccccaggagaaa

SEQ ID NO: 1060027 - RNA, 20 nt, Human
gcugucugugaggugggagg

SEQ ID NO: 1060028 - RNA, 18 nt, Human
ggaaaacaaacagcagaa

SEQ ID NO: 1060029 - RNA, 25 nt, Human
ggaaauugagcuuuucuuuuuaggu

SEQ ID NO: 1060030 - RNA, 22 nt, Human
ggaagaggcugaggguucaagg

SEQ ID NO: 1060031 - RNA, 23 nt, Human
ggagcugccugggguaggucuuc

SEQ ID NO: 1060032 - RNA, 19 nt, Human
ggcagaagccagacaugca

SEQ ID NO: 1060033 - RNA, 18 nt, Human
ggccuugaagagcuggcu

SEQ ID NO: 1060034 - RNA, 18 nt, Human
gggaagaggcccuugaug

SEQ ID NO: 1060035 - RNA, 25 nt, Human
gggagaagccagggcacggagcugc

SEQ ID NO: 1060036 - RNA, 21 nt, Human
gggauuuggggcauggggaga

SEQ ID NO: 1060037 - RNA, 18 nt, Human
gggcagucacagagggcu

SEQ ID NO: 1060038 - RNA, 21 nt, Human
gggugggguaggauggggcug

SEQ ID NO: 1060039 - RNA, 24 nt, Human
gguaaggauucuucuugcagugga

SEQ ID NO: 1060040 - RNA, 18 nt, Human
ggugggguaggauggggc

SEQ ID NO: 1060041 - RNA, 18 nt, Human
ggugggguaggauggggc

SEQ ID NO: 1060042 - RNA, 19 nt, Human
guccuugucuccucuuucu

SEQ ID NO: 1060043 - RNA, 18 nt, Human
uaaaauuuaggaccccac

SEQ ID NO: 1060044 - RNA, 21 nt, Human
uaacuggcaugauggccaccu

SEQ ID NO: 1060045 - RNA, 23 nt, Human
uaagauauacaaacaaaaaccaa

SEQ ID NO: 1060046 - RNA, 20 nt, Human
uaagcaagaugggcuguggc

SEQ ID NO: 1060047 - RNA, 22 nt, Human
uaccaagaaaugucagggucuc

SEQ ID NO: 1060048 - RNA, 18 nt, Human
uaccagggaccugguugc

SEQ ID NO: 1060049 - RNA, 19 nt, Human
uaggaccccacaaagcccc

SEQ ID NO: 1060050 - RNA, 18 nt, Human
uaggauggggcuggggca

SEQ ID NO: 1060051 - RNA, 24 nt, Human
ucaaaccagccccaaaccccuccc

SEQ ID NO: 1060052 - RNA, 24 nt, Human
ucacacgugcaccaagaauccaaa

SEQ ID NO: 1060053 - RNA, 19 nt, Human
ucagagacuuuuccugugg

SEQ ID NO: 1060054 - RNA, 25 nt, Human
ucauggaaagaccccuugaaggccu

SEQ ID NO: 1060055 - RNA, 24 nt, Human
uccaaaaucccaaauaaauggccc

SEQ ID NO: 1060056 - RNA, 23 nt, Human
uccccaagcaggccacggggacu

SEQ ID NO: 1060057 - RNA, 19 nt, Human
ucccccaggagaaaugggg

SEQ ID NO: 1060058 - RNA, 25 nt, Human
ucucaguccccaagcaggccacggg

SEQ ID NO: 1060059 - RNA, 18 nt, Human
ucuguccuugucuccucu

SEQ ID NO: 1060060 - RNA, 20 nt, Human
ugagaggucugagcagcucc

SEQ ID NO: 1060061 - RNA, 25 nt, Human
ugagcagcuccuguacucaagugga

SEQ ID NO: 1060062 - RNA, 24 nt, Human
ugcagcaaacagagcggcagaaac

SEQ ID NO: 1060063 - RNA, 23 nt, Human
ugcagcuaccaagaaaugucagg

SEQ ID NO: 1060064 - RNA, 20 nt, Human
ugccucaaacuuugggauuu

SEQ ID NO: 1060065 - RNA, 18 nt, Human
ugccugggguaggucuuc

SEQ ID NO: 1060066 - RNA, 18 nt, Human
uggaaaacaaacagcaga

SEQ ID NO: 1060067 - RNA, 23 nt, Human
uggaaaacaaacagcagaagaua

SEQ ID NO: 1060068 - RNA, 22 nt, Human
uggaagucauagguuuugcucc

SEQ ID NO: 1060069 - RNA, 22 nt, Human
uggaaugaggagggacagggag

SEQ ID NO: 1060070 - RNA, 19 nt, Human
uggcuggggcugcucacug

SEQ ID NO: 1060071 - RNA, 20 nt, Human
uggcuggggcugcucacugg

SEQ ID NO: 1060072 - RNA, 21 nt, Human
uggggaaggacaaagaauggg

SEQ ID NO: 1060073 - RNA, 20 nt, Human
uggggacccauagggccuug

SEQ ID NO: 1060074 - RNA, 19 nt, Human
uggggcagucacagagggc

SEQ ID NO: 1060075 - RNA, 20 nt, Human
ugggguaggauggggcuggg

SEQ ID NO: 1060076 - RNA, 18 nt, Human
uggguaacuccugcuucu

SEQ ID NO: 1060077 - RNA, 25 nt, Human
ugggugcagggaucaugcugccauu

SEQ ID NO: 1060078 - RNA, 19 nt, Human
uguccucugaaccucuccu

SEQ ID NO: 1060079 - RNA, 23 nt, Human
ugucugucugucuuucccucacu

SEQ ID NO: 1060080 - RNA, 21 nt, Human
uguuuuguuuuguuuuuuuua

SEQ ID NO: 1060081 - RNA, 21 nt, Human
uucacuuguagcuccucacaa

SEQ ID NO: 1060082 - RNA, 20 nt, Human
uuccugaggaaguaacuggc

SEQ ID NO: 1060083 - RNA, 19 nt, Human
uucuugcaguggaggucau

SEQ ID NO: 1060084 - RNA, 22 nt, Human
uugaagagcuggcuggggcugc

SEQ ID NO: 1060085 - RNA, 22 nt, Human
uugucuccucuuucuuccuaac

SEQ ID NO: 1060086 - RNA, 18 nt, Human
uuucuugucuuccucuac

SEQ ID NO: 1060087 - RNA, 21 nt, Human
aaacaaaacgugaagaagcaa

SEQ ID NO: 1060088 - RNA, 21 nt, Human
aaauaauuagcaaaaauccaa

SEQ ID NO: 1060089 - RNA, 24 nt, Human
aaaucccaggucacacuuguuucu

SEQ ID NO: 1060090 - RNA, 20 nt, Human
acagcaaagcuuuucacaau

SEQ ID NO: 1060091 - RNA, 19 nt, Human
acccgugccgucagccccg

SEQ ID NO: 1060092 - RNA, 23 nt, Human
acuccgugcucaauaaaaacaaa

SEQ ID NO: 1060093 - RNA, 23 nt, Human
agaaagcaacaugaacggcagau

SEQ ID NO: 1060094 - RNA, 18 nt, Human
agaaagcaucaaauacca

SEQ ID NO: 1060095 - RNA, 24 nt, Human
agagaagcagagagucgcggccaa

SEQ ID NO: 1060096 - RNA, 19 nt, Human
agggugccacugagcaaaa

SEQ ID NO: 1060097 - RNA, 20 nt, Human
augcaaacgaaauaaugacc

SEQ ID NO: 1060098 - RNA, 18 nt, Human
augugauucacgacagcc

SEQ ID NO: 1060099 - RNA, 19 nt, Human
cacuccucuccccgccaaa

SEQ ID NO: 1060100 - RNA, 21 nt, Human
cacuccucuccccgccaaaac

SEQ ID NO: 1060101 - RNA, 23 nt, Human
cagagagucgcggccaaguccca

SEQ ID NO: 1060102 - RNA, 20 nt, Human
cagcagcaugcggagugguu

SEQ ID NO: 1060103 - RNA, 19 nt, Human
cagccccgucuccugaccc

SEQ ID NO: 1060104 - RNA, 18 nt, Human
cagcuccaggacugcugc

SEQ ID NO: 1060105 - RNA, 21 nt, Human
caugcaaacgaaauaaugacc

SEQ ID NO: 1060106 - RNA, 19 nt, Human
ccaaaaaauucccagcuuc

SEQ ID NO: 1060107 - RNA, 20 nt, Human
ccacagaaagccucauuuca

SEQ ID NO: 1060108 - RNA, 22 nt, Human
ccacccgugccgucagccccgu

SEQ ID NO: 1060109 - RNA, 22 nt, Human
cccaagccugggucacugcuac

SEQ ID NO: 1060110 - RNA, 22 nt, Human
ccuaacccauggacacuaggga

SEQ ID NO: 1060111 - RNA, 21 nt, Human
ccucuccccgccaaaaccaaa

SEQ ID NO: 1060112 - RNA, 19 nt, Human
ccugaccgacgcugcuacc

SEQ ID NO: 1060113 - RNA, 20 nt, Human
ccugggucacugcuacaugg

SEQ ID NO: 1060114 - RNA, 19 nt, Human
cgaggacagaagcggccgg

SEQ ID NO: 1060115 - RNA, 25 nt, Human
cgcaugccgagcacgguggagcgcc

SEQ ID NO: 1060116 - RNA, 21 nt, Human
cgccaaaaccaaauaaacaaa

SEQ ID NO: 1060117 - RNA, 18 nt, Human
cgugugcacgaccgcaug

SEQ ID NO: 1060118 - RNA, 22 nt, Human
cuaaaaauaauuagcaaaaauc

SEQ ID NO: 1060119 - RNA, 20 nt, Human
cucaguuagccaucugcgcc

SEQ ID NO: 1060120 - RNA, 24 nt, Human
cuccaggacugcugcgcugguggu

SEQ ID NO: 1060121 - RNA, 19 nt, Human
cuccuguacuucuaaagcc

SEQ ID NO: 1060122 - RNA, 18 nt, Human
cuggcucccaagccuggg

SEQ ID NO: 1060123 - RNA, 18 nt, Human
cuuuccuuucucuccuuu

SEQ ID NO: 1060124 - RNA, 20 nt, Human
cuuuccuuucucuccuuucu

SEQ ID NO: 1060125 - RNA, 20 nt, Human
gaaucuagcaaaaccuacac

SEQ ID NO: 1060126 - RNA, 23 nt, Human
gaggauccggaagcacuagagga

SEQ ID NO: 1060127 - RNA, 21 nt, Human
gagucaauguucgcgaacuga

SEQ ID NO: 1060128 - RNA, 20 nt, Human
gagucgcggccaagucccaa

SEQ ID NO: 1060129 - RNA, 19 nt, Human
gccaaaaccaaauaaacaa

SEQ ID NO: 1060130 - RNA, 29 nt, Human
gcuggugguggcggcggcuccucgcgcuu

SEQ ID NO: 1060131 - RNA, 21 nt, Human
ggaaggaaagucacugggagg

SEQ ID NO: 1060132 - RNA, 20 nt, Human
ggcagauccucaugugaaag

SEQ ID NO: 1060133 - RNA, 21 nt, Human
ggccgguggcgggacgcagga

SEQ ID NO: 1060134 - RNA, 20 nt, Human
gugguggcggcggcuccucg

SEQ ID NO: 1060135 - RNA, 22 nt, Human
guucaaccuccuugugccgucu

SEQ ID NO: 1060136 - RNA, 19 nt, Human
guuuaggguuacauugucc

SEQ ID NO: 1060137 - RNA, 21 nt, Human
uacauuguccacagaaagcau

SEQ ID NO: 1060138 - RNA, 23 nt, Human
uaccacuccucuccccgccaaaa

SEQ ID NO: 1060139 - RNA, 21 nt, Human
uaccggcccguuuuccccagc

SEQ ID NO: 1060140 - RNA, 22 nt, Human
uacugaauuaccuucuaauucc

SEQ ID NO: 1060141 - RNA, 22 nt, Human
uagcaaaaauccaagaaaaaaa

SEQ ID NO: 1060142 - RNA, 22 nt, Human
uagcaaaaccuacaccauauuu

SEQ ID NO: 1060143 - RNA, 19 nt, Human
ucacugggagggagcaugc

SEQ ID NO: 1060144 - RNA, 21 nt, Human
ucacugggagggagcaugcag

SEQ ID NO: 1060145 - RNA, 19 nt, Human
ucaguuagccaucugcgcc

SEQ ID NO: 1060146 - RNA, 19 nt, Human
uccaagaaaaaaauaugga

SEQ ID NO: 1060147 - RNA, 21 nt, Human
uccaagaggacaaaggagaaa

SEQ ID NO: 1060148 - RNA, 24 nt, Human
uccacagaaagcaucaaauaccac

SEQ ID NO: 1060149 - RNA, 22 nt, Human
ucccaaacgucuguccccgcca

SEQ ID NO: 1060150 - RNA, 26 nt, Human
ucccaggucacacuuguuucuggcuc

SEQ ID NO: 1060151 - RNA, 22 nt, Human
uccccagcauggcccuaacccu

SEQ ID NO: 1060152 - RNA, 24 nt, Human
uccccgccaaaaccaaauaaacaa

SEQ ID NO: 1060153 - RNA, 20 nt, Human
uccuuucucuccuuucuccc

SEQ ID NO: 1060154 - RNA, 19 nt, Human
ucuccugacccugcucuga

SEQ ID NO: 1060155 - RNA, 21 nt, Human
ugaaacaugaguucaaccucc

SEQ ID NO: 1060156 - RNA, 23 nt, Human
ugaccgacgcugcuaccuagcgc

SEQ ID NO: 1060157 - RNA, 22 nt, Human
ugaccggaagugggcgcaucua

SEQ ID NO: 1060158 - RNA, 22 nt, Human
ugauccgugaucgcauaauccu

SEQ ID NO: 1060159 - RNA, 25 nt, Human
ugccgucagccccgucuccugaccc

SEQ ID NO: 1060160 - RNA, 19 nt, Human
ugcuaccuagcgcgugugc

SEQ ID NO: 1060161 - RNA, 22 nt, Human
uggagagaagcagagagucgcg

SEQ ID NO: 1060162 - RNA, 18 nt, Human
uggagcgccagcgucugg

SEQ ID NO: 1060163 - RNA, 20 nt, Human
uggcggcggcuccucgcgcu

SEQ ID NO: 1060164 - RNA, 21 nt, Human
uggguguuuugcgcgugugua

SEQ ID NO: 1060165 - RNA, 23 nt, Human
ugugcacgaccgcaugccgagca

SEQ ID NO: 1060166 - RNA, 19 nt, Human
uguggccucgagacagucc

SEQ ID NO: 1060167 - RNA, 21 nt, Human
uguuaaauaaaaucccagguc

SEQ ID NO: 1060168 - RNA, 21 nt, Human
uuagcaaaaauccaagaaaaa

SEQ ID NO: 1060169 - RNA, 23 nt, Human
uucaacacugcuagauuaaaauu

SEQ ID NO: 1060170 - RNA, 22 nt, Human
uuccagcagcaugcggaguggu

SEQ ID NO: 1060171 - RNA, 18 nt, Human
uuuuuuuuuuuuuuuuug

SEQ ID NO: 1060172 - RNA, 23 nt, Human
uuuuuuuuuuuuuuuuuuguauu

SEQ ID NO: 1060173 - RNA, 19 nt, Human
acagcgggggccacauggc

SEQ ID NO: 1060174 - RNA, 23 nt, Human
acaguucugccccagagcugccc

SEQ ID NO: 1060175 - RNA, 23 nt, Human
agcaacagcgggggccacauggc

SEQ ID NO: 1060176 - RNA, 20 nt, Human
agcagcagcagcaacagcgg

SEQ ID NO: 1060177 - RNA, 24 nt, Human
cacgagccugagccacgcccucga

SEQ ID NO: 1060178 - RNA, 23 nt, Human
cagcagcagcagcagcaacagcg

SEQ ID NO: 1060179 - RNA, 25 nt, Human
ccccagagcugcccuggagcucgga

SEQ ID NO: 1060180 - RNA, 19 nt, Human
ccugagccacgcccucgag

SEQ ID NO: 1060181 - RNA, 21 nt, Human
ccugcgggcagggcggcuguc

SEQ ID NO: 1060182 - RNA, 19 nt, Human
cggccgggagcagcagcag

SEQ ID NO: 1060183 - RNA, 23 nt, Human
cggggcggccgggagcagcagca

SEQ ID NO: 1060184 - RNA, 23 nt, Human
gacgccuccacgagccugagcca

SEQ ID NO: 1060185 - RNA, 21 nt, Human
gcccuggagcucggacgccuc

SEQ ID NO: 1060186 - RNA, 18 nt, Human
gcgguggggaccggggcg

SEQ ID NO: 1060187 - RNA, 19 nt, Human
gcgguggggaccggggcgg

SEQ ID NO: 1060188 - RNA, 22 nt, Human
gcgguggggaccggggcggccg

SEQ ID NO: 1060189 - RNA, 19 nt, Human
gggagcggcuuuggcggug

SEQ ID NO: 1060190 - RNA, 20 nt, Human
gggagcggcuuuggcggugg

SEQ ID NO: 1060191 - RNA, 23 nt, Human
gggauuguuagauccggacaguu

SEQ ID NO: 1060192 - RNA, 19 nt, Human
ucaccggucuccggcuccc

SEQ ID NO: 1060193 - RNA, 19 nt, Human
uccacgagccugagccacg

SEQ ID NO: 1060194 - RNA, 26 nt, Human
acaucaccuuuucuggguuccuccaa

SEQ ID NO: 1060195 - RNA, 24 nt, Human
cugaaaauguaaaccucacuaaca

SEQ ID NO: 1060196 - RNA, 19 nt, Human
ucauaacaucaccuuuucu

SEQ ID NO: 1060197 - RNA, 19 nt, Human
uccuugugguuuaaucuag

SEQ ID NO: 1060198 - RNA, 20 nt, Human
uucaagaagucauaacaagg

SEQ ID NO: 1060199 - RNA, 22 nt, Human
uuuaaucuagaaaacagaaucc

SEQ ID NO: 1060200 - RNA, 23 nt, Human
uuuuuuuuuuuuuuuuucuaguu

SEQ ID NO: 1060201 - RNA, 19 nt, Human
agcuggaaggcagagcgcu

SEQ ID NO: 1060202 - RNA, 22 nt, Human
ugacaacaucuagcuggaaggc

SEQ ID NO: 1060203 - RNA, 24 nt, Human
ugcaaugacaacaucuagcuggaa

SEQ ID NO: 1060204 - RNA, 24 nt, Human
aaaaauaagugagaaaaaagauaa

SEQ ID NO: 1060205 - RNA, 21 nt, Human
aaaagcccgucacucccuaag

SEQ ID NO: 1060206 - RNA, 23 nt, Human
aaacuaaacucuuuaagaagaaa

SEQ ID NO: 1060207 - RNA, 23 nt, Human
aaagaaaaaaaacccaauaauua

SEQ ID NO: 1060208 - RNA, 21 nt, Human
aagagaaacucuugcaugccc

SEQ ID NO: 1060209 - RNA, 18 nt, Human
aagugagaaaaaagauaa

SEQ ID NO: 1060210 - RNA, 20 nt, Human
aauaagugagaaaaaagaua

SEQ ID NO: 1060211 - RNA, 23 nt, Human
acccugaucccucuggagaggaa

SEQ ID NO: 1060212 - RNA, 25 nt, Human
agaagaaaaccaaacccaaccugaa

SEQ ID NO: 1060213 - RNA, 22 nt, Human
agagaaacucuugcaugcccuc

SEQ ID NO: 1060214 - RNA, 25 nt, Human
agcaggaaaaagaaaaaaaacccaa

SEQ ID NO: 1060215 - RNA, 19 nt, Human
agccgggcgccagggugcc

SEQ ID NO: 1060216 - RNA, 18 nt, Human
caaaaauaagugagaaaa

SEQ ID NO: 1060217 - RNA, 18 nt, Human
caacucgaagccaggcgg

SEQ ID NO: 1060218 - RNA, 18 nt, Human
cacaccagugaggggcaa

SEQ ID NO: 1060219 - RNA, 23 nt, Human
cagcaggaaaaagaaaaaaaacc

SEQ ID NO: 1060220 - RNA, 22 nt, Human
cagccgccagccgggcgccagg

SEQ ID NO: 1060221 - RNA, 24 nt, Human
cauauauucuucagcaaaaauaua

SEQ ID NO: 1060222 - RNA, 23 nt, Human
caugaaauccauuaagcugcugg

SEQ ID NO: 1060223 - RNA, 21 nt, Human
ccaaccugaacuaaucgucca

SEQ ID NO: 1060224 - RNA, 21 nt, Human
ccacgaaaggcagauuuccau

SEQ ID NO: 1060225 - RNA, 24 nt, Human
cccggcgccccccaggcucuacaa

SEQ ID NO: 1060226 - RNA, 22 nt, Human
cccucgacuuucaccgcaaaaa

SEQ ID NO: 1060227 - RNA, 19 nt, Human
ccuagaguccucugcgucc

SEQ ID NO: 1060228 - RNA, 21 nt, Human
ccugaacuaaucguccaagga

SEQ ID NO: 1060229 - RNA, 23 nt, Human
cgaaaggcagauuuccauccaca

SEQ ID NO: 1060230 - RNA, 23 nt, Human
cgccagccgggcgccagggugcc

SEQ ID NO: 1060231 - RNA, 21 nt, Human
cuaaacucuuuaagaagaaaa

SEQ ID NO: 1060232 - RNA, 21 nt, Human
cuagaguccucugcguccugg

SEQ ID NO: 1060233 - RNA, 24 nt, Human
cucccuaagaggacccugaucccu

SEQ ID NO: 1060234 - RNA, 21 nt, Human
cuuuaagaagaaaaccaaacc

SEQ ID NO: 1060235 - RNA, 21 nt, Human
cuuugccacccggcgcccccc

SEQ ID NO: 1060236 - RNA, 24 nt, Human
gaaacucuugcaugcccucgacuu

SEQ ID NO: 1060237 - RNA, 21 nt, Human
gaagaaaaccaaacccaaccu

SEQ ID NO: 1060238 - RNA, 24 nt, Human
gaagaaaaccaaacccaaccugaa

SEQ ID NO: 1060239 - RNA, 20 nt, Human
gacuuucaccgcaaaaauaa

SEQ ID NO: 1060240 - RNA, 21 nt, Human
gagaaaaaagauaaaucccau

SEQ ID NO: 1060241 - RNA, 19 nt, Human
gccagccgggcgccagggu

SEQ ID NO: 1060242 - RNA, 23 nt, Human
guccacgugacgcaaaugccacc

SEQ ID NO: 1060243 - RNA, 22 nt, Human
gugagaaaaaagauaaauccca

SEQ ID NO: 1060244 - RNA, 20 nt, Human
gugaggggcaaguguccggg

SEQ ID NO: 1060245 - RNA, 20 nt, Human
guucuccucuuggcuucugg

SEQ ID NO: 1060246 - RNA, 19 nt, Human
uaagaagaaaaccaaaccc

SEQ ID NO: 1060247 - RNA, 23 nt, Human
uacagcaggaaaaagaaaaaaaa

SEQ ID NO: 1060248 - RNA, 26 nt, Human
uauacagcaggaaaaagaaaaaaaac

SEQ ID NO: 1060249 - RNA, 19 nt, Human
uauuucauuccaugaaauc

SEQ ID NO: 1060250 - RNA, 21 nt, Human
ucaccagccgccagccgggcg

SEQ ID NO: 1060251 - RNA, 20 nt, Human
uccaaaggguggaauaguac

SEQ ID NO: 1060252 - RNA, 19 nt, Human
uccacgugacgcaaaugcc

SEQ ID NO: 1060253 - RNA, 23 nt, Human
uccacgugacgcaaaugccaccc

SEQ ID NO: 1060254 - RNA, 22 nt, Human
ucccacgaaaggcagauuucca

SEQ ID NO: 1060255 - RNA, 21 nt, Human
ucccuaagaggacccugaucc

SEQ ID NO: 1060256 - RNA, 22 nt, Human
ucuuuaagaagaaaaccaaacc

SEQ ID NO: 1060257 - RNA, 20 nt, Human
ugaaauccauuaagcugcug

SEQ ID NO: 1060258 - RNA, 18 nt, Human
ugccacccuuuccauaua

SEQ ID NO: 1060259 - RNA, 18 nt, Human
uggcauuugcauggcucu

SEQ ID NO: 1060260 - RNA, 18 nt, Human
uuguucuccucuuggcuu

SEQ ID NO: 1060261 - RNA, 21 nt, Human
agaucugaaagacccggcugu

SEQ ID NO: 1060262 - RNA, 26 nt, Human
caagaguaaaugaacucggaagacca

SEQ ID NO: 1060263 - RNA, 21 nt, Human
caccacccaagaguaaaugaa

SEQ ID NO: 1060264 - RNA, 22 nt, Human
ccacccaagaguaaaugaacuc

SEQ ID NO: 1060265 - RNA, 20 nt, Human
ccggcugugcacggugcugu

SEQ ID NO: 1060266 - RNA, 19 nt, Human
cggaagaccacagcaucaa

SEQ ID NO: 1060267 - RNA, 25 nt, Human
cuugaagacaccuucaaggucacuc

SEQ ID NO: 1060268 - RNA, 25 nt, Human
gacccggcugugcacggugcuguca

SEQ ID NO: 1060269 - RNA, 21 nt, Human
guauaagaucugaaagacccg

SEQ ID NO: 1060270 - RNA, 23 nt, Human
uaccucuucauuccgguauaaga

SEQ ID NO: 1060271 - RNA, 20 nt, Human
ucaaggucacucggaucugg

SEQ ID NO: 1060272 - RNA, 24 nt, Human
ucagucugugggggauccuugaag

SEQ ID NO: 1060273 - RNA, 22 nt, Human
aaggagacagagacggucaugg

SEQ ID NO: 1060274 - RNA, 27 nt, Human
acagacgaugacacaagcugcgaugug

SEQ ID NO: 1060275 - RNA, 20 nt, Human
agacgaugacacaagcugcg

SEQ ID NO: 1060276 - RNA, 22 nt, Human
agagacggucaugguggccccc

SEQ ID NO: 1060277 - RNA, 22 nt, Human
agcgcggaggucccggggagga

SEQ ID NO: 1060278 - RNA, 18 nt, Human
caucagaaauaaaacuca

SEQ ID NO: 1060279 - RNA, 22 nt, Human
caucagaaauaaaacucagcca

SEQ ID NO: 1060280 - RNA, 24 nt, Human
caucagaaauaaaacucagccagc

SEQ ID NO: 1060281 - RNA, 21 nt, Human
cucagccagcugucuucccag

SEQ ID NO: 1060282 - RNA, 21 nt, Human
gcaucagaaauaaaacucagc

SEQ ID NO: 1060283 - RNA, 19 nt, Human
gcgccgcgagagcgcggag

SEQ ID NO: 1060284 - RNA, 27 nt, Human
uaaaacucagccagcugucuucccaga

SEQ ID NO: 1060285 - RNA, 22 nt, Human
uccagaagcgccgcgagagcgc

SEQ ID NO: 1060286 - RNA, 24 nt, Human
agagcuuggacgucuggucugggc

SEQ ID NO: 1060287 - RNA, 22 nt, Human
cggaccguggggcagagggagg

SEQ ID NO: 1060288 - RNA, 18 nt, Human
cugcgggauggcccgugg

SEQ ID NO: 1060289 - RNA, 20 nt, Human
cuggucugggccuggcacug

SEQ ID NO: 1060290 - RNA, 22 nt, Human
ggaaggcagcugugcccgcagg

SEQ ID NO: 1060291 - RNA, 23 nt, Human
gggaggcucggcagcuccucugg

SEQ ID NO: 1060292 - RNA, 24 nt, Human
gggcagagggaggcucggcagcuc

SEQ ID NO: 1060293 - RNA, 19 nt, Human
uagcaggacaagcacaggg

SEQ ID NO: 1060294 - RNA, 23 nt, Human
uggggcagagggaggcucccccg

SEQ ID NO: 1060295 - RNA, 24 nt, Human
aaaguguugggauuacaggcauga

SEQ ID NO: 1060296 - RNA, 27 nt, Human
aagcgauucuccugccucaaccuccca

SEQ ID NO: 1060297 - RNA, 21 nt, Human
aaguguugggauuacaggcau

SEQ ID NO: 1060298 - RNA, 26 nt, Human
aaguguugggauuacaggcaugagcc

SEQ ID NO: 1060299 - RNA, 24 nt, Human
accauguuggccaggcuggucucg

SEQ ID NO: 1060300 - RNA, 22 nt, Human
acccgccucggccucucaaagu

SEQ ID NO: 1060301 - RNA, 18 nt, Human
acgggguuucaccauguu

SEQ ID NO: 1060302 - RNA, 23 nt, Human
acgggguuucaccauguuggcca

SEQ ID NO: 1060303 - RNA, 24 nt, Human
acgggguuucaccauguuggccag

SEQ ID NO: 1060304 - RNA, 21 nt, Human
agaggacagaaucaaaaucug

SEQ ID NO: 1060305 - RNA, 18 nt, Human
aggugacccacccgccuc

SEQ ID NO: 1060306 - RNA, 24 nt, Human
auauuuuauuuuuuaguagagacg

SEQ ID NO: 1060307 - RNA, 23 nt, Human
caaaguguugggauuacaggcau

SEQ ID NO: 1060308 - RNA, 24 nt, Human
caaaguguugggauuacaggcaug

SEQ ID NO: 1060309 - RNA, 20 nt, Human
caauggugcaaucuuggcuc

SEQ ID NO: 1060310 - RNA, 21 nt, Human
caauggugcaaucuuggcuca

SEQ ID NO: 1060311 - RNA, 21 nt, Human
caccauguuggccaggcuggu

SEQ ID NO: 1060312 - RNA, 24 nt, Human
caccauguuggccaggcuggucuc

SEQ ID NO: 1060313 - RNA, 27 nt, Human
caccauguuggccaggcuggucucgaa

SEQ ID NO: 1060314 - RNA, 23 nt, Human
cacccgccucggccucucaaagu

SEQ ID NO: 1060315 - RNA, 20 nt, Human
caccgggcacccaggcuggu

SEQ ID NO: 1060316 - RNA, 21 nt, Human
caccugcugggcuaaaaucau

SEQ ID NO: 1060317 - RNA, 21 nt, Human
cacugcaaccuucgccuccca

SEQ ID NO: 1060318 - RNA, 25 nt, Human
cagccucauugaugcccucagugau

SEQ ID NO: 1060319 - RNA, 22 nt, Human
caggaugcaccaccaugcacgg

SEQ ID NO: 1060320 - RNA, 24 nt, Human
cauguuggccaggcuggucucgaa

SEQ ID NO: 1060321 - RNA, 24 nt, Human
ccagaagucuuccuccaaggcugg

SEQ ID NO: 1060322 - RNA, 18 nt, Human
ccagaggacagaaucaaa

SEQ ID NO: 1060323 - RNA, 21 nt, Human
cccagaagucuuccuccaagg

SEQ ID NO: 1060324 - RNA, 20 nt, Human
cccagguucaagcgauucuc

SEQ ID NO: 1060325 - RNA, 23 nt, Human
cccagguucaagcgauucuccug

SEQ ID NO: 1060326 - RNA, 24 nt, Human
ccucccagguucaagcgauucucc

SEQ ID NO: 1060327 - RNA, 22 nt, Human
ccugaccucaggugacccaccc

SEQ ID NO: 1060328 - RNA, 23 nt, Human
ccugaccucaggugacccacccg

SEQ ID NO: 1060329 - RNA, 19 nt, Human
cucaaccucccaaguagcu

SEQ ID NO: 1060330 - RNA, 24 nt, Human
cucacugcaaccuucgccucccag

SEQ ID NO: 1060331 - RNA, 18 nt, Human
cuccucuagcccaggcug

SEQ ID NO: 1060332 - RNA, 20 nt, Human
cucuuguugcccaggcugga

SEQ ID NO: 1060333 - RNA, 23 nt, Human
cugcaaccuucgccucccagguu

SEQ ID NO: 1060334 - RNA, 24 nt, Human
cugcaaccuucgccucccagguuc

SEQ ID NO: 1060335 - RNA, 22 nt, Human
cuggagccaagacuaugugucu

SEQ ID NO: 1060336 - RNA, 24 nt, Human
gagacgggguuucaccauguuggc

SEQ ID NO: 1060337 - RNA, 20 nt, Human
gauuacaggaugcaccacca

SEQ ID NO: 1060338 - RNA, 21 nt, Human
gauuacaggaugcaccaccau

SEQ ID NO: 1060339 - RNA, 18 nt, Human
gauuacaggcaugagcca

SEQ ID NO: 1060340 - RNA, 22 nt, Human
gauuacaggcaugagccacugc

SEQ ID NO: 1060341 - RNA, 23 nt, Human
gauuacaggcaugagccacugca

SEQ ID NO: 1060342 - RNA, 23 nt, Human
gcaccgggcacccaggcugguuu

SEQ ID NO: 1060343 - RNA, 23 nt, Human
gccaagacuaugugucucugcuc

SEQ ID NO: 1060344 - RNA, 20 nt, Human
gccucaaccucccaaguagc

SEQ ID NO: 1060345 - RNA, 20 nt, Human
gcucuuguugcccaggcugg

SEQ ID NO: 1060346 - RNA, 21 nt, Human
gcucuuguugcccaggcugga

SEQ ID NO: 1060347 - RNA, 23 nt, Human
gcuggucucgaacuccugaccuc

SEQ ID NO: 1060348 - RNA, 22 nt, Human
ggauuacaggcaugagccacug

SEQ ID NO: 1060349 - RNA, 24 nt, Human
ggcuggucucgaacuccugaccuc

SEQ ID NO: 1060350 - RNA, 23 nt, Human
gggguuucaccauguuggccagg

SEQ ID NO: 1060351 - RNA, 22 nt, Human
ggguuucaccauguuggccagg

SEQ ID NO: 1060352 - RNA, 19 nt, Human
ggucucgaacuccugaccu

SEQ ID NO: 1060353 - RNA, 23 nt, Human
guagagacgggguuucaccaugu

SEQ ID NO: 1060354 - RNA, 22 nt, Human
gugacccacccgccucggccuc

SEQ ID NO: 1060355 - RNA, 22 nt, Human
uacaggcaugagccacugcacc

SEQ ID NO: 1060356 - RNA, 22 nt, Human
uagagacgggguuucaccaugu

SEQ ID NO: 1060357 - RNA, 24 nt, Human
uaguagagacgggguuucaccaug

SEQ ID NO: 1060358 - RNA, 26 nt, Human
uaguagagacgggguuucaccauguu

SEQ ID NO: 1060359 - RNA, 19 nt, Human
uauuuuauuuuuuaguaga

SEQ ID NO: 1060360 - RNA, 23 nt, Human
ucaaaguguugggauuacaggca

SEQ ID NO: 1060361 - RNA, 24 nt, Human
ucaaaguguugggauuacaggcau

SEQ ID NO: 1060362 - RNA, 19 nt, Human
ucacugcaaccuucgccuc

SEQ ID NO: 1060363 - RNA, 24 nt, Human
ucacugcaaccuucgccucccagg

SEQ ID NO: 1060364 - RNA, 25 nt, Human
ucacugcaaccuucgccucccaggu

SEQ ID NO: 1060365 - RNA, 23 nt, Human
uccaaggcugggccgggcagucc

SEQ ID NO: 1060366 - RNA, 21 nt, Human
ucccagguucaagcgauucuc

SEQ ID NO: 1060367 - RNA, 24 nt, Human
ucccagguucaagcgauucuccug

SEQ ID NO: 1060368 - RNA, 24 nt, Human
ucucaaaguguugggauuacaggc

SEQ ID NO: 1060369 - RNA, 26 nt, Human
ucuccugccucaaccucccaaguagc

SEQ ID NO: 1060370 - RNA, 23 nt, Human
ucucgaacuccugaccucaggug

SEQ ID NO: 1060371 - RNA, 24 nt, Human
ugaccucaggugacccacccgccu

SEQ ID NO: 1060372 - RNA, 25 nt, Human
ugaccucaggugacccacccgccuc

SEQ ID NO: 1060373 - RNA, 23 nt, Human
ugcaaccuucgccucccagguuc

SEQ ID NO: 1060374 - RNA, 18 nt, Human
ugcccagaagucuuccuc

SEQ ID NO: 1060375 - RNA, 19 nt, Human
ugcccaggcuggaguucaa

SEQ ID NO: 1060376 - RNA, 21 nt, Human
ugcccaggcuggaguucaaug

SEQ ID NO: 1060377 - RNA, 24 nt, Human
ugcccaggcuggaguucaauggug

SEQ ID NO: 1060378 - RNA, 23 nt, Human
ugccucaaccucccaaguagcua

SEQ ID NO: 1060379 - RNA, 25 nt, Human
ugccucaaccucccaaguagcuaug

SEQ ID NO: 1060380 - RNA, 24 nt, Human
ugcucuuguugcccaggcuggagu

SEQ ID NO: 1060381 - RNA, 20 nt, Human
ugcugggcuaaaaucaugac

SEQ ID NO: 1060382 - RNA, 24 nt, Human
uggaguucaauggugcaaucuugg

SEQ ID NO: 1060383 - RNA, 21 nt, Human
uggcauugauacagcugaagu

SEQ ID NO: 1060384 - RNA, 24 nt, Human
uggccaggcuggucucgaacuccu

SEQ ID NO: 1060385 - RNA, 20 nt, Human
uggccaucucgaauucuccu

SEQ ID NO: 1060386 - RNA, 18 nt, Human
ugggauuacaggcaugag

SEQ ID NO: 1060387 - RNA, 19 nt, Human
ugggauuacaggcaugagc

SEQ ID NO: 1060388 - RNA, 21 nt, Human
ugggauuacaggcaugagcca

SEQ ID NO: 1060389 - RNA, 22 nt, Human
ugggauuacaggcaugagccac

SEQ ID NO: 1060390 - RNA, 22 nt, Human
ugggauuacaggcaugagccac

SEQ ID NO: 1060391 - RNA, 24 nt, Human
ugggauuacaggcaugagccacug

SEQ ID NO: 1060392 - RNA, 24 nt, Human
ugggauuacaggcaugagccacug

SEQ ID NO: 1060393 - RNA, 26 nt, Human
ugggauuacaggcaugagccacugca

SEQ ID NO: 1060394 - RNA, 18 nt, Human
uuaguagagacgggguuu

SEQ ID NO: 1060395 - RNA, 22 nt, Human
uuaguagagacgggguuucacc

SEQ ID NO: 1060396 - RNA, 24 nt, Human
uuaguagagacgggguuucaccau

SEQ ID NO: 1060397 - RNA, 21 nt, Human
uucaagcgauucuccugccuc

SEQ ID NO: 1060398 - RNA, 24 nt, Human
uucaagcgauucuccugccucaac

SEQ ID NO: 1060399 - RNA, 23 nt, Human
uuccuccaaggcugggccgggca

SEQ ID NO: 1060400 - RNA, 22 nt, Human
uugcucuuguugcccaggcugg

SEQ ID NO: 1060401 - RNA, 23 nt, Human
uugcucuuguugcccaggcugga

SEQ ID NO: 1060402 - RNA, 21 nt, Human
uuggggauauagaugugcuuc

SEQ ID NO: 1060403 - RNA, 24 nt, Human
uuucaccauguuggccaggcuggu

SEQ ID NO: 1060404 - RNA, 24 nt, Human
uuugcucuuguugcccaggcugga

SEQ ID NO: 1060405 - RNA, 23 nt, Human
uuuugcucuuguugcccaggcug

SEQ ID NO: 1060406 - RNA, 24 nt, Human
uuuugcucuuguugcccaggcugg

SEQ ID NO: 1060407 - RNA, 24 nt, Human
uuuuuaguagagacgggguuucac

SEQ ID NO: 1060408 - RNA, 23 nt, Human
uuuuuuaguagagacgggguuuc

SEQ ID NO: 1060409 - RNA, 23 nt, Human
aacucgucauccucaucaucuuc

SEQ ID NO: 1060410 - RNA, 25 nt, Human
aacucgucauccucaucaucuucug

SEQ ID NO: 1060411 - RNA, 21 nt, Human
aagcccgccccucgcgccgcc

SEQ ID NO: 1060412 - RNA, 18 nt, Human
caagcagccgccgggagc

SEQ ID NO: 1060413 - RNA, 23 nt, Human
cauagcaaagugaguauaaaguu

SEQ ID NO: 1060414 - RNA, 19 nt, Human
ccgccgggagccugaaagc

SEQ ID NO: 1060415 - RNA, 22 nt, Human
ccgccgggagccugaaagcccg

SEQ ID NO: 1060416 - RNA, 18 nt, Human
ccugaaagcccgccccuc

SEQ ID NO: 1060417 - RNA, 23 nt, Human
cgacaaguggauaccuaaaaguu

SEQ ID NO: 1060418 - RNA, 19 nt, Human
gccugaaagcccgccccuc

SEQ ID NO: 1060419 - RNA, 21 nt, Human
uauaaaguucuacaauuuagu

SEQ ID NO: 1060420 - RNA, 22 nt, Human
uguaacaucuaacucgucaucc

SEQ ID NO: 1060421 - RNA, 22 nt, Human
uuggucagcauaaguuuccuuu

SEQ ID NO: 1060422 - RNA, 24 nt, Human
aagaaaaaggaaugauaaaaauau

SEQ ID NO: 1060423 - RNA, 19 nt, Human
auggagcuacaaagucugc

SEQ ID NO: 1060424 - RNA, 19 nt, Human
cacagcucugcucuuucac

SEQ ID NO: 1060425 - RNA, 19 nt, Human
cacuccucaccuguaacac

SEQ ID NO: 1060426 - RNA, 23 nt, Human
cagauuggaccagaacucgagug

SEQ ID NO: 1060427 - RNA, 24 nt, Human
cagcucugcucuuucaccugaggg

SEQ ID NO: 1060428 - RNA, 18 nt, Human
cauugaauuccaaaucug

SEQ ID NO: 1060429 - RNA, 18 nt, Human
ccugcuggacugacugcu

SEQ ID NO: 1060430 - RNA, 20 nt, Human
cugcuggacugacugcucug

SEQ ID NO: 1060431 - RNA, 23 nt, Human
cuucacagcucugcucuuucacc

SEQ ID NO: 1060432 - RNA, 23 nt, Human
gauaguucuucacagcucugcuc

SEQ ID NO: 1060433 - RNA, 19 nt, Human
gcuucauggcuguauagcu

SEQ ID NO: 1060434 - RNA, 19 nt, Human
uccuaggauuacacuccuc

SEQ ID NO: 1060435 - RNA, 24 nt, Human
uggagcuacaaagucugccacucu

SEQ ID NO: 1060436 - RNA, 21 nt, Human
uguggcauaucagggcuuugg

SEQ ID NO: 1060437 - RNA, 21 nt, Human
uuaauccauggcuucagauug

SEQ ID NO: 1060438 - RNA, 19 nt, Human
uugcaugaaacugacugau

SEQ ID NO: 1060439 - RNA, 20 nt, Human
agaggacauuuggaaaacuu

SEQ ID NO: 1060440 - RNA, 23 nt, Human
ugagauguuucuacgguagagga

SEQ ID NO: 1060441 - RNA, 20 nt, Human
aaagaaagaaaaauaagggu

SEQ ID NO: 1060442 - RNA, 22 nt, Human
aaccggccagccagggagccug

SEQ ID NO: 1060443 - RNA, 19 nt, Human
aagaggaaaaaaaucuaaa

SEQ ID NO: 1060444 - RNA, 20 nt, Human
aagcgcuggggaccgcgucu

SEQ ID NO: 1060445 - RNA, 23 nt, Human
accggccagccagggagccuggc

SEQ ID NO: 1060446 - RNA, 18 nt, Human
aggcauuuaaucaaggua

SEQ ID NO: 1060447 - RNA, 26 nt, Human
cacaaagaaagaaaaauaaggguuuc

SEQ ID NO: 1060448 - RNA, 24 nt, Human
caccuucacggcccagacgcccaa

SEQ ID NO: 1060449 - RNA, 22 nt, Human
caugcauaggcauuuaaucaag

SEQ ID NO: 1060450 - RNA, 19 nt, Human
ccaguggcucggcccggcg

SEQ ID NO: 1060451 - RNA, 19 nt, Human
cccaccuucacggcccaga

SEQ ID NO: 1060452 - RNA, 20 nt, Human
cccccgggggcgcucuccgc

SEQ ID NO: 1060453 - RNA, 19 nt, Human
ccgcgccgccgucacuugc

SEQ ID NO: 1060454 - RNA, 19 nt, Human
ccggaggcccuggaaggcu

SEQ ID NO: 1060455 - RNA, 24 nt, Human
ccgucacuugcgugccccgccccc

SEQ ID NO: 1060456 - RNA, 18 nt, Human
ccugcuucucccaguggc

SEQ ID NO: 1060457 - RNA, 21 nt, Human
cggcccagacgcccaaaccgg

SEQ ID NO: 1060458 - RNA, 18 nt, Human
cuccucggguccacgggc

SEQ ID NO: 1060459 - RNA, 21 nt, Human
cucuaagccuguccugccugc

SEQ ID NO: 1060460 - RNA, 24 nt, Human
cucuggccugcuucucccaguggg

SEQ ID NO: 1060461 - RNA, 20 nt, Human
gcgcuggggaccgcgucuuc

SEQ ID NO: 1060462 - RNA, 19 nt, Human
gcgugccccgcccccgggg

SEQ ID NO: 1060463 - RNA, 23 nt, Human
ggaaggcucuggccugcuucucc

SEQ ID NO: 1060464 - RNA, 21 nt, Human
ggagcggggugggacguccgu

SEQ ID NO: 1060465 - RNA, 25 nt, Human
ggcccggcgguucuccagcgacagg

SEQ ID NO: 1060466 - RNA, 22 nt, Human
gguaagaggaacagcaguggaa

SEQ ID NO: 1060467 - RNA, 19 nt, Human
guggaacuuaaauaugaua

SEQ ID NO: 1060468 - RNA, 23 nt, Human
ucaguucuguauacaaucuauau

SEQ ID NO: 1060469 - RNA, 18 nt, Human
uccacgggccggaggccc

SEQ ID NO: 1060470 - RNA, 22 nt, Human
uccacgggccggaggcccugga

SEQ ID NO: 1060471 - RNA, 21 nt, Human
uccguggcccaagcgcugggg

SEQ ID NO: 1060472 - RNA, 18 nt, Human
ucuaaauaccauccuuga

SEQ ID NO: 1060473 - RNA, 21 nt, Human
ucuccagcgacagaggagcgg

SEQ ID NO: 1060474 - RNA, 19 nt, Human
ucucuaagccuguccugcc

SEQ ID NO: 1060475 - RNA, 22 nt, Human
ugcaaaccauaaauauaaaaca

SEQ ID NO: 1060476 - RNA, 22 nt, Human
uggcccaagcgcuggggaccgc

SEQ ID NO: 1060477 - RNA, 25 nt, Human
uggccgcccagcgcuccaccacccg

SEQ ID NO: 1060478 - RNA, 21 nt, Human
ugggacguccguggcccaagc

SEQ ID NO: 1060479 - RNA, 20 nt, Human
ugucccauuccucucuuggc

SEQ ID NO: 1060480 - RNA, 21 nt, Human
uguuugguuuugugucccauu

SEQ ID NO: 1060481 - RNA, 23 nt, Human
uuaaaaguuucuuuugugagaug

SEQ ID NO: 1060482 - RNA, 23 nt, Human
uuccucacaguugaaaauaguuu

SEQ ID NO: 1060483 - RNA, 18 nt, Human
uugaaaaaagguuaagag

SEQ ID NO: 1060484 - RNA, 25 nt, Human
uuuauuguagguauuaaaaguuucu

SEQ ID NO: 1060485 - RNA, 20 nt, Human
caccccacaaccccaugcuc

SEQ ID NO: 1060486 - RNA, 23 nt, Human
caccccacaaccccaugcucuuc

SEQ ID NO: 1060487 - RNA, 25 nt, Human
caccccacaaccccaugcucuucua

SEQ ID NO: 1060488 - RNA, 18 nt, Human
ccaguauuuccacuugac

SEQ ID NO: 1060489 - RNA, 20 nt, Human
cccacaaccccaugcucuuc

SEQ ID NO: 1060490 - RNA, 18 nt, Human
ccuccaccccacaacccc

SEQ ID NO: 1060491 - RNA, 21 nt, Human
gccuccaccccacaaccccau

SEQ ID NO: 1060492 - RNA, 22 nt, Human
uucccugcucuuucagcugcca

SEQ ID NO: 1060493 - RNA, 18 nt, Human
uugccaguauuuccacuu

SEQ ID NO: 1060494 - RNA, 18 nt, Human
aagccauugguguaacag

SEQ ID NO: 1060495 - RNA, 21 nt, Human
accugucaaagcccacaggac

SEQ ID NO: 1060496 - RNA, 18 nt, Human
acuccgaggaucacggaa

SEQ ID NO: 1060497 - RNA, 19 nt, Human
agugagaccaagaacccac

SEQ ID NO: 1060498 - RNA, 21 nt, Human
cacaggaccagagucccgucc

SEQ ID NO: 1060499 - RNA, 18 nt, Human
caccuggucuccugggga

SEQ ID NO: 1060500 - RNA, 20 nt, Human
cagcagaagccauuggugua

SEQ ID NO: 1060501 - RNA, 20 nt, Human
caggaccagagucccgucca

SEQ ID NO: 1060502 - RNA, 23 nt, Human
caggaccagagucccguccaggg

SEQ ID NO: 1060503 - RNA, 21 nt, Human
cagugagaccaagaacccacc

SEQ ID NO: 1060504 - RNA, 21 nt, Human
cccacaggaccagagucccgu

SEQ ID NO: 1060505 - RNA, 20 nt, Human
ccugucaaagcccacaggac

SEQ ID NO: 1060506 - RNA, 18 nt, Human
uaaacgcaaaacgucgac

SEQ ID NO: 1060507 - RNA, 22 nt, Human
uaccacugucuccucacaccgg

SEQ ID NO: 1060508 - RNA, 25 nt, Human
ucacaccggacaugggauagccaca

SEQ ID NO: 1060509 - RNA, 24 nt, Human
ugacgucagugagaccaagaaccc

SEQ ID NO: 1060510 - RNA, 19 nt, Human
ugacugguaaaggcuauua

SEQ ID NO: 1060511 - RNA, 26 nt, Human
ugacugguaaaggcuauuaugguugg

SEQ ID NO: 1060512 - RNA, 18 nt, Human
ugagaccaagaacccacc

SEQ ID NO: 1060513 - RNA, 19 nt, Human
ugagaccaagaacccacca

SEQ ID NO: 1060514 - RNA, 21 nt, Human
uggcaggaaugcagugaccug

SEQ ID NO: 1060515 - RNA, 24 nt, Human
ugguguaacagcuaugaggucugc

SEQ ID NO: 1060516 - RNA, 19 nt, Human
uuagagcuggcuguaccac

SEQ ID NO: 1060517 - RNA, 22 nt, Human
aggcgggggcaggggcaggggc

SEQ ID NO: 1060518 - RNA, 24 nt, Human
cuagagcggcgacagaagcucuuc

SEQ ID NO: 1060519 - RNA, 18 nt, Human
gcaggggcaggggcagcc

SEQ ID NO: 1060520 - RNA, 19 nt, Human
gcggcgacagaagcucuuc

SEQ ID NO: 1060521 - RNA, 22 nt, Human
gggcaggggcagcucuccuuua

SEQ ID NO: 1060522 - RNA, 21 nt, Human
ggggcagcucuccuuuacccu

SEQ ID NO: 1060523 - RNA, 23 nt, Human
ugaaaaugacaaauucaguuucu

SEQ ID NO: 1060524 - RNA, 24 nt, Human
uugacacagaaguuagauaaauau

SEQ ID NO: 1060525 - RNA, 24 nt, Human
auauauccacuuuuuucuguucuu

SEQ ID NO: 1060526 - RNA, 18 nt, Human
auccacuuuuuucuguuc

SEQ ID NO: 1060527 - RNA, 20 nt, Human
ccacuuuuuucuguucuugu

SEQ ID NO: 1060528 - RNA, 27 nt, Human
acauucaauuuauuggucuuuguggag

SEQ ID NO: 1060529 - RNA, 19 nt, Human
caacaguauuccuccuaca

SEQ ID NO: 1060530 - RNA, 22 nt, Human
cagcaaugcuuuugaacgccaa

SEQ ID NO: 1060531 - RNA, 19 nt, Human
cagguaacaccaucuggca

SEQ ID NO: 1060532 - RNA, 21 nt, Human
cugaaacagcaaugcuuuuga

SEQ ID NO: 1060533 - RNA, 20 nt, Human
guaaguaauuaaggaacuac

SEQ ID NO: 1060534 - RNA, 20 nt, Human
uaaguaauuaaggaacuacu

SEQ ID NO: 1060535 - RNA, 29 nt, Human
uaauuaaggaacuacuuaacugaaacagg

SEQ ID NO: 1060536 - RNA, 24 nt, Human
uagccuuacuacauuguaaguaau

SEQ ID NO: 1060537 - RNA, 24 nt, Human
ugaacgccaacaguauuccuccua

SEQ ID NO: 1060538 - RNA, 24 nt, Human
uuaacacuugcgugcagcuuuuua

SEQ ID NO: 1060539 - RNA, 20 nt, Human
caccccaggcuugccuggcg

SEQ ID NO: 1060540 - RNA, 22 nt, Human
ccaggcuugccuggcggggaca

SEQ ID NO: 1060541 - RNA, 22 nt, Human
cccggcccacuccucugugcuc

SEQ ID NO: 1060542 - RNA, 20 nt, Human
cuccucugugcucucacccc

SEQ ID NO: 1060543 - RNA, 19 nt, Human
ggcauucggggcugggccg

SEQ ID NO: 1060544 - RNA, 19 nt, Human
gucccggcccacuccucug

SEQ ID NO: 1060545 - RNA, 21 nt, Human
ugggccgcauagggccauggg

SEQ ID NO: 1060546 - RNA, 18 nt, Human
cugcaaacuucugccagg

SEQ ID NO: 1060547 - RNA, 25 nt, Human
cugcagccuuuuugugacaagaaau

SEQ ID NO: 1060548 - RNA, 21 nt, Human
cuuggcuuucccaguauuugc

SEQ ID NO: 1060549 - RNA, 20 nt, Human
gaggaggcuguagcaguuuc

SEQ ID NO: 1060550 - RNA, 20 nt, Human
uacgcugcagccuuuuugug

SEQ ID NO: 1060551 - RNA, 21 nt, Human
uagcaguuucugaauguggug

SEQ ID NO: 1060552 - RNA, 27 nt, Human
ucugcucuguugaugagccagguugag

SEQ ID NO: 1060553 - RNA, 23 nt, Human
ugccuacagcuaauaaacggucu

SEQ ID NO: 1060554 - RNA, 20 nt, Human
ugcugcaaacuucugccagg

SEQ ID NO: 1060555 - RNA, 23 nt, Human
aaaaggcuauucuggugugagga

SEQ ID NO: 1060556 - RNA, 21 nt, Human
acaggaacaaaaggcuauucu

SEQ ID NO: 1060557 - RNA, 18 nt, Human
accuauguuauucucccu

SEQ ID NO: 1060558 - RNA, 21 nt, Human
augugcaguucauauccaggu

SEQ ID NO: 1060559 - RNA, 19 nt, Human
caugauccaguuuuccugc

SEQ ID NO: 1060560 - RNA, 23 nt, Human
ccugcugacgacgcuuuuuccac

SEQ ID NO: 1060561 - RNA, 23 nt, Human
cggacaggaacaaaaggcuauuc

SEQ ID NO: 1060562 - RNA, 19 nt, Human
cuggugugaggagaaauca

SEQ ID NO: 1060563 - RNA, 22 nt, Human
cuuuuuccacugcugugucaau

SEQ ID NO: 1060564 - RNA, 21 nt, Human
gguccugcaaaaaucuaaaac

SEQ ID NO: 1060565 - RNA, 18 nt, Human
uauguaauguauauaugu

SEQ ID NO: 1060566 - RNA, 18 nt, Human
ucaaucacacccucugug

SEQ ID NO: 1060567 - RNA, 19 nt, Human
ucauauccagguccugcaa

SEQ ID NO: 1060568 - RNA, 24 nt, Human
uccaaaaagaugaauggaaaauug

SEQ ID NO: 1060569 - RNA, 24 nt, Human
uccagguccugcaaaaaucuaaaa

SEQ ID NO: 1060570 - RNA, 24 nt, Human
ucccuuucgagcaaaagucaugau

SEQ ID NO: 1060571 - RNA, 19 nt, Human
uccugcaaaaaucuaaaac

SEQ ID NO: 1060572 - RNA, 21 nt, Human
ucucccuuucgagcaaaaguu

SEQ ID NO: 1060573 - RNA, 19 nt, Human
ugaagcagacggacaggaa

SEQ ID NO: 1060574 - RNA, 19 nt, Human
ugaggagaaaucagucacu

SEQ ID NO: 1060575 - RNA, 19 nt, Human
uggaccauucgaagaagcu

SEQ ID NO: 1060576 - RNA, 18 nt, Human
uggugugaggagaaauca

SEQ ID NO: 1060577 - RNA, 26 nt, Human
uguauuguuuuguuuuguucuguuuu

SEQ ID NO: 1060578 - RNA, 20 nt, Human
ugugaggagaaaucagucaa

SEQ ID NO: 1060579 - RNA, 23 nt, Human
uuuaaaauuuuaaaagucgggga

SEQ ID NO: 1060580 - RNA, 18 nt, Human
uuuguuaaaaaccaugua

SEQ ID NO: 1060581 - RNA, 18 nt, Human
uuuuuuuuuuuucaggga

SEQ ID NO: 1060582 - RNA, 22 nt, Human
uuuuuuuuuuuuuuuuucaggg

SEQ ID NO: 1060583 - RNA, 18 nt, Human
uauccagcccagguuuga

SEQ ID NO: 1060584 - RNA, 23 nt, Human
uccagcccagguuugaccuugac

SEQ ID NO: 1060585 - RNA, 24 nt, Human
aucaaacgacucccaucugcuaac

SEQ ID NO: 1060586 - RNA, 21 nt, Human
cagguguaaggcuuccaaguu

SEQ ID NO: 1060587 - RNA, 25 nt, Human
caguaaugccacauuaaaagauuuc

SEQ ID NO: 1060588 - RNA, 22 nt, Human
ccagcaguaaugccacauuaaa

SEQ ID NO: 1060589 - RNA, 18 nt, Human
gccagcaguaaugccaca

SEQ ID NO: 1060590 - RNA, 23 nt, Human
gucaccccucucuuaacagacuc

SEQ ID NO: 1060591 - RNA, 18 nt, Human
ucaaacgacucccaucug

SEQ ID NO: 1060592 - RNA, 18 nt, Human
uccaaauucacuuggcca

SEQ ID NO: 1060593 - RNA, 23 nt, Human
ucucuuaacagacuccagaaauu

SEQ ID NO: 1060594 - RNA, 24 nt, Human
ugaacaaggcgcugaagcuccagg

SEQ ID NO: 1060595 - RNA, 26 nt, Human
ugaagucacaagaauaaagucaagag

SEQ ID NO: 1060596 - RNA, 22 nt, Human
ugaaucaucaauaagaacaacu

SEQ ID NO: 1060597 - RNA, 18 nt, Human
ugagagucaccccucucu

SEQ ID NO: 1060598 - RNA, 23 nt, Human
uguaucaaacgacucccaucugc

SEQ ID NO: 1060599 - RNA, 25 nt, Human
aaacacggccacaggaggcaacugc

SEQ ID NO: 1060600 - RNA, 23 nt, Human
aaaggaagcaaguucccgaagaa

SEQ ID NO: 1060601 - RNA, 20 nt, Human
aacagcccugugagguagga

SEQ ID NO: 1060602 - RNA, 20 nt, Human
aagaacaaauccaaagccca

SEQ ID NO: 1060603 - RNA, 19 nt, Human
aagcccagugcagcagcuc

SEQ ID NO: 1060604 - RNA, 19 nt, Human
aagcgaccgcgaggcuagg

SEQ ID NO: 1060605 - RNA, 23 nt, Human
aagugagcagugaggacgggggc

SEQ ID NO: 1060606 - RNA, 22 nt, Human
aauagaaggccugggaacagaa

SEQ ID NO: 1060607 - RNA, 21 nt, Human
aaucacuggcacuucacacag

SEQ ID NO: 1060608 - RNA, 20 nt, Human
acagcuuccaggauccuccu

SEQ ID NO: 1060609 - RNA, 20 nt, Human
accccauuccaaaguccaca

SEQ ID NO: 1060610 - RNA, 21 nt, Human
accccgcacgguggccccagc

SEQ ID NO: 1060611 - RNA, 22 nt, Human
accgcucccucccgcccuugcc

SEQ ID NO: 1060612 - RNA, 20 nt, Human
accuggccucuuccccuccc

SEQ ID NO: 1060613 - RNA, 18 nt, Human
agaaggaaagagaugcug

SEQ ID NO: 1060614 - RNA, 19 nt, Human
agaugcaucuggcauuggu

SEQ ID NO: 1060615 - RNA, 20 nt, Human
agauggaguuucugugcaag

SEQ ID NO: 1060616 - RNA, 24 nt, Human
agcuacagucuuugccagaaggaa

SEQ ID NO: 1060617 - RNA, 18 nt, Human
agcucugagcucaggccu

SEQ ID NO: 1060618 - RNA, 23 nt, Human
aggcugggggcgauguugaggcc

SEQ ID NO: 1060619 - RNA, 21 nt, Human
agugagcagugaggacggggg

SEQ ID NO: 1060620 - RNA, 21 nt, Human
aucacauggggaguucagggu

SEQ ID NO: 1060621 - RNA, 19 nt, Human
aucuggccccauccuccuc

SEQ ID NO: 1060622 - RNA, 24 nt, Human
caaacagcugcuuacaugcugcca

SEQ ID NO: 1060623 - RNA, 18 nt, Human
cacauggggaguucaggg

SEQ ID NO: 1060624 - RNA, 28 nt, Human
caccagccagggaaaggaagcaaguucc

SEQ ID NO: 1060625 - RNA, 20 nt, Human
cacccgcagcacuuuaaucc

SEQ ID NO: 1060626 - RNA, 23 nt, Human
cacccuuucuuagcagugaccug

SEQ ID NO: 1060627 - RNA, 24 nt, Human
cagaauggauggacucuaaagaug

SEQ ID NO: 1060628 - RNA, 19 nt, Human
cagaugguccuuccugaca

SEQ ID NO: 1060629 - RNA, 23 nt, Human
cagcaaaccccauuccaaagucc

SEQ ID NO: 1060630 - RNA, 21 nt, Human
cagggaaaggaagcaaguucc

SEQ ID NO: 1060631 - RNA, 19 nt, Human
cagugaggacgggggcucu

SEQ ID NO: 1060632 - RNA, 18 nt, Human
caucacauggggaguuca

SEQ ID NO: 1060633 - RNA, 18 nt, Human
cauggccacaucucccca

SEQ ID NO: 1060634 - RNA, 18 nt, Human
cauuccaaaguccacacc

SEQ ID NO: 1060635 - RNA, 24 nt, Human
cauuccaaaguccacacccuucaa

SEQ ID NO: 1060636 - RNA, 21 nt, Human
ccacacccuucaaccgccuga

SEQ ID NO: 1060637 - RNA, 27 nt, Human
ccacacccuucaaccgccugaauagaa

SEQ ID NO: 1060638 - RNA, 25 nt, Human
ccagaaggaaagagaugcuggcaca

SEQ ID NO: 1060639 - RNA, 21 nt, Human
ccagcucugagcccguuggca

SEQ ID NO: 1060640 - RNA, 19 nt, Human
ccaggccaggccagcaccu

SEQ ID NO: 1060641 - RNA, 20 nt, Human
ccaggccaggccagcaccug

SEQ ID NO: 1060642 - RNA, 18 nt, Human
ccccaaccacucagcccg

SEQ ID NO: 1060643 - RNA, 20 nt, Human
ccccagcacaucccuggcac

SEQ ID NO: 1060644 - RNA, 19 nt, Human
cccgaagaacagcaaaccc

SEQ ID NO: 1060645 - RNA, 22 nt, Human
cccgaagaacagcaaaccccau

SEQ ID NO: 1060646 - RNA, 22 nt, Human
cccgaaggcacccuuucuuagc

SEQ ID NO: 1060647 - RNA, 20 nt, Human
ccgaagaacagcaaacccca

SEQ ID NO: 1060648 - RNA, 21 nt, Human
ccgaagaacagcaaaccccau

SEQ ID NO: 1060649 - RNA, 18 nt, Human
ccucagcugugccuuucc

SEQ ID NO: 1060650 - RNA, 20 nt, Human
ccucccgcccuugccgccgc

SEQ ID NO: 1060651 - RNA, 19 nt, Human
ccugaugcugcuuccagag

SEQ ID NO: 1060652 - RNA, 19 nt, Human
ccugcagaucugucacuac

SEQ ID NO: 1060653 - RNA, 24 nt, Human
ccuggagagcuacagucuuugcca

SEQ ID NO: 1060654 - RNA, 22 nt, Human
ccuggccucuuccccucccuuu

SEQ ID NO: 1060655 - RNA, 20 nt, Human
ccuguacuugaaacacugaa

SEQ ID NO: 1060656 - RNA, 19 nt, Human
cgaccgcgaggcuaggcag

SEQ ID NO: 1060657 - RNA, 23 nt, Human
cgaggcuaggcagcuccaaaucc

SEQ ID NO: 1060658 - RNA, 22 nt, Human
cggcgaccgcucccucccgccc

SEQ ID NO: 1060659 - RNA, 26 nt, Human
cguccugggucgcaacacccagcagc

SEQ ID NO: 1060660 - RNA, 19 nt, Human
cucacaagaacaaauccaa

SEQ ID NO: 1060661 - RNA, 25 nt, Human
cucacccgcagcacuuuaaucccca

SEQ ID NO: 1060662 - RNA, 26 nt, Human
cucacccgcagcacuuuaauccccac

SEQ ID NO: 1060663 - RNA, 21 nt, Human
cuccuaccuggagagcuacag

SEQ ID NO: 1060664 - RNA, 18 nt, Human
cuccucuggcaaggcucc

SEQ ID NO: 1060665 - RNA, 21 nt, Human
cugcccaagagcauucaacag

SEQ ID NO: 1060666 - RNA, 24 nt, Human
cuuccccucccuuuaguaacccca

SEQ ID NO: 1060667 - RNA, 23 nt, Human
gaaaaacacggccacaggaggca

SEQ ID NO: 1060668 - RNA, 18 nt, Human
gaaaggaagcaaguuccc

SEQ ID NO: 1060669 - RNA, 22 nt, Human
gaacaaauccaaagcccagugc

SEQ ID NO: 1060670 - RNA, 23 nt, Human
gaacaaauccaaagcccagugca

SEQ ID NO: 1060671 - RNA, 18 nt, Human
gaccgcucccucccgccc

SEQ ID NO: 1060672 - RNA, 23 nt, Human
gaggccgaagccagccacagugc

SEQ ID NO: 1060673 - RNA, 24 nt, Human
gauccagagcagcccggggagccc

SEQ ID NO: 1060674 - RNA, 18 nt, Human
gaugcaucuggcauuggu

SEQ ID NO: 1060675 - RNA, 19 nt, Human
gcaccccgcacgguggccc

SEQ ID NO: 1060676 - RNA, 22 nt, Human
gcucugagcucaggccugccgu

SEQ ID NO: 1060677 - RNA, 20 nt, Human
ggaaaggacacagcaguggg

SEQ ID NO: 1060678 - RNA, 21 nt, Human
ggcauugguauccucuggaca

SEQ ID NO: 1060679 - RNA, 22 nt, Human
gggaaaccgagacacacauuca

SEQ ID NO: 1060680 - RNA, 18 nt, Human
guggccccagccagcugg

SEQ ID NO: 1060681 - RNA, 18 nt, Human
uaaccccaucagcagcag

SEQ ID NO: 1060682 - RNA, 22 nt, Human
uaacuccagaugcaucuggcau

SEQ ID NO: 1060683 - RNA, 27 nt, Human
uagcacaagaccauggccacaucuccc

SEQ ID NO: 1060684 - RNA, 23 nt, Human
uauccucuggacacucuucuccc

SEQ ID NO: 1060685 - RNA, 24 nt, Human
ucagcggcccaccuggccucuucc

SEQ ID NO: 1060686 - RNA, 18 nt, Human
ucaggccugccgugcccc

SEQ ID NO: 1060687 - RNA, 22 nt, Human
ucaggguuagccuggaguacga

SEQ ID NO: 1060688 - RNA, 24 nt, Human
uccacacccuucaaccgccugaau

SEQ ID NO: 1060689 - RNA, 24 nt, Human
uccagaauggauggacucuaaaga

SEQ ID NO: 1060690 - RNA, 22 nt, Human
uccccacaacagcccugugagg

SEQ ID NO: 1060691 - RNA, 23 nt, Human
ucccgcugcggcucggcgaaagc

SEQ ID NO: 1060692 - RNA, 20 nt, Human
uccucuggcaaggcuccugg

SEQ ID NO: 1060693 - RNA, 18 nt, Human
uccugggauccagagcag

SEQ ID NO: 1060694 - RNA, 19 nt, Human
uccuggugcucacagcuuc

SEQ ID NO: 1060695 - RNA, 25 nt, Human
uccuguggagggguaaucacuggca

SEQ ID NO: 1060696 - RNA, 20 nt, Human
ucucccgaaggcacccuuuc

SEQ ID NO: 1060697 - RNA, 21 nt, Human
ucucuagcacaagaccauggc

SEQ ID NO: 1060698 - RNA, 19 nt, Human
ugccucagcugugccuuuc

SEQ ID NO: 1060699 - RNA, 27 nt, Human
ugcucugcuguccugaugcugcuucca

SEQ ID NO: 1060700 - RNA, 21 nt, Human
ugggucuucaguaaaagcauc

SEQ ID NO: 1060701 - RNA, 24 nt, Human
uggguucuuggcaaacagcugcuu

SEQ ID NO: 1060702 - RNA, 18 nt, Human
uguggaaauuaaauaacu

SEQ ID NO: 1060703 - RNA, 20 nt, Human
uucaacagauaaaucugucc

SEQ ID NO: 1060704 - RNA, 21 nt, Human
uucaggguuagccuggaguac

SEQ ID NO: 1060705 - RNA, 23 nt, Human
uuccagagguuuuacaugguuuu

SEQ ID NO: 1060706 - RNA, 20 nt, Human
uugaaacacugaacgugaug

SEQ ID NO: 1060707 - RNA, 21 nt, Human
uuguaccgccaucucuagcac

SEQ ID NO: 1060708 - RNA, 19 nt, Human
uuucuuagcagugaccugg

SEQ ID NO: 1060709 - RNA, 18 nt, Human
aggcccgcccccaggcgg

SEQ ID NO: 1060710 - RNA, 24 nt, Human
aggucacccgcgaaccuggaaaug

SEQ ID NO: 1060711 - RNA, 22 nt, Human
auggagccuaggggcugagguu

SEQ ID NO: 1060712 - RNA, 20 nt, Human
caccaaauaauaauaaacau

SEQ ID NO: 1060713 - RNA, 18 nt, Human
cagccgcugccguccccc

SEQ ID NO: 1060714 - RNA, 22 nt, Human
ccacuggggcgggagccagggc

SEQ ID NO: 1060715 - RNA, 23 nt, Human
ccaggcuugcccguucccggcuu

SEQ ID NO: 1060716 - RNA, 22 nt, Human
ccccaagggacuuuugugaggc

SEQ ID NO: 1060717 - RNA, 18 nt, Human
ccccuaagcgauacgaaa

SEQ ID NO: 1060718 - RNA, 20 nt, Human
cccgcgaaccuggaaaugga

SEQ ID NO: 1060719 - RNA, 20 nt, Human
cccguucccggcuuucuggg

SEQ ID NO: 1060720 - RNA, 22 nt, Human
ccgugugcucuccucuuuccug

SEQ ID NO: 1060721 - RNA, 24 nt, Human
cucuuuugcuaguuaaaaaaauuu

SEQ ID NO: 1060722 - RNA, 19 nt, Human
cugccguccccccaccccc

SEQ ID NO: 1060723 - RNA, 22 nt, Human
cuuuccaggcuugcccguuccc

SEQ ID NO: 1060724 - RNA, 19 nt, Human
gaccagaauuagaagccac

SEQ ID NO: 1060725 - RNA, 18 nt, Human
gccgcugccgucccccca

SEQ ID NO: 1060726 - RNA, 21 nt, Human
ggaaauggagccuaggggcug

SEQ ID NO: 1060727 - RNA, 24 nt, Human
gggaccagaauuagaagccacugg

SEQ ID NO: 1060728 - RNA, 21 nt, Human
uaauaaacaugagguugggua

SEQ ID NO: 1060729 - RNA, 21 nt, Human
ucacccaaucaacacccgugc

SEQ ID NO: 1060730 - RNA, 24 nt, Human
uccuaaagaaauuccaaaaacaaa

SEQ ID NO: 1060731 - RNA, 21 nt, Human
ucugucagaugguucuugcga

SEQ ID NO: 1060732 - RNA, 25 nt, Human
ucuuuauaauuuuucugaaagacca

SEQ ID NO: 1060733 - RNA, 19 nt, Human
ugaggcagaaacgcauccu

SEQ ID NO: 1060734 - RNA, 22 nt, Human
ugcgaggaaccccuaagcgaua

SEQ ID NO: 1060735 - RNA, 23 nt, Human
ugcgaggaaccccuaagcgauac

SEQ ID NO: 1060736 - RNA, 24 nt, Human
ugcucuccucuuuccugcgccuca

SEQ ID NO: 1060737 - RNA, 22 nt, Human
uggcaugauguuuucucuuuuu

SEQ ID NO: 1060738 - RNA, 20 nt, Human
ugguuccaagggccacuccc

SEQ ID NO: 1060739 - RNA, 18 nt, Human
aaccugacaauuguacag

SEQ ID NO: 1060740 - RNA, 20 nt, Human
acaugacauuguuggaaaua

SEQ ID NO: 1060741 - RNA, 21 nt, Human
aggaacaggaggugaaaugac

SEQ ID NO: 1060742 - RNA, 24 nt, Human
cacagcacaagacaacagcuaaga

SEQ ID NO: 1060743 - RNA, 18 nt, Human
cuccagcuccggcucgcg

SEQ ID NO: 1060744 - RNA, 22 nt, Human
cuggaaaugucuccagcuccgg

SEQ ID NO: 1060745 - RNA, 24 nt, Human
cugugaagaugguuucuuccauuu

SEQ ID NO: 1060746 - RNA, 24 nt, Human
gaaaaaaaaaacauaauuagcaaa

SEQ ID NO: 1060747 - RNA, 27 nt, Human
gaaaaaaaaaacauaauuagcaaaggg

SEQ ID NO: 1060748 - RNA, 19 nt, Human
gagaguuccuaggaacagg

SEQ ID NO: 1060749 - RNA, 21 nt, Human
ggaauuucuaaaacugagcaa

SEQ ID NO: 1060750 - RNA, 23 nt, Human
uaaaacugagcaauacugucccc

SEQ ID NO: 1060751 - RNA, 22 nt, Human
uaaauuauaaaaacuagcauaa

SEQ ID NO: 1060752 - RNA, 22 nt, Human
uacccagacugaaguaauaauu

SEQ ID NO: 1060753 - RNA, 20 nt, Human
uagaagaaauggaauuucua

SEQ ID NO: 1060754 - RNA, 19 nt, Human
uauacagggcagaaauaua

SEQ ID NO: 1060755 - RNA, 18 nt, Human
ucacagaucaaaccaaca

SEQ ID NO: 1060756 - RNA, 23 nt, Human
ucuuuauuaauaaaaagggugcu

SEQ ID NO: 1060757 - RNA, 21 nt, Human
ugcucaacuuaaucacagauc

SEQ ID NO: 1060758 - RNA, 22 nt, Human
uggaaaacacuggcaaugcuuu

SEQ ID NO: 1060759 - RNA, 23 nt, Human
uggaauuucuaaaacugagcaau

SEQ ID NO: 1060760 - RNA, 22 nt, Human
uggcaaugcuugggaauggaga

SEQ ID NO: 1060761 - RNA, 18 nt, Human
uggccuggagccagcccc

SEQ ID NO: 1060762 - RNA, 22 nt, Human
uggggguugucacaguuucucu

SEQ ID NO: 1060763 - RNA, 21 nt, Human
ugucacaguuucucuuuucug

SEQ ID NO: 1060764 - RNA, 23 nt, Human
uguccaguaagaaaccuccuuuc

SEQ ID NO: 1060765 - RNA, 27 nt, Human
ugucuccagcuccggcucgcguggccu

SEQ ID NO: 1060766 - RNA, 21 nt, Human
ugugaagaugguuucuuccau

SEQ ID NO: 1060767 - RNA, 23 nt, Human
uuaaaagaaacaguauuuauuaa

SEQ ID NO: 1060768 - RNA, 22 nt, Human
uucuccuacggucugugaagau

SEQ ID NO: 1060769 - RNA, 18 nt, Human
uucucuuuucugcuuugu

SEQ ID NO: 1060770 - RNA, 23 nt, Human
uuguauauaguguuucccuuacc

SEQ ID NO: 1060771 - RNA, 25 nt, Human
uuuccacagcacaagacaacagcua

SEQ ID NO: 1060772 - RNA, 21 nt, Human
uuucuggggguugucacaguu

SEQ ID NO: 1060773 - RNA, 21 nt, Human
uuuguauauaguguuucccuu

SEQ ID NO: 1060774 - RNA, 19 nt, Human
aacaagagccucagaaagg

SEQ ID NO: 1060775 - RNA, 23 nt, Human
acauagcaagacucucaacaaga

SEQ ID NO: 1060776 - RNA, 24 nt, Human
accagaaccugaaacaagcaguga

SEQ ID NO: 1060777 - RNA, 18 nt, Human
accgcacuccagccuggg

SEQ ID NO: 1060778 - RNA, 23 nt, Human
accgcacuccagccugggugaca

SEQ ID NO: 1060779 - RNA, 20 nt, Human
acgcugcggaggcggggcgg

SEQ ID NO: 1060780 - RNA, 23 nt, Human
acucugaggaacguuuaccagaa

SEQ ID NO: 1060781 - RNA, 22 nt, Human
agccugggugacauagcaagac

SEQ ID NO: 1060782 - RNA, 24 nt, Human
agccugggugacauagcaagacuc

SEQ ID NO: 1060783 - RNA, 21 nt, Human
agcugcagcacuaggcuuccc

SEQ ID NO: 1060784 - RNA, 21 nt, Human
aggcagagcuuggagugagcc

SEQ ID NO: 1060785 - RNA, 23 nt, Human
aggcagagcuuggagugagccga

SEQ ID NO: 1060786 - RNA, 24 nt, Human
aggcagagcuuggagugagccgag

SEQ ID NO: 1060787 - RNA, 19 nt, Human
aggcugagguaggagaaug

SEQ ID NO: 1060788 - RNA, 21 nt, Human
agguaggagaauggugugaac

SEQ ID NO: 1060789 - RNA, 24 nt, Human
agguaggagaauggugugaacccg

SEQ ID NO: 1060790 - RNA, 28 nt, Human
auaucacaaugaugacagcaagaccaau

SEQ ID NO: 1060791 - RNA, 24 nt, Human
auggugccaccgcacuccagccug

SEQ ID NO: 1060792 - RNA, 24 nt, Human
caaacuucuuucucuuccaaggug

SEQ ID NO: 1060793 - RNA, 25 nt, Human
caagaccaauaaggaaugcaaugcu

SEQ ID NO: 1060794 - RNA, 23 nt, Human
caagacucucaacaagagccuca

SEQ ID NO: 1060795 - RNA, 22 nt, Human
caagagagaauaguuuccaaau

SEQ ID NO: 1060796 - RNA, 20 nt, Human
cacaaugaugacagcaagac

SEQ ID NO: 1060797 - RNA, 24 nt, Human
caccgcacuccagccugggugaca

SEQ ID NO: 1060798 - RNA, 23 nt, Human
cacuaggcuucccugcuuuugga

SEQ ID NO: 1060799 - RNA, 19 nt, Human
cacuccagccugggugaca

SEQ ID NO: 1060800 - RNA, 22 nt, Human
cacuccagccugggugacauag

SEQ ID NO: 1060801 - RNA, 23 nt, Human
cacuccagccugggugacauagc

SEQ ID NO: 1060802 - RNA, 21 nt, Human
cagcgcggccagcgcccugcc

SEQ ID NO: 1060803 - RNA, 21 nt, Human
cagcuacucaggaggcugagg

SEQ ID NO: 1060804 - RNA, 19 nt, Human
cauagcaagacucucaaca

SEQ ID NO: 1060805 - RNA, 24 nt, Human
cauuauggauguucuuuaccaaga

SEQ ID NO: 1060806 - RNA, 20 nt, Human
ccaccgcacuccagccuggg

SEQ ID NO: 1060807 - RNA, 20 nt, Human
ccaccgcacuccagccuggg

SEQ ID NO: 1060808 - RNA, 21 nt, Human
ccaccgcacuccagccugggu

SEQ ID NO: 1060809 - RNA, 21 nt, Human
ccaccgcacuccagccugggu

SEQ ID NO: 1060810 - RNA, 23 nt, Human
ccaccgcacuccagccuggguga

SEQ ID NO: 1060811 - RNA, 24 nt, Human
ccaccgcacuccagccugggugac

SEQ ID NO: 1060812 - RNA, 23 nt, Human
ccccgaagagccgccgaccauug

SEQ ID NO: 1060813 - RNA, 22 nt, Human
ccccgaagagccgccgggggcc

SEQ ID NO: 1060814 - RNA, 20 nt, Human
ccccugaagguguccacgcu

SEQ ID NO: 1060815 - RNA, 22 nt, Human
ccugggugacauagcaagacuc

SEQ ID NO: 1060816 - RNA, 18 nt, Human
cgcggccagcgcccugcc

SEQ ID NO: 1060817 - RNA, 18 nt, Human
cucaggaggcugagguag

SEQ ID NO: 1060818 - RNA, 24 nt, Human
cuccaaaucuguauuccaaccuac

SEQ ID NO: 1060819 - RNA, 19 nt, Human
cugcagcacuaggcuuccc

SEQ ID NO: 1060820 - RNA, 21 nt, Human
cugcaguuccagcuacucagg

SEQ ID NO: 1060821 - RNA, 20 nt, Human
gaacccgggaggcagagcuu

SEQ ID NO: 1060822 - RNA, 19 nt, Human
gaaccugaaacaagcagug

SEQ ID NO: 1060823 - RNA, 21 nt, Human
gcagcgcggccagcgcccugc

SEQ ID NO: 1060824 - RNA, 19 nt, Human
gccaccgcacuccagccug

SEQ ID NO: 1060825 - RNA, 22 nt, Human
gcgcggccugggcaucgcgccc

SEQ ID NO: 1060826 - RNA, 18 nt, Human
gcugcggaggcggggcgg

SEQ ID NO: 1060827 - RNA, 22 nt, Human
guccugcugggagaucccagcu

SEQ ID NO: 1060828 - RNA, 20 nt, Human
guggcggcgcggccugggca

SEQ ID NO: 1060829 - RNA, 19 nt, Human
uaccaagagagaauaguuu

SEQ ID NO: 1060830 - RNA, 22 nt, Human
uaccaagagagaauaguuucca

SEQ ID NO: 1060831 - RNA, 22 nt, Human
uaccagaaccugaaacaagcag

SEQ ID NO: 1060832 - RNA, 25 nt, Human
ucauccaaacugcaguuccagcuac

SEQ ID NO: 1060833 - RNA, 25 nt, Human
uccaaauucuccaaaucuguauucc

SEQ ID NO: 1060834 - RNA, 19 nt, Human
uccacgcugcggaggcggg

SEQ ID NO: 1060835 - RNA, 24 nt, Human
uccagccugggugacauagcaaga

SEQ ID NO: 1060836 - RNA, 23 nt, Human
uccgugcugggugcugacagagg

SEQ ID NO: 1060837 - RNA, 22 nt, Human
ugagccgagauggugccaccgc

SEQ ID NO: 1060838 - RNA, 24 nt, Human
ugagguaggagaauggugugaacc

SEQ ID NO: 1060839 - RNA, 24 nt, Human
ugcggaggcggggcggcagggcag

SEQ ID NO: 1060840 - RNA, 27 nt, Human
ugucguucagcugcaggauagauccgg

SEQ ID NO: 1060841 - RNA, 20 nt, Human
uuagaaauccaauuguuaaa

SEQ ID NO: 1060842 - RNA, 22 nt, Human
uuggagugagccgagauggugc

SEQ ID NO: 1060843 - RNA, 18 nt, Human
uuuaccagaaccugaaac

SEQ ID NO: 1060844 - RNA, 19 nt, Human
aauuucuguccuguuuccc

SEQ ID NO: 1060845 - RNA, 22 nt, Human
acuucaggacauacaaauucca

SEQ ID NO: 1060846 - RNA, 19 nt, Human
auacaaauuccaaaagcaa

SEQ ID NO: 1060847 - RNA, 19 nt, Human
caaauuccaaaagcaugca

SEQ ID NO: 1060848 - RNA, 22 nt, Human
ccaauuucuguccuguuuccca

SEQ ID NO: 1060849 - RNA, 21 nt, Human
uaccuaaaaacuucaccaauu

SEQ ID NO: 1060850 - RNA, 24 nt, Human
uccaaaagcaugcauguccaaaga

SEQ ID NO: 1060851 - RNA, 21 nt, Human
uguccaaagaggguuauagag

SEQ ID NO: 1060852 - RNA, 25 nt, Human
uuccaaaagcaugcauguccaaaga

SEQ ID NO: 1060853 - RNA, 19 nt, Human
aagcgccucugcgagcaag

SEQ ID NO: 1060854 - RNA, 18 nt, Human
agagggcuccucucggga

SEQ ID NO: 1060855 - RNA, 23 nt, Human
agcugcccggccgcgccaacccc

SEQ ID NO: 1060856 - RNA, 21 nt, Human
aggccgagguccgggccacgc

SEQ ID NO: 1060857 - RNA, 26 nt, Human
agggagccaagagcggacggggcggu

SEQ ID NO: 1060858 - RNA, 18 nt, Human
caaaaagcgccucugcga

SEQ ID NO: 1060859 - RNA, 18 nt, Human
caagagcggacggggcgg

SEQ ID NO: 1060860 - RNA, 19 nt, Human
cagcuugccagccgccacc

SEQ ID NO: 1060861 - RNA, 22 nt, Human
ccaccccccgccuucccuccug

SEQ ID NO: 1060862 - RNA, 23 nt, Human
ccccccgccuucccuccugccca

SEQ ID NO: 1060863 - RNA, 26 nt, Human
cccccgccuucccuccugcccacccc

SEQ ID NO: 1060864 - RNA, 18 nt, Human
cccggguagccgcaaccc

SEQ ID NO: 1060865 - RNA, 19 nt, Human
ccgcaggcucgcuccgguc

SEQ ID NO: 1060866 - RNA, 21 nt, Human
ccggccgcgccaaccccuucc

SEQ ID NO: 1060867 - RNA, 20 nt, Human
cugccuccgccgcgcagccc

SEQ ID NO: 1060868 - RNA, 24 nt, Human
cuugccagccgccaccccccgccu

SEQ ID NO: 1060869 - RNA, 27 nt, Human
gagccaagagcggacggggcgguggga

SEQ ID NO: 1060870 - RNA, 22 nt, Human
gcgcagcccugcgcagcugccc

SEQ ID NO: 1060871 - RNA, 24 nt, Human
gcggcgaccgggagggugaaggga

SEQ ID NO: 1060872 - RNA, 18 nt, Human
gggcggugggacgggggg

SEQ ID NO: 1060873 - RNA, 19 nt, Human
ggggaaggggaggccgagg

SEQ ID NO: 1060874 - RNA, 21 nt, Human
gguagcccagcaggcugcggc

SEQ ID NO: 1060875 - RNA, 22 nt, Human
guagcccagcaggcugcggcuc

SEQ ID NO: 1060876 - RNA, 23 nt, Human
uccccgccgcagcgcgccccgag

SEQ ID NO: 1060877 - RNA, 22 nt, Human
ucccgggcuccuccgcaggcuc

SEQ ID NO: 1060878 - RNA, 22 nt, Human
uccucucgggagugugcgggga

SEQ ID NO: 1060879 - RNA, 21 nt, Human
ucgcgggcgcucggacggcgg

SEQ ID NO: 1060880 - RNA, 25 nt, Human
ugccagccgccaccccccgccuucc

SEQ ID NO: 1060881 - RNA, 20 nt, Human
aaacaaauaaaacacgacca

SEQ ID NO: 1060882 - RNA, 24 nt, Human
aaacacgaccaccacauaaagcac

SEQ ID NO: 1060883 - RNA, 22 nt, Human
aacacgaccaccacauaaagca

SEQ ID NO: 1060884 - RNA, 23 nt, Human
aaccauccugaacuacuggauuc

SEQ ID NO: 1060885 - RNA, 20 nt, Human
acagaucacauccaauguga

SEQ ID NO: 1060886 - RNA, 21 nt, Human
accaccacauaaagcacuuuu

SEQ ID NO: 1060887 - RNA, 19 nt, Human
auaaaacacgaccaccaca

SEQ ID NO: 1060888 - RNA, 18 nt, Human
cacgaccaccacauaaag

SEQ ID NO: 1060889 - RNA, 20 nt, Human
cauccugaacuacuggauuc

SEQ ID NO: 1060890 - RNA, 27 nt, Human
ccaccacauaaagcacuuuuauacaga

SEQ ID NO: 1060891 - RNA, 23 nt, Human
ccccuuguggacugaaccgaggg

SEQ ID NO: 1060892 - RNA, 25 nt, Human
ccccuuguggacugaaccgaggggg

SEQ ID NO: 1060893 - RNA, 22 nt, Human
ccuuguggacugaaccgagggg

SEQ ID NO: 1060894 - RNA, 19 nt, Human
cuccaagugguguuugaag

SEQ ID NO: 1060895 - RNA, 18 nt, Human
gcaagguggcaguccccu

SEQ ID NO: 1060896 - RNA, 23 nt, Human
gguggcaguccccuuguggacug

SEQ ID NO: 1060897 - RNA, 19 nt, Human
gugguguuugaagaaugca

SEQ ID NO: 1060898 - RNA, 20 nt, Human
guuucaggucuccaaguggu

SEQ ID NO: 1060899 - RNA, 24 nt, Human
uauacagaucacauccaaugugac

SEQ ID NO: 1060900 - RNA, 22 nt, Human
ugaaacaaauaaaacacgacca

SEQ ID NO: 1060901 - RNA, 20 nt, Human
ugacugggucuucaaaacca

SEQ ID NO: 1060902 - RNA, 28 nt, Human
uucaaaaccauccugaacuacuggauuc

SEQ ID NO: 1060903 - RNA, 26 nt, Human
aacucccugcagcguugacaccgcac

SEQ ID NO: 1060904 - RNA, 22 nt, Human
aaggugccacaacucccugcag

SEQ ID NO: 1060905 - RNA, 26 nt, Human
acucugaguaauacguuaacaaaaaa

SEQ ID NO: 1060906 - RNA, 19 nt, Human
agaggcuugggugacucug

SEQ ID NO: 1060907 - RNA, 22 nt, Human
agccccuggcucccaggguucc

SEQ ID NO: 1060908 - RNA, 21 nt, Human
aggcggccaggugcucagagg

SEQ ID NO: 1060909 - RNA, 18 nt, Human
cacaacucccugcagcgu

SEQ ID NO: 1060910 - RNA, 21 nt, Human
caccaccagcccccucccgcc

SEQ ID NO: 1060911 - RNA, 22 nt, Human
caccuucacccucagccaagag

SEQ ID NO: 1060912 - RNA, 20 nt, Human
cagccccuggcucccagggu

SEQ ID NO: 1060913 - RNA, 22 nt, Human
caggccagccccugagcuggga

SEQ ID NO: 1060914 - RNA, 23 nt, Human
ccaccagcccccucccgccuccc

SEQ ID NO: 1060915 - RNA, 22 nt, Human
ccagccccugagcugggagccu

SEQ ID NO: 1060916 - RNA, 25 nt, Human
cccaggccagccccugagcugggag

SEQ ID NO: 1060917 - RNA, 21 nt, Human
cccgccucccgucccaccuuc

SEQ ID NO: 1060918 - RNA, 23 nt, Human
ccgcacgagcggcaccaccagcc

SEQ ID NO: 1060919 - RNA, 25 nt, Human
ccucccaccugagcccuucuccggc

SEQ ID NO: 1060920 - RNA, 24 nt, Human
ccugagcugggagccugcugaggc

SEQ ID NO: 1060921 - RNA, 18 nt, Human
ccugcugaggccccuccc

SEQ ID NO: 1060922 - RNA, 18 nt, Human
ccugcugaggccccuccc

SEQ ID NO: 1060923 - RNA, 19 nt, Human
ccugcugaggccccuccca

SEQ ID NO: 1060924 - RNA, 24 nt, Human
cgagcggcaccaccagcccccucc

SEQ ID NO: 1060925 - RNA, 23 nt, Human
cguugacaccgcacgagcggcac

SEQ ID NO: 1060926 - RNA, 19 nt, Human
cucccagaacaggcagaca

SEQ ID NO: 1060927 - RNA, 22 nt, Human
cucccaggguuccccccaggcc

SEQ ID NO: 1060928 - RNA, 24 nt, Human
gcggccaggugcucagagggcacc

SEQ ID NO: 1060929 - RNA, 25 nt, Human
ggcaccaccagcccccucccgccuc

SEQ ID NO: 1060930 - RNA, 25 nt, Human
uaaaaaaauagguuuaaugcaggug

SEQ ID NO: 1060931 - RNA, 18 nt, Human
ucagccaagaggcuuggg

SEQ ID NO: 1060932 - RNA, 24 nt, Human
ucagccccuggcucccaggguucc

SEQ ID NO: 1060933 - RNA, 18 nt, Human
uccccccaggccagcccc

SEQ ID NO: 1060934 - RNA, 19 nt, Human
ucccgucccaccuucaccc

SEQ ID NO: 1060935 - RNA, 21 nt, Human
ugagcccuucuccggcccccc

SEQ ID NO: 1060936 - RNA, 19 nt, Human
uggagucagccccuggcuc

SEQ ID NO: 1060937 - RNA, 24 nt, Human
uggagucagccccuggcucccagg

SEQ ID NO: 1060938 - RNA, 21 nt, Human
aaaaaaaaaaaaaaagacaua

SEQ ID NO: 1060939 - RNA, 21 nt, Human
aaaacaacaaaaaaaggaaga

SEQ ID NO: 1060940 - RNA, 21 nt, Human
acaaaacaacaaaaaaaggaa

SEQ ID NO: 1060941 - RNA, 23 nt, Human
acaaaacaacaaaaaaaggaaga

SEQ ID NO: 1060942 - RNA, 20 nt, Human
acagagcgggauccugucuc

SEQ ID NO: 1060943 - RNA, 25 nt, Human
acagagcgggauccugucucugaag

SEQ ID NO: 1060944 - RNA, 23 nt, Human
acaugugcaaugcauacaaaaca

SEQ ID NO: 1060945 - RNA, 18 nt, Human
acugcacuccggccuggg

SEQ ID NO: 1060946 - RNA, 24 nt, Human
acugcacuccggccugggagacag

SEQ ID NO: 1060947 - RNA, 21 nt, Human
aggaaaaaguauacuucaaga

SEQ ID NO: 1060948 - RNA, 24 nt, Human
aggaaaaaguauacuucaagacau

SEQ ID NO: 1060949 - RNA, 21 nt, Human
aggaggcuaaggcuaaggcag

SEQ ID NO: 1060950 - RNA, 23 nt, Human
aggcaggaagaucgcuugagucc

SEQ ID NO: 1060951 - RNA, 24 nt, Human
aggcaggaagaucgcuugagucca

SEQ ID NO: 1060952 - RNA, 24 nt, Human
aggcuaaggcaggaagaucgcuug

SEQ ID NO: 1060953 - RNA, 24 nt, Human
aucgugccacugcacuccggccug

SEQ ID NO: 1060954 - RNA, 24 nt, Human
cacuccggccugggagacagagcg

SEQ ID NO: 1060955 - RNA, 18 nt, Human
cacugcacuccggccugg

SEQ ID NO: 1060956 - RNA, 19 nt, Human
cacugcacuccggccuggg

SEQ ID NO: 1060957 - RNA, 22 nt, Human
cacugcacuccggccugggaga

SEQ ID NO: 1060958 - RNA, 24 nt, Human
cacugcacuccggccugggagaca

SEQ ID NO: 1060959 - RNA, 25 nt, Human
cacugcacuccggccugggagacag

SEQ ID NO: 1060960 - RNA, 18 nt, Human
caggaguuugagguuaca

SEQ ID NO: 1060961 - RNA, 26 nt, Human
cauacaaaacaacaaaaaaaggaaga

SEQ ID NO: 1060962 - RNA, 22 nt, Human
caugugcaaugcauacaaaaca

SEQ ID NO: 1060963 - RNA, 20 nt, Human
ccacugcacuccggccuggg

SEQ ID NO: 1060964 - RNA, 22 nt, Human
ccacugcacuccggccugggag

SEQ ID NO: 1060965 - RNA, 24 nt, Human
ccacugcacuccggccugggagac

SEQ ID NO: 1060966 - RNA, 20 nt, Human
ccggccugggagacagagcg

SEQ ID NO: 1060967 - RNA, 18 nt, Human
ccuacaguccuagcuacu

SEQ ID NO: 1060968 - RNA, 22 nt, Human
cuucaagacauuuccuccauuu

SEQ ID NO: 1060969 - RNA, 21 nt, Human
gacacuauuucuaaauuucgu

SEQ ID NO: 1060970 - RNA, 21 nt, Human
gacagagcgggauccugucuc

SEQ ID NO: 1060971 - RNA, 24 nt, Human
gaucgcuugaguccaggaguuuga

SEQ ID NO: 1060972 - RNA, 24 nt, Human
gcacuccggccugggagacagagc

SEQ ID NO: 1060973 - RNA, 18 nt, Human
gccugggagacagagcgg

SEQ ID NO: 1060974 - RNA, 22 nt, Human
gguacgcggagggcccgugcgg

SEQ ID NO: 1060975 - RNA, 24 nt, Human
ggugguacaugccuacaguccuag

SEQ ID NO: 1060976 - RNA, 22 nt, Human
uaaggcaggaagaucgcuugag

SEQ ID NO: 1060977 - RNA, 21 nt, Human
uacuucaagacauuuccucca

SEQ ID NO: 1060978 - RNA, 19 nt, Human
uaguugauuuugagucguu

SEQ ID NO: 1060979 - RNA, 24 nt, Human
uaugaucgugccacugcacuccgg

SEQ ID NO: 1060980 - RNA, 23 nt, Human
uccggccugggagacagagcggg

SEQ ID NO: 1060981 - RNA, 24 nt, Human
uccggccugggagacagagcggga

SEQ ID NO: 1060982 - RNA, 23 nt, Human
uccugucaucacugauaguugau

SEQ ID NO: 1060983 - RNA, 19 nt, Human
ucgcuugaguccaggaguu

SEQ ID NO: 1060984 - RNA, 20 nt, Human
ucgcuugaguccaggaguuu

SEQ ID NO: 1060985 - RNA, 24 nt, Human
ucgcuugaguccaggaguuugagg

SEQ ID NO: 1060986 - RNA, 23 nt, Human
ucgugccacugcacuccggccug

SEQ ID NO: 1060987 - RNA, 20 nt, Human
ucucugaagaaaaaaaaaaa

SEQ ID NO: 1060988 - RNA, 22 nt, Human
ucugaagaaaaaaaaaaaaaaa

SEQ ID NO: 1060989 - RNA, 24 nt, Human
ugccuacaguccuagcuacucagg

SEQ ID NO: 1060990 - RNA, 25 nt, Human
ugguacgcggagggcccgugcgguc

SEQ ID NO: 1060991 - RNA, 22 nt, Human
uuacagugagcuaugaucgugc

SEQ ID NO: 1060992 - RNA, 22 nt, Human
uuucuuagauugaaagugaaca

SEQ ID NO: 1060993 - RNA, 21 nt, Human
uuuuuccaggugguaucacuu

SEQ ID NO: 1060994 - RNA, 20 nt, Human
aagucaauuucagaucaaaa

SEQ ID NO: 1060995 - RNA, 26 nt, Human
aagucaauuucagaucaaaauuccuu

SEQ ID NO: 1060996 - RNA, 20 nt, Human
accaaagucaauuucagauc

SEQ ID NO: 1060997 - RNA, 23 nt, Human
agauauugggaauauugaaaacc

SEQ ID NO: 1060998 - RNA, 19 nt, Human
cuauggaaauuuuccuggg

SEQ ID NO: 1060999 - RNA, 23 nt, Human
gaagugggcuaauugacaauagc

SEQ ID NO: 1061000 - RNA, 19 nt, Human
uccugggucugaacuuucu

SEQ ID NO: 1061001 - RNA, 22 nt, Human
ucugagguuucugaagugggcu

SEQ ID NO: 1061002 - RNA, 21 nt, Human
ugccaagcauuuuagauaugg

SEQ ID NO: 1061003 - RNA, 23 nt, Human
uggagguggugggggagauauug

SEQ ID NO: 1061004 - RNA, 20 nt, Human
uugacaauagccaucauuuu

SEQ ID NO: 1061005 - RNA, 24 nt, Human
aaaguguugggauuacaggcguga

SEQ ID NO: 1061006 - RNA, 23 nt, Human
aacgcagccuuuccgccccggcu

SEQ ID NO: 1061007 - RNA, 22 nt, Human
aagaaagcaggauuaaagagaa
